United States Patent 10,982,187 (BOS TAURUS VARIETY 'HO840003150607238' AND METHODS OF USE THEREOF) - sequence listing, part 6

SEQ ID NO: 79684 - DNA, 201 bp, Bos taurus
aagtgcctcaccttccagattatgagatgatttggcttcagaccagcctcttctcccctcgccctcccaccgggcacctacacctcccaggcctttctccytgtgccttgagtccctcatgaaaacccctgctgcgtcctcattggagcctgggctcccctcccaggggccgggctgcagttaggcccgagccagctggtc

SEQ ID NO: 79685 - DNA, 201 bp, Bos taurus
tgaccgttagttttccttgcaattgggggactgccatttcccacagtagggcgcagagcccgagctgccagaatggctttgttatttgcccttgtgggccyctttgcctggaatattcttcccctgagtgtcctccatggttctgcattgcactgagatcttgtcttaaatgggccttcacagagagtgcttttttggcca

SEQ ID NO: 79686 - DNA, 201 bp, Bos taurus
actacttaacaaatggagtagactagagaatccaggtcagacacgcctaagaagagtcacctgctatgcggcaaagagaccactgcaattcagtgggaaakaaagatcctttcaaagaacagtgctggaaggtctgaatattcacatggcagaaaaagaactttgacctcatctcactccacatacaaaactaatttaaga

SEQ ID NO: 79687 - DNA, 201 bp, Bos taurus
cagcccttactgatctggccaccttcatttacagagggggaaactgaggccatagaaggaaagaaacctgctaaatgccacccagagaccactgaccatcraagaaccggcacccaggtctccagtatccattcccagctacatagctctcctctcggcctctagctgggggagcctattacttccacacctccctgctcc

SEQ ID NO: 79688 - DNA, 201 bp, Bos taurus
catggccaagagtatcttttaagacatcatcattatgccattattatttttttttccttttgtgtgtttcataaatatttatgggatctcctggacacagrggaggggatatttaaaaaggattcctggctcaggaggtaaacatgttccaataattctgtagcctcagtggcctatagagagatgtcctggagggtattg

SEQ ID NO: 79689 - DNA, 201 bp, Bos taurus; identical to SEQ ID NO: 39429

SEQ ID NO: 79690 - DNA, 201 bp, Bos taurus; identical to SEQ ID NO: 39430

SEQ ID NO: 79691 - DNA, 201 bp, Bos taurus
caactgaagcaacttagcagcagctgcagcagcgcaccccagccactgacatctggtgctgccacagcgtggagaccaaaggcaccaatgagggcctctcrccatctgggctaaatccgccccaaaagccacacgtcaacagggaaaccaccggacccacccactgctcagagctaggtctccagggccttgggtaacact

SEQ ID NO: 79692 - DNA, 201 bp, Bos taurus; identical to SEQ ID NO: 39434

SEQ ID NO: 79693 - DNA, 201 bp, Bos taurus
cgcccgagggtccctgagagtgtcaaaagcacaagtgtctgagacctctgatatctggtgccatctgtctttgggggcctgctgtgctttggtttgtcccrttgccgttcactattggttcacttcaagagccggctgtccctcattcttgcccctggggtctcctaggacactctctgaactaatctcaggcctttcttg

SEQ ID NO: 79694 - DNA, 201 bp, Bos taurus
cagaaggtttggggcaatcagtccagataccaggctggcaagggccaagatgagagtttgtcccaaacctgctggttctcaaaacagttctccttccattkcttgaacaaatgataggccatctaaatgttaatataagacaccaaattggaaaagaatcagatgtcataatgttgtcatggtagttattatataaatggt

SEQ ID NO: 79695 - DNA, 201 bp, Bos taurus
caccactgtccaccccaggtaacaccaccagcgttggcaccctgctctgtgcccacagccagcttcccattctgggccacatcataacttttgtggacccyttcatccctcccccaaatattaactttatattttacacctgcattagtataaagatgacctgggccaggtgtattattatctgtgtagtgtctgatgcac

SEQ ID NO: 79696 - DNA, 201 bp, Bos taurus
cacagtgaaatgaagggacaactgtcatttgtgacagtactctgagcactcgtaatccaggccaggctaaaaacaatgagtatcacacaaaactccagacrccatgaacatccggacaaagaaactctgattcaaagacattttcagctgaacatgacttgaaaaaatcaaaatgcctttctactttagagaagcacccat

SEQ ID NO: 79697 - DNA, 201 bp, Bos taurus
cagaagcctgagcaccgcaactagagaaagcctgcgtgcagcaatgaggactcagtgcagtcaactaaataaatgaataaaaaataaaacaaaacaaaacrccaatggtgccgaagctgttaacactgcacggtgaatcgaggcgagaggactgacttgcacacatcagacaaggcaacgtggagcgctttggcaaagatc

SEQ ID NO: 79698 - DNA, 201 bp, Bos taurus
ttcctgccatcacttctgagaagcacagaaatctggctttggccaaggacaggtctggcctttgccctcggcttctgggaggtgacctgtgccattcagcsggaatgtctttgtttaggctggggctgaccacgccagagagaccactagtgtgacctgggatgggggctgtgggtcagacagtaccagtgggcctggaga

SEQ ID NO: 79699 - DNA, 201 bp, Bos taurus
ctggactgagagatgctcttgccttgaccccaacccctgcataaaccgggcccgcattctgcccggaaatcagggttcatccctcagtcagccttggccaygtggcatctttctccttataacctcttcagacacaccccttaatctcagaaaaagaagcttgcaaaccacacaatgcttcataggccaaaatagagattt

SEQ ID NO: 79700 - DNA, 201 bp, Bos taurus
ctacaccagcagagttcagaagctgcaacagagatcacaggccttgcagaccctaaaatgtatgctaaatgtctgctccgttgaataagtcagaccatggrtgtggggcttttcgcaggtgcctggcctctggtcagtgtcctagagatatcgctttgtcactatcatcattctcagatgcttagcaaataattgttacct

SEQ ID NO: 79701 - DNA, 201 bp, Bos taurus
agtttcggatgacaaggcacagggaagctctaagcaccacagggcactgtggttttggagactgcttcttccagttggaaatgcctggggcctgggaggcrtggtggtttggagacctggaaacacgtcgcatagtacactaggggtccagcagggtcgggcagggagcagaggggccccagacccacgaatcagtctcag

SEQ ID NO: 79702 - DNA, 201 bp, Bos taurus
cactcattaccagtgggttggccaaagggctatatccaccaggtccgctgttcggaatctgaagattcttaagaggaatctgcaaccatctggggctcctycaggccctacaggagatttctggtctcactctccccgcctttagagatactgggatgaggctcagagaggcggagaggcttgcccagggctgcacagccc

SEQ ID NO: 79703 - DNA, 201 bp, Bos taurus
cccagggcacgggcctttgtgagccctgggccttcccttcattttcctcagtcccgacgagttctgggctgaaccagctcagctgtcccatctgaggggcrgaatagggccagagccacagtctatagacataggagatggatttttgctcggttaagagaatcattcaagataaaaaccagtgactcagtgtcttgcttc

SEQ ID NO: 79704 - DNA, 201 bp, Bos taurus
gatgtgacccatcatttacttaagatcaacagtgtgaaatgtgttacaagggatgtgggaagtgaaatatggcagcagccttcaagtcgatttctgaattygaggcaaaagcgagtcttgggaccatggctcataaatcattccactgatggctggagaggtggctcctgtgaggtcacctgtgcaagaaggttggaggtg

SEQ ID NO: 79705 - DNA, 201 bp, Bos taurus
ctgaagcaggtgtgaggccatcagcaataagagttcagttttcctgacatttaccaggcaccaaatacatgccaggcctactgcccaaaccaggatgtagygcatagcttagcttatccctccatcactgagactgttttcaggcagtggggcccaaggcaaagccctgggccagaggtgaaggatgaatatgtgtgtgtg

SEQ ID NO: 79706 - DNA, 201 bp, Bos taurus
ggttgaaatgacctggagacaggtgtgggtctagaggaaggttggggctgaattcataggttggaaagtcatcatcagaggtcattgccggccagaggagragagagaactatctggggcagaggtcagcaaactccctgcaaagggacatacagtaaatagttttgattctacaggccatgtggtcagctcctcagctct

SEQ ID NO: 79707 - DNA, 201 bp, Bos taurus
agatccctccagcctcctacactccaccccagcatcacaggcgagctttttgctctgaactctctgccagtgacatttaagagaaatagaacacaacccamaaacaacttaacatttaaaaggccacaatgcaagcaacttaaatatttctagtagcacacacacagtccacaagaaacaggtgaaattgattttaataat

SEQ ID NO: 79708 - DNA, 201 bp, Bos taurus
caggctcacaggtgaggcaggatccaccctcgggtggaagaagaaggggcaggtggtgttggtgaacttgagcacctgctgagggccaggatctgtgctgkgtgatgcccctatgagagcagggctatcacgtgcccatttcagagagcccgagggtctggcccaaagtccctaggcaggaaggactaagacaagctggat

SEQ ID NO: 79709 - DNA, 201 bp, Bos taurus
gaaggggtccttccttccaggaagtcttctacacccttcccagagggctaggtctctcctcggtgccccagcaatggcctttggccccttagtgacagcaycagtcatgctgtgttggagccgtctgtgtgtctgtctctcatgcagtccatgagcctctcaaaggcagggcctcgcctcagccatctgtctatctccagc

SEQ ID NO: 79710 - DNA, 201 bp, Bos taurus
gcagtcaccatctgcagtgattttggagaccctaaaaataaagtcagccactgtttccactgtttccccatctatttgccatttccaggttctcaggcccmaaatctaggcatcatgcaatccctcctttctcatgacacatacacaattggaaaatcatggtggtcctacccttggaatatttctcaagcctggcctcag

SEQ ID NO: 79711 - DNA, 201 bp, Bos taurus
ctctctgtgttcagcatcttttacttctgtagccccctttgcttgccatgttcctgtttctggatgatggttccaagactcttggccctgggtgagtgacrtcattctctaaatcagaacatcttccacaggaatactgtgcagagcacatccccccacgagctggggtctctgcccctagcactaagggggcctgacctt

SEQ ID NO: 79712 - DNA, 201 bp, Bos taurus
gtttctagggattgtgttcttgcttggacttcactgttctcaatgggatattgttctgcaactggaccctttaggctttgtgtctgacacacaatgaatakccttcaaatactcttttttaaaaaaaaaaaaaaacaaaaaacctctctaatcaagaaataaaactttctagatgtttccctttcaccaaattcctgactg

SEQ ID NO: 79713 - DNA, 201 bp, Bos taurus
ggaacaaagcctgagacgcgccgggcagagtagccccaaaacagaaggcagggtgattcactgggagtcaaggtccccctgtgattgtgtgggtacactcrgtaatgatgataaagcactcagaaagtaatgatgtacttaaatggacatgtgaagtgcttttaattttttttttttttgacaaagaggaaactcaagtgg

SEQ ID NO: 79714 - DNA, 201 bp, Bos taurus
ggatcatcttcctaaagcatgatctctaacttcataacacttccttttgtcctgtaaggcaccattcacaggtcccaggaattaggacctgatctctttgrgggcctctattcagatggccacagtggcttataaaaaatttgctgttttatcgaatgttaaatcttgttagccagtcttagaagcgcctttgtcaaatgc

SEQ ID NO: 79715 - DNA, 201 bp, Bos taurus
tccaagtcacccagcgtgtcagagatgggccagcaccttggtttctggagtatcaaatgaggattgatttactgggtcggggggcctgaagactttttttkgtaaagatccagaaagcagaaacaagaagcttggcactagggtctcattaagacctccatgagccctgggcactctggcctcctgggtcttctccataag

SEQ ID NO: 79716 - DNA, 201 bp, Bos taurus
agggagggctggggagacgcccaaagggcaggctgaagacagagcaggctttcatcaagtgaaagggaagaaacggcaatgcccaggtgaagggactggartgtggaaaagctaaaagggaacgggagagcatgaagatggctcttgtgatgagtggtgaaactgaatttctaattttttaatattgttttgaagaagaat

SEQ ID NO: 79717 - DNA, 201 bp, Bos taurus; identical to SEQ ID NO: 39438

SEQ ID NO: 79718 - DNA, 201 bp, Bos taurus; identical to SEQ ID NO: 39439

SEQ ID NO: 79719 - DNA, 201 bp, Bos taurus; identical to SEQ ID NO: 39441

SEQ ID NO: 79720 - DNA, 201 bp, Bos taurus
atgagctgatcacactcttttaactaatactatacagctcctcactaacccctctagggtaggacacacagctttggcccactatagcctgctttgcctgrcaaagcaataaagctattcttttctacttcaccgcaaactctgtatacagagctcatttggagtcgggttactgaggccagattcagcatcaatatggct

SEQ ID NO: 79721 - DNA, 201 bp, Bos taurus; identical to SEQ ID NO: 39444

SEQ ID NO: 79722 - DNA, 201 bp, Bos taurus; identical to SEQ ID NO: 39447

SEQ ID NO: 79723 - DNA, 201 bp, Bos taurus; identical to SEQ ID NO: 39448

SEQ ID NO: 79724 - DNA, 201 bp, Bos taurus
ggaatagagtgtggccaaataaacaaataaaaagtttttaaaaagaaaagaaaaataggtactcaggtctccatggttcactaaagagtattgtgcctacytccatggccgcctcttcggggggtgactgtgaaggggtcttggcctctagagaggaatgggtagagaccgatgccctggacttcatgccaggctggaatc

SEQ ID NO: 79725 - DNA, 201 bp, Bos taurus; identical to SEQ ID NO: 39452

SEQ ID NO: 79726 - DNA, 201 bp, Bos taurus
atccggggctcctagggagctctgtgcctcgaaaaggggaaatgccaccctggacaggcagagggagagcaagcagccaatgtgttagcatcctctccccycagcccaccaccaaaaaaaaaaaaaatccatcagtgacggacacctccctccagaacagggctcagccaccgatgagtgccaggatgtcaggggctgccc

SEQ ID NO: 79727 - DNA, 201 bp, Bos taurus
tcaagcttgcaaactgagagatatggtgtctttgacatgagcatattttagctcatgaataaaaggttttactgaatttaaatgtgcttaacattgggctyccctggtggcgcaatggtgaagaatccgcttgctgatgcaggagacacaggtttgatccctagtctgggaagatcccgcatgccatgaggcaactaagcc

SEQ ID NO: 79728 - DNA, 201 bp, Bos taurus
aggcccacagcagcacagcggaccgggagcggcatcctttcccaggaagaaaaggtgtctgccagcagagggcctgcagaaccttccgaggcgcctctccyctctgtgttctgcttgggcaactggttggtttggcctagaagcaagatggcaatcataatcagaaagggaagctagattttttaaataacttaaaaaaat

SEQ ID NO: 79729 - DNA, 201 bp, Bos taurus; identical to SEQ ID NO: 39454

SEQ ID NO: 79730 - DNA, 201 bp, Bos taurus
aagcaaattcaagcagttttcttattcgagttcaaaatgggtcacagagtagtggagacaactcacagcatcaacactgtatctggcccgggaactgaacrgcgcaacggggcttcaggaagctttgcagaggagacgagagccttgaggatgagggctcagtgactggccgtcggcagctgacagtaaccagttgagagg

SEQ ID NO: 79731 - DNA, 201 bp, Bos taurus
ccctcgccacacgtgtccctccctaacccccgtggtcttatggccccactgcagacccagtggaggttgtgggaagggagccatgaggcgtgggggagggyggtgacatccacagggccgtgtgccacagtccacacgttttgtgcagggccatcccgccaagggacacactccgggcaggctgcctgtcgccacgtctcc

SEQ ID NO: 79732 - DNA, 201 bp, Bos taurus
ctactacggtttgactttggcaccagcctggagatgccacttctgggcagtgggcaatagcagtgggcagcagagctggcttctgctgtgggtgggcctgkgagcctccagggggagatgagagctgttccttgttgggtgtctgtgagttgagcagattgaaactttctccttgtctctcaggagggatttgggggtatc

SEQ ID NO: 79733 - DNA, 201 bp, Bos taurus
caccctaatgaattgggccatttccatgcattctcaggaagtgtacagaacaagggttttcattctcctggaaaagtttgtcttggggaggcaaggtggcrtgttggtgggcacgcaggtagttctgcaagggtcggctgagcactccggcacttcgctcctccgggcttcgacgccgccctccggggtgaagcttcctcc

SEQ ID NO: 79734 - DNA, 201 bp, Bos taurus
cctgtgtccatctatggccccacaccgccagagtgggagctccccaggacagggctttctgtccacctcattccccgctgtgtcctcggaccctgaagcaragcctggcaaccagaagggccctgtaagcattcactgaatgaatggaaaacagagtgaatgtgttttacagatgagcctgtggaggggccgagggagaca

SEQ ID NO: 79735 - DNA, 201 bp, Bos taurus
agcgagtggacttgactctgaagtctaaactcagagcccaaactctcatccactggcaagactactggtctacccaagagctgggcccaaacactagcaaygggcactgtgattataggatctcagccctttcatttgggcttccctgggggctcagtggtaaagaacctgcctgcaatgcaggagacacaggcgagatgg

SEQ ID NO: 79736 - DNA, 201 bp, Bos taurus
gggtcatcttgcttttatttcatcagcattgatgacatgatgatttatatgatccaaatgaatgaatgaaagacctacagctgggccttagggacccagcratgaacttgggtagaggacgaggggtgggcaagtaacccagagtgtctggaagcctgagggccatgacagcacctcccctgtagtctacttttctctctt

SEQ ID NO: 79737 - DNA, 201 bp, Bos taurus
atcctaaacatgtcccatgccattaagtaatttcctatcttatgattttttttttacctagtatcctggcaaatgactatatcataattgatttaattgaygcacgcttgtcagatatttacatgatttttaaaagttggatgatagaagttggagtgagcagctttgtttttccatcttcacgtatgtctcttatttgta

SEQ ID NO: 79738 - DNA, 201 bp, Bos taurus
gacgagcgggagtcacccctgcttagggtaagtgtgtctcgggtgagcatgcaatgaacgtgctcgcatgtcactcggcccactacccaagattgttccaycacttccttacaggcagctaccttggcaggacaggcaatggatttctcacaagtgttcacttatggtacttgaagagaggctggccgtgatgaattcgat

SEQ ID NO: 79739 - DNA, 201 bp, Bos taurus
cccagagccctgtgggcgggcagcagagacctcaggtcaccccggggaggcggggggtgctcacggctcccatctggcccagtgcccccctcggtgcctgyggttggcaggaccacaaagagggttttgttgaccccctgcaagggcaggcccatggggggctgacccctttcatttccaaggcccctcatcaccccattt

SEQ ID NO: 79740 - DNA, 201 bp, Bos taurus
tttctgcttctgtggaggaagaagaaagctgtaaagaatgttgtttccaccctaataatgagaaaaacccagaaaagactccaaagactcacccccatggrccacaaacccaccggtcatgtcacctgaatgacaaagaaggacgatcccctccggaccggctcacgtgggcctcacgtggcaggaagtagcggctaggta

SEQ ID NO: 79741 - DNA, 201 bp, Bos taurus
cccccaaaggccagagctggcagattggaaggcgtggaattactggagatggtgaataggggatggagcagtctagaccggcagctgagacgaagcgttgmagatggggccgctccaaccacagacacgtgcgtgcgtgtgtgctgagttgcttcagtcgtgtccaactctttgcagccctacagactgtagcccatcagg

SEQ ID NO: 79742 - DNA, 201 bp, Bos taurus
ggactcttgctttaaatttttattggagtccagttgctttgcgatcctgtgtcagggtctactgtacggcaaaatgaatcagctacacatataaatacatrcacatatccctccctcttggacttccttctcctccaggtcaccgtagtgcagtaggtcatgttcccggtgccatacaggaggttctcactagttgcctat

SEQ ID NO: 79743 - DNA, 201 bp, Bos taurus
gagaaacatcatctcacaccgcaagtgggggaggaggccccacaggtgctattttagtgactcggggcaggtagggcctgaaagggccagctgggggcccyacagcctgacttattcaccggatccctgggcacgccaggtgtcctcacgtgcacaatgtgtgttcctgcagtaagaacagaggagtgagcatacgtctct

SEQ ID NO: 79744 - DNA, 201 bp, Bos taurus
tcgctgtttccatatcgccgtggctggcgggtcatgtccgagagccactgctggattttatcagatgccgtatggtttctctccttaagatgtgactttartaactgccgtgttgatgaatactgggaggaacctcggcgccgtcgcagtgtggcttcgctgcgtgctgtgttggatttagttttcgttactctctgcctc

SEQ ID NO: 79745 - DNA, 201 bp, Bos taurus
ggaaaatcacttccttaaatacagctcactcgggagcatgtgatgattaaaaaagaagcctcagaggaaggttagaaggtctggcagggccttctgttctkcttccctttcttcccagttccctggagaagccttttcctttaggggtctgttcgcagcacactcacggcgaggggcggaggcgcctctgtctctagtctc

SEQ ID NO: 79746 - DNA, 201 bp, Bos taurus
tggtagggccataaagcacaggtctggatcggcccctgatgtctgtgcctttttgtaagcactcgactccctctgcaaaatccctctctacttaaaatacmtggagtgggttgtttcctggcctgaacactgaatgagtccacaatggcttttaaatgaagcctggagcctttagtttggggaagatgccaatcaaatgcc

SEQ ID NO: 79747 - DNA, 201 bp, Bos taurus
agttcttcattcagcccgcagatgaatacccggccactgggttggcagtggacaagccggacacacacttaaccttcacggccaacaggccctggagaggygggaagatggaccgcacactttccgctgcaggacggttgtgagaaatgcgtcaaagaaagggggaggatgcagggtaaactgaggccagacagggggcga

SEQ ID NO: 79748 - DNA, 201 bp, Bos taurus
ccgcgcggtgccatcacctccattcaagctttggagggtgcgtgtaggggaggggaccggtaggagaactgcagcctcgctgaggccagggagcctcaggratgtttggtccttactcttcatttggcacaacactctcttactgcattggcaggaacaccacagcccagagcaggcagggcctcccaagggcacacagcg

SEQ ID NO: 79749 - DNA, 201 bp, Bos taurus
taatcgggatcctagcgaagagaaaagtcgattggccaaaaatgaaagactctgacaacagcgtgctgggtagcactgatgccacggccctggggctgctygtttgtccggggcaccaagagctttcaattgcaacagccacgagagatgggagagcaggccgggacctgggcgaggttagcactgagactccaagaccag

SEQ ID NO: 79750 - DNA, 201 bp, Bos taurus
ttcccctgagacccccaagcccatgccccagccaccctgcccaaggctggatcctgacctaccagcgtccctggagacggccctggagccctcaccccctyggtcaccttgtgaaagtcgtgaggaagccccagtagcaagggcagcagctcctgagctcaggctcctcgggctggccctgtgtgctgagcaacaggaaga

SEQ ID NO: 79751 - DNA, 201 bp, Bos taurus
aggacatgggtcctgctgaggcgatcatgcagtctgctggaggcacagtttgggaagctgctggaggttacttgagaggtggccttgcacagttgtggttmgtgtctgtgagtgaccatcagtgacggtttcctgagaggatgcagagtggaggagtccatgagtttagtaacattctctgggccatttgggagacccgaa

SEQ ID NO: 79752 - DNA, 201 bp, Bos taurus
tatgatcccatgggcaaaaacatgggccctgttcattaatgctgtgtcttaaggctagctcccaggttgcaggaggagagatggctacgtggagacatagmctctaaggccatagggcagactcgcaggaacaggcctgcagcccgcgaagcccgcactttgcagctgtgtccaggcacacaccccatctcctgcagcctc

SEQ ID NO: 79753 - DNA, 201 bp, Bos taurus
cagtcgcggggcccacagcacctccaccccctcagcccaggccagcgtgtcagccttttctggtgttgtccccagggccattttagacatttcttcccccractgatccccgtgaaatgctcagagcaaggaccgtgtgtgagtggaagccgcctggatgccctgcactttggctcttcagttcgctctggggcccctctg

SEQ ID NO: 79754 - DNA, 201 bp, Bos taurus
actgcccctgcaatgctgagaggtctactccctgaagtttctctacaaaagaggaaaacgaggctcagagaggaaggatctcagggtcccagtgttggtcygaggccaggttggctttaaatcccagtctgttttcaccaccagggccagaggggcccaaagaaggccactgcggccagaaaggatggcccatcctgtgcc

SEQ ID NO: 79755 - DNA, 201 bp, Bos taurus
accttggccaagtctgaaagatgtcacttcagaggtttccctttctgtgaagcacagacagctctacctgccccgctgggctctcaatggaatttcaggargaaacataaaggaccctggcctgcctgtgcagtcgctcagtcatgttcgactctttgcgaccccatggaccgtagcctgccaggctcctctgtccatggg

SEQ ID NO: 79756 - DNA, 201 bp, Bos taurus
acccccagagccctcagaaacgaggcgcagccttggagggccctgttgctgctgtgggttgagggaatgattgattaacgggtgagtgaagctcacttggrcagggagggtcccaagaggcgggggcccaggttttctagtctctacgtttcgcctggggctgaccttgagctcgtgggcaaggagaaccctggactctga

SEQ ID NO: 79757 - DNA, 201 bp, Bos taurus
ggctgtagggcggacctgcagatggctccgctctctgtctccacttgtccacgtgcctgcgttattaagggggccaggccaggaagcatgaaattagttayggtcctgtgcggacgtgtccacactgcctgtgtgtctcctgtgtgctgggcaccaggccaagagaggtgcatgagacacagtcccgagtccctgggaact

SEQ ID NO: 79758 - DNA, 201 bp, Bos taurus
gagaagggggtgtggggggtctcaggggcctgtcccccatctttctggcattggaggcagggctcggcgagattgggggttggggacacaagggaggaggyttggcggatggtgggccacacgcccttaacaggtgggattgctaagcagggtctggggtccttggggtcaggcccacatgactctggagacgccccaacc

SEQ ID NO: 79759 - DNA, 201 bp, Bos taurus
cgtgggcagccttcctgttagctggcgtccactgctctcaatgggcagactctggcccagggtcgtgcagtcagggacaggggggcggggggcctgcccaytgaatccagcaccaagttcttcctcctgttaccgtgtagatccagacagccatgccagaggtggcaggacaccccatggccctgcttcaaaccccggctc

SEQ ID NO: 79760 - DNA, 201 bp, Bos taurus
gaacattcggcacagggtagacaggaattctgtgctgtttctgcaccttttctgtaactcttaaaactattctaaaataaacaggccatttttttttaatygcatttactacggcatcattgagacccatcgcctacaagatccggaacaagaaaggagtggggagccagccccctccctcctgttccccacccccagctc

SEQ ID NO: 79761 - DNA, 201 bp, Bos taurus
tcaggaggtcgaggagaggcccagggcgccgggcgggggtgccagccagccttccaggcagcagcacgtctgcagagctaggatttgcgcattccaagaayggctgtcccagcacgggcggccgccacacacacaggtcactggctttacggtgtccaggagccagtgcaccctccttggtggctcacctggcacgcccgg

SEQ ID NO: 79762 - DNA, 201 bp, Bos taurus
tggggccagctgcccactgacaccccgtgccagctcgtcccattctcctctgttcacccatccaaggtcaccacgtgaggcttacccacatctggatggakcagctgcagcagcggcctccgcgtccggcagacattcaaggcccctggacccagcggggcccggcctcatgtctgctgtcctcagtcagagacaggggta

SEQ ID NO: 79763 - DNA, 201 bp, Bos taurus
tcggtccccccggcccacagccacctccactgcagccccggctgccaccagcttccaggtcaccctctccagcctggctgtctgcctggcccaccaacacmggtgccctccctggacctttggagctgggctccagaccagccctctctcccgacctctgtccttctcatatgcagcttcctctgccatctcactgtcatc

SEQ ID NO: 79764 - DNA, 201 bp, Bos taurus
ggaaagaaagaacactgacgacaggtaccatgactccttacgcggatcctgcctttccagctcaaccgtccatgggcctgtggatagccttccgtgcaccsttcgtaaagcttgccgcatgctgtctcctgggctgcctgagcgtaggtgaccttccccgacagatggcacagttttgggtctggttactggccactactg

SEQ ID NO: 79765 - DNA, 201 bp, Bos taurus; identical to SEQ ID NO: 39455

SEQ ID NO: 79766 - DNA, 201 bp, Bos taurus
tgctgtttggcctcatattgtttatgataacgtatcaactcagacataagagggagacagatgttgcttgagaatcattcctctcatcaatggcatttagygattctgcaatactctggcctggaaaatcccatggacggaggagcctggtgggctgctgtccatggagatgctaggagtcggacacgactgagagacttc

SEQ ID NO: 79767 - DNA, 201 bp, Bos taurus; identical to SEQ ID NO: 39456

SEQ ID NO: 79768 - DNA, 201 bp, Bos taurus; identical to SEQ ID NO: 39457

SEQ ID NO: 79769 - DNA, 201 bp, Bos taurus; identical to SEQ ID NO: 39460

SEQ ID NO: 79770 - DNA, 201 bp, Bos taurus
gggctgcctcaaatatacacgaatgggacgataacacttcctacaggaaagatgagtattgacgttgatgtcaagtgtagcccatgcacacgcatacacaygtcgtatgcatgccgtggtctccactgatgcatgctaacaggcttggggcggtgaagtcttccagctgcctgactgggatgcagcagcggtggaggagac

SEQ ID NO: 79771 - DNA, 201 bp, Bos taurus
aaggcccttaagcagtaactggccccacccacaggccacacaaagctagtccactggtgctcgtctattacagtgtaacagataattctctggaggccgcrtggaaaatgttatcattttggctttctacaaaaatcttctcaatgatcatgatctctatcagatacctctctcggcccagtctaggtatagggtgatgac

SEQ ID NO: 79772 - DNA, 201 bp, Bos taurus
gtccaatagaaatatacctgttctgttctttaaaaaaggagaagggtctggaagtgatggcagaggagtgggagtagaggctgggcggccaacacagactkaaatccctcacaggagatggacttgaaattgatggtgggggtgggggtcacaaggatggggagatgtgctccttctgtatctgaaataaagaagaagcct

SEQ ID NO: 79773 - DNA, 201 bp, Bos taurus; identical to SEQ ID NO: 39461

SEQ ID NO: 79774 - DNA, 201 bp, Bos taurus; identical to SEQ ID NO: 39462

SEQ ID NO: 79775 - DNA, 201 bp, Bos taurus
ggtaaactaattaaatgatcatattatttctgcctggtattagaaagctaagaaaataacatatcacagtcagaaaaaatagaaaatgggaatctactacrcagtaaaatgaaagaaaattacttggattgttcaatgccgggtcagtctcaaaaggatccagtacagacacttaacactatctcagagggggagatagtg

SEQ ID NO: 79776 - DNA, 201 bp, Bos taurus; identical to SEQ ID NO: 39465

SEQ ID NO: 79777 - DNA, 201 bp, Bos taurus; identical to SEQ ID NO: 39466

SEQ ID NO: 79778 - DNA, 201 bp, Bos taurus; identical to SEQ ID NO: 39467

SEQ ID NO: 79779 - DNA, 201 bp, Bos taurus
tttgcttgcatctacaaaatcttccatgcaactttccacttgccactctaatgggaagccctatctatacctagactccttttgaaaaatcagctttataragttatcatttacatacaatgaaattcactcgtttaaaaatgtatagtcttatctgtgtgtttaatgtacacagttgtataactcccaccacaatcaaga

SEQ ID NO: 79780 - DNA, 201 bp, Bos taurus
catgttttttatgtttttacattggattgaagagcttgttctcactctcagcgtctttgtgaactttgttgccatgcagtggagtggtgcagagttccctracttcagttctactgatgtcgacccacctcctttgctgcagtactgccctgtgaatggcatcctgtgaaatgccccgtgaaagcgcatcagggacccgac

SEQ ID NO: 79781 - DNA, 201 bp, Bos taurus; identical to SEQ ID NO: 39473

SEQ ID NO: 79782 - DNA, 201 bp, Bos taurus; identical to SEQ ID NO: 39474

SEQ ID NO: 79783 - DNA, 201 bp, Bos taurus
aattgaacccaggccccctgcctcgggagtgtggagtcttagctacttgaccaccagagaagtcccccgttgttttaaatttggagctactttcctgaaargatatctagaggttaacaaaaatcatagttatcatcttattaaagaaatgtaacatattttaaatcctgtgtttcctgacttgttgggtaccctgtagtg

SEQ ID NO: 79784 - DNA, 201 bp, Bos taurus; identical to SEQ ID NO: 39475

SEQ ID NO: 79785 - DNA, 201 bp, Bos taurus; identical to SEQ ID NO: 39477

SEQ ID NO: 79786 - DNA, 201 bp, Bos taurus
tggaattcgtggcaagcttgccttcctctgaacaatctcattcttaatggtcttaaccattctgaactgacatgccagaaaattgagtttgatgtatcagwctgtcatgacaaatttgtttgctactttgtagtggtatcaacaacatatgagtcacttactttgcatgggagccagttgttagctcttgatgtgaatgac

SEQ ID NO: 79787 - DNA, 201 bp, Bos taurus
ccttgaccacaagaatgaggaaaatgtggtgtccttagcttttacacaagcagggctctgctcctactgtatctttatcttaagagttaacaggaccctayggctgctccacctgggagccggtatctccagcctcacaactcctctccagccccactttctgtattttaggatggacatcgccttctgtaatgttgtgtc

SEQ ID NO: 79788 - DNA, 201 bp, Bos taurus
catttctctcaagccacagttcatgggctagctcttcaggaaatcttaatgacactcgagtctttgtatatgttcacatagaaccatgttcagcctcataracactatattcacaatttataatttaaatcttatataggagataattggatacagtccttctgccccccagactataaaaatcatgggggaaaagaccat

SEQ ID NO: 79789 - DNA, 201 bp, Bos taurus
tagttaaatatgcatatcttattgacatttttcttaaaacaaaaaaattaggatatatgcactgaattgtaggcattataccatcactaaataacagaatygctgtgttcctttttttttttttttactagtgaagtgtagttgatctacagtgttgtgttagtttctggtgtacagttaaattattcaatcatacatata

SEQ ID NO: 79790 - DNA, 201 bp, Bos taurus; identical to SEQ ID NO: 39482

SEQ ID NO: 79791 - DNA, 201 bp, Bos taurus; identical to SEQ ID NO: 39483

SEQ ID NO: 79792 - DNA, 201 bp, Bos taurus; identical to SEQ ID NO: 39484

SEQ ID NO: 79793 - DNA, 201 bp, Bos taurus; identical to SEQ ID NO: 39485

SEQ ID NO: 79794 - DNA, 201 bp, Bos taurus; identical to SEQ ID NO: 39486

SEQ ID NO: 79795 - DNA, 201 bp, Bos taurus; identical to SEQ ID NO: 39487

SEQ ID NO: 79796 - DNA, 201 bp, Bos taurus; identical to SEQ ID NO: 39488

SEQ ID NO: 79797 - DNA, 201 bp, Bos taurus; identical to SEQ ID NO: 39489

SEQ ID NO: 79798 - DNA, 201 bp, Bos taurus; identical to SEQ ID NO: 39490

SEQ ID NO: 79799 - DNA, 201 bp, Bos taurus; identical to SEQ ID NO: 39491

SEQ ID NO: 79800 - DNA, 201 bp, Bos taurus; identical to SEQ ID NO: 39492

SEQ ID NO: 79801 - DNA, 201 bp, Bos taurus; identical to SEQ ID NO: 39493

SEQ ID NO: 79802 - DNA, 201 bp, Bos taurus; identical to SEQ ID NO: 39494

SEQ ID NO: 79803 - DNA, 201 bp, Bos taurus; identical to SEQ ID NO: 39495

SEQ ID NO: 79804 - DNA, 201 bp, Bos taurus; identical to SEQ ID NO: 39496

SEQ ID NO: 79805 - DNA, 201 bp, Bos taurus; identical to SEQ ID NO: 39497

SEQ ID NO: 79806 - DNA, 201 bp, Bos taurus
cattcctcacgctgcgaagcaccgcactccatcacagacctggcgctcagcaggcaggcgagtgggtgtgtggagtgatggctgcttgtgacctgactggrcttgggcagtgacagaacaaacctgaaacacacagactccaccatcgtggctgtgggaccccaactcccactgcggccacgccacgcaccgcccgcctcc

SEQ ID NO: 79807 - DNA, 201 bp, Bos taurus
ttattgttgggtgaggtttttatgcgtttttaatagaccttcattaaactaatgggtggtctcactgctcagcacggcccatgtgctccaaaactgtcatraagtgactgggttttattttgggtggtggatggagaagctctgaaaacccacccagaacaaaggtgcagaggaagagggtgggagagaagaaagagtcta

SEQ ID NO: 79808 - DNA, 201 bp, Bos taurus
aaggtgccaaactccgagacccctctcagaagagggccccttctcaccttgggctcttctaggggagagggtcatgagcttcgggatgttggggagaaacycgacctgctgggccctctctgcggtcgtggcgtgtgcccggagcgggatacttggtgaacattgagtttgtgttcatgagtgtcagagatacctggtgcc

SEQ ID NO: 79809 - DNA, 201 bp, Bos taurus
aaatttacttgaggaggaaaaagtctatgtgctttgaggctctggccttctgatttcaaggcccagcagtttccttagagatggatgtttgaggagatctrtgataacaatgtctaatactctactagcctgtacttttggaagtcatggctcctttaactgtgacatgaatcttgagtggtttttcttttcactcacatg

SEQ ID NO: 79810 - DNA, 201 bp, Bos taurus
cctgtcctttccctctaccttctgtttcagggtccagtcagagtcgcacgttgcatttgggggccttgcatttggtggccttgtctctttgatcgtctttmatctgggagtgtcctcagcctttccttgtcgtaggacactgacatttaggagtctaggccattttctggaatgctccacagcctggtgtgtctgcttcct

SEQ ID NO: 79811 - DNA, 201 bp, Bos taurus
ccggagttgttttgtaagcagaggccaagagggtggggaactttctgaaggaaagtctttgttttcacctggcacacgggtgatttgaaagtgagtcaggkagagtgaggcatgggagaaaggcctgctttggggagtgatgtcactgaagctgggggcgcggaccacagttaactgtgcctttgaaccaaggatgtggtg

SEQ ID NO: 79812 - DNA, 201 bp, Bos taurus
ccagtggttggagctcggagcatctgactcttccaaggaaagaaaatagcctggagggagtggtgaacggccagggacaaccccccagggcccctgcaagmagtgggtgggcgtaaagccaccaagattctcaaacgagcaagtcgtttgaacaagaagtgagtcaccttccaaataaaattcctgggtaagcaggccact

SEQ ID NO: 79813 - DNA, 201 bp, Bos taurus
ttgtcttattttgtcattcccgcctcttcacaggaaggtcagtctcactgactgagagtgagaggcagggaagccttcccgtggccatgcacacaagtccrtattagagagcagattggtcgctgtctcacacggtgagggcgctgcccgtcttcctgacgtcggtggcaggcggtgcctctcgcgctcgttatgctagag

SEQ ID NO: 79814 - DNA, 201 bp, Bos taurus
accatcagaatgaacggcaatactgaagaaatattcttctcaatctacgttatagaaaatgtaatacgctccctgtaaaccaggggattccctggccgtcyagggattagacctccaggctttcactgccaaggacaagggttcaatccccagtcaggaaactaagatcctgaaggccatgaggcgaggccaaaccaagtg

SEQ ID NO: 79815 - DNA, 201 bp, Bos taurus
gtactcccccaaactggagagacaggtgggcggacacagagaatcacaacttactgaagcagaaacttccaggcagaaaccttctaagggagacagcgctrgggtgagagggcctggacgctgactaacagattgcggcagctcagcatggacaggtctcattaaacactatggggatcataaggggatccccacagttct

SEQ ID NO: 79816 - DNA, 201 bp, Bos taurus
aaattacaagtgcaaaataacaagtggtaaagtctaacatacagtaaaagtaggaaataacccgcatacaaatatgatatcaaaactagcaatagtgggcygtccctgagtccagtggttaagacgcggcacttccaatgcagggggcacgggatccatccctggtcagggacctaagataccacatgctgcacggcacag

SEQ ID NO: 79817 - DNA, 201 bp, Bos taurus
gccgtctatggggtcgcacagagtcggccacgactgaggcgacttagcggcagcaggagcagcagtattccattgtgtatgtgtaccacatcttttaaaawttgttttggccacatcttacggcatgggagacttcccccaccaggaatcaaacccatgccctcagcagtggaagctcagagtcttaaccactggaccacc

SEQ ID NO: 79818 - DNA, 201 bp, Bos taurus
aacatgatcatgacccgacagttcaccgtgagatgacccaggccaatctttaacttacaaaaggaagcaatggaagtcagacctgcccaaaggcaagcagrttgtcagcagagctgggattaggcctctgtattctgtaacctgctacatacagtccagcaacaacaactctgccacagaagccagttttaatacaaaagc

SEQ ID NO: 79819 - DNA, 201 bp, Bos taurus
gaaaaggaagctgacaatgtgtcctcacaattagctcatagaagggacactacagaagggtgtccaggttctttgttactcaatctttctaacttaagaaytatcctttaagtcccatctatccttaatactagccaaacagctaactaacttaagtgacgttgtgaataaaacatgttcttaaaaactaaatgtggtgga

SEQ ID NO: 79820 - DNA, 201 bp, Bos taurus
aggggtgcgggaggacaggccgcccctgagaatagaggctactggggccgggggtggcacccaagaggctagacttccgctggcctggttttctagtgcayaggtgtttgcaattctaaataaatgtgcagtgtcagggctcagcagtttctcagctgagacttgtaatgagggctgagcagggaaataaggtgggccctc

SEQ ID NO: 79821 - DNA, 201 bp, Bos taurus
ctcagtcttttggtgatggggcagatggcctggctgggcgatagatctgttttgtccaggggacacagtcatgtgtcaggaagagtgtctgtaaacatgartctcctctggggccttgggatactgtggtccagaggttaatcaatacactgaaatgtgtatgcgccagagaaaggggaaaatgtatgaatctgttgttgt

SEQ ID NO: 79822 - DNA, 201 bp, Bos taurus
gcacagtagagggatggccatttccctcacaaaccatgtgatttctatgggagaggaatggattctgtagcggaggtgctagttttttcataacatctgcycctcctttcttagttctaggcccttagttttcagttggacatatgacttccttaaataaagattacattttctggcctctatcacagatatctgtatgac

SEQ ID NO: 79823 - DNA, 201 bp, Bos taurus
gctttcttcttggggttcagaagtgtatcctccattccttagtctcattttgaactttgttacagatatcaataagctcaaggaaattagagtggatgaargcattggaagtggggatggagagctgggtggatctgagagaatgaaaatggactttgttgtattggatgtggcagagagtgaactttctgggctggtgcc

SEQ ID NO: 79824 - DNA, 201 bp, Bos taurus
tggcacctccttcggttgcgggtggtgtgtgctgtgcccagggccttctctgcaccttctttcagaggctcaaatccacaaggaacaagcagagggaggcrgaggctgccacgtgtctgcccttggcctcatgctgttggatttgcggtgcctcatgaaagaataatcacctacatcaatttttaaagctgcctaatgctt

SEQ ID NO: 79825 - DNA, 201 bp, Bos taurus
tttaacgtgtgaaacacattttaaaatatattatttaattaaaaatgatatttgtcagcttactgctttgccaactcccttcccagagttgtgttgttgcyggggcttcagtacaagagcagagtcgactttctagggagcagaggttgggtggcagggtggcagtgcaaggcagagctgcaaagcttttcagagccagca

SEQ ID NO: 79826 - DNA, 201 bp, Bos taurus
tggacatggtggggaaaagtgtctaccataagggtgcagggagacactacagcagggatggattcagacatggcagagactctgaggggcctaggagaggygtcagtgagagccccaagggagcaccaatcagccggaaagcactgctgggtcttgaagtagctgagaggccagttggcaagtcacagcagccagaggtat

SEQ ID NO: 79827 - DNA, 201 bp, Bos taurus
atgtccacttaggtgggaaacagactctggtggttaaatgacttgcttgcggatgtagaaaagtgaatacggagagaggaggcccgtaacaggtgctgtcractacacctgggctcatgaataatcacgactttgtttgaggggggaatgcacaagagacctataaaaacaccaagaggagagaaaatgttggctggccaa

SEQ ID NO: 79828 - DNA, 201 bp, Bos taurus
agagagatggatagacatgtgaagaaaggtaaagtcctttgacaaggcttttggatatgtaagtgtctcactagagaatcaatatctggtgtattaaagcraagtgaaatgaagtgaaagtcgcttagtcatgtccgactctttgcgaccccttggactctatagtccatggaattctccaggccagaatactggagtggg

SEQ ID NO: 79829 - DNA, 201 bp, Bos taurus
ttaaaacagttgttccaattttcccatgacactgacttttttaaagagcacaaaccactttgcttgtagaatgatttgactcctgaatccacatcttttaytcactggcctggtggtctttgaagtggccaccttgctgataaattgcctaatgggaccctgaatccttcttccagcctgcaggaaaattatgaatgagtc

SEQ ID NO: 79830 - DNA, 201 bp, Bos taurus; identical to SEQ ID NO: 39498

SEQ ID NO: 79831 - DNA, 201 bp, Bos taurus; identical to SEQ ID NO: 39499

SEQ ID NO: 79832 - DNA, 201 bp, Bos taurus
catcagtatgtgggcgataataacatcctcattttaggattgtgaagcacattaaaggagatgcagatgaagcttaagctgcagggcctctcacttgcatrggcttgcaactcatttcatagttaaaatgcgtgtgtgtgtgtgtgtgtatgttgaaatgtataaatttgaggcccaataaaatctagattcatgcttgat

SEQ ID NO: 79833 - DNA, 201 bp, Bos taurus; identical to SEQ ID NO: 39500

SEQ ID NO: 79834 - DNA, 201 bp, Bos taurus
acaccaggcattactgtagggatgaggcatagaaaggctgctgtgtgattctccatgctctgtttcatgaccttgatcactgctgccattccaaatagtayacctctgtcagcctagtcctagagagtgaatgaactcaaccctactcctaccccaggcaagaacaaagagcccataagggaataaaggaagacgtgcctt

SEQ ID NO: 79835 - DNA, 201 bp, Bos taurus
gtagggtatctggccccttggatcaacacaaacactgcaggtattttttcctcctttgcttatatttagagagtaatttaaaaatagattacagaaagatkgaacactctagagtggctggctttcctagctgagctcttaaaagcactccagattgttaacaattataattataccttcactcctggataccagaaataa

SEQ ID NO: 79836 - DNA, 201 bp, Bos taurus; identical to SEQ ID NO: 39501

SEQ ID NO: 79837 - DNA, 201 bp, Bos taurus; identical to SEQ ID NO: 39502

SEQ ID NO: 79838 - DNA, 201 bp, Bos taurus; identical to SEQ ID NO: 39504

SEQ ID NO: 79839 - DNA, 201 bp, Bos taurus
tctacctgagtcataaactgtgaggtagaagccgagcaggacagggaactctggcaagaaacaacgagaaggaaatctcagatcccatgtggaaattcctmtactctttttaaaattttacttattttcatttttttccgagggtctcttccttcttttaagggcacctatcccatcaggcggagaaggcaatggcacccc

SEQ ID NO: 79840 - DNA, 201 bp, Bos taurus
gtggtgcagagaaatgaatcacccagatagtaaaatatgaaattatatcctagatcacagcattcataaaagtaagtatctaaatggcaatagtaaagtcyataacataacatatacacaaggaaacaatttaagcataaaagcctcccctatgcccttaaataatagactgacaaaactacaggttatggatcagaaggg

SEQ ID NO: 79841 - DNA, 201 bp, Bos taurus
aaaccatgggatcttaccctgtcactccaccagggaactgctcatagcagtggggcaagtccgtccatctacttcaaaggcccctgaactccctttccccrtttcaggctcagatatgcacacccactttctgcctccttcatctttccactacctcaggaaggaggctctagccattattccctggcctgtatctcctac

SEQ ID NO: 79842 - DNA, 201 bp, Bos taurus
tgctgatatgggacccctccctccatatctttggtctgggcccctctatgagcctaacggagctctgaattccctctaagggcacacaccaaatcaaatgrtaaaggtgggacttttgactgggctgaggctagaaggccaggccggaggcagcttttatggtaatcattagcaagggctgtgggaaggtgagggactctg

SEQ ID NO: 79843 - DNA, 201 bp, Bos taurus; identical to SEQ ID NO: 39523

SEQ ID NO: 79844 - DNA, 201 bp, Bos taurus
tttgggtttcacaatgtcttcgctgccttctccagacgctgttctcagctgttcatggagattctgcccaaatcagcatgttgattcgtgcaggcccccaycatcaggtgaccgagagtgatgccgagaggggtgctgacccacacccgcgtgtattctggctccaggtctctccaatccctatcctacacttccctaact

SEQ ID NO: 79845 - DNA, 201 bp, Bos taurus
atgtgacttgatagctatttctacacagagatgaagctgatttctccactgctctaaatctggactagacttgagacttattttgacaactagaatgcagyggggagcctgaggccatcccagttgacaatctagtcttcaagaggccctgcatggtactggtcacttttctggaaccatacctctgccgtgtgaataagc

SEQ ID NO: 79846 - DNA, 201 bp, Bos taurus
agaggagtgagttttgtgaaaatcacacttttcttttttgacagaataaacacaaaggggaaacttttaaatagaggtagaagttctgaacatacacagcyaccctagcaggactaactggccttagatgcagccactcagagtgtttgctttctcttagagacatctttctgccatgaaagtggtttccaaagtcttgca

SEQ ID NO: 79847 - DNA, 201 bp, Bos taurus; identical to SEQ ID NO: 39532

SEQ ID NO: 79848 - DNA, 201 bp, Bos taurus; identical to SEQ ID NO: 39533

SEQ ID NO: 79849 - DNA, 201 bp, Bos taurus; identical to SEQ ID NO: 39534

SEQ ID NO: 79850 - DNA, 201 bp, Bos taurus; identical to SEQ ID NO: 39535

SEQ ID NO: 79851 - DNA, 201 bp, Bos taurus; identical to SEQ ID NO: 39536

SEQ ID NO: 79852 - DNA, 201 bp, Bos taurus; identical to SEQ ID NO: 39537

SEQ ID NO: 79853 - DNA, 201 bp, Bos taurus; identical to SEQ ID NO: 39539

SEQ ID NO: 79854 - DNA, 201 bp, Bos taurus; identical to SEQ ID NO: 39540

SEQ ID NO: 79855 - DNA, 201 bp, Bos taurus; identical to SEQ ID NO: 39541

SEQ ID NO: 79856 - DNA, 201 bp, Bos taurus; identical to SEQ ID NO: 39542

SEQ ID NO: 79857 - DNA, 201 bp, Bos taurus; identical to SEQ ID NO: 39543

SEQ ID NO: 79858 - DNA, 201 bp, Bos taurus; identical to SEQ ID NO: 39544

SEQ ID NO: 79859 - DNA, 201 bp, Bos taurus; identical to SEQ ID NO: 39545

SEQ ID NO: 79860 - DNA, 201 bp, Bos taurus; identical to SEQ ID NO: 39546

SEQ ID NO: 79861 - DNA, 201 bp, Bos taurus; identical to SEQ ID NO: 39547

SEQ ID NO: 79862 - DNA, 201 bp, Bos taurus; identical to SEQ ID NO: 39548

SEQ ID NO: 79863 - DNA, 201 bp, Bos taurus; identical to SEQ ID NO: 39549

SEQ ID NO: 79864 - DNA, 201 bp, Bos taurus; identical to SEQ ID NO: 39550

SEQ ID NO: 79865 - DNA, 201 bp, Bos taurus; identical to SEQ ID NO: 39551

SEQ ID NO: 79866 - DNA, 201 bp, Bos taurus; identical to SEQ ID NO: 39552

SEQ ID NO: 79867 - DNA, 201 bp, Bos taurus; identical to SEQ ID NO: 39553

SEQ ID NO: 79868 - DNA, 201 bp, Bos taurus; identical to SEQ ID NO: 39554

SEQ ID NO: 79869 - DNA, 201 bp, Bos taurus; identical to SEQ ID NO: 39555

SEQ ID NO: 79870 - DNA, 201 bp, Bos taurus; identical to SEQ ID NO: 39556

SEQ ID NO: 79871 - DNA, 201 bp, Bos taurus; identical to SEQ ID NO: 39557

SEQ ID NO: 79872 - DNA, 201 bp, Bos taurus; identical to SEQ ID NO: 39558

SEQ ID NO: 79873 - DNA, 201 bp, Bos taurus; identical to SEQ ID NO: 39559

SEQ ID NO: 79874 - DNA, 201 bp, Bos taurus; identical to SEQ ID NO: 39560

SEQ ID NO: 79875 - DNA, 201 bp, Bos taurus; identical to SEQ ID NO: 39561

SEQ ID NO: 79876 - DNA, 201 bp, Bos taurus; identical to SEQ ID NO: 39562

SEQ ID NO: 79877 - DNA, 201 bp, Bos taurus; identical to SEQ ID NO: 39563

SEQ ID NO: 79878 - DNA, 201 bp, Bos taurus; identical to SEQ ID NO: 39564

SEQ ID NO: 79879 - DNA, 201 bp, Bos taurus; identical to SEQ ID NO: 39565

SEQ ID NO: 79880 - DNA, 201 bp, Bos taurus; identical to SEQ ID NO: 39566

SEQ ID NO: 79881 - DNA, 201 bp, Bos taurus; identical to SEQ ID NO: 39568

SEQ ID NO: 79882 - DNA, 201 bp, Bos taurus; identical to SEQ ID NO: 39569

SEQ ID NO: 79883 - DNA, 201 bp, Bos taurus; identical to SEQ ID NO: 39570

SEQ ID NO: 79884 - DNA, 201 bp, Bos taurus; identical to SEQ ID NO: 39571

SEQ ID NO: 79885 - DNA, 201 bp, Bos taurus; identical to SEQ ID NO: 39572

SEQ ID NO: 79886 - DNA, 201 bp, Bos taurus; identical to SEQ ID NO: 39573

SEQ ID NO: 79887 - DNA, 201 bp, Bos taurus; identical to SEQ ID NO: 39574

SEQ ID NO: 79888 - DNA, 201 bp, Bos taurus; identical to SEQ ID NO: 39575

SEQ ID NO: 79889 - DNA, 201 bp, Bos taurus; identical to SEQ ID NO: 39576

SEQ ID NO: 79890 - DNA, 201 bp, Bos taurus; identical to SEQ ID NO: 39577

SEQ ID NO: 79891 - DNA, 201 bp, Bos taurus; identical to SEQ ID NO: 39578

SEQ ID NO: 79892 - DNA, 201 bp, Bos taurus; identical to SEQ ID NO: 39579

SEQ ID NO: 79893 - DNA, 201 bp, Bos taurus; identical to SEQ ID NO: 39580

SEQ ID NO: 79894 - DNA, 201 bp, Bos taurus; identical to SEQ ID NO: 39581

SEQ ID NO: 79895 - DNA, 201 bp, Bos taurus; identical to SEQ ID NO: 39582

SEQ ID NO: 79896 - DNA, 201 bp, Bos taurus; identical to SEQ ID NO: 39583

SEQ ID NO: 79897 - DNA, 201 bp, Bos taurus; identical to SEQ ID NO: 39585

SEQ ID NO: 79898 - DNA, 201 bp, Bos taurus; identical to SEQ ID NO: 39586

SEQ ID NO: 79899 - DNA, 201 bp, Bos taurus; identical to SEQ ID NO: 39587

SEQ ID NO: 79900 - DNA, 201 bp, Bos taurus; identical to SEQ ID NO: 39588

SEQ ID NO: 79901 - DNA, 201 bp, Bos taurus; identical to SEQ ID NO: 39589

SEQ ID NO: 79902 - DNA, 201 bp, Bos taurus; identical to SEQ ID NO: 39590

SEQ ID NO: 79903 - DNA, 201 bp, Bos taurus; identical to SEQ ID NO: 39591

SEQ ID NO: 79904 - DNA, 201 bp, Bos taurus; identical to SEQ ID NO: 39592

SEQ ID NO: 79905 - DNA, 201 bp, Bos taurus; identical to SEQ ID NO: 39593

SEQ ID NO: 79906 - DNA, 201 bp, Bos taurus; identical to SEQ ID NO: 39594

SEQ ID NO: 79907 - DNA, 201 bp, Bos taurus; identical to SEQ ID NO: 39595

SEQ ID NO: 79908 - DNA, 201 bp, Bos taurus; identical to SEQ ID NO: 39596

SEQ ID NO: 79909 - DNA, 201 bp, Bos taurus; identical to SEQ ID NO: 39597

SEQ ID NO: 79910 - DNA, 201 bp, Bos taurus; identical to SEQ ID NO: 39598

SEQ ID NO: 79911 - DNA, 201 bp, Bos taurus; identical to SEQ ID NO: 39599

SEQ ID NO: 79912 - DNA, 201 bp, Bos taurus; identical to SEQ ID NO: 39600

SEQ ID NO: 79913 - DNA, 201 bp, Bos taurus; identical to SEQ ID NO: 39601

SEQ ID NO: 79914 - DNA, 201 bp, Bos taurus; identical to SEQ ID NO: 39602

SEQ ID NO: 79915 - DNA, 201 bp, Bos taurus; identical to SEQ ID NO: 39603

SEQ ID NO: 79916 - DNA, 201 bp, Bos taurus; identical to SEQ ID NO: 39604

SEQ ID NO: 79917 - DNA, 201 bp, Bos taurus; identical to SEQ ID NO: 39605

SEQ ID NO: 79918 - DNA, 201 bp, Bos taurus; identical to SEQ ID NO: 39606

SEQ ID NO: 79919 - DNA, 201 bp, Bos taurus; identical to SEQ ID NO: 39612

SEQ ID NO: 79920 - DNA, 201 bp, Bos taurus; identical to SEQ ID NO: 39613

SEQ ID NO: 79921 - DNA, 201 bp, Bos taurus; identical to SEQ ID NO: 39614

SEQ ID NO: 79922 - DNA, 201 bp, Bos taurus; identical to SEQ ID NO: 39615

SEQ ID NO: 79923 - DNA, 201 bp, Bos taurus; identical to SEQ ID NO: 39616

SEQ ID NO: 79924 - DNA, 201 bp, Bos taurus
taaggagagttacagaaccacattctcaaactaattggaaataacagaattttatgagccaagtggtcatctaagctttcacttcaagttctaaatcattyacttctccacatctgctataattctctttgttttttccccagcagagggtgcaaaatattaaaccttggaactactgcataaatgtgaataaaattatac

SEQ ID NO: 79925 - DNA, 201 bp, Bos taurus
gttaaacatctcagagaggttacagccacgaaactctggtccaagtttaagcttttactttaatagagacccaatctccccagaaacaaatgtctttgggratgagacttgatttcaagactaagttttggactaagaactggtagaaagacttcctgcaaattttatatgcctgaaggcagtcacatgggaagaggactc

SEQ ID NO: 79926 - DNA, 201 bp, Bos taurus
gctggaaaccactgtttcttgtccctgtggatttttgtcttcagattcaacacttgtgtagtatggattgatttaaagatgctggtggacaagacagacarttatttagacaacagcatcatttcattagagagaaagtgaaaggtgtgaataagacatgctagctctccaggagatgttgacctgagaacaaaacaacaa

SEQ ID NO: 79927 - DNA, 201 bp, Bos taurus
aggtgaagttgacccacaaccggttttttgtaaataaagttttattggaacacatccattcctatgaatttacatattgcctttggccgctttcatgctayaatgacagagttgagtagttgctgcaaagactatctgaccctcaaagttgaagatatcatctggccctttacagggaaaaaaaagattgctgactctcgg

SEQ ID NO: 79928 - DNA, 201 bp, Bos taurus
tcactttaagctgttgaaaccctctaaatcttcaaaatatgtgtatctaagccaattgttagttttttggatttattggcacttccacagttaacataaarttaataggaagccagatgtacataaaatatatatttggcttttaaaaaatcatctaaatatgtcttggaatttgacaagaaaatatcattttccatttaa

SEQ ID NO: 79929 - DNA, 201 bp, Bos taurus
cgggcaactctctagttgctgtgcacaggctgctcactgcagtggtttctctcgttgcagagcacaggctctggggccctgactttaatagttgtgacgcrtgggctcggtagttgcagttcccgagttgtacagcacaggctgagtggtaagaaggaatcgactttgcaaagccatcacagcagtgcacatacagggcct

SEQ ID NO: 79930 - DNA, 201 bp, Bos taurus
tattgctgttacagtcatccctgtttatcaacagtttcacttcctacagtttcatttacccacattcaactgtggtctgaaaatattagatggaaaattcyagaaataaacaactgatacattttaaatgtcatcatgctttctgagtagggcttaaataacctattctaaataagaaaaaaaatcttactaacctcgact

SEQ ID NO: 79931 - DNA, 201 bp, Bos taurus
ggtccattagcagatgcaaagacctttacatagctgtattatatctaactagaacattaaaagaactcatttccaaatctttttgcgaaaatgtcacatcytttaaggcagatccactgatttacaggatgctgttagaaacaggaaagaaaaaaaagtcctgagtacagtttcaccttgagtccaatgtcaccctacaaa

SEQ ID NO: 79932 - DNA, 201 bp, Bos taurus
aacagaacagtgggtgactgcctatgagcggaagctcctgctcgactgcccaagctgggacatcagtcttgtcctgctctcaggctacaactgaaacactrgctctccctgggtctcaggccagctggctttgagactggagctataccatcagctctccagcatctccagtttggtgacccagatcttgggacttcccct

SEQ ID NO: 79933 - DNA, 201 bp, Bos taurus; identical to SEQ ID NO: 39618

SEQ ID NO: 79934 - DNA, 201 bp, Bos taurus
agtacagatgaacttacttgcaaaggagaaatagagacacaggtaggacagatgggataccaaggtgggcaggagatgcgcgatgaactgggagattgggrctgatgcctacacactgctgtgtataaaatagatagctaatgagaacctactgaatagcacagggaactccactcagtgctctgtgttggcctaattggg

SEQ ID NO: 79935 - DNA, 201 bp, Bos taurus
caactccacctcagatcatcaggcattagattccagggatcagggaccccctgttctggaatatgtgagtgggcccaatgacatgacattcctgtgtgtawgctcagtcgcttcagttgtgtccagctctttaagaccctgtggactatagccctccaggctcctctgtccatggaattctccaggcaagagtactggagt

SEQ ID NO: 79936 - DNA, 201 bp, Bos taurus
cctcatgcgtttctgggttggctaccaaaggccagccatggcgtatctgtctatgtcgtcagctcaaggttcatggtgggtgaaataaacccatgacatamcatttctggcctttttgggttttttttgactcaatatctcaagtcagtttctggtccctatattaaatcaaattaaatatttacttgagttactggcaca

SEQ ID NO: 79937 - DNA, 201 bp, Bos taurus
ctcaactgaacactgtcttacagtctttggaaaaccaagggagcatcccccagccacctcgacctctcagtcctaccgtggatgctgagtgccaggtgtcmacagaaatgtcaggcctacagagtcagtctcctccagggcctcctgagggccttccaaggacagcactttcaacttcttcccattcttggagacccagca

SEQ ID NO: 79938 - DNA, 201 bp, Bos taurus
tgtttttacaaatggcccccttacagggaacacagacttgactagttgtggttccaccatttcccacaagacaaacatggtgtggatgtagtcatcgcagygctgatggactcatctgagagccttgtttatacagcaagcccacggcttttcttggggctcaaggtgccttcattcacagtacacatagtcgttagaaaa

SEQ ID NO: 79939 - DNA, 201 bp, Bos taurus; identical to SEQ ID NO: 39622

SEQ ID NO: 79940 - DNA, 201 bp, Bos taurus
gtcttttccaatgagtcagctgttcacatcaggtggccaaagtattggagcttcggcatcaatccttccagagcattcaggcatctagggagcatgttagragcccaaagggccagtcccattcccagggatttgactcagttggggtgggtgaggctccattgcctatcctttcgacaagcacccctgggtaattttgat

SEQ ID NO: 79941 - DNA, 201 bp, Bos taurus; identical to SEQ ID NO: 39623

SEQ ID NO: 79942 - DNA, 201 bp, Bos taurus
agaagggcttttgttggggcttttcttttctgtacctattgtcatttccaggttgccagcttttccaactctaaatctgggaaatatatatggcaaaaaamcccaaaaatcccagggacctcaccattgtgttattccttgggttcctatctttacaccttctgtttatttcatatataatgtttaggatttttcactgca

SEQ ID NO: 79943 - DNA, 201 bp, Bos taurus; identical to SEQ ID NO: 39624

SEQ ID NO: 79944 - DNA, 201 bp, Bos taurus
gggaagggcgaacatgggccggagggctatgtctggttcacagctgtctttgtaaagaaagtttcattggaacatggccatatttccttgcttactgatgkctttggctgctttcacctacaaaggcagggttgattatttgtgaccaacaccaaaaagacagcggagcctaaaatattgactatctggccttttacaaaa

SEQ ID NO: 79945 - DNA, 201 bp, Bos taurus; identical to SEQ ID NO: 39625

SEQ ID NO: 79946 - DNA, 201 bp, Bos taurus
taaagttttacatccacatgtctaatttaaattgtgcattttgtaactgaagctatcaaagatacacaagttctgaaagaaagtggtcagtggaagaaagmacatccttcaactcaattacgctggtggaaaccagcatgtgatatgtcaagattatgtagaatttaaattccacagatggcagaaagtcatttacttctt

SEQ ID NO: 79947 - DNA, 201 bp, Bos taurus; identical to SEQ ID NO: 39659

SEQ ID NO: 79948 - DNA, 201 bp, Bos taurus
accacacatttcctaaaaggggaaaaaaatacatccttgacttggaattgaaaattacagttccatggagaattgactactaattctaggccaatccatakcaacagctgttatcaccgcttcatttacatgtcacccattcagaaaactgtcctgagcctgagcgacgggtgtcattctcattttgctgtggccataagt

SEQ ID NO: 79949 - DNA, 201 bp, Bos taurus; identical to SEQ ID NO: 39676

SEQ ID NO: 79950 - DNA, 201 bp, Bos taurus
gtggctcctgagctcagcggcctctccttttgagtttctgggtaaagtgagaactcctgagtatccaagaaagccatagggccaagagtccttcagatgtrccctcaaacatcagtgttttctgcataaacaccgggttggcaaaaaagtttgcttgtgcattacggaaaaacccaagttaactttttggcctacccgata

SEQ ID NO: 79951 - DNA, 201 bp, Bos taurus; identical to SEQ ID NO: 39678

SEQ ID NO: 79952 - DNA, 201 bp, Bos taurus; identical to SEQ ID NO: 39679

SEQ ID NO: 79953 - DNA, 201 bp, Bos taurus
gaaaatttgttgaatggaatttgcccgactggcagaatagtttaaatgtcagatgttgttaggctgggatataaatattatgtttctattgttaattaatygcagcgcctcagtaccagtgatccaaaattcaatttagtctgcaataggcctgtggataagggccagagataatgaatgcagagggaaaaaatgtactca

SEQ ID NO: 79954 - DNA, 201 bp, Bos taurus; identical to SEQ ID NO: 39680

SEQ ID NO: 79955 - DNA, 201 bp, Bos taurus; identical to SEQ ID NO: 39681

SEQ ID NO: 79956 - DNA, 201 bp, Bos taurus
gtacctgggttgttagaaataaaatattggcagtcctgagttctgtgcataatgcaaaatgcatacttaatgtatattagaaaaatgtatgcatcaagctmttcttttgttattttctatatgtgattctcatccccccatgagatgttggtgcttttgacctagcaaacacacatgtgaataattgcttgaagttggatt

SEQ ID NO: 79957 - DNA, 201 bp, Bos taurus; identical to SEQ ID NO: 39690

SEQ ID NO: 79958 - DNA, 201 bp, Bos taurus; identical to SEQ ID NO: 39691

SEQ ID NO: 79959 - DNA, 201 bp, Bos taurus; identical to SEQ ID NO: 39692

SEQ ID NO: 79960 - DNA, 201 bp, Bos taurus; identical to SEQ ID NO: 39696

SEQ ID NO: 79961 - DNA, 201 bp, Bos taurus; identical to SEQ ID NO: 39697

SEQ ID NO: 79962 - DNA, 201 bp, Bos taurus
taataaatgtgtcttatttaaggccgctaagttcatacagtctaattctgcacaaatgggatccgagtgctggtgcagatagtcagtgttccctcatcctrgaggccttccctgcctcccttcagaagaaagttttcctgcttttgctgtcttgggttattcaatgacctgctttttcactttgtgaagcagggacagagg

SEQ ID NO: 79963 - DNA, 201 bp, Bos taurus
tgcccagggcctggcacatttcaaggggtcgaagttccttctgcccccatatctgtcgtcccttcttgggaaaccgtgacgggggcacagcatggctgttmagagtccaggccacagactttggacttgggggtggcgcaggggacctggttctgccattcgtcagacgggtggtgacccggccacctcacttaccatctc

SEQ ID NO: 79964 - DNA, 201 bp, Bos taurus; identical to SEQ ID NO: 39699

SEQ ID NO: 79965 - DNA, 201 bp, Bos taurus
gatctttcttgaatcacggccttagccaccagggaagccccagtgggcttcaataatcctggcgcttgaagacccgtctgccaggtgagggtgtggtagtrctgccagcactgccccggggccacacttctctaggaccctgtgacactagcagtgccagatgtgtttccagctcacccctctttccattatggccaccaa

SEQ ID NO: 79966 - DNA, 201 bp, Bos taurus; identical to SEQ ID NO: 39700

SEQ ID NO: 79967 - DNA, 201 bp, Bos taurus
acagatcccttcagtctgtctgggccaagaccagcatactcctgacaagaactgagaatgctgcctgccccccaacctcccacatcccctggtctcagcarccacagtctgcagtgccaggtgccttccttcaccccattcgggcaatcttgatgctgtctatacaggctgttgtcagcccagcagtccagttcccaagaa

SEQ ID NO: 79968 - DNA, 201 bp, Bos taurus
atgtttatcacctgtatggagcttactgtcaagtgggagacgcggttgttcaaaaataataaagtgtatgatttggtgaattattctagttccatttgttmtttgtagagcattgtttaaaagttgctgcaagatatctttagttgcaattgttttttataaatgtgtgacattagtgtaaatattttgcatcagaagttt

SEQ ID NO: 79969 - DNA, 201 bp, Bos taurus
actgatccctattgtcaggtattttaggctctttgcacatcttttgcttttatagtgttttctcctcctaaaagttaccttagtggaggtcccatgtagargtatttagtccaaatagtttagacatgtgtctgctgtttgctgataaatgaagtcatataaacaagtattaatggcagcagagcagtcagtggtgtaata

SEQ ID NO: 79970 - DNA, 201 bp, Bos taurus; identical to SEQ ID NO: 39709

SEQ ID NO: 79971 - DNA, 201 bp, Bos taurus
tccctttggatttttaaagtaaaaaaataaaacctttaaagacacagcaaaaaatttccactcattttttttaggcccccatcttcactggttttgtacaycaaccttttcctactccacagctaaggactcataatggtgagaaggacaatcgtgcatcttaaataatgtacaaatgtatggattcaggagagccatagg

SEQ ID NO: 79972 - DNA, 201 bp, Bos taurus
tccactggaggaggaagtggcaacccagcccagtattgttgcctgggaaattccatggacagaggagcctggtggaccacagttcgtggggtcacaaagartcagaagactgagcacacttgcaccataattgctaggttttcctacgggaagtatttgtatttaggtgaagcctaggacctggtcagaatgacaactgag

SEQ ID NO: 79973 - DNA, 201 bp, Bos taurus; identical to SEQ ID NO: 39714

SEQ ID NO: 79974 - DNA, 201 bp, Bos taurus
tctctgtgcccctcccctgatgacagattgccagttcctcctgtttccaaccacattaggttcaattacctccgcctaatcctcatattcctcccaaatgkgtcccccgggcagtttctataaattttccaccgctccaagataatgagatattttttcctcttctaaaaatatatagcattcattcttctttccatgtct

SEQ ID NO: 79975 - DNA, 201 bp, Bos taurus
cacttgaggcaaaatagaacttctttgttcaaaggaaatagactttttaaagtcttgtaaaatagacccacaatgctttttgggactcaaataactctgamccaaaacgttttaataaattaaacataagtggattagaaacagacaggttgtcttttcatgaaatacacccaggccagactcagaaggagaagcacagag

SEQ ID NO: 79976 - DNA, 201 bp, Bos taurus
ccagaaagatatcacataaaattgcaaggtgtatgttttgggttatatctgggacagggcaatggtttcttcaaatgaaatggtggtaccatccagctggygagataaggaaccatctcaggctgaaccaaagtcagaattatggaggcagaaaactctgttccttctgagccagaatgatcgctcatgcctatctgcact

SEQ ID NO: 79977 - DNA, 201 bp, Bos taurus
accattgttattctgttattactgctagtatgatgctgacgcaaatggggtggcttagttatttcactctatgattctaaaccaaactagggtcagactcyggacatgataaaatcccacagtctccctggtctctcctacacaagaactattaaatttttcagcttaagacccatctctgctcagggtgatttctccttg

SEQ ID NO: 79978 - DNA, 201 bp, Bos taurus; identical to SEQ ID NO: 39720

SEQ ID NO: 79979 - DNA, 201 bp, Bos taurus; identical to SEQ ID NO: 39721

SEQ ID NO: 79980 - DNA, 201 bp, Bos taurus; identical to SEQ ID NO: 39722

SEQ ID NO: 79981 - DNA, 201 bp, Bos taurus
cttgaatcctagcttgagctacttcattagagtactctgggcaaaagctcttggtacctaatgaacatccattaatgtcagctcttattattgttgatgaygataacaagacaatgctgatgataattaagtaaatgagaagaattacactaaaagctgggccatgaggatgaccaacacattcacagttcagctctgagg

SEQ ID NO: 79982 - DNA, 201 bp, Bos taurus; identical to SEQ ID NO: 39724

SEQ ID NO: 79983 - DNA, 201 bp, Bos taurus
tcctgcattgcaggcagattctgtaccatctgagccaccaggaaatccccacccaaccgtgtgtacatcgtacatcaccttaacctatatttaaagggccrttcagacagcgagacccaccttcctacacaggagagaaggggcaagggcacaaccttgaaaaaaatgacacagcccctgaggataccacataaactgctt

SEQ ID NO: 79984 - DNA, 201 bp, Bos taurus
ggggattctttaccactggaccaccagggaagtcctggtgattgctctaacctttaaatcaaaacaccagcaccaggatagcttatcacaggggcccttgmggggcgtgtttccctactggtttcctagcaaccaatgaaccaatcagacatcaggtcacttctgcctataaccagtaaccttggcttgcagggtgtgaag

SEQ ID NO: 79985 - DNA, 201 bp, Bos taurus
tggcacagggacaggcgtggggacagaacagatgacccagcccgagccggagtgatgtgggagctgctggggccaggcaccttgctgggccctcctcaccraagaccttgtctcatcctcacactgaccccatgtgtgatcgtgcaggtgtgacaccagagggctgagtgtgtgtcatagagcaagggaaagaaccagtgc

SEQ ID NO: 79986 - DNA, 201 bp, Bos taurus; identical to SEQ ID NO: 39729

SEQ ID NO: 79987 - DNA, 201 bp, Bos taurus; identical to SEQ ID NO: 39730

SEQ ID NO: 79988 - DNA, 201 bp, Bos taurus
cacccccactcccacctcccagggacagacatctattaccaatctttgattttaatccccaccgagaagatagggacactggtcagatgtgcccacaccaytccaatcaagaaaaaataaggtgtgagaccagttaaatatgtatcacaccagctctctgtctgaaatactgttaacaaccagttaagtgctccacttcac

SEQ ID NO: 79989 - DNA, 201 bp, Bos taurus; identical to SEQ ID NO: 39731

SEQ ID NO: 79990 - DNA, 201 bp, Bos taurus; identical to SEQ ID NO: 39732

SEQ ID NO: 79991 - DNA, 201 bp, Bos taurus
ttatctccaccttgaaaaaacttttaaaattaaaaacaaaacaaaacttagaagagtcaagctactcacccaatatcagggggcagggcccttttccatcyacttactttgcaatgttttttatgatgcaatgggcttaatgataatcatgctgacagggccaggctaatgagttgagccttataatgcaaagctttccac

SEQ ID NO: 79992 - DNA, 201 bp, Bos taurus; identical to SEQ ID NO: 39733

SEQ ID NO: 79993 - DNA, 201 bp, Bos taurus; identical to SEQ ID NO: 39734

SEQ ID NO: 79994 - DNA, 201 bp, Bos taurus
cccactctggcttcatccaggtcactgcctgctgaggaaagggcaccatagctactctttgctaaggtgcaggaggatccacctaggtgctgccctccagraacgatgcagacaggccttgctcctctgggttacagcagccccagtcatggctgccaaccttgttgcctgcattgagattgtccaggagagcctcaactt

SEQ ID NO: 79995 - DNA, 201 bp, Bos taurus
ttgagtgccccatgtggagctggactccgtactgttgactgaatgaaggacaagtgccgtcttctcgcctaggcacataagagacctgtgccgtcctctaygtagttacctaggccacattgtcatggccgtaccttgatgttttcagccagcacccactgggggacacttcagttgcttaccttttgataaacctgatta

SEQ ID NO: 79996 - DNA, 201 bp, Bos taurus; identical to SEQ ID NO: 39736

SEQ ID NO: 79997 - DNA, 201 bp, Bos taurus
gcagctcatcactgagcagttgggcaagcgggtgtctcctccaactgtcagaggcagtgttgaaacaactttccgtgccaacagtgatgggccagtggtcrtcttccctggtgggactggacccaggctgcagatgttccctctgagaaattcggattctggggccacacctttttctctttgattagccatgaggtgcag

SEQ ID NO: 79998 - DNA, 201 bp, Bos taurus; identical to SEQ ID NO: 39737

SEQ ID NO: 79999 - DNA, 201 bp, Bos taurus; identical to SEQ ID NO: 39738

SEQ ID NO: 80000 - DNA, 201 bp, Bos taurus; identical to SEQ ID NO: 39739

SEQ ID NO: 80001 - DNA, 201 bp, Bos taurus
ggctcagccccgtgtccctagtcccagccctgctgcctggcacagaggagatgcgcagtgactgacagccaagtggatgaatgagaatgtggtcaaggccrggagggctggtgtgccggctgagcttggctgggcgtagaagccacagcaggaagtgggcttgaggaagacttccaggatgggagactgactgagccagca

SEQ ID NO: 80002 - DNA, 201 bp, Bos taurus
tactgtaaaagctggtcacaccctacacaacacaaagagtaaagaaactcccacatttaccacacagtcccctatctggatgacctttctccttggccctraaagaggaagatgcggacacaaaaactcccctagtaatagctcagacaaatctgagggtctggaggagccgaagggcctcttcactcttgtgagggtccc

SEQ ID NO: 80003 - DNA, 201 bp, Bos taurus
taagactccattcttccagtacctggggcatgggtttgatgcgcagtcagcaaactaagatcctacatgcccatgggtgtggccaaaaaaaaagaaccacyaaagggtttattataaatatgggctccctgctccacctggcgctatggctggtctgggaactggcatttaaaccagctgcaccctagattctggaaaacc

SEQ ID NO: 80004 - DNA, 201 bp, Bos taurus; identical to SEQ ID NO: 39740

SEQ ID NO: 80005 - DNA, 201 bp, Bos taurus
cccattcaaatctggtccccatgactgtggagaatctcttttctaattatcttgtgacccacttccagttttagccaggcttgcttgcccacagccttccsaggccctgctcacctctgcctctccacctatgctctggcgaccagccttcctgcccagggatgcatgtgactcctcagtggagctgcgaagccctttctg

SEQ ID NO: 80006 - DNA, 201 bp, Bos taurus
tgggccagtaactgtttgaaaacctgagcatacacaagtgatcaagaaaggtaagatctctgctttagtggagcttaaatttcatccatccccccaccccyggccagctatccattcaatgtagttttactgagtcccattcctcaagaaagatttgaaaggctcttgggaccacagtcttcttcctcagttgttgaacta

SEQ ID NO: 80007 - DNA, 201 bp, Bos taurus
ccacaagcgcacgaagacctgccctcagtagggccatcctaattgaggctctctgaagtctatggtgctcccagcacagagggaggggtgctcttctaacrctgtttaagtggccagtgtctgtgagtcatggacaaaaatcgtaagacactgacaatggcatggaaactttggttattctgggaagtaagacaaaattca

SEQ ID NO: 80008 - DNA, 201 bp, Bos taurus; identical to SEQ ID NO: 39743

SEQ ID NO: 80009 - DNA, 201 bp, Bos taurus
ctcttttcaagggcagtggggtaggtacttaagctgaaccttggccgggccttgtgaattcaccttgagaaaagcacttgttctcagcactgcaaggcccyattagctgacttcccccacatggcttgcctgctcccctcccacagaccaagcagatgaggagggaggaaagggcactctatccaaaaccagggttgctgt

SEQ ID NO: 80010 - DNA, 201 bp, Bos taurus
gtgggtaaggcctgtacatgccgccacgcaccatgggtcgcaggactgaggcaggctgcgtggtgatgggcagtgttgcagcaattggagtattgatggtygagtagatcatgccatcggccgcccgcacggtggctgtggatggcagcagctgtctgactgatgcggcctggccagctgtaggccggtactgggccaggc

SEQ ID NO: 80011 - DNA, 201 bp, Bos taurus
taggcctcttccaggatggatgatttcaatttcactaaattcaatgtagttgaatttaaatttcagttcagtttggcactttcgagccctaggacaaagayagcatcacactaggccccagggatgcagcagaaactaagaccgttgagcccacactaccctcacggaagctgcagtctccaagtctggcctttgcctgct

SEQ ID NO: 80012 - DNA, 201 bp, Bos taurus
actgttgccagacacagcttgcaggaggccctcaggacacgcggggtgtcacctggcaaatgcacaaggcttcggccagctgtcccatccatctctcttcygctcaccactcaggacccataaccttcaaaggtccctccctgcagctgccacttgaccagaatggacggagggcccggttggggtcacccggaaatgggc

SEQ ID NO: 80013 - DNA, 201 bp, Bos taurus
aggcagagaacaagtcacagccaggacaacagagaagcgtgtgttgcaactcccctgggaaagctgcaaacaaggaggggggcatcaggcggcctggcccrggctaggagtgcacctggaggagaggtcactgaagctgggtctttcctgctggcttggggaattcccaggagggcttcggccgcatcagagccagtccag

SEQ ID NO: 80014 - DNA, 201 bp, Bos taurus
ccttaagctttcctgtgtaatgaggtttcctgtgtaatcctttcctcctaaaggatttttaaggtctgtccttagagtatgttgaattgctttaggactckggcctggcctgagtggcacttctctgcctccccattttacatttctaagcctgatttacagggttttctgcttccctgtcataggctacacctctttctc

SEQ ID NO: 80015 - DNA, 201 bp, Bos taurus
attctttccatcctcttggtcacattaatccctgggcaacacgtgtaaatgactattcccagagtttctgtttccataggtctgggctggggcctgagaaygtgcatttctgtcaagtgctcaggtattgctgatgccactggttgggcactgcattctgaggatcagtgacgtagaacagtacagggcagacatttatgg

SEQ ID NO: 80016 - DNA, 201 bp, Bos taurus
cttcataattatatattgacaagagttacatggccttctaaaaaaagaaagtatttaaaataaacagctaataataatctaacctcgggtaaccagttccytctcattcgttccctctgtttgaaagtccactacttcactttttttttctttaatttttattggattatagttgatttacagtgctgtgtactacctcac

SEQ ID NO: 80017 - DNA, 201 bp, Bos taurus
gcccccatggagacaccagcagatggtggtcactgtggagcaccacgcttgtctcagcctcctggctccttgggctagtggccttgagtacgtttacagakaatttacaggaacttgtgagaaaagctgacctgcgtattttcagatttccttccgcacatgccctgtgttctgtctccttgctcaacatcgaggtcctga

SEQ ID NO: 80018 - DNA, 201 bp, Bos taurus
actgattcattggctgtgtccagtgtagtgttcaacatgtccagtgagcttttactttcatttggtatattttctcattggctctttttccaacctatcayttctcatagttttccaatttctagatgaaactttcaaacttatattttacttcttaaaaataagcatacggaatcttaaactaataaaatttatatgtta

SEQ ID NO: 80019 - DNA, 201 bp, Bos taurus
ctaatcgtaaactatgatgtcgatattttcccttggctgatgcagcattaagtacctcgtcagaggatttttttttttctttatctttctgtctttggccygtagctcactagtttatgttatgtgctttcttataggttgggaattttcttttattcattctagtatctttaattaactctgtagacatgggtcaggcca

SEQ ID NO: 80020 - DNA, 201 bp, Bos taurus
ctttatcttccttcttctccctgtgtcttttcctccgtgtgtcccttataaggacactcagcattggatgtagggcccaccaagataatctaggatgatcrcaagatcctcagctaaaatctgcaaagatgctttttccaaatacagttaacatttacaggttccaggtgttagaatgtgtgtgtatgtgtttggaggcca

SEQ ID NO: 80021 - DNA, 201 bp, Bos taurus
ggccaaagtatcctacaattgaattcaaatctgacaccatgtagagttcgtgtggacccctaacagttccaccagattgctcctgcttcagatgccaactrcaagtctgggccacttgtacttctgaccaatcagttacaaggtcagaagagcggtggggttccccacaattcccctcttcaggtttgagaatttgctaga

SEQ ID NO: 80022 - DNA, 201 bp, Bos taurus
atgccaaagtcaagatggaacagaaggtaacttgggggatctgggtctccaggaaggcaaggcctcagggacctcagtactgggacacccaggatggcccyccccactttagaggcagagggggaaaacaccagcccaaggaaatccagtcacccagagtcagtgggtatcttctgccaactccagagtggcacacagtag

SEQ ID NO: 80023 - DNA, 201 bp, Bos taurus
tacttagagactgagaaaaggggaaagtattcttccaaattagaaagagaatccaaaaggacttcagaaaatgaagcaatgaaaagatgctgttctccccmcaatgaactcggattccgacgggggtcatcatattccaagcatgataacaatgcttcccgttacaaatctgccccttcaaaacctgtatccaagtctgat

SEQ ID NO: 80024 - DNA, 201 bp, Bos taurus
gtgggggccctgcacatttcaagctcacctccagtttgggatggagggatagtgggatagtgagaggaacccaggtgagacccttggcttgcctgcatctrccgtcggcctttgtggtggacctggtgggattctggaaacacatccacagaacactttacattccgagcccagctgctccatttgcaaactgggcctcag

SEQ ID NO: 80025 - DNA, 201 bp, Bos taurus
cctgctctgagctgggaactactctgaactgggactcacccagcttccccatcaagcctggcctgtgtttcaagagccccgggggttgcattcctttcgcrtcttcagaggtccccctctcagcctgggctggaggcagacaaggccagagaaggcagggcccgtgcaaatccaagacaggtgggagctgcagcccatcta

SEQ ID NO: 80026 - DNA, 201 bp, Bos taurus
cctccaataagggagcagccctcccatcctgggggtgctgccagcgtgcagtaaagtgggggtcatgatgataatttgagtatatccctgcaggaccaatrtccagggcttactggccttatagctcctgtgcgttcctagaacttgggaaagaatagtatttctcagatgatggtaaagtgttcagctctcaaatgtcat

SEQ ID NO: 80027 - DNA, 201 bp, Bos taurus
aacaaagactatttccttctgcaattctagctttattttttaaagctgtattgttaggagtacaagattcatgcctactataccatcttggtggaatatayactatcagtgtaaaatacaccttttattgcatttaatatttgtttttacagagatccagatcatagagttcagtcctaactctgctgtaataattgatta

SEQ ID NO: 80028 - DNA, 201 bp, Bos taurus
tagaaggtaacaagtgctgacttgttactcagaggcctttgggactatcccttacctttttcaggaaatagggttaggaatagaagtcagtctgtgtagtygaggtccaagtgcctctttgggcctgacactgcagctttcctatgtggccctaggcacttccaccatcttgggccaagcagagcccgggagaaaccactg

SEQ ID NO: 80029 - DNA, 201 bp, Bos taurus
gaacaatttaaatctggggggatggtgagggaggagatttcccttagaagagatggcataaacaaaagtaatgagagagaaagagggacaaagatgtggtraagacatgttactggagataaggccaaaatgttaggttgactcacggaagtcatggaaaacctttaatgataagttcaggccttatatgacttggtgctc

SEQ ID NO: 80030 - DNA, 201 bp, Bos taurus
gggtcatcctgttctgctacgtggagatcctcaggaccctgttccgctcacggtccaaacggcgccaccgcacggtgaggctcatcttcaccatcgtggckgcatacttcctcagctgggctccctacaacctgatcctgttcctgcagacactgttgaaactgggggtcattcagagctgcgaggtcagccagcagctgg

SEQ ID NO: 80031 - DNA, 201 bp, Bos taurus; identical to SEQ ID NO: 39746

SEQ ID NO: 80032 - DNA, 201 bp, Bos taurus
ggtcctggagaagcttctactggctcaagagccctcagggcacatctcttcccgacgttattcagtggtgtcatgtcaacagcttgaaatgggccaaggtrggagtgattacaccatagcagtcagcaaatgctacaacccagggctcctattctgctcagagctggtgaccagttaaatatgcaacagtctacccctgcc

SEQ ID NO: 80033 - DNA, 201 bp, Bos taurus; identical to SEQ ID NO: 39747

SEQ ID NO: 80034 - DNA, 201 bp, Bos taurus
cgaacttgctgaatatgaagacggcctgagatgggttaggaatttgtgggagtaagagagagaggagccgtggaggttggcctcagatcctagagctgaamgctaactctgttcctgatcgctgatgggaggacacccccaccccagtcgctgccaggctgatggaaatctcaagaggaggaatggcttccctggctccct

SEQ ID NO: 80035 - DNA, 201 bp, Bos taurus; identical to SEQ ID NO: 39752

SEQ ID NO: 80036 - DNA, 201 bp, Bos taurus
gccgctccatccctgggctggcacagaatatcaatttgtctcgttaagctgaaagtctgcactgcaccaaaatcagaacccggcccgggcagaggggccaygagaggcagagaacggggagcaccagcagccacacagatacccccttgcccttcatcacaagcagccccgccggggtccccttctgccactgggccaggc

SEQ ID NO: 80037 - DNA, 201 bp, Bos taurus
ggagtcaggattcctagttcccttcttcttgaaagccaaggtgagcctccatcctcccgaatccgcacagcaccctgggcctcacccctctccccatctcygctttccctccctcccttcccttacataggaatatttaggtaggagatagtaacagctgccagagggaagcttggcccaatctctcctggctttagccca

SEQ ID NO: 80038 - DNA, 201 bp, Bos taurus
taggaagattgaaatcccaggacaaaagggcctccttttctctcagctttatggaaagctccccaccattgtccaatttgcctcagatcagagaacctcgytgaggaccagcactggcctcaggtggttgccaggaaaccaccgagacgatgtgcttggccccggagggagcccagtggatattagtattccgtcttattt

SEQ ID NO: 80039 - DNA, 201 bp, Bos taurus; identical to SEQ ID NO: 39756

SEQ ID NO: 80040 - DNA, 201 bp, Bos taurus; identical to SEQ ID NO: 39757

SEQ ID NO: 80041 - DNA, 201 bp, Bos taurus; identical to SEQ ID NO: 39758

SEQ ID NO: 80042 - DNA, 201 bp, Bos taurus; identical to SEQ ID NO: 39759

SEQ ID NO: 80043 - DNA, 201 bp, Bos taurus; identical to SEQ ID NO: 39760

SEQ ID NO: 80044 - DNA, 201 bp, Bos taurus; identical to SEQ ID NO: 39762

SEQ ID NO: 80045 - DNA, 201 bp, Bos taurus; identical to SEQ ID NO: 39763

SEQ ID NO: 80046 - DNA, 201 bp, Bos taurus; identical to SEQ ID NO: 39764

SEQ ID NO: 80047 - DNA, 201 bp, Bos taurus
ttaaccttaaaatctcatttcagacttttttatcttttcagactcactttttaaacatttttatacatttttgaaaggttgtactctatttgcaattattrcaaaatgttggctgtatctctcatgttgtacaatatgtccttgtaaccggtcttgtactgaatcgtttgtacgtctcactcttgcacccataaatcatcc

SEQ ID NO: 80048 - DNA, 201 bp, Bos taurus; identical to SEQ ID NO: 39768

SEQ ID NO: 80049 - DNA, 201 bp, Bos taurus; identical to SEQ ID NO: 39769

SEQ ID NO: 80050 - DNA, 201 bp, Bos taurus
cccgcgtgacagcaaagatcgaggctcccgcgtgctgaagccaaggacctggtgtgcccaaagaaataaataaacacttaaaaaataaataagtaaacagrtgtgatcttggccaagtctctccacctctctcgcacctctgtcctcagctaccctgacagatcatagtgagcatcagtggaaatctgcaggaagtttcca

SEQ ID NO: 80051 - DNA, 201 bp, Bos taurus
tacatagagaccacgcagtataaaccgtcacggaataaacattcagatacgccgagatcaaacagacacggccagaaacaagccctggtaaggctggtgtyatatcctgtgtacatggagaggtgctaaacctggatctgatttcttcaggacacaacccacttttctacaacaccctcacaataaaaagccgaactgagg

SEQ ID NO: 80052 - DNA, 201 bp, Bos taurus
tatctcaataaggctgatgtttttaaaaagcagatacagtcatatggcagcagctgctgtgctgtaccaatcagatcctgcttcaaggccaaggtactcaytccgctacctgctgggaatgttggctgactccttctctcagagtgcctcctagaactggctacagccaagggagctgcctctttccaaagactggaaaat

SEQ ID NO: 80053 - DNA, 201 bp, Bos taurus; identical to SEQ ID NO: 39771

SEQ ID NO: 80054 - DNA, 201 bp, Bos taurus
atgagatgtaattttctcttctgctcttggcagtgtttacctttcagaattgtatatatactggaaataatttattctaagtttaaagcctggtgcaaagygcatagatggcataaaattaatgctaattattattagtagcaactattctgacaacattgcttaaattggagggtttattatttatatgtatgcagtaag

SEQ ID NO: 80055 - DNA, 201 bp, Bos taurus
ggcccgtggccagggcctgcttcagcaggtggttgagccggagggcgtccaccgtcgggtacttctgcaggatgtagaccttgatggctgccaccgaggtrccccggcgccgctccccggcctgcagtgcttccagcaccatgcgcagcaccggagggtggcggcgcggcgcccggacggcgccccgggccaggcctgcgg

SEQ ID NO: 80056 - DNA, 201 bp, Bos taurus
gggaaaggtgtccaggccctctggactgtccctactacctcaccagactttagtacattcagtactggagaagcggcatggaaaagaacatcagtcttcarattttgcacaatagcctactgtccttgatcagcaccacaactttagaggtgaatgacagatacatggataatcccagaagaagggatgagtactgggtcc

SEQ ID NO: 80057 - DNA, 201 bp, Bos taurus
gccccactactaggagagcaaaagggccactctcgccagggtcacggtctttcaacgacagcgttgcctacagccgttctaccaagaggatttcaggcagyagaaggccgggagaccctctgaaatgtctttggtgccactgccccagagggtgtccattctatccacaatcccggtatcgtacagatcacagcaagaacg

SEQ ID NO: 80058 - DNA, 201 bp, Bos taurus
aaaaaaaggaaaaaaaaaaaaaaacaacaaacccacacctattagttttgtacaggtgtttgtcatcagaaattcacttttacaaagatgaggaggcccayggcacacagaatcccagaatgagagtcaagagacttgggtcagtgttagaccttagtttgctaccggatcaccatgagagagcctccaggcaaaccatgg

SEQ ID NO: 80059 - DNA, 201 bp, Bos taurus
aacagaatatagtgctttaccttccaaacgtctctaccacatcaccctgtgatatcagggctccagcatatttatttccatatccaacatgctataaacayataagtatataagtacagaaatgttggggggagagagggacatgtttgggctgaaaaactcagtagttatgccagtacgatgtccaatttgcataagaat

SEQ ID NO: 80060 - DNA, 201 bp, Bos taurus
cctagacttgatgcagagcggcagctactggagaaacctgagtggagagtgccatgatgaaagtcggcttttaggaaaaaaggcctggcagcatttgcaayctaaaatggcaggggagagactaaaggcaaggacactaactaaaaggctgtggccctaatccagcacgtgttcatcttcactggttactaaaatcgtgac

SEQ ID NO: 80061 - DNA, 201 bp, Bos taurus
ctccagtattctggcctggagaattccatggacagtatagcccatggggtcgcaaagagtcggacacgactgagcgactttcacccatctccctaatgacrtgattagaaagtggcccctgtttgtgagttcattgtccatgtgggctagaggaaagagtagggaggatcaatcaccacaataagatgtgagaaacactgt

SEQ ID NO: 80062 - DNA, 201 bp, Bos taurus
ttgggatttttaaaacctcccccagatgattctactctatcgcaaagtttgagaaccacaagcgtcagtaacagtcatatagtttgaactcacagagctamtaaatggccgagccaagtgtctttcttttctttttttttttaattgactgatctgatctaattagttgattcacaatgctgtgtgaattcttgctgcaca

SEQ ID NO: 80063 - DNA, 201 bp, Bos taurus
tcccgtcctggctggcgtggtagccgcgcccacagatcaccggattccgctggcacgtgtaggagcccaccgtgttgatgcagctgaagccgggccgacayggctcggagagagatgtgcactcattgatgtctgtggagggggtgcaggtgacagggagccgggtgcagcccctcctggggccccaggccagcccaggtc

SEQ ID NO: 80064 - DNA, 201 bp, Bos taurus; identical to SEQ ID NO: 39774

SEQ ID NO: 80065 - DNA, 201 bp, Bos taurus; identical to SEQ ID NO: 39775

SEQ ID NO: 80066 - DNA, 201 bp, Bos taurus; identical to SEQ ID NO: 39777

SEQ ID NO: 80067 - DNA, 201 bp, Bos taurus; identical to SEQ ID NO: 39778

SEQ ID NO: 80068 - DNA, 201 bp, Bos taurus
cccttcacctagattcactgcattccttttaaaaattacttgcacaccacggacatgattccacacctgaggtcgtcatggccaacatccactcctggccrggcgagccctgtgtgcacatgacctgctgtgctcaccacgaccccaagatgaacactcattatccagcctcacagattaggcctccagtgctcccaacag

SEQ ID NO: 80069 - DNA, 201 bp, Bos taurus
agcaccgtgccttcttagagaaggcgaggaagcaggccaatgtctggttggagggcctgggaggtccgttccaaaaggcctgggcaggaatcaggcctgarggctgcttccatttttcctgcaggatatctgaactgcccaggaggctgcccagagccgcaggacaaggtgctgggtggacaggcctcctcagccgggctg

SEQ ID NO: 80070 - DNA, 201 bp, Bos taurus
acatgtggaaggacaggcgtgatgagtgacggccagagacgagacgggggcggtgggggcgggggagctggcaggaggaggaggaacaccatcaagcaagycaacgctttccaagcgcgagctcatgcctgctgagcagtttggccctttctgattaataaacaagctttaccatcctccgggccagttattcttcataaa

SEQ ID NO: 80071 - DNA, 201 bp, Bos taurus
agccgctccctgctcccgcgtgtccgcacacgctgctgtccgggaagcccttccctcctccactgggtgacgccggagtggccgctggtctttaagggacrgtcctcaagcccccggggtccctcccaggacagacctgagcttcagagcagggtcaggtcatgctcgggtccgggtgcggctaaggccacaccccctccg

SEQ ID NO: 80072 - DNA, 201 bp, Bos taurus
tctgtaatgcaggcacattctttatcctctgacccaggaagtccatgcttaaatataagcctcaaagaattaaaaacagacgttcaaacaaaaacttgcamaggagtgttcatagcaccacgttcaccatagtcaaaaagtggcggtagccccgcgagtaaggaggagatcaataagaacacgaacaggaagctccctggc

SEQ ID NO: 80073 - DNA, 201 bp, Bos taurus
accatcactaaactcatgggatgcaatccaaggcctttggaaggtcaccctgtcagacgggaggctcgaagggcggctgcccacaccagccaccgtgcacrgcggccatgtcctgacacaggacatctcaaaggagctggtgctgtctccctgacctcggcccccagggatgtcccttgtgccctgagcccacccaggccc

SEQ ID NO: 80074 - DNA, 201 bp, Bos taurus
ccctgggcccagactcggtccagagaacggctcccctcagcccacgagggctccctctgttctctctgtggctccgattctcccagtgaaacctcctggarggcctccaccctaaggtgcgggctggcgggacctgctcagcaacgcgggcagcaggcctgtggctggcccaggcccggggggacccacaggcacctgccc

SEQ ID NO: 80075 - DNA, 201 bp, Bos taurus
tggttctcagtctgcttgaacttgccttcagcccagacgcccaggctccaggccctggaaccccaggccatggctgggcagtgcgggacgggcctgtaccrgggcaggtgtaggccaccacgaacatgctcagcaatgagacgaggaaacagagaaacaaagaaaggccacaatcaaaccttcggctcaaacaagcctgca

SEQ ID NO: 80076 - DNA, 201 bp, Bos taurus
gggacgcaaacctgcagcaccacgctacggagagggcctgacagcaggtgtctaggatctctgatctctgagtctgaaaaaataagacacttcaggagaaragcggcttcttcttcttcctctggccattcagctaaggcttctgaacattacacacaaaacagacctgaaaggtggagagattggggcacctgctagggt

SEQ ID NO: 80077 - DNA, 201 bp, Bos taurus
ctgtctccacgctgagaggtcagcgggggcgcagcctgcatttcctgggccccttctccagggctctgacctgaacgtggccagcgcccccgggaaggaartctgcgcacctttccactggcatcaccttgagtgtgacagcacttcaggctgtcacgggaggccttccttcctgcatgaacccggggatctccaagcaaa

SEQ ID NO: 80078 - DNA, 201 bp, Bos taurus
tcagacaactcagttgtccgctccatatacgagttctctagaatttgtgttccgtgattatgctatttttttcattacagtgtaacacacatactttacaygcccacatcttaggtgcacagcttggtggatttctcaaggtgaacatgtccctgccaacaggacgcagggcaacacagaacaccaccaggtctcgttgag

SEQ ID NO: 80079 - DNA, 201 bp, Bos taurus; identical to SEQ ID NO: 39786

SEQ ID NO: 80080 - DNA, 201 bp, Bos taurus
cgggccagcatttgcttgtgccccctgttctttcttctttaactttccattttatcttggagaccacctcattggtccttagcagcgttgtgagggtttcrggtatatgatgaagggtccggccgtgcacacacgcgcgcgtcccttctcccccagcccccaggcggccccatgaccctgagcggagccccgtgtgctgtg

SEQ ID NO: 80081 - DNA, 201 bp, Bos taurus
cccacaggggtgtggccagggcttaacctcgtttcgtggggagaaacgccgactccccacttgggtggaaacagtcttgggacgatactagctgacactcyagcccctcacaggcctcagtccccagacccccaaacgggctcctggccccagatggcgcgggtgaccctggccccggcccatcacatggccacctggggg

SEQ ID NO: 80082 - DNA, 201 bp, Bos taurus; identical to SEQ ID NO: 39787

SEQ ID NO: 80083 - DNA, 201 bp, Bos taurus; identical to SEQ ID NO: 39788

SEQ ID NO: 80084 - DNA, 201 bp, Bos taurus; identical to SEQ ID NO: 39789

SEQ ID NO: 80085 - DNA, 201 bp, Bos taurus; identical to SEQ ID NO: 39790

SEQ ID NO: 80086 - DNA, 201 bp, Bos taurus; identical to SEQ ID NO: 39791

SEQ ID NO: 80087 - DNA, 201 bp, Bos taurus; identical to SEQ ID NO: 39792

SEQ ID NO: 80088 - DNA, 201 bp, Bos taurus
tcaggatgggatggtggggatgaggagcggcctttccaggcagagggcacgtgtgcacatgtcctggtgagagagagccagggatgttgaagggcctgacwtcagaccactgaggctgaatcaagaagctgtcttggtgcaataatgttggggaggtagacaaggctcaagttttctgttttcaggcctttaaagatttta

SEQ ID NO: 80089 - DNA, 201 bp, Bos taurus
atgggctttgggacactaggagctccacctcttcttcacacacaaggatatccttgcaatcatctggcagggatgaggaatctgaggagcgcaagggcccrgaatcagcctgatctaggagcaaatcctggtcaattccttaaaatataaagtttgtgtaagactatagttattgtttgctcttttatcaaaggccatggg

SEQ ID NO: 80090 - DNA, 201 bp, Bos taurus
ctcagcctcagggagccttctgggaacctaggccagattctctgcacatggaagtcagaggtccccttggctgagtggagcccaggaagccacccaccccmacccagggcctttcttggaagcatgggtcctgaatcatgactctcccttgcctaaatctcacttgcccctaaacacctctaacacccaagtccttctcta

SEQ ID NO: 80091 - DNA, 201 bp, Bos taurus
ttccaaattttttatgaaaagcccttctctcctaaaattattggacacctatgcgtgtgtgtgtgaaatctttgcttttgttgttgttttgattctgacaygcatcatacaggatgtcagttctccaaccagggactgatgccacaccaggccctgcagtggaagtgcaaaatcttaaccgctgaaccaccagcgaagtcc

SEQ ID NO: 80092 - DNA, 201 bp, Bos taurus; identical to SEQ ID NO: 39799

SEQ ID NO: 80093 - DNA, 201 bp, Bos taurus; identical to SEQ ID NO: 39800

SEQ ID NO: 80094 - DNA, 201 bp, Bos taurus
ctgtatgagggccactctgtagttgtggtgcatggacttttcattgcagtggcttttcttgtggagtacgggctctaggctccaattcagaagttgtggcrcacggactcactggccttgtggcacatggaatcttcctagaccagggattgaacctgtgtcccctgcattggcatgcaaattcttaaccactggaccatc

SEQ ID NO: 80095 - DNA, 201 bp, Bos taurus
tatctgaatacctaactaaagcagttccacagtgccattggcggagatcacacccaagtataacatggagactttcagtgctatcttctggaagaacagtyactcttcaaagcatgggatttcaaaagggccgtttacacgggcaaattgttaggacttccctggtggtccagtggttgggaacccacagtgtagtgctgg

SEQ ID NO: 80096 - DNA, 201 bp, Bos taurus
tttgaaagtttccacaccatggcctcaggttgacatttgtgtcctgaggaggcagaagattgggaaactaatagaaactgcttttggggtttcagatgctsagctgtgagggccattaagtaatcgtcagtgagtactgaaagcaaaagctgtagtcagttcatacgtaagtcaagttcctgtatacagttatttgctaaa

SEQ ID NO: 80097 - DNA, 201 bp, Bos taurus; identical to SEQ ID NO: 39802

SEQ ID NO: 80098 - DNA, 201 bp, Bos taurus
cttgtttttggccacagtatgacgtttacccttctgaatgctttactgctgagaagatgggaacctaaggaacttagaaattcccgctctcctggcagagyggaaagatggcccagaggctcaggagcacagggctttggggccagctctttgtctgtgccacgcatcctgggctcggtgcttccccacctgcagcctgtc

SEQ ID NO: 80099 - DNA, 201 bp, Bos taurus
atgcttattgtctagacgctttctgtcttgcaacgcttcccctttcctgtacctttgactagagagaggctttcctgggggccttgtctggcctctgggtrcttctggggggcagtttctccagcatcccgtccagggtatgggagcaaaagaaaaccaggggactggcctctgtggtgttcctggggtccaagactcgta

SEQ ID NO: 80100 - DNA, 201 bp, Bos taurus
taattaaagtataattgatttacagtgttgtattaattttataaataaatatgtacattgtatactttacatatacacacacacacacatacatacagtcytttttacattcttttgcttatgggtcatccccagatactgaatataattccctgtactacatgatgggaccttgctgttttttgtcctatgtataaaagc

SEQ ID NO: 80101 - DNA, 201 bp, Bos taurus
aggccagtcagcacggctgtctggtgtcctgccagccacactgaactgtgtcggtgcatgtgtgcagtgggtggaactggggtctggcagagctgggcacrgagcagggtcgtgatgaagggccccgggagcaggggcactgaggaaagggttgctggagaagggagacacaaggaatcgtgcagccagtgttttgggaaa

SEQ ID NO: 80102 - DNA, 201 bp, Bos taurus
tggaggtagggcctctaaggagagaggattcaggttaattaggcacataagggtgagattacaggatcagtgttcttatgagaagagacaccacccaacgyacacagccagcaagatggtggcccaccaatagggggcctcaccagagcccaccaagccagcacctcaccttggaccactagcctccacagctgtgaggaa

SEQ ID NO: 80103 - DNA, 201 bp, Bos taurus
atgactgaaggcagacaattccacctgcttcttggagtagtaatggcccaaggcagccgttcatagcaacatctctgtacccattgctgagcttttatttycttcttaaaatgtgagcagttgaggccctgtgtagtgaaagaatcaacttgtttccctctagtttgttcaaagacacaatttgctaccctacagatgtgt

SEQ ID NO: 80104 - DNA, 201 bp, Bos taurus
attcccaaccaggttcagtttgagtatctgcattgctatggccttcaaaagcattgcctccaaaataaccaagacctgaagatttttaaggctgctgggarcttcttgagaagccagaggaggggccagctgggtccggcttcccctgggtccttcaattcacaacagggccaggaggcagagactaaccatgtgtgtttt

SEQ ID NO: 80105 - DNA, 201 bp, Bos taurus
ttattttttcatatcacccacagtcagatgctttgttttctcatgggaaaattactccaaaaacatctctagcctgggaatggctttggcattcacacacmaaggttaacacagagtgtcttagacgatgttagagttgtttttaacacaggacagaagtcatgctgtgggaattctgaaatgtgagagtcattttctctg

SEQ ID NO: 80106 - DNA, 201 bp, Bos taurus
tatttctttaaagtctatgccggtggttctcaaatgtcagtatttgtaagaatcaccgggagggctcctgacacctcagattacagtcctccccaacctcygcagagtttttagtccaataggtccgtggtggaggagaagaattagcatttctaacaagttccaggtgatactaatgttgcctagtgtggggatcacatc

SEQ ID NO: 80107 - DNA, 201 bp, Bos taurus; identical to SEQ ID NO: 39805

SEQ ID NO: 80108 - DNA, 201 bp, Bos taurus
ctcctttcttccccagtgcttttctgcccctgcagcatgaggtggacactggggtccgcttaacatttatgaattcattgtttaccatttccagggaatcmagatttacagggccacccctgagaagtgggagacagaattcaaaggataaatatctttcattttcttctgctgtgaagacagcacagtaagtcctctatg

SEQ ID NO: 80109 - DNA, 201 bp, Bos taurus; identical to SEQ ID NO: 39812

SEQ ID NO: 80110 - DNA, 201 bp, Bos taurus
attggagcaaagagacaggaaatgtcaagcttgataggtcatgctgagaggaaaaatgtactctaaaaacatgtgctaccatttgacttactggtgttaayttgatcttatattcaacacaaatacagtatgtctaactgcgatcatatctaaattgttattctaccaaacttaaacatccgttgctcaatggagcgccac

SEQ ID NO: 80111 - DNA, 201 bp, Bos taurus
ccccagtccatatgttctaccaacctcccagagtccttggtactggaatccatcttggctgagcagtgctcactccatcaggaatggctccaagtcagtaygattggccagagagagacaacccagaaactaatctcattgccataaaacctgagactgtgagccacatggtagagcagttctcctgggttcccctgacct

SEQ ID NO: 80112 - DNA, 201 bp, Bos taurus; identical to SEQ ID NO: 39814

SEQ ID NO: 80113 - DNA, 201 bp, Bos taurus; identical to SEQ ID NO: 39815

SEQ ID NO: 80114 - DNA, 201 bp, Bos taurus
cagtggtaaagaattggcctgcaatgcgggagactcagagacactggttggattcctgggtccggaactgaatgcacctgatcatgtctgatcttggaagytaagaagggttgggcctggataggaagttagtgcttggatgggagacacctgggaatactgggtactataggcttttggggcttcccaggtggttcagtg

SEQ ID NO: 80115 - DNA, 201 bp, Bos taurus; identical to SEQ ID NO: 39819

SEQ ID NO: 80116 - DNA, 201 bp, Bos taurus; identical to SEQ ID NO: 39820

SEQ ID NO: 80117 - DNA, 201 bp, Bos taurus; identical to SEQ ID NO: 39821

SEQ ID NO: 80118 - DNA, 201 bp, Bos taurus; identical to SEQ ID NO: 39822

SEQ ID NO: 80119 - DNA, 201 bp, Bos taurus
ctcaggccctattccaaaccatatcctccgtctgcccttccgtgccccagcactcacctgctactctgcagtcacctttgctgcctgcaagaaatcactcrttcctctctggccctcatgggtcccgtgactccctgccaggtaactctcctcccgtcatttcctctctcccatttaagctctctgcaacatcagcccttg

SEQ ID NO: 80120 - DNA, 201 bp, Bos taurus
cccgaggctcatgtctaactcttctatcccttctccaagtcaggggttcagggaacatgaccacagcctctgccctcaaggtcttttaaaggcagctagcrgtgggcttggggcctgaggggggacaccttttgccctggggctcctttctctctaaaggtgaggtcaagggcagcattgaaagttcagattttcacaggg

SEQ ID NO: 80121 - DNA, 201 bp, Bos taurus; identical to SEQ ID NO: 39824

SEQ ID NO: 80122 - DNA, 201 bp, Bos taurus
gagggggcccgctgctagctggcgccgcgagcccgctccgctgaggtaggccccgggcctctcaccgcctcatcggggtaaactctctcagccgctcactsgctctcgcgctcccccccctcccacccccccggcgccgccgcctccgcctccgccgccgccgcctctagctgcgccgccgcctccgcctcctcccgcgcc

SEQ ID NO: 80123 - DNA, 201 bp, Bos taurus
gccacctgattttgtggaaaagaaatactgaaacacagcggtattcgtttctttatggatcgtctacgtcttctctccacaacagcagagttgagtaactscaacaaagactgtatggcccacaaacctaaaataattacaatctggcatgtgaagaaaaagtctgcaatccactgatctaaaacacaatattatgtgttt

SEQ ID NO: 80124 - DNA, 201 bp, Bos taurus
tattctgaacagacatgtggtttgtttccacttttttttgctgtttcaaatagggttcttttgacatgcccatccttgtatatgtctcctgttacgtatgktggagagtttctccaggtttatgttcctgaggaaatagttgctaggtcattagggtaggtatagctgtcattttgctagataatgcccattttttcccca

SEQ ID NO: 80125 - DNA, 201 bp, Bos taurus; identical to SEQ ID NO: 39828

SEQ ID NO: 80126 - DNA, 201 bp, Bos taurus; identical to SEQ ID NO: 39829

SEQ ID NO: 80127 - DNA, 201 bp, Bos taurus
tctccctggggacacagctttccccgccactagctcaaatggtgactgtcttctctctctcgctcctcttgccatggggccaagaagaggtggggtcggcratcgactcgttccacttccagaatgtgacccttccttcttccctccgccccacagctttaaatctcatgctatttaaccgaactggtattacagagctac

SEQ ID NO: 80128 - DNA, 201 bp, Bos taurus
tctctttctggatccatggggctttggcagtgtcaggggaccccccacacacacacatggccagagagctggtgacttaggggttgtccccacaggcaaayggggctaggtgctcccaccactctgagtgtttcagtgactgctgtctcatcaacttggactctggtggcgccttctgtgcccctcgggccagaataacca

SEQ ID NO: 80129 - DNA, 201 bp, Bos taurus
ggttcttgcctccaacacagggctcagtacgcagaaggctcttagtaattgtgccctgaatgatatagggaggagaaaccagtgacccggaagactttgcyggcctccgagggattggaggttccaggaggacatatagggaaccagggaagtatgggctgggctggggactgcgctccagaagtggtttggcggcaggac

SEQ ID NO: 80130 - DNA, 201 bp, Bos taurus
aaaaggaatcactgaaaccttctaataatgtatctcagaggggaataatatgctagggacattcacatatctgggaatttgggaaggtttcaggtgcttcytatttttcatgtaaaggactcactggtgtcatttaaaagcagctttttattcatgaactcactataacctttgggcggtctgactgaatttatgatctgg

SEQ ID NO: 80131 - DNA, 201 bp, Bos taurus
aaaagccttggctcggtggggtgggaaactcttgcctcctcttagatggcctcctctggccacagcatgaaggttgggggtgcgggttctctagcaatgargaggttgcagagactggcggttctggaggcaggtggagccccttctctgctccctggaggtgtgctggcgaggcagtagggtgttacaaactgacctaag

SEQ ID NO: 80132 - DNA, 201 bp, Bos taurus
aacttcttcaaacctcctgagtaccttttagagcagctgaatagtagagaattctgtgtgaactcttttctgtagcatttgaacctattccttgaaatttwttgtagctaactcccaggatgtgccgggagttgctgggcatggcacagatggttgtttcaatggtgttaagagttttctgatttttagtccttgagaaac

SEQ ID NO: 80133 - DNA, 201 bp, Bos taurus
tctgatatgaggctagtgatacttcctttgcagggctttaaggattggaagcagcctatataaagcacttggcatatagcggtagatggtagcagttattrttgtcatctgttgagctatatcaggcgcagccaaacagcactgtgcactaaaaatgaaagatcctgccatagggaaatagatctggataccaggctcacg

SEQ ID NO: 80134 - DNA, 201 bp, Bos taurus
cacagagaaattctggctgcgggccaggccctctctgtcactacctccctcccaaaaagaatgccaagcagtggctctggctttctggccactgaacaaayccaaatcaaagcttcccatttgggatggttggtgaggagagagatccccaccagcagaagggcctgggactgacaacaagcagaagggaggagaggggtt

SEQ ID NO: 80135 - DNA, 201 bp, Bos taurus; identical to SEQ ID NO: 39834

SEQ ID NO: 80136 - DNA, 201 bp, Bos taurus; identical to SEQ ID NO: 39835

SEQ ID NO: 80137 - DNA, 201 bp, Bos taurus
agccagttacccctcaggcagagcctcctgacccttctactctaattgtctgtgacctttgactccaacaaagcaagcccagagtgggtgtggggttccgmggccccgggcccttcacacacgctgctcaaggcttctaaatcctacctgccctctttagagctttactcaagtttcaccgcctgcacgaagctgcctatg

SEQ ID NO: 80138 - DNA, 201 bp, Bos taurus
tctatgtgctgctcctgctccttgaagccctcttgcctcagagaccagtatgcccctctctctcctttgctcagggttcatctaactgtcatctcctcggrgaggccccctccccgaccacctcatttaaaatgtcaccttgtccctctctatcctcttattctcctttgtgacacttaccaccactggaaatcgttattt

SEQ ID NO: 80139 - DNA, 201 bp, Bos taurus; identical to SEQ ID NO: 39836

SEQ ID NO: 80140 - DNA, 201 bp, Bos taurus
ttaattctcatctccagggtaaaaacgtcactccagtctcagtcccaaggtggcaacgccaaaacccatcacacccagatctcagccccaaacttcagackgctcctgcaccccctgcagacgtcacagatacgtccctctcactccccagcagagcacattgccagacaatccctcaccagtgacctaaccttggtcacc

SEQ ID NO: 80141 - DNA, 201 bp, Bos taurus
gaggacaccacaacctttcacaggctgcacggcctgtcctgaggctggtcctccccgaggggcccacaagatgtgggcaggaaggtgctgtttgctggccrgattaatagcctcagtgctttgctcttgccataaaaatagctcgcattctgtgatggacagcccgggctactctctctgagggcaagctgcgcccgcggc

SEQ ID NO: 80142 - DNA, 201 bp, Bos taurus
gagcctgggacagtcacccagttatggttttgcattttaagatctggaggaaatcttgaacatcatcaaatcccactgtgtcgtttcatcactgaggcccrgagaaagattaatctgcccaaggacacggttcttagtcctgcccctgccactaacgagatgtgaagctgtgggccagttgctttccctctctgagcttag

SEQ ID NO: 80143 - DNA, 201 bp, Bos taurus
ttctatgaattttatcaatagcacgtagtccccatgtaaggtgccccctggaatctggggaacaagtctgaaactgtcaccccctgaaatggaaatgcatyagaagagatagccatctgtggccaaggtcctcaggaaatctcatcaggaaacaacccaccaatgtatgatgtgtgtgccagttgctggtaagaccagagg

SEQ ID NO: 80144 - DNA, 201 bp, Bos taurus; identical to SEQ ID NO: 39839

SEQ ID NO: 80145 - DNA, 201 bp, Bos taurus; identical to SEQ ID NO: 39840

SEQ ID NO: 80146 - DNA, 201 bp, Bos taurus
ctaaccgctgtctacatagcatctcttctgggatagagaactctagtgacctcttcctgcctcctttcacgccccgtctcctcattttatcactctgtgayaattactgacagatcttgggtctcagtatattagaagacagtcatgatcatcagggaatacttcctgagggaggctttcattaattgtaaagtttactga

SEQ ID NO: 80147 - DNA, 201 bp, Bos taurus
gtttgatgacttgtgttctctagagccatgtattacagtgttacaggttcagagggggaaagttccagacgtacagttaaggcccagctttgtgttaattytcctgcatcaattacattgctcttcccttgaactggatgctaccccaggattaattttcctcagaatctggagtaattggccaaaatactagggtaaaat

SEQ ID NO: 80148 - DNA, 201 bp, Bos taurus
gttctggttcccagggggaactggtagacacggccttactggcgccctctactcaccctagaggctgctctagtggccccaccgcccaaggcagctgttcmcttcatccagatgtgtctgcttggtcttgaagagcaccggctccatggagatctcggcctgactcctcaccactggctccgcagcaagacacagctggac

SEQ ID NO: 80149 - DNA, 201 bp, Bos taurus
ggggccactggagttcctgccttggtgttccatgagaaatttcccaaccactttaataaactcaccatttaaggcttaagccatcttcatctggtttctgyagcttggaaacaaaagggcctaagataagctcctagcggagtgcacgaggcagaaacgaacagacgttctgatgatgaggatgacaatgacaacgtgatg

SEQ ID NO: 80150 - DNA, 201 bp, Bos taurus
gactaactcagtttggacaaaacagagagaccaacagcagcatccctcactacaaatgattctgagtttcattcctgcagtggcctttcatgccagatagrtttgtttcttcgataattacagtgcctacaaacctgtccttcatccactaagaagggaaaggggccttatatacaacatgctcaaaatgcagtctaccag

SEQ ID NO: 80151 - DNA, 201 bp, Bos taurus
tctacatttcattgcaacaaatgtctctactctattaaacaagtactgaaatttgcccttaatatgccacagagttaagggtttttcctgagatgttctgmagacatgcaggtgtctgagactaagggcctggtgtggggcgttttttaaatcccctcacacccaaatttctacatggaatatgagactctcgtggatctg

SEQ ID NO: 80152 - DNA, 201 bp, Bos taurus
aattcaagtgatttccttatttgagttcaaaatgggtcctaaaacatggagacaactcacaacatcaacaacacatttggcccaggaactgctaatgaatwcagagtgcagcagtggttcaaaaagttttgcaatgaaaacgagagccttgaagatgaagagcataatagtggctggccatcagaagttgacaacaaccaa

SEQ ID NO: 80153 - DNA, 201 bp, Bos taurus
tgctatattgcctactgttctgtaataaaattcatagactgagaacctactacttataaaaaatacattagctataagggagagatttttaaataatttayaataaaataatatgcatttcaaccaaattagaaaaccaaactgtccctataaattttcataatgccttctgagaagagagtccataaccgtagcctctgc

SEQ ID NO: 80154 - DNA, 201 bp, Bos taurus
caggattatagtagaggagagagagagatgagaaaaaaattaagcaaaaacttcagacagtttgagttctaatttgtacatcttggatgtgggtgggtcarcaggttggctggcagctgaaaggtcagtgtgtgtctttctgttctggaatagaccaaagtagtatatcaaagaaaatttcagctgtttatgggtgctttg

SEQ ID NO: 80155 - DNA, 201 bp, Bos taurus; identical to SEQ ID NO: 39845

SEQ ID NO: 80156 - DNA, 201 bp, Bos taurus
ccagagcctcccagctgcccccggtcctgagaagattctgaacagcggtccgtagccgtcctcagcttgctccctggagctgtagtgtccccatctctgcygctttgtttcggccaggcccccctgctgaaatgcccaccctctgcccttgctgggtccaatctctccccacagattccctgcttaacccccgctcacagc

SEQ ID NO: 80157 - DNA, 201 bp, Bos taurus; identical to SEQ ID NO: 39846

SEQ ID NO: 80158 - DNA, 201 bp, Bos taurus
ttcacagatgagggtttgctctgaaatggccccattgtgctctgggtggcgctgaggaggtgggagtggtgtggagaagaggaggcggcgttccgagcccktatgatgagggtaatctggcctcccactgccgggtccgtcaacaggcctggcatggcgccttcctccttggcactttccaggccggattatggttcagtc

SEQ ID NO: 80159 - DNA, 201 bp, Bos taurus
tagccctggggaagccaagtgggggacgagtcacaagtgtggctgtagctgctggggagattcagacaggaaccccatggccaagaggcaagctgtacttyccccttccaggtctttgattttttttcttgaaagcttggactctggctgccctgacccacaaatcctgcagggtcagggcctgacaggtccataaggagg

SEQ ID NO: 80160 - DNA, 201 bp, Bos taurus; identical to SEQ ID NO: 39847

SEQ ID NO: 80161 - DNA, 201 bp, Bos taurus
gagtgtggcctgacatccggcagtgataagggaccttctgaggctgaactaataaggagattggaggaaaaaagaagaaaaacaaccctccccgccacccygatcaatttcatgtacagtggccagaggatgcagggcaaacagagcagctggatgtgggcctctttccgtctgaatgagcccggagggcagggcaggcca

SEQ ID NO: 80162 - DNA, 201 bp, Bos taurus
gaagaaatcatctaggaaaaagtacaaagaaaaagagaaaaggaggtcctaggacaatgcttgaggaatgtccacatgaaaggaggataatctggcccaaraggccaaggagcagtcaggagataaggagaagacaagagaagagagtggtcaatcatgctgaatacagggacttccctggtagtccagtggttaagactc

SEQ ID NO: 80163 - DNA, 201 bp, Bos taurus; identical to SEQ ID NO: 39848

SEQ ID NO: 80164 - DNA, 201 bp, Bos taurus; identical to SEQ ID NO: 39849

SEQ ID NO: 80165 - DNA, 201 bp, Bos taurus; identical to SEQ ID NO: 39850

SEQ ID NO: 80166 - DNA, 201 bp, Bos taurus; identical to SEQ ID NO: 39851

SEQ ID NO: 80167 - DNA, 201 bp, Bos taurus
tcattcctttactattgcactctgacagctctccagcctcttcggaccttaccccattttctcacaggtgtttcttagattccaaggccaggttaagcatrcatcttgcagaacctagatcacatttcttcagtgacaggattcaccttcacatcagacacttgaagtgatcctacaaaaactcattttccaacttgctga

SEQ ID NO: 80168 - DNA, 201 bp, Bos taurus
agcagctacctcaaataagcgttcttacttgaaaagaaaaggaaaagaaagaaaaatgcagtgtttaggaggaggtggccgcgttctgatcttcaccaccyctctgcacttagggaatgaaccacaggtgggaagtagctttcataagtcaattcacctgagtcagtttgagtttggccgcgttccccttctggtcctgag

SEQ ID NO: 80169 - DNA, 201 bp, Bos taurus
tgaaggacatgagtgtgggaggagcaggcagggggccacctctggagaaggctccagagaccacagggagcagacaggacaagcttagagccataatcagygaagcacatcagggcccaggaggccagacaaagagtaggtatcgggagaaggaataagacgggggagtaggggttggtgctccattcattcattcaatca

SEQ ID NO: 80170 - DNA, 201 bp, Bos taurus
tgcagccacagcacaagtgggaggccatctctggagcccacccccgctagaaatagctctcctttgtaaatagttaatgagcttattcatccgcgttgcaygtctccatggccccgctctcaccctgggctggcacatcacagtctgtggttctgtgtgatcctgctcgctcaccaccccccaccacctctgaggctctga

SEQ ID NO: 80171 - DNA, 201 bp, Bos taurus; identical to SEQ ID NO: 39857

SEQ ID NO: 80172 - DNA, 201 bp, Bos taurus
gcctgctgccctcaaaattggactgcagaatttttagtgttaaagcacctcccattgaaactcaatgctgtgagaggccaaccagtccctacccagccatrccctgctccaccctgcggagtgacagagcagggcatgtatgccaggaatcaaagtcacagacacagtcagccccacagcccaccagggtctctcattctg

SEQ ID NO: 80173 - DNA, 201 bp, Bos taurus; identical to SEQ ID NO: 39858

SEQ ID NO: 80174 - DNA, 201 bp, Bos taurus; identical to SEQ ID NO: 39859

SEQ ID NO: 80175 - DNA, 201 bp, Bos taurus
tgtggcccctagtagaatgctcggcacctaatggatcctaaatccataacagacactaacccactgaagccagcacggaaacctgcagctttgcaaggacrcaaggccaacaactaaacacccttttcaatcagatctgcccacaaagaatggtgtttgagtctgtatcacttaagaactttcaggtggcagaaaacccaa

SEQ ID NO: 80176 - DNA, 201 bp, Bos taurus; identical to SEQ ID NO: 39860

SEQ ID NO: 80177 - DNA, 201 bp, Bos taurus
cagggacaaaaaggtgggacttggccacagtcaagtcgccaactagagagtgtaccggtcaggcggagtgtactgccaaggcgcgggcaggggtgacaggraaggcggccccttaaggaaggctcacccacatcttttttggggggttggggggactaggggaagaagtagagaggcctcccattctctgtctcctaccct

SEQ ID NO: 80178 - DNA, 201 bp, Bos taurus
agttggaacatgacatggacagactggcccacatcttcagttattacattagtgacatcgtggagcgtgagtgactattgtgggggaggaaagaggtgtgstgctgggcccctgagggtttgtaacagaaggggacctggggtactttaaaatgcacactaaaagtgacatccttttagtgtcattcatccttaatatctt

SEQ ID NO: 80179 - DNA, 201 bp, Bos taurus; identical to SEQ ID NO: 39861

SEQ ID NO: 80180 - DNA, 201 bp, Bos taurus; identical to SEQ ID NO: 39862

SEQ ID NO: 80181 - DNA, 201 bp, Bos taurus; identical to SEQ ID NO: 39863

SEQ ID NO: 80182 - DNA, 201 bp, Bos taurus; identical to SEQ ID NO: 39866

SEQ ID NO: 80183 - DNA, 201 bp, Bos taurus
gggatagagactgagaagaggggtgtgtgtgtggggggggggggggagggggttggttaatggtgcagggctggggtctgcgcttagggaggggccgcacrtgcaggagaggaaagagacagtggaggctgccctggagacaatgtccaccccctgcttacgtccttccacttccaatcttggaggcggatgaggccaagc

SEQ ID NO: 80184 - DNA, 201 bp, Bos taurus
gggaaagcctctggtcatctggcctgcagccctgtcccacctctctcctctgcctttcacttcatgctgctggtggagcgtgtcagcaggagcctgaccgrggcccagtttgttttttgctggaatcggagggaggaggggcccagggggagtggagggcacgacctccctgttagacagtagacgagcaggagtgtagca

SEQ ID NO: 80185 - DNA, 201 bp, Bos taurus
agagacttgacaaaagacccttggctgttcctagttagataagtttccagatgttgcaagggatttgagtctcttagcaatttttactccagtaattttayctttctaatgccacctgttgtctgattgcagacacatggaacccctgtgctgtactcgaccccttcaaaaacagcctccagtctgtgaccatcacaagac

SEQ ID NO: 80186 - DNA, 201 bp, Bos taurus; identical to SEQ ID NO: 39867

SEQ ID NO: 80187 - DNA, 201 bp, Bos taurus
agatcagggactgaactccttgtctcctgcactggcaggtagattcttcaccattaagccaccagggaagcccaggcctttggcttttaactcaaagtggratgtgagcgtacagggcagtgagcaggggactcattgacctgacacagggtttcccaggagctcctgaaaccactgttaccaggcctgtgctggggacaa

SEQ ID NO: 80188 - DNA, 201 bp, Bos taurus
tagctgaagaccagataggagtctttccatcgatccactaaaaaatacttatggaagttaaacctgcaagtcaaaaaagctcttggttaatggcagtttarttaaacaagactaactggctcctactagagccctagtgaattcgtttattaaacaaatatttattaaaggcctaatttatcaagcaataagttttaaaca

SEQ ID NO: 80189 - DNA, 201 bp, Bos taurus
caaaaataaacacatgttttatgagtaccttgaagttacagaatttgctgggtcaagcgattggaaagaccaagaggctacccttaaagtgaggtggcctrtgtcctctgaccagataggaatggaagaaggaggagttggcagagaaagtctagactctggtctaccatggagcctaggcccaggccgccagaatcccac

SEQ ID NO: 80190 - DNA, 201 bp, Bos taurus; identical to SEQ ID NO: 39872

SEQ ID NO: 80191 - DNA, 201 bp, Bos taurus; identical to SEQ ID NO: 39873

SEQ ID NO: 80192 - DNA, 201 bp, Bos taurus; identical to SEQ ID NO: 39874

SEQ ID NO: 80193 - DNA, 201 bp, Bos taurus; identical to SEQ ID NO: 39875

SEQ ID NO: 80194 - DNA, 201 bp, Bos taurus
actactccccttcttactcattccactccagcccctttgctcttccaatcaaccagctcggctacaacccgagggcctttgcacatgctgttccctcttakgcaacgctttcccgtcattttgcacatggctccctctttcaggtctttactcaaatgttatcttctctgtgtggcctgccccacctctctgttacaatcg

SEQ ID NO: 80195 - DNA, 201 bp, Bos taurus
gctgggactctaccccttcccagtgacacgtcctacactcggctggcctccacacctgctcctggcacccgctcccctcggcactcgctgccctcggtgargcctctctggcctcttttcagcatccttgcttgggggttgacatcgctgtcaatggcccaccggctacagcccagggctgactccccccagggatgatga

SEQ ID NO: 80196 - DNA, 201 bp, Bos taurus
gagatctcttaattaagcggccttcccctaggagaaaggaaatgggcttccatattctcagctccgacatcagatcgcatgatttactacccgaggcctgygtttctccccaaaccagctcctctatagcacaaacatctatcactttgaaggcggttcaaacgccactttccccttctcctccccctttcgcagtgccct

SEQ ID NO: 80197 - DNA, 201 bp, Bos taurus
tggccaaagtactggtgcttcagcttcagcatcagtcctttcagtgaatattcagggtgagtctctcccaaacccacccgagtctgtgactactgccaccrtatgccaccttcatcagaggagaagcctgctttccagtttgggatgtgatattttggaaaggatggcagaatggaaagtgcttggaggatcactcagaat

SEQ ID NO: 80198 - DNA, 201 bp, Bos taurus
tagggctgagagagtcacagagcagtctacgttgaggtcagcttcacttgacttgactgagcaaacactggagaaactgcatccttcctgtgctgtgtggygtggtacttggtgcattgagggctcaaggaatagaacagaaaaggtgtttcagaggggtttggatgatctgcagaagatggagtgatggccatgcttgca

SEQ ID NO: 80199 - DNA, 201 bp, Bos taurus
aaatcaaaacagatcacccacctgagattgtgagggcaatctggagcttggtaagagctgtcagtttggtacagctcccactgaggatgctaatgacacayaactttcatatgtcctcacttcctcacccccgatgtaaggggtgtgtggtgtgcttagttgctcagttatgtctgactctttgctacctcatggactgta

SEQ ID NO: 80200 - DNA, 201 bp, Bos taurus
acttcattgaattacttaaaatgatagcaaggctatgacggttcacagagcccccatactaagaacgttctctttatgagctttcaagcccaaggataagyagagttaacttcttgccctacagcagttaaaagaaggcaaaagggaatgactgcattttttttcccctcagagaattacctccaacaataatgagaattt

SEQ ID NO: 80201 - DNA, 201 bp, Bos taurus
tgagtatttatttttcatcctccttacaagggtcatttcaattaaagtcttaagctaaagagagttggtcagtttatcagcctaaatctgatctaacgtakcttctgtttctttgcagggccatgaaattcttcatgcttcaggatttttgttttactgaaacctttgacacagagctttcattgagagggggaaatgcag

SEQ ID NO: 80202 - DNA, 201 bp, Bos taurus; identical to SEQ ID NO: 39879

SEQ ID NO: 80203 - DNA, 201 bp, Bos taurus; identical to SEQ ID NO: 39880

SEQ ID NO: 80204 - DNA, 201 bp, Bos taurus; identical to SEQ ID NO: 39881

SEQ ID NO: 80205 - DNA, 201 bp, Bos taurus; identical to SEQ ID NO: 39882

SEQ ID NO: 80206 - DNA, 201 bp, Bos taurus
catatggcaataatagggggcagggtggcctttcagaagtatccctacttcaggaccttgtgtttcttggagcagtcattggatgagagccatccctagtrgagggcccttggtgaggtgactcctattgtgcgtgtttgtgtgtgtgtgtgtgtgtgtgtgtgtgtatgtgtgtgtttgcatgctcactcagttgtgtct

SEQ ID NO: 80207 - DNA, 201 bp, Bos taurus; identical to SEQ ID NO: 39886

SEQ ID NO: 80208 - DNA, 201 bp, Bos taurus; identical to SEQ ID NO: 39887

SEQ ID NO: 80209 - DNA, 201 bp, Bos taurus; identical to SEQ ID NO: 39888

SEQ ID NO: 80210 - DNA, 201 bp, Bos taurus; identical to SEQ ID NO: 39889

SEQ ID NO: 80211 - DNA, 201 bp, Bos taurus; identical to SEQ ID NO: 39890

SEQ ID NO: 80212 - DNA, 201 bp, Bos taurus; identical to SEQ ID NO: 39891

SEQ ID NO: 80213 - DNA, 201 bp, Bos taurus; identical to SEQ ID NO: 39892

SEQ ID NO: 80214 - DNA, 201 bp, Bos taurus; identical to SEQ ID NO: 39893

SEQ ID NO: 80215 - DNA, 201 bp, Bos taurus; identical to SEQ ID NO: 39894

SEQ ID NO: 80216 - DNA, 201 bp, Bos taurus; identical to SEQ ID NO: 39895

SEQ ID NO: 80217 - DNA, 201 bp, Bos taurus; identical to SEQ ID NO: 39896

SEQ ID NO: 80218 - DNA, 201 bp, Bos taurus; identical to SEQ ID NO: 39897

SEQ ID NO: 80219 - DNA, 201 bp, Bos taurus; identical to SEQ ID NO: 39898

SEQ ID NO: 80220 - DNA, 201 bp, Bos taurus; identical to SEQ ID NO: 39899

SEQ ID NO: 80221 - DNA, 201 bp, Bos taurus; identical to SEQ ID NO: 39900

SEQ ID NO: 80222 - DNA, 201 bp, Bos taurus; identical to SEQ ID NO: 39901

SEQ ID NO: 80223 - DNA, 201 bp, Bos taurus; identical to SEQ ID NO: 39902

SEQ ID NO: 80224 - DNA, 201 bp, Bos taurus
ccaaaacatatgagcaagaacattctgtagtggatcccgtagagaaaacaatggaacttaaatctacaaatatttcatttacaaatatggtttcagtagayggtttcacatcctcaagacccagaaaaaactattttgactcaagaagccgtaattactgtgaaaggagtcagtctcggcagttaccttgaagggctgatg

SEQ ID NO: 80225 - DNA, 201 bp, Bos taurus
gaggagccaggcaagctacagtccatggggtcaagacacatccatggggtcaagacacatggagtcagacacatctgagcaactgacaatctcatttttayttcatggagcaaaataacaggagaactgtagaaactagttaaggagctatagcaaccagggaagtgcataaacaagagaagggatggttcaggtgaggcc

SEQ ID NO: 80226 - DNA, 201 bp, Bos taurus; identical to SEQ ID NO: 39903

SEQ ID NO: 80227 - DNA, 201 bp, Bos taurus
ttagaaagaaaaaaaattgatttcttttcctagagtaattagaagacaaaagccgggttggactgagagaaataaagagaatcgataccaatcactttctyagttttttcattctccaaccacgaagattgcagtgaggttacttgtattctttaatgcaacacttctttttttcaaagagtagcttaaatcaacatgcat

SEQ ID NO: 80228 - DNA, 201 bp, Bos taurus; identical to SEQ ID NO: 39905

SEQ ID NO: 80229 - DNA, 201 bp, Bos taurus
catgttgaacaataatcctgactatcatgacaactgatcgcgaaggtgagaattttaaaataaagaacagcgtggagaggcaagcctgccatttgtgacgrcatggatgaaccttgagggcattatgcaaaggaaggcagtatgctatgtcagacaaagacaagtacgtaaatatggaatctaaaggagccaaagctgtaa

SEQ ID NO: 80230 - DNA, 201 bp, Bos taurus
agcagtgtgtacatgtccatccccaattccctaactatccctttcccccattctcccctctgttgactctcttttccattgttaaaacagtctttactaayttaggcatgtttgtagtcctgccacagttccatttagagataacatatatatttgtatgatgttgcctgaattttttgaaattcccagcatctgagatca

SEQ ID NO: 80231 - DNA, 201 bp, Bos taurus; identical to SEQ ID NO: 39907

SEQ ID NO: 80232 - DNA, 201 bp, Bos taurus
cactctgctttaatactcagaagggtgggtgaaacatgggagaatacaagctgtaagtctggagatgtaacatttgccttttgtgggcactcatctctatygtgtaaccttaaacaaggaactttacctcctaggatctatacccgaaaaggagattaatttcaatagctccaagctttaaattggtatagttttcctact

SEQ ID NO: 80233 - DNA, 201 bp, Bos taurus
catcctcgtaaatgtgtttatgaaagagggaactgcccactatacagacgaaataggagttagtgacgacacaggccttgggaagtggcctcacctccctrgggtcaacctcttcatttcaacagattaatgagccattttcctaaatggctaaacttactaaggaggaagggccttcccaggtggctcagtggtaaagaa

SEQ ID NO: 80234 - DNA, 201 bp, Bos taurus
ttttgataatgatcaaattgtcctctataaagtttatgccaactgaaagccaccccaataattcatggaaatacttattagggtgtatttttgccaacaayagagtattcttatatactgggtattaaaagtccttcaagtatttgccaattggataaatgaaatgtggtgtcaccttgttttttgaattcagtttgacca

SEQ ID NO: 80235 - DNA, 201 bp, Bos taurus
tgataatttacagtaaaggataaagtgagaatctaattttatatttttccaaagcattgaccaattattccagcacaaattttcaactaaatgggaagccmttaaaattgaaatgctaatttattccaattctaaataatgatacatacctgggtctattgctatgtagtctctcctgttctggtgccaataacaataatt

SEQ ID NO: 80236 - DNA, 201 bp, Bos taurus; identical to SEQ ID NO: 39911

SEQ ID NO: 80237 - DNA, 201 bp, Bos taurus; identical to SEQ ID NO: 39912

SEQ ID NO: 80238 - DNA, 201 bp, Bos taurus; identical to SEQ ID NO: 39913

SEQ ID NO: 80239 - DNA, 201 bp, Bos taurus; identical to SEQ ID NO: 39915

SEQ ID NO: 80240 - DNA, 201 bp, Bos taurus; identical to SEQ ID NO: 39917

SEQ ID NO: 80241 - DNA, 201 bp, Bos taurus; identical to SEQ ID NO: 39918

SEQ ID NO: 80242 - DNA, 201 bp, Bos taurus
aaatcactcactcactcacatgggcacaggcgacacatccaagaacattcaatgcagcattgttttttgttttgggggaggtttctgatcagagagaaaaraagtactttttaattccttcttaactgcaaaagccctttatctcaaatgccaacatatacatttatttctagctagtaaagcatatgagaaccgcagcct

SEQ ID NO: 80243 - DNA, 201 bp, Bos taurus
aggaggtggaagcgatggggtaaatcctggcccagctcaggcttggaggtctccagccaagtgcagagctgactgcatcccacatggcttagaatcagagrggccttccccgaccaccatggtctggattgatcctgcagatgaaagatgaaccatgagtgctggtaattaggggtgccagtggagccaatgaaggagttc

SEQ ID NO: 80244 - DNA, 201 bp, Bos taurus
ttagaatttcagtgattctattcataaaatcccattattctgtagtatcaaatatgcctggttcatgcttagctcttgtcagcaatgacttaagcattcargttcatcttatatcttcaccatctttaccttatggcttctaagttcatcttgcctaccttaagtgagaagaggggggaaagcttttagatcatgagtggg

SEQ ID NO: 80245 - DNA, 201 bp, Bos taurus
tggctcagcagaccggccctactacatgtccaagagccttctgaagattcttggcaagaagaacaaggggaccccgggagacaagaagaggaagaagtgaragatgcagccctgatcctggactgtctcccgcctgtacagcctccccgccttccagatcacgcttttgtagtaaaaagattttattaaaaaattgctatt

SEQ ID NO: 80246 - DNA, 201 bp, Bos taurus
ttcaaacatttattgaacacttactatatacttggcattgttctaggttctgtgaatacagttatgaacaaaacagagcaaaaatccttgccttcatgggrtagggaatggggagacagacaatatacataataaataactaaatgtattttttgtgttaagaggtaataaatacagtggaaaaaaaacaaaatagggcaa

SEQ ID NO: 80247 - DNA, 201 bp, Bos taurus; identical to SEQ ID NO: 39926

SEQ ID NO: 80248 - DNA, 201 bp, Bos taurus; identical to SEQ ID NO: 39929

SEQ ID NO: 80249 - DNA, 201 bp, Bos taurus
cacagcactgtctaccccaccccagcatcagatgaatccttgttcagggggaaatcccaggacttcctcctcagggccacgtgacctctgctttctgttamtggaagtgtgctgcgtcccgcagaagaaaaagctcatccatgggagagaagagaggctcaaggggaccagtcactcacaaggaatgagggcgggacagac

SEQ ID NO: 80250 - DNA, 201 bp, Bos taurus
gtctagggttctgctttcaatgaggctgaaggtggtggccttgggtttctgggtttcctcttcattggtgaaaacataagagagggaattaaaagagcagraagtgaaaaacaagtggcccaagttgtcagtcacccaaaatcaaccaagacctctgaaacaaaagagtctaagagtatgggattgggggaagcctggctc

SEQ ID NO: 80251 - DNA, 201 bp, Bos taurus
cctttattttacacaagaaaattgaagcatagagagggtagtgatttatccaaggtgtacagttatgaagcaacagggccaggattcagactgaggtgaartacatgtccacgtacatcatatcctgcctcacaatatctatggattatgcttttctgcatggaaaggtagagactgaggccttgggatgccagtctgttg

SEQ ID NO: 80252 - DNA, 201 bp, Bos taurus; identical to SEQ ID NO: 39949

SEQ ID NO: 80253 - DNA, 201 bp, Bos taurus
acctgggtggatttctccctcttctgatgagaagccggggccctatttctacaagcacccatttttttctcctcgttggaacccaggtccagcctgagggragatcagggaggcctcgtgccccttgtacctgtgcgcagcagcgcatccttcctgttctccaggtgtctgtggagccactttatgcagtcgccctccagg

SEQ ID NO: 80254 - DNA, 201 bp, Bos taurus
caggagagacctaccagcgtcacatgggtcggagcacagctgggaacaaaactgaggctgaaccagagccagtgtggtgggcagaggcttgtttcacagcragggtggaacgaacccttgcaccccaaccctgctccaagcacaccctgacccttcactcaaagcaaaacttcacgccctgacccttgtagcaacgactgt

SEQ ID NO: 80255 - DNA, 201 bp, Bos taurus
ctaaaagataaataaataaaatgaaattttagcattagagtcccaagagagtggtagtattctaataaataaaagggaatgctgaagcttgccccaaggayagacatcacaatgatttccttgcctaactgcattctgccaaaagaaacacatatttagtacacatcttctttatccattcatcacttgatgaacacttag

SEQ ID NO: 80256 - DNA, 201 bp, Bos taurus
gctggtaaatttgcacagcaccaggaaggtaattagttatggtggctgtgtggcccagctgttcatatttctggctttgggggccactgaatgtgttctgmtgcccgtcatgtgctttgataggtttgtagctatttgtcggcctctccattactcagtcatcatgcaccaaaggctctgcctccagttggcagctgcatc

SEQ ID NO: 80257 - DNA, 201 bp, Bos taurus; identical to SEQ ID NO: 39950

SEQ ID NO: 80258 - DNA, 201 bp, Bos taurus
ttttggccactgacctggaggatctttttccctgaccagggagccaatctggttgcacatggatggaagtgcagagtcccactggatgaccagggaattcycagcctgagcacttttatgtaatctggctccctaactgtgtggtggcttcagaatgatcagacatctcatacattccaaagaggagtgccccagaacacc

SEQ ID NO: 80259 - DNA, 201 bp, Bos taurus; identical to SEQ ID NO: 39951

SEQ ID NO: 80260 - DNA, 201 bp, Bos taurus; identical to SEQ ID NO: 39952

SEQ ID NO: 80261 - DNA, 201 bp, Bos taurus
aatgtaattaaaggcaagggacaaaatccctgtggactaagaaatttaacttgggggggggggaataaaaggaatttaagcttttttatttattcagccaragctattgtatcttcttggggatcaccagaaggtaagattggaaaaagtttagattacaaaatttctaacacctttttgatttcagtgaggtagaaatgg

SEQ ID NO: 80262 - DNA, 201 bp, Bos taurus; identical to SEQ ID NO: 39953

SEQ ID NO: 80263 - DNA, 201 bp, Bos taurus
aaaaaaaaaaaaaaaggtgaatggaaacaggcaaggcatctcaagaggtcttggaatagaaatattgtcaatttctacatgccactggttaaagcaaatcrcgtggccaaatgcaaagttaagaggtggggaaatatactttgccatgatgagaccatatcaaagatgaggattctgggaggattgaaggactggggttag

SEQ ID NO: 80264 - DNA, 201 bp, Bos taurus; identical to SEQ ID NO: 39955

SEQ ID NO: 80265 - DNA, 201 bp, Bos taurus
ttaaatcagaattacatagggtgttggtatgactgtgtgtgtgtgtgttgtaaatgtgttttaaatatagattccagagtcttggcccagataatcctgawttctcctgagaagactcctgttaagaagtgcatccaggattccagcttacagctatctgacttcaaagcatttgctctcaacacacgtgtttttcaggcc

SEQ ID NO: 80266 - DNA, 201 bp, Bos taurus
gctgccctggaatttgggagctaaagcccaaaagctcttaccgggtttctctgttcctggaatcagaactgcccagattggataataattgaaatttccaytctgtgcctaactagagagtatttctccacgtgcagggttttcaactctggtgtgctacaccacgttaaatattgatatttggggacacttttataaaat

SEQ ID NO: 80267 - DNA, 201 bp, Bos taurus; identical to SEQ ID NO: 39957

SEQ ID NO: 80268 - DNA, 201 bp, Bos taurus
tcatttttgcatgagaacacttaaagctgtactctggcctctgctcctgaccttgctacaaagtgctatgggtcaggatgaatgtccacacctgctccccytccacaaactcaagccctgggggcaccttctctttcccaccccaaatgtatgtgtttctacaacaagacactcagaagattgacctggtaggccacatgt

SEQ ID NO: 80269 - DNA, 201 bp, Bos taurus; identical to SEQ ID NO: 39961

SEQ ID NO: 80270 - DNA, 201 bp, Bos taurus
ttaaagaaaaaagtaatatttaaattaaaaaatagaaaaaaaaagaaactgtttacaaatagatacttttataaggcctgtttcatcagagaaaggaagcraggctgaacagtgttataaagtggctgggctatggtgtgaaccaggcaggattcaaggcccaaggccttaaccgctgggccctacggcctcccgagggag

SEQ ID NO: 80271 - DNA, 201 bp, Bos taurus; identical to SEQ ID NO: 39962

SEQ ID NO: 80272 - DNA, 201 bp, Bos taurus; identical to SEQ ID NO: 39963

SEQ ID NO: 80273 - DNA, 201 bp, Bos taurus; identical to SEQ ID NO: 39964

SEQ ID NO: 80274 - DNA, 201 bp, Bos taurus
gttccaactacagttatccccaagttttatcccacaaaatacagcatgaaaaaaaaccacagcataaatattattcaagtaaaatgctatctatcatagcygcatacgaataattaaagctctgggcttcaacctgcagagaaggcagtcatgtggaacagttaaagttaatgatctaagtttacaataaaacagatttat

SEQ ID NO: 80275 - DNA, 201 bp, Bos taurus
catgtcccctgcattggcaggtggagtcctaaacactgaaccaccagagcagtccctgctatttattctttatgtggccatcagagccaaaataaatacaygacttggtcattccagccccaaatgagacatttgaacaattgactcagtttgtccctctctttaaccagcaggtcatagactcttatttagaaacatcca

SEQ ID NO: 80276 - DNA, 201 bp, Bos taurus; identical to SEQ ID NO: 39965

SEQ ID NO: 80277 - DNA, 201 bp, Bos taurus
aggctgaagattctcaagcctgtgagttcccactccacagtgttggggtttgagggtggaaagcttgtgtgaagaaggaaaggaaaggaagggtatctgcrtcttggccaactggacctatcttaaattccagggaagctcagccaaaagcttgacagcagtgagtccaaccaggcaatttatgcaatgttgaattccaag

SEQ ID NO: 80278 - DNA, 201 bp, Bos taurus; identical to SEQ ID NO: 39966

SEQ ID NO: 80279 - DNA, 201 bp, Bos taurus
tttcagagaagcatgcgtggagaaaaactaatttcctaaccaatgctgtatacatattttcaagtcctacctaattacagagacttcctttccaaagtgamggatttcattgaaatttgtattgcctgctccttgtcatatatcacacagcttttatcactcttcaaaaaaaaaaaaaaaaaggagtatatgagttttctg

SEQ ID NO: 80280 - DNA, 201 bp, Bos taurus; identical to SEQ ID NO: 39968

SEQ ID NO: 80281 - DNA, 201 bp, Bos taurus; identical to SEQ ID NO: 39969

SEQ ID NO: 80282 - DNA, 201 bp, Bos taurus; identical to SEQ ID NO: 39970

SEQ ID NO: 80283 - DNA, 201 bp, Bos taurus
gcctcattccttgcatgtggtcaaggtctatttcatttcctgtatctctcacatcctttgctacttttcacttggcagagccctctttgatttttagtgtmataatattctttctggtctctttctctttctctaccagccccaacagccacaactcctcaatccacattgaagtttctcttttctaattctggacattct

SEQ ID NO: 80284 - DNA, 201 bp, Bos taurus
atacgtcaacgataccactctagtagcagaaagtgaaggggaactaaagagcctctgatggggatgaaaaaggagagtgaaaaagctggcctaaaactcartaccaaaaaagtaatatcatggtatctgatcctgtcatttacatggcaactagaagggaaaaaggtagaagcagtgacagatttcctcttcctggcctct

SEQ ID NO: 80285 - DNA, 201 bp, Bos taurus; identical to SEQ ID NO: 39972

SEQ ID NO: 80286 - DNA, 201 bp, Bos taurus; identical to SEQ ID NO: 39974

SEQ ID NO: 80287 - DNA, 201 bp, Bos taurus
cacaatcctaacattatttaaaatattttcacatacatcttctcttaaatacaatctgttctcttactaaaactttgttaataatatcaacattctttccrtctgctcagcatcttaataatggagatgataaaatgaaggaagaaggtcaaggagaaggaggatgtttttaatgaatttaaaataaatttaaaatttact

SEQ ID NO: 80288 - DNA, 201 bp, Bos taurus
gcctgaattgtgttcttgtacagtgagatagttcaaaactcattcctcattacagaaatcacctctctcattcatgaaaatagcaaggaagctttcatgargctgctcacctggccaaatatcatctccatgccttccagaagtcgtttgttttcttcctcaatctctatggccctcgataggatagcatctggggctcct

SEQ ID NO: 80289 - DNA, 201 bp, Bos taurus
cttcagaaaaacagcctgactgctgtggactgaatgagttttcatattcccctccaatttttaattttaagctgactcttatcatcttccttttccaattyccacttcggccttgattttggatgtgggaggtattaatagatagaggcaggagctcagccttaggtccccaattttggatatgacagtgcaccttaataa

SEQ ID NO: 80290 - DNA, 201 bp, Bos taurus
cattctctttactcaaaaatagtgaagtaaacaaaatataggcacaaaggagaaaatattcacatatctcattaacccacttgcacaaatataagtggaarcctggggaaaccctcaagagttcaccttgtcttgcctcttgccctctgtgaaggcactatactgagtcaattgtcagtaactgcaattaatgggaaaata

SEQ ID NO: 80291 - DNA, 201 bp, Bos taurus; identical to SEQ ID NO: 39975

SEQ ID NO: 80292 - DNA, 201 bp, Bos taurus; identical to SEQ ID NO: 39976

SEQ ID NO: 80293 - DNA, 201 bp, Bos taurus; identical to SEQ ID NO: 39977

SEQ ID NO: 80294 - DNA, 201 bp, Bos taurus; identical to SEQ ID NO: 39978

SEQ ID NO: 80295 - DNA, 201 bp, Bos taurus; identical to SEQ ID NO: 39979

SEQ ID NO: 80296 - DNA, 201 bp, Bos taurus; identical to SEQ ID NO: 39981

SEQ ID NO: 80297 - DNA, 201 bp, Bos taurus
aaggctaaaaggaccagggcagatgatgggaagaccagaacttgatcaaagtatgacttccggggtcttcctccagctcagcaggccagctctgagagctscaagttcaaccaagcatgcgttcccggcatcgcctttggggggagcaattttacaatacaactctacaggatatccccattgtacagatggggccacgga

SEQ ID NO: 80298 - DNA, 201 bp, Bos taurus
caaataagacatggcattgactattctccattgattcccgggcaagagactgtgctacagtcgagtctccttcctcaggcccaaagcatggagttgagacyaaattgtagcctagttttcccttgtcctgtggacaaggcatgtgttaacacttctatgggccaataatcagaaatttagagtttttctgtggagttcgga

SEQ ID NO: 80299 - DNA, 201 bp, Bos taurus
tcctataaaccaagaaaaattggtatttggaaatgtctttagtttgctgttatttgtgaaggatacttttgctaaatatagaaatcttggttgacagtttygttctctgagtaccgaatgcatcactccactgtctttgacctctgttgcttctgatgagaagtcaaccattaatctttttgttctctcacacatagtatt

SEQ ID NO: 80300 - DNA, 201 bp, Bos taurus
ttaataaagctaggtccttcaggaggtagagagagtaagatccaaaacaccagtagagacacaagcccagaatgggagaggggccaagtcatcctgttctyaaatagggggttaggagggaagcatgaaaacagatgctattattcttgtagaagccagagaatactaagcaagattcccatctgttggcctcaatttcct

SEQ ID NO: 80301 - DNA, 201 bp, Bos taurus
ccaatgaagaagcaattagcaggaaataacactagaatcaattattcactcaagttgtgattaagagccatgtgtataacccttaaaatttaataaagccracactaagcaggaatccatctttttcatcaccaggaatatagataatccaatcataggaactaccttcgattagtatcaacaccgtttatgtactctgaa

SEQ ID NO: 80302 - DNA, 201 bp, Bos taurus
taggtaaatccaatttgggcaggaaggagctctggttctgggatagctgagaaagagatcagcagcctgtgaagctggctcaagatctggcaggaaaaggrgatagggccccattctcagaagatctgactcttccctgtaccatcacacacagtcctcagatcacacacctgggtatcacctggggaagagaagtgggca

SEQ ID NO: 80303 - DNA, 201 bp, Bos taurus; identical to SEQ ID NO: 39991

SEQ ID NO: 80304 - DNA, 201 bp, Bos taurus; identical to SEQ ID NO: 39992

SEQ ID NO: 80305 - DNA, 201 bp, Bos taurus
taatagtccaaggggtaccaacctgcctttggacacttaaaaggactttccttctttggggtttgccaaaggctgacttcagtattaaaagaaggtctccyattatctggtgttacaaccttggaacagccagcagactgaacagtcacacactaggaagcaaaatgctgaacagaaacacagccaattctgtcagccatc

SEQ ID NO: 80306 - DNA, 201 bp, Bos taurus; identical to SEQ ID NO: 39993

SEQ ID NO: 80307 - DNA, 201 bp, Bos taurus; identical to SEQ ID NO: 39995

SEQ ID NO: 80308 - DNA, 201 bp, Bos taurus; identical to SEQ ID NO: 39996

SEQ ID NO: 80309 - DNA, 201 bp, Bos taurus; identical to SEQ ID NO: 39998

SEQ ID NO: 80310 - DNA, 201 bp, Bos taurus; identical to SEQ ID NO: 39999

SEQ ID NO: 80311 - DNA, 201 bp, Bos taurus; identical to SEQ ID NO: 40000

SEQ ID NO: 80312 - DNA, 201 bp, Bos taurus; identical to SEQ ID NO: 40001

SEQ ID NO: 80313 - DNA, 201 bp, Bos taurus; identical to SEQ ID NO: 40002

SEQ ID NO: 80314 - DNA, 201 bp, Bos taurus; identical to SEQ ID NO: 40003

SEQ ID NO: 80315 - DNA, 201 bp, Bos taurus; identical to SEQ ID NO: 40004

SEQ ID NO: 80316 - DNA, 201 bp, Bos taurus; identical to SEQ ID NO: 40005

SEQ ID NO: 80317 - DNA, 201 bp, Bos taurus; identical to SEQ ID NO: 40006

SEQ ID NO: 80318 - DNA, 201 bp, Bos taurus; identical to SEQ ID NO: 40007

SEQ ID NO: 80319 - DNA, 201 bp, Bos taurus; identical to SEQ ID NO: 40008

SEQ ID NO: 80320 - DNA, 201 bp, Bos taurus; identical to SEQ ID NO: 40009

SEQ ID NO: 80321 - DNA, 201 bp, Bos taurus; identical to SEQ ID NO: 40010

SEQ ID NO: 80322 - DNA, 201 bp, Bos taurus; identical to SEQ ID NO: 40011

SEQ ID NO: 80323 - DNA, 201 bp, Bos taurus; identical to SEQ ID NO: 40012

SEQ ID NO: 80324 - DNA, 201 bp, Bos taurus; identical to SEQ ID NO: 40013

SEQ ID NO: 80325 - DNA, 201 bp, Bos taurus; identical to SEQ ID NO: 40014

SEQ ID NO: 80326 - DNA, 201 bp, Bos taurus; identical to SEQ ID NO: 40015

SEQ ID NO: 80327 - DNA, 201 bp, Bos taurus; identical to SEQ ID NO: 40016

SEQ ID NO: 80328 - DNA, 201 bp, Bos taurus; identical to SEQ ID NO: 40017

SEQ ID NO: 80329 - DNA, 201 bp, Bos taurus; identical to SEQ ID NO: 40018

SEQ ID NO: 80330 - DNA, 201 bp, Bos taurus; identical to SEQ ID NO: 40019

SEQ ID NO: 80331 - DNA, 201 bp, Bos taurus; identical to SEQ ID NO: 40020

SEQ ID NO: 80332 - DNA, 201 bp, Bos taurus; identical to SEQ ID NO: 40021

SEQ ID NO: 80333 - DNA, 201 bp, Bos taurus; identical to SEQ ID NO: 40022

SEQ ID NO: 80334 - DNA, 201 bp, Bos taurus; identical to SEQ ID NO: 40023

SEQ ID NO: 80335 - DNA, 201 bp, Bos taurus; identical to SEQ ID NO: 40024

SEQ ID NO: 80336 - DNA, 201 bp, Bos taurus; identical to SEQ ID NO: 40025

SEQ ID NO: 80337 - DNA, 201 bp, Bos taurus; identical to SEQ ID NO: 40026

SEQ ID NO: 80338 - DNA, 201 bp, Bos taurus; identical to SEQ ID NO: 40027

SEQ ID NO: 80339 - DNA, 201 bp, Bos taurus; identical to SEQ ID NO: 40028

SEQ ID NO: 80340 - DNA, 201 bp, Bos taurus; identical to SEQ ID NO: 40029

SEQ ID NO: 80341 - DNA, 201 bp, Bos taurus; identical to SEQ ID NO: 40030

SEQ ID NO: 80342 - DNA, 201 bp, Bos taurus; identical to SEQ ID NO: 40031

SEQ ID NO: 80343 - DNA, 201 bp, Bos taurus; identical to SEQ ID NO: 40032

SEQ ID NO: 80344 - DNA, 201 bp, Bos taurus; identical to SEQ ID NO: 40033

SEQ ID NO: 80345 - DNA, 201 bp, Bos taurus; identical to SEQ ID NO: 40034

SEQ ID NO: 80346 - DNA, 201 bp, Bos taurus; identical to SEQ ID NO: 40035

SEQ ID NO: 80347 - DNA, 201 bp, Bos taurus; identical to SEQ ID NO: 40036

SEQ ID NO: 80348 - DNA, 201 bp, Bos taurus; identical to SEQ ID NO: 40037

SEQ ID NO: 80349 - DNA, 201 bp, Bos taurus; identical to SEQ ID NO: 40038

SEQ ID NO: 80350 - DNA, 201 bp, Bos taurus; identical to SEQ ID NO: 40039

SEQ ID NO: 80351 - DNA, 201 bp, Bos taurus; identical to SEQ ID NO: 40040

SEQ ID NO: 80352 - DNA, 201 bp, Bos taurus; identical to SEQ ID NO: 40041

SEQ ID NO: 80353 - DNA, 201 bp, Bos taurus; identical to SEQ ID NO: 40042

SEQ ID NO: 80354 - DNA, 201 bp, Bos taurus; identical to SEQ ID NO: 40043

SEQ ID NO: 80355 - DNA, 201 bp, Bos taurus; identical to SEQ ID NO: 40044

SEQ ID NO: 80356 - DNA, 201 bp, Bos taurus; identical to SEQ ID NO: 40045

SEQ ID NO: 80357 - DNA, 201 bp, Bos taurus; identical to SEQ ID NO: 40046

SEQ ID NO: 80358 - DNA, 201 bp, Bos taurus; identical to SEQ ID NO: 40047

SEQ ID NO: 80359 - DNA, 201 bp, Bos taurus; identical to SEQ ID NO: 40048

SEQ ID NO: 80360 - DNA, 201 bp, Bos taurus; identical to SEQ ID NO: 40049

SEQ ID NO: 80361 - DNA, 201 bp, Bos taurus; identical to SEQ ID NO: 40050

SEQ ID NO: 80362 - DNA, 201 bp, Bos taurus; identical to SEQ ID NO: 40051

SEQ ID NO: 80363 - DNA, 201 bp, Bos taurus; identical to SEQ ID NO: 40052

SEQ ID NO: 80364 - DNA, 201 bp, Bos taurus; identical to SEQ ID NO: 40053

SEQ ID NO: 80365 - DNA, 201 bp, Bos taurus; identical to SEQ ID NO: 40054

SEQ ID NO: 80366 - DNA, 201 bp, Bos taurus; identical to SEQ ID NO: 40055

SEQ ID NO: 80367 - DNA, 201 bp, Bos taurus; identical to SEQ ID NO: 40056

SEQ ID NO: 80368 - DNA, 201 bp, Bos taurus; identical to SEQ ID NO: 40057

SEQ ID NO: 80369 - DNA, 201 bp, Bos taurus; identical to SEQ ID NO: 40058

SEQ ID NO: 80370 - DNA, 201 bp, Bos taurus; identical to SEQ ID NO: 40059

SEQ ID NO: 80371 - DNA, 201 bp, Bos taurus; identical to SEQ ID NO: 40060

SEQ ID NO: 80372 - DNA, 201 bp, Bos taurus; identical to SEQ ID NO: 40061

SEQ ID NO: 80373 - DNA, 201 bp, Bos taurus; identical to SEQ ID NO: 40062

SEQ ID NO: 80374 - DNA, 201 bp, Bos taurus; identical to SEQ ID NO: 40063

SEQ ID NO: 80375 - DNA, 201 bp, Bos taurus; identical to SEQ ID NO: 40064

SEQ ID NO: 80376 - DNA, 201 bp, Bos taurus; identical to SEQ ID NO: 40065

SEQ ID NO: 80377 - DNA, 201 bp, Bos taurus; identical to SEQ ID NO: 40066

SEQ ID NO: 80378 - DNA, 201 bp, Bos taurus; identical to SEQ ID NO: 40067

SEQ ID NO: 80379 - DNA, 201 bp, Bos taurus; identical to SEQ ID NO: 40068

SEQ ID NO: 80380 - DNA, 201 bp, Bos taurus; identical to SEQ ID NO: 40069

SEQ ID NO: 80381 - DNA, 201 bp, Bos taurus; identical to SEQ ID NO: 40070

SEQ ID NO: 80382 - DNA, 201 bp, Bos taurus; identical to SEQ ID NO: 40071

SEQ ID NO: 80383 - DNA, 201 bp, Bos taurus; identical to SEQ ID NO: 40072

SEQ ID NO: 80384 - DNA, 201 bp, Bos taurus; identical to SEQ ID NO: 40073

SEQ ID NO: 80385 - DNA, 201 bp, Bos taurus; identical to SEQ ID NO: 40074

SEQ ID NO: 80386 - DNA, 201 bp, Bos taurus; identical to SEQ ID NO: 40075

SEQ ID NO: 80387 - DNA, 201 bp, Bos taurus; identical to SEQ ID NO: 40076

SEQ ID NO: 80388 - DNA, 201 bp, Bos taurus; identical to SEQ ID NO: 40077

SEQ ID NO: 80389 - DNA, 201 bp, Bos taurus; identical to SEQ ID NO: 40078

SEQ ID NO: 80390 - DNA, 201 bp, Bos taurus; identical to SEQ ID NO: 40079

SEQ ID NO: 80391 - DNA, 201 bp, Bos taurus; identical to SEQ ID NO: 40080

SEQ ID NO: 80392 - DNA, 201 bp, Bos taurus; identical to SEQ ID NO: 40081

SEQ ID NO: 80393 - DNA, 201 bp, Bos taurus; identical to SEQ ID NO: 40083

SEQ ID NO: 80394 - DNA, 201 bp, Bos taurus; identical to SEQ ID NO: 40084

SEQ ID NO: 80395 - DNA, 201 bp, Bos taurus; identical to SEQ ID NO: 40085

SEQ ID NO: 80396 - DNA, 201 bp, Bos taurus; identical to SEQ ID NO: 40086

SEQ ID NO: 80397 - DNA, 201 bp, Bos taurus; identical to SEQ ID NO: 40087

SEQ ID NO: 80398 - DNA, 201 bp, Bos taurus; identical to SEQ ID NO: 40088

SEQ ID NO: 80399 - DNA, 201 bp, Bos taurus; identical to SEQ ID NO: 40089

SEQ ID NO: 80400 - DNA, 201 bp, Bos taurus; identical to SEQ ID NO: 40090

SEQ ID NO: 80401 - DNA, 201 bp, Bos taurus
aatgtgctgtctgctgcccactgctctgtctttcagaaggaccaggacttgagcacgtttcacaactgaatctttgggtgtggctgctgcagtttctctgraagtactgctgggccatgagatctgaaaagcttgtaaatactgtggatcgctaaccagatatgctctgtgtcacctggattacttctgttgtttgtggga

SEQ ID NO: 80402 - DNA, 201 bp, Bos taurus
tgttcagggacctcagcaaccagcacccagagaaaagtgtgccccgagtccggagacatgctttcacgactgaagcttcaatgatcaatgccctcaggccmctctgggctcctcagtgccagcgtgggtggctttcccaccccagctccaccctcaagccatgtaacctggcccaagtgggtccctgtccgtgtccaggct

SEQ ID NO: 80403 - DNA, 201 bp, Bos taurus
aagcaaaatttaaagtaataaaaacatctggacccctctaactgttatccatcactcctaacgtggccctcccccacctcccttcccctgcagccttgacwcttcattgctgtccctcaggccctccatctgacacgggggcctcctgggaagcctgtctggctccggctgtcacacactagagtcattgtcctggcactc

SEQ ID NO: 80404 - DNA, 201 bp, Bos taurus
atgctaaaatcatcccaaatgttaacatttcttttctcaagcaggtcacagcttggaactaacgacattcgtgtgtgacttctttggacggccctcgcgtygtccagataagaaccttgacgtgcatcgacggacacaccactgcctccgtaaaacactgcccaacacttctggtatcttcttcagctcatccggccccac

SEQ ID NO: 80405 - DNA, 201 bp, Bos taurus
cttcccaacccagggatcaaacccatgtctcctgcctgtcctgcactgcaggcggattctacaccactgagccacagaccaagcctggttctctgggccarcatttcccagagtgtgcctattccctagaccacgagctagctctatttagcaacgcacatttggctaccacttggagtttcacagtgttggtttctgcat

SEQ ID NO: 80406 - DNA, 201 bp, Bos taurus
cccagcagaacacccgaaggagccgtgaagcctggcttcatctgatattatcatggaaccctcgctcttcaagagccacaaggaccattcgtgatgatatmatttaatcacgtctcgtcttctcctgccgtgaatcacctgctggacacgtccgtccaccgtgactgcctggttctcagaatgtctgagacggagcatcac

SEQ ID NO: 80407 - DNA, 201 bp, Bos taurus
ggtgagatggacaggccagcaacccatgagcagacttgggacgtgggtccgtttctgctgtttttgtgatccttcgtaagtgcccagtctaacaccctcaygtgtgattggtttccaggccttggtggccccactgaaccactccagtctctggtctggaccgacggggttgcttttccttcctttgtctccctgcctcca

SEQ ID NO: 80408 - DNA, 201 bp, Bos taurus
cgggacggggttcccatctccggccccgcgccgacacccccagtgtgaggagaagagtccatgtcgctggaggtgaagccactgcttcatggttttcacgrgctctctgatatcacgtgttcttatttacagtaaaaattaatgacttatttcccatctgagtgaagggctattttattcactggttttttcctttgtcat

SEQ ID NO: 80409 - DNA, 201 bp, Bos taurus
agcgccccttccctggcgcccggcgtcgctgacccgcggtccccgggtccaggcagtgccaccacgatcagcccgcgaccgcctctccagccgttcagttycctgggcccgccgcgggatgttccgctggcccgtcccgggcaccacggccgggccccatcgtctctgccgggggagcggccccgcagggaggccagcgac

SEQ ID NO: 80410 - DNA, 201 bp, Bos taurus; identical to SEQ ID NO: 40094

SEQ ID NO: 80411 - DNA, 201 bp, Bos taurus
ggacatgactgagcacacacacccgtcttctccgggccaaggacgctgacgggcacttagtgggctctgactcagcatttacggaatgagcaggagagggygggctagaggctcctcagtggcctaggcctgtccctcatttcggccccagcctccccagtgacttgatggtgagtccatctacaggggtccggtgtccca

SEQ ID NO: 80412 - DNA, 201 bp, Bos taurus
cgatcagagatactttctttgatcgtttctctaaagcttgtcggtggatggcttcccagaagatgacataaaccaggccagagagtgcagcacaaggactyccggtccagctatccccaaacagactccaaaggtcccgcgaacaaacatttcccgccggctgggcaccaggtctggggcttctgggcccaggactggccc

SEQ ID NO: 80413 - DNA, 201 bp, Bos taurus
tgtttatcactgcatttcctggcatcgagaatgaacagagaaagtttacctattccttctcaaaccctcagcaccttccattcaccctgacgcgtgggacrtgccccgtgctggcctggcgacggtctgtcccggcttcctcaacccacattaggcatttgaactcagaacaagaggaggctcgtcaccagacgcatgttg

SEQ ID NO: 80414 - DNA, 201 bp, Bos taurus; identical to SEQ ID NO: 40096

SEQ ID NO: 80415 - DNA, 201 bp, Bos taurus
ggcgctgtttccgcaccctacaggtgctgagccctgcggttactctgggaagcttgttctgttgtcttcattttattgatgaaaaagctgaggctcagaargacgacatgcattccctgagtcacttgcgtagtgagtggcatttgggcctggagatctggctccaagtctgtgctgtaaactgcagacaggctctgctgg

SEQ ID NO: 80416 - DNA, 201 bp, Bos taurus
cctatggcctacatactttcgtcattgcatgtattatctgctgaagtatttattttattgtgtcttaaactgatagctctttggcaccagggtaaattaaygtgctgttgtgcaaaaggccattgtttgaacttactttggacattcctagaggttgatcacagcagaacagggaagcgcagagctgacttcgtggcggct

SEQ ID NO: 80417 - DNA, 201 bp, Bos taurus
ctctgggtcagaactcctggctctgcaggtcctgagccagatgcggcccttgaacttcagaaagagctgctatgtcccgtctccaacacaaagttcatctyaatcaaaaacaagtgaggccactgagccggcggctctcttcgcacacttggctcgtgccagtgactcaggccaaggacggggaaccacgcagcgtttcta

SEQ ID NO: 80418 - DNA, 201 bp, Bos taurus
atacaaaacaatcttctaagatacaggaacctgccagagactaatcgacctaatgtcaaacagcaggaataggaccagatgcaggtatgacgtggtttacraatgcatccacttacgctaaactaaaaacgggtacttaatggaaagtccagacaaagcagttcataagtcatctggctatgaaattatctgcatgtgaaa

SEQ ID NO: 80419 - DNA, 201 bp, Bos taurus; identical to SEQ ID NO: 40099

SEQ ID NO: 80420 - DNA, 201 bp, Bos taurus
acgtcaggcagcaccaaagggctaagcacccacgatatgcactttctgccgctgcctccagagcctggccgcccgccaaggagggtcattaactcacagcrcaggagtctaggcgaataccagggagagcctattcaagaagccttaacgtaacggacattcataaaaccgtgcctcatctctgaagacagatgcggcctc

SEQ ID NO: 80421 - DNA, 201 bp, Bos taurus; identical to SEQ ID NO: 40100

SEQ ID NO: 80422 - DNA, 201 bp, Bos taurus
accagcaagacaagactgacaagtggccttaggaggtactgtcccaccccaccagcctgagactcccacatcccacccagggacacgggggcatccaagtrgcactggttagggcccctgccacaaaaagaggttagaggcctcagatatcaaggccttccttgatgtctccatgtcccatgagcctgagactcccctctc

SEQ ID NO: 80423 - DNA, 201 bp, Bos taurus
caatagttgaattgcttgggctgcgtagacacagcccgactccaggtgggaagatccacattcagaatttggataatttcaaagagactcggccattctgyccctttgaggaaatgccttccccaaccacttatggaattaattgaccaattagaaaatattcaggaagagagagtggctgatctgaaactttctgataag

SEQ ID NO: 80424 - DNA, 201 bp, Bos taurus
gcgtaatagtctatagcctttagggtattttatacttataaaatcatatctgcagctaaaacaagctttatttttctctttccaatgttatgccttctctkcctttttcttgcctattgtcactggcgggtcatcctgcacgagactgcagagttgatgatgggtgttcttgtcttgttcccaaactcaaggaagatttta

SEQ ID NO: 80425 - DNA, 201 bp, Bos taurus; identical to SEQ ID NO: 40105

SEQ ID NO: 80426 - DNA, 201 bp, Bos taurus; identical to SEQ ID NO: 40106

SEQ ID NO: 80427 - DNA, 201 bp, Bos taurus; identical to SEQ ID NO: 40107

SEQ ID NO: 80428 - DNA, 201 bp, Bos taurus
ttgcctttgggactctaaaaggcagttacttttaactaacataatatgaaaagattgttaagtttcctatgaaagagaactgcacccctgtgtcagaggaragtgcgcaagctctggtggacatctgactcccccgagccccagcctctgccccggggtctccacgctgcaattttggcttctctggttggcttggacatg

SEQ ID NO: 80429 - DNA, 201 bp, Bos taurus
tggctccactggtgccggagagggaaccacagtgcgttcccgctctggatgctatagagccaggactccacgcaccagggaaagccacgtgccggtgctgytctcattctgcagagtactagactcagaatagtcagtgatacgctcacttttcctttatgaaggagacctgggtcttcaacgctcactcccagttcctag

SEQ ID NO: 80430 - DNA, 201 bp, Bos taurus; identical to SEQ ID NO: 40108

SEQ ID NO: 80431 - DNA, 201 bp, Bos taurus; identical to SEQ ID NO: 40109

SEQ ID NO: 80432 - DNA, 201 bp, Bos taurus; identical to SEQ ID NO: 40110

SEQ ID NO: 80433 - DNA, 201 bp, Bos taurus
aaaaaagcaaagggtggtcactgtctctactcagctggagccctacaaccactctaattttattttgccctaagggaagtgctggtcagaggagcaggccrtctggggcaattagaagtctttggctggtgaggaaacctgccagctcactcctgccttgagccagcctcaaacgctgtttctagctctgtgtcctcttgg

SEQ ID NO: 80434 - DNA, 201 bp, Bos taurus
ttgtctcgtttggacccggcccccagcttcgggtctgcgtgaccgacatggtgcagcagcttcgctcaaaccgtgtctggaaaggctcagttttcaaagcycccggggttaccggccagacgtgtggtgccaccccagcggaagtcagtgcaacccccgccccccaccccgccccctcgcttccccaggacagcagagcag

SEQ ID NO: 80435 - DNA, 201 bp, Bos taurus
catccatccaagcagcctggctgaagcccccatgacctttaactagtccatatacaaatgtggtattcaatcacatgtacagtatttaaattaaatgggcrtggctgtgagtcggccccctcttctgggttttctgctctgagcctcgttttcctaaagatgaagtagatcatcagaggaaaacagcagaagagaaagggc

SEQ ID NO: 80436 - DNA, 201 bp, Bos taurus
gccgcggggttgagctccctgtgctatacagcgccttcccactaactgtttcacatgtgtaatgtgtgtttcagtgctactcttcttgtttttaaggtccygtatggctgcagagctgcccgtcaaagctcctgggtctctagacagtttcttgctgagtcagcctcctcagctttaatcatgctgttccccgttttaagg

SEQ ID NO: 80437 - DNA, 201 bp, Bos taurus; identical to SEQ ID NO: 40114

SEQ ID NO: 80438 - DNA, 201 bp, Bos taurus
gtggatgtgggatgctgagcagggaggaaagggccggtggggcttggcaccaactcatggaggacttcgaatccaggggggaggtcagggtgtgaaattayaggtgaggggagaaactgtgtttttgaggagacagccatgaaacttaggtttaagggagatctatggtgtgccaacagtaccaacagattggaaaaagga

SEQ ID NO: 80439 - DNA, 201 bp, Bos taurus
gaattaatgtggagtgggtttgagggagaaaaaaaaaacaggacaaaggagctttgagagaggagataaatgttattgcacattttgatttggcctccttygaattcagcctgaatgctgagtgaagttgttttttttttttttccccatggttgtccatttctgagaggatagagtgttgacctgtgggaagatactcaa

SEQ ID NO: 80440 - DNA, 201 bp, Bos taurus
aaaataggaaatgtctttatgcctctctctcagagtttagtgagtgtgataaacctcacacccgccccttccttcaccaagtgctcagcgagggctggccstgtgccaggtgcttttctaggaaaagggatacatctgtgaagaaaggatacagaaactgcccttgcaggccttgtattctttaaatgattctatgttata

SEQ ID NO: 80441 - DNA, 201 bp, Bos taurus
caggcattagacagtttggggttttgtttttgataacgaggctctttctgttgactaaggggatggtcagcaggtcttgacctagagtgaccccggagccygtggtcagaaatcaccgggtctccatcccagcagggtgagtctggagaccacgcgtcccttttctcctctttccactacgtgtgcggctgtggtccccgg

SEQ ID NO: 80442 - DNA, 201 bp, Bos taurus
gcatggtctaattagcctatgtctcttaaacaaatccaaaacaaagctaggtgagagagttttatgcaaacaaacaatgaaacctaatcactccccgcatycaggagcctccattattatagttgttcaaccctttttaactctccattgcttggaataataataacctgttagaactttgaaatgaaaatctttctacct

SEQ ID NO: 80443 - DNA, 201 bp, Bos taurus
cggaggcccggttcacactttcacgtttgtccggggtgaacgggaggtcaggaggggaaacagagttcacccagaagttgacagatagcgcgggctgtgcrggaggggacgtctagacccggcccggggccgcgagggcgtccggccggccgaaagctgctggctgaggggccctggtgatggatgggccgggccggctcc

SEQ ID NO: 80444 - DNA, 201 bp, Bos taurus
agtttagaatcatccctggatgatctcaaaggagagatggtgacaggttttgtctcagccacgatctggccaccgctcctcaaggctctgctaggcctgtygtcttggggtgaattaagtacccaaatctcacatcacactctttgtccaccaaggcagccctccatgcccgccacaaaccccctgcctgcaggccctgct

SEQ ID NO: 80445 - DNA, 201 bp, Bos taurus; identical to SEQ ID NO: 40118

SEQ ID NO: 80446 - DNA, 201 bp, Bos taurus
gcacagtaggctctggcagtcaccattcaattggtcatcggtggcctgagcagcagcatcttggttgttctaagtacagttaatctttcaattcagggtcygtttgttcccattgcttttgcggccagttctcagaactctggcagtttatgtcctgggtacagtctggtcatcatgtggtcaacttcttccacctgggtt

SEQ ID NO: 80447 - DNA, 201 bp, Bos taurus; identical to SEQ ID NO: 40119

SEQ ID NO: 80448 - DNA, 201 bp, Bos taurus; identical to SEQ ID NO: 40120

SEQ ID NO: 80449 - DNA, 201 bp, Bos taurus
aacaggcagacgtagatgttttttaattatacaaaaaaatttgaccaaaatagctaagaaaaaactgccaaaaacagatgagtgtccccacctattacatragaaaatatcaacaatctaagggtaatgattggaagatacagtaagctgcacacactcacaggcatttaatggatcaaactttctgaaaagcaatggact

SEQ ID NO: 80450 - DNA, 201 bp, Bos taurus
ttgagtgactaagcacagcacacacacagcagctagaatcaccctaacaagaagctaacgccctacttccataatcgcggtaagaagtggatttgcacacrgctcaaatccaggttcacatctcactcctgtaactccccaggccagtgctccaggtaagcaggttggcaggcaggcagatcctggcgctttccatccgga

SEQ ID NO: 80451 - DNA, 201 bp, Bos taurus
cgccccgcccctccacctctctaggggaaaagaggtggctgggggctgggtctgtgaacggacgcccctcccctccaccaccgcagaccccagggcccctragcacagcacacttggacccttttcagatctacccctccacgtcctgacaaaaacgcttttcttatctcatctcaaggtaagagcaagatgcagaaactg

SEQ ID NO: 80452 - DNA, 201 bp, Bos taurus; identical to SEQ ID NO: 40121

SEQ ID NO: 80453 - DNA, 201 bp, Bos taurus
gattggctcagggcagggtggatttgatctaagaaggttttttccccctgcagaagacgttcaggatgacgtgagcaagcacctcctcttctttgtctgaragccctcttccccaacccgagagtccgtgtctgtgaccagctgcccccgccagtcctcggtccctgcgtggcggccgtcctgggttgcaccagttaaagc

SEQ ID NO: 80454 - DNA, 201 bp, Bos taurus; identical to SEQ ID NO: 40123

SEQ ID NO: 80455 - DNA, 201 bp, Bos taurus; identical to SEQ ID NO: 40124

SEQ ID NO: 80456 - DNA, 201 bp, Bos taurus
ctccatatgtacagaatctatggcctctcacgcgtctgtttgctgatgaatttctcatcacatgaatatgtaacaatagtaatgtgatttttatagcctcrctgtcagggcctttccatttggaaaagatattcatcatttctgtttatggccaaattacttctctcaattttgtggccagcctgacatgataagtcatgt

SEQ ID NO: 80457 - DNA, 201 bp, Bos taurus; identical to SEQ ID NO: 40125

SEQ ID NO: 80458 - DNA, 201 bp, Bos taurus; identical to SEQ ID NO: 40126

SEQ ID NO: 80459 - DNA, 201 bp, Bos taurus; identical to SEQ ID NO: 40127

SEQ ID NO: 80460 - DNA, 201 bp, Bos taurus
actcagttaggttggctgagccttgaaagctgagttgaatgcatagttagtggcaatggctgtgaaggtcatctccacacagccttctaagctatttactrtttcattcattaaatgtgtaaattggcaaaatcacttaacctagtgggtatacaatctgccacttacaaatgggatacagtaggcagtaggtcagagaag

SEQ ID NO: 80461 - DNA, 201 bp, Bos taurus; identical to SEQ ID NO: 40128

SEQ ID NO: 80462 - DNA, 201 bp, Bos taurus
gcaggctgaatggagcgggccacttcagtcctcttgaaccatcatgagggaaggcttggcacttgaccttgagactcttgagtcctgaggccagagtgccrcccaagtcccaattaatggcatttgtagcgagccgttttatgagacttgtcatggttttgacactctttggcccaatgtcgcgtctgtctacagattagg

SEQ ID NO: 80463 - DNA, 201 bp, Bos taurus
gcgggcttctagaaatgtaaaatctgataattaatatatggtagcatcaacagctacgtgaagacaaaacatcaaagacttgaccatgaaagatacatatyatatgctatcacttatatatggaatctaaaaaaaaaaatgacacaaatgaatttatttacaaaacagaaactcaaagacatagaaaacaaacttatgggt

SEQ ID NO: 80464 - DNA, 201 bp, Bos taurus; identical to SEQ ID NO: 40131

SEQ ID NO: 80465 - DNA, 201 bp, Bos taurus; identical to SEQ ID NO: 40132

SEQ ID NO: 80466 - DNA, 201 bp, Bos taurus; identical to SEQ ID NO: 40133

SEQ ID NO: 80467 - DNA, 201 bp, Bos taurus; identical to SEQ ID NO: 40135

SEQ ID NO: 80468 - DNA, 201 bp, Bos taurus; identical to SEQ ID NO: 40138

SEQ ID NO: 80469 - DNA, 201 bp, Bos taurus; identical to SEQ ID NO: 40140

SEQ ID NO: 80470 - DNA, 201 bp, Bos taurus
tggattttactatgagttaataagctgctttctatgttcatgaagcttattcaattaagtcaaaataacctaattttgtaggcagtacctcccttgggcayttgggcaagaggacccccctgccttgagatccatgcactgaagaaccccacatattacaaacacatgaacacaaaaaggatgcaagatcacatgagcaca

SEQ ID NO: 80471 - DNA, 201 bp, Bos taurus
catttagggaaataaaagaaccttttatgatttgaatagagcattttattggtcagtaatgcccctctgctgtaagtcccctcctgccatacatgtttaartcttcagagtaacctcagaaagatagtgggagaggaagtcagtcctgcgctctcttccctctacagaaacatggatgaaaagacaccggggccaaaatgc

SEQ ID NO: 80472 - DNA, 201 bp, Bos taurus; identical to SEQ ID NO: 40144

SEQ ID NO: 80473 - DNA, 201 bp, Bos taurus; identical to SEQ ID NO: 40145

SEQ ID NO: 80474 - DNA, 201 bp, Bos taurus; identical to SEQ ID NO: 40146

SEQ ID NO: 80475 - DNA, 201 bp, Bos taurus; identical to SEQ ID NO: 40147

SEQ ID NO: 80476 - DNA, 201 bp, Bos taurus; identical to SEQ ID NO: 40148

SEQ ID NO: 80477 - DNA, 201 bp, Bos taurus; identical to SEQ ID NO: 40149

SEQ ID NO: 80478 - DNA, 201 bp, Bos taurus; identical to SEQ ID NO: 40150

SEQ ID NO: 80479 - DNA, 201 bp, Bos taurus; identical to SEQ ID NO: 40151

SEQ ID NO: 80480 - DNA, 201 bp, Bos taurus; identical to SEQ ID NO: 40152

SEQ ID NO: 80481 - DNA, 201 bp, Bos taurus; identical to SEQ ID NO: 40153

SEQ ID NO: 80482 - DNA, 201 bp, Bos taurus; identical to SEQ ID NO: 40154

SEQ ID NO: 80483 - DNA, 201 bp, Bos taurus; identical to SEQ ID NO: 40155

SEQ ID NO: 80484 - DNA, 201 bp, Bos taurus; identical to SEQ ID NO: 40156

SEQ ID NO: 80485 - DNA, 201 bp, Bos taurus; identical to SEQ ID NO: 40157

SEQ ID NO: 80486 - DNA, 201 bp, Bos taurus
ggactcttaatttcactggaacccatgtcctaggccttctgcttcaaatataggagatttcagttgataaacaagtttattccctaggtacatgatgatayagctctcgacttttcaggggataccaaactaattttatttttttctttcgtatcaactatgtcttgtccttcttttttgtgatcactgcccatttttcca

SEQ ID NO: 80487 - DNA, 201 bp, Bos taurus
tccagtctttttgtctccaagtagaatctcccttgcattagatagaacaataaattagaatttaactgaaataatgctcatttctccttctatctggttakataactatgactttgtcttcctatatcaaaaatcatgtttcttgtgtttctttgtaagaacaatctaatgcacataactcttttgcatcctaaaaatgtc

SEQ ID NO: 80488 - DNA, 201 bp, Bos taurus; identical to SEQ ID NO: 40160

SEQ ID NO: 80489 - DNA, 201 bp, Bos taurus
aggatacagtccatggagttgcaagtcagacaaaacttggccattaaaccaccaccatcacaatttcagacaagatatgaccttaaccatgatgtggttcmatcacctaccttagaggccagaaaactaagagactttagaatttaataaggagccccattaatgagcatttttagtccataacatttgaggtatcgtaat

SEQ ID NO: 80490 - DNA, 201 bp, Bos taurus; identical to SEQ ID NO: 40161

SEQ ID NO: 80491 - DNA, 201 bp, Bos taurus; identical to SEQ ID NO: 40163

SEQ ID NO: 80492 - DNA, 201 bp, Bos taurus
actaagcataagttttcaaggctcatgcatgtttaggatgtatcagtacaaaattcatattatatggttgactaatattccattgtatagaggtgctgtgygcgcagtccaatctgatcctttgccaccccatggactgtagcccgccatgctcctctgtccatggggctttccaggcaagaatcttggagtaggttgtca

SEQ ID NO: 80493 - DNA, 201 bp, Bos taurus; identical to SEQ ID NO: 40168

SEQ ID NO: 80494 - DNA, 201 bp, Bos taurus
aacacttttgaattgtatctctaatgattgctcccttactctacttattgtacttccaaatgcatctattacctcatctccaatataagaatcctgagttyaaggcctttctgaagatttaatcagtactgaatatgaatcagaaattttattggctttaagaagaatcattaggagaaatcatcttttccaacattaaac

SEQ ID NO: 80495 - DNA, 201 bp, Bos taurus; identical to SEQ ID NO: 40169

SEQ ID NO: 80496 - DNA, 201 bp, Bos taurus
tggatgttgaaaggtgggaggaaaggaggaaaaaaatgtggaaaatcttcaaatttattaaaaaataagttatttaaaactatgttcacaaatctactgtyacacacatcccaagggctctctgcttattcatgtgtattttcaaagtttatttacaatgtagaaacagctatgtttttcctgagtgtaatccaacttaaa

SEQ ID NO: 80497 - DNA, 201 bp, Bos taurus
cctaagagcagaatgctgcccaatgtcccaattgatggcatttgtagcaagcctttttagtagacttgtcacggtttggaccctctttggcctcatatccmgcctgtctacagatttggcatttgcctcctgccttgtccatcaaagactcggggtttgccataggccttccctggagggcagccagcatctgggcatgcc

SEQ ID NO: 80498 - DNA, 201 bp, Bos taurus; identical to SEQ ID NO: 40172

SEQ ID NO: 80499 - DNA, 201 bp, Bos taurus
caaatgctacagggatgacaatactgctgtttggaactgagaaatataattagcagatacatacaaaatattttaacgacagcccccttctgaatgcctayacctgccggacaccataataatgaggcttgtctgccacttgaacattgatcagatgtcccactggggctcaaaaaatgtgtgcttcagttgtcatcatag

SEQ ID NO: 80500 - DNA, 201 bp, Bos taurus
ccctggcagccttttgggtcatattctgccctcacccttctaacacagcaggcaaaggacctggttcctgccatgcagggaactgatgtgttaatgggacwggccggaaaccaaaagaagcacacgttgaagataaatatgagaccgtgggtctggaacagagaaagctatttctacaccaggtaataagcccagttcaga

SEQ ID NO: 80501 - DNA, 201 bp, Bos taurus; identical to SEQ ID NO: 40174

SEQ ID NO: 80502 - DNA, 201 bp, Bos taurus
cttgcctatacactggaattacctgggagttttagaaagcctagcttctctcccagagatattgaatgaattgctatgagatgtggtctggccatcagtaytgtggaaaactccttggagttattttaatttgtagccacgttgaagaaccaatgttccaggccaaaatatcatctggacagacatcttcttttatgaaaa

SEQ ID NO: 80503 - DNA, 201 bp, Bos taurus; identical to SEQ ID NO: 40176

SEQ ID NO: 80504 - DNA, 201 bp, Bos taurus
agtttagacaatgtagttccagaataaagtaggaaattaccaaacttacttaaatagtagcacctatttaaagtacgcaaaaagtaagcaaaagctccccrtcagaaaaatacaaattgaaacaacacagtatcattacacacctatcagaatgaccaatatccaaaaccccgacaacatcaaatgctggcgactctgtgg

SEQ ID NO: 80505 - DNA, 201 bp, Bos taurus
actctgatgatatttcttccaaaattccataacctcagtctaattgcaaaaaaaactaacaaccaaaaaagataaacctaaactgaggggacgatccacaraatacctggtcattcctctttggatgtatcaaggtcatgtaaaacaagaaaaatccagagaaactctcacagtccaggggagatagaagaaacatgataa

SEQ ID NO: 80506 - DNA, 201 bp, Bos taurus
ggtctaggagctcagggaaattcagggacaggtaggcaaaggaacagaccccttcatcttggacaccaagcatggagggtatcaggcctgtggaaggggartaatctcctctactccagagtttgagtgaagctgggaccccaagagttctaagcagtgagtaagtatcagtactaaggaaggaggcaaagaactaaaaga

SEQ ID NO: 80507 - DNA, 201 bp, Bos taurus
catgtctggggagtgcccactgtggttgggacctgcaagaggtcaccatagtctgaggcggctcatgcacttccccaggggagttggccctgcattgtggracccttgtggagccaagctgctcaggcttccaggaagatgtggcagtgatccaccccagttcacagcttgacagtagctgcaaacccttgggctgggact

SEQ ID NO: 80508 - DNA, 201 bp, Bos taurus; identical to SEQ ID NO: 40177

SEQ ID NO: 80509 - DNA, 201 bp, Bos taurus; identical to SEQ ID NO: 40178

SEQ ID NO: 80510 - DNA, 201 bp, Bos taurus; identical to SEQ ID NO: 40180

SEQ ID NO: 80511 - DNA, 201 bp, Bos taurus
agaggcctttgggttatgtccagtgccatggtggccacacccatgataccttgcactagggccacatttttctctggcctttctccccagcatcacaaaarctcaattagggtggtagaaaaaacccaaaaaacccgaggagtctcaaggccacagggtcccttatcctggctacctggacttatgcccttgaacctcagc

SEQ ID NO: 80512 - DNA, 201 bp, Bos taurus; identical to SEQ ID NO: 40181

SEQ ID NO: 80513 - DNA, 201 bp, Bos taurus
taagtcctggaagccatgagagatgaaatgtacatgaaatgtgtgttcagccttcagaatctttcatttacatttgggaaaaataaaaattgtatataaayaactactatattgagttatgagataggtgcttgtttaattgaattaaagagtcaccagggagagggtaaagagagaactgtcttttattcatgacatcat

SEQ ID NO: 80514 - DNA, 201 bp, Bos taurus
ccccaagtagctttattaacaatcttctaaagtctctttgaatgagatgaaaaaaccatatacagcacatttttcactagggcacagcgctgtgggccccmcaaggaggtgaatttgatatgatcaggcactgggtacagcttcaataaagagatgttctttaaggcagaatttcattaggtgaaaatgtggccaaagggc

SEQ ID NO: 80515 - DNA, 201 bp, Bos taurus
agccattgtgggaactgacaagtgcagaattagtagggcaggctagaaatttgggaacagatgctacagtcttgaagcagaatatctgctccttctggggwtactcatgttgtccttaaggcctttccactgattagatgaaactcaatacattacagaagataatctcctttacttaaaattaactgattgtacatgtta

SEQ ID NO: 80516 - DNA, 201 bp, Bos taurus
gtttctttataaatttgcattacatgaataatgccttgaaaaaggtgacctcctctggcaaccctgtataaggccactattcttaatcactctcttctggrtatccaagttcacagcctttaaatgacaaaaagtatacaggttttccacagctatgtcagaatctgttctgggcccattaagaaaagagtgagtatttgg

SEQ ID NO: 80517 - DNA, 201 bp, Bos taurus
ggctgacattaagaccatttaggaggctgatgagttaatttaggtgtgatgagataaggggatgaacactgatagtgtttatccagcaggtcccagacacrtgggacattcttccaatctccttcctaacactgcatgcctgacccctggctctactcttctccaactctacaaatcgtatccacttttaagtttcagaac

SEQ ID NO: 80518 - DNA, 201 bp, Bos taurus; identical to SEQ ID NO: 40184

SEQ ID NO: 80519 - DNA, 201 bp, Bos taurus; identical to SEQ ID NO: 40185

SEQ ID NO: 80520 - DNA, 201 bp, Bos taurus; identical to SEQ ID NO: 40187

SEQ ID NO: 80521 - DNA, 201 bp, Bos taurus; identical to SEQ ID NO: 40189

SEQ ID NO: 80522 - DNA, 201 bp, Bos taurus; identical to SEQ ID NO: 40191

SEQ ID NO: 80523 - DNA, 201 bp, Bos taurus; identical to SEQ ID NO: 40192

SEQ ID NO: 80524 - DNA, 201 bp, Bos taurus; identical to SEQ ID NO: 40194

SEQ ID NO: 80525 - DNA, 201 bp, Bos taurus
ccttctccaggggttcttcccaacccagggattgaacccaggtttcctgcatagcaggcagatgctttattgtctgtgctaccaccaacccacgataggarcatatatatcaataattgctttaaatgtaaatggattaaatgctccagccaaaaggaaaagactggctgaataatgatgaagggatcaattaaagagaaa

SEQ ID NO: 80526 - DNA, 201 bp, Bos taurus; identical to SEQ ID NO: 40197

SEQ ID NO: 80527 - DNA, 201 bp, Bos taurus; identical to SEQ ID NO: 40202

SEQ ID NO: 80528 - DNA, 201 bp, Bos taurus; identical to SEQ ID NO: 40203

SEQ ID NO: 80529 - DNA, 201 bp, Bos taurus; identical to SEQ ID NO: 40204

SEQ ID NO: 80530 - DNA, 201 bp, Bos taurus
agcaaaaggcagggccttgaaagcataagactggagtgtaggctgcactgaggtgagaaatgttaagagtcagggattaagagtcaaggttgaagcccagrgagtaatgaggccactaagacgagagtcaagtatgaagaggttgagatgcaactcctaagaacactcaatttttaaatcaagcagaaaaagaaaaaagtc

SEQ ID NO: 80531 - DNA, 201 bp, Bos taurus; identical to SEQ ID NO: 40205

SEQ ID NO: 80532 - DNA, 201 bp, Bos taurus
gccatatatctatccatctgactacgaatgggcatttttgtagtttccagtttaggagtattaagaatagtgctacttctggcttctgcttgaaatgtacraggctgaaagagtttgtaactctcactcttacaacaacaaaaaaatgctgtacaatctacaaatttataactttgcttgaacttgtcagctatctgagct

SEQ ID NO: 80533 - DNA, 201 bp, Bos taurus
ggctttggagggccttgataaaatgcttctatcctagaaagaaagcctcttcccctcagggtccaccattagcgctctagaagccgctggttcaaggggarcacagggccttgctatgctgggacaagagactggggacagctttttatgaaggttagaaagagggctggatctaatcatgggtgctccccgagtagagct

SEQ ID NO: 80534 - DNA, 201 bp, Bos taurus; identical to SEQ ID NO: 40212

SEQ ID NO: 80535 - DNA, 201 bp, Bos taurus
atcccagctcatttccgtcagcagagagtgaactctctcttgctcagccttttgttctattcaggccttcagtgggttgtatgaggcctgccaacagggargagggcaatcttctttactcagtctaccaacgtgaatgttaacctcatccagaaggttaaggatacacactgcaccgacacacagtgatgtctgatcaaa

SEQ ID NO: 80536 - DNA, 201 bp, Bos taurus; identical to SEQ ID NO: 40215

SEQ ID NO: 80537 - DNA, 201 bp, Bos taurus
gagtcctttgcactctccagaagatagaagagagtaacagaaagagatggacattttgaggtcaaaaggatgcagtttacaatctccactagtaacaaaaytttgatgccaattctcaatgaaaagtaacttcttggtcttcaaacaggaatgactcattcatgaaggccgccacgtgcagctgctgtgaccatggacctc

SEQ ID NO: 80538 - DNA, 201 bp, Bos taurus; identical to SEQ ID NO: 40218

SEQ ID NO: 80539 - DNA, 201 bp, Bos taurus
tctaatgaccacaatccaggcccctctttcgatcctgttctgtccattagcattagaactatgtaacaggatctttcctctttgcctaactaagacagccygtggccagaggtgtccatgggacactctaggaagtgcagctggacatttcttttaaaacgattctgtttttctcccagactggtgctaatgtccctgcct

SEQ ID NO: 80540 - DNA, 201 bp, Bos taurus; identical to SEQ ID NO: 40219

SEQ ID NO: 80541 - DNA, 201 bp, Bos taurus; identical to SEQ ID NO: 40220

SEQ ID NO: 80542 - DNA, 201 bp, Bos taurus; identical to SEQ ID NO: 40221

SEQ ID NO: 80543 - DNA, 201 bp, Bos taurus; identical to SEQ ID NO: 40225

SEQ ID NO: 80544 - DNA, 201 bp, Bos taurus; identical to SEQ ID NO: 40226

SEQ ID NO: 80545 - DNA, 201 bp, Bos taurus; identical to SEQ ID NO: 40227

SEQ ID NO: 80546 - DNA, 201 bp, Bos taurus
cgtgaagtcagtagaacatgtacatttcatgtaatgggaaaacattgccttcttgacagtgagtagagcttcagtcatcacagaaggaaggtatgtgagaraattttttagaacaacgtgtcttcatagttatgatttcttggattgtggttacttttatcataacaaccatatattgaaacctcggtcttggaccatgtg

SEQ ID NO: 80547 - DNA, 201 bp, Bos taurus; identical to SEQ ID NO: 40229

SEQ ID NO: 80548 - DNA, 201 bp, Bos taurus
aacactactcggtcgtgaaaaggagtggcattttgccatctgcagcaacatggacggacttggagagtagtatgctaagtgcacaatactgtatggtatcrcttatctgtgcactctaaaaaataaaccagtgaatataaaaaagaagcaaattaatagatactgaaaacaaaccagtagttgccactagggagaggggag

SEQ ID NO: 80549 - DNA, 201 bp, Bos taurus; identical to SEQ ID NO: 40230

SEQ ID NO: 80550 - DNA, 201 bp, Bos taurus; identical to SEQ ID NO: 40231

SEQ ID NO: 80551 - DNA, 201 bp, Bos taurus; identical to SEQ ID NO: 40234

SEQ ID NO: 80552 - DNA, 201 bp, Bos taurus; identical to SEQ ID NO: 40235

SEQ ID NO: 80553 - DNA, 201 bp, Bos taurus; identical to SEQ ID NO: 40238

SEQ ID NO: 80554 - DNA, 201 bp, Bos taurus; identical to SEQ ID NO: 40239

SEQ ID NO: 80555 - DNA, 201 bp, Bos taurus; identical to SEQ ID NO: 40240

SEQ ID NO: 80556 - DNA, 201 bp, Bos taurus; identical to SEQ ID NO: 40241

SEQ ID NO: 80557 - DNA, 201 bp, Bos taurus
aatgttcagttctatctagagatgcagactgagaatgtgtgtcaagaatacaacacaatggggtaggactaaggaaaaagtcatctacaaattgaagcttragtggcctattctattctaggcagttgtctgctgctgctgctgctgctgctaagttgcttcagtcatgtccgactctgtgcgaccccatagacggcagcc

SEQ ID NO: 80558 - DNA, 201 bp, Bos taurus; identical to SEQ ID NO: 40246

SEQ ID NO: 80559 - DNA, 201 bp, Bos taurus
ctgtgttgatgcgagacaggagagcgaatacgcagatcacgcactggccccttaaagcatccacccagcagcgctgcccctcatgtccctcttgtattttrtttttcatggcagatcccacggccacatctaacgtcgggagcatggaggtgtgcagtcttcagtgggccaggagtgtgactctcaagagtcttgtgctaa

SEQ ID NO: 80560 - DNA, 201 bp, Bos taurus
aaaagttcaaaggcagtctgcaggcagaatttcctcttcttctggggacctctgtctctcattgctttaatccttcaatggattagatgaggcccacccayaggaggagcaagtcatctgctactcaaagtctactaatttaaatgttagtatcacctaaaatactttcacagggacatttatatctgtgtttgacaaata

SEQ ID NO: 80561 - DNA, 201 bp, Bos taurus; identical to SEQ ID NO: 40249

SEQ ID NO: 80562 - DNA, 201 bp, Bos taurus; identical to SEQ ID NO: 40250

SEQ ID NO: 80563 - DNA, 201 bp, Bos taurus; identical to SEQ ID NO: 40251

SEQ ID NO: 80564 - DNA, 201 bp, Bos taurus
attagcctccaattaaaataaatttatattttaaaaaaaatccagtaaccaactatagaaggagaaatgatcatctctactggaataagagaggatgaacygttttgacttgaaattttgtccaatatcaaggtcctaatgaaaataaaagactcaattataatacttttaaaatttaggactcattatgtatggatgtga

SEQ ID NO: 80565 - DNA, 201 bp, Bos taurus; identical to SEQ ID NO: 40252

SEQ ID NO: 80566 - DNA, 201 bp, Bos taurus
aatactgacactttgttaaaggtcttgggcaatcagcaagactctcattgtagtggaaacacacaagggttaaggcttggttgcccttttttatagtctamagtagtctagtggtggagtaatcagctcactgcagtttgttatttcgaatctattactgccacccttgatagctcagacggtatagaatctgcctgcaat

SEQ ID NO: 80567 - DNA, 201 bp, Bos taurus
tgaacaacagaaagacaagagaagaagctgagcaatcagtgtggagaataagacagtcatctaggaaaaatgacactgtggccttttcattaagctcaggrcaaaacttaggctcacaggttggtttcaacactggatcagtgtattaaagtctgtcagaaatgtcgttttctaaagaactgttattggaatggggccaat

SEQ ID NO: 80568 - DNA, 201 bp, Bos taurus; identical to SEQ ID NO: 40256

SEQ ID NO: 80569 - DNA, 201 bp, Bos taurus
caaggtcaggaaacagtgaaatctaacaactaaaagtattaaactagaaacttaagatacctggattttagctctgagactctgtaaaagaatttttgatmtgagggaagtcataacatttctgtgtgctttggtttccgcatctgtaaaacaaggacaattcatcttcttcattagaatgctgaacagatgcatgaagaa

SEQ ID NO: 80570 - DNA, 201 bp, Bos taurus
attgtattaacaaaatgtcagtagatgtgcagagagtagttttgttaaacatatagttttaaaacagagactgtgtagtttacttttgatttatgtatgaygttttaagaaaagagaggaataaagaattattcttagctttgagcctgggcttcataatttaatatggataaggataatgtaaggtttgttgttgttgtt

SEQ ID NO: 80571 - DNA, 201 bp, Bos taurus
atgtatctgcatatattcttcagtttgtatgatacgtttgtttttgctgaaggtctgccctgctctggtcgtgctcattacagagaacactggctacacakgacacatcagagagactgttaaagggtcagctttcttggccttaatttctctcggtaagatacaatagtgttgctcttgtcttgtcaggaaggaaaacac

SEQ ID NO: 80572 - DNA, 201 bp, Bos taurus
cgccatgtaaaccatacaatgacttatttacacacacttgtgtgcatatacacaaacaactattctttcactaatacttcctgatgcgaagggaagagggmgaatactactgtgatttggttaaaatagtgcccaatgtttagaatagcattctttgaatttatctatttgtaaaaaaaaaaaaaattaagctcagtttct

SEQ ID NO: 80573 - DNA, 201 bp, Bos taurus
tccgcttttctcccctctctggaggataaaggtgggactgaaacttccaagcttctaatcaggcttcggctttctggtggccagcgcccgtctggaagccyacccatagttgcctcaatagaacaaaggatagatactcagtacgcttagtcctttggaatttagccctgtgtcgggatggggtcattagaataagagagg

SEQ ID NO: 80574 - DNA, 201 bp, Bos taurus
actggtatcagtaatatacaagaatcatgtacaacaaagctagttattactatgtttttgttcttcagtcactttcatgggttttgtttggaactctgcartaaatctcactacgtttcctgtcctgtttcaatctttgcagaggacaaggtgccgactggaagttctctcaaactcaagtgggttcagttttgtatgtac

SEQ ID NO: 80575 - DNA, 201 bp, Bos taurus
tattagactggagattgctgcgtgagcaataggtgattattaatattaccttctttcataagagagcttgcctttggtataaacatattttccagatgctrtaagtgaatgaagtgaactggagacctcagtgactccatatagtcaagataaaacaaagtgtgaaccagaaattgaagaattcatgtctactttgttaca

SEQ ID NO: 80576 - DNA, 201 bp, Bos taurus
aatccacttacattaaaagtaattattctttggtaagaacttactatactatcaccatcatcttaacttttttccaggttggctttcagttccttttttcytcttttgctatcttcttttgtgatttgatgattgcccatggtggtgtccttcgatttcttttatcttttgtgtatctactgtaagtttttgctttgtagt

SEQ ID NO: 80577 - DNA, 201 bp, Bos taurus
tataacacgtgaagtaatttactattccattgttggtaataccacaggaaattgtaagtgtcttaaccatatttcaaattagactgagtctatcttaaggmttgcatatccagacacaaataaatacctatttcaggcttcattctgcgaggagggcatatatggagactagtcattccacaagttgaaacagaccaagaa

SEQ ID NO: 80578 - DNA, 201 bp, Bos taurus
caacttgcctctcataaaatccagtcctccagcaatccccaatttatgtcaaggagacttgaagcaagttattaactttctcacagttttgtggtttttgyttggttttggttttttgtttgtttgtttagatagatagatcactctagattttaaaagaccaagtgagttaggtctggaaggttgaaggaaggaagtgtc

SEQ ID NO: 80579 - DNA, 201 bp, Bos taurus
ttaaaggtagtatgttgtgaaaaacacggtcatttccttatataaaagtcactactatttttctttttccctgattaaaaaagtttggatagtaagttaarggagatgtttatctgaaagaatatctatctataccagtcatgacctgatcatgggtctctgcactggcattgttcttgacctataatggctttaaacttg

SEQ ID NO: 80580 - DNA, 201 bp, Bos taurus
ctgaattaacaacatatgaacaattcaggaaattttaatactaaccttattaattattaacaatgtggattcaatgaatgttagacccatatgtgcatcaraggtaagagatatctttagagggacgatatatattaacaaggtctcatatatgactaggatttcaactaggtgagaagaaggaatgggaaagtttcaggc

SEQ ID NO: 80581 - DNA, 201 bp, Bos taurus
aatggactcccttccacacagaagagcacagtcctggccaagcagctaaaggctgcagggcattgtgatggggtttggacaacaaagcaagtgcaaagcartatgggcaactcccagatcacatttctatcacaaagctattcttccctttcccctctctgctggatgacagagaaatggaaaccacataaccacatgcag

SEQ ID NO: 80582 - DNA, 201 bp, Bos taurus
gggctagtccaagactaacaaacagggcagagctattcacagggaaggactacatacagcagagcctgtagcatcacctagggattcatcagggcttcctygagatggccctgaacaagtcttgaaagaagaaagcaacttaagaaaaaacggggaggacttttaaaccccaactgcatcataaatgaaggtcttaagggt

SEQ ID NO: 80583 - DNA, 201 bp, Bos taurus
tctttattttttatttggctctgtttgggtcttagttgtggcatgtgggatcttagttccctgacctgggttcaaacacaggcctcctgcatcttagccarggaagtccctggtcttaattcatatatttaaataggatgatttccagccattagccaatgcctgaggatgcttcctgatggggtgtgtgttaggccggga

SEQ ID NO: 80584 - DNA, 201 bp, Bos taurus
ttgaggtgggagtcagccagtgatggaaggagaattaggcaattatgggttctggagaggaccatatggatgaagcagacttgaaaagctgtaaacagtargtgaataaagctgagcaaatcagttgtgtagttggcatcatggcggcctttcctgagattcattccttgattactgtacagttcatagatttagaggctt

SEQ ID NO: 80585 - DNA, 201 bp, Bos taurus
ctaatgactcattgatcaaaaggtagggtctacaagtaagtttgaggctttccatttgctgctatgcccttagatgatgatcactttctcacattgtgatkagtcaaaaaaacatgggaaaaaaaaaattggccctagtttcccttagaaacgtatagctcttaaacatatcctcccctgcctttctacagagaagagctc

SEQ ID NO: 80586 - DNA, 201 bp, Bos taurus
agggacttcgtcagtgctgggagggagaagagtagtgggttaaggttattacaacacacacacacacacaaagtgaggagcagttacccaaagaaaatcayaggaggagagggagccagctgagaaatattgagtgtgacaagaattcgggagagcttctgccacatgaggtccaaacatggctacagaggaccccacaag

SEQ ID NO: 80587 - DNA, 201 bp, Bos taurus
tattatgttctcccaagtgaaaagtaactccagttctttcagatggaatgacagccagattgagaggatggagactggggagtggccaaaatcttcagccrcccggagaaagctccatcgatgccctgggcaacacaccccatccgcttagggaacgagcatggcctaagaagtcctccctgtatatttccacatggtatc

SEQ ID NO: 80588 - DNA, 201 bp, Bos taurus
caccaggctgcccttctgagacaggtggccactcacaggccacagatgaccacgtgggcacgagtcctcaagcatctcagggcctcaggatgaccccggarcaaggtccattcacggggtagtcctctgaaggagagagacatgagtaccaggccaggcttagggcagcccagcgtgatggcactgcagccctggctggtg

SEQ ID NO: 80589 - DNA, 201 bp, Bos taurus
taacctggcttccccctgcctattgtacttgattgtttcctgtctcctctctcccactgaaccagcttgctgaggccagggaccagcctgtcctgtccccyggggtatgtgcatccttagggacactgcctgagactgtggaaggagggaacagtgggctacacgaggagggggccataaccgagtaacttaacattagga

SEQ ID NO: 80590 - DNA, 201 bp, Bos taurus
tttatgacttgtaacatttgttgactcaaacgcagggactctttcttttccgaggggcctttcactgcagccaggaatgtgcatgcattgacgcggccatragctcttccttccgagcctgccatccccctcctctgggctcccacgtcaaccatgctgcttccgcctttggtacaggaggcggggagggttttcccacca

SEQ ID NO: 80591 - DNA, 201 bp, Bos taurus; identical to SEQ ID NO: 40263

SEQ ID NO: 80592 - DNA, 201 bp, Bos taurus; identical to SEQ ID NO: 40264

SEQ ID NO: 80593 - DNA, 201 bp, Bos taurus; identical to SEQ ID NO: 40265

SEQ ID NO: 80594 - DNA, 201 bp, Bos taurus; identical to SEQ ID NO: 40266

SEQ ID NO: 80595 - DNA, 201 bp, Bos taurus
ctttctatatccttcccagttttctgtagggctccctgactgtttttctttatatctaaaaacttcttatagctcctggcctcaaagaacacctgaagggrcatttttataagtgacttagaggacaggtgtgagaatgaagcaatttttttgatttcctggaattgtttatttcttgtggcctgcttgggaggattagag

SEQ ID NO: 80596 - DNA, 201 bp, Bos taurus; identical to SEQ ID NO: 40269

SEQ ID NO: 80597 - DNA, 201 bp, Bos taurus; identical to SEQ ID NO: 40270

SEQ ID NO: 80598 - DNA, 201 bp, Bos taurus; identical to SEQ ID NO: 40271

SEQ ID NO: 80599 - DNA, 201 bp, Bos taurus; identical to SEQ ID NO: 40273

SEQ ID NO: 80600 - DNA, 201 bp, Bos taurus
actctggagagaagagactggttgactcaaggtcactgagatagcattcaggttcgaggaactgggtgtaaagacaggccagctcttcaggttaaagattyccaccctttgttagatgtcaatcatagaactttgcagatcaagagcagaatgagaataagttggccaattccccgatggctccgaggaagagaagacggg

SEQ ID NO: 80601 - DNA, 201 bp, Bos taurus; identical to SEQ ID NO: 40276

SEQ ID NO: 80602 - DNA, 201 bp, Bos taurus; identical to SEQ ID NO: 40277

SEQ ID NO: 80603 - DNA, 201 bp, Bos taurus; identical to SEQ ID NO: 40278

SEQ ID NO: 80604 - DNA, 201 bp, Bos taurus; identical to SEQ ID NO: 40279

SEQ ID NO: 80605 - DNA, 201 bp, Bos taurus; identical to SEQ ID NO: 40280

SEQ ID NO: 80606 - DNA, 201 bp, Bos taurus; identical to SEQ ID NO: 40281

SEQ ID NO: 80607 - DNA, 201 bp, Bos taurus
attcactcagctgggacctccaggatgtggtgacacagatcctgaatcagaaagagtacactgcatccttccaccctcccaggctccgaggccctagtgtrcccccttcatctcaccagagctcctgggacttcacgtgcttagaaccagccacgcgaagatggcaagaggctcctgggccagggcgatagtgagaggcaa

SEQ ID NO: 80608 - DNA, 201 bp, Bos taurus; identical to SEQ ID NO: 40282

SEQ ID NO: 80609 - DNA, 201 bp, Bos taurus
tgtggggtgactcaatgccttaatccagagcgggctgggctcccggctcccgcgcctgcagagacagacctgtgcaaactttgcaggctgttaggccaaaygggctggattgtacacagaggaaacctaatccccatctctggttctgccccaagaatgtgagctcatcaaatctaatgaagtgaaggcgcgcatttctgt

SEQ ID NO: 80610 - DNA, 201 bp, Bos taurus
acagagtggcacatccttttgccctgaggggctgtgcggacagaggagcatggcagtgagggttttggtgatgccagcacatacaaaggacaatgagcaayggtgctccccaagtccacagcattccaggtccttcatgcatcctggagaggagaagggtggtgcccagtgataaagtctgaatttcctgtcagttttgta

SEQ ID NO: 80611 - DNA, 201 bp, Bos taurus
taataaattacaacactcaatataaattcactaaaaagagagtggaaatgctatttatagtttacacaccttggttgttttgtagagattttgttttagcrattctacatggatttaactgaagaactgatgcaacttcacatgctccacggactgatctggtttttatctttataggctcatgagaaccagcaccctaaa

SEQ ID NO: 80612 - DNA, 201 bp, Bos taurus
tcaattattttagtgtacttccatttcttttttttcttttaaaaccagtggaggttatatttaattctttatgaaaatgtaacatatatactgtgattctrttttaatgaactttaattgatctgcttctttacctatcatttatctatctagttaacctatgtgcatttaagcatgtagagatatctagatgatagatgg

SEQ ID NO: 80613 - DNA, 201 bp, Bos taurus; identical to SEQ ID NO: 40286

SEQ ID NO: 80614 - DNA, 201 bp, Bos taurus
ccaccccccgccacagtggcgcccgctctggccactccaggcttctggctgctcctcagaggtgtcgttccttttcattcctccacgcctctgcagtcacrtggcctctgttcagagtgcttgccccagaactttccactcaggaaacttactcaagagctgattcagacattccttcaacttgaagcctctggatatctg

SEQ ID NO: 80615 - DNA, 201 bp, Bos taurus
gcagaatggtgaacaaactgggtctagaatgaaactaagaagaaacaaaaacaaaacccactcacgcttgtcttaactcttgacaagttatggtagtgctyggagcttctggttcttattggtagagttgggaggtaataatcgtgtctactttacaaggtcatatatagataaatgccatgatggggaagatattgtctc

SEQ ID NO: 80616 - DNA, 201 bp, Bos taurus
aatcacatcaaaacaagcatggagaggggctctgagcagacaagtggacagtggtattgaagctgcatagatttatggcctgacaactctcttgttagatrtgtaggtcctaggtatgactatcagttcggttcagttcagtcgctcagtcgtgtctgactctttgtgacccatgaattgcagcacgccaggcctccctgt

SEQ ID NO: 80617 - DNA, 201 bp, Bos taurus; identical to SEQ ID NO: 40296

SEQ ID NO: 80618 - DNA, 201 bp, Bos taurus; identical to SEQ ID NO: 40298

SEQ ID NO: 80619 - DNA, 201 bp, Bos taurus; identical to SEQ ID NO: 40299

SEQ ID NO: 80620 - DNA, 201 bp, Bos taurus; identical to SEQ ID NO: 40300

SEQ ID NO: 80621 - DNA, 201 bp, Bos taurus; identical to SEQ ID NO: 40301

SEQ ID NO: 80622 - DNA, 201 bp, Bos taurus; identical to SEQ ID NO: 40302

SEQ ID NO: 80623 - DNA, 201 bp, Bos taurus
agtgtattgtctatagcttcatttctcttgggtgtaattgggtagaatatgaatatttttaattttactaaagtataccagattgctcttcagtatggttytagccctgtccacaatgtgtaagtccattttccctctatggaaagctatacttaatttgtttttccttcaaaatatagctgtctttttaatagagctttt

SEQ ID NO: 80624 - DNA, 201 bp, Bos taurus; identical to SEQ ID NO: 40303

SEQ ID NO: 80625 - DNA, 201 bp, Bos taurus; identical to SEQ ID NO: 40304

SEQ ID NO: 80626 - DNA, 201 bp, Bos taurus; identical to SEQ ID NO: 40305

SEQ ID NO: 80627 - DNA, 201 bp, Bos taurus
gggctgaactgtggtccagggtaagtcgatgttcaaaccctcaacacatcacaccaccaccttatctggaagcaggatctttacagaggttaactgagctyaaatgcggtcgtcaggatgggccctaaatgaatgactggctcccttatgccaaggggagccctggacaaagagagacacacacagacacgcacacccggg

SEQ ID NO: 80628 - DNA, 201 bp, Bos taurus; identical to SEQ ID NO: 40307

SEQ ID NO: 80629 - DNA, 201 bp, Bos taurus; identical to SEQ ID NO: 40308

SEQ ID NO: 80630 - DNA, 201 bp, Bos taurus; identical to SEQ ID NO: 40309

SEQ ID NO: 80631 - DNA, 201 bp, Bos taurus; identical to SEQ ID NO: 40311

SEQ ID NO: 80632 - DNA, 201 bp, Bos taurus; identical to SEQ ID NO: 40312

SEQ ID NO: 80633 - DNA, 201 bp, Bos taurus; identical to SEQ ID NO: 40313

SEQ ID NO: 80634 - DNA, 201 bp, Bos taurus; identical to SEQ ID NO: 40315

SEQ ID NO: 80635 - DNA, 201 bp, Bos taurus; identical to SEQ ID NO: 40317

SEQ ID NO: 80636 - DNA, 201 bp, Bos taurus
gttccttcctgcctgcagccttattttttccatctttaacatatggaaaactggaatttgcccaatctacctaatgggagtgctgtgaggaaaaactaaartaaaatgaaataatgtggatcctatgtgaaaaaaaaaaaagtggaataccatccacatgtgacagggacatgtctatttttccagggctgtacaggggaa

SEQ ID NO: 80637 - DNA, 201 bp, Bos taurus
tgcaggcagattctttatcatctgagccacaagggaagccctggtatctctattcctgccttgcaaatatgtccacctgcacccttttaatagattccatraatacgtgttaatatacaatatttatttctctccttctgactttagaaaagtacaaccttctaagactaaaccaggaagaaatgaaaaatatactccttt

SEQ ID NO: 80638 - DNA, 201 bp, Bos taurus
ttttactcctactggccaagcgtctgccatgaagactccccaggcgtttatcaaccccctgaaccctgcacacaccagactctactgaatcagtttacacrcaggtgctgggaggccatcagcctgtgcagaggccctggcctagaagcatggggttcgaagtgcacctctggtcctttctgagctcttaggaacaagcct

SEQ ID NO: 80639 - DNA, 201 bp, Bos taurus
aaaagttcagaactttcaaagtcaatcaaggtcatctgaattaccatggctctatgggtgaaagagacagtaaaaaggcccaataatatcattacaaactrtaatcatgatgcttcaatgaccaaacacagacataatcactgagaagcaaaggccacaaagaaacgatggctaacggataaccaaaatagtaagaaaatt

SEQ ID NO: 80640 - DNA, 201 bp, Bos taurus
ggaacagctggctccccctctagaggaaaggggacttgcactggtaaaggattttaacagaattcagtgacaccactaacgggaggagaggccaagttccygagaccattaagctgctggcaagttaggtctataaagcgagtggcagaacaacaatctcagttttgctttagtacacctgcattacaaccactgggttaa

SEQ ID NO: 80641 - DNA, 201 bp, Bos taurus
tgcactgcagtgggtgaacgcgtctgtgccctgtactcgacactgctctgtgatgtaactcgtctcccagccaggctgtaaggtcccgtccctggcccccrgctcccagaatggtcccttctacccgactgagctcagtgaatcaaagatgccaattacatggaaggaagggccggcctcttctgttgttagtatcttaac

SEQ ID NO: 80642 - DNA, 201 bp, Bos taurus
aagaaatttggtgtgtgagtgttgtgagcatgagtgtccagaccctaacctaaccactgactaaattatagtctcagaaatggaaagaaagcacagatcaragtgggtgaaataccgcagaatttaagcagctccagattaacagagatctttatgaacaaagaaaaagaacccacacagaacaaaataaagagctgcaca

SEQ ID NO: 80643 - DNA, 201 bp, Bos taurus; identical to SEQ ID NO: 40325

SEQ ID NO: 80644 - DNA, 201 bp, Bos taurus; identical to SEQ ID NO: 40326

SEQ ID NO: 80645 - DNA, 201 bp, Bos taurus
atttaccacccaagcccaagagctattggaaatgggcaataaaatcaagttttagtagaagtacagtataaaagcaacagtcatcctgtgacttcctgccyaatcattggcgcatagctgctaatagacaaagctggctgttcacggtttgcagcaaacaagaactgtttgctctcctggactcaaaacacacttcctcct

SEQ ID NO: 80646 - DNA, 201 bp, Bos taurus; identical to SEQ ID NO: 40327

SEQ ID NO: 80647 - DNA, 201 bp, Bos taurus; identical to SEQ ID NO: 40328

SEQ ID NO: 80648 - DNA, 201 bp, Bos taurus
aaacaatattgtaacaaatttaataaagagtttaaaaatgaaaaagatttccaagacccaaggatccccaagaaggactggtgggcagggggcccttgaaragaccttgtggttttgaacatggttaagatgacctagagccagacatcctggaatgtgaaatcaagtgggccttagaaagcatcactacgaacaaagcta

SEQ ID NO: 80649 - DNA, 201 bp, Bos taurus
tagaaggaattcctggggcatctaaagattcatcctagtggtttaagcctttatatgcaagtggctttgaactctgcttggaggagccttgcttttttcckgtgacaggttctggcctcaggcaggatctgagcaacttcaaaagagggcacctgctccattctttcttctgtgcaggtgtgaactgggtttcactggcga

SEQ ID NO: 80650 - DNA, 201 bp, Bos taurus
cccaaggcagggtaacaaagttgtggaacagatatgtctcaattaagaaagtccctctgataatcaaggtaactgtgctatagacaaagcctcaagtcagkaatcctcaggaacacaggtggggccacctgagttcataacgacacaaacagaagagtttcatgctcagcacccctcccccacccaggctggctttagcct

SEQ ID NO: 80651 - DNA, 201 bp, Bos taurus
caattattgtcttaactaagatcctgtgggcttctgaaaggccagccatctctaaaaattagttactgaaggtaggcctggaacagaacctgtaaaatctrttctctttgcaaccctatgcactctacagtccatggaattctccaggccagaatactggaatgggtaaccgttcccttctccaggggatattcccaacca

SEQ ID NO: 80652 - DNA, 201 bp, Bos taurus
agactgatccaggtgacatggacctggcttcagcagccgtgggacaagcgccccaggtgacctgatgtgcaaccgaggataagaaagttcatgggtggtckagaaaggccctcggcccgtccacacgttggatcagctggggcacttcacagatacaggagccaggctgcgcccccgaagatgggggtagacagagcctgt

SEQ ID NO: 80653 - DNA, 201 bp, Bos taurus
gctcggtctctgttccatgagctttgggtggatgctaacaggctccttgctcatagatcacagaatgtcatttctgtcacatttcactgatcgagtcagayggccagcccagaagcaaagggagaattagactccaactctttttcagtctgttggactgcacgagcatttcacccacatcttgcattaaaggaaactgaa

SEQ ID NO: 80654 - DNA, 201 bp, Bos taurus; identical to SEQ ID NO: 40337

SEQ ID NO: 80655 - DNA, 201 bp, Bos taurus; identical to SEQ ID NO: 40338

SEQ ID NO: 80656 - DNA, 201 bp, Bos taurus; identical to SEQ ID NO: 40339

SEQ ID NO: 80657 - DNA, 201 bp, Bos taurus; identical to SEQ ID NO: 40341

SEQ ID NO: 80658 - DNA, 201 bp, Bos taurus; identical to SEQ ID NO: 40343

SEQ ID NO: 80659 - DNA, 201 bp, Bos taurus; identical to SEQ ID NO: 40344

SEQ ID NO: 80660 - DNA, 201 bp, Bos taurus; identical to SEQ ID NO: 40345

SEQ ID NO: 80661 - DNA, 201 bp, Bos taurus
agagaatgccaagttttgcctcaggtcgttcctgaggcggccgccaggtggcgctgcggcgcgggaaacctgatgaatgcggggcggccgctcccaaaccrtggtcctcactgcctgccctccattaacagggaaaccggctggatctgagctcccaggtgtgaacggtgatgctgggagacagatgaaggcgatggatgg

SEQ ID NO: 80662 - DNA, 201 bp, Bos taurus
aactcattgcaaaatgcattgtggcaattgatgagttactaaacacagtgctgtgaggaagcctgagactaagatagaggggagagcccccaggaacactycaggcacttcacacacagggggctcagaactgacttaagctaagatgttccttgttcagtgacaactatcagcaacatcataaaccaggggaaaacagta

SEQ ID NO: 80663 - DNA, 201 bp, Bos taurus
gctttgtgtgccaaggtataaagtgaagtcagatgaatgcaaggagttaaatctgtgttgtgatgctgtgtttttaaaaattgcactatcttcattgtttracatgaggaagctttatgtgaagtcctgtatgttgttttctcacctatgcatcattaggccccataataatgttccccccataattgtgcaggaaagggt

SEQ ID NO: 80664 - DNA, 201 bp, Bos taurus; identical to SEQ ID NO: 40348

SEQ ID NO: 80665 - DNA, 201 bp, Bos taurus; identical to SEQ ID NO: 40349

SEQ ID NO: 80666 - DNA, 201 bp, Bos taurus; identical to SEQ ID NO: 40350

SEQ ID NO: 80667 - DNA, 201 bp, Bos taurus; identical to SEQ ID NO: 40351

SEQ ID NO: 80668 - DNA, 201 bp, Bos taurus; identical to SEQ ID NO: 40352

SEQ ID NO: 80669 - DNA, 201 bp, Bos taurus; identical to SEQ ID NO: 40353

SEQ ID NO: 80670 - DNA, 201 bp, Bos taurus; identical to SEQ ID NO: 40354

SEQ ID NO: 80671 - DNA, 201 bp, Bos taurus; identical to SEQ ID NO: 40355

SEQ ID NO: 80672 - DNA, 201 bp, Bos taurus; identical to SEQ ID NO: 40356

SEQ ID NO: 80673 - DNA, 201 bp, Bos taurus; identical to SEQ ID NO: 40357

SEQ ID NO: 80674 - DNA, 201 bp, Bos taurus; identical to SEQ ID NO: 40358

SEQ ID NO: 80675 - DNA, 201 bp, Bos taurus; identical to SEQ ID NO: 40363

SEQ ID NO: 80676 - DNA, 201 bp, Bos taurus; identical to SEQ ID NO: 40365

SEQ ID NO: 80677 - DNA, 201 bp, Bos taurus; identical to SEQ ID NO: 40366

SEQ ID NO: 80678 - DNA, 201 bp, Bos taurus; identical to SEQ ID NO: 40367

SEQ ID NO: 80679 - DNA, 201 bp, Bos taurus; identical to SEQ ID NO: 40368

SEQ ID NO: 80680 - DNA, 201 bp, Bos taurus
actgtacatgcttggccaatgcacagccagtgatgacttcgccatccacttctgcttccaggctgttccaaaggctggagaaaacaagtcatgctgacagrggccccccactcctggacaaggccatgtccctctctgttgcacactttcccgaaacactcttcccactcctgttcctggcagaaggtctggcctctcctc

SEQ ID NO: 80681 - DNA, 201 bp, Bos taurus; identical to SEQ ID NO: 40369

SEQ ID NO: 80682 - DNA, 201 bp, Bos taurus
ctccaaggactgtgcttgcccgagttcaagaccaaaggaaaacctaggagtcagaaacagaaataatgatgtaatggatgagggggcaggaacaggaatayttactgtcaaaagcaaggccctggagtgacaccccaaggtgggcaagatatggcagcaatcttcattcctggggaatggtggggttggcgggtagggatg

SEQ ID NO: 80683 - DNA, 201 bp, Bos taurus
tactctgaatctgagctggcctttggacttaactttgatcagtagaacgtggaagtgataagtgcaagttctggaacctaggtcacaataggccttatgayttctgccttttccttcttggaacacttgccttaggactgcagtagaatgaaaaagcccaggatgagagaccatgcatggaatgaaaggccctgacagctc

SEQ ID NO: 80684 - DNA, 201 bp, Bos taurus
cttggctttgggacaaggaggtggccttgtttatcaagtgcttttgtccaagctccactccaaatagcccctaccctttttttttttttttaacctgagawcaaaggtaaaggaggccgtttagggtgcgtagctgctagggatttgcctggatcaacttaagctaacattttggcttcttgcaatttggtttctttcgat

SEQ ID NO: 80685 - DNA, 201 bp, Bos taurus; identical to SEQ ID NO: 40370

SEQ ID NO: 80686 - DNA, 201 bp, Bos taurus; identical to SEQ ID NO: 40371

SEQ ID NO: 80687 - DNA, 201 bp, Bos taurus
attttgatcacggacagagtatttactagaagtttcccagtaccatcagttcccctaaagaatgttcaaaagtagggaatgtatattttaaatagggaaartgaaatgcttaaccatccaaagtgagtagctaacagtgaaatttccaggaagcatcagcagatagagaatataggccaatggatggacaagactcaagag

SEQ ID NO: 80688 - DNA, 201 bp, Bos taurus; identical to SEQ ID NO: 40372

SEQ ID NO: 80689 - DNA, 201 bp, Bos taurus; identical to SEQ ID NO: 40374

SEQ ID NO: 80690 - DNA, 201 bp, Bos taurus; identical to SEQ ID NO: 40375

SEQ ID NO: 80691 - DNA, 201 bp, Bos taurus; identical to SEQ ID NO: 40380

SEQ ID NO: 80692 - DNA, 201 bp, Bos taurus; identical to SEQ ID NO: 40381

SEQ ID NO: 80693 - DNA, 201 bp, Bos taurus; identical to SEQ ID NO: 40382

SEQ ID NO: 80694 - DNA, 201 bp, Bos taurus; identical to SEQ ID NO: 40383

SEQ ID NO: 80695 - DNA, 201 bp, Bos taurus
tcttgtctctctggtgatggcccttcctggtttcttcctcccttttgctgctgaaatgcatctgtgctttggaccaagaggcggagagtcgcaccctagaratggcggaaggctcagaggaaaggccttgagtcccaccagcccgagaacacccatctgtggactttctatttccttgtgagatatttagttgcagctgaa

SEQ ID NO: 80696 - DNA, 201 bp, Bos taurus; identical to SEQ ID NO: 40385

SEQ ID NO: 80697 - DNA, 201 bp, Bos taurus
cttcagtcctggctgggcagatgtacggggtctgatttctctgagcttcctgtccctcatgaaaagaactgggtgggcccagcttcccccagcctgctgcygtgtgtcactgagcagccgtgaggggctcagcacaggggtggtctgactctggcctgcagtctgcgtgagagctggctcaggaaaggacacactggctcc

SEQ ID NO: 80698 - DNA, 201 bp, Bos taurus
tttacaacacagtgaaaaatgacaaggtatggacatgccaactttctttctgaggaattctgtacagagatgaatctctcaaggacacagcaacaaacatkgctggtattaatttagtcccaaatcaacataagtgatttttatctgagtagcacctagaggcttatactgaaggatttctgagaaggcaggctgaaaata

SEQ ID NO: 80699 - DNA, 201 bp, Bos taurus
ggctgagcgactgaactgaactgaacgacattttacatttgtgctaaagattagggacaatagaacatcagagaaaaaagcacatcactgggccacggaamactcactgctctgatatggcttaattattcaactcagagagctgctatttccttttctttatgtctgaatatcaactgtggcctcataatcatcaggttc

SEQ ID NO: 80700 - DNA, 201 bp, Bos taurus
ctgcctgaaaccacaagatggtttgtagtgatggttttaggttttagatgaagaagacaagagatgttcatgcaggactcagaccgcagaagctggccatyggggcttcaccactcctaaccaggataacttttgcattattacttgtattctagtgatctttaggagtacttaggtctcacccctcaccctctatttcag

SEQ ID NO: 80701 - DNA, 201 bp, Bos taurus; identical to SEQ ID NO: 40386

SEQ ID NO: 80702 - DNA, 201 bp, Bos taurus; identical to SEQ ID NO: 40387

SEQ ID NO: 80703 - DNA, 201 bp, Bos taurus; identical to SEQ ID NO: 40388

SEQ ID NO: 80704 - DNA, 201 bp, Bos taurus; identical to SEQ ID NO: 40389

SEQ ID NO: 80705 - DNA, 201 bp, Bos taurus
ggccaattcatcttactgttgctgtgtctacacagactctttttttttgtctcaatgtggaagaactttagttgactgacaggcgctagccattcacagartgtctaattagaactctctgtgggccatgtctaatgaaggctatggtttttgcagtagtcatgtatggatgttagagttggaccataaacaaagctgagc

SEQ ID NO: 80706 - DNA, 201 bp, Bos taurus; identical to SEQ ID NO: 40390

SEQ ID NO: 80707 - DNA, 201 bp, Bos taurus; identical to SEQ ID NO: 40391

SEQ ID NO: 80708 - DNA, 201 bp, Bos taurus; identical to SEQ ID NO: 40392

SEQ ID NO: 80709 - DNA, 201 bp, Bos taurus; identical to SEQ ID NO: 40393

SEQ ID NO: 80710 - DNA, 201 bp, Bos taurus
agtttcagtctgtctgtctttagttcattttgtaggaaatgttgtcctgtggccctttagtgcctcacaggaagactgagagagtgctatattatctaatyagagtctctgagacctacatgtggcctctggccagtgttggcaaataacttctttccactgtttcggatgtggtggattgggttgctgaagaatatctaa

SEQ ID NO: 80711 - DNA, 201 bp, Bos taurus; identical to SEQ ID NO: 40394

SEQ ID NO: 80712 - DNA, 201 bp, Bos taurus
gcctctagggagcattaaatgaataaggtctgatttgcttctaaaaggcacacaatagtctagaacttaatatattatatttctctgtaaacagatttatrttgcaaaggactacagagggccttaagccaaaggaacagaaagcatttagctgtcgtgaggtatgacctcacaccagtccaaatggccatcatcaaaaag

SEQ ID NO: 80713 - DNA, 201 bp, Bos taurus
tcatcccagcattcaaacaacaggatcttcctaaaacagagctaaacatttcatcccagcattcaaacaactgttggatttggccatgctctccgcacccycaacatggcagcaagcttccacaaccacatcccagcctatgctcaagtctactcactcagcagcctcccctgcttgcttccagctaccctcgcactagtg

SEQ ID NO: 80714 - DNA, 201 bp, Bos taurus; identical to SEQ ID NO: 40396

SEQ ID NO: 80715 - DNA, 201 bp, Bos taurus; identical to SEQ ID NO: 40397

SEQ ID NO: 80716 - DNA, 201 bp, Bos taurus; identical to SEQ ID NO: 40398

SEQ ID NO: 80717 - DNA, 201 bp, Bos taurus; identical to SEQ ID NO: 40399

SEQ ID NO: 80718 - DNA, 201 bp, Bos taurus; identical to SEQ ID NO: 40400

SEQ ID NO: 80719 - DNA, 201 bp, Bos taurus
aaccatttgtatggaaacaattattgatcttgcctgggccaccccatagcaacttttgtgcaatgtgggttgcatcattacccatggtgccacattatctrtgaacactggcctcatacaactctctctcaggtcattaatatactaagtgatgactgtgcaaattcacatcttatccaaaatatggaggaaatgtgtgta

SEQ ID NO: 80720 - DNA, 201 bp, Bos taurus; identical to SEQ ID NO: 40401

SEQ ID NO: 80721 - DNA, 201 bp, Bos taurus
gttaatatacaatatttgtttttctctttttgacttaacttcagtctgtgtaacaggctcctggttcatccacctcagtttaactcactcacattaattcmttttcgtggctactagtagagttttaaatcaattcatttctattgtgtttttgatttatatgcttgtgaagaagaaagattgaattccctagtttcagat

SEQ ID NO: 80722 - DNA, 201 bp, Bos taurus; identical to SEQ ID NO: 40404

SEQ ID NO: 80723 - DNA, 201 bp, Bos taurus; identical to SEQ ID NO: 40405

SEQ ID NO: 80724 - DNA, 201 bp, Bos taurus
gtatgattttaaaagaaacattcctacatcacagcttctagcaggctcccccaagtatgttctcattgctggggacaaaagacaggacaagggggaacacrcctgggcccctggggcctggatttggaccatcacattgtgacttccgatgtcgtcagtttaccaaagcgagttacaagttcggcccaaacccaaggtggg

SEQ ID NO: 80725 - DNA, 201 bp, Bos taurus
tatcattgcattttgcaagaaggcgtgactgttgggatgttgtaaccaggatataaagtgttagtgagaggagaagcaggcccagaatccagagtctgacytcttttccccaaacaggaagccagtcacttatttcctgctccaggctaaggacccaaagaggtgccatttctcaaccacttagtttcagagcttttccac

SEQ ID NO: 80726 - DNA, 201 bp, Bos taurus
accaaatgacgcttcctcactttttctttctcttctctagtttgaccacggacttgctgaagcctcggctggattatcatcatgctctgaaaatactcttkaattctacacttccaatcacaccctttgtttcacataaaacttaatcaagaggagtttcatgtaagtttccacttgtacataatgataaacagcttaagc

SEQ ID NO: 80727 - DNA, 201 bp, Bos taurus
ggagcacagactctaggcacaggggcttcagtagccgctgcacctgggcccagcagttgcagcttgtgggctctagagctctggctcagtatttgtgacgyaagggcttaattagatccccccagaccaaggatcaagccaccagagaagcctctgtgtattgtttttaaatgcataggtatgtgactctattctcattaa

SEQ ID NO: 80728 - DNA, 201 bp, Bos taurus; identical to SEQ ID NO: 40409

SEQ ID NO: 80729 - DNA, 201 bp, Bos taurus; identical to SEQ ID NO: 40413

SEQ ID NO: 80730 - DNA, 201 bp, Bos taurus; identical to SEQ ID NO: 40416

SEQ ID NO: 80731 - DNA, 201 bp, Bos taurus
ccgtctccatgacactcgtaataaaacatagtaccttattgcccctcagccctgagagccgactgactcagcccaagaacgctgtgatgtttctggagaaygtttattgtatatggggtaaagtgtggcgattttaggattctgccttgtgtagtttaataggtatatctacagcaagattttacacacactattatattt

SEQ ID NO: 80732 - DNA, 201 bp, Bos taurus
tgactgagctactgaactgatgtcatggctccagtctggtcatcatgtagtttacttctccacctggggtttccaatatctataattcagctcataggatrtggctcagagtattacctatagcccctgagaaggaactaaaggtccttggctatgcttaatgagtatattattatttggtctcctctgattgggcttccc

SEQ ID NO: 80733 - DNA, 201 bp, Bos taurus
tggctccaccactcagatgatgatcaaagaggtttacagtcagcacagctgccggctgtgacactgcccctgcccggccagccttgcgccgagggctcttyttccccttctcccttctcagggatcagccaccctctccacttcacagacctttctcccaaggccctggagctttcagaaaaggacctgacgctcaccctg

SEQ ID NO: 80734 - DNA, 201 bp, Bos taurus
cccctggtaggaaagttttctctgagacatctaccttgatggggaaacagaaagaacttcaaagctgttcctcagggagacttccactctgccaacctttmccgtcttggcccagtggttgacttttccagaaggaacaccaaggtgggtgacggaaagaaagagaaagttggggcagtggtgcaggtgagatcagaacta

SEQ ID NO: 80735 - DNA, 201 bp, Bos taurus; identical to SEQ ID NO: 40419

SEQ ID NO: 80736 - DNA, 201 bp, Bos taurus; identical to SEQ ID NO: 40422

SEQ ID NO: 80737 - DNA, 201 bp, Bos taurus; identical to SEQ ID NO: 40424

SEQ ID NO: 80738 - DNA, 201 bp, Bos taurus; identical to SEQ ID NO: 40426

SEQ ID NO: 80739 - DNA, 201 bp, Bos taurus; identical to SEQ ID NO: 40428

SEQ ID NO: 80740 - DNA, 201 bp, Bos taurus
gggtctgtcatgaagggctcttaccatgttgagctgtgttccctggacacccactttggcaagagtttctttttaatcatgaaggataccgaattttatcmaatgctttttctgcatctatgatcgcgtgtcttttgtctgacactgactcgtttgcatatgttgagccatgcttgtgaccctggaatgaccccaacttga

SEQ ID NO: 80741 - DNA, 201 bp, Bos taurus
cactccagcatgcgcgtgggccaacagatacttgtcagtataataacctcagtgggtaaactctgcgcctccgcgtcgtgctccacggagcagggactacrctcccacggccctgattttccaatttgcttttccctgatgcaccaccgtctttacttgttgtatcataggactgagtttttcgcgatctgctgttctgtt

SEQ ID NO: 80742 - DNA, 201 bp, Bos taurus
gattatttgagttgatccctgtgcagctatagatatgtttgttcatgtgtatgtactttaaaggttcatttatttggctgcgctggctctgagccgccgcrcccaggcccttcggtcttcgtttcagacctctttagatgcagtgcgcagggtctgtaggtgaggcatgtgaacttttagcctcagcatgtgggatctagt

SEQ ID NO: 80743 - DNA, 201 bp, Bos taurus; identical to SEQ ID NO: 40430

SEQ ID NO: 80744 - DNA, 201 bp, Bos taurus; identical to SEQ ID NO: 40431

SEQ ID NO: 80745 - DNA, 201 bp, Bos taurus; identical to SEQ ID NO: 40432

SEQ ID NO: 80746 - DNA, 201 bp, Bos taurus; identical to SEQ ID NO: 40433

SEQ ID NO: 80747 - DNA, 201 bp, Bos taurus; identical to SEQ ID NO: 40434

SEQ ID NO: 80748 - DNA, 201 bp, Bos taurus; identical to SEQ ID NO: 40435

SEQ ID NO: 80749 - DNA, 201 bp, Bos taurus; identical to SEQ ID NO: 40437

SEQ ID NO: 80750 - DNA, 201 bp, Bos taurus; identical to SEQ ID NO: 40438

SEQ ID NO: 80751 - DNA, 201 bp, Bos taurus
aatccgcctcccccaggaacctcactttcgaggatggtgtggagttcattttagcagccctcagtgtattcatctgggcctcctttcttaaggtttgtaayatcccttcctttggattaaatttttctttattccataaagaatttttctatcaccagtataaaataccaggctggaggcaagggcccatacaggctgagg

SEQ ID NO: 80752 - DNA, 201 bp, Bos taurus
ctgggttgcagcgctatctaaatttacatcagaactgaaatctgtccttctttaaagcagattcacgtggtatgggagcatcatgggacactgagggcctytggttcaagttcgctgattccctgctgacaaattgaagttttcatctccagataccatcctacaaggcccaccaccctctcctgcttccatccgaaatcc

SEQ ID NO: 80753 - DNA, 201 bp, Bos taurus; identical to SEQ ID NO: 40441

SEQ ID NO: 80754 - DNA, 201 bp, Bos taurus; identical to SEQ ID NO: 40442

SEQ ID NO: 80755 - DNA, 201 bp, Bos taurus
tttttctccatcaagcattcaaacatggcaaccacgtgctggagagaacacctagctgtctgctcactagctaatgggtttatgaagcaagcctgtttccrattttaaatcagcaagggataatctttagagggggaactcaagagtcacccatgtgttacaaaagcaaagagatgacaaacaatcccagctccaactggc

SEQ ID NO: 80756 - DNA, 201 bp, Bos taurus
ccttgctggcctttccgtggaaactgcaatgacagctcgtgccctcatttcctccccctcgcccctgacgctttctcacgtggcctgccatgccctcttcyctcaggaactgtgagtcacagactctcttttcagtggcaactgtctcttgatctgtgagcctcatcatacctgaacagtaatagaacccattctttatct

SEQ ID NO: 80757 - DNA, 201 bp, Bos taurus; identical to SEQ ID NO: 40443

SEQ ID NO: 80758 - DNA, 201 bp, Bos taurus; identical to SEQ ID NO: 40444

SEQ ID NO: 80759 - DNA, 201 bp, Bos taurus
gcatttgctttctccaaagactctttcctattacagacttctggagaaatagtttagtggagaaatatgtatgatgatcaaataggctctaacctagtagkcctgtatgtctgactgaaaataccagaaagagaaagaaatacttagaaaactaacattagatacttaacatatagaaatatatatatctgaaatcaacaa

SEQ ID NO: 80760 - DNA, 201 bp, Bos taurus
aagggtcaactgtagtgtgaaaatcctaaattagagtcttgtggatagactagtacgtcagaggcttgaaaaaggtgaatttacaagcagtaagatacgcrgcacagcagataacgtacttacagaattcattatttggagagtggtataaatggaagttgtggttaaatgaatgacagaggaagaggaaattaggatttt

SEQ ID NO: 80761 - DNA, 201 bp, Bos taurus
acatggagcgtgggatcagagtgagaccagcacaaaaaagcgagttttacgtgctgtgtgagccccagggatccacaaatcctctactaagaaggcccatyctagtgctgcaagtggaggaaaagaaacagcttcttggaggcaaagagcaaagaacaagggttaagtcagttcagtggctcagtcgtgtccgactcagtg

SEQ ID NO: 80762 - DNA, 201 bp, Bos taurus
aactggtttaaattgaggatttgaaactgaaatcctatgctaatttcaaatgaattgagtcagagacagtgtcagaggtgttaaatctagatggctgaccrcacgatttatttccaggcccccaggcaagacagtaatgtgtgcctaatggactgccttatgtattgataatcggagaaaggtagttggaagcaaactaag

SEQ ID NO: 80763 - DNA, 201 bp, Bos taurus; identical to SEQ ID NO: 40450

SEQ ID NO: 80764 - DNA, 201 bp, Bos taurus
gatcctctccttgccgtcaagggagtctctgcttcaggtttcaagggccttatttgtggcaggaagagaaaggcccctcctgtcctctgaaggccctttcyggtcctaaagttcgtaacttgaagattctggggctccattttaagtgtctgtgcaccaaaagcaggcagaaaaaaggttacataattgggagactgggcg

SEQ ID NO: 80765 - DNA, 201 bp, Bos taurus
cgggcctgctgcagttcatggggcggaccgagcagctgaacagaaacagcagcactcagatggggacgctccaaaacgaagagcccgtgaacacgtgaccygcgcagcaggcgacccaggccccccaaccatcgcggccaagccgggctcccagcagctgcccctccacctccaccctgcagggcggtccaggagccacag

SEQ ID NO: 80766 - DNA, 201 bp, Bos taurus; identical to SEQ ID NO: 40456

SEQ ID NO: 80767 - DNA, 201 bp, Bos taurus
ctactgagtcaccagggaagcccttgtctgtctacatgtctggtgctttttctctatataattattgataccaatattgccagtattttttaatatgtgcktgtgttttctctctcactcattccattaaataaaaatgtattaagcaccagttatgtatccagtggtgaaagattctggtgtcctccttgactttctctc

SEQ ID NO: 80768 - DNA, 201 bp, Bos taurus
tagatttttaaaaatggtgactagaaccttaactataaacactctaaataaaaaataaataaatatttggaagtttccattttgtacaaagtcctgagatrggtgctagcagatgcacaaagcagaataagaaaattttgctctcagggaacttgttctagagatgaaaagatacgaacatatgaaaacagaactagcagt

SEQ ID NO: 80769 - DNA, 201 bp, Bos taurus
tcctccagaatcttacaaggaaagttcaacataaacgatctttgaacaaattccgtttcggatgtatgtatgtgttagaggtagagggtggaccagggagrtggccggcattcagggcccccaggagaaaaagatgctgaatacagtctgtcctccattcgttcagaggttccacttctgcagaactcacaagagactgca

SEQ ID NO: 80770 - DNA, 201 bp, Bos taurus; identical to SEQ ID NO: 40458

SEQ ID NO: 80771 - DNA, 201 bp, Bos taurus
agggctcaggggtaagaaatgagggttggacaggcctggggtcgctggtctgaacctcaggaaggaaggatggagcagctatctccaggagggatgggagrcaggggaggggatgtgagcctgggcggggggtgggggtgtctccagagcacaggtggaggtcagtgccgccaggtggactaagggcagacggaggggggt

SEQ ID NO: 80772 - DNA, 201 bp, Bos taurus
taacccaaggcctctcttcacagcaactgtaaagccagtcaggccccatcacatcagctgaacaccttgcacgccgggcccttcctggaagcagacggacrcagatgggaggtgctcactaacacggacaagttacactcaggatgcactctacacacgggagtgatgctcagagctccaagtgcccagtctgaggcctca

SEQ ID NO: 80773 - DNA, 201 bp, Bos taurus; identical to SEQ ID NO: 40461

SEQ ID NO: 80774 - DNA, 201 bp, Bos taurus
cctgcaggcttatcgccaggacccagagtccatcggccaggggtgccaacctgtctccctgctgcaggactctgcctgccaccccaagaccaaggttgcayggaagccaggccctgtcctcgctacctaccctgggctctggctgtgggtgggccgcccccagccatcctctgtgctctcagtgggcacgggccgagctcc

SEQ ID NO: 80775 - DNA, 201 bp, Bos taurus; identical to SEQ ID NO: 40463

SEQ ID NO: 80776 - DNA, 201 bp, Bos taurus
ccgggaggaggcggtagggaggtgttgtgcctcgggcctcatgccagcacagtgaggctcctggccctagaccacaagggccctgggatgaacagggcagmgagtcatcagtggtacctgctcagacagagcgtccacctgcccactaccccaatccaaggccttggaagtccccactccaaatggtaacactgcgcaagc

SEQ ID NO: 80777 - DNA, 201 bp, Bos taurus
cttgcgagttgctggcccatgtccctgccgtctgggtgaccaggtctctcctgtgcagagatgtacatgcacgtgtaagcctgttcccaccacagtggctrtgtgtcccaggtgtgagctgggccttacctaacacacgcaagagcttgagaccaggtgtaccaaggcctgaagaactccccgcctgggccctgcacttgg

SEQ ID NO: 80778 - DNA, 201 bp, Bos taurus
ctgataacacaaatggagtggtgggggtcccaggagcatctaataacccacaaagtaatttgttcaagattaacaccgtttcctaaagagttcatacagcyttcatacatcctagatgcactgtaggcaagaattgtatccaatccttcattttgcctcttaaaatctattagaattatttgagaaagtttaccgagtaca

SEQ ID NO: 80779 - DNA, 201 bp, Bos taurus
tccaaacccctgtcgtgttttggtctcggtcttcatgaggggtttagggtgactgtcctctctgggccctcgaggatgaactgctcttagaaaactaagtygccagtctgcagcaccttgtagagtggccacactattgacctgaagctttgggcttgcaagccccccaagtgggaatccaagtcccagggtttatagtgt

SEQ ID NO: 80780 - DNA, 201 bp, Bos taurus; identical to SEQ ID NO: 40475

SEQ ID NO: 80781 - DNA, 201 bp, Bos taurus; identical to SEQ ID NO: 40476

SEQ ID NO: 80782 - DNA, 201 bp, Bos taurus; identical to SEQ ID NO: 40477

SEQ ID NO: 80783 - DNA, 201 bp, Bos taurus
gctttggaggggtcgggaaaccccagaagccaggtgagtcccgctctgccctgtcgggctctcggtcggtctgtctgtccgtcctctctgtgtctgtgctyctttcaagccctgcttcagtctcaggcctctcactgtctccccaggattcaggactgggaacggagcccagccgggtgaggcccggagctctagggcctg

SEQ ID NO: 80784 - DNA, 201 bp, Bos taurus
gagactcttgtgtccatccaggaccaggtgtgaagggtgatcatacccagagggcagtgccatagtttggtacgagctggtgttcagaatcagatagcccrgctcccagtgcaagctgtggggcctttgtgagcaagtgtctgtagctcttggaaactcagtttgcccatggaaaatggtagctcgcgcctgctgctgatt

SEQ ID NO: 80785 - DNA, 201 bp, Bos taurus
aagtgtccggtattcagggaggccgtggccacccccactggacagatggtcagaggatccatgttcttctctccatcatgtgtcctggggctgaggatagkttgaaggggcccagggggaaagtagccagtggctgtgagggatgtgggatttggctgtcacattgtaaaaggagatgtccccatcttgtagtcgacggag

SEQ ID NO: 80786 - DNA, 201 bp, Bos taurus
cccaagaccaggggttcttaaccgtgggccatgttgccactcaaagatatttggcagaatctgcaatcattgccaggtctggcaggtgctcctcatagctrgtaggtggaggccaagggtgcggctagacatcctgtgatgcataggccacccatcgacacagacaacaaagacccgtctagtcccaaatgtcaatggtgg

SEQ ID NO: 80787 - DNA, 201 bp, Bos taurus; identical to SEQ ID NO: 40485

SEQ ID NO: 80788 - DNA, 201 bp, Bos taurus
tattatataacaattgtctaaaatagaaatgaacttaaatatttattttaataggagtttattacctgttctatatattgagaatctgggaaagtgttacycaaaaaagaattaagtggtggggacactttccaggaactgaccaagcccacccaccttcacaagtcagatgaggggtgggggcccagctgcctgcctgcc

SEQ ID NO: 80789 - DNA, 201 bp, Bos taurus
ttccttctctgtgcacccccacctgtccttgtctggccacctctgtgggcacaaggaccttgttggtcccactttcactgtatcccttcaggaactgcacrtagtgcgcccggcacatagtaggcccacaataaattctggtgaatgaatagggtgcctcctgggtgccaggtttcaatgcaaagttgtggttcttccccc

SEQ ID NO: 80790 - DNA, 201 bp, Bos taurus
atgccaaagggctcagatggggagcaatgatgagggaaggaggcaggcccccccacccccgcactgagcatccagagtcctcaggccagtcacttccccarctgctttttgtttaaaaaataaggaggttgattcctacaggcttttccttccccagaccccagagcatttgagaacagtgtcctgtaggccatggggtcc

SEQ ID NO: 80791 - DNA, 201 bp, Bos taurus; identical to SEQ ID NO: 40491

SEQ ID NO: 80792 - DNA, 201 bp, Bos taurus; identical to SEQ ID NO: 40495

SEQ ID NO: 80793 - DNA, 201 bp, Bos taurus
tgctatttcctccaggtggcccttaggatgtaatttaatgtctctgagcctcagatgataaaataatatctactcataagagtcgtgtggacttactgagygaatgtctgtaacacatttaatgtaatgtacctggtatattgagcacctcgtgtgctccataaatacggcttttattatttttcgttcccttatgaactg

SEQ ID NO: 80794 - DNA, 201 bp, Bos taurus
ctcaacctgccccaaactgagtttccatcctgatcccttccttgcttctcctcctctgtgctccccaagtcacaggatggaaccatgacccttcctgctayttaggacatgtcctccttatttcctatttcttcagcctccatgtctggttcatcatcagagctcccactgtaccttctgaacacaaatccatctctcagt

SEQ ID NO: 80795 - DNA, 201 bp, Bos taurus
gtgtgatccatattcatggcatgctctgttaggtaaataatagtggctctgagaaagtgcttctgtgaggtccttttccttctcaaatgactttccttttyttccccctaagtacagacaaacagttgtaatttaaacagaacaaaccccacctgtggaggagacgttggtaaagacagacaagaagaattacaaacccac

SEQ ID NO: 80796 - DNA, 201 bp, Bos taurus
cctggccttgtcattctaatgtaattagtttgcaaaaatatcaattaacactcaaaacagctgacacgttttacatgctggtttgaaatgtgttaattacrccttatactttgcccttgtaccatcccgagcggcgccatagacagggattctggtcctccatgccctcctccttacatactgggggcaacatggatactg

SEQ ID NO: 80797 - DNA, 201 bp, Bos taurus
gcccatccttagggctgagatgaggcccttgtccaagccacacagcgttaaagtggggaacagctggaccgtaaaggaaagcaggggccctaacagagagragagtgtttccagaaagcccagcaggtttccccatagcctagcatgtcctactccattttgactttctatgtaggccattggtggggagggcatgatgaa

SEQ ID NO: 80798 - DNA, 201 bp, Bos taurus; identical to SEQ ID NO: 40501

SEQ ID NO: 80799 - DNA, 201 bp, Bos taurus; identical to SEQ ID NO: 40503

SEQ ID NO: 80800 - DNA, 201 bp, Bos taurus
gaggagaatgaatgattgatggatggcgagcttctcaggtggaaacaggctggtgggaagctgcctttaaaatcatattttatatacaactgtgggtcagygcaggctcccagtatacagtgcctgaccttagtatgggggagcgatcgattgtgctcaaacagcgagccatccaaatgatttatttatgcagcagtgcag

SEQ ID NO: 80801 - DNA, 201 bp, Bos taurus; identical to SEQ ID NO: 40504

SEQ ID NO: 80802 - DNA, 201 bp, Bos taurus; identical to SEQ ID NO: 40508

SEQ ID NO: 80803 - DNA, 201 bp, Bos taurus
attaagtttgaagtccaaagaataccctttgacggaccagtccaagcgtcaccctctaaccattgagacaagagtcccgtttggttttattaaccatcatygggcaactttgaggctgaatacaagccttgggaatgaaatgcaaattctataataggaacatcattgtgataataatttattaaatttcccgagccgtct

SEQ ID NO: 80804 - DNA, 201 bp, Bos taurus
taaaacctgagttcagttggttttcattaatgtggtgtatctggtccaattaagcctcattttaaaaatcaagtgccttagaatggagtggcctctttcayatacttaacgtaagataattcaattgtgtgtgttgagtcaacaaaaaccaaccattttacacaccctacaactcctcctcctcaacaactttaacaacac

SEQ ID NO: 80805 - DNA, 201 bp, Bos taurus
attgccaatggccttgtgctttgcagctaataaagactaaattacactcatggtttggaggtatctcgtgcctatagtaagtcatgttacttgagcttgtrtaactgtagctccatcctatccaccttttatttgggaatgaataccccagcctcaaatctcacatttttctcatccaaagctaataactatatagcattt

SEQ ID NO: 80806 - DNA, 201 bp, Bos taurus
cgagctagttatgaactgagcatccttgcacttgtgtttctgctcttttcaacttgaactcgttgacaccgcatacccaggcagggaagctcgtggagttygagggtccttgactcagaagtggactctgatctccagcctcaatcctgtcattacatgcagagcaattgtgtctgaatggttggaatccagtctgtctga

SEQ ID NO: 80807 - DNA, 201 bp, Bos taurus
tgcaacaggccagatgttgtcccttcaccccgaggagactggggctcagggctaagtgtcttctcgtcccagatcaaatgttgaaaaggatgacagagccrggatcccagcttggcctctacaggtatggagctcatgctttctcatggtgcccagacccttccaggtgagttgagatgaccttggaaagctgaagctctc

SEQ ID NO: 80808 - DNA, 201 bp, Bos taurus
tccctgggccctttctattcttggacatcgggagcaatgaggttacatccccgatcagtgattctcaggcaggtggacagagtgcccagaggccatcaacmacatccagagacgcttttggctgtgctgactagggaggaaaggagagttgccatggacatccatggtccagaggccagcgatgctgctaagcatccttca

SEQ ID NO: 80809 - DNA, 201 bp, Bos taurus; identical to SEQ ID NO: 40513

SEQ ID NO: 80810 - DNA, 201 bp, Bos taurus; identical to SEQ ID NO: 40514

SEQ ID NO: 80811 - DNA, 201 bp, Bos taurus
actgtcactagaaaggaaggaaagactggtaataataatatccatctctattgagaaccttctaagcgtctgatgctttatactctccatctttaacattycaactgggttcatgagtatagtttagacaagtcacttgatactgagctgtactctgtcttacttagatcacctaataaattaatgattgaactggtgttt

SEQ ID NO: 80812 - DNA, 201 bp, Bos taurus
accatgttctgatgtctgagctggagccccttctagccccagcccagcctctaaaaggcccagccctctggcacttcaactagaaacagcattgtcaccayagtctcatttctttttaagcagggcctcataaaaactcttctagcagctgtgaacgttcatcactggagcaataaatgatgctgctgctgtgattcatca

SEQ ID NO: 80813 - DNA, 201 bp, Bos taurus
taaatattcagttgaaggttggtcaaatgaattacctgcacagatgttacctgtgtaagaggctattatgcaactgccagaactaatgtttgtgtttgcartgggcttttaatggtggacagaaatgtttacagcatgtgtttaagccaaaattttgcatcaaagacatctcccgattttgttactaacagtaatactact

SEQ ID NO: 80814 - DNA, 201 bp, Bos taurus
agagaaagtgcatgaatgacatcaactcttctgattgttggaaatatattgtgctgagaaccaatgcctgatagagatcaggtttcgttataaggtcagtktcaactgcgggccactgaaatgtcaccgagatatatttcccaatgtgacattttgtaattgaaagtgtacgggtgtgactttcacttttgcatagcattc

SEQ ID NO: 80815 - DNA, 201 bp, Bos taurus; identical to SEQ ID NO: 40518

SEQ ID NO: 80816 - DNA, 201 bp, Bos taurus
gtggagcctttcattcttggatgtcgctacacggcctggtgggtgagggctcctggatcaagaggatcagagaggtgaccccaggctgggtatggtcatgyccactgtgctgctgctggccactcagaggtcaggttcagggctcagtcatcctgggtctcggtgtttatgtttattttttagcatgggaatggtgccatg

SEQ ID NO: 80817 - DNA, 201 bp, Bos taurus
gttgctgctgctaaccatcccccaaccctcaaatttatatccctttgcaaaagctgaaacccaaggggaactgtgatctcgcagctttcatggccagaacyggcctccaggtactaggttttaaaaagatgcccaacttcctgggaactacacgtccctcctccctcttgggagtccaaattccaagaaatgtagctaaaa

SEQ ID NO: 80818 - DNA, 201 bp, Bos taurus
gctttctctcacgagctggcagggtgactcttcagcaccacactttcccacctccatgccttggtctgcattgtggccaccttctggaatgttcttccccrtctcatttataaatccaaacagatccatcctcaccttctctgcgtctttgcgacttggccacacagaggggacgtctgttaaacaatcattcttcctatt

SEQ ID NO: 80819 - DNA, 201 bp, Bos taurus
cggcctgggcgggaggtgaagcagcaatgccctggttctggtgtctcataaatccaagtctccaggctggcttacagcttgccttctcaatctgttctgcrcgtaaccaatggccagaggggtttctctgcaaacacagagcccttaaataccttccctggatgctcagcacctgcagagttcaagcactttggcatggca

SEQ ID NO: 80820 - DNA, 201 bp, Bos taurus
aaggaaaaataattcaggagttggagctggcatttctgtgcatgtgtgtgtggaagcactgggcgcattgaagttctctggatctcctcaaggaccctccyaggtagatttcatgtagatatcatcacttgggtcttccagaggattcacaaactagctcctgtacagagagggcagagaaggaaggaggaaagaggcagg

SEQ ID NO: 80821 - DNA, 201 bp, Bos taurus; identical to SEQ ID NO: 40521

SEQ ID NO: 80822 - DNA, 201 bp, Bos taurus; identical to SEQ ID NO: 40522

SEQ ID NO: 80823 - DNA, 201 bp, Bos taurus
tggttttccttctaccctgctggcttgcccccatcagcctccttgctgatgcttcctcatcctcctgacctggcagcctttagcgtgtgggccagatccartccgctacccagtttttataaataaagtttcattagaactcagccatgccaagtctaatgacattaaatgccatgcaaattcagggagcagcatggataa

SEQ ID NO: 80824 - DNA, 201 bp, Bos taurus; identical to SEQ ID NO: 40523

SEQ ID NO: 80825 - DNA, 201 bp, Bos taurus
ctgttacctgtattctccagttaaactctcaaggtttcctgaagaatctaaagcaattgaactttttctctctgtaaatctagtcggcctattgaagaacygaatgccctctcaacaagctgccagcccattagttggcaacatcaaaagcaagcagtgcacttaggaggcctcagcaatggtccaggcaagaaatgatgg

SEQ ID NO: 80826 - DNA, 201 bp, Bos taurus; identical to SEQ ID NO: 40524

SEQ ID NO: 80827 - DNA, 201 bp, Bos taurus
agcggtcccttgagatgaacaagcacaagggcaagaggcgggtgcaaaagagacccaactacaaaaacgttggggaggaggaagacgaggagaaagggccygccgaggatgcccaggaagacgccgagaaggctaaaggtacagagggtggttcaaaaggcatcaagacgagtggggagaatgaaggtgagtgcacgcgcc

SEQ ID NO: 80828 - DNA, 201 bp, Bos taurus; identical to SEQ ID NO: 40525

SEQ ID NO: 80829 - DNA, 201 bp, Bos taurus; identical to SEQ ID NO: 40534

SEQ ID NO: 80830 - DNA, 201 bp, Bos taurus
atgtttctcgttataggtacacttatgaaacggtctccaagtccttctgtgtccacagctcagtgcttggtgggtggcccaactgtttaatttggtcaagracttactctttaattctcacctgtgctccttgccggctgtgtgccttcaggcaagtctcttgacctctctgggccttgttgccagtgaacaccaagcctg

SEQ ID NO: 80831 - DNA, 201 bp, Bos taurus; identical to SEQ ID NO: 40536

SEQ ID NO: 80832 - DNA, 201 bp, Bos taurus; identical to SEQ ID NO: 40537

SEQ ID NO: 80833 - DNA, 201 bp, Bos taurus; identical to SEQ ID NO: 40539

SEQ ID NO: 80834 - DNA, 201 bp, Bos taurus; identical to SEQ ID NO: 40542

SEQ ID NO: 80835 - DNA, 201 bp, Bos taurus; identical to SEQ ID NO: 40544

SEQ ID NO: 80836 - DNA, 201 bp, Bos taurus; identical to SEQ ID NO: 40546

SEQ ID NO: 80837 - DNA, 201 bp, Bos taurus; identical to SEQ ID NO: 40547

SEQ ID NO: 80838 - DNA, 201 bp, Bos taurus
catggagcgggacctggccttccagcaggcacatggtgggtgctaaacagagaaatgagctgggttgatcagcccctgggccggttggccactgagggaargagcctgaggcaaaggtccagttctccactcattccacaaactccaatgaagcattcattacgagctaagacctgggccaggcctcccctgcactcaagg

SEQ ID NO: 80839 - DNA, 201 bp, Bos taurus
gaggacagctgaaacctagactgacaaggggtaatgttctgacagtcagaatgatggaggaaaaaatgatggatggagatacaatgaaagagggaacgtgrtgacagagtggatacagggactctaagaccaggataaaaagcttgggtttcctctgactcagatgtagagaatagacttgtgattgctaaggtaaaagag

SEQ ID NO: 80840 - DNA, 201 bp, Bos taurus
ccgtccgcacgggacctgctacagctacaagcaagacgcactagaacaggcttccgaagcctttgcatatgctctgcgctccagccagagacataaatacrcctcacacacagcgttaaaagaatcgttctgcagcctacacagatgtcaaaataataacaggatgatgccaggcaaggaaatatttctgatgactcttcc

SEQ ID NO: 80841 - DNA, 201 bp, Bos taurus; identical to SEQ ID NO: 40549

SEQ ID NO: 80842 - DNA, 201 bp, Bos taurus
atatcaaatttgcctagataaggagagaggccggagtcacaagggacagatactacagatgtgacttccctggtttagtaccaggtctctggaggccaagygggcttccctggtggctcaactggtaaagaatctgcctgcaatgcgggagacctgggtttgatccctgggttgggaagatcccccggagaagggaaaggc

SEQ ID NO: 80843 - DNA, 201 bp, Bos taurus
tagttcctttcaatactcagattgccccataacaaagtcaatccatagttttctgttcctgagcagcttgagcaatggtacatataggccattcatgtacrtatagactgttatggcaattgccatccatattggtagaagagctctttatcccttatccatttgagacacagtctggctcatgggggttcaccctgttct

SEQ ID NO: 80844 - DNA, 201 bp, Bos taurus
taactttggggtctgcaaccatattgagtcactgcaagtccccgaggagcaagagaaggagaaggcaaaagccttcctccaaaagaggaaaagcaagttgrgtgggggtgggggtaatagtaaacaaagtttccatggcttttcactggctgagtccttgccggcaaagaaaaggagtccttctttcctttgggctgtgct

SEQ ID NO: 80845 - DNA, 201 bp, Bos taurus
cagttggctggaactccccagccctggcccatgccaggtaagagttcgcattgcattcagatctcctggaggcaatgccgtttctaatccctgtctttacygacaacaggcattttctctgttctgcgtaattccgatataccatccttcagctctaatgaacccagtcttgaacttcattcagtggaactcaataaaccg

SEQ ID NO: 80846 - DNA, 201 bp, Bos taurus; identical to SEQ ID NO: 40554

SEQ ID NO: 80847 - DNA, 201 bp, Bos taurus
gacatagaaataaaaaattcctgatggctcactctcacaccaagttattaacacctatggctcaaccattcatcacagacctcctttcccattttaggcamgacatcctcaaaatgtcctggcctctgccaacaacatcccagacacttccaagcactcagaactagagaagaaatgccaggttttggttaaatgagttac

SEQ ID NO: 80848 - DNA, 201 bp, Bos taurus
ggaagtgaaggacccaaggccctaaaggaggaaggaagacaagacaggaagaggctgctcctcagttcaccacatgaaaagctacctgtcctcccatcaartacaacggagctggaccccatgggccttcctgggacaggcctctccctatatcctctgctttagctcctctccaaaatacctttgttgttgttcagttgc

SEQ ID NO: 80849 - DNA, 201 bp, Bos taurus; identical to SEQ ID NO: 40557

SEQ ID NO: 80850 - DNA, 201 bp, Bos taurus; identical to SEQ ID NO: 40559

SEQ ID NO: 80851 - DNA, 201 bp, Bos taurus
tgttgtggggaaacaggcggccgtgggagggagccccaaatgacaagaaaccgaagccttctcaccaaaaccaggaaaacacggaggcccttagtccaacrggctgcaaggatgtgagttcatcaacagccacatgaatgtggaagcaagtcccccgctgggtgctgtggcctgaatgtttgcagccccccaaaattcacg

SEQ ID NO: 80852 - DNA, 201 bp, Bos taurus
cttcttcatcctttttagtttcttggcctttttccttccctctgagaggggttctgcacagggatctgtctgctcaagctcagtgtcagaaatctcccccratgctcgggcctccaggccggcttctgctcgactgggactcaggtttctctttcctactgtgctggtggctgtgagactgaaatgcaaatagaggaaaaa

SEQ ID NO: 80853 - DNA, 201 bp, Bos taurus; identical to SEQ ID NO: 40562

SEQ ID NO: 80854 - DNA, 201 bp, Bos taurus
ggggacctcagagcaacggctaagagcatggcccccggcgtccactgtctgagtttgaatctttgctccatcacttagctgctatgtgatcttgagcacgytgcccgctctgggcctccaccatggtagcagggcgatgacaatcagagctccctcgttaggcttttggaggatcaaatgagctcaagtaagtaaagctct

SEQ ID NO: 80855 - DNA, 201 bp, Bos taurus
gtgcctcgcccaagccaccccactcctctgtggccaggcccctgtgtgtgctcctgacagcagtggggagagcaaactgcggcggacagctagtgagaacrctcaggaagccggcctcaatctgtgggccggggacggacggcaagcttggcggtgctaaagctaaagccccatctttgggaaaacaggagaaactgtcag

SEQ ID NO: 80856 - DNA, 201 bp, Bos taurus; identical to SEQ ID NO: 40564

SEQ ID NO: 80857 - DNA, 201 bp, Bos taurus; identical to SEQ ID NO: 40565

SEQ ID NO: 80858 - DNA, 201 bp, Bos taurus
ggctggtaagaagactgaggcctgtggtcagcagcagggtcatctcctggacagcagtgtcagcagagcagggaaggacccgtcacaacagaggaggcaayggggaaaggccctcctcgacacggcaggcgggctggcctctcggtgggtggcgatacggcacaaagacgagaggctggggctccagtcctggctctgccc

SEQ ID NO: 80859 - DNA, 201 bp, Bos taurus
ggagtcgtttgtgttgagtggaacctttgccaggcagctcggtctagagcatgcaggtgaaggaaaggactggcccagacccggtttttatggccctcatrccaagaacggtttatacatttttaaaggatagtttaataatttttaaaaaaagacaaaaatgtgacagagaccatttctgggcctttatagaaaaagttg

SEQ ID NO: 80860 - DNA, 201 bp, Bos taurus
gggccccagacttcttcccccactgccctggatcttctcaagtcagagaggaaacatgagtggctaccataatgggaatccacaaacaccaataaaggaaycgacaaatcagaactttaaagggccctgcgcacagtaggcctcagccatgacctaccgggaaaggctcgtctctatccctgccttctccaagtatgcttc

SEQ ID NO: 80861 - DNA, 201 bp, Bos taurus
atgaaagagtcctataagctgctgtcattagtggcctcacccccagcatcttaccaagaggcagtgatggggctgggatggaggtgtgccccaactggggrcttcgggccagagccaggttcagctcctcgctcttttcccacttcttagccatgtgcttttttggaaatgctacttaacttcccaaactctagcttgcag

SEQ ID NO: 80862 - DNA, 201 bp, Bos taurus; identical to SEQ ID NO: 40566

SEQ ID NO: 80863 - DNA, 201 bp, Bos taurus; identical to SEQ ID NO: 40568

SEQ ID NO: 80864 - DNA, 201 bp, Bos taurus
gtatatgttttctttatttctttttttaaagtggtaagcctacttacaaccatactaggaatatagttttgtatcctgctacttttttcacttagcaaaaygagatttttccaagtttaattacatagctttaaaaataaccatcaccatttttttctttttcctgccttttaaattttttatcaaagtaatatatgcaca

SEQ ID NO: 80865 - DNA, 201 bp, Bos taurus
cccttgggtgtatttggaaccttcctgtctgttttaagttccacacatctttggcgttaaaaatccaaatggtgccaactgtggttgggccccttggctgkgctctctgggttggactgtggttttcaaggtgtcagtactgaaaaggaagatgtgtccttatagaaatggcctttggtttgggctgcgtattacctgcca

SEQ ID NO: 80866 - DNA, 201 bp, Bos taurus
agaattaggttcaggtgggacccgactcaggtgttcaaatcatgtcatcataatgaagtctccctccgtcagaaggcttcctttcattttggcctcctagkcaggctccatggggcgacaaaacggcttccagcattcccaagcttaactccaatttcaagtctaggtataaagagccagggcctctaatctttaccttca

SEQ ID NO: 80867 - DNA, 201 bp, Bos taurus
ggcttctctttggaaaaatgcctgctacaaccatctgctcctctttaaaaagcaggcagtgtctagagtgagaactaagtgaaagagggccatggagtctraaccaaaggactgtctctccccacaacccccaggtacacaggatctggtccaagtcagaagtacttggccctcaaacccatcactgttgagagcatctga

SEQ ID NO: 80868 - DNA, 201 bp, Bos taurus
cagtgggaggttcttggcaggatgcccaggccagaccagctgagcttggctggagcctgcaggaccctgccacggggccgtcaatctgctcagcgacgagygctgcctaatggcacggaacgtgtttaaaatgcaacccaggtgccagaccctattctacatgcagtaccattagggaggctccatcctcggccgaacagg

SEQ ID NO: 80869 - DNA, 201 bp, Bos taurus
cccctctctctttcaggaacacagcagacacagttggaaacatgaatccaccttgcaaactgccaaggcagctgtggcaggtcagaccttctagaaccagrtgttggcctggagcctgggctgctgctgctgctgctaagtcacttcagtcgtgtctaactctgtacgaccccatagacggcagcccatcaggctccaccg

SEQ ID NO: 80870 - DNA, 201 bp, Bos taurus
ccagaagagaaaatatttccctttcctcttacactcaaatcttttggtttcccttgacagctgagtagcacctggggccagggggaaggccatggggtcaygcagagctgacagtccctgttgtgtgggtgacaccctgttgtgtctctgagtggacaacccttattaatctcgagtcctattagaactgctactggcccc

SEQ ID NO: 80871 - DNA, 201 bp, Bos taurus
attggactagaaggagggaatgaagtacagggccactttgtgggctgttgagaatctccatcgggtcacacggccctggggctttgcatagggcctggttygcacactccatccctgggagtcccatgctgatagcatagaggaaggatgctccttccgtcagcaggcagtccccgagtgcctatgatgtgtgagggtggg

SEQ ID NO: 80872 - DNA, 201 bp, Bos taurus; identical to SEQ ID NO: 40575

SEQ ID NO: 80873 - DNA, 201 bp, Bos taurus
atatgactgaagtgacttagcatagcatagcatagcatggcagttctatttccagttttgtaaggaatctccacacaacactccatagtggctgtactagkttttgaatacagaatctacgtgtaactaacatgagttttagaaataaaggggaaaaaaacagaaaaaaaaatggagaggaagaaataactcattatatat

SEQ ID NO: 80874 - DNA, 201 bp, Bos taurus; identical to SEQ ID NO: 40580

SEQ ID NO: 80875 - DNA, 201 bp, Bos taurus; identical to SEQ ID NO: 40581

SEQ ID NO: 80876 - DNA, 201 bp, Bos taurus; identical to SEQ ID NO: 40582

SEQ ID NO: 80877 - DNA, 201 bp, Bos taurus; identical to SEQ ID NO: 40595

SEQ ID NO: 80878 - DNA, 201 bp, Bos taurus
aaaaagttaaaaaataaaaaaacaaatttatttttcacagttctggagattgagaagtccaaggtcacagtaccagcatggccactttctggaggataccyccttcatggttcatagctgaagtcttttccgtgtgtcctcacacaagggaagggggatgagaactctctggggtctgtttcataagggcactaatccatt

SEQ ID NO: 80879 - DNA, 201 bp, Bos taurus
ataaaagtatgtatcttcagtatctaatgtgagagtgggataatacagtgtccacagtgcacccagaatgatgcacaggatacggaaaaatgttagctgtyactacgttattcatggcaataaatatgtaagtgattgagcttgagggcccaggtcaggatctctgtgtatgagatgcatctttgagcacaaaaagttgac

SEQ ID NO: 80880 - DNA, 201 bp, Bos taurus
cacaaaggcctgcattctgctgaagtaaaacctggaagtcttcgcatttcctgggttcaggaacaaggtacagtgaagagaaacgcttggcaggaggtgtmagctgccctaggcctttactgattaatcctaaagggggcagggccggaaatggggatttgtacacttaggaagaaagcctgagattctaactatctgcta

SEQ ID NO: 80881 - DNA, 201 bp, Bos taurus; identical to SEQ ID NO: 40596

SEQ ID NO: 80882 - DNA, 201 bp, Bos taurus
acaaagacccagggcagccaaaaacaaaataaaaaaaaaatttttttaaggatcactgtggccagcctcagaccacaaaatggcttctctaatattgagamagtcatgtctggttgtctttctccagcgaatatctgcttatatgcttactgaggtctttagcttactgacatcttaagtgtcctgagacaaaactattca

SEQ ID NO: 80883 - DNA, 201 bp, Bos taurus
ttcaaataattcactttcctcctcttctacttccctgatttcatctaaaagcaagaataagaacctcagaaaaaactgcacagtgcaatagatatgaattrggtagttctatacttgaagggcctggggaagggactgatactgaatgagtggcctgatccttctacatatattaaaataaatttttttattgtagcaaga

SEQ ID NO: 80884 - DNA, 201 bp, Bos taurus; identical to SEQ ID NO: 40598

SEQ ID NO: 80885 - DNA, 201 bp, Bos taurus
gggaaattaaactacatacttctaaataacacatggtcataaaagaaatatcaacagaagttttaaaatattttgaggtaaacgaaaataaaaattaacaycaaaagttgtgagatgtcacaaccattataatattcagtgaaaagccttcccactaaaatctggagcaagacaaatatgtccatttttaccacttttatg

SEQ ID NO: 80886 - DNA, 201 bp, Bos taurus; identical to SEQ ID NO: 40601

SEQ ID NO: 80887 - DNA, 201 bp, Bos taurus; identical to SEQ ID NO: 40602

SEQ ID NO: 80888 - DNA, 201 bp, Bos taurus
gactaaaggaaatgcacagcatgccagggcctgaaggggaaggggagctgtggaacacagacatggtgaagggtggtggagcgggaaagctggagaggtcrttggacagtggccagagcctgtgagcctcaaatgccatcgttatgatcttaatctttattctagaaataaagggaagactttaaacagttttaatcaaga

SEQ ID NO: 80889 - DNA, 201 bp, Bos taurus; identical to SEQ ID NO: 40605

SEQ ID NO: 80890 - DNA, 201 bp, Bos taurus; identical to SEQ ID NO: 40606

SEQ ID NO: 80891 - DNA, 201 bp, Bos taurus
tggggctaaaaggggactgggaggggccttgcacatatcagtagtgatgctaccggttggaaaggaaaaaaaaaaagcatgaaaaaaaagaaattctgtcractagccaaggccactttgtggtgtttcttccacagagtaatgtctggggactcaacaacttacctgttggttcaaggtgaatccagggagtaacacaga

SEQ ID NO: 80892 - DNA, 201 bp, Bos taurus
catgcaatgactgggctcaaccaagcagctcttacacagcttttctcatgcagttgtggtcagatgtcagctggggccattaccatctgagggttctcccrgggtgcatgtccaagaggggtcactcacaatgctggaaggtgatgctggctgttggccatgagctcagctggggtgtcaaccagagggatgatgtgtgac

SEQ ID NO: 80893 - DNA, 201 bp, Bos taurus
gtttccagagagttctaacattgactgtgcttctgcccacatctatcaccccgcctgggtccctggtgcctccagttccagagctctgggaagattccacyctcttctccttagtgatgcccccttctccctgcagccacttcagctttctcttccaaaaccaacacccctcgccagtcagcctcccttcttccacaagcg

SEQ ID NO: 80894 - DNA, 201 bp, Bos taurus
gaactggttatcctgggggataatgtgggttgaggaagaagtgttttatgaacagaatcagcacaggggtaggaaggaggaggtgttcaggggcctcacgragctgccgggagatgtgggaagagcgtgcaggcaaagaggtgggctgtgtcgccggggtgactctctgccgacggcagcctccagctgggccttccgagg

SEQ ID NO: 80895 - DNA, 201 bp, Bos taurus
cactggaccaccagggaagtcccaaggccaagagatttaaaatgctagctcttggggcatgtggatttcaaggatggggtggtttccatgatgacaaggargaaggtggcctacatgaagaagaggttctaataagctgaggctgtcaggcagttttaaaaattaaattacatttttaataagcagtatattcccatggtt

SEQ ID NO: 80896 - DNA, 201 bp, Bos taurus; identical to SEQ ID NO: 40617

SEQ ID NO: 80897 - DNA, 201 bp, Bos taurus; identical to SEQ ID NO: 40619

SEQ ID NO: 80898 - DNA, 201 bp, Bos taurus
aacttgtacagtgtagaacattgctcaaaaaaaggagatctaaagaaaaggagagacatcctatattcacagatcagaagacttgatatagttaagatggmaatattcaccaaactgatctatggatttggcagaatccgtatcaaaatcccagcagtctttttgcagaaattgtcagaatgaccttaaaattcatataga

SEQ ID NO: 80899 - DNA, 201 bp, Bos taurus; identical to SEQ ID NO: 40620

SEQ ID NO: 80900 - DNA, 201 bp, Bos taurus; identical to SEQ ID NO: 40621

SEQ ID NO: 80901 - DNA, 201 bp, Bos taurus
agttttgacaactactgagagccaagcactaagtttcagagattctgaataaagtaatgtagggtctagtcttgaatatcctacagaaacagttagtgacyttctgccctcctgctccaaatgttggttgaaatatctattcaatctaacagcattccagcaacacatatatagatcaaattaaactaattaatatactat

SEQ ID NO: 80902 - DNA, 201 bp, Bos taurus
gattttggagcccaagaaaatgaagtcatctgggggcaggactgtgctcaaacaccttcccaggcttccttgaagctagcggtggccatgtgaaagcactyttgccgatgagaggtaagcagagttctgtcagagctttgtggggtagtttttgcttttgtgttaaagaggtaggctcagaactggccctctgagacttcc

SEQ ID NO: 80903 - DNA, 201 bp, Bos taurus; identical to SEQ ID NO: 40623

SEQ ID NO: 80904 - DNA, 201 bp, Bos taurus
agtaacatccagtgggaagctgaaagacacaagagttttccatgacacagtatgatttccccaatctaggtagcagcacaactgggagggtcaatggaatygctgtgcctacttgaagcagtggtgaagattcatagactgtaaaaaagatgacaggtgcccagctcagtagccttaccaaacacaaagtaaatcagagac

SEQ ID NO: 80905 - DNA, 201 bp, Bos taurus
acacagagggaaggccattcaaaagaggtggcacttgagtggtacaatgctgtgatttgtaataagaaatatgtatttggtcttcgtccacaatcctgctrgcagttctcaaaaccctaggaatttcctagtttggagagtgataaagtgtctatttttatgttaatgaggtgacttctggactacacctaagactgtggc

SEQ ID NO: 80906 - DNA, 201 bp, Bos taurus; identical to SEQ ID NO: 40632

SEQ ID NO: 80907 - DNA, 201 bp, Bos taurus
gaacattagaggcctggagataccagttaaacttcttagaaaatgctctgtatcttttctgtccagcacatcaaaaagtgtacaaggagatggcaacttaytagactacagcccagggaagtgggccctcagagagtcaagtcaggcatttatcagctgcccactggacatgttcaccttaacatagagaagggcctgtcc

SEQ ID NO: 80908 - DNA, 201 bp, Bos taurus; identical to SEQ ID NO: 40638

SEQ ID NO: 80909 - DNA, 201 bp, Bos taurus; identical to SEQ ID NO: 40639

SEQ ID NO: 80910 - DNA, 201 bp, Bos taurus; identical to SEQ ID NO: 40640

SEQ ID NO: 80911 - DNA, 201 bp, Bos taurus
ttgccctttccttctctggtagatcttcctggccctaggatcaaacccacatctcctgcattggcatgagagttctttactactgagccactagggaaacycaggaagggtagatgggtattgataaatggaaaatgtatccaaagggaagggcttggacacgtgacctcaatagccagcttcaacacgcaggcatgtttc

SEQ ID NO: 80912 - DNA, 201 bp, Bos taurus; identical to SEQ ID NO: 40642

SEQ ID NO: 80913 - DNA, 201 bp, Bos taurus; identical to SEQ ID NO: 40643

SEQ ID NO: 80914 - DNA, 201 bp, Bos taurus; identical to SEQ ID NO: 40645

SEQ ID NO: 80915 - DNA, 201 bp, Bos taurus; identical to SEQ ID NO: 40646

SEQ ID NO: 80916 - DNA, 201 bp, Bos taurus; identical to SEQ ID NO: 40647

SEQ ID NO: 80917 - DNA, 201 bp, Bos taurus; identical to SEQ ID NO: 40648

SEQ ID NO: 80918 - DNA, 201 bp, Bos taurus
caaattccctgttggacctgcaaggtggtagctgctcctcctaggcctgcctcttccagctcatgataaacaagaagttctcaaccaaaggtgattatacyctccagggaacatttggccatgtctggagacattcttgattgtcatcaactggagggtgagggacattctattagagcccagtgggtagaggccagagat

SEQ ID NO: 80919 - DNA, 201 bp, Bos taurus
gcctaagaagggcaataagcccgaggaaccggatgtcggcaacgagcgggcggaagtggtggtaggctaagctgattggcaccgggaaggctgatagggayctcaaactcaggcagctggggcaccgccttgtagctttaggttacaagtttttgtttacctgttttaatggacctccccccagtactgatccctcgtggc

SEQ ID NO: 80920 - DNA, 201 bp, Bos taurus
agcttgctagccagagctgccccaagacgggcttacttataatgctccaccccacaaaaatggagcccccatatctgtatcagctgacctcccctttgggyatggggccaggagttgggggtggggtgggggcaggctaaggaatttccattccctgggatctgacatctcaaacctcagtcctgaatgttaggatttctg

SEQ ID NO: 80921 - DNA, 201 bp, Bos taurus
actgaagtgagcggagaagtcagtccttcgcggtctcccaggcagtgcgtggcagagccggcctcagcacagtctaacgccaaagtgtcctgttggccgcyggacttaaagaaacctcgagggtcccatgaaaccaccttattccgctgcctgggtagcctcctcggctttaggaccggcgggcgtggggcactggagtgg

SEQ ID NO: 80922 - DNA, 201 bp, Bos taurus
ctatcttttaaagttactccttccccaggcccaagaaccacctacccgcaacatggtccagagagcaggtaagatcaggttcctgggcttccccagagccygtgggcccaccctgtcctccccacccctaccacatccacggccctgcccaccacagccttctcaaaccttctggaaacgccgtgacagccacttatccca

SEQ ID NO: 80923 - DNA, 201 bp, Bos taurus
agccccaaccagggccgcaccaagctaggaaacaaggtttaatgttttcgcttctccctgggttcttttgtagcgccgtagacctgtccctagtcttcccrtggcctcttttctatgcgtctgtctctctttgtctctgccagcttcactctttgttcctctgcctccgggcttgtttctcaccaggtgccctgcccagtt

SEQ ID NO: 80924 - DNA, 201 bp, Bos taurus
cttcctgttgccagctacatcaaccagaggcccactggtccctgcacactggagtctccctcctgccgcaaccttgcttagtcaatattttattcattcargagccacaggaaagggacttcttttctggtccagtgggtaacagtctgttctcccaatgcagggagcctgggtttgatccctggtcagggaaccattatt

SEQ ID NO: 80925 - DNA, 201 bp, Bos taurus
acttcagattgaggaatctaggcagcttgttggccctcagtcaaacgaagaatgggcgccccctagcagcagtaatcggtagtggacacggaaggatccaratgaggggcccgggcagagggggtgcggctcaagatagggtagacagccgggcatagttttcttctcacaggagctaactccttccggcatgatggacac

SEQ ID NO: 80926 - DNA, 201 bp, Bos taurus
tgtacactcagtcattaattctcctctctcagctgtgctcagcactcctgggcattgagtggcaggacctggggttcagcttgggaccaggccaaccttcytccaggcttcagaacccccaactcctgcccccaccgctgagtcagggagcagcctgtgcctgtggagagcattagcttaattgtgccctgggctgtggag

SEQ ID NO: 80927 - DNA, 201 bp, Bos taurus
aattggattgttctactttggggcacaagcccttagccctgacttggaaatatcctaaaaactcctgccatttatttccaaagcttggatttggggacttycctagtggtccagtggttaagactctgtccttccaatgcagggggtgtgagttcaatccctggttggggaactaagatctctcatgcctctgggctaaaa

SEQ ID NO: 80928 - DNA, 201 bp, Bos taurus
agggatcattgaaatattaacttttctaacaaagagggcatgtaaaaaaacattttatgcaaccattttgttttacaatcaaggaaaaatagtctcagggmggtcctgggcctgctcatttcatacagatgattagtgatggttagtgctggcccctgaatggtagagttcccagctcccaagttgccttctaggactttc

SEQ ID NO: 80929 - DNA, 201 bp, Bos taurus
tatagaaacaagcagttagtttgaaatacagcattaatggtttgttatatgtagaccagtgcacgctgggaatggttggccatggtgaagagcgcccatcrgctctgacacggaggagcatgaagccagccccagggagcagctggctcataggttaccagcaagacacagaacacaggacatccagtggccatgaaacat

SEQ ID NO: 80930 - DNA, 201 bp, Bos taurus
tttcttaggtcagggtctaaactcaggaagacttagaggagatttaagtcttcattgtgtgatatatgtagaaggtagtagaattaacacagtgggccgtmttctttccttcctaaaggttcatcttaaatgggttctagtcataacaggaaggagatggtcaagccattggcttttagaaatctccttgtctgttaggcc

SEQ ID NO: 80931 - DNA, 201 bp, Bos taurus
aaaaatttgttttcagacagacagtgaggcagactcttaaggagggagctggtgtgaggagagagcagacagtgaagcccagagctttcagtaattgcacytcggccccttctctctccctcctcagtgcagagcatcacagcactcagttatttagagtccacacactaaagacagggagcgactggttcacgcaaatgc

SEQ ID NO: 80932 - DNA, 201 bp, Bos taurus
ttatccagtgctgggaacctgagtgcttactatggccaagttttgttctctgtacttcccgtgttttaaaataagagggaggcactcaagatttctgatcyacagacaggaaggaggccctgagaggtttagatacttaaccgcggttgcacagctcataggtgcaactccaggactcaccccaggcagtcagctccaaaa

SEQ ID NO: 80933 - DNA, 201 bp, Bos taurus
agcgtgaggcacaaaaaccttcatcctttaacaatccagccaggtatggacagcagtgtgtccatcaacatcactgggtgacttctggttaaaagaaaacytttggctgagagaaatcttcaagcctatgtatttgtatggacaagaaggtctgaggaggagtaaatgcctgaaaagcaaataaggatatatttcctctgg

SEQ ID NO: 80934 - DNA, 201 bp, Bos taurus
taaacatcgaggtagttacatctacttcacaagatccttagaaatggattacttttatgctatggtctctgaacacactggccaaaaaaaataaaagccaygctcatgagaaaaactttgatgaaccccaccaagtagttacagaagaaatagcttctcctagggccaaaaatgagatcatgagaggtcatttcttttagg

SEQ ID NO: 80935 - DNA, 201 bp, Bos taurus
tttctgtttctctctcagaaaacaatccacttctgagcatcgttggaggccggttactgcgtctgcatgctgatgatggccgcgatgtgcccccatcccaygtggtcctctgccctgcatggggtcactttcatgttaggcaaatggctgaaatgtttggccagcagcagcacagataaagggaaatagtctttaaaattt

SEQ ID NO: 80936 - DNA, 201 bp, Bos taurus
caagagagcaggtgttgctcagagacagtcagggttctcaggaacccctggatgaactggatgtgaaggaaaataaagaggtggagacacatgttcaaaakctgtgtggccactggtcaggggaaatattttttaagctgctctacaaggcatgtggggtcttagttccctgactagggattgaacccatgccccctgcag

SEQ ID NO: 80937 - DNA, 201 bp, Bos taurus
acacaaataaactgaaaaagaaaaaaaaaggcctcggctcacactgtctcttcactgcttctcctcctaactgcctcaggttcttccacagatggcactgmatggcatggcaggcctcctcctcttgaaaactgagagtgaaaaactgtctttttaatggcaataatctcccactttgttgtcctcaccatctctgaattt

SEQ ID NO: 80938 - DNA, 201 bp, Bos taurus
aataaaggtcagcacatgtgggatgtgggtctgtagaccctagggccatctctgcccctgtcactgatggccttagacaaatctctgccgcaaagcacackcatgtaaaacagggacgtgactgaagggtgtctgggccccttggagctctcaaatttcaagctcctctccctgcagctccagtgtgaaaacatacatacc

SEQ ID NO: 80939 - DNA, 201 bp, Bos taurus
agccagcatagcaaatggagagaagtcaccctaaattgacagccatgctacaaaggtacccgacatggacaatattgaattgtgaagctaaaactcatttyctaaagtatcacctctttaaaacaaaagtatcagtcaaccatcctgaaagaaagaccaaattgcctctcaattctctcaacagaaaaggatattccagat

SEQ ID NO: 80940 - DNA, 201 bp, Bos taurus
aggggaggcaaagaagcaaggagaggccctgggccacgcctgctgaagaggggagggcacgtgggtgcagggaggagggcgggaagagcagcagagccaaraacctcatggagggaggcctgaagctttccctctgtttactgccacggtgatgtgctggacttggttcagtgtggaaaccacattttttccccagagata

SEQ ID NO: 80941 - DNA, 201 bp, Bos taurus
atttacccactacaaggtcattattgtagcaaatatgaatgagccttaaaggcctcacgaaaatctgtgggacagtggccaccaggcagtgcccctacccrtccatccacctgtatcttcctgaatgtttgatccccacatcaggactgcacacggcccacttttaaattattctattctaccttctagttagcttttcta

SEQ ID NO: 80942 - DNA, 201 bp, Bos taurus
cagccgggcaaccatgtcaatagccacgtccacaaattctatacattcattagttctaattgacgaggacgcggaggactgaaaaccaaagtctagccagmcttcccaaacacctgcccttagaatttactggatcaagaggctgaaaaagctgagggaagagggaatgaggaagggggaattggctttttagatgcttta

SEQ ID NO: 80943 - DNA, 201 bp, Bos taurus
aagatcctccggagaaggcaatggcaacccactccagtattcttgcctgagaatcccatggacagaggagtctggggggctactgtccacgggtggcaaaragtagaacacagctgaacaagtgagagcaacatcaaccaacatggagaggcttctgccaacaaatgcagggaaaggactgaagcagtgccacagcctagc

SEQ ID NO: 80944 - DNA, 201 bp, Bos taurus
tggctggtggagggagggggtgcacgcaggccgcgatgccccatgtgcctgctcattagtggctggcaggaaagcacaggaacgagtggacattggcacargctggctttctgttcttggagaaggccaaaaataatctcagtagatttaattaaaactgcagtgaacagatggggaagatggaaagaactccaactggag

SEQ ID NO: 80945 - DNA, 201 bp, Bos taurus
tatgctgaacaatgatatgtgtgaagaaagactcaaagtaagtttggactaaacgagtatttctggtaaaccaccaggaaagccacaccactaaacggtarcgtgggtctctgtcaaatgcagtgacagtcgctcacctcatgctgggtaccccagattgaagaactaacaagccagagatgtcaggaacacagaaactag

SEQ ID NO: 80946 - DNA, 201 bp, Bos taurus
tagagactagacactggacacccgtcccagccttggaggagcctgcctgtaggccgcttacacttgaaaccagagggcagccagaaggggtccttccaagmccagaaagaacatgatgggtgccgcctgctgaccttcagtctccagagatggatggtgtccatctgcacttgacctttccacgaggcgcgatcacgtttg

SEQ ID NO: 80947 - DNA, 201 bp, Bos taurus
tcccccggtgagcttaaccttgaagaagacactcaaagttagtttcctcccgagtcgtggaggaaggctggaaaagtgacttcagggtgtgactttcactycacaagaccttcctgtcatttcttctccctccctggggacaggtagacacatttgtatgtctgtctgtctttcagcgggaagatgagatcttagaactca

SEQ ID NO: 80948 - DNA, 201 bp, Bos taurus
cccccggctccgagctctccgggctgcagggagacagcagggtccttgcgcctctccaccagctcttctttgacctccacctgctcgtgaccactaaacakaagctttctctctgggtccctttattctctctgcagtgtcagctgtctcctctgacctccttggggtggcctttctcaagtgcatctgtaggggagctcc

SEQ ID NO: 80949 - DNA, 201 bp, Bos taurus
taaaactcaagcagcctagtgacgttctggaaaatatccatgaacataataagcacaggcccatagatgagagcagagctcaaaggaaagaaggctgaagygtaatgaaaaatgaacattgggccaaaaaacacaagctgaataggttgtcgtttcatcatttcctggcttgattttctggaatctatttgtatgaggggc

SEQ ID NO: 80950 - DNA, 201 bp, Bos taurus
ccgcagcccctggggagcctccgagaaaggccccttttgggaactaaggagtccatttggggaccatgattgcctctccaggatcagcctgctgggctgarcttgaggctggcccccacccacagggcaaaaagcagggaaagtagctcaagacttagtgattaaaggaatcaagtgtaaaacatgtcaaaagaacagtta

SEQ ID NO: 80951 - DNA, 201 bp, Bos taurus
aaatgtcagaaagaacatcacaggaagaggagaaatgggaaaggaaagattatttgttttgtcatttaaattctttcatttctttttaaaggcctacaaartggtttccagttcagaatacccactatattcacttgtgggattcccaaagataggtggagagggccaggctccacggagtgcagctcagccgcactcttt

SEQ ID NO: 80952 - DNA, 201 bp, Bos taurus
tttcagtggagtaagtgcaattactgccagtgaatgcattacaaagtacattattataccttaggtgagcccccaagtcttgcaaaaacttgtttatataygtaaaaccaaacagaagctgaaagtgggaggagagaaaagcaattttcattgaggagacaaaatatacttgctgaagtagaggaaacagttctactctga

SEQ ID NO: 80953 - DNA, 201 bp, Bos taurus
ctatacttgcagtttaggctggtcctcttctacaaggaccaaactacacagtacagccactaaagctttctactccctgtggtcaagtctgtgggaataaygcagtgaaacgagatctgttaagctccactcttaaagttccatccataaggctgtgaagccaacccctaccgcacaaatcttaaggcacaaagataatct

SEQ ID NO: 80954 - DNA, 201 bp, Bos taurus
ccgaagtagtggccaccaaaatgctggtcattcgtggctacacaaagaacacactgaaactgctaatgccgaagaagatgcagcctctgtatttggatttyagagattattattattcacttcttatatgtagactacatcatgagaaatgctggattggatgaagcgcaagctggaaatcaagattgacaggagaaagat

SEQ ID NO: 80955 - DNA, 201 bp, Bos taurus
gccaagcagagctgtaacaggacgcacccgtatctggctggagagcaaacaaggtaggctttcttcctctagcacacagcaggcaccacgccacacacacrcagtgtttgctatttttgcaagtctaatagggtctgctgcgggaggggtgagagatcaccagttcataatgactctcattatgtctggtacactttgagc

SEQ ID NO: 80956 - DNA, 201 bp, Bos taurus
caccactgctctcccacatgccacagtatttgagcttcgctagaaaatacaagtctcaggcagggtcccctgcctgaatacagacaaccgtgtttagcacrtcaggaccttgatacacacagtgcacaggatcagatctgcccgtttcctttcctctaccccagacgatctctccctacaagccagtctacctggacatca

SEQ ID NO: 80957 - DNA, 201 bp, Bos taurus
gacttctcagctaaaagactgtgatttggaaatttagatttctgtctcctgtatatagagaccgaacacaatcaggaactcacattctgtaactttggctkttttgtaaaagcttaagaatgctcttaacttgtggagtaacagtaaatacttaaggacctaagatatgacccactatctaggtattatacccacaccaga

SEQ ID NO: 80958 - DNA, 201 bp, Bos taurus
ttacagaaaaaccacttccctagtgaattccacctcagcagcaactcacttcatctttttaatttaattaagtacaaagaaagaaaacagaatgaaactcrgacaagctagcactgactgttaacgtccaggagtccctcatgtccctcctaaatcaaaatgcatattttaaagtaagctaaaaatgatacacaggcatta

SEQ ID NO: 80959 - DNA, 201 bp, Bos taurus
tcggactcttcaagaccccatggactgaagcctaccaggctcctctgtccatgggattttccaggcaagagtactggagtggggtgccattgccttctctrgtctaaccctatacgcatatataaagcagatagaactcttgtaagccagaatggttgtgagtctctcacttgcccagtaatgagacctaaatagagcgag

SEQ ID NO: 80960 - DNA, 201 bp, Bos taurus
cctcttgagctatgtgccgggtgttttcaagtttgcatttgaaggctggtggtttcacccagacaacctgatcagctgagtcagactggacaatagacaaygagaaagactttgatgtgggagggggtgtggatttcaataagatgggatggttaggagtgtcaaatgacacagagaatcctaaggttttaatagaaacct

SEQ ID NO: 80961 - DNA, 201 bp, Bos taurus
gggaaggttcaggaaaatgtggctggctgtgctttggcagcccaaacagagctaggccaggcctgagcacagggaagaaagtctctgagaggtctgtggamatgtagggcccccttcttggggaattgaggtcttggtgtgcgtgctgcattttaagtcgcttcagtagcgcctgactctgtgtgaccctatggtctatag

SEQ ID NO: 80962 - DNA, 201 bp, Bos taurus
cagctcacaagatgaagtaatgggcttgtctctgtctaggtagggaattctgccaagctctgtgttttaaataaaacgaggcttttgtggttcttggcacrggcccaccagtgcaggctaaccttggcatctgtgtgctgggctttctctagaatgtggctgagaatggacaagagctcatgggtgacccaagggaaggga

SEQ ID NO: 80963 - DNA, 201 bp, Bos taurus
gggaccttagtttctagacctgcaggcagaatcttcattctccgaccagggatcaaagcagcaccccctgcagtggaagtgtggaccaccagggagtcccycatcttaaccagttttataagtgaaaatgatagttggtcagtcatgttcgattctttgcaaccccatggactgtagcccaccaggctcctctgtccattc

SEQ ID NO: 80964 - DNA, 201 bp, Bos taurus
taatatgctgtctaggtttgtcatagctattcttccatggagcaggtgtctttaaatctcatggctgcatcaccgcccacggtcttgaacctaatctgatygagaccaaaagcactcagatgctccatctctccatccaaggacttgcctttgacttattctttgggcagctctgatccttacatggatgtccaagggctg

SEQ ID NO: 80965 - DNA, 201 bp, Bos taurus
ctccatcttcacacaccatcacttttccttccccaaacccatgcttccttcctttgtgcttcatgcttccttcctgttgcaccattctggctccccaggaygctggctttttcatgctacccaacccttgcatgtgctggtccctcagtctagtctgcatttctccatttgacatccctcagccaggagaacttttgtgct

SEQ ID NO: 80966 - DNA, 201 bp, Bos taurus
agcctcagaaggtaagatccaaagaagatccagagagacagtctacgggaaatacaaatgtgtagggggtcgactcatgtaccaccacccccaaacagtayatccaagttataaccactggtacctgattgtgccctttgcacaggtctttgcagatgttgtgaagttaggatgaggtgatcatgccataaatccagggac

SEQ ID NO: 80967 - DNA, 201 bp, Bos taurus
ttttcaggaggtaatttttacggttgaaaggcccactttcacatcatgctggtggtctgaaggcagaaccagagtatcaaagagagagaaagatgaatgcrtcttcttcaaatccacttcttggggcccgagcctccagaacagctttgtcaatcaggaagacgagcattcaggcaacgctttttcccttcaaggagccac

SEQ ID NO: 80968 - DNA, 201 bp, Bos taurus
gtagacagaaagcaacatattctattgaccactgaacttcagattgagaccctctgtcttatcctctgtctccatttctgctacatgaaatttcaattagrttcttcaacttttcaggtcagtctaggatagtaaatggctttccaggtggctcagcggtaaagagtccgcctgcaatgcaggagatgcaggagacagaca

SEQ ID NO: 80969 - DNA, 201 bp, Bos taurus
ccctgtgccctctgccccttgggccctggttcttgcagagcctcagcccctgtgacaccctgcattctcccctccgtctttcccatcacagcatctggtcrcggtggccatcttcttccatcttcctagatggcaatagctttggttcttctgtggggtgataacgaggaaagagtatgggatttttctttgaagactgtg

SEQ ID NO: 80970 - DNA, 201 bp, Bos taurus
agttgcaaactttcatagacatgaacacgtagcttactaatgaagacctgatggaatcagagacccagagaaaggacagagagacaagagggagaagtaayggaaaaaccaaagagattcatgctacaggaaatggcgaggggattttcttcatttgaggagacactgtcagtttctgagacacaagatccaaacacagaa

SEQ ID NO: 80971 - DNA, 201 bp, Bos taurus
tactgtagtgggttgccattaccttctccaggggatcttcctgacccagggattgaacccacatctcctgcattggcaggtgggttatttactgctgaggyacctggaaagccccaaaactgttttcagctaatacaaaacaaactgtggaatggacttggtcctacaggctgtgctttgtgtttggtgcacagtgttcct

SEQ ID NO: 80972 - DNA, 201 bp, Bos taurus
gtttgctataatcacattatcttccacatcccttgtttccccccacgctcaaattgagtaaatcacacctgcaatttaactcttaatcaagaggccctcgrgtctgacttcggagactgactttcctgcttctcttgtgtcaggtgtgaaaatgaagaatgtcttatttgctccgcggtgatgctcagaggctgtaaatca

SEQ ID NO: 80973 - DNA, 201 bp, Bos taurus
ttacaattcgcagtcaggcttatcagtggaggataaggagctcatgcaattgctctttaaatccttcgcaagaccccctttaggccacagaataaatttcrcaacagccttctttgaatgcctttccttctcatgcttggatgtgtaatctcatgggactgttcagttcagggccccacgcaagggaatcacagcaacaga

SEQ ID NO: 80974 - DNA, 201 bp, Bos taurus
aacccaatatatatggcatataacattatatatttgtattaatgtattatatcattattatattagcaagcacatcccctagtaaccgactacagagtggmaagtaaatgtacattcctccaaaagtcccaagtgataaacagtctcctttacctcccagggccttccctttataagcaccttaaataagacccccaagaa

SEQ ID NO: 80975 - DNA, 201 bp, Bos taurus
tgcaaagcctcacagttatgggaacctctcccagttgtttggccacctctctcttttatgagcttcaaagcctgatttattcactctcaaattcccgcagragggcgtagggcctataatttgggagcgtctctgctggggtggagcagaggatatctacgaggtaatgagcctgacagcccactcctacaggctcttcag

SEQ ID NO: 80976 - DNA, 201 bp, Bos taurus
aaggcacaagcccctgcgggatcacaggcaggctcccttggtctcctcctgcccctgctccagccttccagcacctgcgtgaggctcccttctcctgcccrggccccttttgctttcagaaccaacaaccttcacccacacacctgtctcaccctccttcctaactctttgcaaagcccgtgtgccttgcctctcagaaac

SEQ ID NO: 80977 - DNA, 201 bp, Bos taurus
gtgacccccacctcagctgcccaaatcaagtgggcccaggaggggcgcaatgcccaagggtccccactgtccaggtgatgtgcgtgggacaagtagcttcrgataatgaggcccccagcccctggcaggggacacacaagtttggagacaacagtgaggccaagaatgtttactttgaaaaatccattcgtcacagcccct

SEQ ID NO: 80978 - DNA, 201 bp, Bos taurus
ctctcgctgcagtggcgtctcttgtggaggctctgggcacgggcttcaggagttgcgccacacaggctcgctagctgaggtgcgccggcttagttgccccrtagtaacttggatcttcctaggccaagggttgaacccgtgtcttctttattgcaaggcagactgttcacccctggacccccaaggaagccctgctttttt

SEQ ID NO: 80979 - DNA, 201 bp, Bos taurus
actcccttttgccccctccacactaccataggatttaaccccaaaagcctctccagagctgatctggggtgacttatcagatcaggggcccccacttcccrcagttacatttccagcgaaggacaatgaggatttgtggtaggaagatgaacactatggctgctgcccttctgttaccaaagggaagtctaattatactat

SEQ ID NO: 80980 - DNA, 201 bp, Bos taurus
tgtctcagcagagagaagccagggaagcagactctgagctgctgagaaggggttcagcgttccctgcagaagcctgaggaaggaatcagggctctcgccayaggccagctccctcacctgggctttccaggtcagccgcttcatgtacacaccttgatttgtaaataggccaatattttaaattacattctagtgaaaaaa

SEQ ID NO: 80981 - DNA, 201 bp, Bos taurus
cccgctgggctccagccacatccgcctgactttgccccatcgcaccagcccttggcgtgtgctgtgcccactgcctggaatccaacgctctgatctttgcrcagctggtcacgctcatcattttggtctccatgcagatgcccctcctctggaaggcctcccttgacttcctgggttaaaataatgctccgcgacctgcag

SEQ ID NO: 80982 - DNA, 201 bp, Bos taurus
ggtgccctgggtgccatccggtgggggggtcctccacctggcagagctctcgagcaccacccctgccctctcagccatactcgccttggccacaagggackcaggtgtttggaaggaaacctgtatcgcttcctcctttctgtgtgtaagtgactattctgtgtgccaccttccctctctagctatgatcctggcaggaag

SEQ ID NO: 80983 - DNA, 201 bp, Bos taurus; identical to SEQ ID NO: 40650

SEQ ID NO: 80984 - DNA, 201 bp, Bos taurus; identical to SEQ ID NO: 40652

SEQ ID NO: 80985 - DNA, 201 bp, Bos taurus
cttgttgctgttcttgctgacacaactgctttattcgtttggctaaagaactcatggaaaaatcaaggggcactattttcttgttaattttcacagctacrtccactgtagctgacgcactctgggctttcaccgactctgcaaggacactgggatttaaaggaatcccttcttttgtaaaacgctttgcatttggggatg

SEQ ID NO: 80986 - DNA, 201 bp, Bos taurus
ccggaacatccactcgcatgggctttggagcaaccttcgggagatctttctacctgctactgcatgttacgagagaaaggagaaatagggctgggaagagkgctgctgcctttcaaatacagtcacatttatttatacacgtgggtacgctgtaagcgttggtctatttgtttttctggtttctgctgtgtttatgagttg

SEQ ID NO: 80987 - DNA, 201 bp, Bos taurus
tcagagccccctgcgggggcaggaacccactttcagaggccgctacccccatatttattagaggaaaatcagaaaggacagataatgccagtaaaaaaggraaaaaaccctcagccggccacaaagcatccctccgccccgatgcactgcagccccagcgtctgcgtatgctcttccagactcttttcttgggtgagaaaa

SEQ ID NO: 80988 - DNA, 201 bp, Bos taurus
gggagaatgccgtccctgcggccagccacaccagcattccggggagcgcagggtttgaccctgaattgggcaggattgccccaaagcgcggaacgctcagyccgcgccgcgacaaaggagcggccagggagcgctgagtccaaggttggcctgtcctttggttttaaaacaaagcgaaagaatattgtcagtcgggctgcg

SEQ ID NO: 80989 - DNA, 201 bp, Bos taurus; identical to SEQ ID NO: 40658

SEQ ID NO: 80990 - DNA, 201 bp, Bos taurus
gggtgagccaggactcctgactggtggcccacagggtcagcggagctgcgaggggtcagcctagaccagcgaaggctgtgaccagcccgtggctgtgagcrtctggaggccaacaccctgcaggaagataaagctggtgatccaggaggactagtgcagggggacgcagtggagtggcacgcacacattcacccacacaca

SEQ ID NO: 80991 - DNA, 201 bp, Bos taurus; identical to SEQ ID NO: 40665

SEQ ID NO: 80992 - DNA, 201 bp, Bos taurus
ttcttagaatttctaaaaattctttctagaactgcaacagttatgtgctcctgcatcaaagttcagacaacgcaggatgagacacaggcctcattcaggckaagcgagagggacaccaggacacagctctgctccccacaaagagcagagcctttgggcaacattcactccacacacctgcctttcttctacacatatggc

SEQ ID NO: 80993 - DNA, 201 bp, Bos taurus
tctccaggccggctcctctgacctgcacactgtgcctctcagagggcactgggactctccgtctctcgctttaggactagtttcatttcccctctcgaagygtacaggctcaagggccagagaatggctgtgtctcattcatttctgtatcttgaggagaccccctgggtggagggccttgcacagaacagtgactcagtg

SEQ ID NO: 80994 - DNA, 201 bp, Bos taurus; identical to SEQ ID NO: 40668

SEQ ID NO: 80995 - DNA, 201 bp, Bos taurus
ccttctctccctgctctcctttcttggggcaacagtgtggccagccctggggtcctccctgttggctcccctcctggccaggttagcatggccacatccakcaggaagggaggtctgagggtggcaaacacgggtctgacaattgttttcttgatcacattcatgttgcacttccagacaaaccaaaccagtgacaacttt

SEQ ID NO: 80996 - DNA, 201 bp, Bos taurus
ggtccactctctgtgtcgggggcctagtggcaggtgggaaggagcctcgggctgtggcccagacgtggcttccagtcatgactgcccacctgtgccggccygccatcacttcagcaatctgggagtcatttcttcccgatgaaatcagggtattaatgggattattttcaggcctgtcagctacattaaccataaaacgag

SEQ ID NO: 80997 - DNA, 201 bp, Bos taurus
gcctcccaggctgtgctccatctcctaggaggtctccctccgagtcacgctgtttctgtcctctgcaggcctttgtacacgggcagtacttagtccttgtygatttcgtgcttactctggttttgtatttagggggaaaaaaggagcaggaacaaatagataaagaacttgctcagactgtaagacttacaagtctgtggc

SEQ ID NO: 80998 - DNA, 201 bp, Bos taurus; identical to SEQ ID NO: 40673

SEQ ID NO: 80999 - DNA, 201 bp, Bos taurus
cttttttttttaatggtgttttatcaaactaaaaagtaaaaactccttaatatggtcagatagccagcctgtgtgcagatatcctacgttaccacagaacygtcgtgtttgtgtgagggtgtaagttaagtccttgccttacagttattaagctgtctctcaggtggagttccgtctccaggtgcttctgtcccttgctgc

SEQ ID NO: 81000 - DNA, 201 bp, Bos taurus
tgaggccagaacggcagagtcctgatttagaaagtcaggcagcgacgcaaacccgcaaacccttctctacagagcagagtggcgaggcctcccagcccgcrctggagagacagcaacagccttgctcttgtgggaagaaagaagaaaggagcccacactcctctatgcgtgtgtgctcagtcgagccccactctgtgcgac

SEQ ID NO: 81001 - DNA, 201 bp, Bos taurus; identical to SEQ ID NO: 40674

SEQ ID NO: 81002 - DNA, 201 bp, Bos taurus
gttggacacgaccgaagcgatgcagcaacagcaacactagcatgtcttccttgatggcaggcgttacgaggaggcggccaggccacagcacactgtgtgcygtttgcacaacacttgtggggtgcccagcacatgccaggcacacacgagggcaaagatgcctcgcctgccactagggccgtgagaccatgacatcacctc

SEQ ID NO: 81003 - DNA, 201 bp, Bos taurus; identical to SEQ ID NO: 40676

SEQ ID NO: 81004 - DNA, 201 bp, Bos taurus; identical to SEQ ID NO: 40683

SEQ ID NO: 81005 - DNA, 201 bp, Bos taurus; identical to SEQ ID NO: 40684

SEQ ID NO: 81006 - DNA, 201 bp, Bos taurus; identical to SEQ ID NO: 40686

SEQ ID NO: 81007 - DNA, 201 bp, Bos taurus
tttattcaatgccacggcctagtctggaaggtgtgttctgaagagtttctgaagcggtctccgttttccaggtttgaagctgcacagcgaggactgtggaygtgggcccagccctgcagctgtcctgagacgggggtgtcgcaaaggcggcgggagggagatgagtctgaccttcccacttggttgagtgtgaacgtctga

SEQ ID NO: 81008 - DNA, 201 bp, Bos taurus; identical to SEQ ID NO: 40687

SEQ ID NO: 81009 - DNA, 201 bp, Bos taurus
tgggttttactctaattcaggttcccacagaggacttaatgaacctttatggtaatgaacacccagtaaagttaaggtgtaatctatatgtgaaaagggcrtgagaaagaaactatccccagagataagactggcttttcattgagtacttcagaactaacagatctgtctcagcagttctattaaactggttggctacaa

SEQ ID NO: 81010 - DNA, 201 bp, Bos taurus
gctactgaatatagctcctgaatgtaatagtctatggttgaatgctggtcactgtgtctttgagttaatacttctagaaaatttcctttattttcatgtcrgagaagaataaaatggtaatatgtgataaggcctgatgttgcaatctgagtcaatgaaaaatttaagtcatctctagtcttttctctttctattggctat

SEQ ID NO: 81011 - DNA, 201 bp, Bos taurus; identical to SEQ ID NO: 40692

SEQ ID NO: 81012 - DNA, 201 bp, Bos taurus
atgagtttgaggtgttcaagcaaaaaagaaattattaattttaaatattttgatgtactggagttagggtggtgtttacggcctgctatagaagatgaatyagcagctcaggtgaggaaagggaattttgacctagcatttcctctgatacttcttgtaagtaaaggctggacctactgtcagagtgtagacgccttgtgg

SEQ ID NO: 81013 - DNA, 201 bp, Bos taurus; identical to SEQ ID NO: 40695

SEQ ID NO: 81014 - DNA, 201 bp, Bos taurus
gggttgaggatgaagtaaatacacagcaaaagtttgactatgtaagagagtcccttcattaaaaaaaaaaatagtgacaggagataatagtaaacaactcrgcacatggagttagtagaaaagtgttgacttcaaaaaaatcaacattatccattacactaagtttgtgagtgtgtgtgtgtgaataacgaggtggtatct

SEQ ID NO: 81015 - DNA, 201 bp, Bos taurus
cccattaggcccaatataatcataaagtcctcataaagaaaatagggtgactagagagttagagaagatgtgataacaaaaacggaggttgttggagtaayaccattgctggaagaaggccaggtgtcaaggaatgagggcaacttccagaagctaaaataggcaaggactggtttctgccctagagcctccagaaagaca

SEQ ID NO: 81016 - DNA, 201 bp, Bos taurus
tttcacccttgttgaacttctaacctacagaatctcaagataaaaatttatgttgttctaagtcaaaataaagtttaattttaaatttaaaaatatctttyctttctttttctaagtgtaattgtattatgtgcaatatttggggcatatttatactaagttttatgagttttttttaaattttcaattcaaatttaatta

SEQ ID NO: 81017 - DNA, 201 bp, Bos taurus; identical to SEQ ID NO: 40696

SEQ ID NO: 81018 - DNA, 201 bp, Bos taurus
ctaatcaaatcttaactggtgtccttgtaagaagaaatgaggtcatacagagacaccaggcacacacagactaaaagtcaagatcatatggaggcagagtragccaaggagagaggcctcagaaaaagtcaaacctgacaattccttgatctggaagttccagcctcctttggctttaccacctacttgtgattatgggga

SEQ ID NO: 81019 - DNA, 201 bp, Bos taurus
tgaagaacaccagctgagagcagacaggagtacctgaccagaggaaaagaatatataggcccacacaaaacttgctaggatgaaagaactagttggaaaarcaggagtgttagttggactagactgccctcagcaggtgggggaactgaagcaaaggtccaatccccacatcaaggcaattgtctgagtcagaggagaaac

SEQ ID NO: 81020 - DNA, 201 bp, Bos taurus
catttcagctcctcttacgtgtcttgggttctgcctctggcaatctaagaccaccgtggctgctcaggttgctgaatggccagttcttatgtgtgaccccyaaacatgcaagtattttaattaatgagtgggtttccctatgggaccattgcacagtataaggaactaggcctccaccactcccataaatttctcagtcac

SEQ ID NO: 81021 - DNA, 201 bp, Bos taurus
atccatggggacgtgcttttaagatttgttaggtggccctagacaagtgaaggcttccccagtggctcagtagtaaagaatcatcctgccaatgcaggagrcaaaagagaggccagttcgatccctgtgtaggtaagatcccctagaggaaacagcaatccattccagtattacctgagaaatcgcgtgtacagaggagct

SEQ ID NO: 81022 - DNA, 201 bp, Bos taurus
atcatattaaaagttgtaatgtagatgcctttaaaaaggcaagattatactaatttttgtaaaaaggagattatagtatgattaaacattaacattcaaaygctgatttaaattgtgcatatatttttctcatttcttattgaatttatgatcattgatgagtcacttaagtaaatgtaagccacaccctaaaatttatgt

SEQ ID NO: 81023 - DNA, 201 bp, Bos taurus; identical to SEQ ID NO: 40700

SEQ ID NO: 81024 - DNA, 201 bp, Bos taurus; identical to SEQ ID NO: 40701

SEQ ID NO: 81025 - DNA, 201 bp, Bos taurus; identical to SEQ ID NO: 40702

SEQ ID NO: 81026 - DNA, 201 bp, Bos taurus
tatattaacatccatcaataaactgattgccaaaataccacattaaaataatatatatcataaaggttccttattctaaggtggacatcaatgagatattrgatatctgaagagggcttccctggtggctcagatggttaagaatctgcctgcaatgcaataaactggaattctatctcttgatacagaagattccctgga

SEQ ID NO: 81027 - DNA, 201 bp, Bos taurus; identical to SEQ ID NO: 40703

SEQ ID NO: 81028 - DNA, 201 bp, Bos taurus; identical to SEQ ID NO: 40705

SEQ ID NO: 81029 - DNA, 201 bp, Bos taurus
ttgtaagaaaccaccttatgtgcagaattttgtttgaagggccattggttacacaaaattagtttcatagatccttaccaaaatgtgttttctcaagtcartagtatttgagggccaccatttcctgcagtctatcaatattattgagtattatcaataatataaaatcaagaatataatcaagaatcaagaatataattg

SEQ ID NO: 81030 - DNA, 201 bp, Bos taurus; identical to SEQ ID NO: 40707

SEQ ID NO: 81031 - DNA, 201 bp, Bos taurus; identical to SEQ ID NO: 40708

SEQ ID NO: 81032 - DNA, 201 bp, Bos taurus
tcacaagacccacatctgtggaggtcctcttctgtctcatggacccctttattccctacaatttgaaagtttttgttctcacacatatttaatcattaatrtctaaaacagtctggatccacaaaacttggttgacaaagtaaatggattaaaatgaaaaagtggataaatttcataattaactttttacaattatgtgtg

SEQ ID NO: 81033 - DNA, 201 bp, Bos taurus
gagcaaagaaaggaagtttcatttattattctacaatgtgttggtgtattcagtaattgactttgaggaccagggtattattgctaaatagaaatattgamacgcacatatcaagatggacattgtaaattgataggaaacttgcttggagttcataataggtttttatgctgtataaattaatactttatagttcatctc

SEQ ID NO: 81034 - DNA, 201 bp, Bos taurus; identical to SEQ ID NO: 40716

SEQ ID NO: 81035 - DNA, 201 bp, Bos taurus; identical to SEQ ID NO: 40717

SEQ ID NO: 81036 - DNA, 201 bp, Bos taurus; identical to SEQ ID NO: 40718

SEQ ID NO: 81037 - DNA, 201 bp, Bos taurus; identical to SEQ ID NO: 40719

SEQ ID NO: 81038 - DNA, 201 bp, Bos taurus; identical to SEQ ID NO: 40720

SEQ ID NO: 81039 - DNA, 201 bp, Bos taurus; identical to SEQ ID NO: 40721

SEQ ID NO: 81040 - DNA, 201 bp, Bos taurus; identical to SEQ ID NO: 40722

SEQ ID NO: 81041 - DNA, 201 bp, Bos taurus; identical to SEQ ID NO: 40723

SEQ ID NO: 81042 - DNA, 201 bp, Bos taurus; identical to SEQ ID NO: 40724

SEQ ID NO: 81043 - DNA, 201 bp, Bos taurus; identical to SEQ ID NO: 40725

SEQ ID NO: 81044 - DNA, 201 bp, Bos taurus; identical to SEQ ID NO: 40726

SEQ ID NO: 81045 - DNA, 201 bp, Bos taurus; identical to SEQ ID NO: 40727

SEQ ID NO: 81046 - DNA, 201 bp, Bos taurus; identical to SEQ ID NO: 40728

SEQ ID NO: 81047 - DNA, 201 bp, Bos taurus; identical to SEQ ID NO: 40729

SEQ ID NO: 81048 - DNA, 201 bp, Bos taurus; identical to SEQ ID NO: 40731

SEQ ID NO: 81049 - DNA, 201 bp, Bos taurus; identical to SEQ ID NO: 40732

SEQ ID NO: 81050 - DNA, 201 bp, Bos taurus; identical to SEQ ID NO: 40733

SEQ ID NO: 81051 - DNA, 201 bp, Bos taurus; identical to SEQ ID NO: 40734

SEQ ID NO: 81052 - DNA, 201 bp, Bos taurus; identical to SEQ ID NO: 40735

SEQ ID NO: 81053 - DNA, 201 bp, Bos taurus; identical to SEQ ID NO: 40736

SEQ ID NO: 81054 - DNA, 201 bp, Bos taurus; identical to SEQ ID NO: 40737

SEQ ID NO: 81055 - DNA, 201 bp, Bos taurus; identical to SEQ ID NO: 40738

SEQ ID NO: 81056 - DNA, 201 bp, Bos taurus; identical to SEQ ID NO: 40739

SEQ ID NO: 81057 - DNA, 201 bp, Bos taurus; identical to SEQ ID NO: 40740

SEQ ID NO: 81058 - DNA, 201 bp, Bos taurus; identical to SEQ ID NO: 40741

SEQ ID NO: 81059 - DNA, 201 bp, Bos taurus; identical to SEQ ID NO: 40742

SEQ ID NO: 81060 - DNA, 201 bp, Bos taurus; identical to SEQ ID NO: 40743

SEQ ID NO: 81061 - DNA, 201 bp, Bos taurus; identical to SEQ ID NO: 40744

SEQ ID NO: 81062 - DNA, 201 bp, Bos taurus; identical to SEQ ID NO: 40745

SEQ ID NO: 81063 - DNA, 201 bp, Bos taurus; identical to SEQ ID NO: 40746

SEQ ID NO: 81064 - DNA, 201 bp, Bos taurus; identical to SEQ ID NO: 40747

SEQ ID NO: 81065 - DNA, 201 bp, Bos taurus; identical to SEQ ID NO: 40748

SEQ ID NO: 81066 - DNA, 201 bp, Bos taurus; identical to SEQ ID NO: 40749

SEQ ID NO: 81067 - DNA, 201 bp, Bos taurus; identical to SEQ ID NO: 40750

SEQ ID NO: 81068 - DNA, 201 bp, Bos taurus; identical to SEQ ID NO: 40751

SEQ ID NO: 81069 - DNA, 201 bp, Bos taurus; identical to SEQ ID NO: 40752

SEQ ID NO: 81070 - DNA, 201 bp, Bos taurus; identical to SEQ ID NO: 40753

SEQ ID NO: 81071 - DNA, 201 bp, Bos taurus; identical to SEQ ID NO: 40754

SEQ ID NO: 81072 - DNA, 201 bp, Bos taurus; identical to SEQ ID NO: 40755

SEQ ID NO: 81073 - DNA, 201 bp, Bos taurus; identical to SEQ ID NO: 40756

SEQ ID NO: 81074 - DNA, 201 bp, Bos taurus; identical to SEQ ID NO: 40757

SEQ ID NO: 81075 - DNA, 201 bp, Bos taurus; identical to SEQ ID NO: 40758

SEQ ID NO: 81076 - DNA, 201 bp, Bos taurus; identical to SEQ ID NO: 40759

SEQ ID NO: 81077 - DNA, 201 bp, Bos taurus; identical to SEQ ID NO: 40760

SEQ ID NO: 81078 - DNA, 201 bp, Bos taurus; identical to SEQ ID NO: 40761

SEQ ID NO: 81079 - DNA, 201 bp, Bos taurus; identical to SEQ ID NO: 40762

SEQ ID NO: 81080 - DNA, 201 bp, Bos taurus; identical to SEQ ID NO: 40763

SEQ ID NO: 81081 - DNA, 201 bp, Bos taurus; identical to SEQ ID NO: 40764

SEQ ID NO: 81082 - DNA, 201 bp, Bos taurus; identical to SEQ ID NO: 40765

SEQ ID NO: 81083 - DNA, 201 bp, Bos taurus; identical to SEQ ID NO: 40766

SEQ ID NO: 81084 - DNA, 201 bp, Bos taurus; identical to SEQ ID NO: 40767

SEQ ID NO: 81085 - DNA, 201 bp, Bos taurus; identical to SEQ ID NO: 40768

SEQ ID NO: 81086 - DNA, 201 bp, Bos taurus; identical to SEQ ID NO: 40769

SEQ ID NO: 81087 - DNA, 201 bp, Bos taurus; identical to SEQ ID NO: 40770

SEQ ID NO: 81088 - DNA, 201 bp, Bos taurus; identical to SEQ ID NO: 40771

SEQ ID NO: 81089 - DNA, 201 bp, Bos taurus; identical to SEQ ID NO: 40772

SEQ ID NO: 81090 - DNA, 201 bp, Bos taurus; identical to SEQ ID NO: 40773

SEQ ID NO: 81091 - DNA, 201 bp, Bos taurus; identical to SEQ ID NO: 40774

SEQ ID NO: 81092 - DNA, 201 bp, Bos taurus; identical to SEQ ID NO: 40775

SEQ ID NO: 81093 - DNA, 201 bp, Bos taurus; identical to SEQ ID NO: 40776

SEQ ID NO: 81094 - DNA, 201 bp, Bos taurus; identical to SEQ ID NO: 40777

SEQ ID NO: 81095 - DNA, 201 bp, Bos taurus; identical to SEQ ID NO: 40778

SEQ ID NO: 81096 - DNA, 201 bp, Bos taurus; identical to SEQ ID NO: 40779

SEQ ID NO: 81097 - DNA, 201 bp, Bos taurus; identical to SEQ ID NO: 40780

SEQ ID NO: 81098 - DNA, 201 bp, Bos taurus; identical to SEQ ID NO: 40781

SEQ ID NO: 81099 - DNA, 201 bp, Bos taurus; identical to SEQ ID NO: 40782

SEQ ID NO: 81100 - DNA, 201 bp, Bos taurus; identical to SEQ ID NO: 40783

SEQ ID NO: 81101 - DNA, 201 bp, Bos taurus; identical to SEQ ID NO: 40784

SEQ ID NO: 81102 - DNA, 201 bp, Bos taurus; identical to SEQ ID NO: 40785

SEQ ID NO: 81103 - DNA, 201 bp, Bos taurus; identical to SEQ ID NO: 40786

SEQ ID NO: 81104 - DNA, 201 bp, Bos taurus; identical to SEQ ID NO: 40787

SEQ ID NO: 81105 - DNA, 201 bp, Bos taurus; identical to SEQ ID NO: 40788

SEQ ID NO: 81106 - DNA, 201 bp, Bos taurus; identical to SEQ ID NO: 40789

SEQ ID NO: 81107 - DNA, 201 bp, Bos taurus; identical to SEQ ID NO: 40790

SEQ ID NO: 81108 - DNA, 201 bp, Bos taurus; identical to SEQ ID NO: 40791

SEQ ID NO: 81109 - DNA, 201 bp, Bos taurus; identical to SEQ ID NO: 40792

SEQ ID NO: 81110 - DNA, 201 bp, Bos taurus; identical to SEQ ID NO: 40793

SEQ ID NO: 81111 - DNA, 201 bp, Bos taurus; identical to SEQ ID NO: 40794

SEQ ID NO: 81112 - DNA, 201 bp, Bos taurus; identical to SEQ ID NO: 40795

SEQ ID NO: 81113 - DNA, 201 bp, Bos taurus; identical to SEQ ID NO: 40796

SEQ ID NO: 81114 - DNA, 201 bp, Bos taurus; identical to SEQ ID NO: 40797

SEQ ID NO: 81115 - DNA, 201 bp, Bos taurus; identical to SEQ ID NO: 40798

SEQ ID NO: 81116 - DNA, 201 bp, Bos taurus; identical to SEQ ID NO: 40799

SEQ ID NO: 81117 - DNA, 201 bp, Bos taurus; identical to SEQ ID NO: 40800

SEQ ID NO: 81118 - DNA, 201 bp, Bos taurus; identical to SEQ ID NO: 40801

SEQ ID NO: 81119 - DNA, 201 bp, Bos taurus; identical to SEQ ID NO: 40802

SEQ ID NO: 81120 - DNA, 201 bp, Bos taurus; identical to SEQ ID NO: 40803

SEQ ID NO: 81121 - DNA, 201 bp, Bos taurus; identical to SEQ ID NO: 40804

SEQ ID NO: 81122 - DNA, 201 bp, Bos taurus; identical to SEQ ID NO: 40805

SEQ ID NO: 81123 - DNA, 201 bp, Bos taurus; identical to SEQ ID NO: 40806

SEQ ID NO: 81124 - DNA, 201 bp, Bos taurus; identical to SEQ ID NO: 40807

SEQ ID NO: 81125 - DNA, 201 bp, Bos taurus; identical to SEQ ID NO: 40808

SEQ ID NO: 81126 - DNA, 201 bp, Bos taurus; identical to SEQ ID NO: 40809

SEQ ID NO: 81127 - DNA, 201 bp, Bos taurus; identical to SEQ ID NO: 40810

SEQ ID NO: 81128 - DNA, 201 bp, Bos taurus; identical to SEQ ID NO: 40811

SEQ ID NO: 81129 - DNA, 201 bp, Bos taurus; identical to SEQ ID NO: 40812

SEQ ID NO: 81130 - DNA, 201 bp, Bos taurus; identical to SEQ ID NO: 40813

SEQ ID NO: 81131 - DNA, 201 bp, Bos taurus; identical to SEQ ID NO: 40814

SEQ ID NO: 81132 - DNA, 201 bp, Bos taurus; identical to SEQ ID NO: 40815

SEQ ID NO: 81133 - DNA, 201 bp, Bos taurus; identical to SEQ ID NO: 40816

SEQ ID NO: 81134 - DNA, 201 bp, Bos taurus; identical to SEQ ID NO: 40817

SEQ ID NO: 81135 - DNA, 201 bp, Bos taurus; identical to SEQ ID NO: 40818

SEQ ID NO: 81136 - DNA, 201 bp, Bos taurus; identical to SEQ ID NO: 40819

SEQ ID NO: 81137 - DNA, 201 bp, Bos taurus; identical to SEQ ID NO: 40820

SEQ ID NO: 81138 - DNA, 201 bp, Bos taurus; identical to SEQ ID NO: 40821

SEQ ID NO: 81139 - DNA, 201 bp, Bos taurus; identical to SEQ ID NO: 40822

SEQ ID NO: 81140 - DNA, 201 bp, Bos taurus; identical to SEQ ID NO: 40823

SEQ ID NO: 81141 - DNA, 201 bp, Bos taurus; identical to SEQ ID NO: 40824

SEQ ID NO: 81142 - DNA, 201 bp, Bos taurus; identical to SEQ ID NO: 40825

SEQ ID NO: 81143 - DNA, 201 bp, Bos taurus; identical to SEQ ID NO: 40826

SEQ ID NO: 81144 - DNA, 201 bp, Bos taurus; identical to SEQ ID NO: 40827

SEQ ID NO: 81145 - DNA, 201 bp, Bos taurus; identical to SEQ ID NO: 40828

SEQ ID NO: 81146 - DNA, 201 bp, Bos taurus
agtctgtttgtttaaatttttctttccctccgcttctcaccatgactcgactttgggtaaaccgtacctccccatccactgacggcaggcctggacagacrattttctgcagccagtggaaactgggagagtgtgagatcccacagttctgagccaaacctgtaagaaacacggtgtgtctctctggatcacctgcatcca

SEQ ID NO: 81147 - DNA, 201 bp, Bos taurus
ataaagcgcagaataatacctatatgggcaataaaagcatgctggagactcaggttcaaataatgtattgaaaccattgttaagtactacttcaaaatgargttcaaggatggtatcagatatgaaagaaagcaaaagtcgtaattcaaaaaatttcagaaatgagtgacagaactgagggaaaaatcggaaatttaaaag

SEQ ID NO: 81148 - DNA, 201 bp, Bos taurus
gggctcacagcactgacatcctcagccctccttgtgcaacgggcctgtgggtccagaatacacacgtgcaagaaagcctgtgtcttggggtcacccacccyggtgcctcactccttctggggtgggcctgagcccaaacacaggtgccttgaccttcccccaacccagagcaaaggcagcagcatctccagtccggagctc

SEQ ID NO: 81149 - DNA, 201 bp, Bos taurus
gctggagcaggagtctgagcaggcaggcagctccaacaaggggacagctgtccaccccccagtctctgagcaggaaggcagggcccacaggagcacagccrcctgctcgctctgctcctgtccgtccactgtgacttcttctcatccctgggtgtccacggcggggcctgggtcctacagcctcagtgtcaggcccaccga

SEQ ID NO: 81150 - DNA, 201 bp, Bos taurus
agcaccatcttcccgaggacatgctgggccgtcacctcgccacctgtgtgcagcatcgcatcataaaccatgaggaggaggaggcagccgtgcggcacccrgacggggctggtgtccaccgagtggccctcacatgcccactgccgcccctgtaactggcctgccaggtcctgccgccaagtgtgcccctaaagatgcata

SEQ ID NO: 81151 - DNA, 201 bp, Bos taurus
tggtgggtgctgagccttttctgggcacccagaggaaagcccacccaccaggccagaccccaggagagaccaagcattccttgctggcccctcggaccccyttcaccactgcaaggtcacaggtcctcacacacgtgcacacgtgctcatattcagcccccaggcctcccctttgttcctaccacccaagggccctggctc

SEQ ID NO: 81152 - DNA, 201 bp, Bos taurus; identical to SEQ ID NO: 40829

SEQ ID NO: 81153 - DNA, 201 bp, Bos taurus
ggatgggttgataaaagacaattagatttatgggaccccaaggacaattttctgtttgtatcctttgtgctgtggacttttaatttcttagtataggctaygatgcttttacatttctagtggtattgtgcactgggacattaggtaaggaggttagttaataagatgcccctttggtacattagagtcttgaagctccct

SEQ ID NO: 81154 - DNA, 201 bp, Bos taurus
ctagtttacctgtatagagtgcatgtcagtgtgtcttttgtagtatgtctccaggtccaatgtgaactgtcatggttctggggtacacttaaggaagggayattcctttctggcttattggctttcatacatggttctgtacatacttagaatcttcttggaaggtaaagttattagaaaatagaagtaaatgtagttgtt

SEQ ID NO: 81155 - DNA, 201 bp, Bos taurus
gaaccatgtcatgtgactgagtcctcatcatggacacagacattttatctgtcacttctaagtcacagttagtcacatgatatgtgtcgcactggtccagygtactctttttatctcagtaatgattgtaaggtatagtctctggattatgccgccctgaagacttcactcttcttcaaggaactggttatgaatcagtgg

SEQ ID NO: 81156 - DNA, 201 bp, Bos taurus
gtaaatttgttagaatgactgtgaggaaggaaagcaagagttcaaataataacaataataatagtggtaatgatagagttgactatgggaagttactgttytaagagtattatattttaaatcatttaatgcccagaaaaactcactgaaggaggtagtgttttagctttctctcctagaggaggaaacagaagcccagag

SEQ ID NO: 81157 - DNA, 201 bp, Bos taurus
ttgaatctcaatttacatttccttaagtaactcacatgactacaaaatgtcatgcttttgtgcatcctgttctttcctggcaaactcctattcaccctgtraaacctgaatcccagaggcacagaggaaactggaagctaaattcctctcccactcatgtggagcattcttgactcaggtgtggatggtaaatgagggcag

SEQ ID NO: 81158 - DNA, 201 bp, Bos taurus
atttcgatatatggcaaaaccaatacaatattgtaaagttaaaaaataaaataaagaaaaaaaaaaagatgattatcctagcttatccaggtaggccctarattaagtgacaaatatccttataagagacacagaaaggaaagatgctgggagaaaaggaggacatgtgaaaatggaagcagacactggcatgtagtcaca

SEQ ID NO: 81159 - DNA, 201 bp, Bos taurus
atatttatattcttaaaaggttcatatatagctccaggtaaccatacagatttatatacattctttccctaaaattttaaattataccatctgttaaccayattatgactaattagcaagatcactgcatactatatctccaacaacaacaggagatatctagagctattatataggactggctctttaataaatgtactc

SEQ ID NO: 81160 - DNA, 201 bp, Bos taurus
actatttatcatagttaagacatggaagcaacttaagtagccatcaacagacaaatggataacgaaaaagcatatggtatattgcttagccataaaaaagratggaattatgccacttgcagaaagtggatggacctagaaaatattatgcttagtgaagtaatttagacaaaaaagataaacactatatgatatcactta

SEQ ID NO: 81161 - DNA, 201 bp, Bos taurus
tccatctttttcccttcttttttccttctctcccccttcctctcctccttctaccccagtactgcttgtctctggtctttattctcagttcaaattctcartagataatctaattaaccaacctatgaatggatgtcaatcccaagtcagctgtcccttcacattccaatcaacagtgaccactgagaataggataatcta

SEQ ID NO: 81162 - DNA, 201 bp, Bos taurus
aatattgggtagattccttgtattgtacaatacgtcctttagcctatcttatacccaaaatttgtgtctcccactcctaactttattgttcccctgcaacyagtaaccactaattcgttctctgtatatgagtcttcttctttttctttttattcactagtttgttgcattttttagatttcacatataagtgatatcata

SEQ ID NO: 81163 - DNA, 201 bp, Bos taurus
cacaggtaactcaccatggagaccattgctatagactgaggattcctggggcatccttaacatttaaaatgttaaatctttaacactttcctccacaggargccagagagcagattcttaattaaatttttaatgaatgaatgagttcaacaaatatttattgaatgccaataatgtgccaggggtagttctaggtgatga

SEQ ID NO: 81164 - DNA, 201 bp, Bos taurus
aacagcctattcatgtcactctctgcttttcccctggaggaggagtgggaaggaagagacttccagctagtgggaattatccacagggttggccgaaagtyagcatcttcaggtcagcttctgtcagcctgaatccctggagttctccaggaagtactagctgcagccaaccccacacagaagctgcctcaaagccctctg

SEQ ID NO: 81165 - DNA, 201 bp, Bos taurus
gaaatgaaataagctggcaaatgcccaaatggcacataatcatttccagacagattaagaaaacctcagaaggtgttatttttaaaactaagatgctcttytgtggcaacagaccatgctgctctggggatgtcttccaataaagaatatttccatcagaaaaggaatttcaaccaatgtgattttgtccccagaaaaagg

SEQ ID NO: 81166 - DNA, 201 bp, Bos taurus
tgttcatttcattaagtgatttaaaaagctattttccgaccttgatgcattatggaaatgacagagactaatttgccttgaagagtaatcttctggaaatyagaactttgatctcaatgatgttgccaaacacacactggagaaagaactccatatacccctttaactaagacttttgcgcttcttttgtgcttgagttta

SEQ ID NO: 81167 - DNA, 201 bp, Bos taurus
acaatgagtttggaagtgttccttcctctgcaaatttttggcagagtttgaggacaggcattaattcttctctaaatgtttgatagaattcaccagtgaarccatctctggccctgtgcttctgtttttggggagagacttttgatcacagtttcaatttcagtccttgtgattggcttattcataatttctatttcttcc

SEQ ID NO: 81168 - DNA, 201 bp, Bos taurus
atcaatgtttcatgtttccaggtcatttcactgcttatgaagggactgccctcagctaggagacaatggtggatatgagcatataggatagtcaattgggygattgtgacacctctgcactcatgtgctgctacctgaaagctcagtccttgtgacttagaccatcacaggactctgcaagtttagatgttcacagggctt

SEQ ID NO: 81169 - DNA, 201 bp, Bos taurus
tgggggtactccaggagttggtgatgtacagggaggcctggcctgctgcggttcatggggttgcaaagagttggacacgactgagtgactgaactgaactkaactgagagagatgttaaggcctaaggaggtaactttccaggtcacataaaggcacatttagaggtcatgacatgagaaataatttagaatgttcaataa

SEQ ID NO: 81170 - DNA, 201 bp, Bos taurus
cagtgctaaggctggattcagcatctgaatgtgtcccatgtatttcatctcttttctttttgacagtgtatatgctgcttttattcacctctgtattcacrtggaacatgaattaatactgtccgaagactttgaagcttgaaatagttgtaagagatgatgacccgtggagtagtgaagcctttctttccctctgctctt

SEQ ID NO: 81171 - DNA, 201 bp, Bos taurus
ggatccacaggcatctggaaattcaaaaatatcagggcatactcacaaacagcctccaaaatatcaccagctctgcaaaacaggtgtaaaatgaaaacttkctcctgctggataagataatcttctcattagctccaagccaagagcaaaagtgaaacacctcattaaaaattctcacttttgtatgtcttctaacccatg

SEQ ID NO: 81172 - DNA, 201 bp, Bos taurus
ttgtctagtttgtatgagtcaaacccattctatgctgagtcattcaataaattcctttctttgtactttataatggaagataaccaagtaataagaagtgycattatttctgaaaactaaagctacatagaagattgggtagggaaaaggaatgctgagatcagtgtgcctccttaaatatttaatcagtttaaaacagtt

SEQ ID NO: 81173 - DNA, 201 bp, Bos taurus
aggatgctgcattttcctttgattatcacaaatggtttttaaattttttaggctatattgaaagaagttggattatggcatctataaagcttttggagaayatttttattttattttctttctgtgtgccacaaaatctatcaatgagaattctaaaggtcaaagaatactttttctacatagataggtttatcgtactat

SEQ ID NO: 81174 - DNA, 201 bp, Bos taurus
tcattccctattccaaggccaaatttgcctgtgactccaggtgtttcttgacttactacttttgcattccagtcccctataatgaaaaggacatcttttcytacacaaaaatggccctctgattcccagctagagatgagcagaggtagatgaatctctgctttcatctctgttctgttttatatctttgtcctgtgctta

SEQ ID NO: 81175 - DNA, 201 bp, Bos taurus
catatgactattcaacaagcgaattaagggatgttcaacatcaaaaatcactagagagaaatacaaatcaaaatctcatacccactaggatggccactaaygaaaacacaagcaaacaaaccaattaacaaacaaccctagaaagtgactagtgttgtggaggatgggagaggaagtagaagcctggtgcattgctagtag

SEQ ID NO: 81176 - DNA, 201 bp, Bos taurus
tttgctgtttcaacacagaacacctgattatgtgccatgcactgttctagttgagaatatactctggaatgattaagagggccaaagtcaccactcttgcragtttagatcagatcagatcagatcagtcactcagtcatgtccgactctttgcgaccccatgaatcggagcacgccaggcctccctgtccatcaccaact

SEQ ID NO: 81177 - DNA, 201 bp, Bos taurus
aatttaatttgatgggcacttatcatatagatgagaattcttttaaataaactaagaattctggggaccattttggtttatgtaagaaaaactcttctcaytctttcaaaaaatgtattgatcaaaatagatctattggaatcataattatcttcctcattatcagtatcttcatattcctcttggatttctttcttgggg

SEQ ID NO: 81178 - DNA, 201 bp, Bos taurus
gcttctcttgcttcccagatctgtgtgtgcttcccaggttagaggtgacaaaggacagccctgtggcagatctggcccctaacctgtatttataaataaarctttattggaacacagccatccagatgatagctgcttccaggctacaacagcagagttgaataattgtgacagagaccatctggcccacagagcctaaaa

SEQ ID NO: 81179 - DNA, 201 bp, Bos taurus
ctgatcctatccttggttttctctccagagcatgctttagtatctgtagtaatatggatatacagaattttccaaaccacttagttctggttcctttttargtaattgtccctccatctctttcctctcacattttactattagtagcaagcagacactaggctgtaccacacactgcttataaacatcaaagttcattgt

SEQ ID NO: 81180 - DNA, 201 bp, Bos taurus
tccatcttctgccatctgtcttggccacttcagtgcacggtgcagagatggttgctgaacacttgaaaacaatctttctctgcattcaagtcacacatgtrgaaatcatcaggcccacatctcctgatatcatttagtcctaatgctgaccgccaactgaataggtctgcatttcaaggcctggcttcttgttgcagatct

SEQ ID NO: 81181 - DNA, 201 bp, Bos taurus
gttcttctgtgacgatggctgtgcctggaggaggggagcaaaggaatgagagaggttcctgacaaacacctagaagctgcccagaatggcagcaggcaggygagcacagtgagaggccccagactccgtttggccccccacccacccccactttgaggggagcaggtaggcctctgactccaaggaaacctccaggcaaga

SEQ ID NO: 81182 - DNA, 201 bp, Bos taurus
atgttgttgaatgagtagcaacacccagtctggaaaagagctcagtggaggtcctagcatcgtagcatggagctgggagtgaaggagatgagggtttgtgktttttttttttgctgctgagatgagacttgttaaaacttctcctctaaatttcatgtactgaatggaaaggggaacactggggttgaatgtgaaagcatt

SEQ ID NO: 81183 - DNA, 201 bp, Bos taurus
tcagagcagagacctgcgaggaggcctggtgagcccagcaactggaagcagttgcggagggaggaccagggagtgactgatgtcaggagaggagtcagggyggcagcaccaggaagaagacccaggactgccccttccttccttcgctgctcagtgttcaaacccaggagctcctagcctgctccgagcgtgagtagagtt

SEQ ID NO: 81184 - DNA, 201 bp, Bos taurus
gaaagccagatggagaaggaacaggacttgccgtctggaccagccattgccaaacagatggagcgcttgtccatctgtgttacccttctcctggaggacaygaggaggaggtggcttggtgggaggaagacaggagactcagctggtgggaagaaagagctccaggctgcttccggctgtgcagaagcctccattcctgat

SEQ ID NO: 81185 - DNA, 201 bp, Bos taurus
cctgatgaacactcttatgaacgagtctatctatactctgttccccctgtgtttctggggtgcccctgcacaccagggaactgggagggggcagaagggayaaggaggatcacactatgtgagagaatgcacagccctcaggaggggaggcagacccacccgtgagctttagggaggcctcagctgaacaaagttgcagaa

SEQ ID NO: 81186 - DNA, 201 bp, Bos taurus
aaaggatggagagaagcaaaccactcagccctggacatgtgcttcatccagaataagaatcagcccgtgagctctccagcaggttaactaccttgccgttmggggaggtatatggggttaattactaatgaggcatgggctggtggctgcacacaatatccttactctgacactaaactctctgggtctttaaaacatatc

SEQ ID NO: 81187 - DNA, 201 bp, Bos taurus
ttcttaacaagaagtctggaggcaggaggcccagggttgctttagtggttcaacagggtcctcaggaactccatccagggtcttcccatttgtctaccttkatgcttttgttcttctgtctgtggcctccttttcccagggtcttgacccaggtatcatgtactttcatgccaacaggcagagcaggaagttaggggtgga

SEQ ID NO: 81188 - DNA, 201 bp, Bos taurus
gaaagaatgataaaaagtgagtgttttccttcctgcagacctgcatgagaagactgattattctgtagagacttctccagaatcacagtatctcacatgtrggagggaacctgcaatagttgaaagctgtgtgttccagtcactccatcagagaactgtcagggaagtgtcaagtcctcttggccagagactctcatcagg

SEQ ID NO: 81189 - DNA, 201 bp, Bos taurus
aacatattattttttatcgttctatatattttacagtaaaaggtattatcaaatgtttcaagtcaaagcagattcaatggggcagtggcctttcagggaaktcaaactgcctcttgcaaacaaaccttctgaagtgaatcttcctgaatcctcagtgagcagaattgcttgcagttggccatgagcaaaactttggtacca

SEQ ID NO: 81190 - DNA, 201 bp, Bos taurus
aggctgacttctggcttggccattgggagatcccatgagaaaagtggggcgggggaggaagagagcagccacagcactctctccttttctctctgactttmtggcctccctccagtggctcctctgtcgtggcccaggctccccccagatcagccaccatggctccagtgaaataagagcagcaatcagcatttacatagt

SEQ ID NO: 81191 - DNA, 201 bp, Bos taurus
acaaatcttgttagaaagcatcttcacacttcacagactataacatccccactgcatggagaatgcctgttcctgcaacactgagaacctagttggccacrgtcgctttatttcttcagtcatgtccaactctctgtgatcccatggactctagcccaccaggctctctgtccttggggattccccaggcaagaatactgg

SEQ ID NO: 81192 - DNA, 201 bp, Bos taurus
taaaggagctgaaacccacgtcaagtgcagctttccagtaaatgaaggaagcactgagtagcaacctcccgaactgggaatgaaggcatgaagcctgcacrgcagccgtatctcctgggaaggaatcgactgatctttcatcccgactccacttcctgctgtaccttacccgccttcaacacgtattgatatcgtctgaaa

SEQ ID NO: 81193 - DNA, 201 bp, Bos taurus; identical to SEQ ID NO: 40835

SEQ ID NO: 81194 - DNA, 201 bp, Bos taurus; identical to SEQ ID NO: 40836

SEQ ID NO: 81195 - DNA, 201 bp, Bos taurus
aggatgttcattgcaacgttgaaatagcagaaatttagaagcagcataaatttagattcatcagtgggaggggggtggtcaatacaacagaatacagtaaktaaattacataaatgaatcatacacacacgtgctcacatatgcatccatgaactattatgttgagtcaaaagatgattttcaaaatgctgcttagagagt

SEQ ID NO: 81196 - DNA, 201 bp, Bos taurus; identical to SEQ ID NO: 40837

SEQ ID NO: 81197 - DNA, 201 bp, Bos taurus; identical to SEQ ID NO: 40841

SEQ ID NO: 81198 - DNA, 201 bp, Bos taurus; identical to SEQ ID NO: 40842

SEQ ID NO: 81199 - DNA, 201 bp, Bos taurus
agcccattttacagacaggaaaacccaagtccaagatgatttcctcattgcatcaaggaacagccgttagggtctcaggcagaagatgccacatgactccmgcttttatacttgtcctctcctttccatccaagtgccttttcccaaaagtgggaagaggaagaaggcgaggttacttgtagctcccctgaaacaagattt

SEQ ID NO: 81200 - DNA, 201 bp, Bos taurus
tcgtgcttcatccaatagggccttaggaagcctgtggtcctccccactttgctttgcagttgagaaaaagggactagagaggataaagcccagtatacttyctattacatctcagggcctcccttgaccgtgagattaactgtaaacttgcccagcttgggactgtcttatgggaattggaaattccatagcagcccatgt

SEQ ID NO: 81201 - DNA, 201 bp, Bos taurus; identical to SEQ ID NO: 40844

SEQ ID NO: 81202 - DNA, 201 bp, Bos taurus
ggaaaaaaaacaaacaagaaggtaaatgctgtgcatttctgcaggactggaggtccctcctttgcaactgggaaataaatacatttgtaaaaggccattcrctatgtcatggacacaccctcagcttggggaagatatttctttcaataaaggtaatctttcatgggatttccctggagggccagtgtttaagactttgcc

SEQ ID NO: 81203 - DNA, 201 bp, Bos taurus; identical to SEQ ID NO: 40845

SEQ ID NO: 81204 - DNA, 201 bp, Bos taurus; identical to SEQ ID NO: 40846

SEQ ID NO: 81205 - DNA, 201 bp, Bos taurus; identical to SEQ ID NO: 40848

SEQ ID NO: 81206 - DNA, 201 bp, Bos taurus
aacaaaatggccttcgtttctatttacattttgttcatcaaaaatctgggttaaccatttgcccccctgacagtttccttcctgatacagctctcaaaagkgaatctagtctgggcccttgtcctaggctcaggactttgcctttcttctggagtcctgagaaaggtcacacagggagtggagtgggaacatgctgatgat

SEQ ID NO: 81207 - DNA, 201 bp, Bos taurus
catttactgcggtagtcacagtattacttcttagagtccagcatattttccttgaccttaaatatattttatagggctttagttatagtaccatatattcrgtaatgccttaacatgagaggatgaagtaaaatttcaagaaaagttctatagttttctatatcagttggaaattttgtgtgaccttttttagtaataata

SEQ ID NO: 81208 - DNA, 201 bp, Bos taurus
aatttgtatgttgaaacttaatacctaatgtgatgcgttaggagattggggaagtacttaggccatgaaggtggaactcttacaaaagaggccccaaggarcttccttgcctctttcccatgggaggttacagggcaaagacattcatctaagaagcagacgtttatctaggaagcaggccttcacagtactccaaacctg

SEQ ID NO: 81209 - DNA, 201 bp, Bos taurus
gaaataccttggtgcctagcactcagagtcctcattggcttaaataaggtctcctacatttagatagcaaacacaacattgctagctaaacataaagtatkctagcagagatttactgtccaacattttcatttatacatttttaataatgatttattgattatccttaatgtacaaggaacactgctagagaccagggaa

SEQ ID NO: 81210 - DNA, 201 bp, Bos taurus
cctggaactcatgaatgataccttatttgggaaaggggcctttcacatgattaggttaaggatctaggttattctggattacccaggtccagagattattytgggttatccaagtcggccctaattatagtcaccagttttcttataaaacagaggaagaagattagacaacagaaaaggtaatatgaccacagaagcaga

SEQ ID NO: 81211 - DNA, 201 bp, Bos taurus; identical to SEQ ID NO: 40854

SEQ ID NO: 81212 - DNA, 201 bp, Bos taurus
tatcactcagaggggctgaggcctcagaggaggtccgaaggccgcagtcacctgcgggtccctgaatgatgagaagcaggtcaaatacttctgttaacacygcttaggactctatcacgggcctcactctgaggcgagtgtggccttgggggagttaagcgtcacaaattgggcatgtggtggtcacaagagccccttttc

SEQ ID NO: 81213 - DNA, 201 bp, Bos taurus; identical to SEQ ID NO: 40858

SEQ ID NO: 81214 - DNA, 201 bp, Bos taurus; identical to SEQ ID NO: 40859

SEQ ID NO: 81215 - DNA, 201 bp, Bos taurus; identical to SEQ ID NO: 40860

SEQ ID NO: 81216 - DNA, 201 bp, Bos taurus; identical to SEQ ID NO: 40861

SEQ ID NO: 81217 - DNA, 201 bp, Bos taurus
tgtccactgataagacactgagatgacacatcctgtctgttttagggttggatccagcggagccttgctttgagggcacacctgaattggtccgattggaycccagcgatgcccagtttgtggatgtaattcacacagatgctgccccaatgatccccaacctgggtgagtccctcaattcatcctcctggagtgtttttt

SEQ ID NO: 81218 - DNA, 201 bp, Bos taurus; identical to SEQ ID NO: 40862

SEQ ID NO: 81219 - DNA, 201 bp, Bos taurus; identical to SEQ ID NO: 40864

SEQ ID NO: 81220 - DNA, 201 bp, Bos taurus; identical to SEQ ID NO: 40865

SEQ ID NO: 81221 - DNA, 201 bp, Bos taurus
atccagtgtgtttttcaaggccctgtggctctttaacattttaactttgtatggtcttactgcattgccagtgatggccccattttctccctatgacactrgggtcggcgttcagataacccctgcgcatcttgtaacctggcaaggctttggcctgagttgcttggcctctggttacagatcacaccattttccaagtta

SEQ ID NO: 81222 - DNA, 201 bp, Bos taurus; identical to SEQ ID NO: 40869

SEQ ID NO: 81223 - DNA, 201 bp, Bos taurus
acaaatccccacgtgaccctggatagacagatctggacccatcagacttcaagcccatccccatccttataggaggcccaagtcactcataacgtgagggytcttttgcaaaagtataagaaagtgctttccatcccagctggatctggcctctgctcagccaatcccctcccctcctggcctgactgccttcaagtaggt

SEQ ID NO: 81224 - DNA, 201 bp, Bos taurus; identical to SEQ ID NO: 40916

SEQ ID NO: 81225 - DNA, 201 bp, Bos taurus; identical to SEQ ID NO: 40917

SEQ ID NO: 81226 - DNA, 201 bp, Bos taurus; identical to SEQ ID NO: 40918

SEQ ID NO: 81227 - DNA, 201 bp, Bos taurus; identical to SEQ ID NO: 40922

SEQ ID NO: 81228 - DNA, 201 bp, Bos taurus
tcaataaaaagcatcagacgggcatgtcagaaagagctgagatcctgctgtaaggacttcgtcttcaccctcttttctcagctgcttaaatcgctgtcacrgcctacctgtaggaatcttagacaagggggttttctctgatataattatgctggtagtaaaaatcttggcgccttttctccactttccttcttagccact

SEQ ID NO: 81229 - DNA, 201 bp, Bos taurus
cacagggctgagatggacacctggcccctctgcctcgggacctgtgatgcgtgtgcacttgaacccaagctgggggctctggagctcgcgcgcctgtgtgygggtggccgcacactgaggcttcagcaggagagtccgggacccaaggctgagttggaagcttccggccctccctgctgcctccctcccagcgtcacaggc

SEQ ID NO: 81230 - DNA, 201 bp, Bos taurus; identical to SEQ ID NO: 40925

SEQ ID NO: 81231 - DNA, 201 bp, Bos taurus
ccaagaccacgacatctctgattcttcacaggcgtctccaagctacagaatttcagaagaacctaagtgtactggagccaaggccacaggggaatttgagyacaatgtccctccatgcctggttagaccttatcctctccattagctcggcttcctcattcttaagacaactgtacctgggacttctctggagtccagtgg

SEQ ID NO: 81232 - DNA, 201 bp, Bos taurus
tgtgaggctgataattcatagttaatgcagagagattagggatgcagggatcctgcacagggatgcagtttctggcagttgcaagttggccagagctcacygaatggtctcaagacacaggcagagccccgacagtcaatggacagatgtgatgtgactgggtcagcaaaagaagcaaggcatctataaacgatgatttga

SEQ ID NO: 81233 - DNA, 201 bp, Bos taurus; identical to SEQ ID NO: 40930

SEQ ID NO: 81234 - DNA, 201 bp, Bos taurus; identical to SEQ ID NO: 40933

SEQ ID NO: 81235 - DNA, 201 bp, Bos taurus
atggcctttcctgtaactgtaaagctcacttgaaagttaaaaaaattcccataaagattaaaaaaaaagaaagactccatgcacacagcagtcagcttgcrgaggccgagacatttgtttcgtaactagaccaaacttgaaagctctcaatttcgcctctaacaagatgtattccatcagagctttctacataaatcacag

SEQ ID NO: 81236 - DNA, 201 bp, Bos taurus
gccaggcacttgatcatttaaaagaccacctgcagcccaagtgcctgtcaggatggccggacattctgcacacaggaggcaccggcctctcctgaacgttygttgtcagtgaggctgcagtacgaaaacggggcttgtgatgaggaatgctgtgtgaggagaaggccttggctgggtgcctgggccggggtttgcctcagc

SEQ ID NO: 81237 - DNA, 201 bp, Bos taurus
gaccttgtttccaaatccagtccgttcagaggttaaggctcgagcacaacttcggagagacacaatctaacccagcacggtgtccccagcaggccgccatygccgtgagttctcattacactgccctgtaatcagctgggcgtgggtctgtcccctcaagttgatggaggccttcagagggcacctcatcatcaccttccc

SEQ ID NO: 81238 - DNA, 201 bp, Bos taurus
tgactctaaaggacacacacccaagctgtgatgcaatctccactagcttgtaatctgattatgtggtctttccttcccacttggccaggtcatctactcartgtgaaaggaaatgaagaagtggcatgccttagtaaagaaagaaggcaaagtcctaaccttagctcttgctacatggccaggatacatcatttaatccct

SEQ ID NO: 81239 - DNA, 201 bp, Bos taurus
gagaagcgagccctgaaatgagcacacggccccacgagtcattcacaaccgaagctacacaccaggatcaccggagatgcttcgaaactcctgacaatcgrgtcacaccgagggccagtgacttcagaacctcaaagacgggctcttcatctcgtgaagcagaatcacctggagggcttgctaaaattcaggtggctggcc

SEQ ID NO: 81240 - DNA, 201 bp, Bos taurus; identical to SEQ ID NO: 40940

SEQ ID NO: 81241 - DNA, 201 bp, Bos taurus; identical to SEQ ID NO: 40941

SEQ ID NO: 81242 - DNA, 201 bp, Bos taurus; identical to SEQ ID NO: 40942

SEQ ID NO: 81243 - DNA, 201 bp, Bos taurus; identical to SEQ ID NO: 40943

SEQ ID NO: 81244 - DNA, 201 bp, Bos taurus; identical to SEQ ID NO: 40944

SEQ ID NO: 81245 - DNA, 201 bp, Bos taurus; identical to SEQ ID NO: 40945

SEQ ID NO: 81246 - DNA, 201 bp, Bos taurus
agcgaagttctgtgggggatgtgcgccccaccccaggcccagagcaccatagtgggtgtgggtgcagggttccttttcctcccatctgcttccctctttaygacacttagatcatctgggaagtggcctctgtagggtgcaagaggggacttacggctcaatgatagtaatctatgagccagagaaagtgcagtggagcaa

SEQ ID NO: 81247 - DNA, 201 bp, Bos taurus
tattttgtgtgtgtggccatacacatttcgtaggaaatgtatgacttagatattcacaccattggtcatagccataaggagcaggccacactttcagaaaycagtagccaaggattaaaggatccaacagatggaagatgacagaccctctcttccaacctggccatttacagatgaagctcagacggggactctgcccac

SEQ ID NO: 81248 - DNA, 201 bp, Bos taurus
gacccccacccagaaagaggcacggctggccttctgctttagggtgaccacagcctacgagtagccagcatctgggagtccagccagatgagaactccackggctgctccagattgtggcccgaatcccccccgggtagggttgggagggcggccgggtgactgtgactactcagccctgagacgctcttcccgccccgca

SEQ ID NO: 81249 - DNA, 201 bp, Bos taurus; identical to SEQ ID NO: 40947

SEQ ID NO: 81250 - DNA, 201 bp, Bos taurus
cagaggcccagtcgtgacaggacccctcccactgagaagcccgactccccagggtcccttcacagatgatacctgcagacttcaaggtaaataccctggtragtagagaggacgcaggccggccttccccctggggtgaccgtgagcccgaggcctggcaggttcgatcccagtgcagatggcaaggccagtggcgaaccc

SEQ ID NO: 81251 - DNA, 201 bp, Bos taurus
ctagacttccggcctccagactgttagagaataaattcttgctctgttaagccacccagttcatgataatctgttgtagcaggcacaggaggctcttacgraggccacgatataaacagttttacaaaaaggtagaactcagtgccctgcaggctgttgccaagaatggagagaatgctccaggtctgcccactttgagtt

SEQ ID NO: 81252 - DNA, 201 bp, Bos taurus
ctccatccctccctctttcgtcctccccttttttactttttaaaattttgtgttgtttgaagtccagtaaggagtgtatgagatacacatgtaagctgtgsagtgaaagtcatgagcaggacacctgtcgccgcttcactgagtggggtttgtctgggtgcttcctctccctccccagccctgagcaacacacgcacttgg

SEQ ID NO: 81253 - DNA, 201 bp, Bos taurus
cttgtttaaatgggtttaaatgccttacgttttaataagctttgttggtttgtccaactaagactttttctgctgtacacatttttgtcaccatctcttayaatacgtcatagcaaattccacttcaggttgtactgaattagtgtttcctcaactttttggaaaatattctcagcatggccatagtttgtaaacccttga

SEQ ID NO: 81254 - DNA, 201 bp, Bos taurus
cacgcctcctccccagggctggcctgcatcccagatgactactgcctggactgtgccttgcacgagtgttctggggcaacaaatccctgggttaaccctgytctcgatgacgggctcctgggccagtggtggtacctgtggtccgagcatgtgtccacacgtctgtccgtgtgtgagagtgtgtgtgcgcaggcgcactct

SEQ ID NO: 81255 - DNA, 201 bp, Bos taurus
cctggcctgagggccctccccgttcggtgatcttccaccacttgcaaccacctcggtggagattcgtccaaaagacagtaactaaagcttcgtacacatgyggcggattgaccgtgcggcccccacccgccgcctgcggggacgagcctcccaaggacgcccgggcctctctaggctgtccatcccacgtgagcacacccc

SEQ ID NO: 81256 - DNA, 201 bp, Bos taurus
taaaacagatctgacaggtaaactatggtctttccgacaaaggcggtggaggcggtgcgcccttggataattatttcactaggattcagtgaagcctctgraactccggctccgcgtggacagggtgcttttatttcctttgtatataagggctaaatgttttgggaaatcgctgtgttctaacgaagaggttgatgcagg

SEQ ID NO: 81257 - DNA, 201 bp, Bos taurus
gagggtcaggtggttcatgttccatgtccttggagcgaaggagaccctgcacgtgcgcagaaaggctccctgggggtcaaaaggcagggcatgccaggccrtaataagtcttgcttctttcttcccagatgcctttgtgttgaaatctaccttggctgaggggtgtgtgcacacctgggggagggtcctgagacagattgg

SEQ ID NO: 81258 - DNA, 201 bp, Bos taurus
ccgaggaagatcaaagatggccaacaatccccagaagatggggcagggggcatctggggcacagtccctgtcacgtgagtctcccacaggggaagtgagartgtatagggatgcgtcagggcctagctcgtccagctctgctggacaccatccaaggcacactcacttctcaccctgcccagaacatgagggtgacgggca

SEQ ID NO: 81259 - DNA, 201 bp, Bos taurus
gatgttgtaatacagaactgctggggtatctttcacagctggttcttatggaactcagatattattgtgcaaattacacggccttctagaaattgtttctyttgaacatttccaacataaaattaatcatcttcattatttttaagtgacctcatgggcaatacagtctacgggattctccaggccagaatactggagtgg

SEQ ID NO: 81260 - DNA, 201 bp, Bos taurus
agggccagacacagggtcagtggaggacgaggcagggccatgccctgctctccacccacacctgcctctgtggaccggccctgggctgggttctgtctgtmctctgcctcatcttggaagcttgttcatgtcactcccccctgcctgggacttgcagtccctgaggaatccaggagtgagcccccttggatttcctttctt

SEQ ID NO: 81261 - DNA, 201 bp, Bos taurus
aaacaaagtggataagcaacgtgtggacggagtgccaagtcacaggttctccagagtggggctgacttgggggacgacatcgggacaagaggggatgaggytagagaagcagccaggccatgaggctgctgtggaggcaaaccaagcaagtgacagaagcttttttaaaaactgggagatacaccaaacctacccatgcac

SEQ ID NO: 81262 - DNA, 201 bp, Bos taurus
agtttctaagggcaatgcaaaggtgaaggaacgtttttaatcttaatatttgttttttctaccaggactatgtaactgatacttgtgaaacttttaatttwtaaaagtgaaagtaggagacatttttaaagtaccacttgatgatcacatgttaatatctctcactgctgttctctgttttaattgttgtactgttgttac

SEQ ID NO: 81263 - DNA, 201 bp, Bos taurus
ttcaccactcccgaactccactctacgccagggtgcagccgccctggtcctgtgtcttccccgcctgtctcacccaggctgtgcctggccagcggcctggrttcaggggcacaggactccccaagtctcctgctgtatgtgggactggagcagccagctttgcaaccaggacgtgctctccagagatctgggtctctgaca

SEQ ID NO: 81264 - DNA, 201 bp, Bos taurus
gtcggatgcctccctgcatagctggccgcaggcgggcgagggggagccagctccttgggcacaggctggagcccggcctctcccaggcctcaggggtttcyttccatccctgggaaaatcaggaatactgacaacgcttctgtacacacactcttaaaggtggctcattatacagaaacctaacataacctagcatggcca

SEQ ID NO: 81265 - DNA, 201 bp, Bos taurus
gccagtgcccagcgcccccggggacaccagctaggggaccacctcactgaactcggctctgacacttaaccgccgggtcagtgtggccccaaaggatcagrgctccctcgaggcctgccccagcagacccccgtcatgagcatcaggtccccaggccaccacatgtctctccagtgtggccaccatttggggtcccgggct

SEQ ID NO: 81266 - DNA, 201 bp, Bos taurus
gtgttttcctaggacccggaggagacgaggtcaggagcatctttccaggaaagaggaaacagcagccggtgtttgccaatggggaaggccagtggcgctgrtgggggtctctgacggtccctgctgggaagctggggggacgccaagtcccagccatgagcatgatgcctgactcctgccagaggccacccgactcctgcc

SEQ ID NO: 81267 - DNA, 201 bp, Bos taurus
acgggagacacacggggaccctcaggaggtggcagagcttcacaagtgggagacgagaagcccgacgtccaacgccactgggccacacgcagaaacgactyagagcaaacacagcccagcacccttgagactcacaccccggatccaagcagggctctgggcaccagggatgcaggcggagccagggcctggctgaccacc

SEQ ID NO: 81268 - DNA, 201 bp, Bos taurus
tcaaagacaagctcgtgtgtgtatcggggaaacgcaaggcagggcaatggcaagctctcctgccagccccgcagagcagccgtcggcttggtgaggccccrggggatggtcatcttacgtggtctgggtgctgctccaagagcggttcacaccctctcagccgtgagtcagggggcctccgctcccccagtcaccccctcc

SEQ ID NO: 81269 - DNA, 201 bp, Bos taurus
tgggtgtccaagcctcactcagggctgccagatggtagcccaaggcgcagcatggagacgccctgccgggcggcccggacagctcacgggagaccaggccragatgtccaagccgcagaacttaagagggctggactcagccatgaggtttcctgcatccaactgaggctctgataggggaggggtgggcctcggacgtgg

SEQ ID NO: 81270 - DNA, 201 bp, Bos taurus
cccggtgggggtgacaggaggggactgtggggggaaagctcacgagggtggggctccgtgaatggatcagtgccctgataagcacctgcaggagcaaacgygtcttggggccacatccacccttggctgcccatgcaccactcggtggcgtcagctgtcctcccagggcaggaacctgacctgccaagccctccctccaag

SEQ ID NO: 81271 - DNA, 201 bp, Bos taurus; identical to SEQ ID NO: 40950

SEQ ID NO: 81272 - DNA, 201 bp, Bos taurus; identical to SEQ ID NO: 40952

SEQ ID NO: 81273 - DNA, 201 bp, Bos taurus; identical to SEQ ID NO: 40953

SEQ ID NO: 81274 - DNA, 201 bp, Bos taurus; identical to SEQ ID NO: 40954

SEQ ID NO: 81275 - DNA, 201 bp, Bos taurus; identical to SEQ ID NO: 40955

SEQ ID NO: 81276 - DNA, 201 bp, Bos taurus; identical to SEQ ID NO: 40956

SEQ ID NO: 81277 - DNA, 201 bp, Bos taurus; identical to SEQ ID NO: 40960

SEQ ID NO: 81278 - DNA, 201 bp, Bos taurus
gttggagtttcaatatcaagctctcaaaaataatagaatgaatagacagaaaagtagaagaatatagtagatctgggaagcactaaagctgcactgactcyggtataacagtagaaggacactgggcttcagaaagcaaatgctacttcagtgatttgagaaagttagaacagcttccaagaagtgcctaaccttccttcc

SEQ ID NO: 81279 - DNA, 201 bp, Bos taurus; identical to SEQ ID NO: 40962

SEQ ID NO: 81280 - DNA, 201 bp, Bos taurus
atcataatggttgttttcatatccctaaatgaagtaagtataattttaaacaagatcacttgtataattactgagctatggcaaccattcatctgtgtgcyaacaggaagaaaaggtaacatcccccatcctcagggttaattagctaatgtaagcattggcttaggacccagtgtccagatgtgaacgatccctcctgac

SEQ ID NO: 81281 - DNA, 201 bp, Bos taurus
aggtttatggctctaagggagatgaaagggaaaactttgtaacaggaaaaagtgaatgtttggatttctagtggtgaactggtaagggactctttgggaakaaaccttgctcggtagcatttgctggtttcctgtgtcaccctggggggatggcaagcggggtgagaggaacacaggtcttgggagatgcacacaactggc

SEQ ID NO: 81282 - DNA, 201 bp, Bos taurus; identical to SEQ ID NO: 40965

SEQ ID NO: 81283 - DNA, 201 bp, Bos taurus; identical to SEQ ID NO: 40966

SEQ ID NO: 81284 - DNA, 201 bp, Bos taurus; identical to SEQ ID NO: 40967

SEQ ID NO: 81285 - DNA, 201 bp, Bos taurus
aatggcatcactgattcaatggacatatacttgggcaaactgcgatatggtgagggacagggaagcctggcatgctatagtccatgaggtcacaaagagtygggcatgatgtgcgactgaacaactgcaacaaacagcagcagcagtatatctgtatggtgtctttccagcccatggaaagacatccttgtgttagtaagg

SEQ ID NO: 81286 - DNA, 201 bp, Bos taurus; identical to SEQ ID NO: 40968

SEQ ID NO: 81287 - DNA, 201 bp, Bos taurus; identical to SEQ ID NO: 40970

SEQ ID NO: 81288 - DNA, 201 bp, Bos taurus
tgcagccaggccctgccctcactgaaccccacagggaggcctcaccacacatgcctttacaactcatttaatccatttccagccccacaggcttggcagtrgttgctgctggccaagaccgtgtgtctggtctaccacaggccttttgcagatcagagttccagcttcctacttctcctgactgtcattaatcttgggaag

SEQ ID NO: 81289 - DNA, 201 bp, Bos taurus
gtatttgggccacatttttatgccttttagtgagagttcattctttgtcccagtttaggagaggctgaagtcaaagttgaagatgttcgtagcaagatcaygtcatgcagtcctcaggcccacacgtttatccaggtctgcacactgcagggaacagttaagagccggaaagctgtgtcatgaaggacagctggaggggcg

SEQ ID NO: 81290 - DNA, 201 bp, Bos taurus; identical to SEQ ID NO: 40974

SEQ ID NO: 81291 - DNA, 201 bp, Bos taurus; identical to SEQ ID NO: 40975

SEQ ID NO: 81292 - DNA, 201 bp, Bos taurus; identical to SEQ ID NO: 40976

SEQ ID NO: 81293 - DNA, 201 bp, Bos taurus
caagcaatggggccagaataactgccaatactaaaatatcttacatgccaggcaaattcttagcatttttaaaatcacaacatagaaaatacttctaaaamtcaatacaaaaaaattaacatggatggaaaaaaattggcaaaacaaatgaacaagcatttctcagaaagagaatcatgtccattgaacatgacagaagga

SEQ ID NO: 81294 - DNA, 201 bp, Bos taurus
ataagcatgttggggctttaccaaatgcataagaggctgaaggaacgggccccccaccaagggaagctgggagtcacggccagcgtctcacagcaaaaacrcctgaaagacacccgaagtggtgagaccagggcagctttctttcatcctggaaccactatttctaagagtcaaaattcctggagatggccagctggtggc

SEQ ID NO: 81295 - DNA, 201 bp, Bos taurus; identical to SEQ ID NO: 40977

SEQ ID NO: 81296 - DNA, 201 bp, Bos taurus
tccgtcagctccagaagtctccctctctgccctcctcgggttccggcagactggacatcagggaggcagggtcctgcagcacaggccttctgggtggttgrtaaacaaacctgctcgcagccaccagaataaccatgtggacccacgccacggaggatcattcgggcacttcctacctataactcatttgttctggcctat

SEQ ID NO: 81297 - DNA, 201 bp, Bos taurus
tgtcagacagcccccttcaatgcgtggaggccacctgcccatgggaaatggatgttatgtctatactgtatgtaatgcaaactacccatacagtgagcgcrtgtttttttgtaatacataacgggtaagcacacattgtactctgcatcacacagtaaacacgatactaggcttgccttttcctgccttaaatctgttgta

SEQ ID NO: 81298 - DNA, 201 bp, Bos taurus
aacgtaaattgtccttaatatacacagagcttctataaagcaataaggaaagtataatcaaaggatttaaatggataataccatgaaaagaaaaatcaagyggctctttcacttatggaaatagactcaacctccatcattcagttcatttcagtcactcagtcatgtccaactttttgcgaccccatgaactgcagcacg

SEQ ID NO: 81299 - DNA, 201 bp, Bos taurus; identical to SEQ ID NO: 40979

SEQ ID NO: 81300 - DNA, 201 bp, Bos taurus; identical to SEQ ID NO: 40980

SEQ ID NO: 81301 - DNA, 201 bp, Bos taurus; identical to SEQ ID NO: 40981

SEQ ID NO: 81302 - DNA, 201 bp, Bos taurus
aaaactctatgctttcaatgcaggagacgcaggtctgatccctggtccaggaactaagatctcacatgcagtgcaacatggccagaagaattttaaaaagyagcatttactggtgagcactcacgcagcatgaaggcaggtgctagggacaaccctagtggcctggagacagtgctcaggatgggaaggtgggggaaagac

SEQ ID NO: 81303 - DNA, 201 bp, Bos taurus
gaaaacaagaaggctcactaagtgccggacagaataagccttatcactttcgttaccaaattccactgtttagagaccaaaatgtttaggctaacatcgtyccatcatctggccttaatttgatttcacagaccattcttccacataccctgggacaacaaagaaaacattttgaatttctcaaaactctttttccttacc

SEQ ID NO: 81304 - DNA, 201 bp, Bos taurus
actgagttgttagtgacctttgctggaatgatttcagtgaagccagattgccttaagtggttagatatgataacaatgggtttaatcattttttccccccmaaaaaaagcttggctaagaaaaaaggaagataaagataggaatagctacaaagagttgaagcgtcaagggaaaaatgtgtttaaaatataatttgtttgt

SEQ ID NO: 81305 - DNA, 201 bp, Bos taurus
ctatgctttcaacaaccttgattgagacttctgttgttcatcttttagaagaggtacttaggatttctatagatctctataaatttattttcttttgaggraagaaaaagtaaaaaaaaaaaaattccaatatgctagaaatggatgagaactcccaatatagttatttctgagttttggtatttttttctccaacaactg

SEQ ID NO: 81306 - DNA, 201 bp, Bos taurus; identical to SEQ ID NO: 40992

SEQ ID NO: 81307 - DNA, 201 bp, Bos taurus; identical to SEQ ID NO: 40993

SEQ ID NO: 81308 - DNA, 201 bp, Bos taurus
catcaccaaatgatatagaggagtgtctatcaatctgtccagacttttaaaatattaacttggtaggagttgtaaggtttacagaaacttcaaggctcttmctgctatgaaattaagtataaacagcctaagatagcctggaagaattctcctaagatgaagaaatgctattaaaaagttaggtgtcattgaagagaagtg

SEQ ID NO: 81309 - DNA, 201 bp, Bos taurus
cacttccttcctgacatacagactgtctggctggactccgcagtgttggatactcccggattgggagtcttggctccattcctctctgttgaaggcgtggkatccacctctcctcttaggagatgctacgggtgggaaaccctgctcttatactgaaggtgtcaacacgctttgtctttattcacgtgtccccctttcacc

SEQ ID NO: 81310 - DNA, 201 bp, Bos taurus; identical to SEQ ID NO: 40994

SEQ ID NO: 81311 - DNA, 201 bp, Bos taurus
accgccagccctttgaggatgctcaggggccggccctggtccccgggtttccctgagcatctaggaccgtgtgtcccaccaccttccggccctgtagcttyagagggatagggagtctctctgcggttaaactggcagaataacaatcttgtcacctctaactgctcgtgtgttaaatgtgtcctgttggttacaagggtc

SEQ ID NO: 81312 - DNA, 201 bp, Bos taurus; identical to SEQ ID NO: 40995

SEQ ID NO: 81313 - DNA, 201 bp, Bos taurus; identical to SEQ ID NO: 40997

SEQ ID NO: 81314 - DNA, 201 bp, Bos taurus; identical to SEQ ID NO: 40998

SEQ ID NO: 81315 - DNA, 201 bp, Bos taurus
aggccacagtctacgggatctcaaagagttggacatggctgagcaattaacactttctacttcgtttcgcttttcatgaactcctcctaaggtttgcagayggtaaccaagggcccctgaatttcacataacagtttcttccagtcataaaattgtatttcaacagagaatgtgttctactcgagcttatggttccttttt

SEQ ID NO: 81316 - DNA, 201 bp, Bos taurus; identical to SEQ ID NO: 40999

SEQ ID NO: 81317 - DNA, 201 bp, Bos taurus; identical to SEQ ID NO: 41000

SEQ ID NO: 81318 - DNA, 201 bp, Bos taurus
agaatatatgtgtcatatagagtattatttccctaaaatgccataaacatatacttccctgaaatatttttcttccaaattttttccatggtgactttttwaaataaaaataaagatcatgtataaaatcaagtggttcagttagacatacaccaaacatacacctttgtggtatttataattatgtgaatacaactgttt

SEQ ID NO: 81319 - DNA, 201 bp, Bos taurus
aatcctatggacagaggagcctggtgggcttcagtccatggggtcacaaagagttggataggaccgaatcaactgagagcaggcaattgacactttaaacraaaagcaatctgcttggaggtggttaacctgtccattatatgtggccacacatgcactctcaatttagtgttagtttttacacaacaaattcatgtaata

SEQ ID NO: 81320 - DNA, 201 bp, Bos taurus
tacagtccactgggttgcaaagagtcagacatgactgaagtgacttagcacacacacacacacacacacacacattaggccactttcacgttttgtctggktttacacaagactacagaatgactttgtttgcctcgattcttcagtcacaaagtggccttgtctgaggtttgggtcctgtgaaataatttatgttgaata

SEQ ID NO: 81321 - DNA, 201 bp, Bos taurus; identical to SEQ ID NO: 41004

SEQ ID NO: 81322 - DNA, 201 bp, Bos taurus
taaatgcaaatttctatatacatattacattaagtaattatccattataaatatcttgcctttcattaaaaacttcaaacgttcatatattcatcttttcraactatagaaccacagtccatgatcatttttcctttttttttgggaaggaacaatagtattaatataatatgttgtactgtagttcccctgtaaatcatt

SEQ ID NO: 81323 - DNA, 201 bp, Bos taurus
ttctttatccaatagagaattgagatagtaaaagaaaacctgagagcatagttgactgttgatgaaatataatcagagatctcattttctactaaaagaaktcgtacacactacttgagtttttgcaaagaactgggcatatcataggctttgcttgcaaagattccagaagtcaagctaataaatgcatatgtagctcta

SEQ ID NO: 81324 - DNA, 201 bp, Bos taurus
tcttctgcccacctcattctctctcttttttaattatcaaaaatctgtttattattaaaattcattgtacaaacatttctatcccccaaaatattaattcytctagcctattttctcttctaaaattgctacttagactataaataagagaataaatcatgtaaagcatctgatttccagcattctgttatgggtcacaaa

SEQ ID NO: 81325 - DNA, 201 bp, Bos taurus
atcctggtgaaggccaccctgaactaactagcccccacgtgacagcagaagagaaatcaagcccagcagagactgactgacctaggcctatagatgcctgkgaaataatgtttttagactactaaattttagagttgaccctttgttcagcaatgccaaacagatacacctgtgtagctttccaatttcatttcttaccaa

SEQ ID NO: 81326 - DNA, 201 bp, Bos taurus; identical to SEQ ID NO: 41006

SEQ ID NO: 81327 - DNA, 201 bp, Bos taurus
atataacccccacagcaatcaatcagtcaaactggtgaacctcctagtgccctttcacagggagtccttcactctggccacacagatgtgtattctgtccmtgttatctggatatcttcaaaattacatggttgaaaggaaagtgaaaatgttagtcactcgagtcatggccaactctttgcaaccccatggactgtagcc

SEQ ID NO: 81328 - DNA, 201 bp, Bos taurus
tcctcccaacatttgaataagggaaaatctagtcaccgagtcaatgaaaactatgctgtgctcaccagtggtactttgtgtatttcacgggaaaccatttmaattacatgaaaaaaaaaaaaaaagaacaagaaaacttgtttcatccaaaatcctttcatcttcctgttcactcactgatttatttggtataaatattga

SEQ ID NO: 81329 - DNA, 201 bp, Bos taurus; identical to SEQ ID NO: 41009

SEQ ID NO: 81330 - DNA, 201 bp, Bos taurus
tgcattttggtattttctattatctgttgaagtgtttcttttcaaagaatatctatttttatatactgtccccaaatgtgatcttttcagaaggcgtgttrtcatcaaatgcattttcacaaagcataacacattacgggatttgaatggggagggaaaatacatttataaaagcaatacatagttgctgggaatacaaat

SEQ ID NO: 81331 - DNA, 201 bp, Bos taurus
ataatgagggggtacgaacagatttttatgcaagaaccaacggtgtaggggaaaatagacttcctagaattgtgctcaattccaggtacaataagtgaagrtggggatttatagccaaagatggggagtctgattaaatcgatgtgataggattcttgctgaaggcaggagtgaccagatatcacctgagaggcagtgatg

SEQ ID NO: 81332 - DNA, 201 bp, Bos taurus
tatttgcttggccaaaacattcatctgggtttattctgtaccttgaatgagctttttttgccaatccaggataagatttgaacttaagaaagtgacacacragtggcccaacacatatccacttggaatgttgaggtggagacaggtaaattccacaataaacacttgcccaaatctttggactaaatcacataggtggta

SEQ ID NO: 81333 - DNA, 201 bp, Bos taurus
tgtcagggactgtcatttgtattctctacccagaaaggggtcttcagaagattgtaaatgaggtgatggtgctggccaaataccctttgtttggccccttytttgtatccaaaagtaatgaaaatggagcttaatggtacataaataaaaataattacgtagacgatagtggtagtggtgcattacctgaattaatacaca

SEQ ID NO: 81334 - DNA, 201 bp, Bos taurus; identical to SEQ ID NO: 41012

SEQ ID NO: 81335 - DNA, 201 bp, Bos taurus; identical to SEQ ID NO: 41013

SEQ ID NO: 81336 - DNA, 201 bp, Bos taurus; identical to SEQ ID NO: 41015

SEQ ID NO: 81337 - DNA, 201 bp, Bos taurus; identical to SEQ ID NO: 41017

SEQ ID NO: 81338 - DNA, 201 bp, Bos taurus; identical to SEQ ID NO: 41018

SEQ ID NO: 81339 - DNA, 201 bp, Bos taurus; identical to SEQ ID NO: 41019

SEQ ID NO: 81340 - DNA, 201 bp, Bos taurus
tatatcaccataatatgcacacatttgttaatgtatctgtctgtaactgtctgatctcagttgaatgtaagctacatgagggagcatcatctgggtttccrttattgactcagcactcccaacaatgccccaaacacaattgacactcaacagaaatttcttgaggaaataaagctgtatgttgtcgtgttaattaagaag

SEQ ID NO: 81341 - DNA, 201 bp, Bos taurus
cttttaaagtctacattttaaagttatttcaggggcccacttaatcagagtcacagaggccctgtgggttgcctttatctgctccccacttgcattttgtytcagcatttctaggccttgtgtgctgctggcagctcaaatcatggtttgccagcatgcctctgaccaaaagaataactctgggtttgctccatgccatgg

SEQ ID NO: 81342 - DNA, 201 bp, Bos taurus
tgcatttcccagatacctggaaggcattacccatccgggcctgggactcaggaccagtttaagtcaccctccctctgcacctcagccccttccttctcacrgtgaagggctctctcgggccttctctatgtctgctgcccaggctgctggcacatggggctggtgtgacagctctgccctgggcctctagatcactcagct

SEQ ID NO: 81343 - DNA, 201 bp, Bos taurus
gttcccccattttatctgcaaacctagcttctccaaaacaggatctgatcaatggattctagtctccatctagtacagagtgcagcccctgttggtcagarcaatcctgacagacatttactggatgctggccctgccaatagttggttttctttgggtcagcttttaattccatcaatcacttgcagacagagttccagg

SEQ ID NO: 81344 - DNA, 201 bp, Bos taurus; identical to SEQ ID NO: 41024

SEQ ID NO: 81345 - DNA, 201 bp, Bos taurus; identical to SEQ ID NO: 41025

SEQ ID NO: 81346 - DNA, 201 bp, Bos taurus; identical to SEQ ID NO: 41027

SEQ ID NO: 81347 - DNA, 201 bp, Bos taurus
gagctgctctctgcaatggggacatgaccccgtggtgctgaaccacacgggcattttcccacctccctggacctctcggcagcctttggtgtggccgcccmttgctacttctggaaacactgttccgcgtgctccctaacgtcatagtccttccctgcagccccttctgcttccatcagcctctgcacccatggtgctcag

SEQ ID NO: 81348 - DNA, 201 bp, Bos taurus; identical to SEQ ID NO: 41031

SEQ ID NO: 81349 - DNA, 201 bp, Bos taurus; identical to SEQ ID NO: 41032

SEQ ID NO: 81350 - DNA, 201 bp, Bos taurus; identical to SEQ ID NO: 41033

SEQ ID NO: 81351 - DNA, 201 bp, Bos taurus; identical to SEQ ID NO: 41035

SEQ ID NO: 81352 - DNA, 201 bp, Bos taurus
agacaaaggagcccatactgacagtcggaggctgtagcttttcttggagtgatgactcatttcggctcacaaaggattctgggcagggtagtgaggagtcrggttggctgatccacgcctgtgacttcactttgcagaggacaggcagcagaggagacactgccgattcccaaggcactgcagtgggctgtcggctcaggg

SEQ ID NO: 81353 - DNA, 201 bp, Bos taurus
aaatgccttttcctgagccttccaggggaagctcacactcgaaagtgcaccgaagccacagccatacccaggaccgaagatccaggaatgagagatccaayaaggccaaggagaggtccagatcgatggataactctaaaggccctctgggtgcttcttctctggggacgcctgaagacctggccgaaggctgtagccaag

SEQ ID NO: 81354 - DNA, 201 bp, Bos taurus
ttttacaggtgaggaaacagaggcaaagaaggttaaagcaacttcctgtgatagacacagagatgttgcacccggaggcctggtcatgttgcccaccttcraggaacagagaggtcagccttctgccatcagctccttcagggtcagccacaagtgcagcgcacacctggcctgcgagcctgcccttccagggcaacacat

SEQ ID NO: 81355 - DNA, 201 bp, Bos taurus; identical to SEQ ID NO: 41039

SEQ ID NO: 81356 - DNA, 201 bp, Bos taurus
tttgaggcctctccattatcctggctgctgacagtgtatattgctaccaatttcggggattcctttcttcttcaggcggcttcttccagcagcatttattrttttcagagttgggaagatggccattgtgccggatgggatgtgatttcccattggccttttgactgacatttcctgtgtcacttagggatgcttaccatc

SEQ ID NO: 81357 - DNA, 201 bp, Bos taurus
ttgaccccaataaagcaaaacctcaggtgctctgcactctccctccccctaccagagacttcacatgtgaggcccaggtgtgctgtgtcatttccaagtcytgtagtaagaaagctttattttttttccaagtttcttatagttattgctgaggggcatcttgcaatcatcttatgaactacatgggctggtccagccaca

SEQ ID NO: 81358 - DNA, 201 bp, Bos taurus
taagctctctaagctcaacaaaggggacaattgtttttcaaacccctgtttacatcatgtttgctgctgttccattggccaaagcataaccatgtcaaaartccacatgagaaaaaactacccaaggacatggatacagggaggggaaccatgatggccattttgcaatacacacatatcagataattatgttgtacatct

SEQ ID NO: 81359 - DNA, 201 bp, Bos taurus
aattgacttatcttcagtacaacactgaatccacaagaaagagagaacagatactgattagattgaaatggaaaactgagtgtacatttctactctagtgygaatcacccagaaaaaacaccttaaaagaatgaattaaaaagacacataaaataaccacgaccagagagtttaaaactttgagaaattcatgaatgataa

SEQ ID NO: 81360 - DNA, 201 bp, Bos taurus; identical to SEQ ID NO: 41041

SEQ ID NO: 81361 - DNA, 201 bp, Bos taurus; identical to SEQ ID NO: 41042

SEQ ID NO: 81362 - DNA, 201 bp, Bos taurus; identical to SEQ ID NO: 41043

SEQ ID NO: 81363 - DNA, 201 bp, Bos taurus; identical to SEQ ID NO: 41044

SEQ ID NO: 81364 - DNA, 201 bp, Bos taurus; identical to SEQ ID NO: 41045

SEQ ID NO: 81365 - DNA, 201 bp, Bos taurus; identical to SEQ ID NO: 41046

SEQ ID NO: 81366 - DNA, 201 bp, Bos taurus; identical to SEQ ID NO: 41047

SEQ ID NO: 81367 - DNA, 201 bp, Bos taurus; identical to SEQ ID NO: 41048

SEQ ID NO: 81368 - DNA, 201 bp, Bos taurus; identical to SEQ ID NO: 41049

SEQ ID NO: 81369 - DNA, 201 bp, Bos taurus; identical to SEQ ID NO: 41050

SEQ ID NO: 81370 - DNA, 201 bp, Bos taurus; identical to SEQ ID NO: 41051

SEQ ID NO: 81371 - DNA, 201 bp, Bos taurus; identical to SEQ ID NO: 41052

SEQ ID NO: 81372 - DNA, 201 bp, Bos taurus; identical to SEQ ID NO: 41053

SEQ ID NO: 81373 - DNA, 201 bp, Bos taurus; identical to SEQ ID NO: 41054

SEQ ID NO: 81374 - DNA, 201 bp, Bos taurus; identical to SEQ ID NO: 41055

SEQ ID NO: 81375 - DNA, 201 bp, Bos taurus; identical to SEQ ID NO: 41056

SEQ ID NO: 81376 - DNA, 201 bp, Bos taurus; identical to SEQ ID NO: 41057

SEQ ID NO: 81377 - DNA, 201 bp, Bos taurus; identical to SEQ ID NO: 41058

SEQ ID NO: 81378 - DNA, 201 bp, Bos taurus; identical to SEQ ID NO: 41060

SEQ ID NO: 81379 - DNA, 201 bp, Bos taurus; identical to SEQ ID NO: 41061

SEQ ID NO: 81380 - DNA, 201 bp, Bos taurus; identical to SEQ ID NO: 41062

SEQ ID NO: 81381 - DNA, 201 bp, Bos taurus; identical to SEQ ID NO: 41063

SEQ ID NO: 81382 - DNA, 201 bp, Bos taurus; identical to SEQ ID NO: 41064

SEQ ID NO: 81383 - DNA, 201 bp, Bos taurus; identical to SEQ ID NO: 41065

SEQ ID NO: 81384 - DNA, 201 bp, Bos taurus; identical to SEQ ID NO: 41066

SEQ ID NO: 81385 - DNA, 201 bp, Bos taurus; identical to SEQ ID NO: 41067

SEQ ID NO: 81386 - DNA, 201 bp, Bos taurus; identical to SEQ ID NO: 41068

SEQ ID NO: 81387 - DNA, 201 bp, Bos taurus; identical to SEQ ID NO: 41069

SEQ ID NO: 81388 - DNA, 201 bp, Bos taurus; identical to SEQ ID NO: 41070

SEQ ID NO: 81389 - DNA, 201 bp, Bos taurus; identical to SEQ ID NO: 41071

SEQ ID NO: 81390 - DNA, 201 bp, Bos taurus; identical to SEQ ID NO: 41072

SEQ ID NO: 81391 - DNA, 201 bp, Bos taurus; identical to SEQ ID NO: 41073

SEQ ID NO: 81392 - DNA, 201 bp, Bos taurus; identical to SEQ ID NO: 41074

SEQ ID NO: 81393 - DNA, 201 bp, Bos taurus; identical to SEQ ID NO: 41075

SEQ ID NO: 81394 - DNA, 201 bp, Bos taurus; identical to SEQ ID NO: 41076

SEQ ID NO: 81395 - DNA, 201 bp, Bos taurus; identical to SEQ ID NO: 41077

SEQ ID NO: 81396 - DNA, 201 bp, Bos taurus; identical to SEQ ID NO: 41078

SEQ ID NO: 81397 - DNA, 201 bp, Bos taurus; identical to SEQ ID NO: 41079

SEQ ID NO: 81398 - DNA, 201 bp, Bos taurus; identical to SEQ ID NO: 41080

SEQ ID NO: 81399 - DNA, 201 bp, Bos taurus; identical to SEQ ID NO: 41081

SEQ ID NO: 81400 - DNA, 201 bp, Bos taurus; identical to SEQ ID NO: 41082

SEQ ID NO: 81401 - DNA, 201 bp, Bos taurus; identical to SEQ ID NO: 41083

SEQ ID NO: 81402 - DNA, 201 bp, Bos taurus; identical to SEQ ID NO: 41084

SEQ ID NO: 81403 - DNA, 201 bp, Bos taurus; identical to SEQ ID NO: 41085

SEQ ID NO: 81404 - DNA, 201 bp, Bos taurus; identical to SEQ ID NO: 41086

SEQ ID NO: 81405 - DNA, 201 bp, Bos taurus; identical to SEQ ID NO: 41087

SEQ ID NO: 81406 - DNA, 201 bp, Bos taurus; identical to SEQ ID NO: 41088

SEQ ID NO: 81407 - DNA, 201 bp, Bos taurus; identical to SEQ ID NO: 41089

SEQ ID NO: 81408 - DNA, 201 bp, Bos taurus; identical to SEQ ID NO: 41090

SEQ ID NO: 81409 - DNA, 201 bp, Bos taurus; identical to SEQ ID NO: 41091

SEQ ID NO: 81410 - DNA, 201 bp, Bos taurus; identical to SEQ ID NO: 41092

SEQ ID NO: 81411 - DNA, 201 bp, Bos taurus; identical to SEQ ID NO: 41093

SEQ ID NO: 81412 - DNA, 201 bp, Bos taurus; identical to SEQ ID NO: 41094

SEQ ID NO: 81413 - DNA, 201 bp, Bos taurus; identical to SEQ ID NO: 41095

SEQ ID NO: 81414 - DNA, 201 bp, Bos taurus; identical to SEQ ID NO: 41096

SEQ ID NO: 81415 - DNA, 201 bp, Bos taurus; identical to SEQ ID NO: 41097

SEQ ID NO: 81416 - DNA, 201 bp, Bos taurus; identical to SEQ ID NO: 41098

SEQ ID NO: 81417 - DNA, 201 bp, Bos taurus; identical to SEQ ID NO: 41099

SEQ ID NO: 81418 - DNA, 201 bp, Bos taurus; identical to SEQ ID NO: 41100

SEQ ID NO: 81419 - DNA, 201 bp, Bos taurus; identical to SEQ ID NO: 41101

SEQ ID NO: 81420 - DNA, 201 bp, Bos taurus; identical to SEQ ID NO: 41102

SEQ ID NO: 81421 - DNA, 201 bp, Bos taurus; identical to SEQ ID NO: 41103

SEQ ID NO: 81422 - DNA, 201 bp, Bos taurus; identical to SEQ ID NO: 41104

SEQ ID NO: 81423 - DNA, 201 bp, Bos taurus; identical to SEQ ID NO: 41105

SEQ ID NO: 81424 - DNA, 201 bp, Bos taurus; identical to SEQ ID NO: 41106

SEQ ID NO: 81425 - DNA, 201 bp, Bos taurus; identical to SEQ ID NO: 41107

SEQ ID NO: 81426 - DNA, 201 bp, Bos taurus; identical to SEQ ID NO: 41108

SEQ ID NO: 81427 - DNA, 201 bp, Bos taurus; identical to SEQ ID NO: 41109

SEQ ID NO: 81428 - DNA, 201 bp, Bos taurus; identical to SEQ ID NO: 41110

SEQ ID NO: 81429 - DNA, 201 bp, Bos taurus; identical to SEQ ID NO: 41111

SEQ ID NO: 81430 - DNA, 201 bp, Bos taurus; identical to SEQ ID NO: 41113

SEQ ID NO: 81431 - DNA, 201 bp, Bos taurus; identical to SEQ ID NO: 41114

SEQ ID NO: 81432 - DNA, 201 bp, Bos taurus; identical to SEQ ID NO: 41115

SEQ ID NO: 81433 - DNA, 201 bp, Bos taurus; identical to SEQ ID NO: 41116

SEQ ID NO: 81434 - DNA, 201 bp, Bos taurus; identical to SEQ ID NO: 41117

SEQ ID NO: 81435 - DNA, 201 bp, Bos taurus; identical to SEQ ID NO: 41118

SEQ ID NO: 81436 - DNA, 201 bp, Bos taurus; identical to SEQ ID NO: 41119

SEQ ID NO: 81437 - DNA, 201 bp, Bos taurus; identical to SEQ ID NO: 41120

SEQ ID NO: 81438 - DNA, 201 bp, Bos taurus; identical to SEQ ID NO: 41121

SEQ ID NO: 81439 - DNA, 201 bp, Bos taurus; identical to SEQ ID NO: 41122

SEQ ID NO: 81440 - DNA, 201 bp, Bos taurus; identical to SEQ ID NO: 41123

SEQ ID NO: 81441 - DNA, 201 bp, Bos taurus; identical to SEQ ID NO: 41124

SEQ ID NO: 81442 - DNA, 201 bp, Bos taurus; identical to SEQ ID NO: 41125

SEQ ID NO: 81443 - DNA, 201 bp, Bos taurus; identical to SEQ ID NO: 41126

SEQ ID NO: 81444 - DNA, 201 bp, Bos taurus; identical to SEQ ID NO: 41127

SEQ ID NO: 81445 - DNA, 201 bp, Bos taurus; identical to SEQ ID NO: 41128

SEQ ID NO: 81446 - DNA, 201 bp, Bos taurus; identical to SEQ ID NO: 41129

SEQ ID NO: 81447 - DNA, 201 bp, Bos taurus; identical to SEQ ID NO: 41130

SEQ ID NO: 81448 - DNA, 201 bp, Bos taurus; identical to SEQ ID NO: 41131

SEQ ID NO: 81449 - DNA, 201 bp, Bos taurus; identical to SEQ ID NO: 41132

SEQ ID NO: 81450 - DNA, 201 bp, Bos taurus; identical to SEQ ID NO: 41133

SEQ ID NO: 81451 - DNA, 201 bp, Bos taurus; identical to SEQ ID NO: 41134

SEQ ID NO: 81452 - DNA, 201 bp, Bos taurus; identical to SEQ ID NO: 41135

SEQ ID NO: 81453 - DNA, 201 bp, Bos taurus; identical to SEQ ID NO: 41136

SEQ ID NO: 81454 - DNA, 201 bp, Bos taurus; identical to SEQ ID NO: 41137

SEQ ID NO: 81455 - DNA, 201 bp, Bos taurus; identical to SEQ ID NO: 41138

SEQ ID NO: 81456 - DNA, 201 bp, Bos taurus; identical to SEQ ID NO: 41139

SEQ ID NO: 81457 - DNA, 201 bp, Bos taurus; identical to SEQ ID NO: 41140

SEQ ID NO: 81458 - DNA, 201 bp, Bos taurus; identical to SEQ ID NO: 41141

SEQ ID NO: 81459 - DNA, 201 bp, Bos taurus; identical to SEQ ID NO: 41142

SEQ ID NO: 81460 - DNA, 201 bp, Bos taurus; identical to SEQ ID NO: 41143

SEQ ID NO: 81461 - DNA, 201 bp, Bos taurus; identical to SEQ ID NO: 41144

SEQ ID NO: 81462 - DNA, 201 bp, Bos taurus; identical to SEQ ID NO: 41145

SEQ ID NO: 81463 - DNA, 201 bp, Bos taurus; identical to SEQ ID NO: 41146

SEQ ID NO: 81464 - DNA, 201 bp, Bos taurus; identical to SEQ ID NO: 41147

SEQ ID NO: 81465 - DNA, 201 bp, Bos taurus; identical to SEQ ID NO: 41148

SEQ ID NO: 81466 - DNA, 201 bp, Bos taurus; identical to SEQ ID NO: 41149

SEQ ID NO: 81467 - DNA, 201 bp, Bos taurus; identical to SEQ ID NO: 41150

SEQ ID NO: 81468 - DNA, 201 bp, Bos taurus; identical to SEQ ID NO: 41151

SEQ ID NO: 81469 - DNA, 201 bp, Bos taurus
tctaatatggcccttcatccctctcagcctctcatctggcccctgtcttccaatgttctagtctagtggttctcagaatatgctctgaagactcctacacyacccaagatcctctcaaggccatcctctcaagggcatccatatttttacagtatgactgagatctttttcgctttttttcactttgttaaaattctcact

SEQ ID NO: 81470 - DNA, 201 bp, Bos taurus; identical to SEQ ID NO: 41178

SEQ ID NO: 81471 - DNA, 201 bp, Bos taurus; identical to SEQ ID NO: 41179

SEQ ID NO: 81472 - DNA, 201 bp, Bos taurus
tgatgcttaccagtggcctggtgcccaccgaagcaagacctgccttgtccacgtgccatggcttctgagcaccatggctaagctgactgcaccccagaaaygggctggtgcagaaatctggccatttactctgttcccagcagctgtgggcagagggccttgatatcctcggagcagaactgagcaggaacatgtagagca

SEQ ID NO: 81473 - DNA, 201 bp, Bos taurus
ggggagcaaggaggaggtgagcgggtctggagctgagggaagtgggtgagaagcaagggaggggacaagagagctggaggcaggacagtgaggtgggtgcrgggcctcacgactttcatggtgagaaagatggaaacccatccttgtgctctggacctaggagtgaccttgtccttgaggatttagtgaatttaaagaaga

SEQ ID NO: 81474 - DNA, 201 bp, Bos taurus
tttacactacttcttcccatcattaaatattctttgagaaaatcatttttaatgaatggactgttttccattcttaagctgggccatcaattatttaaccratcccctattcgggatttttaggtagtttctaatattttttctattatgctaatgactgagatgaatattcttggccataaatcttgtacataaatttta

SEQ ID NO: 81475 - DNA, 201 bp, Bos taurus
ggagttggtgatagacagggaggcctggcctgctgcgattcatggggtcgcaaagagtcggacacaactgagcgactgatctgatctgatctgatctacaytggctcagggccccaggtgaacagagatatctgagatcaggtacctgagatcagatctctgagatcaggattttccaagggtttagagtttatctcccag

SEQ ID NO: 81476 - DNA, 201 bp, Bos taurus
tctaaaacagagctcctaagcccaagacatccacacacttacggcacagcaactgggtacttggagtctgctgaaaaagacagattctaggtttgcacaakggtctctgtcatttacagacaagatgccttagggagcccttggtgctaattcacagccacccaaagccaagggtgacacaggatgctctacaaataaaat

SEQ ID NO: 81477 - DNA, 201 bp, Bos taurus
cctgggggtaactcctgaggtcggctcagccagcgggggccctggcacgtagactccagtccacacctcatctttgccagctccctgtctccgtgcaggayctcccagggggcctggagtccaggcccacaaactgaggctaggacagcccaccttgaatgttcccccccaattacgtctctccctgacccagtctggggg

SEQ ID NO: 81478 - DNA, 201 bp, Bos taurus; identical to SEQ ID NO: 41186

SEQ ID NO: 81479 - DNA, 201 bp, Bos taurus
ctgacaggcgacagagcggccaggaagcacggaagcgttcagagtgtgtctgcaatcaaagtggggaggacccctggtcaacttgtcagctctcgggactyttctgctccagaccggccatggctctccatcgccttcccagtaaaaccagcgtccccactgcagcctggaggagccggcctcctgcagcccctgccctct

SEQ ID NO: 81480 - DNA, 201 bp, Bos taurus; identical to SEQ ID NO: 41188

SEQ ID NO: 81481 - DNA, 201 bp, Bos taurus; identical to SEQ ID NO: 41189

SEQ ID NO: 81482 - DNA, 201 bp, Bos taurus; identical to SEQ ID NO: 41190

SEQ ID NO: 81483 - DNA, 201 bp, Bos taurus; identical to SEQ ID NO: 41191

SEQ ID NO: 81484 - DNA, 201 bp, Bos taurus
aactttggccctgggagggctggctggctgggctattggccagagatctaaatgactgcacagtgaacatgctgaagggttcattgaggtccaccaccctraagatgaagctccctgctaggcctttgtctctaaaggagagcctggattctgatcaactctaaattcccttcaggtttcaagaaataccacctgatgagg

SEQ ID NO: 81485 - DNA, 201 bp, Bos taurus
ctatttttaaacaatagtcttcacatggttgactaagccagaaatcgacctgcttcactgtccccaaacgcacacgccttcaccttgtctgggagggcccrtgctctcgggtaaggacaggctgtctgcagcagggcaccctgctcatctccgaggtctggacatgccggacacggtgcccttcctccccttgtgagcgct

SEQ ID NO: 81486 - DNA, 201 bp, Bos taurus; identical to SEQ ID NO: 41195

SEQ ID NO: 81487 - DNA, 201 bp, Bos taurus
ctcatgcccctgtgtccatgtccacgcgcagcccctcagcagggtgcaatgtctctgcatgtgggagagagctaagagttggcctttccgaggcttctgcyttgtcccctcctgagccagggctccgtgcctggtgcctgcctgtctccgtatcctccagatggggctctctgcctctgccgtggcccacttcagctgctc

SEQ ID NO: 81488 - DNA, 201 bp, Bos taurus
gacaggagtccttgcttataaaacagatgggctgtgtgtttcccagttaagggggcgatgcagacatgctcaggctggttgactgggacacagctcgtccractcggcctgtgtacacagagctcaaacagctgaaccgtaattgtcttttctctccatctgctgtgtgcacagctgcctctggaacttcattctaaggct

SEQ ID NO: 81489 - DNA, 201 bp, Bos taurus
cacctggccttctctcgaggtttgctttactcgctgttggagcagagggtctgaagtggaaggccttaaccccctcgtggcccatggctctgtcccaagcycacttacagacttaatctgggtagctcttaattcaggctgtacttctgaaacactcggggggctggaggactccacgacacacccaggtggccacatccc

SEQ ID NO: 81490 - DNA, 201 bp, Bos taurus
gggcttttccagggaagggcctaggtgagaaggaccaccaggctgcctcccctgccacttcaggggttgtgagacaggccccagcgactcagtctttgatktgaggcaggcgtgtcaagcttgtctttaccccgttgatgtgtggtcactggccccaccatagagacgacactgggctcaccagagagcataaactccagt

SEQ ID NO: 81491 - DNA, 201 bp, Bos taurus
gcccccgtgactcaggagtgggaggtggcaggggtccgccttgtttacctgtgagccggtagtgccattcgatttgggaattacatgtgtgcacttccacrgacagaggagcctacaggccatggggtcgcacagagtcgaacacgactgagcaacggagcactgaacacgttattttgataaaagtaaaataatccgtag

SEQ ID NO: 81492 - DNA, 201 bp, Bos taurus
tactaacaggatggtcaattccaaagcgttagctcagaagggcagtttggggtacaaatgctcctgagtgaccaggccgggccctggtttctctggattcytctgtgtccctgtgttttcctcttcttgatgtgaggtttgagcctactgaacttacttcttcatgtcgcttggcctcctggcaatgctgatgggcagaca

SEQ ID NO: 81493 - DNA, 201 bp, Bos taurus; identical to SEQ ID NO: 41198

SEQ ID NO: 81494 - DNA, 201 bp, Bos taurus
cacgtggcctgtggccattagtttagacagggcagatcaagggcggttccatcagcagagaaggctctgacgttcagcgctgatctggaaaggcctccgtraaccggtcccagagctggtcggctggcggacctgcaggcagtggagtctcaagttaaatgctggccacgaggttgcgtttctctgggtcctgggagaagt

SEQ ID NO: 81495 - DNA, 201 bp, Bos taurus
tgatgtcaaactcatgaccattcagtgtcttttaagaggggcccatacttggagagggtttactttggtaagattttggtgggccatatattttcttatakaaattaacgcttattggtctataataaagactattattcctaatatttaatgtgctagttaagcttaaattacaggccagatttttgactttcagaatgt

SEQ ID NO: 81496 - DNA, 201 bp, Bos taurus
tggtaattataatggaatgcagggcctgtctcatactgttgtgactgttagggataattgttctgattggaatgtttgggaacctagaggtaaatggaacyagtggaaaactggtctttacccaaaatgttatctctactggttcgtcttggagcctgaatgtttcacttgttactccctttctgaccaaaccattgcctc

SEQ ID NO: 81497 - DNA, 201 bp, Bos taurus
gggccgggacagtggtgggaggactggaccctgaaatgggaggaagtttcagaagaagaactgagatgcagtagagagtggggtaggcggaagcataggcrttggccggtttctcagctaaaagtcggaagcgatccacaagacggtgctgcccaggccaggccgtggtcagaggcaggagccagggcattgttgtcaatc

SEQ ID NO: 81498 - DNA, 201 bp, Bos taurus
ggccaactaggccctcctcacgctgacgccacagtgatgtactcagctcctcccccttcacactccagggagccctaacaccttgccatgagtgttccacrgtgcaaggcctagtggaagctttgtcatgcacatggaacaactcagttcagtcgctcagtcgtgtccaactctttgagaccccgtggactgcagcacgcc

SEQ ID NO: 81499 - DNA, 201 bp, Bos taurus
taagctttttctccaaggaaatattaaatatgttttttagattttcttctatttctttctcattcagtgtcttaaactctaccaaatctgtattgtccttrtaattgaatctcctgtaggtgagcgtgaaacccactaagcaatgaacaccttctggggtctgcaaggagcaaaatgacttgcttgtaaacacagatgctg

SEQ ID NO: 81500 - DNA, 201 bp, Bos taurus
tgaaatgctcttagaaacattaacacacacattcagttatttccctttttttttatgcgcagactgcaaacagaatggtgatcagtaactcgacacagacygtgtcttctgtatttttaacatgatcctttcagattatgacaccgttctcatctttattagtatcattgcttcttgaaaacctgtctttgaatagtaata

SEQ ID NO: 81501 - DNA, 201 bp, Bos taurus
ttctcttggccagacaccaggcacaggttccacctgcacccaaggggagttgacaaaaggatgtaaatcattgagaatcaccttagaattcttccttccayggaggagaaagttcagagatgatggaaatctccgacgtggtgtaaagctcagggtgacaaaatatccacccagtgtgaactcaggaacaacacggcctta

SEQ ID NO: 81502 - DNA, 201 bp, Bos taurus; identical to SEQ ID NO: 41199

SEQ ID NO: 81503 - DNA, 201 bp, Bos taurus
cagtgacttttctttcaagaaactgtcacagccatgcatatcaaaagattctttgggagatttctctggcagtctagtggttaggcctctacttctactgyagggggcacaggtgggatccctggtctgggaactaagatcccagcctcatggcatggccccacaaaaaaaaaaaaaaaattgccaaaaaaactgcaaaaa

SEQ ID NO: 81504 - DNA, 201 bp, Bos taurus; identical to SEQ ID NO: 41202

SEQ ID NO: 81505 - DNA, 201 bp, Bos taurus; identical to SEQ ID NO: 41208

SEQ ID NO: 81506 - DNA, 201 bp, Bos taurus; identical to SEQ ID NO: 41209

SEQ ID NO: 81507 - DNA, 201 bp, Bos taurus
ctccacacctctgaacaggtcccttcctacctcatcagtgcgggagcctctcacccagcccacagctgcaaagccgctccctcccctgagggccactgccrattgtttaaagcactcaatcgcggtccaggtttacatgtctctctcaagccaggtactgagtaaagatcagggaccatctgcgcagttgtatggccaggc

SEQ ID NO: 81508 - DNA, 201 bp, Bos taurus; identical to SEQ ID NO: 41213

SEQ ID NO: 81509 - DNA, 201 bp, Bos taurus
atccctatggtaagggaagcctggcatactgcagtccatggggttgcagagtcaggcaggacttagttactgaacaacaacaataaaaacaaatcatgtaygtacatttattattatcttttgcttcatttgttcaatatttctcacccctatctgccccatgcatagtaatgtagctatgtgataatttcccaccattta

SEQ ID NO: 81510 - DNA, 201 bp, Bos taurus
ccatcagccgtcacctgttcctgggaatggctaacggcagtggtatggcatgctgaattttaatgtgcgagtggccctctctggttcagaaatgggtcccrcaaatatgaacccattaaaacctttgggagcagttttggagtcaggaaaattcatcatacctggtatagacagcgttcaccatgctgctactgacacacg

SEQ ID NO: 81511 - DNA, 201 bp, Bos taurus; identical to SEQ ID NO: 41215

SEQ ID NO: 81512 - DNA, 201 bp, Bos taurus; identical to SEQ ID NO: 41217

SEQ ID NO: 81513 - DNA, 201 bp, Bos taurus; identical to SEQ ID NO: 41218

SEQ ID NO: 81514 - DNA, 201 bp, Bos taurus; identical to SEQ ID NO: 41219

SEQ ID NO: 81515 - DNA, 201 bp, Bos taurus
aactgttgaagaagggacagtgtccttccattgtctatgctataagcttcactacatcaagaaatacctgccaggctgtagttggctccccttaactccaytgtttttaaatactgtatggatgcagatggtggccattttaaataagagaagacataacgcaaagtgtagaaacagtggaaataaaaaggcactaataca

SEQ ID NO: 81516 - DNA, 201 bp, Bos taurus; identical to SEQ ID NO: 41220

SEQ ID NO: 81517 - DNA, 201 bp, Bos taurus; identical to SEQ ID NO: 41221

SEQ ID NO: 81518 - DNA, 201 bp, Bos taurus; identical to SEQ ID NO: 41223

SEQ ID NO: 81519 - DNA, 201 bp, Bos taurus
gaaacgcccgcctgcagactcagaactgaatggccagtcgaagctctgttctctgctttagtgaatttcacaccccgcccctggatggcccgtttctctcktccttcctcttccttcttgcctttcaagccctctgtgagtggttgcagtgactagaaggtcagacgagtgggggcccagactctgacctggggcgttcct

SEQ ID NO: 81520 - DNA, 201 bp, Bos taurus; identical to SEQ ID NO: 41224

SEQ ID NO: 81521 - DNA, 201 bp, Bos taurus
aagatagatgagtcacaggtatgagacgcacagagcgggaaatacagccagtaatcgcagaatagtttcgtacggtgacagatgaaacgacgccaaaaagrcatgcaccttaaccaatttgggattattctggaaatgcaaggacagtttaataacagcagattattaatgtaatgtacttaacaacacattaaagtagaa

SEQ ID NO: 81522 - DNA, 201 bp, Bos taurus
ccctcgcctcctgtccgaacaatttctgttaaacctgctgaaaggaggctccttttctgaatgttgaagatgaaaaagacgagggtctggccaattctccyggcagacagacggacaccgagagaccgagcacgagctgaggtcccactgctgctgctgtactcgcgtgtcgcggccgtggccgggggctcctcttcgggg

SEQ ID NO: 81523 - DNA, 201 bp, Bos taurus
cgcatcagtgatgctgcactgagtgtttaaaggtgcagcagatacgcgcgccctggtccctgcacactcatcggcctgcactcttcctcaggcgtgtggcmgacacagcaggggtacacatcttccatcacccttgagaaagcacagccagcactgggaacagctgcccagcagacaaacctgtcagaaacacccttccta

SEQ ID NO: 81524 - DNA, 201 bp, Bos taurus
cctcactcccaccccgggcgtaactcggcagggcctcacttccgtcctttctctgggtaacagtcggcatctgctaatccagggcttccgctccatccccyacccccacggcctctggcaaccaaagtctgctctctctgtgagtctgtctctatttatagacagcttcatctgtgtcatttcagattccgcatataaatg

SEQ ID NO: 81525 - DNA, 201 bp, Bos taurus
aaacatacgacgaatatgtggactttgaaaaccattttcttaatgaatataggcatttcctcaacaatatgagtctttataacttaaaaggctaccacaakagactagttttttacattccaaactgcagttgatgttaaacacgagccaagaccagaaattagcgctacatgtagaagaaaaaatacagcaacctagcaa

SEQ ID NO: 81526 - DNA, 201 bp, Bos taurus
gcaaaggacacctcagctctgtggaccgctcatgagataccggacaagacaaggcaagagcaagctgccaccctggcctcccctgagggacagagctctgygcacagactactcatctgcagctgcgctgtattcgtgggagatgacacccaataaactaaaacaatgctaaaggccatcagacttggggagcagagtgat

SEQ ID NO: 81527 - DNA, 201 bp, Bos taurus
tattgtctgtaaatggtacaggtgctttgctcagtctcagtttgtgcgatgagaacataattggcccgcggaatttgaagggctctctccgaggcctctgyaggtgcccacgtgttggtcccaccctgagttgggggtgctggctggcggctgcagttgctcactgcctcagtggcctgcacaccagcttagcctgtagat

SEQ ID NO: 81528 - DNA, 201 bp, Bos taurus
tcaccacggaccaaaacgtgggtgtgctcttgtataccaactctgtgtgtcactcaaggatatcaacaaacctgattacccttaaactctaaaatgtgtaytgggggattagaaatcaccatatcctgggcttatcatcaattatgtagccatctatctctctcaaatgctgcagtatattaataggaaaagatgacataa

SEQ ID NO: 81529 - DNA, 201 bp, Bos taurus
atgcacagaagaaaaaaaacagaagaggaagctaaaagggagacagtcatgtctggtcgctagctcgggtcattctttgttgtggggctgttctgagtatygtgggatgtttacagcatcctggtctctacccactagatgcgagaagcactccccactcttatctctggttttgacaatagcaatggtctccagacattg

SEQ ID NO: 81530 - DNA, 201 bp, Bos taurus
aaagcttacttttgctccatgtggtgtcggccagggtagcttgctgaaatgaggatctatatccacgtggttcacttaggtgggcttgcagggagccctgyggggctgctgggtggcccctcagtggtgctctgtgtgggtctgcccctgtggccgcttgagactccttctaacagggtggccggattctaagtgggaggg

SEQ ID NO: 81531 - DNA, 201 bp, Bos taurus
cctgcaagagcaaaagccacctagggagcttgttagaatgcagtctgcggggcctccgcgccacagatgctgagcttccgtgtgtggccgtggacctcccrccggtgtctgtcccgtgtaggctgcccctctgaaggcaggactgatcttccttgtatgtctggctgcttatcccccactcccattatctactcaaggaaa

SEQ ID NO: 81532 - DNA, 201 bp, Bos taurus
cacagcattcatggcacgaacagctgttgttattccgaatctctgtggtttaccctgttgtatatctcaaggagtttgtgtagtaacaaagctgtaatgayaaagttgaaatctgtcatcaaagtgtcctctaaattttctaagtctcttttaaactaaagccaaacagattttagtcttcatcaccttttccgaaaagct

SEQ ID NO: 81533 - DNA, 201 bp, Bos taurus
aataatttgggggccaactggctgttttgcaatttcgtgatgacgctgatgattcctgtgtttgtgctggggctttgctggagaattccgtcctcccttcygtcatctcctgaccttgaactggcctgcaacaggctatagaaaccattttgagtttctgcaaaagagagttaggttaaaacctcaagcacgggttggatt

SEQ ID NO: 81534 - DNA, 201 bp, Bos taurus
gactcaatgtgtagaatccatggtaaatcattagaacacaatggaggtgacctactaaatattacagactatattctagtttataatgttccttgtaagaratggcacatatttttgtaagtcagaaattcgaaagagtctaaaatgcccctgttcccttttttggcaaagatgagatgtctaagtgaattgtagcaattg

SEQ ID NO: 81535 - DNA, 201 bp, Bos taurus
agtcatgattttgtgaatggattacgtggaggacttgtgaagaagtgcttcaaggctggggataaatgtcaaaagcatcccagtggagattgctgggtgtmtgggtcatatgcacagaccctctcactcaacaacaggattattgtccacacaacttatcttggaggtgtcttgttcttgggaagtctttttctaccagaa

SEQ ID NO: 81536 - DNA, 201 bp, Bos taurus
tctctaagtggcccctgaatcattaagggctccaggcttgatcgattagcccaggaggctacagtggtgggtcttgataccagttcttgctgcctgcttcyatgctaataaacatttatgttcaaagcaggttatgggttttccttgtggcatttaaagcttactgagagcagatgctgttagtgaagagattagctagaa

SEQ ID NO: 81537 - DNA, 201 bp, Bos taurus; identical to SEQ ID NO: 41225

SEQ ID NO: 81538 - DNA, 201 bp, Bos taurus; identical to SEQ ID NO: 41226

SEQ ID NO: 81539 - DNA, 201 bp, Bos taurus; identical to SEQ ID NO: 41227

SEQ ID NO: 81540 - DNA, 201 bp, Bos taurus; identical to SEQ ID NO: 41228

SEQ ID NO: 81541 - DNA, 201 bp, Bos taurus; identical to SEQ ID NO: 41229

SEQ ID NO: 81542 - DNA, 201 bp, Bos taurus; identical to SEQ ID NO: 41230

SEQ ID NO: 81543 - DNA, 201 bp, Bos taurus; identical to SEQ ID NO: 41231

SEQ ID NO: 81544 - DNA, 201 bp, Bos taurus; identical to SEQ ID NO: 41232

SEQ ID NO: 81545 - DNA, 201 bp, Bos taurus; identical to SEQ ID NO: 41233

SEQ ID NO: 81546 - DNA, 201 bp, Bos taurus; identical to SEQ ID NO: 41234

SEQ ID NO: 81547 - DNA, 201 bp, Bos taurus; identical to SEQ ID NO: 41235

SEQ ID NO: 81548 - DNA, 201 bp, Bos taurus; identical to SEQ ID NO: 41236

SEQ ID NO: 81549 - DNA, 201 bp, Bos taurus; identical to SEQ ID NO: 41237

SEQ ID NO: 81550 - DNA, 201 bp, Bos taurus; identical to SEQ ID NO: 41238

SEQ ID NO: 81551 - DNA, 201 bp, Bos taurus; identical to SEQ ID NO: 41239

SEQ ID NO: 81552 - DNA, 201 bp, Bos taurus
cttaatttatagggaacctcatgaaattccgtgagggcggatgttgtcccccaggtctctgtggtcctggccattgtggggccctgagtcctgattggacrgcggctcagcccatgatgtcattgcagtgttttagctggatgtcagccttgcaggccagctaatcaggaccaaaaacccggccagtgtcttcatgcagaa

SEQ ID NO: 81553 - DNA, 201 bp, Bos taurus
aggctcaccactcaattagtggctcctttgtagagtggtctccacacacatcaccatttaatgagaagtcccgctgggccctgtgcacctgctcctgtacrgagtttccactgggatatagtctctgtgagttgctgtgggtggggaggcttgtggttttctcatctgcaggaaataggaggttaggggcctgcctgtccc

SEQ ID NO: 81554 - DNA, 201 bp, Bos taurus
cctcccgcagcagctgtttgtggtggagcagatgtggatggtgaggtgacctgcatgggtgcagccccatgctgccccagggctgggccaggtgcattcckagaggatttggtgaaatcccacgccatgcggctcagctgcaaccagcagagactgaagggacccaatttgcggcccaggaacccgtactcttatcctctc

SEQ ID NO: 81555 - DNA, 201 bp, Bos taurus
aggatttctgccagcctttaattgctaccttgaaaaattctgcatccctctcagcattagaccaaagtgcagtgtggtttcttgggcatagtgaactaaamgtgcatgtttgtcagatgaaaggcatttcatggaagcagtgaaagaagaactccaaactgctcctggctctatagcctgcaattggaactctaacttctc

SEQ ID NO: 81556 - DNA, 201 bp, Bos taurus
acatttaataatatgttaatgatatcttaataaagctattttttaaaaaaagcaagtaaatagaatttctcacattagccactaggcctaatggtgggccmcaattgaacatcccacctgtcctcagcaatctgttcaggctggtcacagttttgaaattgtatgttggttactttccttcctgcctggtccactcctggc

SEQ ID NO: 81557 - DNA, 201 bp, Bos taurus
aggcacctccatagcaagtcttcctttgtcatcttttgatcataatccctcatcccaccccttgtggctttcccactccatgggggccaaagatggctggkgagacactgcatttagggagaatgacccatgacccctcctctttttgctatgcagtgtcactgttaaagcagtaagcactgccttaagtgtaaagcacat

SEQ ID NO: 81558 - DNA, 201 bp, Bos taurus; identical to SEQ ID NO: 41246

SEQ ID NO: 81559 - DNA, 201 bp, Bos taurus
acagaagaagttaaaaccgagggaaccactttggaagtgacaggtgcaagagattaaaaccctgttgttagtactgacagcataggaagaggcttatagaycttgagaaatataagctggaccaaggaactatccaaaaatgaactgaccccacactgcccacaacaacatcagagaaagtcctagatatatttttactat

SEQ ID NO: 81560 - DNA, 201 bp, Bos taurus
agttggacacgactgagtgactgaactgaactgaactgatggcagcatgtactctctccgtctgcactgctcaggtttcagattgctcagcagggccaccrtccaaagctgacattgtgttttgtgcccttcccaggtccaagcagctcaggcaaccagctgcttggctagcgcactgttccaggtgggccgtgcatctta

SEQ ID NO: 81561 - DNA, 201 bp, Bos taurus
gtttgatccccttgtagtccaagggactctctagagtcttgtccaacaccacagtccaaaagcatccattctttagcagtcagtcttctttaagggccaamtttcacatccatacatagctactggaaacccatagatttgactagacagactttgtcagcaaagtaatgtctctgttttttaatatgctgtctatttagg

SEQ ID NO: 81562 - DNA, 201 bp, Bos taurus; identical to SEQ ID NO: 41247

SEQ ID NO: 81563 - DNA, 201 bp, Bos taurus
cagaggctgggctcatagccttactcttaggaccacagctgattctcagaacagcatgaagtggggttgctgtgcagccctaggggaagcccccacctgcrtgttagtgggcccagcaggagtgctccactccggccactgcaaacagcgtcctttcatttatttgttttctgttcaagttactacctcccacaaaggagg

SEQ ID NO: 81564 - DNA, 201 bp, Bos taurus
tggccaatcattttgatgaaacagcatccagaaatgccaaaaaatgaattctcctttctccactgcactgtgacttgtcaagggtatgaacaacaatatamaattctcttttttattcaaaaggccaccgtggtatctagcaatgtgatttgtgcattacaacaaacttctgaactgaaatgaacttctggaactctgatt

SEQ ID NO: 81565 - DNA, 201 bp, Bos taurus
atcctgtcccttctaggtcagcactgtcctttgtgcccatccattcctccccatccccgacgcccctcattgcatcttcagctgctgccggaatatcaccrcttggttgtctaagaaaccattcaaaccaatgaagttcaaagctgttctcaactccccctcaaccgtacactctcacctgtgtttcccacctcagctgct

SEQ ID NO: 81566 - DNA, 201 bp, Bos taurus; identical to SEQ ID NO: 41249

SEQ ID NO: 81567 - DNA, 201 bp, Bos taurus; identical to SEQ ID NO: 41250

SEQ ID NO: 81568 - DNA, 201 bp, Bos taurus; identical to SEQ ID NO: 41251

SEQ ID NO: 81569 - DNA, 201 bp, Bos taurus
gcgttggcaggcatattctttactagggccacctttggaagcctaaaacaaaggataagctagtccaaaatgtcagtactgctgaggctgagaaagcctargatagaggaactgtacagacatttgtcaagaataatctggtactattccaccaaaccgagtgtcccctattctgggactctgctgttcccctccagaaca

SEQ ID NO: 81570 - DNA, 201 bp, Bos taurus
aactgatcatcactaccctaaataggatttcttgtcccataaaagatgaatgaaaacaacaattattcttgaagctaagacaaaacagaaacatgtattaycatttgactcatttaacaaagaccagtggctgagctagacattaattcaatattatttacttacctaatttctctcttcagttcagttcatttcaatcat

SEQ ID NO: 81571 - DNA, 201 bp, Bos taurus; identical to SEQ ID NO: 41254

SEQ ID NO: 81572 - DNA, 201 bp, Bos taurus
gggctgaggcatccaagggctcccagtgccttgtccactcccaggtcaccgggcatcctcctttatctggacactggccgcccaggactacagagttaccrcctcttctgcagctagggtgcttgtgtgaccaggctctcttccagaggggatgggagtgattcgcacaaactctagaatgtgtcctgggagagagaagca

SEQ ID NO: 81573 - DNA, 201 bp, Bos taurus
gggtgggtgttttgttccattcagacttggccaaagaaatcagccttgaagtggctctgggcacaagctcctcagagcccatatcattccacatccagccrgagagctgggccacaactgctggctccactaggaaacagtggccattcaggtgtcgtgtggaaatgtgtctggttgaactaataatcatatggatatgat

SEQ ID NO: 81574 - DNA, 201 bp, Bos taurus
attaagttttaactgctggggtgtttattatgatacatcaacattgaaaaaagggtttggaaaatatacttaagattcacattatgttttatgattatctrtgggaaactaaaactcatctatgcctaagtaagactttttgatcagatgatgggagagtgttttatcaggtgtggagaacacaggaacctgaagggaagc

SEQ ID NO: 81575 - DNA, 201 bp, Bos taurus; identical to SEQ ID NO: 41255

SEQ ID NO: 81576 - DNA, 201 bp, Bos taurus; identical to SEQ ID NO: 41257

SEQ ID NO: 81577 - DNA, 201 bp, Bos taurus; identical to SEQ ID NO: 41258

SEQ ID NO: 81578 - DNA, 201 bp, Bos taurus
gcttcatttccattccatttacctgtctgcagaccagagggctaagtgatggatatgatgctacacttctgcacaccctagaatggacacaccctgcttgkctgaccttcccatagtgagacgaggatattagctatgactatgtcctcatgcataaagaatgatgctgctacgactgttatttcattctttctgggtaat

SEQ ID NO: 81579 - DNA, 201 bp, Bos taurus
gagtataaaatagcttcaaattaaatgttgttcctacagattcaataagttactgtacccacaaaatgagggggagaaggatttcaaaaaattagagggcytaacaaaaattgattgctaaaataagagaaattcagtacacagtttgggagataaagtcaaagtaatctcccagaatgtagatgcgaatatcaagagatg

SEQ ID NO: 81580 - DNA, 201 bp, Bos taurus; identical to SEQ ID NO: 41259

SEQ ID NO: 81581 - DNA, 201 bp, Bos taurus
catgttagaaaggaccctgccacacacacaagggacgatggggagcatacagaatgatgaaatttggggttccattaaataaacactacaggagacatttrgggccagcctttccagctctctggacatatagtcaggcaggccacaaaagacccccacaccacccaacattcaaagtaggcttttgcttccaggaagagt

SEQ ID NO: 81582 - DNA, 201 bp, Bos taurus; identical to SEQ ID NO: 41260

SEQ ID NO: 81583 - DNA, 201 bp, Bos taurus; identical to SEQ ID NO: 41262

SEQ ID NO: 81584 - DNA, 201 bp, Bos taurus
ggactcctgctggtgccagaacaggaggcccagggtcacatcaggaaggaacagaagcctcaggacacgccacagccctgcagccagccagagggaacacratcatcctcccaggcctctcaggctggttatgtaatgttccacagaatcgtgtaggcctctataaaaacagttgttttcaacgacaaaaatacttccatt

SEQ ID NO: 81585 - DNA, 201 bp, Bos taurus
agacagagaaagaataagggaagagagacaggaacataaagggaacaatgggtgaggagacaacggagggaaatatgagaagagtggccaagaataaaccrtgtaaattcttgccacaaaatctgaaccttcaatctttgatgtggagagaataagaccatattttaagatcaaaaagtaaggcccaaaagacaataaaac

SEQ ID NO: 81586 - DNA, 201 bp, Bos taurus
cactggccccgattcccattgtcaacctgcccagagccttctgctctgccccacacactcagcacagccccactttaaaagactcttcaggggacttcccyggtgggccagtggttaagaatctgcctgccagtgcaggggacatgggttctacctctggtccaagaagatcccacatgccatggagcaactaagccacaa

SEQ ID NO: 81587 - DNA, 201 bp, Bos taurus; identical to SEQ ID NO: 41263

SEQ ID NO: 81588 - DNA, 201 bp, Bos taurus; identical to SEQ ID NO: 41264

SEQ ID NO: 81589 - DNA, 201 bp, Bos taurus
ttagtcacaaacatgaacagttgagcattctggtcactaacatccatctttatggctagaatacaagggacatgcatcaagctgtcttatttatctctggyggcatttttcatctggtgcacagggctttgtccatgttgtcatattttatttgtctatccatcttgtaaatggttgttccttgttgtcaagcattgccat

SEQ ID NO: 81590 - DNA, 201 bp, Bos taurus; identical to SEQ ID NO: 41266

SEQ ID NO: 81591 - DNA, 201 bp, Bos taurus; identical to SEQ ID NO: 41267

SEQ ID NO: 81592 - DNA, 201 bp, Bos taurus; identical to SEQ ID NO: 41268

SEQ ID NO: 81593 - DNA, 201 bp, Bos taurus
cagacgacggggagcccaggatttaggtcatccccaggcggaagtagagaaggaagtgtctcgtctttaaagtcagagtggaagaggtgaatgaaaacgcygcccaaacctcgtggcattagtaggacgactggaaaattccacctgaagttgctgaaatgaatttgtcttttttcccagaagtgaaaaataaacaaattc

SEQ ID NO: 81594 - DNA, 201 bp, Bos taurus; identical to SEQ ID NO: 41272

SEQ ID NO: 81595 - DNA, 201 bp, Bos taurus
caagtataattaaattagatgtagtcacacctggagggttttgtccaccatctccatcaacatagagaatagacccacgggtctgttctctggataatcayggtagaaactgtaaatagcggtagcatggaggactaacagggaggagcggggaaggccctgccacactgcgctgggcgttgctttcccttccaccacaga

SEQ ID NO: 81596 - DNA, 201 bp, Bos taurus
cagccttgctcccctaactgagcccctcagcataccagtgacactcgaaaacgcaaatcagaagcccctcgcctcagtggccgactccttttccttatagygtcctctgttccacattcagcctcctctgtccccagccagcctgaactcttccatttcctctagggccgctctcctgccttttggcctttgtgtatattg

SEQ ID NO: 81597 - DNA, 201 bp, Bos taurus
aagtcgaagtcatcatccccatagttcaacgtgtatgtttagaggtagggcctttaaagaggtaatgaagttaaaatgaggagccagtgagaaggtggctrtctataagccaagggaagtggcctcagaagaaaccaactttgtagaccctttgatcttggacttccagcccccagaactgggagcaaatacatttcttgg

SEQ ID NO: 81598 - DNA, 201 bp, Bos taurus
tgacagcaagatatttcaaaatacttaaggacttttgcctgcagctaaaaagaaaaaaaaaaaaaacgcaataagtacacataatggaaatctctccccartggccttttcatttcctctcagcccaggggaaagtatttgactggggagcagaaatagggagggtttgcagccagcagtattaaagggcaagaaaagata

SEQ ID NO: 81599 - DNA, 201 bp, Bos taurus
gggtagggccacaaagatcctacactttccctgtctgttttgcagaaccgaacccaaaggggtagctgatcagcgatttgtaaccaggagtctatgtatgraaactggtctgggtgcctgggggcccctgtccccactctgtatacagcgtaactacaagaaggtctttggctggccaccccaccctgaaggtgggccatt

SEQ ID NO: 81600 - DNA, 201 bp, Bos taurus
agaaagcactcataaccatgaagacccagcacagacaaagataaataaacatgcttaattatttaaaaaaaaaaaatccagtggaagtccctacaggactrctaggccccccaaccccacttctttagtgtatgtcaacctgaccttgtatcagtggattaacaaatgggcagttggaggaattccctggttgtccagtga

SEQ ID NO: 81601 - DNA, 201 bp, Bos taurus
ctttccaccttaatttctgttcacctcatccagcgacctctcctgatcccccacaggtctacaagttctgatcaggagccccgaccctggggccccatccyagtgcttatggctttcaaggcatcgtgttaagattagctgtttacttatcaattcccttgttggccaatgttctctgagggtagaggacatatcttttat

SEQ ID NO: 81602 - DNA, 201 bp, Bos taurus
ccctgtgtgaatttggtaaggaaacccaacactgggtttcagttttcattacacaccggaaacttggcctgagatcactaaaaagttcactgtggtttgtraacctttcaagcagatggagccaggtttctgccatgcgcctgcccccgccgatgccagggggggatttatggggctgagcgggaaccaggtacaattcca

SEQ ID NO: 81603 - DNA, 201 bp, Bos taurus; identical to SEQ ID NO: 41277

SEQ ID NO: 81604 - DNA, 201 bp, Bos taurus; identical to SEQ ID NO: 41278

SEQ ID NO: 81605 - DNA, 201 bp, Bos taurus; identical to SEQ ID NO: 41281

SEQ ID NO: 81606 - DNA, 201 bp, Bos taurus; identical to SEQ ID NO: 41282

SEQ ID NO: 81607 - DNA, 201 bp, Bos taurus; identical to SEQ ID NO: 41283

SEQ ID NO: 81608 - DNA, 201 bp, Bos taurus; identical to SEQ ID NO: 41284

SEQ ID NO: 81609 - DNA, 201 bp, Bos taurus; identical to SEQ ID NO: 41285

SEQ ID NO: 81610 - DNA, 201 bp, Bos taurus
ttctccactgactgccactctgctggcagcaagccctggagcgtgaacgagcaccgttctgctccgtgtttcatcatcagggcctaagaatcctgcccccmgagttctgagtgttattcccaagccttcgtgcagtctgtcctttcagatctccttaggtcaggagctggcaagctgtcccctaaggagccagggaataaa

SEQ ID NO: 81611 - DNA, 201 bp, Bos taurus; identical to SEQ ID NO: 41286

SEQ ID NO: 81612 - DNA, 201 bp, Bos taurus; identical to SEQ ID NO: 41287

SEQ ID NO: 81613 - DNA, 201 bp, Bos taurus; identical to SEQ ID NO: 41288

SEQ ID NO: 81614 - DNA, 201 bp, Bos taurus; identical to SEQ ID NO: 41289

SEQ ID NO: 81615 - DNA, 201 bp, Bos taurus; identical to SEQ ID NO: 41290

SEQ ID NO: 81616 - DNA, 201 bp, Bos taurus; identical to SEQ ID NO: 41291

SEQ ID NO: 81617 - DNA, 201 bp, Bos taurus; identical to SEQ ID NO: 41292

SEQ ID NO: 81618 - DNA, 201 bp, Bos taurus; identical to SEQ ID NO: 41293

SEQ ID NO: 81619 - DNA, 201 bp, Bos taurus; identical to SEQ ID NO: 41294

SEQ ID NO: 81620 - DNA, 201 bp, Bos taurus; identical to SEQ ID NO: 41295

SEQ ID NO: 81621 - DNA, 201 bp, Bos taurus; identical to SEQ ID NO: 41296

SEQ ID NO: 81622 - DNA, 201 bp, Bos taurus; identical to SEQ ID NO: 41297

SEQ ID NO: 81623 - DNA, 201 bp, Bos taurus; identical to SEQ ID NO: 41298

SEQ ID NO: 81624 - DNA, 201 bp, Bos taurus; identical to SEQ ID NO: 41299

SEQ ID NO: 81625 - DNA, 201 bp, Bos taurus; identical to SEQ ID NO: 41300

SEQ ID NO: 81626 - DNA, 201 bp, Bos taurus; identical to SEQ ID NO: 41301

SEQ ID NO: 81627 - DNA, 201 bp, Bos taurus; identical to SEQ ID NO: 41302

SEQ ID NO: 81628 - DNA, 201 bp, Bos taurus; identical to SEQ ID NO: 41303

SEQ ID NO: 81629 - DNA, 201 bp, Bos taurus; identical to SEQ ID NO: 41304

SEQ ID NO: 81630 - DNA, 201 bp, Bos taurus; identical to SEQ ID NO: 41305

SEQ ID NO: 81631 - DNA, 201 bp, Bos taurus; identical to SEQ ID NO: 41306

SEQ ID NO: 81632 - DNA, 201 bp, Bos taurus; identical to SEQ ID NO: 41307

SEQ ID NO: 81633 - DNA, 201 bp, Bos taurus; identical to SEQ ID NO: 41308

SEQ ID NO: 81634 - DNA, 201 bp, Bos taurus; identical to SEQ ID NO: 41309

SEQ ID NO: 81635 - DNA, 201 bp, Bos taurus; identical to SEQ ID NO: 41310

SEQ ID NO: 81636 - DNA, 201 bp, Bos taurus; identical to SEQ ID NO: 41311

SEQ ID NO: 81637 - DNA, 201 bp, Bos taurus; identical to SEQ ID NO: 41312

SEQ ID NO: 81638 - DNA, 201 bp, Bos taurus; identical to SEQ ID NO: 41313

SEQ ID NO: 81639 - DNA, 201 bp, Bos taurus; identical to SEQ ID NO: 41314

SEQ ID NO: 81640 - DNA, 201 bp, Bos taurus; identical to SEQ ID NO: 41315

SEQ ID NO: 81641 - DNA, 201 bp, Bos taurus; identical to SEQ ID NO: 41316

SEQ ID NO: 81642 - DNA, 201 bp, Bos taurus; identical to SEQ ID NO: 41317

SEQ ID NO: 81643 - DNA, 201 bp, Bos taurus; identical to SEQ ID NO: 41318

SEQ ID NO: 81644 - DNA, 201 bp, Bos taurus; identical to SEQ ID NO: 41319

SEQ ID NO: 81645 - DNA, 201 bp, Bos taurus; identical to SEQ ID NO: 41320

SEQ ID NO: 81646 - DNA, 201 bp, Bos taurus; identical to SEQ ID NO: 41321

SEQ ID NO: 81647 - DNA, 201 bp, Bos taurus; identical to SEQ ID NO: 41322

SEQ ID NO: 81648 - DNA, 201 bp, Bos taurus; identical to SEQ ID NO: 41323

SEQ ID NO: 81649 - DNA, 201 bp, Bos taurus; identical to SEQ ID NO: 41324

SEQ ID NO: 81650 - DNA, 201 bp, Bos taurus; identical to SEQ ID NO: 41325

SEQ ID NO: 81651 - DNA, 201 bp, Bos taurus; identical to SEQ ID NO: 41326

SEQ ID NO: 81652 - DNA, 201 bp, Bos taurus; identical to SEQ ID NO: 41327

SEQ ID NO: 81653 - DNA, 201 bp, Bos taurus; identical to SEQ ID NO: 41328

SEQ ID NO: 81654 - DNA, 201 bp, Bos taurus; identical to SEQ ID NO: 41329

SEQ ID NO: 81655 - DNA, 201 bp, Bos taurus; identical to SEQ ID NO: 41330

SEQ ID NO: 81656 - DNA, 201 bp, Bos taurus; identical to SEQ ID NO: 41331

SEQ ID NO: 81657 - DNA, 201 bp, Bos taurus; identical to SEQ ID NO: 41332

SEQ ID NO: 81658 - DNA, 201 bp, Bos taurus; identical to SEQ ID NO: 41333

SEQ ID NO: 81659 - DNA, 201 bp, Bos taurus; identical to SEQ ID NO: 41334

SEQ ID NO: 81660 - DNA, 201 bp, Bos taurus; identical to SEQ ID NO: 41336

SEQ ID NO: 81661 - DNA, 201 bp, Bos taurus
cacttaaggttacaatggcatatgttttatacagcttgccacaattttaaaaatgggggcggggtgctcttatttaataatatgggcctggtaaagggagygggggcatggttaaaaaaacccactaagcactctatgcaaattagtgatacagatggaaagcaagaagggacatttgcaccacctactggcctttgggat

SEQ ID NO: 81662 - DNA, 201 bp, Bos taurus
tgaaggccctggtttctgacccattccctcaaggagcaacatcctttccctgacactgagtctcagggagaaactcttttctcaaaccttaacaaaaactmatgaatgccatgcttcccaggccactttattacactgccaaataataattaaaattagaattaaagtaacacataataataaacataatgtttcacagtt

SEQ ID NO: 81663 - DNA, 201 bp, Bos taurus
gacaaaactacaagcaaataagctattttctggaaatagaatcttcagagctgagtgaagaactgaatgtctttctctcctcacctacctgtggccctaayagatcttctctggggtcacaggaccagccaacagcagaactgggaccagaggtagttccaccagttcctcttttgaaggactttctattcactatacaag

SEQ ID NO: 81664 - DNA, 201 bp, Bos taurus
ttgtgcttcatccagtctggcaattctcatgatgtactgtacatataagttaaataagcagggtgacaatatacagccttgtcatactcctttcccaattyagctccatagtccacagaatttcaatactctgtagtttccaaaagattttcacttgctaccaagaattaagcatgaattcaaaaatttttaataaaaaaa

SEQ ID NO: 81665 - DNA, 201 bp, Bos taurus
tccattgcagccaagctagcattacctatttcttacggctgccttcccaatcgtcttaagcttagttcaacccaatgtacataagaacgtttcaggccacrcaatttgtccttctctgaatctgtgcagcaaaccgtataaaattttgtttcccttagatttcctggcttctttggggccactgacccccatgaacacagc

SEQ ID NO: 81666 - DNA, 201 bp, Bos taurus
ttattttgcctccatatggaagaacatagcacacaacctatgcagaagttctaccaatagaagacaaaaaagagagaaagatctgaatctgacagaacttytaaatccaactgccaatttaataaaagtagtataaaataaaattcaatgataccaccaaatgccatgaaatcaggggatgcaatcagtaaacaagtgact

SEQ ID NO: 81667 - DNA, 201 bp, Bos taurus
aaaaaaaaatcaacagcttttagtatcattaaattgacctctgaatagaataagcccgagcctccaccacacaacatcccaaaacaggtatggaactgtgrccttaagatgctctgtgtgagtgctgtaacattttaatttacagagaagcagtgattgatggcctctcaaaagcccccctgctcaatactttctatttta

SEQ ID NO: 81668 - DNA, 201 bp, Bos taurus
acatctgtgtggcccatcacgagagcagcctctgacagatggcactgcaccagccatggctaccccagcaggaagagcatcagtaaccatgggaaccaccrgggaccaaggtccaggcccctccaccaaatgggaaggcaggggatagggaggagcccagatacaggcaaacaggagtggcttagggctgaatctgattta

SEQ ID NO: 81669 - DNA, 201 bp, Bos taurus
catgtgggatcttagttccctgacctgggattgagcccatgtcccttgcattggaagcatggagccttaaccactgaaccaccagagaagtcccagtctcrcaggaaactcctctcaatttttttcttctggctcctctacttcctcccctgaagcatgggccttccttcagattctccacctggcagcgatttcattcac

SEQ ID NO: 81670 - DNA, 201 bp, Bos taurus
aggcctgactgtcagttcaagagggaaatggtgtcaggacatctttcagagctttcccacttgcctctgtatagctttctgctcacacctagtgaaaaggrtctttgggagaagatggcccagttctcatgctttgccatttcactgtttcttagcaagccaggcctcccactcttagttcctgaaactgttccggctctg

SEQ ID NO: 81671 - DNA, 201 bp, Bos taurus
tctcagttattattagaccactcccatctcagttcttagggcctaacagagaagaaacgaattgtctgagcacttcggctacttgatgttaagggcctgtrggcatctcttgatgttaagggactgtcccctgcttgggctggggtctctggaatgtgccctgaggccaaaggtacagcctcttgtggtacaacttagccc

SEQ ID NO: 81672 - DNA, 201 bp, Bos taurus; identical to SEQ ID NO: 41338

SEQ ID NO: 81673 - DNA, 201 bp, Bos taurus
tataaattcaatgaggttcccatgacaggcatatccatgtggccatgtcaagttcctctgtctagaagtcacatgatgaagataaagcttgggcacggcckggaaagatgagtaggggaggagaagtcatctggaatatgactgaataacatgaataaggacacagaaatctgaaaaattatggtgtgctcaggaaccagt

SEQ ID NO: 81674 - DNA, 201 bp, Bos taurus
taccacactctcttgattactgtaactttatagtaagtcttgaagacaggtaatgttggtgccagaacaattttgttctcttcaacattatattggttgtkctgggtcttttgcctctccatataaactttataatgcatttttcaatgtccattaataatttgtagggatttttattgtgattgcatttaatatatacat

SEQ ID NO: 81675 - DNA, 201 bp, Bos taurus
ttgacccccacccctggcccccaccatgcagcctacagattggttcacactcacccatgccaaccccttcagagccactgtttggctctgctgagggtgayaagccaaatggcctcatttcccagggtgctctgcagcttaggttcgacatgtgacctgacttcagccatgcagacactgcctgcaggacatcatgaagct

SEQ ID NO: 81676 - DNA, 201 bp, Bos taurus
ggagcgcacctatctgttctgaagagggggcatttgttttccccgctgcaatgatttcagtctggtttcatcatgttggaatttgatcacaccattttcaracaatgttaacatagtccagcttttgtttttctcatctcttccgagaggagactcactgtttctgtctgaggaagctcataccctcggcaaaacatcagg

SEQ ID NO: 81677 - DNA, 201 bp, Bos taurus
agggaagataatgatagtcacctaaattggaatcttttctagaatcccatgaaaagtttcacatcaacaaggaaagcaaataaaatcatctatggcccaarccaacagcataactggaaaacagacttcaatttacaactgaaaacaacagagccagctcttggaggccttacccaaatggtcaggtattgcaaaacaatt

SEQ ID NO: 81678 - DNA, 201 bp, Bos taurus
ccttgcatacactgctattgcctctcttgaagttttttccctcttttttatactctcatatctttcaaacactccccagacctggccacattgtattcaaycttaaagattcagctcaaatgtcacctttccccaggaatatgtatgtctttgatctcctgccttcatcaatctgggttatatggccttctttgtactact

SEQ ID NO: 81679 - DNA, 201 bp, Bos taurus; identical to SEQ ID NO: 41344

SEQ ID NO: 81680 - DNA, 201 bp, Bos taurus; identical to SEQ ID NO: 41345

SEQ ID NO: 81681 - DNA, 201 bp, Bos taurus; identical to SEQ ID NO: 41348

SEQ ID NO: 81682 - DNA, 201 bp, Bos taurus
tcccatctccaccttggcctccctaccctcgctctcctctcccaactcccagggtctccagagaccagagcccaccaccttcctgctgcagcccaagcccrccaggcctcaaccttcccacttgaccataaggctcaagaccgagtttggggacaaaagaataaggtgctgaaaggcatcagtcagtcttgaaattcccaa

SEQ ID NO: 81683 - DNA, 201 bp, Bos taurus
atactttaatgatgtcacctcagtctacatgttcatttccagggcagtctggaaaagacctaggtccaaatgcctttttcctagatcgatctagtggaaaygtctgtgctacatctctattctctttcagtagcacagcatctgcctgactttgggattccacatgctgttacggactaaatcaagcgaagaaagaaatct

SEQ ID NO: 81684 - DNA, 201 bp, Bos taurus; identical to SEQ ID NO: 41349

SEQ ID NO: 81685 - DNA, 201 bp, Bos taurus
ggaaaacataagatcaggtacattcttaatggaattgagtaagctgcattcctcttttggatttgtttctgattgctctttcttcacagaagcctgtgtgygtcctttctcatttctctgtgtatacccataagcattaaaaacagtcctttccttgtattacttctttctctctgttgggattggttcttctcttcgttc

SEQ ID NO: 81686 - DNA, 201 bp, Bos taurus
gggtgagattagtatttaaagaggtggtctgaatagagatgttctcatcaatgtgtgtgggcatcagccaatccaccaagggccttagtagacaaaaaggyagagagagagggaatttgttttctgtgcttgagctaggacatccatcacctgctctcaaataccagttctcttggttctgaggccttcagatttgaactg

SEQ ID NO: 81687 - DNA, 201 bp, Bos taurus
ggaataggcaggatgcccttctcctgcctacagctgcccctgtctccttacttgttgcctcaatgggcccttatctttctggcccctgagtatatatatawaagccttgttcttgctaattcaacccctgctcatgtgtctttgctccttgactcaactttggaggaagagttggtgtgtatgaatgctgatatgtttggc

SEQ ID NO: 81688 - DNA, 201 bp, Bos taurus
tatcttagactatatagagaaccctttctctatatagtctctataaaattgtgctaagtgttttttctctccataaagtttcgataagtactaagtggccrtggacttgagatcatacttcctggcaagaaccaggaatgtggctatcatcagacctatataccttaaaagacatcaaagcttaggacagaacaggtgaaa

SEQ ID NO: 81689 - DNA, 201 bp, Bos taurus
aaactatccccccagtgggactgagccactgggcaatggactcagtaggaatcttggctgtctgtcagaacaggatgcccagaggatatattgttgtcaaygaggcccaaaatgggctagcagttaggtgtaatggagataagcaggccaagtgtgtgagcaggaaatatgaagagacacatgtcaatgtggttaatatta

SEQ ID NO: 81690 - DNA, 201 bp, Bos taurus
tgctgtcacactcttgtccgttggcttcacttaccctggatgttcaagcaatagatttgataagtaaacatggtctatctgcttggttcaattgttctgtyagtgatagaattctgcagcaagatgcttgcaatttcctccaagaggatgcagagtcatccacttttattcctagccttaagctcccatttctctgactga

SEQ ID NO: 81691 - DNA, 201 bp, Bos taurus
gtgtaaagttataacatagatgtaatataaaacccttgtacaaacgtttctaagaaaacaattcagttaaattgatagaggcattgtgttaaacatacagyagtcagatttgtaggagtgtgttgttgagaaaagggtaatttctgtgaggcatattacagctaggtgtagctttggaggtataggttctacagatgttat

SEQ ID NO: 81692 - DNA, 201 bp, Bos taurus
acagaaatatcctgtaacagcaagtttgaggcatggaaaatgaaactaaggctaattgcttctttttgcagccttgactttgctttttatttatttctctktctgcttaaggaatacaaacaacagaataaatacaaagcttttggtgctgtctttctcagtaggtattgcacttagcagagaaataaaaaattaactcta

SEQ ID NO: 81693 - DNA, 201 bp, Bos taurus
gcaaatcatctggaatttaagtcatactaggatttttgcaaggcctatagtgctatggggaatacaaagaggccagatgatccaggggatactaccaggcyatagcaagtggacagaatccagatcactgaaactggtgaagcaacagggtagtagtcaccacatggacagaagaaactgtcctcaagatcagagaggtca

SEQ ID NO: 81694 - DNA, 201 bp, Bos taurus
aagccacttatcaattattctcctaagatagctttctacttgaaaagcatatgtagggagtaaagtaaataaatataacatatctgtttcattgcctagamtttaataggccctcaaattataaaccatttttatttataaaaataagaatcacagaaaaatgttcatctacatacattaagtattcaatcacaaaataaa

SEQ ID NO: 81695 - DNA, 201 bp, Bos taurus
acttcaaattctccctgaaaagttcattgtcaatgatgttgacattcatagaaaatgtttatacataaaatcagtggctgttgaagagacttaaacttctytgaataattgtttagcaataattgctcagcaatgtagtacttaaattttggtaatgatttaggtcataagttactactaaatacaatgcatttaagttcc

SEQ ID NO: 81696 - DNA, 201 bp, Bos taurus
agaacatgttttccaagtcatgatttaaaaccatcttattttcttatagaaaatatcacagtacatgatgataaagtacagaatatttttagcattaagakaattcagaaatcctaactactcttacagtgatcccactggcatattttcagtgctttacccaacttataaagattatacatttactaaaaaacctaggtt

SEQ ID NO: 81697 - DNA, 201 bp, Bos taurus
gatgtctggccctagatgagtgatcccaccatcgtggttatctgggtcatgaagatcttttttgtatagttcttctgtgtattctctcaacctcttcttawtatcttctgcaaaggccaacagagttctgctgagagcaaactttaacagggaaaagactaacagagttttgcttagagaatgaactggtcatagcaaaca

SEQ ID NO: 81698 - DNA, 201 bp, Bos taurus
tatttaggaaggaaaaatagtaaatgaggaagtcaatggccatgatagttcagttactctgaataaaatccaaatttgcagctctcaagaggaagctcacrgaatgtatttctgtggtttagactctggtgctgaataccttttttctcctccctcaatggggaaaaagtgacatttttctcagaggctaaaatcatgaag

SEQ ID NO: 81699 - DNA, 201 bp, Bos taurus
atattatgatttaatacagtaccatgttaacaatctatatacatatgctgataacatctgttatcacatatatgtgataatttaaaaagctcattagattyggatgtgtaatccccaaagaaaagtgaatagttatatttttgtaacttgattaccacttgctaggtatttaaaaaaagaatttagaaaattcacaaatat

SEQ ID NO: 81700 - DNA, 201 bp, Bos taurus
ggtgcctgcagagaccatttgcaagaaagtagcatcagcaacagtcaccaagagaagacagaagtcagattgcatagcagccagaaggaatcaaaaacagrctcagctgacccaaaggctacaaggccacaaatgtcaagttcttccctcagtgcctgctgctgtcaactacaaaacagtctttcctggcaaggacagcag

SEQ ID NO: 81701 - DNA, 201 bp, Bos taurus
agacactgcatggtgaacctgtcacatcacagctcagaaacttctaacatctcctcaggactggtctcatttggggctcaacctactctttcagtttctcrtgtgtaattacccttatcccactatgctccaacaaaaccacaacttaccattctttcaacatctccctcaaagtctaccactgatttgcttacattttcc

SEQ ID NO: 81702 - DNA, 201 bp, Bos taurus
aatacttagaaaccaaaatagtaattagtcataaaattttcaagattcaagccagcagaaaagatatgttctatcaagtttcctaatattactcagataayaccaatgaaataatatcaaagacacaactttctatttttaccatatttaaagctaccagcctgtacacaaaactcatgtttggtagcacagaaacaaatg

SEQ ID NO: 81703 - DNA, 201 bp, Bos taurus
taaacatttctcactctaaacttcaatgttttggtttgtttggcgtcgttgtgtgttgcacacacaaacttgggttcaacaactgtgctaatgcaacatamccccaccaaaattaggcctgttgagaaaccttctgtacaaggtgattcctgcctgatattacccattcagaaaaatattaaccaaaagagtcaaccagga

SEQ ID NO: 81704 - DNA, 201 bp, Bos taurus
ataaccctaaagattatttaaaagaccaccagaaaggaaaagaaaactttatatattaccataacctctgcacaacatttaccaatgtaaacacagccttkcagtgaaaaatgaaagtaaaactggaatccagttggttccccatgatttagtttaaaacagtaagcacactcactgtaatatacaagtgacttgtcaaat

SEQ ID NO: 81705 - DNA, 201 bp, Bos taurus
taatcaaagggtacaaagttgtaattctacatgataactaagtcctagatatctacttataacatagtacccaaagttaacaatattatattatacacttraaattttgctaacaggggaaatcttatattaagtattcatatcaccaaaaataataataattagaataacaataagaaggagggaggaaatttttagagg

SEQ ID NO: 81706 - DNA, 201 bp, Bos taurus
caggtggattctttaccactgggccatcaggaaagccctccttcatggatcacagcattgtcatagtgagggggcttgcataactcaatgaatctatgaaycaagcaatgcaaggccaccaagatgagcgggtcatagtgaagaactctgacaaaatgtggtccactggagaaggaaatggcaacccactcttgtattctt

SEQ ID NO: 81707 - DNA, 201 bp, Bos taurus
aaaagctagggtggtcctggccccaggcagagttctagaccatttctgaactgctgccgccacaagtgctagtgatgtctgccctcacctggctcaggttyttcttaggcctgagccagctctgcccctacaactgcatgctcttcttgtctgtggcagtctttgtcctggagaagagctgtattgtggaaccaatggggc

SEQ ID NO: 81708 - DNA, 201 bp, Bos taurus
ttacagatggctaccttctccctgggtgttcacatggccattcctccctctgtgcattctctctgtcctagtctcttcttatagaaacaccaggtgtaacrggttgggccctatctccacattcagaatgcagtcacattctgacttactggagattaggatttcagcatatgaattggggaggagggggacagaattcag

SEQ ID NO: 81709 - DNA, 201 bp, Bos taurus
ttgattaccttctatatgctgtgcttgcacagagatgatggtatacaaaacaaagtgaggtaatagtaaataggcaaatacatactgaaataagggctgcrtttgagggttaagacagtgaatttggggagcatattggacagggacccaattcaggaaaaagaagaaattccagggccaagtgtcagctaagagctaaag

SEQ ID NO: 81710 - DNA, 201 bp, Bos taurus
acataatagggaggaaaaaagtaaagcaataaaagcattgcgtccctaggactagagatgcgaaaagtaacctggaaatttcctaattttattctaagaakgtgtccatcctatgccgccgagtggggaaggctacggctccacagcgcagatcactgggcgtctcattccgaccgggccgcgcgacctaactggccatct

SEQ ID NO: 81711 - DNA, 201 bp, Bos taurus
tttgtggctgttttccctgttcttcccagcaatccactggaacagaaataatattcaacatttttaatcattttcaaaaagtagagacagtgtgctagacrccttttcccaatttgtttacttagtgtatgattacccaaattgggtgagacctcttggtttccctcatcccagaataaacactaacgtgatttgaagaaa

SEQ ID NO: 81712 - DNA, 201 bp, Bos taurus
atggtttgagtttctacataaagaacttacattttatttaaaaagtaataaaacatactaaatcaaagtgatgtaatttgcatttagaaagtttagaagasgcagtgcagtggttagaactaatgctttcactgcgaagggcacagtttcaatccctggttccaggaactaagatcctgcaggccatgcagcaaaaaagaa

SEQ ID NO: 81713 - DNA, 201 bp, Bos taurus
aaaaaaacgtttcaattctcacatacacttttattctgcaataatgcatctgcagttagaattcctatattggtgtttctcctttaagaaaatatacttgytcttttttaaaaaaaattttaagtttcaatctttttgtattaaatacattcatttttggaaactaaatccccccaatacttattgaattaagtccttgta

SEQ ID NO: 81714 - DNA, 201 bp, Bos taurus
tttgctggttgagagtcctgataataaaaagaacatttttttttttagtatagtactctaagtggatcaaagtgctatagaggttagtggctacttgtgcycttcataaagaaagctgaaatcagtcttctcaagaggaagcctgattctccaactcagggcactttacaaggacagtgccttctgtttttggtctttcat

SEQ ID NO: 81715 - DNA, 201 bp, Bos taurus
ccaaggagcaccaagcctggggacagagtgttcccagcagctgtaggcagccgaggagctgcaaccctctcctaggtctcgtaaggccctcctcctgtackacggggagcattcttttgggtgcatgcaaatggggggctgagactggtaaccacaacactaggtctttcagggctcaagaggaggcctcctacacgaaag

SEQ ID NO: 81716 - DNA, 201 bp, Bos taurus
tgactgtggcattgcccatcacagccaccagcaccagggccaggtaggctgcggtccacagtgccagctgccagccgggcatggagaaggctgtgatgccygtggcattgctgtcaaggccagacgagatgttgatatcggtcatcacgacacaggcccccatggccgcctctgagtctggcacaagaggtaaggctcctt

SEQ ID NO: 81717 - DNA, 201 bp, Bos taurus
gactgatgagagtggaatgagcccgcggggtggggtcagccaggggcaccctggcttcctgcccagcataggggtgggggtgagggaggccctgagatggkgatcaagggagtctgggtcacttgcagaattaagagacttgacccagagggaggggaggggcaaaaggtcagccatcctaacgaggagactgcctcctct

SEQ ID NO: 81718 - DNA, 201 bp, Bos taurus
gtcacaccggaaggcggagagggaaggaatgaggcttagcttcctgccacaattctatcccaaaccaagtgggcagtgctgggtctccatagcctggcctrgagatgctgtgaatggaattctctgcatacaactgcgaccactcgccaggatgtcctgggctgggacatgacagctgaccaagaagaattcttatcaggc

SEQ ID NO: 81719 - DNA, 201 bp, Bos taurus
aagcagacactgacatgccctgcaccaagccgctcatcttgcacgtggcgttgtcaaagggccagcctgcaaagacagaggccactacaaagtgagagacrcctcatccacaaagagccagagaccttcatccacaaagagccagagacctccagccacctgggccagtcccctctgtggcttgtatcttccctccagtca

SEQ ID NO: 81720 - DNA, 201 bp, Bos taurus
ttgcctgtggtccttttgtaccctgagctatccaggtggtttctcctgctcccgagcaggtcccttccatgggacagaagcacattggataaggcctaacrgtatactctgcaggatggtacccaagaatgacctcggaagacgctgaaacttttgagtaccctacccaggcccagtagtcattgtttctcagtccagtga

SEQ ID NO: 81721 - DNA, 201 bp, Bos taurus
cagaataaacaggatggaggaaggggctgctggcgaggtgctggaggcctctgactgcagatgctttccaggctgctccgggccccctctgcagttgaaaygcttgctgtttcgttgggaaggctggggttaggtccagcccatcttctggaagagctatgcgctctgggctgtctcagcaggcccgtccccgtgctctgg

SEQ ID NO: 81722 - DNA, 201 bp, Bos taurus
atcagaggaggctgggattatgatctctgttttatgagaccaagagaggttctgtaatttactcaaggctcatgtcatatccctaagggatctgggattcyggacaccaagattccctcaaacccatgctggtgactctgtgccctctctgtagcctagaggctacttggggttggggactgtgtttgtgcttttctgaat

SEQ ID NO: 81723 - DNA, 201 bp, Bos taurus
tgcagaccctgcctctgctcattctgttcacacctcccacagggctctccccttccctctgctgaggcatctgccatctgggccacccgcttcccagaackcaagaactgtctgatttctctgcatgctgagcacggggctgggctcatgatacaagggaggtcatgacttcaggagcagggcgtaacacaagaaagagaa

SEQ ID NO: 81724 - DNA, 201 bp, Bos taurus
agcaggagtaacttggccaagggcaaacggccagggcagtgccattttcctattgtgcaaaatgtccccagggcagcccaaactggcaccattcaggccaygagtggaaccctctcttggaaaacagaagaaagggaaggtccgttctccagcctcttaaaaagatccaggcagaggagcttaagggatcctagaatttag

SEQ ID NO: 81725 - DNA, 201 bp, Bos taurus
ctcctctctcagctgggtactttagccaagccattattcacatgacaaacacgtattgagcacctactgtgtgccgggccctgtcccagacattgaaggtrcagtcgtgagcatgacagatccagggatgcctccctgaaggatgcaaaccctgaggcccccaccccatagaaccagccttccaagacacatgggctgagg

SEQ ID NO: 81726 - DNA, 201 bp, Bos taurus
gtgaccctgggccattcatgttctctctctggattcattaagttagggatggtgagaggcaggaggaagtcaggtcagggctcccaggctccctcaccccygttttcaccaccagcaatggcctgtatttagattgtatgtgtagaacatttagcccctggctcataacatgcacttagtaaacaatagccatttagtctt

SEQ ID NO: 81727 - DNA, 201 bp, Bos taurus
agttttgctgtgaactgaaaaagtgctctaaaaataaagtcattttaaaaaaatatgaaaaatacttaaatttgacacctgtttcgatcttaaattcatgyaacatgaccctgatcatatttccactgactggtcatttggattctgttcttactgttaagttgcttattactattattactaaaggtcactggggggctt

SEQ ID NO: 81728 - DNA, 201 bp, Bos taurus
gggtccccagatgccactacctactgcagttaaactctgaaagatgggtaatgagtgaaaaaaggcactgggtccagtcctgaactgtaataaggccctgytttctgtctagattctagaacaacaagttctctccaaggtggctcctgggcatcctggagatgcctgcctcagattatgtgtggcatgtttcccaggtat

SEQ ID NO: 81729 - DNA, 201 bp, Bos taurus
ctcagagactaagggcccgggaggcctctgactggatgaatcgacccatgctcacctagagaatcagcccactacctgtaactgcctcccccgctgtggcrgcaggcgaaccataagaggactggccccagacgagtaaaaaggcatccctgggacaaggtgggacagaggaatgagctgaatgggaaggcttgctcacgt

SEQ ID NO: 81730 - DNA, 201 bp, Bos taurus
ataagatggtaaatatcaacagatataatccacatgaagaaaagttctttgggggtctctcaatgtctcctgaatacacaagaatcctgagaccaaaaagytggagaaccactgcattaaaacatgtaggaacaatcaagttctggaaccaaaaggaggggaaataacttccagaaattatcagggccaccaggggtatct

SEQ ID NO: 81731 - DNA, 201 bp, Bos taurus
tggctttgaaggcagatgaaggggcccacaagccatggaaaacaggcagccacgagagcgggaaaaggcaaggaagaaggtctccccaagactccagaagragcacaggcctgttgattttacgccagtgaaactgatcttagacttgacattcagaactgcaagataataaatatgtgcttttaagctaccaagtttgtg

SEQ ID NO: 81732 - DNA, 201 bp, Bos taurus
cttacttttgtttgtttacttcagttaagtgtttattgaaagtctactatcgatgtacaaaacatcacagataataatctctactctactgattacctgtmtttgtgaaaattcaagccgtgtctataatttatggacaggaattgattacaagagtgaagtcagaagattttaggttaaaaattacaaaagctatagata

SEQ ID NO: 81733 - DNA, 201 bp, Bos taurus
ttttccacattaggctagagcaaaggagtagaaaaacctgcaagattagatttcaaaaaagttgccctctctcaattctcctgaattcttcaaggtatgayggctaggtgcagtctggaagaatctttctgccgtttttttttttttttttttttaacatagactggaagcactgtagttgtattgtagtatttccctggg

SEQ ID NO: 81734 - DNA, 201 bp, Bos taurus
cattaaatcctcagaacaatcaaatgagacaaatactatgacccataaacctgatatatcagtcaaggtacaattagaagaaaccacatggtaatttgaayaggaaaagtttaatataaagcattattaattacaataggcaaagaagtactaaggggtagagacttaagatatagggagcagtcactacttacagggcta

SEQ ID NO: 81735 - DNA, 201 bp, Bos taurus
ggcagtagggcctgatcttatcaactgtatttttcatttctacaggttctgtgtgtatggtttcaattctgctttgtcttcctacacattcttttatttgkttactggcctcgtatctgtttagtcattttttaaatccctgtattatgtattttcttgggttattctgttctctatagttcagcgattaccagttgttac

SEQ ID NO: 81736 - DNA, 201 bp, Bos taurus
tgggtatttgttactgtggtacatgtttataagacggggttcaagatagccctcagtgatccctgtcctggtgtatttatacccgtgtgtactgtcctatkgttggtctgtgtgaccaacagaatatggcagaaatggaggtatgtggcttccaaaattacattataaaagactacaacttctgtcatggaaaggcccatg

SEQ ID NO: 81737 - DNA, 201 bp, Bos taurus
gagcgatgaccactgtctagctgcagtgcgcaggcttgtcatggcactggcctcttttgttgcagagcacaggctctagagcgttcaggcttcagcagttycagctacacaggctctgtagttgtggtacccagccttagctaccctgtggcatgagggatccttctggaccaggaatcaaactcatgtgtcctgcactgg

SEQ ID NO: 81738 - DNA, 201 bp, Bos taurus
ggcccatgcgtgtctcccgcggcttcccatctcacccctggcccctcaggctaattcaccaaaacgaccaactcaaagggcaagaggagggcgcccactgygtgttctctaggcctttcagaaaacatggagttgttcctttggccacatacatgcgaatctacaagaagggtgatattatagatatcaagggaatgggta

SEQ ID NO: 81739 - DNA, 201 bp, Bos taurus
taagacttcttcctagatgtgattctggcagtcacagtagatgaaggcttagttggtcgggaggggagcgtatcgtcaatagctttctatcccagggcccrtgcctgaagagggtgatagggaggaaagcaaaagcccaagaaattgctggatggagcagagttcacacgtgaaacacgcttttaaaagagtcaaggccaa

SEQ ID NO: 81740 - DNA, 201 bp, Bos taurus
gcgtgtgtgtgtgtgtgttggagtgatgactggggaatcctgagttggataggattaacaacagaaagtagatcttttgtcgttcgttggccttagagatrgggtaaaagggaattcccactttgacctgggagtacttatccagttcagcctgaggcagggcagagaatagaaatgaatatgagtagggggccgattgtg

SEQ ID NO: 81741 - DNA, 201 bp, Bos taurus
aacgcagggggtgccgtggtggcctaaacgttagttttctggctttcactgccacagcctggcttcaagggtttaatctctggtctgagaactgaggagaraaaaagaagagaattcaaatcaggccttgagatacggagggcctggcagacgtttgggcgactgtgtggtcaggggagggcatgaaaaggagaggaatgg

SEQ ID NO: 81742 - DNA, 201 bp, Bos taurus
ttcttttttattcataaattcttcacacatttatcaaaatgaatttgggcaggatttttttttttccccagaaggaaaggataatgcatttttcaataaakgataagattcttacctgagaacttgaacttagggtcaaagattgagatggtgaagtgatagttaaaaagagaagataaagacagagggagggtttaacat

SEQ ID NO: 81743 - DNA, 201 bp, Bos taurus
gttgtcaggtgtgtgtatatacatgtttaaaattgttatattttcttgatacattgaccctttcatcattatacagtatccttattttctttcagtaacartatttatgttaaaacatttttttctgatagtaatataaccacttcacctttgtctggttattattttcgtggtttatcatcttcctttcttttactttct

SEQ ID NO: 81744 - DNA, 201 bp, Bos taurus
gctgggagagacgagccagagggccccttgcctgcctcagcgggaaggaggatccagagacggggtctcactggagagatctggcatttgggctctagcarttggcaggtgttttacaggccagaggaccacagacaaatagatgggcatttccttttcctttttctgccatttgcctcttttcattctctggctccccac

SEQ ID NO: 81745 - DNA, 201 bp, Bos taurus
tagggagagccaagctccttctactgggcagctggggagactggggcctctagcaggagggaggtggcttgggcagaggacatacagagatacaggggatytgtcccttttctgcagcctaaggcctgagggcttttgctccagatgcactgaacacgcaacaggaggaggcagaaggtaaatggatagacttcaggaagg

SEQ ID NO: 81746 - DNA, 201 bp, Bos taurus
tctgacaagaagtgatgggaccagatgccatgattccagttttctgctatgttgagttttaagcccaaatcctccccatgtctgtagcgtggcctgaacayccatgttcctggggcttgtgggttctactgcatcactgtgttgaaaccaacctccccccattccctcctgccccaacaaggctttggcccctcagcttgc

SEQ ID NO: 81747 - DNA, 201 bp, Bos taurus
aggcctggggtacatgttctggagactgccagtacggttgcagtggcctttctagctgccatgtacgactggattcctccatggatgcacttgagggccargtgacttccaaggtctttgaatggctctgacagccatgacctagatggtcatgtagctgagtggaggtagggcctactcaggatagcaagggctccccag

SEQ ID NO: 81748 - DNA, 201 bp, Bos taurus
ttactgccattctgcaggtgaggaaatgggctcagggaagtcagtggggaggtaggtactcgatgagaaggttgagggacccaaacctggcccctcagtckagccactctgagtcgctaccctgaaaacgaacaagctcacagccccagccttgagactgtacacctgtctgaggagtgaacacttggcccgtgcagctct

SEQ ID NO: 81749 - DNA, 201 bp, Bos taurus
gaggacaggaatgtaaattcctattgaaagccgtcaatagttaaaatttggagccccattaatatagttcaagtcagaatgcacttaagtaatgaaaagcycaggcggtggcctggagtttccccttcctccatcaggcctgccaattagcccagagtaatggatgcccagaccccaggacaggactgagactggctggaa

SEQ ID NO: 81750 - DNA, 201 bp, Bos taurus
ctgttgtaaccaagccatggtgctcattctccaccatccttagctccatggcactaggctttcactcataactctgagaggccatggattgaagccgggtraaacccagacatcagccaatcagcagcagcctttcctggtttgccatcagttcagttcagtcgctcagtcgtgtccaactctttgcgaccccatgaatcg

SEQ ID NO: 81751 - DNA, 201 bp, Bos taurus
ttttcactggtaggctcccggtagtcatggcctctattcatggcctacactgttctgtttgtcttttcttcttagctttgtactccttttcacccagtgcratgtcttattgccaccagtgaggccactgagcaatgcttagctccacaacaggctctcaggtcacagaggaggccaatcccagtttgcacccatgctact

SEQ ID NO: 81752 - DNA, 201 bp, Bos taurus
tgtgtttggcaacccgcattcacctaatgaaataacacttcagaagtgtgcctgcaacctctaagaaaattgagttagcttagcactccattgtgggccakgtgtagatttgtgtgctcgttttcaagctgtcttcaagctcctccaaggaggaggagtggatggaggaataggctttatctgtatttgtaaggagcttcc

SEQ ID NO: 81753 - DNA, 201 bp, Bos taurus
gatagatagaactcattggaggcagggacccagttttgaaaaattcagaaataagttttcttatgtagaatgagtttgtgttaggacaggccttgaacagrtagaatttaaatctagatttgatttaaagctctgctctgtggttattaatctgcaagcagtgtgcaaggggattggaaagaaaagagccaggacttgaga

SEQ ID NO: 81754 - DNA, 201 bp, Bos taurus
aactatggcaaggctggaaagtccaagggcttggccccaattcctctccccgagctcctttttttttttgtttttttgcagaatttccactcaagctcctytttctggcccctcaataggcgatacacatgggatgaatggggaacatatataggctgaggatacagagacgagaatgactgcctagccatggatctcagc

SEQ ID NO: 81755 - DNA, 201 bp, Bos taurus
tagcatttaaacttccgcattgagacagggtgagaaatctcagtaaacagtcaaatgattctggattgctcagggtctgggcccggggacaggcagggtgyacctgctgtgctcactgatggaagccactgacaggtaaacagcaagttaccgggtgctctggcccctctctgctgctcagagaacagaaaactgtgagga

SEQ ID NO: 81756 - DNA, 201 bp, Bos taurus
tgaatgacacatgaactctgcccaaggcgacgcggcccacaccaatccattccacagatcactgctgacagagaacagggagtagaccttgaggtttcagycaaggtctgctcaaggtcttcagcataaagggtggccaggctgaacacacaccagcagagaagaggatgacatgggcttcataaactggcccatgagagc

SEQ ID NO: 81757 - DNA, 201 bp, Bos taurus
cacacatcagcttggagggctgacaggtccccgatcactcaacgggcaggcagcaaactctgagggcggagggagttaactcggccttatcttgagctccrctatcaacaaacttgtcatcacttaaccaagttgttagtcactggaacaatttgatggaaagaaatttgtgtcccagggagaaacaagttgacccagatg

SEQ ID NO: 81758 - DNA, 201 bp, Bos taurus
ttggactgattggggtcagccttaacttgggttccattggtgctcagcacgacacagggctcggctccagggagttgtacaagagctaaatggccatcagkgatttgtaacacactttgaatgcaatctcattagagttggattcgaatccagagtcacagctggaaaccactcagcagccagttttggtactgagtcgag

SEQ ID NO: 81759 - DNA, 201 bp, Bos taurus
acccttcaataccttccaaccatgctgcgatggaattaggattattcattatttttcacagagatgataaaacactgggcctaaagttggtgctcagtatytcttagctgatgaagatagacagaatggtcctaagggaccacactgaagcagcaggccccacactgtgcgaccgcgctgtctgcggttccctcaccctct

SEQ ID NO: 81760 - DNA, 201 bp, Bos taurus
atgatggcacccaatcagggcctctgaggatgcatgagaggaaatccaactttatggaacagggactctaaggtgtggccctcattggccaagggtcagcrtgggctggagagccaggggaaggcaggaggctgggggaagaccagggaaagaggaggaggagaaggatgagcaggaggcacctggctgggccctggggaa

SEQ ID NO: 81761 - DNA, 201 bp, Bos taurus
cctctggagctgccacacacacacagcacactggcttgtgaacgtctccagacctggctttcacctggaacactctttgtaactccagtgccaggcccgcrtaaggcactcaaaagatgcttgttaagtgagtcactgaatgtccatttccaacatggggacaccgaggcccacctcattcgatgcagttacaacctaagg

SEQ ID NO: 81762 - DNA, 201 bp, Bos taurus
gcagcaacctgaaaacgtagccaggaacgcacccagggtgagtcagacagtactggggacccgcggcctagccaactctcgggtcagccagcgcctggccrggggtctcagtattgtgctgcactgtgaaacaggtatggtggtcaggaagctcttccccacactgagaagtctcctttggggaacttctctcttgggcca

SEQ ID NO: 81763 - DNA, 201 bp, Bos taurus
ttgccagcaaggccaatacaaggtttgcttttccaagctttctggtatttttcccccaatttctggctggttgaatcttcagatgtgaagcccaaggatayagagggccagctgtactttgtcacatatctcatactgctttccgaagatataaattattacagatgctcagccaaagcccccagtatacccttctcttat

SEQ ID NO: 81764 - DNA, 201 bp, Bos taurus
ggcaggctacagtccatggggtcacaaagagtcggacacgactgagcgacttcgctttctttcactttcacacgcttgtcagcagaaggcctgaagctctkttttcttgagcttggtggaggcgggctgctgtgcagcttgtgggaccttggttccctgaccagggattcaacccgggcctgggcagtgaaagcactgagt

SEQ ID NO: 81765 - DNA, 201 bp, Bos taurus
cctggggttttagcctccgatctagggttttttctgtgaagagttgggtgctcagaagtagatggggatctatatggagctggagccctgagggccctctrttctgcgctgattcatgttgtaaaatattgagtggattagcagtgccatttaacccaatctgggtgagccattatggagggaaaaatctgtgtatttgag

SEQ ID NO: 81766 - DNA, 201 bp, Bos taurus
ggcaggacagagtggaggcccagaaagatgcacccagatggagctcatccccagcccaccacctctggcctccaccaccctatcaggcctcactgctcctyctgtccctgtgacctgtcttcctcgttgtccctggaatcagtgactcacaggtcagcgctgactgcctttctcttgggcttacttgagtgcatgtctggc

SEQ ID NO: 81767 - DNA, 201 bp, Bos taurus
gtgacctcaggtaaattgcttcacctttctgggccatgtgagcctcatctgtgaaattcagagaaagccccatccttaggaaatctcatcatgtagtaatracatctggtgacatcattggcctttaattgataggaacaaagcaggaaatttgaaaggaaatatgtctgtgtttcctccctctccccaccacccaattcc

SEQ ID NO: 81768 - DNA, 201 bp, Bos taurus
caaaatgacatgcttctcctgggcttgcagacgtgcggctcacgcctttcttaaacaaagactttcattcattgcctctctcctgactctctggcctgccrctggctacccacccctcccaagtcccaatctcctttacataaaatgtgaagctggagaccaggagctgcgtggagaggagggctcagctggccagggtgg

SEQ ID NO: 81769 - DNA, 201 bp, Bos taurus
aactgttagaaggtgggagcaagtcaagagaagtgataaagcctgaatctgggcagtggtgggagatagtgggggcaggatggggtggatgtgtgtggccrcagtgggaggagtctctgaatgtaccaggctcacaaggagaggtgcctgctgcctgatacccggggtccaggggagaattaatgggtgcatgtgggcgag

SEQ ID NO: 81770 - DNA, 201 bp, Bos taurus
tcattttttactttgattgctcacagtgtcccggccttggcccttgcaagttgttttctctgtcctttggatctgtgggcagggtttatgaaaccccagarctccccttgaggcagccaaggccaggctctgggaaggagcaccttgaaggggagtagaagtgaggggggagatggtggtgcttgacaccccttccccaca

SEQ ID NO: 81771 - DNA, 201 bp, Bos taurus
tccaggcgtttggctgagtggcacagggttaccagacggcctcccgcctgggtccagacccttgctctgcccagcagtcttttctctttctggagacttarttctttggccgtgaaattggtagtactctcctcccaggttgctttgagaattaagtgaggcgaggttcacagtggatttatctcttgtccctgccctacg

SEQ ID NO: 81772 - DNA, 201 bp, Bos taurus
ctcagggccatgagactcagtggctgagatggggtcctcttcatttcactgcatccctcagccacctcagagtctctaaatggacgacagaagcacagagrgggtggaggtttggccaaggccgcacagccactgagcagtagctaccaaatgggatgcctgaggtcttttgtaccaatgagttgcacccacgagtcacct

SEQ ID NO: 81773 - DNA, 201 bp, Bos taurus
gcgcctccccttgttccccctccttggccacagcaggcccaccctgctccccaggttgctgcatgccagctctcagcaatttggcaggcagtgctgaaatrtcaacctccctggctccgagaggcccacgtctgctggctatgagggcaccgggctccaggcagtcgccatgtccaaggtccccaagagccctccgtgtgc

SEQ ID NO: 81774 - DNA, 201 bp, Bos taurus
tagcaagaccacttgggaggattctcctggggggcaggagacacccgaagtcatccaccggctgtgccttcccggcggcccccttgggcggcagcgttccrggagacccactcgtacaagtgttgcttccaattaattgcctaggcgggggagggaaggggcctgtcgccgcccccgcccggaggctggagcgccgctcgt

SEQ ID NO: 81775 - DNA, 201 bp, Bos taurus
gggtccagctgtctgggagtaggcaggacctgactccccacccaggtcatcacggggcccagccctggctcacccctagtcatttgctgaaggcctgagcrggctggtggaaaggcacttggagtctctggctggaatcagaaaaagcacacggcgtggagatggaaggacccgtctgccagtatgggacatcggggccat

SEQ ID NO: 81776 - DNA, 201 bp, Bos taurus
ttccccaccccccacctgtaaagtggaaactttagctccctggcaggtggtgatggggtccagacgagtccatacatgggacacaggtagcaggctctaamgtcctatgccaactcttggttcactgtggccccagcaggcaagatctggccatcctatcctggaagaagggctgtcccaagagtgtgtttatctcacccg

SEQ ID NO: 81777 - DNA, 201 bp, Bos taurus
cagagattctgcccagctgtcctaggtgacctgggcctggagtcgggggtgaggcctgcatgcctatctgtccatcttctgtccaggagctctatgcagcyggggagaaccgcctgggaacagatgagtccaagttcaatgcgattctgtgctcccggagccgggcccacctggtggcaggtaaggctgtcctggcttccc

SEQ ID NO: 81778 - DNA, 201 bp, Bos taurus
ggcaacccactccagtgttcttgcctggagaatcccagggacggggcatcctggtgggctgtcatctctggggtcgcacagagtcggacatgactgaagcratttagcagcagcatagcctcaaagaaaattccagctggaaagttggtgttaggtgattggttgggatgctatagagttagtagcacatatagagtgttt

SEQ ID NO: 81779 - DNA, 201 bp, Bos taurus
agctttacagtttctctctcagagaggagaaaagcccaacactgggagtgacccatgtcctgcaccctgatctcacttagctcctgagtccctttctgatrgtaaccagaagttctattggacatcggctttcctcctctgcagccagtctgcccctggtggcacccgtctcacacatcccctcttccatgaggcccctgt

SEQ ID NO: 81780 - DNA, 201 bp, Bos taurus
cgccctgcttagaaatccacagttctaagcagcatgccaaggccctgagcatgccaaagccctgagaagttctgcaggaaaatacaggacttccattcacyctgcgtttctgtgccactctggcctaggaccccgcccgagagctctgttacatggcaacatgtccacagcagagatgcctggcagtggtcagtggcctct

SEQ ID NO: 81781 - DNA, 201 bp, Bos taurus
gcctctggcccagggagattacagctgggcagggccctttgccttttctggtgctggcgggctgtagaaggacagcctggagtatgcactgtagagtgggyagaggggccagagaaaagccagggttccctccagacccagaacttatgcccaggaggcaggcctgcagtgacacagctggagcagctgttcagtgtttgg

SEQ ID NO: 81782 - DNA, 201 bp, Bos taurus; identical to SEQ ID NO: 41350

SEQ ID NO: 81783 - DNA, 201 bp, Bos taurus; identical to SEQ ID NO: 41351

SEQ ID NO: 81784 - DNA, 201 bp, Bos taurus; identical to SEQ ID NO: 41352

SEQ ID NO: 81785 - DNA, 201 bp, Bos taurus; identical to SEQ ID NO: 41353

SEQ ID NO: 81786 - DNA, 201 bp, Bos taurus; identical to SEQ ID NO: 41354

SEQ ID NO: 81787 - DNA, 201 bp, Bos taurus; identical to SEQ ID NO: 41355

SEQ ID NO: 81788 - DNA, 201 bp, Bos taurus; identical to SEQ ID NO: 41356

SEQ ID NO: 81789 - DNA, 201 bp, Bos taurus; identical to SEQ ID NO: 41357

SEQ ID NO: 81790 - DNA, 201 bp, Bos taurus; identical to SEQ ID NO: 41358

SEQ ID NO: 81791 - DNA, 201 bp, Bos taurus; identical to SEQ ID NO: 41359

SEQ ID NO: 81792 - DNA, 201 bp, Bos taurus; identical to SEQ ID NO: 41360

SEQ ID NO: 81793 - DNA, 201 bp, Bos taurus; identical to SEQ ID NO: 41361

SEQ ID NO: 81794 - DNA, 201 bp, Bos taurus; identical to SEQ ID NO: 41362

SEQ ID NO: 81795 - DNA, 201 bp, Bos taurus; identical to SEQ ID NO: 41363

SEQ ID NO: 81796 - DNA, 201 bp, Bos taurus; identical to SEQ ID NO: 41364

SEQ ID NO: 81797 - DNA, 201 bp, Bos taurus; identical to SEQ ID NO: 41365

SEQ ID NO: 81798 - DNA, 201 bp, Bos taurus; identical to SEQ ID NO: 41366

SEQ ID NO: 81799 - DNA, 201 bp, Bos taurus
agagtccatgttcacacggcagctgactcaggctcaacccttggtcaggggactctatctcacgtgcctcagctcagagctcacacgctgcaacaaaaacygggtgcggccgaataaacgaatgagcatctttaaaaataatgtatctcttggtgttggaaagacctggtcatataacaaaagatgaacacattcacacaa

SEQ ID NO: 81800 - DNA, 201 bp, Bos taurus; identical to SEQ ID NO: 41367

SEQ ID NO: 81801 - DNA, 201 bp, Bos taurus; identical to SEQ ID NO: 41368

SEQ ID NO: 81802 - DNA, 201 bp, Bos taurus; identical to SEQ ID NO: 41369

SEQ ID NO: 81803 - DNA, 201 bp, Bos taurus; identical to SEQ ID NO: 41370

SEQ ID NO: 81804 - DNA, 201 bp, Bos taurus; identical to SEQ ID NO: 41371

SEQ ID NO: 81805 - DNA, 201 bp, Bos taurus; identical to SEQ ID NO: 41372

SEQ ID NO: 81806 - DNA, 201 bp, Bos taurus; identical to SEQ ID NO: 41373

SEQ ID NO: 81807 - DNA, 201 bp, Bos taurus; identical to SEQ ID NO: 41374

SEQ ID NO: 81808 - DNA, 201 bp, Bos taurus; identical to SEQ ID NO: 41375

SEQ ID NO: 81809 - DNA, 201 bp, Bos taurus; identical to SEQ ID NO: 41376

SEQ ID NO: 81810 - DNA, 201 bp, Bos taurus; identical to SEQ ID NO: 41377

SEQ ID NO: 81811 - DNA, 201 bp, Bos taurus; identical to SEQ ID NO: 41379

SEQ ID NO: 81812 - DNA, 201 bp, Bos taurus; identical to SEQ ID NO: 41380

SEQ ID NO: 81813 - DNA, 201 bp, Bos taurus
ggggatgcaggcccccgcaggtctaaggcatgtccatagatgagacttatggtgaaaaaaatagcccttggggagtgctggagggcatcagagggcatccrtcagtaaggccgtgcgaggctcactgctgtgttagcttctcagagtagtgtctgttccctggtggcttccctgatagctcagttggtaaagaatctgcct

SEQ ID NO: 81814 - DNA, 201 bp, Bos taurus; identical to SEQ ID NO: 41381

SEQ ID NO: 81815 - DNA, 201 bp, Bos taurus
gctggattagttggataaatggatttagaccagaggtttctaggatagagactctgcgggagctggcctgtggtgagcacgccactggcctgagaccttckcgagccccctgagtctgtctgtcctcatcggtcatgtggtttacctaagcagaaccattacagatatcaaactatactctgaaaacctgactactagaac

SEQ ID NO: 81816 - DNA, 201 bp, Bos taurus
atgacagctggcttagccctcagggaaggggccatgaagctgcagaggaaacagccacacccagtcaatgaaagtccagggagcttggcaactccgagccrtctgtggccatcattgggccgtactgtgtgccaaggtctgtgtcaggcatttccaccatagttatctttttaaaggctgcttctaacatttgcagaaacc

SEQ ID NO: 81817 - DNA, 201 bp, Bos taurus
cacctttcccagggtggccaccatgcaatgaccgatcgaagccaaagggtgaagacttggccatctctacccaaatcaggacacctctggagggccactcyagccccacagctcccagaagtgtcagacaagatcaaagtttgattctccttcttcccatacctgctgctaacacctccttctacagggttggccccagag

SEQ ID NO: 81818 - DNA, 201 bp, Bos taurus
gtcataaagaaccaactcgcttcttgtacgaggcttgtacacgcacctgtctggactgagaaaacagcaacactcgttggccctgcttgtgccatattttyagcaaggactcaacaactatcattttcccagaacgtttccagtatccaaactgatcttctcctagttcctcgtctggaatgcctttaagattcttggggc

SEQ ID NO: 81819 - DNA, 201 bp, Bos taurus
aacaatataaaagtatggataatgatacgactgaggaaaaaaaagcgttcgctaaatacaatctaagttataaactcagttatatgatgcttttcagataygaaataggatgaacacttatgtttcagaagggtgaccccatgtatgcataacggaagaagcgtctgaaggtctgagagtatcagtgacacagcaaggcta

SEQ ID NO: 81820 - DNA, 201 bp, Bos taurus; identical to SEQ ID NO: 41385

SEQ ID NO: 81821 - DNA, 201 bp, Bos taurus
ttcttaatacaacatgaaacaatgaaaagggcctagggtgttgtccccaaatttcgcagagcataaaaatcacctgggcagcttaaaaaccctggaactcyggcaggcctcgctgcagaccaattaaaccagaatatctgggatgagagtcaggtatcagtagttttcactgacccccaggtgattccactgcacaggcag

SEQ ID NO: 81822 - DNA, 201 bp, Bos taurus; identical to SEQ ID NO: 41387

SEQ ID NO: 81823 - DNA, 201 bp, Bos taurus
ttctgctgaggtctctctgggtcactggggaggtcacagatggcatgcactgtttggatctgagtcctgcctgccccacactgtctgctgctcactcaccrtcagctttggcctgcccctctcttgctctgtttcctgagattctaaattgcacattgccgcctgcagcactctcctctcctggcccagctgtgtttgctc

SEQ ID NO: 81824 - DNA, 201 bp, Bos taurus
catttcagtctcaacaatcctagcagttaggcagcatcggccttactttatagtcagagaactttaaactcaggaaacttaaaaacttctcccaagatggygcagctagaatctgaaatggccactgctttccaggctctagataaggtgaccccttgcttgtaaagggtacttagagatgagttaacatttgttataatt

SEQ ID NO: 81825 - DNA, 201 bp, Bos taurus
gtgttgttaaatttttggttagtgggcagatcttatgttgtgttctaaactacaaaagcaaacaaaactaaagggattgggagaaacttttggaggtgatrtatagatttatggccttgattgtgatgatggtttcatgagtgcatacttatctccaatgtcatcaaattgtacacattaagtatgcacagattttaatat

SEQ ID NO: 81826 - DNA, 201 bp, Bos taurus
aaagtacacacgtgtctgtagccttgaatcagcacaggtggtggtgactatgactgcattgcctgcagtggacaccaggtacgccagaaagtgcaccaggkagaggattttgcccaggtgctggacagcagggaagccctccaaggtgaattcttggaaatttgtcccattcctcatttccatggccatggacatcttttc

SEQ ID NO: 81827 - DNA, 201 bp, Bos taurus
gcggcatgaggcgagggtggacagggtccagtggtccacgtgtttcatggggataatggctggtggttctgcagtaactctgggccaggcactgggaaagyagatggagcccacaccctagaagcaagaccatgttctgctcccctgatttggagaggtgtggcatgaacaggactggccatgccatctagctccttaact

SEQ ID NO: 81828 - DNA, 201 bp, Bos taurus; identical to SEQ ID NO: 41391

SEQ ID NO: 81829 - DNA, 201 bp, Bos taurus
ttaacaaattctagctcctgttttcatgagtcataaatgtactaagacctggggtttcgaggtcccgctatggagggcctccactgaaccagccacacttrggactgttggtgccatgcagatgtgcaggagttaagagaaagcaccttaccaatccgtcttcccagcagcatctcaactaccgagaaagtcgtctggtgt

SEQ ID NO: 81830 - DNA, 201 bp, Bos taurus; identical to SEQ ID NO: 41393

SEQ ID NO: 81831 - DNA, 201 bp, Bos taurus; identical to SEQ ID NO: 41396

SEQ ID NO: 81832 - DNA, 201 bp, Bos taurus; identical to SEQ ID NO: 41397

SEQ ID NO: 81833 - DNA, 201 bp, Bos taurus
gaatcatacgagatgagactatcctggcccgttccttcaaatgccccctcgtgaagccacattccatctacagtcactccacgcgttaggatcatggctcygcaggccaccaacaatgatccttcagccgggacctgtcttccaaactccattcacgtgtcaacagctggttgcacgtccccttggcgagttgaagaggca

SEQ ID NO: 81834 - DNA, 201 bp, Bos taurus; identical to SEQ ID NO: 41400

SEQ ID NO: 81835 - DNA, 201 bp, Bos taurus
tcttgtgaataagtacctgtgctgtcgtctatccaattctagttcttgatctcaggcttaatcaatgacagaagggacatttagagacatggggacacttyagccaggagaaggcatggttgaggcagagaaagaagccgtcgtcactgccgaacatctcaagtatttcatgcagcaggagtcggatatgttcttgtccca

SEQ ID NO: 81836 - DNA, 201 bp, Bos taurus
aactggaccacttcatctcaggcttcgcctgaggccgcccccgataccttccctcccggggagcccccgaagcactcacatcaccgcgacatctgtgaggyagctcaggctgggcctgctccttggcctcaggttttcattttgtgtatttgtttgtttgtttattgctgaaaaataaagaataaatgaggaataaacagt

SEQ ID NO: 81837 - DNA, 201 bp, Bos taurus
tagaaatttataaaacgatgggggttttaatggcaatttggtttacagtcaataacgaacccaactttcattcataagcagggctcctctgatttacatayggaggtcactctctcagccctgagcccctcgggagaggaggcatctccccttctgtttctagagccactgctagctatttcttccaggtgcttcacttgc

SEQ ID NO: 81838 - DNA, 201 bp, Bos taurus
gtggagagagcaggccagcttctgcattaggctcagatccctcatcccaccttttgcccaaatcatttaatacataaaacacaggaagtaagcttcaacayggaaaaggcctgacattaagtgacagcattgttcagaacgcggaaagccagaggcaaccttcacagccccaaggaagggaggtttctgtaagatgcggca

SEQ ID NO: 81839 - DNA, 201 bp, Bos taurus
cggtcactcagtcgtgggctaagcggtacccgcgggcaaaggaaacttcccgatcgctctacagctcttagaaacatggcccggcttcaccacgcaagccygcatgctcgtcaagcgggagcagaacgcgcccaggaacgaccactccaagcacggactcaggccggctggccaagccccggagcctagagcgggtgtacc

SEQ ID NO: 81840 - DNA, 201 bp, Bos taurus; identical to SEQ ID NO: 41402

SEQ ID NO: 81841 - DNA, 201 bp, Bos taurus; identical to SEQ ID NO: 41403

SEQ ID NO: 81842 - DNA, 201 bp, Bos taurus; identical to SEQ ID NO: 41404

SEQ ID NO: 81843 - DNA, 201 bp, Bos taurus; identical to SEQ ID NO: 41405

SEQ ID NO: 81844 - DNA, 201 bp, Bos taurus; identical to SEQ ID NO: 41406

SEQ ID NO: 81845 - DNA, 201 bp, Bos taurus; identical to SEQ ID NO: 41407

SEQ ID NO: 81846 - DNA, 201 bp, Bos taurus; identical to SEQ ID NO: 41408

SEQ ID NO: 81847 - DNA, 201 bp, Bos taurus; identical to SEQ ID NO: 41409

SEQ ID NO: 81848 - DNA, 201 bp, Bos taurus; identical to SEQ ID NO: 41410

SEQ ID NO: 81849 - DNA, 201 bp, Bos taurus; identical to SEQ ID NO: 41411

SEQ ID NO: 81850 - DNA, 201 bp, Bos taurus; identical to SEQ ID NO: 41412

SEQ ID NO: 81851 - DNA, 201 bp, Bos taurus; identical to SEQ ID NO: 41413

SEQ ID NO: 81852 - DNA, 201 bp, Bos taurus; identical to SEQ ID NO: 41414

SEQ ID NO: 81853 - DNA, 201 bp, Bos taurus; identical to SEQ ID NO: 41415

SEQ ID NO: 81854 - DNA, 201 bp, Bos taurus; identical to SEQ ID NO: 41416

SEQ ID NO: 81855 - DNA, 201 bp, Bos taurus; identical to SEQ ID NO: 41417

SEQ ID NO: 81856 - DNA, 201 bp, Bos taurus; identical to SEQ ID NO: 41418

SEQ ID NO: 81857 - DNA, 201 bp, Bos taurus; identical to SEQ ID NO: 41419

SEQ ID NO: 81858 - DNA, 201 bp, Bos taurus; identical to SEQ ID NO: 41420

SEQ ID NO: 81859 - DNA, 201 bp, Bos taurus; identical to SEQ ID NO: 41421

SEQ ID NO: 81860 - DNA, 201 bp, Bos taurus; identical to SEQ ID NO: 41422

SEQ ID NO: 81861 - DNA, 201 bp, Bos taurus; identical to SEQ ID NO: 41423

SEQ ID NO: 81862 - DNA, 201 bp, Bos taurus; identical to SEQ ID NO: 41424

SEQ ID NO: 81863 - DNA, 201 bp, Bos taurus; identical to SEQ ID NO: 41425

SEQ ID NO: 81864 - DNA, 201 bp, Bos taurus; identical to SEQ ID NO: 41426

SEQ ID NO: 81865 - DNA, 201 bp, Bos taurus; identical to SEQ ID NO: 41427

SEQ ID NO: 81866 - DNA, 201 bp, Bos taurus; identical to SEQ ID NO: 41428

SEQ ID NO: 81867 - DNA, 201 bp, Bos taurus; identical to SEQ ID NO: 41429

SEQ ID NO: 81868 - DNA, 201 bp, Bos taurus; identical to SEQ ID NO: 41430

SEQ ID NO: 81869 - DNA, 201 bp, Bos taurus; identical to SEQ ID NO: 41431

SEQ ID NO: 81870 - DNA, 201 bp, Bos taurus; identical to SEQ ID NO: 41432

SEQ ID NO: 81871 - DNA, 201 bp, Bos taurus; identical to SEQ ID NO: 41433

SEQ ID NO: 81872 - DNA, 201 bp, Bos taurus; identical to SEQ ID NO: 41434

SEQ ID NO: 81873 - DNA, 201 bp, Bos taurus; identical to SEQ ID NO: 41435

SEQ ID NO: 81874 - DNA, 201 bp, Bos taurus; identical to SEQ ID NO: 41436

SEQ ID NO: 81875 - DNA, 201 bp, Bos taurus; identical to SEQ ID NO: 41437

SEQ ID NO: 81876 - DNA, 201 bp, Bos taurus; identical to SEQ ID NO: 41438

SEQ ID NO: 81877 - DNA, 201 bp, Bos taurus; identical to SEQ ID NO: 41439

SEQ ID NO: 81878 - DNA, 201 bp, Bos taurus; identical to SEQ ID NO: 41440

SEQ ID NO: 81879 - DNA, 201 bp, Bos taurus; identical to SEQ ID NO: 41441

SEQ ID NO: 81880 - DNA, 201 bp, Bos taurus; identical to SEQ ID NO: 41442

SEQ ID NO: 81881 - DNA, 201 bp, Bos taurus; identical to SEQ ID NO: 41443

SEQ ID NO: 81882 - DNA, 201 bp, Bos taurus; identical to SEQ ID NO: 41444

SEQ ID NO: 81883 - DNA, 201 bp, Bos taurus; identical to SEQ ID NO: 41445

SEQ ID NO: 81884 - DNA, 201 bp, Bos taurus; identical to SEQ ID NO: 41446

SEQ ID NO: 81885 - DNA, 201 bp, Bos taurus; identical to SEQ ID NO: 41447

SEQ ID NO: 81886 - DNA, 201 bp, Bos taurus; identical to SEQ ID NO: 41448

SEQ ID NO: 81887 - DNA, 201 bp, Bos taurus; identical to SEQ ID NO: 41449

SEQ ID NO: 81888 - DNA, 201 bp, Bos taurus; identical to SEQ ID NO: 41450

SEQ ID NO: 81889 - DNA, 201 bp, Bos taurus; identical to SEQ ID NO: 41451

SEQ ID NO: 81890 - DNA, 201 bp, Bos taurus; identical to SEQ ID NO: 41452

SEQ ID NO: 81891 - DNA, 201 bp, Bos taurus; identical to SEQ ID NO: 41453

SEQ ID NO: 81892 - DNA, 201 bp, Bos taurus; identical to SEQ ID NO: 41454

SEQ ID NO: 81893 - DNA, 201 bp, Bos taurus; identical to SEQ ID NO: 41455

SEQ ID NO: 81894 - DNA, 201 bp, Bos taurus; identical to SEQ ID NO: 41456

SEQ ID NO: 81895 - DNA, 201 bp, Bos taurus; identical to SEQ ID NO: 41457

SEQ ID NO: 81896 - DNA, 201 bp, Bos taurus; identical to SEQ ID NO: 41458

SEQ ID NO: 81897 - DNA, 201 bp, Bos taurus; identical to SEQ ID NO: 41459

SEQ ID NO: 81898 - DNA, 201 bp, Bos taurus; identical to SEQ ID NO: 41460

SEQ ID NO: 81899 - DNA, 201 bp, Bos taurus; identical to SEQ ID NO: 41461

SEQ ID NO: 81900 - DNA, 201 bp, Bos taurus; identical to SEQ ID NO: 41462

SEQ ID NO: 81901 - DNA, 201 bp, Bos taurus; identical to SEQ ID NO: 41463

SEQ ID NO: 81902 - DNA, 201 bp, Bos taurus; identical to SEQ ID NO: 41464

SEQ ID NO: 81903 - DNA, 201 bp, Bos taurus; identical to SEQ ID NO: 41465

SEQ ID NO: 81904 - DNA, 201 bp, Bos taurus
ttatacaagtagagtttgtatattccaagttcctatggagtctggcagttggatactagttaacagaagctactgtctcccaaatttccctgataataaarttttcttacagtattggttttaaaaacacaatttttggttacatcccagattggatgaatcagaaactccaagccttgggagccaagaaattgtattttt

SEQ ID NO: 81905 - DNA, 201 bp, Bos taurus; identical to SEQ ID NO: 41466

SEQ ID NO: 81906 - DNA, 201 bp, Bos taurus; identical to SEQ ID NO: 41467

SEQ ID NO: 81907 - DNA, 201 bp, Bos taurus; identical to SEQ ID NO: 41468

SEQ ID NO: 81908 - DNA, 201 bp, Bos taurus; identical to SEQ ID NO: 41469

SEQ ID NO: 81909 - DNA, 201 bp, Bos taurus; identical to SEQ ID NO: 41470

SEQ ID NO: 81910 - DNA, 201 bp, Bos taurus; identical to SEQ ID NO: 41471

SEQ ID NO: 81911 - DNA, 201 bp, Bos taurus; identical to SEQ ID NO: 41472

SEQ ID NO: 81912 - DNA, 201 bp, Bos taurus; identical to SEQ ID NO: 41473

SEQ ID NO: 81913 - DNA, 201 bp, Bos taurus; identical to SEQ ID NO: 41474

SEQ ID NO: 81914 - DNA, 201 bp, Bos taurus; identical to SEQ ID NO: 41475

SEQ ID NO: 81915 - DNA, 201 bp, Bos taurus; identical to SEQ ID NO: 41476

SEQ ID NO: 81916 - DNA, 201 bp, Bos taurus; identical to SEQ ID NO: 41477

SEQ ID NO: 81917 - DNA, 201 bp, Bos taurus; identical to SEQ ID NO: 41479

SEQ ID NO: 81918 - DNA, 201 bp, Bos taurus; identical to SEQ ID NO: 41480

SEQ ID NO: 81919 - DNA, 201 bp, Bos taurus; identical to SEQ ID NO: 41481

SEQ ID NO: 81920 - DNA, 201 bp, Bos taurus
tgtcattctctgattagaaagtaacgcagttcattgtagaaaatatgggaaatatagatatatataaaataaattaggattgctcacaatcttatcaataraaggatctatttattatgtttcttcatagtcagtgcatgtttttacatagttgaacttttcatccttcctttttcatttagtattacagtataggcattt

SEQ ID NO: 81921 - DNA, 201 bp, Bos taurus
cagtatcaggggctatacatcagtgagtataaggaatatggttcttctgctctgacagcctatattctacctaagattacctattgctttcacatcaactrtttctcaagtaagtttctcagatgagccatgctatctccccactctgggtgtttgaatgcatgtttccttctgtaaggatggtcactccccactctcttt

SEQ ID NO: 81922 - DNA, 201 bp, Bos taurus; identical to SEQ ID NO: 41482

SEQ ID NO: 81923 - DNA, 201 bp, Bos taurus
gtcacaaagagtcagacacaaatgaagcatctgagcgtgcatgcacatcccttaggaagtgaagaagcaatgggggctctaaagaaggtggatgttgtatytgttttttaagaaaatctctctgagggtcatttgaaggagaaagtgcagaggtgagtgactgtcaagaggagcctagttaggaaaccctggcaggttcaa

SEQ ID NO: 81924 - DNA, 201 bp, Bos taurus; identical to SEQ ID NO: 41483

SEQ ID NO: 81925 - DNA, 201 bp, Bos taurus
tgttgagaaaacgtggtgggtaggaaggtcttcaagtttccacatcatcaaggtaatgctgttaatactagcgtgtccttccattcctctcccctacctaytgcctccaggacaagttttcggcctggtgacccacaggtctgaatccgggattcaaattgttcacggctttttctgtctctcatgaagaattaggtaacg

SEQ ID NO: 81926 - DNA, 201 bp, Bos taurus; identical to SEQ ID NO: 41484

SEQ ID NO: 81927 - DNA, 201 bp, Bos taurus
tgtggtgcaatgactagctgcccaggctccatattgcttccaaggaagggtcagagaattggggaaggaaaggcaagacaggttgcctaaaacctaaaatkccttaggtaccttctgaaagatttgtgtttatccaaaaaccatgatgagttttccaatcagagggagccgcaagagcaagaaggtatgaaaaaaggccag

SEQ ID NO: 81928 - DNA, 201 bp, Bos taurus
ccatgctcatgcaaaatagaatttgcaaatgttaaaaagcacaaagcagaatgagatcagagtatgcgagaaggacacttaactctcagagaaggagcttrgggattgatgaggaagatgccccagagtgaccttcaatgagatacataaacatcagccacatgtaaatttaccttatttccccaaagcgtcttaaagaac

SEQ ID NO: 81929 - DNA, 201 bp, Bos taurus; identical to SEQ ID NO: 41485

SEQ ID NO: 81930 - DNA, 201 bp, Bos taurus; identical to SEQ ID NO: 41486

SEQ ID NO: 81931 - DNA, 201 bp, Bos taurus
ttccacaaggggagaggtttgaggtatgtgggatacagaggtcacgttgcagctcgccagcgtgtgacttagggtgaatcacttaaacccttggtgtcctyaccagtgtaatgaatgataagaaccagttcttgtggagaggtccggattagatcatgtctgtgaaagcatttggtcaacagtaaagggccataacagaaa

SEQ ID NO: 81932 - DNA, 201 bp, Bos taurus; identical to SEQ ID NO: 41487

SEQ ID NO: 81933 - DNA, 201 bp, Bos taurus; identical to SEQ ID NO: 41488

SEQ ID NO: 81934 - DNA, 201 bp, Bos taurus
atatatatatatatatatacattacttagcttagggtctgtcatatgcagcctctaaaatggtccctgtattaatacattcccctcctcttgaatgtggaytgcacctagagacttgattctaatgaatagaatgtggcaaaactgatgggctgtcactgttgagattaggttctaaaaggactatggctttcatttgctt

SEQ ID NO: 81935 - DNA, 201 bp, Bos taurus; identical to SEQ ID NO: 41490

SEQ ID NO: 81936 - DNA, 201 bp, Bos taurus
tataaaaagagtgataggccttttctaaggccctgcatcaaaattatttggaaaagaacaaattttaaagaaattaaatcaatctatgtttgtcttaattrtaatttgttttcataaggcccaactgacaggtgatacacttgtttgaattacatccatggataataatattttaatgtttgttagttgcataaattattt

SEQ ID NO: 81937 - DNA, 201 bp, Bos taurus
atttttagaagcactgacaaacttgagatgaaagttttcagagtggaacaaagcagcctttggttgccatcatatatttgttttagaactagcagtgcctycatagatgtattagtccaatcccacccagtgaaatttccaattgatctgaagtcacatagagcgtgttcaaactagacaccaagtctgtgtttttctttt

SEQ ID NO: 81938 - DNA, 201 bp, Bos taurus
tgaccttactattgtcacaaatttaccaagaacaacaatttttaaaagggtattaaaaaattagaaagtattttaaagtgtccagttggtaacatgcttcrcattttggattcctatgaacactttcagaaacagtgaaattgggttgaaattgccctgtcattgtatattatttatatatagaaagagaaccccacatat

SEQ ID NO: 81939 - DNA, 201 bp, Bos taurus
gttagaataatatgcagtaaataagcattgaatgcagtttgacaaaagtatttaaaagttatggcatggattttgttacttttacaaattaatatctcaaytattaattccatactggatgggtgtaattgttgggttcttgacttgaagttcaggaattgaagcaggaaaattctgtcatcagtaaaaaccttgtagaat

SEQ ID NO: 81940 - DNA, 201 bp, Bos taurus
tattccacatattaaaactttctataaaagtctacttaaatatttcacatactaaaacctagataaggaaggttcaattcatccattgattaaatgtaccmattgtagaaaaaccgtgaacaatccatgaagattcttagcccttcagatgtctatagattcttgacagttctgttcatggattttgattacaatcaccag

SEQ ID NO: 81941 - DNA, 201 bp, Bos taurus; identical to SEQ ID NO: 41492

SEQ ID NO: 81942 - DNA, 201 bp, Bos taurus
atagaaaaaaattcctatatgaaaattagaccatgctcctcttctgcttcaaaacatctaatggtctttcagtttaacacaatatcacatcctataatttkttccttatttgcctcttcagccagaagttcaatatggctctttaatacaagcactgtcaacatttaatgtcttcctcggatggtctagctggccatatcg

SEQ ID NO: 81943 - DNA, 201 bp, Bos taurus
ctcagtgactcaaggcattctgatgaccactttgtctctgctgcccacgatgacaaatgtgacaactatgccagtggcaccgatgggctcactgacactckgtctctgccattccacagcgcctttggcatcatggataacctctatggtggcatctcttgctgtccatgttcattttcaaacttccatctatacaatcta

SEQ ID NO: 81944 - DNA, 201 bp, Bos taurus; identical to SEQ ID NO: 41494

SEQ ID NO: 81945 - DNA, 201 bp, Bos taurus
gtttatatactgtcttcttcatggagttatcctgatctatctggttggtattaatctctgggttctctaaaggtccatgtgggacctcatatttgcagtcmtgataatatgtcttgtttactcatctttcttccttaacaggttataagtgatgaagacaagtacaatgtcttattatcatttgtatgcctgcagtgatga

SEQ ID NO: 81946 - DNA, 201 bp, Bos taurus
ataaattatgatatattaataggaaacttttaacctaaatgaagatgtttacttgctatttatcactttctcattcagtcatgtcttcagcaatcacacaktcagtgcattctagacaatttcctaggcatttgctaaatatcataaataccatgcagttctgagaagtttctactgttaggaggcttactaccttatagg

SEQ ID NO: 81947 - DNA, 201 bp, Bos taurus; identical to SEQ ID NO: 41496

SEQ ID NO: 81948 - DNA, 201 bp, Bos taurus; identical to SEQ ID NO: 41497

SEQ ID NO: 81949 - DNA, 201 bp, Bos taurus; identical to SEQ ID NO: 41498

SEQ ID NO: 81950 - DNA, 201 bp, Bos taurus; identical to SEQ ID NO: 41499

SEQ ID NO: 81951 - DNA, 201 bp, Bos taurus
cttgtgggcagcataccgtcattaactattaacttcttctacctactgggggtttcagtgtctgcaaaacaactcaaaaatattgttgcgggtggcccttsttggggaaccaggactttgctggaaggctgcaatgtttttctcttgacccttcatttcctcccggtctcacatcctccattccctaataagcaactcttg

SEQ ID NO: 81952 - DNA, 201 bp, Bos taurus; identical to SEQ ID NO: 41500

SEQ ID NO: 81953 - DNA, 201 bp, Bos taurus; identical to SEQ ID NO: 41503

SEQ ID NO: 81954 - DNA, 201 bp, Bos taurus
cagaagtggaccccagaggcagaggccagagagaggctgtgatgtggggaaggtcagcaggtgtcacagctcccagcagagggggaaccaggtccagctargggagttaggccatttgatccctgctgtgtgctgagccccctactgtgagctgaacatcacaactctgccaggctgacttagggtgctcggtcaccaact

SEQ ID NO: 81955 - DNA, 201 bp, Bos taurus; identical to SEQ ID NO: 41504

SEQ ID NO: 81956 - DNA, 201 bp, Bos taurus; identical to SEQ ID NO: 41505

SEQ ID NO: 81957 - DNA, 201 bp, Bos taurus; identical to SEQ ID NO: 41509

SEQ ID NO: 81958 - DNA, 201 bp, Bos taurus
ctgaaagtacagagggaggaatgatcttaaaagataaattcctcattcagtcagtccagatattcaccataagttacaaaaacaggcatttaggccaaatyagtctttagaacactgttgcaactggatcagacagtttactgtggcagagcatacgaggaggaaactaggagataggaaagaactaggctgaagactgaa

SEQ ID NO: 81959 - DNA, 201 bp, Bos taurus
gtcagtctatttgcatttggcaggactccatggtgtcccctgaacaaatgaatcagcctgtttgggggatggggaactgaaccatagggaggctgctagcrctgcttgtgagccccagtgatcctgagatgggggaatcccagacagttcttgttctgttcgtatctggattattcttaggctctggagtaacaagcccct

SEQ ID NO: 81960 - DNA, 201 bp, Bos taurus
gcatggtacccgtgtgtgctcagctgcatgtcccgcagaagactggggatcatcaccacctgctccatgttgcgcaccacggccaggtaccggtccatgayggtcagcaggcagttcttggggtagcgcttggtcagcacctgcatgatggctttatcttccatatggagtcctgcagactgcctcggcctctgtttccag

SEQ ID NO: 81961 - DNA, 201 bp, Bos taurus; identical to SEQ ID NO: 41510

SEQ ID NO: 81962 - DNA, 201 bp, Bos taurus; identical to SEQ ID NO: 41511

SEQ ID NO: 81963 - DNA, 201 bp, Bos taurus; identical to SEQ ID NO: 41512

SEQ ID NO: 81964 - DNA, 201 bp, Bos taurus
ccaaaaagtatgttttcttgactcaacatgaaaattttttaagagagctaaggtaatgggccttggctctgataccagatactttgaatttcaattactcrtaggctgttctatacttcagtttcctaatctcctagtcaaaattgaccatcaggattgtagtgattatatgagattatgtgtgtgaagtacctcttaaaa

SEQ ID NO: 81965 - DNA, 201 bp, Bos taurus; identical to SEQ ID NO: 41514

SEQ ID NO: 81966 - DNA, 201 bp, Bos taurus; identical to SEQ ID NO: 41515

SEQ ID NO: 81967 - DNA, 201 bp, Bos taurus; identical to SEQ ID NO: 41516

SEQ ID NO: 81968 - DNA, 201 bp, Bos taurus; identical to SEQ ID NO: 41517

SEQ ID NO: 81969 - DNA, 201 bp, Bos taurus; identical to SEQ ID NO: 41518

SEQ ID NO: 81970 - DNA, 201 bp, Bos taurus; identical to SEQ ID NO: 41519

SEQ ID NO: 81971 - DNA, 201 bp, Bos taurus; identical to SEQ ID NO: 41520

SEQ ID NO: 81972 - DNA, 201 bp, Bos taurus; identical to SEQ ID NO: 41521

SEQ ID NO: 81973 - DNA, 201 bp, Bos taurus; identical to SEQ ID NO: 41522

SEQ ID NO: 81974 - DNA, 201 bp, Bos taurus; identical to SEQ ID NO: 41523

SEQ ID NO: 81975 - DNA, 201 bp, Bos taurus; identical to SEQ ID NO: 41524

SEQ ID NO: 81976 - DNA, 201 bp, Bos taurus; identical to SEQ ID NO: 41525

SEQ ID NO: 81977 - DNA, 201 bp, Bos taurus
tatctctgaatcctaaaaggtcatttgacagttttatttctctgttctatatactttggcccttctatgtaggatgaatagcatgtatgttaatttacgargttagatcttcatctacctgtttaatcagtaacaatttattatgttcttgccatgtgccagatacactgtagcaagaagagttcttgttcttttactatt

SEQ ID NO: 81978 - DNA, 201 bp, Bos taurus
ttaaaggaatgacaggaagcatgtttatgaatgactgaatggtaaaatattcccagattcatgacttgcatggaataagaatttaataaatattggttctyatcataggaacacctttgtatgactctaatccaaaagtaaatgtgtcagagaaaagtgagaagttattttttactgttttcaacagaaaaactaaagaat

SEQ ID NO: 81979 - DNA, 201 bp, Bos taurus; identical to SEQ ID NO: 41526

SEQ ID NO: 81980 - DNA, 201 bp, Bos taurus
tagtcttctgtaatctaatacttgttgatctggctactcaaatactagtgtcaatgtttatgcctatctatcccctgtttgagtcccctgtttcattgttytttcatttgccttgtgatctgcatgtagggtaaaaaaaaatgtgcataaaacaaatgatttactgcaagtcaacttgttattattttagccatccatttt

SEQ ID NO: 81981 - DNA, 201 bp, Bos taurus; identical to SEQ ID NO: 41528

SEQ ID NO: 81982 - DNA, 201 bp, Bos taurus
ttcatatattttttcttcttgagtgcatcacttagtgctttgtgaatattaaaagaatctaataagtgtaacaggacctccctgttgggccagcagtaagractctgcttaccaatgcagaagacaggggtttgacccctgggtcggaaagatcccctggagaaggaaatggccatgcactccagtattcttgccaaggaa

SEQ ID NO: 81983 - DNA, 201 bp, Bos taurus; identical to SEQ ID NO: 41531

SEQ ID NO: 81984 - DNA, 201 bp, Bos taurus; identical to SEQ ID NO: 41533

SEQ ID NO: 81985 - DNA, 201 bp, Bos taurus; identical to SEQ ID NO: 41534

SEQ ID NO: 81986 - DNA, 201 bp, Bos taurus; identical to SEQ ID NO: 41535

SEQ ID NO: 81987 - DNA, 201 bp, Bos taurus; identical to SEQ ID NO: 41536

SEQ ID NO: 81988 - DNA, 201 bp, Bos taurus; identical to SEQ ID NO: 41537

SEQ ID NO: 81989 - DNA, 201 bp, Bos taurus; identical to SEQ ID NO: 41538

SEQ ID NO: 81990 - DNA, 201 bp, Bos taurus
cttctctttctccttcaccccactctgctaatgtcatcatttcttttcctgttgactttgtagatttcagatgcgcccccatgttttgagccagatctatyctccttggcttatgagcaaggaaattgtgctactttgttacttttgtatttatcttggtatttacagatttctgtggtctgagataatagccattaccaa

SEQ ID NO: 81991 - DNA, 201 bp, Bos taurus; identical to SEQ ID NO: 41539

SEQ ID NO: 81992 - DNA, 201 bp, Bos taurus
aactttaaactttataagtataacacaacagtagcacagatatccgttccctactgggcaaaacccatatttttgcaaaatgtgtgttatatatgagcatmtgtcttctaatttttacacaggggatagactgaaatcatttcatgaaatatatcatgtatcttgtctagtttaaaaatatcctatgcaatatatacagtt

SEQ ID NO: 81993 - DNA, 201 bp, Bos taurus
cagtaagcaaccttagtctctcttttgttccaaatgaggtaaaaataaaagattctgaatctctttctacatgttctgcttttcagtgataaaaactactraattattgaagtctcagttggttctataatggatatattttaaattgtgtgttcacttttatttaaaatatcattgtacccttacaaatttaatggactt

SEQ ID NO: 81994 - DNA, 201 bp, Bos taurus; identical to SEQ ID NO: 41541

SEQ ID NO: 81995 - DNA, 201 bp, Bos taurus; identical to SEQ ID NO: 41544

SEQ ID NO: 81996 - DNA, 201 bp, Bos taurus; identical to SEQ ID NO: 41547

SEQ ID NO: 81997 - DNA, 201 bp, Bos taurus
tgtgtataactgtatgcttgtatgtgtgtgtgtagtaatttctcaatctaaatcaagttattagttggaaggggctttctaagttttggtataccatggakatatacacttacgtgtataattgctcttctgcttgtatcaaatttttggaaaggcttttctcagttttataatttctaggcattatccaatgaccttgaa

SEQ ID NO: 81998 - DNA, 201 bp, Bos taurus
gtgtgcatgcagggcacttgtgtgctcctgggatgttgggggcagtgcttagtgcctgcttgcaggtcttatagcagtggctgtggccagtgtactcccargaaagtgagggcagagtctggctaatttctaatctcatagtgtcatgaatggaaaagatgcttcatatgatttcaactttttaaaatttcccaaggctta

SEQ ID NO: 81999 - DNA, 201 bp, Bos taurus; identical to SEQ ID NO: 41549

SEQ ID NO: 82000 - DNA, 201 bp, Bos taurus; identical to SEQ ID NO: 41550

SEQ ID NO: 82001 - DNA, 201 bp, Bos taurus
ataatgggtttccagttctggcaatgataacaagtacccttgttgaataaatttattcaaataaaaagagtttaaagaggaattataagcaattgactatrtgggtgcaattcagatcatgccatggatgtagaagtatttttaaggtatcacttggatgtgttaagattcaaaaattcttgagtaaattcttgagtacct

SEQ ID NO: 82002 - DNA, 201 bp, Bos taurus
ctttctcccaggtcccagtggcttccaataattccttgcattcctcggcccataaacttcctaaattcaatctctgccttcaactgttatggcctgccacrtaaggctgtgtgtcagttctcccccttgtttctctgataatgacaccagtccattagatttagggcctgttccagatccaggatgatataaccttaagat

SEQ ID NO: 82003 - DNA, 201 bp, Bos taurus; identical to SEQ ID NO: 41552

SEQ ID NO: 82004 - DNA, 201 bp, Bos taurus; identical to SEQ ID NO: 41555

SEQ ID NO: 82005 - DNA, 201 bp, Bos taurus
tcagacactactgaagcaacttagcagcagcaaaaaaaaaaaaaagattcatatcatttaccaatatcatgtcgcattgccatggccactataatttcacrtaattcattggatgggacttccgtgaattaacataactcagcttgggaagaagggctatggtacagcaccgactggcttcaaagtctggccctgcccacc

SEQ ID NO: 82006 - DNA, 201 bp, Bos taurus; identical to SEQ ID NO: 41556

SEQ ID NO: 82007 - DNA, 201 bp, Bos taurus; identical to SEQ ID NO: 41557

SEQ ID NO: 82008 - DNA, 201 bp, Bos taurus
aagttcaaagcagaaatgccagggtaactttatcttcgtctttccccaggcctgatatttacaaatcacattgaaatttacaacacctattatgtgacagytctacgatatacagtggtgatgcaagggtgagctctcgaggggggtctgcagcctgtgagaaagacagacgtcaatcaaatgatcaaaaaccactctgca

SEQ ID NO: 82009 - DNA, 201 bp, Bos taurus
ttccttcatgagttctgaccaactgagaaataaatgagttagcaagaggccaagcatcatctttatcaacatgacagtgttgggagagcatagcctcccaygaaagccaaaatggactggccatcttccctgcctccagcctggatcctggcacagccatctgctcccaccgatcggggtggagaaagtgaaagaggactc

SEQ ID NO: 82010 - DNA, 201 bp, Bos taurus
gagaaagaggtgggggggtggggacgctagggtgggggctgtgaggaaatggttcatggagagggggggcgcaaggagtaattaggctgacatatgcaccrcccaggacccaggagccaagccagggagggtcacttcctgatttacccctggcgttggggcacacctctttgcagggtagaagagaagtgtgcactggga

SEQ ID NO: 82011 - DNA, 201 bp, Bos taurus; identical to SEQ ID NO: 41566

SEQ ID NO: 82012 - DNA, 201 bp, Bos taurus
caatcaaagacaaaaagactcaatgagatgcagaaacattaagtacaactaaatctcacacacacacacacacacacaccccttcagccccaggccactckcaagtctctaacactcagcacttggtcatcagccaaagcatgtttggttttcccaaaccgcaaacatgtcagggagcggaggaccaaaaggaagtgcagc

SEQ ID NO: 82013 - DNA, 201 bp, Bos taurus; identical to SEQ ID NO: 41571

SEQ ID NO: 82014 - DNA, 201 bp, Bos taurus; identical to SEQ ID NO: 41572

SEQ ID NO: 82015 - DNA, 201 bp, Bos taurus; identical to SEQ ID NO: 41573

SEQ ID NO: 82016 - DNA, 201 bp, Bos taurus; identical to SEQ ID NO: 41574

SEQ ID NO: 82017 - DNA, 201 bp, Bos taurus; identical to SEQ ID NO: 41575

SEQ ID NO: 82018 - DNA, 201 bp, Bos taurus; identical to SEQ ID NO: 41576

SEQ ID NO: 82019 - DNA, 201 bp, Bos taurus; identical to SEQ ID NO: 41577

SEQ ID NO: 82020 - DNA, 201 bp, Bos taurus; identical to SEQ ID NO: 41578

SEQ ID NO: 82021 - DNA, 201 bp, Bos taurus; identical to SEQ ID NO: 41579

SEQ ID NO: 82022 - DNA, 201 bp, Bos taurus; identical to SEQ ID NO: 41580

SEQ ID NO: 82023 - DNA, 201 bp, Bos taurus; identical to SEQ ID NO: 41581

SEQ ID NO: 82024 - DNA, 201 bp, Bos taurus; identical to SEQ ID NO: 41582

SEQ ID NO: 82025 - DNA, 201 bp, Bos taurus; identical to SEQ ID NO: 41583

SEQ ID NO: 82026 - DNA, 201 bp, Bos taurus; identical to SEQ ID NO: 41584

SEQ ID NO: 82027 - DNA, 201 bp, Bos taurus; identical to SEQ ID NO: 41585

SEQ ID NO: 82028 - DNA, 201 bp, Bos taurus; identical to SEQ ID NO: 41586

SEQ ID NO: 82029 - DNA, 201 bp, Bos taurus; identical to SEQ ID NO: 41587

SEQ ID NO: 82030 - DNA, 201 bp, Bos taurus; identical to SEQ ID NO: 41588

SEQ ID NO: 82031 - DNA, 201 bp, Bos taurus; identical to SEQ ID NO: 41589

SEQ ID NO: 82032 - DNA, 201 bp, Bos taurus; identical to SEQ ID NO: 41590

SEQ ID NO: 82033 - DNA, 201 bp, Bos taurus; identical to SEQ ID NO: 41591

SEQ ID NO: 82034 - DNA, 201 bp, Bos taurus
gcggtgcagttcccctcgccatacaaacagatgcccctcttaaaaatcgtgcagaccttacacaaggtggctggtgctgcagagaaacacacagggaagcrgaggccggggtaggatgggctgcgaccaaggtgtgtaagacacagtaggacctaggagttgaggggcaaagcctggctctaaatacttgtcctgcatgct

SEQ ID NO: 82035 - DNA, 201 bp, Bos taurus
aaattcacccgacatcctcatcctccaataggtatttattgtgcatcctgtaggctacacactgaggaggagagatgagtcacatgtaccagtcatttccraattcagagcctcacggctgagactctgaattagcaagctttgttttaataatggtgtttgcttaaataaggggcacagaggagggacccctagcaccat

SEQ ID NO: 82036 - DNA, 201 bp, Bos taurus; identical to SEQ ID NO: 41595

SEQ ID NO: 82037 - DNA, 201 bp, Bos taurus; identical to SEQ ID NO: 41598

SEQ ID NO: 82038 - DNA, 201 bp, Bos taurus; identical to SEQ ID NO: 41601

SEQ ID NO: 82039 - DNA, 201 bp, Bos taurus; identical to SEQ ID NO: 41603

SEQ ID NO: 82040 - DNA, 201 bp, Bos taurus
aacataggccatcctatcagataggacaaacgtttttgtatccgagaaagagattcattctgaaacattcaaatgtaatgcagttgtggatacagataggyatcgggtcttcagtgaaggttcactccgtcctcagagaacaagggaaacactagctgggcttctctggagactgttgtagatggcgtgttcgtggagcca

SEQ ID NO: 82041 - DNA, 201 bp, Bos taurus
ttgcacagattataccaaaacggccttctctggcttagtattttatttttatgtattttataaataattttattactttctccctccaaacccctttgccmcatctggcctttaatgggggaaaacaagtctaagattacaatgcatctagatttatacccaaatacaatttagttgcatttggagccctagagagtcagt

SEQ ID NO: 82042 - DNA, 201 bp, Bos taurus; identical to SEQ ID NO: 41607

SEQ ID NO: 82043 - DNA, 201 bp, Bos taurus
gcctaccattttgccaagtcctgcttctcccaacttaaggatgcagatagaatcactaacaaaattacggatatttaaagcaaagatccgaaactctatcrttaaaaatccttttccttggagacattaagcccacaggatatggtttggatggtggaatcagaaaaccagagctggcttcgtgtttctgaaactttgtct

SEQ ID NO: 82044 - DNA, 201 bp, Bos taurus; identical to SEQ ID NO: 41608

SEQ ID NO: 82045 - DNA, 201 bp, Bos taurus
tgagcctctaagtatagttgatccttccatgcatcctgttaggtttgatacctataaaccagcctcagaaaacagaatttgacttaccgggccaacttgaraagcccaggtggcatggtggtaaagaatccacctactaatgcaggagatacaagagatgtgggttcgatccctggcccgggaagatcccctggaggagga

SEQ ID NO: 82046 - DNA, 201 bp, Bos taurus
tgagcctttgagagagatgaatgaaaaaacaaaacaggaagaaggccttgggaaacttacaaaatcatgacaaacacaagcttatgagaattttgaggcaygcttattataatttgcttgtcgttcccgagtccacccagtgtgtggtttaaagaagaaatatcaggtgtttctgccaagattttcaggagaaactgagtt

SEQ ID NO: 82047 - DNA, 201 bp, Bos taurus; identical to SEQ ID NO: 41612

SEQ ID NO: 82048 - DNA, 201 bp, Bos taurus
atgactctaccctccagacgccaccctccctgtgcagtcagcccacttcctgtcatttccttctgctggtcgaggtcctagctgcagcagctggccttgayggaggagaaggagccctcatccatctggagagagctctgctgctcgtgatcagtaatagccagcaccttctgtcacactctggccccatgcctgccttcc

SEQ ID NO: 82049 - DNA, 201 bp, Bos taurus; identical to SEQ ID NO: 41615

SEQ ID NO: 82050 - DNA, 201 bp, Bos taurus; identical to SEQ ID NO: 41617

SEQ ID NO: 82051 - DNA, 201 bp, Bos taurus
cccaccctttaaatgaggtgcaagggcgccccctggtggcggtccgctcccatctgtgggattcggttctccaacccaggctgaacccaggccaggcagcrggaaagccccagggaattcccagcatcttcctcctaattttatttgggtgcccgggacgccctcacaccccacccagcctgcacatccggccagaagtgt

SEQ ID NO: 82052 - DNA, 201 bp, Bos taurus
gcaccgcccagtgcccgtggggaacacgtgtgcccctgccactgacgtcagctgttttccaccagcctctgcacggctggcaccgctgcaggccgtgtgtygatagttatcaatgtcgtagaaaacaaaatggaagtaactgcacagatttaaatctccgagcagtccacaagccaaccgaaggcaggccccttccagaaa

SEQ ID NO: 82053 - DNA, 201 bp, Bos taurus; identical to SEQ ID NO: 41618

SEQ ID NO: 82054 - DNA, 201 bp, Bos taurus
aagactgtaagggaagccagtcatacactgcagtgctccagggaagcgaggtaggactgtgttccctgggaagaaggtctaaaaacagtctgtaggaactyggttgtctgtgttgttagggccacgctgtgacaactggagctgtctctccaagctcctaccattaaacaacatgcccctatcattaaacaacacgcccca

SEQ ID NO: 82055 - DNA, 201 bp, Bos taurus
ggcccaggttgggtgttgtctggaggggagggccagactttcagggagaagaagtagtgagacacgagcccttgagtgtttgctcaggcacattccacttraataaacagctcatgaagctagttttcctaaggatctccttgccccaggaaccagagttgggcgtgaagaacggcggctgacctctgcaacgtgacaagc

SEQ ID NO: 82056 - DNA, 201 bp, Bos taurus
tactaacctgccagccacgccgcccacacagcaaggcgggagggccagcttagaagctgagggcacaggccagcatcacgggcctgtcttcctgttcttgycctctgtgaccctcttcatattgttctaggagcagcagtggtcattccattctccacggggcctaattgctcgaaaaatatttaattcatatctccagag

SEQ ID NO: 82057 - DNA, 201 bp, Bos taurus
tgagcaggccgctccccctgaggggaccttctggggtttgtaacccaccccccaagacagcatataaaatgtccatatatatacatgaaagtaccatgtgragggaagggccctgaatttcaccacctcctacagtgttcacgactctgcaacataaacgactctaaaacagcacccggtgaattaaagacatgaacactt

SEQ ID NO: 82058 - DNA, 201 bp, Bos taurus
taggggtcaggaacatctgtgaggaatccttgagcttgggggccactttctgtggttgtggaggttagtgaggtggtgcaaggcagccaaatccaggctgytctccaggctgagggcccgcatggcgagcaccacccagggcggacacctcttcctcattctcacagttgcccattggtgtgggaggtggccctgaggagg

SEQ ID NO: 82059 - DNA, 201 bp, Bos taurus; identical to SEQ ID NO: 41621

SEQ ID NO: 82060 - DNA, 201 bp, Bos taurus; identical to SEQ ID NO: 41622

SEQ ID NO: 82061 - DNA, 201 bp, Bos taurus; identical to SEQ ID NO: 41624

SEQ ID NO: 82062 - DNA, 201 bp, Bos taurus; identical to SEQ ID NO: 41626

SEQ ID NO: 82063 - DNA, 201 bp, Bos taurus
ggggtagggtgggatctactggcgggcttcctgcctggaggttgattggaactagctcttaaacactggtgatttttttctttagagaccacatgtgtgcrttcctaaatccatgatggtcattttgttcacaccacgggtggggcagccctgaaacaggagagatttcttttcggatcaccatctgagattcagggctag

SEQ ID NO: 82064 - DNA, 201 bp, Bos taurus; identical to SEQ ID NO: 41628

SEQ ID NO: 82065 - DNA, 201 bp, Bos taurus
tggttacaagaggactcattcagcttcagaggtgaccttggctctgggctctgcttctgtgaccttggcacaagggcccacacttgtgacctcgggcaggrttccacatcaatctacagtttgtgaagggactgggcagcgagactaaaggcgcatgtggtcaacgtcttcaaaggccttgaaggttgaaggttggtttgg

SEQ ID NO: 82066 - DNA, 201 bp, Bos taurus; identical to SEQ ID NO: 41631

SEQ ID NO: 82067 - DNA, 201 bp, Bos taurus
cttgacgaagcattcttcaatccaaagagaagggcacagtttgagactgcctgaggccagatgacctctggattgaaggaatccaggtcctgcaaataccytgattctcatcagcaagactgctcgtgaagcgctgctatcaaactcctcaccaaatcccttcccccaacccagggttgggacacccagtttggagggcat

SEQ ID NO: 82068 - DNA, 201 bp, Bos taurus; identical to SEQ ID NO: 41634

SEQ ID NO: 82069 - DNA, 201 bp, Bos taurus; identical to SEQ ID NO: 41635

SEQ ID NO: 82070 - DNA, 201 bp, Bos taurus
catgttggggacatttgttattgcagcataacttagccaaagctgactaatacacattagtatccctcttaactaattttcattgaaataccccatcagaytaactgatgctctctatttcctctgcaaaacataccaaaagtccaaagttcttagactaatacttagtatattagcacttttctgatcctacaagttagg

SEQ ID NO: 82071 - DNA, 201 bp, Bos taurus; identical to SEQ ID NO: 41636

SEQ ID NO: 82072 - DNA, 201 bp, Bos taurus; identical to SEQ ID NO: 41639

SEQ ID NO: 82073 - DNA, 201 bp, Bos taurus
gttgacacacagggctcatctcagatctgcagttgcacagtggtccccctcagtgggagagcctgggctgcttcctgcaacttgagatttccggctcctgygacacgatggccatgtggccacagcctggagggtccacagccctcctgtccacgggctctgctgggtgctcattgagtcatggagaagcagctactctgg

SEQ ID NO: 82074 - DNA, 201 bp, Bos taurus
cctgaaaacttaatatctgtcttccaagcaagaactcagggtcactatgtccaaaagacctgctccactttcctctggcttggctggacacatttctcccrtatttctatacatcctgggctcctttccatcacagcactttctgtatttcattgtaatcatcagtttactgatttctctcctcaagtcagtggtgaacat

SEQ ID NO: 82075 - DNA, 201 bp, Bos taurus
atcgatcctcattctcttctgcctcagcgcagctcacttccacggcacttcctgtggttctgtgatgtcatttccttttgtagctattagttccctgccgygctcgtggttcactcaacccaggcctgtctggtaacagatgtgatttccagctgtgtctatgtaccaaccacagtgggttcattaataacaattattaag

SEQ ID NO: 82076 - DNA, 201 bp, Bos taurus
actcagggtttttttaccatgttcgattagtttcccatttaagttttttcagagtaggcatcatttagagcccagcagtccttgtgaatatgaagtgtccrtgaccaattgttttaagattgcaatttcaaaaagagccacagggaggcacaattttttcatgtcttactgttgttaacggggtaatcagagtttgggggt

SEQ ID NO: 82077 - DNA, 201 bp, Bos taurus
tgcctaaaggcctcataggcccacaggatctgagcacctgtctagaggcctcatagttaaacataagctgagcatctactagaggcctgatagttatgcamatgctgaacatctgcctagaagcctcattggctcacaggatctgagagtctgcctagaggcctcagaggagctgagcttctgcctagagaactcatagtt

SEQ ID NO: 82078 - DNA, 201 bp, Bos taurus
cagacactcgcctgcctggggccaccaggaacctggactaggcatgcggagtgtttgttctaatgggctgttctctgggtggtggccgggtgaggccctcragcgtcatggatggaaaagccctgagtggcttcactttcacggcaagtccttgtgagacgtgttgtctctgctgggggcctgagctgagggtcctccagc

SEQ ID NO: 82079 - DNA, 201 bp, Bos taurus
catttgcttattcttattatttttgttctccttgtagggtggccagatactgcagaccttgagcatgtgacaggcacgtggtttcttcaataaaccttggmgcttccgcagttctcctggggcccacagactgcatagtcctaaagagtcaaatattaagctttctcggcagccacaccttcctttgatgtttgggttatt

SEQ ID NO: 82080 - DNA, 201 bp, Bos taurus
tctcatttcttgtcatactccccaaacatacccctaccaagcagttcctccttaacacttctctctcagtgctatgctttcatatatttaacttcctctasctgcctaccctttttgcttagataacacaccagtcattttatgagatgtagccaagaagttaacctcctcctcctgaaagccttccttgattcatcagtg

SEQ ID NO: 82081 - DNA, 201 bp, Bos taurus
ggagatcacatggttcaggcaggaacatgccttcaagcaagtgacactcataatccagggaccatgtgcatgaacaaaggtgtgaaggcaagaaatcaaayagtgtatttggagaccatgtgcaacgggattttgaaaacatctcaatcgcaatttgggcggaggttccaaacaacagatactaccatttcaaagtgaggt

SEQ ID NO: 82082 - DNA, 201 bp, Bos taurus
tattttggccggttcaggacccctctgaggggctgtttgctcaggattccctgtagagctggccaaggctgcaggacttgcattgccacctgacccctcgmtgtgccctcttctgcttccttcctctccttccagaggccagggtcccagacacgttccctgttaaacatcctgaactctacactcttctcagagtccaca

SEQ ID NO: 82083 - DNA, 201 bp, Bos taurus
tcacactcggggttgtcggccccagcacgcccactcccggagccccatgctgccttcctgtcctcgatgccagagcagctggagcgtttccgcttgctgaktggcccttgcttttccctgccctttaggactcaccccagcagctgtttgcctccttccctggggcccttgctagggtgttaagcccattaatcaaacaga

SEQ ID NO: 82084 - DNA, 201 bp, Bos taurus
atcttgacctgagtttgccttgagatgacttagccactcatgctatggaacaaaagtggtcctggtgagaaagccaggagcgactgactatgaaaacttgyccagttccacctctgttgctggcttacatgctggtggactccagggactaaactcctctcatgcttcctactattcccatttttgctgttgtttagttgg

SEQ ID NO: 82085 - DNA, 201 bp, Bos taurus
ataatctagatgctgggctgaagccagccaagtgaggggacagagactggctcatcaggtagaggaaacagcaagtgcagaggccctgaggtggcttgttyaaagacaaaatagaaggtgggcatggctggaaggtaataagcagaggaaggagggagatgagatgaagctgaagtggtagccagggccagctcttggctc

SEQ ID NO: 82086 - DNA, 201 bp, Bos taurus
gggatagaacccaggtctccggcattgcgagcatcatcagttggcatatctgatgccaagatgactggagacagctttgagagggagatggtggtgggaayacccttctttgttacaaaacctagggacccagcggcagtcctttgcctctcgtgatcccatccgatagaacagtggtccccaatccttttttccacagac

SEQ ID NO: 82087 - DNA, 201 bp, Bos taurus
taatctgagccgggcatggtgccctagaatggcctcatttctgagtctagaaatgatgagtcgagcataattctgctttgaatttttatcacatagcttcyttggaaggtaaatatagatacattaagggtatatttagaagtagccgaaatagctcagttgggagagcgttagactgaagatctaaaggtccctggttca

SEQ ID NO: 82088 - DNA, 201 bp, Bos taurus
cagcttgtctctgctggtcaggaagctcaggccccatctgaggggcgaggagactcctcattcgggcacagaaccctgcatggggtgtgagtgacacaacygaacaccaaggccctcagtgttttacttcttcattaagcaagatgaaaagacgaaacaattagaaagcaagtctgtggaggcactttacctacatgattg

SEQ ID NO: 82089 - DNA, 201 bp, Bos taurus
tttcttctattacctgagtctccctgcatctctcacccctactgtcctgagcttaggtctctacctagggtctccaggtagaaagaagtgatacttctackcccaaggtgccagtccatggcagctcacaaccaaatggtttgtaactccggccctggaggaagctcagagaggctgaacactctgtgccccctggcccac

SEQ ID NO: 82090 - DNA, 201 bp, Bos taurus
tcgtggagtcttatcacagccgatgccaaggtcaatggggatgaaagtgtgaggggctgtggtgtgacaccaatatggcccaacatagagactgagcctgrcttgtcttgatggagcacttgatcaaaaattacacccagccctgttcttgctcttaagaaatgtgtgtacgtttctctttggagtaacgaagactgaaat

SEQ ID NO: 82091 - DNA, 201 bp, Bos taurus
acccaggagggaaagaagaaacactgggaaaagaatagtgcctaccgagggtcagaccttcttgagccttccggttaaacttggaggccacttccttcctkctggagttcctgctccagatgtggaggggagagagctgtactcactgctgatgagtcacagggagagggacagcttcccccagaggccctttgattccac

SEQ ID NO: 82092 - DNA, 201 bp, Bos taurus
gtggccacagtgctggaaagggtcagttttcattccaatccaaaagaaaggcaattccaaagaatgttcaacctattgaaatgttgttgtatcatacaaakatgccaggattcttggccccaaaggagaagaattcaatctggagccagagacaaggcttgaaccctcagagcttttgtgtaataaagttttattaaagta

SEQ ID NO: 82093 - DNA, 201 bp, Bos taurus
aaatcctgatgtgatggtattagggggtagggcctttgcaaggtaattaagttgacatggggttatgatagtagggtcttcgtgatggcattcagttcagytcagttcaatcgctcggcctctccctttttttctctcttattctccctcttcttccgtcccctctcctaccacatatgagaacacagccagacgagaact

SEQ ID NO: 82094 - DNA, 201 bp, Bos taurus
ctaagacttacttgttcaagtagaaggcaaacacgggctcagaaatgactttttgtagcatcaggctgtcaaagacagggatgatcctggaggtggcgagrctggggtagcccaaacccaggactccctcaaaaggtacaaacggcaggatcttgctaatctgcctgtaggtcagggcaaaagtctggttcatgatgacaa

SEQ ID NO: 82095 - DNA, 201 bp, Bos taurus
tgtgacctcgaggcttcgaaaactttggacctggagagctgctcacttaaaatcattcatcctcaaggatgagtttgggcccatatggttcctcagtattkcctcaccggttctgtggcttgtggctgctcagtaacaaaagggaccctccacggagggtggaggattcaagttgttgttggctgtagaaaggaggcctct

SEQ ID NO: 82096 - DNA, 201 bp, Bos taurus
gtccagggcctgtctgtggaggtcaagtagagacacagtcccttcctcagcaggtcattcactctgggtgaatgcagcaagggcatctcctgggcaagggmagccgcccttcccacggccccacttcattcacatcccactgtcccctaagagcaggggtgccctggaaccaactaatacagctcctgagagcgaaagggg

SEQ ID NO: 82097 - DNA, 201 bp, Bos taurus
acagggtgtgctgggagctcagaaaacagaggggcagcaatgaagaagggattctaggagactctgcccggaagagatgggaggatcctggaatgattgcytgggccaagggttagggctgggggtgggagggctggcttagtgacccaagaatgggttactttgtctcagacttggggctgcacccaggagtggactggc

SEQ ID NO: 82098 - DNA, 201 bp, Bos taurus
ggcaccctgggctcaccctcaacttattctcatgtgttactcttgactcgtcatcacaaaaccagaactaccccaagagcaagacctggctcccgaaacayggcccttaccctggcattcaaggctcttggatgttgggtttcctcacctgctataaccccttgctgccttcgcccagtggctctgagcccccatcacctg

SEQ ID NO: 82099 - DNA, 201 bp, Bos taurus
ttgcagccaggcaaccctggcgcttctcagggctggcagtgacccgccggccctctggcatccaaccctgttcccaccccagcactctccgaggtggcccrtccctcttggttcctctcctagtttggtttccttccctttggcgcctcttccatccggctgcctttttttcttttttcttttttttcatccaccttttcc

SEQ ID NO: 82100 - DNA, 201 bp, Bos taurus
atcctggggaggcccctcaggagcctagaccagctccctaaggacccacctgtctcctccgcctggactcatgttcagctgcctcccccggtcactcctgytggacactcttgtgctcctgtggcctcagcttagccctcttcctgtgttaactcagggaggagccctttgttggtctcattttgcaggtgaagaatctgg

SEQ ID NO: 82101 - DNA, 201 bp, Bos taurus
ggcctcctgtatccgtcctgagaacattgtgaatttttccctgatttgtaagaatgcctggactgtcactcgcactgtgaccttttggacgaggttgtacrgaagacactacacactggaggcctctctgcctttgcacctgcgacctgagtcaacagagaagctgcatgcactgtcttcaggcatgtgtgatccgatctc

SEQ ID NO: 82102 - DNA, 201 bp, Bos taurus
ttctccctgctcttgaggtccgcactgcagggctgggtcccagccagcaggtgggacggctccctgagcctgcaggctggccccaccgcctcggacagccrccaatcctctgcccttctgtggggtgatgatgtgctggattccctgggtctccctcccaccgccgggtcggtactgggggcgccctcgcaggccccactt

SEQ ID NO: 82103 - DNA, 201 bp, Bos taurus
aggccctggatctaaacttcagttcactgtgtgactgaacatgcgtgtcttgccctctctctctgagcctcagatgctacatctgtacaaccaccaagtcrgaggagacaaatcagggccctccctggtggctgaccttgtagaaggctcctgaaattcctcctagttctatgctagtggtaaagatcccacctgtcaatg

SEQ ID NO: 82104 - DNA, 201 bp, Bos taurus
accagaggtggggtggggtcgagatctggtaggcggggacctgaattgggcggggcggagtaaggggtctgaaagtgggtagaggccaggaaccaactcgmagaggacaggggtttgagacagggctaaggactcatggagggatgaagcttcgaagagtgagggttgaggcccccagcggggcttcgggaactagtgagg

SEQ ID NO: 82105 - DNA, 201 bp, Bos taurus
tgtgttcatggggttctccaggcaagaatactgcagtggtttggattcctttctcccgtgaaccacattttgtcagaccctgactaggcctgacaggccaygccatgtagcagaatgacatgtccagtgccctggttaatacacatgtatgaaatatgtaaatatatatatatatatattgtttgtttgtttgtttatagg

SEQ ID NO: 82106 - DNA, 201 bp, Bos taurus
ccccagggtccctggcagcctggcctacagcctgaagaagcgctgagccagcccgcgggccgctcgaccatctcggcctctgtctgtgtctgtctgtccakctctctgttgacctactgccctcctgcctggtatcctgtcactgagggtttggtcaggtgtatataaacgtcctctgtgtcatgggtgaagagtggccca

SEQ ID NO: 82107 - DNA, 201 bp, Bos taurus
cctggggcggggtgggggtgttgtcttctgcccagacctcagggaattgttgagttaactctctctctcaactgtttagcccatccagtttcccttctggkagatggtgcaacttccattcatcttgagaggttactgagaggaagaataaataggtggttgagcccactcaaagagtgggtcttttgttggggggaaggt

SEQ ID NO: 82108 - DNA, 201 bp, Bos taurus
tggttgcagctctcagtctggacgctcagtgtgcagccgcccctgggagatgcaactcttatactgtgtccctcaggcaggtcctgaggctacagagccaygaggtatacccgggcagggctgtctaagggcaaccagaacccacttctcatcagtcccccaacccaggggcatggggcagaagggagagcaaagggccca

SEQ ID NO: 82109 - DNA, 201 bp, Bos taurus
cacatcaatgccaggcctgtctcccttagaaccggatacagagaactggggggccttcaccttgggcacattcactttgcccccaggcccatgaatgtcartgtcaggagcttgaacttccaccctggagccagagatgctgccctcagtttggggcacagagatgtccacccctaaactcccctgtggcttggcaccttt

SEQ ID NO: 82110 - DNA, 201 bp, Bos taurus
ctgccccaagaaagatgtgggagttgctgccccctggtggaggctcacagcgagaactcctcttttttcctgtctggcccctcccagggctcctctccatragtcacacttggttcctgactcacccaagtcgctgcccacacccccacccccatcacacaggcctcttcgggttacacacactataatatgacagcaatg

SEQ ID NO: 82111 - DNA, 201 bp, Bos taurus
ttttaagggtctgtggttcaggccagaactagaatccagacaccaacagtaattaatggtttctctctttattgtttctccttttatcaaaacctgtcacrgctgggggccaaaaggaagtaaaaaaaaaaattcccacaaatatcccccccacttgtccccagtgagttctcccccacccgctacccagggccttgggcc

SEQ ID NO: 82112 - DNA, 201 bp, Bos taurus
cttccaccccagcgcccaacacgccccggcccactccccaaagaagaaccatgaaggggagaggaaggggtcctttgagacctgcaaagagaggcgctgtyggggccagatgcccccccacacccactgcatgtagctgaagagcacaatgacgctgaggaaggtgaagttgctggcgacaccaacgaaggcgcaggtcat

SEQ ID NO: 82113 - DNA, 201 bp, Bos taurus
tatggtaatcttgccctgcctcactcaggggcgtgtaagtcaatagtgagtcaaaacaggagtagcctccattgtgggccaggtggtgtgcaaagtctcgraatgactctgaaatgagtgcttttatctccgtgctgaagcttggagaagttgagtctcctggccacagtcatgtgtccaacaagtgttcaaagcccagaa

SEQ ID NO: 82114 - DNA, 201 bp, Bos taurus
caggtttgcctctttattggcttctgagtgacaagcggctgaaccccacttccagttatgttatcgagtccaaacttgccctgctggccgcacaataaatsagtgagtctgagatgaggtgttggactgggaagggactttattcgggagccggctgacagagaaggtggcaggctagtgcttcagaataaccatcttgtc

SEQ ID NO: 82115 - DNA, 201 bp, Bos taurus
gtggagtgccatcgccttctccgtactggcagtcaaaaagggactgcattcctaggcgtcgagtccaagatcttcacaagatcaatgaggccattatatcygtacaccccatggtcactaatccctacacccttctctctcatatttccctgacacactctatttcacaatattaggcctcaaagatgctttctttactat

SEQ ID NO: 82116 - DNA, 201 bp, Bos taurus
catgttgccagaagccctgctggagtttgacggtcccttggtgcaaaagtctggatgcatttgttctgtggctcgagttccactgttctcacaggcccacrgtcttacctagagagaaggagagagaggagaatctttctagagaaacagtgtgatgaaaaggaaggggtgagggagagaaagaaaggcaagttagtgagt

SEQ ID NO: 82117 - DNA, 201 bp, Bos taurus
ctgtcccccaagaaccagaacagtgcccacagagacgagacatccaggaaacatttgcataataaacaagtaaaccccacctcttagtcacaatgtgactrtgggtaaacatccaaccatttgtagttccatttatttataaaactaataccatctcaaagcaacagtgtctgacacaaactccgagcgtgctcagtcaca

SEQ ID NO: 82118 - DNA, 201 bp, Bos taurus
tgagttcccctctcattggaaatttctctggggaagccccatgaaggaaatatattttctaaaagtttctcagctacagttatggcatcagcctttctgcrtaggaaggcttcaatccatcctgagaacatacaagcaattacaagaacatattgataaccgtccatatagtcaaagctatgatctttccagtagtcaggc

SEQ ID NO: 82119 - DNA, 201 bp, Bos taurus
cagtcctcctgggccagggtcccaccagcccatgcccttggggagccccgcagcacccaggggctcaactcagcaagtgtgtgctgaatgaacgagtgatstttctgaacctcacggccaatagtgcctctgctgtagccaccctccctgcaccctgccctttccgagacaaaggccagactctccagacttgtccaaagc

SEQ ID NO: 82120 - DNA, 201 bp, Bos taurus
cttcatcctcccaggggcaggcagctggggcctgggcctcccagctctgtgttcttaggctgtgtcccttgggctgtggtgggggaggtgcttagaagcaygtgtcctgggctgtttgccagggcccaggccaggacaagggcatggggcctggtggctgggggaaggctggactgagactgctgggcattaacaataacc

SEQ ID NO: 82121 - DNA, 201 bp, Bos taurus
aagtcacgtcaggctcagcttttgcctgtagatgaactgagaccaggcgcgcctcatcgtcaggctgcccaggcagcgggtggcgctgggcctggcgctcrctccacacgcctcctttcctcttgtaggttgaacgtctccatcgagtgtaagcgagtgtccggcctggagccagccactgtggactgggccttcgacctg

SEQ ID NO: 82122 - DNA, 201 bp, Bos taurus
ctgctaatgcattgggtcccctggtctggtggagggagtgcccccattttaagcccttgtctttgcaggtccccctgcaccattttaccctggattttctrggcctgcttcaagcccagaacctgcttgatgggcctggcacagtcccctcccctgcccacagtgctccgctctaactctccccatttctgtatctgcagt

SEQ ID NO: 82123 - DNA, 201 bp, Bos taurus
tgggccagggaaggacaggccccagggatagaggctgggcaggtcagtggccgccagcccctggcagtgcccttttcctgcagctcctcggagtggaacgscgtggacccttacatgcgggagcagctccgggtcaagatggaggatggggagttctggtgagcagccccctcctcagtctgagtgggcaccccagctccc

SEQ ID NO: 82124 - DNA, 201 bp, Bos taurus
cgtgccctgcccccaccctgggtgcacgacggggacccgggtgtcctgtgtcttggtctctagccagcaaggcagagcccctcctggcaggagccatacayatccctcacttgccaagcactttacagtttgcaaaggactttgcgatcgatagtaatggcgcagggcccctgggttcttgctctctgcagggtctgtgct

SEQ ID NO: 82125 - DNA, 201 bp, Bos taurus
aaactgagttccagtctcagctgccccggccagcaaggtgatctggtcaggcatgtgctttttgaggctctcttgtcccatgtcatctgggaggcttgggrggccatcaaagaggctttccaggtattggtgttgtctacaaaaataatcaacaacaatctgcaataagaattgaaaagagttttatttgagtcaaactga

SEQ ID NO: 82126 - DNA, 201 bp, Bos taurus
gggccagacctctctcttcctctgtgtcctcaggtggtggtgcccggctggggctctcgggcagctgctggggcttgggtggcccatcggggtgcaggaaragggaaaagtcactttcgccctgaatggtgagcgtctggtgggaggtgaggatgtggtaccccttcccagctgggcagatctccttgaaggcagctgtgg

SEQ ID NO: 82127 - DNA, 201 bp, Bos taurus
tcttagccttttacaggtagcagtggccctcaagtcaagacaagaacctgctcaattaagtggtctgcccatggtctaagcagtcagtgcctgctgacccragggccccgttctgttctctgtggtggccacagggtccagtctcttccccataccctgccaggaccataggaggaagaaccgcattccctaaatagtagg

SEQ ID NO: 82128 - DNA, 201 bp, Bos taurus
gggtggaccatgaagactgggccaataacaaccgttctggggaaacattcgcaggagcatgaaaggagggtgagcaagatggagcagggccttgaatgccrggttcagaagggcggcggtggtcctgacccctcccacccaggctgaccccttctagcctgtctcctgtgattctggcctgagccactcagggtgggccag

SEQ ID NO: 82129 - DNA, 201 bp, Bos taurus
tgcacgggggaaaagcagagagttagcccagtgccttctgagaagacctgcaaacaaggagccccattaagaggaccatgtggccaagcagtcagggctcrgtgagccagacaggagagaactgcaggaaaactggccaaacactacctccctatacccatctcagaaattcgttagaactgctgattttaataggattct

SEQ ID NO: 82130 - DNA, 201 bp, Bos taurus
cctcggcctcgtggtcccccaccgccccctggagatgaaaacagagaggtgagattgcagggttcttcctgggaacaggagagtgttttagaaggggactrtttctggatttttagagaaggactcgagagaagatgggagaacttctgggggtggggttggttggtggaggggatccatgtttacttaaaacacaggtag

SEQ ID NO: 82131 - DNA, 201 bp, Bos taurus
tgggtctgtctctcgctccggccttgcctcacacctgggttcttcgaaatgtccgtttctcatcccttatgctgattgccttccctgagagagggtctctytcccccactctctggggccttctcccctgcctgtctcccttccatcactgcagaactgtcagtcagcctccagcttcttttttgggacccctgcccccct

SEQ ID NO: 82132 - DNA, 201 bp, Bos taurus
gaacccaaggcccccagaagtgaaagcatagagtcctaacccctggactgccagggaattcctgaactccaaccgttatataatgcttgtttcagggagamggtggtggtatatgagatgtgggcctactaggggcagaatgacatgttttggtcatttattgggaccctctggcctacagtagattaaatacggatgcaa

SEQ ID NO: 82133 - DNA, 201 bp, Bos taurus
gcttgtcttggcaggacctgtacatccgctggaagggaccctcctttgacgtgcaggtggggctgcacgagctgctgggccatggcagcggcaagctcttyatgcaggtaagaactcgagaccaggggcttccccagcggtccagtggctaagactccacgctcccagtgcaggggcctgggttcaatccctggtcaggga

SEQ ID NO: 82134 - DNA, 201 bp, Bos taurus
cccaagggaagagacaacagagccctgctggcatccacccccagcacccaggaaggagacagaaagccaaaggccgggggccatttaccccgatgcagackctaaccctgtcccaggtcccagagactcacgatctcatcctccacgtcccggtggaactggtgctgctcgcgggaggcctgcaggcgccggcagcgctcc

SEQ ID NO: 82135 - DNA, 201 bp, Bos taurus
atccagtaaagtctgagacataaagttaagtgttcctcagtgccctcggaaactctgaaggaagtagcaagaagtggagcttctgaatgtctggggaaatrttcacaagcctccctttcagggctcctgacttgtttctgtgttatccttcttttgtgggccagtgttttttcttaagactttactctctaggcattccag

SEQ ID NO: 82136 - DNA, 201 bp, Bos taurus
catgtgtgtttcaacatacccagaaccccttctgccaggaattagggcgtgtacctaattcttgtgtacctcgggcgtgtacacagtgccgggtttggccrgcaggttctcagacaccttttgaaagaatatgccctcctgcagcaaggcacaggggttagggagcaagtgcggaacagaatggcctgcactgaacagttt

SEQ ID NO: 82137 - DNA, 201 bp, Bos taurus
ccgccccctccagtggatccctgcaccctccgacccggggggacgggagggggggggtgggagttggatgggggaggctggggagaccgggcctgctaacrgagtcagcctttctttccactgtggcagcatcaagccaactcttgctttgtggttttgggagctgacgtcatgtcctttggccactcacttttttttttt

SEQ ID NO: 82138 - DNA, 201 bp, Bos taurus
ctgagaggaggagggggcagatggcgggaagacgaaagagcccaggactgaggcttggcttggccctgagcacggggctcctgagcaggcgggccatgccytggtctgctccttttcatccgctcagagcagcagaggagacacagggaggacaggtgagcaggagcacaaccttgggacaaggctatctggtgggctcca

SEQ ID NO: 82139 - DNA, 201 bp, Bos taurus
gtcttgatcactctagctttataattaatcttactctctggcagatctcccctcaattcttttgttcatcttcaagatgaggctggccatcctaggccctytgttcttctatatccattttatttattaaaaaaaaattttatttatttggctgcgctggatctttagttacagcctgcaaacccgggccccctgcattgg

SEQ ID NO: 82140 - DNA, 201 bp, Bos taurus
acagaagggtgcagctgtggctgcccaaggcccaggtgatcagcttctgttcgaagtcagaatagggtgggtagcggatgttgttcagcatctccaggccygggtgggagagcaggcaggcacggtggtgggagaaggtgtcgaaggagaacttgccgtggtatcttcccatcccactttggcctgcacgggcacggaagt

SEQ ID NO: 82141 - DNA, 201 bp, Bos taurus
cacccagaagctgttctcaacccctgttggctccagctatccgtgtcagtcttccctcctgcacaaacaccctgctttcctttcccggacgccagtccctrcacctggccactacggtgtgactgtcctctgaccctcctggggctctgaccgtccacaccaggtgcctcctgtgtgaacaggctcctcactcaggctctg

SEQ ID NO: 82142 - DNA, 201 bp, Bos taurus
gcggactcctcaccattgagcctctagaggagccctgatttttaatttgaagaaaatgcgcgcccttgctctagacagggaacaatggatatagttacatkgtataggccactttacagctagttacaaatggctctcttgggacttccagagcatttaattgttaacaggtatttttctaataatttacttttagatctc

SEQ ID NO: 82143 - DNA, 201 bp, Bos taurus
tggagacactgcgtgtaccttgcatttaatagatgatactgaacgtacattccgcttggagctaatctagtactgtaaatttaggggtaggtgtgtcagaygtgactgtcagtcttgttaattacattagtctgagcaacagcaactgatcattttgtagttttcctgaatgatattgtcagctttgagtattaaccatgg

SEQ ID NO: 82144 - DNA, 201 bp, Bos taurus
acttcagaacaggctggcagctcctcagaagatttaatgtggagttaccatctgatctggcagttccatccctaggagtagacccaggggcaatgaacacmcagggccccacaaaaacatgtaccggagcggtcaaagaagcattttaaataatagacaaaacatatggaaacagcccaactgtccaaacgagtggataaa

SEQ ID NO: 82145 - DNA, 201 bp, Bos taurus
gtgtgggcctccatgacaagacggtgggtcagttctcatccacatagggagcatctgggttcctgtttgacccctggagtcacgggccacagtgtccatcrggtgattaacagttaaacaccaccgcatccaactgctcaccctgatgtaagactaaatcctttatccttatcttatccagagtactgaaaaaatacgcct

SEQ ID NO: 82146 - DNA, 201 bp, Bos taurus
caggagatgattgcgggagccagggtcacccccaggaccggagggaagaaaggacatcagaggggctccacaaagaccctcgcgggcatggccagcattcycgcacgagaccccaggcgccacacaccttgaaggaaaagtatcaaccaaaggcttctccaggccaaatctcacgatattaaaaaaaaaaaaaaggcaagc

SEQ ID NO: 82147 - DNA, 201 bp, Bos taurus
gcagccagggggcagaggccttactcccttctcagctctgctccccagactgcagctccctggggactgcagttccctgtagcgaacagagcatctaggtycctggggagctctggcctgattgaaccctgagtttcctcagggccaaaaataggctagagtctgcctcagaaagtaatctttctccttctctgttttccc

SEQ ID NO: 82148 - DNA, 201 bp, Bos taurus
taaatcttttgtcttctcacctgtgaggccatgagcagagttcaggagactcagcagagaggctggctcacctgcccacagctcttggttccagaacgtgracagagaggccagatatccttccatccccgtctgcacacacccagacctggatgaccggcaggcatgcattgcgagtccccggcatgggcagacccagct

SEQ ID NO: 82149 - DNA, 201 bp, Bos taurus
gcagcaccctgctgagcacggctcccaggggctccctcaggctcaagcggcccccactgcccaccaggaaatagatcatcggtttggtgctgctgctcacrgacagagagaagcaggtgaaatggccgaagagagtcttcgcgctctggggcaggtccagccagtagagcaggaacccagagatgccgaggggcagggcgc

SEQ ID NO: 82150 - DNA, 201 bp, Bos taurus
attacagcaatgactctgacggacagagcccatcctcacagaaggcacagtctatcggcagaggggaaaatacacaatcagacgattgcccccggccgccrggcatggtggtggaacgggggtgactaacgagatggggactcggagcgtgggtggggctgggagggtctgaggtccggggggcagctgggagaggccagg

SEQ ID NO: 82151 - DNA, 201 bp, Bos taurus
tcactgagggcatcttccccacagacttggggtgaagcctgaggatttcttgcaagtgctccagaaagtccagctggacagtgaccacaaacaggccatcrcagaggtactggtcccccctcccccctcccccgcctgtgcctctgggctccctaggtcacgcgggtgtcatttcagatcggcgcggctggcctggtcctg

SEQ ID NO: 82152 - DNA, 201 bp, Bos taurus
ggaggtaccagaatagaacccaggtctgcccgcgcccaagtctatagccccttggcccctcaaagatcctgccctgaccacggctgcccagggccccaggrgttggggcatctgacgtctgatcacacccttactccataacccccgactggactggggcgacctcagagcccttgtgagatccataagtgcttgggtaat

SEQ ID NO: 82153 - DNA, 201 bp, Bos taurus
agcgctccggccatgggggcggtggtggccgctgtgagaggcccgcagaagtccactcgcagtggctgctccccaggcagggcgagatagcatctggtctrcaaaatcaagcatgaagggtttgtgtgacagccgtgatcgagaaagagggtggcatcctcaccaagctccctggtggctctgggcctcctggcggacagc

SEQ ID NO: 82154 - DNA, 201 bp, Bos taurus
caggttgggcctgaaactggccccccaggtgaagatggaggggacgctacctgcggggctgcccacagtcacctcaattcctgctgtggtctcagattccrgctgggaaagcccggcccagccccaggctccagcatgtgactctgagtctccaggactgggttcggcttgcacacaaatccaggtgtgtggaggccaccc

SEQ ID NO: 82155 - DNA, 201 bp, Bos taurus
aaaagagacaagctatttatatttttttatatcacgttggaaaatatgctgtgaggcagggtttcccaggaaaatttctggaacccggccaaacaagcacrtttctactctgcaggactcctcagtgcctttccatgaatccccaagagtgtgtgacatagacccagttaattggccctcagaatcttttttatggtaact

SEQ ID NO: 82156 - DNA, 201 bp, Bos taurus
tcagaaagaaccacggaaagaaacttggaaaatttatcaaagaaccaaacgcctcccccggagctctggccaacaggctctgggcccgtgggatttgaggraaagaagttccaggaaaggcaattcgcggagtggagacagtacccagagaagagtggcccagtcccccgccaatcccgatccacagccaagggccacccg

SEQ ID NO: 82157 - DNA, 201 bp, Bos taurus
ctgaggtcactcaggcccgtggctcacttaggccagatctgatgaccacagcgcctcacacagacctctgggttccaaaaggaatcaggcagcagagcacragaaggtgggcaggggggcctccattaaccagacatcctgggagcggccaggatccgttggacgatggtgtagggcacggcaggcaggcatccgggcgct

SEQ ID NO: 82158 - DNA, 201 bp, Bos taurus
tctgtgactgattgaaatcagacatattggaccctgaggccactgacacccgtctgcaggagacataccaccaggagacccctgacagctgattggcacaygtcatgggcactaaggaagcctggccattgtaccataagcatcccaggcttcagagtgactcactggcccaggggtacgattctcactttgggtgtgaga

SEQ ID NO: 82159 - DNA, 201 bp, Bos taurus
gaagggtcttccttggcacccacccacaccctctcctgggccacctcctcccacccacttcaggcgtcacctccggtccggaatcaggctggctgtacccmccagctttcaggcctcagttggcaggagccgagtagccaatgaaacctcaactcaccacagcttagatggctaagactcccagcgaggctgcctcttgcc

SEQ ID NO: 82160 - DNA, 201 bp, Bos taurus
actgaagccacttagcacgcacaggtcaaactctcagctcccagcagcctcgtctgtgaatcgggcatgtcccaccacagaggcctgcttgaaggacaggrcatcaatggcagcgttttccctggtgatgctcattgtctgatgctggacccaggaagaaccacactgtctgctgcctctatttcgtctctggagtgaggc

SEQ ID NO: 82161 - DNA, 201 bp, Bos taurus
aaggcttgatgattccaagaagccaagggtggccctcacaggcgaggtcatagtcaatactccaggagggtttgctggtctgtttatcagcgggcgctttrcaccaggcgtggccttgacctcttcctttacacacatgtcagccctggcacaaggacatcccctgtgggaattagtatttatgtttcagagaagtcaaac

SEQ ID NO: 82162 - DNA, 201 bp, Bos taurus
caggaatgttactgttggaaattatcattttaaaaaacttgtaaaaacaaacctccatagctgataggaatggtctcaacttgcagccccattatactaaygatgatctgaagtttctcaagcacgcagagaaacgtaagagaaacgttccagcaaagggaggggcgaaaacacgaacatgtttgtcttgaacatgtggtt

SEQ ID NO: 82163 - DNA, 201 bp, Bos taurus
catgaggggcgagaggggctgcttggcaggtgacctcctggaagaggtgactccacggcgtgagaactcagcgatggggagacatcagccatgagagaggygaggccagggtgttctgggaaaaggggaacagctagtgcaaaagcctggaggtgggaaccagcctggcaggtttgagggccgcaaggacggccagtgtga

SEQ ID NO: 82164 - DNA, 201 bp, Bos taurus
ccgccccttcacagatgctctgagatgattggctgtttgagaggcgagagagttttcccctggttgctgtagaaacctccatgttggtgcctgctcatcgmgtggccctgagatggccttcgatgtgtcccaggggacagtggggactccctgtccctgcctgtgtcacagtgacagagggcccccctcacacccacttcc

SEQ ID NO: 82165 - DNA, 201 bp, Bos taurus
gaatggcccccaggtgagcagcccgcctctcctgcagggaaactcacagagctgctgtcatgcaagaggcatgcaggagtctcctgaaaaggccacagtgyaggtattttagggtcaaggttgcatgtctttctgtgtgtgtgtttacagctcttttaagaatgtaaggcccgcctgcttgcagggcgcacccagacgctt

SEQ ID NO: 82166 - DNA, 201 bp, Bos taurus
ccaccgctgcccgcaccccccaccttctgggaaacagcaggtgagccgagcctgcagccatctcctggggatttccagccagcagaggagtcgcacccctraaggcggctcaggattccagggccttctagagatcggagagacgcagcagcaacccttggtctctgcagccggaatctggctggactgttcagttttagt

SEQ ID NO: 82167 - DNA, 201 bp, Bos taurus
acccaggctcctgactcccctattttggcttcaagtggcttgggaaaggctgaggcaggatgtgggggagacaggggctttctggctccccaaggcctccrtgtaacttgaacagcgcacaccagtgagggttagtggagatggctcgctgcaggagcgggaagacacacatggaaaagccagggtgcctgaggccatgtg

SEQ ID NO: 82168 - DNA, 201 bp, Bos taurus
cagatggccggcgggggacaggggcctaccgcagggcgctgtctggccagtgcccacccatcctacttcttggcagctgtgagcaggcccctgtgctgtcrtagagggtctggaggaggaggggctgtccagggagacaccgggcagctcctggaacacctgcctcgctttctccacttatcagagcaggaaaacgctcct

SEQ ID NO: 82169 - DNA, 201 bp, Bos taurus
gcagggggcccaggttcaacccccggtcagggaactagatcccacctgccgcaactagcactgggcacaggcaaattaaatactatgttttaaagccacayaccaaaatcctcaacactgtgggccttccacgtgggggccccagccccttttcctgatttttctagtagacatgtacttgtattataaaataatttaaca

SEQ ID NO: 82170 - DNA, 201 bp, Bos taurus
ggccgctgacacactgcctcccaggttcctcctgctgtggccgcgtttgcagcctggacgtgagagtctgtgtcactcctgtcctggagttttccaccagrgacctggaagaccctctcgggcctgagtgcctcagccagcacagccccgatacccaggggcacgctctacgtgcaggctgggctcagggcgggtgttatg

SEQ ID NO: 82171 - DNA, 201 bp, Bos taurus
ggactccaggcgggacccaggcccgaagcaggggctgtgtgcatctttgaaggcccaggagtctgctgttttttccaggttgtgactcagggctttgggtkaaatacatgattttgatggatttacagtgtttttttccccctcttatgatttataacagtaagacacccaaatgaagctacttcttagaaggtaaagagt

SEQ ID NO: 82172 - DNA, 201 bp, Bos taurus
gcagctgcccatctctgctctgggcaccctgggatctggtgggtaggtttctagggcccctgctgccttctgcccctgggcctctggttgatgcccagctygggggtggtcaggtctcacacgcattttgcgaatgggaatgctagctacgagggatgacctgggcctctctctctgcccctgccaccctgggactcagcc

SEQ ID NO: 82173 - DNA, 201 bp, Bos taurus
ctctgcttcctaaacatccgcctccctgaaatccgggacactgccaggctgtccacacccacgatgggctgggggactttgggcctcagtcccctccctgyagctcagaatggagattgatgcgtctgtggttggaattcctggggggcggcggtctagctcccctggacagcttctcgggcctgcggggcgtctcaggga

SEQ ID NO: 82174 - DNA, 201 bp, Bos taurus
gcctgctttcctgtgggccaaagggctttatgaggctcggggccaccctcgacctgccagtgcggtcaggggcaggctcagaagaggcaaggcggggttcrgaggtcaaagttgggcaggcctggcccagaatggcgtgagtgcttgtcctggcctcccgtacaccctgggaggtcacggaccactgtgggcccctgagtg

SEQ ID NO: 82175 - DNA, 201 bp, Bos taurus
gctcgtggtgggtgtttataacctcgtggtcccttgggatcagggggcgggtgctgggtctctagcgggggctcccgccttgctccagatcccgggggccygtgcggtgtctcccctatggctcttgccaggggctctgcatgttgggtgtctttctcctctgcagatagcctgggtaccagggaatttgccgagtgttat

SEQ ID NO: 82176 - DNA, 201 bp, Bos taurus
ctgagcaccacagccagagcacccccgccttggcagcgactgctactattggcccagccagcggatcatccacctggcagtcgagagcctggggcaccagygacgtccaggtcctctttacccaccgcccaggggagcttcagagacaacacagcaaatagagcacaggtgcccgggcgtccctccctcacacgtccccct

SEQ ID NO: 82177 - DNA, 201 bp, Bos taurus
atagtaaaatggaactttaaaaaagaagtggggaattgtgctaccagctcccatcagatgggcagcgcccacaggagccctggctggcttctatacctggmacaaatcccgtccttgccaggccttgtctggccctaaaatggcctggatggggactctggatatttcaaaatggattttttttttttttttttgcactta

SEQ ID NO: 82178 - DNA, 201 bp, Bos taurus
actgctgtgggttggggactggccgccgccagtggtggctttaggggtggaggtgggccgccagccaagtaatgggggcccccagcagctgaaagtgccaraatccaggttttctcttggagtccccggagggagcttggtcctgtgacccctggattcaggcccagtgaaacccgattcagacctctggcctccagatcc

SEQ ID NO: 82179 - DNA, 201 bp, Bos taurus; identical to SEQ ID NO: 41642

SEQ ID NO: 82180 - DNA, 201 bp, Bos taurus; identical to SEQ ID NO: 41643

SEQ ID NO: 82181 - DNA, 201 bp, Bos taurus
ccctgaatgccaggctagagggatgcaggaccccgggaatccctggcctgaagctgcagagacacgacattggcggggcaggcagccgcacacaagtgaargaggcagggctgggctgtggcatttattacatctgctttgacaaaaataaataattcacacacattcttcagaaacatgaaaaatgaagccggcggagca

SEQ ID NO: 82182 - DNA, 201 bp, Bos taurus
agggaggtagccaggaggagaccaacggcgtccgcaggtgctggcgcccaggtcagccgcggaggggctggacacgggccttcaaactattcttttaacayacttgttccttcctgataaccacgcgggaattccaaggagtcttgaggccctggctgtcacagggcagtgctgagctcaagttcatcaaaactcagcttc

SEQ ID NO: 82183 - DNA, 201 bp, Bos taurus
gtataaaagattaacggcccgattgaaaaactgacacaaggcatggacagggagtctacagggaaatagacatggaggaaccctttggttagaaaattatmtgccggggacgcccctggcaggccactggttaggactctgagctctgaccgccgaggacccagtccctggtctgggaacttagagcccacaagccacatg

SEQ ID NO: 82184 - DNA, 201 bp, Bos taurus
tgcctggctgcaggctttcccggaaagggccctgagggagagaagtcattgggccaacccccatgcccagggaccgcagcccctggggccatctgtatgcrgcagggtgggagtctggctgaaccgtttttctttctgcaaattctccactgagttccccagggcctgcccacccagcgccctgctggctaaggacttgca

SEQ ID NO: 82185 - DNA, 201 bp, Bos taurus; identical to SEQ ID NO: 41647

SEQ ID NO: 82186 - DNA, 201 bp, Bos taurus
agcaggcacatttctaaattagaaggcataattcttatgccaacaaatgttggagaaccactggtctagggaatctttaaaccctaattatacatgaccaatgacccttatttcatgttcagtcacctgggaaaacaggctgcatgtggtccagccgaggagctgtcagctgctcaccagctgttaaggggtctgtgttaa

SEQ ID NO: 82187 - DNA, 201 bp, Bos taurus; identical to SEQ ID NO: 1

SEQ ID NO: 82188 - DNA, 201 bp, Bos taurus; identical to SEQ ID NO: 2

SEQ ID NO: 82189 - DNA, 201 bp, Bos taurus; identical to SEQ ID NO: 5

SEQ ID NO: 82190 - DNA, 201 bp, Bos taurus
tggcctccaggctattatttttttttttcaggcaaatttcctgccttttttttttccttctttttctggcttccatttgcttcagtggcagcaacagcagcagcagctggccctctagattagctttaatccgcttgctatttatagcacactctgtaaacctcatcatacttgtgattccctatttaaatgtgtcttcct

SEQ ID NO: 82191 - DNA, 201 bp, Bos taurus; identical to SEQ ID NO: 6

SEQ ID NO: 82192 - DNA, 201 bp, Bos taurus; identical to SEQ ID NO: 7

SEQ ID NO: 82193 - DNA, 201 bp, Bos taurus; identical to SEQ ID NO: 8

SEQ ID NO: 82194 - DNA, 201 bp, Bos taurus; identical to SEQ ID NO: 9

SEQ ID NO: 82195 - DNA, 201 bp, Bos taurus; identical to SEQ ID NO: 10

SEQ ID NO: 82196 - DNA, 201 bp, Bos taurus; identical to SEQ ID NO: 12

SEQ ID NO: 82197 - DNA, 201 bp, Bos taurus; identical to SEQ ID NO: 13

SEQ ID NO: 82198 - DNA, 201 bp, Bos taurus; identical to SEQ ID NO: 14

SEQ ID NO: 82199 - DNA, 201 bp, Bos taurus; identical to SEQ ID NO: 15

SEQ ID NO: 82200 - DNA, 201 bp, Bos taurus
gagagccaggccatgtctgtggacctcactgcgactgtcgtcctaccctttggcacctctgcaggcagttgcttcaggaaccaagcctcctccaacacttgacttgaataacggccaaaccaaggccacacagaactgaacccgatcctgccccagaaataaatcatttccactttagcctcctgaagtggaagttacctg

SEQ ID NO: 82201 - DNA, 201 bp, Bos taurus; identical to SEQ ID NO: 17

SEQ ID NO: 82202 - DNA, 201 bp, Bos taurus; identical to SEQ ID NO: 18

SEQ ID NO: 82203 - DNA, 201 bp, Bos taurus
cattcagctttaaaaacaaattaaagggggaggccttcttggtaatgatgacacttttacttttgtttccattttatttgtttagactgaaagaaaggattcgggcccagaaaggccaactctctaaaatggatttgattttgaacagtcaacaaaagcaaaaaatgttcttaggtgctatttacatccgcacccaaatta

SEQ ID NO: 82204 - DNA, 201 bp, Bos taurus
tctgcagccccagctgacatcttgctgcaatcaggtgagaaactctgagcccgacccatcctgctaagctgctccggaattcctggcccactggcactgcgaggtgagaagcgtttgtcgttgtgtgaagcagttaagttttagggtgttttgttacaaaggcgtgggccactaatacagttacttacaatgccataagac

SEQ ID NO: 82205 - DNA, 201 bp, Bos taurus; identical to SEQ ID NO: 19

SEQ ID NO: 82206 - DNA, 201 bp, Bos taurus
attaaaaagaacctgggggtgagcaaggtcaaagctgctccaagctccatgcaaagattgaagaaaaatgaatttagggctgccttagtgctgatgagaataagttgctggcagaagttttttctaatagcaagtggtaagtattaaaatacaaagctttcctgttctaaaaaggagacctggtgctaaagaaagctgcat

SEQ ID NO: 82207 - DNA, 201 bp, Bos taurus
tggaaacttagggctgaataagaacatcagggtccgagagggaagtcacaaaagccaagtgcatttgggatttttgttgcttagaaagaggcctaaatccagggaatgctctctccctctagcccttctctccctctcttgccttgccacctcctacctttggcccagctacacagcttccccactgttcctcccctcctc

SEQ ID NO: 82208 - DNA, 201 bp, Bos taurus
gtgggcctgggcccctcctggggaggcccgatacatgtgatgggggtttctgacttggaaacaatttcataagccatcctgggagtaggtaaggcaagaggggcccccagaacctcaggcccgatcctcccgggtttctgagaacctggccgctgttttctttcccccaacagacatgactaccttggtgcccccagtggc

SEQ ID NO: 82209 - DNA, 201 bp, Bos taurus; identical to SEQ ID NO: 20

SEQ ID NO: 82210 - DNA, 201 bp, Bos taurus; identical to SEQ ID NO: 21

SEQ ID NO: 82211 - DNA, 201 bp, Bos taurus; identical to SEQ ID NO: 22

SEQ ID NO: 82212 - DNA, 201 bp, Bos taurus; identical to SEQ ID NO: 24

SEQ ID NO: 82213 - DNA, 201 bp, Bos taurus; identical to SEQ ID NO: 25

SEQ ID NO: 82214 - DNA, 201 bp, Bos taurus; identical to SEQ ID NO: 26

SEQ ID NO: 82215 - DNA, 201 bp, Bos taurus; identical to SEQ ID NO: 27

SEQ ID NO: 82216 - DNA, 201 bp, Bos taurus; identical to SEQ ID NO: 28

SEQ ID NO: 82217 - DNA, 201 bp, Bos taurus
gatgtggcacaggctggtaactgggaggttagacttttccttttttaaatatttatttatgtgcctgttccaggtctttgctgcagcagattcttgtgaacaaggccttagttgcggcaagtgtgatctagttccctgaccagggatcaaacccggacccccagcattgggagcatggagtcttagccactggatcacaag

SEQ ID NO: 82218 - DNA, 201 bp, Bos taurus
gaattcgctaatgagaagatccaagcagatccacttgtgatctgagtgttcattgctgcaccgcctctccaagctcccaagggcatctctctacgtaatagtaatgcctggccaggtcccatccattctgacagacaaaggacaggcgctactttacatttatgtgcagcctctttatttcattatactgagtgccttctg

SEQ ID NO: 82219 - DNA, 201 bp, Bos taurus; identical to SEQ ID NO: 29

SEQ ID NO: 82220 - DNA, 201 bp, Bos taurus
tatggccttgacttaatacagtgccgctcctgttcagggctgtgcaggctctcccagtgtctcaattacaggtttttaagttggagtctgttgggccatgcggggtcatgtttgcacctctggtctacctggctcttgctgggaagttggggtcatttgtgctttgggtggccccagacacgcccaggcaggctctcaaga

SEQ ID NO: 82221 - DNA, 201 bp, Bos taurus; identical to SEQ ID NO: 30

SEQ ID NO: 82222 - DNA, 201 bp, Bos taurus; identical to SEQ ID NO: 32

SEQ ID NO: 82223 - DNA, 201 bp, Bos taurus; identical to SEQ ID NO: 33

SEQ ID NO: 82224 - DNA, 201 bp, Bos taurus; identical to SEQ ID NO: 34

SEQ ID NO: 82225 - DNA, 201 bp, Bos taurus; identical to SEQ ID NO: 36

SEQ ID NO: 82226 - DNA, 201 bp, Bos taurus; identical to SEQ ID NO: 37

SEQ ID NO: 82227 - DNA, 201 bp, Bos taurus
actcaaatttgccttcttattcccaattttattgccacaagcatcactcagaggctcagttttttttttaattgacaattctaatagaatactaatagctctatatccttcacagttctcttccacaatccattattcacactaagccagttctaatcacactatttcctcaattaaatcctttagtaagcagcactttat

SEQ ID NO: 82228 - DNA, 201 bp, Bos taurus
aagcttcccttttagttcagccctgggatattatttaattccaatatggaaatttgaattttcctgtgggaaatctatgggaagacaaatgtgaagtgaattccttcttattgcacaatgaaaaggagctttgaggacagtccttttttaacttctctgtttctggatggtgatgtgtatgaatctgaagcattgaccttc

SEQ ID NO: 82229 - DNA, 201 bp, Bos taurus; identical to SEQ ID NO: 38

SEQ ID NO: 82230 - DNA, 201 bp, Bos taurus; identical to SEQ ID NO: 40

SEQ ID NO: 82231 - DNA, 201 bp, Bos taurus; identical to SEQ ID NO: 41

SEQ ID NO: 82232 - DNA, 201 bp, Bos taurus; identical to SEQ ID NO: 42

SEQ ID NO: 82233 - DNA, 201 bp, Bos taurus; identical to SEQ ID NO: 43

SEQ ID NO: 82234 - DNA, 201 bp, Bos taurus; identical to SEQ ID NO: 44

SEQ ID NO: 82235 - DNA, 201 bp, Bos taurus; identical to SEQ ID NO: 45

SEQ ID NO: 82236 - DNA, 201 bp, Bos taurus; identical to SEQ ID NO: 46

SEQ ID NO: 82237 - DNA, 201 bp, Bos taurus
gcctactagacattatttttttaataagacagtttactttggcaacttctcctcctccttaaaagtactgttttttttcaatctctatatctctatgaaccactcagattttttggcccattaaattttcaaagtttaacaagtgagcaggaaacacacccttccataccctgagttaagctagtacaaggaaccacagaa

SEQ ID NO: 82238 - DNA, 201 bp, Bos taurus; identical to SEQ ID NO: 47

SEQ ID NO: 82239 - DNA, 201 bp, Bos taurus
atgacttttactttgaaaactaggataggcctgagcaaaccaatacaatggtcatcttagtatggaggtgcagggattgacatgattaacaggctcccaggtgatgttgggccttgcgggtggctcagatggtaaagaatctgcctgcaatgaagaagacctgggttcaattcctgggttgggaagatcccctggagaagg

SEQ ID NO: 82240 - DNA, 201 bp, Bos taurus; identical to SEQ ID NO: 49

SEQ ID NO: 82241 - DNA, 201 bp, Bos taurus; identical to SEQ ID NO: 50

SEQ ID NO: 82242 - DNA, 201 bp, Bos taurus; identical to SEQ ID NO: 52

SEQ ID NO: 82243 - DNA, 201 bp, Bos taurus; identical to SEQ ID NO: 53

SEQ ID NO: 82244 - DNA, 201 bp, Bos taurus; identical to SEQ ID NO: 54

SEQ ID NO: 82245 - DNA, 201 bp, Bos taurus; identical to SEQ ID NO: 60

SEQ ID NO: 82246 - DNA, 201 bp, Bos taurus; identical to SEQ ID NO: 61

SEQ ID NO: 82247 - DNA, 201 bp, Bos taurus; identical to SEQ ID NO: 62

SEQ ID NO: 82248 - DNA, 201 bp, Bos taurus; identical to SEQ ID NO: 63

SEQ ID NO: 82249 - DNA, 201 bp, Bos taurus
atttctttaaaatctagtcaccaggaaggatgggcctatgccttgcagcctctgtcggaagacagaatcctaacttggacaactgtcatccatgagaagcgtctggcctatttggtatttgcactgaccaaccttcacttccctcactctactgagacccctgctaaccccttccctactccctcattcttcttttacaat

SEQ ID NO: 82250 - DNA, 201 bp, Bos taurus; identical to SEQ ID NO: 64

SEQ ID NO: 82251 - DNA, 201 bp, Bos taurus
caaaaatagttacatgaaaagaaaattacctaatttatatttcccgaagagtatcctgcatatttaaaaactttagcattctcttatgtagggtttcccttgttgctcagatggtaaagcatttgcctgcaatgcaggagacccggggttcaatccctgggttgggaagatcccgtggggaagaaaatggcaacccactcc

SEQ ID NO: 82252 - DNA, 201 bp, Bos taurus; identical to SEQ ID NO: 65

SEQ ID NO: 82253 - DNA, 201 bp, Bos taurus
tagtacaatatgccaggtaaaaagtttagcagttttacaaatataaatagttctaaatggctcttctagccaaaattatcaccactcagtgagtacaatttctccatctctcataggtgcactaaattttcatgttttattggcaagagtgacagtactctaattcctgtgcactcattatcagcttagtgcaaatcaatc

SEQ ID NO: 82254 - DNA, 201 bp, Bos taurus; identical to SEQ ID NO: 66

SEQ ID NO: 82255 - DNA, 201 bp, Bos taurus; identical to SEQ ID NO: 67

SEQ ID NO: 82256 - DNA, 201 bp, Bos taurus; identical to SEQ ID NO: 69

SEQ ID NO: 82257 - DNA, 201 bp, Bos taurus; identical to SEQ ID NO: 70

SEQ ID NO: 82258 - DNA, 201 bp, Bos taurus
gtgagatgaaagcaacaatatgcttcatcataagacatggaggtacaacctggctgccaatggaatcaaaagaagttgctttcactgtctctcgggaaaagcctgtagtgagccaagttctgcagaggagctatgggcagggctgttataaaatgaccagaacctgtccctgacaatttagggagaggcaaaatacttgtg

SEQ ID NO: 82259 - DNA, 201 bp, Bos taurus
agaatagcccattaatttccattggaaacattccagtgaatagcaagagtttgtgatgctttctttttttgttttttctgtagtaatgtctgagctccacaaaatcaagaggtgaaatatggaatcgtgtgctttaaaaaaacatgtgctacagaggcaaatctggcctcagtcctgaattccatagacagccccttattg

SEQ ID NO: 82260 - DNA, 201 bp, Bos taurus
tctccagaggatcttcccaagtggttattaaccaattttgcattcctgtgataaactgatcagttattgtgttagctttttaattgttgtaccaaacctaggctaacacagaataactgattggtttatcacaggaatgcaagactgcttaataattcaatagcaatccaggttactcatcatactaaaataaaaagggga

SEQ ID NO: 82261 - DNA, 201 bp, Bos taurus; identical to SEQ ID NO: 72

SEQ ID NO: 82262 - DNA, 201 bp, Bos taurus; identical to SEQ ID NO: 73

SEQ ID NO: 82263 - DNA, 201 bp, Bos taurus
ttgtcatcccactggaccttaacggtgcaaaaacagttaagagaaatttgaggaatagttaagaatgactaaaggaaattaacatacacatttccattaagagtcccttacatccaccaggtaattgatctttcttgctgaacgtgggttaggtcagcaatagaacagtacattggatgaatagggatctgtacaaattgg

SEQ ID NO: 82264 - DNA, 201 bp, Bos taurus
agtaattgccgtgcgagggcttggttgccccacagcatgcagatctcagttccttgaccagggatcaaactcatgtcccactggaccaccagggacgttctcatgctgacagattaaacgcaagttattaaagagaaacatgagtctccctaacgtaggtattttggattatgtatctgagagaaaaagagctgtctttac

SEQ ID NO: 82265 - DNA, 201 bp, Bos taurus
tatggaagaataagccattgcacaagactagaatatttcactctcacccagtaattggttggctctttctaattaaattatcagatgtttttattgagcaaactactgaaagcagtgaccactaatgagacacagttccccagaacagatggcagttcagctgtcttgagtgttgcaaaatgcccaagaatcgggccacac

SEQ ID NO: 82266 - DNA, 201 bp, Bos taurus; identical to SEQ ID NO: 75

SEQ ID NO: 82267 - DNA, 201 bp, Bos taurus; identical to SEQ ID NO: 78

SEQ ID NO: 82268 - DNA, 201 bp, Bos taurus; identical to SEQ ID NO: 79

SEQ ID NO: 82269 - DNA, 201 bp, Bos taurus
aagattcaaggtctatatgtattctgacttcagaattcaacagaaactgatttttcaaatgccttaatattaatagtactgtccaatgtagcttccttttgttatctctttacatatgttttcaccaaaagcctcaagaatgctttcaaaagcacacagaagtgccctgatgaaaaataactttattttcagttcagttac

SEQ ID NO: 82270 - DNA, 201 bp, Bos taurus
ttgttgtaaagagcaaggtttgggtgcatgtaacccatttagttatcgggtcataagcaatcgtttcctgaccagttagtgcctgtctttcccccatgattagtgccttataaatgctgcactcggtgttttatggctttactgcctacccatttagagaatactgtcattcattcaaatgcacactgcaaacattgtaga

SEQ ID NO: 82271 - DNA, 201 bp, Bos taurus; identical to SEQ ID NO: 81

SEQ ID NO: 82272 - DNA, 201 bp, Bos taurus; identical to SEQ ID NO: 84

SEQ ID NO: 82273 - DNA, 201 bp, Bos taurus
agaagaaaggttataataaagagtaattcatgtataaatgtaaatgaccattcacattcagataaaatcaaattgattgatttccttggaacaggtaataaattgaaaagaaatagtacaatttgagagttagggatatgtcaggccattgttcactatttgcactaatttaaaattttaaattttactccaaaagttttg

SEQ ID NO: 82274 - DNA, 201 bp, Bos taurus; identical to SEQ ID NO: 85

SEQ ID NO: 82275 - DNA, 201 bp, Bos taurus; identical to SEQ ID NO: 86

SEQ ID NO: 82276 - DNA, 201 bp, Bos taurus; identical to SEQ ID NO: 87

SEQ ID NO: 82277 - DNA, 201 bp, Bos taurus; identical to SEQ ID NO: 89

SEQ ID NO: 82278 - DNA, 201 bp, Bos taurus
tttgctttcaaggaccatggactcaaggctgtgtatatgccagacttcagtgaacattcagggcagtcaaagaatttcacagaagtttggcaaagcaacaatctaatgctaaatatttaagaatgtgttcttaaaagtacctcaaacatttcttcctccaaaaagttctccctgatcgtcactttaactcaagtcacaact

SEQ ID NO: 82279 - DNA, 201 bp, Bos taurus; identical to SEQ ID NO: 92

SEQ ID NO: 82280 - DNA, 201 bp, Bos taurus
taaatgcttagacaagtaaaataagaatgattattcaaaataataagtgaaagagaaaatctaggaaagctagctgataatgccaaataatatttattgtcaaattttattttcaatgattaattatctctaagaatgtagaactggaagttcatcaaaaaagtactccatcagcatgccaacaattatttatccaataaa

SEQ ID NO: 82281 - DNA, 201 bp, Bos taurus
cactcatttaaataaaaaacactttagagaggacattcaatgtgctttatagtaattaggctataaaacataaaaaaacactctaagggcttaaagtccaatgatatgtagaaatataaacaggtcatttaatgaaatatagaaaatgttaacaccaaggtacttacaaagaactttgaaagcattaagggctacttgatt

SEQ ID NO: 82282 - DNA, 201 bp, Bos taurus
gatccaagatcatggattgaagagagaagcaaaggagccaggtactggatttcccatgaagatattttgctgattcctggacttggaaggacatgaggaaaaaagccaagtaaaaagtaacaacaacagcaaaaaaaggtaaagcagaattttcagcagtcatttgttgctaaggaaacaaaaactggaattcaggaccct

SEQ ID NO: 82283 - DNA, 201 bp, Bos taurus
aataagtcactgatgactctacctgcaagattttgttatactcagagaagcaaattaacttaagttatatactgtgcaaagccagtgatttttgtaacattgagattggtatttaatattaactttatacctcagttatttgggtgtactattctcagaagacaatttgtatcaggtgtttcttcttattttaatgcacac

SEQ ID NO: 82284 - DNA, 201 bp, Bos taurus
aacaagaaacagattgcataatttctaaagtttcattcaggtttattatttctctgactggataaagacatctttcagaagggttctataaaataaacatgcttttcacatatcgttatttaacataaatgtgcttgcttcattgctgtttataacaatacttataaattttaaaaagtggtaattttgagggttacagat

SEQ ID NO: 82285 - DNA, 201 bp, Bos taurus; identical to SEQ ID NO: 95

SEQ ID NO: 82286 - DNA, 201 bp, Bos taurus; identical to SEQ ID NO: 96

SEQ ID NO: 82287 - DNA, 201 bp, Bos taurus; identical to SEQ ID NO: 97

SEQ ID NO: 82288 - DNA, 201 bp, Bos taurus
tatccacattgaaattctcagaacctatgaatgaggctttatttggagaaaacaaaaattttttggtagatgcatttaagttaagatctcaggatgagatcatcctggcctatccactaaacccaagtatccttgtaagagacatacaaagaaagatatacacaaaggagaaggtcatgtcaagaagaaggtcaatttgga

SEQ ID NO: 82289 - DNA, 201 bp, Bos taurus
cttatatcattattccttgtttcccggggtccatataatttggtaacatctttggcaatatcttctcagctgaaatggatgctggtcaaaaaatatcttctaggctaaaaaaagcaggtaggtgggaaagattaaaatgacatctctctttcagcataggcagcctcatttaaaggattcctttaaatagttttatttaat

SEQ ID NO: 82290 - DNA, 201 bp, Bos taurus; identical to SEQ ID NO: 98

SEQ ID NO: 82291 - DNA, 201 bp, Bos taurus; identical to SEQ ID NO: 99

SEQ ID NO: 82292 - DNA, 201 bp, Bos taurus; identical to SEQ ID NO: 100

SEQ ID NO: 82293 - DNA, 201 bp, Bos taurus; identical to SEQ ID NO: 101

SEQ ID NO: 82294 - DNA, 201 bp, Bos taurus; identical to SEQ ID NO: 102

SEQ ID NO: 82295 - DNA, 201 bp, Bos taurus
gagctataattacaattcaccattcaaataaagaaatttagctcctttgataaacaccttattaatatcaatactgaatttctcactggctttattttcactgttgtcaaaactgacaaatgcaatagtacatgcattcaagaatttagcaaatgtgcagtcagaattttgtctcagagttaagttttatgagtcattttg

SEQ ID NO: 82296 - DNA, 201 bp, Bos taurus; identical to SEQ ID NO: 103

SEQ ID NO: 82297 - DNA, 201 bp, Bos taurus; identical to SEQ ID NO: 104

SEQ ID NO: 82298 - DNA, 201 bp, Bos taurus
ggacgaggtttcattcattcattgttttgggaacacttgttattttgtcttacataggctgggatacccatacattctaaatggatttctttattcaatcatttattcacttattaaatcaacaaatatttattaaagtagactagggtccagcctgggcttcctgggtggctcagtgagtaaagaatctacctgtgatac

SEQ ID NO: 82299 - DNA, 201 bp, Bos taurus
aaagaagcagatgcagaggacattattggagaactatctatgttgagaagcaaggatgactcaggtttttggcttgagcaatggggtagactttagtgttgttttttttttttttaaaacaggtctaggaagagacagacacacttgtacatagtgaagcagaaggagaatgggagggaagactactattttggccatttg

SEQ ID NO: 82300 - DNA, 201 bp, Bos taurus; identical to SEQ ID NO: 110

SEQ ID NO: 82301 - DNA, 201 bp, Bos taurus; identical to SEQ ID NO: 111

SEQ ID NO: 82302 - DNA, 201 bp, Bos taurus; identical to SEQ ID NO: 112

SEQ ID NO: 82303 - DNA, 201 bp, Bos taurus; identical to SEQ ID NO: 113

SEQ ID NO: 82304 - DNA, 201 bp, Bos taurus
ttattgaccatcctgctggcaattggcttgtcctaggtcttcctcttagcatatttccctcaccagggcttgactggcctaataactggtgctgtcttgggttgatgccccctgtgtgcccatagcatggaagctaagctcctacgggtgccctcactggctgccagccatgtctgttgactctctttacactgggcctgg

SEQ ID NO: 82305 - DNA, 201 bp, Bos taurus; identical to SEQ ID NO: 114

SEQ ID NO: 82306 - DNA, 201 bp, Bos taurus; identical to SEQ ID NO: 115

SEQ ID NO: 82307 - DNA, 201 bp, Bos taurus; identical to SEQ ID NO: 116

SEQ ID NO: 82308 - DNA, 201 bp, Bos taurus; identical to SEQ ID NO: 117

SEQ ID NO: 82309 - DNA, 201 bp, Bos taurus; identical to SEQ ID NO: 118

SEQ ID NO: 82310 - DNA, 201 bp, Bos taurus; identical to SEQ ID NO: 119

SEQ ID NO: 82311 - DNA, 201 bp, Bos taurus; identical to SEQ ID NO: 121

SEQ ID NO: 82312 - DNA, 201 bp, Bos taurus
acaacttcgaacaaatttgacaaagtgattatcaggcttctgttttaagtttaaaacagaatagtccaaatagaggccagaattaaaggaagaggattttctttcatctcaccaaacttccctccttatttacagaagattcccgttctattgtcattaaaacaaaagggaaagaattaaaaaagggaagtgttggtgaaa

SEQ ID NO: 82313 - DNA, 201 bp, Bos taurus
ttcatagtaatttaaaatgaacattaagttctatacaatgagaaattgcccaagaagaaaaaatattgtattaacacaaaaggaaaagatcctatctcctatatttctacacatatatttagggcacacacacatccctgaaagcataaagtttatgttgcaactgtaatctctggtgtattatgtaatgcctccaatctt

SEQ ID NO: 82314 - DNA, 201 bp, Bos taurus; identical to SEQ ID NO: 123

SEQ ID NO: 82315 - DNA, 201 bp, Bos taurus; identical to SEQ ID NO: 124

SEQ ID NO: 82316 - DNA, 201 bp, Bos taurus; identical to SEQ ID NO: 125

SEQ ID NO: 82317 - DNA, 201 bp, Bos taurus; identical to SEQ ID NO: 126

SEQ ID NO: 82318 - DNA, 201 bp, Bos taurus; identical to SEQ ID NO: 127

SEQ ID NO: 82319 - DNA, 201 bp, Bos taurus; identical to SEQ ID NO: 128

SEQ ID NO: 82320 - DNA, 201 bp, Bos taurus; identical to SEQ ID NO: 129

SEQ ID NO: 82321 - DNA, 201 bp, Bos taurus; identical to SEQ ID NO: 130

SEQ ID NO: 82322 - DNA, 201 bp, Bos taurus
tgatggacagggaggcctggcgtgctgtggttcatgggatcgcaaagagttggacacgactgagtgactgaactgaactgaaggttatacagcaagaagcggcaaaactgaaacctcaaccagggccttctggcccaagaattcacgttctcacctaatacacagtgctgttctcttggtacactaccaccaccctgcaaa

SEQ ID NO: 82323 - DNA, 201 bp, Bos taurus; identical to SEQ ID NO: 134

SEQ ID NO: 82324 - DNA, 201 bp, Bos taurus; identical to SEQ ID NO: 136

SEQ ID NO: 82325 - DNA, 201 bp, Bos taurus; identical to SEQ ID NO: 137

SEQ ID NO: 82326 - DNA, 201 bp, Bos taurus; identical to SEQ ID NO: 138

SEQ ID NO: 82327 - DNA, 201 bp, Bos taurus; identical to SEQ ID NO: 139

SEQ ID NO: 82328 - DNA, 201 bp, Bos taurus; identical to SEQ ID NO: 140

SEQ ID NO: 82329 - DNA, 201 bp, Bos taurus; identical to SEQ ID NO: 141

SEQ ID NO: 82330 - DNA, 201 bp, Bos taurus; identical to SEQ ID NO: 142

SEQ ID NO: 82331 - DNA, 201 bp, Bos taurus
gggttgcaatttccttctctacctgtattatatttttctaaagattacctaatacctgtgtttctcaaagtatgtcatgttacatagaaagcaatgttgaagacttccatggtggtacaatggataagaattcacctactaatgcagggagcacaggtttgatctctggtctgggaagattccatatgtcacagggcaact

SEQ ID NO: 82332 - DNA, 201 bp, Bos taurus
taaattgttaaatacagagttcttgcaaatgttccaaccaacgttgtgttcaataagtgttagatattattttatgataaaacaacatattttagattaatgtatttgcttgccagtgtccaaaatacaagaattgtttgtgatattgaatgtaatactgacaacaagtatttatcctctctgctttatttttaattttac

SEQ ID NO: 82333 - DNA, 201 bp, Bos taurus; identical to SEQ ID NO: 145

SEQ ID NO: 82334 - DNA, 201 bp, Bos taurus; identical to SEQ ID NO: 146

SEQ ID NO: 82335 - DNA, 201 bp, Bos taurus
aacatgtactctctcctctaaaattttagtgtcacaaaggactgtatattatgttttgtgaaatgagtgtttcacttccatgcacatatatgccaataaaccatactttaacatggttgtaattcttattagcatataaaaatttaccagcagtatgtatgcagagatgcccataagtacacagtagattacatgaccaaa

SEQ ID NO: 82336 - DNA, 201 bp, Bos taurus
gttatagcaaaactccaaatgtcttttatagtgcattttctcatttttgcttccattttgacttagaagtatacttggtgtactttaatgattgagttctggctgagagatttagttctctaattttgaggtaggagatagatgggcccctgggctgaacacctggtatatgtccagtgtagtaaaattcaagccttgttg

SEQ ID NO: 82337 - DNA, 201 bp, Bos taurus; identical to SEQ ID NO: 147

SEQ ID NO: 82338 - DNA, 201 bp, Bos taurus; identical to SEQ ID NO: 148

SEQ ID NO: 82339 - DNA, 201 bp, Bos taurus
gctgtttaaaattgaacatatttgtctgtatcatgtagaatgctcaccacctcttcttgacaaaataaagcattaatcatggcagcaaccataacattcccgtctcttttattgccaaaaccagcaccctgtgacacagtgagaactggaattttctaaccttcagttcagtggattggaaagttttcattagaagtaggt

SEQ ID NO: 82340 - DNA, 201 bp, Bos taurus
tttctgcaggatgttaataaatccttcacgaagagtggataaaaggaccaagcctccctgtgacttattcccagtttctctgaatttcctagctttatgcacaaatgactgcaaaggtttacatttcttaaggcaaacttctagctacaaccagttttttttttttctaaatactgaaataatcagcacagcagggaaata

SEQ ID NO: 82341 - DNA, 201 bp, Bos taurus
atatgtaaatgaatgggtgtggctgtgttccaataacactttatttacaaaaacaggtggcagggccaaatttggcctatgggttatagtttgcctagtcttgccctacagcaactaaccatggaaagaacattcatcacctcaaactatgaaagccagcggccatgagaagaaactaaagattcctttccaagcaggatc

SEQ ID NO: 82342 - DNA, 201 bp, Bos taurus
tggacaaatttgcctcttttacctatagaattatttattttatgctgttatttgttggtttactaaacataaagaagattttgcttgtttaagagtattaggtataatctagtataatacatttaaggataggaatatccagatttatttctaaagttttctaaactaactttaacactcactttaacatataagtcatta

SEQ ID NO: 82343 - DNA, 201 bp, Bos taurus; identical to SEQ ID NO: 149

SEQ ID NO: 82344 - DNA, 201 bp, Bos taurus
aaataaaacttatgagctaggcctggaggctactttgagtaatcacctttttcctaactcagagtgattttttttaatttttattttattttcctcctgctctctctctcaacactggccatcctccatttttttgagtatctttgattttgctacatagagcaaggattctgatacttagctgcatactatatgggagct

SEQ ID NO: 82345 - DNA, 201 bp, Bos taurus
cagatgatagaagctgccattttgtttatttcatgataccaaggaaattttttttaaagttcttattagagtatatgggtaggccacaatagttggcataattttaatattacgtacatgattagggtagacacacaacacccttcccttggctaccttctggctagctaggtttggccttgtgacacagttctcattagt

SEQ ID NO: 82346 - DNA, 201 bp, Bos taurus; identical to SEQ ID NO: 150

SEQ ID NO: 82347 - DNA, 201 bp, Bos taurus
ggtttcaagcatgaattatgttatctgatgagtcttggttagaagtgaaattgcttccaaaattttttttttttttttgtctttaacactcacccaacttgatttgaaaaaattcaaactcaaacaaaagaataatttggagttcactttcaggctaatagttaattagcaattttaataaagaagtggtttattgagtgt

SEQ ID NO: 82348 - DNA, 201 bp, Bos taurus; identical to SEQ ID NO: 151

SEQ ID NO: 82349 - DNA, 201 bp, Bos taurus; identical to SEQ ID NO: 152

SEQ ID NO: 82350 - DNA, 201 bp, Bos taurus; identical to SEQ ID NO: 153

SEQ ID NO: 82351 - DNA, 201 bp, Bos taurus
ctcttctttttaacatcaaatcttaaattattttttaatcttttattatgcttcatatttgaatgataagacacctgtaattttaatttcaggactatttattggataccaagactaaattcttccattgagtgtttctcaattatgaaggcacagactaagtacttggaaacatggttaaaaatgaagattctcattcca

SEQ ID NO: 82352 - DNA, 201 bp, Bos taurus; identical to SEQ ID NO: 154

SEQ ID NO: 82353 - DNA, 201 bp, Bos taurus; identical to SEQ ID NO: 160

SEQ ID NO: 82354 - DNA, 201 bp, Bos taurus; identical to SEQ ID NO: 161

SEQ ID NO: 82355 - DNA, 201 bp, Bos taurus; identical to SEQ ID NO: 162

SEQ ID NO: 82356 - DNA, 201 bp, Bos taurus; identical to SEQ ID NO: 163

SEQ ID NO: 82357 - DNA, 201 bp, Bos taurus; identical to SEQ ID NO: 164

SEQ ID NO: 82358 - DNA, 201 bp, Bos taurus; identical to SEQ ID NO: 165

SEQ ID NO: 82359 - DNA, 201 bp, Bos taurus; identical to SEQ ID NO: 166

SEQ ID NO: 82360 - DNA, 201 bp, Bos taurus; identical to SEQ ID NO: 168

SEQ ID NO: 82361 - DNA, 201 bp, Bos taurus
tgaggcacagccaacctctgcctccccaagaggccctctcatacctctaggtatgtctctgtttctgctgtgggcacggtgggtccagctcagaccctgacgtggcccaattcccatgtatacttgcctctaaagtccagtactactgaagctaggctggtttcatttgtgataacactaatctattcagatattccacag

SEQ ID NO: 82362 - DNA, 201 bp, Bos taurus
ggatgcccaggttgatgataagtcaccctctgaggatgcaggtcccaactagatcccttctcctcccctcctagtagattctgcatagttttttgtttatgggcttggctgtagaagagccattatgctagtcttctggtgattcttagcaagaattactctatatgaagttatagttttgatatgtttgcaagtaggggt

SEQ ID NO: 82363 - DNA, 201 bp, Bos taurus; identical to SEQ ID NO: 169

SEQ ID NO: 82364 - DNA, 201 bp, Bos taurus; identical to SEQ ID NO: 171

SEQ ID NO: 82365 - DNA, 201 bp, Bos taurus; identical to SEQ ID NO: 172

SEQ ID NO: 82366 - DNA, 201 bp, Bos taurus
gttaataatattttattatatgtatatataatataaatattttaattggtatcaatttaccacaaaatattctgtaggatattcatggacaagatgatgccaataaaatgactaagagaagaatcaaaagaatatatctgttttttgcatataaatatgttaatatcattacttacattaaacaatttttcaagtaaatat

SEQ ID NO: 82367 - DNA, 201 bp, Bos taurus; identical to SEQ ID NO: 173

SEQ ID NO: 82368 - DNA, 201 bp, Bos taurus
caacatcagcagcaagtgaagataattcccacattaaaatacatacatacagataaggttgaaactttacttcacatggaattttggcctctcaggaaaactttgtgtattccttcagttcagttcagttccatcgctcagtcatctctgactctttgcgaccccatgaatcacagcacgccaggcctccctgtccatcac

SEQ ID NO: 82369 - DNA, 201 bp, Bos taurus; identical to SEQ ID NO: 174

SEQ ID NO: 82370 - DNA, 201 bp, Bos taurus
agaagtcacactaaggagctgtaggggcaattctctggggaacttaaaaaaaggaagcagaattccaaggtttgagtcaaggtctttggttacatatggaaccacagatttgttcccagaatatcttaacaatatcgtcccctaaattcctttagcaacattggatttgttcaaagctgttaactgaatctttcatataaa

SEQ ID NO: 82371 - DNA, 201 bp, Bos taurus
tgctgacaatggaaaatcttacaagtattgaacatgacatttatgacagtcttgctgtcatcttggcttcttttattgaatatgcagagaattataattgggctaacaagcctggtagcctggcctctttccaattatattaaccagcctagtctagtattagctgcctgaacacacacagaaacagacattgaacttttg

SEQ ID NO: 82372 - DNA, 201 bp, Bos taurus; identical to SEQ ID NO: 177

SEQ ID NO: 82373 - DNA, 201 bp, Bos taurus; identical to SEQ ID NO: 178

SEQ ID NO: 82374 - DNA, 201 bp, Bos taurus
ctctctttttaccatcttctttccttgcagaccttcaggccattgacattaaagatatagccaaattctctaactcctttttgcctttagaccactacttctcttgtgtcctaattatgttaaaatccacccttctgcattttcaaagtaactatcatttccaacaaatgaagacattagcatctttaaagacagtcccat

SEQ ID NO: 82375 - DNA, 201 bp, Bos taurus; identical to SEQ ID NO: 180

SEQ ID NO: 82376 - DNA, 201 bp, Bos taurus; identical to SEQ ID NO: 181

SEQ ID NO: 82377 - DNA, 201 bp, Bos taurus; identical to SEQ ID NO: 183

SEQ ID NO: 82378 - DNA, 201 bp, Bos taurus; identical to SEQ ID NO: 185

SEQ ID NO: 82379 - DNA, 201 bp, Bos taurus; identical to SEQ ID NO: 186

SEQ ID NO: 82380 - DNA, 201 bp, Bos taurus
aggtctctgttctctgctggtcctctaagattagatttatttttcttaaatcctatcttgctagttgagagtggttttcccaactttcaatgcttgactcgctaatcttcttcaattatattcatcccggtagtgtgtacactcaagtggattttattaccatcaatatgctgatgactctctgatttctatccccattgc

SEQ ID NO: 82381 - DNA, 201 bp, Bos taurus
ctaaaattgcatattacttttttgcaactgtagcctacaaaaagtatttttaacattaaatgtggaactagccctagagcgtaccatgattgataaatttgccactgtaattcaataaatatcccttggaaaaagaaatactttgcttagagggaacattttatttctgtttttcattaatttattgttatttcctattat

SEQ ID NO: 82382 - DNA, 201 bp, Bos taurus; identical to SEQ ID NO: 187

SEQ ID NO: 82383 - DNA, 201 bp, Bos taurus; identical to SEQ ID NO: 189

SEQ ID NO: 82384 - DNA, 201 bp, Bos taurus; identical to SEQ ID NO: 190

SEQ ID NO: 82385 - DNA, 201 bp, Bos taurus; identical to SEQ ID NO: 191

SEQ ID NO: 82386 - DNA, 201 bp, Bos taurus; identical to SEQ ID NO: 192

SEQ ID NO: 82387 - DNA, 201 bp, Bos taurus
tcactcatgggtggcagagagctaaaagaagggccagtgtttcaaatactgtcccataaattgacagtggactctatgatactattaaaatttgcttcacatcaaggccaaatactctttctcttagactggtcacacttcaactaaataggaagtatatgacagagaaatccaattgaggagagagagagagattgggtg

SEQ ID NO: 82388 - DNA, 201 bp, Bos taurus; identical to SEQ ID NO: 193

SEQ ID NO: 82389 - DNA, 201 bp, Bos taurus; identical to SEQ ID NO: 194

SEQ ID NO: 82390 - DNA, 201 bp, Bos taurus; identical to SEQ ID NO: 195

SEQ ID NO: 82391 - DNA, 201 bp, Bos taurus; identical to SEQ ID NO: 196

SEQ ID NO: 82392 - DNA, 201 bp, Bos taurus; identical to SEQ ID NO: 197

SEQ ID NO: 82393 - DNA, 201 bp, Bos taurus; identical to SEQ ID NO: 198

SEQ ID NO: 82394 - DNA, 201 bp, Bos taurus
tcatgacaccaaggattcaagcaatggggtaatggagatcttggacatttatttcctcactggtgaaaattaaatgaagactcaggagtcaccccaactacagtgatgagaagcaagtttcagcaggcagagtgtgttggtgagttcttgctacatagccgcttatatctttgaagacatgttaaagtctttctgtgctgc

SEQ ID NO: 82395 - DNA, 201 bp, Bos taurus; identical to SEQ ID NO: 199

SEQ ID NO: 82396 - DNA, 201 bp, Bos taurus; identical to SEQ ID NO: 200

SEQ ID NO: 82397 - DNA, 201 bp, Bos taurus; identical to SEQ ID NO: 202

SEQ ID NO: 82398 - DNA, 201 bp, Bos taurus; identical to SEQ ID NO: 203

SEQ ID NO: 82399 - DNA, 201 bp, Bos taurus; identical to SEQ ID NO: 204

SEQ ID NO: 82400 - DNA, 201 bp, Bos taurus; identical to SEQ ID NO: 205

SEQ ID NO: 82401 - DNA, 201 bp, Bos taurus; identical to SEQ ID NO: 206

SEQ ID NO: 82402 - DNA, 201 bp, Bos taurus; identical to SEQ ID NO: 207

SEQ ID NO: 82403 - DNA, 201 bp, Bos taurus
taagaaaagtattgtgaaattacctaatatacacatagtgatgactgctgtctgtaaattgttataactgaaacatttctcctggaggtgacattgagaaggttcatgtgggcactcacaaaacaggctgcaaccgctttgtctttatacagtttattatgccctaccagaaatgaagttttattttatatcttaaataaa

SEQ ID NO: 82404 - DNA, 201 bp, Bos taurus; identical to SEQ ID NO: 209

SEQ ID NO: 82405 - DNA, 201 bp, Bos taurus; identical to SEQ ID NO: 210

SEQ ID NO: 82406 - DNA, 201 bp, Bos taurus; identical to SEQ ID NO: 212

SEQ ID NO: 82407 - DNA, 201 bp, Bos taurus; identical to SEQ ID NO: 213

SEQ ID NO: 82408 - DNA, 201 bp, Bos taurus; identical to SEQ ID NO: 214

SEQ ID NO: 82409 - DNA, 201 bp, Bos taurus; identical to SEQ ID NO: 215

SEQ ID NO: 82410 - DNA, 201 bp, Bos taurus; identical to SEQ ID NO: 216

SEQ ID NO: 82411 - DNA, 201 bp, Bos taurus; identical to SEQ ID NO: 217

SEQ ID NO: 82412 - DNA, 201 bp, Bos taurus; identical to SEQ ID NO: 218

SEQ ID NO: 82413 - DNA, 201 bp, Bos taurus; identical to SEQ ID NO: 219

SEQ ID NO: 82414 - DNA, 201 bp, Bos taurus; identical to SEQ ID NO: 220

SEQ ID NO: 82415 - DNA, 201 bp, Bos taurus; identical to SEQ ID NO: 221

SEQ ID NO: 82416 - DNA, 201 bp, Bos taurus; identical to SEQ ID NO: 222

SEQ ID NO: 82417 - DNA, 201 bp, Bos taurus; identical to SEQ ID NO: 223

SEQ ID NO: 82418 - DNA, 201 bp, Bos taurus; identical to SEQ ID NO: 224

SEQ ID NO: 82419 - DNA, 201 bp, Bos taurus; identical to SEQ ID NO: 225

SEQ ID NO: 82420 - DNA, 201 bp, Bos taurus; identical to SEQ ID NO: 226

SEQ ID NO: 82421 - DNA, 201 bp, Bos taurus; identical to SEQ ID NO: 227

SEQ ID NO: 82422 - DNA, 201 bp, Bos taurus
ataattgaaaagccaaagaacaggtcgggtagtaaacataacaccaggtagttggaggggggaaataatctcatattcatggccaacaaagatgaatccgtttgctaaaatgaaagtgaaagattctcagtcgtttccgactctttgcgaccccaatggatccatggaattcttcaggccagaatactggagtgggtagcc

SEQ ID NO: 82423 - DNA, 201 bp, Bos taurus; identical to SEQ ID NO: 228

SEQ ID NO: 82424 - DNA, 201 bp, Bos taurus; identical to SEQ ID NO: 229

SEQ ID NO: 82425 - DNA, 201 bp, Bos taurus; identical to SEQ ID NO: 230

SEQ ID NO: 82426 - DNA, 201 bp, Bos taurus; identical to SEQ ID NO: 231

SEQ ID NO: 82427 - DNA, 201 bp, Bos taurus; identical to SEQ ID NO: 233

SEQ ID NO: 82428 - DNA, 201 bp, Bos taurus; identical to SEQ ID NO: 234

SEQ ID NO: 82429 - DNA, 201 bp, Bos taurus; identical to SEQ ID NO: 235

SEQ ID NO: 82430 - DNA, 201 bp, Bos taurus; identical to SEQ ID NO: 236

SEQ ID NO: 82431 - DNA, 201 bp, Bos taurus; identical to SEQ ID NO: 237

SEQ ID NO: 82432 - DNA, 201 bp, Bos taurus; identical to SEQ ID NO: 238

SEQ ID NO: 82433 - DNA, 201 bp, Bos taurus; identical to SEQ ID NO: 239

SEQ ID NO: 82434 - DNA, 201 bp, Bos taurus; identical to SEQ ID NO: 240

SEQ ID NO: 82435 - DNA, 201 bp, Bos taurus; identical to SEQ ID NO: 241

SEQ ID NO: 82436 - DNA, 201 bp, Bos taurus; identical to SEQ ID NO: 242

SEQ ID NO: 82437 - DNA, 201 bp, Bos taurus; identical to SEQ ID NO: 243

SEQ ID NO: 82438 - DNA, 201 bp, Bos taurus; identical to SEQ ID NO: 244

SEQ ID NO: 82439 - DNA, 201 bp, Bos taurus; identical to SEQ ID NO: 245

SEQ ID NO: 82440 - DNA, 201 bp, Bos taurus; identical to SEQ ID NO: 246

SEQ ID NO: 82441 - DNA, 201 bp, Bos taurus; identical to SEQ ID NO: 250

SEQ ID NO: 82442 - DNA, 201 bp, Bos taurus
ttaaaggaagcatgtagattcttaactgactcaccctggaagtgacaaatgccacagtctactgctcagaactggaaatgtgattctgatcaaatggtgaggtggctgggaaaagtgtggaagagtacacagatatttgataagtactaatgatcttttccacactcttgatgtttgatactttgaaattacctatttaaa

SEQ ID NO: 82443 - DNA, 201 bp, Bos taurus; identical to SEQ ID NO: 251

SEQ ID NO: 82444 - DNA, 201 bp, Bos taurus; identical to SEQ ID NO: 252

SEQ ID NO: 82445 - DNA, 201 bp, Bos taurus; identical to SEQ ID NO: 253

SEQ ID NO: 82446 - DNA, 201 bp, Bos taurus
ctgccactcctggagccattgctagagaagtggcccacgggattctaaagatggttagtgctgttgtgaaatgttacaacaaagggtgaaaggcccaggacacacctaggcatttacatttccaagtagagcctgtttggcttttgtgtgacccaagccatggctcaggctgagctggattcttgccaaggtgggccatcc

SEQ ID NO: 82447 - DNA, 201 bp, Bos taurus
ccggcccagagtttgaccctcccactgagaaccacctggaaggcggcgcttcccgaagcgggggagggggggggggtgcggtgccgcctggagagcagccctgcacatcgcctatgatcaggccggaggccgtgatacacgtttcagtaaacagactggattgtccagagggtgtatgttgagttgctgctgacagtggtt

SEQ ID NO: 82448 - DNA, 201 bp, Bos taurus; identical to SEQ ID NO: 254

SEQ ID NO: 82449 - DNA, 201 bp, Bos taurus; identical to SEQ ID NO: 255

SEQ ID NO: 82450 - DNA, 201 bp, Bos taurus; identical to SEQ ID NO: 256

SEQ ID NO: 82451 - DNA, 201 bp, Bos taurus; identical to SEQ ID NO: 257

SEQ ID NO: 82452 - DNA, 201 bp, Bos taurus; identical to SEQ ID NO: 258

SEQ ID NO: 82453 - DNA, 201 bp, Bos taurus; identical to SEQ ID NO: 259

SEQ ID NO: 82454 - DNA, 201 bp, Bos taurus; identical to SEQ ID NO: 260

SEQ ID NO: 82455 - DNA, 201 bp, Bos taurus; identical to SEQ ID NO: 261

SEQ ID NO: 82456 - DNA, 201 bp, Bos taurus
ttcatcaagggagggtgagaaagatcaaatactcataattcccaggaaccaacatgccaccttgttactttctgctcttgtttccagggcctgacacagtaagaaccattaatgatgacttgtcagtcagtcagttcagtcgctcagttgtgtccgactctttgcgaccccatgaatcgcagcacgccaggcctccctgtc

SEQ ID NO: 82457 - DNA, 201 bp, Bos taurus; identical to SEQ ID NO: 262

SEQ ID NO: 82458 - DNA, 201 bp, Bos taurus; identical to SEQ ID NO: 263

SEQ ID NO: 82459 - DNA, 201 bp, Bos taurus; identical to SEQ ID NO: 264

SEQ ID NO: 82460 - DNA, 201 bp, Bos taurus; identical to SEQ ID NO: 265

SEQ ID NO: 82461 - DNA, 201 bp, Bos taurus; identical to SEQ ID NO: 266

SEQ ID NO: 82462 - DNA, 201 bp, Bos taurus; identical to SEQ ID NO: 267

SEQ ID NO: 82463 - DNA, 201 bp, Bos taurus; identical to SEQ ID NO: 268

SEQ ID NO: 82464 - DNA, 201 bp, Bos taurus; identical to SEQ ID NO: 269

SEQ ID NO: 82465 - DNA, 201 bp, Bos taurus; identical to SEQ ID NO: 270

SEQ ID NO: 82466 - DNA, 201 bp, Bos taurus; identical to SEQ ID NO: 271

SEQ ID NO: 82467 - DNA, 201 bp, Bos taurus; identical to SEQ ID NO: 272

SEQ ID NO: 82468 - DNA, 201 bp, Bos taurus; identical to SEQ ID NO: 273

SEQ ID NO: 82469 - DNA, 201 bp, Bos taurus; identical to SEQ ID NO: 274

SEQ ID NO: 82470 - DNA, 201 bp, Bos taurus; identical to SEQ ID NO: 275

SEQ ID NO: 82471 - DNA, 201 bp, Bos taurus; identical to SEQ ID NO: 276

SEQ ID NO: 82472 - DNA, 201 bp, Bos taurus; identical to SEQ ID NO: 277

SEQ ID NO: 82473 - DNA, 201 bp, Bos taurus; identical to SEQ ID NO: 278

SEQ ID NO: 82474 - DNA, 201 bp, Bos taurus; identical to SEQ ID NO: 279

SEQ ID NO: 82475 - DNA, 201 bp, Bos taurus; identical to SEQ ID NO: 280

SEQ ID NO: 82476 - DNA, 201 bp, Bos taurus; identical to SEQ ID NO: 281

SEQ ID NO: 82477 - DNA, 201 bp, Bos taurus; identical to SEQ ID NO: 282

SEQ ID NO: 82478 - DNA, 201 bp, Bos taurus; identical to SEQ ID NO: 284

SEQ ID NO: 82479 - DNA, 201 bp, Bos taurus; identical to SEQ ID NO: 285

SEQ ID NO: 82480 - DNA, 201 bp, Bos taurus; identical to SEQ ID NO: 286

SEQ ID NO: 82481 - DNA, 201 bp, Bos taurus; identical to SEQ ID NO: 287

SEQ ID NO: 82482 - DNA, 201 bp, Bos taurus; identical to SEQ ID NO: 288

SEQ ID NO: 82483 - DNA, 201 bp, Bos taurus; identical to SEQ ID NO: 289

SEQ ID NO: 82484 - DNA, 201 bp, Bos taurus; identical to SEQ ID NO: 291

SEQ ID NO: 82485 - DNA, 201 bp, Bos taurus; identical to SEQ ID NO: 292

SEQ ID NO: 82486 - DNA, 201 bp, Bos taurus; identical to SEQ ID NO: 293

SEQ ID NO: 82487 - DNA, 201 bp, Bos taurus; identical to SEQ ID NO: 294

SEQ ID NO: 82488 - DNA, 201 bp, Bos taurus; identical to SEQ ID NO: 295

SEQ ID NO: 82489 - DNA, 201 bp, Bos taurus; identical to SEQ ID NO: 296

SEQ ID NO: 82490 - DNA, 201 bp, Bos taurus; identical to SEQ ID NO: 297

SEQ ID NO: 82491 - DNA, 201 bp, Bos taurus; identical to SEQ ID NO: 298

SEQ ID NO: 82492 - DNA, 201 bp, Bos taurus; identical to SEQ ID NO: 299

SEQ ID NO: 82493 - DNA, 201 bp, Bos taurus; identical to SEQ ID NO: 300

SEQ ID NO: 82494 - DNA, 201 bp, Bos taurus; identical to SEQ ID NO: 305

SEQ ID NO: 82495 - DNA, 201 bp, Bos taurus; identical to SEQ ID NO: 306

SEQ ID NO: 82496 - DNA, 201 bp, Bos taurus; identical to SEQ ID NO: 308

SEQ ID NO: 82497 - DNA, 201 bp, Bos taurus; identical to SEQ ID NO: 309

SEQ ID NO: 82498 - DNA, 201 bp, Bos taurus; identical to SEQ ID NO: 310

SEQ ID NO: 82499 - DNA, 201 bp, Bos taurus; identical to SEQ ID NO: 311

SEQ ID NO: 82500 - DNA, 201 bp, Bos taurus; identical to SEQ ID NO: 312

SEQ ID NO: 82501 - DNA, 201 bp, Bos taurus; identical to SEQ ID NO: 313

SEQ ID NO: 82502 - DNA, 201 bp, Bos taurus; identical to SEQ ID NO: 315

SEQ ID NO: 82503 - DNA, 201 bp, Bos taurus; identical to SEQ ID NO: 316

SEQ ID NO: 82504 - DNA, 201 bp, Bos taurus; identical to SEQ ID NO: 320

SEQ ID NO: 82505 - DNA, 201 bp, Bos taurus; identical to SEQ ID NO: 323

SEQ ID NO: 82506 - DNA, 201 bp, Bos taurus; identical to SEQ ID NO: 324

SEQ ID NO: 82507 - DNA, 201 bp, Bos taurus; identical to SEQ ID NO: 325

SEQ ID NO: 82508 - DNA, 201 bp, Bos taurus; identical to SEQ ID NO: 326

SEQ ID NO: 82509 - DNA, 201 bp, Bos taurus; identical to SEQ ID NO: 327

SEQ ID NO: 82510 - DNA, 201 bp, Bos taurus; identical to SEQ ID NO: 332

SEQ ID NO: 82511 - DNA, 201 bp, Bos taurus; identical to SEQ ID NO: 334

SEQ ID NO: 82512 - DNA, 201 bp, Bos taurus; identical to SEQ ID NO: 335

SEQ ID NO: 82513 - DNA, 201 bp, Bos taurus; identical to SEQ ID NO: 336

SEQ ID NO: 82514 - DNA, 201 bp, Bos taurus; identical to SEQ ID NO: 339

SEQ ID NO: 82515 - DNA, 201 bp, Bos taurus; identical to SEQ ID NO: 340

SEQ ID NO: 82516 - DNA, 201 bp, Bos taurus; identical to SEQ ID NO: 341

SEQ ID NO: 82517 - DNA, 201 bp, Bos taurus; identical to SEQ ID NO: 342

SEQ ID NO: 82518 - DNA, 201 bp, Bos taurus; identical to SEQ ID NO: 343

SEQ ID NO: 82519 - DNA, 201 bp, Bos taurus; identical to SEQ ID NO: 344

SEQ ID NO: 82520 - DNA, 201 bp, Bos taurus; identical to SEQ ID NO: 345

SEQ ID NO: 82521 - DNA, 201 bp, Bos taurus; identical to SEQ ID NO: 346

SEQ ID NO: 82522 - DNA, 201 bp, Bos taurus; identical to SEQ ID NO: 347

SEQ ID NO: 82523 - DNA, 201 bp, Bos taurus; identical to SEQ ID NO: 348

SEQ ID NO: 82524 - DNA, 201 bp, Bos taurus; identical to SEQ ID NO: 349

SEQ ID NO: 82525 - DNA, 201 bp, Bos taurus; identical to SEQ ID NO: 350

SEQ ID NO: 82526 - DNA, 201 bp, Bos taurus; identical to SEQ ID NO: 351

SEQ ID NO: 82527 - DNA, 201 bp, Bos taurus; identical to SEQ ID NO: 352

SEQ ID NO: 82528 - DNA, 201 bp, Bos taurus; identical to SEQ ID NO: 353

SEQ ID NO: 82529 - DNA, 201 bp, Bos taurus; identical to SEQ ID NO: 354

SEQ ID NO: 82530 - DNA, 201 bp, Bos taurus; identical to SEQ ID NO: 355

SEQ ID NO: 82531 - DNA, 201 bp, Bos taurus; identical to SEQ ID NO: 356

SEQ ID NO: 82532 - DNA, 201 bp, Bos taurus; identical to SEQ ID NO: 359

SEQ ID NO: 82533 - DNA, 201 bp, Bos taurus; identical to SEQ ID NO: 360

SEQ ID NO: 82534 - DNA, 201 bp, Bos taurus; identical to SEQ ID NO: 362

SEQ ID NO: 82535 - DNA, 201 bp, Bos taurus; identical to SEQ ID NO: 363

SEQ ID NO: 82536 - DNA, 201 bp, Bos taurus; identical to SEQ ID NO: 364

SEQ ID NO: 82537 - DNA, 201 bp, Bos taurus; identical to SEQ ID NO: 367

SEQ ID NO: 82538 - DNA, 201 bp, Bos taurus; identical to SEQ ID NO: 370

SEQ ID NO: 82539 - DNA, 201 bp, Bos taurus; identical to SEQ ID NO: 372

SEQ ID NO: 82540 - DNA, 201 bp, Bos taurus; identical to SEQ ID NO: 373

SEQ ID NO: 82541 - DNA, 201 bp, Bos taurus; identical to SEQ ID NO: 376

SEQ ID NO: 82542 - DNA, 201 bp, Bos taurus; identical to SEQ ID NO: 377

SEQ ID NO: 82543 - DNA, 201 bp, Bos taurus; identical to SEQ ID NO: 378

SEQ ID NO: 82544 - DNA, 201 bp, Bos taurus; identical to SEQ ID NO: 380

SEQ ID NO: 82545 - DNA, 201 bp, Bos taurus; identical to SEQ ID NO: 381

SEQ ID NO: 82546 - DNA, 201 bp, Bos taurus; identical to SEQ ID NO: 382

SEQ ID NO: 82547 - DNA, 201 bp, Bos taurus; identical to SEQ ID NO: 383

SEQ ID NO: 82548 - DNA, 201 bp, Bos taurus; identical to SEQ ID NO: 386

SEQ ID NO: 82549 - DNA, 201 bp, Bos taurus; identical to SEQ ID NO: 387

SEQ ID NO: 82550 - DNA, 201 bp, Bos taurus; identical to SEQ ID NO: 388

SEQ ID NO: 82551 - DNA, 201 bp, Bos taurus; identical to SEQ ID NO: 389

SEQ ID NO: 82552 - DNA, 201 bp, Bos taurus; identical to SEQ ID NO: 390

SEQ ID NO: 82553 - DNA, 201 bp, Bos taurus; identical to SEQ ID NO: 391

SEQ ID NO: 82554 - DNA, 201 bp, Bos taurus; identical to SEQ ID NO: 392

SEQ ID NO: 82555 - DNA, 201 bp, Bos taurus; identical to SEQ ID NO: 394

SEQ ID NO: 82556 - DNA, 201 bp, Bos taurus; identical to SEQ ID NO: 395

SEQ ID NO: 82557 - DNA, 201 bp, Bos taurus; identical to SEQ ID NO: 396

SEQ ID NO: 82558 - DNA, 201 bp, Bos taurus; identical to SEQ ID NO: 397

SEQ ID NO: 82559 - DNA, 201 bp, Bos taurus; identical to SEQ ID NO: 398

SEQ ID NO: 82560 - DNA, 201 bp, Bos taurus; identical to SEQ ID NO: 400

SEQ ID NO: 82561 - DNA, 201 bp, Bos taurus; identical to SEQ ID NO: 401

SEQ ID NO: 82562 - DNA, 201 bp, Bos taurus; identical to SEQ ID NO: 402

SEQ ID NO: 82563 - DNA, 201 bp, Bos taurus; identical to SEQ ID NO: 403

SEQ ID NO: 82564 - DNA, 201 bp, Bos taurus; identical to SEQ ID NO: 404

SEQ ID NO: 82565 - DNA, 201 bp, Bos taurus; identical to SEQ ID NO: 405

SEQ ID NO: 82566 - DNA, 201 bp, Bos taurus; identical to SEQ ID NO: 407

SEQ ID NO: 82567 - DNA, 201 bp, Bos taurus; identical to SEQ ID NO: 408

SEQ ID NO: 82568 - DNA, 201 bp, Bos taurus; identical to SEQ ID NO: 409

SEQ ID NO: 82569 - DNA, 201 bp, Bos taurus; identical to SEQ ID NO: 410

SEQ ID NO: 82570 - DNA, 201 bp, Bos taurus; identical to SEQ ID NO: 411

SEQ ID NO: 82571 - DNA, 201 bp, Bos taurus; identical to SEQ ID NO: 413

SEQ ID NO: 82572 - DNA, 201 bp, Bos taurus; identical to SEQ ID NO: 414

SEQ ID NO: 82573 - DNA, 201 bp, Bos taurus; identical to SEQ ID NO: 415

SEQ ID NO: 82574 - DNA, 201 bp, Bos taurus; identical to SEQ ID NO: 419

SEQ ID NO: 82575 - DNA, 201 bp, Bos taurus; identical to SEQ ID NO: 420

SEQ ID NO: 82576 - DNA, 201 bp, Bos taurus; identical to SEQ ID NO: 421

SEQ ID NO: 82577 - DNA, 201 bp, Bos taurus; identical to SEQ ID NO: 423

SEQ ID NO: 82578 - DNA, 201 bp, Bos taurus; identical to SEQ ID NO: 424

SEQ ID NO: 82579 - DNA, 201 bp, Bos taurus; identical to SEQ ID NO: 427

SEQ ID NO: 82580 - DNA, 201 bp, Bos taurus; identical to SEQ ID NO: 428

SEQ ID NO: 82581 - DNA, 201 bp, Bos taurus; identical to SEQ ID NO: 429

SEQ ID NO: 82582 - DNA, 201 bp, Bos taurus; identical to SEQ ID NO: 431

SEQ ID NO: 82583 - DNA, 201 bp, Bos taurus; identical to SEQ ID NO: 434

SEQ ID NO: 82584 - DNA, 201 bp, Bos taurus; identical to SEQ ID NO: 438

SEQ ID NO: 82585 - DNA, 201 bp, Bos taurus; identical to SEQ ID NO: 440

SEQ ID NO: 82586 - DNA, 201 bp, Bos taurus; identical to SEQ ID NO: 441

SEQ ID NO: 82587 - DNA, 201 bp, Bos taurus; identical to SEQ ID NO: 442

SEQ ID NO: 82588 - DNA, 201 bp, Bos taurus; identical to SEQ ID NO: 443

SEQ ID NO: 82589 - DNA, 201 bp, Bos taurus; identical to SEQ ID NO: 444

SEQ ID NO: 82590 - DNA, 201 bp, Bos taurus; identical to SEQ ID NO: 446

SEQ ID NO: 82591 - DNA, 201 bp, Bos taurus; identical to SEQ ID NO: 448

SEQ ID NO: 82592 - DNA, 201 bp, Bos taurus; identical to SEQ ID NO: 449

SEQ ID NO: 82593 - DNA, 201 bp, Bos taurus; identical to SEQ ID NO: 450

SEQ ID NO: 82594 - DNA, 201 bp, Bos taurus; identical to SEQ ID NO: 451

SEQ ID NO: 82595 - DNA, 201 bp, Bos taurus; identical to SEQ ID NO: 452

SEQ ID NO: 82596 - DNA, 201 bp, Bos taurus; identical to SEQ ID NO: 454

SEQ ID NO: 82597 - DNA, 201 bp, Bos taurus; identical to SEQ ID NO: 455

SEQ ID NO: 82598 - DNA, 201 bp, Bos taurus; identical to SEQ ID NO: 456

SEQ ID NO: 82599 - DNA, 201 bp, Bos taurus; identical to SEQ ID NO: 457

SEQ ID NO: 82600 - DNA, 201 bp, Bos taurus; identical to SEQ ID NO: 458

SEQ ID NO: 82601 - DNA, 201 bp, Bos taurus; identical to SEQ ID NO: 459

SEQ ID NO: 82602 - DNA, 201 bp, Bos taurus; identical to SEQ ID NO: 462

SEQ ID NO: 82603 - DNA, 201 bp, Bos taurus; identical to SEQ ID NO: 463

SEQ ID NO: 82604 - DNA, 201 bp, Bos taurus; identical to SEQ ID NO: 464

SEQ ID NO: 82605 - DNA, 201 bp, Bos taurus; identical to SEQ ID NO: 465

SEQ ID NO: 82606 - DNA, 201 bp, Bos taurus; identical to SEQ ID NO: 466

SEQ ID NO: 82607 - DNA, 201 bp, Bos taurus; identical to SEQ ID NO: 467

SEQ ID NO: 82608 - DNA, 201 bp, Bos taurus; identical to SEQ ID NO: 473

SEQ ID NO: 82609 - DNA, 201 bp, Bos taurus; identical to SEQ ID NO: 475

SEQ ID NO: 82610 - DNA, 201 bp, Bos taurus; identical to SEQ ID NO: 476

SEQ ID NO: 82611 - DNA, 201 bp, Bos taurus; identical to SEQ ID NO: 482

SEQ ID NO: 82612 - DNA, 201 bp, Bos taurus; identical to SEQ ID NO: 484

SEQ ID NO: 82613 - DNA, 201 bp, Bos taurus; identical to SEQ ID NO: 485

SEQ ID NO: 82614 - DNA, 201 bp, Bos taurus; identical to SEQ ID NO: 486

SEQ ID NO: 82615 - DNA, 201 bp, Bos taurus; identical to SEQ ID NO: 487

SEQ ID NO: 82616 - DNA, 201 bp, Bos taurus; identical to SEQ ID NO: 488

SEQ ID NO: 82617 - DNA, 201 bp, Bos taurus; identical to SEQ ID NO: 489

SEQ ID NO: 82618 - DNA, 201 bp, Bos taurus; identical to SEQ ID NO: 492

SEQ ID NO: 82619 - DNA, 201 bp, Bos taurus; identical to SEQ ID NO: 493

SEQ ID NO: 82620 - DNA, 201 bp, Bos taurus; identical to SEQ ID NO: 494

SEQ ID NO: 82621 - DNA, 201 bp, Bos taurus; identical to SEQ ID NO: 495

SEQ ID NO: 82622 - DNA, 201 bp, Bos taurus; identical to SEQ ID NO: 496

SEQ ID NO: 82623 - DNA, 201 bp, Bos taurus; identical to SEQ ID NO: 497

SEQ ID NO: 82624 - DNA, 201 bp, Bos taurus; identical to SEQ ID NO: 501

SEQ ID NO: 82625 - DNA, 201 bp, Bos taurus
tttataaggccacaagtcatagtggattacagcccacccaactccagtctgacctcaactaattctaccttcattgacactatttctttaaaaaaaaagtcacattctcaggtactggccattaaggttgcaacatacctttttggaagaacagaactcaacccataacagccccctaacatagaattatccagcccaaaa

SEQ ID NO: 82626 - DNA, 201 bp, Bos taurus; identical to SEQ ID NO: 508

SEQ ID NO: 82627 - DNA, 201 bp, Bos taurus; identical to SEQ ID NO: 509

SEQ ID NO: 82628 - DNA, 201 bp, Bos taurus
agcctaagatgaggctggccaccagagcaggtggtctgaagacccccactgcgtcctccccagtcctcaagtcccagtgctccaggcccctcaaccctacgctcctgggggcaggaggcagccactcctgagaacagctcaaagaactgccctgtgtggtcagggctgggggagacccaggggcccctcccctgaagaagt

SEQ ID NO: 82629 - DNA, 201 bp, Bos taurus
gggtcaacaatttgatgccaaagtttctaccctgaacccctgtacgaactctgggatctcttcacaccttggaagagcctgctacagagctggtttttcaactccaacacagaggccttcatcattttcagtctgcctggatttcagtgtcttctaattggctcttgtaccaagccaatcttggttttccaacaacttggt

SEQ ID NO: 82630 - DNA, 201 bp, Bos taurus
tctcaaaactgtcaaaggtcatcaaaaccaaagaatatctgagaaactgtcatagccaagaaaagactaagaagagacatgtaatatggtaccctatatatgatcctagactggaaaaatgacattaggtaaaaactaaagaaactggaataatatatgcacttcagttaataaagcataaatattggttcattgattgtg

SEQ ID NO: 82631 - DNA, 201 bp, Bos taurus; identical to SEQ ID NO: 511

SEQ ID NO: 82632 - DNA, 201 bp, Bos taurus; identical to SEQ ID NO: 512

SEQ ID NO: 82633 - DNA, 201 bp, Bos taurus; identical to SEQ ID NO: 513

SEQ ID NO: 82634 - DNA, 201 bp, Bos taurus; identical to SEQ ID NO: 514

SEQ ID NO: 82635 - DNA, 201 bp, Bos taurus; identical to SEQ ID NO: 515

SEQ ID NO: 82636 - DNA, 201 bp, Bos taurus
gcttaacacaccctcctggcctagcgccatcctcctggtggcccctcaattccacctttcctgtctctcctccctttgttacttctcaggcacccagtctactggctctcaactaatgcaggccagtttcctgagagaatacatgcttcccttaggaagacatcccagaatggggagagtgtgggctaaagagggaaaatt

SEQ ID NO: 82637 - DNA, 201 bp, Bos taurus
ggatgagttgactgcatctccaggcatttttcagatttcattttctagtggccagaccctctccctgtcacactgttgggcagggaggtggaacgtctgactgcaatgcagaacatgtatagtggcctccaggcgatgctggagccagtgccaggcccctagacttgctgagggtcctcacttcgtgaccagaccctttaa

SEQ ID NO: 82638 - DNA, 201 bp, Bos taurus; identical to SEQ ID NO: 517

SEQ ID NO: 82639 - DNA, 201 bp, Bos taurus
tcctgaaggacctgaatcaaaagtgtgatcagtgtcattcagagtctccctccccacatgactatctaagcgggcttacaagtgggtctctagggcctaaaggggagaatgtctgaagaaggttgtattggactcaaaacagagaatcatttcattctaggtattggcaggcctgtctgcttctgggagcaaaactgcccc

SEQ ID NO: 82640 - DNA, 201 bp, Bos taurus; identical to SEQ ID NO: 518

SEQ ID NO: 82641 - DNA, 201 bp, Bos taurus; identical to SEQ ID NO: 519

SEQ ID NO: 82642 - DNA, 201 bp, Bos taurus; identical to SEQ ID NO: 520

SEQ ID NO: 82643 - DNA, 201 bp, Bos taurus; identical to SEQ ID NO: 521

SEQ ID NO: 82644 - DNA, 201 bp, Bos taurus; identical to SEQ ID NO: 522

SEQ ID NO: 82645 - DNA, 201 bp, Bos taurus; identical to SEQ ID NO: 523

SEQ ID NO: 82646 - DNA, 201 bp, Bos taurus; identical to SEQ ID NO: 524

SEQ ID NO: 82647 - DNA, 201 bp, Bos taurus; identical to SEQ ID NO: 525

SEQ ID NO: 82648 - DNA, 201 bp, Bos taurus; identical to SEQ ID NO: 528

SEQ ID NO: 82649 - DNA, 201 bp, Bos taurus; identical to SEQ ID NO: 529

SEQ ID NO: 82650 - DNA, 201 bp, Bos taurus; identical to SEQ ID NO: 530

SEQ ID NO: 82651 - DNA, 201 bp, Bos taurus; identical to SEQ ID NO: 532

SEQ ID NO: 82652 - DNA, 201 bp, Bos taurus; identical to SEQ ID NO: 533

SEQ ID NO: 82653 - DNA, 201 bp, Bos taurus
caagttttatcctcaacatgttttgtttctttacagttgctttaggtttccttatcactttaacatttgcatcaaatagaatcaagacctacatagaaaaggctgtcataatatctgagaaatgagttcttaaaatttttagtcaaggaaagtatgtctccatctacaatatattcagactttcagaactccgtgggcagc

SEQ ID NO: 82654 - DNA, 201 bp, Bos taurus; identical to SEQ ID NO: 536

SEQ ID NO: 82655 - DNA, 201 bp, Bos taurus; identical to SEQ ID NO: 537

SEQ ID NO: 82656 - DNA, 201 bp, Bos taurus; identical to SEQ ID NO: 538

SEQ ID NO: 82657 - DNA, 201 bp, Bos taurus; identical to SEQ ID NO: 539

SEQ ID NO: 82658 - DNA, 201 bp, Bos taurus; identical to SEQ ID NO: 540

SEQ ID NO: 82659 - DNA, 201 bp, Bos taurus; identical to SEQ ID NO: 541

SEQ ID NO: 82660 - DNA, 201 bp, Bos taurus; identical to SEQ ID NO: 542

SEQ ID NO: 82661 - DNA, 201 bp, Bos taurus; identical to SEQ ID NO: 543

SEQ ID NO: 82662 - DNA, 201 bp, Bos taurus; identical to SEQ ID NO: 545

SEQ ID NO: 82663 - DNA, 201 bp, Bos taurus; identical to SEQ ID NO: 546

SEQ ID NO: 82664 - DNA, 201 bp, Bos taurus; identical to SEQ ID NO: 547

SEQ ID NO: 82665 - DNA, 201 bp, Bos taurus; identical to SEQ ID NO: 548

SEQ ID NO: 82666 - DNA, 201 bp, Bos taurus; identical to SEQ ID NO: 549

SEQ ID NO: 82667 - DNA, 201 bp, Bos taurus; identical to SEQ ID NO: 550

SEQ ID NO: 82668 - DNA, 201 bp, Bos taurus; identical to SEQ ID NO: 551

SEQ ID NO: 82669 - DNA, 201 bp, Bos taurus; identical to SEQ ID NO: 553

SEQ ID NO: 82670 - DNA, 201 bp, Bos taurus
agtagcatggtttcctgtttgaaaaatgcatttgtatattcatcaaatttataggataaaaaagacaaaatctcttttcttagaatagataaaaggagacaatgtgtggttatttccatagtttccaaaaaagtattagacaaacatttaacaaccagcctcaacttaaacaaacaaaaataagaaaacattctcagaata

SEQ ID NO: 82671 - DNA, 201 bp, Bos taurus; identical to SEQ ID NO: 557

SEQ ID NO: 82672 - DNA, 201 bp, Bos taurus
tcatcaaccttaaagacccctatgtcctcttttgctgagatcatcatgcctcacccctgggaaatacgtataaagaccctggcacagggcctcgcacacaacaggcactaattaaaggctcactccttctaccaacacatcctctcccagccaaggcaagatggcagctgtgaaacaaactgtgttggccaaccagatgag

SEQ ID NO: 82673 - DNA, 201 bp, Bos taurus
gaagcccattcaccttttgtttgaggccaataagaactcctcttgggatactgtggaagagcacctagcaccaagagttccagaccaactggttcactctcaacttggccacctatgatttgcgtacactaacaagttgctaaacctgttagagctttagtttcctcacctgtgaaatgaagacaatgacaaaggcctcct

SEQ ID NO: 82674 - DNA, 201 bp, Bos taurus
actggcactgggtaaatattgtttatgcatgtgtctaagacatggctggctcctctgccccacctcttccagtgtagtgaggccccctcttccttctcttagacacctcttctgtagccaagcacactgcccaccttcctccactgccctgactccgacccctccacgccttgtttgagcacccttcctgacggacatggt

SEQ ID NO: 82675 - DNA, 201 bp, Bos taurus; identical to SEQ ID NO: 560

SEQ ID NO: 82676 - DNA, 201 bp, Bos taurus; identical to SEQ ID NO: 561

SEQ ID NO: 82677 - DNA, 201 bp, Bos taurus; identical to SEQ ID NO: 562

SEQ ID NO: 82678 - DNA, 201 bp, Bos taurus
atacttcccttctcccagcccaggtttccccctatgtaaccgagagtcctgaacctaagctttctaaaatcacagaggtaggaggaggcctgactacaaccctcagagtccaagtttcagtccaacggtctgctgcgccccctggtgtccaattctctgaactacatgtcagtcgtagggagagggagggccctctggatt

SEQ ID NO: 82679 - DNA, 201 bp, Bos taurus; identical to SEQ ID NO: 563

SEQ ID NO: 82680 - DNA, 201 bp, Bos taurus; identical to SEQ ID NO: 564

SEQ ID NO: 82681 - DNA, 201 bp, Bos taurus; identical to SEQ ID NO: 565

SEQ ID NO: 82682 - DNA, 201 bp, Bos taurus; identical to SEQ ID NO: 566

SEQ ID NO: 82683 - DNA, 201 bp, Bos taurus; identical to SEQ ID NO: 567

SEQ ID NO: 82684 - DNA, 201 bp, Bos taurus; identical to SEQ ID NO: 568

SEQ ID NO: 82685 - DNA, 201 bp, Bos taurus; identical to SEQ ID NO: 569

SEQ ID NO: 82686 - DNA, 201 bp, Bos taurus; identical to SEQ ID NO: 570

SEQ ID NO: 82687 - DNA, 201 bp, Bos taurus; identical to SEQ ID NO: 571

SEQ ID NO: 82688 - DNA, 201 bp, Bos taurus; identical to SEQ ID NO: 572

SEQ ID NO: 82689 - DNA, 201 bp, Bos taurus; identical to SEQ ID NO: 573

SEQ ID NO: 82690 - DNA, 201 bp, Bos taurus; identical to SEQ ID NO: 574

SEQ ID NO: 82691 - DNA, 201 bp, Bos taurus; identical to SEQ ID NO: 575

SEQ ID NO: 82692 - DNA, 201 bp, Bos taurus
agactcatctagactccacccctggccactgggacttaggtcggggggagggtacactcttcatcagacagcatttcccagcttgtgatgcaaccacttacaccccaggcctgcaaccgcttccatttcatagcctggtttacagcggcctagtctgtgatcagagcacacagcaccataccacatgcaaagacgtgagaa

SEQ ID NO: 82693 - DNA, 201 bp, Bos taurus; identical to SEQ ID NO: 576

SEQ ID NO: 82694 - DNA, 201 bp, Bos taurus
gagttggttaccaggaaggccccataggctcctttcaaggcagcctccaccgatgctttgtcattcaggtcccctttaaccacctcggccccaaggtcccagagcacctgcgcctttggttgggtcacatctcgggtcagcgctctcaccacatactttttgccctccaacatggcccggccacagagctgccctgagctc

SEQ ID NO: 82695 - DNA, 201 bp, Bos taurus; identical to SEQ ID NO: 577

SEQ ID NO: 82696 - DNA, 201 bp, Bos taurus; identical to SEQ ID NO: 578

SEQ ID NO: 82697 - DNA, 201 bp, Bos taurus
tctcaaaaaaaaaaaaaaaagtattaattagcatatgttcttgtgtgggttgatagtccagggctctgagcaggcacagccttataaacagggttccaagtagcccgctgcacaccaagtcaggaccagggtgcagagagaggccttcatgcacttctgacagctcagtacctgtgagagaacagaggtgatgcagggact

SEQ ID NO: 82698 - DNA, 201 bp, Bos taurus; identical to SEQ ID NO: 579

SEQ ID NO: 82699 - DNA, 201 bp, Bos taurus; identical to SEQ ID NO: 580

SEQ ID NO: 82700 - DNA, 201 bp, Bos taurus; identical to SEQ ID NO: 581

SEQ ID NO: 82701 - DNA, 201 bp, Bos taurus
gtgcagtacttttcttgttaaactagtaaaagcattactttaaaaagtgagattaatgctgctgttttaaaaattaatgatatataggtttgtgctaagtcactttagccgtgtctgaatctgtgtgcccctatggactgtgtgctcctaggctcctctgtccatgggattctccaggcaagaatactggagtgagttgcc

SEQ ID NO: 82702 - DNA, 201 bp, Bos taurus; identical to SEQ ID NO: 584

SEQ ID NO: 82703 - DNA, 201 bp, Bos taurus; identical to SEQ ID NO: 585

SEQ ID NO: 82704 - DNA, 201 bp, Bos taurus; identical to SEQ ID NO: 586

SEQ ID NO: 82705 - DNA, 201 bp, Bos taurus; identical to SEQ ID NO: 587

SEQ ID NO: 82706 - DNA, 201 bp, Bos taurus; identical to SEQ ID NO: 588

SEQ ID NO: 82707 - DNA, 201 bp, Bos taurus; identical to SEQ ID NO: 589

SEQ ID NO: 82708 - DNA, 201 bp, Bos taurus; identical to SEQ ID NO: 590

SEQ ID NO: 82709 - DNA, 201 bp, Bos taurus; identical to SEQ ID NO: 591

SEQ ID NO: 82710 - DNA, 201 bp, Bos taurus; identical to SEQ ID NO: 592

SEQ ID NO: 82711 - DNA, 201 bp, Bos taurus; identical to SEQ ID NO: 593

SEQ ID NO: 82712 - DNA, 201 bp, Bos taurus; identical to SEQ ID NO: 594

SEQ ID NO: 82713 - DNA, 201 bp, Bos taurus; identical to SEQ ID NO: 595

SEQ ID NO: 82714 - DNA, 201 bp, Bos taurus
gctccatttcggcctctgagtctccacctaccatgtgttctcacctgatcccaattcacagaggacgtaggactgagcttcctgccgcagaacccactcactgcatctggatctgtcctcttcccattcaaggccagttgtcttcctgtgctctggaatccttctgtctcctaccaagaatcttccaatttctccttttct

SEQ ID NO: 82715 - DNA, 201 bp, Bos taurus
gttaatttctctgtcttgtatctgtggccacctgttaactggattgttttttctagtctccttttctcttcccacaaataaaaatcgattgaagcatttgaatttacatgtatgtactgaaataattatttctgttgtgtttaaaaatgtagcacaatattttgatacgaatagagaaaatattgtgactatcagatgttg

SEQ ID NO: 82716 - DNA, 201 bp, Bos taurus
aataaaatacctcaaatttctctgcagtcccctctttggtcacactatttaggatttttatttgtctgttctacaactatagctaacttaggatggaaaggaatttactggaatgtgttaaatcagaatcagagaaaaggtctacagtctattttctataaggctgctagagcaacttaatacaaatacaagtcattcaag

SEQ ID NO: 82717 - DNA, 201 bp, Bos taurus; identical to SEQ ID NO: 597

SEQ ID NO: 82718 - DNA, 201 bp, Bos taurus
caaaaaaagatgttaaatgtatttacagctggtgatgctgaatagaaggtccctgaagatgtcaaatatcaggagtccctaccctacagcatgtattatactagatactgaggatgaaaaggtaaataataagcctccccagcccctgggaaactccaccttgcggtgaagatagactcatatacattagtatagatttaa

SEQ ID NO: 82719 - DNA, 201 bp, Bos taurus
ttctaaagtaagttagagttcataagatcatagaacaaagccctctggaattctcccctttataactcagcttgtcctgaaggggccagaaaatcaggccacagcccagacagagaaaattgtgctacatggaaaatgcagagctgagtctcatctcacacctgcagaatctgctgtcagctgttcaattctaagttctgt

SEQ ID NO: 82720 - DNA, 201 bp, Bos taurus
ccccttacacagatcagactctctctgaggtcttcagggccttgtctcatttcctttttcctaattccttttcttttgcccaaggtttttggatagaaccatatcgaaagtctagtctatggtaattttagaatttgagctgctggcctgctgatggggtaagtcaaatgggcgttcatgctaataacctaggtgagagca

SEQ ID NO: 82721 - DNA, 201 bp, Bos taurus; identical to SEQ ID NO: 42219

SEQ ID NO: 82722 - DNA, 201 bp, Bos taurus; identical to SEQ ID NO: 600

SEQ ID NO: 82723 - DNA, 201 bp, Bos taurus; identical to SEQ ID NO: 601

SEQ ID NO: 82724 - DNA, 201 bp, Bos taurus; identical to SEQ ID NO: 602

SEQ ID NO: 82725 - DNA, 201 bp, Bos taurus; identical to SEQ ID NO: 603

SEQ ID NO: 82726 - DNA, 201 bp, Bos taurus; identical to SEQ ID NO: 604

SEQ ID NO: 82727 - DNA, 201 bp, Bos taurus
ctcatgcataaatttcaataggccataataaatttgtaaacgaattaaggctttcctgtttatccttggcattgctaaaaccacatacttcccttagctacactgacaaaccttttatgataggccagccaatttagagtgtcagtgtcaactgtatattaaacactgtagcgtttcttttattcctttttaaagataaag

SEQ ID NO: 82728 - DNA, 201 bp, Bos taurus; identical to SEQ ID NO: 605

SEQ ID NO: 82729 - DNA, 201 bp, Bos taurus; identical to SEQ ID NO: 606

SEQ ID NO: 82730 - DNA, 201 bp, Bos taurus
acaacattatgtgtataagggtggtcaactgactatgcatatgcataggaacccctgtcttcttctccttttaccatttctttctggcctggagtattttctttttgtggatattttagagttaacttcattttggattctagcaaacctgatcattgaaaacaggtgaggccctgtctcaggtgcctgttctgtttacag

SEQ ID NO: 82731 - DNA, 201 bp, Bos taurus; identical to SEQ ID NO: 608

SEQ ID NO: 82732 - DNA, 201 bp, Bos taurus; identical to SEQ ID NO: 609

SEQ ID NO: 82733 - DNA, 201 bp, Bos taurus
cccaagcttctacatcaaatcgcttggagactgaagaccagaatctgagtcttcacatttttactctctttcttgagcccacatagtaaattcaggccacgtctccatatcagtaactcaactattgcagaatgactcaactaacagggaacaaaaggatttcacaagttttctggagcattgcatggccttagagggtag

SEQ ID NO: 82734 - DNA, 201 bp, Bos taurus
tctcactgctctaggggctagaaagtccaagataaacatgctgatatgttttgtttctggcgaaggttgtctttctggcttatagaaagagagtcttccctgctgtatcctcacatcatcacctggcagagagagggagcaagctctggtgtctcatcctcttattagggtcccattcttaaggcaccatttaaccattgt

SEQ ID NO: 82735 - DNA, 201 bp, Bos taurus
actctctgttagaggatgcctgcgtgtgagcggggcgcgcgctttggcaccgtccccgtttaagaagcgttctgtttgcaaagtactccaaaagtgacgttagtcacaggtacttcttaaagtctaggatacaatgagaaaaggaaaaatgtttgtattttatattacgtgattccaaaattatgtttggtttatttcagg

SEQ ID NO: 82736 - DNA, 201 bp, Bos taurus; identical to SEQ ID NO: 611

SEQ ID NO: 82737 - DNA, 201 bp, Bos taurus
ataattaagccaatgcagaaagccaaaaattttaacataaatttgctagcaattttatataattgtattttggtaatgagacaagtaaatgttcatattactgagaagaaaagggtcaaataccttaagagctttgaattgttttgtattttctccaattgatctatttctttggataatctagcaatttcttcttccaga

SEQ ID NO: 82738 - DNA, 201 bp, Bos taurus; identical to SEQ ID NO: 613

SEQ ID NO: 82739 - DNA, 201 bp, Bos taurus; identical to SEQ ID NO: 617

SEQ ID NO: 82740 - DNA, 201 bp, Bos taurus; identical to SEQ ID NO: 618

SEQ ID NO: 82741 - DNA, 201 bp, Bos taurus; identical to SEQ ID NO: 619

SEQ ID NO: 82742 - DNA, 201 bp, Bos taurus; identical to SEQ ID NO: 620

SEQ ID NO: 82743 - DNA, 201 bp, Bos taurus; identical to SEQ ID NO: 621

SEQ ID NO: 82744 - DNA, 201 bp, Bos taurus; identical to SEQ ID NO: 622

SEQ ID NO: 82745 - DNA, 201 bp, Bos taurus; identical to SEQ ID NO: 623

SEQ ID NO: 82746 - DNA, 201 bp, Bos taurus; identical to SEQ ID NO: 624

SEQ ID NO: 82747 - DNA, 201 bp, Bos taurus; identical to SEQ ID NO: 625

SEQ ID NO: 82748 - DNA, 201 bp, Bos taurus; identical to SEQ ID NO: 626

SEQ ID NO: 82749 - DNA, 201 bp, Bos taurus; identical to SEQ ID NO: 627

SEQ ID NO: 82750 - DNA, 201 bp, Bos taurus; identical to SEQ ID NO: 630

SEQ ID NO: 82751 - DNA, 201 bp, Bos taurus; identical to SEQ ID NO: 634

SEQ ID NO: 82752 - DNA, 201 bp, Bos taurus; identical to SEQ ID NO: 635

SEQ ID NO: 82753 - DNA, 201 bp, Bos taurus; identical to SEQ ID NO: 636

SEQ ID NO: 82754 - DNA, 201 bp, Bos taurus
catttgagttttatttttgaaagtaaaaattttaaagaagtgtatgtatatgctctatttcagctgaccctctgtacctgtggatgtactttgccatttcgtataagggattcaagcatcctcagattttggtttgggatgaggatggggaggctgtcatggaacacatccctgcagatacttagggacaactacatatgc

SEQ ID NO: 82755 - DNA, 201 bp, Bos taurus; identical to SEQ ID NO: 638

SEQ ID NO: 82756 - DNA, 201 bp, Bos taurus; identical to SEQ ID NO: 640

SEQ ID NO: 82757 - DNA, 201 bp, Bos taurus
attctaaaaataagactgctgttgaccccattctttaagaattcagttttatgagatcattttctttctttcaaatgaacattgtaaaaatatgaactaggtttcaacttaaattgaaaacaaaatttaggaacatgcaatatattcatattggaaaattcataaaaaagttctttgctttttatgtttaatataaattta

SEQ ID NO: 82758 - DNA, 201 bp, Bos taurus; identical to SEQ ID NO: 643

SEQ ID NO: 82759 - DNA, 201 bp, Bos taurus; identical to SEQ ID NO: 644

SEQ ID NO: 82760 - DNA, 201 bp, Bos taurus; identical to SEQ ID NO: 646

SEQ ID NO: 82761 - DNA, 201 bp, Bos taurus; identical to SEQ ID NO: 647

SEQ ID NO: 82762 - DNA, 201 bp, Bos taurus; identical to SEQ ID NO: 649

SEQ ID NO: 82763 - DNA, 201 bp, Bos taurus; identical to SEQ ID NO: 650

SEQ ID NO: 82764 - DNA, 201 bp, Bos taurus; identical to SEQ ID NO: 652

SEQ ID NO: 82765 - DNA, 201 bp, Bos taurus; identical to SEQ ID NO: 653

SEQ ID NO: 82766 - DNA, 201 bp, Bos taurus; identical to SEQ ID NO: 654

SEQ ID NO: 82767 - DNA, 201 bp, Bos taurus; identical to SEQ ID NO: 655

SEQ ID NO: 82768 - DNA, 201 bp, Bos taurus
gccttaagactctgatcttgaagactcctctaggtccagcttactcctgatattcattgttatttcacatttatttgggtctgcatgatatgtctcaaatgtctccagacttggcctttattaagcaagttctacagccaagggtctccacacccaagtagccagcgccagttagcataaacactgtatcaactttcaaaa

SEQ ID NO: 82769 - DNA, 201 bp, Bos taurus; identical to SEQ ID NO: 656

SEQ ID NO: 82770 - DNA, 201 bp, Bos taurus; identical to SEQ ID NO: 657

SEQ ID NO: 82771 - DNA, 201 bp, Bos taurus
gggcccagctggggtctacttgatccaggaggatcggggagaaagtcagtgtgattcaggcacgcacagtcattccagacaatgcattcttcagtgatgatgcagtcttgatattatcaaaagaaatgtttatttccccccatctttagagctattttaccagcactgtattgctttcactgagagattaactacaacact

SEQ ID NO: 82772 - DNA, 201 bp, Bos taurus
ctatctctctctgctatccctccatcatttttagttttgcttgctccttgggtctgccttccccttgagccttagcccaggtcccacacacaggcctgaaggtctaccacagtcaactctgacacaactgttaggacccaaaggaaagagtgaaggctcgagggaatgaggggctctggggacagaaagaggcaaaaaaga

SEQ ID NO: 82773 - DNA, 201 bp, Bos taurus; identical to SEQ ID NO: 659

SEQ ID NO: 82774 - DNA, 201 bp, Bos taurus
gcgcagcaccctccagatacaggtaggtaggtattcattaaaacataaatttccagaggtactgcttatctgtttttgctcatcttaatataaaaatcttaacagttatggttcgagttcacctggatgagatttctatgtgtaaccatacctaaaggggttctttaattaaaactcttatgaacactcagaagtgttgag

SEQ ID NO: 82775 - DNA, 201 bp, Bos taurus; identical to SEQ ID NO: 660

SEQ ID NO: 82776 - DNA, 201 bp, Bos taurus; identical to SEQ ID NO: 661

SEQ ID NO: 82777 - DNA, 201 bp, Bos taurus
cttataaactcttccacggatgatttgaacttttgcgtgactgtctgggattttttttccaaagctccgagcatggccgcctgtggtatcaaggtgttgcaaaacagtatctgtgttgcgcttcctgttttaacctacctcgtttcgttcgtttcgtttcactgttcatcacagcagtgttatctccaggagacatataga

SEQ ID NO: 82778 - DNA, 201 bp, Bos taurus; identical to SEQ ID NO: 662

SEQ ID NO: 82779 - DNA, 201 bp, Bos taurus; identical to SEQ ID NO: 663

SEQ ID NO: 82780 - DNA, 201 bp, Bos taurus
aagagagtgaatgctacggagaggcagtttctgcctgcagagaatgtccaagctgggtctgtggcagatggaacacaggtgggcccagtggcccctctgagtgaaggagatgaagtggggaatctgggatagccaaggtagctggtgttcccgggaaagagtgggagagaggagaaagtcgcacacagagaacttcagaca

SEQ ID NO: 82781 - DNA, 201 bp, Bos taurus; identical to SEQ ID NO: 665

SEQ ID NO: 82782 - DNA, 201 bp, Bos taurus; identical to SEQ ID NO: 666

SEQ ID NO: 82783 - DNA, 201 bp, Bos taurus
cattgcctattgttgcagagagtcaatggttggtggcaatggcaacagaaataagcttgttactgttgggctcaggagccctactggtgggcccagggactcttaattcagcagaagctattcaacccttgtcaatgctgcactgaatatggctgctcaccaggcccattctccagctgtccccaggagaagctcatgact

SEQ ID NO: 82784 - DNA, 201 bp, Bos taurus
gagatgctaggcctctgagcagtttatagtcttgtgtgaatcacggaaataagagaggactggaagagcagcaagcatgagggccaggaggagaggaaggtggaaggtgggagcctacctaagtctaaggaactgctaaacaagcccccgtcattcaatcacccttgatggtcttctctatcttctccagtgagtaactgg

SEQ ID NO: 82785 - DNA, 201 bp, Bos taurus; identical to SEQ ID NO: 668

SEQ ID NO: 82786 - DNA, 201 bp, Bos taurus; identical to SEQ ID NO: 669

SEQ ID NO: 82787 - DNA, 201 bp, Bos taurus; identical to SEQ ID NO: 671

SEQ ID NO: 82788 - DNA, 201 bp, Bos taurus; identical to SEQ ID NO: 673

SEQ ID NO: 82789 - DNA, 201 bp, Bos taurus; identical to SEQ ID NO: 674

SEQ ID NO: 82790 - DNA, 201 bp, Bos taurus; identical to SEQ ID NO: 675

SEQ ID NO: 82791 - DNA, 201 bp, Bos taurus; identical to SEQ ID NO: 676

SEQ ID NO: 82792 - DNA, 201 bp, Bos taurus; identical to SEQ ID NO: 677

SEQ ID NO: 82793 - DNA, 201 bp, Bos taurus; identical to SEQ ID NO: 678

SEQ ID NO: 82794 - DNA, 201 bp, Bos taurus; identical to SEQ ID NO: 679

SEQ ID NO: 82795 - DNA, 201 bp, Bos taurus; identical to SEQ ID NO: 680

SEQ ID NO: 82796 - DNA, 201 bp, Bos taurus; identical to SEQ ID NO: 681

SEQ ID NO: 82797 - DNA, 201 bp, Bos taurus; identical to SEQ ID NO: 682

SEQ ID NO: 82798 - DNA, 201 bp, Bos taurus; identical to SEQ ID NO: 683

SEQ ID NO: 82799 - DNA, 201 bp, Bos taurus; identical to SEQ ID NO: 684

SEQ ID NO: 82800 - DNA, 201 bp, Bos taurus; identical to SEQ ID NO: 685

SEQ ID NO: 82801 - DNA, 201 bp, Bos taurus; identical to SEQ ID NO: 686

SEQ ID NO: 82802 - DNA, 201 bp, Bos taurus; identical to SEQ ID NO: 687

SEQ ID NO: 82803 - DNA, 201 bp, Bos taurus; identical to SEQ ID NO: 688

SEQ ID NO: 82804 - DNA, 201 bp, Bos taurus; identical to SEQ ID NO: 689

SEQ ID NO: 82805 - DNA, 201 bp, Bos taurus; identical to SEQ ID NO: 690

SEQ ID NO: 82806 - DNA, 201 bp, Bos taurus; identical to SEQ ID NO: 691

SEQ ID NO: 82807 - DNA, 201 bp, Bos taurus; identical to SEQ ID NO: 692

SEQ ID NO: 82808 - DNA, 201 bp, Bos taurus; identical to SEQ ID NO: 693

SEQ ID NO: 82809 - DNA, 201 bp, Bos taurus; identical to SEQ ID NO: 694

SEQ ID NO: 82810 - DNA, 201 bp, Bos taurus; identical to SEQ ID NO: 695

SEQ ID NO: 82811 - DNA, 201 bp, Bos taurus; identical to SEQ ID NO: 697

SEQ ID NO: 82812 - DNA, 201 bp, Bos taurus; identical to SEQ ID NO: 698

SEQ ID NO: 82813 - DNA, 201 bp, Bos taurus; identical to SEQ ID NO: 699

SEQ ID NO: 82814 - DNA, 201 bp, Bos taurus; identical to SEQ ID NO: 700

SEQ ID NO: 82815 - DNA, 201 bp, Bos taurus; identical to SEQ ID NO: 701

SEQ ID NO: 82816 - DNA, 201 bp, Bos taurus; identical to SEQ ID NO: 702

SEQ ID NO: 82817 - DNA, 201 bp, Bos taurus; identical to SEQ ID NO: 703

SEQ ID NO: 82818 - DNA, 201 bp, Bos taurus; identical to SEQ ID NO: 704

SEQ ID NO: 82819 - DNA, 201 bp, Bos taurus
attgtcagttagtttttcagaagttcactatgcccttgaatactatttaactgaaaactgagacacaaaatttctaggaaaaaaaatggttgaaagaaagattggagggtatagctatcaaagagaatttttgtataaaaaagagatttggaagcttaacagtaataactactgaactcttaatatatgctagacattttt

SEQ ID NO: 82820 - DNA, 201 bp, Bos taurus; identical to SEQ ID NO: 713

SEQ ID NO: 82821 - DNA, 201 bp, Bos taurus; identical to SEQ ID NO: 714

SEQ ID NO: 82822 - DNA, 201 bp, Bos taurus; identical to SEQ ID NO: 715

SEQ ID NO: 82823 - DNA, 201 bp, Bos taurus
agcacttgaactggatattgtatacttagtacaaaagagtgctgcatgtgtctaggtgatggcagaatgtcgagagcattaaagaccaattttgagtaagtgccaacccagtgcagctgtggaactgcgcttctggcccaggcagagccacttctacagctggcctagatatttactaaaatttcattaagcattaccagt

SEQ ID NO: 82824 - DNA, 201 bp, Bos taurus
tctgtgggtcagtaaggatatattgtctttaatcaaaaagaataatgaattgaggcacacacagtagcataggctgaaaatctgcagtgaaatttgtccttccctcatactattaacctaattaccatacaatttaaagttaataataaataacaggcttaaattagaccagactaaagtatgggcaattataccaagaac

SEQ ID NO: 82825 - DNA, 201 bp, Bos taurus; identical to SEQ ID NO: 717

SEQ ID NO: 82826 - DNA, 201 bp, Bos taurus; identical to SEQ ID NO: 718

SEQ ID NO: 82827 - DNA, 201 bp, Bos taurus
cactaacctcctatttacaattctttgagtaaggtgctttagttaccagcactttggaaatgacaaaactgtgactcagaaaattaaggaatttgcacaagagcacatagtggagaggaaatgaagatagaattcacactgagctagaccagacctaaagcctgcaatctaatcactgcaaagtaccagctccatagaaca

SEQ ID NO: 82828 - DNA, 201 bp, Bos taurus
aaactcacacaataacaaagacaatataaaaagctgtgcacctatgaaagaaattgaatcaataattaacttttccaaaacagaaatgaaaggcccagaaggttcactgattaattatatcaaatatttcaagaagaaattacaccaatgctctagtaatctctaccagaagatagaagtagagggaatacttcctaactt

SEQ ID NO: 82829 - DNA, 201 bp, Bos taurus
gtggctacttatttatatatgtaatggattctcttcaatggaatttcaagtgtaagtcaccactagaaataagtcaaggattgaagggcagaggccaagtatatgtaggtggtcacagattttccattaagtatctcaaggcacagttcacaaaggtgaaggtagttcctctttgagggcctttatggggaggtgttgagc

SEQ ID NO: 82830 - DNA, 201 bp, Bos taurus
tagtgcatttatttatgatattcaaactgatgagttaatagaagaaacatgtactgctagttagtaggaaataaccatttagtcactaatttgcaatgagatcttagacaatttgcaatttcctggaactcagttttctaaattgtagtgaaagtgaatatatgtttgctaacatccctcccagacgttttacccaaattc

SEQ ID NO: 82831 - DNA, 201 bp, Bos taurus
tgagatatcctaagtgtgaactgatgaactgcccaaattatgaccagcagatattataagtgcttcctgttaaaaccattacattttgttgtgatttgtcatggagccatagataatgaaaacgctctcatccaaattaatcaaacacagggagcatttctccccacatctctgaatctaagagtgtctttaaagcctaat

SEQ ID NO: 82832 - DNA, 201 bp, Bos taurus; identical to SEQ ID NO: 721

SEQ ID NO: 82833 - DNA, 201 bp, Bos taurus; identical to SEQ ID NO: 722

SEQ ID NO: 82834 - DNA, 201 bp, Bos taurus; identical to SEQ ID NO: 723

SEQ ID NO: 82835 - DNA, 201 bp, Bos taurus; identical to SEQ ID NO: 724

SEQ ID NO: 82836 - DNA, 201 bp, Bos taurus; identical to SEQ ID NO: 725

SEQ ID NO: 82837 - DNA, 201 bp, Bos taurus; identical to SEQ ID NO: 726

SEQ ID NO: 82838 - DNA, 201 bp, Bos taurus
tggctctgggctaaacttccaagagcacagtggccacggctctggaattcaatagtccaggagttatacaacttctccttgggccactggcaagtggatggtttttgacctttgctctgggctgtccctggtgacttggaaaaggcgatggcaccccactccagtactcttgcctggagaatcccatggacggacgggcct

SEQ ID NO: 82839 - DNA, 201 bp, Bos taurus
gactgagcagggcagagccggggtggggatgcaaacaccaggtcaggcagtggaaggaccagttaattgaatgcgggagctgtccaggcccttcatttcccggaagtgctctatgggagggaggaggctggagaagcaggtgaggagaccttggagtgagtgggcgagcagccctctgtaggaaccaggaggagggattgg

SEQ ID NO: 82840 - DNA, 201 bp, Bos taurus; identical to SEQ ID NO: 727

SEQ ID NO: 82841 - DNA, 201 bp, Bos taurus
ttatgcatataagatctaaactgccatattttacattattatatataaagatctattaagacagatcttctatctcaatctagggggaaaaaaagtgacatatttgatcaaattaaaaatttaggagcaagttctactgttttaggtcatctgcttctgagggaaagaggtctttctttccaggtcctgatttttcatact

SEQ ID NO: 82842 - DNA, 201 bp, Bos taurus
ataaaaagtaaggtaaagaaacatcacctgagaatcaatttccccctttttttgcattagaattttttttttctcctcattctctgggaacccaaaccttatgcagaattataagaagtttggggaaatgctgttatgcttgtttctcccaccaatgataaaaaggaaataaagaagaaaattctcactcagctgtgcaac

SEQ ID NO: 82843 - DNA, 201 bp, Bos taurus; identical to SEQ ID NO: 728

SEQ ID NO: 82844 - DNA, 201 bp, Bos taurus; identical to SEQ ID NO: 729

SEQ ID NO: 82845 - DNA, 201 bp, Bos taurus; identical to SEQ ID NO: 730

SEQ ID NO: 82846 - DNA, 201 bp, Bos taurus; identical to SEQ ID NO: 732

SEQ ID NO: 82847 - DNA, 201 bp, Bos taurus
tcaagcctttaactccggggcagagtgatttctcatactcagtttccatcactcagatcaaggcttccgagtcgtttactttgtaccttctattaacatttacagcgaaggtatcctaaacactcaattttcacattctttttcactgacaaatcaagaattaaatacaaactttgctaaacgcagaccttttccaaagtg

SEQ ID NO: 82848 - DNA, 201 bp, Bos taurus
tcaatcaaatttgacagctttcaaggacacagtgtggccctgaagtagaccagaattccaggcaaatggacggagcagttaggaccagcatgaaagagaaacttgccccgcaggcctgtgtgttttgagagaagactctgaatcccatccctcgaattcctcaatcatgactgggcaatacaagtgtacaaaacagattgg

SEQ ID NO: 82849 - DNA, 201 bp, Bos taurus; identical to SEQ ID NO: 735

SEQ ID NO: 82850 - DNA, 201 bp, Bos taurus; identical to SEQ ID NO: 736

SEQ ID NO: 82851 - DNA, 201 bp, Bos taurus; identical to SEQ ID NO: 740

SEQ ID NO: 82852 - DNA, 201 bp, Bos taurus; identical to SEQ ID NO: 741

SEQ ID NO: 82853 - DNA, 201 bp, Bos taurus; identical to SEQ ID NO: 743

SEQ ID NO: 82854 - DNA, 201 bp, Bos taurus; identical to SEQ ID NO: 744

SEQ ID NO: 82855 - DNA, 201 bp, Bos taurus; identical to SEQ ID NO: 745

SEQ ID NO: 82856 - DNA, 201 bp, Bos taurus
aaatatgcaattgtttactaagtaacatagaagagaatttgaattaagtggaaattttacattgctcatgaattaaataagtcatctttgaaaagatatcgatacatcccaaatatcctataattttcattacaatccatataattttaattataattctattcaaaacatcaaactggtttctaggaaaaaatattcagt

SEQ ID NO: 82857 - DNA, 201 bp, Bos taurus
gggtgccaggaagatgaagcgggctgcagccgagcaggggccacaccggcagccattccctctggaactcacactcttggcctatacgccaccatctgccagagcctacatccagtacaagctgccggctgcgcagcgccctgctctggaagcagcgagctgaggccgcacttgacctccgggacaaggcccagcaccagc

SEQ ID NO: 82858 - DNA, 201 bp, Bos taurus
tgaatcaaagtttccaggaaaggggcctccccagcctctaccagtgtaattcttgttttggttgtgcagcacgtgggatcttagttccaatcctatatacctgtatctatatatctatatttttggcctgccagggtaattctgatacaccttttcttggatcagtatttgagatcccttggcataatatatttaaagcaa

SEQ ID NO: 82859 - DNA, 201 bp, Bos taurus
attttctgaaaatagactcatttccgcagatggatgaaatgagttctcaccagcaaacaatgaaatgtgtcatgtgaaatttcaaggtcccttctaaagatcctgtgattccatgaaaacaaagtggggaaagaaagcaagttgcatgtatgaaattaggtagatggttaaaactaattcattacccttattatttctgaa

SEQ ID NO: 82860 - DNA, 201 bp, Bos taurus
gcacacccacagtagtcagcactgccacaacagaaggcccacacagtctacataagaatatccatacagagtatagctttcatgatcagaggagagtgtgcttgttgggccccataggacatcttctacataaggccacttctcctagatcagaagatataatcagcctacctaatacataaaaaaaacatagagaattaa

SEQ ID NO: 82861 - DNA, 201 bp, Bos taurus; identical to SEQ ID NO: 747

SEQ ID NO: 82862 - DNA, 201 bp, Bos taurus; identical to SEQ ID NO: 748

SEQ ID NO: 82863 - DNA, 201 bp, Bos taurus; identical to SEQ ID NO: 749

SEQ ID NO: 82864 - DNA, 201 bp, Bos taurus
gcatggagctgtgatgagagatgcctgatgaactagaaattacctttctaagcaactcttaccagccccacagccatgtgtggccattaaactagtttttgacgatggacagagattagatcataaaagatcttacagagcatggtaaagagtttagattttattctgcagttggtaggcaatcattggattgttttaagc

SEQ ID NO: 82865 - DNA, 201 bp, Bos taurus; identical to SEQ ID NO: 753

SEQ ID NO: 82866 - DNA, 201 bp, Bos taurus; identical to SEQ ID NO: 754

SEQ ID NO: 82867 - DNA, 201 bp, Bos taurus
ggggtagtgtcaggatgattctcatacattacatttggtgcagactttattctaatctaatgccaccactgatctgacaggtgccggaccttggcccagaagttggggacccctgctataaaacataaaatattcaaatgataaattcttaaactctgcaaataaaattaacataatcttctcctttaattttaatttctt

SEQ ID NO: 82868 - DNA, 201 bp, Bos taurus
aggccttacgtgctgcagtccatgggtcagaaagagtcagacacgattgagcgactgaaatgatctgaactctaacatctgtcaggtaaaatgtatcttcggaggagaagggccacatgaactagcacaaaggagctttacaggagattgaagtagaagacagatgataagcacatgagaagagctgggaatctgaaatca

SEQ ID NO: 82869 - DNA, 201 bp, Bos taurus
ggcctctctctctctcaattcccctctcattccaatcaaggaaaaaaaaaatctctctttataacagacttcccattgtaccacaccagaactggctcacgtggcctcctgtagctataggtgagcctgacaaagtaagcatttgaagttttcagcctttcttatgagaagcaggctctgccagtgtagaaaatcgggtag

SEQ ID NO: 82870 - DNA, 201 bp, Bos taurus
tggacaaggaatcatagcatctcaggaattcaaaggaatggttttagaagggtgacataggctccaggtggcatatcacgtacctcatggactccgtgccgtggggaggagtgaggccagagaaggaccaataagcacacaacagaaacacagaacaggactcaacagggtcaaatctaagtgtaatacagactggagtgc

SEQ ID NO: 82871 - DNA, 201 bp, Bos taurus
agacatggtcctccccaccagaggggtcgagacttggctctacccatcggtaggcaggcaccagcccttctagccagaaggcctgcacaggcctctagaccagccttacctaccagcgcattgacaccagaagcaagaaaactatgatcctgcagcccacagaatgagactgccaacaataagtcagaccataccctggga

SEQ ID NO: 82872 - DNA, 201 bp, Bos taurus
acccagtaaatagtttgttgaataatgcatttttatgagttagaaccggaagaaatgtggtgactggtggccgatgagaagtaagacagaaaaatacagaatatgttaatctgtataatctgttatcatggtctcttttcttttctcagtgttcactaaccccagttgctacagaatggaatcatgattacctaactctgt

SEQ ID NO: 82873 - DNA, 201 bp, Bos taurus; identical to SEQ ID NO: 758

SEQ ID NO: 82874 - DNA, 201 bp, Bos taurus; identical to SEQ ID NO: 760

SEQ ID NO: 82875 - DNA, 201 bp, Bos taurus; identical to SEQ ID NO: 762

SEQ ID NO: 82876 - DNA, 201 bp, Bos taurus; identical to SEQ ID NO: 764

SEQ ID NO: 82877 - DNA, 201 bp, Bos taurus; identical to SEQ ID NO: 766

SEQ ID NO: 82878 - DNA, 201 bp, Bos taurus; identical to SEQ ID NO: 767

SEQ ID NO: 82879 - DNA, 201 bp, Bos taurus; identical to SEQ ID NO: 768

SEQ ID NO: 82880 - DNA, 201 bp, Bos taurus; identical to SEQ ID NO: 769

SEQ ID NO: 82881 - DNA, 201 bp, Bos taurus
atggggactttgaagtgtgtgctttctgaagtgccgtgtaaggtgagctgatgcctgtccctcacccgccccttttgtttggtacccagcaccatttctgtgctgtgagagttctagggcattgacggtggtactttttaaagtttttattttatattggagtagatccagttaacaatgttgtgatagttccaggtggac

SEQ ID NO: 82882 - DNA, 201 bp, Bos taurus; identical to SEQ ID NO: 771

SEQ ID NO: 82883 - DNA, 201 bp, Bos taurus; identical to SEQ ID NO: 772

SEQ ID NO: 82884 - DNA, 201 bp, Bos taurus; identical to SEQ ID NO: 773

SEQ ID NO: 82885 - DNA, 201 bp, Bos taurus; identical to SEQ ID NO: 775

SEQ ID NO: 82886 - DNA, 201 bp, Bos taurus; identical to SEQ ID NO: 777

SEQ ID NO: 82887 - DNA, 201 bp, Bos taurus; identical to SEQ ID NO: 779

SEQ ID NO: 82888 - DNA, 201 bp, Bos taurus; identical to SEQ ID NO: 781

SEQ ID NO: 82889 - DNA, 201 bp, Bos taurus; identical to SEQ ID NO: 42399

SEQ ID NO: 82890 - DNA, 201 bp, Bos taurus; identical to SEQ ID NO: 782

SEQ ID NO: 82891 - DNA, 201 bp, Bos taurus; identical to SEQ ID NO: 783

SEQ ID NO: 82892 - DNA, 201 bp, Bos taurus; identical to SEQ ID NO: 785

SEQ ID NO: 82893 - DNA, 201 bp, Bos taurus
ttcctaattgcttgtccctgataatttgggaattcatcttagaatttgatgtatataataacaaggaaaactaagccaaaaataggggacttatagatttcattatccatagttttctttcaactgcacaaggtcacttcatgtccttggttaagcactctgtatctattagaacccaggaataggacaagactcagtctg

SEQ ID NO: 82894 - DNA, 201 bp, Bos taurus
aagtgctaagatgctagatatcatgtccttccttacagacgacagacaacttaatagacagctttaggagtatctggccggccccaaactccccttttcagaattctttccatcggacaaggatgggcaacaagtagccatgtttgcattgatcaaggcagccagcctggccttagcgtttagacaaggaacagtcagctg

SEQ ID NO: 82895 - DNA, 201 bp, Bos taurus; identical to SEQ ID NO: 786

SEQ ID NO: 82896 - DNA, 201 bp, Bos taurus; identical to SEQ ID NO: 788

SEQ ID NO: 82897 - DNA, 201 bp, Bos taurus; identical to SEQ ID NO: 789

SEQ ID NO: 82898 - DNA, 201 bp, Bos taurus; identical to SEQ ID NO: 790

SEQ ID NO: 82899 - DNA, 201 bp, Bos taurus; identical to SEQ ID NO: 791

SEQ ID NO: 82900 - DNA, 201 bp, Bos taurus; identical to SEQ ID NO: 792

SEQ ID NO: 82901 - DNA, 201 bp, Bos taurus; identical to SEQ ID NO: 793

SEQ ID NO: 82902 - DNA, 201 bp, Bos taurus; identical to SEQ ID NO: 794

SEQ ID NO: 82903 - DNA, 201 bp, Bos taurus; identical to SEQ ID NO: 795

SEQ ID NO: 82904 - DNA, 201 bp, Bos taurus; identical to SEQ ID NO: 796

SEQ ID NO: 82905 - DNA, 201 bp, Bos taurus; identical to SEQ ID NO: 797

SEQ ID NO: 82906 - DNA, 201 bp, Bos taurus; identical to SEQ ID NO: 799

SEQ ID NO: 82907 - DNA, 201 bp, Bos taurus; identical to SEQ ID NO: 800

SEQ ID NO: 82908 - DNA, 201 bp, Bos taurus; identical to SEQ ID NO: 802

SEQ ID NO: 82909 - DNA, 201 bp, Bos taurus; identical to SEQ ID NO: 804

SEQ ID NO: 82910 - DNA, 201 bp, Bos taurus; identical to SEQ ID NO: 806

SEQ ID NO: 82911 - DNA, 201 bp, Bos taurus; identical to SEQ ID NO: 807

SEQ ID NO: 82912 - DNA, 201 bp, Bos taurus; identical to SEQ ID NO: 808

SEQ ID NO: 82913 - DNA, 201 bp, Bos taurus; identical to SEQ ID NO: 809

SEQ ID NO: 82914 - DNA, 201 bp, Bos taurus; identical to SEQ ID NO: 812

SEQ ID NO: 82915 - DNA, 201 bp, Bos taurus; identical to SEQ ID NO: 814

SEQ ID NO: 82916 - DNA, 201 bp, Bos taurus; identical to SEQ ID NO: 815

SEQ ID NO: 82917 - DNA, 201 bp, Bos taurus; identical to SEQ ID NO: 817

SEQ ID NO: 82918 - DNA, 201 bp, Bos taurus; identical to SEQ ID NO: 818

SEQ ID NO: 82919 - DNA, 201 bp, Bos taurus; identical to SEQ ID NO: 820

SEQ ID NO: 82920 - DNA, 201 bp, Bos taurus; identical to SEQ ID NO: 821

SEQ ID NO: 82921 - DNA, 201 bp, Bos taurus; identical to SEQ ID NO: 824

SEQ ID NO: 82922 - DNA, 201 bp, Bos taurus; identical to SEQ ID NO: 828

SEQ ID NO: 82923 - DNA, 201 bp, Bos taurus; identical to SEQ ID NO: 829

SEQ ID NO: 82924 - DNA, 201 bp, Bos taurus; identical to SEQ ID NO: 830

SEQ ID NO: 82925 - DNA, 201 bp, Bos taurus; identical to SEQ ID NO: 831

SEQ ID NO: 82926 - DNA, 201 bp, Bos taurus; identical to SEQ ID NO: 834

SEQ ID NO: 82927 - DNA, 201 bp, Bos taurus; identical to SEQ ID NO: 835

SEQ ID NO: 82928 - DNA, 201 bp, Bos taurus; identical to SEQ ID NO: 839

SEQ ID NO: 82929 - DNA, 201 bp, Bos taurus; identical to SEQ ID NO: 842

SEQ ID NO: 82930 - DNA, 201 bp, Bos taurus; identical to SEQ ID NO: 843

SEQ ID NO: 82931 - DNA, 201 bp, Bos taurus; identical to SEQ ID NO: 847

SEQ ID NO: 82932 - DNA, 201 bp, Bos taurus; identical to SEQ ID NO: 853

SEQ ID NO: 82933 - DNA, 201 bp, Bos taurus; identical to SEQ ID NO: 855

SEQ ID NO: 82934 - DNA, 201 bp, Bos taurus; identical to SEQ ID NO: 856

SEQ ID NO: 82935 - DNA, 201 bp, Bos taurus; identical to SEQ ID NO: 857

SEQ ID NO: 82936 - DNA, 201 bp, Bos taurus; identical to SEQ ID NO: 858

SEQ ID NO: 82937 - DNA, 201 bp, Bos taurus
tgtaggaaataaaagcagtcttcgggcaatgaatttcccattctttttattatattcatcaatagagagatgaacgcttaagtgaagagacgttattatggccataaaactgatcgatttccagattaaagaaaaagaagaaacacattaaatatattccaaatctttgccctgtaattattttgttcgttgctgtttggt

SEQ ID NO: 82938 - DNA, 201 bp, Bos taurus; identical to SEQ ID NO: 859

SEQ ID NO: 82939 - DNA, 201 bp, Bos taurus; identical to SEQ ID NO: 860

SEQ ID NO: 82940 - DNA, 201 bp, Bos taurus; identical to SEQ ID NO: 863

SEQ ID NO: 82941 - DNA, 201 bp, Bos taurus; identical to SEQ ID NO: 864

SEQ ID NO: 82942 - DNA, 201 bp, Bos taurus; identical to SEQ ID NO: 865

SEQ ID NO: 82943 - DNA, 201 bp, Bos taurus; identical to SEQ ID NO: 866

SEQ ID NO: 82944 - DNA, 201 bp, Bos taurus; identical to SEQ ID NO: 867

SEQ ID NO: 82945 - DNA, 201 bp, Bos taurus
gaagctcaggttcttgatgtctcctcacagaaaaaattcaacgagagccaaagtgataggtaagaaggctgggattcaaacctggccaaaatccagtgtgcgactctaacccatttggacccatttgatcctactcagcttatgttgtgtcctttgttgcactcaacatgccaggaaacttggaaaactcagcagcaaaac

SEQ ID NO: 82946 - DNA, 201 bp, Bos taurus; identical to SEQ ID NO: 872

SEQ ID NO: 82947 - DNA, 201 bp, Bos taurus; identical to SEQ ID NO: 874

SEQ ID NO: 82948 - DNA, 201 bp, Bos taurus; identical to SEQ ID NO: 875

SEQ ID NO: 82949 - DNA, 201 bp, Bos taurus; identical to SEQ ID NO: 876

SEQ ID NO: 82950 - DNA, 201 bp, Bos taurus
tggggcaccatgtctcagcacactgacagccggccctctgtcccctacacttggatccttcacattccccatctttcctcccagcctagctcttctccagcgtggccatccaggcccggcttcatcagcatgtgacctgaacagtcacatggggcccccagcttggtttcatgctttgctgtttctgccttaaaattcttc

SEQ ID NO: 82951 - DNA, 201 bp, Bos taurus; identical to SEQ ID NO: 879

SEQ ID NO: 82952 - DNA, 201 bp, Bos taurus; identical to SEQ ID NO: 880

SEQ ID NO: 82953 - DNA, 201 bp, Bos taurus; identical to SEQ ID NO: 881

SEQ ID NO: 82954 - DNA, 201 bp, Bos taurus; identical to SEQ ID NO: 883

SEQ ID NO: 82955 - DNA, 201 bp, Bos taurus; identical to SEQ ID NO: 885

SEQ ID NO: 82956 - DNA, 201 bp, Bos taurus; identical to SEQ ID NO: 886

SEQ ID NO: 82957 - DNA, 201 bp, Bos taurus; identical to SEQ ID NO: 887

SEQ ID NO: 82958 - DNA, 201 bp, Bos taurus; identical to SEQ ID NO: 889

SEQ ID NO: 82959 - DNA, 201 bp, Bos taurus; identical to SEQ ID NO: 890

SEQ ID NO: 82960 - DNA, 201 bp, Bos taurus; identical to SEQ ID NO: 891

SEQ ID NO: 82961 - DNA, 201 bp, Bos taurus; identical to SEQ ID NO: 892

SEQ ID NO: 82962 - DNA, 201 bp, Bos taurus
aactagtcgttacaagttccactactacaagacactcactgggatcgagggtggtcatgaatactgattgggtgtggggcccagctgagaggtgcctcaccgcacccacagtgtgctgtaagttcagctggtggtgaagaatcccctgtgccctctgggccaaactgtgccaggtgatcgcttcctcttctgactggtctc

SEQ ID NO: 82963 - DNA, 201 bp, Bos taurus
ctagctcagttattagtaaatgattaatatgaaaatatcaaggtaggaatttatatacctgaacgtaacttttcactagggttcaccttcagtgtctgcagaggtttgattccaggagcctcacaagtaccaaaatctgccaatgttcaaggccctcatactatattcaatattgtatggtaaaccataaaggcaaagcat

SEQ ID NO: 82964 - DNA, 201 bp, Bos taurus
tggccacaacgtgtgtggcagtttgggcttgctgcagagccttctcttgttctggacttcattcaaaacctgcaccttttcaggtgctggatcactcaatgcataggccaaggtacaagaggaatatgttgtctccaaaatccaaagaggttcactaggttgtgccttattttgcttgtaaagagggtcctgagcaccaga

SEQ ID NO: 82965 - DNA, 201 bp, Bos taurus
ttcagtggtttttgtctgagagtactcctgacaataagaattattctgcctttgaagccagaatcagaattgatgctagacagtgatagagttggacacccagctaaatgttttagcacagctgggagaggaaggataagtggaaagaagaccccagtgaaggcacctggtggtgaccatctatgtccagtagcagttaat

SEQ ID NO: 82966 - DNA, 201 bp, Bos taurus; identical to SEQ ID NO: 894

SEQ ID NO: 82967 - DNA, 201 bp, Bos taurus; identical to SEQ ID NO: 895

SEQ ID NO: 82968 - DNA, 201 bp, Bos taurus; identical to SEQ ID NO: 896

SEQ ID NO: 82969 - DNA, 201 bp, Bos taurus; identical to SEQ ID NO: 897

SEQ ID NO: 82970 - DNA, 201 bp, Bos taurus; identical to SEQ ID NO: 899

SEQ ID NO: 82971 - DNA, 201 bp, Bos taurus; identical to SEQ ID NO: 900

SEQ ID NO: 82972 - DNA, 201 bp, Bos taurus; identical to SEQ ID NO: 901

SEQ ID NO: 82973 - DNA, 201 bp, Bos taurus; identical to SEQ ID NO: 902

SEQ ID NO: 82974 - DNA, 201 bp, Bos taurus; identical to SEQ ID NO: 903

SEQ ID NO: 82975 - DNA, 201 bp, Bos taurus; identical to SEQ ID NO: 904

SEQ ID NO: 82976 - DNA, 201 bp, Bos taurus; identical to SEQ ID NO: 905

SEQ ID NO: 82977 - DNA, 201 bp, Bos taurus; identical to SEQ ID NO: 906

SEQ ID NO: 82978 - DNA, 201 bp, Bos taurus; identical to SEQ ID NO: 907

SEQ ID NO: 82979 - DNA, 201 bp, Bos taurus; identical to SEQ ID NO: 908

SEQ ID NO: 82980 - DNA, 201 bp, Bos taurus; identical to SEQ ID NO: 909

SEQ ID NO: 82981 - DNA, 201 bp, Bos taurus; identical to SEQ ID NO: 911

SEQ ID NO: 82982 - DNA, 201 bp, Bos taurus; identical to SEQ ID NO: 914

SEQ ID NO: 82983 - DNA, 201 bp, Bos taurus; identical to SEQ ID NO: 915

SEQ ID NO: 82984 - DNA, 201 bp, Bos taurus; identical to SEQ ID NO: 917

SEQ ID NO: 82985 - DNA, 201 bp, Bos taurus; identical to SEQ ID NO: 920

SEQ ID NO: 82986 - DNA, 201 bp, Bos taurus; identical to SEQ ID NO: 921

SEQ ID NO: 82987 - DNA, 201 bp, Bos taurus; identical to SEQ ID NO: 922

SEQ ID NO: 82988 - DNA, 201 bp, Bos taurus; identical to SEQ ID NO: 923

SEQ ID NO: 82989 - DNA, 201 bp, Bos taurus; identical to SEQ ID NO: 924

SEQ ID NO: 82990 - DNA, 201 bp, Bos taurus; identical to SEQ ID NO: 925

SEQ ID NO: 82991 - DNA, 201 bp, Bos taurus; identical to SEQ ID NO: 926

SEQ ID NO: 82992 - DNA, 201 bp, Bos taurus; identical to SEQ ID NO: 927

SEQ ID NO: 82993 - DNA, 201 bp, Bos taurus; identical to SEQ ID NO: 928

SEQ ID NO: 82994 - DNA, 201 bp, Bos taurus; identical to SEQ ID NO: 929

SEQ ID NO: 82995 - DNA, 201 bp, Bos taurus; identical to SEQ ID NO: 930

SEQ ID NO: 82996 - DNA, 201 bp, Bos taurus; identical to SEQ ID NO: 931

SEQ ID NO: 82997 - DNA, 201 bp, Bos taurus; identical to SEQ ID NO: 932

SEQ ID NO: 82998 - DNA, 201 bp, Bos taurus; identical to SEQ ID NO: 933

SEQ ID NO: 82999 - DNA, 201 bp, Bos taurus; identical to SEQ ID NO: 934

SEQ ID NO: 83000 - DNA, 201 bp, Bos taurus; identical to SEQ ID NO: 935

SEQ ID NO: 83001 - DNA, 201 bp, Bos taurus; identical to SEQ ID NO: 936

SEQ ID NO: 83002 - DNA, 201 bp, Bos taurus; identical to SEQ ID NO: 937

SEQ ID NO: 83003 - DNA, 201 bp, Bos taurus; identical to SEQ ID NO: 938

SEQ ID NO: 83004 - DNA, 201 bp, Bos taurus; identical to SEQ ID NO: 939

SEQ ID NO: 83005 - DNA, 201 bp, Bos taurus; identical to SEQ ID NO: 940

SEQ ID NO: 83006 - DNA, 201 bp, Bos taurus; identical to SEQ ID NO: 941

SEQ ID NO: 83007 - DNA, 201 bp, Bos taurus; identical to SEQ ID NO: 942

SEQ ID NO: 83008 - DNA, 201 bp, Bos taurus
gtcagcaacagacttgctattcgtcatttttgcatatgtacattttacttcctcttttgaaagaatatgtatatttccaggtgtttccatcagaaaggcttgcacgtaaggtaagttcataatcttgccagaaccacagtcttcatttctgcccaaaaataacataacctaaattccaatgtgatgtttttgtatattacc

SEQ ID NO: 83009 - DNA, 201 bp, Bos taurus; identical to SEQ ID NO: 943

SEQ ID NO: 83010 - DNA, 201 bp, Bos taurus
tgaggcctcaccatcctctggagctcacagtcctccactggaggcttggcacctcacccaccaatccgttgagaccaagagaatgtggaggctttctctgcaccactcaggggccagatctagaaacagcctagatctctgctcccctgccccggcacagccagtcagacgagtgggcccaagtgccagcagtctgggacc

SEQ ID NO: 83011 - DNA, 201 bp, Bos taurus
actcagagttttaaatatcaattcactttgtactaataatacagtaagtcccctacatatgaaccttcacgtcacaagctttcaaagatgcaaatgtgaatgctagcctctgtctagcagctgttgtactgtactcctgtgctttccaaggtactgtgctgttcgtgtttgcttgtttcttctgtgtcatgtgtgtgaagt

SEQ ID NO: 83012 - DNA, 201 bp, Bos taurus; identical to SEQ ID NO: 944

SEQ ID NO: 83013 - DNA, 201 bp, Bos taurus; identical to SEQ ID NO: 946

SEQ ID NO: 83014 - DNA, 201 bp, Bos taurus; identical to SEQ ID NO: 947

SEQ ID NO: 83015 - DNA, 201 bp, Bos taurus; identical to SEQ ID NO: 948

SEQ ID NO: 83016 - DNA, 201 bp, Bos taurus; identical to SEQ ID NO: 949

SEQ ID NO: 83017 - DNA, 201 bp, Bos taurus; identical to SEQ ID NO: 950

SEQ ID NO: 83018 - DNA, 201 bp, Bos taurus; identical to SEQ ID NO: 951

SEQ ID NO: 83019 - DNA, 201 bp, Bos taurus; identical to SEQ ID NO: 952

SEQ ID NO: 83020 - DNA, 201 bp, Bos taurus; identical to SEQ ID NO: 953

SEQ ID NO: 83021 - DNA, 201 bp, Bos taurus; identical to SEQ ID NO: 954

SEQ ID NO: 83022 - DNA, 201 bp, Bos taurus; identical to SEQ ID NO: 955

SEQ ID NO: 83023 - DNA, 201 bp, Bos taurus; identical to SEQ ID NO: 956

SEQ ID NO: 83024 - DNA, 201 bp, Bos taurus; identical to SEQ ID NO: 957

SEQ ID NO: 83025 - DNA, 201 bp, Bos taurus; identical to SEQ ID NO: 958

SEQ ID NO: 83026 - DNA, 201 bp, Bos taurus; identical to SEQ ID NO: 959

SEQ ID NO: 83027 - DNA, 201 bp, Bos taurus; identical to SEQ ID NO: 960

SEQ ID NO: 83028 - DNA, 201 bp, Bos taurus; identical to SEQ ID NO: 961

SEQ ID NO: 83029 - DNA, 201 bp, Bos taurus; identical to SEQ ID NO: 962

SEQ ID NO: 83030 - DNA, 201 bp, Bos taurus; identical to SEQ ID NO: 963

SEQ ID NO: 83031 - DNA, 201 bp, Bos taurus; identical to SEQ ID NO: 964

SEQ ID NO: 83032 - DNA, 201 bp, Bos taurus; identical to SEQ ID NO: 965

SEQ ID NO: 83033 - DNA, 201 bp, Bos taurus; identical to SEQ ID NO: 967

SEQ ID NO: 83034 - DNA, 201 bp, Bos taurus; identical to SEQ ID NO: 968

SEQ ID NO: 83035 - DNA, 201 bp, Bos taurus; identical to SEQ ID NO: 969

SEQ ID NO: 83036 - DNA, 201 bp, Bos taurus; identical to SEQ ID NO: 970

SEQ ID NO: 83037 - DNA, 201 bp, Bos taurus; identical to SEQ ID NO: 971

SEQ ID NO: 83038 - DNA, 201 bp, Bos taurus; identical to SEQ ID NO: 972

SEQ ID NO: 83039 - DNA, 201 bp, Bos taurus; identical to SEQ ID NO: 973

SEQ ID NO: 83040 - DNA, 201 bp, Bos taurus; identical to SEQ ID NO: 974

SEQ ID NO: 83041 - DNA, 201 bp, Bos taurus; identical to SEQ ID NO: 975

SEQ ID NO: 83042 - DNA, 201 bp, Bos taurus; identical to SEQ ID NO: 976

SEQ ID NO: 83043 - DNA, 201 bp, Bos taurus; identical to SEQ ID NO: 977

SEQ ID NO: 83044 - DNA, 201 bp, Bos taurus; identical to SEQ ID NO: 978

SEQ ID NO: 83045 - DNA, 201 bp, Bos taurus; identical to SEQ ID NO: 979

SEQ ID NO: 83046 - DNA, 201 bp, Bos taurus; identical to SEQ ID NO: 980

SEQ ID NO: 83047 - DNA, 201 bp, Bos taurus; identical to SEQ ID NO: 981

SEQ ID NO: 83048 - DNA, 201 bp, Bos taurus; identical to SEQ ID NO: 983

SEQ ID NO: 83049 - DNA, 201 bp, Bos taurus; identical to SEQ ID NO: 984

SEQ ID NO: 83050 - DNA, 201 bp, Bos taurus; identical to SEQ ID NO: 985

SEQ ID NO: 83051 - DNA, 201 bp, Bos taurus; identical to SEQ ID NO: 986

SEQ ID NO: 83052 - DNA, 201 bp, Bos taurus; identical to SEQ ID NO: 987

SEQ ID NO: 83053 - DNA, 201 bp, Bos taurus; identical to SEQ ID NO: 988

SEQ ID NO: 83054 - DNA, 201 bp, Bos taurus
tcagaatccatgggttctgcatcctcggaggcagagagctggttgtatttcatcatagcttatactcgataaagagtggtttgcaggtggccccgggagatggaaggtgatctgagtccagcttagccttgacagagtgcatgtctccactttccctgtgggcaaggtgggggacagggccccagagaacatggcaggttt

SEQ ID NO: 83055 - DNA, 201 bp, Bos taurus; identical to SEQ ID NO: 990

SEQ ID NO: 83056 - DNA, 201 bp, Bos taurus; identical to SEQ ID NO: 991

SEQ ID NO: 83057 - DNA, 201 bp, Bos taurus; identical to SEQ ID NO: 992

SEQ ID NO: 83058 - DNA, 201 bp, Bos taurus
gtgtgccaaccagcctgggtgtgcggaggatggaggaatggccgtggacagtccagcgttccgtccactgttctgtgctgtccagcacggcatgaaaagagcagtacctgtccactgactggcctagctggccacggcatcgccttcagctgacctctgaagtaggaattggagggttgggctgtcttgtcgatcagttaa

SEQ ID NO: 83059 - DNA, 201 bp, Bos taurus
agggtccccttcgccctgtgtgtctaacgcacttcttcagtgctcagcaggcccacagggtttcttctcatgaccatttaaacctctgcctcctgacagcactgtctgtctatgttttttatgtatcgtcaacatcagagagatacttgtgagctttgcagtatgtggttcataagacaaaatgtccatgtgttcaagggg

SEQ ID NO: 83060 - DNA, 201 bp, Bos taurus; identical to SEQ ID NO: 993

SEQ ID NO: 83061 - DNA, 201 bp, Bos taurus; identical to SEQ ID NO: 994

SEQ ID NO: 83062 - DNA, 201 bp, Bos taurus; identical to SEQ ID NO: 995

SEQ ID NO: 83063 - DNA, 201 bp, Bos taurus; identical to SEQ ID NO: 996

SEQ ID NO: 83064 - DNA, 201 bp, Bos taurus
ggtcccttccctggggagtcccgccaggcccccaagtgctgccacgatgaacgtgcacagacttccaaaggcatctaggagacccaagctggggacaagctggccaagaacgcgtgaactccagggacacggagcggggccgcagaccccaggctccctgggccctgccgtaggatctgggggaatggccgggagcagaga

SEQ ID NO: 83065 - DNA, 201 bp, Bos taurus; identical to SEQ ID NO: 997

SEQ ID NO: 83066 - DNA, 201 bp, Bos taurus; identical to SEQ ID NO: 998

SEQ ID NO: 83067 - DNA, 201 bp, Bos taurus
gcactccagtgggggacagtgcactccactggggggtacattctagtgggagtgcactctggtgggggtgcactctgctggggggaagtgcactccagtgtggcctcctacccatggaagagccagcatcctcctcacatggatgaaccagaatagcaccccaaccctcacccaggggactgctggcccctaattgccatt

SEQ ID NO: 83068 - DNA, 201 bp, Bos taurus; identical to SEQ ID NO: 999

SEQ ID NO: 83069 - DNA, 201 bp, Bos taurus; identical to SEQ ID NO: 1000

SEQ ID NO: 83070 - DNA, 201 bp, Bos taurus; identical to SEQ ID NO: 1001

SEQ ID NO: 83071 - DNA, 201 bp, Bos taurus; identical to SEQ ID NO: 1002

SEQ ID NO: 83072 - DNA, 201 bp, Bos taurus; identical to SEQ ID NO: 1003

SEQ ID NO: 83073 - DNA, 201 bp, Bos taurus
tagctcagccagaacctgctggtcaagtcagtgtcagcccagtgcccagcagctgtggccctaggctgggacgcttgtgggagaggccacgccaggcagtgctggctccgggaacccagcctgcgccctgcacccctgtcctgcctcagggacgtaaccagggcccatccagggcgccggtgtcaccaaggagaagggctg

SEQ ID NO: 83074 - DNA, 201 bp, Bos taurus
taccacaacatccagcatcctcagaaatcctggcattttgggaaaatggattctgagttgtccccacagcccccgtaaggggcccttgaggctcagggccgatgagaagcgaggtaagtgctcactgccagtggactcttctctaggttcctttccaagacaggtctgaggccacaggcagcaccaacccctgggagctga

SEQ ID NO: 83075 - DNA, 201 bp, Bos taurus; identical to SEQ ID NO: 1004

SEQ ID NO: 83076 - DNA, 201 bp, Bos taurus; identical to SEQ ID NO: 1005

SEQ ID NO: 83077 - DNA, 201 bp, Bos taurus; identical to SEQ ID NO: 1006

SEQ ID NO: 83078 - DNA, 201 bp, Bos taurus; identical to SEQ ID NO: 1007

SEQ ID NO: 83079 - DNA, 201 bp, Bos taurus; identical to SEQ ID NO: 1008

SEQ ID NO: 83080 - DNA, 201 bp, Bos taurus; identical to SEQ ID NO: 1009

SEQ ID NO: 83081 - DNA, 201 bp, Bos taurus; identical to SEQ ID NO: 1010

SEQ ID NO: 83082 - DNA, 201 bp, Bos taurus; identical to SEQ ID NO: 1011

SEQ ID NO: 83083 - DNA, 201 bp, Bos taurus; identical to SEQ ID NO: 1012

SEQ ID NO: 83084 - DNA, 201 bp, Bos taurus
aggcccaccgtgctgggggagggatctgcaggtgtgcacaccctggggcagtggggaggaggtcgcgaccagggtagcatcctgggtcgcctgagatccagtgccataggccccatgtcctctttctctcctaagtcttaccctcagcctgacccaggagcagaagattcctgcccctagagagctgcttgccctgggagc

SEQ ID NO: 83085 - DNA, 201 bp, Bos taurus; identical to SEQ ID NO: 1013

SEQ ID NO: 83086 - DNA, 201 bp, Bos taurus; identical to SEQ ID NO: 1014

SEQ ID NO: 83087 - DNA, 201 bp, Bos taurus; identical to SEQ ID NO: 1015

SEQ ID NO: 83088 - DNA, 201 bp, Bos taurus; identical to SEQ ID NO: 1016

SEQ ID NO: 83089 - DNA, 201 bp, Bos taurus; identical to SEQ ID NO: 1017

SEQ ID NO: 83090 - DNA, 201 bp, Bos taurus; identical to SEQ ID NO: 1019

SEQ ID NO: 83091 - DNA, 201 bp, Bos taurus; identical to SEQ ID NO: 1020

SEQ ID NO: 83092 - DNA, 201 bp, Bos taurus; identical to SEQ ID NO: 1021

SEQ ID NO: 83093 - DNA, 201 bp, Bos taurus; identical to SEQ ID NO: 1023

SEQ ID NO: 83094 - DNA, 201 bp, Bos taurus; identical to SEQ ID NO: 1024

SEQ ID NO: 83095 - DNA, 201 bp, Bos taurus; identical to SEQ ID NO: 1025

SEQ ID NO: 83096 - DNA, 201 bp, Bos taurus; identical to SEQ ID NO: 1026

SEQ ID NO: 83097 - DNA, 201 bp, Bos taurus; identical to SEQ ID NO: 1027

SEQ ID NO: 83098 - DNA, 201 bp, Bos taurus; identical to SEQ ID NO: 1028

SEQ ID NO: 83099 - DNA, 201 bp, Bos taurus; identical to SEQ ID NO: 1029

SEQ ID NO: 83100 - DNA, 201 bp, Bos taurus; identical to SEQ ID NO: 1030

SEQ ID NO: 83101 - DNA, 201 bp, Bos taurus
tgggacctgctaccaaccaagaaaccctaggcctggattcagcactcctcctgacaccccctcctggggctgagcagacacccacagaccactcagctggtggtggaaggccaacagctcccgctccagaagaccccaaatcgtcctgacatctgaacccaaaggcaagtgcgggtggaagccatggggggccaggggcac

SEQ ID NO: 83102 - DNA, 201 bp, Bos taurus; identical to SEQ ID NO: 1031

SEQ ID NO: 83103 - DNA, 201 bp, Bos taurus; identical to SEQ ID NO: 1032

SEQ ID NO: 83104 - DNA, 201 bp, Bos taurus
acagctccgctgaggaaagggccttctctgaaccgtgactgactgcatcgtggttttcaagaaaaaaacaaaacttttatagatctcagtatgttttagtatagcctggagtgtgagcgtgctcctctcagcagctgcgtatagacgtctcagaagaaagcaaaatcttcctcaccatgaaaatcatttctgtaaatgtct

SEQ ID NO: 83105 - DNA, 201 bp, Bos taurus
ctcactcaggtcccctcgtgttccagaggttgggcctgcctccatgatcgttgggaacctggtcgccgggaagagaatcgctcaggcctcagggagggagttgtcgcacctagaggacagtgagcaggctaggaaggtaagggggttggaggggagggtgaagaggtccctgggaagccatcaggcccgaccctccccaac

SEQ ID NO: 83106 - DNA, 201 bp, Bos taurus
attggtggctacaaaagcataaaggtcataaaattccctggcttcaccaacagctggaagcagaccctgtctgcacagacagatcaagaatgaccttcaccgcacatcagacacatccatcataaccttcattctacagacagaacaggaggtgcaggtgcttgggtatggccatctccagggcagagctgtgacctgccc

SEQ ID NO: 83107 - DNA, 201 bp, Bos taurus
tttgaatccctggttgctgttcttgagccctatgtggggtgcctcatctatgaagtgacctcaatggtggcgaaaaatcgggagaaatagaggggctgtgtcaggcaaaaggtgtcaggagtatgaagaccctgaagaggggccgagctggtaaggctcctgtctttttccccactcatgcggcagtttgctgttttcttt

SEQ ID NO: 83108 - DNA, 201 bp, Bos taurus
taaagatctcctcttccatttgcaggctggctgtgatggtgagagtattagaaattgcccattttcttagcgtctctttatgattctctggctaaagggcattatatttaatgtgacaacaggggacttgaaaaggtaagaccaggtttctgcagtaatgaaataactatccccaattccctatacacacaggcacatgga

SEQ ID NO: 83109 - DNA, 201 bp, Bos taurus; identical to SEQ ID NO: 1033

SEQ ID NO: 83110 - DNA, 201 bp, Bos taurus; identical to SEQ ID NO: 1034

SEQ ID NO: 83111 - DNA, 201 bp, Bos taurus; identical to SEQ ID NO: 1035

SEQ ID NO: 83112 - DNA, 201 bp, Bos taurus; identical to SEQ ID NO: 1037

SEQ ID NO: 83113 - DNA, 201 bp, Bos taurus; identical to SEQ ID NO: 1038

SEQ ID NO: 83114 - DNA, 201 bp, Bos taurus
ggctgtgcatcagcccccagaaggaacagagtccacacatggcctgatgatagggggtggggagggaagtttgcatcacctgaggtctaattcaagagacctcatagattgtattggctccaatttttaaactagggcttcacaattttttcacagaagaaaaagcacaagcaactcattagatcaaaacattattctaga

SEQ ID NO: 83115 - DNA, 201 bp, Bos taurus
tggtctctggagctagaccagagaataggcctcaacagcttttcctttctccatgcaaatcttctcataggtctccacatctagggactacaggaccatccgtagcaagtcttaattacaaggaggcctagccttgacctcctatgggagagacatagagttagcctgagtataaagatccatccctttaagacagcaacg

SEQ ID NO: 83116 - DNA, 201 bp, Bos taurus
tactggagtgggttgccatttctttctccaggggatctttctgacccagggatcaaaccaaggtctcccacattgcaggcagacacttttccaactgagccgcctgggaagcctcatataggccattacaaagtatcaagcagagttccctgtgctgtacagcaggtccttatcagttacctatgatatatatagtagtgt

SEQ ID NO: 83117 - DNA, 201 bp, Bos taurus; identical to SEQ ID NO: 1039

SEQ ID NO: 83118 - DNA, 201 bp, Bos taurus; identical to SEQ ID NO: 1040

SEQ ID NO: 83119 - DNA, 201 bp, Bos taurus; identical to SEQ ID NO: 1041

SEQ ID NO: 83120 - DNA, 201 bp, Bos taurus
ggctgtctgcaggaggaggaagtggcctgccacagaggagtgtgtgctgatgggaggctgtctgcaggaggaggaagtggcctgccacaccgtcctcctgtgagcggaatgaggaagcagagtccactcgcgttgatgatttgaaagtcagttgtgttggccttatcacagggggcccggagcaatcagaaagcgaagagg

SEQ ID NO: 83121 - DNA, 201 bp, Bos taurus
tgagggggagctattttgctaattaaagggtaagaaactctcactcttgaggggctggagcaagtccctgggtcccttcaggactgttaaaaaagaggccctttgctctctggtcaagaaagagtgttcagtttaatccaaggcatggacgtcactcaggagttcatggcccttgcagctcaagaccggtctggcaagggc

SEQ ID NO: 83122 - DNA, 201 bp, Bos taurus; identical to SEQ ID NO: 1043

SEQ ID NO: 83123 - DNA, 201 bp, Bos taurus; identical to SEQ ID NO: 1044

SEQ ID NO: 83124 - DNA, 201 bp, Bos taurus; identical to SEQ ID NO: 1047

SEQ ID NO: 83125 - DNA, 201 bp, Bos taurus; identical to SEQ ID NO: 1050

SEQ ID NO: 83126 - DNA, 201 bp, Bos taurus; identical to SEQ ID NO: 1051

SEQ ID NO: 83127 - DNA, 201 bp, Bos taurus; identical to SEQ ID NO: 1052

SEQ ID NO: 83128 - DNA, 201 bp, Bos taurus
gtttgctggagacagaccagctcaggggcagctcggccctgctggctaactcggccagctctttggcactgagagatggggtgctggtctcgtaggtctcatggaagctgttgtagtcgacttcgtagaacccatcctccagcgtcaggacaggtgtgaatcggtacccccagaggatctcactggtgatgtaggagcttc

SEQ ID NO: 83129 - DNA, 201 bp, Bos taurus
tgagaaatcaaaaagacaggatgctggccccagagagctgagatgcctgtgaaagagatgacctcaataatccgggcctgttgcatcttcccgtacctacaagagcgctaaattccttaatgtgatatccatgaaagtgaaagtcactcagttgtgttctactctttgcaacctcattaactatatggtccatgggattct

SEQ ID NO: 83130 - DNA, 201 bp, Bos taurus; identical to SEQ ID NO: 1055

SEQ ID NO: 83131 - DNA, 201 bp, Bos taurus
taagacgctttcctttccttgggtgttgggtccatggcttggctggtgttggcacagctggaccagtgggaggggatttcacagagaactctaaatctccataagttcatctgtcttttacaaggtgtgaatttccccagccatctgaggttcactgggcggcagctgctctgtcttgaagccacagccaaccgtttcttt

SEQ ID NO: 83132 - DNA, 201 bp, Bos taurus; identical to SEQ ID NO: 1056

SEQ ID NO: 83133 - DNA, 201 bp, Bos taurus; identical to SEQ ID NO: 42670

SEQ ID NO: 83134 - DNA, 201 bp, Bos taurus; identical to SEQ ID NO: 1057

SEQ ID NO: 83135 - DNA, 201 bp, Bos taurus
cttttattgtagctgagcagatgtttcttctttattacacatttgcttatgccttcagttgtagggtctgtggtctttcttggaggaggggctacttctcgtttccaattgcctgatcagtcactggaggagtgatgggaaaacttcagataagatccacaggatgtgtgtggatgctggaggcaggggcttgggttcaca

SEQ ID NO: 83136 - DNA, 201 bp, Bos taurus; identical to SEQ ID NO: 1058

SEQ ID NO: 83137 - DNA, 201 bp, Bos taurus; identical to SEQ ID NO: 1060

SEQ ID NO: 83138 - DNA, 201 bp, Bos taurus; identical to SEQ ID NO: 1061

SEQ ID NO: 83139 - DNA, 201 bp, Bos taurus; identical to SEQ ID NO: 1063

SEQ ID NO: 83140 - DNA, 201 bp, Bos taurus
agcagagctttgacatctccagatcaaacgtgttattgcttacctggacattcattcagcacacctgcataaaaacgcctttccagaaaggttgctggccttcctgcttctgttcagagcaccaaatacccatcacgtgtgattttaggaatcagtgaggatcaacaataaaaaataaagggacccaaatgctcctctggg

SEQ ID NO: 83141 - DNA, 201 bp, Bos taurus
cattctgtcggcccaggaagaagcttggggcccccggcctagccctgggcaggctgtacggtgacaggatcggtcaggctgttgggtcttctcaaaggagggagcgtgtcacagacgcacacttcttggatttttcttttgcctttttgcagccaggaatcgcacaagagctctctttggttctgagggggaggagggggc

SEQ ID NO: 83142 - DNA, 201 bp, Bos taurus
gacaagctcttgtgctgattaggccaaggcgataagacacgtgtgggtcagttcttgcagaatcctcgaaatgtccgaaacagccttcatctgatggacgcgttagcatgggccaggcacgcaggcaggcagaggcggcacttccagtcttgaaggaggaagaatagataaggggctcttgcagataaaatctaactggca

SEQ ID NO: 83143 - DNA, 201 bp, Bos taurus; identical to SEQ ID NO: 1064

SEQ ID NO: 83144 - DNA, 201 bp, Bos taurus
ctgtctatatgcacaaaccatggccccgcgatagtgaggggacattctctcaggcctgggacacacggctgagtttaccttgcctgcactgctttctctcatccagcctcacgctctccctttgtattcgatcctttttgcagcaaatttagctgtctttgtcttcctcctccctctttgttaagaaaaagttaaattcct

SEQ ID NO: 83145 - DNA, 201 bp, Bos taurus; identical to SEQ ID NO: 1065

SEQ ID NO: 83146 - DNA, 201 bp, Bos taurus; identical to SEQ ID NO: 1066

SEQ ID NO: 83147 - DNA, 201 bp, Bos taurus; identical to SEQ ID NO: 1067

SEQ ID NO: 83148 - DNA, 201 bp, Bos taurus; identical to SEQ ID NO: 1069

SEQ ID NO: 83149 - DNA, 201 bp, Bos taurus; identical to SEQ ID NO: 1070

SEQ ID NO: 83150 - DNA, 201 bp, Bos taurus; identical to SEQ ID NO: 1071

SEQ ID NO: 83151 - DNA, 201 bp, Bos taurus; identical to SEQ ID NO: 1072

SEQ ID NO: 83152 - DNA, 201 bp, Bos taurus; identical to SEQ ID NO: 1073

SEQ ID NO: 83153 - DNA, 201 bp, Bos taurus; identical to SEQ ID NO: 1074

SEQ ID NO: 83154 - DNA, 201 bp, Bos taurus; identical to SEQ ID NO: 1075

SEQ ID NO: 83155 - DNA, 201 bp, Bos taurus; identical to SEQ ID NO: 1077

SEQ ID NO: 83156 - DNA, 201 bp, Bos taurus; identical to SEQ ID NO: 1078

SEQ ID NO: 83157 - DNA, 201 bp, Bos taurus
ggtaatgaaatgaatgagaaactttggaaatgaaagaattcctaaactccttgagctcttccaaaaaggtttccccttgcatttcaagtcctaactcccattctaagcaaaggaatgagaatggctgcatctttgggtatggggacccagcctaatgtagcccatctaagagggagatttctttaaagttttagagttcat

SEQ ID NO: 83158 - DNA, 201 bp, Bos taurus
cagaccaagatgaaagggatgagactgagatataagttaagagctgaggccccagaggtgccaatggactcaaaaaaggagactgaggtggaaaaacagaaatgaaagctgagtaggtatgactaatacaaaagggtgcaacggaagagctgggagacccctaaagaggccataggaaaagctgtcccgtgattcagaaaa

SEQ ID NO: 83159 - DNA, 201 bp, Bos taurus
gcctggcaggctatggtccatggactcgcacagagtcggacatggctgctcctggcaggtatctgttctctgctatttctggctcagctctggagcatagcggccttctgtggtcctgggaaagcagttcctcaggcccaggatgtggattcccttctgaaaagtcacaggagccccctggaaagctcaaggaatatcagg

SEQ ID NO: 83160 - DNA, 201 bp, Bos taurus
gttcctctgagtgggtcaggggtcaggctggctcacagaacctcaggaaacttgagtgactttttgacgcttcaccatgtcaagaaggcattacaagccccgttgagagagtgtctaacacaagggaactctgctcccactccatgcccaccccttcccctcaccatggcagcacacggcctgggccgttgaccagtgagc

SEQ ID NO: 83161 - DNA, 201 bp, Bos taurus; identical to SEQ ID NO: 1080

SEQ ID NO: 83162 - DNA, 201 bp, Bos taurus; identical to SEQ ID NO: 1081

SEQ ID NO: 83163 - DNA, 201 bp, Bos taurus; identical to SEQ ID NO: 1082

SEQ ID NO: 83164 - DNA, 201 bp, Bos taurus; identical to SEQ ID NO: 1083

SEQ ID NO: 83165 - DNA, 201 bp, Bos taurus; identical to SEQ ID NO: 1086

SEQ ID NO: 83166 - DNA, 201 bp, Bos taurus
ttctgggagggtggcccgatggggctgccaaggtgccactcttgattgtcccagactgtagttctgtacaccttgtcagtgacgggtagaagacagggcacgtgacacaattctggccaacaagaagtcagccagaaagacttctaggaaggtctccctcatttcttaaagaagaagaaatcaacgaggccttctgttttt

SEQ ID NO: 83167 - DNA, 201 bp, Bos taurus; identical to SEQ ID NO: 1088

SEQ ID NO: 83168 - DNA, 201 bp, Bos taurus; identical to SEQ ID NO: 1089

SEQ ID NO: 83169 - DNA, 201 bp, Bos taurus
tctctccactcatgcattcaatggaggccataaaagagggaagttccaatgttattccggatcactctgggcagaattgttaaaggtcttatttgttcaatcaggcagaagccagggagggcccagccccaggggtcattctcacgcctgagggtttctggctcagccctcgtctgttcctgcttctttgactcttgggct

SEQ ID NO: 83170 - DNA, 201 bp, Bos taurus; identical to SEQ ID NO: 1090

SEQ ID NO: 83171 - DNA, 201 bp, Bos taurus
ctaattgatttgctaatgtacacaaaagataataatttctgtctttgatcttgtatttggcatccatgctggctagcatcttcatagatctcatagtttgctggttggttctcttgcctctccatgcagacatttaaaagatctgcagataaagactgttgtgtgtcttttttcactggtgtatatcttacatgggggctc

SEQ ID NO: 83172 - DNA, 201 bp, Bos taurus
tcctgggacctgataacacgcccctggtggttctgaacctcagcgagcagtaccccaccatggagttgcaggggatcgtgcccgaggttctgaagaagatcgtgacgacgtacgacatggtgagtggctcttcggactttcagggtgccgcgggggagagaggcgtcttgggccggtgcccctggtgtgctcggggctctg

SEQ ID NO: 83173 - DNA, 201 bp, Bos taurus
tgccacggggctgtagacttcctgcagacagcggctgagtcctttcggttaccggccccagtggcgttcaagggctgcctggagggaacctcacagataacgaatgaaggcctgagcgagcacctgctttgaccttcaaacttcacagtgtttactggcattttcttagaacagtggacgttgataaatgctgtgtgactc

SEQ ID NO: 83174 - DNA, 201 bp, Bos taurus; identical to SEQ ID NO: 1091

SEQ ID NO: 83175 - DNA, 201 bp, Bos taurus; identical to SEQ ID NO: 1092

SEQ ID NO: 83176 - DNA, 201 bp, Bos taurus; identical to SEQ ID NO: 1093

SEQ ID NO: 83177 - DNA, 201 bp, Bos taurus; identical to SEQ ID NO: 1094

SEQ ID NO: 83178 - DNA, 201 bp, Bos taurus; identical to SEQ ID NO: 1095

SEQ ID NO: 83179 - DNA, 201 bp, Bos taurus; identical to SEQ ID NO: 1097

SEQ ID NO: 83180 - DNA, 201 bp, Bos taurus; identical to SEQ ID NO: 1098

SEQ ID NO: 83181 - DNA, 201 bp, Bos taurus
gccagtccagccctggcctcagccctagctgtgcacacgctcccatcgtccacccctgatagtctcgcctccagggttttctcagtgacaagaatcctgactgatctttgaaaggggccacttgctcaacctctgcactcacgcttctttttttttttttttttaagtagatttacaatgtgttaattttggatgtatagc

SEQ ID NO: 83182 - DNA, 201 bp, Bos taurus; identical to SEQ ID NO: 1100

SEQ ID NO: 83183 - DNA, 201 bp, Bos taurus; identical to SEQ ID NO: 1101

SEQ ID NO: 83184 - DNA, 201 bp, Bos taurus; identical to SEQ ID NO: 1102

SEQ ID NO: 83185 - DNA, 201 bp, Bos taurus; identical to SEQ ID NO: 1104

SEQ ID NO: 83186 - DNA, 201 bp, Bos taurus
taagccaagcaaatgttgagctgccagttaaaaatgtaccacctgccttccccttctctttaatatattctttaaagtagcatggtggaaggtatccagcgagactcagagcatgctttttaatttgaaattttgagcatccagattctagaagcaatcctcgttttggacatgtaaacaatgaaggtatttgaaggcttg

SEQ ID NO: 83187 - DNA, 201 bp, Bos taurus; identical to SEQ ID NO: 1105

SEQ ID NO: 83188 - DNA, 201 bp, Bos taurus; identical to SEQ ID NO: 1106

SEQ ID NO: 83189 - DNA, 201 bp, Bos taurus; identical to SEQ ID NO: 1107

SEQ ID NO: 83190 - DNA, 201 bp, Bos taurus; identical to SEQ ID NO: 1108

SEQ ID NO: 83191 - DNA, 201 bp, Bos taurus
gagtgaggggtaaacctcaatcagagcttttatctgggtttctgtgggaacggcgaggcagcacagcatgaatattttaggattggctagcttgggcttctccagtggcccagtggtaaagaatccgcctgcgatgtagaagacacaggaggcatgggttcaatccctgggtcgggaagatcccctggagaaggacacggc

SEQ ID NO: 83192 - DNA, 201 bp, Bos taurus; identical to SEQ ID NO: 1110

SEQ ID NO: 83193 - DNA, 201 bp, Bos taurus; identical to SEQ ID NO: 1111

SEQ ID NO: 83194 - DNA, 201 bp, Bos taurus; identical to SEQ ID NO: 1113

SEQ ID NO: 83195 - DNA, 201 bp, Bos taurus; identical to SEQ ID NO: 1114

SEQ ID NO: 83196 - DNA, 201 bp, Bos taurus; identical to SEQ ID NO: 1115

SEQ ID NO: 83197 - DNA, 201 bp, Bos taurus; identical to SEQ ID NO: 1116

SEQ ID NO: 83198 - DNA, 201 bp, Bos taurus; identical to SEQ ID NO: 1117

SEQ ID NO: 83199 - DNA, 201 bp, Bos taurus; identical to SEQ ID NO: 1118

SEQ ID NO: 83200 - DNA, 201 bp, Bos taurus; identical to SEQ ID NO: 1119

SEQ ID NO: 83201 - DNA, 201 bp, Bos taurus; identical to SEQ ID NO: 1120

SEQ ID NO: 83202 - DNA, 201 bp, Bos taurus; identical to SEQ ID NO: 1121

SEQ ID NO: 83203 - DNA, 201 bp, Bos taurus; identical to SEQ ID NO: 1122

SEQ ID NO: 83204 - DNA, 201 bp, Bos taurus; identical to SEQ ID NO: 1123

SEQ ID NO: 83205 - DNA, 201 bp, Bos taurus; identical to SEQ ID NO: 1125

SEQ ID NO: 83206 - DNA, 201 bp, Bos taurus; identical to SEQ ID NO: 1127

SEQ ID NO: 83207 - DNA, 201 bp, Bos taurus; identical to SEQ ID NO: 1128

SEQ ID NO: 83208 - DNA, 201 bp, Bos taurus; identical to SEQ ID NO: 1134

SEQ ID NO: 83209 - DNA, 201 bp, Bos taurus; identical to SEQ ID NO: 1135

SEQ ID NO: 83210 - DNA, 201 bp, Bos taurus; identical to SEQ ID NO: 1136

SEQ ID NO: 83211 - DNA, 201 bp, Bos taurus; identical to SEQ ID NO: 1137

SEQ ID NO: 83212 - DNA, 201 bp, Bos taurus; identical to SEQ ID NO: 1138

SEQ ID NO: 83213 - DNA, 201 bp, Bos taurus; identical to SEQ ID NO: 1140

SEQ ID NO: 83214 - DNA, 201 bp, Bos taurus; identical to SEQ ID NO: 1141

SEQ ID NO: 83215 - DNA, 201 bp, Bos taurus; identical to SEQ ID NO: 1143

SEQ ID NO: 83216 - DNA, 201 bp, Bos taurus; identical to SEQ ID NO: 1144

SEQ ID NO: 83217 - DNA, 201 bp, Bos taurus; identical to SEQ ID NO: 1145

SEQ ID NO: 83218 - DNA, 201 bp, Bos taurus; identical to SEQ ID NO: 1146

SEQ ID NO: 83219 - DNA, 201 bp, Bos taurus; identical to SEQ ID NO: 1147

SEQ ID NO: 83220 - DNA, 201 bp, Bos taurus; identical to SEQ ID NO: 1148

SEQ ID NO: 83221 - DNA, 201 bp, Bos taurus; identical to SEQ ID NO: 1149

SEQ ID NO: 83222 - DNA, 201 bp, Bos taurus; identical to SEQ ID NO: 1150

SEQ ID NO: 83223 - DNA, 201 bp, Bos taurus; identical to SEQ ID NO: 1152

SEQ ID NO: 83224 - DNA, 201 bp, Bos taurus; identical to SEQ ID NO: 1154

SEQ ID NO: 83225 - DNA, 201 bp, Bos taurus; identical to SEQ ID NO: 1155

SEQ ID NO: 83226 - DNA, 201 bp, Bos taurus; identical to SEQ ID NO: 1156

SEQ ID NO: 83227 - DNA, 201 bp, Bos taurus; identical to SEQ ID NO: 1159

SEQ ID NO: 83228 - DNA, 201 bp, Bos taurus; identical to SEQ ID NO: 1162

SEQ ID NO: 83229 - DNA, 201 bp, Bos taurus; identical to SEQ ID NO: 1163

SEQ ID NO: 83230 - DNA, 201 bp, Bos taurus; identical to SEQ ID NO: 1166

SEQ ID NO: 83231 - DNA, 201 bp, Bos taurus; identical to SEQ ID NO: 1167

SEQ ID NO: 83232 - DNA, 201 bp, Bos taurus; identical to SEQ ID NO: 1168

SEQ ID NO: 83233 - DNA, 201 bp, Bos taurus; identical to SEQ ID NO: 1169

SEQ ID NO: 83234 - DNA, 201 bp, Bos taurus; identical to SEQ ID NO: 1170

SEQ ID NO: 83235 - DNA, 201 bp, Bos taurus; identical to SEQ ID NO: 1173

SEQ ID NO: 83236 - DNA, 201 bp, Bos taurus; identical to SEQ ID NO: 1176

SEQ ID NO: 83237 - DNA, 201 bp, Bos taurus; identical to SEQ ID NO: 1178

SEQ ID NO: 83238 - DNA, 201 bp, Bos taurus; identical to SEQ ID NO: 1180

SEQ ID NO: 83239 - DNA, 201 bp, Bos taurus
caatttcagtgtcatgtggagttgagagtactgggagctgttacaccccaagctagggagcattctggaatgactaggccagctctactaaacgaggaagaaaagcctttggtctttcagcccttgtactcggcactcgttaacagatgaagctggaagacgtcactatcttcagggcctccaaagttttcattatctttt

SEQ ID NO: 83240 - DNA, 201 bp, Bos taurus
tccacagaaattgtgattatcccagaaacagtgaccactaccatgctaaattaatagttctcagtcctcatcttacttgacgtctcaaggcttgaccacttgaaaccctttctcctctccaatgcctggacaccacacttcttgccaattccaccctcatttaactggagctcctttgagatctcctttgcatacatttta

SEQ ID NO: 83241 - DNA, 201 bp, Bos taurus; identical to SEQ ID NO: 1182

SEQ ID NO: 83242 - DNA, 201 bp, Bos taurus; identical to SEQ ID NO: 1186

SEQ ID NO: 83243 - DNA, 201 bp, Bos taurus; identical to SEQ ID NO: 1188

SEQ ID NO: 83244 - DNA, 201 bp, Bos taurus; identical to SEQ ID NO: 1189

SEQ ID NO: 83245 - DNA, 201 bp, Bos taurus; identical to SEQ ID NO: 1190

SEQ ID NO: 83246 - DNA, 201 bp, Bos taurus; identical to SEQ ID NO: 1192

SEQ ID NO: 83247 - DNA, 201 bp, Bos taurus; identical to SEQ ID NO: 1193

SEQ ID NO: 83248 - DNA, 201 bp, Bos taurus; identical to SEQ ID NO: 1194

SEQ ID NO: 83249 - DNA, 201 bp, Bos taurus; identical to SEQ ID NO: 1196

SEQ ID NO: 83250 - DNA, 201 bp, Bos taurus; identical to SEQ ID NO: 1197

SEQ ID NO: 83251 - DNA, 201 bp, Bos taurus; identical to SEQ ID NO: 1199

SEQ ID NO: 83252 - DNA, 201 bp, Bos taurus; identical to SEQ ID NO: 1200

SEQ ID NO: 83253 - DNA, 201 bp, Bos taurus
atgatatcataaacctgaaaagctcctatgttaagaagattgagtcagacccatgatgtaacacccgagtatctattcattcactaatttattcactcattgttttttgaccatctgatatatgctaccacgatggcattccactccagtactcttgcctggaaaatcccatggaaggaggagcctggtaggctgcagtcc

SEQ ID NO: 83254 - DNA, 201 bp, Bos taurus
attaattttaagaaacaaaggaagaggatgaaaagaaacctctaagccttttaaactatgagatgtagtgttaaggcctgtggtggcctctcacctatttgaatggtgggagcccatctgtggagctcacaaaaggagccctacacagtaggatgcaaagctaagtaagtaggagaagagaggcctgaattcattttctct

SEQ ID NO: 83255 - DNA, 201 bp, Bos taurus; identical to SEQ ID NO: 1202

SEQ ID NO: 83256 - DNA, 201 bp, Bos taurus
attagttaatggcttctatttcttcaatggttgcttttatttaagttcagggaatttaatttttttttttttttttaacattttctgttttaggccttacgttcagccaggtatgaacaattcactggggacctttctgatttttcctgagcaggctcaaccttatgcctctgtatatccttccaaaccaccaaggaccag

SEQ ID NO: 83257 - DNA, 201 bp, Bos taurus
ggtgccaatgcttatctccaactctactttgcaggagctctatccctagtaaatgtggctaagatgactgtggttcccttaacccaccttaaagcgctcatagggccagtgaaagtgaagtcgctcagtcatttctgactcttcgtgacccgatggactgtagcctaccaggctcctctgtccatgggattttccaggtaa

SEQ ID NO: 83258 - DNA, 201 bp, Bos taurus
ggcctacagaatgccatttccatcattatggtactccacgtttatgatcattgctctcactaagaaactctcttcacagcaaagaaagaaaaagtgtggaagtgggcccatgctcatagaattcagtggtcttatcatgttccccactgttttgaagtagcttgtttgaaagaagggaggaatgacctttagaaggctcag

SEQ ID NO: 83259 - DNA, 201 bp, Bos taurus
gtgtgagggccaggctcagtaaatctttaattttctggagatggatggggctgtgttctctccctgtagttttgcctgaggccactatagtaggggttattggggtaatggtgtcctccttcaaaaggacttatgctagcacactgtggctcccaatactgttacagtcagcacccctgatcctatggcaggccactgttg

SEQ ID NO: 83260 - DNA, 201 bp, Bos taurus; identical to SEQ ID NO: 1207

SEQ ID NO: 83261 - DNA, 201 bp, Bos taurus
cacctaggacaagccttccaaaagtccatgaacctgaagcttcagggcacacacagcaggagagagaccatcgcaggtctaaagcagatctagctagcttagaataaatcctctgacaaagcagactattgaaagagccgttcagcattctaccagctctagaaagctcagcaggaaaagaaaaaagtgctgaaaaaggta

SEQ ID NO: 83262 - DNA, 201 bp, Bos taurus; identical to SEQ ID NO: 1209

SEQ ID NO: 83263 - DNA, 201 bp, Bos taurus
atacacacatggccaagaaccaagaaatagctctccaccttgcaggtgcttggcaataaccctcaggactaaaattccctttaacagagatcaatactttagtaacttgcagaatcctgaacttgattttatgccactggcttctccttacccagcactgttactaaaccagcactgaggaaggaattttcccctctattc

SEQ ID NO: 83264 - DNA, 201 bp, Bos taurus; identical to SEQ ID NO: 1210

SEQ ID NO: 83265 - DNA, 201 bp, Bos taurus
aaagcttatcaagttatctggccctcaaaacttagctcaggaaaccagatttactgagacatattcacatacatcagaagcactaaacaggattttttaacgcagtattaaaaatatggcccatttagaaagaaaatatatatacatatatagttacagcaatgttgttcttgttgttcagtcgctaagtcttgtcccact

SEQ ID NO: 83266 - DNA, 201 bp, Bos taurus
tcatgtcaccaccaccagtcaagataaagaacatttccaacatttaaaaattttcttgtgcacgtttgcagttgattccctctctagatcctcaacaacccgttgtctgcttttttgtcacttttgccttgaaaaaaaatttttttttcatgtgaatgaaatcatccttgtttttcatttgttttagttagcatgtttttg

SEQ ID NO: 83267 - DNA, 201 bp, Bos taurus
gactggtgtgaggtgatacctcattgtcgttttgatttgtattctctaaaaatgagtcacgttgagcatctgttaatcttagtatatacaagacatacagatggtttattggccatctgtatgtcagagaaaagtctgttaaggtcttctgcccattttttgattgggctgtttgtttttctgatattgagctgtatgagc

SEQ ID NO: 83268 - DNA, 201 bp, Bos taurus; identical to SEQ ID NO: 1211

SEQ ID NO: 83269 - DNA, 201 bp, Bos taurus
atctgtaactacaaggtttaaatccagaaccctgattgtgacagagaggggctagtgttttcccagtcaaatccccacagcacccaggccgggatgctctttctgagtctagagtctgcccttccagatgcctggggtcccagcccaggatgagctaggcagtggaggagctgcccacctactgcttcttttgtaggaatt

SEQ ID NO: 83270 - DNA, 201 bp, Bos taurus; identical to SEQ ID NO: 1213

SEQ ID NO: 83271 - DNA, 201 bp, Bos taurus; identical to SEQ ID NO: 1215

SEQ ID NO: 83272 - DNA, 201 bp, Bos taurus
taagttctttgtatccataatctgtatcagctatgcccatcctcttctatcacctagcttgtaggtcatcaataaatatttcttgtactttttctcatactaccagctaagggcttcaacgtactcgaggtagtatgtgccaggcgattgcaatgccttcattctttcttccacaggagaacagcagattcctatactgtg

SEQ ID NO: 83273 - DNA, 201 bp, Bos taurus; identical to SEQ ID NO: 1218

SEQ ID NO: 83274 - DNA, 201 bp, Bos taurus; identical to SEQ ID NO: 1219

SEQ ID NO: 83275 - DNA, 201 bp, Bos taurus
aaacatcacagagtgatgtgagtgggttaaaaaaaagtgataaatacttctcagtaagactatgtattcaatgtatggtggccataagtagaaacttggcttcgttctaagaaatgactgtttattaccaattcttaaattccaagaaaaggatattgaaaaactgaattttaatcaaggaaactgtctcagagacactta

SEQ ID NO: 83276 - DNA, 201 bp, Bos taurus; identical to SEQ ID NO: 1222

SEQ ID NO: 83277 - DNA, 201 bp, Bos taurus
aaaagaagatcaaatataccaacttgtacaggtctggtcgatggagatgccatccatctgcagtgttgagtgacctaatggaggacaggccatgatctcatatgggctcaaaaatgaatatgtaagataagcaaagaataagctttagctgtgttaaggccatgggatttcagagtaaattttcattgcagcatagcatag

SEQ ID NO: 83278 - DNA, 201 bp, Bos taurus
aggaagaggactgggcagagagaactttgaagattttgcccagatatggcaaaatcttggtcagcacactagggcactgcagagcaaacactgcttgtgaaaggagccctgcattggcagaaatggccaggctccagtacccctgcagagctagatcactaggtgctacctgggaaagacatggccttccttataagcgca

SEQ ID NO: 83279 - DNA, 201 bp, Bos taurus; identical to SEQ ID NO: 1223

SEQ ID NO: 83280 - DNA, 201 bp, Bos taurus
tttttaaattaaatatttcagacacagagaagaaaagcataataaatgcctgtttacccatcatccagatttatcaaactagtaacatgtgcagcattttaatgcaccattccttaagtcattacccagatatttcaagcctcctttgtaaccacccctaattccattcctttctcttttccccatgtttgtcacttcttc

SEQ ID NO: 83281 - DNA, 201 bp, Bos taurus; identical to SEQ ID NO: 1224

SEQ ID NO: 83282 - DNA, 201 bp, Bos taurus; identical to SEQ ID NO: 1225

SEQ ID NO: 83283 - DNA, 201 bp, Bos taurus; identical to SEQ ID NO: 1226

SEQ ID NO: 83284 - DNA, 201 bp, Bos taurus; identical to SEQ ID NO: 1227

SEQ ID NO: 83285 - DNA, 201 bp, Bos taurus; identical to SEQ ID NO: 1228

SEQ ID NO: 83286 - DNA, 201 bp, Bos taurus; identical to SEQ ID NO: 1229

SEQ ID NO: 83287 - DNA, 201 bp, Bos taurus
ggcttaatcgtcttgcctcattcataggttctctggctcttgtccttgttgctttcattccttaattaaggagattcccagataatgaagtcaggttaatcgtgttgctatttaacaatgtctcagtttcacttgaagatttgcccaggatttagaagctgttgacacctcagatacagtactgaggacagcaaagtgcta

SEQ ID NO: 83288 - DNA, 201 bp, Bos taurus; identical to SEQ ID NO: 1230

SEQ ID NO: 83289 - DNA, 201 bp, Bos taurus; identical to SEQ ID NO: 1231

SEQ ID NO: 83290 - DNA, 201 bp, Bos taurus; identical to SEQ ID NO: 1232

SEQ ID NO: 83291 - DNA, 201 bp, Bos taurus; identical to SEQ ID NO: 1233

SEQ ID NO: 83292 - DNA, 201 bp, Bos taurus; identical to SEQ ID NO: 1234

SEQ ID NO: 83293 - DNA, 201 bp, Bos taurus
cccttctgaaatttataatctagtagaggaagactggtaacatacaagtaacattaaaaatcaaatatggagcaacaatatagacccagatgccttggagggtctagtatatgcttgctgtcatcaagttccatacaattttacatatttataaatttttatttttgtgtattttcaattttaaccagtttgagaaataat

SEQ ID NO: 83294 - DNA, 201 bp, Bos taurus; identical to SEQ ID NO: 1235

SEQ ID NO: 83295 - DNA, 201 bp, Bos taurus
tctagctgagcctacattgggtaaacagggtcacccaaaattactcttaggctggaaagtgaatcgaatattggccactgagatgggttctgtggcctcagttcaatctttatcctacgaacatgatcataatgcagcaattgtacctctggaaacctgacactgatggatgcttttggtgaagtgctttggtactaaggc

SEQ ID NO: 83296 - DNA, 201 bp, Bos taurus; identical to SEQ ID NO: 1236

SEQ ID NO: 83297 - DNA, 201 bp, Bos taurus; identical to SEQ ID NO: 1237

SEQ ID NO: 83298 - DNA, 201 bp, Bos taurus; identical to SEQ ID NO: 1238

SEQ ID NO: 83299 - DNA, 201 bp, Bos taurus; identical to SEQ ID NO: 1239

SEQ ID NO: 83300 - DNA, 201 bp, Bos taurus
aatgactgcctaaaagtcacttacacttacacaaaagtcagtgtacagaggagaggcctgggggacacatgccagaagggtggttatccctgggagagcagggggtttcaaggcaaaccttcactttattcacactgtctaaatgattactttatatacagtcacagtaactgaatatatttaaataaagtaaatatattc

SEQ ID NO: 83301 - DNA, 201 bp, Bos taurus; identical to SEQ ID NO: 1240

SEQ ID NO: 83302 - DNA, 201 bp, Bos taurus; identical to SEQ ID NO: 1241

SEQ ID NO: 83303 - DNA, 201 bp, Bos taurus; identical to SEQ ID NO: 1242

SEQ ID NO: 83304 - DNA, 201 bp, Bos taurus; identical to SEQ ID NO: 1243

SEQ ID NO: 83305 - DNA, 201 bp, Bos taurus
gcgctgacaatctcattttacagttgagaaaactgaagttcagagacttccaaaatcaaacattcagtcagtgttcgtcttcaaagctagacactttgccgcacccctgaaatggaaacgacattgtgaatcagctatactccgataaaaagtaaaaactaggactagaacgtgggtcctgatttccaaataactgatttt

SEQ ID NO: 83306 - DNA, 201 bp, Bos taurus; identical to SEQ ID NO: 1244

SEQ ID NO: 83307 - DNA, 201 bp, Bos taurus; identical to SEQ ID NO: 1245

SEQ ID NO: 83308 - DNA, 201 bp, Bos taurus
atgtatcagaactgacaccacagatgaaaccatgcaatatttaaggctactggtaaactggttagtcctgttggaaatgatatacaggcttacagctaggggtctacattgtaaacaagaactcttttaacaaaagaattatctcttggttttaaagaatgaaacaaatacataatgcaagatagatatctccttccagtt

SEQ ID NO: 83309 - DNA, 201 bp, Bos taurus; identical to SEQ ID NO: 1246

SEQ ID NO: 83310 - DNA, 201 bp, Bos taurus; identical to SEQ ID NO: 1247

SEQ ID NO: 83311 - DNA, 201 bp, Bos taurus; identical to SEQ ID NO: 1248

SEQ ID NO: 83312 - DNA, 201 bp, Bos taurus; identical to SEQ ID NO: 1249

SEQ ID NO: 83313 - DNA, 201 bp, Bos taurus
ggcaaaaattctgactttgctgcaggttggaggaggagcaaagtgggagctgggtaggaaagagagtcaggcaaagtagtgcagcgacagccacgcctccacctcaggtacccggccccgcctctgtggggctcctacctacttcatggctccaggtctctcccttctcctcccacctaaccttgctgttaggaaggtgcc

SEQ ID NO: 83314 - DNA, 201 bp, Bos taurus
atttagccataaaaaggaatgaagagctgacacatgctacaacgtgaatgactcttaaaaacattgtgctaactgaaggaagtcagatatagaaggccacatattctatgcttctgtatataggaaatgttcagaataggcaaatagtaacataggaacagaaaagagattagtgatttccagggccttgtgggagaacgg

SEQ ID NO: 83315 - DNA, 201 bp, Bos taurus
gaggggagtagcagagcatacaggggatgtctggcttgcggtaccttaggagaagtcttcaaactgttatccatcatcattactactagtagtggagtacgagtcctaatatcactactactactgcagtagtagtaatgcctggagaaatataaacatcctttaaaggcttccctgatagctcagttggtaaggagtcta

SEQ ID NO: 83316 - DNA, 201 bp, Bos taurus
ctacacagaaatgagatcacagcttttgcaggtcgggaagtctgtcttgcagccagcctttcctcctttacatacaagaaagtttggaggttgatttacttgttttcttttatgagatctttctacttagacacacatatataaatatttgtaagggcaaggcaatcctgtgaacagagacaatccagcctcaacatctct

SEQ ID NO: 83317 - DNA, 201 bp, Bos taurus; identical to SEQ ID NO: 1250

SEQ ID NO: 83318 - DNA, 201 bp, Bos taurus; identical to SEQ ID NO: 1251

SEQ ID NO: 83319 - DNA, 201 bp, Bos taurus; identical to SEQ ID NO: 1252

SEQ ID NO: 83320 - DNA, 201 bp, Bos taurus; identical to SEQ ID NO: 1253

SEQ ID NO: 83321 - DNA, 201 bp, Bos taurus
ttatcctgggtgggcctaacttactaacaaacaaagctcaggctctgcaagcagctgcgcctgctctcttctcctggagccccttcagggctatctacattgtggccttagcatctggttggccaacctccacaagaacatatgcctgtgtgtgtgtctatgtgtctgtctgtctgtgtgtgtttgtatgtgtgtctccct

SEQ ID NO: 83322 - DNA, 201 bp, Bos taurus
aacttagatatttactcactaaccaccctgtactccttgttaattcttgctttgttcataattttattctcatctagaatgtccttcttccttctctattcctttccaacccctgcccatttttaaagtttctgtttaaacctttcatcttgaaaagttctctcatctaccccttggaaatatcttgcccttttgagcatt

SEQ ID NO: 83323 - DNA, 201 bp, Bos taurus; identical to SEQ ID NO: 1255

SEQ ID NO: 83324 - DNA, 201 bp, Bos taurus; identical to SEQ ID NO: 1256

SEQ ID NO: 83325 - DNA, 201 bp, Bos taurus
gggaagaaaacaagtattgactaaaaggaaatttgaagggtctgcatggattgtctctccatgtattttgttagcacatataattgatagcaatattaagtcattaaaaatattatttacttcctggtttgcattattagctcacatgtatttcattaacacacatgagcaagagtgatacatagcaacaagtgagctttc

SEQ ID NO: 83326 - DNA, 201 bp, Bos taurus
cttctccaggggattttcccaacctaggaatcgaaccaggttctcctgcattgcaggtagattttttaccaactgagctatgaaggaagcccaattttatgggcaaggaaactgaaatctacggaggtgaagtgactcacctaaggtcaggtagttagcaacaaacctatttggggtttgttaacctaacccaaaccctct

SEQ ID NO: 83327 - DNA, 201 bp, Bos taurus
gaactcatctttaccatgtagttcttcatcactacccttttattattaacacttcgccctccaaacatgaatctgattatttttagtgaaattcattcaaaattagtaccagtaaactattttctctattatcaaaatattttatttttgactttaaaaaaaacatattttatgtttctttcatctctctatcaggattgt

SEQ ID NO: 83328 - DNA, 201 bp, Bos taurus; identical to SEQ ID NO: 1257

SEQ ID NO: 83329 - DNA, 201 bp, Bos taurus; identical to SEQ ID NO: 1258

SEQ ID NO: 83330 - DNA, 201 bp, Bos taurus; identical to SEQ ID NO: 1259

SEQ ID NO: 83331 - DNA, 201 bp, Bos taurus; identical to SEQ ID NO: 1260

SEQ ID NO: 83332 - DNA, 201 bp, Bos taurus; identical to SEQ ID NO: 1261

SEQ ID NO: 83333 - DNA, 201 bp, Bos taurus; identical to SEQ ID NO: 1262

SEQ ID NO: 83334 - DNA, 201 bp, Bos taurus; identical to SEQ ID NO: 1263

SEQ ID NO: 83335 - DNA, 201 bp, Bos taurus; identical to SEQ ID NO: 1264

SEQ ID NO: 83336 - DNA, 201 bp, Bos taurus
cagacagttttcaactaagtggtctggtgatgaattagaagagatgagaaccagggagaggggattatttcagcatcatccactgagttggtgataggagggtgagctgtgtcctcctagctctgagttcccagatcgtttgcaaagtagtgagagttctgccattgtgtgagaccataatccgaggtctaattgggctaa

SEQ ID NO: 83337 - DNA, 201 bp, Bos taurus; identical to SEQ ID NO: 1265

SEQ ID NO: 83338 - DNA, 201 bp, Bos taurus
tttaaaacttatgtattcatttgctcactgtttactcagcaaataggtattatttgcctaatatgtgttagactctggatatacaatagttcaaaaagtcacatggagttttcagacaataattttagtctaccgctaatatgaattcagttcattttatcatttttttctttcttttcctagaacaatcttcatagaaga

SEQ ID NO: 83339 - DNA, 201 bp, Bos taurus
ttaaatgaagcttagctctcatctggcatttaaccaaatgaagattaaatgccaacaaaagatcagagaggatgagaacccaagatcgaattaataacatttaactttcccggtttttggtacctcaaccccaaaactgggaaatagaaccagtgagagaatgaattcaataaaattaggggaattaaggtaaatgaaaat

SEQ ID NO: 83340 - DNA, 201 bp, Bos taurus
atactctaggaaaattcctgggatctactgttttctacaaaattgcactggctctcaccaaatgtacatatagtttaggggttttgtttgtctttaagcacattaaaccatagatatttgctacctgtgttactcttctaaaaaaacaaatttcctatgtaatatttataatcaaaaagtaactcatctgaataagaaaat

SEQ ID NO: 83341 - DNA, 201 bp, Bos taurus; identical to SEQ ID NO: 1266

SEQ ID NO: 83342 - DNA, 201 bp, Bos taurus; identical to SEQ ID NO: 1267

SEQ ID NO: 83343 - DNA, 201 bp, Bos taurus; identical to SEQ ID NO: 1268

SEQ ID NO: 83344 - DNA, 201 bp, Bos taurus; identical to SEQ ID NO: 1269

SEQ ID NO: 83345 - DNA, 201 bp, Bos taurus; identical to SEQ ID NO: 1270

SEQ ID NO: 83346 - DNA, 201 bp, Bos taurus; identical to SEQ ID NO: 1271

SEQ ID NO: 83347 - DNA, 201 bp, Bos taurus; identical to SEQ ID NO: 1272

SEQ ID NO: 83348 - DNA, 201 bp, Bos taurus; identical to SEQ ID NO: 1273

SEQ ID NO: 83349 - DNA, 201 bp, Bos taurus
ctttgaatgaattaacgagtaatcagtcttcaatccacttatatttgaaaatagccaagtcatttatgacatattataccaagaaataaatataatgtgcagtgtccaataccatgtggatagtcaagtgtatctcaccaagtcaaatattttgtgtttttgtctggctcttagtaaagaggtacacaatttttaaaagtc

SEQ ID NO: 83350 - DNA, 201 bp, Bos taurus; identical to SEQ ID NO: 1274

SEQ ID NO: 83351 - DNA, 201 bp, Bos taurus
taggaaagattctagtagataagacagcagatgctagttaaatcaggccccagacagggggaaaaaaaaatgctaagcaagactgctatagggggtcctggaactagggaagcttcttcagggccttttctctgtgggtgataatcttttcacttccccacattctttcctccttagcatttattgaggataggaggagga

SEQ ID NO: 83352 - DNA, 201 bp, Bos taurus
gctcatattatgcaacagtaccacttttgttagaaaatctgaaagaacagattatttatgcttcgaattaaaagtattatagaatttactgggagttaatatatgcacaatggatggctccttacgtttaaccctaattctgctgaagacattgctttctgctcacacaggtacacgtgatttgagagcacccatctctgg

SEQ ID NO: 83353 - DNA, 201 bp, Bos taurus; identical to SEQ ID NO: 1276

SEQ ID NO: 83354 - DNA, 201 bp, Bos taurus; identical to SEQ ID NO: 1277

SEQ ID NO: 83355 - DNA, 201 bp, Bos taurus
ctccctccctgctcccttaagtaggcactcctgccctcaacagtttatgtctttccttctattgccccttgagacctttgcccaccttgttcttaaaggttggccagactgctctctcctttcttctttctgccccttctgacttgactctgcccccatcctgtcagatacaggacctcagtcaattactcccagcttacc

SEQ ID NO: 83356 - DNA, 201 bp, Bos taurus; identical to SEQ ID NO: 1278

SEQ ID NO: 83357 - DNA, 201 bp, Bos taurus; identical to SEQ ID NO: 1279

SEQ ID NO: 83358 - DNA, 201 bp, Bos taurus; identical to SEQ ID NO: 1280

SEQ ID NO: 83359 - DNA, 201 bp, Bos taurus; identical to SEQ ID NO: 1281

SEQ ID NO: 83360 - DNA, 201 bp, Bos taurus; identical to SEQ ID NO: 1282

SEQ ID NO: 83361 - DNA, 201 bp, Bos taurus; identical to SEQ ID NO: 1283

SEQ ID NO: 83362 - DNA, 201 bp, Bos taurus; identical to SEQ ID NO: 1285

SEQ ID NO: 83363 - DNA, 201 bp, Bos taurus; identical to SEQ ID NO: 1286

SEQ ID NO: 83364 - DNA, 201 bp, Bos taurus; identical to SEQ ID NO: 1287

SEQ ID NO: 83365 - DNA, 201 bp, Bos taurus
aggaagattatcttgcttctttgttccctgttttgttttataagtgaaaggtgtggttgtgaaatccttcttgagtgtcctgccgctgatgaatctcagcgtggccccagggagctggggcacaggaaacggctgacaaggccttttgatgatcagttcccctactgttccctaactggttgcctggcctcctctgcttca

SEQ ID NO: 83366 - DNA, 201 bp, Bos taurus
tttatgttttaaatgagatactgtaccctcattttggctattttgcttactttctatctaacagatctaacatttctcatttaacatatctaattatatagctcccaaaagacagacatttcagtactttgaacacattagtaaaataatattttctggaaattatagaatcctatagtattagctttctccatactggta

SEQ ID NO: 83367 - DNA, 201 bp, Bos taurus
acagaaaagcagagaaagcaacactgcagaatgagcaacggatgaaacagagacacacaaagcagagacaagaggccatgggcctccatgaagaacatagtttgtttagttcccgattctttttggattcctggttcttcttttgcatgaggcccatctgtccttcctaactttgagacttttcagatacccatggtagtg

SEQ ID NO: 83368 - DNA, 201 bp, Bos taurus; identical to SEQ ID NO: 1289

SEQ ID NO: 83369 - DNA, 201 bp, Bos taurus
caggatgtagctcaggataaaggacacttcaagtaggcatctctggccagcttcagttctgactcaggagaacggcactgtccttacaatttcttcctgcgatggacatggaggtaaatttggaaggccttagggagtgcttcttgttagaggattcatgagggtcccaagggcagaactaggtttgatggagcttgaaaa

SEQ ID NO: 83370 - DNA, 201 bp, Bos taurus; identical to SEQ ID NO: 1290

SEQ ID NO: 83371 - DNA, 201 bp, Bos taurus
agctttctgggaaagtgatagagttgaacttgtaggttgaaccacagaagacagaaattggccaggaaggactgaataagcccagggcacagacaggccttggtgtacgcctgtcatgaacagcctgctggggacaaaagaaatgtggtggggagagaggctatgggagaagctggaggaaaatcataaagcagagctgct

SEQ ID NO: 83372 - DNA, 201 bp, Bos taurus
tcatatcatttatctactcaaaagtatctggtggtttctctgctcactcagagagaaagctaaggtccttaagctgtggtaagatgctctgcagtctgcacggtccctgacctgtaagctctctgacctcatctcctatcacacgtcccctggcttaatctgctccggttctgctgcctttcttgctgttcccagtcaggt

SEQ ID NO: 83373 - DNA, 201 bp, Bos taurus
ttcccagcttgcatgttttgatgaaggaagtggccatgttggagggactcatgtattaagaaaccgtgggtcgtctccagaatatagccaacaaagaaccgaggccctcagtccaacaccccacagagaactgagtcctgccagtagtcacttaagtctggcagtgtatcattccctgggccagccttcagatgaggccct

SEQ ID NO: 83374 - DNA, 201 bp, Bos taurus
agagatttacaactttactgggttttcacagaaatgacttcatataacataatgaatattatttccctttagtaaacatggccatgggtttcatagggctgtttcatatatcaataacatgtttaatcccaactgatatcttgtatcaaagaaccatcaagtaaaaacattctccctgggtggccaaggaaacacagagtt

SEQ ID NO: 83375 - DNA, 201 bp, Bos taurus; identical to SEQ ID NO: 1292

SEQ ID NO: 83376 - DNA, 201 bp, Bos taurus; identical to SEQ ID NO: 1297

SEQ ID NO: 83377 - DNA, 201 bp, Bos taurus
tgacatttcataggtccaaaaaaattaaaaatgaacacatctgaaattggacaccctagtaggtctttgataggggtagcagtagtggtagtctctcaattgggtccaactctttgactccacaggctgttgcccaccaggctcctctgtccatgggattctccaggcaagaatactggagtagatttccattcctttctc

SEQ ID NO: 83378 - DNA, 201 bp, Bos taurus
cacatgagaatatctttaagtattttccacctaacatttctctgaagaattcccagattccaggacgtgatttgaagtttttcagaaaatgttatggtttctcaggacaatgatactctttcatccaatagaagtttgattgtgcccttaataggatcaggttttatgacaattacatctttgggtacagtttatatgctt

SEQ ID NO: 83379 - DNA, 201 bp, Bos taurus
tagcatctgtgtgaatctgagtgcagtgtgtgatggtgtctctgactgccccggtgggacagatgagtccccactttgcagtaagtctcctgaccacagtgtactggccatgaactcatcctgagcaggggccagctgcgtgtcgtcattgtcacaatcaccatgtagttgttgaggaaggaatctcagttctctgaattt

SEQ ID NO: 83380 - DNA, 201 bp, Bos taurus
atctggagtgcgtttcaaaatggaacagataaaaaactagtaagtacataagtacatatctactggcctttgatctgactagttccccagtctcaggtctgtttgctgttaatcaccagtgagagaaggtcctaccctatcttaagtggttctcatgtctccctctgggccatccatacttaaaagccctggatgttccta

SEQ ID NO: 83381 - DNA, 201 bp, Bos taurus
tgtttgttttttcctttgtggattcaaatatcttcatccatgaggatatttcaaacttcattcagggaaataaaataaaaagtcttctagttcagaatgcgcctatctttgcagaatctaatgcagaatgaggtccaatgactccctattctaccacaactacctaagacacatttgctcagatcgccagactattttctt

SEQ ID NO: 83382 - DNA, 201 bp, Bos taurus; identical to SEQ ID NO: 1299

SEQ ID NO: 83383 - DNA, 201 bp, Bos taurus; identical to SEQ ID NO: 1300

SEQ ID NO: 83384 - DNA, 201 bp, Bos taurus; identical to SEQ ID NO: 1307

SEQ ID NO: 83385 - DNA, 201 bp, Bos taurus; identical to SEQ ID NO: 1308

SEQ ID NO: 83386 - DNA, 201 bp, Bos taurus; identical to SEQ ID NO: 1310

SEQ ID NO: 83387 - DNA, 201 bp, Bos taurus; identical to SEQ ID NO: 1311

SEQ ID NO: 83388 - DNA, 201 bp, Bos taurus; identical to SEQ ID NO: 1312

SEQ ID NO: 83389 - DNA, 201 bp, Bos taurus; identical to SEQ ID NO: 1313

SEQ ID NO: 83390 - DNA, 201 bp, Bos taurus; identical to SEQ ID NO: 1314

SEQ ID NO: 83391 - DNA, 201 bp, Bos taurus; identical to SEQ ID NO: 1315

SEQ ID NO: 83392 - DNA, 201 bp, Bos taurus; identical to SEQ ID NO: 1318

SEQ ID NO: 83393 - DNA, 201 bp, Bos taurus; identical to SEQ ID NO: 1320

SEQ ID NO: 83394 - DNA, 201 bp, Bos taurus; identical to SEQ ID NO: 1321

SEQ ID NO: 83395 - DNA, 201 bp, Bos taurus; identical to SEQ ID NO: 1322

SEQ ID NO: 83396 - DNA, 201 bp, Bos taurus; identical to SEQ ID NO: 1325

SEQ ID NO: 83397 - DNA, 201 bp, Bos taurus; identical to SEQ ID NO: 1327

SEQ ID NO: 83398 - DNA, 201 bp, Bos taurus; identical to SEQ ID NO: 1328

SEQ ID NO: 83399 - DNA, 201 bp, Bos taurus; identical to SEQ ID NO: 1333

SEQ ID NO: 83400 - DNA, 201 bp, Bos taurus; identical to SEQ ID NO: 1335

SEQ ID NO: 83401 - DNA, 201 bp, Bos taurus; identical to SEQ ID NO: 1336

SEQ ID NO: 83402 - DNA, 201 bp, Bos taurus; identical to SEQ ID NO: 1337

SEQ ID NO: 83403 - DNA, 201 bp, Bos taurus; identical to SEQ ID NO: 1338

SEQ ID NO: 83404 - DNA, 201 bp, Bos taurus; identical to SEQ ID NO: 1339

SEQ ID NO: 83405 - DNA, 201 bp, Bos taurus
atgagcacgacaatttgcacagtaccaaggtaaaagcagacaccgatagtgcagaaagcatagatgaaagtcgccgcctactaacttctggaaatattcaaacaagcccacctagggaaaaaggaaagaaaaaaagaaagaaaggaataaaatgtctggtattagaagtgcaaggcttgcaaataaagattaactaattcc

SEQ ID NO: 83406 - DNA, 201 bp, Bos taurus; identical to SEQ ID NO: 1342

SEQ ID NO: 83407 - DNA, 201 bp, Bos taurus; identical to SEQ ID NO: 1344

SEQ ID NO: 83408 - DNA, 201 bp, Bos taurus; identical to SEQ ID NO: 1345

SEQ ID NO: 83409 - DNA, 201 bp, Bos taurus; identical to SEQ ID NO: 1346

SEQ ID NO: 83410 - DNA, 201 bp, Bos taurus; identical to SEQ ID NO: 1350

SEQ ID NO: 83411 - DNA, 201 bp, Bos taurus
ttttcactcataaatgtttgataggaaatatgcccaaaggggaagaggaatcttagcattaccattttctaattgttcagttgtacctgtgataagagaactgcctttgatgactcctttgcaagagacttttttgaatttcttgttcattttgtgagggcaaatttcattaagactggacaatgtaatctgtaaatctgt

SEQ ID NO: 83412 - DNA, 201 bp, Bos taurus
aactgactgatgggggccctgtttgttactaagtttgcattttttcaattactctgcattctctaggtaggggagttcatcaaccccattgatttagacgacagcaacttcatctgctccttttgctcattctctgaaatcttaagactaatgtctaaatatggcttcttgatccctgagcccatcacctttcttatatgc

SEQ ID NO: 83413 - DNA, 201 bp, Bos taurus
aaatggcataaggaaatttatttgttattttagcaacttccacagttatctgaaatctacctaagactggttaacttttttatgtgactaataaagagatgtcaagtatttgacttttaaatatttttaaagggttcatgagttctatcataatccattgatcaggattgatcacaatcttcttggtcaagaaggaatgga

SEQ ID NO: 83414 - DNA, 201 bp, Bos taurus; identical to SEQ ID NO: 1352

SEQ ID NO: 83415 - DNA, 201 bp, Bos taurus; identical to SEQ ID NO: 1353

SEQ ID NO: 83416 - DNA, 201 bp, Bos taurus; identical to SEQ ID NO: 1356

SEQ ID NO: 83417 - DNA, 201 bp, Bos taurus
gggaggggaactgggtgaattcggcttttccccccgaagttgcttcctcttttttgcagataaagtcattctctggctggtgctgggagccccagggagaatgagggtgaggtcccggctctcgggggtctgggtcccgtcctgtgcgcggagtcatgggggtggggaaggtgggaagcggcgaggcagctgtcgagaggg

SEQ ID NO: 83418 - DNA, 201 bp, Bos taurus; identical to SEQ ID NO: 1359

SEQ ID NO: 83419 - DNA, 201 bp, Bos taurus
gtagaaattttccttaacattagtctgatactaacactctagattcacatcagcgatttatatcttatggaacccaatatattttgaaagctttaactccctttccccctccttcacagaatcatttcaacaggggcatgaagtatcatttctattgtaagagaggtcacatcgcaccagggagtttttagagaagctggc

SEQ ID NO: 83420 - DNA, 201 bp, Bos taurus
gagattatgatcctgtcctaacaatctcaggaatgttggtatttgatgtcttcctgaaagaccagattgttgcacatgccttcaaataactgtcatttttaaaaattaattggttgtaagtcatagagtagtgatatttgacttgaaaaaatgtgaggttatctgttaaaaggtattttttgaaggcagttttcaaatttt

SEQ ID NO: 83421 - DNA, 201 bp, Bos taurus; identical to SEQ ID NO: 1361

SEQ ID NO: 83422 - DNA, 201 bp, Bos taurus; identical to SEQ ID NO: 1362

SEQ ID NO: 83423 - DNA, 201 bp, Bos taurus; identical to SEQ ID NO: 1363

SEQ ID NO: 83424 - DNA, 201 bp, Bos taurus; identical to SEQ ID NO: 1364

SEQ ID NO: 83425 - DNA, 201 bp, Bos taurus
tgctgaaagagctggtggctaaaagcttacagctgggcccgctgcacccaagccagagatcacttgtctctcaggccaaaaccaagaatcactccattctgggagataaaaggcaaactagttggttccattcaagacagcgccaaaggccagccagctccagagctcccagtgaggttggctgaggtctctgttgtgact

SEQ ID NO: 83426 - DNA, 201 bp, Bos taurus
aaatttatacaaatagacatatctcaagcagtgcagcctcctccaacacatacctttaagaatttttggaattacattttgagtgatagtgagatgcatggaattcataatttacctttctgctagcctccctaaatatttgctttggataatttatgttatttcatttgcttcccacacctttgtgtgattttgtatgac

SEQ ID NO: 83427 - DNA, 201 bp, Bos taurus; identical to SEQ ID NO: 1367

SEQ ID NO: 83428 - DNA, 201 bp, Bos taurus
atgttgcaatggttgcagatcccaaattgaaattctttgcaagtcctgaataaattctttattttgctagagaaataactggtagtctatttgttgtaggtcaacaatttaatggcccttaagaggatccccagaaatcccccaagagctctgaagctggtgagccaacaggtgtggtaccaacattgaacctattgcttc

SEQ ID NO: 83429 - DNA, 201 bp, Bos taurus
gccagaagtgaatatgtttcctaaaaggataacaaagaacttgctaggattttccccactccaggatgaaagagtatagagttaggatttagcattcacaaacacatgtagctgctgctgctgctgctgctaacactttagtcatggccgactctgtgcgaccccatagacagcagcccaccaggctaccctgtccctggg

SEQ ID NO: 83430 - DNA, 201 bp, Bos taurus
tgttgacttcaaggagcaagggaaaactccaaggtagaagtcacctactttgtcattggaggtgtccaatggggttgtaaagttaccattcaaagcggccacccaaccccaaatctaactttttgataaggaaaagaaagccttcctacctataacatatcctttgattctactagtagaaattaaatagagagcaagaaa

SEQ ID NO: 83431 - DNA, 201 bp, Bos taurus
cacaaacacggtcaatgagtttttccataataaggtatggattaaattattgaaaataatttctaatgcagaagtagtcactcccttttatagccttattcaaaactttagaccataaaataaaagcacattcataaaaacacacatttttaaactatgagagaaaaattatttcacaatttgcacataggtaactgatac

SEQ ID NO: 83432 - DNA, 201 bp, Bos taurus; identical to SEQ ID NO: 1369

SEQ ID NO: 83433 - DNA, 201 bp, Bos taurus
cacattgcaccaatggaaactaattttaagattctaaaacttgtctgtcatataacaaatatagttctcagtgaggcatagttataagccaagttttgatatttaaatattacctgggggaagaaacttttggtatagcctttttttgtgctcaagaatatcaagaaatttaaaccccaaaattacctggatagatttact

SEQ ID NO: 83434 - DNA, 201 bp, Bos taurus
taaaaaaaggtggaggataaaatgaccaggatcagtacagcagttcttcattctctacattattggtgcttcacaccccttcaattataaggatttactctaaggagcttttgtttgccttttaaagttctggatctttctgctgaatattactgttgccttaagaacaatgtacagttgaccttgaacaacatgggtttt

SEQ ID NO: 83435 - DNA, 201 bp, Bos taurus; identical to SEQ ID NO: 1370

SEQ ID NO: 83436 - DNA, 201 bp, Bos taurus; identical to SEQ ID NO: 1371

SEQ ID NO: 83437 - DNA, 201 bp, Bos taurus
atgaaaacctagattaaataagttggtctctaaagaaatataaattaccaaactgacccaataaaagatttttttttaaacaagcaggccaattgccagtcaagaaattgagaaggttatcaaagattaacccctcacaaaagcaccaggctccatcaatctcactaatgactgcattcaaaacattagatgtatttcaat

SEQ ID NO: 83438 - DNA, 201 bp, Bos taurus
tttgttgtactatgacaatttcaactgtagtactatgctattctataaataagtacattgcagttactcttgggaaagttcaaacctgatggaaatccttccttattgtatatagaaacccacatggttgaatgtgacactgttcctatcaaataggattagttcattcgtgtgagccttacaggagcaaggatcttttct

SEQ ID NO: 83439 - DNA, 201 bp, Bos taurus; identical to SEQ ID NO: 1374

SEQ ID NO: 83440 - DNA, 201 bp, Bos taurus
gaaggacctcagctagtgtcctgggcatttgtgtgctgtggccagccccacccaccctcctcctctctcaggaggaggctgaccccagagcaaatgtccccgtctttctacttctgatgggcccagcacagaaaacaaatgtggggaagcatttttgctcacaagcactgggtctcctgtcaaaacacaaagaaacccttg

SEQ ID NO: 83441 - DNA, 201 bp, Bos taurus; identical to SEQ ID NO: 1375

SEQ ID NO: 83442 - DNA, 201 bp, Bos taurus; identical to SEQ ID NO: 1376

SEQ ID NO: 83443 - DNA, 201 bp, Bos taurus
tggaagctcggctcgcagaatgtaaactctgacaaaaacaaaagcagctcttctgctatgcagcctctacagctgtctttggtatatgtcacggaagtgactttgacatgttcggacctgggcggctcgtggtgaaggatttttttaacttggaatttgtctctaactgggaccaagacgatcaggttgcctggtacctcc

SEQ ID NO: 83444 - DNA, 201 bp, Bos taurus
gcacaaacaggctaagatttttcagtgtgaaaggaagaaacgtggaatggtaatcacaaaaaaaaaattatgaaaaggtgcaaattatgcaaattaaaacatgattattttaagcagtctgctaggatgttcctttcttattttagggaaaacacgtgggactcaccccatctctctttgttcctttctgggtatcatgga

SEQ ID NO: 83445 - DNA, 201 bp, Bos taurus
cacacatccaccctgctgactgtacgtactctcgtgaacttcatgccaacaacacctatagtaggctaaataatggcctccaaatatatccaggttctaaattttagaacctgtgactgctaccttctttggcaaaagggatcttatgatgcaaagattatcgtgggtcatctgtgtgggcccaatgtaaccacaagtgtc

SEQ ID NO: 83446 - DNA, 201 bp, Bos taurus; identical to SEQ ID NO: 1380

SEQ ID NO: 83447 - DNA, 201 bp, Bos taurus
agtggcctcagcagccagcactgtgcccagggatagcaggatctgagggttgctggaagatctgccctttgaggaaaatctcaagttgctcctgtgactgacagatggcccagaaacagttgctgcagaagaatataatgctccaagccccagtgatgatcctaagctattcgaggactgggagggtggtttggatattgc

SEQ ID NO: 83448 - DNA, 201 bp, Bos taurus; identical to SEQ ID NO: 1382

SEQ ID NO: 83449 - DNA, 201 bp, Bos taurus; identical to SEQ ID NO: 1383

SEQ ID NO: 83450 - DNA, 201 bp, Bos taurus; identical to SEQ ID NO: 1385

SEQ ID NO: 83451 - DNA, 201 bp, Bos taurus; identical to SEQ ID NO: 1386

SEQ ID NO: 83452 - DNA, 201 bp, Bos taurus; identical to SEQ ID NO: 1388

SEQ ID NO: 83453 - DNA, 201 bp, Bos taurus; identical to SEQ ID NO: 1389

SEQ ID NO: 83454 - DNA, 201 bp, Bos taurus; identical to SEQ ID NO: 1391

SEQ ID NO: 83455 - DNA, 201 bp, Bos taurus; identical to SEQ ID NO: 1394

SEQ ID NO: 83456 - DNA, 201 bp, Bos taurus; identical to SEQ ID NO: 1395

SEQ ID NO: 83457 - DNA, 201 bp, Bos taurus; identical to SEQ ID NO: 1396

SEQ ID NO: 83458 - DNA, 201 bp, Bos taurus; identical to SEQ ID NO: 1398

SEQ ID NO: 83459 - DNA, 201 bp, Bos taurus
acttagcactaactacatgcgaaaggacttgtagaccttgagaagaagtataagctggaacaaggaactatctgaaactgaactgaccctgtaccatccgtgacagctccagagaaactcctagatatattttgctattatcattttttaatcttttttattttaagtcctatattattcctttaattttcatttttataa

SEQ ID NO: 83460 - DNA, 201 bp, Bos taurus; identical to SEQ ID NO: 1399

SEQ ID NO: 83461 - DNA, 201 bp, Bos taurus; identical to SEQ ID NO: 1402

SEQ ID NO: 83462 - DNA, 201 bp, Bos taurus; identical to SEQ ID NO: 1403

SEQ ID NO: 83463 - DNA, 201 bp, Bos taurus; identical to SEQ ID NO: 1405

SEQ ID NO: 83464 - DNA, 201 bp, Bos taurus; identical to SEQ ID NO: 1406

SEQ ID NO: 83465 - DNA, 201 bp, Bos taurus; identical to SEQ ID NO: 1407

SEQ ID NO: 83466 - DNA, 201 bp, Bos taurus; identical to SEQ ID NO: 1408

SEQ ID NO: 83467 - DNA, 201 bp, Bos taurus; identical to SEQ ID NO: 1409

SEQ ID NO: 83468 - DNA, 201 bp, Bos taurus; identical to SEQ ID NO: 1411

SEQ ID NO: 83469 - DNA, 201 bp, Bos taurus; identical to SEQ ID NO: 1412

SEQ ID NO: 83470 - DNA, 201 bp, Bos taurus
actacttggggtagtaaagcaattataattggccatgtctttaaaacactctccttcttcccaaggaaaacaccgccctctccttaccagggctctggaacctggttggcctaaaatattttaaaacatacagtttgatttgtaaagatcaacagttggtctgaggaaaacgccatacattttaatctttcaaagtttata

SEQ ID NO: 83471 - DNA, 201 bp, Bos taurus; identical to SEQ ID NO: 1413

SEQ ID NO: 83472 - DNA, 201 bp, Bos taurus
tacaaaaaatattacattgtttaaaaaaacaaaaacaaagcacagatgtgcgtatataacatggtcccacttatttaaagaaagcagagagaagacatatacatatgtttgtttatatatacttttttttcctggaaggataaacaaggacctgttagtactggttatctctggcaaaggaagatgaattacgaggtagaa

SEQ ID NO: 83473 - DNA, 201 bp, Bos taurus; identical to SEQ ID NO: 1414

SEQ ID NO: 83474 - DNA, 201 bp, Bos taurus
tctataggcttctacagactacctaagggatccatggcatgaaaatggttatgtgattagagactaattagaagatagcaaagcagaaaggtacataaatatagtccaggacaatcagtcacttccgtggaactggatcaagttattagggctatttacactagaaacacttgaattgcataaaagctcttaagaacactt

SEQ ID NO: 83475 - DNA, 201 bp, Bos taurus
gactggatctgatttaaacactggactgggtccatctttaaaaatggtttgggtccagaactaaactgaggtcagactaggtttgacttgagctgaagtgggtccagtaagggccactgctaatgggaatctcagaagctgaaaaaaaaaggggggaggggtgcagaattgatgaaccttggttgagcatttcaaagctgt

SEQ ID NO: 83476 - DNA, 201 bp, Bos taurus
tccagactttaccctatgtacctttaccctttgcttattctgttttatatcctctagttgtaaaaaaaaaaaaaaaaatacagtcatgaaggtgactatacgctgaatcctatgagtcccaatgaatcattaaacctggtggtgatgttggggacatctggcacaccagaattggattctggaaaaaaaaaaaagaggcca

SEQ ID NO: 83477 - DNA, 201 bp, Bos taurus; identical to SEQ ID NO: 1416

SEQ ID NO: 83478 - DNA, 201 bp, Bos taurus
ctttgcctttggaaccaagaggaatattccccagaggcaacggaaatacttgtaacactggaagttatggtcacaaggattatttctggggccatgtgtcgtctctgcttctattaacttgtcaatatagctctctctctctctgttcctgagtgctgaccagttcctacctgtcggccccaaataggcaataccctaggt

SEQ ID NO: 83479 - DNA, 201 bp, Bos taurus; identical to SEQ ID NO: 1417

SEQ ID NO: 83480 - DNA, 201 bp, Bos taurus; identical to SEQ ID NO: 1418

SEQ ID NO: 83481 - DNA, 201 bp, Bos taurus; identical to SEQ ID NO: 1419

SEQ ID NO: 83482 - DNA, 201 bp, Bos taurus; identical to SEQ ID NO: 1420

SEQ ID NO: 83483 - DNA, 201 bp, Bos taurus; identical to SEQ ID NO: 1421

SEQ ID NO: 83484 - DNA, 201 bp, Bos taurus; identical to SEQ ID NO: 1422

SEQ ID NO: 83485 - DNA, 201 bp, Bos taurus; identical to SEQ ID NO: 1424

SEQ ID NO: 83486 - DNA, 201 bp, Bos taurus; identical to SEQ ID NO: 1425

SEQ ID NO: 83487 - DNA, 201 bp, Bos taurus; identical to SEQ ID NO: 1426

SEQ ID NO: 83488 - DNA, 201 bp, Bos taurus; identical to SEQ ID NO: 1427

SEQ ID NO: 83489 - DNA, 201 bp, Bos taurus; identical to SEQ ID NO: 1428

SEQ ID NO: 83490 - DNA, 201 bp, Bos taurus; identical to SEQ ID NO: 1429

SEQ ID NO: 83491 - DNA, 201 bp, Bos taurus; identical to SEQ ID NO: 1430

SEQ ID NO: 83492 - DNA, 201 bp, Bos taurus; identical to SEQ ID NO: 1431

SEQ ID NO: 83493 - DNA, 201 bp, Bos taurus; identical to SEQ ID NO: 1432

SEQ ID NO: 83494 - DNA, 201 bp, Bos taurus; identical to SEQ ID NO: 1435

SEQ ID NO: 83495 - DNA, 201 bp, Bos taurus; identical to SEQ ID NO: 1437

SEQ ID NO: 83496 - DNA, 201 bp, Bos taurus; identical to SEQ ID NO: 1438

SEQ ID NO: 83497 - DNA, 201 bp, Bos taurus; identical to SEQ ID NO: 1439

SEQ ID NO: 83498 - DNA, 201 bp, Bos taurus
acaataaatagtgatatttgttgttttggatttaaagaactttaagattcatgtcaaagcaatgttgctggagagcatgccatggggacaagactaaagcagttggctgtgtgagtgtctgcacaaagcaataagggaacacatgtgcatgccataggattctggagtgggttgcaacgacctcctccaggggttcttccc

SEQ ID NO: 83499 - DNA, 201 bp, Bos taurus; identical to SEQ ID NO: 1440

SEQ ID NO: 83500 - DNA, 201 bp, Bos taurus; identical to SEQ ID NO: 1442

SEQ ID NO: 83501 - DNA, 201 bp, Bos taurus; identical to SEQ ID NO: 1444

SEQ ID NO: 83502 - DNA, 201 bp, Bos taurus
aaatctaattaaacttaaaagcttttgcacagcaaaggaaaccataaacaaagcaaaccaccaaaggggagaaaatagttacaaatgaagcaaccttcaagaattaatatccaggatttccctggtgctccagtggttaggaatctgtttgccagtgcaggggccatgggttcaacaccatggggcaactaatcccatgct

SEQ ID NO: 83503 - DNA, 201 bp, Bos taurus; identical to SEQ ID NO: 1446

SEQ ID NO: 83504 - DNA, 201 bp, Bos taurus; identical to SEQ ID NO: 1447

SEQ ID NO: 83505 - DNA, 201 bp, Bos taurus
tctgggccatccctacatttgcttcattgttttaaaaacttattattttttattttggttaaggtaaagaatccctctcaaaagagatcaaatgacagggggcagacagccacttaaagttacagaaagatattatggatactgaagaaaggggaacccagaccttgttatagacccagattcttgaactctttaatcaat

SEQ ID NO: 83506 - DNA, 201 bp, Bos taurus; identical to SEQ ID NO: 1448

SEQ ID NO: 83507 - DNA, 201 bp, Bos taurus; identical to SEQ ID NO: 1449

SEQ ID NO: 83508 - DNA, 201 bp, Bos taurus; identical to SEQ ID NO: 1450

SEQ ID NO: 83509 - DNA, 201 bp, Bos taurus; identical to SEQ ID NO: 1451

SEQ ID NO: 83510 - DNA, 201 bp, Bos taurus; identical to SEQ ID NO: 1452

SEQ ID NO: 83511 - DNA, 201 bp, Bos taurus; identical to SEQ ID NO: 1453

SEQ ID NO: 83512 - DNA, 201 bp, Bos taurus; identical to SEQ ID NO: 1454

SEQ ID NO: 83513 - DNA, 201 bp, Bos taurus
cttgccacctggtcaagctctggcccctgcctttccccacctctggctccttggtgtttactgtccagccccaagtctggttgctcagagaggggccagcggtgctttgcagtctcctgccccactgtgccagttactcgggacactgatcactaccctgtgaccgcctcctccatgatctctgcgaatctgcttcctgtg

SEQ ID NO: 83514 - DNA, 201 bp, Bos taurus
tttctttctttcaggacagcatgaggcccactgtcaggtcctagggcccattggcagaattcccggtggcttggtccatccatgcccctctgagtcagccggatgagtcatgcccctctgtggccagctggtggaattgctagtggctgaaactgtctatgccctgctggatgagtgggggtagggctctctgacccactg

SEQ ID NO: 83515 - DNA, 201 bp, Bos taurus; identical to SEQ ID NO: 1455

SEQ ID NO: 83516 - DNA, 201 bp, Bos taurus; identical to SEQ ID NO: 1456

SEQ ID NO: 83517 - DNA, 201 bp, Bos taurus
gaagacattccataaatgatttggccccaaggatggtatcctcccttatggacagctgtggctgctcagctctgagtctgtgtattacatctatttactcaggccagtattctgtgcccctctggtgaaggcaaactctattccttccaatctgcactttgttcctttgcgctttatgtgacagtgagttcctaaactgaa

SEQ ID NO: 83518 - DNA, 201 bp, Bos taurus
tagagacatcacgctactgtcattccattcctttctataggcctgggacttattttccctgctgaagtagtcttttggatctctaatatcaagggcaaacgtgttacttgacagcattccacacttgtctgttgggaagacttacaccacctgattctctctcctgctcctggtccaatgttgacctccaccacaggccta

SEQ ID NO: 83519 - DNA, 201 bp, Bos taurus; identical to SEQ ID NO: 1457

SEQ ID NO: 83520 - DNA, 201 bp, Bos taurus; identical to SEQ ID NO: 1459

SEQ ID NO: 83521 - DNA, 201 bp, Bos taurus; identical to SEQ ID NO: 1460

SEQ ID NO: 83522 - DNA, 201 bp, Bos taurus
ttcccttagtaggggtaaatctgtcttattgctttactgaaaacaaactaattaaaagtcattacatgatctacaaacatgagttctaaataagatgtacgtaccaggatcatcacttaacaaaatatgacaattcttccaactagttatcattcttcactaactttcttaaaagattatttatgcttttctcaaaagatt

SEQ ID NO: 83523 - DNA, 201 bp, Bos taurus; identical to SEQ ID NO: 1461

SEQ ID NO: 83524 - DNA, 201 bp, Bos taurus; identical to SEQ ID NO: 1462

SEQ ID NO: 83525 - DNA, 201 bp, Bos taurus; identical to SEQ ID NO: 1464

SEQ ID NO: 83526 - DNA, 201 bp, Bos taurus; identical to SEQ ID NO: 1466

SEQ ID NO: 83527 - DNA, 201 bp, Bos taurus; identical to SEQ ID NO: 1467

SEQ ID NO: 83528 - DNA, 201 bp, Bos taurus; identical to SEQ ID NO: 1468

SEQ ID NO: 83529 - DNA, 201 bp, Bos taurus
tacttcaactgcggagattttgcagaatcacaattagggtgaagatacctttaggttcctaagaaggaaactagtgggtttggaccccagtctatagatgtgttagaggtgtgaggctatgtggagggaatacccttgtccggagctaggtctccagtatgtggtggatgggggttgggggagaagtatgtgcaggcaggg

SEQ ID NO: 83530 - DNA, 201 bp, Bos taurus; identical to SEQ ID NO: 1469

SEQ ID NO: 83531 - DNA, 201 bp, Bos taurus; identical to SEQ ID NO: 1470

SEQ ID NO: 83532 - DNA, 201 bp, Bos taurus; identical to SEQ ID NO: 1471

SEQ ID NO: 83533 - DNA, 201 bp, Bos taurus
ggtttcaagaatgggtgattagaaatgtgtttctaatctcaaaaataataaggaaacaaggagaaggttgtttgggggtgaaatgcttatttattcagaagggacgaatcatcaaagtagaaatgtccggtgaacatttggaaataaatggtgagtgccaacacaagaggaaaagatttgcaatagagattttggaattat

SEQ ID NO: 83534 - DNA, 201 bp, Bos taurus
tgaaatggcaatctccttagatacagaagagaaccataaggggtataagtaatgcaatcttctctctgcttcctctgtcagttttgacctaatctagcaagaaatgctgagccattttccgcctcttgcgtacaagtatcaattaagggaaaacagggtgactatcttagggcagcggacgatgaaatgtcacttacacag

SEQ ID NO: 83535 - DNA, 201 bp, Bos taurus; identical to SEQ ID NO: 1472

SEQ ID NO: 83536 - DNA, 201 bp, Bos taurus; identical to SEQ ID NO: 1473

SEQ ID NO: 83537 - DNA, 201 bp, Bos taurus
gaggtttgaaagggtttcagaaccagatatttactctgtccccaaatccctggaaatagtgacagttctaaaatggaattcaactagaaactatttgcctgttataatttggctataatgtggagaactcaaaaggtagaatatgcctcctgacagggaagtgtatgagaggatcattttcatgaattcaaggcaaaaaaa

SEQ ID NO: 83538 - DNA, 201 bp, Bos taurus; identical to SEQ ID NO: 43046

SEQ ID NO: 83539 - DNA, 201 bp, Bos taurus; identical to SEQ ID NO: 1474

SEQ ID NO: 83540 - DNA, 201 bp, Bos taurus; identical to SEQ ID NO: 1475

SEQ ID NO: 83541 - DNA, 201 bp, Bos taurus
ttcccaagttttcattcaggaacttggagtcaactcaggccagtttgagctcaaaccagttaaaactggttggggtcactgggcatgtgacagcatctaataggtgaacttttgatgttagagggccaaaatgtccactctcaggtcatgctgctactgctaagtcacttcagtcgtgtccgactctgtgcgaccccatag

SEQ ID NO: 83542 - DNA, 201 bp, Bos taurus; identical to SEQ ID NO: 1476

SEQ ID NO: 83543 - DNA, 201 bp, Bos taurus; identical to SEQ ID NO: 1477

SEQ ID NO: 83544 - DNA, 201 bp, Bos taurus; identical to SEQ ID NO: 1478

SEQ ID NO: 83545 - DNA, 201 bp, Bos taurus; identical to SEQ ID NO: 1479

SEQ ID NO: 83546 - DNA, 201 bp, Bos taurus; identical to SEQ ID NO: 1480

SEQ ID NO: 83547 - DNA, 201 bp, Bos taurus
gtttaaatatcatcttaagtaaattagtgtgtataggcatgatttgtgtaattacagcagttagtaattagtataaatggagatcatatcaccactagcaaacataattaaagctcataacaagtctaaaaaaaactatatattttgaaacaaaaagttaattagatgaattccagaatcatactttggaacaaacttaca

SEQ ID NO: 83548 - DNA, 201 bp, Bos taurus; identical to SEQ ID NO: 1483

SEQ ID NO: 83549 - DNA, 201 bp, Bos taurus
aaacatcccagttaatgtacatagaagtaagaaagcatatgggagtaatttaaagcacatttggagagtttcatgaagtccaggatatctagagagaagatgaaataaatgtgcagagataagagcagggtgtttccccttctctctgagttgagttggtattttattctcaaggataatccattcactaattctaagcac

SEQ ID NO: 83550 - DNA, 201 bp, Bos taurus
ttatgaacataaccatttaggaatactttctagagtttacactttcctctattaaaaaaaaagaccagagataaaattccagccaagatgagtgaagaaaagaagggaactcttgaacaccagtggtgtaaatgtaaagtggtacagacattacagaaaacaatatggaggtccctcaataatataaagatatagagctat

SEQ ID NO: 83551 - DNA, 201 bp, Bos taurus; identical to SEQ ID NO: 1485

SEQ ID NO: 83552 - DNA, 201 bp, Bos taurus; identical to SEQ ID NO: 1486

SEQ ID NO: 83553 - DNA, 201 bp, Bos taurus; identical to SEQ ID NO: 1487

SEQ ID NO: 83554 - DNA, 201 bp, Bos taurus; identical to SEQ ID NO: 1489

SEQ ID NO: 83555 - DNA, 201 bp, Bos taurus
ttagtgtgggttattttggaacttaaactgtccatctcttctccaagtaaaaataatatttttcaaagttgcgtttctaaaacgatactactagttcactgagagtatgaacttaaatcactgtattgatgcaaattttctgaaattcaagtttgcagattttattctgtatgagaaatgcacagatgggttaatatttca

SEQ ID NO: 83556 - DNA, 201 bp, Bos taurus
tgccagaggaaaaaaagtagaattctaggtatgatgcctttttcagattttatagagtatatttcatgataagttaggttatgataggctcatttcacagggggaaaattcagattcagaaaagtaaattaacttaacaaactgtcaaagtttgtcttaggaaattgctatacatagttgaatctgtaaagtgagttttgt

SEQ ID NO: 83557 - DNA, 201 bp, Bos taurus
atggtggctacatatacaggattggacataggtattattgtccatatataccaattggacattggtttataggtatttacataaacaaaacaaatgaggggagaaatctctaaaagtaataacttgtgacatctgcttaccaacttctaataacctttctctactgatacttttacttggaggcaggttagcaaaatttat

SEQ ID NO: 83558 - DNA, 201 bp, Bos taurus
gagaaatagtggaacaggaaggtggagagacgttcaaaagctctgtcatctcctgtccattcttcctaacaaaaataacaacatccaagacccatgaagagaactgataccagctcaccatcccatatcagaagtacctactttgtcttttttcatagacatatatacagattgcatgtagaactttgtgactattcctat

SEQ ID NO: 83559 - DNA, 201 bp, Bos taurus
tttagcccaaaatgccaggtcaagtatttttgtgtattgtttattctatttccatagcctcactgaattaataataataacaaatatatgaggtacaatgtataatttacctaaataaatatctgtagtcagtaaaggacaaactaatccattctggattataattctaaatcagactatagatgtagaaaacaatatata

SEQ ID NO: 83560 - DNA, 201 bp, Bos taurus; identical to SEQ ID NO: 1492

SEQ ID NO: 83561 - DNA, 201 bp, Bos taurus; identical to SEQ ID NO: 1493

SEQ ID NO: 83562 - DNA, 201 bp, Bos taurus; identical to SEQ ID NO: 1494

SEQ ID NO: 83563 - DNA, 201 bp, Bos taurus
tatgttcacaccactaagggaatatataatcctataactgattacactgttactcaaaatgaagggaaacagatttttttcagacatgaaatcagtaacagtatatatacatatgctcactgaaaaaaaaacaaaagtacataaaaattatgccctcaaacctgacaataatccacactaagaactaaaatttgtgtttta

SEQ ID NO: 83564 - DNA, 201 bp, Bos taurus; identical to SEQ ID NO: 1495

SEQ ID NO: 83565 - DNA, 201 bp, Bos taurus
catgcttgcctattctacacaaaaacttttcatttaaaaaaattgactcccaagtttattttgcaaatttctaccaatttcatgcttatatgaatatttacctcaaaaatgatcaaatattgaatgctgatatcagaacacaaatgcccaggtctcgatgcaactcatacttttgttagtataatggcaagatatgcattc

SEQ ID NO: 83566 - DNA, 201 bp, Bos taurus
gactggcacagtcttgattatctttagttttctttatctaaaacagaagtttgctttgcaaaaacattggtcctgtcgaataattttatgtattaatgaagtgataatgaagtattatgaagttatattacccagggcttaatcatgttcatattctttgccagcctcttagtttctctatcttcaccatttaataaggtt

SEQ ID NO: 83567 - DNA, 201 bp, Bos taurus; identical to SEQ ID NO: 1497

SEQ ID NO: 83568 - DNA, 201 bp, Bos taurus
actgtcattttggtttttttttaatggcaatcgacacgctgcctcccaccttatagaattggcaaataggtacgaactgacagggaagtaccttgtcttcgttgttccagtgatgtagaactcgcaggcaatgttttggatgccaatgacaaatctaaagatagagacagaaatagtggtgatgataatgatttcctgaag

SEQ ID NO: 83569 - DNA, 201 bp, Bos taurus; identical to SEQ ID NO: 1499

SEQ ID NO: 83570 - DNA, 201 bp, Bos taurus; identical to SEQ ID NO: 1500

SEQ ID NO: 83571 - DNA, 201 bp, Bos taurus; identical to SEQ ID NO: 1501

SEQ ID NO: 83572 - DNA, 201 bp, Bos taurus; identical to SEQ ID NO: 1503

SEQ ID NO: 83573 - DNA, 201 bp, Bos taurus; identical to SEQ ID NO: 1505

SEQ ID NO: 83574 - DNA, 201 bp, Bos taurus
atgcaaataatgattttaagtcttaggacaagcagaagtgggttgttgctactgcagcctttgcatgggtcctataattcaccagtcacccttggccaagagttaggaaggatatataatccttttttgactcttcctccacagggaatggagttgtatatcccacccacagcctcagagacaacacctctcaaagtcaca

SEQ ID NO: 83575 - DNA, 201 bp, Bos taurus
tcagtcaccatctaaggagtctgaattttattctcagcgcaatgaaattctctgacaagtttgagcatggcctgattgcctaaaggtcattctttaggcacacacagagagccatggaaggggcaagattggacacaaggttcctaagatgtccaggagagagatctcattgttgatggaagagacagtggaagtggagac

SEQ ID NO: 83576 - DNA, 201 bp, Bos taurus; identical to SEQ ID NO: 1507

SEQ ID NO: 83577 - DNA, 201 bp, Bos taurus; identical to SEQ ID NO: 1508

SEQ ID NO: 83578 - DNA, 201 bp, Bos taurus; identical to SEQ ID NO: 1509

SEQ ID NO: 83579 - DNA, 201 bp, Bos taurus; identical to SEQ ID NO: 1510

SEQ ID NO: 83580 - DNA, 201 bp, Bos taurus; identical to SEQ ID NO: 1511

SEQ ID NO: 83581 - DNA, 201 bp, Bos taurus; identical to SEQ ID NO: 1512

SEQ ID NO: 83582 - DNA, 201 bp, Bos taurus
cagacatgtacaaggggctgcctgggtatgatgaggattataacaataaataagaacaacactttttttccacgtctcaggagaagaacacttaatggatgacagagaaagatacataataaatataatgctttgaactggcaggtactaaaagtgaagaataaaaattaccatcagaccagggctttggcaccaactgat

SEQ ID NO: 83583 - DNA, 201 bp, Bos taurus; identical to SEQ ID NO: 1515

SEQ ID NO: 83584 - DNA, 201 bp, Bos taurus
actgctgtccgctctgttctttccaggctctgagagctgagttcacagaggagaccctcttccatgctgtatcctgcctcagtccctcagacaatcccaactaaggcagagaagtattaacagtcccagcatattcacttgtgagtagcttagagatgagcccatatcgcagtggcagtggtccaatcacagagcttctaa

SEQ ID NO: 83585 - DNA, 201 bp, Bos taurus
ggacatcctaggccaggtatggcactgagatgtgcacatgtgtgagaaataaaagtattgagtataaagatatgcaaaattggtaacccaccacagtgctctcttggccagaattcatcccaagggttgtgaaacagtctttacactaagaaccctggtggccaggtgacagtcagcaaggatgaaccacaggaccaccac

SEQ ID NO: 83586 - DNA, 201 bp, Bos taurus; identical to SEQ ID NO: 1519

SEQ ID NO: 83587 - DNA, 201 bp, Bos taurus; identical to SEQ ID NO: 1520

SEQ ID NO: 83588 - DNA, 201 bp, Bos taurus; identical to SEQ ID NO: 1521

SEQ ID NO: 83589 - DNA, 201 bp, Bos taurus
gcaggcagctcagcttctgcacatggccgctgaattccaagaaggtaagactcaaagtccctgaggtctgagcatggaagtcacacataactttcctgcactattggctagaacatgtcagaaggccagcccagcttcaggatgtctggaaataggctccacctcctgatgaaagaaactttcactaatttctggccaagt

SEQ ID NO: 83590 - DNA, 201 bp, Bos taurus; identical to SEQ ID NO: 1522

SEQ ID NO: 83591 - DNA, 201 bp, Bos taurus; identical to SEQ ID NO: 1523

SEQ ID NO: 83592 - DNA, 201 bp, Bos taurus; identical to SEQ ID NO: 1524

SEQ ID NO: 83593 - DNA, 201 bp, Bos taurus; identical to SEQ ID NO: 1525

SEQ ID NO: 83594 - DNA, 201 bp, Bos taurus
attgtcgaatgcaatttgagaatgggttacctagtccccccactttacagaaaaagtattgggttggtcaaaaaactcattcatatttttttcagtaaatgttatggaaaaacccaaacaaactttttggccaacctgatggttaataatcagcagggttaaatgctttccctgaggctacacaactggatacaaccaaga

SEQ ID NO: 83595 - DNA, 201 bp, Bos taurus
tcccaccccaagagtttctgattcagtaggcctgggtagggccatgaatttccatgtctaacaatttcccaggagatgctgattctggtgctgatggactgggatgtacaccttgaggcccatgaggtttgtcaatattaagttgtcacaaaagaaccacaaggctgagagagaatttctggagaagttgctatatgcttg

SEQ ID NO: 83596 - DNA, 201 bp, Bos taurus
attacaaaacctataaggccaaataaagtcatgagtctgagaccctgataatctacaactgaatattaactaccaaaggtcagctgagactatgggccttcgagtaacattcagccagaaactgccctacttgatatgtcttcacaaatgttataaactgaatgggactccagcaatttgtcccattagagtcagggccta

SEQ ID NO: 83597 - DNA, 201 bp, Bos taurus
gcatgaactccaatgaaggaatctattctccaggaattaatagtaacagcctgaaggaatatccaccctgcaaacccacagacacaaggagcccctgcacggatccccacaaggcatttgtttatgacacggattctcatgacgaggctgatgaggacgcttcctccttagcctctgtccaagcggttccaaaccagggct

SEQ ID NO: 83598 - DNA, 201 bp, Bos taurus
ccacagacacaaggagcccctgcacggatccccacaaggcatttgtttatgacacggattctcatgacgaggctgatgaggacgcttcctccttagcctctgtccaagcggttccaaaccagggctgcaggctgcacagttgtaaattaacccacagtgtctctgacagcctctttggctgggagctgaatggcaaacact

SEQ ID NO: 83599 - DNA, 201 bp, Bos taurus; identical to SEQ ID NO: 1529

SEQ ID NO: 83600 - DNA, 201 bp, Bos taurus; identical to SEQ ID NO: 1530

SEQ ID NO: 83601 - DNA, 201 bp, Bos taurus; identical to SEQ ID NO: 1531

SEQ ID NO: 83602 - DNA, 201 bp, Bos taurus; identical to SEQ ID NO: 1532

SEQ ID NO: 83603 - DNA, 201 bp, Bos taurus; identical to SEQ ID NO: 1533

SEQ ID NO: 83604 - DNA, 201 bp, Bos taurus; identical to SEQ ID NO: 1534

SEQ ID NO: 83605 - DNA, 201 bp, Bos taurus; identical to SEQ ID NO: 1535

SEQ ID NO: 83606 - DNA, 201 bp, Bos taurus; identical to SEQ ID NO: 1536

SEQ ID NO: 83607 - DNA, 201 bp, Bos taurus; identical to SEQ ID NO: 1537

SEQ ID NO: 83608 - DNA, 201 bp, Bos taurus; identical to SEQ ID NO: 1538

SEQ ID NO: 83609 - DNA, 201 bp, Bos taurus
taatggttgatgttctcaaaatgctgtattctggtaagcaaaggctcctttactgctgagtgaagctgaattttttgtccgtggcctcccatatggacaacactggatagcttttgtataaatcttcatttttcttaatggaggttgaatgtgggccttagggatctctgaccaattaggcatcaactgtttatagcattc

SEQ ID NO: 83610 - DNA, 201 bp, Bos taurus; identical to SEQ ID NO: 1540

SEQ ID NO: 83611 - DNA, 201 bp, Bos taurus
tggtaacgataaccctgtatacgagacagcatgctttgtatttttgttattaaacttctaccagataaatagtgatgcctgggttacaaccttgtgatctttaatattagtcttccaaaagcttaactaagaagataaaactcaacaatttccactcagttttattattatccttttcgatagaactttttgttaaaacat

SEQ ID NO: 83612 - DNA, 201 bp, Bos taurus; identical to SEQ ID NO: 1541

SEQ ID NO: 83613 - DNA, 201 bp, Bos taurus; identical to SEQ ID NO: 1542

SEQ ID NO: 83614 - DNA, 201 bp, Bos taurus; identical to SEQ ID NO: 1545

SEQ ID NO: 83615 - DNA, 201 bp, Bos taurus; identical to SEQ ID NO: 1546

SEQ ID NO: 83616 - DNA, 201 bp, Bos taurus; identical to SEQ ID NO: 1547

SEQ ID NO: 83617 - DNA, 201 bp, Bos taurus; identical to SEQ ID NO: 1548

SEQ ID NO: 83618 - DNA, 201 bp, Bos taurus; identical to SEQ ID NO: 1549

SEQ ID NO: 83619 - DNA, 201 bp, Bos taurus; identical to SEQ ID NO: 1550

SEQ ID NO: 83620 - DNA, 201 bp, Bos taurus; identical to SEQ ID NO: 1551

SEQ ID NO: 83621 - DNA, 201 bp, Bos taurus; identical to SEQ ID NO: 1552

SEQ ID NO: 83622 - DNA, 201 bp, Bos taurus; identical to SEQ ID NO: 1553

SEQ ID NO: 83623 - DNA, 201 bp, Bos taurus; identical to SEQ ID NO: 1554

SEQ ID NO: 83624 - DNA, 201 bp, Bos taurus; identical to SEQ ID NO: 1555

SEQ ID NO: 83625 - DNA, 201 bp, Bos taurus; identical to SEQ ID NO: 1556

SEQ ID NO: 83626 - DNA, 201 bp, Bos taurus; identical to SEQ ID NO: 1558

SEQ ID NO: 83627 - DNA, 201 bp, Bos taurus; identical to SEQ ID NO: 1559

SEQ ID NO: 83628 - DNA, 201 bp, Bos taurus; identical to SEQ ID NO: 1560

SEQ ID NO: 83629 - DNA, 201 bp, Bos taurus; identical to SEQ ID NO: 1561

SEQ ID NO: 83630 - DNA, 201 bp, Bos taurus; identical to SEQ ID NO: 1562

SEQ ID NO: 83631 - DNA, 201 bp, Bos taurus; identical to SEQ ID NO: 1563

SEQ ID NO: 83632 - DNA, 201 bp, Bos taurus; identical to SEQ ID NO: 1564

SEQ ID NO: 83633 - DNA, 201 bp, Bos taurus; identical to SEQ ID NO: 1566

SEQ ID NO: 83634 - DNA, 201 bp, Bos taurus; identical to SEQ ID NO: 1567

SEQ ID NO: 83635 - DNA, 201 bp, Bos taurus; identical to SEQ ID NO: 1568

SEQ ID NO: 83636 - DNA, 201 bp, Bos taurus; identical to SEQ ID NO: 1569

SEQ ID NO: 83637 - DNA, 201 bp, Bos taurus; identical to SEQ ID NO: 1570

SEQ ID NO: 83638 - DNA, 201 bp, Bos taurus
caggccctaaggccacaggaagaaataggacagtctcatcctccccttagctggcatggggtggcgtgcaggcctgcaggccagaactctggactcttgttctctagcatcactgatgagaacaaagagcttgaccttgagcaagtcatggcccctccttggttctcagcaccctgatgtagatggaggtcttacccagtg

SEQ ID NO: 83639 - DNA, 201 bp, Bos taurus
aaggaccagtaaagaaaatcaggatgagtggccaggggagcaccagaaagccgaatgaacacaagcaggagggtgccaagtgaatctgtaccaaatgcttctgataggcccagtaatttgaagccaaagcatcatactcctttggcaagagggaatccactggtgatcctgaccagacccaagtcagtacagtgatgggga

SEQ ID NO: 83640 - DNA, 201 bp, Bos taurus
aatacacaagtattaaaaacaaaatacctgtaatgctaataagataaaagaagatgtccaacctcaccagtaatcagagaaattcaaaataacaatgagcgatatattactcatcaaactgacaaacgaaaaagcctgacaatacctactgttggcaagagtgcagaacaatgagagtttaatcagttaagatgggcatcc

SEQ ID NO: 83641 - DNA, 201 bp, Bos taurus; identical to SEQ ID NO: 1571

SEQ ID NO: 83642 - DNA, 201 bp, Bos taurus; identical to SEQ ID NO: 1572

SEQ ID NO: 83643 - DNA, 201 bp, Bos taurus
attcccgggggttcatatgtgggccaggaaccaccagctgatatcagtaaacacagagactttaccagatgcacaaacagaaaatacaagggatgttggcgctatcgggccacaataatcctttaaccagataaaagaggtaacttctaagactaatgaaaaaatagcctgaagctgaagaaggaatccttggggcccagc

SEQ ID NO: 83644 - DNA, 201 bp, Bos taurus; identical to SEQ ID NO: 1573

SEQ ID NO: 83645 - DNA, 201 bp, Bos taurus
ggcacaaagccttgcagcgattctccaccctctcagaaaacagagagctccattaaacacagaagacaaaacaacccaaaccagcacacacccgctggagcggggccattcagggagtgtgttgccaggggcacacccctctttgaacctcccatccacctgtcttctgggctccccagagagaaggctgctaaccagcat

SEQ ID NO: 83646 - DNA, 201 bp, Bos taurus; identical to SEQ ID NO: 1574

SEQ ID NO: 83647 - DNA, 201 bp, Bos taurus
tgcccacctgcagaggttcacgtgcctggttgaacttggcccaaaccccactgaggacccagtgtttgcagtactgctgctgtagggtgttcatggccacgttgggaaggttgactgccttctcaaccaccctgggagtaaggaggatgctcagtgttacacgggaggctcagagagggaaatccacctggtcagacacac

SEQ ID NO: 83648 - DNA, 201 bp, Bos taurus; identical to SEQ ID NO: 1575

SEQ ID NO: 83649 - DNA, 201 bp, Bos taurus
gagtcctcccagctgtggggctgggcactccaggcgggtacaggaggccacctcaaggactgtgaccatgtataagtgagtagagttggatctcattattggcagtagttgtggcctagacttggagaaggaaatggcaaccctctccagtattcttgcctggagaatcccagggacggaagtctagactaggggtcccca

SEQ ID NO: 83650 - DNA, 201 bp, Bos taurus
caggaccgtgctggccacaatgcagaggcagaagggaagacagacgagataggaggttagcaccacagtgggacatccaggtgggtggtctaggatgccaagctgagccccggagagaggcctgggctgaacaactatctgggcatcagcaatggtggccaggagcagcccctgactgacttgggcacagggacaaagaag

SEQ ID NO: 83651 - DNA, 201 bp, Bos taurus
aatgggttatgccagcatctccctggtgcccacttgaggccttgatagtggtcttgtacagagaagatgccctggaagacagaccaggggtgcggatagtaatgagtgtcagggccacatggggtagggggtggatgagaggctgctccattatcctgtccattctggcctctgtgcctccttctgcagatcgagggctca

SEQ ID NO: 83652 - DNA, 201 bp, Bos taurus; identical to SEQ ID NO: 1576

SEQ ID NO: 83653 - DNA, 201 bp, Bos taurus; identical to SEQ ID NO: 1577

SEQ ID NO: 83654 - DNA, 201 bp, Bos taurus; identical to SEQ ID NO: 1579

SEQ ID NO: 83655 - DNA, 201 bp, Bos taurus; identical to SEQ ID NO: 1581

SEQ ID NO: 83656 - DNA, 201 bp, Bos taurus; identical to SEQ ID NO: 1582

SEQ ID NO: 83657 - DNA, 201 bp, Bos taurus; identical to SEQ ID NO: 1583

SEQ ID NO: 83658 - DNA, 201 bp, Bos taurus; identical to SEQ ID NO: 1584

SEQ ID NO: 83659 - DNA, 201 bp, Bos taurus; identical to SEQ ID NO: 1585

SEQ ID NO: 83660 - DNA, 201 bp, Bos taurus; identical to SEQ ID NO: 1586

SEQ ID NO: 83661 - DNA, 201 bp, Bos taurus
ttgaattgaagagattgttgtgaggtagggatggtgtgatagggatccaatttcattcttttgcaggtagatatccagttatccctgaaccaattcttgaagagactattctaccttttatgtaacattttatcccataaggatgcccagtatccaaggcatcttatctgtacaactgtgattcccaaaccaagtgaggat

SEQ ID NO: 83662 - DNA, 201 bp, Bos taurus; identical to SEQ ID NO: 1587

SEQ ID NO: 83663 - DNA, 201 bp, Bos taurus
ttggtgacatcatcttgcacattatattttctaacatagatgatttaaagattgaaatcatggccctactctgtttatattcataaataaagtcatggaacatcatcaaaatggagtttatattaccagtcatttataaatgattgctgtgaaactttaagataacctgtcttctgagttatattaagaacttctcctgta

SEQ ID NO: 83664 - DNA, 201 bp, Bos taurus
tgttgtgatttcagtttcaaatctctgttttgcaggtatctaactccaaaatttcctttccttttaagaacaacaatttcttatttaaatacccatttccaatgcattcccaacttcctttacattagtatggcagttgactgtgctgtcttcaagtctccttttgtctgataccaggaaattttaattatttatactcat

SEQ ID NO: 83665 - DNA, 201 bp, Bos taurus; identical to SEQ ID NO: 1590

SEQ ID NO: 83666 - DNA, 201 bp, Bos taurus; identical to SEQ ID NO: 1591

SEQ ID NO: 83667 - DNA, 201 bp, Bos taurus
tcatgggacagattttcttgattatcctggagcatctacagagaaaaatttacaagatctcaggtcattaaactttctattcatgtcacagagaaccagagttcttctaaggaaaccttaaacactctcttctttttttccttatagccccagagataaatatttctgaaaattaaaacaaaatttaatggcttggactat

SEQ ID NO: 83668 - DNA, 201 bp, Bos taurus; identical to SEQ ID NO: 1592

SEQ ID NO: 83669 - DNA, 201 bp, Bos taurus; identical to SEQ ID NO: 1593

SEQ ID NO: 83670 - DNA, 201 bp, Bos taurus; identical to SEQ ID NO: 1594

SEQ ID NO: 83671 - DNA, 201 bp, Bos taurus; identical to SEQ ID NO: 1595

SEQ ID NO: 83672 - DNA, 201 bp, Bos taurus; identical to SEQ ID NO: 1596

SEQ ID NO: 83673 - DNA, 201 bp, Bos taurus; identical to SEQ ID NO: 1597

SEQ ID NO: 83674 - DNA, 201 bp, Bos taurus; identical to SEQ ID NO: 1598

SEQ ID NO: 83675 - DNA, 201 bp, Bos taurus; identical to SEQ ID NO: 1599

SEQ ID NO: 83676 - DNA, 201 bp, Bos taurus; identical to SEQ ID NO: 1600

SEQ ID NO: 83677 - DNA, 201 bp, Bos taurus; identical to SEQ ID NO: 1601

SEQ ID NO: 83678 - DNA, 201 bp, Bos taurus; identical to SEQ ID NO: 1602

SEQ ID NO: 83679 - DNA, 201 bp, Bos taurus; identical to SEQ ID NO: 1603

SEQ ID NO: 83680 - DNA, 201 bp, Bos taurus
ccaacacccatttgtggaacacctactgtgacaaggagagtcactgagaatacagtggtactcactatccatttccaaaaatattcatcctaggaacagagaatacaatttaacctattccctcatctgacttagcatttgagagcaagagtgataccttattcatctttgtgtgcccagcatctatgactaattcagatt

SEQ ID NO: 83681 - DNA, 201 bp, Bos taurus
caaatcaagacttggttccaaaaaagtaagatttgtttcctgatacagctagttcattatttatgcgttgagtctttcctttctctctttaaaatcatgacattctagaactttgtgaaaaagcaaattttgttcctttcaactatgactttgcatgaggaaatcacctcaggaaggttgatgagtctaagctacagagtc

SEQ ID NO: 83682 - DNA, 201 bp, Bos taurus; identical to SEQ ID NO: 1604

SEQ ID NO: 83683 - DNA, 201 bp, Bos taurus; identical to SEQ ID NO: 1605

SEQ ID NO: 83684 - DNA, 201 bp, Bos taurus; identical to SEQ ID NO: 1606

SEQ ID NO: 83685 - DNA, 201 bp, Bos taurus; identical to SEQ ID NO: 1607

SEQ ID NO: 83686 - DNA, 201 bp, Bos taurus
cagttctaactgttgggatgtaaatattctacctgatcttcctagattgttttgtgtctgtgtttttgattgttcacattttaggaaacttggccttgagagtaaactctgaatttaggttatatcctcccggactcatatatggggaagtcctttgcatcttgttggtctgaatcgctgttgtaatatatttaattggtg

SEQ ID NO: 83687 - DNA, 201 bp, Bos taurus
ttctgtcactgtttccattgtgacctccatgaggtcacagagaatcgaacatgactgaataacaccaatattctggaaacatctaccataaataactgttgctttattcatcaaaataaatgcctctcaaaacactctctccagctcatggaaccaaaaggcatgaaggcaatttttttttttaagagttttaaacttcta

SEQ ID NO: 83688 - DNA, 201 bp, Bos taurus
tcatttacagaattccatctgtgctgtatattctgcttcactcttaggagatatgcagaatttttcagaatgaacactacttaatgttaggaaattaggagggaaatcatctcattcctttttcctggagcagtagctgaaaatctttgaaaagttgagagattcatgaaactcagtatattgaagcaagatatcaggaat

SEQ ID NO: 83689 - DNA, 201 bp, Bos taurus; identical to SEQ ID NO: 1608

SEQ ID NO: 83690 - DNA, 201 bp, Bos taurus; identical to SEQ ID NO: 1610

SEQ ID NO: 83691 - DNA, 201 bp, Bos taurus
aaatatttgttcatcccagcaatgaagaagtgctcaggtgaatcttttgtaattatttgccctaaagtacccaaaatggtacaagtttggcaggagaactttggagtaggaggtcaggacaaaataggtagtccctgtgtcaatcaagcaattctcacagctacctcccacatccagctgtacccttggcctcggccccat

SEQ ID NO: 83692 - DNA, 201 bp, Bos taurus; identical to SEQ ID NO: 1611

SEQ ID NO: 83693 - DNA, 201 bp, Bos taurus
gacctcctccaatagggctaatgacacaacctgttctactgcacccagatcccctgcccctgggacaggccactgccaacccttacctctgcaagaaacattcaagcattcaaggttaggtctggcacagtctctgtggggtctcctggtgcacacaagattttgtttgagcatctctggagggcatgaggtttgattctt

SEQ ID NO: 83694 - DNA, 201 bp, Bos taurus
aattactatagaccatatctcatctgagaggctgcctccaccaagtaattgactttatttagctgtggttctttgctgtggaaagtaattatatgtaataggcattccctcatcttcaagtcacccaagatatgaagccaatagcaagaagtgattgcatataatgggagtagttgtttctaacagttgatgtacagtttc

SEQ ID NO: 83695 - DNA, 201 bp, Bos taurus; identical to SEQ ID NO: 1613

SEQ ID NO: 83696 - DNA, 201 bp, Bos taurus; identical to SEQ ID NO: 1614

SEQ ID NO: 83697 - DNA, 201 bp, Bos taurus; identical to SEQ ID NO: 1615

SEQ ID NO: 83698 - DNA, 201 bp, Bos taurus; identical to SEQ ID NO: 1616

SEQ ID NO: 83699 - DNA, 201 bp, Bos taurus; identical to SEQ ID NO: 1617

SEQ ID NO: 83700 - DNA, 201 bp, Bos taurus
cttctcatcatgatcaaataagtcatatttataccatatgacaaatataaggatattgatattaccaataaaatcttggacctcagcttagctacagaaaccttatagttttacactgggctctcaattagtttactcagcactttcccctcctgaatagtaaaaagcctccccttgactcagtgtatgcatgctcagtca

SEQ ID NO: 83701 - DNA, 201 bp, Bos taurus; identical to SEQ ID NO: 1618

SEQ ID NO: 83702 - DNA, 201 bp, Bos taurus; identical to SEQ ID NO: 1620

SEQ ID NO: 83703 - DNA, 201 bp, Bos taurus; identical to SEQ ID NO: 1621

SEQ ID NO: 83704 - DNA, 201 bp, Bos taurus; identical to SEQ ID NO: 1622

SEQ ID NO: 83705 - DNA, 201 bp, Bos taurus; identical to SEQ ID NO: 1623

SEQ ID NO: 83706 - DNA, 201 bp, Bos taurus
ttggtttctgacgggaggaaagtcacatttttttgatatgatggggctggtcatgtggagaaggataagatgggtgtgggcccatgcctgttcttttcttatgtggagggaagatgatttctgttcttgctggatgggatctgcactcaggcctccccactggtttcattgcacatggacatggggtggcagcatgagcag

SEQ ID NO: 83707 - DNA, 201 bp, Bos taurus
cttaagaaaaacacagctctccacgttgaaaccgtgcactcgcttttcctcccaaatggcttccagttttaaccatatggccatggttttctaaattacactttgaatctgcctttgcctcggtggaaggtgctagacaagcccagagccatccctctgctttgatgaccagaacgagatgcctacccaggcctgggaccc

SEQ ID NO: 83708 - DNA, 201 bp, Bos taurus
tgtgtctatatccttcctgtctcagtttacatcactaccccacccccagaaccagatattacaatggagaggacctgctgctccctcccagccaggccccggctatccaactgggtgcataaacccaaaggcaacaattattgcggaggagttatgtgcagaaatcaatcgccttgcccttgatggggaggatcaggctca

SEQ ID NO: 83709 - DNA, 201 bp, Bos taurus; identical to SEQ ID NO: 1624

SEQ ID NO: 83710 - DNA, 201 bp, Bos taurus; identical to SEQ ID NO: 1625

SEQ ID NO: 83711 - DNA, 201 bp, Bos taurus
ggctcaaacacatctttattaatcaaagtaggaaccattacaatcaacacattttttgccaatgaaaaataaatttattcctgtagtgtaaaaatccatgttttgggatttgataaacatttggagagcattttctgcttcctgctggttgtggaagtgttttccctgcaaaaagttaatgagatgcttgaagaagtggta

SEQ ID NO: 83712 - DNA, 201 bp, Bos taurus
agtcgagaagggtgactaaaatgggggagaaagaaacaggaaatgttgacatctaaattgtggaagcagtaccaccagcttggccatttcatctctggcccgtgtcatcacttcagttttttatttcaagagaagtatgtgcacttgtaagatacatttgaaaaagcaaggatctcaagaggttcatgtccccagcccggc

SEQ ID NO: 83713 - DNA, 201 bp, Bos taurus
accacgcggggcgccctctcctcatccccatcaatcactccagccactccctgtggcccgagggtgtcaggaagaagagggtgggtgggggccacactctctttttcttccggtttccccagaccgagagcccctgcagacttaacttgtgccgcgcttagtcgctcagtcctgtccgactctttgcgaccccatccatgg

SEQ ID NO: 83714 - DNA, 201 bp, Bos taurus
aacacaacttgatgcagctctagggaatgagtctagtgtgctcatgaggagtagagaactgctgaaggccctcggacagccccccggccccccctccccccgcgacatgcagggtcctcaaggagagcttatgtagcaaggacagtcactgaccttaaggggccctttggagaggaacaaggcccaaccaagtagccatct

SEQ ID NO: 83715 - DNA, 201 bp, Bos taurus; identical to SEQ ID NO: 1626

SEQ ID NO: 83716 - DNA, 201 bp, Bos taurus; identical to SEQ ID NO: 1627

SEQ ID NO: 83717 - DNA, 201 bp, Bos taurus; identical to SEQ ID NO: 1628

SEQ ID NO: 83718 - DNA, 201 bp, Bos taurus; identical to SEQ ID NO: 1629

SEQ ID NO: 83719 - DNA, 201 bp, Bos taurus
tagcaaccgtatttatgcctgcagaaattcttcacttttgccacataatgtcactcagtcagggaagtgatagttcatcacattcactggagctgcccccactcaagggcagctgccacaatgcagcttataattctgcctatcatacttttgtagccccaagacctctagggcatctgacactgaataggagtttagtac

SEQ ID NO: 83720 - DNA, 201 bp, Bos taurus; identical to SEQ ID NO: 43197

SEQ ID NO: 83721 - DNA, 201 bp, Bos taurus; identical to SEQ ID NO: 1631

SEQ ID NO: 83722 - DNA, 201 bp, Bos taurus
atgtgttggaaatattacacgtgggagctggtgaacacagcaagaaagcagcatctgtctcacacactcaagctgtgtgttctttcacctccaatctttggatgttattgtcaactcccagctcccaagactcctcctctaagtagtatcacacctgctgcaaggcttagggactctctgtaaccagcttgtagcagtact

SEQ ID NO: 83723 - DNA, 201 bp, Bos taurus; identical to SEQ ID NO: 1632

SEQ ID NO: 83724 - DNA, 201 bp, Bos taurus; identical to SEQ ID NO: 1634

SEQ ID NO: 83725 - DNA, 201 bp, Bos taurus
ctattgtcttcttaaatgaaaaaaaaaatgtagataaaaataaattttaaaacatactcaccattcagttttgagataataagagtataatagaagtgagtaagagatagaagtgagtaagaaagagtgttcctaaaggatttgtatagcttaatgaaaatttaaaaatttagcagaataagacattcattgactacttgt

SEQ ID NO: 83726 - DNA, 201 bp, Bos taurus
agaaagcaaccacttcaagaaagagggttcaagagtacataaatctcaaatatttggcatgcaagggcttcggggatgggggaaagaggggagaagagaatttcagagtttctgacttagacaccaaggtggattgtaatattattcacagcatgggaaatgctataaaaggagcatatttggactgtgggagaaggcagg

SEQ ID NO: 83727 - DNA, 201 bp, Bos taurus; identical to SEQ ID NO: 1635

SEQ ID NO: 83728 - DNA, 201 bp, Bos taurus; identical to SEQ ID NO: 1636

SEQ ID NO: 83729 - DNA, 201 bp, Bos taurus
gaatacagaagcctggcaggttacagtccatagggtcacaagagcccaacatgactgagggagtaaatatgggggaaactggattaagcacggaaattgagtccaggttctttctgtactatctttacaatttcctgtcaatctataatattttaaactaaaaacaaactaaaaacaaaaagctttcctttttccattgta

SEQ ID NO: 83730 - DNA, 201 bp, Bos taurus; identical to SEQ ID NO: 1637

SEQ ID NO: 83731 - DNA, 201 bp, Bos taurus; identical to SEQ ID NO: 1639

SEQ ID NO: 83732 - DNA, 201 bp, Bos taurus; identical to SEQ ID NO: 1640

SEQ ID NO: 83733 - DNA, 201 bp, Bos taurus; identical to SEQ ID NO: 1641

SEQ ID NO: 83734 - DNA, 201 bp, Bos taurus; identical to SEQ ID NO: 1642

SEQ ID NO: 83735 - DNA, 201 bp, Bos taurus; identical to SEQ ID NO: 1643

SEQ ID NO: 83736 - DNA, 201 bp, Bos taurus
ctttgcctctcgagttctgtgtgaagagttaggcctggtgtagggggctggatttttttctagactacttaactgcccggcatgattgtgcatttgggcagaggcccattggacaggacactctagatataagtatacattacatacaatacgtacatcgaatgcatacactacccttggaatccatttcttaaactgtca

SEQ ID NO: 83737 - DNA, 201 bp, Bos taurus; identical to SEQ ID NO: 1645

SEQ ID NO: 83738 - DNA, 201 bp, Bos taurus; identical to SEQ ID NO: 1646

SEQ ID NO: 83739 - DNA, 201 bp, Bos taurus; identical to SEQ ID NO: 1647

SEQ ID NO: 83740 - DNA, 201 bp, Bos taurus; identical to SEQ ID NO: 1648

SEQ ID NO: 83741 - DNA, 201 bp, Bos taurus; identical to SEQ ID NO: 1649

SEQ ID NO: 83742 - DNA, 201 bp, Bos taurus
ctcataaagatattaaaaggtaatctcctttctgatatggaattctagactcctgtattagagggcacaataaagatcagatacctctagaggctaaaacctggaggccataggctcttgactaaggccagtaaaaaattaacacccaagtaaggatcagaccccaagactgccgatgaacatgccctgtggcgtttcctc

SEQ ID NO: 83743 - DNA, 201 bp, Bos taurus; identical to SEQ ID NO: 1650

SEQ ID NO: 83744 - DNA, 201 bp, Bos taurus; identical to SEQ ID NO: 1651

SEQ ID NO: 83745 - DNA, 201 bp, Bos taurus; identical to SEQ ID NO: 1652

SEQ ID NO: 83746 - DNA, 201 bp, Bos taurus; identical to SEQ ID NO: 1653

SEQ ID NO: 83747 - DNA, 201 bp, Bos taurus; identical to SEQ ID NO: 1654

SEQ ID NO: 83748 - DNA, 201 bp, Bos taurus
catggatgcctgctgcagtctaaatccggccatcgatattgggcaggtaggtgctgccccacctggatggatgcctctttttgagagtcattgtggggtcggtaaaggccttctgaaaagcacataatatcagagcttggcattttccctcttcagattgaaggtgcgtttattcagggaatgggcctttataccactgaa

SEQ ID NO: 83749 - DNA, 201 bp, Bos taurus
agagataattaggagtaaatgaggtcatcagggagtggcctaattcaatttagctggtgtctttctaaaaagagactaggaaacacacccagaggaatgatgaggttaagaaaggagatggccatctacaagcctcaagagtaaacaactctgcccacaccttgacctcccaacttctagtctctagaactttctagaaaa

SEQ ID NO: 83750 - DNA, 201 bp, Bos taurus; identical to SEQ ID NO: 1655

SEQ ID NO: 83751 - DNA, 201 bp, Bos taurus; identical to SEQ ID NO: 1656

SEQ ID NO: 83752 - DNA, 201 bp, Bos taurus
taggtgaccctctgttctaacacattgggtcctctggctggtgtctcaggaggaatggacactgccagctgggataagggttggggggccaggacttctcccctctgtgcagtcacacaacaatgtggggtgacaggaggaatgtgagaattacaatgtgaagtctctccatcgaaataatctctaaatatgtcttcagta

SEQ ID NO: 83753 - DNA, 201 bp, Bos taurus
ttcatattttgcattgtttttctagtaaggattcaatttaattcaaataagtcaaaaagttttgagcacctactatctgccaggcattgtgttatatgcttggcctgcatagatgaatttggcacattcttggatctctaagaggttgggtttgtagtcactcaaccacagtctttcaccagctcagcttatgagagggtg

SEQ ID NO: 83754 - DNA, 201 bp, Bos taurus
ttgtttccttctggccacttattctagccattccacatataaaagcaagtccaagacattttctcttgagcctgttaactaccctctctctcttcccattataaatggccttgccacagaaggcaatccagtttggggtaggagttcttagttaaaatagaaacttctctcattggattacatcctgagttcttgtgttta

SEQ ID NO: 83755 - DNA, 201 bp, Bos taurus; identical to SEQ ID NO: 1657

SEQ ID NO: 83756 - DNA, 201 bp, Bos taurus
agtatggatagaggagaaagaagatattaagtatcaattgtggccctcggaaaaaccacagaggctaatttccaagttttttctcaggaagagagtaaggtgggtacatagaaaaaaggcccagtaaagcccaattatcgttgtaattctcatcccaaactccccactaggttggtttaggagttatgggggctgcatcat

SEQ ID NO: 83757 - DNA, 201 bp, Bos taurus
aggtcactggaataatggccaaatcatttatacctcttaaatatccatacggttgaataaaatggtcctaagtaaatggtcctaagaaacaaggaggcaacttgtgttaaattttaggccaagatgttgaaagttaaaaaaaaaatccttcccatcatggaaaactccaaaatacccctttctacctttcaaaggaacaaa

SEQ ID NO: 83758 - DNA, 201 bp, Bos taurus
agactgtatcttattcatatatgtgttttctccagcaccttgcatatggcatcttgtacatacagaagttcagcaatgtttgtcaaactaaaagatgagatatactactaagaaatatctggcaacactttgaaaactagattagagtaacagaaacaactaggggagcgctgtttgtattaatccatgtatgaagtgatg

SEQ ID NO: 83759 - DNA, 201 bp, Bos taurus
gataacctctattctactttctacatctttgattttgcatattttaggtaccacaggtcatacaacatttatccatttgtgactgactccatttcgcataatattttcaaagttcatccaattgcagcacgcaccattacttcactcctttctatgactgaataacattccattgtatggatatgccacattttgtttatc

SEQ ID NO: 83760 - DNA, 201 bp, Bos taurus; identical to SEQ ID NO: 1659

SEQ ID NO: 83761 - DNA, 201 bp, Bos taurus; identical to SEQ ID NO: 1660

SEQ ID NO: 83762 - DNA, 201 bp, Bos taurus; identical to SEQ ID NO: 1662

SEQ ID NO: 83763 - DNA, 201 bp, Bos taurus; identical to SEQ ID NO: 1663

SEQ ID NO: 83764 - DNA, 201 bp, Bos taurus; identical to SEQ ID NO: 1664

SEQ ID NO: 83765 - DNA, 201 bp, Bos taurus; identical to SEQ ID NO: 1665

SEQ ID NO: 83766 - DNA, 201 bp, Bos taurus; identical to SEQ ID NO: 1666

SEQ ID NO: 83767 - DNA, 201 bp, Bos taurus; identical to SEQ ID NO: 1667

SEQ ID NO: 83768 - DNA, 201 bp, Bos taurus; identical to SEQ ID NO: 1668

SEQ ID NO: 83769 - DNA, 201 bp, Bos taurus; identical to SEQ ID NO: 1669

SEQ ID NO: 83770 - DNA, 201 bp, Bos taurus; identical to SEQ ID NO: 1670

SEQ ID NO: 83771 - DNA, 201 bp, Bos taurus; identical to SEQ ID NO: 1671

SEQ ID NO: 83772 - DNA, 201 bp, Bos taurus; identical to SEQ ID NO: 1672

SEQ ID NO: 83773 - DNA, 201 bp, Bos taurus; identical to SEQ ID NO: 1673

SEQ ID NO: 83774 - DNA, 201 bp, Bos taurus; identical to SEQ ID NO: 1674

SEQ ID NO: 83775 - DNA, 201 bp, Bos taurus; identical to SEQ ID NO: 1675

SEQ ID NO: 83776 - DNA, 201 bp, Bos taurus; identical to SEQ ID NO: 1676

SEQ ID NO: 83777 - DNA, 201 bp, Bos taurus; identical to SEQ ID NO: 1677

SEQ ID NO: 83778 - DNA, 201 bp, Bos taurus; identical to SEQ ID NO: 1678

SEQ ID NO: 83779 - DNA, 201 bp, Bos taurus
gagagtgctgcggtcatgtcctctttctgtcattgaatccagtgctggtaatgggctcttgtttagggtcctgtcctcctaggacctcaccacagcctcaagggccgctgaacttctcatcgttattccccaatcttcagcgtctttaggggactccattgccttccctggaaaaggccatactccatatgttcataaaaa

SEQ ID NO: 83780 - DNA, 201 bp, Bos taurus; identical to SEQ ID NO: 1679

SEQ ID NO: 83781 - DNA, 201 bp, Bos taurus; identical to SEQ ID NO: 1680

SEQ ID NO: 83782 - DNA, 201 bp, Bos taurus; identical to SEQ ID NO: 1681

SEQ ID NO: 83783 - DNA, 201 bp, Bos taurus; identical to SEQ ID NO: 1682

SEQ ID NO: 83784 - DNA, 201 bp, Bos taurus; identical to SEQ ID NO: 1683

SEQ ID NO: 83785 - DNA, 201 bp, Bos taurus; identical to SEQ ID NO: 1684

SEQ ID NO: 83786 - DNA, 201 bp, Bos taurus; identical to SEQ ID NO: 1685

SEQ ID NO: 83787 - DNA, 201 bp, Bos taurus; identical to SEQ ID NO: 1686

SEQ ID NO: 83788 - DNA, 201 bp, Bos taurus; identical to SEQ ID NO: 1687

SEQ ID NO: 83789 - DNA, 201 bp, Bos taurus; identical to SEQ ID NO: 1688

SEQ ID NO: 83790 - DNA, 201 bp, Bos taurus; identical to SEQ ID NO: 1689

SEQ ID NO: 83791 - DNA, 201 bp, Bos taurus; identical to SEQ ID NO: 1690

SEQ ID NO: 83792 - DNA, 201 bp, Bos taurus; identical to SEQ ID NO: 1691

SEQ ID NO: 83793 - DNA, 201 bp, Bos taurus; identical to SEQ ID NO: 1692

SEQ ID NO: 83794 - DNA, 201 bp, Bos taurus; identical to SEQ ID NO: 1693

SEQ ID NO: 83795 - DNA, 201 bp, Bos taurus; identical to SEQ ID NO: 1694

SEQ ID NO: 83796 - DNA, 201 bp, Bos taurus; identical to SEQ ID NO: 1695

SEQ ID NO: 83797 - DNA, 201 bp, Bos taurus; identical to SEQ ID NO: 1696

SEQ ID NO: 83798 - DNA, 201 bp, Bos taurus; identical to SEQ ID NO: 1697

SEQ ID NO: 83799 - DNA, 201 bp, Bos taurus; identical to SEQ ID NO: 1698

SEQ ID NO: 83800 - DNA, 201 bp, Bos taurus; identical to SEQ ID NO: 43249

SEQ ID NO: 83801 - DNA, 201 bp, Bos taurus; identical to SEQ ID NO: 1699

SEQ ID NO: 83802 - DNA, 201 bp, Bos taurus; identical to SEQ ID NO: 1701

SEQ ID NO: 83803 - DNA, 201 bp, Bos taurus; identical to SEQ ID NO: 1702

SEQ ID NO: 83804 - DNA, 201 bp, Bos taurus; identical to SEQ ID NO: 1703

SEQ ID NO: 83805 - DNA, 201 bp, Bos taurus; identical to SEQ ID NO: 1704

SEQ ID NO: 83806 - DNA, 201 bp, Bos taurus; identical to SEQ ID NO: 1706

SEQ ID NO: 83807 - DNA, 201 bp, Bos taurus; identical to SEQ ID NO: 1707

SEQ ID NO: 83808 - DNA, 201 bp, Bos taurus; identical to SEQ ID NO: 43257

SEQ ID NO: 83809 - DNA, 201 bp, Bos taurus; identical to SEQ ID NO: 1708

SEQ ID NO: 83810 - DNA, 201 bp, Bos taurus; identical to SEQ ID NO: 1709

SEQ ID NO: 83811 - DNA, 201 bp, Bos taurus; identical to SEQ ID NO: 1710

SEQ ID NO: 83812 - DNA, 201 bp, Bos taurus; identical to SEQ ID NO: 1711

SEQ ID NO: 83813 - DNA, 201 bp, Bos taurus; identical to SEQ ID NO: 1712

SEQ ID NO: 83814 - DNA, 201 bp, Bos taurus; identical to SEQ ID NO: 1713

SEQ ID NO: 83815 - DNA, 201 bp, Bos taurus; identical to SEQ ID NO: 1716

SEQ ID NO: 83816 - DNA, 201 bp, Bos taurus; identical to SEQ ID NO: 1717

SEQ ID NO: 83817 - DNA, 201 bp, Bos taurus; identical to SEQ ID NO: 1718

SEQ ID NO: 83818 - DNA, 201 bp, Bos taurus
cttggccagctccctccagccgtctcatttccttttgccccacggccctatggtcactgcctccctccagagcttgctatgttggcttctctacgtgctccatccatcccggccccgagctgccccttcacccattcctccagccctgcagtctgcttttgcctgctgggcttaatcttcacacccgcctctttgagcccc

SEQ ID NO: 83819 - DNA, 201 bp, Bos taurus
acagtgcctgcagtaatcagaaacccaggagaagcagtcaccacctggctgtatgaagtctgcagaaaagcttttccacgggtcgccctcgagtgtgcttggctgaaaacaagcaaatccacacagctcagccgggtctttgctggtctttgctctcccggtcctactgtgtgaccatgggtttcacttcttaatagaccc

SEQ ID NO: 83820 - DNA, 201 bp, Bos taurus; identical to SEQ ID NO: 1719

SEQ ID NO: 83821 - DNA, 201 bp, Bos taurus; identical to SEQ ID NO: 1720

SEQ ID NO: 83822 - DNA, 201 bp, Bos taurus; identical to SEQ ID NO: 1721

SEQ ID NO: 83823 - DNA, 201 bp, Bos taurus; identical to SEQ ID NO: 1722

SEQ ID NO: 83824 - DNA, 201 bp, Bos taurus; identical to SEQ ID NO: 1723

SEQ ID NO: 83825 - DNA, 201 bp, Bos taurus; identical to SEQ ID NO: 1724

SEQ ID NO: 83826 - DNA, 201 bp, Bos taurus; identical to SEQ ID NO: 1725

SEQ ID NO: 83827 - DNA, 201 bp, Bos taurus; identical to SEQ ID NO: 1726

SEQ ID NO: 83828 - DNA, 201 bp, Bos taurus; identical to SEQ ID NO: 1727

SEQ ID NO: 83829 - DNA, 201 bp, Bos taurus; identical to SEQ ID NO: 1728

SEQ ID NO: 83830 - DNA, 201 bp, Bos taurus; identical to SEQ ID NO: 1729

SEQ ID NO: 83831 - DNA, 201 bp, Bos taurus; identical to SEQ ID NO: 1730

SEQ ID NO: 83832 - DNA, 201 bp, Bos taurus; identical to SEQ ID NO: 1731

SEQ ID NO: 83833 - DNA, 201 bp, Bos taurus; identical to SEQ ID NO: 1732

SEQ ID NO: 83834 - DNA, 201 bp, Bos taurus; identical to SEQ ID NO: 1733

SEQ ID NO: 83835 - DNA, 201 bp, Bos taurus; identical to SEQ ID NO: 1734

SEQ ID NO: 83836 - DNA, 201 bp, Bos taurus; identical to SEQ ID NO: 1735

SEQ ID NO: 83837 - DNA, 201 bp, Bos taurus; identical to SEQ ID NO: 1737

SEQ ID NO: 83838 - DNA, 201 bp, Bos taurus; identical to SEQ ID NO: 1738

SEQ ID NO: 83839 - DNA, 201 bp, Bos taurus; identical to SEQ ID NO: 1739

SEQ ID NO: 83840 - DNA, 201 bp, Bos taurus; identical to SEQ ID NO: 1740

SEQ ID NO: 83841 - DNA, 201 bp, Bos taurus; identical to SEQ ID NO: 1741

SEQ ID NO: 83842 - DNA, 201 bp, Bos taurus; identical to SEQ ID NO: 1742

SEQ ID NO: 83843 - DNA, 201 bp, Bos taurus; identical to SEQ ID NO: 1743

SEQ ID NO: 83844 - DNA, 201 bp, Bos taurus; identical to SEQ ID NO: 1744

SEQ ID NO: 83845 - DNA, 201 bp, Bos taurus; identical to SEQ ID NO: 1745

SEQ ID NO: 83846 - DNA, 201 bp, Bos taurus; identical to SEQ ID NO: 1746

SEQ ID NO: 83847 - DNA, 201 bp, Bos taurus; identical to SEQ ID NO: 1747

SEQ ID NO: 83848 - DNA, 201 bp, Bos taurus; identical to SEQ ID NO: 1748

SEQ ID NO: 83849 - DNA, 201 bp, Bos taurus; identical to SEQ ID NO: 1749

SEQ ID NO: 83850 - DNA, 201 bp, Bos taurus; identical to SEQ ID NO: 1751

SEQ ID NO: 83851 - DNA, 201 bp, Bos taurus; identical to SEQ ID NO: 1752

SEQ ID NO: 83852 - DNA, 201 bp, Bos taurus; identical to SEQ ID NO: 1753

SEQ ID NO: 83853 - DNA, 201 bp, Bos taurus; identical to SEQ ID NO: 1754

SEQ ID NO: 83854 - DNA, 201 bp, Bos taurus
cacaaaagtgcattcacacaaaaatggttgctgtttaccagagcaaggattacctcttggtcaataaattaagcatcatagttatatttccttttgtgtaatatctgctaagcatttatgcaaaacacatgcctttacctaaaacattatgtttactgttacgaagaagacaattaaaatataagtatgaagccctctact

SEQ ID NO: 83855 - DNA, 201 bp, Bos taurus; identical to SEQ ID NO: 1755

SEQ ID NO: 83856 - DNA, 201 bp, Bos taurus; identical to SEQ ID NO: 1757

SEQ ID NO: 83857 - DNA, 201 bp, Bos taurus; identical to SEQ ID NO: 1758

SEQ ID NO: 83858 - DNA, 201 bp, Bos taurus; identical to SEQ ID NO: 1759

SEQ ID NO: 83859 - DNA, 201 bp, Bos taurus; identical to SEQ ID NO: 1760

SEQ ID NO: 83860 - DNA, 201 bp, Bos taurus; identical to SEQ ID NO: 1761

SEQ ID NO: 83861 - DNA, 201 bp, Bos taurus; identical to SEQ ID NO: 1762

SEQ ID NO: 83862 - DNA, 201 bp, Bos taurus; identical to SEQ ID NO: 1771

SEQ ID NO: 83863 - DNA, 201 bp, Bos taurus
ccagcatcacctggccttccaatcacattttgcgtagtaaggaagtagggcacgaggcacatatcagtggataactgctatcagacacagttgtttataactgcctatgcaatatcacacaacatcagaaccttccctggcagcaagtttttatttcgtttgatgaactgcagcccggttcaatttcacctgctccctaaa

SEQ ID NO: 83864 - DNA, 201 bp, Bos taurus
caccagtccaaggtgacccagccaaaagaggtagagtggtccaactcttccattatttcaaaggtagagatacaggtagcatctccatcagaaagaccagaaggaggcctgacctgtgaatctcaccatgcattattgatctgtcagctgaaataaataaagctctgcataaaacaggaggacaaagtgaaatttcactgg

SEQ ID NO: 83865 - DNA, 201 bp, Bos taurus; identical to SEQ ID NO: 1774

SEQ ID NO: 83866 - DNA, 201 bp, Bos taurus; identical to SEQ ID NO: 1775

SEQ ID NO: 83867 - DNA, 201 bp, Bos taurus; identical to SEQ ID NO: 1776

SEQ ID NO: 83868 - DNA, 201 bp, Bos taurus
gaaaaagatgtcagaatccaagtttttctcctcttggcagtggttcactttaacttctgcctagtggtactgtttccttgatactttttgatttcccaaatcaaaatgatagtgatagagagaccataaaagtagttgaggcaagattggttatcttgaggtagtctttttctttaccttttgatagaaacatgggtagta

SEQ ID NO: 83869 - DNA, 201 bp, Bos taurus; identical to SEQ ID NO: 1777

SEQ ID NO: 83870 - DNA, 201 bp, Bos taurus
ttatggcacagagactctatttggggatattttgaggtgggcttagaggtaaggatatttggctgaagtcaacagtaagcaatgaccacagagtcaactctgattagagtacaatacacaatacgggatatccatatagatagagggagacaatgtgaaacacacgagtcaaagaaactcaaggattttgagaacatcatg

SEQ ID NO: 83871 - DNA, 201 bp, Bos taurus
ccacatttaagcctatttcattggttttttatagattcaattgtactttagctacattcaaagagtgacattaaatctatttcacctcagattttcacttaatctaatgaatttgggcctcctttggaaatgatcacatcattcacgaggtactgtaagaatctatgatatgaagctggatgatccaaaatgatgctgacc

SEQ ID NO: 83872 - DNA, 201 bp, Bos taurus
aagatattattaaaagctattatattttaccttccctaatagagatcatattttaaggggaatgaaaaccaagatggcaatgtggtcaacatctatttcccatttgttactgtctaccctggaaatgttttgagggaaggaggaacagtctatgtaccttacccaaattctaatagttaaatcaactgaaaattctatttt

SEQ ID NO: 83873 - DNA, 201 bp, Bos taurus; identical to SEQ ID NO: 1778

SEQ ID NO: 83874 - DNA, 201 bp, Bos taurus; identical to SEQ ID NO: 1779

SEQ ID NO: 83875 - DNA, 201 bp, Bos taurus
gtgtaggatgagcatgccttcagaatcattagatccatgtatatgttgggcaagggattgaacctcaaagccaatgatttcaaaatccaaggcagggagtgggaagggtgatgaagagtcagaatcacctagtcctcaagtgagtagggacagggaaagagtggagagttaacatggcccagggaaatgtgctaggattgt

SEQ ID NO: 83876 - DNA, 201 bp, Bos taurus
ctcaaagaaaaatttggaatggaaatagaaggatgaggctaggtgggcaggaaaatggaggaaatctgaagaaaaaaataacaaggctcatgacccattaactataggcctgtagaatactcatgcaaaaaaactcattgtttctgaatcagctcacaatactacggtgacttgggtccacttttcttgctaaggttggag

SEQ ID NO: 83877 - DNA, 201 bp, Bos taurus; identical to SEQ ID NO: 1780

SEQ ID NO: 83878 - DNA, 201 bp, Bos taurus; identical to SEQ ID NO: 1781

SEQ ID NO: 83879 - DNA, 201 bp, Bos taurus
aatggaaggcctggggaaggtgaggtggtaacttactgtggttttgatttgcatttcccagatgattaatgacattaagcacttttctcatgtacctggtggctatttgtatgtcttcagtggcctgttcaggttctgtgcccatcttttagctaggttattcgtgggttttttttttttttttttagttatatgaattac

SEQ ID NO: 83880 - DNA, 201 bp, Bos taurus; identical to SEQ ID NO: 1782

SEQ ID NO: 83881 - DNA, 201 bp, Bos taurus; identical to SEQ ID NO: 1783

SEQ ID NO: 83882 - DNA, 201 bp, Bos taurus; identical to SEQ ID NO: 1784

SEQ ID NO: 83883 - DNA, 201 bp, Bos taurus; identical to SEQ ID NO: 1785

SEQ ID NO: 83884 - DNA, 201 bp, Bos taurus
aaacaaaaacattaactttccctcttgtccttaaattcttgtgctcttaagtatttaagaacataacaaatgagtatcagtcattctgtgggttccatttgacaataacttctcttattgtccatgccacacaggtggtgctcatctagaattactgcatgcacatcacagacagagattccttatcatgattgacgatgc

SEQ ID NO: 83885 - DNA, 201 bp, Bos taurus; identical to SEQ ID NO: 1786

SEQ ID NO: 83886 - DNA, 201 bp, Bos taurus; identical to SEQ ID NO: 1787

SEQ ID NO: 83887 - DNA, 201 bp, Bos taurus; identical to SEQ ID NO: 1788

SEQ ID NO: 83888 - DNA, 201 bp, Bos taurus; identical to SEQ ID NO: 1789

SEQ ID NO: 83889 - DNA, 201 bp, Bos taurus
ggcccagagattctaccctataaagagcgaaatgatgtcatctgtgttcaaattattgcataaggtttttctttccttaagtattttttaaacatcctctctttattccttttttacttcttggccatcccacgtggcatatgggatattagttccctgatcagggatcgaaccagtgccccctgttttggaagtgtagag

SEQ ID NO: 83890 - DNA, 201 bp, Bos taurus; identical to SEQ ID NO: 1790

SEQ ID NO: 83891 - DNA, 201 bp, Bos taurus
gccaagtcagatgttcaggcctgtgttctgtttatagaatgtgtgatctgaaagcccaaacagcactggtcattttgacagccttaatgagtcatttagattggcaattactaaaataattacatgaagacaagctcactgtggtcatcacaaacggtttcacctttttcaatagactctcctctatctcctgttgttaaa

SEQ ID NO: 83892 - DNA, 201 bp, Bos taurus
agtgctccatcatcaaattgagaagtgaagaacactaggttaagaggtaggttcttctcagtgattctttttgtctcttttccttgtctatatcatgagacaggaccagctgtctccaaaacagatggctctggggaggaaatggaagtaggcttgatggagactgtgcaagggatgactgactaccccttcagtggtaga

SEQ ID NO: 83893 - DNA, 201 bp, Bos taurus
agaacctggtactattatttagcaacttgatggtgctggccatatttgataacactcatgaagttggagtgtgtgataggaaatcagaatattggttaactatagcccttagatgactggccgctagcttttcccattggcctcggtcaagtcagtgtcagtgatggctgttaagatgcttactcacatgatctctcgtgt

SEQ ID NO: 83894 - DNA, 201 bp, Bos taurus; identical to SEQ ID NO: 1791

SEQ ID NO: 83895 - DNA, 201 bp, Bos taurus; identical to SEQ ID NO: 1792

SEQ ID NO: 83896 - DNA, 201 bp, Bos taurus; identical to SEQ ID NO: 1793

SEQ ID NO: 83897 - DNA, 201 bp, Bos taurus; identical to SEQ ID NO: 1794

SEQ ID NO: 83898 - DNA, 201 bp, Bos taurus
tcacaggttagactgggctaaacaggtgaaagagaagaacgatgtgtgtctgtatgaacaccaccagcagcagccaaaacgacagataactggacagcgaaataagagaataggacactgaaccaatctaccaaaaataaactgacagggaggaatccaaccaaacacatcgccaaaagtgtcagctaaaaatacagccag

SEQ ID NO: 83899 - DNA, 201 bp, Bos taurus
tgtgtgtgtgtgtgtgtgtgtgtgagtgtgtgtgtgtgtgtgtgtgtttgtatgcgtatctgtctgtccatgtgagatttatagtgtctttttctgtaaacgcaacaattatagattttttttcactttatcagtacttcctagaaaaacaatggcttgagtatttatttagttgtagaccttgagctcagtcttctttag

SEQ ID NO: 83900 - DNA, 201 bp, Bos taurus; identical to SEQ ID NO: 1795

SEQ ID NO: 83901 - DNA, 201 bp, Bos taurus; identical to SEQ ID NO: 1796

SEQ ID NO: 83902 - DNA, 201 bp, Bos taurus
gggagagtttcattatcattttgtatatattgaggtaatctgaaaggtgggattatcttttgaagcaagttctttgttactcctaaggcctgttctagccgtgtgggaaaactctctacccatcagtgaatgtgcttacctttaagacttgagcatccgagtaaaatcaattggccagttcttcattttgtttccttggtg

SEQ ID NO: 83903 - DNA, 201 bp, Bos taurus; identical to SEQ ID NO: 1797

SEQ ID NO: 83904 - DNA, 201 bp, Bos taurus; identical to SEQ ID NO: 1798

SEQ ID NO: 83905 - DNA, 201 bp, Bos taurus; identical to SEQ ID NO: 1799

SEQ ID NO: 83906 - DNA, 201 bp, Bos taurus; identical to SEQ ID NO: 1800

SEQ ID NO: 83907 - DNA, 201 bp, Bos taurus; identical to SEQ ID NO: 1801

SEQ ID NO: 83908 - DNA, 201 bp, Bos taurus
gattaagaggtagggcaggcctgttctatgcgatttctgaggtccaggaaagtaccatcacattcttacctgaagacactgatgcctggaaatcccataatggaaggcagggccattcatgcttcactcagagcttgggtaaaaatgcaaagacattggaaaagtacctgtaaaataaaattcacaatgagccctaaatga

SEQ ID NO: 83909 - DNA, 201 bp, Bos taurus
ttctgtgtatccttctctaccctagtttctgggaactacaaatctgttttctgtccccacagtattgatttttccaaaaagtcatataagtggaatgacgaggtatgtagctttttcagtctggattccctccctcaccataatgtgtttaaggtttgtcataagctgaattgtaaccctacaaattcacatgttggagcc

SEQ ID NO: 83910 - DNA, 201 bp, Bos taurus; identical to SEQ ID NO: 1802

SEQ ID NO: 83911 - DNA, 201 bp, Bos taurus; identical to SEQ ID NO: 1803

SEQ ID NO: 83912 - DNA, 201 bp, Bos taurus; identical to SEQ ID NO: 1804

SEQ ID NO: 83913 - DNA, 201 bp, Bos taurus
gtctgcatttcagtcaaggtctcttctggatatactgttgcctaatcgctatcttgtaaagttaacctccaataatcctcatatgaaataatatgaagtaagggagagacagaggatgaaagtaagatacacatgtaacaagtgaaaaagaaaatacccatattttctatgaccggtaccaatcatgatgtcataatggat

SEQ ID NO: 83914 - DNA, 201 bp, Bos taurus
accaggctcctccgtccatgggattttccaggcaagagtactggagtggggtgccatcgccttctccgttacataggttagtatgaactaaatactataacataacctataaaggaagagtttttaaaaagtgagtataactcatatacatctttcacttttaagagcagagatccatactgacatattcaatgagaaaag

SEQ ID NO: 83915 - DNA, 201 bp, Bos taurus
ctgtccccagactacaggtccagacaggaatgaattttgtggccgtcttgtgaaatccatgtctggtgtgaaccacgtcttgtgtgaaccacacactgcacccagaccaggcagcggtgcctggccagttccagattcctattgcagaatcgatgatgatcacgctcacatgatctggattattaacttgattctttgaga

SEQ ID NO: 83916 - DNA, 201 bp, Bos taurus
cggcacggatcactttggcactctggttgcggttgggactgaggttcacccgcgtgaaggcgctcgggccccccaggagggccgagcgggccgccagctcccctgttcccggaggaggcgcagtggaggaaacagaggctgtcgaagatgaggagggagcggccgcggtggccctgggcaagctggcatcctccacaacga

SEQ ID NO: 83917 - DNA, 201 bp, Bos taurus; identical to SEQ ID NO: 1805

SEQ ID NO: 83918 - DNA, 201 bp, Bos taurus; identical to SEQ ID NO: 1806

SEQ ID NO: 83919 - DNA, 201 bp, Bos taurus
gtcccaggtgatgtaggcccaggccagggaaggctctaaaccggggaaggatgaaatccacttaaggactggagacctcctcactccaaacccagtagcaccaagctctcttgggtgcaggcctgggagacagaatgtcatgtcaggctccactcaggcctccccagctggattctgcagttaatgtatttagaggattcc

SEQ ID NO: 83920 - DNA, 201 bp, Bos taurus; identical to SEQ ID NO: 1807

SEQ ID NO: 83921 - DNA, 201 bp, Bos taurus; identical to SEQ ID NO: 1808

SEQ ID NO: 83922 - DNA, 201 bp, Bos taurus; identical to SEQ ID NO: 1809

SEQ ID NO: 83923 - DNA, 201 bp, Bos taurus
gctccaggggttcccccacttctgaagtggactctgctctgtgactctctgcacattctgtaaggacaaatctatacttcatcaaccacctgaatgaatactggggacattttcaccgggggaagtttggtgtctgtaactttccaggtaatttccctcatctgaataacttgagtgaaaacaggtccaagcacacagcct

SEQ ID NO: 83924 - DNA, 201 bp, Bos taurus; identical to SEQ ID NO: 1810

SEQ ID NO: 83925 - DNA, 201 bp, Bos taurus; identical to SEQ ID NO: 1811

SEQ ID NO: 83926 - DNA, 201 bp, Bos taurus; identical to SEQ ID NO: 1812

SEQ ID NO: 83927 - DNA, 201 bp, Bos taurus
ttcccaagccagggatcgaatccaggtctccctcattgcaggtggtttctttaccatctgagccaccagggaatcccataatgtacatccaggcctgccaatgactttggatgatttttgtgcaaagtgtacatggtgcagatttgctactcatgaaagggacagcgggtttggccatgcaacgcttgagtattggtctgt

SEQ ID NO: 83928 - DNA, 201 bp, Bos taurus; identical to SEQ ID NO: 1813

SEQ ID NO: 83929 - DNA, 201 bp, Bos taurus; identical to SEQ ID NO: 1814

SEQ ID NO: 83930 - DNA, 201 bp, Bos taurus
atctggagctttctgtcctttccaaagatctttcagttcctcgtgttgtagaatgggggcttctttttttaaactgcctgtcaaccagggtacctttcaacaaccacaggccacccccaggtcctagttaactgattccctccacagatggctcaaaacatggctgtttgctttcttctaggccagcaaaagcagacttga

SEQ ID NO: 83931 - DNA, 201 bp, Bos taurus
tgtttccattaaaaaattatatccagactcaccagagtctataacctctcttgagctcccaccagtgatcagcggtgagaagcatgaacaaggctgtccagagaagccccaaagccctgcttggcctgtccccctcaagactgaagtacacatcccctgccatgtgtcactgccacatgaagagaactgtaattaaacaat

SEQ ID NO: 83932 - DNA, 201 bp, Bos taurus
cagggccctcccacagcctgtggctttaccttcctcctggaatctggagcctgtccatccagatggcaggaggagaatgaaggaacgctgcacatttcataggccaggcttggacaaggaatacatctcttctgcccgcatttcaggggtcaggactcagttatatgggacgcctacctgccaaggagactgggaaaggtc

SEQ ID NO: 83933 - DNA, 201 bp, Bos taurus
ggggacactctaccctggccgccattttgctgggactccatgagaggtacatgaagctgcagctcaactcagcttgacttctgacacacaggaaggtcctgaagatggtactaatggccctattcttatgtgggttggacaaccacattgcacagaagttctgagactgtctttctttccccactggcattactatcagaa

SEQ ID NO: 83934 - DNA, 201 bp, Bos taurus; identical to SEQ ID NO: 1815

SEQ ID NO: 83935 - DNA, 201 bp, Bos taurus; identical to SEQ ID NO: 1817

SEQ ID NO: 83936 - DNA, 201 bp, Bos taurus; identical to SEQ ID NO: 1819

SEQ ID NO: 83937 - DNA, 201 bp, Bos taurus; identical to SEQ ID NO: 1820

SEQ ID NO: 83938 - DNA, 201 bp, Bos taurus; identical to SEQ ID NO: 1821

SEQ ID NO: 83939 - DNA, 201 bp, Bos taurus; identical to SEQ ID NO: 1825

SEQ ID NO: 83940 - DNA, 201 bp, Bos taurus; identical to SEQ ID NO: 1827

SEQ ID NO: 83941 - DNA, 201 bp, Bos taurus; identical to SEQ ID NO: 1828

SEQ ID NO: 83942 - DNA, 201 bp, Bos taurus; identical to SEQ ID NO: 1829

SEQ ID NO: 83943 - DNA, 201 bp, Bos taurus; identical to SEQ ID NO: 1832

SEQ ID NO: 83944 - DNA, 201 bp, Bos taurus; identical to SEQ ID NO: 1833

SEQ ID NO: 83945 - DNA, 201 bp, Bos taurus; identical to SEQ ID NO: 1834

SEQ ID NO: 83946 - DNA, 201 bp, Bos taurus; identical to SEQ ID NO: 1835

SEQ ID NO: 83947 - DNA, 201 bp, Bos taurus; identical to SEQ ID NO: 1836

SEQ ID NO: 83948 - DNA, 201 bp, Bos taurus; identical to SEQ ID NO: 1837

SEQ ID NO: 83949 - DNA, 201 bp, Bos taurus
ttagtaagatgaagtgtatgctgaatgataggctggtactagttaggctggattagcagagaggaaaggcggggaaggagaaagtcagagctggaagagaccgggactctaactcactggaatttgaagaaaccttgaggacatcattggatttctaccaagtgtgaggtaggaaatgccagtcaatttttatttagatct

SEQ ID NO: 83950 - DNA, 201 bp, Bos taurus; identical to SEQ ID NO: 1839

SEQ ID NO: 83951 - DNA, 201 bp, Bos taurus
gtttaatacccctgctctgaagaaactgtccagcgctgcctacccagatccctcaaagcagagtaaggccagctggggaggggcccgggaaggggggtctatgggggctgcctacatgagagagcatgagagacatgtagagagcctgtcagtgcctcagaaaagggtttgtcttcagttcaggcccaagaagccaggagg

SEQ ID NO: 83952 - DNA, 201 bp, Bos taurus
cccagttgctctgggaacggccgggcctgtccaggtggggccggcgggtcgctcgctttcccaagccagggactgcctctgaggattgcagtggaaccaagagaactaggggcccaggctccagataggcggggtccggaaccttgctgctgctagggacaatcaaccactaccccgtgagtgtcacgtgtctgcgtatct

SEQ ID NO: 83953 - DNA, 201 bp, Bos taurus
ccttaaatgtgctctgacctagttccctgtgaaaattcaatagtggtagtttacatgtttttgaaacactttgaaattattttatataaagtttggttgtcgtgaatttattgaaaatattttctttgaaaaaagttccctaagtagatttttcaatatttttttaaaaaaggtatttctgtaacacaataaaagtaagag

SEQ ID NO: 83954 - DNA, 201 bp, Bos taurus; identical to SEQ ID NO: 1840

SEQ ID NO: 83955 - DNA, 201 bp, Bos taurus; identical to SEQ ID NO: 1841

SEQ ID NO: 83956 - DNA, 201 bp, Bos taurus
gccccctctgatgtccaggaggctcatgtcatgcccaatgctgctgcccatctcaaacacgcgccggcagtcgacgatggccttcatgaagttacggggtgtctggcatcttgagcccacatggaagctgaacacacatcaagtgacatgtagagaaacacccgtgaaaaagcaaaggtcagtaggaggacagacatggcc

SEQ ID NO: 83957 - DNA, 201 bp, Bos taurus; identical to SEQ ID NO: 1842

SEQ ID NO: 83958 - DNA, 201 bp, Bos taurus; identical to SEQ ID NO: 1843

SEQ ID NO: 83959 - DNA, 201 bp, Bos taurus
ctcaactcccagactctggtaagaggttgaaaactgggtgctggcccccgaaatcagtggcagagccaaggcttaaatccaggcccatccccttggcattccaatgttgcgcgtttatttatgtccaacgactttaactgatcatttcactttaatatagtctgatgtaacattcaatggcagcctctgggactatgaaat

SEQ ID NO: 83960 - DNA, 201 bp, Bos taurus
aaccatgccatccatgtctgtgactccagcgcccacctcagctgtcggtaagtgacagtgaatcagaaacccagacaggaacagattttggaggagggccgtggggtttggtgtcaggatgcctgaacctcagttcccccacctgtcaggtggaaacaataacccccaccctggggaatcatgaagtgaaggggcccagca

SEQ ID NO: 83961 - DNA, 201 bp, Bos taurus; identical to SEQ ID NO: 1847

SEQ ID NO: 83962 - DNA, 201 bp, Bos taurus; identical to SEQ ID NO: 1849

SEQ ID NO: 83963 - DNA, 201 bp, Bos taurus; identical to SEQ ID NO: 1850

SEQ ID NO: 83964 - DNA, 201 bp, Bos taurus
gctgcacttacagtgggaaccagccaggccgctgctgactggcacagggctgtgtcttttggactgtggtcctcatgtccacagttcctaatcaggccagcgtctgttctttctcatctcgtgcagagatactgtcatgccagaatgtgtgccctttccccatgaaggtctgaccgaggcctccctgcccagaatcatcta

SEQ ID NO: 83965 - DNA, 201 bp, Bos taurus; identical to SEQ ID NO: 1854

SEQ ID NO: 83966 - DNA, 201 bp, Bos taurus; identical to SEQ ID NO: 1855

SEQ ID NO: 83967 - DNA, 201 bp, Bos taurus
ctggggagggcgggcaggcagcagccagggccagacccacggagggagccaggatgcctggctgatgactctgaggatgtctgccaaggccggacagccacgtggagaatgcccaccatcctgggtgggtagacgctccaataactgcaagttccaatgccagtttcccagtttcatctcaggagagatgtgtcgagttgg

SEQ ID NO: 83968 - DNA, 201 bp, Bos taurus; identical to SEQ ID NO: 1856

SEQ ID NO: 83969 - DNA, 201 bp, Bos taurus; identical to SEQ ID NO: 1857

SEQ ID NO: 83970 - DNA, 201 bp, Bos taurus; identical to SEQ ID NO: 1858

SEQ ID NO: 83971 - DNA, 201 bp, Bos taurus; identical to SEQ ID NO: 1859

SEQ ID NO: 83972 - DNA, 201 bp, Bos taurus; identical to SEQ ID NO: 1860

SEQ ID NO: 83973 - DNA, 201 bp, Bos taurus; identical to SEQ ID NO: 1861

SEQ ID NO: 83974 - DNA, 201 bp, Bos taurus; identical to SEQ ID NO: 1862

SEQ ID NO: 83975 - DNA, 201 bp, Bos taurus
ctcattggcccagcttgggttatatgtccatctttgtaccagtcactgttgtgctctgattggttagatagaccagacctccttgtgtgctctcatctagcgaaataaagatggagttgggccccccagggctttatagaatgagaataggacaagtgaatctgtaaattactacaggagcatgcagtttccaaaaggtgt

SEQ ID NO: 83976 - DNA, 201 bp, Bos taurus; identical to SEQ ID NO: 1863

SEQ ID NO: 83977 - DNA, 201 bp, Bos taurus; identical to SEQ ID NO: 1865

SEQ ID NO: 83978 - DNA, 201 bp, Bos taurus; identical to SEQ ID NO: 1868

SEQ ID NO: 83979 - DNA, 201 bp, Bos taurus; identical to SEQ ID NO: 1869

SEQ ID NO: 83980 - DNA, 201 bp, Bos taurus; identical to SEQ ID NO: 1870

SEQ ID NO: 83981 - DNA, 201 bp, Bos taurus; identical to SEQ ID NO: 1871

SEQ ID NO: 83982 - DNA, 201 bp, Bos taurus; identical to SEQ ID NO: 1872

SEQ ID NO: 83983 - DNA, 201 bp, Bos taurus; identical to SEQ ID NO: 1873

SEQ ID NO: 83984 - DNA, 201 bp, Bos taurus; identical to SEQ ID NO: 1874

SEQ ID NO: 83985 - DNA, 201 bp, Bos taurus; identical to SEQ ID NO: 1875

SEQ ID NO: 83986 - DNA, 201 bp, Bos taurus; identical to SEQ ID NO: 1878

SEQ ID NO: 83987 - DNA, 201 bp, Bos taurus; identical to SEQ ID NO: 1879

SEQ ID NO: 83988 - DNA, 201 bp, Bos taurus
tgctcaggaaatgctagtggcctgtaccgtggtcccagtctgaaaacaggttccctgggaagggctggtttccctggattctcccatgcccagtgcccagtacctgggtgcgatgtgggccagctggtgctgttcagtggacatttgctgagtaccatctgcacgccaaacactgtgctgggcactgaggattcaagagcg

SEQ ID NO: 83989 - DNA, 201 bp, Bos taurus; identical to SEQ ID NO: 1880

SEQ ID NO: 83990 - DNA, 201 bp, Bos taurus; identical to SEQ ID NO: 1881

SEQ ID NO: 83991 - DNA, 201 bp, Bos taurus; identical to SEQ ID NO: 1883

SEQ ID NO: 83992 - DNA, 201 bp, Bos taurus; identical to SEQ ID NO: 1885

SEQ ID NO: 83993 - DNA, 201 bp, Bos taurus; identical to SEQ ID NO: 1886

SEQ ID NO: 83994 - DNA, 201 bp, Bos taurus; identical to SEQ ID NO: 1887

SEQ ID NO: 83995 - DNA, 201 bp, Bos taurus; identical to SEQ ID NO: 1888

SEQ ID NO: 83996 - DNA, 201 bp, Bos taurus; identical to SEQ ID NO: 1889

SEQ ID NO: 83997 - DNA, 201 bp, Bos taurus; identical to SEQ ID NO: 1890

SEQ ID NO: 83998 - DNA, 201 bp, Bos taurus
atcaacttgactttgtcagaacatgaaggctcaagtcctggcttggcctgccacttgctataaactgggggcaaaggccttgccctttctgaacccatttactcgaggaatgccacctgcctcatataatggctatgagccctcccctgctgtgcaaactgtcaaataaaatatactctgaatgtgggcctgatgggtcca

SEQ ID NO: 83999 - DNA, 201 bp, Bos taurus
tctgtgaagagagacaaggcagttgtttcagatccacagcagtttggacaccagacaccagtggtttaggcaaacccaaggcctgctactcttggctctacgcagccagatgaaccgatgcaagtagcagcccaaagcgaatgctttccaagcacccgccagggccccgacaatcactccctctaagtctctcgggctggc

SEQ ID NO: 84000 - DNA, 201 bp, Bos taurus
ctctaaagcctgcagaaaggagtacagccctgcagacacctggattgtagctcaatgagacccatttccggattctggcctccagaaatgtgagaggatatgtttgtgacaactttttacagcagcaacaggaaactactcaacggtctaggcgctgccatgatccaggaggcctcacgttcacctgcgggccacaccagt

SEQ ID NO: 84001 - DNA, 201 bp, Bos taurus; identical to SEQ ID NO: 1893

SEQ ID NO: 84002 - DNA, 201 bp, Bos taurus
agaacttacttgctctttctccaccatgtgagggcttagcaagaaggtggctgtataaagcctagaagagagctctggccagaaaccagattaacggacaacttgatcttagacttcccagtctccagaattgtgagaaatgaattgctgctaagtaacgtagtctatagtattttattatggcagcctgagctgactagg

SEQ ID NO: 84003 - DNA, 201 bp, Bos taurus; identical to SEQ ID NO: 1894

SEQ ID NO: 84004 - DNA, 201 bp, Bos taurus; identical to SEQ ID NO: 1895

SEQ ID NO: 84005 - DNA, 201 bp, Bos taurus; identical to SEQ ID NO: 1897

SEQ ID NO: 84006 - DNA, 201 bp, Bos taurus; identical to SEQ ID NO: 1898

SEQ ID NO: 84007 - DNA, 201 bp, Bos taurus; identical to SEQ ID NO: 1899

SEQ ID NO: 84008 - DNA, 201 bp, Bos taurus; identical to SEQ ID NO: 1900

SEQ ID NO: 84009 - DNA, 201 bp, Bos taurus
gctcagcgtctggtgcaggacggtgcttccaggatagccacaggcgaaataaatgagtgcctgctctcaggcaacggcagctcaggacgtggctacaaccatgatacaaaagaaaggaaaggccccacctgcggctgactggcttggaaccattgctcaaggctcacagactcagaggaacactgtcacgtggtcaactcc

SEQ ID NO: 84010 - DNA, 201 bp, Bos taurus; identical to SEQ ID NO: 1901

SEQ ID NO: 84011 - DNA, 201 bp, Bos taurus; identical to SEQ ID NO: 1902

SEQ ID NO: 84012 - DNA, 201 bp, Bos taurus; identical to SEQ ID NO: 1903

SEQ ID NO: 84013 - DNA, 201 bp, Bos taurus; identical to SEQ ID NO: 1904

SEQ ID NO: 84014 - DNA, 201 bp, Bos taurus; identical to SEQ ID NO: 1905

SEQ ID NO: 84015 - DNA, 201 bp, Bos taurus; identical to SEQ ID NO: 1906

SEQ ID NO: 84016 - DNA, 201 bp, Bos taurus; identical to SEQ ID NO: 1907

SEQ ID NO: 84017 - DNA, 201 bp, Bos taurus; identical to SEQ ID NO: 1908

SEQ ID NO: 84018 - DNA, 201 bp, Bos taurus; identical to SEQ ID NO: 1909

SEQ ID NO: 84019 - DNA, 201 bp, Bos taurus; identical to SEQ ID NO: 1910

SEQ ID NO: 84020 - DNA, 201 bp, Bos taurus; identical to SEQ ID NO: 1911

SEQ ID NO: 84021 - DNA, 201 bp, Bos taurus; identical to SEQ ID NO: 1912

SEQ ID NO: 84022 - DNA, 201 bp, Bos taurus; identical to SEQ ID NO: 1913

SEQ ID NO: 84023 - DNA, 201 bp, Bos taurus; identical to SEQ ID NO: 1914

SEQ ID NO: 84024 - DNA, 201 bp, Bos taurus; identical to SEQ ID NO: 1915

SEQ ID NO: 84025 - DNA, 201 bp, Bos taurus; identical to SEQ ID NO: 1916

SEQ ID NO: 84026 - DNA, 201 bp, Bos taurus; identical to SEQ ID NO: 1917

SEQ ID NO: 84027 - DNA, 201 bp, Bos taurus; identical to SEQ ID NO: 1918

SEQ ID NO: 84028 - DNA, 201 bp, Bos taurus; identical to SEQ ID NO: 1919

SEQ ID NO: 84029 - DNA, 201 bp, Bos taurus; identical to SEQ ID NO: 1920

SEQ ID NO: 84030 - DNA, 201 bp, Bos taurus; identical to SEQ ID NO: 1921

SEQ ID NO: 84031 - DNA, 201 bp, Bos taurus; identical to SEQ ID NO: 1922

SEQ ID NO: 84032 - DNA, 201 bp, Bos taurus; identical to SEQ ID NO: 1923

SEQ ID NO: 84033 - DNA, 201 bp, Bos taurus; identical to SEQ ID NO: 1924

SEQ ID NO: 84034 - DNA, 201 bp, Bos taurus; identical to SEQ ID NO: 1925

SEQ ID NO: 84035 - DNA, 201 bp, Bos taurus; identical to SEQ ID NO: 1926

SEQ ID NO: 84036 - DNA, 201 bp, Bos taurus; identical to SEQ ID NO: 1927

SEQ ID NO: 84037 - DNA, 201 bp, Bos taurus; identical to SEQ ID NO: 1928

SEQ ID NO: 84038 - DNA, 201 bp, Bos taurus; identical to SEQ ID NO: 1929

SEQ ID NO: 84039 - DNA, 201 bp, Bos taurus; identical to SEQ ID NO: 1930

SEQ ID NO: 84040 - DNA, 201 bp, Bos taurus; identical to SEQ ID NO: 1931

SEQ ID NO: 84041 - DNA, 201 bp, Bos taurus; identical to SEQ ID NO: 1932

SEQ ID NO: 84042 - DNA, 201 bp, Bos taurus; identical to SEQ ID NO: 1933

SEQ ID NO: 84043 - DNA, 201 bp, Bos taurus; identical to SEQ ID NO: 1934

SEQ ID NO: 84044 - DNA, 201 bp, Bos taurus; identical to SEQ ID NO: 1935

SEQ ID NO: 84045 - DNA, 201 bp, Bos taurus; identical to SEQ ID NO: 1936

SEQ ID NO: 84046 - DNA, 201 bp, Bos taurus; identical to SEQ ID NO: 1937

SEQ ID NO: 84047 - DNA, 201 bp, Bos taurus; identical to SEQ ID NO: 1938

SEQ ID NO: 84048 - DNA, 201 bp, Bos taurus; identical to SEQ ID NO: 1939

SEQ ID NO: 84049 - DNA, 201 bp, Bos taurus; identical to SEQ ID NO: 1940

SEQ ID NO: 84050 - DNA, 201 bp, Bos taurus; identical to SEQ ID NO: 1941

SEQ ID NO: 84051 - DNA, 201 bp, Bos taurus; identical to SEQ ID NO: 1942

SEQ ID NO: 84052 - DNA, 201 bp, Bos taurus; identical to SEQ ID NO: 1943

SEQ ID NO: 84053 - DNA, 201 bp, Bos taurus; identical to SEQ ID NO: 1944

SEQ ID NO: 84054 - DNA, 201 bp, Bos taurus; identical to SEQ ID NO: 1945

SEQ ID NO: 84055 - DNA, 201 bp, Bos taurus; identical to SEQ ID NO: 1946

SEQ ID NO: 84056 - DNA, 201 bp, Bos taurus; identical to SEQ ID NO: 1947

SEQ ID NO: 84057 - DNA, 201 bp, Bos taurus; identical to SEQ ID NO: 1948

SEQ ID NO: 84058 - DNA, 201 bp, Bos taurus; identical to SEQ ID NO: 1949

SEQ ID NO: 84059 - DNA, 201 bp, Bos taurus; identical to SEQ ID NO: 1950

SEQ ID NO: 84060 - DNA, 201 bp, Bos taurus
gcaggagaagggcacagattccctgtggtgtccctggccccgcctaaggagggctgaccgacctctgccagtaagcagatgggcccccagcttccccagcgtggctcaggtctgtgtcaacccgtccataatctccagatttggtgaatccctacccaggcccggctccttcatggatcacagccttgtcgtgacaaacct

SEQ ID NO: 84061 - DNA, 201 bp, Bos taurus; identical to SEQ ID NO: 1951

SEQ ID NO: 84062 - DNA, 201 bp, Bos taurus; identical to SEQ ID NO: 1953

SEQ ID NO: 84063 - DNA, 201 bp, Bos taurus; identical to SEQ ID NO: 1955

SEQ ID NO: 84064 - DNA, 201 bp, Bos taurus; identical to SEQ ID NO: 1956

SEQ ID NO: 84065 - DNA, 201 bp, Bos taurus; identical to SEQ ID NO: 1957

SEQ ID NO: 84066 - DNA, 201 bp, Bos taurus; identical to SEQ ID NO: 1959

SEQ ID NO: 84067 - DNA, 201 bp, Bos taurus; identical to SEQ ID NO: 1961

SEQ ID NO: 84068 - DNA, 201 bp, Bos taurus; identical to SEQ ID NO: 1964

SEQ ID NO: 84069 - DNA, 201 bp, Bos taurus; identical to SEQ ID NO: 1965

SEQ ID NO: 84070 - DNA, 201 bp, Bos taurus
ttcttgagtctccaacaatctaaggccggggctgagctgttaatcagtctactagctgtggggcttctactctgaaacgtctggtgaggagtggcaggcgggaaggggcagggccacgaataccctcctgggctcctgacctccgctgtcctgtgccccaggccatctgcagatctgctcaggcagggatgtcctctcctc

SEQ ID NO: 84071 - DNA, 201 bp, Bos taurus; identical to SEQ ID NO: 1967

SEQ ID NO: 84072 - DNA, 201 bp, Bos taurus; identical to SEQ ID NO: 1970

SEQ ID NO: 84073 - DNA, 201 bp, Bos taurus
aaggaagaggagtgagaggtagagcagtcataatcataacaactctggaagcccactaggtgaatgttgtcccttggttaggccctggatctgctcctgggagtaactcccaagtttatgttctttaccattatggctccacactctaggaggcccttcacttttcatcattctccttagcctcttccaaggccaaagggg

SEQ ID NO: 84074 - DNA, 201 bp, Bos taurus
tgttttgtcagaactcttcatgttttggctggccctgcacgacaaggtcatagcttcactgagttttgtaaatctcttcaccatgacaaagttgtgatctgtgaaggggacattatatacaaacctgtattatgtgcttagtcactcagttgtgtctgattgacacaaccccatggattgtagcccaccaagctcctctgt

SEQ ID NO: 84075 - DNA, 201 bp, Bos taurus; identical to SEQ ID NO: 1972

SEQ ID NO: 84076 - DNA, 201 bp, Bos taurus; identical to SEQ ID NO: 1973

SEQ ID NO: 84077 - DNA, 201 bp, Bos taurus; identical to SEQ ID NO: 1975

SEQ ID NO: 84078 - DNA, 201 bp, Bos taurus; identical to SEQ ID NO: 1979

SEQ ID NO: 84079 - DNA, 201 bp, Bos taurus
gagacagagggacgttgggtcaataacttgatttgttcaggatctgagtgggcagcagtagaaaagaggaaggaaactcatattggtaagacttctctttaggccttcattactttggaccatcattactttaggccccatgacttacttgtatctctctaaggtatgttattcttattttagaaaggggaaaactgaggt

SEQ ID NO: 84080 - DNA, 201 bp, Bos taurus; identical to SEQ ID NO: 1980

SEQ ID NO: 84081 - DNA, 201 bp, Bos taurus
gagaggctgctggctctgctctgaatgggctttagaaccaccttgcctgtctaacctgtcgtcttcttccttttctgctatttggtgtataaaactaaatcctatccccgggatgggcttccagcttttaacacagacctctcattgtggttctcagagcttttaaaatgaaaacagtgtttccagaattaggcaagtatg

SEQ ID NO: 84082 - DNA, 201 bp, Bos taurus
tcataagtagtatgtagcttcctgggaaggagctgaagttgtcagttctcaagacaaaagtacttccaaatacacagaattactctccctcaaaaagtcagccagacagtgtacctgaagtgggggctctgagacctcctctggagccatggatgggttttgtcatcagacacacttctggggattcatttttgagagatt

SEQ ID NO: 84083 - DNA, 201 bp, Bos taurus; identical to SEQ ID NO: 1982

SEQ ID NO: 84084 - DNA, 201 bp, Bos taurus; identical to SEQ ID NO: 1983

SEQ ID NO: 84085 - DNA, 201 bp, Bos taurus
aagtgttgctcactttttttgcttaggttctggctgctttctgaatgcttactcatttgaggaatgaaaaccatttaaattaagtttctccagataacattgctttcttttctcccctaacttaacaaaaacattccgaatcaagccagtttgacaatctgctttaagcagctgcctaaatcagaagttagcgagaggtgc

SEQ ID NO: 84086 - DNA, 201 bp, Bos taurus
ggttaagtgtgtgaacacaggggtagacagcagcctctctgtgagagacaaataagcattcggaagactcaagaagctaaagtcagtggaggctcacttcggcacaaaccttgggggaatttatgcattattagtcaatatcagagcctccaagcatgtgtccctttagaacaagaactctcaaaggcctgacaaggagga

SEQ ID NO: 84087 - DNA, 201 bp, Bos taurus; identical to SEQ ID NO: 1987

SEQ ID NO: 84088 - DNA, 201 bp, Bos taurus; identical to SEQ ID NO: 1988

SEQ ID NO: 84089 - DNA, 201 bp, Bos taurus; identical to SEQ ID NO: 1989

SEQ ID NO: 84090 - DNA, 201 bp, Bos taurus; identical to SEQ ID NO: 1991

SEQ ID NO: 84091 - DNA, 201 bp, Bos taurus; identical to SEQ ID NO: 1992

SEQ ID NO: 84092 - DNA, 201 bp, Bos taurus; identical to SEQ ID NO: 1996

SEQ ID NO: 84093 - DNA, 201 bp, Bos taurus; identical to SEQ ID NO: 1997

SEQ ID NO: 84094 - DNA, 201 bp, Bos taurus; identical to SEQ ID NO: 1998

SEQ ID NO: 84095 - DNA, 201 bp, Bos taurus; identical to SEQ ID NO: 2000

SEQ ID NO: 84096 - DNA, 201 bp, Bos taurus
tgacaccccatgacagccctcattttctaagctgaccttcagtctttgcccttggacccttttgttcacattctgttgttgcaaagggacagaaacacaacccactactgccttattatgttttaatttcctgagtagttctagcatctcataggcatcttcactgtctctctcttttcagttgctcccctttgttctggg

SEQ ID NO: 84097 - DNA, 201 bp, Bos taurus; identical to SEQ ID NO: 2001

SEQ ID NO: 84098 - DNA, 201 bp, Bos taurus; identical to SEQ ID NO: 2002

SEQ ID NO: 84099 - DNA, 201 bp, Bos taurus; identical to SEQ ID NO: 2003

SEQ ID NO: 84100 - DNA, 201 bp, Bos taurus; identical to SEQ ID NO: 2004

SEQ ID NO: 84101 - DNA, 201 bp, Bos taurus; identical to SEQ ID NO: 2005

SEQ ID NO: 84102 - DNA, 201 bp, Bos taurus; identical to SEQ ID NO: 2006

SEQ ID NO: 84103 - DNA, 201 bp, Bos taurus; identical to SEQ ID NO: 2007

SEQ ID NO: 84104 - DNA, 201 bp, Bos taurus; identical to SEQ ID NO: 2009

SEQ ID NO: 84105 - DNA, 201 bp, Bos taurus; identical to SEQ ID NO: 2010

SEQ ID NO: 84106 - DNA, 201 bp, Bos taurus; identical to SEQ ID NO: 2011

SEQ ID NO: 84107 - DNA, 201 bp, Bos taurus; identical to SEQ ID NO: 2012

SEQ ID NO: 84108 - DNA, 201 bp, Bos taurus; identical to SEQ ID NO: 2013

SEQ ID NO: 84109 - DNA, 201 bp, Bos taurus; identical to SEQ ID NO: 2014

SEQ ID NO: 84110 - DNA, 201 bp, Bos taurus; identical to SEQ ID NO: 2015

SEQ ID NO: 84111 - DNA, 201 bp, Bos taurus; identical to SEQ ID NO: 2016

SEQ ID NO: 84112 - DNA, 201 bp, Bos taurus; identical to SEQ ID NO: 2017

SEQ ID NO: 84113 - DNA, 201 bp, Bos taurus; identical to SEQ ID NO: 2018

SEQ ID NO: 84114 - DNA, 201 bp, Bos taurus; identical to SEQ ID NO: 2019

SEQ ID NO: 84115 - DNA, 201 bp, Bos taurus; identical to SEQ ID NO: 2020

SEQ ID NO: 84116 - DNA, 201 bp, Bos taurus; identical to SEQ ID NO: 2021

SEQ ID NO: 84117 - DNA, 201 bp, Bos taurus; identical to SEQ ID NO: 2022

SEQ ID NO: 84118 - DNA, 201 bp, Bos taurus; identical to SEQ ID NO: 2023

SEQ ID NO: 84119 - DNA, 201 bp, Bos taurus; identical to SEQ ID NO: 2024

SEQ ID NO: 84120 - DNA, 201 bp, Bos taurus; identical to SEQ ID NO: 2025

SEQ ID NO: 84121 - DNA, 201 bp, Bos taurus; identical to SEQ ID NO: 2026

SEQ ID NO: 84122 - DNA, 201 bp, Bos taurus; identical to SEQ ID NO: 2027

SEQ ID NO: 84123 - DNA, 201 bp, Bos taurus
gggccctaccatgcagggattgtgtgggccccaccatagacatacagatggtgcatctcgacttagacagacttaggaagttgtgaaatggatatgtacacacagggaggatggaggccccaacacacacacacacattcgaacacaagtgtacacagagtatctatcattcccttctcttcttctacaccgtggcttatg

SEQ ID NO: 84124 - DNA, 201 bp, Bos taurus; identical to SEQ ID NO: 2028

SEQ ID NO: 84125 - DNA, 201 bp, Bos taurus; identical to SEQ ID NO: 2029

SEQ ID NO: 84126 - DNA, 201 bp, Bos taurus; identical to SEQ ID NO: 2030

SEQ ID NO: 84127 - DNA, 201 bp, Bos taurus; identical to SEQ ID NO: 2031

SEQ ID NO: 84128 - DNA, 201 bp, Bos taurus; identical to SEQ ID NO: 2032

SEQ ID NO: 84129 - DNA, 201 bp, Bos taurus; identical to SEQ ID NO: 2033

SEQ ID NO: 84130 - DNA, 201 bp, Bos taurus
ctacagtttaaaaagtttgatgtaaaaataaatgatgagattgtcactgctcttctcaataagaaaataaaagtccctaaataaaatgttcatattgtttcaaatgagaatttaatgcccagtgacatgctgatgtctttagtctcagacacatcgtggaatcttctattaaactttctggtgaaatttgccaaaattacc

SEQ ID NO: 84131 - DNA, 201 bp, Bos taurus; identical to SEQ ID NO: 2035

SEQ ID NO: 84132 - DNA, 201 bp, Bos taurus; identical to SEQ ID NO: 2036

SEQ ID NO: 84133 - DNA, 201 bp, Bos taurus; identical to SEQ ID NO: 2037

SEQ ID NO: 84134 - DNA, 201 bp, Bos taurus; identical to SEQ ID NO: 2038

SEQ ID NO: 84135 - DNA, 201 bp, Bos taurus
aatctgcctctgaaaccaggcagatgcctccaccggtgacctgtgtccttggacaagacactccacttccttattcttcagtttcctcatattaaaatgaaattaatttattttctcataagattttgtgatgattaaatgagttaacatattcaaagggcttggaactatgtctgaaatttactaaacattcaaatagca

SEQ ID NO: 84136 - DNA, 201 bp, Bos taurus; identical to SEQ ID NO: 2039

SEQ ID NO: 84137 - DNA, 201 bp, Bos taurus
agatcttattataaattctcctgctatgccatggtctagtgagcaatgccctcatcactttcatcatcttactaagtaaatctctctaatctcaacacatgtgtagaggcctcttcttcctcttgagcgatatgtggtcagaaacctaataggcaagtctttctgactgtcaacattaccaaacatctgtgaaaatccttt

SEQ ID NO: 84138 - DNA, 201 bp, Bos taurus
attctgtgctcaaacctttataaaggcctttattttagaaaggaggcctcagcagccatgccaaacatgcaggtggtatttgcatgacataaggaataatgaactgctaggtgtgaaggataggcctggaacctgtgagagtctgtttttccaggaagccttgggatgcaagcagcaattgccatatattgctctaatggc

SEQ ID NO: 84139 - DNA, 201 bp, Bos taurus; identical to SEQ ID NO: 2040

SEQ ID NO: 84140 - DNA, 201 bp, Bos taurus; identical to SEQ ID NO: 2041

SEQ ID NO: 84141 - DNA, 201 bp, Bos taurus; identical to SEQ ID NO: 2044

SEQ ID NO: 84142 - DNA, 201 bp, Bos taurus; identical to SEQ ID NO: 2045

SEQ ID NO: 84143 - DNA, 201 bp, Bos taurus; identical to SEQ ID NO: 2046

SEQ ID NO: 84144 - DNA, 201 bp, Bos taurus; identical to SEQ ID NO: 2048

SEQ ID NO: 84145 - DNA, 201 bp, Bos taurus; identical to SEQ ID NO: 2050

SEQ ID NO: 84146 - DNA, 201 bp, Bos taurus; identical to SEQ ID NO: 2052

SEQ ID NO: 84147 - DNA, 201 bp, Bos taurus; identical to SEQ ID NO: 2053

SEQ ID NO: 84148 - DNA, 201 bp, Bos taurus; identical to SEQ ID NO: 2054

SEQ ID NO: 84149 - DNA, 201 bp, Bos taurus; identical to SEQ ID NO: 2055

SEQ ID NO: 84150 - DNA, 201 bp, Bos taurus; identical to SEQ ID NO: 2056

SEQ ID NO: 84151 - DNA, 201 bp, Bos taurus; identical to SEQ ID NO: 2057

SEQ ID NO: 84152 - DNA, 201 bp, Bos taurus; identical to SEQ ID NO: 2058

SEQ ID NO: 84153 - DNA, 201 bp, Bos taurus; identical to SEQ ID NO: 2059

SEQ ID NO: 84154 - DNA, 201 bp, Bos taurus; identical to SEQ ID NO: 2061

SEQ ID NO: 84155 - DNA, 201 bp, Bos taurus; identical to SEQ ID NO: 2062

SEQ ID NO: 84156 - DNA, 201 bp, Bos taurus; identical to SEQ ID NO: 2063

SEQ ID NO: 84157 - DNA, 201 bp, Bos taurus
tgcacagctacagttggaaactgagaagggaaaaattttcggcccatattatgtttctcggcaaccagttgcagatttgaactggtgcaggtcaggcctcggtccagcccttggtgaaatgggtgtttatctgtagcccgttggctgcattctgttgtctgccgtggtaaatggcctctatcggcagagccagggtgtagc

SEQ ID NO: 84158 - DNA, 201 bp, Bos taurus; identical to SEQ ID NO: 2064

SEQ ID NO: 84159 - DNA, 201 bp, Bos taurus; identical to SEQ ID NO: 2065

SEQ ID NO: 84160 - DNA, 201 bp, Bos taurus; identical to SEQ ID NO: 2066

SEQ ID NO: 84161 - DNA, 201 bp, Bos taurus; identical to SEQ ID NO: 2067

SEQ ID NO: 84162 - DNA, 201 bp, Bos taurus; identical to SEQ ID NO: 2068

SEQ ID NO: 84163 - DNA, 201 bp, Bos taurus; identical to SEQ ID NO: 2069

SEQ ID NO: 84164 - DNA, 201 bp, Bos taurus; identical to SEQ ID NO: 2070

SEQ ID NO: 84165 - DNA, 201 bp, Bos taurus; identical to SEQ ID NO: 2071

SEQ ID NO: 84166 - DNA, 201 bp, Bos taurus; identical to SEQ ID NO: 2072

SEQ ID NO: 84167 - DNA, 201 bp, Bos taurus; identical to SEQ ID NO: 2073

SEQ ID NO: 84168 - DNA, 201 bp, Bos taurus
gttaatttcaccggaaaaagtaaaaagaaagggagcagtgaccttggacaggctctgccacacccaatttcctaacataatcacagccttgtatcaacatcggttgtctaattcagaaggggtaaagtagcccatgacactgagtaatctggatgtgatttcaaaatagagttgtgacatgatttgctcagttcaggatga

SEQ ID NO: 84169 - DNA, 201 bp, Bos taurus
gaagcagtacttttcacattaaggttgtgataatcttatagtttgcagcgtagttagcctatgtctttcctgtattagatttttgctttggcatcttaagttgtctcctctttgcactcctcaccctccccttctgttcctctgtcttctttgtctcttcttcctgttcctctttccctcattcttttgggaatttacagt

SEQ ID NO: 84170 - DNA, 201 bp, Bos taurus; identical to SEQ ID NO: 2074

SEQ ID NO: 84171 - DNA, 201 bp, Bos taurus; identical to SEQ ID NO: 2075

SEQ ID NO: 84172 - DNA, 201 bp, Bos taurus
agactcattctctcacctacagtctgtctgtctcacccccttttcttctctttgagaaagacacaggcagagacaggccaaagttagttgcacaaaaaagtgttgggaaaggctctgaaagagttttgaggcagggctctgttggctcagccagttctggggaatgctacatctgggtggccatttttcacagatatcaag

SEQ ID NO: 84173 - DNA, 201 bp, Bos taurus
ttggaatcatataatttatcatttcccaatagttgctaccactccttcccaattcctgatgatcatattgtataagttgtaagcctatgtgacttcacccagcttcagtgagacttgtgctatacatttacaacagatggtgtgtagagcaaggtcctcaaggacgacccctaacatatgattcagtttatatccatgtga

SEQ ID NO: 84174 - DNA, 201 bp, Bos taurus; identical to SEQ ID NO: 2076

SEQ ID NO: 84175 - DNA, 201 bp, Bos taurus; identical to SEQ ID NO: 2077

SEQ ID NO: 84176 - DNA, 201 bp, Bos taurus; identical to SEQ ID NO: 2078

SEQ ID NO: 84177 - DNA, 201 bp, Bos taurus
gaagagaattgctcattctgcagaaaccagagttccacggaagcagccaatcagcgtaagaagagaggaagtgacagagccaggtggagccagagagccaactttatggaaaaacactggcactagcttaaaacaggctgcacctctggcagttcctccccacaaaggagatggtgacgtggctgctgtgggaccagaaga

SEQ ID NO: 84178 - DNA, 201 bp, Bos taurus
tccttcaagtcaggatccggggccagaagcaaggagcctagggaatgatcagctcacgagacagcgagtgctgtagccaagtgaagcttgtcattcactcgacaatcatttcacaaaaccaaggccaggccagggttgaagagctcgctgcctcgtccctgagggtctcacgtgtgggggacaggtgtggcacccacaacc

SEQ ID NO: 84179 - DNA, 201 bp, Bos taurus; identical to SEQ ID NO: 2079

SEQ ID NO: 84180 - DNA, 201 bp, Bos taurus
gaattctatttttgtaaacagtgacgtattaaagatctatgttgtttatttttaatactagttaattaattccattttcatttattgaatattctcatctatctctgttggtttaaaaggacacctccatcatatactatattcctaaataatcacgactcatgacccctttttacgaaagttgaaactgatggttaggga

SEQ ID NO: 84181 - DNA, 201 bp, Bos taurus
agcactacaaagggctgcccagcaatgccctgcacgcgcacagcaaccccgtaagtactggctcttgcatccttagctggccgtcgcccaccacgacgtaaggtgcctatctctgcctcacccactggctctgtgatgaagcgaatctggactccatggtcaacagggccccggggctcggccatggtggacgcctgctcc

SEQ ID NO: 84182 - DNA, 201 bp, Bos taurus; identical to SEQ ID NO: 2080

SEQ ID NO: 84183 - DNA, 201 bp, Bos taurus
gaatcaggtaaagcactttacctgttaaaatgggcccttgactagctatggaatattttaaattttcaagtagacaacgccatctgttgggcatcttgcaaactatcaaattgtatggccctataacacaatggttaaattggttgttttgtttgttttgccttagggtgtggtggaaaaaattctgagattcggaggcac

SEQ ID NO: 84184 - DNA, 201 bp, Bos taurus; identical to SEQ ID NO: 2081

SEQ ID NO: 84185 - DNA, 201 bp, Bos taurus
cttccacaatgtcaagaatctaggcaagtggcatttgtgggctgactttctttcattaaagcagaagggtagagctgcataagagaaatagttatgatccgggttggagctaaattctatgcctttgtctctctcccttccctccctgcccctttcttctcccccttgccctccggccctttcccaggagctctcctccag

SEQ ID NO: 84186 - DNA, 201 bp, Bos taurus; identical to SEQ ID NO: 2082

SEQ ID NO: 84187 - DNA, 201 bp, Bos taurus
ggttccagccttggtcggggaactaagagcccacatgtctcgcaacatggccaaaataaatacataagaaaagcattcctgggaggagtaaaaaggcccaaaattctagctctatcagtagcttgctaggcaagtcacttaacctctctgagcctcagttctttcacctttatggtagttttcaaagtatcatatatgggg

SEQ ID NO: 84188 - DNA, 201 bp, Bos taurus; identical to SEQ ID NO: 2083

SEQ ID NO: 84189 - DNA, 201 bp, Bos taurus
gctgacttccgcaatccgggtggaataaatccagcacccctagtcatccggccacattatccacacttctctgctgagacgagcccagagaacagatgcctatcaacaggtaacattttcagcttcctggatcctttaacctctcattcctgtcagttttccatttttaggaatattaggaacatagtgacttgtatatca

SEQ ID NO: 84190 - DNA, 201 bp, Bos taurus
gaatcatcctagttcctctcaaaaatccctttcctgttggcatctgtctcccctattatggggtgaaaatagctggtatttggtacattttcagtaaataatgtttcttaacatgtttgaatatggcatttatgccgtgaggtcagccattcataaatattcattaaagttagacttgttccagagaacaatcattgccat

SEQ ID NO: 84191 - DNA, 201 bp, Bos taurus
aagacatgacagaggtggccgcaggaggaagctattgaaaggtctgaatttttccccagcaggagagcagcttggtggtttaactggcctgcgcaaagccaccctgatatcttccctgagtggggatgaggaggctgtggctgctctgcacccttccagggacctgtcatcagtagctgattctgctccccgacttgtggg

SEQ ID NO: 84192 - DNA, 201 bp, Bos taurus
gtcctggattaggggtcgagaggatggacagcaggagcaactgcaggatggcctctcatctgttccaggtgtcctgtggtcctctctctggtcgaggcaggtagaccaagaggggaaagggcacagctacagtttgatggcagagttactggaaaattgtaataatgagacccctctgcagatagtttctgatgattacca

SEQ ID NO: 84193 - DNA, 201 bp, Bos taurus; identical to SEQ ID NO: 2084

SEQ ID NO: 84194 - DNA, 201 bp, Bos taurus; identical to SEQ ID NO: 2085

SEQ ID NO: 84195 - DNA, 201 bp, Bos taurus
cagttattcaactctgcttttggataaggggtcctggagttgattgcaggtgtttcatgaatccaaatggactccagacattatcagagactgaataaattttaatgtttcttacatgtgtgttttcaaatgtgtgtatatgctattgttattaataaatttaccagttaattaaaaagcttggctgcattcttttatctg

SEQ ID NO: 84196 - DNA, 201 bp, Bos taurus; identical to SEQ ID NO: 2086

SEQ ID NO: 84197 - DNA, 201 bp, Bos taurus
atccccgggggcctcgcttcaggagaagcgaggagccctaaagcagagcctttcagaagccacagtctccttatctaagggatagcctcttccaggatcctcttcctttgaaaatttctgatggcccttgtggtcaaacatagaattcttgggtatgtcattagaactatatagccgtgtggtttccgtagtgtagtggtt

SEQ ID NO: 84198 - DNA, 201 bp, Bos taurus
ttcttctctttggataagttgctcggcagaaagaggccatcctggccatcttctctggacccggttgaccaggtcaccggacaaaacaatggacagttaccggaggactttaaaagtggtcagtgactaactctccaccataagcagtagagcacctctgtgtaatgccacagcgtccctctattgtctttccccttagtt

SEQ ID NO: 84199 - DNA, 201 bp, Bos taurus
gtttcgtcttctgaggtggaacgctttaagcctgcccgccgagagccggagctttcctccagctgttagaaagaaagagcttatttttctcttgcaatcttttgatataactcgcgacttacatttttgggtggacgtgttttcgaaaatttagtagagaattgagaagtgaaaaagttttaacttacagcaaagggtcct

SEQ ID NO: 84200 - DNA, 201 bp, Bos taurus; identical to SEQ ID NO: 2087

SEQ ID NO: 84201 - DNA, 201 bp, Bos taurus; identical to SEQ ID NO: 2088

SEQ ID NO: 84202 - DNA, 201 bp, Bos taurus
gcgcctggcaggaatcttacacttaatgactgggtgacggggctccaagcttttacacttttcctttcctcatcctgtggcccaggacctcgatcctacacgggtgaaagaagtagcaggatgggtggaaaagtaaggggcttcaggagggataaacctgacctggcagcgggagccctctctctgtgggggaatccctat

SEQ ID NO: 84203 - DNA, 201 bp, Bos taurus; identical to SEQ ID NO: 2089

SEQ ID NO: 84204 - DNA, 201 bp, Bos taurus; identical to SEQ ID NO: 2090

SEQ ID NO: 84205 - DNA, 201 bp, Bos taurus; identical to SEQ ID NO: 2091

SEQ ID NO: 84206 - DNA, 201 bp, Bos taurus; identical to SEQ ID NO: 2092

SEQ ID NO: 84207 - DNA, 201 bp, Bos taurus
tgagtgtaaagaggaagtgaggccaatctcaaggaatttgatctgatctggggaatttattcaaattctcaaccacagaatactctggctctcaaggcagccagccttctagggcccttgtaagtcaacagaagcagtggtggaagggtgaggtgtgcccgccagctttgaccatgtcttcagtgtgacttagggagggct

SEQ ID NO: 84208 - DNA, 201 bp, Bos taurus; identical to SEQ ID NO: 2093

SEQ ID NO: 84209 - DNA, 201 bp, Bos taurus
acaaaattagaattcagaaaacagagcctctcagaggcccaccagatcctgattccttgaatactctattacagtggctttgaccaactagctttttttttccagctttttcagctggttgctgaaggctggatctgatgctgagctgattgttaagatactagctgtcctgaggatgaagatgaggcctgtagatgaagg

SEQ ID NO: 84210 - DNA, 201 bp, Bos taurus; identical to SEQ ID NO: 2094

SEQ ID NO: 84211 - DNA, 201 bp, Bos taurus
aagcgtatttttcatataatttatatttctagtcaattcacttgattcccactaagattatttttgcctcttaacacaaaccttccatatgtgttgtgggcaaggtctattcaaaagaggatgaatagattctgaagcttagagtttctgccctggactcagaatttttgtgattttctgtgatgagaatgtattattgat

SEQ ID NO: 84212 - DNA, 201 bp, Bos taurus; identical to SEQ ID NO: 2095

SEQ ID NO: 84213 - DNA, 201 bp, Bos taurus; identical to SEQ ID NO: 2096

SEQ ID NO: 84214 - DNA, 201 bp, Bos taurus; identical to SEQ ID NO: 2097

SEQ ID NO: 84215 - DNA, 201 bp, Bos taurus
agtaaagctgggcatgctgctgaggccatgcccttcaaggtcttgaggacaataattactagaacaaaagttaaagcagtactttattcagtgctggcactatgcaggcctccatatgctgtatttcttgtcctccaagagccctgcaagtcaggtgtggtcaccttctattttactcagtgtttttctcctcaatttcaa

SEQ ID NO: 84216 - DNA, 201 bp, Bos taurus; identical to SEQ ID NO: 2098

SEQ ID NO: 84217 - DNA, 201 bp, Bos taurus
cattctagctccagattctatcctcttaacctgtgtgtcagcccccagcttggacccatcttagttcaacctaacactgttggactggtgctgttaacatcggtgcttctgatctagcagggccctgttctgtcctccattatccccaaggagaatggcttgctgtgaagatgtcttcaaggctttgggggtctaatgcat

SEQ ID NO: 84218 - DNA, 201 bp, Bos taurus
ctgctcaagggcctcctccccaacccccatgacagtcatcttcccctggtcaggtggtcacagtctctacttcctgacattccttctgatcccaggccccgttcacctatcttcctgccacacttcgtggtctgattacttgtgcacccagtaggtcctcactgaacacctgggttttctgtgttcaagggtgggaactag

SEQ ID NO: 84219 - DNA, 201 bp, Bos taurus; identical to SEQ ID NO: 2100

SEQ ID NO: 84220 - DNA, 201 bp, Bos taurus; identical to SEQ ID NO: 2101

SEQ ID NO: 84221 - DNA, 201 bp, Bos taurus; identical to SEQ ID NO: 2102

SEQ ID NO: 84222 - DNA, 201 bp, Bos taurus; identical to SEQ ID NO: 2103

SEQ ID NO: 84223 - DNA, 201 bp, Bos taurus; identical to SEQ ID NO: 2104

SEQ ID NO: 84224 - DNA, 201 bp, Bos taurus
tctaggatggtatcctaagagaaaccaggatatctgacaaattatcataagctttcacatgtaatcaggaagaacaaggtgaatgtcactggatatttcgggtgcattttagtgcccagctttgaatgagagtaatttcacagactgttgaggggagaagcaaaaaaatcaaaccaacttaaaagctaaatgacagaagga

SEQ ID NO: 84225 - DNA, 201 bp, Bos taurus; identical to SEQ ID NO: 2105

SEQ ID NO: 84226 - DNA, 201 bp, Bos taurus
ctacttctttatatattcaggtgaatctggcaaggaatcatctagaagaaccttagaatataatcctagggaacaaatgataaacaggaaaaaaaaaaagtgcctctgtattataccaagcaacaagataaaacctgaaaatgttggatgtttataaacttcctgcaagtatacagtaaatatctgctactctatagatac

SEQ ID NO: 84227 - DNA, 201 bp, Bos taurus
ggatggaagccctctagatctggctggtgaggcccccgcccaccttggtggcatgctgccagactccaagcaggggcagtggtttgggggtggggagccctggggaagcacaggcccaccctgtgtttagtgctttaagagaaacacaaacaaactggagcacattctgggtagaacctcagccctcatgataggaggggc

SEQ ID NO: 84228 - DNA, 201 bp, Bos taurus; identical to SEQ ID NO: 2106

SEQ ID NO: 84229 - DNA, 201 bp, Bos taurus; identical to SEQ ID NO: 43638

SEQ ID NO: 84230 - DNA, 201 bp, Bos taurus; identical to SEQ ID NO: 2107

SEQ ID NO: 84231 - DNA, 201 bp, Bos taurus; identical to SEQ ID NO: 2108

SEQ ID NO: 84232 - DNA, 201 bp, Bos taurus; identical to SEQ ID NO: 2109

SEQ ID NO: 84233 - DNA, 201 bp, Bos taurus; identical to SEQ ID NO: 2110

SEQ ID NO: 84234 - DNA, 201 bp, Bos taurus; identical to SEQ ID NO: 2111

SEQ ID NO: 84235 - DNA, 201 bp, Bos taurus
agcaccagaagatccatcaggaagagataggtggagacagcagaaaacaggcatggccagggaaggaggtcacagcaacgctcaggacctagggcctccttgctgttgtgtggtgttccctccaatccctatgagcagtcactgctcagctgggctcagatcagaggagtcacttgccagggcattggccacagtggtctt

SEQ ID NO: 84236 - DNA, 201 bp, Bos taurus; identical to SEQ ID NO: 2112

SEQ ID NO: 84237 - DNA, 201 bp, Bos taurus; identical to SEQ ID NO: 2113

SEQ ID NO: 84238 - DNA, 201 bp, Bos taurus
gaaagccaaggagagctcaaaggaccagggtcaagtcgctccccgcagatcctagtgcaaaccaaccgtggcgctattctgcgcccaagaaacaggaagttagatgccaaaaaggactttgaggtcagccaaggagagcttggtgacaaattcttcagatcctgatagaatctgtttggctaaatctttctttttttcttg

SEQ ID NO: 84239 - DNA, 201 bp, Bos taurus; identical to SEQ ID NO: 2114

SEQ ID NO: 84240 - DNA, 201 bp, Bos taurus; identical to SEQ ID NO: 2115

SEQ ID NO: 84241 - DNA, 201 bp, Bos taurus; identical to SEQ ID NO: 2116

SEQ ID NO: 84242 - DNA, 201 bp, Bos taurus; identical to SEQ ID NO: 2117

SEQ ID NO: 84243 - DNA, 201 bp, Bos taurus; identical to SEQ ID NO: 2118

SEQ ID NO: 84244 - DNA, 201 bp, Bos taurus; identical to SEQ ID NO: 2119

SEQ ID NO: 84245 - DNA, 201 bp, Bos taurus; identical to SEQ ID NO: 2120

SEQ ID NO: 84246 - DNA, 201 bp, Bos taurus; identical to SEQ ID NO: 2121

SEQ ID NO: 84247 - DNA, 201 bp, Bos taurus
cgcagttaggggagcctcattcaaatgccaggcagacgcaaatagcacgctctgctctcctatgaatagcctgcccagctgttctgcaggaggccaagccagttctcatccaaagtacatgtgttcttatttatgagctgcatcagatgccgtcggcagcctacctttggcccttcaaggccagcttcgtgcgtgttcttt

SEQ ID NO: 84248 - DNA, 201 bp, Bos taurus; identical to SEQ ID NO: 2122

SEQ ID NO: 84249 - DNA, 201 bp, Bos taurus; identical to SEQ ID NO: 2123

SEQ ID NO: 84250 - DNA, 201 bp, Bos taurus; identical to SEQ ID NO: 2124

SEQ ID NO: 84251 - DNA, 201 bp, Bos taurus; identical to SEQ ID NO: 2125

SEQ ID NO: 84252 - DNA, 201 bp, Bos taurus; identical to SEQ ID NO: 2126

SEQ ID NO: 84253 - DNA, 201 bp, Bos taurus; identical to SEQ ID NO: 2127

SEQ ID NO: 84254 - DNA, 201 bp, Bos taurus
aacccaatcattcattgttagaagtacggaaaagtaaaacatataccaaagttacatttgacaggaaccaacactggctaagttattgcaggttaccaggtagtctgtcaagtgctttcacatagttgttctcacaacagtgctgtcagatatttatttcacaaagaacagcttaagtcagattaagcaggaggtcatgca

SEQ ID NO: 84255 - DNA, 201 bp, Bos taurus
aggcacacagactgtgtaatcaggctcagctggtaatcagggagctgccaaacagacgcgagacgaaattacctccctgtcccagacaaagtggccttctcgatgagggttaaaaccagcgatggtgggaaaaacaaaggaaggtatgcggcagctgctaccaaacacttggccagtggacggctcccaatccgtccctat

SEQ ID NO: 84256 - DNA, 201 bp, Bos taurus
gagccagtactgttgttaagaagaggcagtcatctaagtccaggcgaagggagactgggggtggggggcagtattagtagagaaggggaggcccagagaagcataaaggaaattcatcactctcgtttggttataatgggctgggagggaatacggcagctcctgggtaagaactcatctgaaggaagacagagtcagaca

SEQ ID NO: 84257 - DNA, 201 bp, Bos taurus
ttctttatttggatccagctctgagattccaggcacactcagggaaatcactgacagccaactgaacaggctgtggctcagctgcagactagaaagaggggaaggggcccgtgactactggggaagggggaggcaaaggccagcccaccagcccccaggtccacccacatgtctcccactgcccatgccctcgcttccctc

SEQ ID NO: 84258 - DNA, 201 bp, Bos taurus; identical to SEQ ID NO: 2128

SEQ ID NO: 84259 - DNA, 201 bp, Bos taurus; identical to SEQ ID NO: 2129

SEQ ID NO: 84260 - DNA, 201 bp, Bos taurus
tctttctatcctcttgaagaaaactcaatctctcggccttagaaattcataggctcttctgggaatggtctggttgtcaaataagttgcttctcacaaatatccacatgcggagagaagggcccagggccggtgggaaggcgtgcgtaagctctccaaattgcctcagtctctgggtcgtgtttttctgcagtctgagagg

SEQ ID NO: 84261 - DNA, 201 bp, Bos taurus; identical to SEQ ID NO: 2130

SEQ ID NO: 84262 - DNA, 201 bp, Bos taurus; identical to SEQ ID NO: 2131

SEQ ID NO: 84263 - DNA, 201 bp, Bos taurus; identical to SEQ ID NO: 2133

SEQ ID NO: 84264 - DNA, 201 bp, Bos taurus
attacataatgtttggggataattggccagaaaatatgtgaaagtacttagagaaggtgactcaggcaagacctatagttcctacatacacacttgacttaacactgtggccaatcatacgagattgacctgaaaaatttgtcttgggttcatagctgtctgtctcaatttaaggaaggaggaaacagattaaatgtcatt

SEQ ID NO: 84265 - DNA, 201 bp, Bos taurus
ccatcaggacacaactgtttgctttttccacatcctcactacttgttatcttttttttgtttttttccgaccagggacaggtcatgatagaaaaaaatcagaataagagcaaatattctattttgagaacagctgagaaagcatttttgactattacaattatttaacaaaaaagttcagtaagaaaatgtacacaaccca

SEQ ID NO: 84266 - DNA, 201 bp, Bos taurus; identical to SEQ ID NO: 2134

SEQ ID NO: 84267 - DNA, 201 bp, Bos taurus; identical to SEQ ID NO: 2135

SEQ ID NO: 84268 - DNA, 201 bp, Bos taurus; identical to SEQ ID NO: 2136

SEQ ID NO: 84269 - DNA, 201 bp, Bos taurus; identical to SEQ ID NO: 2137

SEQ ID NO: 84270 - DNA, 201 bp, Bos taurus; identical to SEQ ID NO: 2138

SEQ ID NO: 84271 - DNA, 201 bp, Bos taurus; identical to SEQ ID NO: 2139

SEQ ID NO: 84272 - DNA, 201 bp, Bos taurus; identical to SEQ ID NO: 2140

SEQ ID NO: 84273 - DNA, 201 bp, Bos taurus; identical to SEQ ID NO: 2141

SEQ ID NO: 84274 - DNA, 201 bp, Bos taurus; identical to SEQ ID NO: 2142

SEQ ID NO: 84275 - DNA, 201 bp, Bos taurus; identical to SEQ ID NO: 2143

SEQ ID NO: 84276 - DNA, 201 bp, Bos taurus; identical to SEQ ID NO: 2144

SEQ ID NO: 84277 - DNA, 201 bp, Bos taurus
gtatgactaaagcaaagtaagtgaggaagaaacaatggaagactagtcatggagctggaaggagccagggcatggaaggcactacaaacaaaggtatcccactcagcactggccgcacacttttatctgtcttcaagcccagaaaaccatcagtcattgtctctgcaaacacgtctcatctgcccccgctccttctctttt

SEQ ID NO: 84278 - DNA, 201 bp, Bos taurus; identical to SEQ ID NO: 2145

SEQ ID NO: 84279 - DNA, 201 bp, Bos taurus; identical to SEQ ID NO: 2146

SEQ ID NO: 84280 - DNA, 201 bp, Bos taurus; identical to SEQ ID NO: 2147

SEQ ID NO: 84281 - DNA, 201 bp, Bos taurus; identical to SEQ ID NO: 2148

SEQ ID NO: 84282 - DNA, 201 bp, Bos taurus; identical to SEQ ID NO: 2149

SEQ ID NO: 84283 - DNA, 201 bp, Bos taurus
gtattataagacggtttcagctaagatcaaaataaataacatgatctgactcaacggtttgactcttgagctcctggacgaaatctgatggaatgtcaaacgcagagactccctcctaggcactagctgctggtaggcaaaagtatctcaacatccttgccattggcaacaacagcattagaagagcagctgctgccaagg

SEQ ID NO: 84284 - DNA, 201 bp, Bos taurus
tggatcagtcttctagacagcaaagtggcagagcactagaatcaggagatgaaacggccacagccggagaaaggccacattcagatgtgcaggagcaaacagtggaggccaggcctccacaggggacaccactgaggaactgcgcagcccctccagacttggagtacatcctgtctcaccctggctgtgctctacagtgaa

SEQ ID NO: 84285 - DNA, 201 bp, Bos taurus; identical to SEQ ID NO: 2151

SEQ ID NO: 84286 - DNA, 201 bp, Bos taurus; identical to SEQ ID NO: 2152

SEQ ID NO: 84287 - DNA, 201 bp, Bos taurus; identical to SEQ ID NO: 2154

SEQ ID NO: 84288 - DNA, 201 bp, Bos taurus; identical to SEQ ID NO: 2155

SEQ ID NO: 84289 - DNA, 201 bp, Bos taurus; identical to SEQ ID NO: 2156

SEQ ID NO: 84290 - DNA, 201 bp, Bos taurus; identical to SEQ ID NO: 2157

SEQ ID NO: 84291 - DNA, 201 bp, Bos taurus
gcgtggtgaggactacaggcacctcactaggcacagagggaatttatgaatatataaaacattttcttctggccagtttaagttctgcctgggaaattaatggctgctttcactgcaaaatctatttactgtcactggggagaccagtgatttcctttagccttcgctgtgtagatcaaggtcaagtctagcgtcaggggg

SEQ ID NO: 84292 - DNA, 201 bp, Bos taurus; identical to SEQ ID NO: 2158

SEQ ID NO: 84293 - DNA, 201 bp, Bos taurus
ctcaccatctcccagagtttgcccaagctcatgtactagtcatcattgttcatgttttgcttgaatatgatatcaattacaaataaccctgttgcttaacaatcaacttaaaagacatatcagaaatcaatggcttttcccctggagccttcactctgtcactctgagccttgaagagaagggccttcagaggcatgaatc

SEQ ID NO: 84294 - DNA, 201 bp, Bos taurus; identical to SEQ ID NO: 2159

SEQ ID NO: 84295 - DNA, 201 bp, Bos taurus; identical to SEQ ID NO: 2160

SEQ ID NO: 84296 - DNA, 201 bp, Bos taurus; identical to SEQ ID NO: 2161

SEQ ID NO: 84297 - DNA, 201 bp, Bos taurus
agatgctttgagcattctgaaacatagcttgggagacacaggagaaactaatgattgtccgagagggctgggctacaagatgagagaaaccatacatcctttcatggtgtgcacatgcctcagtgttcattcatacagctacaagtttcacagcaatcccctcaggctgcaataagactaaactgaatccaccctgcaatt

SEQ ID NO: 84298 - DNA, 201 bp, Bos taurus; identical to SEQ ID NO: 2162

SEQ ID NO: 84299 - DNA, 201 bp, Bos taurus; identical to SEQ ID NO: 2164

SEQ ID NO: 84300 - DNA, 201 bp, Bos taurus
atcacacaacttgtaattgtgagtcactggctgatccatcttataaagtcgttaaacccctcgtcttataacacgggcctctaatccctccactggtaattcaggtgtgagcttgcagctgttatatgtcaccactgctcttagttgttaaaaacatgtcaagagttttgttttgaggtgttgggggttttttgtttgttt

SEQ ID NO: 84301 - DNA, 201 bp, Bos taurus; identical to SEQ ID NO: 2165

SEQ ID NO: 84302 - DNA, 201 bp, Bos taurus
gcatcccggatgccttctggtgggcagtcgtctccatgacaactgtaggctatggagacatggttccgactaccattgggggaaagatcgtgggttccctatgtgcaattgcaggtgttttaaccattgccttaccggtccctgtcatagtgtccaatttcaactacttctaccaccgggagacagagggagaggagcagg

SEQ ID NO: 84303 - DNA, 201 bp, Bos taurus; identical to SEQ ID NO: 2166

SEQ ID NO: 84304 - DNA, 201 bp, Bos taurus
ctctttgcaatccaagggactctcaaaagtcttctccagcaccacaatatgaaaatttcccagtcctgcagggcaccaaatccagcctgtggagtggccccgaagggcagacctcttttgcttacaagcatctctactgggctgcagcacaacctttgcagaacttgccctaggaaaaaggcctgtgggtgaccactccct

SEQ ID NO: 84305 - DNA, 201 bp, Bos taurus
cagctgggggcaaccggcccctggccctgctccagcaggtggtggtaatagagccagaggtcagagtagagagcaaggagatcaggttcttggcaagaacaaaactggactgcatcactgggcctgcacacagggagaaaagggtcacagacacatccaggtgggggaggggcagggtgactggggcatcaaacctcaaga

SEQ ID NO: 84306 - DNA, 201 bp, Bos taurus; identical to SEQ ID NO: 2167

SEQ ID NO: 84307 - DNA, 201 bp, Bos taurus
gaagaagatgggaggagtccaggggtctttaatgcaggacagaggaactgcaacggctcaccggagagagatctcagaaggccggaaacctggaaaacacgttggaaaatactgctggcacatgtggaagtccccacccttgtcccctcctgaccacaaagggatccctgtgagtgacatactggccagtcctccagtctt

SEQ ID NO: 84308 - DNA, 201 bp, Bos taurus; identical to SEQ ID NO: 2168

SEQ ID NO: 84309 - DNA, 201 bp, Bos taurus; identical to SEQ ID NO: 2169

SEQ ID NO: 84310 - DNA, 201 bp, Bos taurus; identical to SEQ ID NO: 2170

SEQ ID NO: 84311 - DNA, 201 bp, Bos taurus; identical to SEQ ID NO: 2171

SEQ ID NO: 84312 - DNA, 201 bp, Bos taurus; identical to SEQ ID NO: 2172

SEQ ID NO: 84313 - DNA, 201 bp, Bos taurus; identical to SEQ ID NO: 2173

SEQ ID NO: 84314 - DNA, 201 bp, Bos taurus; identical to SEQ ID NO: 2174

SEQ ID NO: 84315 - DNA, 201 bp, Bos taurus
tggtaaagggtgccttcactgggggctggggggacttgccaggaaatgtgggctctttccccagggctgccccaaagctgacctgggcctcaggctgcccaggcacagctcaccccctaagaactttagctcctcattcagggggtcatcagacacccacctaggccctgcccagaccccagtcctaccgcaccaacccct

SEQ ID NO: 84316 - DNA, 201 bp, Bos taurus; identical to SEQ ID NO: 2175

SEQ ID NO: 84317 - DNA, 201 bp, Bos taurus
gacaaagcagtaaactaaagtgttttcagtcccactctttttgtgtgtttacttcagaaaagagggtgagcactgtagctcagggcccaggaagaagtgagggacgtgtgactggctgtcacctgctgcccacagtgcttgctaaggaaaccaacagtcctccgcctctgtgagctgcccagggtgtcctgcggaggcctg

SEQ ID NO: 84318 - DNA, 201 bp, Bos taurus; identical to SEQ ID NO: 2176

SEQ ID NO: 84319 - DNA, 201 bp, Bos taurus
tgatgctcttggcatttggggccagatgccctatctgatgccagatgcttgtggccctctctttttttgggacactgtcccatgtattgtaggatgtttggcagcacccctgacttctacctactacaatgccaatacaatgtcagtagcacccaaccctgacttgtgataatgaacaatgtctccagatattaccaaatg

SEQ ID NO: 84320 - DNA, 201 bp, Bos taurus
gcaaggccaacaagatgaggttttgagcctccttttcaattgccaccctcttttttcagaaaaccctaaagtcatatccgcctgttctcaactccttggtcgcttgccaagatggccacaggagaggaacacatcacacaacacttcttctgttcttcatgcccctcctccacccaaaccgccaaagttgaacagagggca

SEQ ID NO: 84321 - DNA, 201 bp, Bos taurus; identical to SEQ ID NO: 2177

SEQ ID NO: 84322 - DNA, 201 bp, Bos taurus
agactggcttctaggtcatccctttcttttcttccacgggcctggtctgctttcttcttagttctgcctgcttttgcttctcctaagtaggaattactctcttcttttttaggacttattcttaatgtactccttcctacttttagaagtgttctaggagtcccttccctttttttttctttcttttgttgtttacatatt

SEQ ID NO: 84323 - DNA, 201 bp, Bos taurus
ctgtttttatattaaaaaaaaaaaaaagaaaatgtgtgttaccctccctttgtgactagcaaactgctgccagtcttaaaggaaattacaacctaggatgacaatggcattatgaggaatgttccaattagataagatcatttaaaaagtgtacttaaaagcaagggcttccaaatcaaacaaatagaattggatacctat

SEQ ID NO: 84324 - DNA, 201 bp, Bos taurus
gtgaaggggttgctgagaaataacattttgagagtattcatattaatggttcactggtgatcttggtgcatgaattggagctgtgtcactactctctgaaccctgtggttagttagctaagatatttaatatctttactcctttggactgtgcatcaatacatttgttttctgctttggaaccagatatccttccctaact

SEQ ID NO: 84325 - DNA, 201 bp, Bos taurus
tgtctagtttggatatcaaggttatactgtttttagaaagactaacagtgttctacttttccagttacctatataattttacagaaggttggaatcagttttttttaaatgtttgggagatcacactgtaaaatccccttggccaggtattttctcagtggaaggattttaaataatggaccaaatttctctatggtttta

SEQ ID NO: 84326 - DNA, 201 bp, Bos taurus
aacactgtttaaaggagatactaactatggctagtatattttcatatttaaatttcaaatgatcagagttaaacacatgtttaaataaatattaaaattatccactaagaaagcagcagtcttacctgtaacgaacatgaaaagaatggtcttctctcatgtttatcaaattttcctccatcgagtcatattataagctgg

SEQ ID NO: 84327 - DNA, 201 bp, Bos taurus; identical to SEQ ID NO: 2178

SEQ ID NO: 84328 - DNA, 201 bp, Bos taurus; identical to SEQ ID NO: 2179

SEQ ID NO: 84329 - DNA, 201 bp, Bos taurus; identical to SEQ ID NO: 2180

SEQ ID NO: 84330 - DNA, 201 bp, Bos taurus; identical to SEQ ID NO: 2181

SEQ ID NO: 84331 - DNA, 201 bp, Bos taurus; identical to SEQ ID NO: 2182

SEQ ID NO: 84332 - DNA, 201 bp, Bos taurus; identical to SEQ ID NO: 2183

SEQ ID NO: 84333 - DNA, 201 bp, Bos taurus
aactcccagagttcactcaaactcatgtccattgagtcggtgatgccatccagccatctcatcctctgtcgtccggttctcctcctgcccccattaatttcggggccaagtgaggaaagcttattcaaagtcagagctggtgaaaattaattttagtcactcaaaaagagaggatatggggaaaagactttagataaacgg

SEQ ID NO: 84334 - DNA, 201 bp, Bos taurus
ccattctggggagagaactggaaggccataaaacagtacataaggtagaacaagctaggacgagtactcttaattcatctggcattaccaatacgtgatccgaagacctggcctgtggcacggatatcaacaactctgggcatgggtattctttttctcagtcaaactacacaggcaacccatcaaactgctgaccagaag

SEQ ID NO: 84335 - DNA, 201 bp, Bos taurus
cctgcttgcagtagggcttaagcagagatcccagccagcagttctgcaaaattgcagaaccaagccaatgacccaatcaggtcagggagctcagcttgccgtttggcctgatttggatcgccaccaccaggccatgctggccatggagcacatactattccctggtaggagagcagattcacagcccaacttctgattata

SEQ ID NO: 84336 - DNA, 201 bp, Bos taurus
ggcagctgcctttgcttataacacctttctaaaaggacaggccacgtaaggtttgctgctcccagaaacttctttgtcatcgatgtttgtcaacttctttgatttcatagatgtttgcctggcctactggataaaagatattcaaaatttgctttaagaaatttaaaaatttgaggtgaaatatggtcataagttagactg

SEQ ID NO: 84337 - DNA, 201 bp, Bos taurus; identical to SEQ ID NO: 2185

SEQ ID NO: 84338 - DNA, 201 bp, Bos taurus; identical to SEQ ID NO: 2186

SEQ ID NO: 84339 - DNA, 201 bp, Bos taurus
acaatgtgttcaatccctggccaaccctactctttgaaaagcagttacattaacagttactgcagggcatctaagtggatgctgtgcagtaaatagaagagggatggaccacagcaaacatggccttaaagtgaaactggatcagaacactttgacaagtcacttctaagaatgatgcatcactgtttttataagtctgga

SEQ ID NO: 84340 - DNA, 201 bp, Bos taurus; identical to SEQ ID NO: 2187

SEQ ID NO: 84341 - DNA, 201 bp, Bos taurus
taatgaaaaagtatttacatctcaacttggtctttggcagagtacactcctttagtggaaaaaggagttatgtcaggcctctttctttccaaaatttgttcttctatactctgtcattcacattgcaaactctggtttctacttcttcataattcagagagaaaaaaatgaggatgcttactgggggccagaaaagttctt

SEQ ID NO: 84342 - DNA, 201 bp, Bos taurus; identical to SEQ ID NO: 2190

SEQ ID NO: 84343 - DNA, 201 bp, Bos taurus; identical to SEQ ID NO: 2191

SEQ ID NO: 84344 - DNA, 201 bp, Bos taurus; identical to SEQ ID NO: 2193

SEQ ID NO: 84345 - DNA, 201 bp, Bos taurus; identical to SEQ ID NO: 2195

SEQ ID NO: 84346 - DNA, 201 bp, Bos taurus; identical to SEQ ID NO: 2196

SEQ ID NO: 84347 - DNA, 201 bp, Bos taurus; identical to SEQ ID NO: 2197

SEQ ID NO: 84348 - DNA, 201 bp, Bos taurus; identical to SEQ ID NO: 2198

SEQ ID NO: 84349 - DNA, 201 bp, Bos taurus; identical to SEQ ID NO: 2199

SEQ ID NO: 84350 - DNA, 201 bp, Bos taurus; identical to SEQ ID NO: 2200

SEQ ID NO: 84351 - DNA, 201 bp, Bos taurus; identical to SEQ ID NO: 2201

SEQ ID NO: 84352 - DNA, 201 bp, Bos taurus; identical to SEQ ID NO: 2202

SEQ ID NO: 84353 - DNA, 201 bp, Bos taurus; identical to SEQ ID NO: 2203

SEQ ID NO: 84354 - DNA, 201 bp, Bos taurus; identical to SEQ ID NO: 2204

SEQ ID NO: 84355 - DNA, 201 bp, Bos taurus; identical to SEQ ID NO: 2206

SEQ ID NO: 84356 - DNA, 201 bp, Bos taurus; identical to SEQ ID NO: 2207

SEQ ID NO: 84357 - DNA, 201 bp, Bos taurus; identical to SEQ ID NO: 2208

SEQ ID NO: 84358 - DNA, 201 bp, Bos taurus; identical to SEQ ID NO: 2209

SEQ ID NO: 84359 - DNA, 201 bp, Bos taurus; identical to SEQ ID NO: 2210

SEQ ID NO: 84360 - DNA, 201 bp, Bos taurus; identical to SEQ ID NO: 2211

SEQ ID NO: 84361 - DNA, 201 bp, Bos taurus; identical to SEQ ID NO: 2212

SEQ ID NO: 84362 - DNA, 201 bp, Bos taurus; identical to SEQ ID NO: 2213

SEQ ID NO: 84363 - DNA, 201 bp, Bos taurus; identical to SEQ ID NO: 2214

SEQ ID NO: 84364 - DNA, 201 bp, Bos taurus; identical to SEQ ID NO: 2216

SEQ ID NO: 84365 - DNA, 201 bp, Bos taurus; identical to SEQ ID NO: 2218

SEQ ID NO: 84366 - DNA, 201 bp, Bos taurus; identical to SEQ ID NO: 2221

SEQ ID NO: 84367 - DNA, 201 bp, Bos taurus; identical to SEQ ID NO: 2224

SEQ ID NO: 84368 - DNA, 201 bp, Bos taurus; identical to SEQ ID NO: 2226

SEQ ID NO: 84369 - DNA, 201 bp, Bos taurus; identical to SEQ ID NO: 2230

SEQ ID NO: 84370 - DNA, 201 bp, Bos taurus; identical to SEQ ID NO: 2231

SEQ ID NO: 84371 - DNA, 201 bp, Bos taurus; identical to SEQ ID NO: 2232

SEQ ID NO: 84372 - DNA, 201 bp, Bos taurus; identical to SEQ ID NO: 2233

SEQ ID NO: 84373 - DNA, 201 bp, Bos taurus; identical to SEQ ID NO: 2235

SEQ ID NO: 84374 - DNA, 201 bp, Bos taurus; identical to SEQ ID NO: 2236

SEQ ID NO: 84375 - DNA, 201 bp, Bos taurus; identical to SEQ ID NO: 2246

SEQ ID NO: 84376 - DNA, 201 bp, Bos taurus; identical to SEQ ID NO: 2247

SEQ ID NO: 84377 - DNA, 201 bp, Bos taurus; identical to SEQ ID NO: 2249

SEQ ID NO: 84378 - DNA, 201 bp, Bos taurus; identical to SEQ ID NO: 2252

SEQ ID NO: 84379 - DNA, 201 bp, Bos taurus; identical to SEQ ID NO: 2253

SEQ ID NO: 84380 - DNA, 201 bp, Bos taurus; identical to SEQ ID NO: 2254

SEQ ID NO: 84381 - DNA, 201 bp, Bos taurus; identical to SEQ ID NO: 2258

SEQ ID NO: 84382 - DNA, 201 bp, Bos taurus; identical to SEQ ID NO: 2259

SEQ ID NO: 84383 - DNA, 201 bp, Bos taurus; identical to SEQ ID NO: 2260

SEQ ID NO: 84384 - DNA, 201 bp, Bos taurus; identical to SEQ ID NO: 2261

SEQ ID NO: 84385 - DNA, 201 bp, Bos taurus; identical to SEQ ID NO: 2262

SEQ ID NO: 84386 - DNA, 201 bp, Bos taurus; identical to SEQ ID NO: 2263

SEQ ID NO: 84387 - DNA, 201 bp, Bos taurus; identical to SEQ ID NO: 2264

SEQ ID NO: 84388 - DNA, 201 bp, Bos taurus; identical to SEQ ID NO: 2265

SEQ ID NO: 84389 - DNA, 201 bp, Bos taurus; identical to SEQ ID NO: 2266

SEQ ID NO: 84390 - DNA, 201 bp, Bos taurus; identical to SEQ ID NO: 2267

SEQ ID NO: 84391 - DNA, 201 bp, Bos taurus; identical to SEQ ID NO: 2269

SEQ ID NO: 84392 - DNA, 201 bp, Bos taurus; identical to SEQ ID NO: 2270

SEQ ID NO: 84393 - DNA, 201 bp, Bos taurus; identical to SEQ ID NO: 2271

SEQ ID NO: 84394 - DNA, 201 bp, Bos taurus; identical to SEQ ID NO: 2272

SEQ ID NO: 84395 - DNA, 201 bp, Bos taurus; identical to SEQ ID NO: 2277

SEQ ID NO: 84396 - DNA, 201 bp, Bos taurus; identical to SEQ ID NO: 2281

SEQ ID NO: 84397 - DNA, 201 bp, Bos taurus; identical to SEQ ID NO: 2282

SEQ ID NO: 84398 - DNA, 201 bp, Bos taurus; identical to SEQ ID NO: 2284

SEQ ID NO: 84399 - DNA, 201 bp, Bos taurus; identical to SEQ ID NO: 2286

SEQ ID NO: 84400 - DNA, 201 bp, Bos taurus; identical to SEQ ID NO: 2287

SEQ ID NO: 84401 - DNA, 201 bp, Bos taurus; identical to SEQ ID NO: 2288

SEQ ID NO: 84402 - DNA, 201 bp, Bos taurus; identical to SEQ ID NO: 2292

SEQ ID NO: 84403 - DNA, 201 bp, Bos taurus; identical to SEQ ID NO: 2293

SEQ ID NO: 84404 - DNA, 201 bp, Bos taurus; identical to SEQ ID NO: 2294

SEQ ID NO: 84405 - DNA, 201 bp, Bos taurus; identical to SEQ ID NO: 2295

SEQ ID NO: 84406 - DNA, 201 bp, Bos taurus; identical to SEQ ID NO: 2296

SEQ ID NO: 84407 - DNA, 201 bp, Bos taurus; identical to SEQ ID NO: 2297

SEQ ID NO: 84408 - DNA, 201 bp, Bos taurus; identical to SEQ ID NO: 2299

SEQ ID NO: 84409 - DNA, 201 bp, Bos taurus; identical to SEQ ID NO: 2300

SEQ ID NO: 84410 - DNA, 201 bp, Bos taurus; identical to SEQ ID NO: 2301

SEQ ID NO: 84411 - DNA, 201 bp, Bos taurus; identical to SEQ ID NO: 2302

SEQ ID NO: 84412 - DNA, 201 bp, Bos taurus; identical to SEQ ID NO: 2303

SEQ ID NO: 84413 - DNA, 201 bp, Bos taurus; identical to SEQ ID NO: 2304

SEQ ID NO: 84414 - DNA, 201 bp, Bos taurus; identical to SEQ ID NO: 2306

SEQ ID NO: 84415 - DNA, 201 bp, Bos taurus; identical to SEQ ID NO: 2307

SEQ ID NO: 84416 - DNA, 201 bp, Bos taurus; identical to SEQ ID NO: 2308

SEQ ID NO: 84417 - DNA, 201 bp, Bos taurus; identical to SEQ ID NO: 2309

SEQ ID NO: 84418 - DNA, 201 bp, Bos taurus; identical to SEQ ID NO: 2310

SEQ ID NO: 84419 - DNA, 201 bp, Bos taurus; identical to SEQ ID NO: 2313

SEQ ID NO: 84420 - DNA, 201 bp, Bos taurus; identical to SEQ ID NO: 2314

SEQ ID NO: 84421 - DNA, 201 bp, Bos taurus; identical to SEQ ID NO: 2315

SEQ ID NO: 84422 - DNA, 201 bp, Bos taurus; identical to SEQ ID NO: 2316

SEQ ID NO: 84423 - DNA, 201 bp, Bos taurus; identical to SEQ ID NO: 2317

SEQ ID NO: 84424 - DNA, 201 bp, Bos taurus; identical to SEQ ID NO: 2318

SEQ ID NO: 84425 - DNA, 201 bp, Bos taurus; identical to SEQ ID NO: 2323

SEQ ID NO: 84426 - DNA, 201 bp, Bos taurus; identical to SEQ ID NO: 2324

SEQ ID NO: 84427 - DNA, 201 bp, Bos taurus; identical to SEQ ID NO: 2325

SEQ ID NO: 84428 - DNA, 201 bp, Bos taurus; identical to SEQ ID NO: 2331

SEQ ID NO: 84429 - DNA, 201 bp, Bos taurus; identical to SEQ ID NO: 2332

SEQ ID NO: 84430 - DNA, 201 bp, Bos taurus; identical to SEQ ID NO: 2333

SEQ ID NO: 84431 - DNA, 201 bp, Bos taurus; identical to SEQ ID NO: 2334

SEQ ID NO: 84432 - DNA, 201 bp, Bos taurus; identical to SEQ ID NO: 2336

SEQ ID NO: 84433 - DNA, 201 bp, Bos taurus; identical to SEQ ID NO: 2337

SEQ ID NO: 84434 - DNA, 201 bp, Bos taurus; identical to SEQ ID NO: 2338

SEQ ID NO: 84435 - DNA, 201 bp, Bos taurus; identical to SEQ ID NO: 2339

SEQ ID NO: 84436 - DNA, 201 bp, Bos taurus; identical to SEQ ID NO: 2340

SEQ ID NO: 84437 - DNA, 201 bp, Bos taurus; identical to SEQ ID NO: 2341

SEQ ID NO: 84438 - DNA, 201 bp, Bos taurus; identical to SEQ ID NO: 2342

SEQ ID NO: 84439 - DNA, 201 bp, Bos taurus; identical to SEQ ID NO: 2344

SEQ ID NO: 84440 - DNA, 201 bp, Bos taurus; identical to SEQ ID NO: 2345

SEQ ID NO: 84441 - DNA, 201 bp, Bos taurus; identical to SEQ ID NO: 2347

SEQ ID NO: 84442 - DNA, 201 bp, Bos taurus; identical to SEQ ID NO: 2348

SEQ ID NO: 84443 - DNA, 201 bp, Bos taurus; identical to SEQ ID NO: 2349

SEQ ID NO: 84444 - DNA, 201 bp, Bos taurus; identical to SEQ ID NO: 2350

SEQ ID NO: 84445 - DNA, 201 bp, Bos taurus; identical to SEQ ID NO: 2351

SEQ ID NO: 84446 - DNA, 201 bp, Bos taurus; identical to SEQ ID NO: 2354

SEQ ID NO: 84447 - DNA, 201 bp, Bos taurus; identical to SEQ ID NO: 2355

SEQ ID NO: 84448 - DNA, 201 bp, Bos taurus; identical to SEQ ID NO: 2356

SEQ ID NO: 84449 - DNA, 201 bp, Bos taurus; identical to SEQ ID NO: 2357

SEQ ID NO: 84450 - DNA, 201 bp, Bos taurus; identical to SEQ ID NO: 2358

SEQ ID NO: 84451 - DNA, 201 bp, Bos taurus; identical to SEQ ID NO: 2359

SEQ ID NO: 84452 - DNA, 201 bp, Bos taurus; identical to SEQ ID NO: 2360

SEQ ID NO: 84453 - DNA, 201 bp, Bos taurus; identical to SEQ ID NO: 2361

SEQ ID NO: 84454 - DNA, 201 bp, Bos taurus; identical to SEQ ID NO: 2362

SEQ ID NO: 84455 - DNA, 201 bp, Bos taurus; identical to SEQ ID NO: 2365

SEQ ID NO: 84456 - DNA, 201 bp, Bos taurus; identical to SEQ ID NO: 2366

SEQ ID NO: 84457 - DNA, 201 bp, Bos taurus; identical to SEQ ID NO: 2367

SEQ ID NO: 84458 - DNA, 201 bp, Bos taurus; identical to SEQ ID NO: 2369

SEQ ID NO: 84459 - DNA, 201 bp, Bos taurus; identical to SEQ ID NO: 2370

SEQ ID NO: 84460 - DNA, 201 bp, Bos taurus; identical to SEQ ID NO: 2374

SEQ ID NO: 84461 - DNA, 201 bp, Bos taurus; identical to SEQ ID NO: 2378

SEQ ID NO: 84462 - DNA, 201 bp, Bos taurus; identical to SEQ ID NO: 2379

SEQ ID NO: 84463 - DNA, 201 bp, Bos taurus; identical to SEQ ID NO: 2380

SEQ ID NO: 84464 - DNA, 201 bp, Bos taurus; identical to SEQ ID NO: 2381

SEQ ID NO: 84465 - DNA, 201 bp, Bos taurus; identical to SEQ ID NO: 2382

SEQ ID NO: 84466 - DNA, 201 bp, Bos taurus; identical to SEQ ID NO: 2385

SEQ ID NO: 84467 - DNA, 201 bp, Bos taurus; identical to SEQ ID NO: 2386

SEQ ID NO: 84468 - DNA, 201 bp, Bos taurus; identical to SEQ ID NO: 2388

SEQ ID NO: 84469 - DNA, 201 bp, Bos taurus; identical to SEQ ID NO: 2389

SEQ ID NO: 84470 - DNA, 201 bp, Bos taurus; identical to SEQ ID NO: 2391

SEQ ID NO: 84471 - DNA, 201 bp, Bos taurus; identical to SEQ ID NO: 2395

SEQ ID NO: 84472 - DNA, 201 bp, Bos taurus; identical to SEQ ID NO: 2396

SEQ ID NO: 84473 - DNA, 201 bp, Bos taurus; identical to SEQ ID NO: 2397

SEQ ID NO: 84474 - DNA, 201 bp, Bos taurus; identical to SEQ ID NO: 2398

SEQ ID NO: 84475 - DNA, 201 bp, Bos taurus; identical to SEQ ID NO: 2399

SEQ ID NO: 84476 - DNA, 201 bp, Bos taurus; identical to SEQ ID NO: 2401

SEQ ID NO: 84477 - DNA, 201 bp, Bos taurus; identical to SEQ ID NO: 2403

SEQ ID NO: 84478 - DNA, 201 bp, Bos taurus; identical to SEQ ID NO: 2404

SEQ ID NO: 84479 - DNA, 201 bp, Bos taurus; identical to SEQ ID NO: 2405

SEQ ID NO: 84480 - DNA, 201 bp, Bos taurus; identical to SEQ ID NO: 2408

SEQ ID NO: 84481 - DNA, 201 bp, Bos taurus; identical to SEQ ID NO: 2410

SEQ ID NO: 84482 - DNA, 201 bp, Bos taurus; identical to SEQ ID NO: 2412

SEQ ID NO: 84483 - DNA, 201 bp, Bos taurus; identical to SEQ ID NO: 2416

SEQ ID NO: 84484 - DNA, 201 bp, Bos taurus; identical to SEQ ID NO: 2421

SEQ ID NO: 84485 - DNA, 201 bp, Bos taurus; identical to SEQ ID NO: 2427

SEQ ID NO: 84486 - DNA, 201 bp, Bos taurus; identical to SEQ ID NO: 2429

SEQ ID NO: 84487 - DNA, 201 bp, Bos taurus; identical to SEQ ID NO: 2430

SEQ ID NO: 84488 - DNA, 201 bp, Bos taurus; identical to SEQ ID NO: 2431

SEQ ID NO: 84489 - DNA, 201 bp, Bos taurus; identical to SEQ ID NO: 2435

SEQ ID NO: 84490 - DNA, 201 bp, Bos taurus; identical to SEQ ID NO: 2436

SEQ ID NO: 84491 - DNA, 201 bp, Bos taurus; identical to SEQ ID NO: 2437

SEQ ID NO: 84492 - DNA, 201 bp, Bos taurus; identical to SEQ ID NO: 2438

SEQ ID NO: 84493 - DNA, 201 bp, Bos taurus; identical to SEQ ID NO: 2440

SEQ ID NO: 84494 - DNA, 201 bp, Bos taurus; identical to SEQ ID NO: 2442

SEQ ID NO: 84495 - DNA, 201 bp, Bos taurus; identical to SEQ ID NO: 2444

SEQ ID NO: 84496 - DNA, 201 bp, Bos taurus; identical to SEQ ID NO: 2446

SEQ ID NO: 84497 - DNA, 201 bp, Bos taurus; identical to SEQ ID NO: 2448

SEQ ID NO: 84498 - DNA, 201 bp, Bos taurus; identical to SEQ ID NO: 2449

SEQ ID NO: 84499 - DNA, 201 bp, Bos taurus; identical to SEQ ID NO: 2450

SEQ ID NO: 84500 - DNA, 201 bp, Bos taurus; identical to SEQ ID NO: 2452

SEQ ID NO: 84501 - DNA, 201 bp, Bos taurus; identical to SEQ ID NO: 2453

SEQ ID NO: 84502 - DNA, 201 bp, Bos taurus; identical to SEQ ID NO: 2458

SEQ ID NO: 84503 - DNA, 201 bp, Bos taurus; identical to SEQ ID NO: 2463

SEQ ID NO: 84504 - DNA, 201 bp, Bos taurus; identical to SEQ ID NO: 2467

SEQ ID NO: 84505 - DNA, 201 bp, Bos taurus; identical to SEQ ID NO: 2468

SEQ ID NO: 84506 - DNA, 201 bp, Bos taurus; identical to SEQ ID NO: 2469

SEQ ID NO: 84507 - DNA, 201 bp, Bos taurus; identical to SEQ ID NO: 2470

SEQ ID NO: 84508 - DNA, 201 bp, Bos taurus; identical to SEQ ID NO: 2471

SEQ ID NO: 84509 - DNA, 201 bp, Bos taurus; identical to SEQ ID NO: 2472

SEQ ID NO: 84510 - DNA, 201 bp, Bos taurus; identical to SEQ ID NO: 2473

SEQ ID NO: 84511 - DNA, 201 bp, Bos taurus; identical to SEQ ID NO: 2477

SEQ ID NO: 84512 - DNA, 201 bp, Bos taurus; identical to SEQ ID NO: 2478

SEQ ID NO: 84513 - DNA, 201 bp, Bos taurus; identical to SEQ ID NO: 2479

SEQ ID NO: 84514 - DNA, 201 bp, Bos taurus; identical to SEQ ID NO: 2480

SEQ ID NO: 84515 - DNA, 201 bp, Bos taurus; identical to SEQ ID NO: 2481

SEQ ID NO: 84516 - DNA, 201 bp, Bos taurus; identical to SEQ ID NO: 2482

SEQ ID NO: 84517 - DNA, 201 bp, Bos taurus; identical to SEQ ID NO: 2483

SEQ ID NO: 84518 - DNA, 201 bp, Bos taurus; identical to SEQ ID NO: 2486

SEQ ID NO: 84519 - DNA, 201 bp, Bos taurus; identical to SEQ ID NO: 2487

SEQ ID NO: 84520 - DNA, 201 bp, Bos taurus; identical to SEQ ID NO: 2488

SEQ ID NO: 84521 - DNA, 201 bp, Bos taurus; identical to SEQ ID NO: 2489

SEQ ID NO: 84522 - DNA, 201 bp, Bos taurus; identical to SEQ ID NO: 2490

SEQ ID NO: 84523 - DNA, 201 bp, Bos taurus; identical to SEQ ID NO: 2491

SEQ ID NO: 84524 - DNA, 201 bp, Bos taurus; identical to SEQ ID NO: 2492

SEQ ID NO: 84525 - DNA, 201 bp, Bos taurus; identical to SEQ ID NO: 2493

SEQ ID NO: 84526 - DNA, 201 bp, Bos taurus; identical to SEQ ID NO: 2494

SEQ ID NO: 84527 - DNA, 201 bp, Bos taurus; identical to SEQ ID NO: 2495

SEQ ID NO: 84528 - DNA, 201 bp, Bos taurus; identical to SEQ ID NO: 2496

SEQ ID NO: 84529 - DNA, 201 bp, Bos taurus; identical to SEQ ID NO: 2498

SEQ ID NO: 84530 - DNA, 201 bp, Bos taurus; identical to SEQ ID NO: 2499

SEQ ID NO: 84531 - DNA, 201 bp, Bos taurus; identical to SEQ ID NO: 2500

SEQ ID NO: 84532 - DNA, 201 bp, Bos taurus; identical to SEQ ID NO: 2501

SEQ ID NO: 84533 - DNA, 201 bp, Bos taurus; identical to SEQ ID NO: 2502

SEQ ID NO: 84534 - DNA, 201 bp, Bos taurus; identical to SEQ ID NO: 2503

SEQ ID NO: 84535 - DNA, 201 bp, Bos taurus; identical to SEQ ID NO: 2505

SEQ ID NO: 84536 - DNA, 201 bp, Bos taurus; identical to SEQ ID NO: 2506

SEQ ID NO: 84537 - DNA, 201 bp, Bos taurus; identical to SEQ ID NO: 2507

SEQ ID NO: 84538 - DNA, 201 bp, Bos taurus; identical to SEQ ID NO: 2508

SEQ ID NO: 84539 - DNA, 201 bp, Bos taurus; identical to SEQ ID NO: 2509

SEQ ID NO: 84540 - DNA, 201 bp, Bos taurus; identical to SEQ ID NO: 2510

SEQ ID NO: 84541 - DNA, 201 bp, Bos taurus; identical to SEQ ID NO: 2511

SEQ ID NO: 84542 - DNA, 201 bp, Bos taurus; identical to SEQ ID NO: 2512

SEQ ID NO: 84543 - DNA, 201 bp, Bos taurus; identical to SEQ ID NO: 2513

SEQ ID NO: 84544 - DNA, 201 bp, Bos taurus; identical to SEQ ID NO: 2514

SEQ ID NO: 84545 - DNA, 201 bp, Bos taurus; identical to SEQ ID NO: 2515

SEQ ID NO: 84546 - DNA, 201 bp, Bos taurus; identical to SEQ ID NO: 2516

SEQ ID NO: 84547 - DNA, 201 bp, Bos taurus; identical to SEQ ID NO: 2517

SEQ ID NO: 84548 - DNA, 201 bp, Bos taurus; identical to SEQ ID NO: 2519

SEQ ID NO: 84549 - DNA, 201 bp, Bos taurus; identical to SEQ ID NO: 2520

SEQ ID NO: 84550 - DNA, 201 bp, Bos taurus; identical to SEQ ID NO: 2521

SEQ ID NO: 84551 - DNA, 201 bp, Bos taurus; identical to SEQ ID NO: 2522

SEQ ID NO: 84552 - DNA, 201 bp, Bos taurus; identical to SEQ ID NO: 2523

SEQ ID NO: 84553 - DNA, 201 bp, Bos taurus; identical to SEQ ID NO: 2524

SEQ ID NO: 84554 - DNA, 201 bp, Bos taurus; identical to SEQ ID NO: 2525

SEQ ID NO: 84555 - DNA, 201 bp, Bos taurus; identical to SEQ ID NO: 2526

SEQ ID NO: 84556 - DNA, 201 bp, Bos taurus; identical to SEQ ID NO: 2527

SEQ ID NO: 84557 - DNA, 201 bp, Bos taurus; identical to SEQ ID NO: 2528

SEQ ID NO: 84558 - DNA, 201 bp, Bos taurus; identical to SEQ ID NO: 2529

SEQ ID NO: 84559 - DNA, 201 bp, Bos taurus; identical to SEQ ID NO: 2530

SEQ ID NO: 84560 - DNA, 201 bp, Bos taurus; identical to SEQ ID NO: 2531

SEQ ID NO: 84561 - DNA, 201 bp, Bos taurus; identical to SEQ ID NO: 2532

SEQ ID NO: 84562 - DNA, 201 bp, Bos taurus; identical to SEQ ID NO: 2533

SEQ ID NO: 84563 - DNA, 201 bp, Bos taurus; identical to SEQ ID NO: 2534

SEQ ID NO: 84564 - DNA, 201 bp, Bos taurus; identical to SEQ ID NO: 2535

SEQ ID NO: 84565 - DNA, 201 bp, Bos taurus; identical to SEQ ID NO: 2536

SEQ ID NO: 84566 - DNA, 201 bp, Bos taurus; identical to SEQ ID NO: 2537

SEQ ID NO: 84567 - DNA, 201 bp, Bos taurus; identical to SEQ ID NO: 2538

SEQ ID NO: 84568 - DNA, 201 bp, Bos taurus; identical to SEQ ID NO: 2539

SEQ ID NO: 84569 - DNA, 201 bp, Bos taurus; identical to SEQ ID NO: 2540

SEQ ID NO: 84570 - DNA, 201 bp, Bos taurus; identical to SEQ ID NO: 2541

SEQ ID NO: 84571 - DNA, 201 bp, Bos taurus; identical to SEQ ID NO: 2542

SEQ ID NO: 84572 - DNA, 201 bp, Bos taurus; identical to SEQ ID NO: 2543

SEQ ID NO: 84573 - DNA, 201 bp, Bos taurus; identical to SEQ ID NO: 2544

SEQ ID NO: 84574 - DNA, 201 bp, Bos taurus; identical to SEQ ID NO: 2545

SEQ ID NO: 84575 - DNA, 201 bp, Bos taurus; identical to SEQ ID NO: 2546

SEQ ID NO: 84576 - DNA, 201 bp, Bos taurus; identical to SEQ ID NO: 2547

SEQ ID NO: 84577 - DNA, 201 bp, Bos taurus; identical to SEQ ID NO: 2548

SEQ ID NO: 84578 - DNA, 201 bp, Bos taurus; identical to SEQ ID NO: 2549

SEQ ID NO: 84579 - DNA, 201 bp, Bos taurus; identical to SEQ ID NO: 2550

SEQ ID NO: 84580 - DNA, 201 bp, Bos taurus; identical to SEQ ID NO: 2551

SEQ ID NO: 84581 - DNA, 201 bp, Bos taurus; identical to SEQ ID NO: 2552

SEQ ID NO: 84582 - DNA, 201 bp, Bos taurus; identical to SEQ ID NO: 2553

SEQ ID NO: 84583 - DNA, 201 bp, Bos taurus; identical to SEQ ID NO: 2554

SEQ ID NO: 84584 - DNA, 201 bp, Bos taurus; identical to SEQ ID NO: 2555

SEQ ID NO: 84585 - DNA, 201 bp, Bos taurus; identical to SEQ ID NO: 2556

SEQ ID NO: 84586 - DNA, 201 bp, Bos taurus; identical to SEQ ID NO: 2557

SEQ ID NO: 84587 - DNA, 201 bp, Bos taurus; identical to SEQ ID NO: 2558

SEQ ID NO: 84588 - DNA, 201 bp, Bos taurus; identical to SEQ ID NO: 2559

SEQ ID NO: 84589 - DNA, 201 bp, Bos taurus; identical to SEQ ID NO: 2560

SEQ ID NO: 84590 - DNA, 201 bp, Bos taurus; identical to SEQ ID NO: 2561

SEQ ID NO: 84591 - DNA, 201 bp, Bos taurus; identical to SEQ ID NO: 2564

SEQ ID NO: 84592 - DNA, 201 bp, Bos taurus; identical to SEQ ID NO: 2565

SEQ ID NO: 84593 - DNA, 201 bp, Bos taurus; identical to SEQ ID NO: 2566

SEQ ID NO: 84594 - DNA, 201 bp, Bos taurus; identical to SEQ ID NO: 2567

SEQ ID NO: 84595 - DNA, 201 bp, Bos taurus; identical to SEQ ID NO: 2568

SEQ ID NO: 84596 - DNA, 201 bp, Bos taurus; identical to SEQ ID NO: 2569

SEQ ID NO: 84597 - DNA, 201 bp, Bos taurus; identical to SEQ ID NO: 2570

SEQ ID NO: 84598 - DNA, 201 bp, Bos taurus; identical to SEQ ID NO: 2571

SEQ ID NO: 84599 - DNA, 201 bp, Bos taurus; identical to SEQ ID NO: 2572

SEQ ID NO: 84600 - DNA, 201 bp, Bos taurus; identical to SEQ ID NO: 2573

SEQ ID NO: 84601 - DNA, 201 bp, Bos taurus; identical to SEQ ID NO: 2574

SEQ ID NO: 84602 - DNA, 201 bp, Bos taurus; identical to SEQ ID NO: 2575

SEQ ID NO: 84603 - DNA, 201 bp, Bos taurus; identical to SEQ ID NO: 2577

SEQ ID NO: 84604 - DNA, 201 bp, Bos taurus; identical to SEQ ID NO: 2579

SEQ ID NO: 84605 - DNA, 201 bp, Bos taurus; identical to SEQ ID NO: 2580

SEQ ID NO: 84606 - DNA, 201 bp, Bos taurus; identical to SEQ ID NO: 2581

SEQ ID NO: 84607 - DNA, 201 bp, Bos taurus; identical to SEQ ID NO: 2582

SEQ ID NO: 84608 - DNA, 201 bp, Bos taurus; identical to SEQ ID NO: 2583

SEQ ID NO: 84609 - DNA, 201 bp, Bos taurus; identical to SEQ ID NO: 2584

SEQ ID NO: 84610 - DNA, 201 bp, Bos taurus; identical to SEQ ID NO: 2585

SEQ ID NO: 84611 - DNA, 201 bp, Bos taurus; identical to SEQ ID NO: 2586

SEQ ID NO: 84612 - DNA, 201 bp, Bos taurus; identical to SEQ ID NO: 2587

SEQ ID NO: 84613 - DNA, 201 bp, Bos taurus; identical to SEQ ID NO: 2588

SEQ ID NO: 84614 - DNA, 201 bp, Bos taurus; identical to SEQ ID NO: 2589

SEQ ID NO: 84615 - DNA, 201 bp, Bos taurus; identical to SEQ ID NO: 2590

SEQ ID NO: 84616 - DNA, 201 bp, Bos taurus; identical to SEQ ID NO: 2591

SEQ ID NO: 84617 - DNA, 201 bp, Bos taurus; identical to SEQ ID NO: 2592

SEQ ID NO: 84618 - DNA, 201 bp, Bos taurus; identical to SEQ ID NO: 2593

SEQ ID NO: 84619 - DNA, 201 bp, Bos taurus; identical to SEQ ID NO: 2594

SEQ ID NO: 84620 - DNA, 201 bp, Bos taurus; identical to SEQ ID NO: 2596

SEQ ID NO: 84621 - DNA, 201 bp, Bos taurus; identical to SEQ ID NO: 2597

SEQ ID NO: 84622 - DNA, 201 bp, Bos taurus; identical to SEQ ID NO: 2598

SEQ ID NO: 84623 - DNA, 201 bp, Bos taurus; identical to SEQ ID NO: 2599

SEQ ID NO: 84624 - DNA, 201 bp, Bos taurus; identical to SEQ ID NO: 2600

SEQ ID NO: 84625 - DNA, 201 bp, Bos taurus; identical to SEQ ID NO: 2601

SEQ ID NO: 84626 - DNA, 201 bp, Bos taurus; identical to SEQ ID NO: 2602

SEQ ID NO: 84627 - DNA, 201 bp, Bos taurus; identical to SEQ ID NO: 2603

SEQ ID NO: 84628 - DNA, 201 bp, Bos taurus; identical to SEQ ID NO: 2604

SEQ ID NO: 84629 - DNA, 201 bp, Bos taurus; identical to SEQ ID NO: 2605

SEQ ID NO: 84630 - DNA, 201 bp, Bos taurus; identical to SEQ ID NO: 2606

SEQ ID NO: 84631 - DNA, 201 bp, Bos taurus; identical to SEQ ID NO: 2607

SEQ ID NO: 84632 - DNA, 201 bp, Bos taurus; identical to SEQ ID NO: 2608

SEQ ID NO: 84633 - DNA, 201 bp, Bos taurus; identical to SEQ ID NO: 2609

SEQ ID NO: 84634 - DNA, 201 bp, Bos taurus; identical to SEQ ID NO: 2610

SEQ ID NO: 84635 - DNA, 201 bp, Bos taurus; identical to SEQ ID NO: 2611

SEQ ID NO: 84636 - DNA, 201 bp, Bos taurus; identical to SEQ ID NO: 2612

SEQ ID NO: 84637 - DNA, 201 bp, Bos taurus; identical to SEQ ID NO: 2613

SEQ ID NO: 84638 - DNA, 201 bp, Bos taurus; identical to SEQ ID NO: 2614

SEQ ID NO: 84639 - DNA, 201 bp, Bos taurus; identical to SEQ ID NO: 2615

SEQ ID NO: 84640 - DNA, 201 bp, Bos taurus; identical to SEQ ID NO: 2616

SEQ ID NO: 84641 - DNA, 201 bp, Bos taurus; identical to SEQ ID NO: 2617

SEQ ID NO: 84642 - DNA, 201 bp, Bos taurus; identical to SEQ ID NO: 2618

SEQ ID NO: 84643 - DNA, 201 bp, Bos taurus; identical to SEQ ID NO: 2619

SEQ ID NO: 84644 - DNA, 201 bp, Bos taurus; identical to SEQ ID NO: 2620

SEQ ID NO: 84645 - DNA, 201 bp, Bos taurus; identical to SEQ ID NO: 2621

SEQ ID NO: 84646 - DNA, 201 bp, Bos taurus; identical to SEQ ID NO: 2622

SEQ ID NO: 84647 - DNA, 201 bp, Bos taurus; identical to SEQ ID NO: 2624

SEQ ID NO: 84648 - DNA, 201 bp, Bos taurus; identical to SEQ ID NO: 2626

SEQ ID NO: 84649 - DNA, 201 bp, Bos taurus
gcagtcttattaggaccccatgggactctgtggactgcttttaaaggcaacagtgggcagtgtcatggctgaaggaggagaggttttacaggtagcctgcgggagctcaagatgcctcctttttaacatgcagcatatggggttgcaaccagaggaggggcagtcttaccaaagcaccggcttggggtagacacttaccag

SEQ ID NO: 84650 - DNA, 201 bp, Bos taurus; identical to SEQ ID NO: 2627

SEQ ID NO: 84651 - DNA, 201 bp, Bos taurus; identical to SEQ ID NO: 2628

SEQ ID NO: 84652 - DNA, 201 bp, Bos taurus; identical to SEQ ID NO: 2631

SEQ ID NO: 84653 - DNA, 201 bp, Bos taurus; identical to SEQ ID NO: 2632

SEQ ID NO: 84654 - DNA, 201 bp, Bos taurus; identical to SEQ ID NO: 2633

SEQ ID NO: 84655 - DNA, 201 bp, Bos taurus; identical to SEQ ID NO: 2634

SEQ ID NO: 84656 - DNA, 201 bp, Bos taurus; identical to SEQ ID NO: 2635

SEQ ID NO: 84657 - DNA, 201 bp, Bos taurus; identical to SEQ ID NO: 2636

SEQ ID NO: 84658 - DNA, 201 bp, Bos taurus; identical to SEQ ID NO: 2637

SEQ ID NO: 84659 - DNA, 201 bp, Bos taurus; identical to SEQ ID NO: 2640

SEQ ID NO: 84660 - DNA, 201 bp, Bos taurus; identical to SEQ ID NO: 2641

SEQ ID NO: 84661 - DNA, 201 bp, Bos taurus; identical to SEQ ID NO: 2642

SEQ ID NO: 84662 - DNA, 201 bp, Bos taurus; identical to SEQ ID NO: 2643

SEQ ID NO: 84663 - DNA, 201 bp, Bos taurus; identical to SEQ ID NO: 2644

SEQ ID NO: 84664 - DNA, 201 bp, Bos taurus; identical to SEQ ID NO: 2645

SEQ ID NO: 84665 - DNA, 201 bp, Bos taurus; identical to SEQ ID NO: 2646

SEQ ID NO: 84666 - DNA, 201 bp, Bos taurus; identical to SEQ ID NO: 2648

SEQ ID NO: 84667 - DNA, 201 bp, Bos taurus; identical to SEQ ID NO: 2649

SEQ ID NO: 84668 - DNA, 201 bp, Bos taurus; identical to SEQ ID NO: 2650

SEQ ID NO: 84669 - DNA, 201 bp, Bos taurus
tcacccaccaaggggcaggcataagaagcaagaaagctgtaataccataactcaggccagactctgccctgggaccagctggaccctggccttgcccactaacatgccaacacaaaatttgggacactgcaaaccccatacccaactgtggcagaaaccgtccccccacccccactgagcaatgaacaatctgaaatgagc

SEQ ID NO: 84670 - DNA, 201 bp, Bos taurus
cactcacactcgcaagagttgcccaaagcagctgtgtcagctcctccctcttctcagacgcaccccgcctttgatctggccagctgacaaccagccaacattcacagtgctcctctccaacccccatccccaccccagagattcagggatcaggggaaggcagagcctcttgcacctctttcccttcatctgagtgcttcc

SEQ ID NO: 84671 - DNA, 201 bp, Bos taurus
gctggccccctccttccagctccctcctattccaatccatgcacccaagttcctgccacctggggtcctgtacacctgctgctccctccacctggagagccctctgtccccattcagggccctcatttcacaaccccctttgagacccatgccaaataccacatcctcgaagaagcctttctgctgctaccacccacacct

SEQ ID NO: 84672 - DNA, 201 bp, Bos taurus; identical to SEQ ID NO: 2651

SEQ ID NO: 84673 - DNA, 201 bp, Bos taurus
cttgaggttgtggactgcctccaccaccagcagcccatccacactcttcagacccttcaccatggagggcaggagggcctgcaccttggcagcctgcagaaaaggagtatttgggatgggggctcctatctgatctaacaggtgaggggcccagcctctgagtcacagagatgaacttggtcaagcaagtcctacctccag

SEQ ID NO: 84674 - DNA, 201 bp, Bos taurus; identical to SEQ ID NO: 2653

SEQ ID NO: 84675 - DNA, 201 bp, Bos taurus; identical to SEQ ID NO: 2655

SEQ ID NO: 84676 - DNA, 201 bp, Bos taurus; identical to SEQ ID NO: 2656

SEQ ID NO: 84677 - DNA, 201 bp, Bos taurus; identical to SEQ ID NO: 2658

SEQ ID NO: 84678 - DNA, 201 bp, Bos taurus; identical to SEQ ID NO: 2659

SEQ ID NO: 84679 - DNA, 201 bp, Bos taurus; identical to SEQ ID NO: 2661

SEQ ID NO: 84680 - DNA, 201 bp, Bos taurus; identical to SEQ ID NO: 2662

SEQ ID NO: 84681 - DNA, 201 bp, Bos taurus
cacagttgtttgcaactcagcaaagcagtagtaaaccatcaggttctattcacccagcacttagaaaaaacagaattgatcacacccatttaaaaacaaacctcatgctatttcccaatgtatagtttcaatctaagttctgacaatgaaatatatggatatatatctatatatctcatcttgattttcaaaggaggcaaa

SEQ ID NO: 84682 - DNA, 201 bp, Bos taurus; identical to SEQ ID NO: 2663

SEQ ID NO: 84683 - DNA, 201 bp, Bos taurus
tccatggacttcccatctatgggacttaggacactaaaacagaaacaaaggagagagatggaagcagctcttagaagaactacttctctcttatcatacactgggtgccttgctgaaaagacctatgcaaaacatcacaaagaagaagccactgccccaaaatgtacacgaacagagctctcagggaggggcctgtgcact

SEQ ID NO: 84684 - DNA, 201 bp, Bos taurus; identical to SEQ ID NO: 2665

SEQ ID NO: 84685 - DNA, 201 bp, Bos taurus; identical to SEQ ID NO: 2666

SEQ ID NO: 84686 - DNA, 201 bp, Bos taurus; identical to SEQ ID NO: 2667

SEQ ID NO: 84687 - DNA, 201 bp, Bos taurus; identical to SEQ ID NO: 2668

SEQ ID NO: 84688 - DNA, 201 bp, Bos taurus; identical to SEQ ID NO: 2669

SEQ ID NO: 84689 - DNA, 201 bp, Bos taurus
gttggcgcctcttgagcgatgagcggctgccaagagcggaacacagctcggctgggtgcgcgaaggacccttggaggtcatgcgcccttcgaggccccccgggaggaggaggtcccgcccaaggtcacccaggggtgcgtgttaacagtgcgggaacccaaatcccttcgtccttggctcttccctaaagcccaagaggcc

SEQ ID NO: 84690 - DNA, 201 bp, Bos taurus
caggtgaaagaatttgcctgaggcccctggtgagcagctgagctggaatttgaattgccttctctctggcctcttcgtttaaactctttctctcactctttttgccacatcccagctgcctctggccagacccgaaaaacaaatcctgtaattgagttggaatgtgggtgctggggcccaggagacaatgtttcctgcttt

SEQ ID NO: 84691 - DNA, 201 bp, Bos taurus
gaacatcctcacctgaaattgaaaggtaaatatttcagttgtgagtctctctgtcatgactcaaataattttaaaattgcttagatgtctttgcctaacaatgttcagattgttctaatgcaggggaaaacggtagtttcagacacagtaatattgatagcagctagtaatttccatgtatttctcatggttactggcgct

SEQ ID NO: 84692 - DNA, 201 bp, Bos taurus; identical to SEQ ID NO: 2674

SEQ ID NO: 84693 - DNA, 201 bp, Bos taurus
tataaaaccaatattctttagtggctcacactgaagtatcaagtagcatcaattatttacaattccagttagtataggggccttttgaccaatgaaaacacacatttttaagtactcaaacttaaaagtagaactgaacttaggatttcagattccaaagcccttttaccaagtacctttcttctcagagcctcaggcctc

SEQ ID NO: 84694 - DNA, 201 bp, Bos taurus; identical to SEQ ID NO: 2675

SEQ ID NO: 84695 - DNA, 201 bp, Bos taurus; identical to SEQ ID NO: 2677

SEQ ID NO: 84696 - DNA, 201 bp, Bos taurus; identical to SEQ ID NO: 2678

SEQ ID NO: 84697 - DNA, 201 bp, Bos taurus; identical to SEQ ID NO: 2680

SEQ ID NO: 84698 - DNA, 201 bp, Bos taurus; identical to SEQ ID NO: 2681

SEQ ID NO: 84699 - DNA, 201 bp, Bos taurus; identical to SEQ ID NO: 2682

SEQ ID NO: 84700 - DNA, 201 bp, Bos taurus; identical to SEQ ID NO: 2684

SEQ ID NO: 84701 - DNA, 201 bp, Bos taurus; identical to SEQ ID NO: 2685

SEQ ID NO: 84702 - DNA, 201 bp, Bos taurus; identical to SEQ ID NO: 2688

SEQ ID NO: 84703 - DNA, 201 bp, Bos taurus; identical to SEQ ID NO: 2692

SEQ ID NO: 84704 - DNA, 201 bp, Bos taurus; identical to SEQ ID NO: 2693

SEQ ID NO: 84705 - DNA, 201 bp, Bos taurus; identical to SEQ ID NO: 2695

SEQ ID NO: 84706 - DNA, 201 bp, Bos taurus; identical to SEQ ID NO: 2696

SEQ ID NO: 84707 - DNA, 201 bp, Bos taurus; identical to SEQ ID NO: 2697

SEQ ID NO: 84708 - DNA, 201 bp, Bos taurus; identical to SEQ ID NO: 2698

SEQ ID NO: 84709 - DNA, 201 bp, Bos taurus; identical to SEQ ID NO: 2701

SEQ ID NO: 84710 - DNA, 201 bp, Bos taurus; identical to SEQ ID NO: 2702

SEQ ID NO: 84711 - DNA, 201 bp, Bos taurus; identical to SEQ ID NO: 2704

SEQ ID NO: 84712 - DNA, 201 bp, Bos taurus; identical to SEQ ID NO: 2705

SEQ ID NO: 84713 - DNA, 201 bp, Bos taurus; identical to SEQ ID NO: 2706

SEQ ID NO: 84714 - DNA, 201 bp, Bos taurus; identical to SEQ ID NO: 2707

SEQ ID NO: 84715 - DNA, 201 bp, Bos taurus; identical to SEQ ID NO: 2711

SEQ ID NO: 84716 - DNA, 201 bp, Bos taurus; identical to SEQ ID NO: 2713

SEQ ID NO: 84717 - DNA, 201 bp, Bos taurus; identical to SEQ ID NO: 2714

SEQ ID NO: 84718 - DNA, 201 bp, Bos taurus; identical to SEQ ID NO: 2715

SEQ ID NO: 84719 - DNA, 201 bp, Bos taurus; identical to SEQ ID NO: 2716

SEQ ID NO: 84720 - DNA, 201 bp, Bos taurus; identical to SEQ ID NO: 2717

SEQ ID NO: 84721 - DNA, 201 bp, Bos taurus; identical to SEQ ID NO: 2718

SEQ ID NO: 84722 - DNA, 201 bp, Bos taurus; identical to SEQ ID NO: 2719

SEQ ID NO: 84723 - DNA, 201 bp, Bos taurus; identical to SEQ ID NO: 2720

SEQ ID NO: 84724 - DNA, 201 bp, Bos taurus; identical to SEQ ID NO: 2721

SEQ ID NO: 84725 - DNA, 201 bp, Bos taurus; identical to SEQ ID NO: 2722

SEQ ID NO: 84726 - DNA, 201 bp, Bos taurus; identical to SEQ ID NO: 2723

SEQ ID NO: 84727 - DNA, 201 bp, Bos taurus; identical to SEQ ID NO: 2724

SEQ ID NO: 84728 - DNA, 201 bp, Bos taurus; identical to SEQ ID NO: 2725

SEQ ID NO: 84729 - DNA, 201 bp, Bos taurus; identical to SEQ ID NO: 2726

SEQ ID NO: 84730 - DNA, 201 bp, Bos taurus; identical to SEQ ID NO: 2727

SEQ ID NO: 84731 - DNA, 201 bp, Bos taurus; identical to SEQ ID NO: 2728

SEQ ID NO: 84732 - DNA, 201 bp, Bos taurus; identical to SEQ ID NO: 2729

SEQ ID NO: 84733 - DNA, 201 bp, Bos taurus; identical to SEQ ID NO: 2730

SEQ ID NO: 84734 - DNA, 201 bp, Bos taurus; identical to SEQ ID NO: 2731

SEQ ID NO: 84735 - DNA, 201 bp, Bos taurus; identical to SEQ ID NO: 2732

SEQ ID NO: 84736 - DNA, 201 bp, Bos taurus; identical to SEQ ID NO: 2733

SEQ ID NO: 84737 - DNA, 201 bp, Bos taurus; identical to SEQ ID NO: 2736

SEQ ID NO: 84738 - DNA, 201 bp, Bos taurus; identical to SEQ ID NO: 2737

SEQ ID NO: 84739 - DNA, 201 bp, Bos taurus; identical to SEQ ID NO: 2740

SEQ ID NO: 84740 - DNA, 201 bp, Bos taurus; identical to SEQ ID NO: 2741

SEQ ID NO: 84741 - DNA, 201 bp, Bos taurus; identical to SEQ ID NO: 2742

SEQ ID NO: 84742 - DNA, 201 bp, Bos taurus; identical to SEQ ID NO: 2743

SEQ ID NO: 84743 - DNA, 201 bp, Bos taurus; identical to SEQ ID NO: 2744

SEQ ID NO: 84744 - DNA, 201 bp, Bos taurus; identical to SEQ ID NO: 2745

SEQ ID NO: 84745 - DNA, 201 bp, Bos taurus; identical to SEQ ID NO: 2746

SEQ ID NO: 84746 - DNA, 201 bp, Bos taurus; identical to SEQ ID NO: 2748

SEQ ID NO: 84747 - DNA, 201 bp, Bos taurus; identical to SEQ ID NO: 2749

SEQ ID NO: 84748 - DNA, 201 bp, Bos taurus; identical to SEQ ID NO: 2750

SEQ ID NO: 84749 - DNA, 201 bp, Bos taurus
tatttgcagtggcatcctgggtcctatggtaccaagtggacatgtgagctcttctgctggggaggatacccttggggcctgcccttagcccaggacctggcatgcagtatggaatcaaagtattggtgttggatttgcaagcttgtattaggagacagggaaggcctgcatgctgcatgcagtccatgggatcgcaaagag

SEQ ID NO: 84750 - DNA, 201 bp, Bos taurus; identical to SEQ ID NO: 2751

SEQ ID NO: 84751 - DNA, 201 bp, Bos taurus; identical to SEQ ID NO: 2753

SEQ ID NO: 84752 - DNA, 201 bp, Bos taurus
ggggtgctttcaagcagaactttacaatatagcttgcctcttggtccttgtggctccttggtgttttgcctgaccctcatatggaatcagagacacaggggcaaagctgacaggatgactgcccagtcctgagtgcctaatgactaggtttggactttcctgttcactgcccaaggcacctaactccgtgtcaggtgattt

SEQ ID NO: 84753 - DNA, 201 bp, Bos taurus
gggttagatggagggaggcttggcccatccatccttctctcaatggaccaagctgttgaggctttatgtcctgcctccttaccaggcttttctgggagacagaggggagggccatcttcctgcttcctgccactgtctctgtccctggtggggatgccaagatggaattctccaaatgttgtcaacaagaatcccacaaga

SEQ ID NO: 84754 - DNA, 201 bp, Bos taurus
ggggctcatgctctaaaaagccctgaactctccaaagggtttcaacaaaatattttttaaagccacatgcggggcagagcacagggccagttgggttgccaggtctgtgatcagcttgtgcacagttctctgattgggtgatggtgaggtaacacggtggtgttacaggggttaacattaacagtccttaggcttcaggag

SEQ ID NO: 84755 - DNA, 201 bp, Bos taurus
tcttaggatttgggaggagagtcatctctcctctcaatcacctctcatggttggccacaagaaagaaagggtcgagtaacctgagctgcccttcctgaaacgaggtgttctattatctactgagcattgagttgggcatgggcagtagtactctgtcctcaaaccgaaatgctatggaaaatactgagcaagctgcatgag

SEQ ID NO: 84756 - DNA, 201 bp, Bos taurus; identical to SEQ ID NO: 2756

SEQ ID NO: 84757 - DNA, 201 bp, Bos taurus; identical to SEQ ID NO: 2757

SEQ ID NO: 84758 - DNA, 201 bp, Bos taurus; identical to SEQ ID NO: 2758

SEQ ID NO: 84759 - DNA, 201 bp, Bos taurus
taaagcagtgggaaaaagcactccagagagtagccacaggaaggtagggtgaggggcagaaagagccaggggtgttttctggccctgtgtggtcagagggcgatgctggatcagggctcagcttacccatgctgcccagcattgagctctgggggccttgcacctgtttataatgtgttgtaaaaacttagggctggctgc

SEQ ID NO: 84760 - DNA, 201 bp, Bos taurus
aaaagaaaagccaggcctcttcccttggcccagagtcttatgtggatgaacatacctcagcttccactgctttctctgagctctccaagtcccattaacactggccaagatcattgctgcctcagggattttgtgcttactgttccttctgcctgcaactttctttcacctgatttttatagggtttgcttcttcttcatt

SEQ ID NO: 84761 - DNA, 201 bp, Bos taurus; identical to SEQ ID NO: 2759

SEQ ID NO: 84762 - DNA, 201 bp, Bos taurus
agggggaaggggagccagttccactgccttacttctcaccgaggacagactgaggtcttcatggccagttcagggccctgtttcctcagcaaacatgccaccttgtgaagtccttgatttctaaccccaaaatggtgttgatgagaggttggtgtgaaaaataactggataatggatgtgaggagattagcagaggcccag

SEQ ID NO: 84763 - DNA, 201 bp, Bos taurus; identical to SEQ ID NO: 2761

SEQ ID NO: 84764 - DNA, 201 bp, Bos taurus; identical to SEQ ID NO: 2762

SEQ ID NO: 84765 - DNA, 201 bp, Bos taurus; identical to SEQ ID NO: 2763

SEQ ID NO: 84766 - DNA, 201 bp, Bos taurus; identical to SEQ ID NO: 2764

SEQ ID NO: 84767 - DNA, 201 bp, Bos taurus; identical to SEQ ID NO: 2765

SEQ ID NO: 84768 - DNA, 201 bp, Bos taurus; identical to SEQ ID NO: 2766

SEQ ID NO: 84769 - DNA, 201 bp, Bos taurus; identical to SEQ ID NO: 2767

SEQ ID NO: 84770 - DNA, 201 bp, Bos taurus; identical to SEQ ID NO: 2768

SEQ ID NO: 84771 - DNA, 201 bp, Bos taurus; identical to SEQ ID NO: 2769

SEQ ID NO: 84772 - DNA, 201 bp, Bos taurus; identical to SEQ ID NO: 2770

SEQ ID NO: 84773 - DNA, 201 bp, Bos taurus; identical to SEQ ID NO: 2771

SEQ ID NO: 84774 - DNA, 201 bp, Bos taurus
gccagggtcttggatttgtgaggttagaggctgaggaaatatgaaaagaaccaaaataagaacactgtccaagaaattcaagcttggttgaagagactgggcctctttaactctgctgagtacattagatgcaggaaacatccaagttcttgaaggcacatcttctgttcatttggcctttttgacttgtggctctagcgt

SEQ ID NO: 84775 - DNA, 201 bp, Bos taurus; identical to SEQ ID NO: 2772

SEQ ID NO: 84776 - DNA, 201 bp, Bos taurus; identical to SEQ ID NO: 2773

SEQ ID NO: 84777 - DNA, 201 bp, Bos taurus
aggccttgcctcttatgggtcaggtcctagggtagagacagtcccccttctttatcagcactagctccggaggatgagcatccttgtccaaagaatgattgggcttgtcatcaagataggtgggatcctctttcactaagtggaatcatttggttgtgtcttacccactgtcaaatctccatggatctagttactcccaca

SEQ ID NO: 84778 - DNA, 201 bp, Bos taurus; identical to SEQ ID NO: 2775

SEQ ID NO: 84779 - DNA, 201 bp, Bos taurus; identical to SEQ ID NO: 2776

SEQ ID NO: 84780 - DNA, 201 bp, Bos taurus
gtaagagatttctgtgagtctctgaggtttttttgatagtgtatttattgtgttggcgctttgcttttcaggattcaaaagccaaataaaccctcatggagttcagctcaaggtttgaagacttcctagcttgtcctatggacctcaacaccaagaaccacaattgcaaatttaataggtcattttgtatcaaaaggtcaa

SEQ ID NO: 84781 - DNA, 201 bp, Bos taurus; identical to SEQ ID NO: 2778

SEQ ID NO: 84782 - DNA, 201 bp, Bos taurus; identical to SEQ ID NO: 2779

SEQ ID NO: 84783 - DNA, 201 bp, Bos taurus; identical to SEQ ID NO: 2780

SEQ ID NO: 84784 - DNA, 201 bp, Bos taurus
ttaagaatcttaagcaatgacagttccactagggactagactcacagatcagagcaaagcttttccagacattttgtctggaagtgacggttagttttgcactggtcttagttggcaaagtcatcagcattgtcagtctcagaaagcagagacacccaggaaaaaggagagctgtggagtcagaagacctgagttccactc

SEQ ID NO: 84785 - DNA, 201 bp, Bos taurus; identical to SEQ ID NO: 2781

SEQ ID NO: 84786 - DNA, 201 bp, Bos taurus
cttttgcaacacatcacttaatggccattaatgtaatatatatactgcatcctggaaaacagaatcttaaccttgcagggtgctatttttcaagctgccacgttgctgagtttttaaggggctattacaacattctatcagccagaatcttccaggtgatatgatatacaatagggccaatgaatcccaatgtcaagtatc

SEQ ID NO: 84787 - DNA, 201 bp, Bos taurus; identical to SEQ ID NO: 2782

SEQ ID NO: 84788 - DNA, 201 bp, Bos taurus; identical to SEQ ID NO: 2783

SEQ ID NO: 84789 - DNA, 201 bp, Bos taurus; identical to SEQ ID NO: 2786

SEQ ID NO: 84790 - DNA, 201 bp, Bos taurus
tgacttccagcgtttgattggttttttcccctcttggtgtgtgtgccattttttacagaggaggcgagaagcacggcagcagcgatctagaaaagtcggcatacgctactatgaaacacacaatgtgaagaataggaacaggaacaaaaagaagaccaccgactcagaagggcagaaacacagacacaagaaagccaaaca

SEQ ID NO: 84791 - DNA, 201 bp, Bos taurus
ccccaaggtaaggcgttcagagcgggtggcagcgtgtatgtccatgaacgtgcacaagcatccctgtgtgtgtgcaggccccttctgtgtgaagcgtcgcgtacctgcgtgcttggaggtgtctctcccctgggcagctgccggtacctctgggcctgttctgcctgcgcggacatgcgtgctcttgcttttgtgctacat

SEQ ID NO: 84792 - DNA, 201 bp, Bos taurus; identical to SEQ ID NO: 44369

SEQ ID NO: 84793 - DNA, 201 bp, Bos taurus; identical to SEQ ID NO: 2790

SEQ ID NO: 84794 - DNA, 201 bp, Bos taurus; identical to SEQ ID NO: 2793

SEQ ID NO: 84795 - DNA, 201 bp, Bos taurus; identical to SEQ ID NO: 2794

SEQ ID NO: 84796 - DNA, 201 bp, Bos taurus; identical to SEQ ID NO: 2795

SEQ ID NO: 84797 - DNA, 201 bp, Bos taurus; identical to SEQ ID NO: 2796

SEQ ID NO: 84798 - DNA, 201 bp, Bos taurus; identical to SEQ ID NO: 2797

SEQ ID NO: 84799 - DNA, 201 bp, Bos taurus; identical to SEQ ID NO: 2798

SEQ ID NO: 84800 - DNA, 201 bp, Bos taurus; identical to SEQ ID NO: 2799

SEQ ID NO: 84801 - DNA, 201 bp, Bos taurus; identical to SEQ ID NO: 2801

SEQ ID NO: 84802 - DNA, 201 bp, Bos taurus; identical to SEQ ID NO: 2802

SEQ ID NO: 84803 - DNA, 201 bp, Bos taurus; identical to SEQ ID NO: 2804

SEQ ID NO: 84804 - DNA, 201 bp, Bos taurus; identical to SEQ ID NO: 2805

SEQ ID NO: 84805 - DNA, 201 bp, Bos taurus; identical to SEQ ID NO: 2807

SEQ ID NO: 84806 - DNA, 201 bp, Bos taurus; identical to SEQ ID NO: 2808

SEQ ID NO: 84807 - DNA, 201 bp, Bos taurus; identical to SEQ ID NO: 2810

SEQ ID NO: 84808 - DNA, 201 bp, Bos taurus; identical to SEQ ID NO: 2811

SEQ ID NO: 84809 - DNA, 201 bp, Bos taurus; identical to SEQ ID NO: 2812

SEQ ID NO: 84810 - DNA, 201 bp, Bos taurus; identical to SEQ ID NO: 2813

SEQ ID NO: 84811 - DNA, 201 bp, Bos taurus; identical to SEQ ID NO: 2814

SEQ ID NO: 84812 - DNA, 201 bp, Bos taurus; identical to SEQ ID NO: 2815

SEQ ID NO: 84813 - DNA, 201 bp, Bos taurus
aagcaacagaaaagagccgaagtcaatgctgagccccaacgaggtgctcaaagaataatggttccatctaaccttgtcttccgtgggccgccctttcccaggaaagcagcaataacagacagcatgtttactgcattcttgccacgtgccaggaccgtgcaaagggctgtgtgcgtgtatcatcctatcagagtctcacaa

SEQ ID NO: 84814 - DNA, 201 bp, Bos taurus; identical to SEQ ID NO: 2817

SEQ ID NO: 84815 - DNA, 201 bp, Bos taurus; identical to SEQ ID NO: 2820

SEQ ID NO: 84816 - DNA, 201 bp, Bos taurus; identical to SEQ ID NO: 2821

SEQ ID NO: 84817 - DNA, 201 bp, Bos taurus; identical to SEQ ID NO: 2822

SEQ ID NO: 84818 - DNA, 201 bp, Bos taurus
agcctccgcagaggtacagggccctcttattttgggatgcttggaagcgtgagggactctctcgtggttgctatggccatgtggatgtgtgaagagtctcaaactcgccacctgtttggtgaaccacctgatgtgtgtggtttacctgctgcaggcccagcaggaccctgggtcgggaggggccttgctgctggggcccgt

SEQ ID NO: 84819 - DNA, 201 bp, Bos taurus
gttcatgacgcacacacagacgagaggagggtttctgacggcggttctgacgccgtctgggggggagggcagaggaaggaaaggcggcatttcactcctctgtcccgtcagcgtctggaagagcagctggggcgcagcgacagcccctcaattcctcaggccgggggcgcaggcgaagaccccagtccacacgtgtcattt

SEQ ID NO: 84820 - DNA, 201 bp, Bos taurus
gttaaaatgaggccttaagggtgggcccttatccaatcaagcatccttataagaaaggaaatttggacccacagagacaccagggatgcacatgaacacaagaaaggccatatgaggacacagcaagagccaagcagagaagcctcagaagaaaccagatctgcagacaccttgtccagcctgagaactatgagaaagcaa

SEQ ID NO: 84821 - DNA, 201 bp, Bos taurus; identical to SEQ ID NO: 2824

SEQ ID NO: 84822 - DNA, 201 bp, Bos taurus; identical to SEQ ID NO: 2825

SEQ ID NO: 84823 - DNA, 201 bp, Bos taurus
gacatataagacaacctcaagaggaacccattttgcaaagcaggaaactggactcctagagcccagctctcctgacccctggcatccagggccaggacctagaggcacagatgactgttgggaaacagtcatccagtcagggactacgtttcccaggattccttgcagctaggtggagccatgtgaccaagttctggccaa

SEQ ID NO: 84824 - DNA, 201 bp, Bos taurus; identical to SEQ ID NO: 2826

SEQ ID NO: 84825 - DNA, 201 bp, Bos taurus; identical to SEQ ID NO: 2827

SEQ ID NO: 84826 - DNA, 201 bp, Bos taurus
ctttcccctcttatgtggtggtcagggatgctggatcccaccccccagacaagagggcgcacccagaggggccctgcccacaagggaagggccagggaaaacatacggagggactgaactcaggctgggtcctggaggagagatgaagcgaggagagcagaggcggggggacaactaccccgttaggggggccagggtggg

SEQ ID NO: 84827 - DNA, 201 bp, Bos taurus; identical to SEQ ID NO: 2830

SEQ ID NO: 84828 - DNA, 201 bp, Bos taurus; identical to SEQ ID NO: 2833

SEQ ID NO: 84829 - DNA, 201 bp, Bos taurus; identical to SEQ ID NO: 2834

SEQ ID NO: 84830 - DNA, 201 bp, Bos taurus
agtttccatggttcttcctccagttctctggtagcatccatacctgaacgtgacctactttgtttctcgtcatagagagaggcctgacagataccagctccggagctgctgccaagatgaagcgaaataaaagcacaaagtgtttagtgagttcctgacataataaggccataataagaggtggctgttgttactacccca

SEQ ID NO: 84831 - DNA, 201 bp, Bos taurus; identical to SEQ ID NO: 2835

SEQ ID NO: 84832 - DNA, 201 bp, Bos taurus; identical to SEQ ID NO: 2836

SEQ ID NO: 84833 - DNA, 201 bp, Bos taurus; identical to SEQ ID NO: 2837

SEQ ID NO: 84834 - DNA, 201 bp, Bos taurus
gtatttaatgggttgtctttctgctcttgctaaaatataggctctttgagaccaaggaaagattattttccccccactgatggactcaagaacacttgattggggcctgggaccaagaggaaagctgataaatatttggtgatttatggataggagtggcggcaggccaggaaatgttagttttcatgaacttccactccc

SEQ ID NO: 84835 - DNA, 201 bp, Bos taurus
ttgacttcactgcttaatggtttcggaagcgactcaattctaaaagcatgcccacccactgttacgacaaataaatgagaggccatccttagagcaactcgtataaagcccaaccaggaaagactcatgtcggtttcaccctcgcagtacattccaccctgctctgccctctctggggacttgaatctagaccctacttgt

SEQ ID NO: 84836 - DNA, 201 bp, Bos taurus; identical to SEQ ID NO: 2838

SEQ ID NO: 84837 - DNA, 201 bp, Bos taurus; identical to SEQ ID NO: 2839

SEQ ID NO: 84838 - DNA, 201 bp, Bos taurus; identical to SEQ ID NO: 2841

SEQ ID NO: 84839 - DNA, 201 bp, Bos taurus; identical to SEQ ID NO: 2843

SEQ ID NO: 84840 - DNA, 201 bp, Bos taurus
ctcccccctcaaataaaatataactctcaacttataggttgtgactattttttttcaaagtcgacaccagcctcctcccaagtggtcctgcgtctcagaggagcaaggtcatggaggccacctctgagttggcggttcttacaccctagagaagaagtgttcccactcttgcctcccctccacatgtgcccttggtcccct

SEQ ID NO: 84841 - DNA, 201 bp, Bos taurus; identical to SEQ ID NO: 2849

SEQ ID NO: 84842 - DNA, 201 bp, Bos taurus; identical to SEQ ID NO: 2850

SEQ ID NO: 84843 - DNA, 201 bp, Bos taurus; identical to SEQ ID NO: 2851

SEQ ID NO: 84844 - DNA, 201 bp, Bos taurus
agcctggtgggctgccgtctatggggtcgcacagagtcggacacgactgaagcgacttagcagcagcagcagcagcatagagacagaaggccatgaaaacggaaacccaagaacagggactagaacattttgactaaaagaaacgtcaagatggacacaaggcaagctggaaacccgggaagaaaaggcccatgcgatgac

SEQ ID NO: 84845 - DNA, 201 bp, Bos taurus; identical to SEQ ID NO: 2852

SEQ ID NO: 84846 - DNA, 201 bp, Bos taurus; identical to SEQ ID NO: 2854

SEQ ID NO: 84847 - DNA, 201 bp, Bos taurus; identical to SEQ ID NO: 2856

SEQ ID NO: 84848 - DNA, 201 bp, Bos taurus; identical to SEQ ID NO: 2857

SEQ ID NO: 84849 - DNA, 201 bp, Bos taurus
ttggcctctgtcatctgacggtatatggtggcttccggtatttgctgtagagtttccacatggaggggaaatgctgacccagcaaactgtggaaagttccggagtcttaatgacaaccacagtccagcaccgtaggttgctctgttaatcctcataacagccctgcaagatgcgtgtgcttatcaccttcatagatgcgtg

SEQ ID NO: 84850 - DNA, 201 bp, Bos taurus
aaaaggttcacaacattacacacgattttttctttttttgaggagggcatctctctgtattcccttttgttataaaatggtcatgttagctgtccatcgctgcatttgttagactgtccgtctacttgagaggacgacagggtgagtgccacccacctgtgaccctgactggagaagctatcgtccctgtgattccctctc

SEQ ID NO: 84851 - DNA, 201 bp, Bos taurus
gtggccaaagtattggagcttcatctcaggtgaccttcagacagctgtataatgtaagcatgtgcttctttacccctgatctatcatctacatcccttgcctcagcgcccagccaatggccaggtgggtccggtgtgtcctggggagaggaagggctgagtcttctgaatgaccacacattctatctgtgatcgtggtgcc

SEQ ID NO: 84852 - DNA, 201 bp, Bos taurus
gttcagacagactaaatggaaacctgccattaggcagggtgggaggcttgttctgtggagagagagggctttgggctgtggggacctcaggtgcctctgccgtcaaatacagccatgtcaaccctggtgatcagtgttttgcgtcctggtttatatagtgagagaacagagagcttgattccgattgcagtcttcagaatt

SEQ ID NO: 84853 - DNA, 201 bp, Bos taurus; identical to SEQ ID NO: 2860

SEQ ID NO: 84854 - DNA, 201 bp, Bos taurus; identical to SEQ ID NO: 2861

SEQ ID NO: 84855 - DNA, 201 bp, Bos taurus; identical to SEQ ID NO: 2862

SEQ ID NO: 84856 - DNA, 201 bp, Bos taurus; identical to SEQ ID NO: 2863

SEQ ID NO: 84857 - DNA, 201 bp, Bos taurus; identical to SEQ ID NO: 2864

SEQ ID NO: 84858 - DNA, 201 bp, Bos taurus; identical to SEQ ID NO: 2865

SEQ ID NO: 84859 - DNA, 201 bp, Bos taurus; identical to SEQ ID NO: 2866

SEQ ID NO: 84860 - DNA, 201 bp, Bos taurus
agaagaggagctgatggaaacaggcagtggccctgaccaccaggaacaaggaagctcagagcttcagcagagtcacagaggggcacttgcacctccccagtttttggccctctctgagaaagtgatgtctaagcttaaaaaaaaattagggtaaagaaggaggaaactgtccccaaacagaagtaacaccatgaatttttt

SEQ ID NO: 84861 - DNA, 201 bp, Bos taurus; identical to SEQ ID NO: 2867

SEQ ID NO: 84862 - DNA, 201 bp, Bos taurus
ctctttttgagagctgctggaggctggagacctccatcagccagggcagtggcccgacgcccacccacactgccgcagcccatctcccaggcccccagatcaatgtggttccacctgtttctgtttcaagccaaactggggtctgagtccctccacagactcctgggccagtgggagggctggctcagcacacagtccacc

SEQ ID NO: 84863 - DNA, 201 bp, Bos taurus
ttccgttcctggtcaaggaactaaggtcccacgtgcctggcacacaatacagccaaagcaaagtgggaggggggcagagaactgagaacaccacgtgcctatctgggaccaggcactgggctctcaacagctttgtaagcaaagtcatattggcggtggacagggcgcacaaggtgtccctcgagtcttcaggtgagagcc

SEQ ID NO: 84864 - DNA, 201 bp, Bos taurus
caggggaactaagatcccacttgctgcaccgtgcggccaaaataaaaaagttttatctgaaagaataaatacatggtcatagcctttcataaaaatgctcgaaaggaccagttttaggccagtaatgtattcttcacttcattcctttaaatagagaaagaacccctctagctgggcgtctgagtccgcgtttccctgttg

SEQ ID NO: 84865 - DNA, 201 bp, Bos taurus
gcaaccagcccaggccacgcccagcaggtgcccccggcctgagcaagggtcggtgcccagaggctctgcccctctgcaagccaggacagtttcccggcctgaggtaaggacagaaaactcgaagtccagctctgccccagagaaccttccagatcacccagcaccagcccctcagtcgtaacttcctgggggctttgaccc

SEQ ID NO: 84866 - DNA, 201 bp, Bos taurus
caggtgaggcccgttcccctccgtgtcgcctgaccccccagcacaggtgctccggttgcttttggtaacagccttgcttgtgcgaatggagccctttgcacacctgcagtgctctggcctctgcacccggagcccagaccacaccctggaccaatccagtcccacgtcagcgtggctgccttgggaagggggcatcctcac

SEQ ID NO: 84867 - DNA, 201 bp, Bos taurus
gtaaggaaataactgtcccacctgtctgtcgagggtcatctgaggctccactggagaaaagaccaggtgtcctttgggagccagggaaggtcctggacccatcagtctctgatcctctcggccatcactggcttgggggccctgagtcccccttgggactggggaatgcgctgcttccagtggccccagaaaccaagcaga

SEQ ID NO: 84868 - DNA, 201 bp, Bos taurus
gggtaagacccgctggaggaggggcagagggggtcttggagagtgtgagtccaggtcaggggcccctcttctctggtcaaagagaaggaccaaaaagcccgggcaggaaaagccttgaccagaaggagactccaaagacaaagaggaaagggtgtgaatggatttgttgttgttgttcagtcactcagtcatgtctgactc

SEQ ID NO: 84869 - DNA, 201 bp, Bos taurus
gctctgcctctgctgatacagaggaccaggaagagccaggaagagccccccgtcctgatcagagaagtggtgtgcacggctgggaagaacaaggctctgttcgggccagaggactcgagggccgcggagtgcgatggaggtgggacgcagtggatgggaggacttccggttccatgacttcacctggttggtgaagcagag

SEQ ID NO: 84870 - DNA, 201 bp, Bos taurus
ctcagaaggagtgtcgcttttggacttccagcctgcagatggtgagggaatgtgctcagaggaggtaggcctccgctggggcccttgctacctcagccctggggaactaaagcaaaaatatccctccacggggagtgctcccgtcagaaggagtgtgatgtccagatgggcgtgtgtgcgcggcaatggggagccggggag

SEQ ID NO: 84871 - DNA, 201 bp, Bos taurus; identical to SEQ ID NO: 2871

SEQ ID NO: 84872 - DNA, 201 bp, Bos taurus; identical to SEQ ID NO: 2873

SEQ ID NO: 84873 - DNA, 201 bp, Bos taurus; identical to SEQ ID NO: 2875

SEQ ID NO: 84874 - DNA, 201 bp, Bos taurus; identical to SEQ ID NO: 2876

SEQ ID NO: 84875 - DNA, 201 bp, Bos taurus; identical to SEQ ID NO: 2877

SEQ ID NO: 84876 - DNA, 201 bp, Bos taurus; identical to SEQ ID NO: 2878

SEQ ID NO: 84877 - DNA, 201 bp, Bos taurus; identical to SEQ ID NO: 2879

SEQ ID NO: 84878 - DNA, 201 bp, Bos taurus; identical to SEQ ID NO: 2880

SEQ ID NO: 84879 - DNA, 201 bp, Bos taurus; identical to SEQ ID NO: 2881

SEQ ID NO: 84880 - DNA, 201 bp, Bos taurus; identical to SEQ ID NO: 2882

SEQ ID NO: 84881 - DNA, 201 bp, Bos taurus; identical to SEQ ID NO: 2883

SEQ ID NO: 84882 - DNA, 201 bp, Bos taurus; identical to SEQ ID NO: 2884

SEQ ID NO: 84883 - DNA, 201 bp, Bos taurus; identical to SEQ ID NO: 2885

SEQ ID NO: 84884 - DNA, 201 bp, Bos taurus; identical to SEQ ID NO: 2886

SEQ ID NO: 84885 - DNA, 201 bp, Bos taurus; identical to SEQ ID NO: 2887

SEQ ID NO: 84886 - DNA, 201 bp, Bos taurus; identical to SEQ ID NO: 2889

SEQ ID NO: 84887 - DNA, 201 bp, Bos taurus; identical to SEQ ID NO: 2890

SEQ ID NO: 84888 - DNA, 201 bp, Bos taurus; identical to SEQ ID NO: 2891

SEQ ID NO: 84889 - DNA, 201 bp, Bos taurus; identical to SEQ ID NO: 2892

SEQ ID NO: 84890 - DNA, 201 bp, Bos taurus; identical to SEQ ID NO: 2893

SEQ ID NO: 84891 - DNA, 201 bp, Bos taurus; identical to SEQ ID NO: 2894

SEQ ID NO: 84892 - DNA, 201 bp, Bos taurus; identical to SEQ ID NO: 2895

SEQ ID NO: 84893 - DNA, 201 bp, Bos taurus; identical to SEQ ID NO: 2896

SEQ ID NO: 84894 - DNA, 201 bp, Bos taurus; identical to SEQ ID NO: 2898

SEQ ID NO: 84895 - DNA, 201 bp, Bos taurus; identical to SEQ ID NO: 2899

SEQ ID NO: 84896 - DNA, 201 bp, Bos taurus; identical to SEQ ID NO: 2900

SEQ ID NO: 84897 - DNA, 201 bp, Bos taurus; identical to SEQ ID NO: 2901

SEQ ID NO: 84898 - DNA, 201 bp, Bos taurus; identical to SEQ ID NO: 2903

SEQ ID NO: 84899 - DNA, 201 bp, Bos taurus; identical to SEQ ID NO: 2905

SEQ ID NO: 84900 - DNA, 201 bp, Bos taurus; identical to SEQ ID NO: 2906

SEQ ID NO: 84901 - DNA, 201 bp, Bos taurus; identical to SEQ ID NO: 2908

SEQ ID NO: 84902 - DNA, 201 bp, Bos taurus; identical to SEQ ID NO: 2910

SEQ ID NO: 84903 - DNA, 201 bp, Bos taurus; identical to SEQ ID NO: 2911

SEQ ID NO: 84904 - DNA, 201 bp, Bos taurus; identical to SEQ ID NO: 2913

SEQ ID NO: 84905 - DNA, 201 bp, Bos taurus; identical to SEQ ID NO: 2914

SEQ ID NO: 84906 - DNA, 201 bp, Bos taurus; identical to SEQ ID NO: 2915

SEQ ID NO: 84907 - DNA, 201 bp, Bos taurus; identical to SEQ ID NO: 2916

SEQ ID NO: 84908 - DNA, 201 bp, Bos taurus; identical to SEQ ID NO: 2917

SEQ ID NO: 84909 - DNA, 201 bp, Bos taurus; identical to SEQ ID NO: 2918

SEQ ID NO: 84910 - DNA, 201 bp, Bos taurus; identical to SEQ ID NO: 2919

SEQ ID NO: 84911 - DNA, 201 bp, Bos taurus
tctcctgcatctcagcagagctgggttcccactctgttcttccaagcctgtgccttctgtgaaagcaataagtacagtgtttcatgtgtggttgtgtttgtgagtgtgtgtttatgcagctatgcacagcatgcatgaacatgcacagaagtacctccctagagactgacaactgccagcatcttaaatagaaagaaatgt

SEQ ID NO: 84912 - DNA, 201 bp, Bos taurus; identical to SEQ ID NO: 2921

SEQ ID NO: 84913 - DNA, 201 bp, Bos taurus; identical to SEQ ID NO: 2922

SEQ ID NO: 84914 - DNA, 201 bp, Bos taurus; identical to SEQ ID NO: 2923

SEQ ID NO: 84915 - DNA, 201 bp, Bos taurus; identical to SEQ ID NO: 2924

SEQ ID NO: 84916 - DNA, 201 bp, Bos taurus
ggagaacgaatccgaaaggctctgccagccctcccctccctcggcccgatagtgacttttcccggcagtgtgcagaatttgacttagaataattttcttcctttggaacctgtggcctgtcggtgccggatgcacgcagtttctggccctgagaggagggcatttcaccccagggtcatggtcagggccacagtgcagggg

SEQ ID NO: 84917 - DNA, 201 bp, Bos taurus; identical to SEQ ID NO: 2926

SEQ ID NO: 84918 - DNA, 201 bp, Bos taurus; identical to SEQ ID NO: 2927

SEQ ID NO: 84919 - DNA, 201 bp, Bos taurus; identical to SEQ ID NO: 2928

SEQ ID NO: 84920 - DNA, 201 bp, Bos taurus; identical to SEQ ID NO: 2929

SEQ ID NO: 84921 - DNA, 201 bp, Bos taurus; identical to SEQ ID NO: 2930

SEQ ID NO: 84922 - DNA, 201 bp, Bos taurus; identical to SEQ ID NO: 2932

SEQ ID NO: 84923 - DNA, 201 bp, Bos taurus; identical to SEQ ID NO: 2938

SEQ ID NO: 84924 - DNA, 201 bp, Bos taurus; identical to SEQ ID NO: 2939

SEQ ID NO: 84925 - DNA, 201 bp, Bos taurus
gggaagagtatttcaggcagagggaacataagggaggccgttgtgggtgcacagagtgaacaagcgggagaatggcaggaacgaaaaataagctacaccagagagagcttattggcctctgtaaccctgacttttgttctctatgaaatgagaagccatggagagggcggccatatttgtttttggccgccccgggtcttg

SEQ ID NO: 84926 - DNA, 201 bp, Bos taurus; identical to SEQ ID NO: 2940

SEQ ID NO: 84927 - DNA, 201 bp, Bos taurus; identical to SEQ ID NO: 2941

SEQ ID NO: 84928 - DNA, 201 bp, Bos taurus; identical to SEQ ID NO: 2942

SEQ ID NO: 84929 - DNA, 201 bp, Bos taurus
ttatgatagctttttttctgtaaagaataaatttacataactttctataatatggaggttgatttttaaatcatcagccatcatctttgtcacaatttttatgaggtgttatcttatatttggatattccaaaaccataaacaggcaatcaataaatggttacctgtgtgtttataagcattttaagcagcagttaggtgg

SEQ ID NO: 84930 - DNA, 201 bp, Bos taurus; identical to SEQ ID NO: 2944

SEQ ID NO: 84931 - DNA, 201 bp, Bos taurus
ccactgcagtactctggcctaggaaatcccatggacagaggattctggtgggctatagtccatgggattgcaaagaatcggtcacaactgagtgactaacacttcactgagtctagagggcccaaagtatcaggtaaaggaatgagtgaaataaaaagagacaggtgaacttgaggatgggtgagtataaaaacaaagtct

SEQ ID NO: 84932 - DNA, 201 bp, Bos taurus
aacattcataggctggcctgatgcccaacaaagatgaatccaatccataagcaactagagaaaccttcctctttctacacgaacagctgggtctctcatcctgtagcacaggcttaaggcccaaaaacactttatcacattctcatggaagaggaatacctctcccaagggatttgaattttgaataggctgaatttctca

SEQ ID NO: 84933 - DNA, 201 bp, Bos taurus; identical to SEQ ID NO: 2945

SEQ ID NO: 84934 - DNA, 201 bp, Bos taurus; identical to SEQ ID NO: 2946

SEQ ID NO: 84935 - DNA, 201 bp, Bos taurus; identical to SEQ ID NO: 2947

SEQ ID NO: 84936 - DNA, 201 bp, Bos taurus; identical to SEQ ID NO: 2948

SEQ ID NO: 84937 - DNA, 201 bp, Bos taurus
ggatgagaaaggtggctgagttctgaagggaaagtagacattactgagaatgggagagggagaggaacagatggaaagatgggccagaggaataaatgagcatcatgcattttcaggaactgtgagtaatatatgataaacacagcacagtagcttatgtgtgaatctgagattagaaaaggggacagtaagtgaatcctg

SEQ ID NO: 84938 - DNA, 201 bp, Bos taurus; identical to SEQ ID NO: 2949

SEQ ID NO: 84939 - DNA, 201 bp, Bos taurus; identical to SEQ ID NO: 2950

SEQ ID NO: 84940 - DNA, 201 bp, Bos taurus
atgacccgcacagactcataaacctcgaggtctttcggccttctcgagcccggtagaatttgtctgttacagagatacatgcacaaaatataatttttattccaagactgagtcatccaaagaggccatgtggtcttgagctgaaagaaccgtgctctgttttggagagtcagctggtgttctgtgtgatctctcagtgcc

SEQ ID NO: 84941 - DNA, 201 bp, Bos taurus; identical to SEQ ID NO: 2951

SEQ ID NO: 84942 - DNA, 201 bp, Bos taurus; identical to SEQ ID NO: 2952

SEQ ID NO: 84943 - DNA, 201 bp, Bos taurus; identical to SEQ ID NO: 2953

SEQ ID NO: 84944 - DNA, 201 bp, Bos taurus; identical to SEQ ID NO: 2954

SEQ ID NO: 84945 - DNA, 201 bp, Bos taurus; identical to SEQ ID NO: 2955

SEQ ID NO: 84946 - DNA, 201 bp, Bos taurus
aaagaatttaagtttgttgaatacagatgtatttaagaattgcctttctttagaagtgggtttgttccccagctgagagggttgcatctaaaaatcaggccgaaaagatggatctatgcctggaaatcactgtttggctaaccccaaagttgccttttagataataattgtagccactttagcaacagcccattgctgctt

SEQ ID NO: 84947 - DNA, 201 bp, Bos taurus; identical to SEQ ID NO: 2956

SEQ ID NO: 84948 - DNA, 201 bp, Bos taurus; identical to SEQ ID NO: 2957

SEQ ID NO: 84949 - DNA, 201 bp, Bos taurus; identical to SEQ ID NO: 2959

SEQ ID NO: 84950 - DNA, 201 bp, Bos taurus; identical to SEQ ID NO: 2960

SEQ ID NO: 84951 - DNA, 201 bp, Bos taurus; identical to SEQ ID NO: 2961

SEQ ID NO: 84952 - DNA, 201 bp, Bos taurus; identical to SEQ ID NO: 2962

SEQ ID NO: 84953 - DNA, 201 bp, Bos taurus; identical to SEQ ID NO: 2964

SEQ ID NO: 84954 - DNA, 201 bp, Bos taurus; identical to SEQ ID NO: 2965

SEQ ID NO: 84955 - DNA, 201 bp, Bos taurus; identical to SEQ ID NO: 2966

SEQ ID NO: 84956 - DNA, 201 bp, Bos taurus
gctcagctgttacactgttaacctggagccttactggtggcagctgaaaaagccctgggtggaccacatgcactcctgtgcccaaaccctacagcctgatcgctgcgctcaccggaggggcagggctctgcctgtcaggcatggcgttcacctaagtgagaaggtggtaaggtgttcttttgattttatgcccagccaagg

SEQ ID NO: 84957 - DNA, 201 bp, Bos taurus; identical to SEQ ID NO: 2967

SEQ ID NO: 84958 - DNA, 201 bp, Bos taurus; identical to SEQ ID NO: 2968

SEQ ID NO: 84959 - DNA, 201 bp, Bos taurus; identical to SEQ ID NO: 2969

SEQ ID NO: 84960 - DNA, 201 bp, Bos taurus; identical to SEQ ID NO: 2970

SEQ ID NO: 84961 - DNA, 201 bp, Bos taurus; identical to SEQ ID NO: 2971

SEQ ID NO: 84962 - DNA, 201 bp, Bos taurus; identical to SEQ ID NO: 2972

SEQ ID NO: 84963 - DNA, 201 bp, Bos taurus; identical to SEQ ID NO: 2974

SEQ ID NO: 84964 - DNA, 201 bp, Bos taurus; identical to SEQ ID NO: 2975

SEQ ID NO: 84965 - DNA, 201 bp, Bos taurus; identical to SEQ ID NO: 2976

SEQ ID NO: 84966 - DNA, 201 bp, Bos taurus; identical to SEQ ID NO: 2977

SEQ ID NO: 84967 - DNA, 201 bp, Bos taurus; identical to SEQ ID NO: 2978

SEQ ID NO: 84968 - DNA, 201 bp, Bos taurus; identical to SEQ ID NO: 2979

SEQ ID NO: 84969 - DNA, 201 bp, Bos taurus
agtcttttaagagcaatagttagagaaacaagaaggggaataatgtttgcaataatagaataaaataagttataggcagcattctatgtgattttccattggggtcactgctacttcagcaaacaaaatatctgttgcattgcacttcaaaatcactaagtgatttccactacatgcaatcttcagaatttccaccccaaa

SEQ ID NO: 84970 - DNA, 201 bp, Bos taurus; identical to SEQ ID NO: 2981

SEQ ID NO: 84971 - DNA, 201 bp, Bos taurus; identical to SEQ ID NO: 2982

SEQ ID NO: 84972 - DNA, 201 bp, Bos taurus; identical to SEQ ID NO: 2984

SEQ ID NO: 84973 - DNA, 201 bp, Bos taurus; identical to SEQ ID NO: 2988

SEQ ID NO: 84974 - DNA, 201 bp, Bos taurus; identical to SEQ ID NO: 2990

SEQ ID NO: 84975 - DNA, 201 bp, Bos taurus; identical to SEQ ID NO: 2991

SEQ ID NO: 84976 - DNA, 201 bp, Bos taurus
tgacatttgccacgatagtaaatcttaagcgttttcaccacacacatacatcaaaggctatgaggtggtggatatctcagctaacatgactgtagatgtcgtttcacaaaggaaacataaatcaaatcatcgcattacacagtttaaatatatacacttttatttgtcaattataccccaacaaaggtaattcttccattt

SEQ ID NO: 84977 - DNA, 201 bp, Bos taurus; identical to SEQ ID NO: 2992

SEQ ID NO: 84978 - DNA, 201 bp, Bos taurus; identical to SEQ ID NO: 2993

SEQ ID NO: 84979 - DNA, 201 bp, Bos taurus; identical to SEQ ID NO: 2994

SEQ ID NO: 84980 - DNA, 201 bp, Bos taurus
cggagttgtgctttcaaagttggacttcttttgaagtgtctcattgaatttataagtatacatatttagttatgcttacaaattatgaactaatatttagcattaaaaattataaacattatctatttaacagtgttttagtgcctgttttttctaagtactagaaatgttacagtaaacaaaacagacaaaaatccctgc

SEQ ID NO: 84981 - DNA, 201 bp, Bos taurus
ctatatatacttttgtttccatggaaaatcttcatgggaacaggagtcgaaatttacagcaattaatttgtccaaagttactaacaagttagcttggcctaacactagccctggctcccttagggtctccatgagggtgggggaggaggtggacattcccctgagagccatccagcaggggcctttggagatgtgcaaaga

SEQ ID NO: 84982 - DNA, 201 bp, Bos taurus; identical to SEQ ID NO: 2995

SEQ ID NO: 84983 - DNA, 201 bp, Bos taurus; identical to SEQ ID NO: 2996

SEQ ID NO: 84984 - DNA, 201 bp, Bos taurus; identical to SEQ ID NO: 2997

SEQ ID NO: 84985 - DNA, 201 bp, Bos taurus
ctcaagattgttttttctattcagggtcttttgtgtctccaccaatactcacagcaactgtcagtttcacagttataattcaatgatatcttatgaatacatgatttagtaaatgcaatatacatcagtgttatctgttatttagcaatagttatgaatatttaaacatttaaaaacattatatataattgttaattgaaa

SEQ ID NO: 84986 - DNA, 201 bp, Bos taurus; identical to SEQ ID NO: 2998

SEQ ID NO: 84987 - DNA, 201 bp, Bos taurus; identical to SEQ ID NO: 2999

SEQ ID NO: 84988 - DNA, 201 bp, Bos taurus
agggagattcttgctaaagtgacctgacagagttcttgccaaagagaggccaaggacttctatatcacaggtggggcctgaggaatttgatcagatattaatgtgatcagtcatcaatggtgggggaatcctctctacactgactttgccagattcctgctaaaactaggccatacatgtctgacaaagatagaatgatac

SEQ ID NO: 84989 - DNA, 201 bp, Bos taurus; identical to SEQ ID NO: 3000

SEQ ID NO: 84990 - DNA, 201 bp, Bos taurus; identical to SEQ ID NO: 3001

SEQ ID NO: 84991 - DNA, 201 bp, Bos taurus; identical to SEQ ID NO: 3002

SEQ ID NO: 84992 - DNA, 201 bp, Bos taurus; identical to SEQ ID NO: 3003

SEQ ID NO: 84993 - DNA, 201 bp, Bos taurus; identical to SEQ ID NO: 3004

SEQ ID NO: 84994 - DNA, 201 bp, Bos taurus; identical to SEQ ID NO: 3006

SEQ ID NO: 84995 - DNA, 201 bp, Bos taurus
ttgatgttgagttcttcagcatcttttcctgtagttttaagaggatcggcttctatgatgctctcaattggtcgttgtgaacttcggatggccagtcattatgctcctcatctttgcaaaatttcttgaagcaccactgcactgcatgttcattagcagtttctgggccaaatgcattgttgatgttgagagctgcctcca

SEQ ID NO: 84996 - DNA, 201 bp, Bos taurus; identical to SEQ ID NO: 3009

SEQ ID NO: 84997 - DNA, 201 bp, Bos taurus; identical to SEQ ID NO: 3010

SEQ ID NO: 84998 - DNA, 201 bp, Bos taurus; identical to SEQ ID NO: 3011

SEQ ID NO: 84999 - DNA, 201 bp, Bos taurus; identical to SEQ ID NO: 3012

SEQ ID NO: 85000 - DNA, 201 bp, Bos taurus; identical to SEQ ID NO: 3013

SEQ ID NO: 85001 - DNA, 201 bp, Bos taurus; identical to SEQ ID NO: 3015

SEQ ID NO: 85002 - DNA, 201 bp, Bos taurus
aataagaactgatgtgtttcagtccatcctcatggattccagctcatccttgcaggttttcgctcactcttgatatctccacttcatgcccatcttccctcatatctgcctgctttgtgaaatttaagctccagatcacacaaggaccttaaagacaaagaccttaaagaaactgcttgttgttcagtggcccagtcatgt

SEQ ID NO: 85003 - DNA, 201 bp, Bos taurus; identical to SEQ ID NO: 3016

SEQ ID NO: 85004 - DNA, 201 bp, Bos taurus
gttaaaagtgactaactcaatgaactgttgagtttattgagttaaagacttaatgttacaatggttagagtggtgggcctcagttttttaattggattctgtgcctcaatttcttctggtattgactacaaaactttgtgtttctgtctggctttaagaataaatattgaaatttctgaaaactgactacccttgcagata

SEQ ID NO: 85005 - DNA, 201 bp, Bos taurus
cagtgggttgctatttccttctccaggagatcttcccgacccagggattgaatctgcatctcctgcattggcaggcaggctcttcaccactgagccacctgggaagcccaccttaacaaaatcacatcccaaattccttttgaatttaaaaattttaaaataggcaatgtattcacattgtttaacaatcaaaacaacata

SEQ ID NO: 85006 - DNA, 201 bp, Bos taurus; identical to SEQ ID NO: 3017

SEQ ID NO: 85007 - DNA, 201 bp, Bos taurus; identical to SEQ ID NO: 3018

SEQ ID NO: 85008 - DNA, 201 bp, Bos taurus; identical to SEQ ID NO: 3019

SEQ ID NO: 85009 - DNA, 201 bp, Bos taurus; identical to SEQ ID NO: 3020

SEQ ID NO: 85010 - DNA, 201 bp, Bos taurus; identical to SEQ ID NO: 3021

SEQ ID NO: 85011 - DNA, 201 bp, Bos taurus
ccccaactgtggttgtaagtagcaacaattagacatctgtcagccagtaaaactgtatttatggtgcccttggtttagaagatcatccaccttgctttcactctataaagtaggtagaaggagactgggagtttctagggttcattcaagcaatgctcacagaagaattactttctgatatggatatatatggaactttag

SEQ ID NO: 85012 - DNA, 201 bp, Bos taurus
cgtgatacgctattctcctaggaccatgacttagaaaactctgatacatcctcttacctaatctgagctttatcagagatgttattaaatctaacacacatgctcacacatacagcttagagatgcaagcttttaaaaacccacacaactcataatacctttgtaagctctgatggttcactcccttcttctaccacaatc

SEQ ID NO: 85013 - DNA, 201 bp, Bos taurus; identical to SEQ ID NO: 3022

SEQ ID NO: 85014 - DNA, 201 bp, Bos taurus; identical to SEQ ID NO: 3023

SEQ ID NO: 85015 - DNA, 201 bp, Bos taurus; identical to SEQ ID NO: 3024

SEQ ID NO: 85016 - DNA, 201 bp, Bos taurus
ttatgttaaaagtatcaggatacatttcatggaattgaaaagggtaatttctgcctgtccctgactcatgataataatggttctcatttcttatccaagcggaacagtgtgataatataaccatgtacactctgataataattgccccatcacaccccaccacaggatcaccaccactataataaaacaaagaagaaaata

SEQ ID NO: 85017 - DNA, 201 bp, Bos taurus; identical to SEQ ID NO: 3026

SEQ ID NO: 85018 - DNA, 201 bp, Bos taurus
gttaagtggcagcaactactctctttcacttctttctccaaatcaatttttatgtgatttctgagcaaagcccttgttattttgtgtattactccaatttgcacataggaaaagttgtttgcatcacttttcaacattgtaaagcttttaattttaaacatccaaagagttttttttttttttttctttaatacactttgg

SEQ ID NO: 85019 - DNA, 201 bp, Bos taurus
acccagctgtctccatttccttcaccttgccctgcacactggcatcttgaaaacaccaaatatactcttcaatcacttctttttttttttttggccttttttctcccactgtctgagttaacactctcaagatggcaccatggcttgctcactcatttctgtcaggtttctatggaaaaattaggtaattcacagggcctc

SEQ ID NO: 85020 - DNA, 201 bp, Bos taurus
tgtgtataaaatgtacaagtagctcagaagagaagtggttaaccgtgttttcaggggtagggtatagagtatggggtttctcttaggcaataatggttattcagagttttgaaaatgaacatgaatttccaggtattgtgggaagctgggtagaaaggtcattccaggaagagactatagcaaatggaaaggaacagagca

SEQ ID NO: 85021 - DNA, 201 bp, Bos taurus
ttagtccttgattattagtattttatcatgatgtttaaggttatatgaactttcactacaactgaaaattgttacaatggccaatatagatggaagggtaggtcatattcttgttcaaccacaaaatctcacaccagtggataagcagtattaggccttggatatcaaatgatgcctaacaatattatcattagtatatag

SEQ ID NO: 85022 - DNA, 201 bp, Bos taurus; identical to SEQ ID NO: 3027

SEQ ID NO: 85023 - DNA, 201 bp, Bos taurus; identical to SEQ ID NO: 3028

SEQ ID NO: 85024 - DNA, 201 bp, Bos taurus
ctgcccagcttccttccagttgagatttaaaatgaactaaattatttgacaaactgtttttactatcttagtgagaaatacagaaaattgaagttttaataaagctaacttctatataagcacttcacaattaaaaagaacaacatgcctaataaatttagtccataagaaaaggtagggggaggagctaagatggcggag

SEQ ID NO: 85025 - DNA, 201 bp, Bos taurus
gcagttaattcattaaggaaaactgagctggataaaatattaggtaatatttgaaattttttcagggaattaaggtcatgcctaaatactgttctactttgatgtttaaacagacatcagtattagtagtcaggacatatataagtatatatatgtataaatttatatatgtataaacatatataagtatgtatatgtata

SEQ ID NO: 85026 - DNA, 201 bp, Bos taurus; identical to SEQ ID NO: 3029

SEQ ID NO: 85027 - DNA, 201 bp, Bos taurus
caaaggagatatgccaaaacagactgaatcaacttctttagtcatagtggttaaagatcatcatcactttctaagtggtaaattcagaatgaaatcagaatacatcacgtattttaatttcacatagataatatagtgcattaatttaatgtcagtttggttagtacttttgaagttgtctatgtttccatatgtactaga

SEQ ID NO: 85028 - DNA, 201 bp, Bos taurus; identical to SEQ ID NO: 3030

SEQ ID NO: 85029 - DNA, 201 bp, Bos taurus; identical to SEQ ID NO: 3031

SEQ ID NO: 85030 - DNA, 201 bp, Bos taurus
gtgaaatcttagaaaattaccttacttcttctttaatgaatgataatgaatattttacttgggagattcttggtggggaattgaaataatagcaaaaaatggaataactcagaggtacctaaatgattggagctataaaataatgaagaaagaaagaaaagaaacatggatcctctacttgattacatggatcttcaggaa

SEQ ID NO: 85031 - DNA, 201 bp, Bos taurus; identical to SEQ ID NO: 3032

SEQ ID NO: 85032 - DNA, 201 bp, Bos taurus
tggatacaatatctctagagtcagtactttccctcagatgtaccagcatattttaaattttattagctgatggataacaggtgagctaaaagaggcttaaaatgttactgatctgtgtggatgagtttgatgctacttttgaagtgaagtaattgttttagagaaggatgattggtgaacattatctgcaagagtgctttg

SEQ ID NO: 85033 - DNA, 201 bp, Bos taurus
tgtgtagcagtccatggggtcacaaagagtaggacacaactgaatgactaaactgaactgaaaaatgagatctaattactggggaagatacagctaatttagctatatcttgttactggcccagagtgagagcacccacaggctctgttcaacccaccttaaacttctgggaaagcactaaagctataaaaagtatgttac

SEQ ID NO: 85034 - DNA, 201 bp, Bos taurus; identical to SEQ ID NO: 3033

SEQ ID NO: 85035 - DNA, 201 bp, Bos taurus; identical to SEQ ID NO: 3034

SEQ ID NO: 85036 - DNA, 201 bp, Bos taurus; identical to SEQ ID NO: 3035

SEQ ID NO: 85037 - DNA, 201 bp, Bos taurus; identical to SEQ ID NO: 3036

SEQ ID NO: 85038 - DNA, 201 bp, Bos taurus; identical to SEQ ID NO: 3037

SEQ ID NO: 85039 - DNA, 201 bp, Bos taurus; identical to SEQ ID NO: 3038

SEQ ID NO: 85040 - DNA, 201 bp, Bos taurus; identical to SEQ ID NO: 3039

SEQ ID NO: 85041 - DNA, 201 bp, Bos taurus
agtcacagattttgtaggaatatttctttttttggcactgaggtagtagatgtcctcctcagtttctttctgtatttagacatggcctaatcataaacctcggagaaggcaatggcaccccactccagtactgttgcctggaaaatcccatggacggaagagcctggtaggccgaagtccatggggtcgctcagagttgga

SEQ ID NO: 85042 - DNA, 201 bp, Bos taurus; identical to SEQ ID NO: 3040

SEQ ID NO: 85043 - DNA, 201 bp, Bos taurus
atcttcctgacccaggaattgaacctgggtctcctgcatttcaggaagattctctaccaactgagctgtaagggaagccccttattaatacggtagtatcaaattattagtccggaacactaatttttcagttttgtttcttctcacatatttagaaggcaaggctctctgtcatatcttatatcattacctagattctta

SEQ ID NO: 85044 - DNA, 201 bp, Bos taurus; identical to SEQ ID NO: 3041

SEQ ID NO: 85045 - DNA, 201 bp, Bos taurus; identical to SEQ ID NO: 3042

SEQ ID NO: 85046 - DNA, 201 bp, Bos taurus; identical to SEQ ID NO: 3043

SEQ ID NO: 85047 - DNA, 201 bp, Bos taurus; identical to SEQ ID NO: 3044

SEQ ID NO: 85048 - DNA, 201 bp, Bos taurus
aattttaaagttacaaactctaaatgatactgatattactacttccctattctgttttattctttctcctatttatactgagggaggaaaggaacaggccgaaggaaaagaaggaaactccatcttgcactttcagtgagctttggactatgcgcctggtagccatggggataacataccatggccgaactggcctcccag

SEQ ID NO: 85049 - DNA, 201 bp, Bos taurus
acagcatttttgttttggatgatggaaaagtttggaaatagtgggaatagatatgtaacattgtgagtatacccaatgccactgaaccatacaactgaaacgttgacttaaaacatgctgaattgtagaattagaaatggtcaaattaatcaactttctgttgtgaaaattttaccacagttgaaaataaaagaatgaaag

SEQ ID NO: 85050 - DNA, 201 bp, Bos taurus
aaaggggacacaataacatcctccccactgcttacctctacatgtcagagatcttccaaactgagcaaaggattttggaaaaggggacagatggagagactgattaaatccacccttacctgcaagacaggcagcctctccccagagaagagctctctgtaattctgccaggggatatggagggtcaggtgcaacccacct

SEQ ID NO: 85051 - DNA, 201 bp, Bos taurus; identical to SEQ ID NO: 3045

SEQ ID NO: 85052 - DNA, 201 bp, Bos taurus; identical to SEQ ID NO: 3046

SEQ ID NO: 85053 - DNA, 201 bp, Bos taurus; identical to SEQ ID NO: 3047

SEQ ID NO: 85054 - DNA, 201 bp, Bos taurus
tagatagataaatattaaacactaaatattgtgagccaactatattagtgagaaaaatcaacacaaggtatttcatactaaattcaaagtagaaagtggaggaaatcttaattgtaagagttccaataattcattatctttgagactgggacagttactggtggtattttagaaagtgtgacttaaactgtgtcttgaagt

SEQ ID NO: 85055 - DNA, 201 bp, Bos taurus; identical to SEQ ID NO: 3048

SEQ ID NO: 85056 - DNA, 201 bp, Bos taurus; identical to SEQ ID NO: 3049

SEQ ID NO: 85057 - DNA, 201 bp, Bos taurus; identical to SEQ ID NO: 3050

SEQ ID NO: 85058 - DNA, 201 bp, Bos taurus; identical to SEQ ID NO: 44609

SEQ ID NO: 85059 - DNA, 201 bp, Bos taurus
atttccatactatttttaacttgtatatggaaatgattatctgtttacctctgaagcatgaaaactcttacagcaccctttataatgtatttatgtaccattttccttctcatgtccttgtcagaagtattcacatctacctcccagaacaaaagttgagaagcaggctgatttcttttttgtattttattattaattttt

SEQ ID NO: 85060 - DNA, 201 bp, Bos taurus; identical to SEQ ID NO: 3051

SEQ ID NO: 85061 - DNA, 201 bp, Bos taurus; identical to SEQ ID NO: 3052

SEQ ID NO: 85062 - DNA, 201 bp, Bos taurus
actttgcttcacaccaatgttgggtggttcttttagtttgggctgactggcaatcagatgcatctgtctagtttctgctggaaagtcattgataaaactgaagaaaaacttcctaagggttggagacatgagaggacagtgcctgggacccaaagttagcctaagatagtggcagccagactggagcaatttttgagagaa

SEQ ID NO: 85063 - DNA, 201 bp, Bos taurus; identical to SEQ ID NO: 3054

SEQ ID NO: 85064 - DNA, 201 bp, Bos taurus; identical to SEQ ID NO: 3055

SEQ ID NO: 85065 - DNA, 201 bp, Bos taurus; identical to SEQ ID NO: 3056

SEQ ID NO: 85066 - DNA, 201 bp, Bos taurus; identical to SEQ ID NO: 3057

SEQ ID NO: 85067 - DNA, 201 bp, Bos taurus; identical to SEQ ID NO: 3058

SEQ ID NO: 85068 - DNA, 201 bp, Bos taurus; identical to SEQ ID NO: 3059

SEQ ID NO: 85069 - DNA, 201 bp, Bos taurus
atgacatgttggccgttagccttttttttaataaaagagtcgagaagttactctcctgtggcttttgctggtactttttatagccgaagtgtggtaggaagtaggccccaagttcccttggcaacaagtagagtagaagcgatacacagaaatctgaatcatcggtgaatcatctgaggatttctgtttctaatccttgga

SEQ ID NO: 85070 - DNA, 201 bp, Bos taurus
ttcttcctgaattatacttaaataaaatactgaaaggtaaataaatattctctcacctgggaaatacttttttccccctcttttctttaacatttaatcagtttctcagtggtctcaagaacctgctgcctgttttgttttggtccagttttcactctgatacctgtgtcttcctgatttcttagccccctggctttaagc

SEQ ID NO: 85071 - DNA, 201 bp, Bos taurus; identical to SEQ ID NO: 3060

SEQ ID NO: 85072 - DNA, 201 bp, Bos taurus; identical to SEQ ID NO: 3061

SEQ ID NO: 85073 - DNA, 201 bp, Bos taurus
agaagaaacaaagttcataaccagtaggggttatatctttatgcagttaccacttcagtgaattagaagccaaacatgtcgagaagaaacaaaagcacacatgaagcaatatacttgcaatcagatctcaaatcatctattaaatttaggatcatgacttcaaagtcaaaaatcacaatgcatgcaaagaaataggacagc

SEQ ID NO: 85074 - DNA, 201 bp, Bos taurus
tacctggtagatacccaccccaaatgggtgtatgaagcagaggagcagaaagagactctggagtgggattataactgaactacatttctgaagtaggcacgaaatgattctctgacccccaagattctgtgtcctcccactccagagacccccaagaacttccactctcactctgctccagactacagccctgacttaaca

SEQ ID NO: 85075 - DNA, 201 bp, Bos taurus; identical to SEQ ID NO: 3062

SEQ ID NO: 85076 - DNA, 201 bp, Bos taurus
gccatccttacttctctagcctcagttattgagttctaggtcaaaatccatatggctttatcctaggttgcttctaaacactgccatactctgtagaaacatgctacagaaggaatcagtttctgcttccacctccacagaaatgaaacacacatggaaagacagaagggctctatcctttgcccagcactgctcaaatcc

SEQ ID NO: 85077 - DNA, 201 bp, Bos taurus
atgcctgtgttaggcttttctagaggaagttaatacatatataggccctttctaaaaagtctgtatggcatcagagaagacgaagcatgttgacacatagctacacaagtagccacaaggcaagcttgcagtgaaagttataaaggagatacagagtgagatgaaattttggaaggtgaagcagtgtttttaaactcaaga

SEQ ID NO: 85078 - DNA, 201 bp, Bos taurus
taaactctcagctccagagttgccttgcaatgcatctctattccagttagccagaaaagggaaaggaaaaagatgagcattcataggattaggccgcatatggaacattactttccactgtaaatgcattcaatacactcagtcatacagagggtctgggcaacacagtccacctgcatccttaaaaaaggacaatgtggc

SEQ ID NO: 85079 - DNA, 201 bp, Bos taurus; identical to SEQ ID NO: 3063

SEQ ID NO: 85080 - DNA, 201 bp, Bos taurus
tcggagacccatgcagaacaaactgtacaacactttcatcacattaaaaaaccaccatcactcaacagtgtcagcatgccaacaagggaatggctttacacgctgtgttcaggaaaggtttgggaaaggataatagaaatcaggggccacttaggcagcaaaccataaccaattatgagttaataaaaacaaggaaactag

SEQ ID NO: 85081 - DNA, 201 bp, Bos taurus
aaggtttacttaagtagtaaataaaaattttaaaacattaataagtataagagtaacaaggtggaggtgatgagggcagacacactgctgcaagccactgcgaagaggcagctggaccacagtcagaaataatcctcaagataatcatgactgagctgcgactcctggacatggagtgctgctcaaagaataagccagcct

SEQ ID NO: 85082 - DNA, 201 bp, Bos taurus; identical to SEQ ID NO: 3064

SEQ ID NO: 85083 - DNA, 201 bp, Bos taurus
aagtaaaaaaaaaaaaaaaacaactatatgttttattttagttttctttcttgcattactaggaagcttaaattccatcccattctcaatttattttgcctttgttttccttctgtgaattattcacacttgtttatgttcatttttttctgagatgatcatttctctgattcatttatttctctttacacagtaaagcta

SEQ ID NO: 85084 - DNA, 201 bp, Bos taurus; identical to SEQ ID NO: 3066

SEQ ID NO: 85085 - DNA, 201 bp, Bos taurus; identical to SEQ ID NO: 3067

SEQ ID NO: 85086 - DNA, 201 bp, Bos taurus; identical to SEQ ID NO: 3068

SEQ ID NO: 85087 - DNA, 201 bp, Bos taurus; identical to SEQ ID NO: 3069

SEQ ID NO: 85088 - DNA, 201 bp, Bos taurus
caagcccctaaatactttattgtatacactacatttttttcatagttacatgtttgtgagactagtagattattgaggtctttgaaaatacaaagcttacgggaaatactgaaaaatactcactgaagatatatgttcatttttgttgaaatatagttgatttgcaatgttgttttaatttcaggtgtacagcaaagttaa

SEQ ID NO: 85089 - DNA, 201 bp, Bos taurus
aacttttgtttgttaactctcatatgaaaagataagtcaaaatagcaagttcttttgtttgttctaaaaatctaattaaagttgattcttggctagaactattattcttccttcctgttttctcctctcgtctctttatgtattaagtgttctttgttgtgagactacaatacagatattcatatttgtttgtgctgaagt

SEQ ID NO: 85090 - DNA, 201 bp, Bos taurus; identical to SEQ ID NO: 3070

SEQ ID NO: 85091 - DNA, 201 bp, Bos taurus; identical to SEQ ID NO: 3071

SEQ ID NO: 85092 - DNA, 201 bp, Bos taurus; identical to SEQ ID NO: 3072

SEQ ID NO: 85093 - DNA, 201 bp, Bos taurus
ttggaagaaaatgggtagttctagtattcaggccaattctggagtttactaacctgtgaaaatcctaaaatcatgcctccaagtaaagaaaaaaaagcaccgaactaggcccaattagtcttgggcaaatatcctaaacactgtggacctcagagtcctttgccgtaaattaaatggctgaattcaatgaatctaaacctt

SEQ ID NO: 85094 - DNA, 201 bp, Bos taurus; identical to SEQ ID NO: 3073

SEQ ID NO: 85095 - DNA, 201 bp, Bos taurus
ccagagtacattattacatacactaaaaatactccaaatgaaatcaggcactctgaggacatctatatgatgagaaaatactttttcccttgatttttcaatttaacctggtgacttttcttttagctgaatgacatgaaaacaagtgttggaaaaagcgatattataaggttagtatgttaaaaaaaattaacaatagag

SEQ ID NO: 85096 - DNA, 201 bp, Bos taurus
attttgcatcaagcctactttgggatatatagcattttcatcttataccacatctatgtgcctcagtcaatgaacatcataaatgtcagaatacatatgatattgtatattatgaaatccccatcttttctctgaagcccaacagaaatccatacctggatcattaataaggaaatttgctctcaacacagaccatctagc

SEQ ID NO: 85097 - DNA, 201 bp, Bos taurus; identical to SEQ ID NO: 3074

SEQ ID NO: 85098 - DNA, 201 bp, Bos taurus; identical to SEQ ID NO: 3075

SEQ ID NO: 85099 - DNA, 201 bp, Bos taurus; identical to SEQ ID NO: 3076

SEQ ID NO: 85100 - DNA, 201 bp, Bos taurus
cacactcgtagagccctcatccctttcatctgggctgcacctgcagcttgcaaactgaaagagcatggtagaagcgataactgccagtttcaggcccaaggcttgacggtacctgcagcttctgcttttgtggtttgtggtgctaagccatcatataagaactccagccaccctgatgagattacatagaagttcacttag

SEQ ID NO: 85101 - DNA, 201 bp, Bos taurus
tgctttctattgattaaaaagtcattttaaaaatctgtgatctataaatacctattctctattcttttcaaacatttgattttaaaaagcaaggatttatgtgtgatggccttatcagtggcaaacaaaacctatttccaggtaaataatttagccttgatggtattctgaatttctgttgggtcatactgactggattaa

SEQ ID NO: 85102 - DNA, 201 bp, Bos taurus; identical to SEQ ID NO: 3077

SEQ ID NO: 85103 - DNA, 201 bp, Bos taurus; identical to SEQ ID NO: 3078

SEQ ID NO: 85104 - DNA, 201 bp, Bos taurus; identical to SEQ ID NO: 3080

SEQ ID NO: 85105 - DNA, 201 bp, Bos taurus; identical to SEQ ID NO: 3081

SEQ ID NO: 85106 - DNA, 201 bp, Bos taurus; identical to SEQ ID NO: 3082

SEQ ID NO: 85107 - DNA, 201 bp, Bos taurus
tctatctaaatatatttgaaatatttaggagagtttttttaaaaagctgctcaagccatcttcctgatttctgatcaaaagaatttaatcctgatttgatctgaatcttccaaagagtttatactacactgttacatgatctacatgtgtaacggcaactttgacaactccctgttgaaataaactcaaagcaataataca

SEQ ID NO: 85108 - DNA, 201 bp, Bos taurus; identical to SEQ ID NO: 3083

SEQ ID NO: 85109 - DNA, 201 bp, Bos taurus
tgtttctcaagccagaatgaaaagtatgatttggtacttgcaatcagtatctggaccacattcctatatatttcaatttaagaagtctagcagaggcctagacttctgtattttgaaattgttgaccaggtaatactctctactgatttaagaactgttgttaaaaagaagatgccatgtttcaaaaaaggacaaagtgag

SEQ ID NO: 85110 - DNA, 201 bp, Bos taurus; identical to SEQ ID NO: 3084

SEQ ID NO: 85111 - DNA, 201 bp, Bos taurus; identical to SEQ ID NO: 3085

SEQ ID NO: 85112 - DNA, 201 bp, Bos taurus; identical to SEQ ID NO: 3086

SEQ ID NO: 85113 - DNA, 201 bp, Bos taurus
attcccaagccaacttttacagccagcgcccaagaaatcctgctcaaagcataacttgcccagttccttaaaaagaactagatgagctgctgttaataccccagctcttctctttaaaaggagggacaaaggtatgagaaaaccccacaccgctgacacctccttctatttacacagtttaaactccgtgtgtccttgatc

SEQ ID NO: 85114 - DNA, 201 bp, Bos taurus; identical to SEQ ID NO: 3087

SEQ ID NO: 85115 - DNA, 201 bp, Bos taurus
tctgagcaacaggatagaccttggccaaggtcagtggcagggacaaagtcccaaattgattcttcacaacatgctggagaatacaggtgtgatttttaacctctggccactacaaaagtccacagctgcttctcctgagaaagatatggttttcccaccccaacatcaaccttactttcgggtaaggccactccgacatag

SEQ ID NO: 85116 - DNA, 201 bp, Bos taurus; identical to SEQ ID NO: 3088

SEQ ID NO: 85117 - DNA, 201 bp, Bos taurus
agatggaaaaaaaaaaaaggatagtgagaaagacaagaacttcacagttaaaaatgaacctaagctttttcttttttccataaaataaatgagaatactctactgtaccacaccacatcccctgaacatctgcagtcagggaggacggacaagtgttatgtgcggtggcatgtagaacagcttccacatttctgcccccga

SEQ ID NO: 85118 - DNA, 201 bp, Bos taurus; identical to SEQ ID NO: 3089

SEQ ID NO: 85119 - DNA, 201 bp, Bos taurus; identical to SEQ ID NO: 3090

SEQ ID NO: 85120 - DNA, 201 bp, Bos taurus
agtatggcacagtaatagctggtattacaaggctataatgaaaagaatttttatatactagaacattcttagtctttacaaatataaacataagctttctcaaaaaataaagccctctggttaagaactttccatttgcctgccagatgatttcttatatctataattaaatggctggtttcaatttgttaatcaaataaa

SEQ ID NO: 85121 - DNA, 201 bp, Bos taurus; identical to SEQ ID NO: 3091

SEQ ID NO: 85122 - DNA, 201 bp, Bos taurus; identical to SEQ ID NO: 3092

SEQ ID NO: 85123 - DNA, 201 bp, Bos taurus; identical to SEQ ID NO: 3093

SEQ ID NO: 85124 - DNA, 201 bp, Bos taurus; identical to SEQ ID NO: 3094

SEQ ID NO: 85125 - DNA, 201 bp, Bos taurus
ccttacaaatacgagtcaccacaagcttccagcctcaaaacatctcaactgccgaaataaactttgatgttgctctttcattctaacagttaggcctctttaacattttaggaataaccaaaggttatactgaaggctgttcgttttctcaggcaagacttggagtcaccatgtagggttcactttggtttgaggaactga

SEQ ID NO: 85126 - DNA, 201 bp, Bos taurus; identical to SEQ ID NO: 3095

SEQ ID NO: 85127 - DNA, 201 bp, Bos taurus
gaaagtctgggagttttacaataaacataggctttaactagacagtcgtaaaaacttttgagtgaacatgtccttctctgctgctgtaatagacccattaccatctttccttcttgtaacacctttctctaatcatctttttgttgtggacctgatatcctgatatcctcccttgtatctccatcttgttagattttgcct

SEQ ID NO: 85128 - DNA, 201 bp, Bos taurus; identical to SEQ ID NO: 3096

SEQ ID NO: 85129 - DNA, 201 bp, Bos taurus
tctccatcactgcatcactgcttcccatcatgccaggtgaggctgtatgtggcactccatctaggggcataaagtctctaagctatgcttatgtgttgcagataaggttatcaggagacaggttgagataagatttattgcatgcagaagtttattgagaaggttccccagaatctattcttggaggcagggaatgacaac

SEQ ID NO: 85130 - DNA, 201 bp, Bos taurus; identical to SEQ ID NO: 3097

SEQ ID NO: 85131 - DNA, 201 bp, Bos taurus; identical to SEQ ID NO: 3098

SEQ ID NO: 85132 - DNA, 201 bp, Bos taurus
gaaagagaacaaggaatccttttagccaacgggaaagaaatatgcctacatgtaaataagaacatcaacaagaaatggcctgttttaatgcactgttttgatatcttcctgtctcactttaattttgtaaaatgagataaattatttttcttctctaagaatttcacaattaagaacctgaaaaagagagtatccaagcat

SEQ ID NO: 85133 - DNA, 201 bp, Bos taurus
tcctaaacattgttcttgggactttggaaaagaagatatcctgcattttcattgcctcattcagctgtgaaccaccagagtgattttccaatggaataagatgcttttccaggctccttgctaaaaatttaggtggttttgggaaatgagagccatcaaaccttccctgacaggtcagttttggtattcagaggaatacag

SEQ ID NO: 85134 - DNA, 201 bp, Bos taurus; identical to SEQ ID NO: 3099

SEQ ID NO: 85135 - DNA, 201 bp, Bos taurus
tccattcctggaagagtttaacaccatttcctaattctttcaaaatgttgaggtatttgaccaaagcgtctgtttcacaaaagggcatagtatacatctacgggaaggaacaaggtcaagtcttctgaaatcctcagaatgacttctccttttatatatgcaaattccgctctttaagcttctcacccaagccttcttgtt

SEQ ID NO: 85136 - DNA, 201 bp, Bos taurus; identical to SEQ ID NO: 3101

SEQ ID NO: 85137 - DNA, 201 bp, Bos taurus
gtattttctggcatatttttctcattgctggtaatgtgctggcatgttcagtgatatgttttaaaaagtttagaaagatccagaaaatttaagatctgcaataaagtgaaaacaatggtattttcttgaacatttagggttctgtttgatgctctcataaaaattcctgaaactaaagcaggaattgcagttactactttg

SEQ ID NO: 85138 - DNA, 201 bp, Bos taurus
cctgacgcgccaaataacagagaaggatcccaggcaattgagccctttaagtgcctgaacaggtggagctacagagaaagactggtcaaaaagaccttccaatcgccagctataagaggcttgaaaaaagactctgatggggccataactcctgtggcagaggcagtccatgtccctgccgcttccagggtccccgcaagc

SEQ ID NO: 85139 - DNA, 201 bp, Bos taurus
agatgctgttaggatgacatttgcattcccattgattacattcaataaaatctgacatttttaaaggaggagacaaaaaaaaagcagcttgcctattaatcatggctgttgccaaattatattatgaaaccttggttttccaacaattgttctgaacctgcagctttaacaatattaaagacttttagtgaatagttttaa

SEQ ID NO: 85140 - DNA, 201 bp, Bos taurus; identical to SEQ ID NO: 3103

SEQ ID NO: 85141 - DNA, 201 bp, Bos taurus
ttcatataagcatggaaaatgtattaaataattcctaaaatctttgtcattactcacagtcctttcagtgatccactaagtcattcagaaacaacataccgtctcttctgagagggcatcatgctgtctagtaaagtgagatggtgtatttcaagagtaaagcatcttgattttaatcagggccgctagccgctgactgtg

SEQ ID NO: 85142 - DNA, 201 bp, Bos taurus; identical to SEQ ID NO: 3104

SEQ ID NO: 85143 - DNA, 201 bp, Bos taurus; identical to SEQ ID NO: 3105

SEQ ID NO: 85144 - DNA, 201 bp, Bos taurus; identical to SEQ ID NO: 3106

SEQ ID NO: 85145 - DNA, 201 bp, Bos taurus
cctttcattttggtcattctggtggatgtgtaatggaatcacattgtggttttaatttgtatttccgtggtagctgccgacattattggccctttaaataccctcttttacgaaaagtctgctcaagtctttagaccattttatattactttgccatctggcctttggttagatttagtcaagacaaaagtttgcagatga

SEQ ID NO: 85146 - DNA, 201 bp, Bos taurus; identical to SEQ ID NO: 3107

SEQ ID NO: 85147 - DNA, 201 bp, Bos taurus; identical to SEQ ID NO: 3108

SEQ ID NO: 85148 - DNA, 201 bp, Bos taurus; identical to SEQ ID NO: 3109

SEQ ID NO: 85149 - DNA, 201 bp, Bos taurus; identical to SEQ ID NO: 3110

SEQ ID NO: 85150 - DNA, 201 bp, Bos taurus; identical to SEQ ID NO: 3111

SEQ ID NO: 85151 - DNA, 201 bp, Bos taurus; identical to SEQ ID NO: 3112

SEQ ID NO: 85152 - DNA, 201 bp, Bos taurus
accttcaccaaacaaggactgttgttgaagttctgtgaccccattgccatggaagtctggaaactgacccagtattacttcagtgagggtgttgggtaatgtgtattggacaataacaagtaaagaaaataattaacattgacattttaaatatgttatttttccatttaggtatatgttttctgaaagtaaacctgtggg

SEQ ID NO: 85153 - DNA, 201 bp, Bos taurus
tgtgagtcagggttcaggcctacagtttaaatcagaatggcacatgattctatgaatgtttctgaaggcctcactaccttgggtttattcatatatgttctttatgtaaataaataaaaatttcatatgtatatgttatgtaatctgctttcgtcattttattatgcattgtggtattttcaatgccaattataaaattta

SEQ ID NO: 85154 - DNA, 201 bp, Bos taurus
tatctactttattattttatggagttgtaaataattgaaaataaattaaatacctcaatatttctaaagggcctccatagcataaggacttagctaaggtataaaatgattatactgagctcagggacagctttcagtcttgtttgcatggttctttgcagttaatttacatttaaaaatctcaactgtaaatttctaaga

SEQ ID NO: 85155 - DNA, 201 bp, Bos taurus; identical to SEQ ID NO: 3113

SEQ ID NO: 85156 - DNA, 201 bp, Bos taurus
cttctgattgtgaatcttgacctttataatcctgtgtgtctaccacacaaagaaacatttttgaccctgccatggagatcctctgtagtccccatgcaaatgtatctgtaaccatctctggttcttttttttttttttttttgcaaacatgtacagatttgctcaagtcttttctgttttattttctaggaaacatttgat

SEQ ID NO: 85157 - DNA, 201 bp, Bos taurus; identical to SEQ ID NO: 3114

SEQ ID NO: 85158 - DNA, 201 bp, Bos taurus
gagttggtgatggacagggaggcctggcatgcctggttcatggggtcacaaacagtcagacatgactgaccgactgaactgaattgataagtcgtatttatagatttttagagaagtggcccaaatattagtttttgagtacacttatatacatatacatttgttatatatattatataacctttctgtttaactaaaatc

SEQ ID NO: 85159 - DNA, 201 bp, Bos taurus; identical to SEQ ID NO: 3115

SEQ ID NO: 85160 - DNA, 201 bp, Bos taurus
cctccgaagcagggaaagttatatactatacagtgaaatcatttcacacatcacttcaaaccacctatttcatgagcttgccaactactttttatagtttcgtggagtaaaaaccttcagtgattggctttccctgtgtattggacctgggactctcagagtcccatgagtatgctcggtatgatgtgttctgtacgccgt

SEQ ID NO: 85161 - DNA, 201 bp, Bos taurus; identical to SEQ ID NO: 3116

SEQ ID NO: 85162 - DNA, 201 bp, Bos taurus; identical to SEQ ID NO: 3117

SEQ ID NO: 85163 - DNA, 201 bp, Bos taurus; identical to SEQ ID NO: 3118

SEQ ID NO: 85164 - DNA, 201 bp, Bos taurus; identical to SEQ ID NO: 3119

SEQ ID NO: 85165 - DNA, 201 bp, Bos taurus
tagaaataataaagaataattctagataagttaatggaaaaagcaaaacatatttaccacaaatgttttgctcatttctaaaaagtttgcaactttcctcgtgtcatatacaattttaaaaatagtcaaatctgctaccctatttgcaattacctttatggtgtccaagaatagcaaatcttgccctctccatgtttgaaa

SEQ ID NO: 85166 - DNA, 201 bp, Bos taurus; identical to SEQ ID NO: 3120

SEQ ID NO: 85167 - DNA, 201 bp, Bos taurus; identical to SEQ ID NO: 3121

SEQ ID NO: 85168 - DNA, 201 bp, Bos taurus
ataggagaagaatcacctcaaaagttaattattccaaaatttgagatgaaatttatgacctgcttataaaaaagaatttgcttttgatttgaagaatttgcacatttgaagaatggcacaagacactttgttagttttaacacatcgacaaaacaatcacagacacattttttcaggttcttgaaatgctttccttatagc

SEQ ID NO: 85169 - DNA, 201 bp, Bos taurus
tgctgtggtcaggaagatggcgatcagttttctgagttttcttcctgaggtcaggaaggtggtggttaggcctctgagtccttattgctgctgctaagtctcgtcagttgtgtcggactgtgtgcgacctcatagatggcagcccaccaggctcccctccctgggattctccaggcaagaacaacggagtgggttgccatt

SEQ ID NO: 85170 - DNA, 201 bp, Bos taurus; identical to SEQ ID NO: 3122

SEQ ID NO: 85171 - DNA, 201 bp, Bos taurus; identical to SEQ ID NO: 3123

SEQ ID NO: 85172 - DNA, 201 bp, Bos taurus; identical to SEQ ID NO: 3124

SEQ ID NO: 85173 - DNA, 201 bp, Bos taurus; identical to SEQ ID NO: 3125

SEQ ID NO: 85174 - DNA, 201 bp, Bos taurus
gagaattatgtaactccagcattctgaaatctacacatttattttagaggccattttcttttcctgcttttactttcaaaatttactacttatctagcttggcaaagacatttcttttttttcctcccttttgttctttttaaattgcttcttcatgaatcattcaaattcattctctacatgaaaacagcagaaaatttg

SEQ ID NO: 85175 - DNA, 201 bp, Bos taurus
agccctatacgtgaagtagtatagttttaatgtagatgctgtcttagattcaatgaaataaaccattacagtggtattgtagcttagggaatgcttattagattgaaaagaacagttattgaaaactcagaatgactgggtaggtttaaaaggaattcccagacttaaatattcagaaaactctaaaacttagctcaatgt

SEQ ID NO: 85176 - DNA, 201 bp, Bos taurus; identical to SEQ ID NO: 3127

SEQ ID NO: 85177 - DNA, 201 bp, Bos taurus
tataatctgggttcttgagttgaaaataagtcaaattcacctgcaaaaataagataatgctactaatgtgttttggcaatttactgagacaaatccaaatgctttatctaaataacctagacatttttatgacctatgaatttcatgtgttaaagagtatatatagattctgctttgtacttttaataatgggagggggta

SEQ ID NO: 85178 - DNA, 201 bp, Bos taurus; identical to SEQ ID NO: 3128

SEQ ID NO: 85179 - DNA, 201 bp, Bos taurus; identical to SEQ ID NO: 3129

SEQ ID NO: 85180 - DNA, 201 bp, Bos taurus; identical to SEQ ID NO: 3130

SEQ ID NO: 85181 - DNA, 201 bp, Bos taurus; identical to SEQ ID NO: 3132

SEQ ID NO: 85182 - DNA, 201 bp, Bos taurus; identical to SEQ ID NO: 3133

SEQ ID NO: 85183 - DNA, 201 bp, Bos taurus; identical to SEQ ID NO: 3134

SEQ ID NO: 85184 - DNA, 201 bp, Bos taurus
ttatttgaattcctctttgtaacttaaatcagtgaagaaaatggcttccttggagtcaatttttctgatatacaattggttagtgtagagattaaattatgagtgtcacatttaatttaaaaccaaagagagaaatagcattatcacggagagtgtgctcttttgtgaatgtcaagtgcaacttgttgaaggtcttttgaa

SEQ ID NO: 85185 - DNA, 201 bp, Bos taurus
tccatatataattcttcaggataaagaggtccagttatttgaaggccacaatgtaatatctcttaatgctgaggacagcgcatactggaaaatgaagaggcacagttttataattaaatagtatggccaaggaatctgtgataaagtaaaaaaaataatgtattaagcaaaaaaaaaaaaaaaccctcaatttgaggtaaa

SEQ ID NO: 85186 - DNA, 201 bp, Bos taurus
gtacattcaaactgtttttctttcatcttaggcgtgctacagttaattctgtgatccaaaaatttcattgtagtcttacgtattcttgaaatcctgctaacttcatcaggtttgctggagatgggccatttcatgtaaaatttttaagaatttgtaaacaattgtaagataatacattttaaaattcattataactttgtt

SEQ ID NO: 85187 - DNA, 201 bp, Bos taurus; identical to SEQ ID NO: 3135

SEQ ID NO: 85188 - DNA, 201 bp, Bos taurus; identical to SEQ ID NO: 3136

SEQ ID NO: 85189 - DNA, 201 bp, Bos taurus
aagactgatgggacatggtactacattttagtttaaagttttgttttttctgtgagtacaaactgcatatatatccatacaggggtgacacaaagattattctttacaaagaagttcttttatattttatagtttatctatatctttattgatagttatagtagagaaaatatattaaacatttctttcctctaagtgaac

SEQ ID NO: 85190 - DNA, 201 bp, Bos taurus
atgcacaaaaaaatagtagggaaaatcttatccaaagatatttttgagtttcctccaaaattaagtttgtgttttaactgtttttagcaaaacaagcatcagttgttaatacatatggaagagtaagtattttcagcaaaggaattttattttcagatgctgtttttgaatgactcctgttttaaatttttcttttattga

SEQ ID NO: 85191 - DNA, 201 bp, Bos taurus
acttatttaaacaagaaaacactgccatcatctggacaggatatgagcaaaaagctattccagggacagttgcttttcagctggccttccccaaagttctatgagtcatcatcagctaaaagagcatgcccttctcacctttaaataaatgactaaaagatgagttccttgtattgctacttatggtggagttgaaggcca

SEQ ID NO: 85192 - DNA, 201 bp, Bos taurus
ctgaatttaacatcgtcagtcaatttctaattaacaatgtacaatactgtgtttctttacctttcttatcttttgttagattccttgtcatacttttcatcgccttctttaatccatctactcagacctgttctcctcaacccctacaagcttacatcctatttttcttcaagaaattatgaacaatcacaaagaaccgaa

SEQ ID NO: 85193 - DNA, 201 bp, Bos taurus; identical to SEQ ID NO: 3137

SEQ ID NO: 85194 - DNA, 201 bp, Bos taurus; identical to SEQ ID NO: 3138

SEQ ID NO: 85195 - DNA, 201 bp, Bos taurus
ggtcaacatttatattcaaacagtaaattatttaaatgaagaagtcagtttactatgctttaaacttattatctattttgccttccatattatgtcatacgctccttgaggatggggagaatctgagcagatttcaatttttaaaatatccttcttacattttgcacagcaaggtactcaataaacatttgtcaaatggaa

SEQ ID NO: 85196 - DNA, 201 bp, Bos taurus; identical to SEQ ID NO: 3139

SEQ ID NO: 85197 - DNA, 201 bp, Bos taurus; identical to SEQ ID NO: 3140

SEQ ID NO: 85198 - DNA, 201 bp, Bos taurus; identical to SEQ ID NO: 3141

SEQ ID NO: 85199 - DNA, 201 bp, Bos taurus
gttaatagcctccttatctagctcctgtatctattttcaaattgttacagaatctaaacgcaagaactgatgagaaataaggatatttcaagctattatgcgttatttatgtagggtttgatactctttccttgtgggattatgaaaggtatttatttaactggattcttgtttggttaaacaaagaattgaaaattgaca

SEQ ID NO: 85200 - DNA, 201 bp, Bos taurus; identical to SEQ ID NO: 3142

SEQ ID NO: 85201 - DNA, 201 bp, Bos taurus; identical to SEQ ID NO: 3143

SEQ ID NO: 85202 - DNA, 201 bp, Bos taurus; identical to SEQ ID NO: 3144

SEQ ID NO: 85203 - DNA, 201 bp, Bos taurus; identical to SEQ ID NO: 3145

SEQ ID NO: 85204 - DNA, 201 bp, Bos taurus; identical to SEQ ID NO: 3146

SEQ ID NO: 85205 - DNA, 201 bp, Bos taurus; identical to SEQ ID NO: 3147

SEQ ID NO: 85206 - DNA, 201 bp, Bos taurus
ctggcaaagcttttccctgatggggagaaattacctagaaagcaagcagttgtgagcccctcagagatggagtggatactgtggttccacccaggtcccccctgtagggccagtcactccatcctcagccaagagtaatcattcccttaggcagctgtcctcagttgcaggacaccacccagctaaggcagcccagcccag

SEQ ID NO: 85207 - DNA, 201 bp, Bos taurus; identical to SEQ ID NO: 3148

SEQ ID NO: 85208 - DNA, 201 bp, Bos taurus; identical to SEQ ID NO: 3149

SEQ ID NO: 85209 - DNA, 201 bp, Bos taurus; identical to SEQ ID NO: 3151

SEQ ID NO: 85210 - DNA, 201 bp, Bos taurus; identical to SEQ ID NO: 3153

SEQ ID NO: 85211 - DNA, 201 bp, Bos taurus
aagtattcacagtaaaataccaaggtaaggtaaattcatccactccatattcccaaacaaggtgaggttaagtttttgcctttggaaggacaggtggaaatggaagagaggacgagatgtaagtctacacatagggcgttgacaggcaaccctaaaacacaaaatgtttgtcctccaacctgttctccttggaccatccca

SEQ ID NO: 85212 - DNA, 201 bp, Bos taurus
aaaaggcaaaggccaatttgtcactatagttttagcatcacattttctgccactgtaaatagatctctgacttaaatttgccattgtatattaaagccactatatgtatgaaaacactgggtgtaattctgaatatctaaatcaatgttagactcaaatacactgtcacaagtgcaaatatttcactgtgactttgaatat

SEQ ID NO: 85213 - DNA, 201 bp, Bos taurus; identical to SEQ ID NO: 3154

SEQ ID NO: 85214 - DNA, 201 bp, Bos taurus; identical to SEQ ID NO: 3155

SEQ ID NO: 85215 - DNA, 201 bp, Bos taurus; identical to SEQ ID NO: 3156

SEQ ID NO: 85216 - DNA, 201 bp, Bos taurus
ctctgaaaggatattttaaatttcagattgcatggaagagaatagctatgaaatcttgagttttactcagataaacaattaaatcatggattggagtcttctatagtatgcacgactattccaaaatggttattgctatagtttgtagtatctgtaattggcctaaaaacaataaatttgttccagcaaagtaactccaaa

SEQ ID NO: 85217 - DNA, 201 bp, Bos taurus
attagctttgcaagactatctctcagttggccccttagagagcagactggaggctgatcaagatgaacatggttagatgtggctaccaagtccaccaagtcactgatggcccagagaataacggtggcatggaggaggaaatgctgaagaatttgtgagcacgaatataagttagtcttttcactgcattttaccttatgt

SEQ ID NO: 85218 - DNA, 201 bp, Bos taurus
ttttaaacagcactagcaatatttctcagagaagcagagggctgtgtgtgcaattgcataatacacttccttgacagttcaaaaaatcataggccttctcagataacttagaagctgtctgcatctgtgtatcatattacgttggggaagagcaattagtcaaggggaggcccaggcccagggcaccactgacattcctct

SEQ ID NO: 85219 - DNA, 201 bp, Bos taurus
caaagcaatttatcttataattctacaattaaacagacccttctcttttaaaccagttaactacttagactcagctaatcacagacgaactaaagaaaaatcattttaattaagcaggttgctaactgattcccacgtctatatcagcaggtcacctttctggttcataaagaaaaagtagccctttcacttcactaatac

SEQ ID NO: 85220 - DNA, 201 bp, Bos taurus
gtgtgtcagtggccctcaggcacaccgccagctttcagcgtttcagactccacaagaaggatcaagcttcctttcaccatagtttaagacaatcgtgagcataggccagtcaccctgagttggccatcaggagagacagctggccactggggaccaaaggtcactactgaagctgatcttcctctgcctcttctttgtgta

SEQ ID NO: 85221 - DNA, 201 bp, Bos taurus
actctaaaagtggctattttcagagttagcgaagggagaggccaatgccatggcattaagggagggagttgaggggtgcaaaagaccttagtgtgcttactgaccccctctccaaggccaaacatactgtcttggcccaaggctggctctggtttgaactactttgcagcttgaagctccacgaagtgagaaatgggcctg

SEQ ID NO: 85222 - DNA, 201 bp, Bos taurus
ccagtgggttcctgtgtagatttcccgccccccccccccccacccccgtccctccaatggctaatgggcttgagggaaaagcgcaggccttccgagttccgtccaacacctgccctacttagcatcctgcacattgccttctgggaaatgtagtttcttagttgcccgagcccttcaacatctggccaccattggaactac

SEQ ID NO: 85223 - DNA, 201 bp, Bos taurus; identical to SEQ ID NO: 3157

SEQ ID NO: 85224 - DNA, 201 bp, Bos taurus
cactttaccaacaaaacttagtctttcaaagggaataaatgtgagattagttaaaaggcatatttataccttattgagatggatggatttggcaaaaacatgtgaaagtaggttttaaaaactgctttttagcttcacacttaccagaataatttgctatttttaaggattcattttcctcctaagattagggctggggag

SEQ ID NO: 85225 - DNA, 201 bp, Bos taurus
ctgttgagcagcagcatcttgccagtccactgtgcgatagatcatcaaagtagggagtaaatgcctttagctccaggatgcttttaccacttatttgatttcctgggtcttattcactaaactgtagtatttctaagttattgctagatcatgcatcaacaaacattttctaaaaaggggcaaaaaagtatatattttgac

SEQ ID NO: 85226 - DNA, 201 bp, Bos taurus; identical to SEQ ID NO: 3158

SEQ ID NO: 85227 - DNA, 201 bp, Bos taurus; identical to SEQ ID NO: 3159

SEQ ID NO: 85228 - DNA, 201 bp, Bos taurus; identical to SEQ ID NO: 3160

SEQ ID NO: 85229 - DNA, 201 bp, Bos taurus
aggagcctggtggcctacagtccatttggtcacaaagagtcggacacgactgaagcgacttagcatacagcatgcacaatgcttagcataaaatccaaaacttctctattgctctatgaggccctaacataatctagttccttgcctgcctcgggacctttgatcttgctgttctttctacctgtcatggtttgcttgcac

SEQ ID NO: 85230 - DNA, 201 bp, Bos taurus; identical to SEQ ID NO: 3161

SEQ ID NO: 85231 - DNA, 201 bp, Bos taurus; identical to SEQ ID NO: 3162

SEQ ID NO: 85232 - DNA, 201 bp, Bos taurus; identical to SEQ ID NO: 3163

SEQ ID NO: 85233 - DNA, 201 bp, Bos taurus; identical to SEQ ID NO: 3164

SEQ ID NO: 85234 - DNA, 201 bp, Bos taurus; identical to SEQ ID NO: 3165

SEQ ID NO: 85235 - DNA, 201 bp, Bos taurus; identical to SEQ ID NO: 3166

SEQ ID NO: 85236 - DNA, 201 bp, Bos taurus; identical to SEQ ID NO: 3167

SEQ ID NO: 85237 - DNA, 201 bp, Bos taurus
gagggggattctttccttataatttgtatcatgaatgcgcctcaaggatctagtgcatccttccacatgcgcctatggatcctggctttgtagaggccttgccttcagtacaaacagatgaaccctgctattgaactaattgttatgccagctgcattgtcctgtggaccctcccacccctttcacacctatgacactttt

SEQ ID NO: 85238 - DNA, 201 bp, Bos taurus; identical to SEQ ID NO: 3168

SEQ ID NO: 85239 - DNA, 201 bp, Bos taurus; identical to SEQ ID NO: 3169

SEQ ID NO: 85240 - DNA, 201 bp, Bos taurus; identical to SEQ ID NO: 3170

SEQ ID NO: 85241 - DNA, 201 bp, Bos taurus
gaactctggaaagaggccccgctgaggaggacacgcctctcctagctctgctctctccgaggattccgttttctgcctgcaatttggtaaggcccatggcatctatctctagggtggaatccagggggatccttgaatacacaagtgcagtgtcctcgaaatcatcagactgagatccaatataggagaaaaatgttgcca

SEQ ID NO: 85242 - DNA, 201 bp, Bos taurus; identical to SEQ ID NO: 3171

SEQ ID NO: 85243 - DNA, 201 bp, Bos taurus
cttgttaaaatgcacactcctgtgctctaggccgagtgcttctgattcagtgtcactgcaacctgggatgctaagttaagtacctaggtggtttcaacacagggtccccgaaatggccacactggaaaactgaaactgactcagccttgaaaactcatagccaggaacatgggtccaactcttcttgtgtttattcctggc

SEQ ID NO: 85244 - DNA, 201 bp, Bos taurus; identical to SEQ ID NO: 3174

SEQ ID NO: 85245 - DNA, 201 bp, Bos taurus
agattttttttttttttttcatgtggatcatttttaaagtctttattaaacttgctacaatatcgtttctgttgtttctattctgggttttgggccctgaggcacatgagatcttaactctccaaccagggatttaaccgccccctacttcccccaaatatgaaggcaaagtcttaaccactggactgccaagaaagttcc

SEQ ID NO: 85246 - DNA, 201 bp, Bos taurus; identical to SEQ ID NO: 3175

SEQ ID NO: 85247 - DNA, 201 bp, Bos taurus; identical to SEQ ID NO: 3176

SEQ ID NO: 85248 - DNA, 201 bp, Bos taurus
attggttcatggcacttgtggaaaagaggctttgagttcaaggctctgttgggactgagaggccatgggaaggaggtggttgcccgtgggcctgatggctgttggaaaaagcaagatcaagaacaatagtataagagacatcagaacatctcaagaacccctcaactatagggataatttgagggctgaggttgcagctgc

SEQ ID NO: 85249 - DNA, 201 bp, Bos taurus
gtagacatgagcacttgagtacctcgggaaaacaattctagacacaattaaaaataattcagctaaaattgttaataaattcctaaaggctgagtgtgtgccagcaagaaaacacagaacccatgaaggccacaacccgttcacgggttcttcagagcctctccaggtttgcatcaaagaaaataaaaggccaggtgcaga

SEQ ID NO: 85250 - DNA, 201 bp, Bos taurus
ccaccctcgaccggctccttcctctcccctttcccctccccaccccgggtcactgccgggcgcctcccatttaggggagtgtcggaccccggaaacctccaggccggaaacctcgcggcccaagggcctctccttaaaccgaattttctttgacaggcaactgagtgaaataagtgtttatctatttaggtgtgaagaaaa

SEQ ID NO: 85251 - DNA, 201 bp, Bos taurus; identical to SEQ ID NO: 3183

SEQ ID NO: 85252 - DNA, 201 bp, Bos taurus; identical to SEQ ID NO: 3184

SEQ ID NO: 85253 - DNA, 201 bp, Bos taurus
catttcctactccagggtatcttcccaacacagggatcagtcctgtgtctcttgtgtctcctgcacccagttacatatgacttattaataagaattcactaatttcatttgatcaacagtatattgtaggcaactgcagtgtttttttttgaattgtggaatgacatatgacataatattagtttcaagtgtactacataa

SEQ ID NO: 85254 - DNA, 201 bp, Bos taurus; identical to SEQ ID NO: 3186

SEQ ID NO: 85255 - DNA, 201 bp, Bos taurus
caacactaatcaaagaaaatgaactgtaatcgtttcgaggaagctgaattgcatcaacatttgagtatccattattcctttcatcatttcagcattgtacgctatcattatctattctttcagggttctgaaaaggctttagaatctgctgattgtcagtcactagctaccggatgccacaaagctctgcaattctactgg

SEQ ID NO: 85256 - DNA, 201 bp, Bos taurus
aggcctagtaacactgttcttaacaacttgatacactgaaataaaaacaaattgactctctaaaggtgtgtgtgcttaatcactcagtcatgtctgactgtgtgcgaccctttgggccaaagcctgccaggttcctctgtccacaggatttttcaggcaagagtactggagtggattaccattttcctcctccatgggatt

SEQ ID NO: 85257 - DNA, 201 bp, Bos taurus; identical to SEQ ID NO: 3189

SEQ ID NO: 85258 - DNA, 201 bp, Bos taurus; identical to SEQ ID NO: 3190

SEQ ID NO: 85259 - DNA, 201 bp, Bos taurus
tgactaaggtcttgctgagttaagtgtttttagtgtctgttatcctcacattctctctcagagtagaacatacattgtcttgctgtggccggaagtaatacagagaagaaggctgggaccctgggttgagagacttgatttgactgccaccactaggtgcccagaggccctttccttttctcccaggagactgtgggactt

SEQ ID NO: 85260 - DNA, 201 bp, Bos taurus; identical to SEQ ID NO: 3191

SEQ ID NO: 85261 - DNA, 201 bp, Bos taurus; identical to SEQ ID NO: 3194

SEQ ID NO: 85262 - DNA, 201 bp, Bos taurus
ataaatcaaatttaaaaattgtgatcaattaattttcttattaaaggagaccttgaaaaatatttctttgtaaccaccctacactgccattttaatatatttctcagcagtttacctaaaaataaaatcaaatatctggatcattggttttcaaagttatttattttgaccaattattttcataattatttcagaatcacc

SEQ ID NO: 85263 - DNA, 201 bp, Bos taurus; identical to SEQ ID NO: 3195

SEQ ID NO: 85264 - DNA, 201 bp, Bos taurus; identical to SEQ ID NO: 3196

SEQ ID NO: 85265 - DNA, 201 bp, Bos taurus
cctggggggccaggacaggggccacacgctgcacactaagtcttccctattttctctgacttctggcattctgggacatgtctcttcctggtcacaacaggttgttagaggagcggaggggccaggtcactgtttccacccccctcaacatttcctctttctagagcagatgactagagagaaaaagtgtctcaaatgagc

SEQ ID NO: 85266 - DNA, 201 bp, Bos taurus; identical to SEQ ID NO: 3197

SEQ ID NO: 85267 - DNA, 201 bp, Bos taurus; identical to SEQ ID NO: 3198

SEQ ID NO: 85268 - DNA, 201 bp, Bos taurus; identical to SEQ ID NO: 3199

SEQ ID NO: 85269 - DNA, 201 bp, Bos taurus
aagaaaaatgtattttttaaactctgcctaatatattctatgatttttttagtaaaggggtttaagagctttgtgtaattaacaaatcatttcaaattaatgaacatccacatcaatataaattaggagaaatgaatgtccttatttattttgttccagactgcagactgaagtctgaagaatacataaataagtaagcaa

SEQ ID NO: 85270 - DNA, 201 bp, Bos taurus
aaagtaaagccaggggcctttagtttcttccttcagtgctatagatagtatcctgagccatatccttgtactggttttatagaaaccagcccccaccccagtcagatgaaccaccaacatgtaggccccagaccagttgcaattaagaaggttgatgattgggattcctgaaatagcatgctgttacttcaccaccgacaa

SEQ ID NO: 85271 - DNA, 201 bp, Bos taurus
ttatttgttgacctttttggatgaaaatttctaaaatccagaggaacaaagccagataatgatgacaaaggaataatttatcttttcctaggagacttcatgtaatggtggcaatattatcctcttattacacattgaaatttgtgcttacttctcagttttatattaatcacttctaacttttatttgtatgtagagcat

SEQ ID NO: 85272 - DNA, 201 bp, Bos taurus; identical to SEQ ID NO: 3200

SEQ ID NO: 85273 - DNA, 201 bp, Bos taurus; identical to SEQ ID NO: 3201

SEQ ID NO: 85274 - DNA, 201 bp, Bos taurus; identical to SEQ ID NO: 3202

SEQ ID NO: 85275 - DNA, 201 bp, Bos taurus
gcatctgtagattttttttcctgtctttgtccaacataaataattttctcttactgatagtctgagagtactacaatataagttttaagtaatcctagttctacttcctatatccatgattctgtggcataacaattgtattttattaaaaaaatcagctttctgggaaactgaaaacacttatgaatgataatacacttt

SEQ ID NO: 85276 - DNA, 201 bp, Bos taurus
ctaatttaaatctctaatatataggatggataaagaccttttcaaaagcctataatttcttagaaaataatataggaagctatgttgtgaacttggagtggtaagtctcatagacacaaaaggcaaaaagaaaaatagtcacacatatgactatacctcccaataaaaataccatacaagtagcagatgagacagaatatt

SEQ ID NO: 85277 - DNA, 201 bp, Bos taurus
tttcaattatctgcacatctcccccaaactcttggatttctcaatctttaggagacaactactatttatttgtatgaattttccccttcaaaataggaacttggattagtttccctgagcaaactgtttattacttattcttttattttcttctaattggttcctatatccatttgatagatgtctaccaccttccatttt

SEQ ID NO: 85278 - DNA, 201 bp, Bos taurus
caaacttcagtggttggaaatatctttttaatttaaatttcataagaaacagagctacaatgcacattccctgaccagattgtgtgtggcctatttattcaaaatgtttgattccatatggatttctgctctttatttataacttcaagaaaggattctaataagttagcaactcaaggacaactgacttgaaatccaggc

SEQ ID NO: 85279 - DNA, 201 bp, Bos taurus; identical to SEQ ID NO: 3207

SEQ ID NO: 85280 - DNA, 201 bp, Bos taurus; identical to SEQ ID NO: 3208

SEQ ID NO: 85281 - DNA, 201 bp, Bos taurus; identical to SEQ ID NO: 3209

SEQ ID NO: 85282 - DNA, 201 bp, Bos taurus; identical to SEQ ID NO: 3210

SEQ ID NO: 85283 - DNA, 201 bp, Bos taurus
tcctaacagcattcactattataatcatgtaacaacaaataagggactatagggctatgcaaaacagaatcatttgttatatcaaagtaaaaattttctcgtgaaacatcaaaatcattttcaactgccaggtttagagagttatttagacacaggctcttactaaagattctgcaatcaactctgaatacttgccatgta

SEQ ID NO: 85284 - DNA, 201 bp, Bos taurus
tagtggtcaagggcttttaaaatcagtttaagttaacctctgctttcagaaaatttgtaatgaaaaataatttacagatggctggattgtctcctaaaagggataaaaattgagacaaaatacatttggcattcagagatattaacttcgattatctttcaccctcatcactgaagagacatttggtttgactgatacaga

SEQ ID NO: 85285 - DNA, 201 bp, Bos taurus; identical to SEQ ID NO: 3212

SEQ ID NO: 85286 - DNA, 201 bp, Bos taurus; identical to SEQ ID NO: 3215

SEQ ID NO: 85287 - DNA, 201 bp, Bos taurus; identical to SEQ ID NO: 3216

SEQ ID NO: 85288 - DNA, 201 bp, Bos taurus
ggtgctaaaatgtcaaactgttcccaagtgtgggccacgactgaggaggctagatagagaaaacacccttcagataaaggatctgctgagcttgtttattcctcagccactggcttcatcgcttggatgcttgaatgagcatttattaagtaatctttggttgatagtgagctacttatatttggggagggagcaaagtaa

SEQ ID NO: 85289 - DNA, 201 bp, Bos taurus
gccctgtcttcctctgactttttttctcctctgcttttctgcaatggtttccacttcttgtcttgaagtggatattcctgtctcctgtactggggccttggtggactgacattaactccttgtctgttgtctatggatgtttctatattggaatggttggaaacaggcagctaataagagtgactagctctggccccaacc

SEQ ID NO: 85290 - DNA, 201 bp, Bos taurus; identical to SEQ ID NO: 3218

SEQ ID NO: 85291 - DNA, 201 bp, Bos taurus; identical to SEQ ID NO: 3219

SEQ ID NO: 85292 - DNA, 201 bp, Bos taurus; identical to SEQ ID NO: 3220

SEQ ID NO: 85293 - DNA, 201 bp, Bos taurus
ctctccatggaaggatctaggtgtgaaagggttaagaccgatctctgtgacctttatagaaaggatgcataaaatgtatttttagggattgtgcttactttgctttcttccaaattgagaatttgcccacttaacttcgttatacagtttttaaaatactctgtaacatgtgttcactaacatttggagggaacacggttg

SEQ ID NO: 85294 - DNA, 201 bp, Bos taurus
acccacaataaaagtcttggccaagaattcacacttattttgcagaattattctagagacaaatttgagtgttatagaattattttttaaaagtatcccaactagtcctagtttcagttcaatctcctgcagcacaggttgtagctatgagtaactgtcctaggcagtacctatgtgacaatacctatttcatgcaaagcg

SEQ ID NO: 85295 - DNA, 201 bp, Bos taurus; identical to SEQ ID NO: 3221

SEQ ID NO: 85296 - DNA, 201 bp, Bos taurus
ctcatgacctgtaatatgaaaaatgctgttttactgcaagagggaggattgaaaaggtgaagctgctcaaactgagctattagctaagggcatggaacactttagcccttgattctgaaattttaaaggtgggcttgtcataagaacttcaagcagtaaatgtaacacacaaaggataaggaggcccatgatctgagaaag

SEQ ID NO: 85297 - DNA, 201 bp, Bos taurus
aaacatgcagattgtgttaaaacataagagaaagtgatagcttacagtgaaccatgtcagatttgtcatctccaaagacttagcttcgggaccagagaccaggcttgatcacttaaaggtttctgtgtagcagcattttattaaagtataaaaagggacaagagggctggagggctgcagtctgtggggtcccaaacagtg

SEQ ID NO: 85298 - DNA, 201 bp, Bos taurus; identical to SEQ ID NO: 3222

SEQ ID NO: 85299 - DNA, 201 bp, Bos taurus; identical to SEQ ID NO: 3223

SEQ ID NO: 85300 - DNA, 201 bp, Bos taurus; identical to SEQ ID NO: 3225

SEQ ID NO: 85301 - DNA, 201 bp, Bos taurus; identical to SEQ ID NO: 3226

SEQ ID NO: 85302 - DNA, 201 bp, Bos taurus
tagacatgacttagccactaaacagcaaaacaaactagttggaaattttcactctttgccttcagctccttcccctgatgcttccctatgccacacaagcgtcccagtcagaattcccactcaaggaaaagacttaggaaaaagtccttttcaaacaacagtgaatgaaacctatattagcaactccactttctgacccaa

SEQ ID NO: 85303 - DNA, 201 bp, Bos taurus
gtcagctgtgtctaggcaggtaatttacctggttctcatgctgcagttatgaggaacctcttggaatgagcttgtatagcagatgccctgaagcctcccatattctggcagtgagattaggagtcactttccttggcattgcccttcacaatctcatttttgattagactatacctgctctccatggtatttgctctgacc

SEQ ID NO: 85304 - DNA, 201 bp, Bos taurus
aagaaaaatgtaggtgacatatcctcccttttttgctacagtagacataccaaatattttctctactatcatcagcgagtgtaaaaaagtatttagcccatgtaaaaagtaaattcttaagcagcagtttcagagagggcttaaacacagaagacttttcctgtgtgtgtgtgtgtgtgggcgtgggtgtgtgtgcgtggg

SEQ ID NO: 85305 - DNA, 201 bp, Bos taurus
ttttaattctcatagaaacacatatgtatgtaactggatatgtatttctttaatccagaactttggttttctgtaactccatattttcaatctgagatgcgtcataaactttatattatcacaaatctaactcatttgtaatctatacacagcatttgtcagtttaaatgcattgtaatttctaagccatttatttattgt

SEQ ID NO: 85306 - DNA, 201 bp, Bos taurus
tggtggcttattagttctgtgttccttaccaggacctcctgtggtaaaacaactcatgcaaatgattactatggtgcctggccagggtgggcagtttgtcagtgtgcttcccctaacagtcccatggaaatcttattttgctgataccagtgtagagaaaggagttgttgttcccagtttctgcagggtgcgaataggcca

SEQ ID NO: 85307 - DNA, 201 bp, Bos taurus; identical to SEQ ID NO: 3227

SEQ ID NO: 85308 - DNA, 201 bp, Bos taurus
ttctatcaaacatcaacaaaaatcaaccataggtttacccatgcccctgccctcttgaacatcactccccatcccaccaacaacactaggttattcccgagccctagtttgagttctctgagtcatacagcaaattcccaatggctatctattttacatatgataatatatgtttccatgttactctgtccatacatccca

SEQ ID NO: 85309 - DNA, 201 bp, Bos taurus
tctcaccatctggcaggaaagacagagtttaccatggccgagagtggctgcatctaccatggcagcagggctggcagtagctattgaaaccttcttgtcctgaatcctctcctaccaatggccctctaggttgtctcagtgctgtctgcccaatggtctaagcatggtttaaaacaatgtcaacaacagtaaagactttta

SEQ ID NO: 85310 - DNA, 201 bp, Bos taurus
ccactgtctttgatattctgcatagctcataccacatttatatcacactcatactacatgccaaatgtaaggctctattccacacagtcattcagggatcttggctggggaagtttctattatattgaaagtatttcatttacagtcttgctgcgcaatgtatgatctgcaaaccagcatcactggtatcattaggaattt

SEQ ID NO: 85311 - DNA, 201 bp, Bos taurus
atatatgaaactacagccgaccatggaaaacatcactcacccttagacggacactgctataagcactctgaggcctgagattaggaagagaggggaggcccaagcccctcgccatcccagttcagcaggaagtagccagaatgacctcgacacccctattcccaaagaattgggcctcatatctcttgagaagggaatgtc

SEQ ID NO: 85312 - DNA, 201 bp, Bos taurus
cacttatcagactgacaaaaattgatacttgcaataatacccagatttgaaaagacatagagaaattaacagaatcaaatattgttgagagtgatgtaaattttacataaaaaaaatttgaaaatgcacatatctatttcaaatcctaaaatatgatgctattaaagtgctatactcaatatgccagcaaatttgaaaaac

SEQ ID NO: 85313 - DNA, 201 bp, Bos taurus
ctgaagtaaaaatgggttttgtttttaatttagaaaatataaattcagtacaattaaaggttttttccatcaatttcattgtacttttaatctctaagatcaatctctaaattttgtgttagagtcagataaaacaaactactaactctgtccattcctcttttcttagatatgtggtaacacactgtacatactattttc

SEQ ID NO: 85314 - DNA, 201 bp, Bos taurus; identical to SEQ ID NO: 3229

SEQ ID NO: 85315 - DNA, 201 bp, Bos taurus; identical to SEQ ID NO: 3230

SEQ ID NO: 85316 - DNA, 201 bp, Bos taurus; identical to SEQ ID NO: 3231

SEQ ID NO: 85317 - DNA, 201 bp, Bos taurus; identical to SEQ ID NO: 3234

SEQ ID NO: 85318 - DNA, 201 bp, Bos taurus
atttctaggctagctatgctattgtacaattttttactgtgaaattttcacataaagtatttctggatgaataattcttatatgtcaaattagcattatcgctcattttctggaaaagtaaggtataagggagtcaattgataaataataaataagaaagggaactttggatcactttggtttgttttgtaatccttacaa

SEQ ID NO: 85319 - DNA, 201 bp, Bos taurus; identical to SEQ ID NO: 3235

SEQ ID NO: 85320 - DNA, 201 bp, Bos taurus; identical to SEQ ID NO: 3236

SEQ ID NO: 85321 - DNA, 201 bp, Bos taurus; identical to SEQ ID NO: 3237

SEQ ID NO: 85322 - DNA, 201 bp, Bos taurus; identical to SEQ ID NO: 3239

SEQ ID NO: 85323 - DNA, 201 bp, Bos taurus; identical to SEQ ID NO: 3240

SEQ ID NO: 85324 - DNA, 201 bp, Bos taurus
tcttgagctcaagcactggaagacatccatataaattctgcaagatgatagctatgatgtcacccaaaagtgttccttctcatgtctccccacttcatctagctcatcggaagctttgaggcctcagtagtcttgtgatgctgttttgaggagggtgaaaaattcttttctggttggaataaagaagcatccgggttgggg

SEQ ID NO: 85325 - DNA, 201 bp, Bos taurus; identical to SEQ ID NO: 3242

SEQ ID NO: 85326 - DNA, 201 bp, Bos taurus
cctgcctttcccatggttcccaattaaaaaaaaaaaaaagcagtgtgtgaataatatggggtagtataagaacacgtctttagattctgaccagtcttgattcttcttttttgaagttatatgatttggtggaagtttttctataaaattcatgtaatcatacttatagtttaccaggtatctacaaggtactgaactgta

SEQ ID NO: 85327 - DNA, 201 bp, Bos taurus; identical to SEQ ID NO: 3244

SEQ ID NO: 85328 - DNA, 201 bp, Bos taurus; identical to SEQ ID NO: 3245

SEQ ID NO: 85329 - DNA, 201 bp, Bos taurus; identical to SEQ ID NO: 3246

SEQ ID NO: 85330 - DNA, 201 bp, Bos taurus; identical to SEQ ID NO: 3247

SEQ ID NO: 85331 - DNA, 201 bp, Bos taurus; identical to SEQ ID NO: 3248

SEQ ID NO: 85332 - DNA, 201 bp, Bos taurus; identical to SEQ ID NO: 3250

SEQ ID NO: 85333 - DNA, 201 bp, Bos taurus; identical to SEQ ID NO: 3251

SEQ ID NO: 85334 - DNA, 201 bp, Bos taurus; identical to SEQ ID NO: 3252

SEQ ID NO: 85335 - DNA, 201 bp, Bos taurus
aaatgcccaggtgacaaagctgtcagtagtgatgccgaggtttggatcagtcccatctgataccagtgttagggtggctcacatcacagcaggttgtgtttgagatgccagacaccacactgtctctttgaaaccagcagcaagctcagttactcttccttttctggtgtttccatcccattttattcagtagctctcctc

SEQ ID NO: 85336 - DNA, 201 bp, Bos taurus
aggacgttgtctgtggcccagctgcttatcccagtgatcttgtccagttctgcttgtactcatccctctaaagctctctcactcccgtctctccttgtgctgaactcctggcctatcacgctcacgcctccttgtgttttccagctttggagacatgctgtccttcaccctgacggcctttgtggagctgatggaccatgg

SEQ ID NO: 85337 - DNA, 201 bp, Bos taurus
aaataacaaagagaaatggaaatctcttaagacttttctgacttcttgagaagagtctcaggattctgtctagtactgctctgttcaatctaatgctgtaaatacaataagataaacagagaagtgtgggagagatggggagggagatgaaatgtcttcttgcatttcataacagattagtgaaacaccagctaccagagc

SEQ ID NO: 85338 - DNA, 201 bp, Bos taurus
aattcccattcctagtaagtggtcaagagggagttcacccaaatctttaaaacttgcgtttatgcagtatactttcctgcttctagtttggacaagtttattttatagacattccggctctttgcttcttatcattttctctatttattcactggccacagaagccatttttctcatattcattttaatgttcagtgttta

SEQ ID NO: 85339 - DNA, 201 bp, Bos taurus
tctgtgtttttgccttttattaccaatatttcagagcatacattattcattgtcatgggtattagagaagagctaaagcacagctggatcccccgaaatgcaagtggccccatagtcatttcattgaagcctttacttttgagttgggggttaagaaggaggatgcaagtgacttggatatttcaggtatgggaatctcat

SEQ ID NO: 85340 - DNA, 201 bp, Bos taurus
ccatataggccaagtaaaatgtcagagagaaaatcattctgttgagtggcgagtaggaataagcaaagttgggctggtactcaattttatctttacttttaaaatttttatttaggcccttaattttatttttagaatggggttttgttaagtaaactcagcacagtcatatctaaacatgtctgtatttattttcacaaa

SEQ ID NO: 85341 - DNA, 201 bp, Bos taurus; identical to SEQ ID NO: 3254

SEQ ID NO: 85342 - DNA, 201 bp, Bos taurus
ataatcccccttttccttttcctttgggttcttgcttgcaggtggttttacagctgttggcagatcacttctggaagaagatgcagcaccagtggccccacgtcctgggaaaggagaatccattcaatccgcagattgagcaggtgtttggagaccaaggggggcactgaggccccaaggacatgtgcttctggggaggca

SEQ ID NO: 85343 - DNA, 201 bp, Bos taurus
atttcaaatcattttattttgatagtgattttcaaaacttgcatgtgtgcaaagattgtgtgcacactttccaggaaggagacgctcccacaggtaaagagtggaggtagtgagtaatacttagatattgttggtagccagtgtgttggatacctgagatttggaggatatggccatgggtgttattttaacttttaaccc

SEQ ID NO: 85344 - DNA, 201 bp, Bos taurus; identical to SEQ ID NO: 3256

SEQ ID NO: 85345 - DNA, 201 bp, Bos taurus; identical to SEQ ID NO: 3257

SEQ ID NO: 85346 - DNA, 201 bp, Bos taurus; identical to SEQ ID NO: 3258

SEQ ID NO: 85347 - DNA, 201 bp, Bos taurus; identical to SEQ ID NO: 3259

SEQ ID NO: 85348 - DNA, 201 bp, Bos taurus
cataactgtttaacactgaactctgggttcacaggggcaaaaatgttgtgaaacattctgagcctttaatattctctttgaacatataagaggcacttttagaagagaatgacgagtaataatttacattcaccatttcccaaagggataacacagatccagcttcctcaacttcattgtctactcctcaggaatttcaaa

SEQ ID NO: 85349 - DNA, 201 bp, Bos taurus; identical to SEQ ID NO: 3260

SEQ ID NO: 85350 - DNA, 201 bp, Bos taurus
tagtttattggtacaacggaaactgaaacagagccctgtagatcttaggctggtttctttccactacactaagcatgaactgtggcatttgggttggcactacactccatgggcctactttccaaggacaaccgccacagtattccatctcactgctcttctccaatgtgaccttggttaattaccctcctcttgcatctg

SEQ ID NO: 85351 - DNA, 201 bp, Bos taurus; identical to SEQ ID NO: 3261

SEQ ID NO: 85352 - DNA, 201 bp, Bos taurus; identical to SEQ ID NO: 3262

SEQ ID NO: 85353 - DNA, 201 bp, Bos taurus; identical to SEQ ID NO: 3263

SEQ ID NO: 85354 - DNA, 201 bp, Bos taurus; identical to SEQ ID NO: 3266

SEQ ID NO: 85355 - DNA, 201 bp, Bos taurus; identical to SEQ ID NO: 3267

SEQ ID NO: 85356 - DNA, 201 bp, Bos taurus; identical to SEQ ID NO: 3269

SEQ ID NO: 85357 - DNA, 201 bp, Bos taurus; identical to SEQ ID NO: 3270

SEQ ID NO: 85358 - DNA, 201 bp, Bos taurus; identical to SEQ ID NO: 3271

SEQ ID NO: 85359 - DNA, 201 bp, Bos taurus; identical to SEQ ID NO: 3272

SEQ ID NO: 85360 - DNA, 201 bp, Bos taurus; identical to SEQ ID NO: 3274

SEQ ID NO: 85361 - DNA, 201 bp, Bos taurus; identical to SEQ ID NO: 3275

SEQ ID NO: 85362 - DNA, 201 bp, Bos taurus; identical to SEQ ID NO: 3276

SEQ ID NO: 85363 - DNA, 201 bp, Bos taurus; identical to SEQ ID NO: 3277

SEQ ID NO: 85364 - DNA, 201 bp, Bos taurus; identical to SEQ ID NO: 3278

SEQ ID NO: 85365 - DNA, 201 bp, Bos taurus; identical to SEQ ID NO: 3279

SEQ ID NO: 85366 - DNA, 201 bp, Bos taurus; identical to SEQ ID NO: 3280

SEQ ID NO: 85367 - DNA, 201 bp, Bos taurus; identical to SEQ ID NO: 3281

SEQ ID NO: 85368 - DNA, 201 bp, Bos taurus; identical to SEQ ID NO: 3283

SEQ ID NO: 85369 - DNA, 201 bp, Bos taurus; identical to SEQ ID NO: 3284

SEQ ID NO: 85370 - DNA, 201 bp, Bos taurus; identical to SEQ ID NO: 3286

SEQ ID NO: 85371 - DNA, 201 bp, Bos taurus; identical to SEQ ID NO: 3287

SEQ ID NO: 85372 - DNA, 201 bp, Bos taurus; identical to SEQ ID NO: 3288

SEQ ID NO: 85373 - DNA, 201 bp, Bos taurus; identical to SEQ ID NO: 3289

SEQ ID NO: 85374 - DNA, 201 bp, Bos taurus; identical to SEQ ID NO: 3290

SEQ ID NO: 85375 - DNA, 201 bp, Bos taurus; identical to SEQ ID NO: 3291

SEQ ID NO: 85376 - DNA, 201 bp, Bos taurus; identical to SEQ ID NO: 3292

SEQ ID NO: 85377 - DNA, 201 bp, Bos taurus; identical to SEQ ID NO: 3293

SEQ ID NO: 85378 - DNA, 201 bp, Bos taurus; identical to SEQ ID NO: 3300

SEQ ID NO: 85379 - DNA, 201 bp, Bos taurus; identical to SEQ ID NO: 3302

SEQ ID NO: 85380 - DNA, 201 bp, Bos taurus; identical to SEQ ID NO: 3303

SEQ ID NO: 85381 - DNA, 201 bp, Bos taurus; identical to SEQ ID NO: 3304

SEQ ID NO: 85382 - DNA, 201 bp, Bos taurus; identical to SEQ ID NO: 3305

SEQ ID NO: 85383 - DNA, 201 bp, Bos taurus; identical to SEQ ID NO: 3306

SEQ ID NO: 85384 - DNA, 201 bp, Bos taurus; identical to SEQ ID NO: 3307

SEQ ID NO: 85385 - DNA, 201 bp, Bos taurus; identical to SEQ ID NO: 3309

SEQ ID NO: 85386 - DNA, 201 bp, Bos taurus; identical to SEQ ID NO: 3310

SEQ ID NO: 85387 - DNA, 201 bp, Bos taurus; identical to SEQ ID NO: 3312

SEQ ID NO: 85388 - DNA, 201 bp, Bos taurus; identical to SEQ ID NO: 3313

SEQ ID NO: 85389 - DNA, 201 bp, Bos taurus; identical to SEQ ID NO: 3317

SEQ ID NO: 85390 - DNA, 201 bp, Bos taurus; identical to SEQ ID NO: 3318

SEQ ID NO: 85391 - DNA, 201 bp, Bos taurus; identical to SEQ ID NO: 3319

SEQ ID NO: 85392 - DNA, 201 bp, Bos taurus; identical to SEQ ID NO: 3320

SEQ ID NO: 85393 - DNA, 201 bp, Bos taurus; identical to SEQ ID NO: 3321

SEQ ID NO: 85394 - DNA, 201 bp, Bos taurus; identical to SEQ ID NO: 3322

SEQ ID NO: 85395 - DNA, 201 bp, Bos taurus; identical to SEQ ID NO: 3323

SEQ ID NO: 85396 - DNA, 201 bp, Bos taurus; identical to SEQ ID NO: 3324

SEQ ID NO: 85397 - DNA, 201 bp, Bos taurus; identical to SEQ ID NO: 3325

SEQ ID NO: 85398 - DNA, 201 bp, Bos taurus; identical to SEQ ID NO: 3326

SEQ ID NO: 85399 - DNA, 201 bp, Bos taurus; identical to SEQ ID NO: 3327

SEQ ID NO: 85400 - DNA, 201 bp, Bos taurus; identical to SEQ ID NO: 3328

SEQ ID NO: 85401 - DNA, 201 bp, Bos taurus; identical to SEQ ID NO: 3329

SEQ ID NO: 85402 - DNA, 201 bp, Bos taurus; identical to SEQ ID NO: 3331

SEQ ID NO: 85403 - DNA, 201 bp, Bos taurus; identical to SEQ ID NO: 3335

SEQ ID NO: 85404 - DNA, 201 bp, Bos taurus; identical to SEQ ID NO: 3336

SEQ ID NO: 85405 - DNA, 201 bp, Bos taurus; identical to SEQ ID NO: 3337

SEQ ID NO: 85406 - DNA, 201 bp, Bos taurus; identical to SEQ ID NO: 3338

SEQ ID NO: 85407 - DNA, 201 bp, Bos taurus; identical to SEQ ID NO: 3339

SEQ ID NO: 85408 - DNA, 201 bp, Bos taurus; identical to SEQ ID NO: 3340

SEQ ID NO: 85409 - DNA, 201 bp, Bos taurus; identical to SEQ ID NO: 3341

SEQ ID NO: 85410 - DNA, 201 bp, Bos taurus; identical to SEQ ID NO: 3343

SEQ ID NO: 85411 - DNA, 201 bp, Bos taurus; identical to SEQ ID NO: 3344

SEQ ID NO: 85412 - DNA, 201 bp, Bos taurus; identical to SEQ ID NO: 3345

SEQ ID NO: 85413 - DNA, 201 bp, Bos taurus; identical to SEQ ID NO: 3346

SEQ ID NO: 85414 - DNA, 201 bp, Bos taurus; identical to SEQ ID NO: 3347

SEQ ID NO: 85415 - DNA, 201 bp, Bos taurus; identical to SEQ ID NO: 3348

SEQ ID NO: 85416 - DNA, 201 bp, Bos taurus; identical to SEQ ID NO: 3353

SEQ ID NO: 85417 - DNA, 201 bp, Bos taurus; identical to SEQ ID NO: 3354

SEQ ID NO: 85418 - DNA, 201 bp, Bos taurus; identical to SEQ ID NO: 3356

SEQ ID NO: 85419 - DNA, 201 bp, Bos taurus; identical to SEQ ID NO: 3357

SEQ ID NO: 85420 - DNA, 201 bp, Bos taurus; identical to SEQ ID NO: 3359

SEQ ID NO: 85421 - DNA, 201 bp, Bos taurus; identical to SEQ ID NO: 3360

SEQ ID NO: 85422 - DNA, 201 bp, Bos taurus; identical to SEQ ID NO: 3362

SEQ ID NO: 85423 - DNA, 201 bp, Bos taurus; identical to SEQ ID NO: 3363

SEQ ID NO: 85424 - DNA, 201 bp, Bos taurus; identical to SEQ ID NO: 3364

SEQ ID NO: 85425 - DNA, 201 bp, Bos taurus; identical to SEQ ID NO: 3365

SEQ ID NO: 85426 - DNA, 201 bp, Bos taurus; identical to SEQ ID NO: 3367

SEQ ID NO: 85427 - DNA, 201 bp, Bos taurus; identical to SEQ ID NO: 3368

SEQ ID NO: 85428 - DNA, 201 bp, Bos taurus; identical to SEQ ID NO: 3369

SEQ ID NO: 85429 - DNA, 201 bp, Bos taurus; identical to SEQ ID NO: 3370

SEQ ID NO: 85430 - DNA, 201 bp, Bos taurus; identical to SEQ ID NO: 3371

SEQ ID NO: 85431 - DNA, 201 bp, Bos taurus; identical to SEQ ID NO: 3372

SEQ ID NO: 85432 - DNA, 201 bp, Bos taurus; identical to SEQ ID NO: 3376

SEQ ID NO: 85433 - DNA, 201 bp, Bos taurus; identical to SEQ ID NO: 3378

SEQ ID NO: 85434 - DNA, 201 bp, Bos taurus; identical to SEQ ID NO: 3379

SEQ ID NO: 85435 - DNA, 201 bp, Bos taurus; identical to SEQ ID NO: 3380

SEQ ID NO: 85436 - DNA, 201 bp, Bos taurus; identical to SEQ ID NO: 3382

SEQ ID NO: 85437 - DNA, 201 bp, Bos taurus; identical to SEQ ID NO: 3383

SEQ ID NO: 85438 - DNA, 201 bp, Bos taurus; identical to SEQ ID NO: 3384

SEQ ID NO: 85439 - DNA, 201 bp, Bos taurus; identical to SEQ ID NO: 3386

SEQ ID NO: 85440 - DNA, 201 bp, Bos taurus; identical to SEQ ID NO: 3387

SEQ ID NO: 85441 - DNA, 201 bp, Bos taurus; identical to SEQ ID NO: 3388

SEQ ID NO: 85442 - DNA, 201 bp, Bos taurus; identical to SEQ ID NO: 3390

SEQ ID NO: 85443 - DNA, 201 bp, Bos taurus; identical to SEQ ID NO: 3393

SEQ ID NO: 85444 - DNA, 201 bp, Bos taurus; identical to SEQ ID NO: 3394

SEQ ID NO: 85445 - DNA, 201 bp, Bos taurus; identical to SEQ ID NO: 3397

SEQ ID NO: 85446 - DNA, 201 bp, Bos taurus; identical to SEQ ID NO: 3398

SEQ ID NO: 85447 - DNA, 201 bp, Bos taurus; identical to SEQ ID NO: 3401

SEQ ID NO: 85448 - DNA, 201 bp, Bos taurus; identical to SEQ ID NO: 3402

SEQ ID NO: 85449 - DNA, 201 bp, Bos taurus; identical to SEQ ID NO: 3403

SEQ ID NO: 85450 - DNA, 201 bp, Bos taurus; identical to SEQ ID NO: 3404

SEQ ID NO: 85451 - DNA, 201 bp, Bos taurus; identical to SEQ ID NO: 3405

SEQ ID NO: 85452 - DNA, 201 bp, Bos taurus; identical to SEQ ID NO: 3406

SEQ ID NO: 85453 - DNA, 201 bp, Bos taurus; identical to SEQ ID NO: 3407

SEQ ID NO: 85454 - DNA, 201 bp, Bos taurus; identical to SEQ ID NO: 3408

SEQ ID NO: 85455 - DNA, 201 bp, Bos taurus; identical to SEQ ID NO: 3409

SEQ ID NO: 85456 - DNA, 201 bp, Bos taurus; identical to SEQ ID NO: 3410

SEQ ID NO: 85457 - DNA, 201 bp, Bos taurus; identical to SEQ ID NO: 3411

SEQ ID NO: 85458 - DNA, 201 bp, Bos taurus; identical to SEQ ID NO: 3412

SEQ ID NO: 85459 - DNA, 201 bp, Bos taurus; identical to SEQ ID NO: 3413

SEQ ID NO: 85460 - DNA, 201 bp, Bos taurus; identical to SEQ ID NO: 3414

SEQ ID NO: 85461 - DNA, 201 bp, Bos taurus; identical to SEQ ID NO: 3415

SEQ ID NO: 85462 - DNA, 201 bp, Bos taurus
ttatcatttaccattttttaaagaggtggtggctaccctcatcttctctcaccccagagtgagcaaaacggtgatgggggcccaataaggagcaaagaactaacaaaagaacgaggactggcaggggcgccctcggcgctgagctccaggaagcccctctggccgcagcacaaagggctgggaggcagagatgctgagaca

SEQ ID NO: 85463 - DNA, 201 bp, Bos taurus
ttggttctcccttgagctggcccactgttctaatcgcgtttcccactctaatacactttatttatttctaaaaaaaaaaaaaagaggcaggacctggctgtgggccctagagaaagaggacgacctgggtagagtatggcagccttgctggggctagaagactagagaaagtttcaggaagaaaggcagaatgcaggaaaa

SEQ ID NO: 85464 - DNA, 201 bp, Bos taurus; identical to SEQ ID NO: 3417

SEQ ID NO: 85465 - DNA, 201 bp, Bos taurus
gatgggggaaacgaactaaagcagagagggcgtgcgtggccgtggcaccatcctgctgaccctgcaggatctggagtgggaaatcagggtctgactcttcggcagtgatgctatactgggccccgggcaggtggttctccaccaggggtccctgccgcctcagcctatcctgacgggctggcagtggagccctcagccctc

SEQ ID NO: 85466 - DNA, 201 bp, Bos taurus; identical to SEQ ID NO: 3418

SEQ ID NO: 85467 - DNA, 201 bp, Bos taurus; identical to SEQ ID NO: 3419

SEQ ID NO: 85468 - DNA, 201 bp, Bos taurus; identical to SEQ ID NO: 3420

SEQ ID NO: 85469 - DNA, 201 bp, Bos taurus; identical to SEQ ID NO: 3423

SEQ ID NO: 85470 - DNA, 201 bp, Bos taurus; identical to SEQ ID NO: 3424

SEQ ID NO: 85471 - DNA, 201 bp, Bos taurus; identical to SEQ ID NO: 3425

SEQ ID NO: 85472 - DNA, 201 bp, Bos taurus; identical to SEQ ID NO: 3426

SEQ ID NO: 85473 - DNA, 201 bp, Bos taurus; identical to SEQ ID NO: 3429

SEQ ID NO: 85474 - DNA, 201 bp, Bos taurus
ggggggaggcggggttgcagagagaaggagctgcagccagccaacattggagttgaggtctcagagttgtcaaagtgtggcccaagaatccacacttcgaatcacctaagtttcatgttaaaggcagattcctgtgtcccatgtgacatttacaaagcagaatctttgaaggttagtgtggtctgaccttgagggccggag

SEQ ID NO: 85475 - DNA, 201 bp, Bos taurus
acaatgtcatattcacatgtactttttatataaaacttgagatgaatgaactcaagctatgtgtaataacatgcattgtcatagtcttttatatccatctgaatttagaatataataatgggaatagttcaaatgacagggaaaggagttatttgaacaataaattgtttaaaattggttttaaatttaaaaaaaaagaaa

SEQ ID NO: 85476 - DNA, 201 bp, Bos taurus
aaagggaaaattcccaagatgctaacctttttgaaactgaggttgcttccacggtcccaaggaacttctcctctgttcctctccagatgagagaaggccgggtattgtggttactgatgggcactggattcccaccactgggatttttcagacattgtccagaggtcaaggctgatgcaacttggccaggtattaatctga

SEQ ID NO: 85477 - DNA, 201 bp, Bos taurus; identical to SEQ ID NO: 3430

SEQ ID NO: 85478 - DNA, 201 bp, Bos taurus
ctctttatttggagatcttagataggaaattaagtttcatttgataagcttcaaaaactccctctaattaggcagtatgatttccatcaattctattaatttttcatggcacatagacaaaaaccctaaacatagaaggaaataaaaccatattagagcaacagaaggggttgactaggtgcagaaggtcattagagaaaa

SEQ ID NO: 85479 - DNA, 201 bp, Bos taurus; identical to SEQ ID NO: 3431

SEQ ID NO: 85480 - DNA, 201 bp, Bos taurus
aacttaaatttcatataattttcacatgtcacagcatcttatttttcttcagccatttagagatgtccaaactgtccttaagatacataggccttcattcacagagcctggttagagatgatttgtaacagaggctgccatgcttgccagaaattaggaggtggccttgaacttgacactaacatatccctgctctctttt

SEQ ID NO: 85481 - DNA, 201 bp, Bos taurus; identical to SEQ ID NO: 3433

SEQ ID NO: 85482 - DNA, 201 bp, Bos taurus; identical to SEQ ID NO: 3434

SEQ ID NO: 85483 - DNA, 201 bp, Bos taurus; identical to SEQ ID NO: 3437

SEQ ID NO: 85484 - DNA, 201 bp, Bos taurus
tttgacatggataccataccacaagcctggtatcttaggatggccctagtatgaagatgaatgtagtattcttaagccaatggactttaatgatttctggacccactgacaaaatcaaagtcatcatcttatggagtagacatagcaagatatcttggtttggcactccattgaatgtttaatgcatccaacatggttttt

SEQ ID NO: 85485 - DNA, 201 bp, Bos taurus; identical to SEQ ID NO: 3439

SEQ ID NO: 85486 - DNA, 201 bp, Bos taurus; identical to SEQ ID NO: 3440

SEQ ID NO: 85487 - DNA, 201 bp, Bos taurus; identical to SEQ ID NO: 3441

SEQ ID NO: 85488 - DNA, 201 bp, Bos taurus; identical to SEQ ID NO: 3442

SEQ ID NO: 85489 - DNA, 201 bp, Bos taurus
aacaaaaaatattaaagaattcaggaaaaaaaatattaaattgagttaaaaagaataatttaaaaaagaaaaagaaaaaattggagaatatcattatatagcccaagaaatgaattagaattaactagaaataatgaagcattttggtgacattgccaattatgagccatatataacataaggagttaccattggggaaac

SEQ ID NO: 85490 - DNA, 201 bp, Bos taurus; identical to SEQ ID NO: 3443

SEQ ID NO: 85491 - DNA, 201 bp, Bos taurus; identical to SEQ ID NO: 3444

SEQ ID NO: 85492 - DNA, 201 bp, Bos taurus
taaattaaacatgaccttattcatgaatattattgaatattttctaaggcactgctatctgttaattttaaaaacaggtaaaaatggggactgtcctgaccgcaatgatggaaggtccatcaataacatgaaaaaaggagattttgtggatcatactgtcatgagtttgttaactaaggatgcttgaaaaatagaggagaa

SEQ ID NO: 85493 - DNA, 201 bp, Bos taurus
tccaggttctgtaggatgattgatgtgtctgtgctgaggaaacagggaacactcaatggaggggaaagaaataaacaagtctggccagcacactgtgatttggcagaaaactagtagaaagctctctgaagggatgcatttaagttttattttaaaatttactgataaaattttcaggcccagagctgaggggaaaaactt

SEQ ID NO: 85494 - DNA, 201 bp, Bos taurus; identical to SEQ ID NO: 3445

SEQ ID NO: 85495 - DNA, 201 bp, Bos taurus; identical to SEQ ID NO: 3446

SEQ ID NO: 85496 - DNA, 201 bp, Bos taurus; identical to SEQ ID NO: 3447

SEQ ID NO: 85497 - DNA, 201 bp, Bos taurus; identical to SEQ ID NO: 3448

SEQ ID NO: 85498 - DNA, 201 bp, Bos taurus; identical to SEQ ID NO: 3449

SEQ ID NO: 85499 - DNA, 201 bp, Bos taurus
ggagctaaatatttttggaggataaattgtctctggttctttatttcaaaaactgctttgtattcatataatatactttttttttttttttaagcaaggacacttttagatgaagcaggatttggtaatcacagagtctttagcatcagacaaagccaaatccgaactctagttctttccttgactgtgtgaccttcgagc

SEQ ID NO: 85500 - DNA, 201 bp, Bos taurus
tgagaaagctaaaaacgcaagatatatttccccttaatttcaaaacatgaatagatgtcatgtaacttctgtgacattctctcttataacttagattttcgttaattcatcaagaagaagagagaaagtttacttaacagagttaatttttttgcttcaaatttattcatacatgtagacaccccatatgtacttttaaaa

SEQ ID NO: 85501 - DNA, 201 bp, Bos taurus; identical to SEQ ID NO: 3453

SEQ ID NO: 85502 - DNA, 201 bp, Bos taurus; identical to SEQ ID NO: 3454

SEQ ID NO: 85503 - DNA, 201 bp, Bos taurus; identical to SEQ ID NO: 3455

SEQ ID NO: 85504 - DNA, 201 bp, Bos taurus; identical to SEQ ID NO: 3456

SEQ ID NO: 85505 - DNA, 201 bp, Bos taurus; identical to SEQ ID NO: 3457

SEQ ID NO: 85506 - DNA, 201 bp, Bos taurus; identical to SEQ ID NO: 3458

SEQ ID NO: 85507 - DNA, 201 bp, Bos taurus; identical to SEQ ID NO: 3460

SEQ ID NO: 85508 - DNA, 201 bp, Bos taurus; identical to SEQ ID NO: 3461

SEQ ID NO: 85509 - DNA, 201 bp, Bos taurus; identical to SEQ ID NO: 3462

SEQ ID NO: 85510 - DNA, 201 bp, Bos taurus; identical to SEQ ID NO: 3463

SEQ ID NO: 85511 - DNA, 201 bp, Bos taurus; identical to SEQ ID NO: 3464

SEQ ID NO: 85512 - DNA, 201 bp, Bos taurus; identical to SEQ ID NO: 3465

SEQ ID NO: 85513 - DNA, 201 bp, Bos taurus; identical to SEQ ID NO: 3466

SEQ ID NO: 85514 - DNA, 201 bp, Bos taurus; identical to SEQ ID NO: 3467

SEQ ID NO: 85515 - DNA, 201 bp, Bos taurus; identical to SEQ ID NO: 3468

SEQ ID NO: 85516 - DNA, 201 bp, Bos taurus
agactctttctgcctaggtgtgaagtcatggatcattttctagacaagaatgagagttcctgagattccataatttttaagatgaaatgcatgcttgtctattaaatcagggggaaaaagaggcctgggattctcttcttatagtgttccttctttgaataataaaaatatgactctgtattcttacagaatacctgagaa

SEQ ID NO: 85517 - DNA, 201 bp, Bos taurus; identical to SEQ ID NO: 3471

SEQ ID NO: 85518 - DNA, 201 bp, Bos taurus; identical to SEQ ID NO: 3472

SEQ ID NO: 85519 - DNA, 201 bp, Bos taurus; identical to SEQ ID NO: 3473

SEQ ID NO: 85520 - DNA, 201 bp, Bos taurus; identical to SEQ ID NO: 3474

SEQ ID NO: 85521 - DNA, 201 bp, Bos taurus; identical to SEQ ID NO: 3477

SEQ ID NO: 85522 - DNA, 201 bp, Bos taurus; identical to SEQ ID NO: 3478

SEQ ID NO: 85523 - DNA, 201 bp, Bos taurus; identical to SEQ ID NO: 3479

SEQ ID NO: 85524 - DNA, 201 bp, Bos taurus; identical to SEQ ID NO: 3480

SEQ ID NO: 85525 - DNA, 201 bp, Bos taurus; identical to SEQ ID NO: 3481

SEQ ID NO: 85526 - DNA, 201 bp, Bos taurus; identical to SEQ ID NO: 3482

SEQ ID NO: 85527 - DNA, 201 bp, Bos taurus; identical to SEQ ID NO: 3483

SEQ ID NO: 85528 - DNA, 201 bp, Bos taurus; identical to SEQ ID NO: 3484

SEQ ID NO: 85529 - DNA, 201 bp, Bos taurus; identical to SEQ ID NO: 3485

SEQ ID NO: 85530 - DNA, 201 bp, Bos taurus; identical to SEQ ID NO: 3486

SEQ ID NO: 85531 - DNA, 201 bp, Bos taurus
taacatcatatataatactattcattcattcattcattcattacactaacatctttgcctaccgtgagtaacaagtgcattgggctatctgcaatccaccattgattcaacagcatctgtggaacattatcattcactcatatttatttgaatattttatttttctcaaatcatgaggagggtcatgatagattcaccaga

SEQ ID NO: 85532 - DNA, 201 bp, Bos taurus; identical to SEQ ID NO: 3488

SEQ ID NO: 85533 - DNA, 201 bp, Bos taurus; identical to SEQ ID NO: 3489

SEQ ID NO: 85534 - DNA, 201 bp, Bos taurus; identical to SEQ ID NO: 3490

SEQ ID NO: 85535 - DNA, 201 bp, Bos taurus
agtccctcttccagtgacctgtttgtttgcaggctgagcatagcctgggggcctctttctggtgatcttgggctcaatggccagttgacttgcatctgtaatatttccccttgttggtcttatccccagatgaatagttggattttcttggccccgttgggttgtcctgaagtcacaaagcatggcggatagcaatggcta

SEQ ID NO: 85536 - DNA, 201 bp, Bos taurus; identical to SEQ ID NO: 3491

SEQ ID NO: 85537 - DNA, 201 bp, Bos taurus
tacctaaattgtattatttacttctcacaagaactcaatgtgctaaaaaattatttccattcgatagactagaataataaaactgggaaacattaaaaaatttttttaagttatccttggtcacaaagctaggaagaggatttcattcagtactcatgttctctttatttcaacattatgttctgatggcacagaggagat

SEQ ID NO: 85538 - DNA, 201 bp, Bos taurus
atcttggttcctttgtgtctgatgacacagtggtcagaggagtgaatcccggctgccatttcggaatatactttggccaagctactgaactgcttggactcccccatagttagaaagcccactaactcaattggagcatcacctctcttggccacaccaaaacctggctcacaccaccaccaccttttggagaaacgagtt

SEQ ID NO: 85539 - DNA, 201 bp, Bos taurus; identical to SEQ ID NO: 3493

SEQ ID NO: 85540 - DNA, 201 bp, Bos taurus; identical to SEQ ID NO: 3494

SEQ ID NO: 85541 - DNA, 201 bp, Bos taurus
ggttgtttctattttgtaacagttcttatgttcagaaggattatgcagatatttcctggatgaattatttaattcagttaaccagttttgctgaatttcctaaggaagacatttccaactttggaacaattgtgcagaaatcgtatataggtcagataggctcttaacatactatgttgagctacacacaaatgaaaaaaa

SEQ ID NO: 85542 - DNA, 201 bp, Bos taurus; identical to SEQ ID NO: 3495

SEQ ID NO: 85543 - DNA, 201 bp, Bos taurus
atgtatatattatctaacttaacccttaaaatagcttatagccttgtgaggttgtctttattattgttattgtgagaaagagtatttaatatctctgaaaacttagatgattctatgatggtcaaaatattactaggagacagagctagggtataaatttaagattttaaattccgaaatccatgcctttggggaaacatt

SEQ ID NO: 85544 - DNA, 201 bp, Bos taurus; identical to SEQ ID NO: 3496

SEQ ID NO: 85545 - DNA, 201 bp, Bos taurus; identical to SEQ ID NO: 3497

SEQ ID NO: 85546 - DNA, 201 bp, Bos taurus; identical to SEQ ID NO: 3498

SEQ ID NO: 85547 - DNA, 201 bp, Bos taurus; identical to SEQ ID NO: 3499

SEQ ID NO: 85548 - DNA, 201 bp, Bos taurus; identical to SEQ ID NO: 3500

SEQ ID NO: 85549 - DNA, 201 bp, Bos taurus; identical to SEQ ID NO: 3501

SEQ ID NO: 85550 - DNA, 201 bp, Bos taurus; identical to SEQ ID NO: 3503

SEQ ID NO: 85551 - DNA, 201 bp, Bos taurus
ccctataaggaaaatgcccaccccacctccccccttctgtttcacctctcctttgatgacatattcacatcagcatttctttggtgcttttgctcttatagtaggtaaaggcccaagaccttggaaagtttataatccttttcagaattagacattcaagtactcataaaatatactggcagacacaatctttctcaggtt

SEQ ID NO: 85552 - DNA, 201 bp, Bos taurus; identical to SEQ ID NO: 3504

SEQ ID NO: 85553 - DNA, 201 bp, Bos taurus; identical to SEQ ID NO: 3505

SEQ ID NO: 85554 - DNA, 201 bp, Bos taurus; identical to SEQ ID NO: 3509

SEQ ID NO: 85555 - DNA, 201 bp, Bos taurus
agatgaaagaggagggcagtgagttagtttgtcagagaaaccctgagaaaagactttgaaggagagtgaaggttgttagctctaattcataaggacctgggaatccagagagttctaaagactggcttggtgtggtgtttaatcaagaggaaaatgccatgataagaggcaggaaggacagactacaggaggtggtgccga

SEQ ID NO: 85556 - DNA, 201 bp, Bos taurus
cagaagaccaacttccctggaccacaagcttctgagcataagaaccatgacttctatggttctggggctggattcatttcccagcacgggccaggcatcagtatattagtgcttgaataaatgaccccacataacctctttcaaacctatgaaattatttcccatttataaaaatttccagagacaccagacatgaagacg

SEQ ID NO: 85557 - DNA, 201 bp, Bos taurus
tttggagatctttaaagacatcaaaggattttaaagagattaaagggtctcttagttaaaatgaggtcattagggtgggccttaatcctgtagacctagtgtcctcataggaagaagacacagacacagaaggaagcagaaggaggaccacgtgaagatataagaagaagaaggcatctcccagccaaggagagaggcctc

SEQ ID NO: 85558 - DNA, 201 bp, Bos taurus; identical to SEQ ID NO: 3510

SEQ ID NO: 85559 - DNA, 201 bp, Bos taurus; identical to SEQ ID NO: 3511

SEQ ID NO: 85560 - DNA, 201 bp, Bos taurus; identical to SEQ ID NO: 3512

SEQ ID NO: 85561 - DNA, 201 bp, Bos taurus
aggctcaccttgggtggtctgttgtccacccccttgcggtgctgtgtgtaggcatccggagcttttgcacctccagtggtggcaagtctgtggcctctttttatcttgtccatacatgcagttacttggagtcccttatagtttctttgtattctattgtttagaggccgtttgtccacctgcgagcactcagatagaggg

SEQ ID NO: 85562 - DNA, 201 bp, Bos taurus; identical to SEQ ID NO: 3513

SEQ ID NO: 85563 - DNA, 201 bp, Bos taurus; identical to SEQ ID NO: 3514

SEQ ID NO: 85564 - DNA, 201 bp, Bos taurus
tcacggccatcttcctagcctgttggcattttccaccagccctatagtagtgatggtggccagcagcagtgcccaggactgggctgcccaccactctccctgccctgagagggagcgttctctatttggccagcctaagagtaggaaatgacaggaccttggatgcaggagagggagtgtaaatggtgtggtaatttgaaa

SEQ ID NO: 85565 - DNA, 201 bp, Bos taurus; identical to SEQ ID NO: 3515

SEQ ID NO: 85566 - DNA, 201 bp, Bos taurus
ctcttgctttcctccccttcccttcctccctcccctcgcactcactcagcccaggtcatttttccagactgactcccagatcaccagccttctccagctccctggggcctgcccagccccctcttcctcctcagcctcaagtcagggcactgctcttagatctgtagtttcttagatctgtgggtggatgttttttcacca

SEQ ID NO: 85567 - DNA, 201 bp, Bos taurus
ctccccatgagtcagctgcttccaccatgccgaatttcttgtggtttccataaggcaccacgtgtttagatgctgcaaggatgttgcacatccttcactcaattcaaatatcttttcttgtgttttctacctgttgttctcacattgctctcaagatacttgtccttattgatggagctcttccaggctaccagtgtgccc

SEQ ID NO: 85568 - DNA, 201 bp, Bos taurus; identical to SEQ ID NO: 3519

SEQ ID NO: 85569 - DNA, 201 bp, Bos taurus; identical to SEQ ID NO: 3523

SEQ ID NO: 85570 - DNA, 201 bp, Bos taurus
gtaaaagccctgttgcttgtttattaagttatgcaacaaatggctaagactgttagatataaagtatgaggtaagaattccatccaggtcttttgagatttcaagattcagaacaagggatccaaggggttggggaaaaagagatctggactgaggcaggagaggaaagaggctgacattgggactggagagagaagagga

SEQ ID NO: 85571 - DNA, 201 bp, Bos taurus; identical to SEQ ID NO: 3524

SEQ ID NO: 85572 - DNA, 201 bp, Bos taurus; identical to SEQ ID NO: 3525

SEQ ID NO: 85573 - DNA, 201 bp, Bos taurus
agcttaaaactcatttcaagtctcctccgtgtaaccctgttacaacttgtccccacagaagcagtcagtagggctccaatagccagcagtggccaggatggtaagattgcatctcctacactgctgtcattcccttgggattctctgcacactccctctgacagcaggccccctggggaaacaccaacacgcccccacctg

SEQ ID NO: 85574 - DNA, 201 bp, Bos taurus; identical to SEQ ID NO: 3528

SEQ ID NO: 85575 - DNA, 201 bp, Bos taurus; identical to SEQ ID NO: 3529

SEQ ID NO: 85576 - DNA, 201 bp, Bos taurus; identical to SEQ ID NO: 3531

SEQ ID NO: 85577 - DNA, 201 bp, Bos taurus; identical to SEQ ID NO: 3533

SEQ ID NO: 85578 - DNA, 201 bp, Bos taurus; identical to SEQ ID NO: 3534

SEQ ID NO: 85579 - DNA, 201 bp, Bos taurus; identical to SEQ ID NO: 3537

SEQ ID NO: 85580 - DNA, 201 bp, Bos taurus; identical to SEQ ID NO: 3538

SEQ ID NO: 85581 - DNA, 201 bp, Bos taurus; identical to SEQ ID NO: 3539

SEQ ID NO: 85582 - DNA, 201 bp, Bos taurus; identical to SEQ ID NO: 3540

SEQ ID NO: 85583 - DNA, 201 bp, Bos taurus
tggaagacagtcttggcctgggccggagtgaggcccagggtcaggtgtgttttccatgcctagattcctcccagtgtgatactcttttggggcaggccctccagacagatggctctgggcaggtcaatggtcaaagcaaggctcacacatccttcataaggatgctgcctcatgggctcactgcagactctcagatcccca

SEQ ID NO: 85584 - DNA, 201 bp, Bos taurus; identical to SEQ ID NO: 3542

SEQ ID NO: 85585 - DNA, 201 bp, Bos taurus; identical to SEQ ID NO: 3543

SEQ ID NO: 85586 - DNA, 201 bp, Bos taurus; identical to SEQ ID NO: 3544

SEQ ID NO: 85587 - DNA, 201 bp, Bos taurus; identical to SEQ ID NO: 3545

SEQ ID NO: 85588 - DNA, 201 bp, Bos taurus
aagattctttaccatctgggccacctgggaagccctacaatccacatataaggataacctattcagaatatagataaattcagtgtatctattcacattcagaaaacaatgtattggccagtgcattgttttcagtttcagaaaagttagtaaaatagcacataaaagtaaaatacaagtaggctacaaaagtcactatct

SEQ ID NO: 85589 - DNA, 201 bp, Bos taurus; identical to SEQ ID NO: 3548

SEQ ID NO: 85590 - DNA, 201 bp, Bos taurus
gatattaataatgatgaatcattaatttgtaatgaatcattatggagttacattaagacctgcggagtcttctccaacaagtggaaatgtatgaatagatttttcaaaaagcatcacagatgggcatataggaaattatattaagtatatggttgtatgggacctttgtcttattaaatattattttgaaataactaaatc

SEQ ID NO: 85591 - DNA, 201 bp, Bos taurus; identical to SEQ ID NO: 3549

SEQ ID NO: 85592 - DNA, 201 bp, Bos taurus; identical to SEQ ID NO: 3552

SEQ ID NO: 85593 - DNA, 201 bp, Bos taurus; identical to SEQ ID NO: 3553

SEQ ID NO: 85594 - DNA, 201 bp, Bos taurus; identical to SEQ ID NO: 3554

SEQ ID NO: 85595 - DNA, 201 bp, Bos taurus; identical to SEQ ID NO: 3555

SEQ ID NO: 85596 - DNA, 201 bp, Bos taurus; identical to SEQ ID NO: 3556

SEQ ID NO: 85597 - DNA, 201 bp, Bos taurus; identical to SEQ ID NO: 3557

SEQ ID NO: 85598 - DNA, 201 bp, Bos taurus
ttggctgacctgccccctgaaatagctatgattatccccataatggagtcaagccactgaggcccaaagggctactgaggggcagggttggacttggccccagttttccttatgcctcacttgctgctctgtggacagcgttgcggtagtgtggtcatacctgatgacaatggcagtgctgctatgatgaagccagttacc

SEQ ID NO: 85599 - DNA, 201 bp, Bos taurus
atttgtctttctctttttgatttacttcacttagtatgacaatctttaggcccatccatgttgctgcaaatggcatactttcattcctttttatgactcaagagtattccaccgtaatatatgcaccacatctttattcatctgttggtggacatttcggctgtttccatgtcttggctactgtaaacagtgaacagaggg

SEQ ID NO: 85600 - DNA, 201 bp, Bos taurus
agctgattctcatatctgcttccacattcaatttattttgacatactcttttggctgaaatatatgaagaaaaatttggcctcctgaagatatgtagtttcaacaagtaaaaaaaattttaagtctttttagttgattatggatattcttcttgacattataataaatatccatgcagcatgattctgtaatctcctgaac

SEQ ID NO: 85601 - DNA, 201 bp, Bos taurus
ctccaatattcttgcctggagaatcccatggactgagaagcctggcgggctaccgtccgtagggtggaaaaagttggacacgactgaagtgactgagcatgcaaacacgcacgcaggcatcgtgttggcaacttaccttaaatgtttctggaaaaatcatactgtattttcaacttctctttaagtttaagatagtttcaa

SEQ ID NO: 85602 - DNA, 201 bp, Bos taurus
gcttatattcggttgaagaagatacacaaactggccaaaatttaaataaaaatcagtcagatatatttttgaggatgcacagaaccctttgggagcacagcagagtggcctttcaactgtcctcctggaatactccaggggtgggctgtgttgttggtgatgagaggttatgctggggagaaaaagctatagattgaattg

SEQ ID NO: 85603 - DNA, 201 bp, Bos taurus; identical to SEQ ID NO: 3559

SEQ ID NO: 85604 - DNA, 201 bp, Bos taurus; identical to SEQ ID NO: 3560

SEQ ID NO: 85605 - DNA, 201 bp, Bos taurus; identical to SEQ ID NO: 3561

SEQ ID NO: 85606 - DNA, 201 bp, Bos taurus; identical to SEQ ID NO: 3562

SEQ ID NO: 85607 - DNA, 201 bp, Bos taurus
ttccaaagaagagcttggtgaccaacggctgcagcatattttctttccaggcactgggcaaacaacaaaattaatcaaacttttttcccggtctcaccctccacacaacctaggtggccaaaacttccctgcctccctctattgtcaaaaatgcatactggtcagctcatcccagtgcttgacccaaaggagtcacatgaa

SEQ ID NO: 85608 - DNA, 201 bp, Bos taurus
tgttctctttgagtcatctgcattcatgagctccccagcatcctcgtggtgggaggcgtctctggcagagagcggaggcctcagaggctccacagagatggcatcttcgcatcagcacccaaacagcttgcaaggctggcttgggcttctgagcctcgctaccacactcccagctctctctctgtgagcgcgcacccgccc

SEQ ID NO: 85609 - DNA, 201 bp, Bos taurus; identical to SEQ ID NO: 3564

SEQ ID NO: 85610 - DNA, 201 bp, Bos taurus; identical to SEQ ID NO: 3565

SEQ ID NO: 85611 - DNA, 201 bp, Bos taurus
catatttgggtaaatctactttggactttctactttgtttcattgatttatgtatcttttccttcactgacacgacattgtctagatacttttaactttataaaaggccttaaaatcatatggtgtaatttctccaaccttattcttttccaaaagtgccttagttattcttatttatttaattcctaccataaatgttag

SEQ ID NO: 85612 - DNA, 201 bp, Bos taurus; identical to SEQ ID NO: 3566

SEQ ID NO: 85613 - DNA, 201 bp, Bos taurus
gctactcttgctgttcccacagacccatccaaacctttcaagggtgatgtgtgtatctaacttagagggcttaatgggatctataacctgaaatgcttcagcctgctgcagtgtccacttagtagctcagaatgcttgttctatggtatccaaccattcggggccacccactttcttgtaagtgagtatataaggggcaca

SEQ ID NO: 85614 - DNA, 201 bp, Bos taurus; identical to SEQ ID NO: 3568

SEQ ID NO: 85615 - DNA, 201 bp, Bos taurus; identical to SEQ ID NO: 3569

SEQ ID NO: 85616 - DNA, 201 bp, Bos taurus; identical to SEQ ID NO: 3570

SEQ ID NO: 85617 - DNA, 201 bp, Bos taurus; identical to SEQ ID NO: 3572

SEQ ID NO: 85618 - DNA, 201 bp, Bos taurus
gccctgggaccagggttagagtctcagatgttgcccaggcaacaggaaggaagctggggaaagtcagcccttgtggatgctgtttgggaagcagattgagcagggccagggtggaaagaggggggcaagggccatcctctcagccaatcctatgcaagcaggctggcagtatgtggggctttgcctccctgagtctcaaga

SEQ ID NO: 85619 - DNA, 201 bp, Bos taurus; identical to SEQ ID NO: 3573

SEQ ID NO: 85620 - DNA, 201 bp, Bos taurus
atccaatcttgccataaatacagaggaatgtgctgaggctgtgagtagttactcacactgctgggcaggcaaggtcaccattaaaacagagaggaacccagaggcccctagcatggtcaacaccgtcagaatggctgagcctgatgggatccagttcctggatggcaccgtcattggcaacaggacatcagtatgagaact

SEQ ID NO: 85621 - DNA, 201 bp, Bos taurus; identical to SEQ ID NO: 3576

SEQ ID NO: 85622 - DNA, 201 bp, Bos taurus; identical to SEQ ID NO: 3577

SEQ ID NO: 85623 - DNA, 201 bp, Bos taurus; identical to SEQ ID NO: 3578

SEQ ID NO: 85624 - DNA, 201 bp, Bos taurus; identical to SEQ ID NO: 3579

SEQ ID NO: 85625 - DNA, 201 bp, Bos taurus; identical to SEQ ID NO: 3581

SEQ ID NO: 85626 - DNA, 201 bp, Bos taurus; identical to SEQ ID NO: 3582

SEQ ID NO: 85627 - DNA, 201 bp, Bos taurus
gttggtgtgcctgggagtctgagtgggctgagaacaatgaatctagtcctgtccacagagaccccagaccaacttcagggcctcatgcacacacctgagcgggcattagcccctgatgctgctttgctggtggctcccaggtgtgcctacagggaggaggccagcatgaacttgaagccaactacttacttcatcatgtag

SEQ ID NO: 85628 - DNA, 201 bp, Bos taurus; identical to SEQ ID NO: 3583

SEQ ID NO: 85629 - DNA, 201 bp, Bos taurus; identical to SEQ ID NO: 3584

SEQ ID NO: 85630 - DNA, 201 bp, Bos taurus; identical to SEQ ID NO: 3585

SEQ ID NO: 85631 - DNA, 201 bp, Bos taurus; identical to SEQ ID NO: 3586

SEQ ID NO: 85632 - DNA, 201 bp, Bos taurus; identical to SEQ ID NO: 3587

SEQ ID NO: 85633 - DNA, 201 bp, Bos taurus; identical to SEQ ID NO: 3588

SEQ ID NO: 85634 - DNA, 201 bp, Bos taurus; identical to SEQ ID NO: 3589

SEQ ID NO: 85635 - DNA, 201 bp, Bos taurus; identical to SEQ ID NO: 3590

SEQ ID NO: 85636 - DNA, 201 bp, Bos taurus; identical to SEQ ID NO: 3591

SEQ ID NO: 85637 - DNA, 201 bp, Bos taurus; identical to SEQ ID NO: 3592

SEQ ID NO: 85638 - DNA, 201 bp, Bos taurus; identical to SEQ ID NO: 3593

SEQ ID NO: 85639 - DNA, 201 bp, Bos taurus
cagggagagagtcaccccccgtggtagtttgaatcacttttatgaggcatttcttccaggtttcctttggtcaatcatcttgctggcctggtcctgagttcgtatttgatgtctctgtggatcctcatccacatcttttagccaagacggattgtagtgaagaggcctatgggtagttgacatcacttactatgaggtgac

SEQ ID NO: 85640 - DNA, 201 bp, Bos taurus
taagtcagtcacacagtaaatcactgtgacttgaaggtgtctgtcgcttggaaatgaggctctttttcggaaacatagtctggccaggaaaagatatcctgcaggttcaagagcttcaggctgctctgctgaggtgaccttttggggttaagaggatacagtgggctaggaccctttgggggcagtgacagaggagtcccc

SEQ ID NO: 85641 - DNA, 201 bp, Bos taurus; identical to SEQ ID NO: 3595

SEQ ID NO: 85642 - DNA, 201 bp, Bos taurus; identical to SEQ ID NO: 3596

SEQ ID NO: 85643 - DNA, 201 bp, Bos taurus; identical to SEQ ID NO: 3597

SEQ ID NO: 85644 - DNA, 201 bp, Bos taurus; identical to SEQ ID NO: 3599

SEQ ID NO: 85645 - DNA, 201 bp, Bos taurus
acaaagcaattaattcaccccaggacatggcactttaaaagcatgaagatgatgcagaaacatgacatgctaacaatgagtgtttctatttgtatcaataacttgctgagcctttaaggggaattactgacccaagaacagggattactatattttctttgtcaagcccttaactattatttgtttttaagagatgaaagc

SEQ ID NO: 85646 - DNA, 201 bp, Bos taurus; identical to SEQ ID NO: 3600

SEQ ID NO: 85647 - DNA, 201 bp, Bos taurus; identical to SEQ ID NO: 3601

SEQ ID NO: 85648 - DNA, 201 bp, Bos taurus; identical to SEQ ID NO: 3602

SEQ ID NO: 85649 - DNA, 201 bp, Bos taurus; identical to SEQ ID NO: 3603

SEQ ID NO: 85650 - DNA, 201 bp, Bos taurus; identical to SEQ ID NO: 3604

SEQ ID NO: 85651 - DNA, 201 bp, Bos taurus; identical to SEQ ID NO: 3605

SEQ ID NO: 85652 - DNA, 201 bp, Bos taurus
aaattatgaataaaacccatttatctcaacctgatatatgatgtatgagaaatagaatattgagctattgatataaaatctttcttttccctttttaatcatcacaaaagcccatgacatggccagacacctctgtatctggagaagggaagaagctgcaggtagtagataaatggctcaggaaagttattataaaaataa

SEQ ID NO: 85653 - DNA, 201 bp, Bos taurus
ttacattctggtggacagctctgttttctacaagagagaggaatatgtaatcattacatccaagagtctgaattgcagcaatgctatgcctgcttcatagatgtattgttttatggccagatgcgttttaatatttcttatcattggcttataaaggattcccattttgaaaagtgttgatacctagcctaattaaatgac

SEQ ID NO: 85654 - DNA, 201 bp, Bos taurus; identical to SEQ ID NO: 3607

SEQ ID NO: 85655 - DNA, 201 bp, Bos taurus; identical to SEQ ID NO: 3608

SEQ ID NO: 85656 - DNA, 201 bp, Bos taurus
tgtgtttatttaccaagcctctgacattaattgaaggtagtaatacattaagtgctcagaacagctggctcttgtggttggccttttgattcaaattcttagttgctaactaagcaatctttcagcatactcaattgttaaataaccaacaatggactcttgtatttctgattaggccatttcaagctgtatattaaaatt

SEQ ID NO: 85657 - DNA, 201 bp, Bos taurus
attgggagatatggagagaactctgagcagagaagcagtaaagtacatacaatgccccaagcccttagctttgactgggcatagatggttggctgacaccatagccaagtttccagtagagcggagcctgcacttttaagctttatgtcatgatgtggttggctgacaccatagccaagtttccagtagagcagagcctgc

SEQ ID NO: 85658 - DNA, 201 bp, Bos taurus; identical to SEQ ID NO: 3610

SEQ ID NO: 85659 - DNA, 201 bp, Bos taurus; identical to SEQ ID NO: 3611

SEQ ID NO: 85660 - DNA, 201 bp, Bos taurus
aagcttgcaactcatcataaattttccagaaatctatccttctcacctggtttccttacctgggaattttacaaagtgaacagaaaaacatcacactttacatttgagaagtttgacggatccttgaaaacataatttgtcctcttttaacaatacatatctcactataatgcagtgtgagactacctagagtggttccgg

SEQ ID NO: 85661 - DNA, 201 bp, Bos taurus; identical to SEQ ID NO: 3612

SEQ ID NO: 85662 - DNA, 201 bp, Bos taurus; identical to SEQ ID NO: 3613

SEQ ID NO: 85663 - DNA, 201 bp, Bos taurus; identical to SEQ ID NO: 3617

SEQ ID NO: 85664 - DNA, 201 bp, Bos taurus
gtggcctattaattggtccatcttcccgtatgggcagctccacagaatacagacagtatgaactcagcatcagaagactttaattagagttcatggtttaccactggccatatcattcaccttaaaacctaaataaagaaacaaacaatcggccaaccagaagtatagaaatggtatagaatttaaagactcaagagacag

SEQ ID NO: 85665 - DNA, 201 bp, Bos taurus; identical to SEQ ID NO: 3618

SEQ ID NO: 85666 - DNA, 201 bp, Bos taurus
aatttaacctccacgtggaggaggcccccagcagctccaggcctgcccatcctggttttaagaggatgactttttctcagtagtcctggtgagttcgagggctggctctgattggcccagcttggatcatatgctcatccatgagccaatcactgtggccaggggtgcccagcgcgcccattggtcagctctgtgtcacat

SEQ ID NO: 85667 - DNA, 201 bp, Bos taurus
aagctacccaagtggcccctgaacgaagagttgggaagagagatacaggagcacccaggacataatatttccaccctacagagaaaataaatgtaagtgatctcaaggccatcaataataacaacatgtagtaaaataatcaggaagtgacgtgtcttgagtgtacatgacctttgtttttaatagaatgtatttaatcag

SEQ ID NO: 85668 - DNA, 201 bp, Bos taurus
accagggaagcccatttagaaaaattggtattattctggatgaacactagacttcattttaaatgaattctggacattttaaataatcaatccacacttatgtgttgaagggctgcccgctgggaagattcaagaaaacatagtgcagtcatcgccagcctgcagcacatcttctgcataaagggtttctatgccctggtg

SEQ ID NO: 85669 - DNA, 201 bp, Bos taurus; identical to SEQ ID NO: 3621

SEQ ID NO: 85670 - DNA, 201 bp, Bos taurus; identical to SEQ ID NO: 3622

SEQ ID NO: 85671 - DNA, 201 bp, Bos taurus; identical to SEQ ID NO: 3625

SEQ ID NO: 85672 - DNA, 201 bp, Bos taurus; identical to SEQ ID NO: 3626

SEQ ID NO: 85673 - DNA, 201 bp, Bos taurus; identical to SEQ ID NO: 3627

SEQ ID NO: 85674 - DNA, 201 bp, Bos taurus; identical to SEQ ID NO: 3629

SEQ ID NO: 85675 - DNA, 201 bp, Bos taurus; identical to SEQ ID NO: 3630

SEQ ID NO: 85676 - DNA, 201 bp, Bos taurus
tcggggatggccacggccaggggaaccgctccttggtccagccctggagtaggcgctggggggaggtctcaccaatgtagtctttcaagggcactgtctcgctcttctttagaaggcctaagacgacgagctcttcaaacagggagtccataggcctggcagagggtggcacaggggggcgcccaggacaaagggaaaggg

SEQ ID NO: 85677 - DNA, 201 bp, Bos taurus
tgcatacttcatcctgcccagtggggtcccggcctgggtgcctggagataggggttctgtttgggacaattagtgccgttgtcccctgcgagctttacttctgcatcatcagcagggaagatagaaacagtttagtcacgccatttgcccctgtagagaggaagggaattataaatgtattatagacctataatgaaaaat

SEQ ID NO: 85678 - DNA, 201 bp, Bos taurus
gaggagcctgcacctcgatcctggacttccggcctccagagctatgagagagcagtttccattatcctagccccgaacctactgattttgctcccagttcacaccaggccccgcttcttcctgaaccctttcctcacgggtcactgggagtttgaatgaggtgacgcagggactatggttctgcgtgtgtgattgctgctg

SEQ ID NO: 85679 - DNA, 201 bp, Bos taurus; identical to SEQ ID NO: 3632

SEQ ID NO: 85680 - DNA, 201 bp, Bos taurus
cgtgggtgctgcggggatggggggcagccaggagcaggggccgcccttgcaggctctgtgacatgaaccacgaagcccagtctggcctccgtctgcaatcacctcccccaccatgtgccaggtgcatggtgaacacagacccctccacgtagacaggaaagcagagcccaaggcgacggagcctcagcctccagaccatca

SEQ ID NO: 85681 - DNA, 201 bp, Bos taurus; identical to SEQ ID NO: 3633

SEQ ID NO: 85682 - DNA, 201 bp, Bos taurus; identical to SEQ ID NO: 3634

SEQ ID NO: 85683 - DNA, 201 bp, Bos taurus
ataaattgaaaaatggacaaaggatgtggatatgcaacgcagttcagcaagaaacacaaatggaaaacccgaaaggctgcagccgaggcgacagcatcagtctgtgcttaacaggcggcaagagtataaaaggtcctaacacttcaagtgggaaacaagaaaaaggctcacactctgctggagaagagcacacagttatag

SEQ ID NO: 85684 - DNA, 201 bp, Bos taurus; identical to SEQ ID NO: 3635

SEQ ID NO: 85685 - DNA, 201 bp, Bos taurus; identical to SEQ ID NO: 3640

SEQ ID NO: 85686 - DNA, 201 bp, Bos taurus
gaatcccccatccttcagacccctctggttctgtccccagcgtgagcccttccccaggtactccatcagctctaagtccatagtcacttcccttagcattcggtgaccgtctccggtgtgagctttggctccgtgcctatgttctaggcttcttgagagcaggggtgatgtttatgccactctgcatctccacggtgttgt

SEQ ID NO: 85687 - DNA, 201 bp, Bos taurus
gatcagatccccttaagtaacttgcttaaggtgtcactgccgagccggatttgaacctgggcagtctagccccagggcctggactctgatctgctgccccctgatgtatgatcaccgtaagctaacaataataacaagctagacaagggtcatgacatcacatgggcaaacgcaggtcacgacggcatacgggaaccggcc

SEQ ID NO: 85688 - DNA, 201 bp, Bos taurus
aaagttcactgagggtagacatacccccccagttgaaatgtgtgatcatttagatgtggtcacagtagcttgtccatggtacgaatgaagagcaggttcatgaagagggtcagttgtataaaactattgtaaactgagttcttgtttgactccaaggttctctctggccctaaaattctggggatgcggacttccctggtg

SEQ ID NO: 85689 - DNA, 201 bp, Bos taurus; identical to SEQ ID NO: 3646

SEQ ID NO: 85690 - DNA, 201 bp, Bos taurus; identical to SEQ ID NO: 3647

SEQ ID NO: 85691 - DNA, 201 bp, Bos taurus; identical to SEQ ID NO: 3649

SEQ ID NO: 85692 - DNA, 201 bp, Bos taurus; identical to SEQ ID NO: 3650

SEQ ID NO: 85693 - DNA, 201 bp, Bos taurus
ctctgtccgctggtttaatagttgaactcatttagtcctggccatgtgctgtgagccgtctactgtgtgttcattcaacagccggaacctggaatcggcagcttacatatggccagcaagtgaaacagacctgggatttgcgcacaagaaattattctgaccttgaagctcattcctctaactgatatgtagctcttcatt

SEQ ID NO: 85694 - DNA, 201 bp, Bos taurus
ttagctccacttccctctgggtgtttgtttcactctctctcaccgtgaaaagacatattctatgggaccaggtagatcagtaatccctgggccttccagcgccagaacccagtggcaggaaaccattaacttcataactctgtcagggagacgctgagggatgacctggaccgaacccacaccgagtgtcgccgaggccag

SEQ ID NO: 85695 - DNA, 201 bp, Bos taurus; identical to SEQ ID NO: 3654

SEQ ID NO: 85696 - DNA, 201 bp, Bos taurus; identical to SEQ ID NO: 3655

SEQ ID NO: 85697 - DNA, 201 bp, Bos taurus; identical to SEQ ID NO: 3656

SEQ ID NO: 85698 - DNA, 201 bp, Bos taurus
cagggcccgatggggcggcaccagcttcttcttcttcaggaccgtgttcagccagtgtgccgtgatgcacctcttcctctccttcatcgcctgtgaacataatagagcgggccggtcgctgggggctttaccgcaggcaacacacagagctgtgaggctgtaaactacaaggtcacttctgctggaagtcctatcaataca

SEQ ID NO: 85699 - DNA, 201 bp, Bos taurus; identical to SEQ ID NO: 3657

SEQ ID NO: 85700 - DNA, 201 bp, Bos taurus
tcccctcggtggagtggtcctggctgggccggactgggcaggcgagttgtagagccgcatgaaaataaagatatactttgtcccaaactcctcccgtccccaccccggaggctgaggccctctcactgtctggctgagcagctgatttcatttcgggagggagtaccccggcactgttctcaaacctctcatgcttcagtg

SEQ ID NO: 85701 - DNA, 201 bp, Bos taurus; identical to SEQ ID NO: 3658

SEQ ID NO: 85702 - DNA, 201 bp, Bos taurus; identical to SEQ ID NO: 3659

SEQ ID NO: 85703 - DNA, 201 bp, Bos taurus; identical to SEQ ID NO: 3660

SEQ ID NO: 85704 - DNA, 201 bp, Bos taurus
tctgagcgctcgagctgctgagctgggaaagtccgtctcgtgcggtctccactgaaacagcgggcttgctctccctgtttcagggaaaaggccagcaggaccatctccttggctctgaaaccgctctgtgacttgccccctttcttccctctatgcccggcaccttccttgcctcctggatttctgtcctgtggggccctt

SEQ ID NO: 85705 - DNA, 201 bp, Bos taurus; identical to SEQ ID NO: 3661

SEQ ID NO: 85706 - DNA, 201 bp, Bos taurus; identical to SEQ ID NO: 3663

SEQ ID NO: 85707 - DNA, 201 bp, Bos taurus; identical to SEQ ID NO: 3665

SEQ ID NO: 85708 - DNA, 201 bp, Bos taurus; identical to SEQ ID NO: 3666

SEQ ID NO: 85709 - DNA, 201 bp, Bos taurus; identical to SEQ ID NO: 3667

SEQ ID NO: 85710 - DNA, 201 bp, Bos taurus; identical to SEQ ID NO: 3668

SEQ ID NO: 85711 - DNA, 201 bp, Bos taurus; identical to SEQ ID NO: 3671

SEQ ID NO: 85712 - DNA, 201 bp, Bos taurus; identical to SEQ ID NO: 3672

SEQ ID NO: 85713 - DNA, 201 bp, Bos taurus; identical to SEQ ID NO: 3673

SEQ ID NO: 85714 - DNA, 201 bp, Bos taurus
ccccaccccgagccctcctttcctgtccaccttctgcagttaaaacaggcacaacttttgcaaagatgctcttctccacagtgtcaccacgtcacacagctctccagtcggcctctctccgctagacttcgttgacacccgtaccttgcagagccaaaaaggaggtttccttctgaaatgagaggcctgtcgccatgccta

SEQ ID NO: 85715 - DNA, 201 bp, Bos taurus; identical to SEQ ID NO: 3674

SEQ ID NO: 85716 - DNA, 201 bp, Bos taurus; identical to SEQ ID NO: 3675

SEQ ID NO: 85717 - DNA, 201 bp, Bos taurus; identical to SEQ ID NO: 3676

SEQ ID NO: 85718 - DNA, 201 bp, Bos taurus; identical to SEQ ID NO: 3677

SEQ ID NO: 85719 - DNA, 201 bp, Bos taurus; identical to SEQ ID NO: 3678

SEQ ID NO: 85720 - DNA, 201 bp, Bos taurus; identical to SEQ ID NO: 3679

SEQ ID NO: 85721 - DNA, 201 bp, Bos taurus; identical to SEQ ID NO: 3680

SEQ ID NO: 85722 - DNA, 201 bp, Bos taurus
cagggtgtgtccgggctgggagccggcggggctggggggtgggcgagccaagatgagggctggacccgggggaggccagcggttctgcagagggtgggggtgcgggacctgacccccacacggctggaaccgccgagaacagcatcacatcgtccctgtggtccagaccgaggccaggaccaagctctgaagcatctgagc

SEQ ID NO: 85723 - DNA, 201 bp, Bos taurus
caatggcaacgttgaagtaaacacatgagcgccgggaaggcacgggggtggggactgcccacgccttcctcctggagggcccctccctgttcacactgccgcaccgtgcagtaagaggagtagaaacaggaacggttgcacgctaaccacacgcatagcagaggctgctcggaggtcggtaatgggccgccagtcttcagt

SEQ ID NO: 85724 - DNA, 201 bp, Bos taurus
cggtctctgctgcagggcaactgtctcggctttcaggcctgttggccgagttgcgcttgtggaatgcagtgccctccggcttctcatctatcagataaaatgaccagagctggacaggcccgcacgcctggaggatcacagaaaattatttcacctctctgggcctcgtcaacagagcaagggacttggctctgctgggtt

SEQ ID NO: 85725 - DNA, 201 bp, Bos taurus; identical to SEQ ID NO: 3683

SEQ ID NO: 85726 - DNA, 201 bp, Bos taurus
tatctatcattcatcttctatgctgcaaattattgtaattttcaagcattataatcatttcatcttatgtattatgactgtttgtcttccctgtggcttaatgatactgaatttgcctaccaaggcaaaagacatgagttaagtccctgaattgagaagattccctggagaaggaaataacaaccgaccccagtattcctg

SEQ ID NO: 85727 - DNA, 201 bp, Bos taurus
caaggtgagaccggcctccttttgaggggcaatggcagggtggggattcctttcccgaagaagcaggggaaccgaccctcatcttgaatagaggaggggggaaacggggcccttcttgagttgtggcatgaaactcggcattcctctctagtggggacgtgtatctcggggaccttcctgagttgcataaagggtgtcaag

SEQ ID NO: 85728 - DNA, 201 bp, Bos taurus; identical to SEQ ID NO: 3685

SEQ ID NO: 85729 - DNA, 201 bp, Bos taurus; identical to SEQ ID NO: 3686

SEQ ID NO: 85730 - DNA, 201 bp, Bos taurus
ctggggctgagggagctggggacatgtggcaggcagtgtgactccacgatgaacctggagggcctgttgccctccagacacaggctggataattgaagggattggaattaacatatacacattaatatatatcaaatagatgatcaaaaagtacttactgaataacatagggaagtttattgaacaccatagaaaagaaat

SEQ ID NO: 85731 - DNA, 201 bp, Bos taurus; identical to SEQ ID NO: 3688

SEQ ID NO: 85732 - DNA, 201 bp, Bos taurus
agaaaaggacaagttatcaagaatgtcaatgatagtaagaatctactttgaagatactctttgggaggtagtgttttagctgatgtgaagaaataaggagtcagtcatacaaagagttgacggggggattattcaggaaaaggaaaggtattttacttctttcacaagatagctacatataaagcactcagcacaagactg

SEQ ID NO: 85733 - DNA, 201 bp, Bos taurus
acaggatagatcaaataattttttttgagaaatgtttcattgtgggctacagttaggcaataagaatccagccagtcacccacattcattggcatgcgctatgccctttccaaagccatttgtttgcttttatgaaagcagactgaaaattaaacacaaggaatattaaattattattaatgaggacatttgcgggacact

SEQ ID NO: 85734 - DNA, 201 bp, Bos taurus
tttacaactttctaacattattattaaatggtagaaactttttgagacctcttgttgacactttaatttttcattcaagggtgttttcatcaagtctgaattcacatatggcattttcttcctaaataattttgaaaatgacatgtttaccttctcttttgacttgtagtaaaggcctaaaatgtccataaatgagggata

SEQ ID NO: 85735 - DNA, 201 bp, Bos taurus; identical to SEQ ID NO: 3689

SEQ ID NO: 85736 - DNA, 201 bp, Bos taurus; identical to SEQ ID NO: 3690

SEQ ID NO: 85737 - DNA, 201 bp, Bos taurus; identical to SEQ ID NO: 3693

SEQ ID NO: 85738 - DNA, 201 bp, Bos taurus; identical to SEQ ID NO: 3695

SEQ ID NO: 85739 - DNA, 201 bp, Bos taurus; identical to SEQ ID NO: 3696

SEQ ID NO: 85740 - DNA, 201 bp, Bos taurus; identical to SEQ ID NO: 3697

SEQ ID NO: 85741 - DNA, 201 bp, Bos taurus; identical to SEQ ID NO: 3698

SEQ ID NO: 85742 - DNA, 201 bp, Bos taurus; identical to SEQ ID NO: 3699

SEQ ID NO: 85743 - DNA, 201 bp, Bos taurus
gtcagttatacattgcctgctggtagctgacagctcttctgggacatgccagactgttctacatgcagttgtcacttgggatcccagctcaggaggcagccgcactgggggacgtgccttttttttggtgcagtagagagtaacagtcagctggtggaagtatatgctgactcttgatgctttggctctgcactggggcct

SEQ ID NO: 85744 - DNA, 201 bp, Bos taurus; identical to SEQ ID NO: 3700

SEQ ID NO: 85745 - DNA, 201 bp, Bos taurus; identical to SEQ ID NO: 3701

SEQ ID NO: 85746 - DNA, 201 bp, Bos taurus; identical to SEQ ID NO: 3702

SEQ ID NO: 85747 - DNA, 201 bp, Bos taurus; identical to SEQ ID NO: 3703

SEQ ID NO: 85748 - DNA, 201 bp, Bos taurus
tgggagagcaggttgatgtttttcattaacaccaggtactatgccataataaggaatgccaactctcagctgacaacaaaattatgtttaaaatagagacctaactgtatctttccacaaacttgttggcatgtaagcaaaggcatttagctcaggtttacttagagtcctatgactatacagttctatgagggggtcaaa

SEQ ID NO: 85749 - DNA, 201 bp, Bos taurus
atctgtaacatgaacataaccaaaaaggaaaactgggaaccaagaggacaaccaaagactaattcattaattttccaattattaatcatccttaaccaggtcactatatgcattaaaagacattagaacacaacttatttctaaaccaggaatgactgtttcagtccataacactttatgggactttttttttttttttcc

SEQ ID NO: 85750 - DNA, 201 bp, Bos taurus
tctgcaagcttccccagctcttcctcttttaaatagatccctcttttcagcctccactttctctgtttactgtctactacatacaggctatcaaatgaatatagcattgctattttgtcctcttcggcacatttgtgcatactggatggtttctggtgtgggatatgtattgattcactagcacttgcagtcatttctgta

SEQ ID NO: 85751 - DNA, 201 bp, Bos taurus; identical to SEQ ID NO: 3704

SEQ ID NO: 85752 - DNA, 201 bp, Bos taurus; identical to SEQ ID NO: 3705

SEQ ID NO: 85753 - DNA, 201 bp, Bos taurus; identical to SEQ ID NO: 3708

SEQ ID NO: 85754 - DNA, 201 bp, Bos taurus; identical to SEQ ID NO: 3709

SEQ ID NO: 85755 - DNA, 201 bp, Bos taurus; identical to SEQ ID NO: 3710

SEQ ID NO: 85756 - DNA, 201 bp, Bos taurus; identical to SEQ ID NO: 3711

SEQ ID NO: 85757 - DNA, 201 bp, Bos taurus
gctgtttagaaagctctcaggttactaagtttctattttggggggcataaactaatttataaattaaaatataatgatgctatataatgcacatttgaaagtatgtggttttcattttcttttggccaacgcgtctccacttacaaattaacttcctattaaatctgcttttgctaatggtttattttattaatcagtatt

SEQ ID NO: 85758 - DNA, 201 bp, Bos taurus; identical to SEQ ID NO: 3712

SEQ ID NO: 85759 - DNA, 201 bp, Bos taurus
tgcaatatgccatctttgctttaaaacaactttttttttttttcctgaagagtatgattcagagaatggtactcagtgccagaaatcatttgaggggatatttattattaatattggcaggtactattgcccagttaaaaaaatttcttacaaactactcattaattaaaacttatacagaatttccttttcataaaaagt

SEQ ID NO: 85760 - DNA, 201 bp, Bos taurus; identical to SEQ ID NO: 3714

SEQ ID NO: 85761 - DNA, 201 bp, Bos taurus; identical to SEQ ID NO: 3715

SEQ ID NO: 85762 - DNA, 201 bp, Bos taurus; identical to SEQ ID NO: 3716

SEQ ID NO: 85763 - DNA, 201 bp, Bos taurus; identical to SEQ ID NO: 3717

SEQ ID NO: 85764 - DNA, 201 bp, Bos taurus
tatgtttgaccagaagagaatctcactgcacagaattatttcaagggtacatgccacttgcacgttttaaaagaaagctttattataaaagccaataaatgtatttatagttgaatgcttgagacttgcttgggatgcagacaggctatcttccagagaaagacaaatgcttaaagtgcagaattatcacactaattttaa

SEQ ID NO: 85765 - DNA, 201 bp, Bos taurus
tccactcactgtttcatatggcctccacttcctactcctctgatcaaaaagaaagtgcttctttagagactgctcctttctcgaactgatatgcacttccgggcttcaggccatctttgatttgaggcttggagaaaaagaaaacaagactgaaacagaaaattcacccttgttgctggctaaaatcttggctttctctgc

SEQ ID NO: 85766 - DNA, 201 bp, Bos taurus; identical to SEQ ID NO: 3718

SEQ ID NO: 85767 - DNA, 201 bp, Bos taurus; identical to SEQ ID NO: 3719

SEQ ID NO: 85768 - DNA, 201 bp, Bos taurus; identical to SEQ ID NO: 3720

SEQ ID NO: 85769 - DNA, 201 bp, Bos taurus; identical to SEQ ID NO: 3721

SEQ ID NO: 85770 - DNA, 201 bp, Bos taurus; identical to SEQ ID NO: 3722

SEQ ID NO: 85771 - DNA, 201 bp, Bos taurus; identical to SEQ ID NO: 3723

SEQ ID NO: 85772 - DNA, 201 bp, Bos taurus; identical to SEQ ID NO: 3724

SEQ ID NO: 85773 - DNA, 201 bp, Bos taurus; identical to SEQ ID NO: 3726

SEQ ID NO: 85774 - DNA, 201 bp, Bos taurus; identical to SEQ ID NO: 3727

SEQ ID NO: 85775 - DNA, 201 bp, Bos taurus
atgggggctctctgtacaccacctgtttgtctaattctctacttaccaatctggagtagtttcccaaaactttttcagctgtagaatcttttaagaaatcgtatctgaaaatgtaacatgaaacaaagacactctggccgtgactggggagaaacctactcggggcgggttctgtcccactgtttggacagaggatggtgg

SEQ ID NO: 85776 - DNA, 201 bp, Bos taurus; identical to SEQ ID NO: 3728

SEQ ID NO: 85777 - DNA, 201 bp, Bos taurus; identical to SEQ ID NO: 3729

SEQ ID NO: 85778 - DNA, 201 bp, Bos taurus; identical to SEQ ID NO: 3730

SEQ ID NO: 85779 - DNA, 201 bp, Bos taurus; identical to SEQ ID NO: 3732

SEQ ID NO: 85780 - DNA, 201 bp, Bos taurus
agtaggtgcggccttggggaggtgcttccgtcctaaaggaaggctcagaaggggattactgccccaccataacagacccacagagatcccttgccccttccggcgtgtgaaggcccggtaagaaggcaccagcttcaaaccaggaagaggaccttcagaaagtcactctatgcagcagcttgatctttgacttcccagctc

SEQ ID NO: 85781 - DNA, 201 bp, Bos taurus; identical to SEQ ID NO: 3734

SEQ ID NO: 85782 - DNA, 201 bp, Bos taurus
tgaaatataagacatatattcaggaacacacttgttatgtgtgtctggtctcatatagtttcagaactgatcctagaaacgtcttaccaaggacagaggaactgcttcggttcatggaggaaactgatctaggtctccttttgtctgagccactctaatgaagctactctgtgttagtcacctgaggttatcccagcagtg

SEQ ID NO: 85783 - DNA, 201 bp, Bos taurus; identical to SEQ ID NO: 3735

SEQ ID NO: 85784 - DNA, 201 bp, Bos taurus
gcaaagagtcggacacaactgagcgacttcacttcactttgcactcatttgttaaaattataacatgcctttggtgagtagtaagttggatgatagagttgctatatatgctaaagtgggttttttatttaaaagaataggaatacaatgaaattctaaagttggaaagtatatagaataaaattctaattcttgatgaat

SEQ ID NO: 85785 - DNA, 201 bp, Bos taurus; identical to SEQ ID NO: 3736

SEQ ID NO: 85786 - DNA, 201 bp, Bos taurus
ccacctgagtactaatggtctaagaaatatcacttgggaaagattcacctacatggtttctatggagtttattacctggatttaccagataaaagggcacaaacaggtttgtagttcttgtacatgtcttccaatggattcaaacaacactatataaggaccttgactgcatttctgtgactgacaggttttgtcttgatt

SEQ ID NO: 85787 - DNA, 201 bp, Bos taurus; identical to SEQ ID NO: 3737

SEQ ID NO: 85788 - DNA, 201 bp, Bos taurus; identical to SEQ ID NO: 3738

SEQ ID NO: 85789 - DNA, 201 bp, Bos taurus; identical to SEQ ID NO: 3739

SEQ ID NO: 85790 - DNA, 201 bp, Bos taurus; identical to SEQ ID NO: 3740

SEQ ID NO: 85791 - DNA, 201 bp, Bos taurus; identical to SEQ ID NO: 3741

SEQ ID NO: 85792 - DNA, 201 bp, Bos taurus; identical to SEQ ID NO: 3742

SEQ ID NO: 85793 - DNA, 201 bp, Bos taurus; identical to SEQ ID NO: 3743

SEQ ID NO: 85794 - DNA, 201 bp, Bos taurus; identical to SEQ ID NO: 3744

SEQ ID NO: 85795 - DNA, 201 bp, Bos taurus; identical to SEQ ID NO: 3745

SEQ ID NO: 85796 - DNA, 201 bp, Bos taurus; identical to SEQ ID NO: 3746

SEQ ID NO: 85797 - DNA, 201 bp, Bos taurus
taggtgcttggagaccagtaatcaagacttgcaaatagatgggactctgcatgtcatgcgccaaagaactgtcgtgtccatcaacgtgaatcagtcaatacctgttcgatcaattcatgccttaaatttttgatgatcttctttttactgaactttcttgtggcttggaaccttttgtttactgtgatagaattaaatgat

SEQ ID NO: 85798 - DNA, 201 bp, Bos taurus; identical to SEQ ID NO: 3747

SEQ ID NO: 85799 - DNA, 201 bp, Bos taurus
ctgaggcttgatcccacctttgcgtatgtcgagcctccttcctcataacctttgccgtgggtggagtgcctcacgctggcccccaacagtacagggtgttatgagtgttagaaaggagaactaatatgtctgagattgagtagtgatcagctaaatgaaacaggtgggatgggctgagcattccaggcctaacgtgcagat

SEQ ID NO: 85800 - DNA, 201 bp, Bos taurus
ttggagtgctgttaaaatatttttttattgttacctgtctttgcttgatttttggatgtttttacatgtaattttatgtttaactacattttcctactctctgggttgcatttatattttcttctttgtacaatctgatgattttggtcatctcatgtgcacagatgactcattggaaaagtccctgattctgggaaagat

SEQ ID NO: 85801 - DNA, 201 bp, Bos taurus
tgtagtttatgcatgccatgctcacttaactgtcagatttatttttaaactttcaatttcctctcctatctccaggaagcatgtatttttatttttccacgcagtgtgttgtcctatttattattctggacatgggaataaaggcattcttggaaatgtctcgattatctttgccattctcttgttacatcctgtgatatc

SEQ ID NO: 85802 - DNA, 201 bp, Bos taurus; identical to SEQ ID NO: 3748

SEQ ID NO: 85803 - DNA, 201 bp, Bos taurus; identical to SEQ ID NO: 3749

SEQ ID NO: 85804 - DNA, 201 bp, Bos taurus; identical to SEQ ID NO: 3750

SEQ ID NO: 85805 - DNA, 201 bp, Bos taurus; identical to SEQ ID NO: 3751

SEQ ID NO: 85806 - DNA, 201 bp, Bos taurus
ttctaaaactgtcaaatcatttattcacgatttgcttttgaacaagatttctttatccatctctaccactgaatctgcagatctctcaaaatgcaagcaaagtggcctccttttattttctaatacccggaaacactagctgcctttctccccagctgctttcctgcccatgtcccttttatgagaacaaacgttgccatt

SEQ ID NO: 85807 - DNA, 201 bp, Bos taurus; identical to SEQ ID NO: 3753

SEQ ID NO: 85808 - DNA, 201 bp, Bos taurus; identical to SEQ ID NO: 3754

SEQ ID NO: 85809 - DNA, 201 bp, Bos taurus; identical to SEQ ID NO: 3755

SEQ ID NO: 85810 - DNA, 201 bp, Bos taurus; identical to SEQ ID NO: 3756

SEQ ID NO: 85811 - DNA, 201 bp, Bos taurus
ggcttagttttgtggtccttcttttataagaaaaggaaaagtataaaatattaaattacatgctatttagaatattgtttatcacttatttttgctttctaattcctaggtggcttcacttgtagaaaaactcccgttaaatattagatgatttatcaaattcaaaaccagctggtcctactacctttaataattgtgtat

SEQ ID NO: 85812 - DNA, 201 bp, Bos taurus
cttataaaagtacatggcacatctcatgttcagtaagtattaataaccactgctgtgatggtggtcagcgttgttactactgagtcatgctgccatctctcggaccagtttctcatgatgcataaagttacacttagcagctttaagaatgtgtaagtaactgttagacaatctattttgacagatggacatctgaaataa

SEQ ID NO: 85813 - DNA, 201 bp, Bos taurus; identical to SEQ ID NO: 3757

SEQ ID NO: 85814 - DNA, 201 bp, Bos taurus; identical to SEQ ID NO: 3758

SEQ ID NO: 85815 - DNA, 201 bp, Bos taurus; identical to SEQ ID NO: 3759

SEQ ID NO: 85816 - DNA, 201 bp, Bos taurus; identical to SEQ ID NO: 3760

SEQ ID NO: 85817 - DNA, 201 bp, Bos taurus; identical to SEQ ID NO: 3761

SEQ ID NO: 85818 - DNA, 201 bp, Bos taurus; identical to SEQ ID NO: 3762

SEQ ID NO: 85819 - DNA, 201 bp, Bos taurus; identical to SEQ ID NO: 3763

SEQ ID NO: 85820 - DNA, 201 bp, Bos taurus
ccccattctcactgttcaaatactatgtcatctctgctaatcccgattctcttcaaaactgaacttaagctgatctaacatgcaaaacttagaaatgcattcagagcctactcatgacacctactcaggaaaagtcatgaagaatcacaagcaaattcacctattgtacctatttatatgttttactccctcatgccagga

SEQ ID NO: 85821 - DNA, 201 bp, Bos taurus
ttcttgcttggagaattctatggacagaggagcacccatggggtctcaaaaagttgcatatgactgagcaactaacacttttacttttactatatttcctcttggggagtacctatgtgaggaactgctgagtagtaatgtaatatttgttttctttgtataaaaaagattgtcaaacttttcctaaaaatgaccgtggta

SEQ ID NO: 85822 - DNA, 201 bp, Bos taurus; identical to SEQ ID NO: 3764

SEQ ID NO: 85823 - DNA, 201 bp, Bos taurus; identical to SEQ ID NO: 3765

SEQ ID NO: 85824 - DNA, 201 bp, Bos taurus; identical to SEQ ID NO: 3766

SEQ ID NO: 85825 - DNA, 201 bp, Bos taurus; identical to SEQ ID NO: 3767

SEQ ID NO: 85826 - DNA, 201 bp, Bos taurus; identical to SEQ ID NO: 3768

SEQ ID NO: 85827 - DNA, 201 bp, Bos taurus; identical to SEQ ID NO: 3769

SEQ ID NO: 85828 - DNA, 201 bp, Bos taurus; identical to SEQ ID NO: 3771

SEQ ID NO: 85829 - DNA, 201 bp, Bos taurus; identical to SEQ ID NO: 3772

SEQ ID NO: 85830 - DNA, 201 bp, Bos taurus; identical to SEQ ID NO: 3773

SEQ ID NO: 85831 - DNA, 201 bp, Bos taurus; identical to SEQ ID NO: 3774

SEQ ID NO: 85832 - DNA, 201 bp, Bos taurus; identical to SEQ ID NO: 3775

SEQ ID NO: 85833 - DNA, 201 bp, Bos taurus; identical to SEQ ID NO: 3776

SEQ ID NO: 85834 - DNA, 201 bp, Bos taurus; identical to SEQ ID NO: 3777

SEQ ID NO: 85835 - DNA, 201 bp, Bos taurus; identical to SEQ ID NO: 3778

SEQ ID NO: 85836 - DNA, 201 bp, Bos taurus; identical to SEQ ID NO: 3779

SEQ ID NO: 85837 - DNA, 201 bp, Bos taurus; identical to SEQ ID NO: 3780

SEQ ID NO: 85838 - DNA, 201 bp, Bos taurus; identical to SEQ ID NO: 3781

SEQ ID NO: 85839 - DNA, 201 bp, Bos taurus; identical to SEQ ID NO: 3782

SEQ ID NO: 85840 - DNA, 201 bp, Bos taurus
tttaatgttaatagatgttgttaaaacttcacattttatatatttatcaattttttatcttctgaagaagataaattatatccaggactgcttgactttgtaacataaaatttacactataggttgttatcaatatgtaaagaaaacagcaagaattgattttttcagtggttctcattccaaccaaacataatcagagaa

SEQ ID NO: 85841 - DNA, 201 bp, Bos taurus; identical to SEQ ID NO: 3783

SEQ ID NO: 85842 - DNA, 201 bp, Bos taurus
acacagaagctactgtttcaaacagaagacaattataggaaaatctcttaagactctgagataatttaaatattttggtttgtattatcgaaaactgaatgttaaaattatattgggattaaaactgggagtttgtttttctaatatgggaaaatgtaatttaatttaatttctccattaactgtaagaaaagactctatt

SEQ ID NO: 85843 - DNA, 201 bp, Bos taurus; identical to SEQ ID NO: 3784

SEQ ID NO: 85844 - DNA, 201 bp, Bos taurus
ggtccaacagatcttattgctatctccagctcctttggtttcattattgtccttcttagtgtgtggaacatgaatcactgggaactggcacctttggcctaatcttcttttcattgcctatgttagtaataaatagtctaaatctacaagtgactcattgtatctttatgaattggatcaatcaagccttgggcttggcct

SEQ ID NO: 85845 - DNA, 201 bp, Bos taurus
ttaaccgtctgagccaccaatcaaagagtttagtttactcaaaatctgcacccctcttgttataagaaacagaaataatggccaggtaaataggagatactgttattctctctactgtacagctctagagtacagttagctacttggcatttcactttttccttcattcacaggtctgtgccatgcctaccctctactcaa

SEQ ID NO: 85846 - DNA, 201 bp, Bos taurus; identical to SEQ ID NO: 3785

SEQ ID NO: 85847 - DNA, 201 bp, Bos taurus; identical to SEQ ID NO: 3786

SEQ ID NO: 85848 - DNA, 201 bp, Bos taurus; identical to SEQ ID NO: 3787

SEQ ID NO: 85849 - DNA, 201 bp, Bos taurus; identical to SEQ ID NO: 3789

SEQ ID NO: 85850 - DNA, 201 bp, Bos taurus; identical to SEQ ID NO: 3790

SEQ ID NO: 85851 - DNA, 201 bp, Bos taurus
ctttcaaatacatgtaggccaatattagaacttttgatttgaaatgcaatgggtaaatgttaaaggatttttacaaagaggcctgacctgatctggttcacgtgtaaccttggcggctgtgtaacaataggatggacgaagaccacaggcaaagccgagacaccagtaatgaggctatttcagtggccctggaaggagttt

SEQ ID NO: 85852 - DNA, 201 bp, Bos taurus; identical to SEQ ID NO: 3791

SEQ ID NO: 85853 - DNA, 201 bp, Bos taurus
taaaacattttaagcctgttggactagatacacaatttatccccaatatattagagcttgatgtggggtggagagaggccttcctaggcaatggttcttcgatgctctgccctatgactttgaattgcctagccagcttcaaaggaatggcctacacttgctctcattctctttgtattaatttaaatttcccctatggtt

SEQ ID NO: 85854 - DNA, 201 bp, Bos taurus; identical to SEQ ID NO: 3796

SEQ ID NO: 85855 - DNA, 201 bp, Bos taurus; identical to SEQ ID NO: 3797

SEQ ID NO: 85856 - DNA, 201 bp, Bos taurus; identical to SEQ ID NO: 3798

SEQ ID NO: 85857 - DNA, 201 bp, Bos taurus; identical to SEQ ID NO: 3799

SEQ ID NO: 85858 - DNA, 201 bp, Bos taurus; identical to SEQ ID NO: 3801

SEQ ID NO: 85859 - DNA, 201 bp, Bos taurus; identical to SEQ ID NO: 3805

SEQ ID NO: 85860 - DNA, 201 bp, Bos taurus; identical to SEQ ID NO: 3806

SEQ ID NO: 85861 - DNA, 201 bp, Bos taurus; identical to SEQ ID NO: 3807

SEQ ID NO: 85862 - DNA, 201 bp, Bos taurus; identical to SEQ ID NO: 3809

SEQ ID NO: 85863 - DNA, 201 bp, Bos taurus; identical to SEQ ID NO: 3811

SEQ ID NO: 85864 - DNA, 201 bp, Bos taurus; identical to SEQ ID NO: 3815

SEQ ID NO: 85865 - DNA, 201 bp, Bos taurus; identical to SEQ ID NO: 3816

SEQ ID NO: 85866 - DNA, 201 bp, Bos taurus
tttaaaaagactagaagagattgaacgtattttaaatggtgaatagcattactctttatcatgtgacagggtttcaaagaacttcagtctatatcatgtggttacttatactgagagctttgaaaatagtgagcatactaagagtctctcatgagctgcctctacgtagtatcaaaataagattttcattgaagacccttt

SEQ ID NO: 85867 - DNA, 201 bp, Bos taurus
ggaaaatctattgccctgtctccgaatagacaaaagaaggtttctctatgcccagaagaaattctcaggctataaatctggatattaattgaaggtgtcagaataaatatggatgaatcaaactattgaaagttgttaaaataggacaaaaaatgcttgtgtttgtatgcaagattattgattcaggtagcatttcatgca

SEQ ID NO: 85868 - DNA, 201 bp, Bos taurus; identical to SEQ ID NO: 3817

SEQ ID NO: 85869 - DNA, 201 bp, Bos taurus; identical to SEQ ID NO: 3818

SEQ ID NO: 85870 - DNA, 201 bp, Bos taurus
tactggccctgagataacacaggtccctatccttgaggaattcagctttacagtaatacaattttagttgctaacttttattgatctcttattatgtatcagccactttgccaagggtattgcatatgttttcttttctttttttgattggtaagaagtggatttattcagatacagagagaagcacacttcacagacata

SEQ ID NO: 85871 - DNA, 201 bp, Bos taurus; identical to SEQ ID NO: 3821

SEQ ID NO: 85872 - DNA, 201 bp, Bos taurus
ctgcgcccaccgcggatatctccgggggcacctgaggtcgcggggtctccccaagctagacgccctgcacccacgggcctgcctgctgacgcccccgctctaatttgcatctttagtcacccgcctcttccctggtttggagaatgtaggcttaaaaaaaaaaaaaaaaaggcggctgctaggcccaggttgccaattttg

SEQ ID NO: 85873 - DNA, 201 bp, Bos taurus
gaaaacatttagtgccttcatctacggaagatacgtgcacgtcacatatttctaactcttcattttctttcaggttggtcaaagaataagcaatatatgccgtaaattaaatcaaaatccctgccatatgtcctgtatgtgctgttgctaattaaaataagtgtattcttgctgtggaaattctgtggtttgagagtttgt

SEQ ID NO: 85874 - DNA, 201 bp, Bos taurus
gcataaagtacaaaaggggccaggaaaatggagcttcaaggaggaatctgtaagagaggggagagaagacggatagagagtgtgctcagagcatggagagcgggcatgtgaccatgtaaggccagaattatcaaggagcaattaaggggcattacagcaacccactccagtactcttgcctggaggatcccatggacggag

SEQ ID NO: 85875 - DNA, 201 bp, Bos taurus
ttaagtgcaaacactaaataacttttaccacggagcaaaaacatctttagattgtttatcaagaccttctggtagatcttgagtctctttaaatggccctaagacaccaacaactctagattttcttctcagttggatataacaccagttatctccttaagcaaatttgaaaaagggcctgtcactacactgtacaaatga

SEQ ID NO: 85876 - DNA, 201 bp, Bos taurus
aaaagccaggaacatggttgactggtccctgggtagtatggagggaaattttgcatctggttaagagttaaaaatataaacaaaaaaacatggctgctatatgatccacaactggatggaaggctagaagaggtcgctataacaaacacaatcacaatgaaaaagccccaaagattatgagacttaaaaaaatgtgacaca

SEQ ID NO: 85877 - DNA, 201 bp, Bos taurus; identical to SEQ ID NO: 3824

SEQ ID NO: 85878 - DNA, 201 bp, Bos taurus
ctcaatttgggaaaatctgctctcaagatcattcatgttattggcagaatttatttccttgtggctgtttaactgagggccctaaactttagctttcgtggtggctgaggaagtcctcaaatttgaaggctaactgcaggttggcgaggacaccagtggttaggaggcagcctgcagatcccggtcatgggcttcctcaac

SEQ ID NO: 85879 - DNA, 201 bp, Bos taurus; identical to SEQ ID NO: 3825

SEQ ID NO: 85880 - DNA, 201 bp, Bos taurus
tgaatattttgtccttccctcaggataacatgctgagatctcttccatatttttttaatacatttcttgacctgcccctagactttttggggttgattttcataatgaacatttttcttttatactttcttttgaacacttccagacaaatgaagaacttccagacaaatggaaaaacaaacaaacaaaaaaaacaaacct

SEQ ID NO: 85881 - DNA, 201 bp, Bos taurus; identical to SEQ ID NO: 3827

SEQ ID NO: 85882 - DNA, 201 bp, Bos taurus; identical to SEQ ID NO: 3828

SEQ ID NO: 85883 - DNA, 201 bp, Bos taurus; identical to SEQ ID NO: 3829

SEQ ID NO: 85884 - DNA, 201 bp, Bos taurus; identical to SEQ ID NO: 3830

SEQ ID NO: 85885 - DNA, 201 bp, Bos taurus; identical to SEQ ID NO: 3832

SEQ ID NO: 85886 - DNA, 201 bp, Bos taurus; identical to SEQ ID NO: 3834

SEQ ID NO: 85887 - DNA, 201 bp, Bos taurus; identical to SEQ ID NO: 3835

SEQ ID NO: 85888 - DNA, 201 bp, Bos taurus
cttctgcagtttcagtatcctcagtttttctaatagttactcaaataccctggatcccaagctcctcaccagctctctcctagtgatccagcccagtaccgcagcatcttaaccaagtaggatgagtccagtagattggacccttccatgagtgtttcctaaaattcctaaaattcattgacttctgcttgctccatcacg

SEQ ID NO: 85889 - DNA, 201 bp, Bos taurus; identical to SEQ ID NO: 3837

SEQ ID NO: 85890 - DNA, 201 bp, Bos taurus; identical to SEQ ID NO: 3838

SEQ ID NO: 85891 - DNA, 201 bp, Bos taurus; identical to SEQ ID NO: 3839

SEQ ID NO: 85892 - DNA, 201 bp, Bos taurus
aacaggaagtacgtggtccttcagtacttttaccaaggcatgtgaactggtaggcacacttcagagtgtattctgaattgggatggaattccggcctaacgctcggctctccttaaatgaatccctgcagtcagcaagctggcaatttatgtgcactacccaagatacagagataaataaaacatagtgcctgccccagag

SEQ ID NO: 85893 - DNA, 201 bp, Bos taurus; identical to SEQ ID NO: 3840

SEQ ID NO: 85894 - DNA, 201 bp, Bos taurus; identical to SEQ ID NO: 3841

SEQ ID NO: 85895 - DNA, 201 bp, Bos taurus; identical to SEQ ID NO: 3842

SEQ ID NO: 85896 - DNA, 201 bp, Bos taurus; identical to SEQ ID NO: 3843

SEQ ID NO: 85897 - DNA, 201 bp, Bos taurus; identical to SEQ ID NO: 3844

SEQ ID NO: 85898 - DNA, 201 bp, Bos taurus; identical to SEQ ID NO: 3845

SEQ ID NO: 85899 - DNA, 201 bp, Bos taurus; identical to SEQ ID NO: 45407

SEQ ID NO: 85900 - DNA, 201 bp, Bos taurus; identical to SEQ ID NO: 3854

SEQ ID NO: 85901 - DNA, 201 bp, Bos taurus; identical to SEQ ID NO: 3855

SEQ ID NO: 85902 - DNA, 201 bp, Bos taurus; identical to SEQ ID NO: 3856

SEQ ID NO: 85903 - DNA, 201 bp, Bos taurus; identical to SEQ ID NO: 3857

SEQ ID NO: 85904 - DNA, 201 bp, Bos taurus; identical to SEQ ID NO: 3858

SEQ ID NO: 85905 - DNA, 201 bp, Bos taurus; identical to SEQ ID NO: 3861

SEQ ID NO: 85906 - DNA, 201 bp, Bos taurus; identical to SEQ ID NO: 3862

SEQ ID NO: 85907 - DNA, 201 bp, Bos taurus; identical to SEQ ID NO: 3864

SEQ ID NO: 85908 - DNA, 201 bp, Bos taurus; identical to SEQ ID NO: 3865

SEQ ID NO: 85909 - DNA, 201 bp, Bos taurus; identical to SEQ ID NO: 3867

SEQ ID NO: 85910 - DNA, 201 bp, Bos taurus; identical to SEQ ID NO: 3868

SEQ ID NO: 85911 - DNA, 201 bp, Bos taurus; identical to SEQ ID NO: 3869

SEQ ID NO: 85912 - DNA, 201 bp, Bos taurus; identical to SEQ ID NO: 3871

SEQ ID NO: 85913 - DNA, 201 bp, Bos taurus; identical to SEQ ID NO: 3872

SEQ ID NO: 85914 - DNA, 201 bp, Bos taurus; identical to SEQ ID NO: 3873

SEQ ID NO: 85915 - DNA, 201 bp, Bos taurus; identical to SEQ ID NO: 3875

SEQ ID NO: 85916 - DNA, 201 bp, Bos taurus; identical to SEQ ID NO: 3876

SEQ ID NO: 85917 - DNA, 201 bp, Bos taurus; identical to SEQ ID NO: 3877

SEQ ID NO: 85918 - DNA, 201 bp, Bos taurus; identical to SEQ ID NO: 3878

SEQ ID NO: 85919 - DNA, 201 bp, Bos taurus; identical to SEQ ID NO: 3880

SEQ ID NO: 85920 - DNA, 201 bp, Bos taurus; identical to SEQ ID NO: 3881

SEQ ID NO: 85921 - DNA, 201 bp, Bos taurus; identical to SEQ ID NO: 3882

SEQ ID NO: 85922 - DNA, 201 bp, Bos taurus; identical to SEQ ID NO: 3883

SEQ ID NO: 85923 - DNA, 201 bp, Bos taurus; identical to SEQ ID NO: 3885

SEQ ID NO: 85924 - DNA, 201 bp, Bos taurus; identical to SEQ ID NO: 3886

SEQ ID NO: 85925 - DNA, 201 bp, Bos taurus; identical to SEQ ID NO: 3887

SEQ ID NO: 85926 - DNA, 201 bp, Bos taurus; identical to SEQ ID NO: 3888

SEQ ID NO: 85927 - DNA, 201 bp, Bos taurus; identical to SEQ ID NO: 3889

SEQ ID NO: 85928 - DNA, 201 bp, Bos taurus; identical to SEQ ID NO: 3890

SEQ ID NO: 85929 - DNA, 201 bp, Bos taurus; identical to SEQ ID NO: 3891

SEQ ID NO: 85930 - DNA, 201 bp, Bos taurus; identical to SEQ ID NO: 3893

SEQ ID NO: 85931 - DNA, 201 bp, Bos taurus; identical to SEQ ID NO: 3898

SEQ ID NO: 85932 - DNA, 201 bp, Bos taurus; identical to SEQ ID NO: 3904

SEQ ID NO: 85933 - DNA, 201 bp, Bos taurus; identical to SEQ ID NO: 3905

SEQ ID NO: 85934 - DNA, 201 bp, Bos taurus; identical to SEQ ID NO: 3910

SEQ ID NO: 85935 - DNA, 201 bp, Bos taurus; identical to SEQ ID NO: 3913

SEQ ID NO: 85936 - DNA, 201 bp, Bos taurus; identical to SEQ ID NO: 3914

SEQ ID NO: 85937 - DNA, 201 bp, Bos taurus; identical to SEQ ID NO: 3917

SEQ ID NO: 85938 - DNA, 201 bp, Bos taurus; identical to SEQ ID NO: 3918

SEQ ID NO: 85939 - DNA, 201 bp, Bos taurus; identical to SEQ ID NO: 3919

SEQ ID NO: 85940 - DNA, 201 bp, Bos taurus; identical to SEQ ID NO: 3920

SEQ ID NO: 85941 - DNA, 201 bp, Bos taurus; identical to SEQ ID NO: 3921

SEQ ID NO: 85942 - DNA, 201 bp, Bos taurus; identical to SEQ ID NO: 3922

SEQ ID NO: 85943 - DNA, 201 bp, Bos taurus; identical to SEQ ID NO: 3923

SEQ ID NO: 85944 - DNA, 201 bp, Bos taurus; identical to SEQ ID NO: 3924

SEQ ID NO: 85945 - DNA, 201 bp, Bos taurus; identical to SEQ ID NO: 3925

SEQ ID NO: 85946 - DNA, 201 bp, Bos taurus; identical to SEQ ID NO: 3927

SEQ ID NO: 85947 - DNA, 201 bp, Bos taurus; identical to SEQ ID NO: 3928

SEQ ID NO: 85948 - DNA, 201 bp, Bos taurus; identical to SEQ ID NO: 3930

SEQ ID NO: 85949 - DNA, 201 bp, Bos taurus; identical to SEQ ID NO: 3931

SEQ ID NO: 85950 - DNA, 201 bp, Bos taurus; identical to SEQ ID NO: 3932

SEQ ID NO: 85951 - DNA, 201 bp, Bos taurus; identical to SEQ ID NO: 3933

SEQ ID NO: 85952 - DNA, 201 bp, Bos taurus; identical to SEQ ID NO: 3934

SEQ ID NO: 85953 - DNA, 201 bp, Bos taurus; identical to SEQ ID NO: 3935

SEQ ID NO: 85954 - DNA, 201 bp, Bos taurus; identical to SEQ ID NO: 3937

SEQ ID NO: 85955 - DNA, 201 bp, Bos taurus; identical to SEQ ID NO: 3940

SEQ ID NO: 85956 - DNA, 201 bp, Bos taurus; identical to SEQ ID NO: 3943

SEQ ID NO: 85957 - DNA, 201 bp, Bos taurus; identical to SEQ ID NO: 3944

SEQ ID NO: 85958 - DNA, 201 bp, Bos taurus; identical to SEQ ID NO: 3945

SEQ ID NO: 85959 - DNA, 201 bp, Bos taurus
agtttcttgtcacgttagggtgtccccctatagccataaaaggttgtttctctaattccaaagtaattctgtaatttgtcagaggccactgctactggtatgtcataggatcacagtcacacgtggtctgttgacttcctttcctctgtgcctgttcatacactgagctcacacacttgctgctaggcctctcatgacacc

SEQ ID NO: 85960 - DNA, 201 bp, Bos taurus; identical to SEQ ID NO: 3948

SEQ ID NO: 85961 - DNA, 201 bp, Bos taurus
cacacatacatgcacacagtcaaagaatacctaggaatcaaatttagaacagaaaaaacattctctgagtagcattttaaggagaagcatatgttttaggtgtgtgacatacattgaccacacaaatgatataactaaacgttttgttaattctggaaatttttgcctcaaatgacattatggggcatttgggattagcag

SEQ ID NO: 85962 - DNA, 201 bp, Bos taurus
agcatgttttttcttacttggccagcaaccgccatcttgttacaaaatcacattatttacagcaagaaaattattgaaatgggctggtgctctgacctccgttaacagtcacaggcttaggaaggcccatcaagttcttctctgctctcaggacaatgatgagatggtgtaagaacagacacagttcagaagactgcgtta

SEQ ID NO: 85963 - DNA, 201 bp, Bos taurus; identical to SEQ ID NO: 3950

SEQ ID NO: 85964 - DNA, 201 bp, Bos taurus; identical to SEQ ID NO: 3951

SEQ ID NO: 85965 - DNA, 201 bp, Bos taurus; identical to SEQ ID NO: 3952

SEQ ID NO: 85966 - DNA, 201 bp, Bos taurus; identical to SEQ ID NO: 3953

SEQ ID NO: 85967 - DNA, 201 bp, Bos taurus; identical to SEQ ID NO: 3954

SEQ ID NO: 85968 - DNA, 201 bp, Bos taurus; identical to SEQ ID NO: 3955

SEQ ID NO: 85969 - DNA, 201 bp, Bos taurus
tctgaatggcgcctggtcagtcattgttccaaccagtgtgggcagggagggccattttcctgtctcagcctacaaggactgatgagatggaatctttagtgtgtctctgtggcaaattttcttggccaaagtggaaagcaaaggcaattatccaagaatctgaggtaaatgtgtgtttttctgacccaaatacttgaaaaa

SEQ ID NO: 85970 - DNA, 201 bp, Bos taurus; identical to SEQ ID NO: 3956

SEQ ID NO: 85971 - DNA, 201 bp, Bos taurus; identical to SEQ ID NO: 3957

SEQ ID NO: 85972 - DNA, 201 bp, Bos taurus
tatctgtattttatttgccagatgatcaggttaagaaggtctgatacttggaagttgcttataaaatagcttagaaattatatagcaaattcttgaactaaaggaattttgtggtggctaaatgattgggtctatatataaagcttctttaaatactatactctgaaaatataactaacctcaattttaaatcaaagtgac

SEQ ID NO: 85973 - DNA, 201 bp, Bos taurus; identical to SEQ ID NO: 3958

SEQ ID NO: 85974 - DNA, 201 bp, Bos taurus; identical to SEQ ID NO: 3960

SEQ ID NO: 85975 - DNA, 201 bp, Bos taurus; identical to SEQ ID NO: 3962

SEQ ID NO: 85976 - DNA, 201 bp, Bos taurus; identical to SEQ ID NO: 3963

SEQ ID NO: 85977 - DNA, 201 bp, Bos taurus; identical to SEQ ID NO: 3964

SEQ ID NO: 85978 - DNA, 201 bp, Bos taurus; identical to SEQ ID NO: 3966

SEQ ID NO: 85979 - DNA, 201 bp, Bos taurus; identical to SEQ ID NO: 3969

SEQ ID NO: 85980 - DNA, 201 bp, Bos taurus; identical to SEQ ID NO: 3970

SEQ ID NO: 85981 - DNA, 201 bp, Bos taurus; identical to SEQ ID NO: 3971

SEQ ID NO: 85982 - DNA, 201 bp, Bos taurus; identical to SEQ ID NO: 3972

SEQ ID NO: 85983 - DNA, 201 bp, Bos taurus; identical to SEQ ID NO: 3973

SEQ ID NO: 85984 - DNA, 201 bp, Bos taurus; identical to SEQ ID NO: 3975

SEQ ID NO: 85985 - DNA, 201 bp, Bos taurus; identical to SEQ ID NO: 3976

SEQ ID NO: 85986 - DNA, 201 bp, Bos taurus; identical to SEQ ID NO: 3977

SEQ ID NO: 85987 - DNA, 201 bp, Bos taurus; identical to SEQ ID NO: 3978

SEQ ID NO: 85988 - DNA, 201 bp, Bos taurus; identical to SEQ ID NO: 3980

SEQ ID NO: 85989 - DNA, 201 bp, Bos taurus; identical to SEQ ID NO: 3982

SEQ ID NO: 85990 - DNA, 201 bp, Bos taurus; identical to SEQ ID NO: 3983

SEQ ID NO: 85991 - DNA, 201 bp, Bos taurus; identical to SEQ ID NO: 3984

SEQ ID NO: 85992 - DNA, 201 bp, Bos taurus; identical to SEQ ID NO: 3985

SEQ ID NO: 85993 - DNA, 201 bp, Bos taurus; identical to SEQ ID NO: 3986

SEQ ID NO: 85994 - DNA, 201 bp, Bos taurus; identical to SEQ ID NO: 3988

SEQ ID NO: 85995 - DNA, 201 bp, Bos taurus; identical to SEQ ID NO: 3989

SEQ ID NO: 85996 - DNA, 201 bp, Bos taurus; identical to SEQ ID NO: 3990

SEQ ID NO: 85997 - DNA, 201 bp, Bos taurus; identical to SEQ ID NO: 3991

SEQ ID NO: 85998 - DNA, 201 bp, Bos taurus; identical to SEQ ID NO: 3992

SEQ ID NO: 85999 - DNA, 201 bp, Bos taurus; identical to SEQ ID NO: 3993

SEQ ID NO: 86000 - DNA, 201 bp, Bos taurus; identical to SEQ ID NO: 3994

SEQ ID NO: 86001 - DNA, 201 bp, Bos taurus; identical to SEQ ID NO: 3995

SEQ ID NO: 86002 - DNA, 201 bp, Bos taurus; identical to SEQ ID NO: 3996

SEQ ID NO: 86003 - DNA, 201 bp, Bos taurus; identical to SEQ ID NO: 4000

SEQ ID NO: 86004 - DNA, 201 bp, Bos taurus
ggttaggaccctttgttttatcgttctctagaatggtggaaagtacagaaaggcaatatgatgagcaacgggagagaaacgttattacttttgatgattcgtaactacttgttcagggaggatccagtgttctccaaatgcagatcttctcaaaagggcttttcgcttgcttcaagaatctgaaagttgagaaatggctgt

SEQ ID NO: 86005 - DNA, 201 bp, Bos taurus; identical to SEQ ID NO: 4001

SEQ ID NO: 86006 - DNA, 201 bp, Bos taurus; identical to SEQ ID NO: 4002

SEQ ID NO: 86007 - DNA, 201 bp, Bos taurus; identical to SEQ ID NO: 4004

SEQ ID NO: 86008 - DNA, 201 bp, Bos taurus; identical to SEQ ID NO: 4005

SEQ ID NO: 86009 - DNA, 201 bp, Bos taurus; identical to SEQ ID NO: 4007

SEQ ID NO: 86010 - DNA, 201 bp, Bos taurus; identical to SEQ ID NO: 4008

SEQ ID NO: 86011 - DNA, 201 bp, Bos taurus; identical to SEQ ID NO: 4010

SEQ ID NO: 86012 - DNA, 201 bp, Bos taurus; identical to SEQ ID NO: 4011

SEQ ID NO: 86013 - DNA, 201 bp, Bos taurus; identical to SEQ ID NO: 4012

SEQ ID NO: 86014 - DNA, 201 bp, Bos taurus; identical to SEQ ID NO: 4013

SEQ ID NO: 86015 - DNA, 201 bp, Bos taurus; identical to SEQ ID NO: 4014

SEQ ID NO: 86016 - DNA, 201 bp, Bos taurus; identical to SEQ ID NO: 4015

SEQ ID NO: 86017 - DNA, 201 bp, Bos taurus; identical to SEQ ID NO: 4016

SEQ ID NO: 86018 - DNA, 201 bp, Bos taurus; identical to SEQ ID NO: 4017

SEQ ID NO: 86019 - DNA, 201 bp, Bos taurus; identical to SEQ ID NO: 4018

SEQ ID NO: 86020 - DNA, 201 bp, Bos taurus; identical to SEQ ID NO: 4019

SEQ ID NO: 86021 - DNA, 201 bp, Bos taurus; identical to SEQ ID NO: 4020

SEQ ID NO: 86022 - DNA, 201 bp, Bos taurus; identical to SEQ ID NO: 4021

SEQ ID NO: 86023 - DNA, 201 bp, Bos taurus; identical to SEQ ID NO: 4022

SEQ ID NO: 86024 - DNA, 201 bp, Bos taurus; identical to SEQ ID NO: 4023

SEQ ID NO: 86025 - DNA, 201 bp, Bos taurus; identical to SEQ ID NO: 4024

SEQ ID NO: 86026 - DNA, 201 bp, Bos taurus; identical to SEQ ID NO: 4025

SEQ ID NO: 86027 - DNA, 201 bp, Bos taurus; identical to SEQ ID NO: 4026

SEQ ID NO: 86028 - DNA, 201 bp, Bos taurus; identical to SEQ ID NO: 4027

SEQ ID NO: 86029 - DNA, 201 bp, Bos taurus; identical to SEQ ID NO: 4028

SEQ ID NO: 86030 - DNA, 201 bp, Bos taurus; identical to SEQ ID NO: 4029

SEQ ID NO: 86031 - DNA, 201 bp, Bos taurus
catgctggtgtaggcctgttttgagtctaatttagcaagctattagggaataatgtacttgcagatatccattgttataactgtcctattgcaacaactggctagcaggaaggcctaaacaaagattcattacaaatagactaatttattttagtaagtatcttactgtgtgaccccataatcattcagtttgacaagcca

SEQ ID NO: 86032 - DNA, 201 bp, Bos taurus; identical to SEQ ID NO: 4032

SEQ ID NO: 86033 - DNA, 201 bp, Bos taurus
tcctactcttttctctgcatgtctgggacttttacatggtaaataaactaccttatattctcaaactctccagagaatactctcttcttttccaagcttagctgaacttgactcaccttcaggtctaatctttcaccctacaaccacacagagtatacatgttcatgcagggatggcccacaaaccacagggcaggttcat

SEQ ID NO: 86034 - DNA, 201 bp, Bos taurus
ttcgccatctgtcttcctcttcctgagacttcctactccctgagacacaacaacattgaaattagaccacttaataatcctacaatggcctctaagcgttccagtgaaaggaacagtcacatgtctctcacttaaatcaaaagctagaaatgattaagcttagtgaggaaggcatgtcaaaagctgagacaggctggaagc

SEQ ID NO: 86035 - DNA, 201 bp, Bos taurus; identical to SEQ ID NO: 4034

SEQ ID NO: 86036 - DNA, 201 bp, Bos taurus
gaagtttacttcaattttcataaacctgaagatagaatactgtatttaccagtgtcatgatgaataacttttaacgaaaaaaaaaaaaagagggtatacacatttcgtctttctggtttattaaatattgtaaagcctacatgttaaagaccactgtttacacggctctgtcccagtgaaacatatggcccagttaactga

SEQ ID NO: 86037 - DNA, 201 bp, Bos taurus
gaggaaaaaagcatggagactcatgtaccagttcctaagtgcttccacctggaaatgatagccatgcctaactgcaacggccttggatgcctaatcctctatgtacacaaaaatagaaggatatgagtaactgttggtgctattgccatgttagacatggccatccctgttcaaatagaatcactatatgtacacttttat

SEQ ID NO: 86038 - DNA, 201 bp, Bos taurus; identical to SEQ ID NO: 4035

SEQ ID NO: 86039 - DNA, 201 bp, Bos taurus
caactctcccacttattagctctggaaacttgagcaatttatttaatctctgttttccagatctttcatctgtaaaatgatataataacagaatgtacctcaaaatcatttacaggttaaatacagttatgtgtttagcacagaatctagctcatagcaaacatcagtaaatgctagaaaaaaggcaaccatacaatagaa

SEQ ID NO: 86040 - DNA, 201 bp, Bos taurus; identical to SEQ ID NO: 4037

SEQ ID NO: 86041 - DNA, 201 bp, Bos taurus
caaggccacacaccttgtatgcagtagagccaaaattgaagcctaagtctgtgacacctgtgtcaccaccctgttgttcactggtcagaggagagatggtcgagggtcccttgctgtatcttgggccttccttctttttccatctcactctcatgcatgtgtcacctagaacaggctccatagctggggagagaggaggca

SEQ ID NO: 86042 - DNA, 201 bp, Bos taurus; identical to SEQ ID NO: 4039

SEQ ID NO: 86043 - DNA, 201 bp, Bos taurus; identical to SEQ ID NO: 4040

SEQ ID NO: 86044 - DNA, 201 bp, Bos taurus; identical to SEQ ID NO: 4041

SEQ ID NO: 86045 - DNA, 201 bp, Bos taurus; identical to SEQ ID NO: 4042

SEQ ID NO: 86046 - DNA, 201 bp, Bos taurus; identical to SEQ ID NO: 4043

SEQ ID NO: 86047 - DNA, 201 bp, Bos taurus; identical to SEQ ID NO: 4044

SEQ ID NO: 86048 - DNA, 201 bp, Bos taurus; identical to SEQ ID NO: 4045

SEQ ID NO: 86049 - DNA, 201 bp, Bos taurus
atggttgaagatcattttttcaccaccttaaataaatcttcaaaagttcctactgatcctcatgctggacttgcatctgtttttagaaaaacaacaaaaacgacaaatgtggactctggcttgagtgggagatcatgctccagtattgttttccacgactggatatcaatgttagcaaaggaatcaatcatttactgaaga

SEQ ID NO: 86050 - DNA, 201 bp, Bos taurus
tcttacctattatcccctacctgctgtctgctgcctctacttcctcaccctcaggatgcacaagaggacttgggggtggggagcatcaggactctcaactctgggatgggcaaagggaagggcgagctgggcccaagctctgtgtacaactgacatcacagcttcttcccgccctggagcatctccttcctctccctacag

SEQ ID NO: 86051 - DNA, 201 bp, Bos taurus; identical to SEQ ID NO: 4047

SEQ ID NO: 86052 - DNA, 201 bp, Bos taurus; identical to SEQ ID NO: 4048

SEQ ID NO: 86053 - DNA, 201 bp, Bos taurus
cacaggttatatttgttctatggagagcatgcactggggaatcaattgagtgaagaggcataagttgccctggggattcttgttggagcaggctaaagactgtcctctgtcgacaactctgggaacaaattttaaacatatggctgttggatgagggtccagagagactagcttggaggtgaggtgggtatgggggttcca

SEQ ID NO: 86054 - DNA, 201 bp, Bos taurus; identical to SEQ ID NO: 4049

SEQ ID NO: 86055 - DNA, 201 bp, Bos taurus; identical to SEQ ID NO: 4050

SEQ ID NO: 86056 - DNA, 201 bp, Bos taurus; identical to SEQ ID NO: 4054

SEQ ID NO: 86057 - DNA, 201 bp, Bos taurus
gaggacaatattcaaaggccatttttacttagctttgtaatggataacactttgttccctaacgcattctctcttgcctttctaatgatttcttaccaaaaatctctcacttaatattttcactttctgtaagaaaccacacataggtacaggagagaagagtaaaagtatgtgtagatttctagagccaagagaacctta

SEQ ID NO: 86058 - DNA, 201 bp, Bos taurus
gttcctgcaaaattcaaaatggcccctcccatgttctaccttaaactttctgtacttataaatgctatttactcacagaaatattgcctactaaacttgaggaataagggccttaaatccaaagttaatacaaaattattatgaaaatagtcctaactctgatgaagtctaagcactttttcatgaatgcagttagtttct

SEQ ID NO: 86059 - DNA, 201 bp, Bos taurus; identical to SEQ ID NO: 4055

SEQ ID NO: 86060 - DNA, 201 bp, Bos taurus; identical to SEQ ID NO: 4056

SEQ ID NO: 86061 - DNA, 201 bp, Bos taurus
catactaatcataaatgtgtatataccaaataacagagattcagaatatactttggatacccaaagcttgaaaaacattctgcttggtggacacattgatatactaagcagatctcaggccctgagtccataggaaaggtcacagaaatgccttatcttagacccatccagacctggcccgtcttgcatttggctattctt

SEQ ID NO: 86062 - DNA, 201 bp, Bos taurus
agatcactgccatggcagtcggggccacggagagacagtccctcacccctcatgggtagtggctgctccttacgtgtccagcctctcctgaaactctcttatggccgcagaccaccctcaggtagagaggtccaggtggttgaagtaggataccatccacatatgagtgacctattcatggaagatgctggtgacttccag

SEQ ID NO: 86063 - DNA, 201 bp, Bos taurus; identical to SEQ ID NO: 4057

SEQ ID NO: 86064 - DNA, 201 bp, Bos taurus; identical to SEQ ID NO: 4059

SEQ ID NO: 86065 - DNA, 201 bp, Bos taurus
attttccattcacttgtccaacctccccattctcaccttttttctctcaatacattcagttagctgttgattgtccctggttttagacccatttttcttggcccttggatttttcattttttaaaaatagattctggtcctattctatctgcaacataattactttcttgtgaagtcttgggtttttctcctggactcttg

SEQ ID NO: 86066 - DNA, 201 bp, Bos taurus; identical to SEQ ID NO: 4061

SEQ ID NO: 86067 - DNA, 201 bp, Bos taurus; identical to SEQ ID NO: 4062

SEQ ID NO: 86068 - DNA, 201 bp, Bos taurus; identical to SEQ ID NO: 4064

SEQ ID NO: 86069 - DNA, 201 bp, Bos taurus; identical to SEQ ID NO: 4065

SEQ ID NO: 86070 - DNA, 201 bp, Bos taurus
taataaaaatgttctataatcagttaatagctcatgttactggcctttaatcatcctaattggcagttgaaaaatatgcttataaatgaattcatactgagggactggctggggaggtatcttgaacagaacttcctgataggttggtggtgctggaatgtggacaggacctgggatctcacaactgatgtaaccgagcag

SEQ ID NO: 86071 - DNA, 201 bp, Bos taurus
ggtgctggaatgtggacaggacctgggatctcacaactgatgtaaccgagcaggactcactgctgatgtaaccgagtgaggccttttcaggacagaccccgctcccacatgctctcagaagtacccagataatagtagctcatgcctgagtttttcagatgctaaaaaaccaccaccatgcatgcatgcttagttgcttca

SEQ ID NO: 86072 - DNA, 201 bp, Bos taurus; identical to SEQ ID NO: 4070

SEQ ID NO: 86073 - DNA, 201 bp, Bos taurus; identical to SEQ ID NO: 4071

SEQ ID NO: 86074 - DNA, 201 bp, Bos taurus
cccagggacgggggagcctggtgggctgccgtctatggggtcacacagagtcggacacgactgaagtgacttagcggcagcagcagcagtctccatctttatgtatactgggtttaatcttaaaaagctcttgggatcagccaaagtggcatcggtcatttttaatatgtgaaatatttatattttagccatcaattgtaa

SEQ ID NO: 86075 - DNA, 201 bp, Bos taurus
actcaccaggctacccacttagaactgggacaggccagaaggccctggggtaacccagaagtataactgccagagcacctggggggcactggatgattctgtgtgcagagagttactgggggcctcagaggcaagcagtggggacaatgggccatgcagatcctggtctggattcagagaaccaggcccagacaggattgt

SEQ ID NO: 86076 - DNA, 201 bp, Bos taurus; identical to SEQ ID NO: 4072

SEQ ID NO: 86077 - DNA, 201 bp, Bos taurus; identical to SEQ ID NO: 4073

SEQ ID NO: 86078 - DNA, 201 bp, Bos taurus
tctaccacatggcctcacatcctctgactggctagacccagcttcattacatgatagatgttatagatataatagatagaatgtacttcttacattataagaaggagagaatggaagcagtaggggcctcttgaggccaagtctcagatgcctcacagtgtcacttctcccacattttttggttccagagccatccccagt

SEQ ID NO: 86079 - DNA, 201 bp, Bos taurus
gatgactcactacttaaggggttggtaacatttctataaaggaccagatattttaggccttggccacacggtctctgtgagaaccattcaactccgccattgtagtgcaaaagcagtatagacaatacactgaaaagcgagtgtagttctgttgaaataaatttataaaaccaggtggatttagtccatgggctacagttg

SEQ ID NO: 86080 - DNA, 201 bp, Bos taurus; identical to SEQ ID NO: 4074

SEQ ID NO: 86081 - DNA, 201 bp, Bos taurus; identical to SEQ ID NO: 4076

SEQ ID NO: 86082 - DNA, 201 bp, Bos taurus
tagcttgactctcaggctttccagcctggtggtttttgcactgtgtgtctttccttggcaagatggaaggggatgctcactgatgtctgagtggcacagtgtggggccaggagtgggtttgtggaagaatggacgttagtcatgcagccacagagggacaaactcttgttcccagagccacttacctgggaggtaaggaca

SEQ ID NO: 86083 - DNA, 201 bp, Bos taurus; identical to SEQ ID NO: 4077

SEQ ID NO: 86084 - DNA, 201 bp, Bos taurus; identical to SEQ ID NO: 4078

SEQ ID NO: 86085 - DNA, 201 bp, Bos taurus; identical to SEQ ID NO: 4079

SEQ ID NO: 86086 - DNA, 201 bp, Bos taurus; identical to SEQ ID NO: 4081

SEQ ID NO: 86087 - DNA, 201 bp, Bos taurus; identical to SEQ ID NO: 4082

SEQ ID NO: 86088 - DNA, 201 bp, Bos taurus; identical to SEQ ID NO: 4083

SEQ ID NO: 86089 - DNA, 201 bp, Bos taurus
ataagaacaaagttttgagtagatgtagcactcggcaattccaggaactacctttaaaaggagacaaaattagcgagcatagctaatccaaggaaatggcatctccactcagttttgattcagaaagtataaacacaaaaatttaatgataagcctctgggtgaacatgcatatttttgagctcttgttttaagtcatcaa

SEQ ID NO: 86090 - DNA, 201 bp, Bos taurus; identical to SEQ ID NO: 4086

SEQ ID NO: 86091 - DNA, 201 bp, Bos taurus; identical to SEQ ID NO: 4087

SEQ ID NO: 86092 - DNA, 201 bp, Bos taurus; identical to SEQ ID NO: 4088

SEQ ID NO: 86093 - DNA, 201 bp, Bos taurus
tggccactggtgatccattcattctccagcccctctccctccctgaggagtagggggactagaagacataagtgctaaatctccaatcacagggctaggtccccctggcaaccaggcccccctccttggttgcctaggagtactccaaaagtcacctaattaatataacaaaggatacctttatccatctgtatacttagg

SEQ ID NO: 86094 - DNA, 201 bp, Bos taurus
tggggcggcttgtcttgttggggaggataggttctaggcgctgggctcagtagttgcagctcctgggccctagagcacacgggcttcagcagttgcggcccactggcaaagttgctctttggcacatgggatcttcctagatcagggctccaacccctgttgcctgcattggcagacagattcttaaccagtggtccaccc

SEQ ID NO: 86095 - DNA, 201 bp, Bos taurus
gcctgtaccttttcctttttaatctcaccttttgagatctatccatattattgcatttaagtcttgtgctttgtttaccaattgcacaatccctgattgctaaaatgaataaaggaagagtctaacatgaagtggattacatacagaaggcccttcctgactgttttcagggagccattgaacatcagataaggctctgcg

SEQ ID NO: 86096 - DNA, 201 bp, Bos taurus; identical to SEQ ID NO: 4090

SEQ ID NO: 86097 - DNA, 201 bp, Bos taurus; identical to SEQ ID NO: 4091

SEQ ID NO: 86098 - DNA, 201 bp, Bos taurus; identical to SEQ ID NO: 4093

SEQ ID NO: 86099 - DNA, 201 bp, Bos taurus; identical to SEQ ID NO: 4094

SEQ ID NO: 86100 - DNA, 201 bp, Bos taurus
cttcatttgaaaacaaatattgattgaactcctcctatgtgttagacactggagatagagcattgaacaaaagcccctgttcacaaagcttcagttctaatgggaagagatggatgattaataaccatgtggtgataagtgctgcaaaaacaatgcaggagaaggcaaatgacaaaatgagaggacaaatgtggtgtggat

SEQ ID NO: 86101 - DNA, 201 bp, Bos taurus; identical to SEQ ID NO: 4095

SEQ ID NO: 86102 - DNA, 201 bp, Bos taurus; identical to SEQ ID NO: 4096

SEQ ID NO: 86103 - DNA, 201 bp, Bos taurus; identical to SEQ ID NO: 4100

SEQ ID NO: 86104 - DNA, 201 bp, Bos taurus; identical to SEQ ID NO: 4101

SEQ ID NO: 86105 - DNA, 201 bp, Bos taurus; identical to SEQ ID NO: 4102

SEQ ID NO: 86106 - DNA, 201 bp, Bos taurus; identical to SEQ ID NO: 4105

SEQ ID NO: 86107 - DNA, 201 bp, Bos taurus; identical to SEQ ID NO: 4107

SEQ ID NO: 86108 - DNA, 201 bp, Bos taurus; identical to SEQ ID NO: 4108

SEQ ID NO: 86109 - DNA, 201 bp, Bos taurus; identical to SEQ ID NO: 4110

SEQ ID NO: 86110 - DNA, 201 bp, Bos taurus; identical to SEQ ID NO: 4111

SEQ ID NO: 86111 - DNA, 201 bp, Bos taurus; identical to SEQ ID NO: 4113

SEQ ID NO: 86112 - DNA, 201 bp, Bos taurus; identical to SEQ ID NO: 4114

SEQ ID NO: 86113 - DNA, 201 bp, Bos taurus; identical to SEQ ID NO: 4115

SEQ ID NO: 86114 - DNA, 201 bp, Bos taurus; identical to SEQ ID NO: 4117

SEQ ID NO: 86115 - DNA, 201 bp, Bos taurus; identical to SEQ ID NO: 4118

SEQ ID NO: 86116 - DNA, 201 bp, Bos taurus; identical to SEQ ID NO: 4119

SEQ ID NO: 86117 - DNA, 201 bp, Bos taurus; identical to SEQ ID NO: 4120

SEQ ID NO: 86118 - DNA, 201 bp, Bos taurus; identical to SEQ ID NO: 4121

SEQ ID NO: 86119 - DNA, 201 bp, Bos taurus; identical to SEQ ID NO: 4122

SEQ ID NO: 86120 - DNA, 201 bp, Bos taurus; identical to SEQ ID NO: 4123

SEQ ID NO: 86121 - DNA, 201 bp, Bos taurus; identical to SEQ ID NO: 4125

SEQ ID NO: 86122 - DNA, 201 bp, Bos taurus; identical to SEQ ID NO: 4126

SEQ ID NO: 86123 - DNA, 201 bp, Bos taurus; identical to SEQ ID NO: 4127

SEQ ID NO: 86124 - DNA, 201 bp, Bos taurus; identical to SEQ ID NO: 4130

SEQ ID NO: 86125 - DNA, 201 bp, Bos taurus; identical to SEQ ID NO: 4132

SEQ ID NO: 86126 - DNA, 201 bp, Bos taurus; identical to SEQ ID NO: 4133

SEQ ID NO: 86127 - DNA, 201 bp, Bos taurus; identical to SEQ ID NO: 4135

SEQ ID NO: 86128 - DNA, 201 bp, Bos taurus; identical to SEQ ID NO: 4136

SEQ ID NO: 86129 - DNA, 201 bp, Bos taurus; identical to SEQ ID NO: 4137

SEQ ID NO: 86130 - DNA, 201 bp, Bos taurus; identical to SEQ ID NO: 4141

SEQ ID NO: 86131 - DNA, 201 bp, Bos taurus
cctagacctctgttggtcaatcaagacattgggccttcattgtctctggcatctgctcaggtgtcttcttccaggtccttgtctgcctgtggataccatgccagctggcctctgctgagctgtcctgtctggtcctccgtggttgatccacagaaagagcagtttatccagggcctctccaggcaaggctctgtcttgtca

SEQ ID NO: 86132 - DNA, 201 bp, Bos taurus
tagtggctgggagccaaggaaaggtttggaaaggaggggaggtgtgttgggctcggaggcctggggattagggtcaggggccctcgtgtgttgccaactgcggacccatctctgggtccacactgccttcccacctctgcccaggcaagtagcttcctgccaggttgggaaattgctttggcctggaaattttctgctggg

SEQ ID NO: 86133 - DNA, 201 bp, Bos taurus
tctcccaccctgtgggcttcttcccagcccctccctctctccccctttcccatgtgatacctgcctgacttgctgatgttgctctggccaatggggtaaaggttgctgtccaggtctttgatctagaagaggagagctggatgcttaccccataccacaccccactccccgcagcagtacccaccactgagctctggagca

SEQ ID NO: 86134 - DNA, 201 bp, Bos taurus
aaaaccttttgctgcagaacattttgctaacaatctctgtctatgtaacagaccacagttggtaaacacggccaggcccgtctctgctgagatgctgcagagaaccgctaatcaatggggtagtccaagaaattaaccagagggctgtgacagacagcaaccagggctaaacacgtcattaggcaaataggccggtgtcac

SEQ ID NO: 86135 - DNA, 201 bp, Bos taurus; identical to SEQ ID NO: 4148

SEQ ID NO: 86136 - DNA, 201 bp, Bos taurus
tgctgaatatagcctcccttgctggattatgggaactctttattattaagtctttgtgggcttcgtggattgagcccctgaactcggtgggcatccattccgaggcctgcacatggaccgtgcatgcacaagggtttggatgcaatgaaagatttctatctccaggcctcagttcccaggatgagaaatgaaagattctta

SEQ ID NO: 86137 - DNA, 201 bp, Bos taurus; identical to SEQ ID NO: 4149

SEQ ID NO: 86138 - DNA, 201 bp, Bos taurus
ttgcaagtgaagttaagttgcacgggagcaaacacagccatactcagttgcttccgggtttgcttttgtgctacaaggtcaaggttgagtagttgagacagaaactttatggcccacaaagcttggaatgtctcttttcagaaaaggtttgcgaatttgttatagatgattaaaaaatatttttggattaagtcaactcaa

SEQ ID NO: 86139 - DNA, 201 bp, Bos taurus; identical to SEQ ID NO: 4154

SEQ ID NO: 86140 - DNA, 201 bp, Bos taurus; identical to SEQ ID NO: 4155

SEQ ID NO: 86141 - DNA, 201 bp, Bos taurus; identical to SEQ ID NO: 4157

SEQ ID NO: 86142 - DNA, 201 bp, Bos taurus; identical to SEQ ID NO: 4158

SEQ ID NO: 86143 - DNA, 201 bp, Bos taurus; identical to SEQ ID NO: 4160

SEQ ID NO: 86144 - DNA, 201 bp, Bos taurus; identical to SEQ ID NO: 4162

SEQ ID NO: 86145 - DNA, 201 bp, Bos taurus; identical to SEQ ID NO: 4163

SEQ ID NO: 86146 - DNA, 201 bp, Bos taurus; identical to SEQ ID NO: 4164

SEQ ID NO: 86147 - DNA, 201 bp, Bos taurus; identical to SEQ ID NO: 4165

SEQ ID NO: 86148 - DNA, 201 bp, Bos taurus
atgttgtaacactaccaccttgtgggaaatttgagcatgtgagtcaaatatttgagaactattttcaaacagccaaacaataaggcagaatttcttgataattagagtcacaatatatgaacagatgatatatgaaaaaaacatttatggtcaggtcattttagaaagctcaggataaaacaaataagtatttttttttaa

SEQ ID NO: 86149 - DNA, 201 bp, Bos taurus; identical to SEQ ID NO: 4166

SEQ ID NO: 86150 - DNA, 201 bp, Bos taurus; identical to SEQ ID NO: 4167

SEQ ID NO: 86151 - DNA, 201 bp, Bos taurus; identical to SEQ ID NO: 4168

SEQ ID NO: 86152 - DNA, 201 bp, Bos taurus; identical to SEQ ID NO: 4169

SEQ ID NO: 86153 - DNA, 201 bp, Bos taurus
aggaggctcccattggccaaaggtgagatgatttgatgattcaaaaacactattgttccaagtgattaaaatgaatgaaaaatataaaatgagaaaggaaaaatataagccttcatggccataattaaaggttgttgggcaccaactcattatttttaaaactgctaactaaagcgaaagaactgagattttatattgttt

SEQ ID NO: 86154 - DNA, 201 bp, Bos taurus; identical to SEQ ID NO: 4171

SEQ ID NO: 86155 - DNA, 201 bp, Bos taurus; identical to SEQ ID NO: 4172

SEQ ID NO: 86156 - DNA, 201 bp, Bos taurus; identical to SEQ ID NO: 4173

SEQ ID NO: 86157 - DNA, 201 bp, Bos taurus; identical to SEQ ID NO: 4174

SEQ ID NO: 86158 - DNA, 201 bp, Bos taurus; identical to SEQ ID NO: 4175

SEQ ID NO: 86159 - DNA, 201 bp, Bos taurus; identical to SEQ ID NO: 4178

SEQ ID NO: 86160 - DNA, 201 bp, Bos taurus; identical to SEQ ID NO: 4179

SEQ ID NO: 86161 - DNA, 201 bp, Bos taurus; identical to SEQ ID NO: 4180

SEQ ID NO: 86162 - DNA, 201 bp, Bos taurus; identical to SEQ ID NO: 4181

SEQ ID NO: 86163 - DNA, 201 bp, Bos taurus; identical to SEQ ID NO: 4182

SEQ ID NO: 86164 - DNA, 201 bp, Bos taurus; identical to SEQ ID NO: 4184

SEQ ID NO: 86165 - DNA, 201 bp, Bos taurus; identical to SEQ ID NO: 4185

SEQ ID NO: 86166 - DNA, 201 bp, Bos taurus; identical to SEQ ID NO: 4187

SEQ ID NO: 86167 - DNA, 201 bp, Bos taurus
tgaccgccagcttctcactgccctccatcttggactctgccctaaggccaagacctcagccagggtaaggatctaatttgctcactgctgtagccttggaatatttttcaaagtaggcctccaggcttcttgcccctgtgccatcttaaagcaagcggaggccaaaaaagagatcaagaaggttcccgtttattctcagac

SEQ ID NO: 86168 - DNA, 201 bp, Bos taurus
aaacatgtattgtattaactttaaaaaaaaaaaaagttaaggtagcctatgacttagaattgaaaaaagagagactaggaaaatgcacttttctcatatactcagaaagataatgcctttactaacatattgacttaaattcgatttacccttaaagaaaagtagagaaatcaaagattatttagggaaaaactaccaaaa

SEQ ID NO: 86169 - DNA, 201 bp, Bos taurus; identical to SEQ ID NO: 4188

SEQ ID NO: 86170 - DNA, 201 bp, Bos taurus; identical to SEQ ID NO: 4189

SEQ ID NO: 86171 - DNA, 201 bp, Bos taurus
ccttaacgcctgatttgtcttgttatttcctgcatctcagctcttgtggggggacatctccacttgtccagacacactcatgataagattgatccaaaatgtgacacaaaggaatgttaccaacaatgcttatatacactcttctgctatgatcattacctttcatgcagagattctttcttccccaagttccaagaaaag

SEQ ID NO: 86172 - DNA, 201 bp, Bos taurus; identical to SEQ ID NO: 4190

SEQ ID NO: 86173 - DNA, 201 bp, Bos taurus; identical to SEQ ID NO: 4191

SEQ ID NO: 86174 - DNA, 201 bp, Bos taurus; identical to SEQ ID NO: 4192

SEQ ID NO: 86175 - DNA, 201 bp, Bos taurus; identical to SEQ ID NO: 4193

SEQ ID NO: 86176 - DNA, 201 bp, Bos taurus
tttaattaatcatcccataatagacttgcagggtatgttgaaaagcagagccttaactgaaaaaagagtgtcctgtgattcaaggaggtgccatttatgggaactaatccttaaaaattacttgcaaaagcaagaaaatatatggatttttgaggtatagtttataattgattataaaaccacaaatatctaacaaaataa

SEQ ID NO: 86177 - DNA, 201 bp, Bos taurus; identical to SEQ ID NO: 4195

SEQ ID NO: 86178 - DNA, 201 bp, Bos taurus; identical to SEQ ID NO: 4196

SEQ ID NO: 86179 - DNA, 201 bp, Bos taurus; identical to SEQ ID NO: 4197

SEQ ID NO: 86180 - DNA, 201 bp, Bos taurus; identical to SEQ ID NO: 4198

SEQ ID NO: 86181 - DNA, 201 bp, Bos taurus; identical to SEQ ID NO: 4200

SEQ ID NO: 86182 - DNA, 201 bp, Bos taurus
catattttatttcatggactacagaggataattctgctttcttgtatgactcctcatgtctttgcctaggtgctcttttataaataatttactcatcctgacagttcatctccaggtgatcctacctgctgtcttcttgcctaaaaagagtcatgctcctcaatgctttttaaatacttcccaactgctaattttcttaca

SEQ ID NO: 86183 - DNA, 201 bp, Bos taurus; identical to SEQ ID NO: 4201

SEQ ID NO: 86184 - DNA, 201 bp, Bos taurus; identical to SEQ ID NO: 4202

SEQ ID NO: 86185 - DNA, 201 bp, Bos taurus; identical to SEQ ID NO: 4203

SEQ ID NO: 86186 - DNA, 201 bp, Bos taurus; identical to SEQ ID NO: 4205

SEQ ID NO: 86187 - DNA, 201 bp, Bos taurus; identical to SEQ ID NO: 4206

SEQ ID NO: 86188 - DNA, 201 bp, Bos taurus
gatatatgcccaggagtggaattgctccttcttctactttaaagatgattgtgatttctcattcattggtgttccaccatcctttgcttcttaacccagttgttatctctgtaaacagtccctttattatactgttaggcttaagccctttgaagtggatacttgcagtgttcctgatactggaggagggagccctatcat

SEQ ID NO: 86189 - DNA, 201 bp, Bos taurus; identical to SEQ ID NO: 4208

SEQ ID NO: 86190 - DNA, 201 bp, Bos taurus; identical to SEQ ID NO: 4209

SEQ ID NO: 86191 - DNA, 201 bp, Bos taurus; identical to SEQ ID NO: 4210

SEQ ID NO: 86192 - DNA, 201 bp, Bos taurus
ataatcagtggaggaaatggttcggttattaaaagcaaatgaaagatatttctacccctgacagctcaatattagtaccagtccttatagttctgcagatcttctcaacaaggctgggttacacctaggtattactaataataataaccagcattttcgattgtttagtatgtactgctgctgctgctgctgctaagtcac

SEQ ID NO: 86193 - DNA, 201 bp, Bos taurus; identical to SEQ ID NO: 4212

SEQ ID NO: 86194 - DNA, 201 bp, Bos taurus
gtattccctcccgatcaacggacactggctgcagctgcccagcaaggattcctccttcctccaggcttcagctataaggctggatgtagtaagtaccgttgatttttcatttgggagtgggtggagggcatgtctttaggcaatttaatattcctgccacaccaagaaatgagatcacccgtatagcatttttattttaaa

SEQ ID NO: 86195 - DNA, 201 bp, Bos taurus
caaggatcccagcatacatccttgcggcttagcagacccaaatgccaagactgtataaggggattctgcgaatcagagttccttcaaaattcctactgatcgttggcttcggttacctcagtataacgtgctaagtgtgcaaaggtgaataaatcaacgtctcatcccttcctgaagcaaatgtacccaaagggggggaaa

SEQ ID NO: 86196 - DNA, 201 bp, Bos taurus
cttccctgaattccaaagagcagatttaaacagttgctaatcagggaagggaagacttgcagagataagggaggatcagccaagaaacaatggtagagccttggggcagggtcctggttccacctcaagggacaaaccctttttaagaactaaaacccagtaaatggaaactacaggcatactctataccagagaagacca

SEQ ID NO: 86197 - DNA, 201 bp, Bos taurus; identical to SEQ ID NO: 4216

SEQ ID NO: 86198 - DNA, 201 bp, Bos taurus; identical to SEQ ID NO: 4217

SEQ ID NO: 86199 - DNA, 201 bp, Bos taurus; identical to SEQ ID NO: 4218

SEQ ID NO: 86200 - DNA, 201 bp, Bos taurus; identical to SEQ ID NO: 4219

SEQ ID NO: 86201 - DNA, 201 bp, Bos taurus
gacacctcaatgctgtttctctgaagcatccatgcaaggatatcatggacaaactgcctctatcctgggctaaaatgactcaccccaaatagacactttttggaaatgctagcactgctgtccaccaaggagtgcattccaggcttcccataaccctcttaacagcagttcagttttactcaaaagtttcagcatgagtat

SEQ ID NO: 86202 - DNA, 201 bp, Bos taurus
aattaatatgtttaattaataactgatggccggaacataacttatttaaataaatgtaaaaaaccagaataagttaataaataataaactaaagaagtgtggagtttcaacttggaagtttcaattaaactaattttccttaaagaaaatacgctgttattgttcagtcactaagttgtgttggactctgcaacccatgga

SEQ ID NO: 86203 - DNA, 201 bp, Bos taurus
atattaaagtgagtgtatatttaaaccacactataatacttatatttgtaaaactgatttaggttctaggtaggtttttgacccatctggctatctggtgcggacattttgatagtcatgacattggacaagtcttcattgttggggactgtctcttgaattgcaggacacctagcatctctgagcttcttcgcttaatag

SEQ ID NO: 86204 - DNA, 201 bp, Bos taurus; identical to SEQ ID NO: 4221

SEQ ID NO: 86205 - DNA, 201 bp, Bos taurus; identical to SEQ ID NO: 4222

SEQ ID NO: 86206 - DNA, 201 bp, Bos taurus; identical to SEQ ID NO: 4223

SEQ ID NO: 86207 - DNA, 201 bp, Bos taurus; identical to SEQ ID NO: 4224

SEQ ID NO: 86208 - DNA, 201 bp, Bos taurus; identical to SEQ ID NO: 4225

SEQ ID NO: 86209 - DNA, 201 bp, Bos taurus; identical to SEQ ID NO: 4226

SEQ ID NO: 86210 - DNA, 201 bp, Bos taurus; identical to SEQ ID NO: 4227

SEQ ID NO: 86211 - DNA, 201 bp, Bos taurus; identical to SEQ ID NO: 4228

SEQ ID NO: 86212 - DNA, 201 bp, Bos taurus
cctggagttcactcaaactcacatccatcgagtcggtgacgccatccagccatctcatcctctgtcatcccgttctcctcctgcccccaatccctcccagtatcagagcatccactatacagtagatccccttgatccatttcatcttcccctccacctctttccttttggtaaccgctactctgttctctgtatatccat

SEQ ID NO: 86213 - DNA, 201 bp, Bos taurus; identical to SEQ ID NO: 4229

SEQ ID NO: 86214 - DNA, 201 bp, Bos taurus; identical to SEQ ID NO: 4231

SEQ ID NO: 86215 - DNA, 201 bp, Bos taurus; identical to SEQ ID NO: 4232

SEQ ID NO: 86216 - DNA, 201 bp, Bos taurus
atgtggctcactgggagcaggagtgatctgtagagttggatcaggtgtgggttagtatgcccaaggacatactgagctgctctctgaggctattttaggccgtgactttggccaaccctctcctctgtcctggatctcaggcttcattataatttgcctatcatccttaccccatcacataaattaacttccctatctaag

SEQ ID NO: 86217 - DNA, 201 bp, Bos taurus
ctgctatacgtcaaatttataaaattaatattcttcagagaaatctcaaaattgaattacttcccctggtcaaaatcgaaaggtttacctgaggggcgctcgtggcaaccaggaaagcattagtccttcccgggtgatcatagtcatgcatggctgcagccacatacaaggccatcaactccaaggcagggatatttccag

SEQ ID NO: 86218 - DNA, 201 bp, Bos taurus
caacatagcacactcccatctagtccaaagttaaaaaaaaaagcaaaacataaatttatctactatagtcagctaaaaaagggccccaaagatagtataccgtaatccctagaaactgtgaactgttatgtgaaaaaagggacttggcaaatgtgattaaattaaggatcttgagatggtaagattatcttggatcactgg

SEQ ID NO: 86219 - DNA, 201 bp, Bos taurus; identical to SEQ ID NO: 4233

SEQ ID NO: 86220 - DNA, 201 bp, Bos taurus
tagcaattattagagtacagaaaagaaagtattctcccagtgttcaagaagaacataaaaataatttccctgaatacaggccattaagctttaattttgaccctctttaaaatattaatatggattataaattgttttctagctctcataaaggtaatgcctcgaatccagcatagattcacttagagtaggccatgccac

SEQ ID NO: 86221 - DNA, 201 bp, Bos taurus; identical to SEQ ID NO: 4234

SEQ ID NO: 86222 - DNA, 201 bp, Bos taurus; identical to SEQ ID NO: 4235

SEQ ID NO: 86223 - DNA, 201 bp, Bos taurus; identical to SEQ ID NO: 4237

SEQ ID NO: 86224 - DNA, 201 bp, Bos taurus; identical to SEQ ID NO: 4238

SEQ ID NO: 86225 - DNA, 201 bp, Bos taurus; identical to SEQ ID NO: 4239

SEQ ID NO: 86226 - DNA, 201 bp, Bos taurus; identical to SEQ ID NO: 4240

SEQ ID NO: 86227 - DNA, 201 bp, Bos taurus; identical to SEQ ID NO: 4242

SEQ ID NO: 86228 - DNA, 201 bp, Bos taurus; identical to SEQ ID NO: 4243

SEQ ID NO: 86229 - DNA, 201 bp, Bos taurus; identical to SEQ ID NO: 4244

SEQ ID NO: 86230 - DNA, 201 bp, Bos taurus
ctctcttcctgggctccctgcctgctctctcatggctgcagaagcgccatctgtgtgagagctcctgagagacaaattgcttcctatcctgggcctccatcgcttgcctggagtagtgcttaagaaataattgcttcagggatctcagagtactctgacctgaggagttcttctggcagcttctcgaggagtcacaggact

SEQ ID NO: 86231 - DNA, 201 bp, Bos taurus; identical to SEQ ID NO: 4245

SEQ ID NO: 86232 - DNA, 201 bp, Bos taurus; identical to SEQ ID NO: 4248

SEQ ID NO: 86233 - DNA, 201 bp, Bos taurus
atatattaaggacttaaagtactgggcttggtgaaatatgggaaaatgtttattgcacctgattttgcaatgagaaaagacttgtagtaacaggaaataagcaatgacaatatataggtgattaaaatgccttaattaggatgttttgtttgcatttttatggaaataagggagtaagagtacatgactttattctagtgt

SEQ ID NO: 86234 - DNA, 201 bp, Bos taurus; identical to SEQ ID NO: 4249

SEQ ID NO: 86235 - DNA, 201 bp, Bos taurus
tgattctagagaattctgctaaataatcattcaaataattgccaatccaaacagtgatgatccaggggcttatatgttaagtcagccttataaagcaagaagatattatagataagatcctcctagaggaattgctttatactacctacaggtacctgttaagtgtttctgtaaagcagtgcttaaatattagcatttttt

SEQ ID NO: 86236 - DNA, 201 bp, Bos taurus
ctttcactggacaatctatgctatagactgttcttcatattctttgggttgactgctctgataaaagataaaataaaacacttgatgataattagagataggcaggagaggcaagcggtgacgggagtaggatatctgaatatgtgtggttcattcaaaaactattcaatgagtataaaatatgtaccaggctctgtggag

SEQ ID NO: 86237 - DNA, 201 bp, Bos taurus; identical to SEQ ID NO: 4253

SEQ ID NO: 86238 - DNA, 201 bp, Bos taurus; identical to SEQ ID NO: 4254

SEQ ID NO: 86239 - DNA, 201 bp, Bos taurus; identical to SEQ ID NO: 4255

SEQ ID NO: 86240 - DNA, 201 bp, Bos taurus; identical to SEQ ID NO: 4257

SEQ ID NO: 86241 - DNA, 201 bp, Bos taurus; identical to SEQ ID NO: 4260

SEQ ID NO: 86242 - DNA, 201 bp, Bos taurus; identical to SEQ ID NO: 4261

SEQ ID NO: 86243 - DNA, 201 bp, Bos taurus; identical to SEQ ID NO: 4262

SEQ ID NO: 86244 - DNA, 201 bp, Bos taurus; identical to SEQ ID NO: 4263

SEQ ID NO: 86245 - DNA, 201 bp, Bos taurus; identical to SEQ ID NO: 4264

SEQ ID NO: 86246 - DNA, 201 bp, Bos taurus; identical to SEQ ID NO: 4265

SEQ ID NO: 86247 - DNA, 201 bp, Bos taurus; identical to SEQ ID NO: 4267

SEQ ID NO: 86248 - DNA, 201 bp, Bos taurus
gtttgatttcagaaaacccagtcccactgcaaatgtaaccctcaaaaatgcttatacactccatacatgcctcatgacttccaactggccctccagttaggtggactcagcttttctaataatcacctctggtcatctctgcatctccacaagacatcataatagagaataagcaacactgacacttggaatcaagggccc

SEQ ID NO: 86249 - DNA, 201 bp, Bos taurus
cacatgttttccttaaaaaggaagcaaatccggagtgtttggtggcttcgccctcactcagctccctttgctggattgacaggccacaaactcagaagaagagaaaagagtggaggaggactcccctggtggtcggtccagtggttaagactccgagctcccactgcaggggccacagattccaaccctggtcagggaagt

SEQ ID NO: 86250 - DNA, 201 bp, Bos taurus; identical to SEQ ID NO: 4269

SEQ ID NO: 86251 - DNA, 201 bp, Bos taurus; identical to SEQ ID NO: 4271

SEQ ID NO: 86252 - DNA, 201 bp, Bos taurus; identical to SEQ ID NO: 4272

SEQ ID NO: 86253 - DNA, 201 bp, Bos taurus; identical to SEQ ID NO: 4273

SEQ ID NO: 86254 - DNA, 201 bp, Bos taurus; identical to SEQ ID NO: 4274

SEQ ID NO: 86255 - DNA, 201 bp, Bos taurus; identical to SEQ ID NO: 4276

SEQ ID NO: 86256 - DNA, 201 bp, Bos taurus; identical to SEQ ID NO: 4277

SEQ ID NO: 86257 - DNA, 201 bp, Bos taurus
gcagtaacacaccgactgtgaccctgggttccgcggccaggacaacactcatcggaccacggaaaggatgctgtccagcctatgggttccgttccaaggaagacaaaacactcacttgggcatcccataccacacacttatctcccttgtttctctttctgttcatctctagggtgactgacgtggtcttcatttttaaat

SEQ ID NO: 86258 - DNA, 201 bp, Bos taurus
ttgtttgtatgtagtgcagaaagactctgttgagtaatgcaagagaggaaaactttcttctctaccctccctaggttcactggccgcccacttctccaatcaaactgataagaaatagattaataagagaacaacaaaaaaacccagacttcattatgtataggtgcaatgagtttccaaagaaatgaaagctcaaggaag

SEQ ID NO: 86259 - DNA, 201 bp, Bos taurus; identical to SEQ ID NO: 4278

SEQ ID NO: 86260 - DNA, 201 bp, Bos taurus; identical to SEQ ID NO: 4280

SEQ ID NO: 86261 - DNA, 201 bp, Bos taurus; identical to SEQ ID NO: 4282

SEQ ID NO: 86262 - DNA, 201 bp, Bos taurus
ccctgtctgcatgtatacaggaagactctttgggggtcaaaatggagggtgcaccatcccataataagtgtggacgtgtacccacaggcctctgctgtgcgatccatctcagcaaaatgtttttgtgcacccacgttggggagggtccaggactagtcaagtgtgggaaaagaactgagataattggccaaaggtaaacaa

SEQ ID NO: 86263 - DNA, 201 bp, Bos taurus; identical to SEQ ID NO: 4283

SEQ ID NO: 86264 - DNA, 201 bp, Bos taurus
tcccagaccaggaatcaaaccaatgcccctactttgtgaggcagattcttaaaccattggcctatgagggaataatctttttaccatcacctttgcctttaccagactatcatatagctggagttatactatacgacttttcaaatggccatctttcccttagcaataaatattaatatttaaagttccttcatatctttt

SEQ ID NO: 86265 - DNA, 201 bp, Bos taurus
tactttgagagcttttaacccaatttaaggaccctgttagttgacaaaaagtttttccccaaaagaggtgaatacttaaactcactcaaagaagagagacagaagctccctggagggtcatttaattcctttttgctttataggtgacaaatgagaccctgaccttgaccttcacagttctgcaagacatcccagtaaggg

SEQ ID NO: 86266 - DNA, 201 bp, Bos taurus; identical to SEQ ID NO: 4284

SEQ ID NO: 86267 - DNA, 201 bp, Bos taurus
agataagaccgttaaaaattacgctgtatagacttattctctgcgccaacttctaaagtacatgtttggaagttaagggatgggtgtgcaggcaccatcttatctagagccggggcctgccgacacacctgaggtcttctctcatctgttcctccagttgggaggctctgccaagaatctcccttctcaagattttttttg

SEQ ID NO: 86268 - DNA, 201 bp, Bos taurus; identical to SEQ ID NO: 4286

SEQ ID NO: 86269 - DNA, 201 bp, Bos taurus; identical to SEQ ID NO: 4288

SEQ ID NO: 86270 - DNA, 201 bp, Bos taurus; identical to SEQ ID NO: 4292

SEQ ID NO: 86271 - DNA, 201 bp, Bos taurus
tcttgccaaccacattggctgtttttggtctttgcattttgtataaacttgtgagtcagcttatcatttttcaccaaaaaagcataaggtattttgactgcgatttgatttaatctaaatataaatttgaggatgattgactgtagtaattttgagttttccaactcactgacatcatacattcctctattcaatttggtc

SEQ ID NO: 86272 - DNA, 201 bp, Bos taurus; identical to SEQ ID NO: 4293

SEQ ID NO: 86273 - DNA, 201 bp, Bos taurus; identical to SEQ ID NO: 4294

SEQ ID NO: 86274 - DNA, 201 bp, Bos taurus; identical to SEQ ID NO: 4296

SEQ ID NO: 86275 - DNA, 201 bp, Bos taurus; identical to SEQ ID NO: 4297

SEQ ID NO: 86276 - DNA, 201 bp, Bos taurus; identical to SEQ ID NO: 4298

SEQ ID NO: 86277 - DNA, 201 bp, Bos taurus; identical to SEQ ID NO: 4299

SEQ ID NO: 86278 - DNA, 201 bp, Bos taurus; identical to SEQ ID NO: 4300

SEQ ID NO: 86279 - DNA, 201 bp, Bos taurus; identical to SEQ ID NO: 4301

SEQ ID NO: 86280 - DNA, 201 bp, Bos taurus; identical to SEQ ID NO: 4302

SEQ ID NO: 86281 - DNA, 201 bp, Bos taurus; identical to SEQ ID NO: 4303

SEQ ID NO: 86282 - DNA, 201 bp, Bos taurus; identical to SEQ ID NO: 4304

SEQ ID NO: 86283 - DNA, 201 bp, Bos taurus; identical to SEQ ID NO: 4305

SEQ ID NO: 86284 - DNA, 201 bp, Bos taurus; identical to SEQ ID NO: 4306

SEQ ID NO: 86285 - DNA, 201 bp, Bos taurus
tgagatttaaaagatctggaaatcacttaatgactaagaaagacttcatctaagaaaacaagaaggaagggagggagggaaggaggaaagatggagaggaggggggaggagggaagatggagagagagggaaagtaactgagaaacagaggaaagggatttatcatacttggtatcatataaaaagctatgaccgcttcca

SEQ ID NO: 86286 - DNA, 201 bp, Bos taurus; identical to SEQ ID NO: 4307

SEQ ID NO: 86287 - DNA, 201 bp, Bos taurus; identical to SEQ ID NO: 4308

SEQ ID NO: 86288 - DNA, 201 bp, Bos taurus
gtgccccctagtggccacttccttcatcacggaggttgagatccgcgggatgtcaataggagtggcgacttggacgctaattttatgaatagactgcagtccttgcctagaaagagctcacggccctgagtggaggagccacctgcccaaccgatgctgcttcaatcagaacgcgtccgagggtgcccaggaaaaggtgac

SEQ ID NO: 86289 - DNA, 201 bp, Bos taurus
caaggccagaaggcaagataacagtgggttggataagggaaagaaaagcaggcacctaagaagtaaaggtgagtgagaaggaaaagattagaaaacgaagaaaaaaaaagaaccacaaaggaaaaatccaaacacaccagaaaccagagtcaacatggattaaaccactctcaccagttaacaaaaagactgctttttttt

SEQ ID NO: 86290 - DNA, 201 bp, Bos taurus
cttcccctttcacacacaggcactctctgtggacagagggaccaaggccagctctttcacaagcagctttccccctcaactgcccacaacgccccagggttgctactgccgcctccagacctgggcctctgagcccctggctgccagagctcagagacagaaccagcgggatccacgtggggtgggggtggggaaacagga

SEQ ID NO: 86291 - DNA, 201 bp, Bos taurus; identical to SEQ ID NO: 4309

SEQ ID NO: 86292 - DNA, 201 bp, Bos taurus; identical to SEQ ID NO: 4311

SEQ ID NO: 86293 - DNA, 201 bp, Bos taurus; identical to SEQ ID NO: 4312

SEQ ID NO: 86294 - DNA, 201 bp, Bos taurus; identical to SEQ ID NO: 4313

SEQ ID NO: 86295 - DNA, 201 bp, Bos taurus
agccgggaccacctcagggagcctatgtgggcagcttctgcacactttcggccaccccatggagccccctcaccctcacctttgaagcaggccagccgaccgccacacctcctgtgtctccccacttcactcttgtcccaggaattcgagcagcgtccacagtctgccccaatcgtagcagcctagctccttccatcaaca

SEQ ID NO: 86296 - DNA, 201 bp, Bos taurus
ttccttccagacctgccccggcctctcacaagcatgctctttccaacagctcacacctgccccacaagtgttcacagcactcacaccagaccctgactggcaggccaggcggaagccagcgtgcagatgaagccagccccagagtctcaacaaggagaacgccgagcctggggggtgggcttcccagacgagaggcacagc

SEQ ID NO: 86297 - DNA, 201 bp, Bos taurus
ctctgcgggcagtggaaggagctgtcttttcactgcttccctacatgttccagagatgagagtgtgtgcccaacaccagccttgatcccctggagtgtgaagtttgtgcaggcctgcttggggcaggccctttggtatggacgccttggcagcacccaagggcagctggctcgatgggtcctcaccttgtagccccggagc

SEQ ID NO: 86298 - DNA, 201 bp, Bos taurus; identical to SEQ ID NO: 4317

SEQ ID NO: 86299 - DNA, 201 bp, Bos taurus
gctgggttgtgggtcccacacagagtttgggggagtagaggtcagcccaaggctgtgctggaggagggagaattgggtctgaggaaggctgaccaggcctcggcagaaggacaggaacaaagtggagatttaaggtaaaagtggcagcagttgccccagagccacaccttagggcccgtgctcaccccagggcctcagctt

SEQ ID NO: 86300 - DNA, 201 bp, Bos taurus
gctccctggtacaggtgcaggagtgtgctggcccctgctgtcaccatgatccctgcgctcctggggctcaccctgttcctccccttccacctgttgcttccgccattgcagaccccaggcccaagaatgccctccgctcagcagcgactttgttggaataaacacccgtttctctaagctggtgtccttctctgtttctag

SEQ ID NO: 86301 - DNA, 201 bp, Bos taurus; identical to SEQ ID NO: 4319

SEQ ID NO: 86302 - DNA, 201 bp, Bos taurus; identical to SEQ ID NO: 4320

SEQ ID NO: 86303 - DNA, 201 bp, Bos taurus
ggcctggcgccccactggagaagggatgggaggaagggggatggcgtcaggattctgcagatggtcccaggaccccaaaacagctcctgggaccagcatgctagagggcaggccctgccccgggaggaggcagccacgtcctacttctgcacccccgctccttcagtgaagaatcaggggctgtggtcgtgatcccagcct

SEQ ID NO: 86304 - DNA, 201 bp, Bos taurus; identical to SEQ ID NO: 4322

SEQ ID NO: 86305 - DNA, 201 bp, Bos taurus; identical to SEQ ID NO: 4323

SEQ ID NO: 86306 - DNA, 201 bp, Bos taurus; identical to SEQ ID NO: 4324

SEQ ID NO: 86307 - DNA, 201 bp, Bos taurus; identical to SEQ ID NO: 4325

SEQ ID NO: 86308 - DNA, 201 bp, Bos taurus; identical to SEQ ID NO: 4327

SEQ ID NO: 86309 - DNA, 201 bp, Bos taurus; identical to SEQ ID NO: 4330

SEQ ID NO: 86310 - DNA, 201 bp, Bos taurus; identical to SEQ ID NO: 4331

SEQ ID NO: 86311 - DNA, 201 bp, Bos taurus; identical to SEQ ID NO: 4332

SEQ ID NO: 86312 - DNA, 201 bp, Bos taurus; identical to SEQ ID NO: 4333

SEQ ID NO: 86313 - DNA, 201 bp, Bos taurus; identical to SEQ ID NO: 4334

SEQ ID NO: 86314 - DNA, 201 bp, Bos taurus; identical to SEQ ID NO: 4335

SEQ ID NO: 86315 - DNA, 201 bp, Bos taurus; identical to SEQ ID NO: 4336

SEQ ID NO: 86316 - DNA, 201 bp, Bos taurus; identical to SEQ ID NO: 4337

SEQ ID NO: 86317 - DNA, 201 bp, Bos taurus
tgagctcagttgcccctgaggcatgtggcctcttagttccccgcccaggatggaaccaagtcccctgtgttgcaaggtggattcccagccatgggccacccgggacattctggcgtgtaatgaactgtaccctaaaaaaatactcttctggttttaggttttgtacatctgtaagtagacattttcggagctctgccggcc

SEQ ID NO: 86318 - DNA, 201 bp, Bos taurus
gctgagttccaagatgctttacaccgtacagcccaaccgacagagcgcttctgctactagtggaacgtggcctctgtcggccagcaggtgataaactggcacaattgctttgaagccgatgtttacaggacacacctgaagagctccgaacagcagctccttgataaggcccccctgaaaccaccagtgacaatcaacaga

SEQ ID NO: 86319 - DNA, 201 bp, Bos taurus
catcttccaagcagtaaagcaaggttgttgttaccacgcgatgggcctccatcactgttcctcaccctgccactgccaagctcaccttccctctgcaagagtctgaggaggtggggccggaagacctctgacacctggtgctgagggaggcttttgctcatctgagccccctttcaccctcaaagcgcccccaaagcctca

SEQ ID NO: 86320 - DNA, 201 bp, Bos taurus; identical to SEQ ID NO: 4340

SEQ ID NO: 86321 - DNA, 201 bp, Bos taurus; identical to SEQ ID NO: 4341

SEQ ID NO: 86322 - DNA, 201 bp, Bos taurus; identical to SEQ ID NO: 4342

SEQ ID NO: 86323 - DNA, 201 bp, Bos taurus; identical to SEQ ID NO: 4343

SEQ ID NO: 86324 - DNA, 201 bp, Bos taurus; identical to SEQ ID NO: 4344

SEQ ID NO: 86325 - DNA, 201 bp, Bos taurus; identical to SEQ ID NO: 4345

SEQ ID NO: 86326 - DNA, 201 bp, Bos taurus; identical to SEQ ID NO: 4346

SEQ ID NO: 86327 - DNA, 201 bp, Bos taurus; identical to SEQ ID NO: 4347

SEQ ID NO: 86328 - DNA, 201 bp, Bos taurus; identical to SEQ ID NO: 4348

SEQ ID NO: 86329 - DNA, 201 bp, Bos taurus; identical to SEQ ID NO: 4350

SEQ ID NO: 86330 - DNA, 201 bp, Bos taurus; identical to SEQ ID NO: 4351

SEQ ID NO: 86331 - DNA, 201 bp, Bos taurus
cactgggccattctgaggctcgaaggacagacacagcttggagagtgctcggcaacagcagagtcctcacaagtatctgctgtcaggacagtccttcccacctcaggatggaaagacagcgtctggtcccggctgtttgggatcctcagtcactggacgtgtgtgtggtcaccctgtgtctcatgccgtgaccctgcagag

SEQ ID NO: 86332 - DNA, 201 bp, Bos taurus; identical to SEQ ID NO: 4352

SEQ ID NO: 86333 - DNA, 201 bp, Bos taurus
acattgtaggcagacactttaatctctgagccaccagggacgctcaaatgacccagaggtcatttgagccagaaacatagggagaggccacagaaaggaacattttaagggaaaggacggtgcgcccccgccctgccacacacacacagggagatctgtggaagggaaatgaaaacaccagtttctgtcccggcccctcct

SEQ ID NO: 86334 - DNA, 201 bp, Bos taurus; identical to SEQ ID NO: 4355

SEQ ID NO: 86335 - DNA, 201 bp, Bos taurus; identical to SEQ ID NO: 4356

SEQ ID NO: 86336 - DNA, 201 bp, Bos taurus
gtggagagaaactgaggcccagcggacacagcaagcatcagttacccgacaagtgagtggatgagccatcagatgattcctgtccccagcctctgtgttctcgagctgaggcccagacatacgtcatggagcagagaccagtcgcccccgctgtgccctgtcctaatttccgacccagagaatccgtgagcagaataaatg

SEQ ID NO: 86337 - DNA, 201 bp, Bos taurus; identical to SEQ ID NO: 4359

SEQ ID NO: 86338 - DNA, 201 bp, Bos taurus; identical to SEQ ID NO: 4360

SEQ ID NO: 86339 - DNA, 201 bp, Bos taurus; identical to SEQ ID NO: 4361

SEQ ID NO: 86340 - DNA, 201 bp, Bos taurus
gaaccacggactaaaaggagggagggcacgggagggatacaagggaggcgagcgtggcggcgggacttcctgtgactgacggcccagcgcagccaatgggcagcggggagatgacctcattgtcgaggaaagtctggaactggtggagtggcggcgcggaggtgggaggaggtcggagacgagccggaggcggggcgctgg

SEQ ID NO: 86341 - DNA, 201 bp, Bos taurus; identical to SEQ ID NO: 4363

SEQ ID NO: 86342 - DNA, 201 bp, Bos taurus; identical to SEQ ID NO: 4365

SEQ ID NO: 86343 - DNA, 201 bp, Bos taurus; identical to SEQ ID NO: 4366

SEQ ID NO: 86344 - DNA, 201 bp, Bos taurus; identical to SEQ ID NO: 4367

SEQ ID NO: 86345 - DNA, 201 bp, Bos taurus; identical to SEQ ID NO: 4368

SEQ ID NO: 86346 - DNA, 201 bp, Bos taurus; identical to SEQ ID NO: 4369

SEQ ID NO: 86347 - DNA, 201 bp, Bos taurus; identical to SEQ ID NO: 4370

SEQ ID NO: 86348 - DNA, 201 bp, Bos taurus
atttttttttttttttttttggccacacctgaccagggattgacctgtacccacctctgccgtggaatctcggagtcttaacccagtggaccggcagggaggtccaagaggcctgcattttcattgcccactgggtcccacaaatcctgcagctggctctggcctcatggaagctttgcctggaggaagtctgctgggtct

SEQ ID NO: 86349 - DNA, 201 bp, Bos taurus
gggcggggcttactgatgccattttacaggtgtggaaactgaggcccagaggacccagaattgtctcaggtcacacagtgaggcatggacagggctgggacattaaccccaggtcccagaggccccccagccagtgctcagtgccaggctggtcagggtgatgctgcctaccccccacccctcttcttgctacctaccagc

SEQ ID NO: 86350 - DNA, 201 bp, Bos taurus; identical to SEQ ID NO: 4374

SEQ ID NO: 86351 - DNA, 201 bp, Bos taurus; identical to SEQ ID NO: 4376

SEQ ID NO: 86352 - DNA, 201 bp, Bos taurus; identical to SEQ ID NO: 4379

SEQ ID NO: 86353 - DNA, 201 bp, Bos taurus; identical to SEQ ID NO: 4380

SEQ ID NO: 86354 - DNA, 201 bp, Bos taurus; identical to SEQ ID NO: 4381

SEQ ID NO: 86355 - DNA, 201 bp, Bos taurus
tgtctccccttcgtgtatccacgtccctcgcttttgaccttgaagtccctgtctctgaataacatccatttccccactccttgaagccacactcagccacgtgacttgttttggccaaagagctacaaatcagcacgatacaaccgaggtctgagaagcacctgtggtctggggccttgagatcctggagagggcatcact

SEQ ID NO: 86356 - DNA, 201 bp, Bos taurus; identical to SEQ ID NO: 4383

SEQ ID NO: 86357 - DNA, 201 bp, Bos taurus
ctccatgggcctgcatttgagaacatctggagacacgggcgggggtgatggggtggactggagtgggggacaggagcagacaccctcagacccatcccccgtctcaggcccctgggggattctttctccctgatacctcggagaggtgacttgaatcagttgaccctcttgctttcggtctgaaaaaatgatcaagtcatc

SEQ ID NO: 86358 - DNA, 201 bp, Bos taurus
acaccaggcccaaaggggtgacaagcccatcacctggtgaatgaatctgtaaagtgtgtctctctgagcaacggactgtgactcagccgtaagaaggagcaaggccccggcatgtgccacaatgtgggtgaaccttgaaaacatcatgctaagggagagaagaaggaaatggcagcccacccccgtgttcttgcatggaga

SEQ ID NO: 86359 - DNA, 201 bp, Bos taurus; identical to SEQ ID NO: 4384

SEQ ID NO: 86360 - DNA, 201 bp, Bos taurus; identical to SEQ ID NO: 4385

SEQ ID NO: 86361 - DNA, 201 bp, Bos taurus; identical to SEQ ID NO: 4386

SEQ ID NO: 86362 - DNA, 201 bp, Bos taurus
tgctccacttggacaagtccccggggcaggtccggggatgactcagcatccagggtgaaggaagcagcgctgatccctaagcaagagccaggcagaggttctccagcttggcctccaccaactgtggccctgggttctggcagcactgtctggaggagatgagactcaagccataggtcggggtcttcctcagcttgccct

SEQ ID NO: 86363 - DNA, 201 bp, Bos taurus; identical to SEQ ID NO: 4387

SEQ ID NO: 86364 - DNA, 201 bp, Bos taurus; identical to SEQ ID NO: 4388

SEQ ID NO: 86365 - DNA, 201 bp, Bos taurus; identical to SEQ ID NO: 4389

SEQ ID NO: 86366 - DNA, 201 bp, Bos taurus; identical to SEQ ID NO: 4391

SEQ ID NO: 86367 - DNA, 201 bp, Bos taurus; identical to SEQ ID NO: 4392

SEQ ID NO: 86368 - DNA, 201 bp, Bos taurus; identical to SEQ ID NO: 4394

SEQ ID NO: 86369 - DNA, 201 bp, Bos taurus; identical to SEQ ID NO: 4395

SEQ ID NO: 86370 - DNA, 201 bp, Bos taurus; identical to SEQ ID NO: 4398

SEQ ID NO: 86371 - DNA, 201 bp, Bos taurus
aaggcccttggccccgttctcagaacgaggcatcccaacagggaggtgctggggtaggttctccgtggtcccagggaggcccccacctgccagccttcaagtggcttcaagtcaggttgggtgggctcgagtccactcagtgtctctccagggccagagcaggtggtcctgaccccagcgccctggacgctccgtgggtca

SEQ ID NO: 86372 - DNA, 201 bp, Bos taurus; identical to SEQ ID NO: 4400

SEQ ID NO: 86373 - DNA, 201 bp, Bos taurus
agccccccaccgtagcccctccacacgggcctgagctgctccccgcccgggcccagggtgggtggggctctgcgcctggacaagcccgcgccttggccccaagagacacaaagcccccgagacagacgccctaatcccgagcacttcccatggtgcgcggaggcagaccacaggggcggcctccaggtctgcgtgcaaact

SEQ ID NO: 86374 - DNA, 201 bp, Bos taurus; identical to SEQ ID NO: 4404

SEQ ID NO: 86375 - DNA, 201 bp, Bos taurus; identical to SEQ ID NO: 4405

SEQ ID NO: 86376 - DNA, 201 bp, Bos taurus
ccaaagctctgcccagccgggtgtggcccgtgctgcccagagctgggggcgtctgccgcctcccccctgcacccggggtgccccagctctccccgcggcctgcctccatcccaacggtaagatgggcagaaccttctggaatgggctccctcctgccccaggctccctgcgtgctccggctccctttctcctccaagaggc

SEQ ID NO: 86377 - DNA, 201 bp, Bos taurus; identical to SEQ ID NO: 4406

SEQ ID NO: 86378 - DNA, 201 bp, Bos taurus; identical to SEQ ID NO: 4407

SEQ ID NO: 86379 - DNA, 201 bp, Bos taurus
ggcccgtggctggtggtggggggagccgtggcccttcccagctacatggagtaattgttcctatctgcccatcctgccttcccagcctggtctccctgatatctgcctgtggccgaggggccagccagctctgcagccctctgcctccctctccctcactttccatggctgctttctcttccagttttgtccaccatgtcc

SEQ ID NO: 86380 - DNA, 201 bp, Bos taurus; identical to SEQ ID NO: 4408

SEQ ID NO: 86381 - DNA, 201 bp, Bos taurus
agaagagctggtagtattaggaacatgagaccctcggggcctccagaattgtggagtgtggtctcgctttctctagagatgggcaggccaagaggctctccgagaggacacagaggctctgtgtgtgtgttggtgccacagccaggcttccttcccactccggtgggccctccttgccttgccgtctgagtcctgtgtttg

SEQ ID NO: 86382 - DNA, 201 bp, Bos taurus
gctcagaaggggatgggccatctgtgcggatgggcgggggcatggccaattttgctcatcctcagagactaagaagacttcctttgaggattctgtttcacgacgatctggttgacctggggcagtttacctaacctctctgttcccgggttgcttcatctacagatctgacaatagtaactaccctggcgaaacacagag

SEQ ID NO: 86383 - DNA, 201 bp, Bos taurus; identical to SEQ ID NO: 4410

SEQ ID NO: 86384 - DNA, 201 bp, Bos taurus; identical to SEQ ID NO: 4411

SEQ ID NO: 86385 - DNA, 201 bp, Bos taurus; identical to SEQ ID NO: 4412

SEQ ID NO: 86386 - DNA, 201 bp, Bos taurus; identical to SEQ ID NO: 4413

SEQ ID NO: 86387 - DNA, 201 bp, Bos taurus; identical to SEQ ID NO: 4414

SEQ ID NO: 86388 - DNA, 201 bp, Bos taurus; identical to SEQ ID NO: 4415

SEQ ID NO: 86389 - DNA, 201 bp, Bos taurus
tcttggcacagcccccagttctgaccagttacctgccctgccctccccaagcacagagcctgcacatccagctggtcatctcttgactggcccacggcacgcgaggctggttcagtacccagggtctgtagagcttcccttttcaactgacgaggagctttcaaaactgcaggcatcccttgccttcttcttctgcccaag

SEQ ID NO: 86390 - DNA, 201 bp, Bos taurus; identical to SEQ ID NO: 4418

SEQ ID NO: 86391 - DNA, 201 bp, Bos taurus
cggccccattgttcttccccttgacaaataagagagatgtcatggagcctggcgctttgttagaacacagggaaggaaattaggtcctctccatctgtcatggcgatgatggagggcctgccccagcctcctgtgcgatgccctggaatgagcggtgctctgccatgagcccgccttaaccgcgttcccctgcaagcctgc

SEQ ID NO: 86392 - DNA, 201 bp, Bos taurus
gtataactgatggctgttgctggccattcattcttctaacaaaaatcatgtttcccagtgctgttcttgcagaagagaaagtggccagtccagaccccactgtcccggacacatgtccagggatgggggacagatgacaaatgggtggacacggaggataaaacagaatcataagacagaagtaaagcagagatcactgag

SEQ ID NO: 86393 - DNA, 201 bp, Bos taurus; identical to SEQ ID NO: 4420

SEQ ID NO: 86394 - DNA, 201 bp, Bos taurus; identical to SEQ ID NO: 4425

SEQ ID NO: 86395 - DNA, 201 bp, Bos taurus; identical to SEQ ID NO: 4426

SEQ ID NO: 86396 - DNA, 201 bp, Bos taurus; identical to SEQ ID NO: 4427

SEQ ID NO: 86397 - DNA, 201 bp, Bos taurus; identical to SEQ ID NO: 4428

SEQ ID NO: 86398 - DNA, 201 bp, Bos taurus; identical to SEQ ID NO: 4429

SEQ ID NO: 86399 - DNA, 201 bp, Bos taurus; identical to SEQ ID NO: 4430

SEQ ID NO: 86400 - DNA, 201 bp, Bos taurus; identical to SEQ ID NO: 4431

SEQ ID NO: 86401 - DNA, 201 bp, Bos taurus; identical to SEQ ID NO: 4432

SEQ ID NO: 86402 - DNA, 201 bp, Bos taurus; identical to SEQ ID NO: 4434

SEQ ID NO: 86403 - DNA, 201 bp, Bos taurus; identical to SEQ ID NO: 4435

SEQ ID NO: 86404 - DNA, 201 bp, Bos taurus; identical to SEQ ID NO: 4437

SEQ ID NO: 86405 - DNA, 201 bp, Bos taurus; identical to SEQ ID NO: 4438

SEQ ID NO: 86406 - DNA, 201 bp, Bos taurus
cttcgctttcactttcacttttattgccctagggaaatcactgtactactgctttgttgtcctagggaaatcatttattcatttaccttaacatttttttccccatgtgacaggcattattctagaattatcaattaatttggcaataagtttttatagaaaaaacaagatagggtttccctgatgctcagtggtaaagaa

SEQ ID NO: 86407 - DNA, 201 bp, Bos taurus
tacaaaggactttcttaaagatggagcatatttagtactttttcttctcaaattttaaaaatgagcatttgaacaattgtcagaagtagactttaatttttactgtgtttctttccttaattgaagtgaagggggagcaagggaaaggcaatgtcttcttagacaatacaggcaattatttgaagtttattgtttagttgt

SEQ ID NO: 86408 - DNA, 201 bp, Bos taurus
ttattgtatggaattttaaaagtcctaatttctttctttcttttttttttttgtaacatgtagctatccaatttttcagcacaatttattgaagatactgtcttcccccactgtgtaatattacctcattagttgcagattaattgaccatgctgctgctgcgtcgctttagtcatgtccgactctgtgcaaccccactga

SEQ ID NO: 86409 - DNA, 201 bp, Bos taurus
aggaaactggaacccaccaaaaaatataccccatatccaaagacaaagaaaaagccacaagatggttggcagggtaccatcataagaaaataaaatcccatacccaccaagtgggcaacccacaaactagagaacaataatacctaagaagttctctcactgttgtgaaggttatagaccacacatcaggcttcataactt

SEQ ID NO: 86410 - DNA, 201 bp, Bos taurus
tacaatgcccaaaatcctacaacatccagtccttacttgcttttctgacataatctcccaacttttaacctcacacactctgtttcagccacttgtacaaagaaatgcttttgccaacacatctacatcctttttcttctctatcattcaaatctttctcaaaaaccatattctttataaagaacttcccacaccaaacta

SEQ ID NO: 86411 - DNA, 201 bp, Bos taurus; identical to SEQ ID NO: 4442

SEQ ID NO: 86412 - DNA, 201 bp, Bos taurus; identical to SEQ ID NO: 4443

SEQ ID NO: 86413 - DNA, 201 bp, Bos taurus
tctcttcctgagccccatctgggcccacaatgttgcctctacaatcttgtggtgagacaaccaggagacagatgatccttggaagggaaatactgtataacttccaattcctctagatatccaggccttcatcttccatgtttcctacaacatgtgcaacaacatcatctcttagtgaacatgctagggtgggtgacaggc

SEQ ID NO: 86414 - DNA, 201 bp, Bos taurus; identical to SEQ ID NO: 4449

SEQ ID NO: 86415 - DNA, 201 bp, Bos taurus; identical to SEQ ID NO: 45947

SEQ ID NO: 86416 - DNA, 201 bp, Bos taurus; identical to SEQ ID NO: 4451

SEQ ID NO: 86417 - DNA, 201 bp, Bos taurus; identical to SEQ ID NO: 4452

SEQ ID NO: 86418 - DNA, 201 bp, Bos taurus; identical to SEQ ID NO: 4453

SEQ ID NO: 86419 - DNA, 201 bp, Bos taurus; identical to SEQ ID NO: 4455

SEQ ID NO: 86420 - DNA, 201 bp, Bos taurus; identical to SEQ ID NO: 4456

SEQ ID NO: 86421 - DNA, 201 bp, Bos taurus; identical to SEQ ID NO: 4457

SEQ ID NO: 86422 - DNA, 201 bp, Bos taurus; identical to SEQ ID NO: 4460

SEQ ID NO: 86423 - DNA, 201 bp, Bos taurus
atgaataataaacatatctgtcttcctgaatttctcatgggtgtatgtctagaaaacttacttgatttacgtattgaacaagaatatatttttttcaggccaatcagttgacagtgttatcagttgacaactgaattgtcaaaagttattaaaagttgacttttggttgaaaagcatgaaataacaacactgcagaatgaa

SEQ ID NO: 86424 - DNA, 201 bp, Bos taurus
ggaaacatgaattttttttttatttaaaaagtttggtacactttattaccttggagaaaaaagctccatatgttaaaggcaagttatttcaactccctttgcattataaatgatatttgctttagactttgcctgtcataatatattcaagagcctatgagaatctaacggaacactcttacctagctccataagccctct

SEQ ID NO: 86425 - DNA, 201 bp, Bos taurus; identical to SEQ ID NO: 4461

SEQ ID NO: 86426 - DNA, 201 bp, Bos taurus; identical to SEQ ID NO: 4464

SEQ ID NO: 86427 - DNA, 201 bp, Bos taurus
ttgatgttacacaagaaaaaatttatatcccaaaacttaataagagattttaaacaaaatgatttatctataaaataaaaattctcaagctatattccaagtacatttggtagaacatcaaaatcatggatattttgaacagcatgcctagtgtccacaaagggatgtgtgtacagaatgttgctgacactaataaaagaa

SEQ ID NO: 86428 - DNA, 201 bp, Bos taurus; identical to SEQ ID NO: 4465

SEQ ID NO: 86429 - DNA, 201 bp, Bos taurus; identical to SEQ ID NO: 4466

SEQ ID NO: 86430 - DNA, 201 bp, Bos taurus; identical to SEQ ID NO: 4467

SEQ ID NO: 86431 - DNA, 201 bp, Bos taurus; identical to SEQ ID NO: 4468

SEQ ID NO: 86432 - DNA, 201 bp, Bos taurus; identical to SEQ ID NO: 4469

SEQ ID NO: 86433 - DNA, 201 bp, Bos taurus; identical to SEQ ID NO: 4470

SEQ ID NO: 86434 - DNA, 201 bp, Bos taurus
ggaaagtttggcactctgttagatgaaaaattgaagggtaagacaccttttaaaaggtataattttatttggtaattgtaaatgtttcttggagacagacgtcttctatcaacaacttacaggcatagtgattcactacggcctcacttaagtgagacagtgctgagactttcatgagttatgccatcacagcttggtggt

SEQ ID NO: 86435 - DNA, 201 bp, Bos taurus
cggcctgaagatgcacattcgtactcacaccagggtaagaatattctatctcatttcttataagatccacacttactttaaagatatttaactttacctgagaaagcaaaggtggtagatctgaaactttatgtttgtggtgaatatttaaggatatctttttttttttttaaagacataacaatgaaagacacaaaaatc

SEQ ID NO: 86436 - DNA, 201 bp, Bos taurus
aggtagagatccaccttgtgggactgaaaggaggcgcttctttctttatcattcctgtgaatatttacgagggctctggcacaacatgactggtgctgctgagaccatgcctctcacagaatgctcatctttcccaactagaaacaaatgcaggaatacccctggtatgcacagggcttcattcatgactaatggagacag

SEQ ID NO: 86437 - DNA, 201 bp, Bos taurus; identical to SEQ ID NO: 4473

SEQ ID NO: 86438 - DNA, 201 bp, Bos taurus; identical to SEQ ID NO: 4474

SEQ ID NO: 86439 - DNA, 201 bp, Bos taurus; identical to SEQ ID NO: 4475

SEQ ID NO: 86440 - DNA, 201 bp, Bos taurus
actttacagtagaaggttgatcttcactattaattagttcaaggagagaaatcacatatcacccccaaaagttgacctgaccaggtcagggaacagttctcctgggaatcatacagcatttttaagtctcttcataatggcatcagtggtgtcttggtttgcttctttcagctcctgtttttctatgccctcgaaactagt

SEQ ID NO: 86441 - DNA, 201 bp, Bos taurus
cttctctgccttgttttcatgtctgagaactgggaacccagatatctacttaatgagagggttgtaaggataaaatgagttcatgtatggaaagggcctgtcacatagttcctgctcaataaacattcacctccttccctccactctgctaggagacctttctgtgactctgagaattgtcctctggtagctcttttctat

SEQ ID NO: 86442 - DNA, 201 bp, Bos taurus; identical to SEQ ID NO: 4477

SEQ ID NO: 86443 - DNA, 201 bp, Bos taurus; identical to SEQ ID NO: 4478

SEQ ID NO: 86444 - DNA, 201 bp, Bos taurus; identical to SEQ ID NO: 4479

SEQ ID NO: 86445 - DNA, 201 bp, Bos taurus
cctttgttatactagcatatatgcctatctgttgtttctgatagattaatacaatttataggtattactttattttttgaaaatactaatttaaaatatgtaattatttgttggaagaggtctcctccctccatccaaaatcagtgactcaactagagtttgtttttgcctcctgtaacagttcagaggtagacatggggt

SEQ ID NO: 86446 - DNA, 201 bp, Bos taurus
tgctttgaacacggagcatgaagtccaaggccccagttcaggacatgcccctccgacccctcgtctcaacagtgtagcagtggggcctgcggggaggacgcgaaggttgaacccagacgctacctctggttcattacccttgtgatgctggtgacgttcctaggcctctagatctcattttcttcacttgtaaaatgaaga

SEQ ID NO: 86447 - DNA, 201 bp, Bos taurus; identical to SEQ ID NO: 4481

SEQ ID NO: 86448 - DNA, 201 bp, Bos taurus
tctggttaaataggcttagtgcttccaacacagttccagtaacctcttttatggttagctgttgcttttaagacttaaaaccctttcttcctcttttttcttcccagagaaaacttccctagttagaaatcaataggggactttggacatttcatagccaaactgttgacatgttccttctcaagtggttaacatcaactt

SEQ ID NO: 86449 - DNA, 201 bp, Bos taurus; identical to SEQ ID NO: 4485

SEQ ID NO: 86450 - DNA, 201 bp, Bos taurus; identical to SEQ ID NO: 4486

SEQ ID NO: 86451 - DNA, 201 bp, Bos taurus; identical to SEQ ID NO: 4488

SEQ ID NO: 86452 - DNA, 201 bp, Bos taurus; identical to SEQ ID NO: 4489

SEQ ID NO: 86453 - DNA, 201 bp, Bos taurus; identical to SEQ ID NO: 4490

SEQ ID NO: 86454 - DNA, 201 bp, Bos taurus; identical to SEQ ID NO: 4492

SEQ ID NO: 86455 - DNA, 201 bp, Bos taurus; identical to SEQ ID NO: 4493

SEQ ID NO: 86456 - DNA, 201 bp, Bos taurus; identical to SEQ ID NO: 4494

SEQ ID NO: 86457 - DNA, 201 bp, Bos taurus; identical to SEQ ID NO: 4495

SEQ ID NO: 86458 - DNA, 201 bp, Bos taurus
ttgaattcattatatttactctatagaaacagcaggaagcatatattaaaatgcttggggtaattcaaattcattcttatttattatgatattcttcagctcttaaaaatatctattttattaaaacacgcttactccttggaagaaaatttatgaccaacctagacagcatatttgtagaaggaaatggcaacccactcc

SEQ ID NO: 86459 - DNA, 201 bp, Bos taurus; identical to SEQ ID NO: 4496

SEQ ID NO: 86460 - DNA, 201 bp, Bos taurus; identical to SEQ ID NO: 4497

SEQ ID NO: 86461 - DNA, 201 bp, Bos taurus; identical to SEQ ID NO: 4498

SEQ ID NO: 86462 - DNA, 201 bp, Bos taurus; identical to SEQ ID NO: 4499

SEQ ID NO: 86463 - DNA, 201 bp, Bos taurus; identical to SEQ ID NO: 4505

SEQ ID NO: 86464 - DNA, 201 bp, Bos taurus; identical to SEQ ID NO: 4506

SEQ ID NO: 86465 - DNA, 201 bp, Bos taurus; identical to SEQ ID NO: 4507

SEQ ID NO: 86466 - DNA, 201 bp, Bos taurus; identical to SEQ ID NO: 4508

SEQ ID NO: 86467 - DNA, 201 bp, Bos taurus; identical to SEQ ID NO: 4509

SEQ ID NO: 86468 - DNA, 201 bp, Bos taurus; identical to SEQ ID NO: 4510

SEQ ID NO: 86469 - DNA, 201 bp, Bos taurus; identical to SEQ ID NO: 4511

SEQ ID NO: 86470 - DNA, 201 bp, Bos taurus; identical to SEQ ID NO: 4512

SEQ ID NO: 86471 - DNA, 201 bp, Bos taurus; identical to SEQ ID NO: 4513

SEQ ID NO: 86472 - DNA, 201 bp, Bos taurus; identical to SEQ ID NO: 4514

SEQ ID NO: 86473 - DNA, 201 bp, Bos taurus; identical to SEQ ID NO: 4515

SEQ ID NO: 86474 - DNA, 201 bp, Bos taurus; identical to SEQ ID NO: 4517

SEQ ID NO: 86475 - DNA, 201 bp, Bos taurus; identical to SEQ ID NO: 4519

SEQ ID NO: 86476 - DNA, 201 bp, Bos taurus; identical to SEQ ID NO: 4520

SEQ ID NO: 86477 - DNA, 201 bp, Bos taurus; identical to SEQ ID NO: 4521

SEQ ID NO: 86478 - DNA, 201 bp, Bos taurus; identical to SEQ ID NO: 4523

SEQ ID NO: 86479 - DNA, 201 bp, Bos taurus; identical to SEQ ID NO: 4525

SEQ ID NO: 86480 - DNA, 201 bp, Bos taurus; identical to SEQ ID NO: 4527

SEQ ID NO: 86481 - DNA, 201 bp, Bos taurus; identical to SEQ ID NO: 4528

SEQ ID NO: 86482 - DNA, 201 bp, Bos taurus; identical to SEQ ID NO: 4529

SEQ ID NO: 86483 - DNA, 201 bp, Bos taurus; identical to SEQ ID NO: 4530

SEQ ID NO: 86484 - DNA, 201 bp, Bos taurus; identical to SEQ ID NO: 4531

SEQ ID NO: 86485 - DNA, 201 bp, Bos taurus; identical to SEQ ID NO: 4533

SEQ ID NO: 86486 - DNA, 201 bp, Bos taurus; identical to SEQ ID NO: 4534

SEQ ID NO: 86487 - DNA, 201 bp, Bos taurus; identical to SEQ ID NO: 4535

SEQ ID NO: 86488 - DNA, 201 bp, Bos taurus; identical to SEQ ID NO: 4536

SEQ ID NO: 86489 - DNA, 201 bp, Bos taurus; identical to SEQ ID NO: 4537

SEQ ID NO: 86490 - DNA, 201 bp, Bos taurus; identical to SEQ ID NO: 4538

SEQ ID NO: 86491 - DNA, 201 bp, Bos taurus; identical to SEQ ID NO: 4539

SEQ ID NO: 86492 - DNA, 201 bp, Bos taurus; identical to SEQ ID NO: 4541

SEQ ID NO: 86493 - DNA, 201 bp, Bos taurus; identical to SEQ ID NO: 4542

SEQ ID NO: 86494 - DNA, 201 bp, Bos taurus; identical to SEQ ID NO: 4545

SEQ ID NO: 86495 - DNA, 201 bp, Bos taurus; identical to SEQ ID NO: 4546

SEQ ID NO: 86496 - DNA, 201 bp, Bos taurus; identical to SEQ ID NO: 4547

SEQ ID NO: 86497 - DNA, 201 bp, Bos taurus; identical to SEQ ID NO: 4548

SEQ ID NO: 86498 - DNA, 201 bp, Bos taurus; identical to SEQ ID NO: 4549

SEQ ID NO: 86499 - DNA, 201 bp, Bos taurus; identical to SEQ ID NO: 4553

SEQ ID NO: 86500 - DNA, 201 bp, Bos taurus; identical to SEQ ID NO: 4556

SEQ ID NO: 86501 - DNA, 201 bp, Bos taurus; identical to SEQ ID NO: 4557

SEQ ID NO: 86502 - DNA, 201 bp, Bos taurus; identical to SEQ ID NO: 4558

SEQ ID NO: 86503 - DNA, 201 bp, Bos taurus; identical to SEQ ID NO: 4561

SEQ ID NO: 86504 - DNA, 201 bp, Bos taurus; identical to SEQ ID NO: 4562

SEQ ID NO: 86505 - DNA, 201 bp, Bos taurus; identical to SEQ ID NO: 4563

SEQ ID NO: 86506 - DNA, 201 bp, Bos taurus; identical to SEQ ID NO: 4564

SEQ ID NO: 86507 - DNA, 201 bp, Bos taurus; identical to SEQ ID NO: 4565

SEQ ID NO: 86508 - DNA, 201 bp, Bos taurus; identical to SEQ ID NO: 4566

SEQ ID NO: 86509 - DNA, 201 bp, Bos taurus; identical to SEQ ID NO: 4567

SEQ ID NO: 86510 - DNA, 201 bp, Bos taurus; identical to SEQ ID NO: 4568

SEQ ID NO: 86511 - DNA, 201 bp, Bos taurus; identical to SEQ ID NO: 4569

SEQ ID NO: 86512 - DNA, 201 bp, Bos taurus; identical to SEQ ID NO: 4570

SEQ ID NO: 86513 - DNA, 201 bp, Bos taurus; identical to SEQ ID NO: 4571

SEQ ID NO: 86514 - DNA, 201 bp, Bos taurus; identical to SEQ ID NO: 4572

SEQ ID NO: 86515 - DNA, 201 bp, Bos taurus; identical to SEQ ID NO: 4573

SEQ ID NO: 86516 - DNA, 201 bp, Bos taurus; identical to SEQ ID NO: 4574

SEQ ID NO: 86517 - DNA, 201 bp, Bos taurus; identical to SEQ ID NO: 4575

SEQ ID NO: 86518 - DNA, 201 bp, Bos taurus; identical to SEQ ID NO: 4576

SEQ ID NO: 86519 - DNA, 201 bp, Bos taurus; identical to SEQ ID NO: 4577

SEQ ID NO: 86520 - DNA, 201 bp, Bos taurus; identical to SEQ ID NO: 4578

SEQ ID NO: 86521 - DNA, 201 bp, Bos taurus; identical to SEQ ID NO: 4579

SEQ ID NO: 86522 - DNA, 201 bp, Bos taurus; identical to SEQ ID NO: 4580

SEQ ID NO: 86523 - DNA, 201 bp, Bos taurus; identical to SEQ ID NO: 4581

SEQ ID NO: 86524 - DNA, 201 bp, Bos taurus; identical to SEQ ID NO: 4582

SEQ ID NO: 86525 - DNA, 201 bp, Bos taurus; identical to SEQ ID NO: 4583

SEQ ID NO: 86526 - DNA, 201 bp, Bos taurus; identical to SEQ ID NO: 4584

SEQ ID NO: 86527 - DNA, 201 bp, Bos taurus; identical to SEQ ID NO: 4585

SEQ ID NO: 86528 - DNA, 201 bp, Bos taurus; identical to SEQ ID NO: 4586

SEQ ID NO: 86529 - DNA, 201 bp, Bos taurus; identical to SEQ ID NO: 4587

SEQ ID NO: 86530 - DNA, 201 bp, Bos taurus; identical to SEQ ID NO: 4588

SEQ ID NO: 86531 - DNA, 201 bp, Bos taurus; identical to SEQ ID NO: 4589

SEQ ID NO: 86532 - DNA, 201 bp, Bos taurus; identical to SEQ ID NO: 4590

SEQ ID NO: 86533 - DNA, 201 bp, Bos taurus; identical to SEQ ID NO: 4591

SEQ ID NO: 86534 - DNA, 201 bp, Bos taurus; identical to SEQ ID NO: 4592

SEQ ID NO: 86535 - DNA, 201 bp, Bos taurus; identical to SEQ ID NO: 46055

SEQ ID NO: 86536 - DNA, 201 bp, Bos taurus; identical to SEQ ID NO: 4593

SEQ ID NO: 86537 - DNA, 201 bp, Bos taurus; identical to SEQ ID NO: 4594

SEQ ID NO: 86538 - DNA, 201 bp, Bos taurus; identical to SEQ ID NO: 4595

SEQ ID NO: 86539 - DNA, 201 bp, Bos taurus; identical to SEQ ID NO: 4596

SEQ ID NO: 86540 - DNA, 201 bp, Bos taurus; identical to SEQ ID NO: 4597

SEQ ID NO: 86541 - DNA, 201 bp, Bos taurus; identical to SEQ ID NO: 4598

SEQ ID NO: 86542 - DNA, 201 bp, Bos taurus; identical to SEQ ID NO: 4599

SEQ ID NO: 86543 - DNA, 201 bp, Bos taurus; identical to SEQ ID NO: 4600

SEQ ID NO: 86544 - DNA, 201 bp, Bos taurus
caccagggaagcccctagttggcttactttccctaattctgagaactttgctgttctcaataaagtatgtgctgctttccaaacttatactgggctatctgttattctcagataattgagcaagctatattttatgcaaaggaggagccgtcatacaaggaaaatagtctgtgggactcccaggctgtgcatattcttctc

SEQ ID NO: 86545 - DNA, 201 bp, Bos taurus; identical to SEQ ID NO: 4601

SEQ ID NO: 86546 - DNA, 201 bp, Bos taurus; identical to SEQ ID NO: 4602

SEQ ID NO: 86547 - DNA, 201 bp, Bos taurus; identical to SEQ ID NO: 4603

SEQ ID NO: 86548 - DNA, 201 bp, Bos taurus; identical to SEQ ID NO: 4604

SEQ ID NO: 86549 - DNA, 201 bp, Bos taurus; identical to SEQ ID NO: 4605

SEQ ID NO: 86550 - DNA, 201 bp, Bos taurus; identical to SEQ ID NO: 4606

SEQ ID NO: 86551 - DNA, 201 bp, Bos taurus; identical to SEQ ID NO: 4607

SEQ ID NO: 86552 - DNA, 201 bp, Bos taurus; identical to SEQ ID NO: 4608

SEQ ID NO: 86553 - DNA, 201 bp, Bos taurus; identical to SEQ ID NO: 4609

SEQ ID NO: 86554 - DNA, 201 bp, Bos taurus
ttggaagtggcagaagtacaagcaaggccctacttaaatttatgagcactcattttcactgtccaaagcaagaagtatgaccaagtcaaaggtcaggaagaataaaactctttttcatcattaggccattaaaaggatgaagatgcattatatactgtaatgatgtgaaaaattaaggccataaatttaatattccacaat

SEQ ID NO: 86555 - DNA, 201 bp, Bos taurus
gtgtagattacagtagattgaaattttgtatcccatttttcatccctttccacatccacctttttgtcatgacctaatctggacatagtgttctttcctatgccttgattttgaccttaggcatatgtcttgcattgtccaattgcttgcagagggtagtgacagtatgcctattctgaaccttgacctcaagtggaatta

SEQ ID NO: 86556 - DNA, 201 bp, Bos taurus; identical to SEQ ID NO: 4610

SEQ ID NO: 86557 - DNA, 201 bp, Bos taurus; identical to SEQ ID NO: 4611

SEQ ID NO: 86558 - DNA, 201 bp, Bos taurus; identical to SEQ ID NO: 4612

SEQ ID NO: 86559 - DNA, 201 bp, Bos taurus; identical to SEQ ID NO: 4613

SEQ ID NO: 86560 - DNA, 201 bp, Bos taurus
cactactacaaccaaatctactatgtaaaattcaaattttcttggcagttattttcgtccttatagtttatctcactaaaggttcacagttagagacaaacacttcaaatctttattgatattgtttcaaagttattggagttatgcaaggggaaaatcaagagtatattaataatggcagcaaaatctggaacaactaga

SEQ ID NO: 86561 - DNA, 201 bp, Bos taurus
catatgcataaataaagatacatttttaattactaaacttaactaaaatagcatcacattattgtgtcattttaaatttaccattcacagagttatcaaaatatatttattctgtgcttagcccttactgtgtccttacgtctgtcataccagctggcacatggtaagcacacaatccagactactgaataaaataatcat

SEQ ID NO: 86562 - DNA, 201 bp, Bos taurus
gcaacctaaaacaatgttgtccatatacagaccgatatattaaaacctcatgggaacagcaaatcccaaaaccaagacagatacacaacaaaagaaaaagtaactaaaacacaacactgaagacagtcatcaagccaaaagagtagaggacaaaagaggaagggatgaaaaaagacctaccaaaaattaaatcaatctttt

SEQ ID NO: 86563 - DNA, 201 bp, Bos taurus
agtcatgtctctccataaagactgtcccactgttaattatctcaagcttcagtgggtctaaagccaaattaatttattcctatcatagtgaatattccttgtaccagtagtacttatatcttaatttcatgctgctttccttaccactgtccccctttgttatgcccctacctaggtcatttgtgaagtgaagtcgctcag

SEQ ID NO: 86564 - DNA, 201 bp, Bos taurus
agtttgaaaataattgatgctattcatgaaaatttaaatgttataacctttcagggagacagtttgacaatagtattttaaaatctatcaacagagacatttgctacagcagtttcacttgtaggaatttatcctaccagtatatccacatatacgggcagaaatacaaccgcattcactgcagcaccatatgtgatgaac

SEQ ID NO: 86565 - DNA, 201 bp, Bos taurus; identical to SEQ ID NO: 4614

SEQ ID NO: 86566 - DNA, 201 bp, Bos taurus; identical to SEQ ID NO: 4615

SEQ ID NO: 86567 - DNA, 201 bp, Bos taurus
gtagtaggaccaacgagagggaagacgagagcttgaagtggagtgtttgaggttgaggttactcccaggagaggctgtaccagagtcaaggtgtttatgcgagaatgggtaactgaagagcaactccaaactcatttgcagggaactttaaagagtttttatgtccatttgactggtagaggttgaattgaatgatctctt

SEQ ID NO: 86568 - DNA, 201 bp, Bos taurus; identical to SEQ ID NO: 4616

SEQ ID NO: 86569 - DNA, 201 bp, Bos taurus; identical to SEQ ID NO: 4617

SEQ ID NO: 86570 - DNA, 201 bp, Bos taurus; identical to SEQ ID NO: 4618

SEQ ID NO: 86571 - DNA, 201 bp, Bos taurus; identical to SEQ ID NO: 4619

SEQ ID NO: 86572 - DNA, 201 bp, Bos taurus; identical to SEQ ID NO: 4620

SEQ ID NO: 86573 - DNA, 201 bp, Bos taurus; identical to SEQ ID NO: 4621

SEQ ID NO: 86574 - DNA, 201 bp, Bos taurus; identical to SEQ ID NO: 4622

SEQ ID NO: 86575 - DNA, 201 bp, Bos taurus
cttcttatgacagcagcgcaaactctaaaatattttaagttgtacatattaatccaaatctcttaatgtttcttgccaagctgcagtctactgtcaccaatttagaataattctacctctcaggactcagacctcaggtttaaagtgtctcccaggagtgaaaacctgaatcaagctgtgactgcctgcaatccccctttc

SEQ ID NO: 86576 - DNA, 201 bp, Bos taurus; identical to SEQ ID NO: 4623

SEQ ID NO: 86577 - DNA, 201 bp, Bos taurus; identical to SEQ ID NO: 4624

SEQ ID NO: 86578 - DNA, 201 bp, Bos taurus; identical to SEQ ID NO: 4625

SEQ ID NO: 86579 - DNA, 201 bp, Bos taurus
tggatttaggatacagaaggtttttctctaacaagacatcctttagataattctattattagtcttctcaggctgccataaccataggccagttggtttaaataacaaaaattaattttttctgagttctggaggctgtaggtctgagattagggatcattatggtgagattctggtgagggttctcttggcctcacatga

SEQ ID NO: 86580 - DNA, 201 bp, Bos taurus; identical to SEQ ID NO: 4626

SEQ ID NO: 86581 - DNA, 201 bp, Bos taurus; identical to SEQ ID NO: 4627

SEQ ID NO: 86582 - DNA, 201 bp, Bos taurus; identical to SEQ ID NO: 4628

SEQ ID NO: 86583 - DNA, 201 bp, Bos taurus; identical to SEQ ID NO: 4629

SEQ ID NO: 86584 - DNA, 201 bp, Bos taurus; identical to SEQ ID NO: 4630

SEQ ID NO: 86585 - DNA, 201 bp, Bos taurus; identical to SEQ ID NO: 4631

SEQ ID NO: 86586 - DNA, 201 bp, Bos taurus; identical to SEQ ID NO: 4632

SEQ ID NO: 86587 - DNA, 201 bp, Bos taurus; identical to SEQ ID NO: 4633

SEQ ID NO: 86588 - DNA, 201 bp, Bos taurus; identical to SEQ ID NO: 4634

SEQ ID NO: 86589 - DNA, 201 bp, Bos taurus; identical to SEQ ID NO: 4635

SEQ ID NO: 86590 - DNA, 201 bp, Bos taurus; identical to SEQ ID NO: 4636

SEQ ID NO: 86591 - DNA, 201 bp, Bos taurus; identical to SEQ ID NO: 4637

SEQ ID NO: 86592 - DNA, 201 bp, Bos taurus; identical to SEQ ID NO: 4638

SEQ ID NO: 86593 - DNA, 201 bp, Bos taurus; identical to SEQ ID NO: 4639

SEQ ID NO: 86594 - DNA, 201 bp, Bos taurus; identical to SEQ ID NO: 4640

SEQ ID NO: 86595 - DNA, 201 bp, Bos taurus; identical to SEQ ID NO: 4643

SEQ ID NO: 86596 - DNA, 201 bp, Bos taurus; identical to SEQ ID NO: 4647

SEQ ID NO: 86597 - DNA, 201 bp, Bos taurus; identical to SEQ ID NO: 4648

SEQ ID NO: 86598 - DNA, 201 bp, Bos taurus; identical to SEQ ID NO: 4649

SEQ ID NO: 86599 - DNA, 201 bp, Bos taurus; identical to SEQ ID NO: 4650

SEQ ID NO: 86600 - DNA, 201 bp, Bos taurus; identical to SEQ ID NO: 4651

SEQ ID NO: 86601 - DNA, 201 bp, Bos taurus; identical to SEQ ID NO: 4652

SEQ ID NO: 86602 - DNA, 201 bp, Bos taurus
caagaatctgatcagcatgcaaaaattcacaggtgaatggagacactggaaaatgtgaatagtacatggcagtctggactctataaactctagaaaccaaccaagtgtaactgatttaaaagactcagtctggtttgaaagaaacttctggaaagagaaacttcattgagcaggaaggagacaagaaaaaggaaaaagaag

SEQ ID NO: 86603 - DNA, 201 bp, Bos taurus
cagtgattggttccagttaatccaacttttttgctaaactgcatatttcaggagagctaactatagttctacatcagactgacccttattatttcttctgctcactacaaatatggtgatttctgtgataatcaaaaatgttcaatattttattttcttgctttatcatctctatttatgagaggactatattctttattt

SEQ ID NO: 86604 - DNA, 201 bp, Bos taurus; identical to SEQ ID NO: 4653

SEQ ID NO: 86605 - DNA, 201 bp, Bos taurus
caacacagaaatatcaaaatcctagttataggtaacccagcacaccgaagagagtcttagctccatcctgccaaaactgccttatgcccatgctcgaagtgggcccaataactcagaaatgcccttcattaccaaaattctgccttcttggcatgttgcctgcccatgttcccctccagcctccctcccatctccctgatc

SEQ ID NO: 86606 - DNA, 201 bp, Bos taurus; identical to SEQ ID NO: 4655

SEQ ID NO: 86607 - DNA, 201 bp, Bos taurus; identical to SEQ ID NO: 4656

SEQ ID NO: 86608 - DNA, 201 bp, Bos taurus; identical to SEQ ID NO: 4657

SEQ ID NO: 86609 - DNA, 201 bp, Bos taurus; identical to SEQ ID NO: 4658

SEQ ID NO: 86610 - DNA, 201 bp, Bos taurus; identical to SEQ ID NO: 4660

SEQ ID NO: 86611 - DNA, 201 bp, Bos taurus; identical to SEQ ID NO: 4664

SEQ ID NO: 86612 - DNA, 201 bp, Bos taurus; identical to SEQ ID NO: 4665

SEQ ID NO: 86613 - DNA, 201 bp, Bos taurus
acttagtgtaaaggaaaatacatagccaaatagtggagacagacaaacagattttaattatcaaacggaaaatattaagaaaaaaagtcagctgaatgtactatggagcttgcaggaagaatgcataggtcaggttgggagcaacagtgaaaataattttattattgcttcatttaatataaaatcttttatatagataag

SEQ ID NO: 86614 - DNA, 201 bp, Bos taurus; identical to SEQ ID NO: 4666

SEQ ID NO: 86615 - DNA, 201 bp, Bos taurus
ataactgattctgcagaacttcttctgacctacactctagtttttgagctgtgctgtttctactaactttctaatgagatttaatctcaatcattacatctcatgttctagatgttctctttgtttagtgttttctgcttttttctgaatttcattggtcatctttgagggtcttatgcttttaccaattacttttctttc

SEQ ID NO: 86616 - DNA, 201 bp, Bos taurus
agaattcccaggcctgttgccagcctactggtgagtagactgggaactgccatcacaggctgaaggtctgtggtggttacgactccgatatctaccagcttgtgggtggcctggctatattttcactctggagtcactttttaagttctaggtcattagtcttccattttctttataaaaaaaagaaaaagaaacactttt

SEQ ID NO: 86617 - DNA, 201 bp, Bos taurus
attgcaccctgtctgaattcctgacccaaaaaatcatggaatatgaatgtttgctgtttaaagccattaagtgttaggaaaacgtgttgtacagaaatagttaagcaatatattcataaagaacacatataactaatgacatataaattttgttgcccctagacatgtttttattgaaagtattacctcagtaatatagaa

SEQ ID NO: 86618 - DNA, 201 bp, Bos taurus; identical to SEQ ID NO: 4670

SEQ ID NO: 86619 - DNA, 201 bp, Bos taurus; identical to SEQ ID NO: 4671

SEQ ID NO: 86620 - DNA, 201 bp, Bos taurus
gagtgggaaaccactggaaaatgctagaaaatgaacataacacaatttaatttagatattaaaggatcattccagtggccatgaagacaacagactataaatgaacataaaaagaagtagggagaaagttgggaggctgttgcaataatccagtcaagtaggtgggccggaaatatagtagtagtgtggagggtgcaaact

SEQ ID NO: 86621 - DNA, 201 bp, Bos taurus
cttgtatttgccaatgtgatcactgaacttgaacgaatcatatacattgttctaacttttattattcaaaatgctggatattgtaattcataaatcagaataatttttagaatccagggggaaaaggcatgactgatacatattttagtaataaaagtctctgttgtaatacagtatcagattgaaattacttcagattac

SEQ ID NO: 86622 - DNA, 201 bp, Bos taurus
cacctctctaggttgtcaaagagcagatttgagccccctgtgtcatacagcaaattcccactggccatctgtaatgtgaatgtttgtgtaaagtgtatggcaatgtgtatgtttcagagttactctctcaattcgtcccaccctttccttcccatggtctgtgttcaagtctgttctctatgtctgtgtctctactgttct

SEQ ID NO: 86623 - DNA, 201 bp, Bos taurus
aagtaatacatgatcaccgcttctgtgtaataaagaacatttgctactcaggcatctttaactttttggcgacatctgctgtacaaatgggaaaatgctgtggaatcattctgaacccagagatagtctagaaattattttgtttttaacttaaacactacagccttttttattctttccttcagtataagcaggcctctt

SEQ ID NO: 86624 - DNA, 201 bp, Bos taurus; identical to SEQ ID NO: 4674

SEQ ID NO: 86625 - DNA, 201 bp, Bos taurus; identical to SEQ ID NO: 4675

SEQ ID NO: 86626 - DNA, 201 bp, Bos taurus; identical to SEQ ID NO: 4676

SEQ ID NO: 86627 - DNA, 201 bp, Bos taurus; identical to SEQ ID NO: 4677

SEQ ID NO: 86628 - DNA, 201 bp, Bos taurus; identical to SEQ ID NO: 4678

SEQ ID NO: 86629 - DNA, 201 bp, Bos taurus; identical to SEQ ID NO: 4679

SEQ ID NO: 86630 - DNA, 201 bp, Bos taurus; identical to SEQ ID NO: 4680

SEQ ID NO: 86631 - DNA, 201 bp, Bos taurus; identical to SEQ ID NO: 4682

SEQ ID NO: 86632 - DNA, 201 bp, Bos taurus; identical to SEQ ID NO: 4684

SEQ ID NO: 86633 - DNA, 201 bp, Bos taurus; identical to SEQ ID NO: 4685

SEQ ID NO: 86634 - DNA, 201 bp, Bos taurus; identical to SEQ ID NO: 4686

SEQ ID NO: 86635 - DNA, 201 bp, Bos taurus; identical to SEQ ID NO: 4687

SEQ ID NO: 86636 - DNA, 201 bp, Bos taurus; identical to SEQ ID NO: 4688

SEQ ID NO: 86637 - DNA, 201 bp, Bos taurus; identical to SEQ ID NO: 4689

SEQ ID NO: 86638 - DNA, 201 bp, Bos taurus; identical to SEQ ID NO: 4690

SEQ ID NO: 86639 - DNA, 201 bp, Bos taurus
cccagatgtaggaatggagaatctcaacagtaaactggatgtagcactggcaggatatacaatgaatgtggtaaaagcaaatggacgcaaggacattacaactatggaaagaaagaatgtcaactaatgaaagcaaaactatattaggaagttgaaagggacaaaaactttaggaaaaagaggaaagttcagggacctggg

SEQ ID NO: 86640 - DNA, 201 bp, Bos taurus
gagaaagaaaatataacgtctcagcccgatacactgcgggatgttgactcactttgcaacaatagtccttcatgaatgtagaaaggaagctagtcttttacgcaatgagttcagttcaaacaaatctctcctaaccctgcgttgctacaggaatagatgtcgccaatgttaatatctgtattggacactctgtgtaattat

SEQ ID NO: 86641 - DNA, 201 bp, Bos taurus; identical to SEQ ID NO: 4691

SEQ ID NO: 86642 - DNA, 201 bp, Bos taurus; identical to SEQ ID NO: 4692

SEQ ID NO: 86643 - DNA, 201 bp, Bos taurus; identical to SEQ ID NO: 4693

SEQ ID NO: 86644 - DNA, 201 bp, Bos taurus; identical to SEQ ID NO: 4696

SEQ ID NO: 86645 - DNA, 201 bp, Bos taurus; identical to SEQ ID NO: 4697

SEQ ID NO: 86646 - DNA, 201 bp, Bos taurus; identical to SEQ ID NO: 4699

SEQ ID NO: 86647 - DNA, 201 bp, Bos taurus; identical to SEQ ID NO: 4703

SEQ ID NO: 86648 - DNA, 201 bp, Bos taurus; identical to SEQ ID NO: 4705

SEQ ID NO: 86649 - DNA, 201 bp, Bos taurus; identical to SEQ ID NO: 4706

SEQ ID NO: 86650 - DNA, 201 bp, Bos taurus; identical to SEQ ID NO: 4708

SEQ ID NO: 86651 - DNA, 201 bp, Bos taurus; identical to SEQ ID NO: 46163

SEQ ID NO: 86652 - DNA, 201 bp, Bos taurus; identical to SEQ ID NO: 4709

SEQ ID NO: 86653 - DNA, 201 bp, Bos taurus
tttcctcgttttctatcctttttattctgacagaagaattattgtaaaaacactctgattcaatattgctcaaacatgagtaatgtaagctacaattttataggaaaattacacctgtgaacttctgccattgaattacttttagcataatgttaatgtttccatgtctatagtatataattttcttgtgcttatatctct

SEQ ID NO: 86654 - DNA, 201 bp, Bos taurus
aggccaggagtttacttaattgataatgtaagacaaaatgtcactaaatttttatttcattggagcaactcataattcacaagtctgtgtagtcctgagtatacataattatgtcctaattcttacctacctaagagatttgtaaattagaaatttgatattttcctctggttctttttcttgtaagttggcttgacataa

SEQ ID NO: 86655 - DNA, 201 bp, Bos taurus; identical to SEQ ID NO: 4711

SEQ ID NO: 86656 - DNA, 201 bp, Bos taurus; identical to SEQ ID NO: 4713

SEQ ID NO: 86657 - DNA, 201 bp, Bos taurus; identical to SEQ ID NO: 4714

SEQ ID NO: 86658 - DNA, 201 bp, Bos taurus; identical to SEQ ID NO: 4718

SEQ ID NO: 86659 - DNA, 201 bp, Bos taurus
attcttgagagaatgaggagtttagcagaaggatgtgtgacagcagaaaaatagttttctacaataatcatatttcacttgacttggtagtggattatctgatcagagatgacctggagaaaattcacggggtactattatattagtgggaaagcctccaaagtttgacaggtaaggttgtttgtatgttggtgataacta

SEQ ID NO: 86660 - DNA, 201 bp, Bos taurus; identical to SEQ ID NO: 4720

SEQ ID NO: 86661 - DNA, 201 bp, Bos taurus
gatacagacaaagagggagcaagatatcagagggaatgggattaataacacagggaaaatagaacatccttttcttttgtactggaaagaataaaccaataaataaatctgaatcaagtgccaatggttctctacaccctgagctaggaattaaggatgggtggtgattgataaagacagacaaaatacctcagttcatag

SEQ ID NO: 86662 - DNA, 201 bp, Bos taurus; identical to SEQ ID NO: 4722

SEQ ID NO: 86663 - DNA, 201 bp, Bos taurus; identical to SEQ ID NO: 4723

SEQ ID NO: 86664 - DNA, 201 bp, Bos taurus; identical to SEQ ID NO: 4724

SEQ ID NO: 86665 - DNA, 201 bp, Bos taurus; identical to SEQ ID NO: 4725

SEQ ID NO: 86666 - DNA, 201 bp, Bos taurus; identical to SEQ ID NO: 4726

SEQ ID NO: 86667 - DNA, 201 bp, Bos taurus
gactatatcctcctctggtttactgattcattcctttactccccaattcaacaaatcatgccagttaatatgcttaactcactatctctagcttctctctttccattttctcatttctaaagagaaataactccatgactcaaaattcaagaaaggtagaaagctatgtatctacaatctaacatttctcaccactagcct

SEQ ID NO: 86668 - DNA, 201 bp, Bos taurus; identical to SEQ ID NO: 4727

SEQ ID NO: 86669 - DNA, 201 bp, Bos taurus
cagtgactcagacacactttgaagctgtattttagtgcatccttacaggactgaagataaatgggaagaactgtaaatagtagcaatattatccaggactggcaagagagaacagaaaactgttatacatatatattaactggcagtgcttaaagtttagactgcatcagaattaccttgagatcttcttcaaagtgaatc

SEQ ID NO: 86670 - DNA, 201 bp, Bos taurus; identical to SEQ ID NO: 4728

SEQ ID NO: 86671 - DNA, 201 bp, Bos taurus
ataggagggttcaaacttgtttgataagcagaagtagctacagaacttgctgggcccatgacagaatgaaattgcagggaaccatgtttaaaaagcacttgtaatttccagacagcaacaacagtacattaaaacaagtactagcctcttctaagcttggacaaggactgcatatccatgaggctggccctgttgacaaac

SEQ ID NO: 86672 - DNA, 201 bp, Bos taurus; identical to SEQ ID NO: 4729

SEQ ID NO: 86673 - DNA, 201 bp, Bos taurus; identical to SEQ ID NO: 4730

SEQ ID NO: 86674 - DNA, 201 bp, Bos taurus; identical to SEQ ID NO: 4731

SEQ ID NO: 86675 - DNA, 201 bp, Bos taurus; identical to SEQ ID NO: 4734

SEQ ID NO: 86676 - DNA, 201 bp, Bos taurus
ccactatttccctccaacaactggcaggcaggttgtggcccctgtcaaacatgcattgtcattccaagttcattttcagcatgtgagtgggttggccaaccctgaactccaatttgacacatgtctgcagccaaggtctatgtcagtaaaaattccagagatatacctgccttgccctgggtcagctgggccctatgaact

SEQ ID NO: 86677 - DNA, 201 bp, Bos taurus
ggagttcagaatcagaagggtcacctcagattcaagtttaacaaagttactgtggagggtataaaatctcagagaggaaattgaatgagcaaatcagttcaaagcattagagtaaaattcccaactgaacagctccacggcagttacaatcacgagcagtgaaatcacctttcaaaacacgatcatggcaagcaccaccta

SEQ ID NO: 86678 - DNA, 201 bp, Bos taurus; identical to SEQ ID NO: 4735

SEQ ID NO: 86679 - DNA, 201 bp, Bos taurus; identical to SEQ ID NO: 4736

SEQ ID NO: 86680 - DNA, 201 bp, Bos taurus; identical to SEQ ID NO: 4737

SEQ ID NO: 86681 - DNA, 201 bp, Bos taurus
aatgatttcaacaatgtatgtattaataaattacctctaagtttctttccttgggatttttatggaaaaaataatacagactaaagtaaatatgaatcatatattgcacaaaccaataattttgtgtttgcctctaccatccatgtttacatattttgtataattgtactgattatgtgttatttaattatgtgccttata

SEQ ID NO: 86682 - DNA, 201 bp, Bos taurus
tgtgtcagtttcaaatgattgaattttctcattatcacaagtcatgtttatctgattctttgcttgccttctaatttttgattgtggccacacattatggattttattttaatgggtgttggatttttatgtgtttatttctataagtatttttgagctctgttctaggatacaatttgtatcctacattggaagcaatgt

SEQ ID NO: 86683 - DNA, 201 bp, Bos taurus; identical to SEQ ID NO: 4738

SEQ ID NO: 86684 - DNA, 201 bp, Bos taurus
cggggcatccccgatgtacctatgaatgaccgcccaaccttcacccgataaggagcataggaagggaaaatagggccttttagatgtgaagatagagtgtaaccatggtagatccatgcaggaagatgtgtgtctcttcctcatcaattccactggagccagaaatgatgtcaccccaccctctgaccctcttccgccctc

SEQ ID NO: 86685 - DNA, 201 bp, Bos taurus; identical to SEQ ID NO: 4739

SEQ ID NO: 86686 - DNA, 201 bp, Bos taurus; identical to SEQ ID NO: 4741

SEQ ID NO: 86687 - DNA, 201 bp, Bos taurus; identical to SEQ ID NO: 4742

SEQ ID NO: 86688 - DNA, 201 bp, Bos taurus; identical to SEQ ID NO: 4746

SEQ ID NO: 86689 - DNA, 201 bp, Bos taurus; identical to SEQ ID NO: 4747

SEQ ID NO: 86690 - DNA, 201 bp, Bos taurus; identical to SEQ ID NO: 4750

SEQ ID NO: 86691 - DNA, 201 bp, Bos taurus; identical to SEQ ID NO: 4751

SEQ ID NO: 86692 - DNA, 201 bp, Bos taurus; identical to SEQ ID NO: 4752

SEQ ID NO: 86693 - DNA, 201 bp, Bos taurus; identical to SEQ ID NO: 4753

SEQ ID NO: 86694 - DNA, 201 bp, Bos taurus; identical to SEQ ID NO: 4754

SEQ ID NO: 86695 - DNA, 201 bp, Bos taurus; identical to SEQ ID NO: 4755

SEQ ID NO: 86696 - DNA, 201 bp, Bos taurus
atagcttgttttatgtgactgtttactataagtttctaatgttgtataaataaaaaacttgaaaatcttactttttaaagccaactatacatggcagaggtgtctagtctgatagataagcttataatgtccactgaaacaagaaaaagaaatttaattgaaaatctattccaacccatctctatatctccaaaagaaaag

SEQ ID NO: 86697 - DNA, 201 bp, Bos taurus; identical to SEQ ID NO: 4756

SEQ ID NO: 86698 - DNA, 201 bp, Bos taurus
tgttaagtctggagagcttaagtttggacagctgttcctctctttgtctcctttcctgtttcctgtgttctaagggatgccttatagtaaacctattccaacttggtggggcctggatttccatcagcgacgtttagaatcaccataaaaggaattccctgggagcctagtgaactaaggtcccgcaagctgtgtcagttc

SEQ ID NO: 86699 - DNA, 201 bp, Bos taurus; identical to SEQ ID NO: 4757

SEQ ID NO: 86700 - DNA, 201 bp, Bos taurus; identical to SEQ ID NO: 4758

SEQ ID NO: 86701 - DNA, 201 bp, Bos taurus; identical to SEQ ID NO: 4761

SEQ ID NO: 86702 - DNA, 201 bp, Bos taurus; identical to SEQ ID NO: 4764

SEQ ID NO: 86703 - DNA, 201 bp, Bos taurus; identical to SEQ ID NO: 4765

SEQ ID NO: 86704 - DNA, 201 bp, Bos taurus; identical to SEQ ID NO: 4766

SEQ ID NO: 86705 - DNA, 201 bp, Bos taurus
agccctcaacgtatttcttctcatgcctcataggtcaggcctgggttattggacaatggaaataggatttcctttgtttagaacaatcaggattcattgtccctgggctaggcgagtggcccaccttcctgagcacattgctggcccatatttgaacaaaatggaggttgtcttaggaaggaagaagagagggagtgacac

SEQ ID NO: 86706 - DNA, 201 bp, Bos taurus; identical to SEQ ID NO: 4767

SEQ ID NO: 86707 - DNA, 201 bp, Bos taurus; identical to SEQ ID NO: 4768

SEQ ID NO: 86708 - DNA, 201 bp, Bos taurus; identical to SEQ ID NO: 4769

SEQ ID NO: 86709 - DNA, 201 bp, Bos taurus; identical to SEQ ID NO: 4770

SEQ ID NO: 86710 - DNA, 201 bp, Bos taurus; identical to SEQ ID NO: 4771

SEQ ID NO: 86711 - DNA, 201 bp, Bos taurus; identical to SEQ ID NO: 4772

SEQ ID NO: 86712 - DNA, 201 bp, Bos taurus; identical to SEQ ID NO: 4773

SEQ ID NO: 86713 - DNA, 201 bp, Bos taurus; identical to SEQ ID NO: 4774

SEQ ID NO: 86714 - DNA, 201 bp, Bos taurus; identical to SEQ ID NO: 4775

SEQ ID NO: 86715 - DNA, 201 bp, Bos taurus; identical to SEQ ID NO: 4776

SEQ ID NO: 86716 - DNA, 201 bp, Bos taurus; identical to SEQ ID NO: 4777

SEQ ID NO: 86717 - DNA, 201 bp, Bos taurus; identical to SEQ ID NO: 4778

SEQ ID NO: 86718 - DNA, 201 bp, Bos taurus
tctgaaaatttattcatcaactaaagtttctctacagagaaaaggcaaacagaagacatggggagagccctgttctgggaaggtcctgtagggtcctgatcagttgcaattagatgattaaaagtgtggttgaaaactttcttacctgtgggttttggcctttgactctgcaaagtatagtggttcttctcttctcattaa

SEQ ID NO: 86719 - DNA, 201 bp, Bos taurus; identical to SEQ ID NO: 4779

SEQ ID NO: 86720 - DNA, 201 bp, Bos taurus; identical to SEQ ID NO: 4781

SEQ ID NO: 86721 - DNA, 201 bp, Bos taurus; identical to SEQ ID NO: 4782

SEQ ID NO: 86722 - DNA, 201 bp, Bos taurus
gaatgttttaccatggaccatggacagggattatctttgctgagttatatataggcaagctgcttatacaaataagaactcctgcaaggaaggcaggtaggtagatgatgataacaaccaacggtgtaggctgtacattttttgcatatttatatcaacaatatctgaaagcatacaaagcatagttgaaaatactagtaa

SEQ ID NO: 86723 - DNA, 201 bp, Bos taurus
aagtaaataaactatttcgagaaaaaataaacttaaatgtaaatatcataagatttcaaaaggtggtaggttattagcacatagcctttgctatcagtagggcttcagcttaaatactgaaaaggaagttattcaccttttgaaattaaaaattcacttataaactatgaataactgaaccaattttataaaattgttgtg

SEQ ID NO: 86724 - DNA, 201 bp, Bos taurus; identical to SEQ ID NO: 4786

SEQ ID NO: 86725 - DNA, 201 bp, Bos taurus
aaatactaaaaactactgagaaaaagacagcattagtcatggtctgccatttagcaactaaacacagaagcctcatgtgtgttgcatgggttgatatttatattggcttgtttttacagctcagagcatccttatataaaagacttgaatatttttgtataattctaataactatgtttattattaatatatcctgtgagt

SEQ ID NO: 86726 - DNA, 201 bp, Bos taurus
ttgtgtgtattattaaactctcatggtgtattggctacctattacaacataccaaattactgcaaacagtgacttatagcaacaaagataattctaacatgtattattacaattaaacttcttatctagacagtatatttaagacaactaaaccttttatctagacagtgcatttaagtccaataataaagttattggatt

SEQ ID NO: 86727 - DNA, 201 bp, Bos taurus; identical to SEQ ID NO: 4787

SEQ ID NO: 86728 - DNA, 201 bp, Bos taurus; identical to SEQ ID NO: 4788

SEQ ID NO: 86729 - DNA, 201 bp, Bos taurus; identical to SEQ ID NO: 4790

SEQ ID NO: 86730 - DNA, 201 bp, Bos taurus; identical to SEQ ID NO: 4791

SEQ ID NO: 86731 - DNA, 201 bp, Bos taurus; identical to SEQ ID NO: 4792

SEQ ID NO: 86732 - DNA, 201 bp, Bos taurus; identical to SEQ ID NO: 4793

SEQ ID NO: 86733 - DNA, 201 bp, Bos taurus
aaaagtatcttagataatgtctatctattttgtccatcactgtaattaagtaaatatagcgatatctgatgtgtaagacaggctaaatccatatttgtaagttaattttcaagggaataaaaaataattgagctgtgaatagcaattttagctgcatattgctgagaggtaatagacataattgctacataagaaaatggc

SEQ ID NO: 86734 - DNA, 201 bp, Bos taurus; identical to SEQ ID NO: 4794

SEQ ID NO: 86735 - DNA, 201 bp, Bos taurus; identical to SEQ ID NO: 4795

SEQ ID NO: 86736 - DNA, 201 bp, Bos taurus; identical to SEQ ID NO: 4797

SEQ ID NO: 86737 - DNA, 201 bp, Bos taurus; identical to SEQ ID NO: 4798

SEQ ID NO: 86738 - DNA, 201 bp, Bos taurus
catcacatcacttcctgtgtagaataaataattacttaccttattaagggtacatcctgtaccacagtgaaaaggaattggactgagcagccaaaaaatgctatgacttaaaagaataagaaaatattttcattcagcatattttcgttctgaatttacatattaacctcacaacattaattcttgccaaagacaattata

SEQ ID NO: 86739 - DNA, 201 bp, Bos taurus; identical to SEQ ID NO: 4799

SEQ ID NO: 86740 - DNA, 201 bp, Bos taurus
tccaccctgttctcaaccctcttttcttatcatcagtcctctcctgccctgtacacacacacacacacacatacatgataaaaaaatatgatccattctactagagatttcacttaacattgattgtactggaaatgggtgaacttagatctgacaaaattgtaaaattcctggataatttgcctaataagagtgatttta

SEQ ID NO: 86741 - DNA, 201 bp, Bos taurus; identical to SEQ ID NO: 4802

SEQ ID NO: 86742 - DNA, 201 bp, Bos taurus
tgggacacttggacatcagccccttagatttttaagccaggcattttgggagctcatctctctggtgtcaaatccatgggccagggtgtctgatgtggggttccatgccctttgtcttccaggagataaatccttctaagaacatcttgtggccaggccaggaatggggttttgagtgagaacttttctctgtctctctta

SEQ ID NO: 86743 - DNA, 201 bp, Bos taurus
cagggagtctagtaaaatcccacacaatcttgactacaaggattgttatgaaaatataactctaattcagtttattaaacataaaagttatcttatgtggcattaaatttggcactgcctttccataaaccatgccagatacagatagaacttccttaggtttgttcatttctcatcagctaagaagttaaactaatctta

SEQ ID NO: 86744 - DNA, 201 bp, Bos taurus; identical to SEQ ID NO: 4806

SEQ ID NO: 86745 - DNA, 201 bp, Bos taurus
taaaagctgtagtatgtgttgtcatggcaatagtgttttgtttacagaacttgccttttttagaacttgtcctttaaatggtaggaaagattcactttagtcttaacgttgtattatactcttagctttcattagtgaaatattatttgttcttttttcagtaagaagcacaaaatattccattgctcagtttgtgcattt

SEQ ID NO: 86746 - DNA, 201 bp, Bos taurus
ttcttgcctgggaaatcccatggacagaggatactggtgggctacagtccatagggtcataaagaaatggacacagctaaagcgacagcatacacgtacagatggcccacacacaggaaaaaaaaaagaagccaaagctgcctgatggaggaccaagatgttgggtttaacagacaaaaacatcaaaggaaccattataaa

SEQ ID NO: 86747 - DNA, 201 bp, Bos taurus
agattatagataagaatattttaaaatttgagtttcttctaacctcaggagtctatagattaaaatatttgcttgacctttaatacaagcaggaacccaacaattccagcaataattacaaaaatattactacctcccgtttattaagcatttattttcctgtttatcttacttgagaccttttcaattgttttcttttgt

SEQ ID NO: 86748 - DNA, 201 bp, Bos taurus; identical to SEQ ID NO: 4807

SEQ ID NO: 86749 - DNA, 201 bp, Bos taurus
actttattgactctattttctcaatatgagatgaaaattaacactgacatttctagcagagatcacaaagagaaggaaatgggatcaattacatgtgataaaatggttgtacaattagaataaccaacacaaccaaggtgggttgtggcctcaaataagctcaactgttctccttccaaggctttaaaggaactcgcattt

SEQ ID NO: 86750 - DNA, 201 bp, Bos taurus; identical to SEQ ID NO: 4808

SEQ ID NO: 86751 - DNA, 201 bp, Bos taurus
aatggatatgttatgaatttccagaaaatactgttgaatgaaagagtcacagaaaagagggcatggtaggagtctgttctctttagaagaaatactaacaaatagcaattctatatgtgtgcctgatggatgggagtacttatgcacattcatatatacatattacagtactaccatatggatagcagtaaaagatgaaag

SEQ ID NO: 86752 - DNA, 201 bp, Bos taurus; identical to SEQ ID NO: 4809

SEQ ID NO: 86753 - DNA, 201 bp, Bos taurus; identical to SEQ ID NO: 4810

SEQ ID NO: 86754 - DNA, 201 bp, Bos taurus; identical to SEQ ID NO: 4811

SEQ ID NO: 86755 - DNA, 201 bp, Bos taurus; identical to SEQ ID NO: 4812

SEQ ID NO: 86756 - DNA, 201 bp, Bos taurus; identical to SEQ ID NO: 4813

SEQ ID NO: 86757 - DNA, 201 bp, Bos taurus
aaatcttagactcttctcatattattccattcactgtttacataaagttgtacattttgtgagagaactttcactagggaactatttctctaaaatttctctaaagacaaaaaagtacacacacacagacacacagacacttctcaatggagcttacccacacacacacacacacacacactactcaatggagcttaccca

SEQ ID NO: 86758 - DNA, 201 bp, Bos taurus; identical to SEQ ID NO: 4814

SEQ ID NO: 86759 - DNA, 201 bp, Bos taurus; identical to SEQ ID NO: 4815

SEQ ID NO: 86760 - DNA, 201 bp, Bos taurus; identical to SEQ ID NO: 4816

SEQ ID NO: 86761 - DNA, 201 bp, Bos taurus; identical to SEQ ID NO: 4817

SEQ ID NO: 86762 - DNA, 201 bp, Bos taurus; identical to SEQ ID NO: 4818

SEQ ID NO: 86763 - DNA, 201 bp, Bos taurus; identical to SEQ ID NO: 4819

SEQ ID NO: 86764 - DNA, 201 bp, Bos taurus; identical to SEQ ID NO: 4820

SEQ ID NO: 86765 - DNA, 201 bp, Bos taurus; identical to SEQ ID NO: 4821

SEQ ID NO: 86766 - DNA, 201 bp, Bos taurus; identical to SEQ ID NO: 4822

SEQ ID NO: 86767 - DNA, 201 bp, Bos taurus
tctttcttaaaatgagctgtgcttagattctctttcctaattcagttagcatttttcttaaattcttgtctgggagacagattatccctgtttcattgtccggcccccctccaccccacccaggggttctctcttgctcttttaattgagagtagttcctctgccttttgatcttaaactttctctgtctctatgaatcta

SEQ ID NO: 86768 - DNA, 201 bp, Bos taurus; identical to SEQ ID NO: 4823

SEQ ID NO: 86769 - DNA, 201 bp, Bos taurus; identical to SEQ ID NO: 4824

SEQ ID NO: 86770 - DNA, 201 bp, Bos taurus; identical to SEQ ID NO: 4825

SEQ ID NO: 86771 - DNA, 201 bp, Bos taurus
tcctcccttgtgttacgacttaagcacaaaatctgggtcttcctttgctctaattatggcttcagttatccctactgtataaacaataattcccatagacttcatctctttctctaatttggctttcatcagctcctggatttccaaatgtatctaaggcatttctgggacaaccttccaaacctataatatcctgaatta

SEQ ID NO: 86772 - DNA, 201 bp, Bos taurus
agttttaagctctggaaaatgtcatttctttaagcatggataaaaagaaacactggaaaatagaagtaaaatatttcatcatttttgaggttttgcacttttactctctgcttcttggaccctacttattattggctcatctttctctttgaaccatgtttatctgctttgttactaacctccactaacataaaaaggcga

SEQ ID NO: 86773 - DNA, 201 bp, Bos taurus
ttaaagtccctaggaaggcccatttaccgtttctcaatctgccacacccagccgctggttttccttctggtgttagggtatgagccctttcttcaactgaaacggcaggcttatatttaggggccacgttgtgtcaaaataggtgtgtgcatgtgcatgtgtgtgaccatctgcctgtgcctgcatactgctttgtaggtg

SEQ ID NO: 86774 - DNA, 201 bp, Bos taurus; identical to SEQ ID NO: 4828

SEQ ID NO: 86775 - DNA, 201 bp, Bos taurus
ccggttagatgaaggagacaaaggaaggattggtctgatacccacccaaggtggaccggagtgagaagagctgggcctggttaggagggaatagcagaaccgtaggaaagagggcttgttctgggcagtacatgaagccctgccaggaaacgcacggacacctctagcacacagggagcccctccttgctctgggcctggc

SEQ ID NO: 86776 - DNA, 201 bp, Bos taurus
ccaattgttttaaaatgaggtggtttctagtatctgctaataggagcaataaatttttaaaaatcattatcattatgaactcatgaattgtagtttattgcaataaaagtccttactgaggctcaaattttcccatctttggcaagtgagatccttttcagattgggtcttgtgtctgttcacaatatgacccttgtaatc

SEQ ID NO: 86777 - DNA, 201 bp, Bos taurus
gctccagcaaagggcagccgccactccttacctctgacgcggggtagcttgtctcagccactgcccccaacctctggcccggggtagctcctctcagccatgctcctgccctgagcacaagtatctctttaagtatctctcttcagttcagttcagtcgctcagacatgtccgactctttgcaaccccatgaatcgcagca

SEQ ID NO: 86778 - DNA, 201 bp, Bos taurus; identical to SEQ ID NO: 4829

SEQ ID NO: 86779 - DNA, 201 bp, Bos taurus; identical to SEQ ID NO: 4830

SEQ ID NO: 86780 - DNA, 201 bp, Bos taurus; identical to SEQ ID NO: 4831

SEQ ID NO: 86781 - DNA, 201 bp, Bos taurus; identical to SEQ ID NO: 4832

SEQ ID NO: 86782 - DNA, 201 bp, Bos taurus
gggagagcaagacaccactgttccaacctgctggaggatcgcatggaacagagctgtgccagacccagccccagggctcgtgcacatgggggcctccagagcagagaactctgcccatagagcttgggcagaggtggtgtcattccctaggcattaccattcctcctttcacaggaccctatgacaccaaagcacgagacc

SEQ ID NO: 86783 - DNA, 201 bp, Bos taurus; identical to SEQ ID NO: 4833

SEQ ID NO: 86784 - DNA, 201 bp, Bos taurus; identical to SEQ ID NO: 4834

SEQ ID NO: 86785 - DNA, 201 bp, Bos taurus; identical to SEQ ID NO: 4835

SEQ ID NO: 86786 - DNA, 201 bp, Bos taurus; identical to SEQ ID NO: 4836

SEQ ID NO: 86787 - DNA, 201 bp, Bos taurus; identical to SEQ ID NO: 4837

SEQ ID NO: 86788 - DNA, 201 bp, Bos taurus; identical to SEQ ID NO: 4838

SEQ ID NO: 86789 - DNA, 201 bp, Bos taurus; identical to SEQ ID NO: 4839

SEQ ID NO: 86790 - DNA, 201 bp, Bos taurus; identical to SEQ ID NO: 4841

SEQ ID NO: 86791 - DNA, 201 bp, Bos taurus; identical to SEQ ID NO: 4842

SEQ ID NO: 86792 - DNA, 201 bp, Bos taurus
gggctcacctgaagacaagactctggacccagagacatctgcgtgcgtggactttgtttcttacctggatgaagatgttgagttagatgttggagtcgcatgtgtggagtggcaccaaccattgacccattacaaacacattaatgaatgttagggttgtttagaggtggagaggtggagactatatctgagccatggttg

SEQ ID NO: 86793 - DNA, 201 bp, Bos taurus
gcaaagagggaggccaggggtgtgagtccccataatgataaccatcatattaatatattaaaacccacctgtgtacaaagtgcaaggtgtatccttcttgatctttacagttgccctgtgatgcagttattgctatgccttagctataatctcaggagacaagggtgctaagaggtgggttaccagctttccaataaaaaa

SEQ ID NO: 86794 - DNA, 201 bp, Bos taurus
caatttctagccaaaaggagtaatggcctcttggtggccaactgcttcagctacagagtttgtgttacagtggaattttctttttttcaattaaagtaagctgggtaacgcttagacttgaccctcatcccacggaaaactcttatcaagtagaaactgattaaaagggatttgaaaaaaatatatatgtgtgtacataaa

SEQ ID NO: 86795 - DNA, 201 bp, Bos taurus; identical to SEQ ID NO: 4845

SEQ ID NO: 86796 - DNA, 201 bp, Bos taurus; identical to SEQ ID NO: 4846

SEQ ID NO: 86797 - DNA, 201 bp, Bos taurus; identical to SEQ ID NO: 4847

SEQ ID NO: 86798 - DNA, 201 bp, Bos taurus; identical to SEQ ID NO: 4848

SEQ ID NO: 86799 - DNA, 201 bp, Bos taurus
aggattcatttcagttcagtcgctcagtcatgtccaacagaactgaactgaactgaactgtccaactgaactgaattgaactgaactgcccaactctttgtggccccatggactggagcacaccaggcttccacttccctgtccatcaccaactcctggagtttgctcaaactcatgtccatcaagttggtgatgccatcc

SEQ ID NO: 86800 - DNA, 201 bp, Bos taurus; identical to SEQ ID NO: 4850

SEQ ID NO: 86801 - DNA, 201 bp, Bos taurus; identical to SEQ ID NO: 4851

SEQ ID NO: 86802 - DNA, 201 bp, Bos taurus; identical to SEQ ID NO: 4852

SEQ ID NO: 86803 - DNA, 201 bp, Bos taurus
ccaacattcactatagccaaaaggcacattcaatttttatacagtgagactctgaatgaaagaaaatgcaagagcaggaaattagtatttttgagaactaactctgctattaaattttttatgaatggttcttctaaactagagtttctagcaaaatagagaattcattatgttataaagattatcagtgtatatgccttg

SEQ ID NO: 86804 - DNA, 201 bp, Bos taurus; identical to SEQ ID NO: 4853

SEQ ID NO: 86805 - DNA, 201 bp, Bos taurus; identical to SEQ ID NO: 4854

SEQ ID NO: 86806 - DNA, 201 bp, Bos taurus; identical to SEQ ID NO: 4855

SEQ ID NO: 86807 - DNA, 201 bp, Bos taurus; identical to SEQ ID NO: 4857

SEQ ID NO: 86808 - DNA, 201 bp, Bos taurus; identical to SEQ ID NO: 4858

SEQ ID NO: 86809 - DNA, 201 bp, Bos taurus
tctgcacagggctactcgagtgtcctcagcatggagctggattattccagagtaaataatcaaagaggccagtgaaaaagttccaatgacttttatggccatggcttggaagtcaaaagtcttctttagttttgctgtattcttctgatctcagagatcacctctgatcaacatgcagtgactgtacaaaggcatgaggtt

SEQ ID NO: 86810 - DNA, 201 bp, Bos taurus
gatatttttattttataaacttaaaagtgtattttgcaagatttgatcttcctccctcttactcttcatgggaaaaaatttttattcagggtctctcctttctatattttattactctttctatttctagtttttacacttgtaaaacacagttggacttaacctactgttaattataaaattgtacattgatttgcattt

SEQ ID NO: 86811 - DNA, 201 bp, Bos taurus; identical to SEQ ID NO: 4859

SEQ ID NO: 86812 - DNA, 201 bp, Bos taurus; identical to SEQ ID NO: 4860

SEQ ID NO: 86813 - DNA, 201 bp, Bos taurus; identical to SEQ ID NO: 4861

SEQ ID NO: 86814 - DNA, 201 bp, Bos taurus; identical to SEQ ID NO: 4862

SEQ ID NO: 86815 - DNA, 201 bp, Bos taurus; identical to SEQ ID NO: 4863

SEQ ID NO: 86816 - DNA, 201 bp, Bos taurus; identical to SEQ ID NO: 4866

SEQ ID NO: 86817 - DNA, 201 bp, Bos taurus; identical to SEQ ID NO: 4867

SEQ ID NO: 86818 - DNA, 201 bp, Bos taurus
aatcctgatttttatcaggatataaagattaagagtgtccaaatattcactgtcaattatttgttaaaatctattaagaatcgagtattatactaggtacggtaggtgatttcaaaattaagaaactttcctagatcttatagatctcagaaacaaactgagtaaaatttcaggcttgtaaccatttaatttcagagctct

SEQ ID NO: 86819 - DNA, 201 bp, Bos taurus; identical to SEQ ID NO: 4869

SEQ ID NO: 86820 - DNA, 201 bp, Bos taurus
tttaatggtttcagaattatcatactctattatgctgaagaggcaaaaggaactgccactctgtagaagtttgatctactattagagagaactcttattcctccctgttccccacagtttcctgggaacaataatgaaataacacttccagccccattccctatacagtcatgcctccctgaaagagaattgtgacaagtg

SEQ ID NO: 86821 - DNA, 201 bp, Bos taurus
cgtgctgcgattcatgggtcgcaaagagttggacacgactgagtgactgatctgatctgatttgatctgatttatactgtgctcacaactgtgactacgtcctggcccccagtcacctatctgctctgatacatacccctacattttactcacctgttgagttttttcactccattgctttacctttactcctgctgttac

SEQ ID NO: 86822 - DNA, 201 bp, Bos taurus; identical to SEQ ID NO: 4870

SEQ ID NO: 86823 - DNA, 201 bp, Bos taurus
cttaggaaacaaaaaaatacattttgcatattcttgtcctaaggaacctatgtgtatattagcaccagtacatcttttttgttaaatcaagagcataagaaagtaaatttgtgatttggattccacagtctcttgctgtctcaagggcatctttctttcagttatcctttccctccactctaatattaagttattctctcc

SEQ ID NO: 86824 - DNA, 201 bp, Bos taurus; identical to SEQ ID NO: 4871

SEQ ID NO: 86825 - DNA, 201 bp, Bos taurus
tcaccatcactatctattttcagaacatttttttcaccccagttagaacccttgtaagtcattggcagtcactgcctattctcctcacttcccaggccctggcaactactattctactttctgcctctgtggatttacctattctgggcatttcataaaaacagaatcatacaatatgtggcctgttatgtctggtctctt

SEQ ID NO: 86826 - DNA, 201 bp, Bos taurus; identical to SEQ ID NO: 4873

SEQ ID NO: 86827 - DNA, 201 bp, Bos taurus; identical to SEQ ID NO: 4876

SEQ ID NO: 86828 - DNA, 201 bp, Bos taurus; identical to SEQ ID NO: 4877

SEQ ID NO: 86829 - DNA, 201 bp, Bos taurus; identical to SEQ ID NO: 4878

SEQ ID NO: 86830 - DNA, 201 bp, Bos taurus; identical to SEQ ID NO: 4880

SEQ ID NO: 86831 - DNA, 201 bp, Bos taurus
ataagtatagcttacaacagtaagactaaatttttaatgtagagattatacaaacatttgattgtatgagaagccaccttgggaattgataacattttttaaaatgatgtatctattgcataaaaccagattggattgataatgccccttttggcagaatcacagaatcctgattgagtaataaaatgatggtcttgtatg

SEQ ID NO: 86832 - DNA, 201 bp, Bos taurus; identical to SEQ ID NO: 4885

SEQ ID NO: 86833 - DNA, 201 bp, Bos taurus
gtaattttgaatacttacagggaaccaaaacccgtaactacagttaaaggcaggtgtgactttgtatattcactggcaactggttaaccttgaaaacaatcccaagcaagagaaaactctaaattcttagaaaactctaaagcatacctatatcccagctttgactcaggcttttcacaattataactcaaccagatttct

SEQ ID NO: 86834 - DNA, 201 bp, Bos taurus
ggtcttagaagacagagaaaccgagaagaaaggcatcaccttttcagtgcaccaagcaacattaatgccactcgacaggagggagcagggggcctgtctctgcgtggagaaggaagagaggaaatggaaacccaccaggagccacccaccacgtttaactggtcctgcgccagtatctttgcagctgtcactccgggaagg

SEQ ID NO: 86835 - DNA, 201 bp, Bos taurus
gagaactgtatggagcacaacttctacatcagctttggtcctgatgaacatctgccttgttcaaggtcctgttactgtggccctgtttctggcacagaacgcctaaaactcttgatgagtacaataaaaagtgtcttttgttatgctaatgacatgacttttggaaagtacaggataggggccggttgccagaggacccaa

SEQ ID NO: 86836 - DNA, 201 bp, Bos taurus; identical to SEQ ID NO: 4887

SEQ ID NO: 86837 - DNA, 201 bp, Bos taurus; identical to SEQ ID NO: 4888

SEQ ID NO: 86838 - DNA, 201 bp, Bos taurus; identical to SEQ ID NO: 4889

SEQ ID NO: 86839 - DNA, 201 bp, Bos taurus; identical to SEQ ID NO: 4890

SEQ ID NO: 86840 - DNA, 201 bp, Bos taurus; identical to SEQ ID NO: 4891

SEQ ID NO: 86841 - DNA, 201 bp, Bos taurus; identical to SEQ ID NO: 4892

SEQ ID NO: 86842 - DNA, 201 bp, Bos taurus; identical to SEQ ID NO: 4893

SEQ ID NO: 86843 - DNA, 201 bp, Bos taurus; identical to SEQ ID NO: 4894

SEQ ID NO: 86844 - DNA, 201 bp, Bos taurus; identical to SEQ ID NO: 4895

SEQ ID NO: 86845 - DNA, 201 bp, Bos taurus; identical to SEQ ID NO: 4897

SEQ ID NO: 86846 - DNA, 201 bp, Bos taurus; identical to SEQ ID NO: 4898

SEQ ID NO: 86847 - DNA, 201 bp, Bos taurus; identical to SEQ ID NO: 4899

SEQ ID NO: 86848 - DNA, 201 bp, Bos taurus; identical to SEQ ID NO: 4900

SEQ ID NO: 86849 - DNA, 201 bp, Bos taurus; identical to SEQ ID NO: 4901

SEQ ID NO: 86850 - DNA, 201 bp, Bos taurus; identical to SEQ ID NO: 4902

SEQ ID NO: 86851 - DNA, 201 bp, Bos taurus; identical to SEQ ID NO: 4903

SEQ ID NO: 86852 - DNA, 201 bp, Bos taurus; identical to SEQ ID NO: 4905

SEQ ID NO: 86853 - DNA, 201 bp, Bos taurus; identical to SEQ ID NO: 4906

SEQ ID NO: 86854 - DNA, 201 bp, Bos taurus
tgtcagtatgctgagattttcaagtaggaagagctatttttcccccaaatcagagaaatggcatcacaatatgggccctccccttctaggcttcttcagaattgacaacttccaacaagctttagtgagagttgctcagtcatgtccaactttttgtgaccccatggatatatagtccatggaattctccaggccagaata

SEQ ID NO: 86855 - DNA, 201 bp, Bos taurus; identical to SEQ ID NO: 4907

SEQ ID NO: 86856 - DNA, 201 bp, Bos taurus; identical to SEQ ID NO: 4908

SEQ ID NO: 86857 - DNA, 201 bp, Bos taurus; identical to SEQ ID NO: 4909

SEQ ID NO: 86858 - DNA, 201 bp, Bos taurus; identical to SEQ ID NO: 4910

SEQ ID NO: 86859 - DNA, 201 bp, Bos taurus; identical to SEQ ID NO: 4911

SEQ ID NO: 86860 - DNA, 201 bp, Bos taurus; identical to SEQ ID NO: 4912

SEQ ID NO: 86861 - DNA, 201 bp, Bos taurus; identical to SEQ ID NO: 4913

SEQ ID NO: 86862 - DNA, 201 bp, Bos taurus; identical to SEQ ID NO: 4914

SEQ ID NO: 86863 - DNA, 201 bp, Bos taurus
tccagttgaatagcaagtgtatatcaattgtttgattagaaaagatattctgagtactgccgtctgtctatgctggcctggatgggagacatggagatgtgagatattgcttctataattagagagtgtagagtctacttgaaatgcaatcttaagttgctcagttgtgtccgattctttgtggcctcgtggactatggtg

SEQ ID NO: 86864 - DNA, 201 bp, Bos taurus
tataaactcaaaagataaactaaaacctccactacttaacaatttttagtagttctgaacaagtgctataaatactagatgtttgttaacaaatttttgtcccaaagaatatgtatcagggtagaaataaaagtaaatctctaccatatatacattaacaattactaacatgatttatttggtacaaaggatcttttctaa

SEQ ID NO: 86865 - DNA, 201 bp, Bos taurus; identical to SEQ ID NO: 4915

SEQ ID NO: 86866 - DNA, 201 bp, Bos taurus; identical to SEQ ID NO: 4916

SEQ ID NO: 86867 - DNA, 201 bp, Bos taurus; identical to SEQ ID NO: 4917

SEQ ID NO: 86868 - DNA, 201 bp, Bos taurus; identical to SEQ ID NO: 4918

SEQ ID NO: 86869 - DNA, 201 bp, Bos taurus; identical to SEQ ID NO: 4919

SEQ ID NO: 86870 - DNA, 201 bp, Bos taurus; identical to SEQ ID NO: 4920

SEQ ID NO: 86871 - DNA, 201 bp, Bos taurus; identical to SEQ ID NO: 4921

SEQ ID NO: 86872 - DNA, 201 bp, Bos taurus; identical to SEQ ID NO: 4923

SEQ ID NO: 86873 - DNA, 201 bp, Bos taurus; identical to SEQ ID NO: 4924

SEQ ID NO: 86874 - DNA, 201 bp, Bos taurus
ttctctgaaatgctgaaatgtgattctaaatacactttaactgaagggatagtgaccaaaatttaaagtagaaaagaaatgaggtacttctttcagtattccaacaaattctggtgtcaatgaaaatctgggaggagaaacgttagccagtttgtaaactgcttttaagttattgacttatcaatacaattcaccttttct

SEQ ID NO: 86875 - DNA, 201 bp, Bos taurus
tatcatgaggttggaaaaagagtagtgtaacgatgtcacagaattcagctggtggctaaaattcagctagtgggaaaagggacaaaagtagttttttctataagactagttcagtttataacttaacaactctttgggtaaataaaaattcttgctctggctgttttgtttggttgtgatgagcaaaatccaatcgacgag

SEQ ID NO: 86876 - DNA, 201 bp, Bos taurus
tataaacaggaagaaactaagaatgtagaagagggctcctcactgaggctaagatttagaactcagaccagaatgaatcatacagtttgtaggccccatgtaaaatgtccattcaggtatgacctaaatcaaaacacttatgattatatagtgggggtgacaaatagattcaagtgattagatctgttagacagaggcctg

SEQ ID NO: 86877 - DNA, 201 bp, Bos taurus
tttttctcatgtctaaagactattgtgacattatttcttagtacaagtctatggccaaaaaaagaaatcatagattctgctgacatcctatttattcttacgattttatgacttcaaataaaaatctgccgctgtcagtgtttcatcctttttttttttttttctcagcttctctgagtactgggtaggcttctatctccc

SEQ ID NO: 86878 - DNA, 201 bp, Bos taurus
gcaaagaaagtcacaagactagatttaagagttgtgtaaacagacacattgcaaaaatgcctgtataaagggagaggtggaatcattatggccttttgttgtaaacaattggacatacaaaggcatgaaaagtatttgcatgttgagacttgatacctccatcaaatccttcagctatcattctggaggatgagatctatg

SEQ ID NO: 86879 - DNA, 201 bp, Bos taurus
ctgcgattcatggggtcgcaaagagttggacacgactgagtgactgaactgaactgaactgaaatgcaattaaacactactgaattattttctaataattgggccaaagaattgccagtgtaaaaatattccagtgaatatttcaaaataagataaagcatatgcttctagtcatctttttagatgctctgagaaccgtct

SEQ ID NO: 86880 - DNA, 201 bp, Bos taurus; identical to SEQ ID NO: 4925

SEQ ID NO: 86881 - DNA, 201 bp, Bos taurus
ttcatgggcttttcataactataatataacatttctcatttataaaaacatgactgaaataaactcacatcccatgtagtgggattaaatgtccagtatacccaagaacttcagggcaagccctactacctcagttgtttgcctcatgcaactcaaaaatcccagattgttctatggaagtttgcttatggtaaattagag

SEQ ID NO: 86882 - DNA, 201 bp, Bos taurus; identical to SEQ ID NO: 4927

SEQ ID NO: 86883 - DNA, 201 bp, Bos taurus; identical to SEQ ID NO: 4932

SEQ ID NO: 86884 - DNA, 201 bp, Bos taurus; identical to SEQ ID NO: 4937

SEQ ID NO: 86885 - DNA, 201 bp, Bos taurus
atggcctcttttcagtttatacttactagagcaggtcagtctctggtttcaacatttccttctgtcatagtctgaattgatcggaatacttaaggtcaatggagcagaataatttgtccttggccctttctttaattccttaaaagtaaaaatataaaggctagtttcattttataaaaataggagtatagagatctcctt

SEQ ID NO: 86886 - DNA, 201 bp, Bos taurus
ttaaaatgcagatttcctatctctctcaaatcacagccctaagatgttgattcagcgtcaagtgagacctggggacagtatttttaaaaagtgattctggatttgaaaaaatatatcactgctttagattccctaaggtataaataaaatttgtatcttagcaggaatgttattttaatgcattaagaatctgtggagcga

SEQ ID NO: 86887 - DNA, 201 bp, Bos taurus
catgactgagcgactggaaaacaacaaaaacaaaaacaatgtgagagtggcattttcagtcaatgtttcatttcctagatgagtttatcaaggaaatgagcatagagaggaaggaatctagggctgagacccaggacactgtcatatgatgaggtctgggagaggaagagtaaccagccgcagagaaggaggaggacctga

SEQ ID NO: 86888 - DNA, 201 bp, Bos taurus
cataaaaaataaagacttcccctccagaagaatgagaatttcagaaacagacataagaaaattaatatatggtcagctgaaacttgtagtaccttagaaaatatgacagagtaaggtccaactgccttttttaccaagcttgtgtagaccagcatttagtaaaataacacaaaaaataagaaaatgaaagcacttatggaa

SEQ ID NO: 86889 - DNA, 201 bp, Bos taurus
ttaccagtgtgatggcacagtttgtgatatttttggccatacattcaagacaatctatagtcagacccttctgactggtcagtatgtaaagaattaaacttatatttctttgtggtggatcctggtttttgcagccagtgcatgctggcctagacttacgtaaattttatctatcgtttcatctttcttcttccctgaact

SEQ ID NO: 86890 - DNA, 201 bp, Bos taurus; identical to SEQ ID NO: 4940

SEQ ID NO: 86891 - DNA, 201 bp, Bos taurus
agaagatgagatgagatgtcccagctggtgcaggaatctaggaaaaaagggcaaattccttcttccttcacattttgttctatttaggcccacaatggatggaataatgtctacttacctacattctttgagattggactgaaaactgaccttttccagtcctgtggccaagactgagttttccaaatttgctggcatatt

SEQ ID NO: 86892 - DNA, 201 bp, Bos taurus
gataacttggcatagaatgatcttctggatgttaagattttgagaaagacaaaaatgtagtagaaagtttttgagtgttcaatatatgatataaaagtatgttattattaaagctcagtagttgtcccaagcaaaagagatttctaacatcaagaaagaaatatttgagtacaatgtagcaattacaattcttctagtagt

SEQ ID NO: 86893 - DNA, 201 bp, Bos taurus; identical to SEQ ID NO: 4941

SEQ ID NO: 86894 - DNA, 201 bp, Bos taurus; identical to SEQ ID NO: 4942

SEQ ID NO: 86895 - DNA, 201 bp, Bos taurus
cttctggggaaaagagaaatacttccacaacaggaaccaatagccattcctacttcattactacctaattgaaggaatatacatcctgagcaacactctttcaagtggaacagcatcacagagtctttcatctctataatccacatatacccctaagaaatagtgaaaaaaaatctaggttttcctctttgcatttattta

SEQ ID NO: 86896 - DNA, 201 bp, Bos taurus
ttctgttttcctttctctgtaggccagcatttttttgcttatttgtccaaaagaatggaaattggtgcattaatggcttctaggtttatatcctcttttttaataggccagttcatggtaagctattttcaacttaaattccaagcttgcaaaagatagaatgaaaatattccagtttaggtgttgttcagtagcctgcag

SEQ ID NO: 86897 - DNA, 201 bp, Bos taurus; identical to SEQ ID NO: 4943

SEQ ID NO: 86898 - DNA, 201 bp, Bos taurus; identical to SEQ ID NO: 4944

SEQ ID NO: 86899 - DNA, 201 bp, Bos taurus
aggctattaactacacctgtgatctctgtgtctcactatatcccctcactccttatgatttcttgtatgctggcctgatatcctactgccagcagttgacccttatcactggggatttttctctaaatcctaaggcccattctatttatttgtgctgtcaatccaaaactgatggattttttaagcccctggggtaactat

SEQ ID NO: 86900 - DNA, 201 bp, Bos taurus; identical to SEQ ID NO: 4945

SEQ ID NO: 86901 - DNA, 201 bp, Bos taurus; identical to SEQ ID NO: 4946

SEQ ID NO: 86902 - DNA, 201 bp, Bos taurus
gattggtatgatagtggcagcattctgctgtgtcctgtcaagaaggaaaaaagcttaatcaaatattcttggataattttacaaggagcccatccaattatctaaagctatatctccattcactgtcaaagcaaatggacaacaacaacaacaacaaatcactacctaataatataaaacattttatttgatgtcccttat

SEQ ID NO: 86903 - DNA, 201 bp, Bos taurus
acataaaggtaggaaaaaagaaaaaattcagcactttctaaatgcatccccaaaagagtataacagtgttgcttttattttcctttcaatattatctttcattcaatattgtttattgataaagagcccagttagaagactaagggaaggggctaaaaactatttcactaaatattccttcaatttagttcaaatttcaat

SEQ ID NO: 86904 - DNA, 201 bp, Bos taurus; identical to SEQ ID NO: 4947

SEQ ID NO: 86905 - DNA, 201 bp, Bos taurus; identical to SEQ ID NO: 4948

SEQ ID NO: 86906 - DNA, 201 bp, Bos taurus; identical to SEQ ID NO: 4949

SEQ ID NO: 86907 - DNA, 201 bp, Bos taurus
cttactacagtccttccctctaatagacttagggagatcagtatgttccaaagtctaaaaataaaatgcaattttcttctggcttacaatactaaaatgagaccattttcattaacattcctacctacattatgctttttaaagtgtgcttttctaagaaagttattaaatcttataagaattaattccccactaggtaaa

SEQ ID NO: 86908 - DNA, 201 bp, Bos taurus; identical to SEQ ID NO: 4950

SEQ ID NO: 86909 - DNA, 201 bp, Bos taurus
tagagacatgagggtgaaaatcactgatgttctccaagagagacttcaagatacaagcaaaaacaatgattacaaatgttaatgaataaatagagaatattcagcaaagggtcttttataatttttcatacattaaagaagaagaagtgaaataggcaaaagtatatatttgtgtgcacatgcatatatataatttatagt

SEQ ID NO: 86910 - DNA, 201 bp, Bos taurus; identical to SEQ ID NO: 4951

SEQ ID NO: 86911 - DNA, 201 bp, Bos taurus; identical to SEQ ID NO: 4952

SEQ ID NO: 86912 - DNA, 201 bp, Bos taurus; identical to SEQ ID NO: 4953

SEQ ID NO: 86913 - DNA, 201 bp, Bos taurus; identical to SEQ ID NO: 4954

SEQ ID NO: 86914 - DNA, 201 bp, Bos taurus; identical to SEQ ID NO: 4955

SEQ ID NO: 86915 - DNA, 201 bp, Bos taurus
atggtttaacccccagagttcctgaatgtgattttatttggaaatagtctttgcagatgatcaaagtaacatgaagtcactagctgttctaagtagtttagtcatgtccaactctttgcaacctcatggactgtagcccaccaggctcctctgtccatggggattcttcaggcaagaatgctggggtaggttgccatgccc

SEQ ID NO: 86916 - DNA, 201 bp, Bos taurus
aaaacaatatatcaatattttctcaaagacaataaaaattctcactctctagcatcctttatcaaaattaatcagtaaccataataattctataggatttgttttctttattatgcctttgattacttaattacctgtacctttaccatttttctactttgtattcagtttctcctctctctacctttgtggaagctccta

SEQ ID NO: 86917 - DNA, 201 bp, Bos taurus; identical to SEQ ID NO: 4956

SEQ ID NO: 86918 - DNA, 201 bp, Bos taurus; identical to SEQ ID NO: 4957

SEQ ID NO: 86919 - DNA, 201 bp, Bos taurus; identical to SEQ ID NO: 4958

SEQ ID NO: 86920 - DNA, 201 bp, Bos taurus
aatattagcttttatttttattgtgttctgaaaatattacattagcacttccttgtatcttctaaacagttttaaataaagttatctgaaaaagtatcaagactctctaatggctgaaaacaggaaaaatatcttttcccaatccttcacacctttttgtttctatgtccttttccatgtaaatttagattgtccattcac

SEQ ID NO: 86921 - DNA, 201 bp, Bos taurus; identical to SEQ ID NO: 4959

SEQ ID NO: 86922 - DNA, 201 bp, Bos taurus
taagtgtggcttcccttcccttttgggatctgcttctcagcattatatcagcaatcttttctactcctacttcgataggacatatacttatgggccagggtctccaacccacctcttagagtctggtttgaatactcatctatttttatccttgttctattagaactcaaactgttctaaatagtgcatgtcattcagatc

SEQ ID NO: 86923 - DNA, 201 bp, Bos taurus; identical to SEQ ID NO: 4960

SEQ ID NO: 86924 - DNA, 201 bp, Bos taurus; identical to SEQ ID NO: 4961

SEQ ID NO: 86925 - DNA, 201 bp, Bos taurus; identical to SEQ ID NO: 4962

SEQ ID NO: 86926 - DNA, 201 bp, Bos taurus
tgttatctatcatgggactaagatttatgtaccaatagtgttagatatttctaaatgaacatatgaacaaatgtttattgacagtgtttaaaaataggtcattgtcattaataaaatagactgggttcataaaccacacaaataattagcaacattatagagttatatagtaaaatttaaaaaaatatcttaaagagatga

SEQ ID NO: 86927 - DNA, 201 bp, Bos taurus
attcaagacaggtgtttgtttcttttagcacttaaagaataccactccattgtattcacatttccatttctgctgaaagaatatttgctatcctgatattgctcctttgaagataatgcacactcttctctggctgcttttagaatattcaatttgtttgatttccagcagtcttactgttgtatatctttaggtatagtt

SEQ ID NO: 86928 - DNA, 201 bp, Bos taurus; identical to SEQ ID NO: 4963

SEQ ID NO: 86929 - DNA, 201 bp, Bos taurus; identical to SEQ ID NO: 4964

SEQ ID NO: 86930 - DNA, 201 bp, Bos taurus; identical to SEQ ID NO: 4965

SEQ ID NO: 86931 - DNA, 201 bp, Bos taurus
ccagccctctttcctagcttctggtagtgcccaggattgtaacagcataactctaatcttcacagggtattctatcagtgtacatatctgtttctatgttttaatttccctttaagaagacaccagtcatattggattagggccaacactgatgacctcaccttaacttgaacatctgtgaagactgcatttctaaataaa

SEQ ID NO: 86932 - DNA, 201 bp, Bos taurus; identical to SEQ ID NO: 4967

SEQ ID NO: 86933 - DNA, 201 bp, Bos taurus; identical to SEQ ID NO: 4968

SEQ ID NO: 86934 - DNA, 201 bp, Bos taurus; identical to SEQ ID NO: 4969

SEQ ID NO: 86935 - DNA, 201 bp, Bos taurus; identical to SEQ ID NO: 4970

SEQ ID NO: 86936 - DNA, 201 bp, Bos taurus
ttcaatttttttcctgacttgctcagcactatcagtagatgggaatcgaaacacaagcaccatatgaatgttcataccattttgatctggactaaagagggaaaagcagatagaggtaatcataataaagtcagttctctaaccaggaactatttttacacgttatgattcacactagatttaatagtgagtggcatgtgt

SEQ ID NO: 86937 - DNA, 201 bp, Bos taurus; identical to SEQ ID NO: 4971

SEQ ID NO: 86938 - DNA, 201 bp, Bos taurus; identical to SEQ ID NO: 4972

SEQ ID NO: 86939 - DNA, 201 bp, Bos taurus; identical to SEQ ID NO: 4973

SEQ ID NO: 86940 - DNA, 201 bp, Bos taurus
gataagtacattgtaagctttgataacatggcactgataatatagcaaagaaataagatgtgatgtttaagagacactgatggaacctggtgcttatttactttcatggctgcagtctatccacagtgattttggagccccccatctatttgccatggttcttctagtgaaagctatgattcttccagtaatcaagcatgg

SEQ ID NO: 86941 - DNA, 201 bp, Bos taurus; identical to SEQ ID NO: 4975

SEQ ID NO: 86942 - DNA, 201 bp, Bos taurus; identical to SEQ ID NO: 4976

SEQ ID NO: 86943 - DNA, 201 bp, Bos taurus; identical to SEQ ID NO: 4977

SEQ ID NO: 86944 - DNA, 201 bp, Bos taurus; identical to SEQ ID NO: 4978

SEQ ID NO: 86945 - DNA, 201 bp, Bos taurus; identical to SEQ ID NO: 4979

SEQ ID NO: 86946 - DNA, 201 bp, Bos taurus
aaacatctcacctctaacaggaactgagttgtacagtatttgactgtacagaatttgtagtaaattttattctaaatagttttaacatgtgtagtaatctcgttttcatattatctttcctttcctagttgcttctgaatcttaataatgctcagcttcgaccactacagcttcaggtatccctaccccaataattatttc

SEQ ID NO: 86947 - DNA, 201 bp, Bos taurus
gcaggtggattctttatcatctgagccacactttagttaaacatacaatgaaaatttataggctttagatttggatagaactgaattaaagttttgctcacaatcgcttgcttaactgtgtggctctgggtaataaataaggtggaaagtacattttttgatttactgatatatgtgtcaggctctctataaaagatttta

SEQ ID NO: 86948 - DNA, 201 bp, Bos taurus; identical to SEQ ID NO: 4980

SEQ ID NO: 86949 - DNA, 201 bp, Bos taurus
agcacctactaggccctggtactgcgctagcccactagagacacaatgataccaagatgagtaggtcactcagatgctgctgtaaatgctgctacttagaaaaggactcaaaggaaaagctgactctgcagggagtgaaggaggaagtggcacaaataagggtatttttgagctggctctgaaaaaatacagagctttcta

SEQ ID NO: 86950 - DNA, 201 bp, Bos taurus; identical to SEQ ID NO: 4981

SEQ ID NO: 86951 - DNA, 201 bp, Bos taurus; identical to SEQ ID NO: 4982

SEQ ID NO: 86952 - DNA, 201 bp, Bos taurus; identical to SEQ ID NO: 4983

SEQ ID NO: 86953 - DNA, 201 bp, Bos taurus; identical to SEQ ID NO: 4984

SEQ ID NO: 86954 - DNA, 201 bp, Bos taurus; identical to SEQ ID NO: 4985

SEQ ID NO: 86955 - DNA, 201 bp, Bos taurus; identical to SEQ ID NO: 4986

SEQ ID NO: 86956 - DNA, 201 bp, Bos taurus; identical to SEQ ID NO: 4987

SEQ ID NO: 86957 - DNA, 201 bp, Bos taurus; identical to SEQ ID NO: 4988

SEQ ID NO: 86958 - DNA, 201 bp, Bos taurus; identical to SEQ ID NO: 4989

SEQ ID NO: 86959 - DNA, 201 bp, Bos taurus; identical to SEQ ID NO: 4990

SEQ ID NO: 86960 - DNA, 201 bp, Bos taurus
tattttagaaaacgttccctgtgtgcttgagaagaaggtatattccgctgttactgggtagaatgtcttttatgttctgtggggaccattctgtctgtagcagtgctcaaggccactgtttccttattgcttctctgcctggatgatgcctctattgttgagagtagggtattaaagtccccacttatgtctgtattacta

SEQ ID NO: 86961 - DNA, 201 bp, Bos taurus; identical to SEQ ID NO: 4991

SEQ ID NO: 86962 - DNA, 201 bp, Bos taurus; identical to SEQ ID NO: 4992

SEQ ID NO: 86963 - DNA, 201 bp, Bos taurus; identical to SEQ ID NO: 4993

SEQ ID NO: 86964 - DNA, 201 bp, Bos taurus
cctatgaaatgatctgatcactgtaagcaggtacacgtattagctttgactaaaaattaaaactaaaaagagctaatgacatttaaatccctttcattttcttccttgatatataaggataggtcaaataaatgcttacagtggatgtgtgcactcctgaatattgcacattcttctaataggttttggctttttgttgac

SEQ ID NO: 86965 - DNA, 201 bp, Bos taurus; identical to SEQ ID NO: 4994

SEQ ID NO: 86966 - DNA, 201 bp, Bos taurus; identical to SEQ ID NO: 4995

SEQ ID NO: 86967 - DNA, 201 bp, Bos taurus; identical to SEQ ID NO: 4996

SEQ ID NO: 86968 - DNA, 201 bp, Bos taurus; identical to SEQ ID NO: 4997

SEQ ID NO: 86969 - DNA, 201 bp, Bos taurus; identical to SEQ ID NO: 4998

SEQ ID NO: 86970 - DNA, 201 bp, Bos taurus
ctccattggcagccctggaccaccagtttgtttgcagcatttggaacagctggggaatttaatcgcaatgtagactatacttctttttgaaatagagcacatataaaaagaatgagaaaaacaaagaaataatcagttacctccttacaacctctttccatccttcttccctcttctgtccacgcttgggacttgctactg

SEQ ID NO: 86971 - DNA, 201 bp, Bos taurus; identical to SEQ ID NO: 4999

SEQ ID NO: 86972 - DNA, 201 bp, Bos taurus; identical to SEQ ID NO: 5000

SEQ ID NO: 86973 - DNA, 201 bp, Bos taurus; identical to SEQ ID NO: 5001

SEQ ID NO: 86974 - DNA, 201 bp, Bos taurus; identical to SEQ ID NO: 5002

SEQ ID NO: 86975 - DNA, 201 bp, Bos taurus
gatgattccgtaacggtcagtgatattagaaaccacacagagcccagcatggagcacttgctgaataaatgtttattaatacatttagatatttaatagagttttcattgtgttagtcctaggatgtcttgtttcaaaacattagctgaaagatttttccagtgtttactttagccttcaaatcctaacaataataaaatt

SEQ ID NO: 86976 - DNA, 201 bp, Bos taurus
gtggtccccacaatgtgatctgtatccagggccaaggtaaacacttagatgaactgtgagatttctgatggagaggacatttgaaacggctcctgagtgacgggtgtctgggccatgcttgtcctcctgctctctatgtatcccggccttgatgacaaactccaggttacaacaaagacctagcccaacaaaataaataaa

SEQ ID NO: 86977 - DNA, 201 bp, Bos taurus
tactggaaaaaccataactttgactatacagaccttggtcagccaaatgcttagtatttggcacaaccctgactattgactggacataataagaacctaggtagtgacaaagtagggtcactagagtggggtctagaccagtggttttccacatatggtctggagacacttaggagatcttgaaacactgccagggtgact

SEQ ID NO: 86978 - DNA, 201 bp, Bos taurus
tctgaaatccagagaatccacagaaccatgctctcttggcctgttgttgctggcaatccttggcttttttttggcttacaactgtatgactccaattttgcgtctatagccatgtggccatcttgcctctgtcttcacgtgatgtctagtctgtcttttataaggacaaaagtcatattgtatttatggtcactgaactcc

SEQ ID NO: 86979 - DNA, 201 bp, Bos taurus
cgactccataaggtaccagggaaaactgtgttcatgagggagtctgtgcttgaacttgaggagggatttgtaggtgaggagtggggtggtcctagagagaaggaacagggggcatctaggccagccatcctgggacagtaagaggaaagagaaagtcagatgctggatcagtctgtctgtccattcctaggcctataactc

SEQ ID NO: 86980 - DNA, 201 bp, Bos taurus
ccatacttcattgcacaatgatagagaattgacagaataaacattctttcttgaaatctgagaagcatagatctcagtgaggcaatggcttgccttagagctttccttttgaccctgagagtttatgagctgcctggtgttggcacagcctgagatgacacatcacgggcaaaaacacgatgacaggcctctccggtctgg

SEQ ID NO: 86981 - DNA, 201 bp, Bos taurus; identical to SEQ ID NO: 5003

SEQ ID NO: 86982 - DNA, 201 bp, Bos taurus
tctgcataacattttctagcaccccattggccaaagcaagtcccataggtaaatctacattcaagggtggtgaaaaaattccacatctttataaaagaaactgctaaatgttgtggccactttgtttccatctaccacagtccattcccaatgcaaactacactgacctccccataatttttcccaaaatctgatccattt

SEQ ID NO: 86983 - DNA, 201 bp, Bos taurus
atggctgttttctaccaaggatgacaagtggatgccaagaacaaaatctgagtattaaactgtgaataaatagctgaggaatacaaagagtgcaagcaaaggattcaaaccaggtgctgacttaccatgttggcatgaatctgacaggccatgagcaataagcacaggcctctatggataccacaccaagctgaaggctgg

SEQ ID NO: 86984 - DNA, 201 bp, Bos taurus; identical to SEQ ID NO: 5006

SEQ ID NO: 86985 - DNA, 201 bp, Bos taurus; identical to SEQ ID NO: 5008

SEQ ID NO: 86986 - DNA, 201 bp, Bos taurus; identical to SEQ ID NO: 5009

SEQ ID NO: 86987 - DNA, 201 bp, Bos taurus; identical to SEQ ID NO: 5012

SEQ ID NO: 86988 - DNA, 201 bp, Bos taurus
ttcaggtgtggccaagtgacttgacttgattaactgaatgtggatggaatgggaatgccccagcttcaagctgaggccttaaaggcatggcaagtttccaccagccaccctctgctaccctgtttcaggcagttggtgacccttcagccaaggccctaaaatggtcatgtgtagaccagccatggtgccaggagtccagcc

SEQ ID NO: 86989 - DNA, 201 bp, Bos taurus; identical to SEQ ID NO: 5015

SEQ ID NO: 86990 - DNA, 201 bp, Bos taurus; identical to SEQ ID NO: 5016

SEQ ID NO: 86991 - DNA, 201 bp, Bos taurus; identical to SEQ ID NO: 5018

SEQ ID NO: 86992 - DNA, 201 bp, Bos taurus; identical to SEQ ID NO: 5020

SEQ ID NO: 86993 - DNA, 201 bp, Bos taurus; identical to SEQ ID NO: 5021

SEQ ID NO: 86994 - DNA, 201 bp, Bos taurus; identical to SEQ ID NO: 5023

SEQ ID NO: 86995 - DNA, 201 bp, Bos taurus; identical to SEQ ID NO: 5024

SEQ ID NO: 86996 - DNA, 201 bp, Bos taurus; identical to SEQ ID NO: 5025

SEQ ID NO: 86997 - DNA, 201 bp, Bos taurus; identical to SEQ ID NO: 5026

SEQ ID NO: 86998 - DNA, 201 bp, Bos taurus; identical to SEQ ID NO: 5027

SEQ ID NO: 86999 - DNA, 201 bp, Bos taurus; identical to SEQ ID NO: 5028

SEQ ID NO: 87000 - DNA, 201 bp, Bos taurus
agcctttcaaggcccataagtccattatgtttcaaacagagaaagagcagattgactcactttatcaaggacagcagaaaagcaatgtatctttagacctgtagccctatattggcctcttttctttctttctttaaacctcattcatcttggatatgtgttttcagtactttacctggaagattcctgaactgtgtcttg

SEQ ID NO: 87001 - DNA, 201 bp, Bos taurus; identical to SEQ ID NO: 5029

SEQ ID NO: 87002 - DNA, 201 bp, Bos taurus; identical to SEQ ID NO: 5030

SEQ ID NO: 87003 - DNA, 201 bp, Bos taurus; identical to SEQ ID NO: 5031

SEQ ID NO: 87004 - DNA, 201 bp, Bos taurus; identical to SEQ ID NO: 5032

SEQ ID NO: 87005 - DNA, 201 bp, Bos taurus
caatcacaaagtcagcaacttggttgtggtggagcaatggggtatgaacttggttgggataattaactcagccacgtaattggcccaattctgtggcaaactgggcttcccttgtggctcagctggtaaagaatctgcctgcactgaaggagacctgggttggggagatcccctggagaagggaaaggctacccactccag

SEQ ID NO: 87006 - DNA, 201 bp, Bos taurus; identical to SEQ ID NO: 5033

SEQ ID NO: 87007 - DNA, 201 bp, Bos taurus; identical to SEQ ID NO: 5034

SEQ ID NO: 87008 - DNA, 201 bp, Bos taurus; identical to SEQ ID NO: 5035

SEQ ID NO: 87009 - DNA, 201 bp, Bos taurus; identical to SEQ ID NO: 5036

SEQ ID NO: 87010 - DNA, 201 bp, Bos taurus
ccggacctggaatcaaacccaggttccctgcactggcagggcagattcccaacctggactaccagagaagtccctcaatggtttttgaagctctgtggctggaattcaggacaaacatcagttatatctttaccaaaccatatatatatatacatcaaggatgagtaaagtgtctaaaacatcatattcctgtaaacatat

SEQ ID NO: 87011 - DNA, 201 bp, Bos taurus; identical to SEQ ID NO: 5037

SEQ ID NO: 87012 - DNA, 201 bp, Bos taurus
agtgggtagccgttcccttctccagggcatcttcctgacccagggattgaacttgggtctcctgctttgcaggcagagactttactatctgagccaccagagaagcccactttagaatagaagcatcaaataattctcaaggagaaaaaccaagcccttgattctgggtaaaacggctcatagacttcaaagaccctccaa

SEQ ID NO: 87013 - DNA, 201 bp, Bos taurus
agttcaattaaacatctttgtgtttattgatactgagtgaggatttgtgcttgttaggaaaaatatttaaactttgaccttgtatttactattaagaagttgatattattgcattgaaaactgtgtggaaaacttgttactttctaatgctgttttggagaactctttggtagaaatataaatcatatctgccttatgttt

SEQ ID NO: 87014 - DNA, 201 bp, Bos taurus
cttcatcaactagtaaatgggtttaggtttcttccagacatccttaaactgtgctggaagttgcttttagttgaatctattatgttgcattgataattttgaaaccagttccaataagcagatgtaagttccagtcacttactgattataggtatttcacattagtgtttgactattgaatacccaagtcattgttacggt

SEQ ID NO: 87015 - DNA, 201 bp, Bos taurus; identical to SEQ ID NO: 5038

SEQ ID NO: 87016 - DNA, 201 bp, Bos taurus; identical to SEQ ID NO: 5039

SEQ ID NO: 87017 - DNA, 201 bp, Bos taurus; identical to SEQ ID NO: 5040

SEQ ID NO: 87018 - DNA, 201 bp, Bos taurus; identical to SEQ ID NO: 5041

SEQ ID NO: 87019 - DNA, 201 bp, Bos taurus
cccagtttgtatatatcaggtgcagactttgaagacagaccaagtgaaccgatctttgtctctctcttcctgcattcccttccaggggttattctctggctgatattttcccatttatccaggacattagaatcagtcatatgaacactagcgctatgaagatggagggatggagagtcattaaagaaggaaagttgtgag

SEQ ID NO: 87020 - DNA, 201 bp, Bos taurus; identical to SEQ ID NO: 5042

SEQ ID NO: 87021 - DNA, 201 bp, Bos taurus; identical to SEQ ID NO: 5043

SEQ ID NO: 87022 - DNA, 201 bp, Bos taurus
caagtactcatccaggcaaacatttggtgcatgatttgtttttgatacagttgtaatgaaattccattcttctctatggaacaacaggccagatctttagcgcattgctgcctggtgcccagtgggcagcgagtgcctgattgccagtaccactttttagcgcgtgttcatctgcaggatattaaacagattgccgtcctt

SEQ ID NO: 87023 - DNA, 201 bp, Bos taurus; identical to SEQ ID NO: 5047

SEQ ID NO: 87024 - DNA, 201 bp, Bos taurus
tgactttgggaagctataccatcttgaagtccttgttgttttgaccctttgctagatgtgatccttgcacatctaataccactcctctttagatctaaaggcattgatcacttagaacactgacaatctctctaagtggactgccctacagaaggatcaataactccatcccacatggtcctagcttcttgccattcctag

SEQ ID NO: 87025 - DNA, 201 bp, Bos taurus
agcaaaatgaatggtaggttggctcaagacctgagtccgggcccttagctagcagaggggcggagggtggggagcgttggggtcactctggcgcctgggcgagccttccctcctttggggttccttgtagagagcttctgagatatagtctggggtgaagctgggacagctaggtgaggatgaatcgggacacgctaggct

SEQ ID NO: 87026 - DNA, 201 bp, Bos taurus; identical to SEQ ID NO: 5052

SEQ ID NO: 87027 - DNA, 201 bp, Bos taurus; identical to SEQ ID NO: 5054

SEQ ID NO: 87028 - DNA, 201 bp, Bos taurus; identical to SEQ ID NO: 5055

SEQ ID NO: 87029 - DNA, 201 bp, Bos taurus; identical to SEQ ID NO: 5056

SEQ ID NO: 87030 - DNA, 201 bp, Bos taurus; identical to SEQ ID NO: 5057

SEQ ID NO: 87031 - DNA, 201 bp, Bos taurus; identical to SEQ ID NO: 5058

SEQ ID NO: 87032 - DNA, 201 bp, Bos taurus; identical to SEQ ID NO: 5059

SEQ ID NO: 87033 - DNA, 201 bp, Bos taurus
tcgagttcaaagctgacagacttgagatccaggaagaactgatgaattaatttgagtccaaaggcaggaagacacctttgtccaacttcaaaagcaatcagacaggaggaattttcacttccttggggaagagtcggcctttttgttctattcaggccttcaactgattggatgaggcccatctgcactagagagggccat

SEQ ID NO: 87034 - DNA, 201 bp, Bos taurus; identical to SEQ ID NO: 5062

SEQ ID NO: 87035 - DNA, 201 bp, Bos taurus; identical to SEQ ID NO: 5064

SEQ ID NO: 87036 - DNA, 201 bp, Bos taurus
gtttctgctttggttccctgaaacattgcctggatcactcatgaaaggaagctggtttagcctaacaaagaatgagaggccctgagaaagagatccgaggcgtccagccagcactcagcgcccagcgcccgctgtgtgagtgtgagtgatgactacccatccagcccaggtgagaccaacagagaagcaggccagccaccc

SEQ ID NO: 87037 - DNA, 201 bp, Bos taurus; identical to SEQ ID NO: 5065

SEQ ID NO: 87038 - DNA, 201 bp, Bos taurus; identical to SEQ ID NO: 5067

SEQ ID NO: 87039 - DNA, 201 bp, Bos taurus; identical to SEQ ID NO: 5068

SEQ ID NO: 87040 - DNA, 201 bp, Bos taurus; identical to SEQ ID NO: 5069

SEQ ID NO: 87041 - DNA, 201 bp, Bos taurus
ggaacattttcagcaacgttctgatgctgaaagctgggcctgtttgtccccccttcgcccactggattccatctttcctttctctctgtcttctttactcatagttatggacagatactgtggccaaacagctcattgtcactttctttgccaatcacttcctgtttgtttttttttttaacttgagatacctctaccgtg

SEQ ID NO: 87042 - DNA, 201 bp, Bos taurus; identical to SEQ ID NO: 5075

SEQ ID NO: 87043 - DNA, 201 bp, Bos taurus; identical to SEQ ID NO: 5076

SEQ ID NO: 87044 - DNA, 201 bp, Bos taurus; identical to SEQ ID NO: 5077

SEQ ID NO: 87045 - DNA, 201 bp, Bos taurus; identical to SEQ ID NO: 5078

SEQ ID NO: 87046 - DNA, 201 bp, Bos taurus; identical to SEQ ID NO: 5079

SEQ ID NO: 87047 - DNA, 201 bp, Bos taurus; identical to SEQ ID NO: 5080

SEQ ID NO: 87048 - DNA, 201 bp, Bos taurus; identical to SEQ ID NO: 5081

SEQ ID NO: 87049 - DNA, 201 bp, Bos taurus; identical to SEQ ID NO: 5086

SEQ ID NO: 87050 - DNA, 201 bp, Bos taurus; identical to SEQ ID NO: 5087

SEQ ID NO: 87051 - DNA, 201 bp, Bos taurus; identical to SEQ ID NO: 5088

SEQ ID NO: 87052 - DNA, 201 bp, Bos taurus; identical to SEQ ID NO: 5089

SEQ ID NO: 87053 - DNA, 201 bp, Bos taurus; identical to SEQ ID NO: 5090

SEQ ID NO: 87054 - DNA, 201 bp, Bos taurus; identical to SEQ ID NO: 5091

SEQ ID NO: 87055 - DNA, 201 bp, Bos taurus; identical to SEQ ID NO: 5092

SEQ ID NO: 87056 - DNA, 201 bp, Bos taurus; identical to SEQ ID NO: 5093

SEQ ID NO: 87057 - DNA, 201 bp, Bos taurus; identical to SEQ ID NO: 5094

SEQ ID NO: 87058 - DNA, 201 bp, Bos taurus; identical to SEQ ID NO: 5095

SEQ ID NO: 87059 - DNA, 201 bp, Bos taurus; identical to SEQ ID NO: 5096

SEQ ID NO: 87060 - DNA, 201 bp, Bos taurus; identical to SEQ ID NO: 5097

SEQ ID NO: 87061 - DNA, 201 bp, Bos taurus; identical to SEQ ID NO: 5098

SEQ ID NO: 87062 - DNA, 201 bp, Bos taurus; identical to SEQ ID NO: 5099

SEQ ID NO: 87063 - DNA, 201 bp, Bos taurus; identical to SEQ ID NO: 5101

SEQ ID NO: 87064 - DNA, 201 bp, Bos taurus; identical to SEQ ID NO: 5103

SEQ ID NO: 87065 - DNA, 201 bp, Bos taurus; identical to SEQ ID NO: 5110

SEQ ID NO: 87066 - DNA, 201 bp, Bos taurus; identical to SEQ ID NO: 5112

SEQ ID NO: 87067 - DNA, 201 bp, Bos taurus; identical to SEQ ID NO: 5114

SEQ ID NO: 87068 - DNA, 201 bp, Bos taurus; identical to SEQ ID NO: 5115

SEQ ID NO: 87069 - DNA, 201 bp, Bos taurus; identical to SEQ ID NO: 5116

SEQ ID NO: 87070 - DNA, 201 bp, Bos taurus; identical to SEQ ID NO: 5117

SEQ ID NO: 87071 - DNA, 201 bp, Bos taurus; identical to SEQ ID NO: 5121

SEQ ID NO: 87072 - DNA, 201 bp, Bos taurus; identical to SEQ ID NO: 5123

SEQ ID NO: 87073 - DNA, 201 bp, Bos taurus; identical to SEQ ID NO: 5124

SEQ ID NO: 87074 - DNA, 201 bp, Bos taurus; identical to SEQ ID NO: 5129

SEQ ID NO: 87075 - DNA, 201 bp, Bos taurus; identical to SEQ ID NO: 5131

SEQ ID NO: 87076 - DNA, 201 bp, Bos taurus; identical to SEQ ID NO: 5132

SEQ ID NO: 87077 - DNA, 201 bp, Bos taurus; identical to SEQ ID NO: 5133

SEQ ID NO: 87078 - DNA, 201 bp, Bos taurus; identical to SEQ ID NO: 5136

SEQ ID NO: 87079 - DNA, 201 bp, Bos taurus; identical to SEQ ID NO: 5137

SEQ ID NO: 87080 - DNA, 201 bp, Bos taurus; identical to SEQ ID NO: 5138

SEQ ID NO: 87081 - DNA, 201 bp, Bos taurus; identical to SEQ ID NO: 5139

SEQ ID NO: 87082 - DNA, 201 bp, Bos taurus; identical to SEQ ID NO: 5140

SEQ ID NO: 87083 - DNA, 201 bp, Bos taurus; identical to SEQ ID NO: 5141

SEQ ID NO: 87084 - DNA, 201 bp, Bos taurus; identical to SEQ ID NO: 5142

SEQ ID NO: 87085 - DNA, 201 bp, Bos taurus; identical to SEQ ID NO: 5144

SEQ ID NO: 87086 - DNA, 201 bp, Bos taurus; identical to SEQ ID NO: 5145

SEQ ID NO: 87087 - DNA, 201 bp, Bos taurus; identical to SEQ ID NO: 5146

SEQ ID NO: 87088 - DNA, 201 bp, Bos taurus; identical to SEQ ID NO: 5147

SEQ ID NO: 87089 - DNA, 201 bp, Bos taurus; identical to SEQ ID NO: 5149

SEQ ID NO: 87090 - DNA, 201 bp, Bos taurus; identical to SEQ ID NO: 5150

SEQ ID NO: 87091 - DNA, 201 bp, Bos taurus; identical to SEQ ID NO: 5151

SEQ ID NO: 87092 - DNA, 201 bp, Bos taurus; identical to SEQ ID NO: 5152

SEQ ID NO: 87093 - DNA, 201 bp, Bos taurus; identical to SEQ ID NO: 5153

SEQ ID NO: 87094 - DNA, 201 bp, Bos taurus
catgcggcctccagggctggcagggcgacggcaggggtgaggacggggaggtgccgggggacagggcagacctagtgcagggccagacaagccctcgagacggcaaggtcggctgcgctgggtgggggtcagtccacagcatagccccacggagaggggcccctcagactcaggcgaaagagggctggagggcaaacctgg

SEQ ID NO: 87095 - DNA, 201 bp, Bos taurus; identical to SEQ ID NO: 5154

SEQ ID NO: 87096 - DNA, 201 bp, Bos taurus
tgccccccaccagcgggggttcaccccaggccgacccgtccaagcctcttcttgaaagcgttactcattccatttatagacaacacagcttagccttggggattcaggcctgagcacaattaccgtgagaacgagccagcagcgaaactccccgctgagacaaaaggacccctcaggcctccagtctagctgcctccagct

SEQ ID NO: 87097 - DNA, 201 bp, Bos taurus
ggctcggagactcagaaggcatagcttgatttctttaaacttttacagcaaatacccttttcaagaaacgtaatattaaatgacaatgatcagacatttgcttgttttacttatttcccatattagacaaaaatttaaagagccctagtcggagaaggcaatggcaacccactctggtactcttgcctggaaaatcccgga

SEQ ID NO: 87098 - DNA, 201 bp, Bos taurus
ttctgctttggcctccagaaagctcaccaacctaacacaaaagaacatatttcacggtgaataattcagctactgaacaaagccgcgtggacggcctgcacggcacgcagaggaggacggccaggccagggccgcaggtggaagccggggaggctctgaggcagccccacgccacacggcaggaagatgcctgcttccaac

SEQ ID NO: 87099 - DNA, 201 bp, Bos taurus
ggttggaggacattctgatgaaacgtcccactgtgacaataagtccctaaggcagggttttaaacaccttctctcttcttgttcatggcccactgcccaccgcctatccgggcactcgtctcagacctggagtggggggtctccagagcagcagttccctccctgccagcctcacggtccgtctgcgggttccacggcctc

SEQ ID NO: 87100 - DNA, 201 bp, Bos taurus; identical to SEQ ID NO: 5155

SEQ ID NO: 87101 - DNA, 201 bp, Bos taurus
cattggtcacctaaggcggccttcttctctctccttgttattctctggaactctgccttctgtcgagtgtgtctttcccttcctcccttgcctttagcttttcttctctgctctctgtaaggcctcctcagacggccactttgtcttcttgcatttccttttcttggggatggttttggccaccacctcctgtacagtgtt

SEQ ID NO: 87102 - DNA, 201 bp, Bos taurus
gctcctgcctggagaatcccagggacgggggagcctggtgggctgccatctgtggggtcacacagagtcggacacgattgaagtgacttagcagcagcagtggctgcttatggcttacagtttccttcttggcacggcctggatcctaacactttgaactgtaccttgtcatgcaggacagttttgtttaagtctgtcggg

SEQ ID NO: 87103 - DNA, 201 bp, Bos taurus; identical to SEQ ID NO: 5156

SEQ ID NO: 87104 - DNA, 201 bp, Bos taurus
gcagagttctcactccacagattcacggggcaactcctgcactcgtctgcaacaagcggcatcacacagcatctcctcttgtcgggcctctctcacagtatcatcacttggagatgatccctcgtgtggctcacgagactgctcctttcactcctgagcagtggcccttggagataagtcacaactcgcttaccattctgc

SEQ ID NO: 87105 - DNA, 201 bp, Bos taurus
gaacccaggtctcccgcactgcaggcgggtcctccaccagctgagcccccggggtgcggctccactctaaggagcccctgaacgacgtcaaggcaagtcatgacagtgcgccggccctaaaactttaggggcgaacatacgagccctgtgactatccagaaatctgtgtcatctttgactgcctttagttcagtttagtcg

SEQ ID NO: 87106 - DNA, 201 bp, Bos taurus
aggctatgcctcagggcacagagcctagcaagtctgtgtcccccggctttgcgtattttgtgtacagagctgtgctatgggccgaagactctagaagctaagctgtttcctattcatcccacagtcctcatttccccgtagaagccaactgcacatggaagcggcctctctgcctcaaggccgcctccgacggccgtggtc

SEQ ID NO: 87107 - DNA, 201 bp, Bos taurus
cttcagccttcccggccactaaggcagcctaaactggagcacagagtgcaggaccacagagctggagaccccaggtctggttccaagaaaagtggcgcaggaggaggaaggtagggccgtgacagtcgacgggcaggggctggagttacacaaaagccaacaccccccgaaaacgcctaccaaggctctgaactctcccct

SEQ ID NO: 87108 - DNA, 201 bp, Bos taurus; identical to SEQ ID NO: 5158

SEQ ID NO: 87109 - DNA, 201 bp, Bos taurus; identical to SEQ ID NO: 5159

SEQ ID NO: 87110 - DNA, 201 bp, Bos taurus; identical to SEQ ID NO: 5160

SEQ ID NO: 87111 - DNA, 201 bp, Bos taurus
cttgcccctaaataagggccttgggagctcaagctgcccagggcctctgggtcacctttcccatctgccccctgccctcccagcggcctgatatcccccccatagtatgagcatgagcttaggcctcacaggccagcctccccaccccaggggcagcacaggcctctgcattatctgtccccagatgcagctggatgcccc

SEQ ID NO: 87112 - DNA, 201 bp, Bos taurus
acttttttaattgagtgtttgtctttttattgttgagttataagtgtttatgcattgcttgtattcttacatattcttttctcgaggaagattttgggttatttctttttggtcgcgctgggtctttgttgctgtgtgcaggctttctgtagttgcagggagcagggcccactcttcctcgcagtacgggggcttctcatc

SEQ ID NO: 87113 - DNA, 201 bp, Bos taurus; identical to SEQ ID NO: 5162

SEQ ID NO: 87114 - DNA, 201 bp, Bos taurus; identical to SEQ ID NO: 5163

SEQ ID NO: 87115 - DNA, 201 bp, Bos taurus; identical to SEQ ID NO: 5164

SEQ ID NO: 87116 - DNA, 201 bp, Bos taurus; identical to SEQ ID NO: 5165

SEQ ID NO: 87117 - DNA, 201 bp, Bos taurus; identical to SEQ ID NO: 5166

SEQ ID NO: 87118 - DNA, 201 bp, Bos taurus
ctggccgaaccctcccctgctctagtttgcgttggggaggggaggggggtgcaggctggcagcgacaaccacagcagcacctgagtggaccccgtcacccgagcgagcttttccagaaacgcctcaagccctacaaggggtcaatcggctgccacattcacacccgctgcccacctcagtcccatgagtgacagacgccct

SEQ ID NO: 87119 - DNA, 201 bp, Bos taurus
ttccaactttcttcttgcaggtgaagaagaggccgtgctccttgcagtggttttcgttccttgttacacgctgtgcccagtagtctttgtgcagcaggctagggttggccgtgcagccctggctcctcctggagtccagctccccctgaggccagggacaggagcgtgcaggacgagggtccacggggccaaggcttctgc

SEQ ID NO: 87120 - DNA, 201 bp, Bos taurus
ttcaggatgtcagccaccatgagcacccaggggtccgagtccaggctggcgagctggatgatctccgtgagtgcgcccttcatctgcgagacagcacaggcgcgtctgggcccaccccgtgctgcccgcgcgggtctgagggcaggcgccgagctgggcctctgagcgcctcgccttctcacaccttctcacacgtgggcc

SEQ ID NO: 87121 - DNA, 201 bp, Bos taurus; identical to SEQ ID NO: 5168

SEQ ID NO: 87122 - DNA, 201 bp, Bos taurus; identical to SEQ ID NO: 5172

SEQ ID NO: 87123 - DNA, 201 bp, Bos taurus; identical to SEQ ID NO: 5173

SEQ ID NO: 87124 - DNA, 201 bp, Bos taurus; identical to SEQ ID NO: 5174

SEQ ID NO: 87125 - DNA, 201 bp, Bos taurus; identical to SEQ ID NO: 5176

SEQ ID NO: 87126 - DNA, 201 bp, Bos taurus; identical to SEQ ID NO: 5177

SEQ ID NO: 87127 - DNA, 201 bp, Bos taurus; identical to SEQ ID NO: 5179

SEQ ID NO: 87128 - DNA, 201 bp, Bos taurus; identical to SEQ ID NO: 5181

SEQ ID NO: 87129 - DNA, 201 bp, Bos taurus; identical to SEQ ID NO: 5183

SEQ ID NO: 87130 - DNA, 201 bp, Bos taurus; identical to SEQ ID NO: 5184

SEQ ID NO: 87131 - DNA, 201 bp, Bos taurus; identical to SEQ ID NO: 5185

SEQ ID NO: 87132 - DNA, 201 bp, Bos taurus; identical to SEQ ID NO: 5186

SEQ ID NO: 87133 - DNA, 201 bp, Bos taurus; identical to SEQ ID NO: 5187

SEQ ID NO: 87134 - DNA, 201 bp, Bos taurus; identical to SEQ ID NO: 5188

SEQ ID NO: 87135 - DNA, 201 bp, Bos taurus; identical to SEQ ID NO: 5189

SEQ ID NO: 87136 - DNA, 201 bp, Bos taurus; identical to SEQ ID NO: 5190

SEQ ID NO: 87137 - DNA, 201 bp, Bos taurus; identical to SEQ ID NO: 5191

SEQ ID NO: 87138 - DNA, 201 bp, Bos taurus; identical to SEQ ID NO: 5192

SEQ ID NO: 87139 - DNA, 201 bp, Bos taurus; identical to SEQ ID NO: 5193

SEQ ID NO: 87140 - DNA, 201 bp, Bos taurus; identical to SEQ ID NO: 5194

SEQ ID NO: 87141 - DNA, 201 bp, Bos taurus; identical to SEQ ID NO: 5195

SEQ ID NO: 87142 - DNA, 201 bp, Bos taurus; identical to SEQ ID NO: 5196

SEQ ID NO: 87143 - DNA, 201 bp, Bos taurus; identical to SEQ ID NO: 5197

SEQ ID NO: 87144 - DNA, 201 bp, Bos taurus; identical to SEQ ID NO: 5198

SEQ ID NO: 87145 - DNA, 201 bp, Bos taurus; identical to SEQ ID NO: 5199

SEQ ID NO: 87146 - DNA, 201 bp, Bos taurus; identical to SEQ ID NO: 5200

SEQ ID NO: 87147 - DNA, 201 bp, Bos taurus; identical to SEQ ID NO: 5201

SEQ ID NO: 87148 - DNA, 201 bp, Bos taurus; identical to SEQ ID NO: 5202

SEQ ID NO: 87149 - DNA, 201 bp, Bos taurus; identical to SEQ ID NO: 5203

SEQ ID NO: 87150 - DNA, 201 bp, Bos taurus; identical to SEQ ID NO: 5204

SEQ ID NO: 87151 - DNA, 201 bp, Bos taurus; identical to SEQ ID NO: 5205

SEQ ID NO: 87152 - DNA, 201 bp, Bos taurus; identical to SEQ ID NO: 5206

SEQ ID NO: 87153 - DNA, 201 bp, Bos taurus; identical to SEQ ID NO: 5207

SEQ ID NO: 87154 - DNA, 201 bp, Bos taurus; identical to SEQ ID NO: 5208

SEQ ID NO: 87155 - DNA, 201 bp, Bos taurus; identical to SEQ ID NO: 5209

SEQ ID NO: 87156 - DNA, 201 bp, Bos taurus; identical to SEQ ID NO: 5210

SEQ ID NO: 87157 - DNA, 201 bp, Bos taurus; identical to SEQ ID NO: 5211

SEQ ID NO: 87158 - DNA, 201 bp, Bos taurus; identical to SEQ ID NO: 5212

SEQ ID NO: 87159 - DNA, 201 bp, Bos taurus; identical to SEQ ID NO: 5213

SEQ ID NO: 87160 - DNA, 201 bp, Bos taurus; identical to SEQ ID NO: 5214

SEQ ID NO: 87161 - DNA, 201 bp, Bos taurus; identical to SEQ ID NO: 5215

SEQ ID NO: 87162 - DNA, 201 bp, Bos taurus; identical to SEQ ID NO: 5216

SEQ ID NO: 87163 - DNA, 201 bp, Bos taurus; identical to SEQ ID NO: 5217

SEQ ID NO: 87164 - DNA, 201 bp, Bos taurus; identical to SEQ ID NO: 5218

SEQ ID NO: 87165 - DNA, 201 bp, Bos taurus; identical to SEQ ID NO: 5219

SEQ ID NO: 87166 - DNA, 201 bp, Bos taurus; identical to SEQ ID NO: 5220

SEQ ID NO: 87167 - DNA, 201 bp, Bos taurus; identical to SEQ ID NO: 5221

SEQ ID NO: 87168 - DNA, 201 bp, Bos taurus; identical to SEQ ID NO: 5223

SEQ ID NO: 87169 - DNA, 201 bp, Bos taurus; identical to SEQ ID NO: 5224

SEQ ID NO: 87170 - DNA, 201 bp, Bos taurus; identical to SEQ ID NO: 5225

SEQ ID NO: 87171 - DNA, 201 bp, Bos taurus; identical to SEQ ID NO: 5226

SEQ ID NO: 87172 - DNA, 201 bp, Bos taurus; identical to SEQ ID NO: 5227

SEQ ID NO: 87173 - DNA, 201 bp, Bos taurus; identical to SEQ ID NO: 5228

SEQ ID NO: 87174 - DNA, 201 bp, Bos taurus; identical to SEQ ID NO: 5229

SEQ ID NO: 87175 - DNA, 201 bp, Bos taurus; identical to SEQ ID NO: 5230

SEQ ID NO: 87176 - DNA, 201 bp, Bos taurus; identical to SEQ ID NO: 5231

SEQ ID NO: 87177 - DNA, 201 bp, Bos taurus; identical to SEQ ID NO: 5232

SEQ ID NO: 87178 - DNA, 201 bp, Bos taurus; identical to SEQ ID NO: 5233

SEQ ID NO: 87179 - DNA, 201 bp, Bos taurus; identical to SEQ ID NO: 5234

SEQ ID NO: 87180 - DNA, 201 bp, Bos taurus; identical to SEQ ID NO: 5235

SEQ ID NO: 87181 - DNA, 201 bp, Bos taurus; identical to SEQ ID NO: 5236

SEQ ID NO: 87182 - DNA, 201 bp, Bos taurus; identical to SEQ ID NO: 5237

SEQ ID NO: 87183 - DNA, 201 bp, Bos taurus; identical to SEQ ID NO: 5238

SEQ ID NO: 87184 - DNA, 201 bp, Bos taurus; identical to SEQ ID NO: 5239

SEQ ID NO: 87185 - DNA, 201 bp, Bos taurus; identical to SEQ ID NO: 5240

SEQ ID NO: 87186 - DNA, 201 bp, Bos taurus; identical to SEQ ID NO: 5241

SEQ ID NO: 87187 - DNA, 201 bp, Bos taurus; identical to SEQ ID NO: 5242

SEQ ID NO: 87188 - DNA, 201 bp, Bos taurus; identical to SEQ ID NO: 5243

SEQ ID NO: 87189 - DNA, 201 bp, Bos taurus; identical to SEQ ID NO: 5244

SEQ ID NO: 87190 - DNA, 201 bp, Bos taurus; identical to SEQ ID NO: 5245

SEQ ID NO: 87191 - DNA, 201 bp, Bos taurus; identical to SEQ ID NO: 5246

SEQ ID NO: 87192 - DNA, 201 bp, Bos taurus; identical to SEQ ID NO: 5247

SEQ ID NO: 87193 - DNA, 201 bp, Bos taurus; identical to SEQ ID NO: 5248

SEQ ID NO: 87194 - DNA, 201 bp, Bos taurus; identical to SEQ ID NO: 5249

SEQ ID NO: 87195 - DNA, 201 bp, Bos taurus; identical to SEQ ID NO: 5250

SEQ ID NO: 87196 - DNA, 201 bp, Bos taurus; identical to SEQ ID NO: 5251

SEQ ID NO: 87197 - DNA, 201 bp, Bos taurus; identical to SEQ ID NO: 5252

SEQ ID NO: 87198 - DNA, 201 bp, Bos taurus; identical to SEQ ID NO: 5253

SEQ ID NO: 87199 - DNA, 201 bp, Bos taurus; identical to SEQ ID NO: 5254

SEQ ID NO: 87200 - DNA, 201 bp, Bos taurus; identical to SEQ ID NO: 5255

SEQ ID NO: 87201 - DNA, 201 bp, Bos taurus; identical to SEQ ID NO: 5256

SEQ ID NO: 87202 - DNA, 201 bp, Bos taurus; identical to SEQ ID NO: 5257

SEQ ID NO: 87203 - DNA, 201 bp, Bos taurus; identical to SEQ ID NO: 5258

SEQ ID NO: 87204 - DNA, 201 bp, Bos taurus; identical to SEQ ID NO: 5259

SEQ ID NO: 87205 - DNA, 201 bp, Bos taurus; identical to SEQ ID NO: 5260

SEQ ID NO: 87206 - DNA, 201 bp, Bos taurus; identical to SEQ ID NO: 5261

SEQ ID NO: 87207 - DNA, 201 bp, Bos taurus; identical to SEQ ID NO: 5262

SEQ ID NO: 87208 - DNA, 201 bp, Bos taurus; identical to SEQ ID NO: 5263

SEQ ID NO: 87209 - DNA, 201 bp, Bos taurus; identical to SEQ ID NO: 5264

SEQ ID NO: 87210 - DNA, 201 bp, Bos taurus; identical to SEQ ID NO: 5265

SEQ ID NO: 87211 - DNA, 201 bp, Bos taurus; identical to SEQ ID NO: 5266

SEQ ID NO: 87212 - DNA, 201 bp, Bos taurus; identical to SEQ ID NO: 5267

SEQ ID NO: 87213 - DNA, 201 bp, Bos taurus; identical to SEQ ID NO: 5268

SEQ ID NO: 87214 - DNA, 201 bp, Bos taurus; identical to SEQ ID NO: 5269

SEQ ID NO: 87215 - DNA, 201 bp, Bos taurus
atgaaaaataagattgcccctcatttatgagtatatacatgtgtaagtaaaaagtattcctaaaacatatctagataataataataaagaccaaattctaaataaaagttatcttggaagagggagagagaattaataggggaggcatgtttcaggtataccggtggctttgggggtcttaaaaaggttgacgacataaac

SEQ ID NO: 87216 - DNA, 201 bp, Bos taurus
ctcctccgcccatgccatccccagggcagaggcaggctggccagtgatgccagagaagggagaaacacagaaggagccctgggcttgggatgtttctgaaccagagacagcaaaaaggggcctgactgacagtggccaccacaggggctatggtcttctaaaaaaaaaaaaaaaaaaaagtgtgcatgtgcgtgcatgtgt

SEQ ID NO: 87217 - DNA, 201 bp, Bos taurus; identical to SEQ ID NO: 5270

SEQ ID NO: 87218 - DNA, 201 bp, Bos taurus; identical to SEQ ID NO: 5271

SEQ ID NO: 87219 - DNA, 201 bp, Bos taurus; identical to SEQ ID NO: 5272

SEQ ID NO: 87220 - DNA, 201 bp, Bos taurus; identical to SEQ ID NO: 5273

SEQ ID NO: 87221 - DNA, 201 bp, Bos taurus; identical to SEQ ID NO: 5275

SEQ ID NO: 87222 - DNA, 201 bp, Bos taurus; identical to SEQ ID NO: 5276

SEQ ID NO: 87223 - DNA, 201 bp, Bos taurus; identical to SEQ ID NO: 5277

SEQ ID NO: 87224 - DNA, 201 bp, Bos taurus; identical to SEQ ID NO: 5278

SEQ ID NO: 87225 - DNA, 201 bp, Bos taurus; identical to SEQ ID NO: 5279

SEQ ID NO: 87226 - DNA, 201 bp, Bos taurus; identical to SEQ ID NO: 5280

SEQ ID NO: 87227 - DNA, 201 bp, Bos taurus
ttgtatctgtacctgcaaagatacctggaatatacctgtagttccacatctcaagggggagatccgtgttttagccctcccctgctcacatgtcaattctattatccacccttcatttgagaaacagcactttgtgctgtgcattgtaatatgaactaatatgaactggtgagagttgataaaaagagccctgggccacac

SEQ ID NO: 87228 - DNA, 201 bp, Bos taurus; identical to SEQ ID NO: 5282

SEQ ID NO: 87229 - DNA, 201 bp, Bos taurus; identical to SEQ ID NO: 5283

SEQ ID NO: 87230 - DNA, 201 bp, Bos taurus; identical to SEQ ID NO: 5284

SEQ ID NO: 87231 - DNA, 201 bp, Bos taurus; identical to SEQ ID NO: 5286

SEQ ID NO: 87232 - DNA, 201 bp, Bos taurus
tgggccacagtgagcccccggggactcagctggcccttgggcaagaccctgctcccagagccccagtgaagagataggtcaggagcaagagggaagagatgagtgagctggccacggggtcacgggaccaggaggtccctgcctgcctacctgcctctcttcctctccatctgccttaagtaagtcactgactctggaatg

SEQ ID NO: 87233 - DNA, 201 bp, Bos taurus; identical to SEQ ID NO: 5287

SEQ ID NO: 87234 - DNA, 201 bp, Bos taurus; identical to SEQ ID NO: 5288

SEQ ID NO: 87235 - DNA, 201 bp, Bos taurus
ctcgcgtcaaatcgttctgtacgcaccgagctgcgtgggcttttcccgtgtgcgcaggttagacgtggactctcagaggaacacgtcctgtgagggccatcctgaaaggagaatccaggaacagcccgcgaaggaatgatcttccagggacacgcaagatactcacaaaggccaagtttgtttcaaagagtagaagtacag

SEQ ID NO: 87236 - DNA, 201 bp, Bos taurus
ctgcacgtcctcgatggtgacctgcatggacggggggcctggggtgggggaaggagctggtgggcagaagccaggctgtgttcgccacagcctactctgcactgaaatcttctcatgcctggcctccgtgcacagacacccagacctgggtggactggcagcaaccccatgtgtgtcttgctgcccgagctgggcaggaag

SEQ ID NO: 87237 - DNA, 201 bp, Bos taurus; identical to SEQ ID NO: 5291

SEQ ID NO: 87238 - DNA, 201 bp, Bos taurus; identical to SEQ ID NO: 5292

SEQ ID NO: 87239 - DNA, 201 bp, Bos taurus; identical to SEQ ID NO: 5293

SEQ ID NO: 87240 - DNA, 201 bp, Bos taurus; identical to SEQ ID NO: 5294

SEQ ID NO: 87241 - DNA, 201 bp, Bos taurus; identical to SEQ ID NO: 5295

SEQ ID NO: 87242 - DNA, 201 bp, Bos taurus; identical to SEQ ID NO: 5296

SEQ ID NO: 87243 - DNA, 201 bp, Bos taurus; identical to SEQ ID NO: 5298

SEQ ID NO: 87244 - DNA, 201 bp, Bos taurus; identical to SEQ ID NO: 5300

SEQ ID NO: 87245 - DNA, 201 bp, Bos taurus; identical to SEQ ID NO: 5301

SEQ ID NO: 87246 - DNA, 201 bp, Bos taurus; identical to SEQ ID NO: 5302

SEQ ID NO: 87247 - DNA, 201 bp, Bos taurus
tgcagagcagagggctagggcagtcagcatgcccgcctcggcgctgcacagtcaagaagacgggcttgaacggagcgtcccgttgcccagggaggccctcggtgcccccaagtggaggagtcaaggtggggcttcctgcctgtaacagggtgagccgtctgtctttcagggccgagatggtggtgcctgacttctcggagc

SEQ ID NO: 87248 - DNA, 201 bp, Bos taurus; identical to SEQ ID NO: 5303

SEQ ID NO: 87249 - DNA, 201 bp, Bos taurus; identical to SEQ ID NO: 5304

SEQ ID NO: 87250 - DNA, 201 bp, Bos taurus; identical to SEQ ID NO: 5305

SEQ ID NO: 87251 - DNA, 201 bp, Bos taurus; identical to SEQ ID NO: 5307

SEQ ID NO: 87252 - DNA, 201 bp, Bos taurus
aacaacaataaaaagagctcatccttctcccattcctgaccataatgccatgtctggctctgtgtatatcagcctggggcctcttgaggcctcttgtccatcgcttaccatggacagggggagtgaatgtgaagccctctccccctctctcatcccttcagtggtgtttctctggaggcaggagggtctcccctccccatc

SEQ ID NO: 87253 - DNA, 201 bp, Bos taurus; identical to SEQ ID NO: 5308

SEQ ID NO: 87254 - DNA, 201 bp, Bos taurus; identical to SEQ ID NO: 5309

SEQ ID NO: 87255 - DNA, 201 bp, Bos taurus; identical to SEQ ID NO: 5310

SEQ ID NO: 87256 - DNA, 201 bp, Bos taurus; identical to SEQ ID NO: 5311

SEQ ID NO: 87257 - DNA, 201 bp, Bos taurus; identical to SEQ ID NO: 5312

SEQ ID NO: 87258 - DNA, 201 bp, Bos taurus
ggaagcgtttggacgtcggcgtacacgattcattctctggtttcagggtcctggagcaggtcaggcccacgtgggtttcgagggctggcctcacagcatcgcactgccctctctgggtgtcgctgccccagtttttaagatgctgtgtacctccctggaaggtcccaaggacactgcctccacgcctggctccaaggaggg

SEQ ID NO: 87259 - DNA, 201 bp, Bos taurus; identical to SEQ ID NO: 5314

SEQ ID NO: 87260 - DNA, 201 bp, Bos taurus
caaggaacctgaggttcaaagaactgcagcgagtcaggagttatcctcaggtcagctccctgggaaggagcctcagatggaggtgaagggccccctctctcctcagactccagaagagtcttcacttggcactcagggccccttccccagtgaaaccctgagagagacaggtaatgtgactagatattacttttctctgaa

SEQ ID NO: 87261 - DNA, 201 bp, Bos taurus; identical to SEQ ID NO: 5315

SEQ ID NO: 87262 - DNA, 201 bp, Bos taurus; identical to SEQ ID NO: 5316

SEQ ID NO: 87263 - DNA, 201 bp, Bos taurus; identical to SEQ ID NO: 5317

SEQ ID NO: 87264 - DNA, 201 bp, Bos taurus; identical to SEQ ID NO: 5318

SEQ ID NO: 87265 - DNA, 201 bp, Bos taurus; identical to SEQ ID NO: 5319

SEQ ID NO: 87266 - DNA, 201 bp, Bos taurus; identical to SEQ ID NO: 5320

SEQ ID NO: 87267 - DNA, 201 bp, Bos taurus; identical to SEQ ID NO: 5321

SEQ ID NO: 87268 - DNA, 201 bp, Bos taurus
tgtcctcctttccatcacccttaagcccagctccaatgtcctctcctccaggaagccccgcctgaatccctcagctcccctccctgcttctggccttcccgtggctttgtggtgctgggagtgtctgtgtcagactctgtgactgtgggcttctcagggattgcccagtatggcccaggcttagagcaggcaccaaggagg

SEQ ID NO: 87269 - DNA, 201 bp, Bos taurus; identical to SEQ ID NO: 5322

SEQ ID NO: 87270 - DNA, 201 bp, Bos taurus
ttgaaacttatggggcttggtggttaactcagagcccctcaggggtctgagcccttcagaccctcaggggtctcccgaggtcctggccccatccctgtcctgcaaaactggaaaataaattccatgtcattatctccatgtcacttgagccacaaccaaatgtgcctcatggccaagttaggtctaggatgaagggtgcac

SEQ ID NO: 87271 - DNA, 201 bp, Bos taurus; identical to SEQ ID NO: 5323

SEQ ID NO: 87272 - DNA, 201 bp, Bos taurus; identical to SEQ ID NO: 5324

SEQ ID NO: 87273 - DNA, 201 bp, Bos taurus; identical to SEQ ID NO: 5327

SEQ ID NO: 87274 - DNA, 201 bp, Bos taurus; identical to SEQ ID NO: 5331

SEQ ID NO: 87275 - DNA, 201 bp, Bos taurus; identical to SEQ ID NO: 5332

SEQ ID NO: 87276 - DNA, 201 bp, Bos taurus; identical to SEQ ID NO: 5333

SEQ ID NO: 87277 - DNA, 201 bp, Bos taurus
ctgtgaccaaatgaaggctctggtttcatgttaatgctgtttgttttgttgtgtaaaacttgggatgctgccaagcctggggcttggttggccaggccctctccaagggctcaacaaccttgagatttcttcctcgccttatctaaggtgtgcaagtcttgcactcacagcaggctcatcatcatcatcatcatcaccatc

SEQ ID NO: 87278 - DNA, 201 bp, Bos taurus
ctatggcccatggggctacagagagtcggatatggctgagcacacagaatacagtatagccccaccacaaaagatgatccatcagcccccaatctcaacacggccaaggtcaagaaaacttgagctacataaactaacatgaatatcactccaaaatactgagtaagaaagcaaattacagaaagatatctacaaaacaat

SEQ ID NO: 87279 - DNA, 201 bp, Bos taurus
acaggctcacaaagagttggacgtactgagcacacatgcacagggacggtgtattcagtaaataacttcaatttaatgagatttcaatgtgcctttataactaacaactatttttgagtgattttttttaaaggcattttcaagtttaaactgcagtgaaccactaatctgctttctgtttctatagatttgcctgtgcct

SEQ ID NO: 87280 - DNA, 201 bp, Bos taurus
cccagagaaggagtgtgacctggctctgtggcacttggaggaactcacagaggggccagtccccacccaaaactcaggggtcaaaccctcctatggccaagtcctatctacacatatcatggcagcagagttttccaactttagcatcagggactttcagttcagtcactcagtcgtgtctgactctttgcaaccccatgg

SEQ ID NO: 87281 - DNA, 201 bp, Bos taurus
aaaggatgaacaagagtccttgagcacagtgtaggcagggcattccagatggaggaaccaggatgagggaaaatgtacagaaaggcccagaacagggttagcggagactaggagttcagaccaggaccaaattgtgaaggggcttgaaggcaccttagaaccgtcactctaaggccaaaggaaatgatgggctggaagcaa

SEQ ID NO: 87282 - DNA, 201 bp, Bos taurus; identical to SEQ ID NO: 5336

SEQ ID NO: 87283 - DNA, 201 bp, Bos taurus; identical to SEQ ID NO: 5337

SEQ ID NO: 87284 - DNA, 201 bp, Bos taurus; identical to SEQ ID NO: 5338

SEQ ID NO: 87285 - DNA, 201 bp, Bos taurus; identical to SEQ ID NO: 5339

SEQ ID NO: 87286 - DNA, 201 bp, Bos taurus
acctctcctgtgaccctctgccctctgctccctctccacaacctctttattcctggctacatctctcacctgctatgaggataactctgtcttccatgacctacgatgtcatctgctgtaacccatgctgtatgcctgtgaccctcacctgtcccatagacatctatctgctctgacctctgactccactcctgtcccttc

SEQ ID NO: 87287 - DNA, 201 bp, Bos taurus; identical to SEQ ID NO: 5340

SEQ ID NO: 87288 - DNA, 201 bp, Bos taurus; identical to SEQ ID NO: 5341

SEQ ID NO: 87289 - DNA, 201 bp, Bos taurus; identical to SEQ ID NO: 5343

SEQ ID NO: 87290 - DNA, 201 bp, Bos taurus; identical to SEQ ID NO: 5344

SEQ ID NO: 87291 - DNA, 201 bp, Bos taurus; identical to SEQ ID NO: 5345

SEQ ID NO: 87292 - DNA, 201 bp, Bos taurus; identical to SEQ ID NO: 5346

SEQ ID NO: 87293 - DNA, 201 bp, Bos taurus; identical to SEQ ID NO: 5348

SEQ ID NO: 87294 - DNA, 201 bp, Bos taurus; identical to SEQ ID NO: 5349

SEQ ID NO: 87295 - DNA, 201 bp, Bos taurus; identical to SEQ ID NO: 5350

SEQ ID NO: 87296 - DNA, 201 bp, Bos taurus; identical to SEQ ID NO: 5351

SEQ ID NO: 87297 - DNA, 201 bp, Bos taurus; identical to SEQ ID NO: 5352

SEQ ID NO: 87298 - DNA, 201 bp, Bos taurus; identical to SEQ ID NO: 5354

SEQ ID NO: 87299 - DNA, 201 bp, Bos taurus
agcaaactcgtcctcatcatggttgtgcccccatgtccttacatggtttcacacagatccctactccatcctctgttgctgctgacatctctgaaagatgtgtaagactctttgttattgtcattgttgtttagtcacaaagtcatgtctgactcttttgcaaccccatagactgtagcctgctaggctcctctgttcgtg

SEQ ID NO: 87300 - DNA, 201 bp, Bos taurus; identical to SEQ ID NO: 5355

SEQ ID NO: 87301 - DNA, 201 bp, Bos taurus; identical to SEQ ID NO: 5356

SEQ ID NO: 87302 - DNA, 201 bp, Bos taurus
gcccctttctctccccagatgccctgccacactcaggcctgccacacagagctgaccccttgctcctttctggggtgtcagagagccaaggcctggccatcgccctgagtctgggggctaccccagccctccctcatcttttcaccagtggaccagctggtgttttctttctcagggtgctgtgatgtctgaggagccaat

SEQ ID NO: 87303 - DNA, 201 bp, Bos taurus
cgcccacctcgccctccacgtctgagatgtccaccagctccccggggggctcattcaacatctggatgaactgctcctgatgccggctgatttgctgtgggagacagaggagggaagggtgacccacggcctttgtccccgctcccccaggtccctatcacagccctttgcactcactcagcaaacatttacagggcacct

SEQ ID NO: 87304 - DNA, 201 bp, Bos taurus; identical to SEQ ID NO: 5359

SEQ ID NO: 87305 - DNA, 201 bp, Bos taurus
ggaagcagggccagcagcatagacagcgcgacttctgccccggaaacgaaaaggagcctggcgccagcaggtacagaagaggtacagaggtcgcagatatcggttctgggtgtagattcaggccgtccccgagactgaaagcctccttaaatttcgatcttggtgcctcactggcctcacactaggcgctagtggtaaaga

SEQ ID NO: 87306 - DNA, 201 bp, Bos taurus
tgaggtcagagatcacaggcctggacctcccactccccaggatcagagatactcaggccagctagtctacaaaggccagaattaggtctgaagcaggagatgaagggcaggggattaggcagatgaacagagagtgagatggagcaaaagatcagagaacacagtaaaaggtcagctaggccggctgggctgggctagacc

SEQ ID NO: 87307 - DNA, 201 bp, Bos taurus
agtaggggacagcaggccctgggctccctctcagagggagggagcctatgcagagcaaatcacaaagattcaaatcacgacctcggatcccaggggttacagaaaggagggctggtggcctgccccatgtgcctccctgagccccacccccctccccgatttcctctcctgccccagggaagtgctcggcggctgcactgg

SEQ ID NO: 87308 - DNA, 201 bp, Bos taurus; identical to SEQ ID NO: 5360

SEQ ID NO: 87309 - DNA, 201 bp, Bos taurus; identical to SEQ ID NO: 5361

SEQ ID NO: 87310 - DNA, 201 bp, Bos taurus; identical to SEQ ID NO: 5363

SEQ ID NO: 87311 - DNA, 201 bp, Bos taurus; identical to SEQ ID NO: 5364

SEQ ID NO: 87312 - DNA, 201 bp, Bos taurus; identical to SEQ ID NO: 5365

SEQ ID NO: 87313 - DNA, 201 bp, Bos taurus; identical to SEQ ID NO: 5366

SEQ ID NO: 87314 - DNA, 201 bp, Bos taurus
actgtcccttcccataagggatccagaggaccacgaagctgggagtactcaccggggagccggggtgtcccaccagaccccgtatccctgttggtccaggcgggccctggaggcgggaacagagtcaagaaaccctcaggtttaagattaaggtcgcaggtggggaacttccctggtcgtccagtgactaagactctgcac

SEQ ID NO: 87315 - DNA, 201 bp, Bos taurus; identical to SEQ ID NO: 5368

SEQ ID NO: 87316 - DNA, 201 bp, Bos taurus
ctccatccccatccccttgtgaatgatcctgtggaacagggccccacgtgtgccaggcactgggcttcatgtgactcgtccttctagtcctgcctgccaacgacctgatgggccaggcactgtttttttccctcatttttagttgctaaatcgtgtccaactcttttgcgaccccatagactgtagtctgccaggcttctc

SEQ ID NO: 87317 - DNA, 201 bp, Bos taurus; identical to SEQ ID NO: 5369

SEQ ID NO: 87318 - DNA, 201 bp, Bos taurus
tgacatgggcacgtcagagcatcgggcagggacacctgaccagtaacagggcaggtggtgcgaggagagagggtggcccagagaagtctcagaaggtgccagtctttccaagccctcagggagccttgaggttccttggagagcagacccagcctccagcctgagatgcagcacccagaggggagcctgtgggtgcgtggg

SEQ ID NO: 87319 - DNA, 201 bp, Bos taurus
tggggttttatggaggcttcattgtataggtacggttaatttaaccattggtctttggcggctgaggagggcggactgaaagttgcaacggtctaattgccaagctggtcccgacatggctttctaaagtcatataccccagggtgcttgaagggggcgtcacgtgaatcacagaagacacctttattgctctttaattta

SEQ ID NO: 87320 - DNA, 201 bp, Bos taurus
tcagcgtcagccgcttggggcagacgcagaaacctcaagggtctgtcgtggaaggcgtcctttttccttgtagctaacgttaggcctgtgtacccccttcagtatttgtagatgctcctcccgcccctcctactctgatggcattctggtcccaccccagcctgggaaggggccttgcagggacctctccaaaaaaaaagg

SEQ ID NO: 87321 - DNA, 201 bp, Bos taurus
gaccaggcctgccctcgcactggtggagggatgcccatggatacccttcggcacatctatgggggagaagcagccctgagacagatgcaggcaccacgccggggaggagacggagcgagaggcctgtggaagatgctgcagaggggcagggtcttcctagagctgggtctgatcttcccaaactgggagtggagaatagcc

SEQ ID NO: 87322 - DNA, 201 bp, Bos taurus; identical to SEQ ID NO: 5370

SEQ ID NO: 87323 - DNA, 201 bp, Bos taurus; identical to SEQ ID NO: 5371

SEQ ID NO: 87324 - DNA, 201 bp, Bos taurus; identical to SEQ ID NO: 5373

SEQ ID NO: 87325 - DNA, 201 bp, Bos taurus; identical to SEQ ID NO: 5374

SEQ ID NO: 87326 - DNA, 201 bp, Bos taurus; identical to SEQ ID NO: 5377

SEQ ID NO: 87327 - DNA, 201 bp, Bos taurus; identical to SEQ ID NO: 5381

SEQ ID NO: 87328 - DNA, 201 bp, Bos taurus; identical to SEQ ID NO: 5382

SEQ ID NO: 87329 - DNA, 201 bp, Bos taurus
gacactgtgcccccaattcagggggcatgggtttgatccctggtcaggaaactaagatcccacaggcggagcagtgaggccaaaataaaagaaagtaaggaaattcttttttttaaaaaggatatgtactatcaactttatttatgtgtgttgatattggccttcatcacctggctaacttagtatttgttaggtttttcc

SEQ ID NO: 87330 - DNA, 201 bp, Bos taurus; identical to SEQ ID NO: 5383

SEQ ID NO: 87331 - DNA, 201 bp, Bos taurus; identical to SEQ ID NO: 5384

SEQ ID NO: 87332 - DNA, 201 bp, Bos taurus; identical to SEQ ID NO: 5385

SEQ ID NO: 87333 - DNA, 201 bp, Bos taurus
aggaggctggtattcaggctgggtttaggtacaggaaactctttgaggcgctctgtggcttcagctgcccagagacaccattgagtcatttcctctccggagacctgcagtctctctgcaacagggaacaggactccagcctcttctagttttcagtcccctttctccagaatttctcagggggatgtagcctttcccctt

SEQ ID NO: 87334 - DNA, 201 bp, Bos taurus
ctttcccctgtctctctctccctctccctctgtatgattaagtttgttgctctgagcgtgtgccttttgctacatctcagtgatggggagtctggcttccgcggccagcagtgggggaagggggactctgtgtgtccatgtgtgtgtgtgactaattgtgtgggatttatgtcagtgtgaggatgaagctcagcgtgagga

SEQ ID NO: 87335 - DNA, 201 bp, Bos taurus; identical to SEQ ID NO: 5386

SEQ ID NO: 87336 - DNA, 201 bp, Bos taurus; identical to SEQ ID NO: 5388

SEQ ID NO: 87337 - DNA, 201 bp, Bos taurus
ttttctattctcttacaagttctatataaattttagatcagtttatctatatttacaaaaaattcctagtgagattttgattaaatagccttaaagctctgtatcagtttggagagaattgacatctttaagtatcttttgggtttggagctattgtaagtggtattgatttttaatttccaactcttcattgctaatgta

SEQ ID NO: 87338 - DNA, 201 bp, Bos taurus
ccggggctaccagggcgacccctcatctgcactgcttgagctgctggaccctgagcagaatgcaaacttcctggaccactacctggacgtgcccgtggacttgtccaaggtgcgtgtcctgcccggggctgggccagcggggagggatgggcaccctgtcccccaacacctcacggccccacccccaggtgctgttcatct

SEQ ID NO: 87339 - DNA, 201 bp, Bos taurus
tttaatcatggccggacttggtttccgatgtgttagtcacatgggttagatcataccagaggttaagaccaccaaggctttcttattacccagtttgtcaacaggccacagattaatttggcattggcttcgtgggttggatctctacttttgagacccctgtgagggactttagttcagtaaaaccttcctccccacttt

SEQ ID NO: 87340 - DNA, 201 bp, Bos taurus
gagcatccgttagctgcctgggggctgcagacgcccccaccccaccccgacctacaactccagaccctttccaccttcccagccttgctctctattcccttggccgccccgtgccaggcttctgtttagtttaataatctcccgaaagtttaattgttgttttattcatccgtgacctttctctctcatctggagacgtat

SEQ ID NO: 87341 - DNA, 201 bp, Bos taurus; identical to SEQ ID NO: 5392

SEQ ID NO: 87342 - DNA, 201 bp, Bos taurus; identical to SEQ ID NO: 5394

SEQ ID NO: 87343 - DNA, 201 bp, Bos taurus
tactgtgttctgcagctgtcatttttatctcatttcaaaatattttcatcagcctcaaagacagccacatcccatcagcagtcactctgcaccctctttccaccaacccactctgtgcgtcagtggatttgcctgttctgggtatttcgtatacatggaatcacacactgtgtggccttctgtgcctggctcctctcactg

SEQ ID NO: 87344 - DNA, 201 bp, Bos taurus; identical to SEQ ID NO: 5395

SEQ ID NO: 87345 - DNA, 201 bp, Bos taurus; identical to SEQ ID NO: 5396

SEQ ID NO: 87346 - DNA, 201 bp, Bos taurus; identical to SEQ ID NO: 5400

SEQ ID NO: 87347 - DNA, 201 bp, Bos taurus; identical to SEQ ID NO: 5401

SEQ ID NO: 87348 - DNA, 201 bp, Bos taurus; identical to SEQ ID NO: 5402

SEQ ID NO: 87349 - DNA, 201 bp, Bos taurus; identical to SEQ ID NO: 5403

SEQ ID NO: 87350 - DNA, 201 bp, Bos taurus
ggcacagggcagcacatgctcacctgtagagaggcggagggaaatccacttccagggtcccccgggggacacagggccaggcagcctgccgcctcagggtctgcatgtctgcctctgcgtgcctgggggctcctgcctccaagtcctgtggggccattgttgacagcaacaaaggccaccccagtgtcctggcaacagctg

SEQ ID NO: 87351 - DNA, 201 bp, Bos taurus
gagtttgagtgaactccgggagatggtgatggacagggaggcctggcgtgctgcaattcatagggttgcaaaaagtcggacacgactgagcgactgaactgaattcccatctaattggccacgcccctgagacttgaccacgccccaggagcaagctgcgtcgcttgccggcctcacctctcggctgaatcgggacaaacc

SEQ ID NO: 87352 - DNA, 201 bp, Bos taurus; identical to SEQ ID NO: 5406

SEQ ID NO: 87353 - DNA, 201 bp, Bos taurus
acctcagtgttcacagcagcactatttacaacagccagtacagggaaaccgccgaagtgtccacagacagatgagtgggtaaagaccatgtcgggtatatacacaaggcaataccatctggccatgaaaagaatgaagcaaatgccacgtgcagcagcctggatggacctagagatcatcacaccaagtgaagtcagacac

SEQ ID NO: 87354 - DNA, 201 bp, Bos taurus; identical to SEQ ID NO: 5407

SEQ ID NO: 87355 - DNA, 201 bp, Bos taurus
cctgggccttctggattggaaatgtagaatcttagcctttggaccaccagggaagtccctagcattctgttctttctacccccaaagctcctccagacagcgggcctgggccagcctgggcctctcctgaaccttcgtttaggtatccgctgtggtctcctggcttcctgacttgcctatatccattcccactaccggcaa

SEQ ID NO: 87356 - DNA, 201 bp, Bos taurus; identical to SEQ ID NO: 5409

SEQ ID NO: 87357 - DNA, 201 bp, Bos taurus
agcaggaacagtttcagaagcctcctttgtctgtgagctgagtgtccataaatcctgccgtgtcctgcgggcgtgtgccgtgtgaggtctcccgccaccactctgggccgctcctgactcaggtggacggtggaacatggttcattggttggggggggcttcctcccaggggtcactgtgcctcgaaaaggcgtgtccgcg

SEQ ID NO: 87358 - DNA, 201 bp, Bos taurus
cccacctgtttggggtcactgtcctccttcataagtggtccccttaggatttcaaggagaggctgagagctagcttctcagaagtgtttccaccttggacgctggctgatttaggccaagtagaagcaagaagcatcagctaacagctgacctcgtggtatgggcaaggaaaatgttttcctctaccttttttttttttta

SEQ ID NO: 87359 - DNA, 201 bp, Bos taurus
aattgtgattaaacagttacatgtcgtgtagtctggtttagaagcaaagttgctatgacactttgcaccataaagagtggatttttcagtttcttgttaatcatttctctttgattatttactgtgtggaaaggatacacgaatgaaagatatcacagattgctttctatgttgtccaaaattttgttgcttattgataat

SEQ ID NO: 87360 - DNA, 201 bp, Bos taurus
ctctttggaatgctggcagctctgatgtgggtctggccacatggttcttctttttttatgaacctggaagagggaatatgtctcggccgggtcaggcctgatgtgtcctctcattctcctgtaggacagagtcatggagcctggatggtgtgtcttaagcttgagcccaatccaactcagataaacctgtcttcagcctct

SEQ ID NO: 87361 - DNA, 201 bp, Bos taurus
cacggcctccgcgcctgcccttgggcgtggggtagctcctcccggccctcgctgccccggcgttgcgcagccactcctgtgggccctgcccgcccgtgtctgggacgtgcgagtggacgctctcaagaaaacgctccagtagcagtgctgctccagccgatgggccacgccgtctggtacagagttcgagctgctgaagtt

SEQ ID NO: 87362 - DNA, 201 bp, Bos taurus; identical to SEQ ID NO: 5411

SEQ ID NO: 87363 - DNA, 201 bp, Bos taurus; identical to SEQ ID NO: 5412

SEQ ID NO: 87364 - DNA, 201 bp, Bos taurus; identical to SEQ ID NO: 5415

SEQ ID NO: 87365 - DNA, 201 bp, Bos taurus; identical to SEQ ID NO: 5416

SEQ ID NO: 87366 - DNA, 201 bp, Bos taurus
gatgtggggaactatccaaaaataggagagtggtcaaaaatcttggagagctcgaataacagagggtccatcactgtcggagaagcatggcccgggtgtcctaagtgtggaaaacctgggtccagagtaactgagtccatccttgactggctgtcagggtcactagaaggctggacgtagaatggacatgagggacagaag

SEQ ID NO: 87367 - DNA, 201 bp, Bos taurus; identical to SEQ ID NO: 5417

SEQ ID NO: 87368 - DNA, 201 bp, Bos taurus
ttgtggaaacagttaccttaatattaaaaaccaaattcccctagtttgaaggctctcacacacacagctgtaaaaccctgggcctctgcggaggttctctcttacagactatctctggggttttgcaggtcatcgcagtgtcacaaggcacgcttggccactgtgcgtggcgctgctttcagttggctctgggccgccacg

SEQ ID NO: 87369 - DNA, 201 bp, Bos taurus
cttcttcccatacacagacagctacatctgtttgctatctgacccctaaggtctcatccatgttcaaaaccaggacctccagatgatgtgctgtagccttcccattaggtccagctgtgggtcacatggtagctgcctactggaccacagcaaagaacaacaggatacagcaatagaaacctggaatggaaaacacatggc

SEQ ID NO: 87370 - DNA, 201 bp, Bos taurus; identical to SEQ ID NO: 5418

SEQ ID NO: 87371 - DNA, 201 bp, Bos taurus; identical to SEQ ID NO: 5419

SEQ ID NO: 87372 - DNA, 201 bp, Bos taurus; identical to SEQ ID NO: 5420

SEQ ID NO: 87373 - DNA, 201 bp, Bos taurus; identical to SEQ ID NO: 5421

SEQ ID NO: 87374 - DNA, 201 bp, Bos taurus; identical to SEQ ID NO: 5422

SEQ ID NO: 87375 - DNA, 201 bp, Bos taurus; identical to SEQ ID NO: 5423

SEQ ID NO: 87376 - DNA, 201 bp, Bos taurus; identical to SEQ ID NO: 5424

SEQ ID NO: 87377 - DNA, 201 bp, Bos taurus; identical to SEQ ID NO: 5425

SEQ ID NO: 87378 - DNA, 201 bp, Bos taurus; identical to SEQ ID NO: 5426

SEQ ID NO: 87379 - DNA, 201 bp, Bos taurus; identical to SEQ ID NO: 5427

SEQ ID NO: 87380 - DNA, 201 bp, Bos taurus
ctggaggctgcagctttgagatcagggtgccagcattgttgagttctgctgacagctctctgtaaggtggcagaaggccattatcctcacatgacaaagaatgtaagagagatttctgggatctcttttttaagatcaacaatctcattcacgagggctccaccctcaggacctaatcacattctggaggtctcatctcct

SEQ ID NO: 87381 - DNA, 201 bp, Bos taurus; identical to SEQ ID NO: 5428

SEQ ID NO: 87382 - DNA, 201 bp, Bos taurus
tcaaaaaattcttaacaaattctcaactgaggcattgtcctaaaaacaaaaggttgaaatgaactctgaatagccaggaagtccatctcatggaccagcctcggtgtgcaattccttcttccaccataaagatggatgagcttccaccacagctcaaaaactgtagtaagctcaaattttagcaagagactgaccatggac

SEQ ID NO: 87383 - DNA, 201 bp, Bos taurus; identical to SEQ ID NO: 5429

SEQ ID NO: 87384 - DNA, 201 bp, Bos taurus; identical to SEQ ID NO: 5430

SEQ ID NO: 87385 - DNA, 201 bp, Bos taurus; identical to SEQ ID NO: 5431

SEQ ID NO: 87386 - DNA, 201 bp, Bos taurus
tcaagtttctataaagaccttacctggtttcccctggagggtctccccatcttactctctcatggttacctcctagtgacagggccccctacaggaccagcgggtgcaagatttcctagcttcagctctctgatccactcaactggtggtcacatcctcctcaatggcctcctccagtgcacttgctatttgtgctaagct

SEQ ID NO: 87387 - DNA, 201 bp, Bos taurus
actgagacagagagagtccaagaaagagggcaaagcagaaatcgggacagtgtgggacgggaacgaaagacaagcctgcagtcatgtcagaagaagcaagagagtatgtctgtaccccgtgaccaggttattatattatctcattttaatcaccatgacaactctatgaaataagaaacattatccccattttgcacactg

SEQ ID NO: 87388 - DNA, 201 bp, Bos taurus; identical to SEQ ID NO: 5432

SEQ ID NO: 87389 - DNA, 201 bp, Bos taurus
ttttcctatgccacttcaaagaagatgttgaaagttaatttaatattactttagatgtaaaaaagtctcctctcttttaggaggcacattatggccagcaagatattccatgaaaatctttatatgaggtaagtggcaggatgaacatctggattccctctgtatcatgaaaagacctagggtttggcctcttaggaactt

SEQ ID NO: 87390 - DNA, 201 bp, Bos taurus; identical to SEQ ID NO: 5434

SEQ ID NO: 87391 - DNA, 201 bp, Bos taurus; identical to SEQ ID NO: 5435

SEQ ID NO: 87392 - DNA, 201 bp, Bos taurus; identical to SEQ ID NO: 5436

SEQ ID NO: 87393 - DNA, 201 bp, Bos taurus; identical to SEQ ID NO: 5437

SEQ ID NO: 87394 - DNA, 201 bp, Bos taurus; identical to SEQ ID NO: 5438

SEQ ID NO: 87395 - DNA, 201 bp, Bos taurus
tccaaaagcttgctcaaaagtgggtgactgacaaaggcagtattctccaggggctcttggacctcagctaagaggaactgaattggttcacgggccacttcacagtcggcagcccagagcaaggttggtatgcctagtacccgatgcacaggtgggcgagactcctcccagatcctttggtgtttgatgctagctcccaca

SEQ ID NO: 87396 - DNA, 201 bp, Bos taurus; identical to SEQ ID NO: 5441

SEQ ID NO: 87397 - DNA, 201 bp, Bos taurus; identical to SEQ ID NO: 5442

SEQ ID NO: 87398 - DNA, 201 bp, Bos taurus; identical to SEQ ID NO: 5444

SEQ ID NO: 87399 - DNA, 201 bp, Bos taurus; identical to SEQ ID NO: 5447

SEQ ID NO: 87400 - DNA, 201 bp, Bos taurus; identical to SEQ ID NO: 5448

SEQ ID NO: 87401 - DNA, 201 bp, Bos taurus; identical to SEQ ID NO: 5449

SEQ ID NO: 87402 - DNA, 201 bp, Bos taurus; identical to SEQ ID NO: 5451

SEQ ID NO: 87403 - DNA, 201 bp, Bos taurus; identical to SEQ ID NO: 5452

SEQ ID NO: 87404 - DNA, 201 bp, Bos taurus; identical to SEQ ID NO: 5454

SEQ ID NO: 87405 - DNA, 201 bp, Bos taurus
gagtacaagtctctaaactacttaggcaggaacttctctcccagacaaatgtgtttatcagagagcagttggattgcatgtacggaagcctcaacaaagaggatgttccatctcaaatttatggcctcttggcaacccaagtatgcatatgactctcaagatgccacagcgtgtcagcaaccacagtcgctgatgggaaca

SEQ ID NO: 87406 - DNA, 201 bp, Bos taurus
cctccttgcagatgtagtagcttttttctttcacttttaatataaaaatttccaaatatatatatatgtgtgtgtattacattaagaataatattatgatcccaatgtttacatcaccagtctcaaaaatgaccagtcttatgtcatttttaacttcactctgctacccattgtaatttttctttttaatgtttagaacat

SEQ ID NO: 87407 - DNA, 201 bp, Bos taurus; identical to SEQ ID NO: 5457

SEQ ID NO: 87408 - DNA, 201 bp, Bos taurus
gacacaaagccaagctgtgttattcacctaatgccccgatttacagttcccaagacaaaagaacatacagatagagtttcagggctctgtttgccttcacgtttattgaaaggttagtttcaggtcaagctcaagaaacctgacaaatggtggtgaataaacctaaaaataaagtaagtgcaagtaggaaacttaagcatt

SEQ ID NO: 87409 - DNA, 201 bp, Bos taurus; identical to SEQ ID NO: 5459

SEQ ID NO: 87410 - DNA, 201 bp, Bos taurus; identical to SEQ ID NO: 5461

SEQ ID NO: 87411 - DNA, 201 bp, Bos taurus; identical to SEQ ID NO: 5462

SEQ ID NO: 87412 - DNA, 201 bp, Bos taurus; identical to SEQ ID NO: 5463

SEQ ID NO: 87413 - DNA, 201 bp, Bos taurus
taagatgggggtggatacttggcccaggttgggggtgggtaatgagggatagtgaaatgggcctattttccacggaaactgacaggtggccaagccccttagaattcctttgtcaccatgcatctggaaagcaagctaacggtgtacagcagtgggaagagagggaagagagaggccgtgctcaggaggtcctgaggccag

SEQ ID NO: 87414 - DNA, 201 bp, Bos taurus
tcttggccagagatacacatttgggaatcatctaattgtgaatgtgatctaatgtcaggagacaggatctgattatctaggaagagaagtttattctgcaatcttgaggccatatcagtgcttatggttttccattctagtatgagaaaacttagctgcattttaaagtcttccccttccagattgaaacttctctagctc

SEQ ID NO: 87415 - DNA, 201 bp, Bos taurus; identical to SEQ ID NO: 5465

SEQ ID NO: 87416 - DNA, 201 bp, Bos taurus; identical to SEQ ID NO: 5466

SEQ ID NO: 87417 - DNA, 201 bp, Bos taurus; identical to SEQ ID NO: 5467

SEQ ID NO: 87418 - DNA, 201 bp, Bos taurus
acagcagccaagagtcagactggaagcagcagggagttcgtgagtgcagaggacactaagaagttcatcagtccacaggagtacaggatgaatcagggcctcagaggtcagcctgtcctgtccttagcaatacatgactcttcctcgatattcccaacaagtgtccaacccatgttttgaaagctccagttactgaaagat

SEQ ID NO: 87419 - DNA, 201 bp, Bos taurus; identical to SEQ ID NO: 5468

SEQ ID NO: 87420 - DNA, 201 bp, Bos taurus; identical to SEQ ID NO: 5469

SEQ ID NO: 87421 - DNA, 201 bp, Bos taurus; identical to SEQ ID NO: 5470

SEQ ID NO: 87422 - DNA, 201 bp, Bos taurus; identical to SEQ ID NO: 5471

SEQ ID NO: 87423 - DNA, 201 bp, Bos taurus; identical to SEQ ID NO: 5473

SEQ ID NO: 87424 - DNA, 201 bp, Bos taurus; identical to SEQ ID NO: 5475

SEQ ID NO: 87425 - DNA, 201 bp, Bos taurus; identical to SEQ ID NO: 5476

SEQ ID NO: 87426 - DNA, 201 bp, Bos taurus
tggaagtctgggccacttcggtgctactgtttgagtcagaaccaacaatagccatcacgcccacctggactccaggcccctgaccctctctgcatccctcgatcaagtccttgccgccctagatctgttccatgctgtagtttggggtgagaaaggcttgggggcctcactcagcttggggtgagtcacatggtaatgtgg

SEQ ID NO: 87427 - DNA, 201 bp, Bos taurus
ataaggctgtcctcaggagaaaaatatcagacaaaactcattttcaaaagcagacagagttgcaagtttagactgaatttaaaggagtgaactgaagtatttgattttccttttttgttaccaaaggaattttttcaaaccaatagaaagaactaggtaagttattcactacagtactccatattttttaatgaatatggc

SEQ ID NO: 87428 - DNA, 201 bp, Bos taurus
tatgtatattagttgaaatgttaccgtttactgcactatgcagcatttcaaatggcttagctaatgtataggatattacatggccagctttaccatgaacaaatgaaaagacaaggacttatgggaagttgtattttagagagtactatgaaataatgacccacaaggagatccaaccagtccattctgaaggagatcggc

SEQ ID NO: 87429 - DNA, 201 bp, Bos taurus; identical to SEQ ID NO: 5478

SEQ ID NO: 87430 - DNA, 201 bp, Bos taurus
ttctttatttaatgatcttcttgtatctaacacaaagtgctgtttagaagactgacaaaaatgaagtatgtgagaagagcactgtaaactcaataatgttgccagatattatctttatgatgtgtctatggattgctgaggttgccaactggttcaattgttttctttcactcacatctgattccctctttcgcagcataa

SEQ ID NO: 87431 - DNA, 201 bp, Bos taurus; identical to SEQ ID NO: 5481

SEQ ID NO: 87432 - DNA, 201 bp, Bos taurus; identical to SEQ ID NO: 5482

SEQ ID NO: 87433 - DNA, 201 bp, Bos taurus; identical to SEQ ID NO: 5485

SEQ ID NO: 87434 - DNA, 201 bp, Bos taurus
taaagccaggttcacctgggcctgaagctaactgagattccttaagaatatgccctgatttatcaaatgttcagccacttaattgaaatgttaataaaaacgctaacaacaatggccaatcgttattgggtgcttcagtgtacactgtttgaagtgctttgcatatattaaccttcttatccttaacataaccttgtgaga

SEQ ID NO: 87435 - DNA, 201 bp, Bos taurus
agtcttttttatacatggtccattgaaatcaaaatttaaacaaggtccacatgttgcaattggctgatgtgtctgttagtctacaacagctctccctcctcttttggcactgatttattaaagaaactaagtaatttatcctgtagaattttccacagaagtctattgactatattcctgtgatgttatttaagatgctcc

SEQ ID NO: 87436 - DNA, 201 bp, Bos taurus
aacaaaatgtttattttcaccttatttactgcactgattcctgagatctgagagaaatctacaagaggcttggtgggaggtgattaaagcttggtctatggaaacactttaaaattcagtaaacctgagcagcaagctacatgatggcataggacattcttctcatctttgacacattaactcacctctcctttaaagtaa

SEQ ID NO: 87437 - DNA, 201 bp, Bos taurus
gttgtgttctgaaaatgacctaagcccttacactgattctctctacttgctgtttcagttcagaaaggctataagtttcccaaaagagaatttataatttcatcaaagtaaagttcattagctaggacatgatatatccccagaagatgaactctttacttctgacagactataggctgttcaaaactttgccaggccagt

SEQ ID NO: 87438 - DNA, 201 bp, Bos taurus; identical to SEQ ID NO: 5489

SEQ ID NO: 87439 - DNA, 201 bp, Bos taurus; identical to SEQ ID NO: 5490

SEQ ID NO: 87440 - DNA, 201 bp, Bos taurus; identical to SEQ ID NO: 5491

SEQ ID NO: 87441 - DNA, 201 bp, Bos taurus; identical to SEQ ID NO: 5492

SEQ ID NO: 87442 - DNA, 201 bp, Bos taurus; identical to SEQ ID NO: 5493

SEQ ID NO: 87443 - DNA, 201 bp, Bos taurus; identical to SEQ ID NO: 5496

SEQ ID NO: 87444 - DNA, 201 bp, Bos taurus; identical to SEQ ID NO: 5497

SEQ ID NO: 87445 - DNA, 201 bp, Bos taurus; identical to SEQ ID NO: 5498

SEQ ID NO: 87446 - DNA, 201 bp, Bos taurus; identical to SEQ ID NO: 5499

SEQ ID NO: 87447 - DNA, 201 bp, Bos taurus; identical to SEQ ID NO: 5500

SEQ ID NO: 87448 - DNA, 201 bp, Bos taurus; identical to SEQ ID NO: 5501

SEQ ID NO: 87449 - DNA, 201 bp, Bos taurus; identical to SEQ ID NO: 5502

SEQ ID NO: 87450 - DNA, 201 bp, Bos taurus; identical to SEQ ID NO: 5503

SEQ ID NO: 87451 - DNA, 201 bp, Bos taurus; identical to SEQ ID NO: 5504

SEQ ID NO: 87452 - DNA, 201 bp, Bos taurus; identical to SEQ ID NO: 5505

SEQ ID NO: 87453 - DNA, 201 bp, Bos taurus; identical to SEQ ID NO: 5506

SEQ ID NO: 87454 - DNA, 201 bp, Bos taurus; identical to SEQ ID NO: 5507

SEQ ID NO: 87455 - DNA, 201 bp, Bos taurus; identical to SEQ ID NO: 5508

SEQ ID NO: 87456 - DNA, 201 bp, Bos taurus; identical to SEQ ID NO: 5509

SEQ ID NO: 87457 - DNA, 201 bp, Bos taurus; identical to SEQ ID NO: 5510

SEQ ID NO: 87458 - DNA, 201 bp, Bos taurus; identical to SEQ ID NO: 5511

SEQ ID NO: 87459 - DNA, 201 bp, Bos taurus; identical to SEQ ID NO: 5512

SEQ ID NO: 87460 - DNA, 201 bp, Bos taurus; identical to SEQ ID NO: 5513

SEQ ID NO: 87461 - DNA, 201 bp, Bos taurus; identical to SEQ ID NO: 5514

SEQ ID NO: 87462 - DNA, 201 bp, Bos taurus; identical to SEQ ID NO: 5515

SEQ ID NO: 87463 - DNA, 201 bp, Bos taurus; identical to SEQ ID NO: 5516

SEQ ID NO: 87464 - DNA, 201 bp, Bos taurus; identical to SEQ ID NO: 5517

SEQ ID NO: 87465 - DNA, 201 bp, Bos taurus; identical to SEQ ID NO: 5518

SEQ ID NO: 87466 - DNA, 201 bp, Bos taurus; identical to SEQ ID NO: 5519

SEQ ID NO: 87467 - DNA, 201 bp, Bos taurus; identical to SEQ ID NO: 5520

SEQ ID NO: 87468 - DNA, 201 bp, Bos taurus; identical to SEQ ID NO: 5521

SEQ ID NO: 87469 - DNA, 201 bp, Bos taurus; identical to SEQ ID NO: 5522

SEQ ID NO: 87470 - DNA, 201 bp, Bos taurus; identical to SEQ ID NO: 5523

SEQ ID NO: 87471 - DNA, 201 bp, Bos taurus; identical to SEQ ID NO: 5524

SEQ ID NO: 87472 - DNA, 201 bp, Bos taurus; identical to SEQ ID NO: 5525

SEQ ID NO: 87473 - DNA, 201 bp, Bos taurus; identical to SEQ ID NO: 5526

SEQ ID NO: 87474 - DNA, 201 bp, Bos taurus; identical to SEQ ID NO: 5527

SEQ ID NO: 87475 - DNA, 201 bp, Bos taurus; identical to SEQ ID NO: 5528

SEQ ID NO: 87476 - DNA, 201 bp, Bos taurus; identical to SEQ ID NO: 5529

SEQ ID NO: 87477 - DNA, 201 bp, Bos taurus; identical to SEQ ID NO: 5530

SEQ ID NO: 87478 - DNA, 201 bp, Bos taurus; identical to SEQ ID NO: 5531

SEQ ID NO: 87479 - DNA, 201 bp, Bos taurus; identical to SEQ ID NO: 5532

SEQ ID NO: 87480 - DNA, 201 bp, Bos taurus; identical to SEQ ID NO: 5533

SEQ ID NO: 87481 - DNA, 201 bp, Bos taurus; identical to SEQ ID NO: 5534

SEQ ID NO: 87482 - DNA, 201 bp, Bos taurus; identical to SEQ ID NO: 5535

SEQ ID NO: 87483 - DNA, 201 bp, Bos taurus; identical to SEQ ID NO: 5536

SEQ ID NO: 87484 - DNA, 201 bp, Bos taurus; identical to SEQ ID NO: 5537

SEQ ID NO: 87485 - DNA, 201 bp, Bos taurus; identical to SEQ ID NO: 5538

SEQ ID NO: 87486 - DNA, 201 bp, Bos taurus; identical to SEQ ID NO: 5539

SEQ ID NO: 87487 - DNA, 201 bp, Bos taurus; identical to SEQ ID NO: 5540

SEQ ID NO: 87488 - DNA, 201 bp, Bos taurus; identical to SEQ ID NO: 5541

SEQ ID NO: 87489 - DNA, 201 bp, Bos taurus; identical to SEQ ID NO: 5542

SEQ ID NO: 87490 - DNA, 201 bp, Bos taurus; identical to SEQ ID NO: 5543

SEQ ID NO: 87491 - DNA, 201 bp, Bos taurus; identical to SEQ ID NO: 5544

SEQ ID NO: 87492 - DNA, 201 bp, Bos taurus; identical to SEQ ID NO: 5545

SEQ ID NO: 87493 - DNA, 201 bp, Bos taurus; identical to SEQ ID NO: 5546

SEQ ID NO: 87494 - DNA, 201 bp, Bos taurus; identical to SEQ ID NO: 5547

SEQ ID NO: 87495 - DNA, 201 bp, Bos taurus; identical to SEQ ID NO: 5549

SEQ ID NO: 87496 - DNA, 201 bp, Bos taurus; identical to SEQ ID NO: 5550

SEQ ID NO: 87497 - DNA, 201 bp, Bos taurus; identical to SEQ ID NO: 5551

SEQ ID NO: 87498 - DNA, 201 bp, Bos taurus; identical to SEQ ID NO: 5552

SEQ ID NO: 87499 - DNA, 201 bp, Bos taurus; identical to SEQ ID NO: 5553

SEQ ID NO: 87500 - DNA, 201 bp, Bos taurus; identical to SEQ ID NO: 46993

SEQ ID NO: 87501 - DNA, 201 bp, Bos taurus; identical to SEQ ID NO: 5554

SEQ ID NO: 87502 - DNA, 201 bp, Bos taurus; identical to SEQ ID NO: 5555

SEQ ID NO: 87503 - DNA, 201 bp, Bos taurus; identical to SEQ ID NO: 5556

SEQ ID NO: 87504 - DNA, 201 bp, Bos taurus; identical to SEQ ID NO: 5557

SEQ ID NO: 87505 - DNA, 201 bp, Bos taurus; identical to SEQ ID NO: 5559

SEQ ID NO: 87506 - DNA, 201 bp, Bos taurus; identical to SEQ ID NO: 5560

SEQ ID NO: 87507 - DNA, 201 bp, Bos taurus; identical to SEQ ID NO: 5561

SEQ ID NO: 87508 - DNA, 201 bp, Bos taurus; identical to SEQ ID NO: 5562

SEQ ID NO: 87509 - DNA, 201 bp, Bos taurus; identical to SEQ ID NO: 5563

SEQ ID NO: 87510 - DNA, 201 bp, Bos taurus; identical to SEQ ID NO: 5564

SEQ ID NO: 87511 - DNA, 201 bp, Bos taurus; identical to SEQ ID NO: 5565

SEQ ID NO: 87512 - DNA, 201 bp, Bos taurus; identical to SEQ ID NO: 5566

SEQ ID NO: 87513 - DNA, 201 bp, Bos taurus; identical to SEQ ID NO: 5567

SEQ ID NO: 87514 - DNA, 201 bp, Bos taurus; identical to SEQ ID NO: 5569

SEQ ID NO: 87515 - DNA, 201 bp, Bos taurus; identical to SEQ ID NO: 5570

SEQ ID NO: 87516 - DNA, 201 bp, Bos taurus; identical to SEQ ID NO: 5571

SEQ ID NO: 87517 - DNA, 201 bp, Bos taurus; identical to SEQ ID NO: 5572

SEQ ID NO: 87518 - DNA, 201 bp, Bos taurus; identical to SEQ ID NO: 5573

SEQ ID NO: 87519 - DNA, 201 bp, Bos taurus; identical to SEQ ID NO: 5574

SEQ ID NO: 87520 - DNA, 201 bp, Bos taurus; identical to SEQ ID NO: 5575

SEQ ID NO: 87521 - DNA, 201 bp, Bos taurus; identical to SEQ ID NO: 5577

SEQ ID NO: 87522 - DNA, 201 bp, Bos taurus; identical to SEQ ID NO: 5579

SEQ ID NO: 87523 - DNA, 201 bp, Bos taurus; identical to SEQ ID NO: 5580

SEQ ID NO: 87524 - DNA, 201 bp, Bos taurus; identical to SEQ ID NO: 5581

SEQ ID NO: 87525 - DNA, 201 bp, Bos taurus; identical to SEQ ID NO: 5582

SEQ ID NO: 87526 - DNA, 201 bp, Bos taurus; identical to SEQ ID NO: 5583

SEQ ID NO: 87527 - DNA, 201 bp, Bos taurus; identical to SEQ ID NO: 5584

SEQ ID NO: 87528 - DNA, 201 bp, Bos taurus; identical to SEQ ID NO: 5585

SEQ ID NO: 87529 - DNA, 201 bp, Bos taurus; identical to SEQ ID NO: 5586

SEQ ID NO: 87530 - DNA, 201 bp, Bos taurus; identical to SEQ ID NO: 5587

SEQ ID NO: 87531 - DNA, 201 bp, Bos taurus; identical to SEQ ID NO: 5588

SEQ ID NO: 87532 - DNA, 201 bp, Bos taurus; identical to SEQ ID NO: 5589

SEQ ID NO: 87533 - DNA, 201 bp, Bos taurus; identical to SEQ ID NO: 5590

SEQ ID NO: 87534 - DNA, 201 bp, Bos taurus; identical to SEQ ID NO: 5591

SEQ ID NO: 87535 - DNA, 201 bp, Bos taurus; identical to SEQ ID NO: 5592

SEQ ID NO: 87536 - DNA, 201 bp, Bos taurus; identical to SEQ ID NO: 5593

SEQ ID NO: 87537 - DNA, 201 bp, Bos taurus; identical to SEQ ID NO: 5594

SEQ ID NO: 87538 - DNA, 201 bp, Bos taurus; identical to SEQ ID NO: 5595

SEQ ID NO: 87539 - DNA, 201 bp, Bos taurus; identical to SEQ ID NO: 5596

SEQ ID NO: 87540 - DNA, 201 bp, Bos taurus; identical to SEQ ID NO: 5597

SEQ ID NO: 87541 - DNA, 201 bp, Bos taurus; identical to SEQ ID NO: 5598

SEQ ID NO: 87542 - DNA, 201 bp, Bos taurus; identical to SEQ ID NO: 5599

SEQ ID NO: 87543 - DNA, 201 bp, Bos taurus; identical to SEQ ID NO: 5600

SEQ ID NO: 87544 - DNA, 201 bp, Bos taurus; identical to SEQ ID NO: 5601

SEQ ID NO: 87545 - DNA, 201 bp, Bos taurus; identical to SEQ ID NO: 5602

SEQ ID NO: 87546 - DNA, 201 bp, Bos taurus; identical to SEQ ID NO: 5603

SEQ ID NO: 87547 - DNA, 201 bp, Bos taurus; identical to SEQ ID NO: 5604

SEQ ID NO: 87548 - DNA, 201 bp, Bos taurus; identical to SEQ ID NO: 5605

SEQ ID NO: 87549 - DNA, 201 bp, Bos taurus; identical to SEQ ID NO: 5606

SEQ ID NO: 87550 - DNA, 201 bp, Bos taurus; identical to SEQ ID NO: 5607

SEQ ID NO: 87551 - DNA, 201 bp, Bos taurus; identical to SEQ ID NO: 5608

SEQ ID NO: 87552 - DNA, 201 bp, Bos taurus; identical to SEQ ID NO: 5609

SEQ ID NO: 87553 - DNA, 201 bp, Bos taurus; identical to SEQ ID NO: 5610

SEQ ID NO: 87554 - DNA, 201 bp, Bos taurus; identical to SEQ ID NO: 5611

SEQ ID NO: 87555 - DNA, 201 bp, Bos taurus; identical to SEQ ID NO: 5612

SEQ ID NO: 87556 - DNA, 201 bp, Bos taurus; identical to SEQ ID NO: 5613

SEQ ID NO: 87557 - DNA, 201 bp, Bos taurus; identical to SEQ ID NO: 5614

SEQ ID NO: 87558 - DNA, 201 bp, Bos taurus; identical to SEQ ID NO: 5615

SEQ ID NO: 87559 - DNA, 201 bp, Bos taurus; identical to SEQ ID NO: 5616

SEQ ID NO: 87560 - DNA, 201 bp, Bos taurus; identical to SEQ ID NO: 5617

SEQ ID NO: 87561 - DNA, 201 bp, Bos taurus; identical to SEQ ID NO: 5618

SEQ ID NO: 87562 - DNA, 201 bp, Bos taurus; identical to SEQ ID NO: 5619

SEQ ID NO: 87563 - DNA, 201 bp, Bos taurus; identical to SEQ ID NO: 5620

SEQ ID NO: 87564 - DNA, 201 bp, Bos taurus; identical to SEQ ID NO: 5621

SEQ ID NO: 87565 - DNA, 201 bp, Bos taurus; identical to SEQ ID NO: 5622

SEQ ID NO: 87566 - DNA, 201 bp, Bos taurus; identical to SEQ ID NO: 5623

SEQ ID NO: 87567 - DNA, 201 bp, Bos taurus; identical to SEQ ID NO: 5624

SEQ ID NO: 87568 - DNA, 201 bp, Bos taurus; identical to SEQ ID NO: 5625

SEQ ID NO: 87569 - DNA, 201 bp, Bos taurus; identical to SEQ ID NO: 5626

SEQ ID NO: 87570 - DNA, 201 bp, Bos taurus; identical to SEQ ID NO: 5627

SEQ ID NO: 87571 - DNA, 201 bp, Bos taurus; identical to SEQ ID NO: 5628

SEQ ID NO: 87572 - DNA, 201 bp, Bos taurus; identical to SEQ ID NO: 5629

SEQ ID NO: 87573 - DNA, 201 bp, Bos taurus; identical to SEQ ID NO: 5630

SEQ ID NO: 87574 - DNA, 201 bp, Bos taurus; identical to SEQ ID NO: 5631

SEQ ID NO: 87575 - DNA, 201 bp, Bos taurus; identical to SEQ ID NO: 5632

SEQ ID NO: 87576 - DNA, 201 bp, Bos taurus; identical to SEQ ID NO: 5634

SEQ ID NO: 87577 - DNA, 201 bp, Bos taurus; identical to SEQ ID NO: 5635

SEQ ID NO: 87578 - DNA, 201 bp, Bos taurus; identical to SEQ ID NO: 5636

SEQ ID NO: 87579 - DNA, 201 bp, Bos taurus; identical to SEQ ID NO: 5637

SEQ ID NO: 87580 - DNA, 201 bp, Bos taurus; identical to SEQ ID NO: 5640

SEQ ID NO: 87581 - DNA, 201 bp, Bos taurus; identical to SEQ ID NO: 5642

SEQ ID NO: 87582 - DNA, 201 bp, Bos taurus; identical to SEQ ID NO: 5643

SEQ ID NO: 87583 - DNA, 201 bp, Bos taurus; identical to SEQ ID NO: 5644

SEQ ID NO: 87584 - DNA, 201 bp, Bos taurus; identical to SEQ ID NO: 5645

SEQ ID NO: 87585 - DNA, 201 bp, Bos taurus; identical to SEQ ID NO: 5646

SEQ ID NO: 87586 - DNA, 201 bp, Bos taurus; identical to SEQ ID NO: 5649

SEQ ID NO: 87587 - DNA, 201 bp, Bos taurus; identical to SEQ ID NO: 5652

SEQ ID NO: 87588 - DNA, 201 bp, Bos taurus; identical to SEQ ID NO: 5656

SEQ ID NO: 87589 - DNA, 201 bp, Bos taurus; identical to SEQ ID NO: 5657

SEQ ID NO: 87590 - DNA, 201 bp, Bos taurus; identical to SEQ ID NO: 5658

SEQ ID NO: 87591 - DNA, 201 bp, Bos taurus; identical to SEQ ID NO: 5661

SEQ ID NO: 87592 - DNA, 201 bp, Bos taurus; identical to SEQ ID NO: 5662

SEQ ID NO: 87593 - DNA, 201 bp, Bos taurus; identical to SEQ ID NO: 5664

SEQ ID NO: 87594 - DNA, 201 bp, Bos taurus; identical to SEQ ID NO: 5665

SEQ ID NO: 87595 - DNA, 201 bp, Bos taurus; identical to SEQ ID NO: 5667

SEQ ID NO: 87596 - DNA, 201 bp, Bos taurus; identical to SEQ ID NO: 5670

SEQ ID NO: 87597 - DNA, 201 bp, Bos taurus; identical to SEQ ID NO: 5673

SEQ ID NO: 87598 - DNA, 201 bp, Bos taurus; identical to SEQ ID NO: 5675

SEQ ID NO: 87599 - DNA, 201 bp, Bos taurus; identical to SEQ ID NO: 5676

SEQ ID NO: 87600 - DNA, 201 bp, Bos taurus; identical to SEQ ID NO: 5677

SEQ ID NO: 87601 - DNA, 201 bp, Bos taurus; identical to SEQ ID NO: 5680

SEQ ID NO: 87602 - DNA, 201 bp, Bos taurus; identical to SEQ ID NO: 5681

SEQ ID NO: 87603 - DNA, 201 bp, Bos taurus; identical to SEQ ID NO: 5683

SEQ ID NO: 87604 - DNA, 201 bp, Bos taurus; identical to SEQ ID NO: 5684

SEQ ID NO: 87605 - DNA, 201 bp, Bos taurus; identical to SEQ ID NO: 5685

SEQ ID NO: 87606 - DNA, 201 bp, Bos taurus; identical to SEQ ID NO: 5686

SEQ ID NO: 87607 - DNA, 201 bp, Bos taurus; identical to SEQ ID NO: 5687

SEQ ID NO: 87608 - DNA, 201 bp, Bos taurus; identical to SEQ ID NO: 5688

SEQ ID NO: 87609 - DNA, 201 bp, Bos taurus; identical to SEQ ID NO: 5689

SEQ ID NO: 87610 - DNA, 201 bp, Bos taurus; identical to SEQ ID NO: 5690

SEQ ID NO: 87611 - DNA, 201 bp, Bos taurus; identical to SEQ ID NO: 5691

SEQ ID NO: 87612 - DNA, 201 bp, Bos taurus; identical to SEQ ID NO: 5692

SEQ ID NO: 87613 - DNA, 201 bp, Bos taurus; identical to SEQ ID NO: 5694

SEQ ID NO: 87614 - DNA, 201 bp, Bos taurus; identical to SEQ ID NO: 5696

SEQ ID NO: 87615 - DNA, 201 bp, Bos taurus; identical to SEQ ID NO: 5700

SEQ ID NO: 87616 - DNA, 201 bp, Bos taurus; identical to SEQ ID NO: 5701

SEQ ID NO: 87617 - DNA, 201 bp, Bos taurus; identical to SEQ ID NO: 5702

SEQ ID NO: 87618 - DNA, 201 bp, Bos taurus; identical to SEQ ID NO: 5703

SEQ ID NO: 87619 - DNA, 201 bp, Bos taurus; identical to SEQ ID NO: 5704

SEQ ID NO: 87620 - DNA, 201 bp, Bos taurus; identical to SEQ ID NO: 5705

SEQ ID NO: 87621 - DNA, 201 bp, Bos taurus; identical to SEQ ID NO: 5706

SEQ ID NO: 87622 - DNA, 201 bp, Bos taurus; identical to SEQ ID NO: 5707

SEQ ID NO: 87623 - DNA, 201 bp, Bos taurus; identical to SEQ ID NO: 5709

SEQ ID NO: 87624 - DNA, 201 bp, Bos taurus; identical to SEQ ID NO: 5710

SEQ ID NO: 87625 - DNA, 201 bp, Bos taurus; identical to SEQ ID NO: 5711

SEQ ID NO: 87626 - DNA, 201 bp, Bos taurus; identical to SEQ ID NO: 5714

SEQ ID NO: 87627 - DNA, 201 bp, Bos taurus; identical to SEQ ID NO: 5715

SEQ ID NO: 87628 - DNA, 201 bp, Bos taurus; identical to SEQ ID NO: 5718

SEQ ID NO: 87629 - DNA, 201 bp, Bos taurus; identical to SEQ ID NO: 5719

SEQ ID NO: 87630 - DNA, 201 bp, Bos taurus; identical to SEQ ID NO: 5720

SEQ ID NO: 87631 - DNA, 201 bp, Bos taurus; identical to SEQ ID NO: 5721

SEQ ID NO: 87632 - DNA, 201 bp, Bos taurus; identical to SEQ ID NO: 5725

SEQ ID NO: 87633 - DNA, 201 bp, Bos taurus; identical to SEQ ID NO: 5726

SEQ ID NO: 87634 - DNA, 201 bp, Bos taurus; identical to SEQ ID NO: 5727

SEQ ID NO: 87635 - DNA, 201 bp, Bos taurus; identical to SEQ ID NO: 5728

SEQ ID NO: 87636 - DNA, 201 bp, Bos taurus; identical to SEQ ID NO: 5729

SEQ ID NO: 87637 - DNA, 201 bp, Bos taurus; identical to SEQ ID NO: 5730

SEQ ID NO: 87638 - DNA, 201 bp, Bos taurus; identical to SEQ ID NO: 5731

SEQ ID NO: 87639 - DNA, 201 bp, Bos taurus; identical to SEQ ID NO: 5732

SEQ ID NO: 87640 - DNA, 201 bp, Bos taurus; identical to SEQ ID NO: 5733

SEQ ID NO: 87641 - DNA, 201 bp, Bos taurus
aatcatctccccatctatctgtttcttctctatggatcttgaaataaacctcttgtctattttcagctgaatgatgccatggagatgggcctggtgtccaggaagtacagatcccagcggtctgtcctggagtgccttatgactctggagccagggcaagcacagagctcccactcctgtgggggcccagcctgggtgtgg

SEQ ID NO: 87642 - DNA, 201 bp, Bos taurus
gaagaatggtaaatgtaatgtggtaaggaaaaaggcagtcctggtgggaaagctggcttgggcaaagaataggtggccctcaagaccagtgttctagtgcgtgtgatgagattagagacaaagtctgagctggtgagtgtgactgagagggctcacccaggggccagaagctgcaggaacagctgcacagaattcaggcat

SEQ ID NO: 87643 - DNA, 201 bp, Bos taurus
gtttatctatctaataatcatctatgttattgattaatttgactatatatagagaaaaccaacctttaatagttaacatgaacattaacatactgtaaacgttcctcttcactttgcttttcttatttatgatgaaggtatatatcaatacattaaaatttttcagttcttttaacctattgccttgttttatgttgtatt

SEQ ID NO: 87644 - DNA, 201 bp, Bos taurus; identical to SEQ ID NO: 5738

SEQ ID NO: 87645 - DNA, 201 bp, Bos taurus; identical to SEQ ID NO: 5739

SEQ ID NO: 87646 - DNA, 201 bp, Bos taurus; identical to SEQ ID NO: 5740

SEQ ID NO: 87647 - DNA, 201 bp, Bos taurus
acacgtaagctttggcctacaaaaatatgatagaatgtcttaactgaaaataaatacacagctattaacaacatagacttgttttctaaaaaaaaaaaaaaggataaatataaggagggccaaaattcctcacagtgcagtaaggaataagcaaattgcaaaggaagacactttcatttttttctgtctctaatttaatca

SEQ ID NO: 87648 - DNA, 201 bp, Bos taurus; identical to SEQ ID NO: 5741

SEQ ID NO: 87649 - DNA, 201 bp, Bos taurus; identical to SEQ ID NO: 5742

SEQ ID NO: 87650 - DNA, 201 bp, Bos taurus; identical to SEQ ID NO: 5743

SEQ ID NO: 87651 - DNA, 201 bp, Bos taurus
tttcaggcccccagagcctgcttagttctgaaagaactagcctctgtctctctcctttgcagaaggaaggaaggggacctgcaatcacagcaatatttagctatggtcccacctgggcctctccagatagcctaggtgggagtccgcctgcaatggaggcgacctgggttcaatccctgggtcaggaagatctcctggaga

SEQ ID NO: 87652 - DNA, 201 bp, Bos taurus
taatctctactgcagggaattcattttcaaacacaaagctttcttgtttgattttcatattgaatctgcgggttcagagagatagaactacataagtatgacagtctattgcctttttccatccaataacacacccacagggctttgtgtctccctcagttaactggtttcccacttgtatccaaagcataaaagtaaata

SEQ ID NO: 87653 - DNA, 201 bp, Bos taurus; identical to SEQ ID NO: 5744

SEQ ID NO: 87654 - DNA, 201 bp, Bos taurus; identical to SEQ ID NO: 5745

SEQ ID NO: 87655 - DNA, 201 bp, Bos taurus; identical to SEQ ID NO: 5746

SEQ ID NO: 87656 - DNA, 201 bp, Bos taurus; identical to SEQ ID NO: 5748

SEQ ID NO: 87657 - DNA, 201 bp, Bos taurus; identical to SEQ ID NO: 5749

SEQ ID NO: 87658 - DNA, 201 bp, Bos taurus
aacccaggttggtacagtgaagagtggtgtctatggcaaattggagaatgccctctctgtttaaagttgtttaaattcaaataaaaaataaaaatccattttactggctaaatagaagatctaactagccactgcatctactatggtaggcctgttcccatacaggatttttattttatgattaaactcagcactacatta

SEQ ID NO: 87659 - DNA, 201 bp, Bos taurus; identical to SEQ ID NO: 5754

SEQ ID NO: 87660 - DNA, 201 bp, Bos taurus; identical to SEQ ID NO: 5755

SEQ ID NO: 87661 - DNA, 201 bp, Bos taurus; identical to SEQ ID NO: 5757

SEQ ID NO: 87662 - DNA, 201 bp, Bos taurus; identical to SEQ ID NO: 5758

SEQ ID NO: 87663 - DNA, 201 bp, Bos taurus; identical to SEQ ID NO: 5759

SEQ ID NO: 87664 - DNA, 201 bp, Bos taurus; identical to SEQ ID NO: 5761

SEQ ID NO: 87665 - DNA, 201 bp, Bos taurus; identical to SEQ ID NO: 5762

SEQ ID NO: 87666 - DNA, 201 bp, Bos taurus; identical to SEQ ID NO: 5764

SEQ ID NO: 87667 - DNA, 201 bp, Bos taurus; identical to SEQ ID NO: 5765

SEQ ID NO: 87668 - DNA, 201 bp, Bos taurus; identical to SEQ ID NO: 5766

SEQ ID NO: 87669 - DNA, 201 bp, Bos taurus
tggccaacttttcaaagatactttagataaccagaaagaaaacttattttacaaatttgtggggaagttccctaaatttgttgaataattttccatctgcgaaggccaaacaccattttgatgttggcataaccatgtcatattttattacttcttttctttttactgtaaagatggacttttgttgtcactgttatcatt

SEQ ID NO: 87670 - DNA, 201 bp, Bos taurus; identical to SEQ ID NO: 5770

SEQ ID NO: 87671 - DNA, 201 bp, Bos taurus; identical to SEQ ID NO: 5771

SEQ ID NO: 87672 - DNA, 201 bp, Bos taurus; identical to SEQ ID NO: 5772

SEQ ID NO: 87673 - DNA, 201 bp, Bos taurus; identical to SEQ ID NO: 5774

SEQ ID NO: 87674 - DNA, 201 bp, Bos taurus; identical to SEQ ID NO: 5776

SEQ ID NO: 87675 - DNA, 201 bp, Bos taurus
ccaataactaatattatcaacgttgtatttaaaatgcaagctgtgtgatagctgtattcagccagggggaaaagacccggatgcatttggttcagatgggtaacctgggctttgggcactcagtgatgccaagtgactcacccgggggaccgtctcttgtagcaggtttctctccagggatgtgtatccccaaccctgaga

SEQ ID NO: 87676 - DNA, 201 bp, Bos taurus
aatttggtgttgctgtattttaattcagcaatttggctactcaaagtctacgctgccatctattagtaaatgaattggactaatctctctgttagttgtgctgaaatggtttgccaataggtatggagagtaagaatatccaagacacagatttttaaagccccaattttatcatagattagccctttcccccctctggag

SEQ ID NO: 87677 - DNA, 201 bp, Bos taurus; identical to SEQ ID NO: 5779

SEQ ID NO: 87678 - DNA, 201 bp, Bos taurus
aatgcagagggtgaatgagggtagtgagcagcttggccagtgaatggaaggatgtgatggaagagccgtggaaaatagtaggagaggtgcagcaggaacaattgatggatggcctagaaatctggcaggaggtttaatttgattaatttggcaacagggaggtgctttaagttcataagctggagtataatacaataaaat

SEQ ID NO: 87679 - DNA, 201 bp, Bos taurus
cgtgcaaaggccctgaggctgggatgagcttggcctattccaggaacagagaggagagcggtatggctgaaacacaagagagagaagttaggaggtggacggaggagattatgggccgggtatagtcattgcccagcaaaggcatgccaggcctctcttggcatcttttttcatcatctccagtgggacatcttcctgtcc

SEQ ID NO: 87680 - DNA, 201 bp, Bos taurus
gggagcacaagcttggctcccaggtcagctgtgagtacctcccaccaccagtacccccaccaacatgacctcaaggaagaggaaatggccacactgactcctgcatgtattgcctctcgatgcttctcagatctacctgtgttctttcctctccactccttgcgcaaaccaccacccttttcctgctcctgcttgtgcttt

SEQ ID NO: 87681 - DNA, 201 bp, Bos taurus; identical to SEQ ID NO: 5780

SEQ ID NO: 87682 - DNA, 201 bp, Bos taurus
tttagacttttacttgcacatgaattgttctacagtggtcaccaagttccctagttctggtcttccaggcccaagcccagagtgcatgtgatggtcccatgccgcatcataacatctgtttggcctactgtctcatgtagaggtgtaatcactggcaggaatcagtggcttttccccaagagtaatgaggtggaaaaagtt

SEQ ID NO: 87683 - DNA, 201 bp, Bos taurus; identical to SEQ ID NO: 5781

SEQ ID NO: 87684 - DNA, 201 bp, Bos taurus; identical to SEQ ID NO: 5782

SEQ ID NO: 87685 - DNA, 201 bp, Bos taurus; identical to SEQ ID NO: 5783

SEQ ID NO: 87686 - DNA, 201 bp, Bos taurus; identical to SEQ ID NO: 5784

SEQ ID NO: 87687 - DNA, 201 bp, Bos taurus
ggtatcttaactccatccaagcttgttcatcttaacttctcagggctgtgtgagctagatgctggaggaggtgcttgtctgttcctctaggccttcatcccctgactcctccacatttctgcacaccccgctggagtacagcttcctgctggcagagccacgccctcttacatattcctaggactgagtcctggggtgaaa

SEQ ID NO: 87688 - DNA, 201 bp, Bos taurus; identical to SEQ ID NO: 5785

SEQ ID NO: 87689 - DNA, 201 bp, Bos taurus; identical to SEQ ID NO: 5787

SEQ ID NO: 87690 - DNA, 201 bp, Bos taurus; identical to SEQ ID NO: 5789

SEQ ID NO: 87691 - DNA, 201 bp, Bos taurus; identical to SEQ ID NO: 5790

SEQ ID NO: 87692 - DNA, 201 bp, Bos taurus; identical to SEQ ID NO: 5791

SEQ ID NO: 87693 - DNA, 201 bp, Bos taurus; identical to SEQ ID NO: 5794

SEQ ID NO: 87694 - DNA, 201 bp, Bos taurus
tcccttggcaaccatgtagcttgaccctgcacaaagcagttctcactgtaatgttagcatttcaaaactgaatcccttgtcaatataattgtgtgttgtcaggaatctagattgtccttacagcagccttcaggagacaatatgtctatttgtcgtctaatacttttgtgaccctgatggtaaaaggaacaggccagcaag

SEQ ID NO: 87695 - DNA, 201 bp, Bos taurus; identical to SEQ ID NO: 5796

SEQ ID NO: 87696 - DNA, 201 bp, Bos taurus; identical to SEQ ID NO: 5797

SEQ ID NO: 87697 - DNA, 201 bp, Bos taurus; identical to SEQ ID NO: 5798

SEQ ID NO: 87698 - DNA, 201 bp, Bos taurus; identical to SEQ ID NO: 5799

SEQ ID NO: 87699 - DNA, 201 bp, Bos taurus
tggccagtaaatgatatgcatgtaacttagaaaacaataacataactttcaagtaagaattaaaatagttttttatccagtgctttttgaaagtgcaatgaaaggacagcctatgtacaaacctgcatctttttataaaggtaaagatttaatgaactggcatgtacttcagtagtcagaatttgattggttgttgactta

SEQ ID NO: 87700 - DNA, 201 bp, Bos taurus; identical to SEQ ID NO: 5800

SEQ ID NO: 87701 - DNA, 201 bp, Bos taurus
cacaaggataacaatcaccaccgcttgagatgaacagaacaaaactgttggttgccagaggcagcagggtggaggagagggtgaaatgtatcaagggagggtcaaaagataaataagtgctggggatgtcatgcagagcatgatggctatagttttaatgctgtattccatatttaaaggttgctaagagtagattagcat

SEQ ID NO: 87702 - DNA, 201 bp, Bos taurus
tcagtgtaggttgcagcagatgagaaacacaggacctgagataagtgtgaaaagagggacaggttctggggatataaaagggaaaggaaagtatgccctcaacagaaagccatgaactaaagctttgaagtgagacagagcgcagcatgtgtgacttggaagagcagtgactatttgtctcctagggagaagaaacacggg

SEQ ID NO: 87703 - DNA, 201 bp, Bos taurus
ggaagtatgcagagaagtatttagaggaaggttttggtttataaagtctttgttttattgtttgttgatttgcttgtttttggccaatggcccaatgaggcagtgcctcaggacttaaagttgttattaccaactccttctttgtgaaagtatgaagagaagtgttaatctctcctggccaaagacttcaggcagcatact

SEQ ID NO: 87704 - DNA, 201 bp, Bos taurus; identical to SEQ ID NO: 5801

SEQ ID NO: 87705 - DNA, 201 bp, Bos taurus
cctctgtccctgggattctccaggcaagaatactggagtgggttgccatttccttctccaaatgctgttctgaacatggccaaatccaatggtcagttcttacttctcatcttacttgtccagttcagttcagtcactcagtcatgttcgactccctgcgaccccatgaatcgcagcacgccaggcctccctgtccatcac

SEQ ID NO: 87706 - DNA, 201 bp, Bos taurus
aggcggccactggcatggcaaggacaccattaagccaaactatagatgccaccagggcatcctggactcctggtgaaaaaaggagccaccatctcggccagagtaatagatgcacctaagcatgaggtggaagagctgcttttatacagctggggcaggtaaaatatttatgaatcctgggtgatctatatgtgcttcttg

SEQ ID NO: 87707 - DNA, 201 bp, Bos taurus; identical to SEQ ID NO: 5803

SEQ ID NO: 87708 - DNA, 201 bp, Bos taurus; identical to SEQ ID NO: 5804

SEQ ID NO: 87709 - DNA, 201 bp, Bos taurus; identical to SEQ ID NO: 5805

SEQ ID NO: 87710 - DNA, 201 bp, Bos taurus; identical to SEQ ID NO: 5806

SEQ ID NO: 87711 - DNA, 201 bp, Bos taurus; identical to SEQ ID NO: 5807

SEQ ID NO: 87712 - DNA, 201 bp, Bos taurus
tttaccatgttagtcaatatatgttgatagtatctcactaaaatatactttataaaagctgagttaatcatataaccaaatagttttccatacatggccccttgctaatatgctctaatatagcatacattttatcttactgagtacataaactactctgtgttcttcctctaatcatcatttgcccaagggccctctcag

SEQ ID NO: 87713 - DNA, 201 bp, Bos taurus; identical to SEQ ID NO: 5810

SEQ ID NO: 87714 - DNA, 201 bp, Bos taurus; identical to SEQ ID NO: 5813

SEQ ID NO: 87715 - DNA, 201 bp, Bos taurus
gcacaataaaactctctttttcgcacaataaacagaccaagacagcttcaggttcctgggtggagataagattcggccccatgcagtcaatcaaggaccccggcagaaggtttttctgtatcttccacaaataaatttccaggtcatggtgagcatcaacatccagccagtgcaaaagaaatgagcacattgggcctttct

SEQ ID NO: 87716 - DNA, 201 bp, Bos taurus; identical to SEQ ID NO: 5814

SEQ ID NO: 87717 - DNA, 201 bp, Bos taurus
gtgttattcactctaatagagaaaagagattgtgtcagtaatttctaaaaagaattttatcaactggaaataatgtgtgtctttccaagggcaggtgagaagtcagttatgagtgtggatccctctttaagagtaaattagagaaatattatctaaatgaggactacaccagtaactgaagggggcagactagcaatagct

SEQ ID NO: 87718 - DNA, 201 bp, Bos taurus; identical to SEQ ID NO: 5815

SEQ ID NO: 87719 - DNA, 201 bp, Bos taurus; identical to SEQ ID NO: 5816

SEQ ID NO: 87720 - DNA, 201 bp, Bos taurus; identical to SEQ ID NO: 5817

SEQ ID NO: 87721 - DNA, 201 bp, Bos taurus; identical to SEQ ID NO: 5818

SEQ ID NO: 87722 - DNA, 201 bp, Bos taurus; identical to SEQ ID NO: 5819

SEQ ID NO: 87723 - DNA, 201 bp, Bos taurus; identical to SEQ ID NO: 5820

SEQ ID NO: 87724 - DNA, 201 bp, Bos taurus
ccgtgaccggcagaggtgcagaggcagctgatgcaacctgagctgaaccggaagtccctgtttcctccaccgtctctgactggagaatcggagaaaccacccaggccaattcaacaacccttgctggaaacccagacagctgttttctggggctctctaaaggagacagtcaaacctcatcgttgctgtcatcattatcat

SEQ ID NO: 87725 - DNA, 201 bp, Bos taurus; identical to SEQ ID NO: 5827

SEQ ID NO: 87726 - DNA, 201 bp, Bos taurus; identical to SEQ ID NO: 5828

SEQ ID NO: 87727 - DNA, 201 bp, Bos taurus; identical to SEQ ID NO: 5829

SEQ ID NO: 87728 - DNA, 201 bp, Bos taurus
ctttaaacagctttaggaaaatgccagttgttttaattatttctccagtgggaatctttggcttcactgaaaagtgtatatgagccgtttggtggccaaacggcaaagtaaaaagaaaaaagaaaaatacacagaccaccaccaccaacatccccttctaagttacatgaaacttcaataaaatatggtttgatggcctgt

SEQ ID NO: 87729 - DNA, 201 bp, Bos taurus; identical to SEQ ID NO: 5830

SEQ ID NO: 87730 - DNA, 201 bp, Bos taurus; identical to SEQ ID NO: 5831

SEQ ID NO: 87731 - DNA, 201 bp, Bos taurus
ccaggagcacaggccctgctgaggggagcttacattccagttattaaagacgctgcactggtcaaacagagcacgcagtcaggctgaaggtcactctcccatgtgtcccgcctgctgtcaggccaagttcagctgtctcagcagtttagtctgggggagcccatcagatttctcaagtgtgtgtcagcatttgaggggctc

SEQ ID NO: 87732 - DNA, 201 bp, Bos taurus; identical to SEQ ID NO: 5832

SEQ ID NO: 87733 - DNA, 201 bp, Bos taurus; identical to SEQ ID NO: 5833

SEQ ID NO: 87734 - DNA, 201 bp, Bos taurus; identical to SEQ ID NO: 5834

SEQ ID NO: 87735 - DNA, 201 bp, Bos taurus; identical to SEQ ID NO: 5835

SEQ ID NO: 87736 - DNA, 201 bp, Bos taurus; identical to SEQ ID NO: 5837

SEQ ID NO: 87737 - DNA, 201 bp, Bos taurus; identical to SEQ ID NO: 5843

SEQ ID NO: 87738 - DNA, 201 bp, Bos taurus; identical to SEQ ID NO: 5844

SEQ ID NO: 87739 - DNA, 201 bp, Bos taurus
gagcctcagcttcctttttgtggtcaggattaattaaataacaatacaatgtatccataacattacccactactctgttcatgctcaataaatggcagtcataattttcacaagattcttaatagcatgagttagcaggccaaacctgtccacccctgttttataaataaagttttattgggccacaatcacaatcattag

SEQ ID NO: 87740 - DNA, 201 bp, Bos taurus; identical to SEQ ID NO: 5845

SEQ ID NO: 87741 - DNA, 201 bp, Bos taurus; identical to SEQ ID NO: 5847

SEQ ID NO: 87742 - DNA, 201 bp, Bos taurus; identical to SEQ ID NO: 5849

SEQ ID NO: 87743 - DNA, 201 bp, Bos taurus; identical to SEQ ID NO: 5850

SEQ ID NO: 87744 - DNA, 201 bp, Bos taurus
ctattatccaaatcattaacattcgcttcaccctgttgaaatgcagtgacacccagggatttaaagtgtaccactacatgaatgaaccccacactctagttggcaacagaattaccagagggcttattagattcctaagctccaccctcagagtttctgatttagtaattctggagctggacctgagtatttttatttcta

SEQ ID NO: 87745 - DNA, 201 bp, Bos taurus; identical to SEQ ID NO: 5851

SEQ ID NO: 87746 - DNA, 201 bp, Bos taurus; identical to SEQ ID NO: 5852

SEQ ID NO: 87747 - DNA, 201 bp, Bos taurus; identical to SEQ ID NO: 5854

SEQ ID NO: 87748 - DNA, 201 bp, Bos taurus
ctgtaggatttatttccctgttcaccgactgttgactgggaactgtctgtggcagctgcagagtggaccaggttttgcaggttccctggacctggaggcattttagataaactgcagaatccttgccacagacccggagccttgggatgcaggcatggaagccccttttaactagtttttttttatcctttgaccaccaga

SEQ ID NO: 87749 - DNA, 201 bp, Bos taurus; identical to SEQ ID NO: 5855

SEQ ID NO: 87750 - DNA, 201 bp, Bos taurus; identical to SEQ ID NO: 5856

SEQ ID NO: 87751 - DNA, 201 bp, Bos taurus; identical to SEQ ID NO: 5857

SEQ ID NO: 87752 - DNA, 201 bp, Bos taurus
caagatgtcatacttaggtaatagagatgctgtccatcagctggtagctcagctaggactgtcagctgagggtcttgattttcctcaagacttcctgagcgtcttcttatgattgtttaggctctgtgtagcatggtggttggatttcaagaggcagaaggtggaggctgccagtcctcttaaaggctagccctgaagtga

SEQ ID NO: 87753 - DNA, 201 bp, Bos taurus; identical to SEQ ID NO: 5858

SEQ ID NO: 87754 - DNA, 201 bp, Bos taurus; identical to SEQ ID NO: 5859

SEQ ID NO: 87755 - DNA, 201 bp, Bos taurus; identical to SEQ ID NO: 5860

SEQ ID NO: 87756 - DNA, 201 bp, Bos taurus
tactacctggctttgttaactttcccttctttatttgggcctctgaagtcaggctttcacttgcccacctctgaagtcgcctcgtaaaaagtcactggtttgcaggttgccagatctagtggcctctctttggcttcatcgtacgtgaccttcctaagacattcaacaccagccacttccttcttcatgaactcttccttt

SEQ ID NO: 87757 - DNA, 201 bp, Bos taurus; identical to SEQ ID NO: 5862

SEQ ID NO: 87758 - DNA, 201 bp, Bos taurus; identical to SEQ ID NO: 5863

SEQ ID NO: 87759 - DNA, 201 bp, Bos taurus; identical to SEQ ID NO: 5865

SEQ ID NO: 87760 - DNA, 201 bp, Bos taurus; identical to SEQ ID NO: 5866

SEQ ID NO: 87761 - DNA, 201 bp, Bos taurus
tgctcccttggaccactcagtctgggagaatccagctgcctgttatgagaactccgaagcagctctattggagaggtccatcggtgaggccttttgagtgcgaaatcttggaggtggatcttctagcctgagtcaagccttcagatgactacagcctgggccaatatcttgcctgcaacctcatgagaccctgagctagaa

SEQ ID NO: 87762 - DNA, 201 bp, Bos taurus
gagccagttttcgggcctacatcttgagaaaatagcagcttctcttggaatagacactcttggagtgaagtcaccacagtgtaaagcttaagctacacatgcgtgtcggggcctgccaggtggtatagtggtgaagaatctgcctgctaatgcaggagacctaagagacatgggtgcaatccctcggtggggaagatccca

SEQ ID NO: 87763 - DNA, 201 bp, Bos taurus; identical to SEQ ID NO: 5872

SEQ ID NO: 87764 - DNA, 201 bp, Bos taurus; identical to SEQ ID NO: 5873

SEQ ID NO: 87765 - DNA, 201 bp, Bos taurus; identical to SEQ ID NO: 5875

SEQ ID NO: 87766 - DNA, 201 bp, Bos taurus
atgtagaactacagtggagactttagtttttggcaacctgtcatgtagttatcctgcacaacaacaacaaaaagttagagaaatatccagaggccccaaatcacactcaaatagagaagaaattgaacaagtgtagctggtagctgcccatggaaaaaatattaaatctcacctgcctagattttcctgtttaacaggaca

SEQ ID NO: 87767 - DNA, 201 bp, Bos taurus
gccctcacactcaggaaatttccctttacgaagaccatgggcaatcctgggcaaccagttcagtgaccccagttcttccactgtctcaagccccagattccactcttatgctgcaaactggcccacagtgagtgatccagtggaatccagataagccaccctcacactgcaataaaagtagagcctaaatccaggctttct

SEQ ID NO: 87768 - DNA, 201 bp, Bos taurus; identical to SEQ ID NO: 5876

SEQ ID NO: 87769 - DNA, 201 bp, Bos taurus; identical to SEQ ID NO: 5877

SEQ ID NO: 87770 - DNA, 201 bp, Bos taurus
gttaacaatagatatacatccataggccaggaataaagaacaaagaagtttgagctagagttgggattcctgattatcatttttcagccttgctaaaaccggaggaaaggctcttctctaggcccaacctgcttttgtaccttttgaagtgagcagtgagatggatgcatacttcagggtgccaagaagcaaaggctattt

SEQ ID NO: 87771 - DNA, 201 bp, Bos taurus
atgactgagcacgtaagcacatcatctatctcaaaacaagaaatggaaaaaaaagttcagaagcaactatgaaactgatcttattgtgttgtacaactataccgctttggtactatggaaaatcctaggacttaaaatagagtcagctatcagagtgtgctctgctcaaattggaatctgctttgtgagattcagctgctc

SEQ ID NO: 87772 - DNA, 201 bp, Bos taurus
atgcctttcaaaacacttgtaaaataaattgattataatatctttaaccttcaaaattacttaaatacatctcctgatcttttgtgtacatagaatgacacgctgaatgtgctttgcagtatgcagttttgcaggtgcgagttcattgggaatttctgctagcaaaacaaaaatcacaagatcatggtgctaccaacactc

SEQ ID NO: 87773 - DNA, 201 bp, Bos taurus
gttaaagggtatttttactggttttaccacaccaagtccctggtgcagcagcgatcttaaaggggccgcagcccatggttctagtgtgggttcttagtcttcagttccagagagagaagagcagaccccattcacaagttattgtgtaagtctgttctgattcatctggagggatacctgaacgaatgacgggcagtgttt

SEQ ID NO: 87774 - DNA, 201 bp, Bos taurus; identical to SEQ ID NO: 5882

SEQ ID NO: 87775 - DNA, 201 bp, Bos taurus; identical to SEQ ID NO: 5883

SEQ ID NO: 87776 - DNA, 201 bp, Bos taurus
gtcaaaaaaagtctaccctggcctaaaacctaaggaaagagtagaagtagaaactaggattttttaaatgtccaatcattttgagttcagtccctcagtcatgtctgactctttgtgatcccatgaatcgcagcacgccaggcctccctgtccatcaccaactcctggagttcactcagactcacatccatcgagtcggtg

SEQ ID NO: 87777 - DNA, 201 bp, Bos taurus; identical to SEQ ID NO: 5884

SEQ ID NO: 87778 - DNA, 201 bp, Bos taurus
tggagatcagctgtggccaaaagatctaaatctgcacacttcttcatctccatttctgtggtcttattgctgctaagactattgccacagcctcctaatctgttttcctatcttccttgtcaggccatcatctacactaagatcagaatcaatttttaaaatgtgtaattcaacataaaaattctcctgttacatctaaga

SEQ ID NO: 87779 - DNA, 201 bp, Bos taurus; identical to SEQ ID NO: 5886

SEQ ID NO: 87780 - DNA, 201 bp, Bos taurus; identical to SEQ ID NO: 5887

SEQ ID NO: 87781 - DNA, 201 bp, Bos taurus; identical to SEQ ID NO: 5888

SEQ ID NO: 87782 - DNA, 201 bp, Bos taurus; identical to SEQ ID NO: 5889

SEQ ID NO: 87783 - DNA, 201 bp, Bos taurus
tggtttatttgtttattcattaagcatacgtaaaatcgagtcatctctgagtgcataatcccttagaagagataaaatggccaactagagataaaatacaaaatagagagcgataagtgttgcaagataggtgagcacagaagcccaggaaatggagatgctttgtttgcttaggaccatctgggattgttctctagcaga

SEQ ID NO: 87784 - DNA, 201 bp, Bos taurus; identical to SEQ ID NO: 5890

SEQ ID NO: 87785 - DNA, 201 bp, Bos taurus
cagaagacagagaccatctctgtgattgtagagttagtgaatcaggaaggaatttaggggaagatccccataaggctgagatgtggcctcagatggaggagcatgactgcccacaatacactgtattctactggggtgaaggactcgggggtctcctcacagaaacccgaggccggcctggggatggtcagtgcttcagag

SEQ ID NO: 87786 - DNA, 201 bp, Bos taurus; identical to SEQ ID NO: 5892

SEQ ID NO: 87787 - DNA, 201 bp, Bos taurus; identical to SEQ ID NO: 5893

SEQ ID NO: 87788 - DNA, 201 bp, Bos taurus; identical to SEQ ID NO: 5894

SEQ ID NO: 87789 - DNA, 201 bp, Bos taurus; identical to SEQ ID NO: 5895

SEQ ID NO: 87790 - DNA, 201 bp, Bos taurus; identical to SEQ ID NO: 5896

SEQ ID NO: 87791 - DNA, 201 bp, Bos taurus; identical to SEQ ID NO: 5897

SEQ ID NO: 87792 - DNA, 201 bp, Bos taurus
ggggtgccattgccttctccgtctttctgggtctagacctttccattctctggcttggcaagctgcaaggttgctgtcctcatctgggtaaccagagctttattgcaaacatgccgttgtttcctttcacaagaagaggaaaggagaacactaatacagaagtgggcagtgttttgagttggagatgattcagaagttaag

SEQ ID NO: 87793 - DNA, 201 bp, Bos taurus; identical to SEQ ID NO: 5898

SEQ ID NO: 87794 - DNA, 201 bp, Bos taurus
attttagtacattataatgacaatttcgtgtgtttatatttccactcctttgaacagtttgttggtggagtgtccttttaattttcatttgttaagagcttttacattatttggcaaacaataggtttttaataaatatttgtagttagttggataaacagcatccatgtggtctaagattctcagctttttctcttaaac

SEQ ID NO: 87795 - DNA, 201 bp, Bos taurus; identical to SEQ ID NO: 5899

SEQ ID NO: 87796 - DNA, 201 bp, Bos taurus
agtgtcagatgttcaccgattacaatgttagtggctggaggtgagaatttagcactaacctgtagctatgctcttccagttgagccagtgactgtgggccttgtctcagttgttggtttggtgacagggacatcttcaatcagccaaatccaatgacgtaggagcctttactgtggttggttgaaacagtgacttagttga

SEQ ID NO: 87797 - DNA, 201 bp, Bos taurus; identical to SEQ ID NO: 5900

SEQ ID NO: 87798 - DNA, 201 bp, Bos taurus; identical to SEQ ID NO: 5901

SEQ ID NO: 87799 - DNA, 201 bp, Bos taurus; identical to SEQ ID NO: 5902

SEQ ID NO: 87800 - DNA, 201 bp, Bos taurus; identical to SEQ ID NO: 5903

SEQ ID NO: 87801 - DNA, 201 bp, Bos taurus; identical to SEQ ID NO: 5904

SEQ ID NO: 87802 - DNA, 201 bp, Bos taurus
gaagaagtgatagttggaaatcaagcaaggtcatgaggaagagagagattattttctttaatgttttttcacacatttcaaaatcaacttaagtaagatgcctgtggacacataagccgacaaaataacacaatcagaaaacatggcaaaaatatccctcctctagatttttcctgaaaaaatagctttctttttctatca

SEQ ID NO: 87803 - DNA, 201 bp, Bos taurus
aatatatactacatgggtcctaatttgagtataaatagctcctaatgttcaaactgcttttatcactattaagtaatttgttttacatttattggattgagtaacagcttcattggctgtgactttgaagacccatgaaagttaaaccctggcatgtactctgacactgactgtggcaataaagaaattaagaagacctca

SEQ ID NO: 87804 - DNA, 201 bp, Bos taurus; identical to SEQ ID NO: 5905

SEQ ID NO: 87805 - DNA, 201 bp, Bos taurus
cacagactgttccaattcttgggcatgtgccccaaggtcacagcggataggaactaaccactggggggcttccccaagtccaccccatgggcccttgatgcagagttgtgtcttccaagtaacctcaggcagccaggagcccattcagttcagttcagttcagtcgctcagtcgtgtccgactctttgcgaccccatgaat

SEQ ID NO: 87806 - DNA, 201 bp, Bos taurus
ataccaggtggtgagtgtagacacggaggaccttgtcagcctaaggaccaggtggcaccccaaaaggatgcagcaaggaggtactgaaactcaggcagccaggccctgggggaggactcacgtagacaggaagagacagccctgagggcctggggtgcagctggggtggaccacaaggaccatggtcagggttcttgggag

SEQ ID NO: 87807 - DNA, 201 bp, Bos taurus
atttattactctcaatatctttaatactaaatattgatgagggatgataagtaactttttttccccccaaatcacacatttagatttgctactctaaatcaaatcatccttcttactaattagtggagcactttggactgtaaggaaaaaatcagctaaaatagtatcatatccatgggggctttacatttgacaaaatag

SEQ ID NO: 87808 - DNA, 201 bp, Bos taurus
cttggaaattttttttacaaataaaaaggtagaaaatctccaaaattaatatggcagcattttaaaatattcttgtaatgaggaacatttggaaaaaacatttaaatgaaaccataaaagtaaaaggattaaatctaacagaacttttaattaaaaagaaatcattcaagagaaaagtcgtttattctacatagaacctaa

SEQ ID NO: 87809 - DNA, 201 bp, Bos taurus; identical to SEQ ID NO: 5906

SEQ ID NO: 87810 - DNA, 201 bp, Bos taurus; identical to SEQ ID NO: 5907

SEQ ID NO: 87811 - DNA, 201 bp, Bos taurus; identical to SEQ ID NO: 5908

SEQ ID NO: 87812 - DNA, 201 bp, Bos taurus; identical to SEQ ID NO: 5909

SEQ ID NO: 87813 - DNA, 201 bp, Bos taurus; identical to SEQ ID NO: 5910

SEQ ID NO: 87814 - DNA, 201 bp, Bos taurus; identical to SEQ ID NO: 5911

SEQ ID NO: 87815 - DNA, 201 bp, Bos taurus; identical to SEQ ID NO: 5912

SEQ ID NO: 87816 - DNA, 201 bp, Bos taurus
cccactaggctcccaaagtataaatcacccccatcctcctcccttgatcgccatcatcacccagggatagccccagggccctagggccactgggataatcttcatggtgtagtgacaaaataccgaatacgggttcaccaaaattttgtgtgagtttttccttaccaccttatggagaaactcaaactttttggccaaccc

SEQ ID NO: 87817 - DNA, 201 bp, Bos taurus
agactcctctgtccatgggattcttcaggcaagaatactggagtgggttgccctgccctcctgcaggggatcttcccgacccagggattgaactcgcttcctgtatgtcccctgcactggcaaacagtttgtttaccagtagctacacagcgaagcaaagacagcctggcatgctgtaaagtttgtccctttcagttgcta

SEQ ID NO: 87818 - DNA, 201 bp, Bos taurus; identical to SEQ ID NO: 5913

SEQ ID NO: 87819 - DNA, 201 bp, Bos taurus
gtctaacacaggcacttctgccctagtggagaacagtgctggggcaaatggaactgcagtggacacccagggcaggccaggttcatgctggaacagtccctgcaagccagtcagaacccgggctgtttccagtctactgcatctgtgtgctcactgtcaacagctatcctcactttgttcagaggcaggcccagatccaag

SEQ ID NO: 87820 - DNA, 201 bp, Bos taurus; identical to SEQ ID NO: 5914

SEQ ID NO: 87821 - DNA, 201 bp, Bos taurus; identical to SEQ ID NO: 5915

SEQ ID NO: 87822 - DNA, 201 bp, Bos taurus; identical to SEQ ID NO: 5916

SEQ ID NO: 87823 - DNA, 201 bp, Bos taurus
atggctatcattgaagagcctacagataacaaatgctggagaggatgtagagaaaaaggaaccctcctacgctgttggcagaaatgtaaattagcgcagccgctatagaaaactgtatactcctaagtcgcttcatttgtgtccaactctgtgcgaccccatagaaagcacagcccaacaggctcctctgtccctgggatt

SEQ ID NO: 87824 - DNA, 201 bp, Bos taurus
cacagagtggacttgctggatcactgttgttgttcagtcactcagacgtgtccaactccttgcaaccccatggattgcagtcaggctttcatccttcactgtctccaggagtttgcacaaaccctcaacatgtccattgagtcagtgatgccatccaaccatctcatcctctgtcgtccccttcccctcctgctctcaata

SEQ ID NO: 87825 - DNA, 201 bp, Bos taurus
gcttgaacattttaaactcccctctgcatactcatagtgacacagtcttgaaaacctcagctcaaggcacgacaaactttaaagcgcttcccagtttttacagggtgtcactctctatccaactctaaaagatctaacgacacagaaatgcttccacatcaagatgtttcacaagatactttataaatgaatctggattcc

SEQ ID NO: 87826 - DNA, 201 bp, Bos taurus; identical to SEQ ID NO: 5917

SEQ ID NO: 87827 - DNA, 201 bp, Bos taurus
catggctggcctcacctctgacctcctcgtgtgtatggatgcagtatggacacacgcacaccataaataccctctgtagtgctgtagtgtccagtggagcaccaagggtaatttccaggccaaaatgtatgaactactttgggcatcttctggtttcttcctgaagtactccctctcttgctaagtgttcactgatcccct

SEQ ID NO: 87828 - DNA, 201 bp, Bos taurus; identical to SEQ ID NO: 5918

SEQ ID NO: 87829 - DNA, 201 bp, Bos taurus; identical to SEQ ID NO: 5919

SEQ ID NO: 87830 - DNA, 201 bp, Bos taurus; identical to SEQ ID NO: 5920

SEQ ID NO: 87831 - DNA, 201 bp, Bos taurus; identical to SEQ ID NO: 5921

SEQ ID NO: 87832 - DNA, 201 bp, Bos taurus; identical to SEQ ID NO: 5922

SEQ ID NO: 87833 - DNA, 201 bp, Bos taurus; identical to SEQ ID NO: 5923

SEQ ID NO: 87834 - DNA, 201 bp, Bos taurus; identical to SEQ ID NO: 5924

SEQ ID NO: 87835 - DNA, 201 bp, Bos taurus; identical to SEQ ID NO: 5925

SEQ ID NO: 87836 - DNA, 201 bp, Bos taurus; identical to SEQ ID NO: 5926

SEQ ID NO: 87837 - DNA, 201 bp, Bos taurus; identical to SEQ ID NO: 5927

SEQ ID NO: 87838 - DNA, 201 bp, Bos taurus; identical to SEQ ID NO: 5928

SEQ ID NO: 87839 - DNA, 201 bp, Bos taurus; identical to SEQ ID NO: 5929

SEQ ID NO: 87840 - DNA, 201 bp, Bos taurus; identical to SEQ ID NO: 5930

SEQ ID NO: 87841 - DNA, 201 bp, Bos taurus; identical to SEQ ID NO: 5931

SEQ ID NO: 87842 - DNA, 201 bp, Bos taurus; identical to SEQ ID NO: 5932

SEQ ID NO: 87843 - DNA, 201 bp, Bos taurus; identical to SEQ ID NO: 5933

SEQ ID NO: 87844 - DNA, 201 bp, Bos taurus; identical to SEQ ID NO: 5934

SEQ ID NO: 87845 - DNA, 201 bp, Bos taurus; identical to SEQ ID NO: 5935

SEQ ID NO: 87846 - DNA, 201 bp, Bos taurus; identical to SEQ ID NO: 5936

SEQ ID NO: 87847 - DNA, 201 bp, Bos taurus; identical to SEQ ID NO: 5937

SEQ ID NO: 87848 - DNA, 201 bp, Bos taurus; identical to SEQ ID NO: 5938

SEQ ID NO: 87849 - DNA, 201 bp, Bos taurus; identical to SEQ ID NO: 5939

SEQ ID NO: 87850 - DNA, 201 bp, Bos taurus; identical to SEQ ID NO: 5940

SEQ ID NO: 87851 - DNA, 201 bp, Bos taurus; identical to SEQ ID NO: 5941

SEQ ID NO: 87852 - DNA, 201 bp, Bos taurus; identical to SEQ ID NO: 5943

SEQ ID NO: 87853 - DNA, 201 bp, Bos taurus; identical to SEQ ID NO: 5944

SEQ ID NO: 87854 - DNA, 201 bp, Bos taurus; identical to SEQ ID NO: 5945

SEQ ID NO: 87855 - DNA, 201 bp, Bos taurus; identical to SEQ ID NO: 5946

SEQ ID NO: 87856 - DNA, 201 bp, Bos taurus; identical to SEQ ID NO: 5947

SEQ ID NO: 87857 - DNA, 201 bp, Bos taurus; identical to SEQ ID NO: 5948

SEQ ID NO: 87858 - DNA, 201 bp, Bos taurus; identical to SEQ ID NO: 5949

SEQ ID NO: 87859 - DNA, 201 bp, Bos taurus; identical to SEQ ID NO: 5950

SEQ ID NO: 87860 - DNA, 201 bp, Bos taurus; identical to SEQ ID NO: 5951

SEQ ID NO: 87861 - DNA, 201 bp, Bos taurus; identical to SEQ ID NO: 5952

SEQ ID NO: 87862 - DNA, 201 bp, Bos taurus; identical to SEQ ID NO: 5953

SEQ ID NO: 87863 - DNA, 201 bp, Bos taurus; identical to SEQ ID NO: 5954

SEQ ID NO: 87864 - DNA, 201 bp, Bos taurus; identical to SEQ ID NO: 5955

SEQ ID NO: 87865 - DNA, 201 bp, Bos taurus; identical to SEQ ID NO: 5956

SEQ ID NO: 87866 - DNA, 201 bp, Bos taurus; identical to SEQ ID NO: 5957

SEQ ID NO: 87867 - DNA, 201 bp, Bos taurus; identical to SEQ ID NO: 5958

SEQ ID NO: 87868 - DNA, 201 bp, Bos taurus; identical to SEQ ID NO: 5960

SEQ ID NO: 87869 - DNA, 201 bp, Bos taurus; identical to SEQ ID NO: 5961

SEQ ID NO: 87870 - DNA, 201 bp, Bos taurus; identical to SEQ ID NO: 5963

SEQ ID NO: 87871 - DNA, 201 bp, Bos taurus; identical to SEQ ID NO: 5964

SEQ ID NO: 87872 - DNA, 201 bp, Bos taurus; identical to SEQ ID NO: 5965

SEQ ID NO: 87873 - DNA, 201 bp, Bos taurus; identical to SEQ ID NO: 5966

SEQ ID NO: 87874 - DNA, 201 bp, Bos taurus; identical to SEQ ID NO: 5967

SEQ ID NO: 87875 - DNA, 201 bp, Bos taurus; identical to SEQ ID NO: 5968

SEQ ID NO: 87876 - DNA, 201 bp, Bos taurus; identical to SEQ ID NO: 5969

SEQ ID NO: 87877 - DNA, 201 bp, Bos taurus; identical to SEQ ID NO: 5970

SEQ ID NO: 87878 - DNA, 201 bp, Bos taurus; identical to SEQ ID NO: 5971

SEQ ID NO: 87879 - DNA, 201 bp, Bos taurus; identical to SEQ ID NO: 5972

SEQ ID NO: 87880 - DNA, 201 bp, Bos taurus; identical to SEQ ID NO: 5974

SEQ ID NO: 87881 - DNA, 201 bp, Bos taurus
tttgtgaagtctcttatctacttttatatcctttagccacacttgacatttttctttagaaagaccccacacaagttcttgttacggttatcatctgttgcattagtcagggtccaatcagagaagcagagccagtggaggtgcatgttaaaaaatctgttgtaaaaaattggctaatggaatttgggaagccggtccaaa

SEQ ID NO: 87882 - DNA, 201 bp, Bos taurus; identical to SEQ ID NO: 5975

SEQ ID NO: 87883 - DNA, 201 bp, Bos taurus; identical to SEQ ID NO: 5977

SEQ ID NO: 87884 - DNA, 201 bp, Bos taurus
tgttttaaaatgtcccgttctgtctaaattgaaacattgtttccttattcaactgaaagtttccccacccctctttcacctaaggaagctgggcctactgcgttttgataaactcctggttcacattcctgggtgccgcccctcactctggctcctccaggtgggctggggagaggagagacaagggaagatgtggccacg

SEQ ID NO: 87885 - DNA, 201 bp, Bos taurus; identical to SEQ ID NO: 5978

SEQ ID NO: 87886 - DNA, 201 bp, Bos taurus
agggtcttctccagtttaatcccctttaggctaggttttgagaaccagaggttctctaattctctgatctcctagcctcaagcatcctaccagggcctatgaaatcctcttcctcctcaggcacactcatctgcgcgccgtccatgcagcaggcatgtacacctttgggccgtggcattggcttcggacagagctctgcaa

SEQ ID NO: 87887 - DNA, 201 bp, Bos taurus
tctttaaagaggtaattaagttaaaatgtggtgtcatgttggatttcccctgtgcgtcagcctttaaagaattccttggccaatgcaggaggtgggtcccatctctgggtcaggaccatcctgtggagtaggaaatggcaacccactccactattcttgcttggagaattccatggccagaagagcctggaatgctacagt

SEQ ID NO: 87888 - DNA, 201 bp, Bos taurus; identical to SEQ ID NO: 5979

SEQ ID NO: 87889 - DNA, 201 bp, Bos taurus
tgtgtttctctgagtcatcccacagtggaattgagttccttttcataaactgagttctgctagatgacctgctttagatgtggagaaggccctcaaggaacgtgtgagatgcagggaatttctcctttctctgatcctcctctacatagagtccaaaccagacagtgaacatttgcatttgaaagtaaaggaagtatgtgg

SEQ ID NO: 87890 - DNA, 201 bp, Bos taurus
ggacagaagagcctggtaggctacagtccatggggtctcaaagagtcgggcacgactgaacgatttcacttttcactttcagacatggccatgaggataactgcacaataaaaattcaaccatggggcaaagcttatgcaatagacagactgaacaagaaagttgtattcacaacacagagtactaaccactatactatca

SEQ ID NO: 87891 - DNA, 201 bp, Bos taurus; identical to SEQ ID NO: 5981

SEQ ID NO: 87892 - DNA, 201 bp, Bos taurus; identical to SEQ ID NO: 5982

SEQ ID NO: 87893 - DNA, 201 bp, Bos taurus
acctgttggtgagactggccaggaggtttgactccagagtgcatgctcttttcattattttactctaactcacatggcttgtagggtgttgctccaccctgccctgggccacacagatatctctaagtcctggcatctaatttaagtaacagagatttttaaatcttgcattgtctgaatctttttctggcaataaaaata

SEQ ID NO: 87894 - DNA, 201 bp, Bos taurus; identical to SEQ ID NO: 5983

SEQ ID NO: 87895 - DNA, 201 bp, Bos taurus; identical to SEQ ID NO: 5984

SEQ ID NO: 87896 - DNA, 201 bp, Bos taurus; identical to SEQ ID NO: 5985

SEQ ID NO: 87897 - DNA, 201 bp, Bos taurus; identical to SEQ ID NO: 5986

SEQ ID NO: 87898 - DNA, 201 bp, Bos taurus; identical to SEQ ID NO: 5987

SEQ ID NO: 87899 - DNA, 201 bp, Bos taurus; identical to SEQ ID NO: 5988

SEQ ID NO: 87900 - DNA, 201 bp, Bos taurus
aaatgaaattgaaattgagcgatgcccccttttcctccttttttgtaggcaagaccctagcctccatgaccttccctgagtccccaaaggcagatgcaaatagttgcttaaacaagggccaagaaaccacctgaggcgagattaaagggaccagagaatctcaagattaggagaccacattaagccttggagataccataa

SEQ ID NO: 87901 - DNA, 201 bp, Bos taurus; identical to SEQ ID NO: 5989

SEQ ID NO: 87902 - DNA, 201 bp, Bos taurus
tggtaaacctttcagatattagatagttaagaaagtagtaacataaatatgctttgattcagatttgtcaggggtacttgaactagtagaatatatttccgaaaaattattggatcctaacaccaaaaaactgaatatatagtcttaaatgttcttgaaaagatttattttctccattaattaatggctaattttttcata

SEQ ID NO: 87903 - DNA, 201 bp, Bos taurus; identical to SEQ ID NO: 5990

SEQ ID NO: 87904 - DNA, 201 bp, Bos taurus; identical to SEQ ID NO: 5991

SEQ ID NO: 87905 - DNA, 201 bp, Bos taurus
tgctcgtaacagtacaaatacacattcctattttcctaataataaaaaaccgcgtcctctgactgtgaaaaggagaggacagatgaaaggttttgttacaactggtggaccttggctgctggtttcaaatgcacttattccctcctgtgactggagttaagaccccttgaaggtcacctccgccaagcccagactctgtct

SEQ ID NO: 87906 - DNA, 201 bp, Bos taurus
gcctggatttctgttgatcttttttgacaaagaatcattaactgtgatgtatagtattttatatggaatttgtagtaatttctttgtagatgaatgataacccagaattcaacaaagtagaaaaaaggaattacttctcaatttgttggcatttagttaatagggctaacgatcgagtagtacgtttgctttaactataat

SEQ ID NO: 87907 - DNA, 201 bp, Bos taurus; identical to SEQ ID NO: 5995

SEQ ID NO: 87908 - DNA, 201 bp, Bos taurus; identical to SEQ ID NO: 5997

SEQ ID NO: 87909 - DNA, 201 bp, Bos taurus; identical to SEQ ID NO: 5998

SEQ ID NO: 87910 - DNA, 201 bp, Bos taurus; identical to SEQ ID NO: 5999

SEQ ID NO: 87911 - DNA, 201 bp, Bos taurus; identical to SEQ ID NO: 6000

SEQ ID NO: 87912 - DNA, 201 bp, Bos taurus; identical to SEQ ID NO: 6002

SEQ ID NO: 87913 - DNA, 201 bp, Bos taurus; identical to SEQ ID NO: 6003

SEQ ID NO: 87914 - DNA, 201 bp, Bos taurus; identical to SEQ ID NO: 6004

SEQ ID NO: 87915 - DNA, 201 bp, Bos taurus; identical to SEQ ID NO: 6005

SEQ ID NO: 87916 - DNA, 201 bp, Bos taurus; identical to SEQ ID NO: 6006

SEQ ID NO: 87917 - DNA, 201 bp, Bos taurus; identical to SEQ ID NO: 6007

SEQ ID NO: 87918 - DNA, 201 bp, Bos taurus; identical to SEQ ID NO: 6008

SEQ ID NO: 87919 - DNA, 201 bp, Bos taurus; identical to SEQ ID NO: 6009

SEQ ID NO: 87920 - DNA, 201 bp, Bos taurus; identical to SEQ ID NO: 6011

SEQ ID NO: 87921 - DNA, 201 bp, Bos taurus; identical to SEQ ID NO: 6012

SEQ ID NO: 87922 - DNA, 201 bp, Bos taurus
aagtcttgtccagtagaggagctcagctttcaacccagaaagactggccagtctcttaaccgtggacccagagttccaccaggttctgccaacagatggatggcttgaccatcttgccgggggcctgattctcctcccagtagcagacagtgatttttgaacatgagcaattcaaaaatcactttgtgaaagacagtcatg

SEQ ID NO: 87923 - DNA, 201 bp, Bos taurus; identical to SEQ ID NO: 6013

SEQ ID NO: 87924 - DNA, 201 bp, Bos taurus; identical to SEQ ID NO: 6015

SEQ ID NO: 87925 - DNA, 201 bp, Bos taurus; identical to SEQ ID NO: 6016

SEQ ID NO: 87926 - DNA, 201 bp, Bos taurus; identical to SEQ ID NO: 6017

SEQ ID NO: 87927 - DNA, 201 bp, Bos taurus; identical to SEQ ID NO: 6018

SEQ ID NO: 87928 - DNA, 201 bp, Bos taurus; identical to SEQ ID NO: 6020

SEQ ID NO: 87929 - DNA, 201 bp, Bos taurus; identical to SEQ ID NO: 6021

SEQ ID NO: 87930 - DNA, 201 bp, Bos taurus; identical to SEQ ID NO: 6022

SEQ ID NO: 87931 - DNA, 201 bp, Bos taurus
agctctagctccgcgtccaactctaagagcaatcgatgctgaaacagtcccccaaaggcagcacggaaggggcagaactgagagtggccttgaaaggcccgggaaggttgaaatgggctgtgatgaagaaagtcaacttcctggaggaagttactaagagcaggagtcaggctcaggggccaaagcagaaatgaagaacac

SEQ ID NO: 87932 - DNA, 201 bp, Bos taurus; identical to SEQ ID NO: 6023

SEQ ID NO: 87933 - DNA, 201 bp, Bos taurus; identical to SEQ ID NO: 6024

SEQ ID NO: 87934 - DNA, 201 bp, Bos taurus; identical to SEQ ID NO: 6026

SEQ ID NO: 87935 - DNA, 201 bp, Bos taurus; identical to SEQ ID NO: 6027

SEQ ID NO: 87936 - DNA, 201 bp, Bos taurus; identical to SEQ ID NO: 6028

SEQ ID NO: 87937 - DNA, 201 bp, Bos taurus; identical to SEQ ID NO: 6029

SEQ ID NO: 87938 - DNA, 201 bp, Bos taurus
tcaggcctgattggcaggagagtatttccaggggttgtactgaaaagaggacctttatggttcagaacatccactttttgagacaggtttgaaaccgtgcatggcctgctcctcaccgcagctctctgtcgggaggacgtcacgcctcccgcgcacgcttctgaaagccttggtccttgtgcttcggtccccacggtgacg

SEQ ID NO: 87939 - DNA, 201 bp, Bos taurus; identical to SEQ ID NO: 6032

SEQ ID NO: 87940 - DNA, 201 bp, Bos taurus; identical to SEQ ID NO: 6033

SEQ ID NO: 87941 - DNA, 201 bp, Bos taurus; identical to SEQ ID NO: 6036

SEQ ID NO: 87942 - DNA, 201 bp, Bos taurus
aatggctcaggatgactctgcttgttctttgacacatggcatggggtttggggcctgagccttcacagcgcctgctccttcccttcttccttggcctccaaaacctccttccacagaaacagagtcttctattcctcacctgtcttcagtctccatccttcacctggcccgccacctatttgaaccattcaacttttgctc

SEQ ID NO: 87943 - DNA, 201 bp, Bos taurus; identical to SEQ ID NO: 6037

SEQ ID NO: 87944 - DNA, 201 bp, Bos taurus; identical to SEQ ID NO: 6038

SEQ ID NO: 87945 - DNA, 201 bp, Bos taurus
taggcattttaataatggccaccctgaacccgtgtgaaggtggaacctcattgtagctttgattttcatttctctaatagtgctgtccatcatctttccatgtgcctgttggccacttgtattgatttggagaaatgtcggtctgtttaggtcttctgatcatttttctattgggtttgtttttgttattgttgagttgta

SEQ ID NO: 87946 - DNA, 201 bp, Bos taurus; identical to SEQ ID NO: 6040

SEQ ID NO: 87947 - DNA, 201 bp, Bos taurus; identical to SEQ ID NO: 6041

SEQ ID NO: 87948 - DNA, 201 bp, Bos taurus; identical to SEQ ID NO: 6042

SEQ ID NO: 87949 - DNA, 201 bp, Bos taurus; identical to SEQ ID NO: 6043

SEQ ID NO: 87950 - DNA, 201 bp, Bos taurus; identical to SEQ ID NO: 6044

SEQ ID NO: 87951 - DNA, 201 bp, Bos taurus; identical to SEQ ID NO: 6046

SEQ ID NO: 87952 - DNA, 201 bp, Bos taurus
cttgtttaaatacttcttgatatagacactcattaatgatattcctctttcctcaagcacctgttcctggtaaaaacaagggctatattgatttgctgcagtttatcttctcccaggatttttgtcttgacagtgtgagaagattaattggaattaatggcatttgcacagctaattaaagtcactcttcctaaagtcaaa

SEQ ID NO: 87953 - DNA, 201 bp, Bos taurus; identical to SEQ ID NO: 6047

SEQ ID NO: 87954 - DNA, 201 bp, Bos taurus
tcagccagggactcctcggcatcttaaaggatgcccctaacaaatcctcatatagattctatggaaaagatatggttgtaattctaattcttaagtttgaacatgaggcctgttcttcttttcacagcatgtaaggaggttgctcatagttgaataaaataaaaatgaaataaaattatgtgtcatcttagttcgcaacgc

SEQ ID NO: 87955 - DNA, 201 bp, Bos taurus
cagctgtcatctttagttatataagagctcgtcttttgcctttgggtgtgaggcatgggttagttagcttgccactgctacatttgctgctggcgcaagctcatcctggggcaaaggccacaccttgatatttaagcaaattcaagcctttgactgtgtggatcacaataaactgtggaaaattctgaaagagatgggagt

SEQ ID NO: 87956 - DNA, 201 bp, Bos taurus; identical to SEQ ID NO: 6050

SEQ ID NO: 87957 - DNA, 201 bp, Bos taurus
aattttttaaatataaaggttaggtgctttccaacttctgtttaggatgttagcaagcaagaaagagcattactcccacatctataacaacaaccacagcattcaactcactatataatctaaaatgtcacagcttttccagaactcattagattcatggttacaggacaaccaactcaaccaaaatccaaggatgacaag

SEQ ID NO: 87958 - DNA, 201 bp, Bos taurus; identical to SEQ ID NO: 6051

SEQ ID NO: 87959 - DNA, 201 bp, Bos taurus
taactttgttctacttgatttgggaagtatgttgatgtttcaagttattggtttaatggaaatacatttgatgttcatcatgactattcataagcacaagcgcaggaaaataaataagatctctggcctgggcagttgttgttgagacattattatcccatggctccaaacccatgtactctgaacttcactgaatgtgac

SEQ ID NO: 87960 - DNA, 201 bp, Bos taurus
ctgattagcccgttttccttagttatgaccagacaaaaaactcactgtaacaggctaccagtgaggtggacactcagctgttggcctggttcagtgtctgatggctttgctcatgctagtcttcttcttcatgcccgcactgggcagcacccattctgcctgcagtgactggccttttgagacaccttggaccattttgct

SEQ ID NO: 87961 - DNA, 201 bp, Bos taurus; identical to SEQ ID NO: 6052

SEQ ID NO: 87962 - DNA, 201 bp, Bos taurus; identical to SEQ ID NO: 6054

SEQ ID NO: 87963 - DNA, 201 bp, Bos taurus; identical to SEQ ID NO: 6055

SEQ ID NO: 87964 - DNA, 201 bp, Bos taurus
gtcatatttttagatatgatcataagaaaatgacttgtgatattccaggatcacctccctactccactgaaacattaaaatatgtttcaattaactaaacagtagattttatttgatagctttcacattccatatatatttgtaattattcgataaacactttagacattaaaaaatattttaagtgacttaatgatataa

SEQ ID NO: 87965 - DNA, 201 bp, Bos taurus; identical to SEQ ID NO: 6057

SEQ ID NO: 87966 - DNA, 201 bp, Bos taurus
cctacaaaatttttactgataggatgtgggtttgactctcatgtgagattcagtggtgaaggagtcagttcttggtgaacacacgcacacagaatatttcctcactcaaggaaactcagaatatatctattgggtagaagtttctgtgtaacaaaatgattaacattcactccaagaactcatcagcaaatgcctgctgcc

SEQ ID NO: 87967 - DNA, 201 bp, Bos taurus
accaaagactcaaggcagttacaacatctctgtgtttcaggagtctcacttcacagatttactttaagaatgaaattgctcacagtggtgaagatctttgaagtttgcaaagcacgtctgcattatgcatttgcagaaatgaatctgaaaaggtcaaagatagttgaagtctttgagcccagacttaggagtttgaaatag

SEQ ID NO: 87968 - DNA, 201 bp, Bos taurus
gaccccgaatccatccagcagtcagccaacagtaacccatgggggccactggggttctgtagtcagcttcccatgaccaagtggtaccaaccagtagccagtagccttcacacacggcagggcctagcaacaaaccaaaccaggaataagtcaagcctaccagactgctgacatagtctgctcaccacaacaggactcaga

SEQ ID NO: 87969 - DNA, 201 bp, Bos taurus
gcgagaatgttcagaaatgactcaaaccttaagtaaaagcctctactagatggtttttaaaattttgttggccattatgaatccatatcaagtttttttaaatgtattttagggtttttgccttcttattggagcatagcatttttatgcacatataccttcacatccaattagtagctctaatcagaacagacaggtaaa

SEQ ID NO: 87970 - DNA, 201 bp, Bos taurus; identical to SEQ ID NO: 6059

SEQ ID NO: 87971 - DNA, 201 bp, Bos taurus; identical to SEQ ID NO: 6061

SEQ ID NO: 87972 - DNA, 201 bp, Bos taurus; identical to SEQ ID NO: 6063

SEQ ID NO: 87973 - DNA, 201 bp, Bos taurus; identical to SEQ ID NO: 6064

SEQ ID NO: 87974 - DNA, 201 bp, Bos taurus
ttgcagcctagagaagtaggtgtatccagcttccaacctcattttaaagcaaagcatctcccctttcatcaggctaatgcacaacatggtgcttcagaacagttcccaggactggtgcagtttgacaatcactgattcagagttacatttgtgtattttctctgggtttgacttattcacgatatcccatcactcataaat

SEQ ID NO: 87975 - DNA, 201 bp, Bos taurus
tttctgggggcccggcagcccactgggtaaactataaaatcttcgctgctaactccttacactaactttacggagcccgtttttgagcaaaggggatagaacaagaaggccccgcccctcctctcgccggcctcctgcgtttacgtaatcgtatttcgaaaacgccaagacgtacctacggcgtcccacgaggaaatgcta

SEQ ID NO: 87976 - DNA, 201 bp, Bos taurus; identical to SEQ ID NO: 6065

SEQ ID NO: 87977 - DNA, 201 bp, Bos taurus; identical to SEQ ID NO: 6069

SEQ ID NO: 87978 - DNA, 201 bp, Bos taurus
gtctttgagtagtttttttttgtttgtttgtttttaagtatctttgcatgcagagagagctccttttgtgatggatgccctggccatgatttgccttttggtagttagatgcataagctattcccgaccgttttgggtttggcacttctgtgctacccttcctctcatgcttcatgcctagctgcatttaacttgacaggc

SEQ ID NO: 87979 - DNA, 201 bp, Bos taurus
cctgcttcgggcactgtgccgcccgtgttcctttacaaggcctggctcccagctgtttcacggtggaggcatctgacactctgataaatgaacaggccattggatattccatccaacagagggcagtggctcactgaaactctcacatatttgctctgaaaatagattttcctgaaactttccacttaaatagctgggatt

SEQ ID NO: 87980 - DNA, 201 bp, Bos taurus
gtaacaaatatgttctcccaaaagctgtgtgcacatctgctcatattgtacatgaggaaatgttcagtgaatctttttgtaaaaggaagacttccttcttagcataatgtgcttaattttctctctgtaggagaactctatgtcagttagaaaccagtttgtttagtcggattgactggtagatgctaagctccttgagtg

SEQ ID NO: 87981 - DNA, 201 bp, Bos taurus; identical to SEQ ID NO: 6070

SEQ ID NO: 87982 - DNA, 201 bp, Bos taurus; identical to SEQ ID NO: 6071

SEQ ID NO: 87983 - DNA, 201 bp, Bos taurus; identical to SEQ ID NO: 6072

SEQ ID NO: 87984 - DNA, 201 bp, Bos taurus
gcctcagtgggggacagtgggccatagagttcttagtgaagaggcacagtggaggcaaggatccaatcaaaccgtgcgtttctgatctccacgtgcaggcaagggagcaaaggcatgggcctgagagcctcatcacgaaaggattgcaggctggagctacagctggggctgaggcaaagcgttattagaggaaaagagaac

SEQ ID NO: 87985 - DNA, 201 bp, Bos taurus; identical to SEQ ID NO: 6074

SEQ ID NO: 87986 - DNA, 201 bp, Bos taurus
catacactaaggttcttgcttaattaccagcgtgtttctcagaagagctttctatctgccaatttactatcttggtagcatgtgaaatgggcttcccaggcggcgctagtggtaaagaacccacctgccaatccaggcgatgtaagagacatggatttgatcccagagcggggaaggaggagaccatggcaaccctatcca

SEQ ID NO: 87987 - DNA, 201 bp, Bos taurus; identical to SEQ ID NO: 6077

SEQ ID NO: 87988 - DNA, 201 bp, Bos taurus; identical to SEQ ID NO: 6078

SEQ ID NO: 87989 - DNA, 201 bp, Bos taurus; identical to SEQ ID NO: 6079

SEQ ID NO: 87990 - DNA, 201 bp, Bos taurus; identical to SEQ ID NO: 6080

SEQ ID NO: 87991 - DNA, 201 bp, Bos taurus; identical to SEQ ID NO: 6081

SEQ ID NO: 87992 - DNA, 201 bp, Bos taurus; identical to SEQ ID NO: 6083

SEQ ID NO: 87993 - DNA, 201 bp, Bos taurus
agtggtcttagggaactgatctgaaggggaggcactatgctacccttcttttctcctccaactgtacaggttttcactttccttcagtctcacctcctcttagcatgaaactttactaaaggctctgaggtcttcacacaatagttttctaccagcctcaccccaagtatctgccaggcgtaataggcaagtctaattttt

SEQ ID NO: 87994 - DNA, 201 bp, Bos taurus; identical to SEQ ID NO: 6084

SEQ ID NO: 87995 - DNA, 201 bp, Bos taurus
caattgctgtagtaaaggaagccttaagcatcttcctgctgcacctttgggtgacagatgctgatgtaggttgaatgtagaggcaggtgttctgtggcctatttccacctttacattatttcagattctgtgttactgagtagagcagtcttcctttaaaattttaggtcccatttcttggcctcttgccttgtctattgg

SEQ ID NO: 87996 - DNA, 201 bp, Bos taurus
ctggtgcgaactgcactgccctgggatcaggaggcctgagcatctggcctcattctgttgtgtacaagctctgtgtcctctctagtttcagtgcatgtgagtaccaagcgttgccacatggccgaggctaaggagatgctacctattagtactagtatttctgttattgctgctttacttgtattaatattttcgagatcg

SEQ ID NO: 87997 - DNA, 201 bp, Bos taurus; identical to SEQ ID NO: 6087

SEQ ID NO: 87998 - DNA, 201 bp, Bos taurus; identical to SEQ ID NO: 6091

SEQ ID NO: 87999 - DNA, 201 bp, Bos taurus; identical to SEQ ID NO: 6092

SEQ ID NO: 88000 - DNA, 201 bp, Bos taurus; identical to SEQ ID NO: 6093

SEQ ID NO: 88001 - DNA, 201 bp, Bos taurus; identical to SEQ ID NO: 6094

SEQ ID NO: 88002 - DNA, 201 bp, Bos taurus; identical to SEQ ID NO: 6095

SEQ ID NO: 88003 - DNA, 201 bp, Bos taurus; identical to SEQ ID NO: 6096

SEQ ID NO: 88004 - DNA, 201 bp, Bos taurus; identical to SEQ ID NO: 6097

SEQ ID NO: 88005 - DNA, 201 bp, Bos taurus; identical to SEQ ID NO: 6098

SEQ ID NO: 88006 - DNA, 201 bp, Bos taurus
agtatgggttcttttctgtcttctgaaaggtaagatatggataaaagtatattactggccaactaacttattgctgtaagaattgggaggcatgaaaaaattctaaccctggggaaaatgctatctctgcaccctcttccttttcactatatatttatttttaggcataattgtgggcccggtgcccagtgttttccagaa

SEQ ID NO: 88007 - DNA, 201 bp, Bos taurus; identical to SEQ ID NO: 6100

SEQ ID NO: 88008 - DNA, 201 bp, Bos taurus; identical to SEQ ID NO: 6101

SEQ ID NO: 88009 - DNA, 201 bp, Bos taurus; identical to SEQ ID NO: 6102

SEQ ID NO: 88010 - DNA, 201 bp, Bos taurus; identical to SEQ ID NO: 6103

SEQ ID NO: 88011 - DNA, 201 bp, Bos taurus; identical to SEQ ID NO: 6104

SEQ ID NO: 88012 - DNA, 201 bp, Bos taurus; identical to SEQ ID NO: 6105

SEQ ID NO: 88013 - DNA, 201 bp, Bos taurus
attcatgatagattggcaggtggtcagtggatgatgggctgaagccactctgagtccttttgcttttttcattttttattagagaaacttgtaaggtcaggtgagatgcctcattcatcatttacttctgatgtcagtttggggaaattttcccaaagtgggctacaggagatagcctaatgttaaaatcctgtcttcagt

SEQ ID NO: 88014 - DNA, 201 bp, Bos taurus; identical to SEQ ID NO: 6107

SEQ ID NO: 88015 - DNA, 201 bp, Bos taurus; identical to SEQ ID NO: 6108

SEQ ID NO: 88016 - DNA, 201 bp, Bos taurus
gtctgtgtacacacagtgctgaggaggcacagggtgacagtgtgattggtctaaatattactcctctgatgtctaagtcttgtggtgcaaagcagaacacttgcctacctgcctgtgcccaaatgcaaaaagtgatggagctggaagccatagaaggaataggtatctcctgtggtcaccaactccctctgagcttctgtg

SEQ ID NO: 88017 - DNA, 201 bp, Bos taurus; identical to SEQ ID NO: 6110

SEQ ID NO: 88018 - DNA, 201 bp, Bos taurus; identical to SEQ ID NO: 6111

SEQ ID NO: 88019 - DNA, 201 bp, Bos taurus; identical to SEQ ID NO: 6112

SEQ ID NO: 88020 - DNA, 201 bp, Bos taurus; identical to SEQ ID NO: 6113

SEQ ID NO: 88021 - DNA, 201 bp, Bos taurus; identical to SEQ ID NO: 6114

SEQ ID NO: 88022 - DNA, 201 bp, Bos taurus; identical to SEQ ID NO: 6118

SEQ ID NO: 88023 - DNA, 201 bp, Bos taurus; identical to SEQ ID NO: 6119

SEQ ID NO: 88024 - DNA, 201 bp, Bos taurus; identical to SEQ ID NO: 6120

SEQ ID NO: 88025 - DNA, 201 bp, Bos taurus; identical to SEQ ID NO: 6123

SEQ ID NO: 88026 - DNA, 201 bp, Bos taurus
agactaggactcagatctcctgtcccaccggcagtctcccaccacacacttctttttcttcaccatgtctcggctgggcctctccagactctattggtacgtgtagtctggcatcacctctagtcagctcttaattattctgaggtgggtgactagtctggcaatgaatcagcccttctcaaatctgttctcggccttggg

SEQ ID NO: 88027 - DNA, 201 bp, Bos taurus
aaaacacttaagaactccacggtctgaaattggaagacttagaaacaaatgagaacctcaaggtcaagactattaaatgcctacaaagtgacctgatggataaaattgattctctgcttgtacttgttccactatccattccttttcaactacatatgaacaatttgggcacatgtatttttacattcccagcaatgacaa

SEQ ID NO: 88028 - DNA, 201 bp, Bos taurus
tgcaccccaaagctgcattttgaaaacaattttaaactgaagagggggtaatgaaatctcaccctgaaaaacagtgccataaattgagtcctcgatgtgaaagtgtttctttggcataggtaatgtatttttgtaaccttagttttacaattcaacacttctgctctatgctaatctttcattataaaaacattctgaagg

SEQ ID NO: 88029 - DNA, 201 bp, Bos taurus
ctattcctataactctcgtggctgattaaaaagcaaaagataaaaccctgcaaagaacatctcactggctttgcctttcactcgacttctaagaagttttagttttcttttgcaggtaattctttaacatttacacaggcactggtattcattatacactgaaaaagaaagacaaaagtaatgtatcctcagctagatcat

SEQ ID NO: 88030 - DNA, 201 bp, Bos taurus
gtgcttcatgtacataattccattgtattcctcacatcttcacaggtgatgaaagagactctggtaatcactaaacccaggccactcatcagtgccagagttgggattttaaattcagttatatcggattcctaaacttatattccttttactctgtccagcagcctcttgatagagtcatgctgagctcaggtactccag

SEQ ID NO: 88031 - DNA, 201 bp, Bos taurus; identical to SEQ ID NO: 6125

SEQ ID NO: 88032 - DNA, 201 bp, Bos taurus; identical to SEQ ID NO: 6128

SEQ ID NO: 88033 - DNA, 201 bp, Bos taurus; identical to SEQ ID NO: 6129

SEQ ID NO: 88034 - DNA, 201 bp, Bos taurus; identical to SEQ ID NO: 6130

SEQ ID NO: 88035 - DNA, 201 bp, Bos taurus; identical to SEQ ID NO: 6131

SEQ ID NO: 88036 - DNA, 201 bp, Bos taurus; identical to SEQ ID NO: 6132

SEQ ID NO: 88037 - DNA, 201 bp, Bos taurus; identical to SEQ ID NO: 6134

SEQ ID NO: 88038 - DNA, 201 bp, Bos taurus; identical to SEQ ID NO: 6135

SEQ ID NO: 88039 - DNA, 201 bp, Bos taurus; identical to SEQ ID NO: 6136

SEQ ID NO: 88040 - DNA, 201 bp, Bos taurus; identical to SEQ ID NO: 6137

SEQ ID NO: 88041 - DNA, 201 bp, Bos taurus; identical to SEQ ID NO: 6139

SEQ ID NO: 88042 - DNA, 201 bp, Bos taurus; identical to SEQ ID NO: 6140

SEQ ID NO: 88043 - DNA, 201 bp, Bos taurus; identical to SEQ ID NO: 6141

SEQ ID NO: 88044 - DNA, 201 bp, Bos taurus; identical to SEQ ID NO: 6142

SEQ ID NO: 88045 - DNA, 201 bp, Bos taurus; identical to SEQ ID NO: 6143

SEQ ID NO: 88046 - DNA, 201 bp, Bos taurus; identical to SEQ ID NO: 6144

SEQ ID NO: 88047 - DNA, 201 bp, Bos taurus; identical to SEQ ID NO: 6145

SEQ ID NO: 88048 - DNA, 201 bp, Bos taurus; identical to SEQ ID NO: 6146

SEQ ID NO: 88049 - DNA, 201 bp, Bos taurus; identical to SEQ ID NO: 6147

SEQ ID NO: 88050 - DNA, 201 bp, Bos taurus
atttattattcttatgttttgacttgttctgtaaattcttttgaatttttttttcttttttctcctttttatccccctctgttatagctgtcgattttaatggcactatgaaatttaattaacttttcagctttttttttaatatcacctggtcatcctcctttttggaacctagaatgactcacagtcatctctgagaac

SEQ ID NO: 88051 - DNA, 201 bp, Bos taurus; identical to SEQ ID NO: 6148

SEQ ID NO: 88052 - DNA, 201 bp, Bos taurus
agtcagtgtaattatactttatttaactttgcatcaagaatattcaatttatttttacaaatgactctttttaggttgataaaatctaaaaagtgaagttttattgtttatttcctagaattataagctaagtttgaggctatcactgagtcagctgttgaaaagtgaaaatcatatagaagtaatgcttagtggtggtct

SEQ ID NO: 88053 - DNA, 201 bp, Bos taurus
acttgtgaaataaactttactcaagggagaacaagaagggcagtcatttcttaaaagactccaaatgaaacagccaatgagctaaaagcaggagccaacaatggtgtaggaggggacccatgggattcggtttcttttactagtctgatgcaaagcagttcccagtggaaatctcagactgcagagctaagctcagtagtt

SEQ ID NO: 88054 - DNA, 201 bp, Bos taurus
tcaacttggtaggtgttgtggccagagaccgaggagctagagcaagagccaggtgtgagccagggcttctctgctcagttgccaacaccaccaccctactggggtagggccatgtcccaaggtactggagcaatggccgtgagggtggggcccaagccagctctatcccccacaactgggcactctcctcagctatggcag

SEQ ID NO: 88055 - DNA, 201 bp, Bos taurus; identical to SEQ ID NO: 6154

SEQ ID NO: 88056 - DNA, 201 bp, Bos taurus; identical to SEQ ID NO: 6155

SEQ ID NO: 88057 - DNA, 201 bp, Bos taurus; identical to SEQ ID NO: 6156

SEQ ID NO: 88058 - DNA, 201 bp, Bos taurus; identical to SEQ ID NO: 6157

SEQ ID NO: 88059 - DNA, 201 bp, Bos taurus; identical to SEQ ID NO: 6158

SEQ ID NO: 88060 - DNA, 201 bp, Bos taurus; identical to SEQ ID NO: 6159

SEQ ID NO: 88061 - DNA, 201 bp, Bos taurus; identical to SEQ ID NO: 6160

SEQ ID NO: 88062 - DNA, 201 bp, Bos taurus; identical to SEQ ID NO: 6163

SEQ ID NO: 88063 - DNA, 201 bp, Bos taurus; identical to SEQ ID NO: 6165

SEQ ID NO: 88064 - DNA, 201 bp, Bos taurus; identical to SEQ ID NO: 6166

SEQ ID NO: 88065 - DNA, 201 bp, Bos taurus; identical to SEQ ID NO: 6167

SEQ ID NO: 88066 - DNA, 201 bp, Bos taurus; identical to SEQ ID NO: 6169

SEQ ID NO: 88067 - DNA, 201 bp, Bos taurus; identical to SEQ ID NO: 6170

SEQ ID NO: 88068 - DNA, 201 bp, Bos taurus; identical to SEQ ID NO: 6171

SEQ ID NO: 88069 - DNA, 201 bp, Bos taurus; identical to SEQ ID NO: 6172

SEQ ID NO: 88070 - DNA, 201 bp, Bos taurus; identical to SEQ ID NO: 6173

SEQ ID NO: 88071 - DNA, 201 bp, Bos taurus; identical to SEQ ID NO: 6176

SEQ ID NO: 88072 - DNA, 201 bp, Bos taurus; identical to SEQ ID NO: 6179

SEQ ID NO: 88073 - DNA, 201 bp, Bos taurus; identical to SEQ ID NO: 6186

SEQ ID NO: 88074 - DNA, 201 bp, Bos taurus; identical to SEQ ID NO: 6187

SEQ ID NO: 88075 - DNA, 201 bp, Bos taurus; identical to SEQ ID NO: 6188

SEQ ID NO: 88076 - DNA, 201 bp, Bos taurus
tactcacaaatcaagccattgaagaaaacagaagaggacactgaatacacctgtgagcccctgggagatttcagatacctattcagaactacaaatgagtaccgctctaatgaacacctccataattaagtttctagggataagatttctcaggacagctcttacgagccaacacagcttggcaggggttatactccaaaa

SEQ ID NO: 88077 - DNA, 201 bp, Bos taurus; identical to SEQ ID NO: 6189

SEQ ID NO: 88078 - DNA, 201 bp, Bos taurus; identical to SEQ ID NO: 6190

SEQ ID NO: 88079 - DNA, 201 bp, Bos taurus; identical to SEQ ID NO: 6192

SEQ ID NO: 88080 - DNA, 201 bp, Bos taurus; identical to SEQ ID NO: 6194

SEQ ID NO: 88081 - DNA, 201 bp, Bos taurus; identical to SEQ ID NO: 6195

SEQ ID NO: 88082 - DNA, 201 bp, Bos taurus; identical to SEQ ID NO: 6196

SEQ ID NO: 88083 - DNA, 201 bp, Bos taurus; identical to SEQ ID NO: 6197

SEQ ID NO: 88084 - DNA, 201 bp, Bos taurus; identical to SEQ ID NO: 6199

SEQ ID NO: 88085 - DNA, 201 bp, Bos taurus; identical to SEQ ID NO: 6201

SEQ ID NO: 88086 - DNA, 201 bp, Bos taurus; identical to SEQ ID NO: 6204

SEQ ID NO: 88087 - DNA, 201 bp, Bos taurus; identical to SEQ ID NO: 6205

SEQ ID NO: 88088 - DNA, 201 bp, Bos taurus; identical to SEQ ID NO: 6206

SEQ ID NO: 88089 - DNA, 201 bp, Bos taurus; identical to SEQ ID NO: 6207

SEQ ID NO: 88090 - DNA, 201 bp, Bos taurus; identical to SEQ ID NO: 6208

SEQ ID NO: 88091 - DNA, 201 bp, Bos taurus; identical to SEQ ID NO: 6209

SEQ ID NO: 88092 - DNA, 201 bp, Bos taurus; identical to SEQ ID NO: 6210

SEQ ID NO: 88093 - DNA, 201 bp, Bos taurus; identical to SEQ ID NO: 6211

SEQ ID NO: 88094 - DNA, 201 bp, Bos taurus; identical to SEQ ID NO: 6212

SEQ ID NO: 88095 - DNA, 201 bp, Bos taurus; identical to SEQ ID NO: 6214

SEQ ID NO: 88096 - DNA, 201 bp, Bos taurus; identical to SEQ ID NO: 6215

SEQ ID NO: 88097 - DNA, 201 bp, Bos taurus; identical to SEQ ID NO: 6217

SEQ ID NO: 88098 - DNA, 201 bp, Bos taurus; identical to SEQ ID NO: 6218

SEQ ID NO: 88099 - DNA, 201 bp, Bos taurus; identical to SEQ ID NO: 6222

SEQ ID NO: 88100 - DNA, 201 bp, Bos taurus; identical to SEQ ID NO: 6223

SEQ ID NO: 88101 - DNA, 201 bp, Bos taurus; identical to SEQ ID NO: 6224

SEQ ID NO: 88102 - DNA, 201 bp, Bos taurus; identical to SEQ ID NO: 6225

SEQ ID NO: 88103 - DNA, 201 bp, Bos taurus; identical to SEQ ID NO: 6226

SEQ ID NO: 88104 - DNA, 201 bp, Bos taurus; identical to SEQ ID NO: 6231

SEQ ID NO: 88105 - DNA, 201 bp, Bos taurus; identical to SEQ ID NO: 6233

SEQ ID NO: 88106 - DNA, 201 bp, Bos taurus; identical to SEQ ID NO: 6238

SEQ ID NO: 88107 - DNA, 201 bp, Bos taurus; identical to SEQ ID NO: 6239

SEQ ID NO: 88108 - DNA, 201 bp, Bos taurus; identical to SEQ ID NO: 6244

SEQ ID NO: 88109 - DNA, 201 bp, Bos taurus; identical to SEQ ID NO: 6245

SEQ ID NO: 88110 - DNA, 201 bp, Bos taurus; identical to SEQ ID NO: 6246

SEQ ID NO: 88111 - DNA, 201 bp, Bos taurus; identical to SEQ ID NO: 6247

SEQ ID NO: 88112 - DNA, 201 bp, Bos taurus; identical to SEQ ID NO: 6251

SEQ ID NO: 88113 - DNA, 201 bp, Bos taurus; identical to SEQ ID NO: 6252

SEQ ID NO: 88114 - DNA, 201 bp, Bos taurus; identical to SEQ ID NO: 6253

SEQ ID NO: 88115 - DNA, 201 bp, Bos taurus; identical to SEQ ID NO: 6254

SEQ ID NO: 88116 - DNA, 201 bp, Bos taurus; identical to SEQ ID NO: 6255

SEQ ID NO: 88117 - DNA, 201 bp, Bos taurus; identical to SEQ ID NO: 6262

SEQ ID NO: 88118 - DNA, 201 bp, Bos taurus; identical to SEQ ID NO: 6264

SEQ ID NO: 88119 - DNA, 201 bp, Bos taurus; identical to SEQ ID NO: 6265

SEQ ID NO: 88120 - DNA, 201 bp, Bos taurus; identical to SEQ ID NO: 6266

SEQ ID NO: 88121 - DNA, 201 bp, Bos taurus; identical to SEQ ID NO: 6267

SEQ ID NO: 88122 - DNA, 201 bp, Bos taurus; identical to SEQ ID NO: 6268

SEQ ID NO: 88123 - DNA, 201 bp, Bos taurus; identical to SEQ ID NO: 6270

SEQ ID NO: 88124 - DNA, 201 bp, Bos taurus; identical to SEQ ID NO: 6271

SEQ ID NO: 88125 - DNA, 201 bp, Bos taurus; identical to SEQ ID NO: 6272

SEQ ID NO: 88126 - DNA, 201 bp, Bos taurus; identical to SEQ ID NO: 6275

SEQ ID NO: 88127 - DNA, 201 bp, Bos taurus; identical to SEQ ID NO: 6276

SEQ ID NO: 88128 - DNA, 201 bp, Bos taurus; identical to SEQ ID NO: 6277

SEQ ID NO: 88129 - DNA, 201 bp, Bos taurus; identical to SEQ ID NO: 6278

SEQ ID NO: 88130 - DNA, 201 bp, Bos taurus; identical to SEQ ID NO: 6279

SEQ ID NO: 88131 - DNA, 201 bp, Bos taurus; identical to SEQ ID NO: 6281

SEQ ID NO: 88132 - DNA, 201 bp, Bos taurus; identical to SEQ ID NO: 6282

SEQ ID NO: 88133 - DNA, 201 bp, Bos taurus; identical to SEQ ID NO: 6284

SEQ ID NO: 88134 - DNA, 201 bp, Bos taurus; identical to SEQ ID NO: 6285

SEQ ID NO: 88135 - DNA, 201 bp, Bos taurus; identical to SEQ ID NO: 6287

SEQ ID NO: 88136 - DNA, 201 bp, Bos taurus; identical to SEQ ID NO: 6290

SEQ ID NO: 88137 - DNA, 201 bp, Bos taurus; identical to SEQ ID NO: 6292

SEQ ID NO: 88138 - DNA, 201 bp, Bos taurus; identical to SEQ ID NO: 6293

SEQ ID NO: 88139 - DNA, 201 bp, Bos taurus; identical to SEQ ID NO: 6295

SEQ ID NO: 88140 - DNA, 201 bp, Bos taurus; identical to SEQ ID NO: 6296

SEQ ID NO: 88141 - DNA, 201 bp, Bos taurus; identical to SEQ ID NO: 6297

SEQ ID NO: 88142 - DNA, 201 bp, Bos taurus; identical to SEQ ID NO: 6298

SEQ ID NO: 88143 - DNA, 201 bp, Bos taurus; identical to SEQ ID NO: 6300

SEQ ID NO: 88144 - DNA, 201 bp, Bos taurus; identical to SEQ ID NO: 6301

SEQ ID NO: 88145 - DNA, 201 bp, Bos taurus; identical to SEQ ID NO: 6303

SEQ ID NO: 88146 - DNA, 201 bp, Bos taurus; identical to SEQ ID NO: 6304

SEQ ID NO: 88147 - DNA, 201 bp, Bos taurus; identical to SEQ ID NO: 6307

SEQ ID NO: 88148 - DNA, 201 bp, Bos taurus; identical to SEQ ID NO: 6308

SEQ ID NO: 88149 - DNA, 201 bp, Bos taurus; identical to SEQ ID NO: 6309

SEQ ID NO: 88150 - DNA, 201 bp, Bos taurus; identical to SEQ ID NO: 6310

SEQ ID NO: 88151 - DNA, 201 bp, Bos taurus; identical to SEQ ID NO: 6311

SEQ ID NO: 88152 - DNA, 201 bp, Bos taurus; identical to SEQ ID NO: 6312

SEQ ID NO: 88153 - DNA, 201 bp, Bos taurus; identical to SEQ ID NO: 6313

SEQ ID NO: 88154 - DNA, 201 bp, Bos taurus; identical to SEQ ID NO: 6315

SEQ ID NO: 88155 - DNA, 201 bp, Bos taurus; identical to SEQ ID NO: 6316

SEQ ID NO: 88156 - DNA, 201 bp, Bos taurus; identical to SEQ ID NO: 6317

SEQ ID NO: 88157 - DNA, 201 bp, Bos taurus; identical to SEQ ID NO: 6318

SEQ ID NO: 88158 - DNA, 201 bp, Bos taurus; identical to SEQ ID NO: 6319

SEQ ID NO: 88159 - DNA, 201 bp, Bos taurus; identical to SEQ ID NO: 6320

SEQ ID NO: 88160 - DNA, 201 bp, Bos taurus; identical to SEQ ID NO: 6321

SEQ ID NO: 88161 - DNA, 201 bp, Bos taurus; identical to SEQ ID NO: 6323

SEQ ID NO: 88162 - DNA, 201 bp, Bos taurus; identical to SEQ ID NO: 6324

SEQ ID NO: 88163 - DNA, 201 bp, Bos taurus; identical to SEQ ID NO: 6325

SEQ ID NO: 88164 - DNA, 201 bp, Bos taurus; identical to SEQ ID NO: 6326

SEQ ID NO: 88165 - DNA, 201 bp, Bos taurus; identical to SEQ ID NO: 6327

SEQ ID NO: 88166 - DNA, 201 bp, Bos taurus; identical to SEQ ID NO: 6328

SEQ ID NO: 88167 - DNA, 201 bp, Bos taurus
tgttacaagtctttcatttaaaagatgaaaaattaagggccaacaaaattaagtgacttgtccagggtcacacagcctgttgttagcacagctgagacaagatccatgtcaactaactcccaggtgaatgttgctttaatttttgtttttagggacttttgagtgctttattaaaatggatcttttggagtctttaaaaga

SEQ ID NO: 88168 - DNA, 201 bp, Bos taurus; identical to SEQ ID NO: 6329

SEQ ID NO: 88169 - DNA, 201 bp, Bos taurus; identical to SEQ ID NO: 6330

SEQ ID NO: 88170 - DNA, 201 bp, Bos taurus; identical to SEQ ID NO: 6331

SEQ ID NO: 88171 - DNA, 201 bp, Bos taurus; identical to SEQ ID NO: 6332

SEQ ID NO: 88172 - DNA, 201 bp, Bos taurus; identical to SEQ ID NO: 6333

SEQ ID NO: 88173 - DNA, 201 bp, Bos taurus; identical to SEQ ID NO: 6334

SEQ ID NO: 88174 - DNA, 201 bp, Bos taurus; identical to SEQ ID NO: 6335

SEQ ID NO: 88175 - DNA, 201 bp, Bos taurus; identical to SEQ ID NO: 6336

SEQ ID NO: 88176 - DNA, 201 bp, Bos taurus; identical to SEQ ID NO: 6337

SEQ ID NO: 88177 - DNA, 201 bp, Bos taurus; identical to SEQ ID NO: 6338

SEQ ID NO: 88178 - DNA, 201 bp, Bos taurus
ataggccatgcttctcatccctttacattatccgagtgtttgactgtcccaagatgaatccaccttttcttaataaaatattgatgcttggagaggcttacccatcttgcccgaggccacacaaagccaacagtagaactacaaagttaaccatggaatcaagtattcctcctcccgttgaggatgttcatatttctctac

SEQ ID NO: 88179 - DNA, 201 bp, Bos taurus; identical to SEQ ID NO: 6340

SEQ ID NO: 88180 - DNA, 201 bp, Bos taurus
gtgccctgttatgaaaagttaaaacgaaaaatcacctgtgatgttttccaaggtgtttttcaactcattctaggagactgttaaaccaaacacattttaaacttaattcttttaaaacaataagtaaccttttgtttcctgttgaatcttccaattacagtccaattagtgtggccagataatttagatgtgttgattata

SEQ ID NO: 88181 - DNA, 201 bp, Bos taurus; identical to SEQ ID NO: 6345

SEQ ID NO: 88182 - DNA, 201 bp, Bos taurus; identical to SEQ ID NO: 6346

SEQ ID NO: 88183 - DNA, 201 bp, Bos taurus; identical to SEQ ID NO: 6347

SEQ ID NO: 88184 - DNA, 201 bp, Bos taurus; identical to SEQ ID NO: 6349

SEQ ID NO: 88185 - DNA, 201 bp, Bos taurus; identical to SEQ ID NO: 6353

SEQ ID NO: 88186 - DNA, 201 bp, Bos taurus; identical to SEQ ID NO: 6354

SEQ ID NO: 88187 - DNA, 201 bp, Bos taurus; identical to SEQ ID NO: 6356

SEQ ID NO: 88188 - DNA, 201 bp, Bos taurus
gtgacattctatcaagaactcaggcagcatatgttcccagttcattattctgcactgcctgtctgtgacatagtctagcctaactcttgtctgtttgcttttatgaagaatacatgctagatacttttacatatagctccagaaatacgctccttgcttttttaatataaactaatttaatgtgaaattgtttttcaaaat

SEQ ID NO: 88189 - DNA, 201 bp, Bos taurus
ttaacagagttgtttttatcaagattttagtaagatttttctttaattagtaactcattttctgttggagagctgatgggattgacccttgagctcacttgatctgtccttgacttcttaacatgttgattcaagttcctttatcaaagtttctctgaattcctcatttcttatttacttctcaccctgtgttgggattag

SEQ ID NO: 88190 - DNA, 201 bp, Bos taurus
aaactgtgataggtggaagttaagttcgtaaaatacagtttaggtagaaaatccactatattttaaggtttttaatggtctagtccaatgatttggccacagtatatagtaaacaacctgatcatatgagaaagaataaatctttccatacatctccatcagtttgttctacaggccaatctctgcttgtaagtgaagctg

SEQ ID NO: 88191 - DNA, 201 bp, Bos taurus; identical to SEQ ID NO: 6358

SEQ ID NO: 88192 - DNA, 201 bp, Bos taurus
ctctctttcagcttctgtgcattagccctctacccctaactgctcctgcaccacactgctgcctcatcagatcctcccatccttcaaggcccagatacaggcatcatcccctacagcaagtgttttccacctactgccttccttctctgcctgactaacttggaatctgccaggcagaattaatttcgttatttcaacaat

SEQ ID NO: 88193 - DNA, 201 bp, Bos taurus
agaaagtcaggaaagcaggctcatctgaactgtggaggagaaaactcaggaaagcctcctttgccccaaagggctgagctgaggatgaacatgtaggtataacactgctccactcagccagttcccagcggctggacttcagacatcaggttggagggggagctgtgcaaacaggacaggcaggcaggagatcaccaagtc

SEQ ID NO: 88194 - DNA, 201 bp, Bos taurus
gtcaaaagaagggccaggattactctcagcagaactgcgtttcagctgcttctgtcacttttctattttgctttccagaaatgaacgatttctgcactggaatgagcagagcagaaaacatcactggaaaggagaagccctttgattttggattatcagagtggaaaactccatcaacctccctgaagatttgtctcacct

SEQ ID NO: 88195 - DNA, 201 bp, Bos taurus
aaagtgacatacctgagggaagagaaaaactgaagctgtgatcgggcagtgatcagaagccagggacccacaaacccacagatattacagaaggccatgcagacttttttaggaaactccaggaaagagagaaggaacactgaaccagaatagaccagaggcaaacctgggagaaacccaagttgcagccatcgtcaatac

SEQ ID NO: 88196 - DNA, 201 bp, Bos taurus; identical to SEQ ID NO: 6359

SEQ ID NO: 88197 - DNA, 201 bp, Bos taurus
aactgtcaaacttccattgctatttgcactatatgtgcagggcatcaaaatgctttaaatacaagtcagaaattatcttcaggccctacccaagaggcagagagtatttgggctaaatctggtgggacaagagttgtatttctatgttatcattttatattatataagagctatttatagaaaggctcaaagcaggccaaa

SEQ ID NO: 88198 - DNA, 201 bp, Bos taurus; identical to SEQ ID NO: 6360

SEQ ID NO: 88199 - DNA, 201 bp, Bos taurus
ctctaggcacatgacagtaaaactgctaaaattcacagaggaaaaagtatgtatcagagaaaaagaaatatattcctgtcaaaggaactacaataaaacttagccctaatctcatctaaaatgatgaaagtcaaaagacactgaaattccagtttcaaagtgctgatataaaaaaaaatgccgatattgaattcttccctg

SEQ ID NO: 88200 - DNA, 201 bp, Bos taurus; identical to SEQ ID NO: 6361

SEQ ID NO: 88201 - DNA, 201 bp, Bos taurus; identical to SEQ ID NO: 6362

SEQ ID NO: 88202 - DNA, 201 bp, Bos taurus; identical to SEQ ID NO: 6363

SEQ ID NO: 88203 - DNA, 201 bp, Bos taurus; identical to SEQ ID NO: 6365

SEQ ID NO: 88204 - DNA, 201 bp, Bos taurus; identical to SEQ ID NO: 6366

SEQ ID NO: 88205 - DNA, 201 bp, Bos taurus; identical to SEQ ID NO: 6367

SEQ ID NO: 88206 - DNA, 201 bp, Bos taurus; identical to SEQ ID NO: 6368

SEQ ID NO: 88207 - DNA, 201 bp, Bos taurus; identical to SEQ ID NO: 6369

SEQ ID NO: 88208 - DNA, 201 bp, Bos taurus; identical to SEQ ID NO: 6370

SEQ ID NO: 88209 - DNA, 201 bp, Bos taurus
ctaagtaagtgtaattgcaagggtccttataagtgtaatacaagggtaaagaaagaagaaggcaatgttatgatggaagcaggtggaaaaaagtctatgagatgcaaggccacaagccaaggaatgaagataccctttagaatttggcagaagcaagacagtaagttctctcctagagtctgcagaagaaaccagctgtac

SEQ ID NO: 88210 - DNA, 201 bp, Bos taurus; identical to SEQ ID NO: 6371

SEQ ID NO: 88211 - DNA, 201 bp, Bos taurus; identical to SEQ ID NO: 6374

SEQ ID NO: 88212 - DNA, 201 bp, Bos taurus; identical to SEQ ID NO: 6376

SEQ ID NO: 88213 - DNA, 201 bp, Bos taurus
tatttacataatagttcttgagatatgggctacttggtgtatcatttattgctgctacagtatagtttgacctcataaccacagtatgggtactgaagttcccatccttattcaaatcaagaaggagaatgatcattaattttatcaagaaaagcagaagttttcttagagctcccagcttcttaagatcctttggccaga

SEQ ID NO: 88214 - DNA, 201 bp, Bos taurus; identical to SEQ ID NO: 6378

SEQ ID NO: 88215 - DNA, 201 bp, Bos taurus
tttccgatgttctaaagggattaatttaccatatcgtatagccctggaagactgtgataattgaaaacatccatattcattgcatgttcaaagggatctgtctgactttgtaatgtaaaaagtgcatttttaacctgaacggggacctgcatctgccattgcttaatcctattagtccaacagtcccaaagctttagtgta

SEQ ID NO: 88216 - DNA, 201 bp, Bos taurus; identical to SEQ ID NO: 6380

SEQ ID NO: 88217 - DNA, 201 bp, Bos taurus; identical to SEQ ID NO: 6381

SEQ ID NO: 88218 - DNA, 201 bp, Bos taurus; identical to SEQ ID NO: 6382

SEQ ID NO: 88219 - DNA, 201 bp, Bos taurus; identical to SEQ ID NO: 6383

SEQ ID NO: 88220 - DNA, 201 bp, Bos taurus
ttctattcccataagcatcattgtgaaaaatctagagttcccaacattagtgtaaagactactcaacttgatgattatattcctctaactagtagatagcgtagatagcagaatcatctcatttacctaaaatatttggcaaaataaattggaagatgttgctacaaatgagtcggtattcatccaaatacgagctttatc

SEQ ID NO: 88221 - DNA, 201 bp, Bos taurus
aaaatgtgtgcatctgtttggaatgcattgctaataaacattcccaaatacatttgctccagcctagcagtatgaaaccactagggcaaatccagaaagtcacatattgtgctggctagctcagaatgtgtgaacatggtgatcaaggacaccagaaagaagcctattattcctgtatataaaaaaagtaatgtgtatggc

SEQ ID NO: 88222 - DNA, 201 bp, Bos taurus
agacccaggaaaatcattgagttacctggatgttattattcaggttttctattgtcttgtctttttatactacggttttctaaatactaaaataaaataacacagatagtaaaatccaaactttagtgcttcatccccaaatctcgtattttgaaagcatattgattgtttctgcttattcctgaccttaactcatttcct

SEQ ID NO: 88223 - DNA, 201 bp, Bos taurus; identical to SEQ ID NO: 6384

SEQ ID NO: 88224 - DNA, 201 bp, Bos taurus
agagcaacaggtgttgtcaagggaagaaagaaataaaaggtttacagattttcaagttttcttatgttagatcaaaagctggcaaacttctcctgtaaatagccagagagtaaaaatttagactatgtggaacagttatacagtcttcatctcaactactcaactttgatattgaagcacaaaagaagccataaacctagg

SEQ ID NO: 88225 - DNA, 201 bp, Bos taurus
tggggggttgtgctacaagtgctgagtagactcctccaaatcaacatggtaagttctttttttccttttatttgaatggtgtctagcttccataaaactctcctcagttttggccttatacaagcaacttcctgttaaaaagctctccctgaatcttattggaatctcaaatttattacattagcaaaaagaattaattat

SEQ ID NO: 88226 - DNA, 201 bp, Bos taurus; identical to SEQ ID NO: 6386

SEQ ID NO: 88227 - DNA, 201 bp, Bos taurus; identical to SEQ ID NO: 6388

SEQ ID NO: 88228 - DNA, 201 bp, Bos taurus; identical to SEQ ID NO: 6389

SEQ ID NO: 88229 - DNA, 201 bp, Bos taurus; identical to SEQ ID NO: 6390

SEQ ID NO: 88230 - DNA, 201 bp, Bos taurus; identical to SEQ ID NO: 6392

SEQ ID NO: 88231 - DNA, 201 bp, Bos taurus; identical to SEQ ID NO: 6393

SEQ ID NO: 88232 - DNA, 201 bp, Bos taurus; identical to SEQ ID NO: 6394

SEQ ID NO: 88233 - DNA, 201 bp, Bos taurus; identical to SEQ ID NO: 6395

SEQ ID NO: 88234 - DNA, 201 bp, Bos taurus; identical to SEQ ID NO: 6396

SEQ ID NO: 88235 - DNA, 201 bp, Bos taurus
aatgttgttctgctaatgtgtacctcctgcccagtatttcttattaataaggcactaaataaggggcaatcggtgtttccattgccaaaagaaaacgtcttttttaattaatcaatgtaaatgggcttttactggaaaatagaagggaagtgtttctagaactcaggatataatgttacatcagggaataccatgccctct

SEQ ID NO: 88236 - DNA, 201 bp, Bos taurus; identical to SEQ ID NO: 6397

SEQ ID NO: 88237 - DNA, 201 bp, Bos taurus
aatgagtcagctctttgcatcaggtggccaaagtagtggagtttcagcttcaacatcagtccttccaatgaacatccattgtccagcatcatattaatgtggcaagatagggcctgaaagtgttatacttattaacttttatattactaataagctgtcatttactgtatgccaagatccatgataagtgcactatgtata

SEQ ID NO: 88238 - DNA, 201 bp, Bos taurus; identical to SEQ ID NO: 6398

SEQ ID NO: 88239 - DNA, 201 bp, Bos taurus; identical to SEQ ID NO: 6399

SEQ ID NO: 88240 - DNA, 201 bp, Bos taurus; identical to SEQ ID NO: 6400

SEQ ID NO: 88241 - DNA, 201 bp, Bos taurus; identical to SEQ ID NO: 6401

SEQ ID NO: 88242 - DNA, 201 bp, Bos taurus; identical to SEQ ID NO: 6402

SEQ ID NO: 88243 - DNA, 201 bp, Bos taurus; identical to SEQ ID NO: 6403

SEQ ID NO: 88244 - DNA, 201 bp, Bos taurus; identical to SEQ ID NO: 6404

SEQ ID NO: 88245 - DNA, 201 bp, Bos taurus; identical to SEQ ID NO: 6405

SEQ ID NO: 88246 - DNA, 201 bp, Bos taurus
aataaacttctcgtacatttttttctgattaaaaatacattgcataagtaggaaattattacttattaaccagtgaataagaaaattttttgagctgagcactttgctaaattgtgtacaagaagtccccattcagtctggaaataccattagtacacacatgaaattattagagttaagtgataaagttttcagttctga

SEQ ID NO: 88247 - DNA, 201 bp, Bos taurus
tccttctgggacggttaatctcctttcagagactgtaagtcctagtggcttctcagcggtccttaagaagataaggacaaggtcactaaggccactgtaattcagacctctgatctacagttgctcaagattctgagagagtaatagcaaacgacgtctttcagcaagtaacgtacggcagtgagagatacacctgatgtc

SEQ ID NO: 88248 - DNA, 201 bp, Bos taurus; identical to SEQ ID NO: 6408

SEQ ID NO: 88249 - DNA, 201 bp, Bos taurus; identical to SEQ ID NO: 6409

SEQ ID NO: 88250 - DNA, 201 bp, Bos taurus; identical to SEQ ID NO: 6410

SEQ ID NO: 88251 - DNA, 201 bp, Bos taurus; identical to SEQ ID NO: 6411

SEQ ID NO: 88252 - DNA, 201 bp, Bos taurus
tgattccagaagaatagtaaatataagtggacaagctggcaaggtaggggaaccttggggctcctctgaagggctttctgggatataagggcctctgccaaggctgcaggctctggttctaaatttttttctaatttcacatctcatctcagagttcatctttcccttgagagagtttgtcactggcgagactcttggccc

SEQ ID NO: 88253 - DNA, 201 bp, Bos taurus
aaacagaacacagagaggccaagtaacttgcccagtgccacacagggattgcccagaagatgcagtcctaaacagtacactatgccacccatccctggagcgccaggcccactctgagagccgggctgagttaagacatgatgttcccttgaggaaaacccagtttcaggacgtgaaaagggacgctatcctttagtgagt

SEQ ID NO: 88254 - DNA, 201 bp, Bos taurus; identical to SEQ ID NO: 6412

SEQ ID NO: 88255 - DNA, 201 bp, Bos taurus; identical to SEQ ID NO: 6414

SEQ ID NO: 88256 - DNA, 201 bp, Bos taurus; identical to SEQ ID NO: 6415

SEQ ID NO: 88257 - DNA, 201 bp, Bos taurus; identical to SEQ ID NO: 6416

SEQ ID NO: 88258 - DNA, 201 bp, Bos taurus; identical to SEQ ID NO: 6417

SEQ ID NO: 88259 - DNA, 201 bp, Bos taurus; identical to SEQ ID NO: 6418

SEQ ID NO: 88260 - DNA, 201 bp, Bos taurus
gggtgggtgggtgtggcctcagacatgtcatgccctctgcctgggtgatattttgggctttacagctagtgctgcaaagcacaggatgtgttagatctcagcaactagctgtgagctggcctgaacgccaaagctttcatggcattgtgggtatgaggtcgctaggggaactgatttagtatctaaggaggttaaagaaaa

SEQ ID NO: 88261 - DNA, 201 bp, Bos taurus; identical to SEQ ID NO: 6420

SEQ ID NO: 88262 - DNA, 201 bp, Bos taurus
tggcctgtcccagtcctgtcagaactttcctgaaaagctgaacacgctcaatgtcaagggtcaaaagggcaaggggcactcggggtaagagaagaggaagtgactgccagtgtgggcctgctggtcaccacgggaacctgaacttcctgctgtcctcctcagcagctcctctccccacccggccttcccagtcctggagct

SEQ ID NO: 88263 - DNA, 201 bp, Bos taurus
cccacgtctggcctcacagagacactagggcatggggttagagcaggcccgggggtagcaccatcagggctcaaatgccacgtctgtcctctgctgggttgttacgcacgttactcaaattcctgtgcctcagtttctactcactggggataataaaagtacctactgggaacttccctggtggcccacggttaagaatcc

SEQ ID NO: 88264 - DNA, 201 bp, Bos taurus
ttaaaggtaagtgaccccaaaggttgtcttctaagacctgcctctgtttttaaatttatggtttctgatgggccaaatgttgagtgaaataagaggccaactaagcgagttagaccttcagtcagcctctgggtagagcttcagggctgggaacagtgcaattgtgtttcttgatgagatggccgttcccgcagagcaagc

SEQ ID NO: 88265 - DNA, 201 bp, Bos taurus; identical to SEQ ID NO: 6421

SEQ ID NO: 88266 - DNA, 201 bp, Bos taurus; identical to SEQ ID NO: 6422

SEQ ID NO: 88267 - DNA, 201 bp, Bos taurus; identical to SEQ ID NO: 6423

SEQ ID NO: 88268 - DNA, 201 bp, Bos taurus; identical to SEQ ID NO: 6424

SEQ ID NO: 88269 - DNA, 201 bp, Bos taurus
gggagggggccagttcaggctctaaatttagtaagaaaacattaggaaaaaattagagtgaagtataaagaaaagtctaaccaggacatgtataagactagggttgaaatttgctggtgatggccagagaatagtaagaaagaaaccaaattgtttgtatttttctttaaaacagacaaacctgaccatgaaatgcatgct

SEQ ID NO: 88270 - DNA, 201 bp, Bos taurus; identical to SEQ ID NO: 6427

SEQ ID NO: 88271 - DNA, 201 bp, Bos taurus
gtgttgacacaccttctgaccccacaattcagctcgtgggcatttgtcctcaagaaacgccagctgggttcatagggaacatgtccgaggacactcactatgtgtggagccagggagttgaaggtgatctaggtggtgtcatcaggggagtggaggctatgtcctgtgagggccatggcctagatgtatactcggccatgt

SEQ ID NO: 88272 - DNA, 201 bp, Bos taurus
ccaacctgttctttgaagtcaagcccaactgtctagactaaaagtctaggccactggcccaggggctccttcaatgtttaaaccaataggatatgagtcacgtatgtcacttaaaagacttcagtaaccaaaactagttcatcacagtaatcaagttttgtttctgcagcattaggaggggcgatggcaccatccagtttc

SEQ ID NO: 88273 - DNA, 201 bp, Bos taurus
actttttcttccacctcattccctcctctgagcattccccaataaaccttccacaactctcaggttcctaagggaacctgactgaggccaggctcacccatgttcaccttggctcagcttaagccagtggtttgttctctgtttttaaacaatgacacctcttacgctgagaactcagggacagctgcttgcttaagggta

SEQ ID NO: 88274 - DNA, 201 bp, Bos taurus; identical to SEQ ID NO: 6428

SEQ ID NO: 88275 - DNA, 201 bp, Bos taurus; identical to SEQ ID NO: 6429

SEQ ID NO: 88276 - DNA, 201 bp, Bos taurus; identical to SEQ ID NO: 6430

SEQ ID NO: 88277 - DNA, 201 bp, Bos taurus; identical to SEQ ID NO: 6432

SEQ ID NO: 88278 - DNA, 201 bp, Bos taurus; identical to SEQ ID NO: 6434

SEQ ID NO: 88279 - DNA, 201 bp, Bos taurus; identical to SEQ ID NO: 6435

SEQ ID NO: 88280 - DNA, 201 bp, Bos taurus
tctttgtccgatttacttcatgtagtacaatcatcgctaggtccattctcgctgcaatttgccaacacatcttcatagaaagctgactttcagaacagactggtggcaaaagatctgagggtcaatttctcacaggtgagaagcacggcacaggccttgtttacaaacccagaaagacctgctgggatttttctctgctct

SEQ ID NO: 88281 - DNA, 201 bp, Bos taurus; identical to SEQ ID NO: 6438

SEQ ID NO: 88282 - DNA, 201 bp, Bos taurus
aagattattattatccttacatcaaagatgagggcactgagacttagagaaataaagtaagttgctccaggacacacagctagtaagtggtagagacagcaatcaagtccaagtctctctgacattggaatctttgtcctcaactacacaacttccactacaatgtcgcattctacagcagctcatgggtatggtaaagaa

SEQ ID NO: 88283 - DNA, 201 bp, Bos taurus; identical to SEQ ID NO: 6440

SEQ ID NO: 88284 - DNA, 201 bp, Bos taurus; identical to SEQ ID NO: 6441

SEQ ID NO: 88285 - DNA, 201 bp, Bos taurus; identical to SEQ ID NO: 6442

SEQ ID NO: 88286 - DNA, 201 bp, Bos taurus; identical to SEQ ID NO: 6444

SEQ ID NO: 88287 - DNA, 201 bp, Bos taurus; identical to SEQ ID NO: 6446

SEQ ID NO: 88288 - DNA, 201 bp, Bos taurus
tggagccagggtgtccaggacactgtagcacatacggccatctgtgtcacaatggagggaggtgcagagaaaagcgcagagggatcacgtgtgactgcactgtctctgcatatgacgggccattctgcgagaacggtgagtgtgcccaaggaacagggaaaggctggagcatgagaagtccatgaagatgcctctggtatt

SEQ ID NO: 88289 - DNA, 201 bp, Bos taurus; identical to SEQ ID NO: 6448

SEQ ID NO: 88290 - DNA, 201 bp, Bos taurus; identical to SEQ ID NO: 6449

SEQ ID NO: 88291 - DNA, 201 bp, Bos taurus
cctgtacaccacaccctcaactccaataaaggcaaagagctgggtccttgccccttctctccactcaagatctggctgggtggcccctgatgtgctctgtcccctctagtacctagaagcagtaaactttgtgttttcaaagttccctaataattattgttgatcctaatgatcatccttcagtcataataaggaccacaa

SEQ ID NO: 88292 - DNA, 201 bp, Bos taurus; identical to SEQ ID NO: 6451

SEQ ID NO: 88293 - DNA, 201 bp, Bos taurus; identical to SEQ ID NO: 6452

SEQ ID NO: 88294 - DNA, 201 bp, Bos taurus
gctctgcataaaagattgggctgtgtcacacagtgaaagaaatgcttttcagtaaaaggtcaccatttgtttgatatagaaaccttctctgaattttcatcgataccccaactatctaattttcactcctggggggtttgttgttctatgagggtgagatttaaagtagaaagtatggctctggtatctattaccagaatt

SEQ ID NO: 88295 - DNA, 201 bp, Bos taurus
tctgttgtaataccctggaggaactgcgctacaggaggtggtggtctctgggcgggtaccacttctcgctttttagagagtaattcattatgaaatcatataaacataactttgaaagctaacaatgactggcctgagactctttatgcctatttatagaaggtataaaaagaggcctgaccctgaaacccttttcagcct

SEQ ID NO: 88296 - DNA, 201 bp, Bos taurus; identical to SEQ ID NO: 6454

SEQ ID NO: 88297 - DNA, 201 bp, Bos taurus
aaatgtgctgggcctatccaggcactgatgagcagactggtccagaggaggtgagggctgtgggtgagcagagagaaaagtcagggtggagagttagactgcgtcaagccaagggggcctcagatgctggctgaggcattcggacctgaataagcgggagccattgaaggataatgaacagaggttattaaaacaaaatat

SEQ ID NO: 88298 - DNA, 201 bp, Bos taurus; identical to SEQ ID NO: 6457

SEQ ID NO: 88299 - DNA, 201 bp, Bos taurus; identical to SEQ ID NO: 6458

SEQ ID NO: 88300 - DNA, 201 bp, Bos taurus; identical to SEQ ID NO: 6459

SEQ ID NO: 88301 - DNA, 201 bp, Bos taurus; identical to SEQ ID NO: 47871

SEQ ID NO: 88302 - DNA, 201 bp, Bos taurus
tggggtagttccctgcagtctgggagtgctaacagtcctgtgcaccttcccatgagaaaacctgtctgccatttctctttcaagaaggcacagacacctgtattcaggaaatcacagattttgttgttttttcagcctcccaagagaagccaggatgaaccactacactggtttccaagctgtttctttgtttgagcagca

SEQ ID NO: 88303 - DNA, 201 bp, Bos taurus
gtgggctacagtccacggggcctcaaagagtcggacatggctgagcaactaacacttttgctttcatttgtacagaaaacttgctgtgcccccagtgcacttgccctctgcctctggctggccctacactgctatccctctgccaacaatatctgcctggctggccatgaaaacatcacatgagttgctagcagactcccc

SEQ ID NO: 88304 - DNA, 201 bp, Bos taurus
cggttgacaggaaactagccttgtatttgccctgggagcagcagttctgtactcactaattcaatgttcacagcgatagacactgcctaccttctcagcaggaaccaactgtacacccatacataacagcacaaaaacagggttaccctgtccagttctagtttcaaaaagaaaggaaggcttgaaccctcctataaataa

SEQ ID NO: 88305 - DNA, 201 bp, Bos taurus; identical to SEQ ID NO: 6460

SEQ ID NO: 88306 - DNA, 201 bp, Bos taurus
gaaattttgaaggcttctgaagatgtcccagtttctttttagatctgccggagataagtgtttctgatttaccatctctgcagtcttagctggacccagcaaggcctctttcctgcttcatcctggccaccctcgtgactgggaaccagctctgaggctggcactaggatgcttggggtttatttctctgaaataaattaa

SEQ ID NO: 88307 - DNA, 201 bp, Bos taurus
atggccccagcaaaacaatcaaatcagatctatgcttgtaagccctctgaaaggaagtgcctaggagaccctttcaatgagacaaaaggacttgtgagaatcttgagggtattggcccacagcgaatgacatgctcaaaaaaatatatggacaaaattctgaagacatagggtgaatcccaccaaaattcctaggaaatgc

SEQ ID NO: 88308 - DNA, 201 bp, Bos taurus; identical to SEQ ID NO: 6461

SEQ ID NO: 88309 - DNA, 201 bp, Bos taurus; identical to SEQ ID NO: 6462

SEQ ID NO: 88310 - DNA, 201 bp, Bos taurus; identical to SEQ ID NO: 6463

SEQ ID NO: 88311 - DNA, 201 bp, Bos taurus; identical to SEQ ID NO: 6465

SEQ ID NO: 88312 - DNA, 201 bp, Bos taurus; identical to SEQ ID NO: 6466

SEQ ID NO: 88313 - DNA, 201 bp, Bos taurus
ctgataccttcgggtaaggtctgaactagctttttttttttttttctcaaaggttcattgaggcaaggatttgattgattgattgagtttttggccaccccagccatgtgggatcctagttgcctgaccagggatcgaacccacgccccctgcacttgaagtacggagtcacttggccactagggaagtccctgaaactag

SEQ ID NO: 88314 - DNA, 201 bp, Bos taurus; identical to SEQ ID NO: 6468

SEQ ID NO: 88315 - DNA, 201 bp, Bos taurus; identical to SEQ ID NO: 6469

SEQ ID NO: 88316 - DNA, 201 bp, Bos taurus
gtccctggagaagacggccagcagagctgcccaagatgggggtggcatgcacagtgctgtactgggaggaaggggggccttggggttgagctgcactgaacaacccagctgggaccccagggcaatctgcattcattcctttggggaacaggccggcaggctggagtgtatggggctctgattggaaccagagccagggca

SEQ ID NO: 88317 - DNA, 201 bp, Bos taurus; identical to SEQ ID NO: 6470

SEQ ID NO: 88318 - DNA, 201 bp, Bos taurus; identical to SEQ ID NO: 6471

SEQ ID NO: 88319 - DNA, 201 bp, Bos taurus
atcccccttcaaaagccagaagatgactctggtccacccgcagttgaggaggaggttttcagaagccctctgaacaagccacccatgtgttgcctggcctcgggcaccccatcctgctgtggagcaggactgatggcagccttcccactcccaggactagtcgaagacctgtgccaggctggggactctggtggggccagc

SEQ ID NO: 88320 - DNA, 201 bp, Bos taurus; identical to SEQ ID NO: 6472

SEQ ID NO: 88321 - DNA, 201 bp, Bos taurus; identical to SEQ ID NO: 6473

SEQ ID NO: 88322 - DNA, 201 bp, Bos taurus; identical to SEQ ID NO: 6474

SEQ ID NO: 88323 - DNA, 201 bp, Bos taurus
gctgcagttcacggtgtcgcaaagagtcagacacaactgagcaactgaactgaactgaagagttctaactcctaagaactgcttaggagtaaggaactccctgagtggggctgctggccagtcatgtagattacgtgttaatttcttaatagtcatcaggtctgcaaagtaggagaggctagtgctagaactttctgccct

SEQ ID NO: 88324 - DNA, 201 bp, Bos taurus
aagaaaaaaagaaaggctcacctttggcccactgaagtcctaatttcagatccaatttcctgggccctagggtttcaggcaattaagctgggcctgtgacaggaggaagcaaaagctactgatgtctgcatgggaaggaagcaggtctgactgagaccagcttatgaggacggccccagagggactaactcagaaagcgct

SEQ ID NO: 88325 - DNA, 201 bp, Bos taurus
agggggtgaggcatctgggacgtacagggggcctgaggactcagagcacaaagcgggctgggaatgcaagaggtaagagcgagcagagagcaggtgtatcggggccaggcaggggctctgtatataagtggtttctcaactctgttgcatgctggaaccactgcagtggctgaaaaatgtccccagaggtagtaggcccta

SEQ ID NO: 88326 - DNA, 201 bp, Bos taurus
gcacgcatctcttagtcaagatggatgttactgaaaagctgtctggtagaacatcccttgtcataactctcctttggcctccaaggaacctttctatacacgtgtggtcagggaggtctcctgactttgataatgagaaatatggggtctgggtggggcccagcctcattgccttaattgtcctgctgttctcatctcgga

SEQ ID NO: 88327 - DNA, 201 bp, Bos taurus; identical to SEQ ID NO: 6477

SEQ ID NO: 88328 - DNA, 201 bp, Bos taurus; identical to SEQ ID NO: 6478

SEQ ID NO: 88329 - DNA, 201 bp, Bos taurus
acagtgaatgtagttcattgcaagaaaaaaaaacaactgataggccccctttaggtaaactggagacacaagaaaaacagcattatatattttatgagcatataccaattcagggccatgtatcaaagtccttggagcatgtgtccatggggagaaaatgagagcaagaatttaatgataaagaagagaaaaatctaaaga

SEQ ID NO: 88330 - DNA, 201 bp, Bos taurus; identical to SEQ ID NO: 6479

SEQ ID NO: 88331 - DNA, 201 bp, Bos taurus; identical to SEQ ID NO: 6480

SEQ ID NO: 88332 - DNA, 201 bp, Bos taurus; identical to SEQ ID NO: 6481

SEQ ID NO: 88333 - DNA, 201 bp, Bos taurus; identical to SEQ ID NO: 6482

SEQ ID NO: 88334 - DNA, 201 bp, Bos taurus
gcgtggtgacattagaatatgtacctttagtgctactcccaggtggagagtacacgtgaggccacgattgaggcatccttggtgttgtcagtaacaccctaagtcctcagttgaatcactgcagaaatgcttggaaagggcagcaagaagatggttaaaatcctaagctagtcccagactctctggctgtttcttagggga

SEQ ID NO: 88335 - DNA, 201 bp, Bos taurus
tttatgagaacatcattaaggccatgaggcctcagcccgagtactttgctgttggctactacggacagggcttcccttctttcctgcgggtaagaagcgcgagggtggtctccctggccattgagccatgcagttggaggagggaatgtcttcatctcttttccagatgagtctagtgtgttagcagctggagccctgtgt

SEQ ID NO: 88336 - DNA, 201 bp, Bos taurus; identical to SEQ ID NO: 6483

SEQ ID NO: 88337 - DNA, 201 bp, Bos taurus; identical to SEQ ID NO: 6484

SEQ ID NO: 88338 - DNA, 201 bp, Bos taurus
acaacaaaaaatctttaaaaaaaaaaattagcctcatatataatccaaatcttctcctgtatccttctccctccttcccccatgcagaggcttgtggcctggggactgagggtgggaacaagactgatcttcactgtccctctgcacttaccaaggtgtgttttctctgacattggggccaacggaagaagaaagagggag

SEQ ID NO: 88339 - DNA, 201 bp, Bos taurus; identical to SEQ ID NO: 6487

SEQ ID NO: 88340 - DNA, 201 bp, Bos taurus
caccagttttgaagcccaaattattatagaatatattcttctttacccttttacccttctcgttcagtttttccaggaagtgagatgctgttttcagagcgtcagtttgaaacagggtgattcttttctatttacaaacagtgcttttttttcagaaagattttctcagtgtcatccttgatctttggttctgtttcttaa

SEQ ID NO: 88341 - DNA, 201 bp, Bos taurus; identical to SEQ ID NO: 6488

SEQ ID NO: 88342 - DNA, 201 bp, Bos taurus
cccatcccccctctcccatcattcattgttcttgtcacaaattaaaacgaaaagcaggcagtgctgagggaaagctgtggccccactcttgacacctcccgcgcagaaaagcatgtgacaaccggttcccatggcaacgggctttctttgaaataatttctccttcggtgtaccagtcccccgcctgtctcttcttgggag

SEQ ID NO: 88343 - DNA, 201 bp, Bos taurus; identical to SEQ ID NO: 6489

SEQ ID NO: 88344 - DNA, 201 bp, Bos taurus
ataaaaatgatacaacaaccaaaaagtaggggataaaagcaccaattactgttcaaataacaagcaacaacaacaatacaagaaatcctcttcagttcctgtaagactaaagagctacaaacagagggaaaaaaaaactggatgagagcactgcctagcaaaacataaggcaagaaactcaagctgcagggaagaaaatga

SEQ ID NO: 88345 - DNA, 201 bp, Bos taurus
ctatgagataggcccaaatgtttctatgcttaccataaatcacattgtatacttttttgataccttttatcttccagtccatacagatgtagaaggacttccctggaaggccaatggttaagactcaatgatttcactgcagggggagtgggtttgatccctggttgagaactaagatcctgcatgactatgtgatacggt

SEQ ID NO: 88346 - DNA, 201 bp, Bos taurus
agccttatactcataatactccattttgtctctacatacatgacagttccataaaataaccacagagaaaaagaagtaagaaaacttaaatgcacattgctatgactgtgcaaatactttcactgaattttagaagataaagaaagcagattaatatcctgtgtgagatattcaagacttctgacacaacacgactgaaat

SEQ ID NO: 88347 - DNA, 201 bp, Bos taurus
ctgggctgttctgtgtggggaatggcccacactgcccatgtgaccagttccaggtagtgagaactgtcctttcactctgccccaggatgagtggatgaccgtcctgtggcccttaggagagctgatgctcattctgctttgtttctgaagaaggaaagaaaggaggcagcagcttttcatcccaaaactactctctacttc

SEQ ID NO: 88348 - DNA, 201 bp, Bos taurus; identical to SEQ ID NO: 6492

SEQ ID NO: 88349 - DNA, 201 bp, Bos taurus; identical to SEQ ID NO: 6493

SEQ ID NO: 88350 - DNA, 201 bp, Bos taurus; identical to SEQ ID NO: 6494

SEQ ID NO: 88351 - DNA, 201 bp, Bos taurus; identical to SEQ ID NO: 6495

SEQ ID NO: 88352 - DNA, 201 bp, Bos taurus
agtcacggcctccgccaccgattgctcatcacagacagacagacaagtaaggattctttagctgcttcccaaagggccatgtctgttcggagatgccaccgaggagtaaattgccctgggctgcactagtcattggcacctcattgggtctggccttggggtgttgcattcagatatatgatgtttgactgagatgctgga

SEQ ID NO: 88353 - DNA, 201 bp, Bos taurus; identical to SEQ ID NO: 6497

SEQ ID NO: 88354 - DNA, 201 bp, Bos taurus
aactattctgtggttaagagaattccggggtaggggcccaggtttaaaccctggtcagggaactaagatcccacaaactgtgcaaaatgatacctccccccaaaaaactattctattattaaaattaaaaaaggaatgagatgagagtgaggatttgttactatcctagccactccagccactaagcccagatatccaccc

SEQ ID NO: 88355 - DNA, 201 bp, Bos taurus; identical to SEQ ID NO: 6498

SEQ ID NO: 88356 - DNA, 201 bp, Bos taurus; identical to SEQ ID NO: 6499

SEQ ID NO: 88357 - DNA, 201 bp, Bos taurus; identical to SEQ ID NO: 6503

SEQ ID NO: 88358 - DNA, 201 bp, Bos taurus
atatctccatggcttccagtccccttcagcaaccccaggctctggaatcctccaggaaaggggaaaggcactctctcttggggcctcatccccttctcttcgccctgcagttgccctaggggacacatcctgggaatgaggcaagaacctgggacaaaagaacccactgattcaaaggcctgggaaactctacaggcctca

SEQ ID NO: 88359 - DNA, 201 bp, Bos taurus; identical to SEQ ID NO: 6504

SEQ ID NO: 88360 - DNA, 201 bp, Bos taurus
tttatactaacaggcaaagggccaaatgggccttactttgattccttttatagtctattagcataaggccctgagcacaggaatggggatggggcaatgcccaggaaaataagcctttgctcacatcttgatcctcggtccataccacattttttcatttatggacatcacattatcaatgtgcttatatatgcagacagt

SEQ ID NO: 88361 - DNA, 201 bp, Bos taurus
ctaagtaaaacaccaaaaacataaaatttccctactcttaaaatgctggccatgtaactatttaaggcatagcattaaaaatctagctgtcccttcacatcccaaacacaacttgtcatctggcctcttgagaattagacccttaatgactgtccccatctggtgccattcaatcttctttctggttcatcttttgttctg

SEQ ID NO: 88362 - DNA, 201 bp, Bos taurus; identical to SEQ ID NO: 6508

SEQ ID NO: 88363 - DNA, 201 bp, Bos taurus; identical to SEQ ID NO: 6511

SEQ ID NO: 88364 - DNA, 201 bp, Bos taurus; identical to SEQ ID NO: 6515

SEQ ID NO: 88365 - DNA, 201 bp, Bos taurus
caggtggtaggagagaggacagtgggagcttgtacacagtttgactcatctaatgtgaaaggaagaaaagaagctgcatttaattgaggtctagctgcttcaaggagaactaattcccttctattcccatgttctaggctatgtccctattttaaaatggtgctttccccaaactgtagaataataaattcaaatgtactc

SEQ ID NO: 88366 - DNA, 201 bp, Bos taurus; identical to SEQ ID NO: 6516

SEQ ID NO: 88367 - DNA, 201 bp, Bos taurus
caatacactaagcagagattccccatgtcaccaaggggcatacagacatgtagggcacagggtgaagtccaagaaagcaggccttgatgaagattccttgatcacattgggcagcagtaggtagtgacagtttctacccaaacccttgttgtgtgggcccgcctgggagcacgcttcctgtcacctcagcgaagccttcct

SEQ ID NO: 88368 - DNA, 201 bp, Bos taurus; identical to SEQ ID NO: 6517

SEQ ID NO: 88369 - DNA, 201 bp, Bos taurus
caggtgttctggggggaaagcctgaataagcaattgaaataaagtgtgatctgtaagcagatttaccattgtaaacagaaccttgtaaacagaaccttcaatatctctcataaaacacatcccatgaaagcattttccctaaggaaaaacaagaagagtgggactgaatgacatctcttgttctgaagcctctttgtccta

SEQ ID NO: 88370 - DNA, 201 bp, Bos taurus; identical to SEQ ID NO: 6518

SEQ ID NO: 88371 - DNA, 201 bp, Bos taurus; identical to SEQ ID NO: 6519

SEQ ID NO: 88372 - DNA, 201 bp, Bos taurus; identical to SEQ ID NO: 6520

SEQ ID NO: 88373 - DNA, 201 bp, Bos taurus; identical to SEQ ID NO: 6521

SEQ ID NO: 88374 - DNA, 201 bp, Bos taurus; identical to SEQ ID NO: 6522

SEQ ID NO: 88375 - DNA, 201 bp, Bos taurus; identical to SEQ ID NO: 6523

SEQ ID NO: 88376 - DNA, 201 bp, Bos taurus; identical to SEQ ID NO: 6524

SEQ ID NO: 88377 - DNA, 201 bp, Bos taurus; identical to SEQ ID NO: 6525

SEQ ID NO: 88378 - DNA, 201 bp, Bos taurus; identical to SEQ ID NO: 6526

SEQ ID NO: 88379 - DNA, 201 bp, Bos taurus
taagctgcatttcttgaactatattgatttcttagcttgagagtaggggacaggatctgttatttaaacatgtagttttaaaatggaaaatgtattcaagtccctataattaaacccctcacatagttttttgcaaatgacatatcaatgggtctataacattatttctgtaatttaattacaaaatgctgttatcgcaaa

SEQ ID NO: 88380 - DNA, 201 bp, Bos taurus
aatatgaagtactagctgacaaagtggacaggatgtatgtaaagagaaaaatgtgacctacagacttcatgacagctctgcagctggagaaaatgcctcagatcctttgtcttttcatttttctaaaatgcgggctgttagggtaaattttttttctttgaggcctgagttaggggaatgagcactttccaggaaagtatg

SEQ ID NO: 88381 - DNA, 201 bp, Bos taurus; identical to SEQ ID NO: 47974

SEQ ID NO: 88382 - DNA, 201 bp, Bos taurus; identical to SEQ ID NO: 6528

SEQ ID NO: 88383 - DNA, 201 bp, Bos taurus; identical to SEQ ID NO: 6529

SEQ ID NO: 88384 - DNA, 201 bp, Bos taurus; identical to SEQ ID NO: 6530

SEQ ID NO: 88385 - DNA, 201 bp, Bos taurus; identical to SEQ ID NO: 6531

SEQ ID NO: 88386 - DNA, 201 bp, Bos taurus; identical to SEQ ID NO: 6532

SEQ ID NO: 88387 - DNA, 201 bp, Bos taurus
gacatagggcccaggaggtgagggctgtgtctggctgcatcagtaagtaaaatcccagagaaagattctgactgctccagcctgggtcatgctctgtcccagtgcttcaaatgattggcctggccccgggaaccctgggacagttttgggaaaggagcatttcccccaagaagggagtcctgtcagcaggagaaagggaca

SEQ ID NO: 88388 - DNA, 201 bp, Bos taurus; identical to SEQ ID NO: 6533

SEQ ID NO: 88389 - DNA, 201 bp, Bos taurus
ggccctcacacccagtcattctgcttctgaaacagctctcccatctccccactttttgccagttcccatcctctcattctctgcccttaatgctttactgatcttgaagatactcagatcttgtcactccttcactcttgaatctctcaaggctccctactggcagggggaaaatgtcagctcttgagcaggacgtctaaa

SEQ ID NO: 88390 - DNA, 201 bp, Bos taurus; identical to SEQ ID NO: 6535

SEQ ID NO: 88391 - DNA, 201 bp, Bos taurus; identical to SEQ ID NO: 6536

SEQ ID NO: 88392 - DNA, 201 bp, Bos taurus
atgttttctcatctgggtgtccagctgtttcactgacacttgttgaaaaccttccacatttaacttccttggcatctctgtcaaaaaccagttgattacatgaaaatatctagatacgattctgttccactggtctatccttttgccagtacctcactgtcttgaatttgattactgtagcttaaagtcttgaaatcaatc

SEQ ID NO: 88393 - DNA, 201 bp, Bos taurus; identical to SEQ ID NO: 6538

SEQ ID NO: 88394 - DNA, 201 bp, Bos taurus
tctacatccaaatacatacaagggaaaaaaacttacaacaaggtgctaggaggggcgtacttgtgatataatcaaatcccatacccctcaagtaggggacccagaaactgaagaacaattacattgcagaagctcctccacaggagtgaaagctctgagtgccatgtcaggctccccaccctagggtcctggcactggaca

SEQ ID NO: 88395 - DNA, 201 bp, Bos taurus; identical to SEQ ID NO: 6539

SEQ ID NO: 88396 - DNA, 201 bp, Bos taurus; identical to SEQ ID NO: 6540

SEQ ID NO: 88397 - DNA, 201 bp, Bos taurus
gctatgttctgtgctacagtttgttcctttgtgtgatccagggatgaggtgggagagaaatgagctgattatcgagggcacagatgaatccaccagtgcaaagaagacgagactcctggatcaactgcactgtggggataagcgggtgggactgtggcccggcaggccctctggaaacttaatactgcctgggacggaagg

SEQ ID NO: 88398 - DNA, 201 bp, Bos taurus
tgcaataggaatgaatcatgggttctaagtaagtaagtatgtggcctgacatggtgctaaaaagagctctgactcctgtggatgagcctgggaaaaccaggaatgacaatagggaggccagcgaggttgctaaagaattgtaacaatgacaatgaagaaataactcagtgtggtattctttcatcatagttggatacaata

SEQ ID NO: 88399 - DNA, 201 bp, Bos taurus; identical to SEQ ID NO: 6542

SEQ ID NO: 88400 - DNA, 201 bp, Bos taurus
cgggaggaggcgcggccgaaacaggaagggccgcgaaggggaccccacacgccctgcgccccaaagctgccgcacgtaggagcgggttcggctcaagttcgtcgtcaaaggccccaccctctgactcttggctgggtttaggagagtttttaaaaaccctatcttcctctaaactgccaccttagagaaaaacgttaagac

SEQ ID NO: 88401 - DNA, 201 bp, Bos taurus
cggggatatgtattcaatattttgtgataaaccataatggaaaagaatatacatatatgtataaccttgctgttcagcagattgacacaatagccaagatgtacttaaattttttaaaaaaggaatgattctgctgtataaaaaaaagctaactatctaaaatgtatttctttttttttattgttattaaagatatataac

SEQ ID NO: 88402 - DNA, 201 bp, Bos taurus; identical to SEQ ID NO: 6545

SEQ ID NO: 88403 - DNA, 201 bp, Bos taurus; identical to SEQ ID NO: 6546

SEQ ID NO: 88404 - DNA, 201 bp, Bos taurus; identical to SEQ ID NO: 6547

SEQ ID NO: 88405 - DNA, 201 bp, Bos taurus; identical to SEQ ID NO: 6548

SEQ ID NO: 88406 - DNA, 201 bp, Bos taurus; identical to SEQ ID NO: 6549

SEQ ID NO: 88407 - DNA, 201 bp, Bos taurus
aagcaaataaaactctggagtgaggtactgactctctgctggggacagtactatcaccttccttggggagctagttggacagccacaaggcagaggtgggcaacgctgggtgttctctcaggacctcccagaaatgccaggctgaaaatccagagatgtatgttgcctttagcacaaggtcataggggacagcctgatgac

SEQ ID NO: 88408 - DNA, 201 bp, Bos taurus; identical to SEQ ID NO: 6554

SEQ ID NO: 88409 - DNA, 201 bp, Bos taurus; identical to SEQ ID NO: 6555

SEQ ID NO: 88410 - DNA, 201 bp, Bos taurus
tcttatttctaggtatttggtgagaggaaaggagtgatatctgcttagcttgccctcttgaatctcggtagttctttttataactttatccacttgaattctcctcctctagtcaggttgcacttgggtcacatgctgacttgtcaccactttacattagctcaacaaatggcagcctctagggtattttcatgtcaacta

SEQ ID NO: 88411 - DNA, 201 bp, Bos taurus; identical to SEQ ID NO: 6556

SEQ ID NO: 88412 - DNA, 201 bp, Bos taurus; identical to SEQ ID NO: 6557

SEQ ID NO: 88413 - DNA, 201 bp, Bos taurus; identical to SEQ ID NO: 6558

SEQ ID NO: 88414 - DNA, 201 bp, Bos taurus; identical to SEQ ID NO: 6559

SEQ ID NO: 88415 - DNA, 201 bp, Bos taurus
ctgggcctgccccctccgacctcagcttggaggacactccagcctggtgctcccacgatgtgcccccagcctgcttggctctccttgcccagctcccggggaggctgttgcctggaactggccatttgcaattctttgcaatctcacctcctgctatacctcagcacagcccttccagtgctcccagttacatgactttct

SEQ ID NO: 88416 - DNA, 201 bp, Bos taurus; identical to SEQ ID NO: 6560

SEQ ID NO: 88417 - DNA, 201 bp, Bos taurus
aagggcatgctgaccacccacccagccactgtgaccagtatgaagccactgaccagcataggctgaggtcgctttctccagccctggggcaggaacatggaggcccaagaggagttaggtgggatccccacccgctatggtggccacaaaccaacaaacgtgtcccacgtcatggcgtcagagatgatgccggctgaggaa

SEQ ID NO: 88418 - DNA, 201 bp, Bos taurus
tttctccctgagatgggtgtgtgggttcttctgttatgggggctatatgtacagtcttgtaggctttattggcccctagcccatttggctttcagaccccacattgtccaaatgctactggttgctgtttagcaagacagcacaaggtctggtcacaaggcagctggctacagaaccctagggagcctcatggctagtgct

SEQ ID NO: 88419 - DNA, 201 bp, Bos taurus
ggctcagtgatattggcttgttagcccaaaatgtaccatgaattatttgtagctgcttttccatctcctaccactaatcaagcaaggtgtgtacactttccaggaggtcaggccttccagatgcagaggcaagaagaggaggcatggagcctgccttcactcacaactatttgacaggaggagagcacttccacgcatgat

SEQ ID NO: 88420 - DNA, 201 bp, Bos taurus; identical to SEQ ID NO: 6561

SEQ ID NO: 88421 - DNA, 201 bp, Bos taurus; identical to SEQ ID NO: 6562

SEQ ID NO: 88422 - DNA, 201 bp, Bos taurus; identical to SEQ ID NO: 6563

SEQ ID NO: 88423 - DNA, 201 bp, Bos taurus
gatgacgagagactagacactgtgtacaacatcccgccactggcctgctgaactgtgagggaattaagaccctcagcctctgtttaggccacaataccccgtcagctcatgtttgaggacttcctaatcctggagacagccaccatgtctctcagcactgaagtaccagagtgctttcatttgcatctctgtcagacatgg

SEQ ID NO: 88424 - DNA, 201 bp, Bos taurus
gcctcctggaccagggaggaggcctgcatcagcctccagggaaggggatgcagtaagcagggaaggaggttggctttgtcacttactcagctgatgctcactgcgctctgcatgtgctggccctgggcacccagcacccctgccctgatgcagctggcagttctaaggtcctgtccacctcttagcctgagtcctgtccac

SEQ ID NO: 88425 - DNA, 201 bp, Bos taurus; identical to SEQ ID NO: 6564

SEQ ID NO: 88426 - DNA, 201 bp, Bos taurus; identical to SEQ ID NO: 6565

SEQ ID NO: 88427 - DNA, 201 bp, Bos taurus; identical to SEQ ID NO: 6567

SEQ ID NO: 88428 - DNA, 201 bp, Bos taurus; identical to SEQ ID NO: 6569

SEQ ID NO: 88429 - DNA, 201 bp, Bos taurus
gcagcagcagcatatctacttctccatctactgagagagagagattgagatttattatgaggaattggctcatgtaaatatggggcctgagaggcccacaatctgcttctgtaagctgcagagccaggaaagccaagccagttgtataaccatctgagtgcaaaggcctgagaaccaggagagcagatggtgcaaatctca

SEQ ID NO: 88430 - DNA, 201 bp, Bos taurus; identical to SEQ ID NO: 6571

SEQ ID NO: 88431 - DNA, 201 bp, Bos taurus; identical to SEQ ID NO: 6572

SEQ ID NO: 88432 - DNA, 201 bp, Bos taurus; identical to SEQ ID NO: 6573

SEQ ID NO: 88433 - DNA, 201 bp, Bos taurus
tgcaccacctgggagccctgctcagtagtgtgcttgccagcatcatgccgagagcatccttggactcaggagaggtaccagccctaatgatccacagaacagaaaagaaaatgcaacttctgggtgcttctgtcttgcacttgagcaaaatttaggcacgtgagacttccactcatgcagtgaaagcaaaatcagtatgga

SEQ ID NO: 88434 - DNA, 201 bp, Bos taurus; identical to SEQ ID NO: 6574

SEQ ID NO: 88435 - DNA, 201 bp, Bos taurus; identical to SEQ ID NO: 6575

SEQ ID NO: 88436 - DNA, 201 bp, Bos taurus; identical to SEQ ID NO: 6578

SEQ ID NO: 88437 - DNA, 201 bp, Bos taurus; identical to SEQ ID NO: 6579

SEQ ID NO: 88438 - DNA, 201 bp, Bos taurus; identical to SEQ ID NO: 6580

SEQ ID NO: 88439 - DNA, 201 bp, Bos taurus; identical to SEQ ID NO: 6581

SEQ ID NO: 88440 - DNA, 201 bp, Bos taurus
tgcttccctttttaaaaggtaaggtccaaagcactgcaggttgttcctattgtttcaaatggaatagtcctagattcaagactgggtgggctttagccctgtatttctctgcagaatctactcttcctggagtctggtaggaacgggctctgaactaaggcactgaatcttgctcctgacagagtgtgtaaaataaaccca

SEQ ID NO: 88441 - DNA, 201 bp, Bos taurus; identical to SEQ ID NO: 6582

SEQ ID NO: 88442 - DNA, 201 bp, Bos taurus; identical to SEQ ID NO: 6583

SEQ ID NO: 88443 - DNA, 201 bp, Bos taurus
caaacaggtataatgatggcttcagtagataccactaatacatataaaacacgtgtatcaatttgtccacagtgttaccaaaccaaacttggttctattaacctgtacacagtgaagccaatctactgacatttggttgtggtgaaagaaagtgtaactatgactgtaagcaccaagaaaggaattgttgttcagatgtat

SEQ ID NO: 88444 - DNA, 201 bp, Bos taurus; identical to SEQ ID NO: 6584

SEQ ID NO: 88445 - DNA, 201 bp, Bos taurus
ataccctgggaccctcaggcatgcacaccaagggaggggtactgagtgtttgtagtgaggtcactatgatcagctcaaaactaggaccttccaaatatccaccaagtgaacaaccagaagtactccatgtatctgtcatgcagcaccgcatagcactgaacatgaccaacagcatggggaaaacccaagctcatattggta

SEQ ID NO: 88446 - DNA, 201 bp, Bos taurus; identical to SEQ ID NO: 6585

SEQ ID NO: 88447 - DNA, 201 bp, Bos taurus
aaaagctgggaaacattccaaagggttggcctgtgtcactggagcacctttttttcttggctggatttgcattttcagagccttagagttttggcctggcgaccctccagggtggcggtcacaataatgtagacctgtcagagacatctacacagcccagccactctcatcagtggggacatgtgagaggagaagagcacc

SEQ ID NO: 88448 - DNA, 201 bp, Bos taurus; identical to SEQ ID NO: 6586

SEQ ID NO: 88449 - DNA, 201 bp, Bos taurus; identical to SEQ ID NO: 6587

SEQ ID NO: 88450 - DNA, 201 bp, Bos taurus; identical to SEQ ID NO: 6588

SEQ ID NO: 88451 - DNA, 201 bp, Bos taurus; identical to SEQ ID NO: 6589

SEQ ID NO: 88452 - DNA, 201 bp, Bos taurus; identical to SEQ ID NO: 6590

SEQ ID NO: 88453 - DNA, 201 bp, Bos taurus; identical to SEQ ID NO: 6591

SEQ ID NO: 88454 - DNA, 201 bp, Bos taurus; identical to SEQ ID NO: 6592

SEQ ID NO: 88455 - DNA, 201 bp, Bos taurus; identical to SEQ ID NO: 6593

SEQ ID NO: 88456 - DNA, 201 bp, Bos taurus
gcaaagagtcagacacgactgaagtgactgagcacgcacacataccttgaaagcatgtagaacagagcctggaaaatgtcaggcccccttttgcttttggtggctgttcagttgctcagtcgtgtcggattctttgtgaccctgtggattgcagcacaccaggcctccttgtccttcactctctccccgagtttgcccaag

SEQ ID NO: 88457 - DNA, 201 bp, Bos taurus
ctagaggaagatgaatatttcaccatcttggacctagttggttctcatcgtattctgtggccatgtctttcttttaaaggctatgccctgaccccttcccccctgcttcacttgcagtagctagaattcccagtaccatattgtttagtggtgagagtaaacatccttgccttgttcctgactatagagggaaacattcag

SEQ ID NO: 88458 - DNA, 201 bp, Bos taurus; identical to SEQ ID NO: 6594

SEQ ID NO: 88459 - DNA, 201 bp, Bos taurus; identical to SEQ ID NO: 6595

SEQ ID NO: 88460 - DNA, 201 bp, Bos taurus
aagcatcgggcaatatctatcaagacaaaatacagcaaatcatttgcccttgcactcccttttgatcatctctactatggaacaaaagaacaagtacttaaggatatgtgaataaggatatttaatgttgtttgtagtaggaaataaacaatctgggaacaatcagaatgaacattaatgggagactggtagaataaatta

SEQ ID NO: 88461 - DNA, 201 bp, Bos taurus; identical to SEQ ID NO: 6596

SEQ ID NO: 88462 - DNA, 201 bp, Bos taurus; identical to SEQ ID NO: 6597

SEQ ID NO: 88463 - DNA, 201 bp, Bos taurus; identical to SEQ ID NO: 6598

SEQ ID NO: 88464 - DNA, 201 bp, Bos taurus; identical to SEQ ID NO: 6602

SEQ ID NO: 88465 - DNA, 201 bp, Bos taurus
ggaagttgacaagttgacgaacaccagacttaattttgcccatcaatctaaattaatatactgcacaattacttatacttaactctaggcactgttgagaagaattaaataggtctctgcccttataaattcatagttgaactcagctggcacaaagagaaaacaaaagctaccttcagattttacatgccctaagaattt

SEQ ID NO: 88466 - DNA, 201 bp, Bos taurus; identical to SEQ ID NO: 6605

SEQ ID NO: 88467 - DNA, 201 bp, Bos taurus; identical to SEQ ID NO: 6606

SEQ ID NO: 88468 - DNA, 201 bp, Bos taurus; identical to SEQ ID NO: 6607

SEQ ID NO: 88469 - DNA, 201 bp, Bos taurus; identical to SEQ ID NO: 6608

SEQ ID NO: 88470 - DNA, 201 bp, Bos taurus; identical to SEQ ID NO: 6609

SEQ ID NO: 88471 - DNA, 201 bp, Bos taurus; identical to SEQ ID NO: 6610

SEQ ID NO: 88472 - DNA, 201 bp, Bos taurus; identical to SEQ ID NO: 6611

SEQ ID NO: 88473 - DNA, 201 bp, Bos taurus; identical to SEQ ID NO: 6612

SEQ ID NO: 88474 - DNA, 201 bp, Bos taurus; identical to SEQ ID NO: 6614

SEQ ID NO: 88475 - DNA, 201 bp, Bos taurus; identical to SEQ ID NO: 6616

SEQ ID NO: 88476 - DNA, 201 bp, Bos taurus; identical to SEQ ID NO: 6617

SEQ ID NO: 88477 - DNA, 201 bp, Bos taurus; identical to SEQ ID NO: 6618

SEQ ID NO: 88478 - DNA, 201 bp, Bos taurus; identical to SEQ ID NO: 6619

SEQ ID NO: 88479 - DNA, 201 bp, Bos taurus; identical to SEQ ID NO: 6620

SEQ ID NO: 88480 - DNA, 201 bp, Bos taurus; identical to SEQ ID NO: 6621

SEQ ID NO: 88481 - DNA, 201 bp, Bos taurus; identical to SEQ ID NO: 6622

SEQ ID NO: 88482 - DNA, 201 bp, Bos taurus; identical to SEQ ID NO: 6623

SEQ ID NO: 88483 - DNA, 201 bp, Bos taurus; identical to SEQ ID NO: 6625

SEQ ID NO: 88484 - DNA, 201 bp, Bos taurus
ataattagtaagtttaataaatatggctttatgaaatataaactattcaagataaatatgtcaaataattatggtgttaaattgtttccagctcccctccgacccaatccttggtaattagaaaatagaatgagcataaaaatggcaaagtatgcattactactgaaagctagggaaactttccactcaaattttagaaaa

SEQ ID NO: 88485 - DNA, 201 bp, Bos taurus
attagataccacaattcagggatggccagcctgcctacatgctctgggagcagctgcacttccctctcaggaaagtaaataatttacttttggagcacccgctgtcattcgttcaccacctgactttaaggacttactttctcacaaatccatgacccttctatttccttcccacatccaactaattcatgtcacccttct

SEQ ID NO: 88486 - DNA, 201 bp, Bos taurus
cagatgacaactatccatatgatagattaggctgcaatcagtataccaagaaagccagttcatcaaaaattagtcaaatgttgctaaagtcttaatatattccatgacttacttgcatactgaggtcttctgaactaaggcaaatgcaattcacttccaaattgctctccattgttttcttttgtactctggaacagattg

SEQ ID NO: 88487 - DNA, 201 bp, Bos taurus
attttgaatcaacagagaatttggggtctgcaaacatggcaagctacatacaagcccctgcactgcaagggaaggagagcacttttatggaaggaagaggaaattgtgagggctgcagtccacaaagagcccttggtttttcattggcccagttcttgcaaaagaaaaggagtctgtcttcttcctcttgggctctgcttt

SEQ ID NO: 88488 - DNA, 201 bp, Bos taurus; identical to SEQ ID NO: 6627

SEQ ID NO: 88489 - DNA, 201 bp, Bos taurus; identical to SEQ ID NO: 6628

SEQ ID NO: 88490 - DNA, 201 bp, Bos taurus; identical to SEQ ID NO: 6629

SEQ ID NO: 88491 - DNA, 201 bp, Bos taurus
tcgatctcagcttgtggaggacgccgggctgacggggcgctcagccccaccccctaccccctctggaggaggagccgacccgcccagagccggcctcccgaagttgtgcaggcgctgctccctgcaagtcaggaagacacaagaagaggaatttaaggaagagtgccggccgttgcccttctcagccctcgaagccgcatc

SEQ ID NO: 88492 - DNA, 201 bp, Bos taurus; identical to SEQ ID NO: 6632

SEQ ID NO: 88493 - DNA, 201 bp, Bos taurus; identical to SEQ ID NO: 6633

SEQ ID NO: 88494 - DNA, 201 bp, Bos taurus; identical to SEQ ID NO: 6635

SEQ ID NO: 88495 - DNA, 201 bp, Bos taurus
gggaccaagtttgttttattcataactgtatccctagcattgtgtctggtgcctatagtagatttttaatatatatttgttgactgactgataaatggccgaaatgttctttcataggtctctctgtatttaattcagttcagttcagtcactcagtcgtgtccaactctctgcgaccccatgaatcgcagcacaccaggc

SEQ ID NO: 88496 - DNA, 201 bp, Bos taurus; identical to SEQ ID NO: 6638

SEQ ID NO: 88497 - DNA, 201 bp, Bos taurus
aaagctcttactcaccctttaggccacaacttaccatttatttctgatagtcactttccgtaaccaccgctctcgaccctggactgtgtcctgtcactgtacagggtgtttccatggcagggctctacaggaagcctgccttccctgccatggcacttgttttaattgcacggtattgtaattgccttggtgattgtttgt

SEQ ID NO: 88498 - DNA, 201 bp, Bos taurus
ctagggatatttgggagacatttattatttattgaaataaaggatttcagaggcaaaaacttgaaatttaaatcctggttcagagtcttcattagccatgtgccttgagcatattaactgaacctctcttggtctcataggttttaaaaaaaaaggattataacacctaccttattgacttattagaatttagaagtatac

SEQ ID NO: 88499 - DNA, 201 bp, Bos taurus
atcttcgcttcctaggtctcatgcccttgtgtaatcccctcttcttgagtatgactcagttctagtgacttccttctattcgatagactgtggcaaaaatggcagtatgtcactttcactataggattacaaaagattgtgatggtcatcttgttaacacactcttcccgggccctctcatttgcccactctggtgaagtc

SEQ ID NO: 88500 - DNA, 201 bp, Bos taurus; identical to SEQ ID NO: 6640

SEQ ID NO: 88501 - DNA, 201 bp, Bos taurus; identical to SEQ ID NO: 6641

SEQ ID NO: 88502 - DNA, 201 bp, Bos taurus; identical to SEQ ID NO: 6643

SEQ ID NO: 88503 - DNA, 201 bp, Bos taurus; identical to SEQ ID NO: 6644

SEQ ID NO: 88504 - DNA, 201 bp, Bos taurus; identical to SEQ ID NO: 6645

SEQ ID NO: 88505 - DNA, 201 bp, Bos taurus; identical to SEQ ID NO: 6646

SEQ ID NO: 88506 - DNA, 201 bp, Bos taurus; identical to SEQ ID NO: 6649

SEQ ID NO: 88507 - DNA, 201 bp, Bos taurus; identical to SEQ ID NO: 6650

SEQ ID NO: 88508 - DNA, 201 bp, Bos taurus; identical to SEQ ID NO: 6651

SEQ ID NO: 88509 - DNA, 201 bp, Bos taurus
tacccacagtttggcaaggcctggggaaactaggttatgcttagaaatatgttcatgtccgtaaaaataaaatgaagatggcctgtcaaagtaagtgctgatgcacatcataaacatacaattagaaattacgggtatcatgttattcttttctgtgtaccatctcttgttttggccacagcacgcagcatgtggatctta

SEQ ID NO: 88510 - DNA, 201 bp, Bos taurus; identical to SEQ ID NO: 6652

SEQ ID NO: 88511 - DNA, 201 bp, Bos taurus; identical to SEQ ID NO: 6653

SEQ ID NO: 88512 - DNA, 201 bp, Bos taurus; identical to SEQ ID NO: 6656

SEQ ID NO: 88513 - DNA, 201 bp, Bos taurus; identical to SEQ ID NO: 6657

SEQ ID NO: 88514 - DNA, 201 bp, Bos taurus
agcttcaaagaaaaggtgattcttgaaccaaaccttaaaagagaagctggcacttgccaggcagatgacagctgggactaattcccaagagaggatactgggagcaaatgctttagtgttccaggggaattgaaaatgatctgactatgagaggaaaggggacagtattagagaaaggtaaagggacaggtaagaatcatc

SEQ ID NO: 88515 - DNA, 201 bp, Bos taurus
aagcccatgccagttctcaagggcatctgtaggccttaaaagaaagcaaagaaggcattgttccctgacacctccctgcaagatgcataatgaggacttgttgtgggccaggcactatgctttatgcacatcaaatcacttaagcctcacaacaagctagaaaagctgctattattgtccccactctagagaaaagaactg

SEQ ID NO: 88516 - DNA, 201 bp, Bos taurus
accagttaattccccctgcagaagtctggagaagacaagagctagggagaggaacaggggtgacaggggttgaagaggtactggcaagggtgagaatgactatctccctaacgcttttagctcaggctgtagaagagtcactcatggccaaggatcttgatttcaaagaaagcatgggaggaaaaataagtttttgttaaa

SEQ ID NO: 88517 - DNA, 201 bp, Bos taurus
tacccctactgctgagtgagacatcatgaagtgtccatgacaaatctgtggtcggcatcttcaatgcaacctgtgtcattcgatggggaatccacttcatcagctatttgaatattggtttcacaatctgaagaatagacctgtggttgccaagtttaaatcttaggcatcatctggttatgaaatcagtttggaaacatt

SEQ ID NO: 88518 - DNA, 201 bp, Bos taurus; identical to SEQ ID NO: 6658

SEQ ID NO: 88519 - DNA, 201 bp, Bos taurus; identical to SEQ ID NO: 6660

SEQ ID NO: 88520 - DNA, 201 bp, Bos taurus; identical to SEQ ID NO: 6661

SEQ ID NO: 88521 - DNA, 201 bp, Bos taurus; identical to SEQ ID NO: 6662

SEQ ID NO: 88522 - DNA, 201 bp, Bos taurus
tgttctagaaacctgcttttgtttctgcacagactgttgaacaccttcccaggtctgttcatcctcagacctgaatcagccactgctcacaccctcctgtccatatggctgaagccacctcaggtagtgacaatcagccagcccctgagactgcactttgagctatccctagggcaccacacagcccgcccagaagatcct

SEQ ID NO: 88523 - DNA, 201 bp, Bos taurus; identical to SEQ ID NO: 6663

SEQ ID NO: 88524 - DNA, 201 bp, Bos taurus; identical to SEQ ID NO: 6664

SEQ ID NO: 88525 - DNA, 201 bp, Bos taurus
gggagcagggcctgagctccctgggcaggtgggagcctccccaaagcaggtgttcagaacacaagccctcagatgcaaggggagtctgtggccacatcaacgggacctctaagctgccaggaagcaaaggtgattggtggggaagggctccaaggatgaggaccccactccttacccaggcattaggtagcgtacagctca

SEQ ID NO: 88526 - DNA, 201 bp, Bos taurus; identical to SEQ ID NO: 6668

SEQ ID NO: 88527 - DNA, 201 bp, Bos taurus
caaatcctattgggatttttttagtctctatgaggacacaaggtttttctactgctccatatttcatgctatttgattgtcccttcatcaaaggtgacacgcagccaggtaataaaccttccaaagagtggctgcattaatactctgggtgtgttcctactgagccatggcagccacctggacctccaccaaacacctcca

SEQ ID NO: 88528 - DNA, 201 bp, Bos taurus
ctctgtcttgtcagcagtgctgacttgcaggatgagtacgatgtgatcacatcacggttaacaatgaaagcgttgatggccacactgcaaaacaggattcgaagctgacggggcacttcatggtcattgttctaagtcaaactagactggcccctaagctctctgagaagcccgtgacctgattgtgtccactggcatcag

SEQ ID NO: 88529 - DNA, 201 bp, Bos taurus; identical to SEQ ID NO: 6669

SEQ ID NO: 88530 - DNA, 201 bp, Bos taurus; identical to SEQ ID NO: 6672

SEQ ID NO: 88531 - DNA, 201 bp, Bos taurus; identical to SEQ ID NO: 6673

SEQ ID NO: 88532 - DNA, 201 bp, Bos taurus; identical to SEQ ID NO: 6674

SEQ ID NO: 88533 - DNA, 201 bp, Bos taurus; identical to SEQ ID NO: 6675

SEQ ID NO: 88534 - DNA, 201 bp, Bos taurus; identical to SEQ ID NO: 6676

SEQ ID NO: 88535 - DNA, 201 bp, Bos taurus; identical to SEQ ID NO: 6677

SEQ ID NO: 88536 - DNA, 201 bp, Bos taurus; identical to SEQ ID NO: 6678

SEQ ID NO: 88537 - DNA, 201 bp, Bos taurus; identical to SEQ ID NO: 6679

SEQ ID NO: 88538 - DNA, 201 bp, Bos taurus; identical to SEQ ID NO: 6680

SEQ ID NO: 88539 - DNA, 201 bp, Bos taurus; identical to SEQ ID NO: 6681

SEQ ID NO: 88540 - DNA, 201 bp, Bos taurus; identical to SEQ ID NO: 6682

SEQ ID NO: 88541 - DNA, 201 bp, Bos taurus; identical to SEQ ID NO: 6683

SEQ ID NO: 88542 - DNA, 201 bp, Bos taurus; identical to SEQ ID NO: 6684

SEQ ID NO: 88543 - DNA, 201 bp, Bos taurus; identical to SEQ ID NO: 6685

SEQ ID NO: 88544 - DNA, 201 bp, Bos taurus; identical to SEQ ID NO: 6686

SEQ ID NO: 88545 - DNA, 201 bp, Bos taurus; identical to SEQ ID NO: 6687

SEQ ID NO: 88546 - DNA, 201 bp, Bos taurus; identical to SEQ ID NO: 6688

SEQ ID NO: 88547 - DNA, 201 bp, Bos taurus; identical to SEQ ID NO: 6689

SEQ ID NO: 88548 - DNA, 201 bp, Bos taurus; identical to SEQ ID NO: 6690

SEQ ID NO: 88549 - DNA, 201 bp, Bos taurus; identical to SEQ ID NO: 6691

SEQ ID NO: 88550 - DNA, 201 bp, Bos taurus; identical to SEQ ID NO: 6692

SEQ ID NO: 88551 - DNA, 201 bp, Bos taurus; identical to SEQ ID NO: 6693

SEQ ID NO: 88552 - DNA, 201 bp, Bos taurus; identical to SEQ ID NO: 6694

SEQ ID NO: 88553 - DNA, 201 bp, Bos taurus; identical to SEQ ID NO: 6695

SEQ ID NO: 88554 - DNA, 201 bp, Bos taurus; identical to SEQ ID NO: 6697

SEQ ID NO: 88555 - DNA, 201 bp, Bos taurus; identical to SEQ ID NO: 6698

SEQ ID NO: 88556 - DNA, 201 bp, Bos taurus; identical to SEQ ID NO: 6699

SEQ ID NO: 88557 - DNA, 201 bp, Bos taurus; identical to SEQ ID NO: 6700

SEQ ID NO: 88558 - DNA, 201 bp, Bos taurus; identical to SEQ ID NO: 6701

SEQ ID NO: 88559 - DNA, 201 bp, Bos taurus; identical to SEQ ID NO: 6702

SEQ ID NO: 88560 - DNA, 201 bp, Bos taurus; identical to SEQ ID NO: 6703

SEQ ID NO: 88561 - DNA, 201 bp, Bos taurus; identical to SEQ ID NO: 6704

SEQ ID NO: 88562 - DNA, 201 bp, Bos taurus; identical to SEQ ID NO: 6705

SEQ ID NO: 88563 - DNA, 201 bp, Bos taurus; identical to SEQ ID NO: 6706

SEQ ID NO: 88564 - DNA, 201 bp, Bos taurus; identical to SEQ ID NO: 6707

SEQ ID NO: 88565 - DNA, 201 bp, Bos taurus; identical to SEQ ID NO: 6708

SEQ ID NO: 88566 - DNA, 201 bp, Bos taurus; identical to SEQ ID NO: 6709

SEQ ID NO: 88567 - DNA, 201 bp, Bos taurus; identical to SEQ ID NO: 6710

SEQ ID NO: 88568 - DNA, 201 bp, Bos taurus; identical to SEQ ID NO: 6711

SEQ ID NO: 88569 - DNA, 201 bp, Bos taurus; identical to SEQ ID NO: 6712

SEQ ID NO: 88570 - DNA, 201 bp, Bos taurus; identical to SEQ ID NO: 6713

SEQ ID NO: 88571 - DNA, 201 bp, Bos taurus; identical to SEQ ID NO: 6714

SEQ ID NO: 88572 - DNA, 201 bp, Bos taurus; identical to SEQ ID NO: 6715

SEQ ID NO: 88573 - DNA, 201 bp, Bos taurus; identical to SEQ ID NO: 6716

SEQ ID NO: 88574 - DNA, 201 bp, Bos taurus; identical to SEQ ID NO: 6717

SEQ ID NO: 88575 - DNA, 201 bp, Bos taurus; identical to SEQ ID NO: 6718

SEQ ID NO: 88576 - DNA, 201 bp, Bos taurus; identical to SEQ ID NO: 6719

SEQ ID NO: 88577 - DNA, 201 bp, Bos taurus; identical to SEQ ID NO: 6720

SEQ ID NO: 88578 - DNA, 201 bp, Bos taurus; identical to SEQ ID NO: 6721

SEQ ID NO: 88579 - DNA, 201 bp, Bos taurus; identical to SEQ ID NO: 6722

SEQ ID NO: 88580 - DNA, 201 bp, Bos taurus; identical to SEQ ID NO: 6723

SEQ ID NO: 88581 - DNA, 201 bp, Bos taurus; identical to SEQ ID NO: 6724

SEQ ID NO: 88582 - DNA, 201 bp, Bos taurus; identical to SEQ ID NO: 6725

SEQ ID NO: 88583 - DNA, 201 bp, Bos taurus; identical to SEQ ID NO: 6726

SEQ ID NO: 88584 - DNA, 201 bp, Bos taurus; identical to SEQ ID NO: 6727

SEQ ID NO: 88585 - DNA, 201 bp, Bos taurus; identical to SEQ ID NO: 6728

SEQ ID NO: 88586 - DNA, 201 bp, Bos taurus; identical to SEQ ID NO: 6729

SEQ ID NO: 88587 - DNA, 201 bp, Bos taurus; identical to SEQ ID NO: 6730

SEQ ID NO: 88588 - DNA, 201 bp, Bos taurus; identical to SEQ ID NO: 6731

SEQ ID NO: 88589 - DNA, 201 bp, Bos taurus; identical to SEQ ID NO: 6732

SEQ ID NO: 88590 - DNA, 201 bp, Bos taurus; identical to SEQ ID NO: 6733

SEQ ID NO: 88591 - DNA, 201 bp, Bos taurus; identical to SEQ ID NO: 6734

SEQ ID NO: 88592 - DNA, 201 bp, Bos taurus; identical to SEQ ID NO: 6735

SEQ ID NO: 88593 - DNA, 201 bp, Bos taurus; identical to SEQ ID NO: 6736

SEQ ID NO: 88594 - DNA, 201 bp, Bos taurus; identical to SEQ ID NO: 6737

SEQ ID NO: 88595 - DNA, 201 bp, Bos taurus; identical to SEQ ID NO: 6738

SEQ ID NO: 88596 - DNA, 201 bp, Bos taurus; identical to SEQ ID NO: 6739

SEQ ID NO: 88597 - DNA, 201 bp, Bos taurus; identical to SEQ ID NO: 6740

SEQ ID NO: 88598 - DNA, 201 bp, Bos taurus; identical to SEQ ID NO: 6741

SEQ ID NO: 88599 - DNA, 201 bp, Bos taurus; identical to SEQ ID NO: 6742

SEQ ID NO: 88600 - DNA, 201 bp, Bos taurus; identical to SEQ ID NO: 6743

SEQ ID NO: 88601 - DNA, 201 bp, Bos taurus; identical to SEQ ID NO: 6744

SEQ ID NO: 88602 - DNA, 201 bp, Bos taurus; identical to SEQ ID NO: 6745

SEQ ID NO: 88603 - DNA, 201 bp, Bos taurus; identical to SEQ ID NO: 6746

SEQ ID NO: 88604 - DNA, 201 bp, Bos taurus; identical to SEQ ID NO: 6747

SEQ ID NO: 88605 - DNA, 201 bp, Bos taurus; identical to SEQ ID NO: 6748

SEQ ID NO: 88606 - DNA, 201 bp, Bos taurus; identical to SEQ ID NO: 6749

SEQ ID NO: 88607 - DNA, 201 bp, Bos taurus; identical to SEQ ID NO: 6750

SEQ ID NO: 88608 - DNA, 201 bp, Bos taurus; identical to SEQ ID NO: 6751

SEQ ID NO: 88609 - DNA, 201 bp, Bos taurus; identical to SEQ ID NO: 6752

SEQ ID NO: 88610 - DNA, 201 bp, Bos taurus; identical to SEQ ID NO: 6753

SEQ ID NO: 88611 - DNA, 201 bp, Bos taurus; identical to SEQ ID NO: 6754

SEQ ID NO: 88612 - DNA, 201 bp, Bos taurus; identical to SEQ ID NO: 6755

SEQ ID NO: 88613 - DNA, 201 bp, Bos taurus; identical to SEQ ID NO: 6756

SEQ ID NO: 88614 - DNA, 201 bp, Bos taurus; identical to SEQ ID NO: 6757

SEQ ID NO: 88615 - DNA, 201 bp, Bos taurus; identical to SEQ ID NO: 6758

SEQ ID NO: 88616 - DNA, 201 bp, Bos taurus; identical to SEQ ID NO: 6759

SEQ ID NO: 88617 - DNA, 201 bp, Bos taurus; identical to SEQ ID NO: 6760

SEQ ID NO: 88618 - DNA, 201 bp, Bos taurus; identical to SEQ ID NO: 6761

SEQ ID NO: 88619 - DNA, 201 bp, Bos taurus; identical to SEQ ID NO: 6762

SEQ ID NO: 88620 - DNA, 201 bp, Bos taurus; identical to SEQ ID NO: 6763

SEQ ID NO: 88621 - DNA, 201 bp, Bos taurus; identical to SEQ ID NO: 6764

SEQ ID NO: 88622 - DNA, 201 bp, Bos taurus; identical to SEQ ID NO: 6766

SEQ ID NO: 88623 - DNA, 201 bp, Bos taurus; identical to SEQ ID NO: 6767

SEQ ID NO: 88624 - DNA, 201 bp, Bos taurus; identical to SEQ ID NO: 6768

SEQ ID NO: 88625 - DNA, 201 bp, Bos taurus; identical to SEQ ID NO: 6769

SEQ ID NO: 88626 - DNA, 201 bp, Bos taurus; identical to SEQ ID NO: 6770

SEQ ID NO: 88627 - DNA, 201 bp, Bos taurus; identical to SEQ ID NO: 6771

SEQ ID NO: 88628 - DNA, 201 bp, Bos taurus; identical to SEQ ID NO: 6772

SEQ ID NO: 88629 - DNA, 201 bp, Bos taurus; identical to SEQ ID NO: 6773

SEQ ID NO: 88630 - DNA, 201 bp, Bos taurus; identical to SEQ ID NO: 6774

SEQ ID NO: 88631 - DNA, 201 bp, Bos taurus; identical to SEQ ID NO: 6775

SEQ ID NO: 88632 - DNA, 201 bp, Bos taurus; identical to SEQ ID NO: 6776

SEQ ID NO: 88633 - DNA, 201 bp, Bos taurus; identical to SEQ ID NO: 6777

SEQ ID NO: 88634 - DNA, 201 bp, Bos taurus; identical to SEQ ID NO: 6778

SEQ ID NO: 88635 - DNA, 201 bp, Bos taurus; identical to SEQ ID NO: 6779

SEQ ID NO: 88636 - DNA, 201 bp, Bos taurus; identical to SEQ ID NO: 6780

SEQ ID NO: 88637 - DNA, 201 bp, Bos taurus; identical to SEQ ID NO: 6781

SEQ ID NO: 88638 - DNA, 201 bp, Bos taurus; identical to SEQ ID NO: 6782

SEQ ID NO: 88639 - DNA, 201 bp, Bos taurus; identical to SEQ ID NO: 6783

SEQ ID NO: 88640 - DNA, 201 bp, Bos taurus; identical to SEQ ID NO: 6784

SEQ ID NO: 88641 - DNA, 201 bp, Bos taurus; identical to SEQ ID NO: 6785

SEQ ID NO: 88642 - DNA, 201 bp, Bos taurus; identical to SEQ ID NO: 6786

SEQ ID NO: 88643 - DNA, 201 bp, Bos taurus; identical to SEQ ID NO: 6787

SEQ ID NO: 88644 - DNA, 201 bp, Bos taurus; identical to SEQ ID NO: 6788

SEQ ID NO: 88645 - DNA, 201 bp, Bos taurus; identical to SEQ ID NO: 6789

SEQ ID NO: 88646 - DNA, 201 bp, Bos taurus; identical to SEQ ID NO: 6790

SEQ ID NO: 88647 - DNA, 201 bp, Bos taurus; identical to SEQ ID NO: 6791

SEQ ID NO: 88648 - DNA, 201 bp, Bos taurus; identical to SEQ ID NO: 6792

SEQ ID NO: 88649 - DNA, 201 bp, Bos taurus; identical to SEQ ID NO: 6793

SEQ ID NO: 88650 - DNA, 201 bp, Bos taurus; identical to SEQ ID NO: 6794

SEQ ID NO: 88651 - DNA, 201 bp, Bos taurus; identical to SEQ ID NO: 6795

SEQ ID NO: 88652 - DNA, 201 bp, Bos taurus; identical to SEQ ID NO: 6796

SEQ ID NO: 88653 - DNA, 201 bp, Bos taurus; identical to SEQ ID NO: 6797

SEQ ID NO: 88654 - DNA, 201 bp, Bos taurus
ccatgctccacaccacacacccttagagctgagagtgtgtggtcctcatcctcgccactgctccagcacatgagaaacacagaggaagggtgacaggcctggtccatctcactacagctccatccagaagaggacagagccattccaggacagagccatctaatcccaccattacacggggacgttctctcaccctggact

SEQ ID NO: 88655 - DNA, 201 bp, Bos taurus; identical to SEQ ID NO: 6799

SEQ ID NO: 88656 - DNA, 201 bp, Bos taurus
aatcttagtaatttttctattattttgaatctattaatttctattaattttaatgattaacattgtaacatttataatcaatgtaatatttaatattgtaatatctcagatttaatggtagcccacaatacatttgttaaacactactagacttgacctatttttagaaaggtggaatgattttttcttgtggttctgtag

SEQ ID NO: 88657 - DNA, 201 bp, Bos taurus; identical to SEQ ID NO: 6800

SEQ ID NO: 88658 - DNA, 201 bp, Bos taurus; identical to SEQ ID NO: 6801

SEQ ID NO: 88659 - DNA, 201 bp, Bos taurus; identical to SEQ ID NO: 6802

SEQ ID NO: 88660 - DNA, 201 bp, Bos taurus
ctgtttcatgcttaatgatcgctcttttgttatgctgacatgtgtgtgtgtcaaaggcatttatttagactttgtgggcaggaactaggtccttctgcagttccacaggagaggtttggaggccagttccccagcatcagctgctggggttggggcttggttagaggaacttggtccatgagagaaggaggcacaccatgg

SEQ ID NO: 88661 - DNA, 201 bp, Bos taurus; identical to SEQ ID NO: 6803

SEQ ID NO: 88662 - DNA, 201 bp, Bos taurus; identical to SEQ ID NO: 6804

SEQ ID NO: 88663 - DNA, 201 bp, Bos taurus
cttgcagctctacaaccagcattcatcatctttctttgcctccatgtgacattccccatgttgtatattttccttctaaagtaggttccataataatatgaagtgccacatctggggccaggttgtctgcacttgaatgctagctgtctgagtgaccttgtgcaagttatttagtatttctgtcctcttctgtaaaatgag

SEQ ID NO: 88664 - DNA, 201 bp, Bos taurus; identical to SEQ ID NO: 6805

SEQ ID NO: 88665 - DNA, 201 bp, Bos taurus
aaaacataaatgatgaaaccatgtgaaacttggccatataatggttcaccagcatcctattatccaaaaaataacttctattctgcacttgaagaaaatgtgcatggatttgtaggcttgtgaaaggagccatactagaaactctgcatgtagaagttctttgtatacataacaacacatcgataggcagtaccatgcaag

SEQ ID NO: 88666 - DNA, 201 bp, Bos taurus
tatagctctagatatttacttaaaatgggtgaaatgtataatatgtcaattaaaactcagtaatgctcttaagtaaattatactgttagatattaattagtgctaaagcttcaaagtagaatcagcaggataaacactttagagactaggaaaattcaatatttatagaattcctgagaggaatttttaaaaagattttga

SEQ ID NO: 88667 - DNA, 201 bp, Bos taurus
tttttttttttttgctactttcttaatgtcttttcaatatctccccattaactagaataaacctgaattaatcttggtgtttttttttggaacttgaaaatgtctaatactccactattcatgcttgaggatcaagacttaataattttgacaggttctggtcctattaaggccatgggatctactctattgatgactgac

SEQ ID NO: 88668 - DNA, 201 bp, Bos taurus
ttcctgactattctatacattacttacaaatataccttaaatgctaagtatcattaaaccaaaacacttacgcttcataaatcatactgtatcatctttacatcattgttgattttcaatttaaattttctaaatctaaaccactgacctgaagagttaaatttactattttttgacccctgtaaatgtctcttttcttat

SEQ ID NO: 88669 - DNA, 201 bp, Bos taurus; identical to SEQ ID NO: 6807

SEQ ID NO: 88670 - DNA, 201 bp, Bos taurus; identical to SEQ ID NO: 6808

SEQ ID NO: 88671 - DNA, 201 bp, Bos taurus; identical to SEQ ID NO: 6809

SEQ ID NO: 88672 - DNA, 201 bp, Bos taurus; identical to SEQ ID NO: 6811

SEQ ID NO: 88673 - DNA, 201 bp, Bos taurus; identical to SEQ ID NO: 6812

SEQ ID NO: 88674 - DNA, 201 bp, Bos taurus
tgggttaaagaaagtctacaatttcactccaggtcctgctctaagcactctgagtctaagtgcacctaacacttgtacacagtctttccaggccccagaattgactgtgatttttcggcttccctcgtggctcagctggtgaagaatccacctgcaatgcgggaggcctgagttcaacccctgggttgggaagaccccctg

SEQ ID NO: 88675 - DNA, 201 bp, Bos taurus
tgggcaggaggttatgtcccaagggagggagccctgaaacaggagttcctgttcacagggaaactccctcacagtcaggcccaaaagggagctgcaaagtgttggaaaaccaggcacaacagggacttgaagggcagtaaacagagaaagccgcacttctcagcccgttaacagctcgtggactttggccccaaacagaca

SEQ ID NO: 88676 - DNA, 201 bp, Bos taurus
gagatatttgccatagtccccgattttgcaactagaactattctgcaaaaagcaggggaaatggatagaggtcccctatgtccaaattttttcaactaaagacatgaagggactatgccttaagtatgggattaatctataccctaaaaatgaacttactaggcaaatggaattagacctcatataactaagagaaggaag

SEQ ID NO: 88677 - DNA, 201 bp, Bos taurus; identical to SEQ ID NO: 6813

SEQ ID NO: 88678 - DNA, 201 bp, Bos taurus; identical to SEQ ID NO: 6814

SEQ ID NO: 88679 - DNA, 201 bp, Bos taurus
atgagttatgcatgtttcagtttttactgacctgaatttctaatattcataaatttgggcaggtaattcaggtcatttataaaaaccatacaataaatcattacagttctaaatcacatacagaattttcttccttaagaagaaatgcaagcatatcacaagttatttttcaaagaatttttcaagtatatatagaaatgc

SEQ ID NO: 88680 - DNA, 201 bp, Bos taurus; identical to SEQ ID NO: 6815

SEQ ID NO: 88681 - DNA, 201 bp, Bos taurus; identical to SEQ ID NO: 6816

SEQ ID NO: 88682 - DNA, 201 bp, Bos taurus; identical to SEQ ID NO: 6818

SEQ ID NO: 88683 - DNA, 201 bp, Bos taurus; identical to SEQ ID NO: 6819

SEQ ID NO: 88684 - DNA, 201 bp, Bos taurus
aggcatattttatagacttagacacattccaagtccacctgaagagaaaaacttaaattcgttacaaagctatcaaacatcagaagtcaagggatacttcgtttctgttctatttttgacaactgtatgcaatcttattatcagttttcatgttcccaaatttagaatttgcttgccttgttaaggctctttcttctttta

SEQ ID NO: 88685 - DNA, 201 bp, Bos taurus; identical to SEQ ID NO: 6822

SEQ ID NO: 88686 - DNA, 201 bp, Bos taurus; identical to SEQ ID NO: 6827

SEQ ID NO: 88687 - DNA, 201 bp, Bos taurus; identical to SEQ ID NO: 6828

SEQ ID NO: 88688 - DNA, 201 bp, Bos taurus; identical to SEQ ID NO: 6829

SEQ ID NO: 88689 - DNA, 201 bp, Bos taurus; identical to SEQ ID NO: 6830

SEQ ID NO: 88690 - DNA, 201 bp, Bos taurus
atccttctagagcactctatttcctgctaccctagccaccaactcccctgagtacatggtgatgtctggtcccctgagactcaagtagctgcaccaccttcactcctggccctcacaggggcaagcccaaaccttccagggcagcctcaggagcgaacccctgtggacaacccacatgcaaaggtggaaataaaaccacga

SEQ ID NO: 88691 - DNA, 201 bp, Bos taurus; identical to SEQ ID NO: 6831

SEQ ID NO: 88692 - DNA, 201 bp, Bos taurus; identical to SEQ ID NO: 6832

SEQ ID NO: 88693 - DNA, 201 bp, Bos taurus; identical to SEQ ID NO: 6833

SEQ ID NO: 88694 - DNA, 201 bp, Bos taurus; identical to SEQ ID NO: 6834

SEQ ID NO: 88695 - DNA, 201 bp, Bos taurus; identical to SEQ ID NO: 6835

SEQ ID NO: 88696 - DNA, 201 bp, Bos taurus; identical to SEQ ID NO: 6836

SEQ ID NO: 88697 - DNA, 201 bp, Bos taurus; identical to SEQ ID NO: 6837

SEQ ID NO: 88698 - DNA, 201 bp, Bos taurus; identical to SEQ ID NO: 6838

SEQ ID NO: 88699 - DNA, 201 bp, Bos taurus; identical to SEQ ID NO: 6840

SEQ ID NO: 88700 - DNA, 201 bp, Bos taurus; identical to SEQ ID NO: 6842

SEQ ID NO: 88701 - DNA, 201 bp, Bos taurus; identical to SEQ ID NO: 6847

SEQ ID NO: 88702 - DNA, 201 bp, Bos taurus; identical to SEQ ID NO: 6848

SEQ ID NO: 88703 - DNA, 201 bp, Bos taurus; identical to SEQ ID NO: 6849

SEQ ID NO: 88704 - DNA, 201 bp, Bos taurus; identical to SEQ ID NO: 6850

SEQ ID NO: 88705 - DNA, 201 bp, Bos taurus; identical to SEQ ID NO: 6851

SEQ ID NO: 88706 - DNA, 201 bp, Bos taurus; identical to SEQ ID NO: 6852

SEQ ID NO: 88707 - DNA, 201 bp, Bos taurus; identical to SEQ ID NO: 6855

SEQ ID NO: 88708 - DNA, 201 bp, Bos taurus; identical to SEQ ID NO: 6856

SEQ ID NO: 88709 - DNA, 201 bp, Bos taurus; identical to SEQ ID NO: 6857

SEQ ID NO: 88710 - DNA, 201 bp, Bos taurus; identical to SEQ ID NO: 6858

SEQ ID NO: 88711 - DNA, 201 bp, Bos taurus; identical to SEQ ID NO: 6859

SEQ ID NO: 88712 - DNA, 201 bp, Bos taurus; identical to SEQ ID NO: 6862

SEQ ID NO: 88713 - DNA, 201 bp, Bos taurus; identical to SEQ ID NO: 6863

SEQ ID NO: 88714 - DNA, 201 bp, Bos taurus; identical to SEQ ID NO: 6864

SEQ ID NO: 88715 - DNA, 201 bp, Bos taurus; identical to SEQ ID NO: 6866

SEQ ID NO: 88716 - DNA, 201 bp, Bos taurus; identical to SEQ ID NO: 6872

SEQ ID NO: 88717 - DNA, 201 bp, Bos taurus; identical to SEQ ID NO: 6873

SEQ ID NO: 88718 - DNA, 201 bp, Bos taurus; identical to SEQ ID NO: 6874

SEQ ID NO: 88719 - DNA, 201 bp, Bos taurus; identical to SEQ ID NO: 6875

SEQ ID NO: 88720 - DNA, 201 bp, Bos taurus; identical to SEQ ID NO: 6877

SEQ ID NO: 88721 - DNA, 201 bp, Bos taurus; identical to SEQ ID NO: 6878

SEQ ID NO: 88722 - DNA, 201 bp, Bos taurus; identical to SEQ ID NO: 6879

SEQ ID NO: 88723 - DNA, 201 bp, Bos taurus; identical to SEQ ID NO: 6880

SEQ ID NO: 88724 - DNA, 201 bp, Bos taurus; identical to SEQ ID NO: 6881

SEQ ID NO: 88725 - DNA, 201 bp, Bos taurus; identical to SEQ ID NO: 6883

SEQ ID NO: 88726 - DNA, 201 bp, Bos taurus; identical to SEQ ID NO: 6885

SEQ ID NO: 88727 - DNA, 201 bp, Bos taurus; identical to SEQ ID NO: 6886

SEQ ID NO: 88728 - DNA, 201 bp, Bos taurus; identical to SEQ ID NO: 6887

SEQ ID NO: 88729 - DNA, 201 bp, Bos taurus; identical to SEQ ID NO: 6888

SEQ ID NO: 88730 - DNA, 201 bp, Bos taurus; identical to SEQ ID NO: 6890

SEQ ID NO: 88731 - DNA, 201 bp, Bos taurus; identical to SEQ ID NO: 6891

SEQ ID NO: 88732 - DNA, 201 bp, Bos taurus; identical to SEQ ID NO: 6893

SEQ ID NO: 88733 - DNA, 201 bp, Bos taurus; identical to SEQ ID NO: 6894

SEQ ID NO: 88734 - DNA, 201 bp, Bos taurus; identical to SEQ ID NO: 6895

SEQ ID NO: 88735 - DNA, 201 bp, Bos taurus; identical to SEQ ID NO: 6896

SEQ ID NO: 88736 - DNA, 201 bp, Bos taurus; identical to SEQ ID NO: 6900

SEQ ID NO: 88737 - DNA, 201 bp, Bos taurus; identical to SEQ ID NO: 6901

SEQ ID NO: 88738 - DNA, 201 bp, Bos taurus; identical to SEQ ID NO: 6902

SEQ ID NO: 88739 - DNA, 201 bp, Bos taurus; identical to SEQ ID NO: 6904

SEQ ID NO: 88740 - DNA, 201 bp, Bos taurus; identical to SEQ ID NO: 6905

SEQ ID NO: 88741 - DNA, 201 bp, Bos taurus; identical to SEQ ID NO: 6906

SEQ ID NO: 88742 - DNA, 201 bp, Bos taurus; identical to SEQ ID NO: 6908

SEQ ID NO: 88743 - DNA, 201 bp, Bos taurus; identical to SEQ ID NO: 6914

SEQ ID NO: 88744 - DNA, 201 bp, Bos taurus; identical to SEQ ID NO: 6915

SEQ ID NO: 88745 - DNA, 201 bp, Bos taurus
gtggaggccagctgccaggtcctatgtagtgacagtggctagttgcaaacagacttgtagggacggggacagaaccaactatgggctcacagccagtgaggttctggttactggcctactgttccatggctgcacactctcccctttggtgtgtataaagtattaatatcttagttactcaagaactactttgtccacagt

SEQ ID NO: 88746 - DNA, 201 bp, Bos taurus
ttccttttcatatttagaattatttttcaatgtataaaaatagatggcacaaaccaattgcaatttccagcttttattgaaaatgtgaaatatctggtcattttaggcccacgtgtgtgcttagtcactcagtcgggcccaactctttgcaaccccacggactctaggcaagaatactggagtgggttgccatttcctcct

SEQ ID NO: 88747 - DNA, 201 bp, Bos taurus; identical to SEQ ID NO: 6916

SEQ ID NO: 88748 - DNA, 201 bp, Bos taurus; identical to SEQ ID NO: 6917

SEQ ID NO: 88749 - DNA, 201 bp, Bos taurus
agatcctaaattagaaggaatttattttagtgttgaattcctgggaacaactctgaagatctgtataaatcccatgacatcagcccatcctctttcttccgtaataattagaagaggttggtaaatacataagcaacagcagtggccctttgcccactgcagtcagccaacatgattgttacaggcaagaaccaaaatctg

SEQ ID NO: 88750 - DNA, 201 bp, Bos taurus; identical to SEQ ID NO: 6920

SEQ ID NO: 88751 - DNA, 201 bp, Bos taurus; identical to SEQ ID NO: 6921

SEQ ID NO: 88752 - DNA, 201 bp, Bos taurus; identical to SEQ ID NO: 6922

SEQ ID NO: 88753 - DNA, 201 bp, Bos taurus; identical to SEQ ID NO: 6923

SEQ ID NO: 88754 - DNA, 201 bp, Bos taurus; identical to SEQ ID NO: 6924

SEQ ID NO: 88755 - DNA, 201 bp, Bos taurus
cgtcccaccttgagatcttagaaaagcatctcatcccagcttcccaggcagctcctcagcctctggcaaggttaaattccatggcctcgcaccctcaaagggtacccaaccttagcaaaaccccacaagccatgcctccaaggctctattatttcagcatctggacaagcacaccttgtaactgcattaacgaggaggccc

SEQ ID NO: 88756 - DNA, 201 bp, Bos taurus
gctttccttccaagaagcacatgtcttttaatctatcaaatgtaactttatcaaactcctaaaaagcaatgcatcctattattaggccagcatgagcccagagtcatagaaataatgaaggtagagaaaatgtgggctttgttatggagtgttttcaaagagtaaagataggactctgtgcaggtgatggccaccctctat

SEQ ID NO: 88757 - DNA, 201 bp, Bos taurus; identical to SEQ ID NO: 6925

SEQ ID NO: 88758 - DNA, 201 bp, Bos taurus; identical to SEQ ID NO: 6926

SEQ ID NO: 88759 - DNA, 201 bp, Bos taurus
agggaggctgtgaaaaaaggtaagaggaggacttcgttgaaaacatggcctaagggagacaccatgttagaagatgaacatgtatttgtctttcactgtccagaacttagaatgtcttttctcaaagaaacactgaaaatgatgagttcccacactagtccaaacagaaaacctattttagataatgacgtgaattaaaaa

SEQ ID NO: 88760 - DNA, 201 bp, Bos taurus
tgtagaagctgattactcaggtgtaatccacaaagaatcaataatgcagcagaaagacaagtaaaacaagtataataaagggtagtaagtgatgactaacaactcttcctttgccaactgtgtaacattggaagatgagttaatctcaccgcttcagtctctggcagccccagtaaatgtagtaataaaaatattaatctc

SEQ ID NO: 88761 - DNA, 201 bp, Bos taurus
agcagttcccctatctctcttgtgggatctccatattccctgagacacaacgatattgaaattagggcaattagtaactctacagtggcctctgagtagttaagtgaaaggatgaatttcttgtctctcactttaaatcaaaagtgagaaatggttaaacttagtgagaagggcatgtcaaaagcagagagaggcaaccaa

SEQ ID NO: 88762 - DNA, 201 bp, Bos taurus; identical to SEQ ID NO: 6927

SEQ ID NO: 88763 - DNA, 201 bp, Bos taurus; identical to SEQ ID NO: 6928

SEQ ID NO: 88764 - DNA, 201 bp, Bos taurus; identical to SEQ ID NO: 6929

SEQ ID NO: 88765 - DNA, 201 bp, Bos taurus; identical to SEQ ID NO: 6930

SEQ ID NO: 88766 - DNA, 201 bp, Bos taurus
gtaattcatgtttctcagaaaggcgtggatttcttttaagccagcaaattctggtttgaacagaaatcatggcctcttggggctttcagccttcctccattgccctcttcctcggttgaagatcactttgagtcttgccaaactcccttctgcacatcctgggtactggaattctgtgtcaggggacagcacgacgtgcga

SEQ ID NO: 88767 - DNA, 201 bp, Bos taurus; identical to SEQ ID NO: 6931

SEQ ID NO: 88768 - DNA, 201 bp, Bos taurus
tacagcttattttagaatattagtacttctgcaactaattagccaccatctatggactattgcttgcttcttatttattctaatatggccaaagagtgtaattagcaaatgtaaagatggctcaaggcaaaatttaatatacaaacataaaataagcttcatgcaaagctctgaatgggaactgaggaaacagaagttttt

SEQ ID NO: 88769 - DNA, 201 bp, Bos taurus; identical to SEQ ID NO: 6932

SEQ ID NO: 88770 - DNA, 201 bp, Bos taurus; identical to SEQ ID NO: 6933

SEQ ID NO: 88771 - DNA, 201 bp, Bos taurus; identical to SEQ ID NO: 6934

SEQ ID NO: 88772 - DNA, 201 bp, Bos taurus; identical to SEQ ID NO: 6936

SEQ ID NO: 88773 - DNA, 201 bp, Bos taurus; identical to SEQ ID NO: 6937

SEQ ID NO: 88774 - DNA, 201 bp, Bos taurus; identical to SEQ ID NO: 6938

SEQ ID NO: 88775 - DNA, 201 bp, Bos taurus; identical to SEQ ID NO: 6939

SEQ ID NO: 88776 - DNA, 201 bp, Bos taurus; identical to SEQ ID NO: 6940

SEQ ID NO: 88777 - DNA, 201 bp, Bos taurus; identical to SEQ ID NO: 6942

SEQ ID NO: 88778 - DNA, 201 bp, Bos taurus; identical to SEQ ID NO: 6943

SEQ ID NO: 88779 - DNA, 201 bp, Bos taurus; identical to SEQ ID NO: 6945

SEQ ID NO: 88780 - DNA, 201 bp, Bos taurus; identical to SEQ ID NO: 6946

SEQ ID NO: 88781 - DNA, 201 bp, Bos taurus; identical to SEQ ID NO: 6949

SEQ ID NO: 88782 - DNA, 201 bp, Bos taurus; identical to SEQ ID NO: 6950

SEQ ID NO: 88783 - DNA, 201 bp, Bos taurus; identical to SEQ ID NO: 6952

SEQ ID NO: 88784 - DNA, 201 bp, Bos taurus; identical to SEQ ID NO: 6953

SEQ ID NO: 88785 - DNA, 201 bp, Bos taurus; identical to SEQ ID NO: 6954

SEQ ID NO: 88786 - DNA, 201 bp, Bos taurus; identical to SEQ ID NO: 6956

SEQ ID NO: 88787 - DNA, 201 bp, Bos taurus; identical to SEQ ID NO: 6957

SEQ ID NO: 88788 - DNA, 201 bp, Bos taurus; identical to SEQ ID NO: 6958

SEQ ID NO: 88789 - DNA, 201 bp, Bos taurus; identical to SEQ ID NO: 6960

SEQ ID NO: 88790 - DNA, 201 bp, Bos taurus; identical to SEQ ID NO: 6961

SEQ ID NO: 88791 - DNA, 201 bp, Bos taurus; identical to SEQ ID NO: 6962

SEQ ID NO: 88792 - DNA, 201 bp, Bos taurus; identical to SEQ ID NO: 6964

SEQ ID NO: 88793 - DNA, 201 bp, Bos taurus; identical to SEQ ID NO: 6965

SEQ ID NO: 88794 - DNA, 201 bp, Bos taurus; identical to SEQ ID NO: 6966

SEQ ID NO: 88795 - DNA, 201 bp, Bos taurus; identical to SEQ ID NO: 6967

SEQ ID NO: 88796 - DNA, 201 bp, Bos taurus; identical to SEQ ID NO: 6968

SEQ ID NO: 88797 - DNA, 201 bp, Bos taurus; identical to SEQ ID NO: 6969

SEQ ID NO: 88798 - DNA, 201 bp, Bos taurus; identical to SEQ ID NO: 6973

SEQ ID NO: 88799 - DNA, 201 bp, Bos taurus; identical to SEQ ID NO: 6974

SEQ ID NO: 88800 - DNA, 201 bp, Bos taurus
cccttacaaattaaaaatcagtatagtaaacatgaagaaagaaggtatcttagggtccctaatggtgtacttccagaatttctagtgggatatagacaaaagatagatgttacggtgctccttttccctcaatttctaataaaatataaactaataaaaacatcccattgatttacaaagaatgatttttaaagtaatcaa

SEQ ID NO: 88801 - DNA, 201 bp, Bos taurus; identical to SEQ ID NO: 6977

SEQ ID NO: 88802 - DNA, 201 bp, Bos taurus; identical to SEQ ID NO: 6978

SEQ ID NO: 88803 - DNA, 201 bp, Bos taurus; identical to SEQ ID NO: 6979

SEQ ID NO: 88804 - DNA, 201 bp, Bos taurus; identical to SEQ ID NO: 6980

SEQ ID NO: 88805 - DNA, 201 bp, Bos taurus; identical to SEQ ID NO: 6981

SEQ ID NO: 88806 - DNA, 201 bp, Bos taurus; identical to SEQ ID NO: 6982

SEQ ID NO: 88807 - DNA, 201 bp, Bos taurus; identical to SEQ ID NO: 6983

SEQ ID NO: 88808 - DNA, 201 bp, Bos taurus; identical to SEQ ID NO: 6984

SEQ ID NO: 88809 - DNA, 201 bp, Bos taurus; identical to SEQ ID NO: 6986

SEQ ID NO: 88810 - DNA, 201 bp, Bos taurus; identical to SEQ ID NO: 6987

SEQ ID NO: 88811 - DNA, 201 bp, Bos taurus; identical to SEQ ID NO: 6988

SEQ ID NO: 88812 - DNA, 201 bp, Bos taurus; identical to SEQ ID NO: 6989

SEQ ID NO: 88813 - DNA, 201 bp, Bos taurus; identical to SEQ ID NO: 6990

SEQ ID NO: 88814 - DNA, 201 bp, Bos taurus; identical to SEQ ID NO: 6991

SEQ ID NO: 88815 - DNA, 201 bp, Bos taurus; identical to SEQ ID NO: 6992

SEQ ID NO: 88816 - DNA, 201 bp, Bos taurus; identical to SEQ ID NO: 6993

SEQ ID NO: 88817 - DNA, 201 bp, Bos taurus; identical to SEQ ID NO: 6994

SEQ ID NO: 88818 - DNA, 201 bp, Bos taurus; identical to SEQ ID NO: 6995

SEQ ID NO: 88819 - DNA, 201 bp, Bos taurus; identical to SEQ ID NO: 6996

SEQ ID NO: 88820 - DNA, 201 bp, Bos taurus; identical to SEQ ID NO: 7000

SEQ ID NO: 88821 - DNA, 201 bp, Bos taurus; identical to SEQ ID NO: 7001

SEQ ID NO: 88822 - DNA, 201 bp, Bos taurus; identical to SEQ ID NO: 7008

SEQ ID NO: 88823 - DNA, 201 bp, Bos taurus; identical to SEQ ID NO: 7009

SEQ ID NO: 88824 - DNA, 201 bp, Bos taurus; identical to SEQ ID NO: 7011

SEQ ID NO: 88825 - DNA, 201 bp, Bos taurus; identical to SEQ ID NO: 7012

SEQ ID NO: 88826 - DNA, 201 bp, Bos taurus; identical to SEQ ID NO: 7013

SEQ ID NO: 88827 - DNA, 201 bp, Bos taurus; identical to SEQ ID NO: 7014

SEQ ID NO: 88828 - DNA, 201 bp, Bos taurus; identical to SEQ ID NO: 7015

SEQ ID NO: 88829 - DNA, 201 bp, Bos taurus; identical to SEQ ID NO: 7016

SEQ ID NO: 88830 - DNA, 201 bp, Bos taurus; identical to SEQ ID NO: 7018

SEQ ID NO: 88831 - DNA, 201 bp, Bos taurus; identical to SEQ ID NO: 7019

SEQ ID NO: 88832 - DNA, 201 bp, Bos taurus; identical to SEQ ID NO: 7020

SEQ ID NO: 88833 - DNA, 201 bp, Bos taurus; identical to SEQ ID NO: 7021

SEQ ID NO: 88834 - DNA, 201 bp, Bos taurus; identical to SEQ ID NO: 7023

SEQ ID NO: 88835 - DNA, 201 bp, Bos taurus; identical to SEQ ID NO: 7025

SEQ ID NO: 88836 - DNA, 201 bp, Bos taurus; identical to SEQ ID NO: 7026

SEQ ID NO: 88837 - DNA, 201 bp, Bos taurus; identical to SEQ ID NO: 7027

SEQ ID NO: 88838 - DNA, 201 bp, Bos taurus; identical to SEQ ID NO: 7028

SEQ ID NO: 88839 - DNA, 201 bp, Bos taurus; identical to SEQ ID NO: 7029

SEQ ID NO: 88840 - DNA, 201 bp, Bos taurus; identical to SEQ ID NO: 7030

SEQ ID NO: 88841 - DNA, 201 bp, Bos taurus; identical to SEQ ID NO: 7033

SEQ ID NO: 88842 - DNA, 201 bp, Bos taurus; identical to SEQ ID NO: 7034

SEQ ID NO: 88843 - DNA, 201 bp, Bos taurus; identical to SEQ ID NO: 7035

SEQ ID NO: 88844 - DNA, 201 bp, Bos taurus; identical to SEQ ID NO: 7036

SEQ ID NO: 88845 - DNA, 201 bp, Bos taurus; identical to SEQ ID NO: 7037

SEQ ID NO: 88846 - DNA, 201 bp, Bos taurus; identical to SEQ ID NO: 7039

SEQ ID NO: 88847 - DNA, 201 bp, Bos taurus; identical to SEQ ID NO: 7040

SEQ ID NO: 88848 - DNA, 201 bp, Bos taurus
gagtttggctgtgagttgcttcaattttctttgggttttcccatcattggacagccatgttagtgggaggcctggaggtgatcagaaattgaagaattccaccttagaagaggactggaaacagcaagggaatattttaatgttgattatgattatatattttaggaaataaaagggattatgatatcctgttactggctt

SEQ ID NO: 88849 - DNA, 201 bp, Bos taurus; identical to SEQ ID NO: 7043

SEQ ID NO: 88850 - DNA, 201 bp, Bos taurus; identical to SEQ ID NO: 7044

SEQ ID NO: 88851 - DNA, 201 bp, Bos taurus; identical to SEQ ID NO: 7045

SEQ ID NO: 88852 - DNA, 201 bp, Bos taurus; identical to SEQ ID NO: 7046

SEQ ID NO: 88853 - DNA, 201 bp, Bos taurus; identical to SEQ ID NO: 7047

SEQ ID NO: 88854 - DNA, 201 bp, Bos taurus
tctttttagatttgggatacaagtttgcttttggttcagaactctttttgttttttcagcaaacattgttcactacttacttggcccctgacaaccttaatgcatctgaaatggaacactccctatgtgcatggccatgtccaatcactgagcaagagaggagcaacaatgcctgatttacattaggagttcatcttcatc

SEQ ID NO: 88855 - DNA, 201 bp, Bos taurus; identical to SEQ ID NO: 7048

SEQ ID NO: 88856 - DNA, 201 bp, Bos taurus; identical to SEQ ID NO: 7049

SEQ ID NO: 88857 - DNA, 201 bp, Bos taurus
tcatatcaaaaaagttgatacacctctccatcatgtctccatagatactctgatagagaaataactttctgctcagcaggtcatgcatatcactcagggtatcatttcttctgttcttagttaagtcatttaatcaagactcaggatatgagatgtggcagctagaaaaaaatctgtgtttatggatcattcccataatca

SEQ ID NO: 88858 - DNA, 201 bp, Bos taurus; identical to SEQ ID NO: 7050

SEQ ID NO: 88859 - DNA, 201 bp, Bos taurus; identical to SEQ ID NO: 7051

SEQ ID NO: 88860 - DNA, 201 bp, Bos taurus; identical to SEQ ID NO: 7052

SEQ ID NO: 88861 - DNA, 201 bp, Bos taurus
aaataaccacaaagtattaaaaggtgaaagtcttacaaagagacaattctgagatttgtactatgccacactgtcatttttttctggctttaaggttcaaactctgttcatttttgacataccacattaacatgagataaaatattaattaatttacattccaaatgtacttctggcagaagaaactaactatatttcaag

SEQ ID NO: 88862 - DNA, 201 bp, Bos taurus
tccccttcactcaaattcttgtcaaaactctcccatgcaggtgactagttcaagtgcttgcttcaaagtttctagagttttttgactctgatgaactttacattcacctcgtctcaggccctcaaacccaaaactacacatgtgatgtgtgcttagtcactcagtcatgtctgattccttgcgaccccacgtactgcagcc

SEQ ID NO: 88863 - DNA, 201 bp, Bos taurus; identical to SEQ ID NO: 7055

SEQ ID NO: 88864 - DNA, 201 bp, Bos taurus; identical to SEQ ID NO: 7057

SEQ ID NO: 88865 - DNA, 201 bp, Bos taurus; identical to SEQ ID NO: 7058

SEQ ID NO: 88866 - DNA, 201 bp, Bos taurus; identical to SEQ ID NO: 7059

SEQ ID NO: 88867 - DNA, 201 bp, Bos taurus; identical to SEQ ID NO: 7060

SEQ ID NO: 88868 - DNA, 201 bp, Bos taurus; identical to SEQ ID NO: 7062

SEQ ID NO: 88869 - DNA, 201 bp, Bos taurus; identical to SEQ ID NO: 48434

SEQ ID NO: 88870 - DNA, 201 bp, Bos taurus; identical to SEQ ID NO: 7063

SEQ ID NO: 88871 - DNA, 201 bp, Bos taurus
agaacaagaaaaatgaaaaggagataattaaacatggataataacaaaattctttaacaattttattgtgaaaagtgaaaatacaaaaattatttgaatacatttaaaatgtgtgtagatttatggttatagttgcattcaggtgtatcttaaagaagcaatggtacgtcctttctaaaagttgatcattagggatacagg

SEQ ID NO: 88872 - DNA, 201 bp, Bos taurus; identical to SEQ ID NO: 7064

SEQ ID NO: 88873 - DNA, 201 bp, Bos taurus; identical to SEQ ID NO: 7065

SEQ ID NO: 88874 - DNA, 201 bp, Bos taurus; identical to SEQ ID NO: 7066

SEQ ID NO: 88875 - DNA, 201 bp, Bos taurus; identical to SEQ ID NO: 7068

SEQ ID NO: 88876 - DNA, 201 bp, Bos taurus; identical to SEQ ID NO: 7070

SEQ ID NO: 88877 - DNA, 201 bp, Bos taurus; identical to SEQ ID NO: 7072

SEQ ID NO: 88878 - DNA, 201 bp, Bos taurus; identical to SEQ ID NO: 7073

SEQ ID NO: 88879 - DNA, 201 bp, Bos taurus; identical to SEQ ID NO: 7074

SEQ ID NO: 88880 - DNA, 201 bp, Bos taurus; identical to SEQ ID NO: 7075

SEQ ID NO: 88881 - DNA, 201 bp, Bos taurus; identical to SEQ ID NO: 7076

SEQ ID NO: 88882 - DNA, 201 bp, Bos taurus; identical to SEQ ID NO: 7077

SEQ ID NO: 88883 - DNA, 201 bp, Bos taurus; identical to SEQ ID NO: 7078

SEQ ID NO: 88884 - DNA, 201 bp, Bos taurus; identical to SEQ ID NO: 7079

SEQ ID NO: 88885 - DNA, 201 bp, Bos taurus; identical to SEQ ID NO: 7080

SEQ ID NO: 88886 - DNA, 201 bp, Bos taurus; identical to SEQ ID NO: 7081

SEQ ID NO: 88887 - DNA, 201 bp, Bos taurus; identical to SEQ ID NO: 7082

SEQ ID NO: 88888 - DNA, 201 bp, Bos taurus; identical to SEQ ID NO: 7083

SEQ ID NO: 88889 - DNA, 201 bp, Bos taurus; identical to SEQ ID NO: 7084

SEQ ID NO: 88890 - DNA, 201 bp, Bos taurus; identical to SEQ ID NO: 7085

SEQ ID NO: 88891 - DNA, 201 bp, Bos taurus; identical to SEQ ID NO: 7086

SEQ ID NO: 88892 - DNA, 201 bp, Bos taurus; identical to SEQ ID NO: 7088

SEQ ID NO: 88893 - DNA, 201 bp, Bos taurus; identical to SEQ ID NO: 7089

SEQ ID NO: 88894 - DNA, 201 bp, Bos taurus; identical to SEQ ID NO: 7090

SEQ ID NO: 88895 - DNA, 201 bp, Bos taurus; identical to SEQ ID NO: 7091

SEQ ID NO: 88896 - DNA, 201 bp, Bos taurus; identical to SEQ ID NO: 7092

SEQ ID NO: 88897 - DNA, 201 bp, Bos taurus; identical to SEQ ID NO: 7093

SEQ ID NO: 88898 - DNA, 201 bp, Bos taurus; identical to SEQ ID NO: 7094

SEQ ID NO: 88899 - DNA, 201 bp, Bos taurus; identical to SEQ ID NO: 7095

SEQ ID NO: 88900 - DNA, 201 bp, Bos taurus; identical to SEQ ID NO: 7096

SEQ ID NO: 88901 - DNA, 201 bp, Bos taurus; identical to SEQ ID NO: 7097

SEQ ID NO: 88902 - DNA, 201 bp, Bos taurus; identical to SEQ ID NO: 7098

SEQ ID NO: 88903 - DNA, 201 bp, Bos taurus; identical to SEQ ID NO: 7099

SEQ ID NO: 88904 - DNA, 201 bp, Bos taurus; identical to SEQ ID NO: 7101

SEQ ID NO: 88905 - DNA, 201 bp, Bos taurus; identical to SEQ ID NO: 7103

SEQ ID NO: 88906 - DNA, 201 bp, Bos taurus; identical to SEQ ID NO: 7104

SEQ ID NO: 88907 - DNA, 201 bp, Bos taurus; identical to SEQ ID NO: 7105

SEQ ID NO: 88908 - DNA, 201 bp, Bos taurus; identical to SEQ ID NO: 7106

SEQ ID NO: 88909 - DNA, 201 bp, Bos taurus; identical to SEQ ID NO: 7107

SEQ ID NO: 88910 - DNA, 201 bp, Bos taurus; identical to SEQ ID NO: 7108

SEQ ID NO: 88911 - DNA, 201 bp, Bos taurus; identical to SEQ ID NO: 7110

SEQ ID NO: 88912 - DNA, 201 bp, Bos taurus; identical to SEQ ID NO: 7112

SEQ ID NO: 88913 - DNA, 201 bp, Bos taurus; identical to SEQ ID NO: 7113

SEQ ID NO: 88914 - DNA, 201 bp, Bos taurus
gctaattaggtgtgtgaaaggctacttggcatctgctattgactggacccagcaaaagtgatcactaggctggatgatcaataagggatcgataacaagcatgtgattggattagccatttgatcaatgctgtgtgctaatatattaacaagcaaattacccacagcacttaagagcagaatgctgactctgattgcatta

SEQ ID NO: 88915 - DNA, 201 bp, Bos taurus; identical to SEQ ID NO: 7114

SEQ ID NO: 88916 - DNA, 201 bp, Bos taurus; identical to SEQ ID NO: 7115

SEQ ID NO: 88917 - DNA, 201 bp, Bos taurus; identical to SEQ ID NO: 7117

SEQ ID NO: 88918 - DNA, 201 bp, Bos taurus
attttgtttataattcatgccgtactaaaactggtaactccttgtttctgatctgcttcagcaaatggtcacagaagcagagctagaagctagtgagcccgtcctcggctgccatctcaaacccagcccccaccacccactcgcctttgcacagccctcttcaaatcctgatgagctgagcccatcaaaagtctccagtgt

SEQ ID NO: 88919 - DNA, 201 bp, Bos taurus; identical to SEQ ID NO: 7118

SEQ ID NO: 88920 - DNA, 201 bp, Bos taurus
tccaacaagaaatgattgattgctcggggcatgagattctattctattccatcaaagtgacgttcaggtgcagaaagctccacacatgtgacaaacagaagtgagaaaggaatgaaatgtgagacaccatcgatctccccatgtggtccttcagccccctggaaaaactgacctccggcgtcgcagaagcccagcagagag

SEQ ID NO: 88921 - DNA, 201 bp, Bos taurus
gtagtatttttcaggaagttaagtagaacatgatacattctttgaccatggtgcagtaaaactagaaggacactagacatttgctggttgactgaaataatgaacaggtaacaaaaaataaaagtacaaaaccaactctggatattttattgtatcaaagagaacatttaaaatacagttacatattatctaggaaatggt

SEQ ID NO: 88922 - DNA, 201 bp, Bos taurus
aagcgcaaagcacgcgtggttctctgaatccactgctgtggtgttctctgcacttccttctgtgcgcactcctgtttgatctccactgctttgaggtggacgtcttcccatttaatttgtgactttgggcttcagctatgtcctggttgctctgagaatgaactttgcatttctgctttctgttctttttgcccttggata

SEQ ID NO: 88923 - DNA, 201 bp, Bos taurus
cagagattagaagagaccaggtactagttctcatcccagaaggttggagactgctccatgttttctgcttctgagttcatcatggcccacttcatgactcccgggaataggcccaagcagaacaattctggggtggtagtttgtttcctctcctgatcaaggtagcagagcagagaggggagatgtaacattagcagctca

SEQ ID NO: 88924 - DNA, 201 bp, Bos taurus; identical to SEQ ID NO: 7119

SEQ ID NO: 88925 - DNA, 201 bp, Bos taurus; identical to SEQ ID NO: 7120

SEQ ID NO: 88926 - DNA, 201 bp, Bos taurus; identical to SEQ ID NO: 7122

SEQ ID NO: 88927 - DNA, 201 bp, Bos taurus; identical to SEQ ID NO: 7125

SEQ ID NO: 88928 - DNA, 201 bp, Bos taurus; identical to SEQ ID NO: 7126

SEQ ID NO: 88929 - DNA, 201 bp, Bos taurus
cctactttacaacacctttacttcgtttttaatgaacatcatttttgtaggacatttgttcttttataaacttgagatccagcatatatatttctttatcactaaagatatttgtaaattctataaattaatagaacactgatgcacaatgaaatacatttgaaactttatgtattaccaataatggtaacaatttatttc

SEQ ID NO: 88930 - DNA, 201 bp, Bos taurus; identical to SEQ ID NO: 7127

SEQ ID NO: 88931 - DNA, 201 bp, Bos taurus; identical to SEQ ID NO: 7128

SEQ ID NO: 88932 - DNA, 201 bp, Bos taurus
acaagggagtcttgtcagtttatctaagatgacacaaacaccagagagcaaaagcaaggcccctcctccaactgctgagccaaataagcactggggccaagcaattagtgcaacacaaaggcaagcattacaatatcagagccaacctccattgtctccgtgcaccccacaggcttgacaagttttctcatgggccacagc

SEQ ID NO: 88933 - DNA, 201 bp, Bos taurus
actaataaaagtctacttatgttatactctttctgacaacctacagtaaaattaaggcaaatgttatttggaggagtctgcttactggtcacataaccaacattttagttaaatttctatcaactgaactgtaaaaaattaaagatcctagataaaatgtgctcccatgcttcaaatctgaccgattccattacgtgcact

SEQ ID NO: 88934 - DNA, 201 bp, Bos taurus
taacccttctggtgatcattattcccatttcctctgtgctttctatctccagactcagcttctcttctctcctcttcctctacttctttttgcttttcctctagaatctctgttccatggaaagcaaacgatccttaacattaacttttccatccaatactttgttttatctggctggaattaaaccttagtttttatcta

SEQ ID NO: 88935 - DNA, 201 bp, Bos taurus; identical to SEQ ID NO: 7130

SEQ ID NO: 88936 - DNA, 201 bp, Bos taurus; identical to SEQ ID NO: 7132

SEQ ID NO: 88937 - DNA, 201 bp, Bos taurus; identical to SEQ ID NO: 7133

SEQ ID NO: 88938 - DNA, 201 bp, Bos taurus; identical to SEQ ID NO: 7135

SEQ ID NO: 88939 - DNA, 201 bp, Bos taurus; identical to SEQ ID NO: 7137

SEQ ID NO: 88940 - DNA, 201 bp, Bos taurus; identical to SEQ ID NO: 7138

SEQ ID NO: 88941 - DNA, 201 bp, Bos taurus; identical to SEQ ID NO: 7139

SEQ ID NO: 88942 - DNA, 201 bp, Bos taurus; identical to SEQ ID NO: 7140

SEQ ID NO: 88943 - DNA, 201 bp, Bos taurus; identical to SEQ ID NO: 7142

SEQ ID NO: 88944 - DNA, 201 bp, Bos taurus; identical to SEQ ID NO: 7143

SEQ ID NO: 88945 - DNA, 201 bp, Bos taurus; identical to SEQ ID NO: 7144

SEQ ID NO: 88946 - DNA, 201 bp, Bos taurus; identical to SEQ ID NO: 7145

SEQ ID NO: 88947 - DNA, 201 bp, Bos taurus; identical to SEQ ID NO: 7146

SEQ ID NO: 88948 - DNA, 201 bp, Bos taurus; identical to SEQ ID NO: 7147

SEQ ID NO: 88949 - DNA, 201 bp, Bos taurus; identical to SEQ ID NO: 7148

SEQ ID NO: 88950 - DNA, 201 bp, Bos taurus; identical to SEQ ID NO: 7149

SEQ ID NO: 88951 - DNA, 201 bp, Bos taurus
ttgcctgtgattcaaaggtaaatgattttagggatagaattgggaaaatgcctgaaagaataaaggagagaaagagaactccaaaaatggcactggaagtgtcagggagaaaagaattgccactgaggagccctctaggtaagctgtcgttccacatacttttgtgaagatgggcatatctatagggatcggctacctcta

SEQ ID NO: 88952 - DNA, 201 bp, Bos taurus
gtgtaactacttatccaacctaatcctcatactgtagccagctactaaatattccaaaagatatttgcggggctttgtcacaaatagtaagaattaattttactgtccctaagatttagtgatctaggaggaattatgattaatggggaaatgaggttaatagtcaactcatggtcttctaaatcttaatactgattgata

SEQ ID NO: 88953 - DNA, 201 bp, Bos taurus; identical to SEQ ID NO: 7152

SEQ ID NO: 88954 - DNA, 201 bp, Bos taurus; identical to SEQ ID NO: 7153

SEQ ID NO: 88955 - DNA, 201 bp, Bos taurus; identical to SEQ ID NO: 7154

SEQ ID NO: 88956 - DNA, 201 bp, Bos taurus
tgattttttcagttgcctagcgtgtggcactttgctacaacggtcctgagtgactaaactcctctggtctgtccgctgtcttagctcaagtggagaaggtaaacacgattcttagtaatacagaaggtaaattgtttttaacaactgcatatagatttctttagcaaaaatgtggataacaagccatagcttgaataacat

SEQ ID NO: 88957 - DNA, 201 bp, Bos taurus; identical to SEQ ID NO: 7156

SEQ ID NO: 88958 - DNA, 201 bp, Bos taurus; identical to SEQ ID NO: 7158

SEQ ID NO: 88959 - DNA, 201 bp, Bos taurus; identical to SEQ ID NO: 7159

SEQ ID NO: 88960 - DNA, 201 bp, Bos taurus
ttgtttcgatgttaatacatctgactgtgattccattttaaaacaatgatagtacacatttaaggactatatcattggtgaagaaggtgaaggagagttcaaagtcaaaccatatataatccttcttccagacttctcatcatgtaagataaacatttatatcatataaatatttgaaattatttgaaatttctgtaattc

SEQ ID NO: 88961 - DNA, 201 bp, Bos taurus
gaatttttacatgttgttaagaggataacccttatattaacaagtatatactagttagaggttcagcagccatccagactatggaatgaccttaagattggaagcttccttttaaaaacaaactagaaggagcctcgtctgtatataaggaagcaccatttgtacttgtagactaacttcttccagttaggaaaacatttt

SEQ ID NO: 88962 - DNA, 201 bp, Bos taurus; identical to SEQ ID NO: 7162

SEQ ID NO: 88963 - DNA, 201 bp, Bos taurus; identical to SEQ ID NO: 7163

SEQ ID NO: 88964 - DNA, 201 bp, Bos taurus
gcactatttaccaaactttgctctaaatgttcagataaggagatatatttgtttatacacagtcagaggaaggtccctaacagattccaggcatctgcatgtaaatacagggttatgcacacaaatagggactggttgatgaaatgtgagtgaaccaggacaaagccttggaactattatggaagcaatgaaagcaacgtt

SEQ ID NO: 88965 - DNA, 201 bp, Bos taurus; identical to SEQ ID NO: 7164

SEQ ID NO: 88966 - DNA, 201 bp, Bos taurus
aactcttaaaaacaaggggcttaaaaacccttcttgcatcaccaaaaacactaattctacaaagagaaagcagatgccagtagacacagagttctcagaatagcagggcagagacacagaagtatcagaatagaagggcagagaacagctggaaactactcctagagagcagttttcaaaatatattaaggggaagcacag

SEQ ID NO: 88967 - DNA, 201 bp, Bos taurus
attacagaccctcagggtacctctatatttcccttcaaaacacgtaatttgagcaagtatccacaatttaggacttacatataacaacccctccatcttataatgcctattaagtctttataccttttcttagtggatcctgtgatttaatcagaaatttttccagtgttcttttcctttgagtgcagtgaaggctgtctt

SEQ ID NO: 88968 - DNA, 201 bp, Bos taurus; identical to SEQ ID NO: 7165

SEQ ID NO: 88969 - DNA, 201 bp, Bos taurus
gccaaacccctacctactccagtgaagttacaagcaatgagggaaatacttgtcatgtttcgtctatagacatattttttattgttatggctgaacatggctatctttatacaaatggctttcatatcatttataagtaaaaggagaagcatatgttttttatcatctattagttttagctatttacaaaaactcccactg

SEQ ID NO: 88970 - DNA, 201 bp, Bos taurus; identical to SEQ ID NO: 7166

SEQ ID NO: 88971 - DNA, 201 bp, Bos taurus; identical to SEQ ID NO: 7167

SEQ ID NO: 88972 - DNA, 201 bp, Bos taurus; identical to SEQ ID NO: 7169

SEQ ID NO: 88973 - DNA, 201 bp, Bos taurus; identical to SEQ ID NO: 7170

SEQ ID NO: 88974 - DNA, 201 bp, Bos taurus
tcatatcatatttcaggggcccttgttggggcagaggggtgggtgggtgagtattcacagagcaggtattggacaaaagacaccaaacaatcccaaccaagatggaccttcctctctcggccttgcaaagtgtctggactggggaagttcttttccaccaaaccatgtttcttggctctcagcttaagacaaagtacaaca

SEQ ID NO: 88975 - DNA, 201 bp, Bos taurus
tggacaataaaattcattattaaatagtaagaaatgagaatatatatgtatatttctatatgtgcactagcaagtatgctcagtcaacttcttgcgaccccgtgtactgtaacctgccagtttcctctgtccatggaattttccagctaagaatactaaagtgggttgccgttacctactctagggaatctttccgaccca

SEQ ID NO: 88976 - DNA, 201 bp, Bos taurus
ctatgacaaactcattgttaagcaacttgcctctctcatttcacagaactctcatgtcatgaaaatgtcacgaggacttacaggagaaagagcagactactcgttaaacagtagtgggtggatttggatcagacaagtgaaaaggggccagcagatgaggagatctgggcaaggggtttgtaccaagtgcacaggatagat

SEQ ID NO: 88977 - DNA, 201 bp, Bos taurus; identical to SEQ ID NO: 7171

SEQ ID NO: 88978 - DNA, 201 bp, Bos taurus; identical to SEQ ID NO: 7172

SEQ ID NO: 88979 - DNA, 201 bp, Bos taurus; identical to SEQ ID NO: 7173

SEQ ID NO: 88980 - DNA, 201 bp, Bos taurus
ttatgaacgctgataatgcagtggctcataaacttatgttatttgctcccttgtttaggttgcagttctgagctctttagttgctatggtgacagtaataataaaggctgattggaagaagacatcttatctgggatttttgttgttgagagaggagaccacgctccatgttgccctattagagaagatactgggttacat

SEQ ID NO: 88981 - DNA, 201 bp, Bos taurus
gtatatgctgaaaaaaatgcataatatgatgaaagttgcagtatagatgtgtcaatttggtttcataaacatacactggccatatacacagttatccagttgttaagatgctgtgtttccactgcagggggcttgggtttgatttctggtccaggaactaagatcccacatactgtgcaatggggccaaaaaacagaagga

SEQ ID NO: 88982 - DNA, 201 bp, Bos taurus; identical to SEQ ID NO: 7174

SEQ ID NO: 88983 - DNA, 201 bp, Bos taurus
ccaaaggagtaatagaaagatactaccttggccagctctgtggctcacaacttagaccctggaggagctataaatggatgattaattacaacaagagtctaggaagggaaagggttccactggaagtcctctctccccctgctgttagaaaatgtccatccaacttactctccaatcactagagatactggtaagtcatgg

SEQ ID NO: 88984 - DNA, 201 bp, Bos taurus
ttataaaaaacacagtctttagaataatttatgttctttacactgttttttttttctatatgtgactgctgatgtagttaatatcttatttgaattatttaagacatgcattctcaatccataaatagtagaattataattgttatcaactagacatttttatattatttttaaaatgagatttttatcttcaaaatacta

SEQ ID NO: 88985 - DNA, 201 bp, Bos taurus
gctgtgtacctacgaaattagtatgttgaagtgttaactcctagtaactcagaatgtgcctatatttagggataagatcttttaaagtaagatgaggtcacggggtgggccctagtacaatatgactggtgtcccataagaaaaggaatttaggacacaggccatgcagactgaaggaagaacaagtgaggaccaggccag

SEQ ID NO: 88986 - DNA, 201 bp, Bos taurus; identical to SEQ ID NO: 7175

SEQ ID NO: 88987 - DNA, 201 bp, Bos taurus
gagcgaagcagaactacaataaatatcaaaggatatccttcaagcagaaagaaagtgatatcatatagaaacatggatcttcacaaagaaataaaaagcaatggaaatgataaatgcatgggcaaatataaaggcttttattctcattaaatatccacaaaagataattccttaaagtaaaaatagtaacagtatgttgtg

SEQ ID NO: 88988 - DNA, 201 bp, Bos taurus
atctgggtgcttgataacttgataattaaatttacaaaaggttggaaatatttgccacagaaagatttaaaatcattcctgaaatcctaatgacagctcccgcaatatgtgtatgcctcttgagggcccagtgaggataggtggtattaaaaatataattggttttaaagtacattagattaaatttttttcctatgattc

SEQ ID NO: 88989 - DNA, 201 bp, Bos taurus; identical to SEQ ID NO: 7176

SEQ ID NO: 88990 - DNA, 201 bp, Bos taurus
ggagagtctggaggcagcgaaaccaccgaggacgtaaatgggaagagattagagtgttagggataagcgtctgaattagagagaggaagaggcgaatgaaagagacccttcagaaaatggtggaaggataatgaggaagaaaaaagaaatgagcccaaaatgtctaccagattctgcccctaagagatcaatcaagaaacc

SEQ ID NO: 88991 - DNA, 201 bp, Bos taurus; identical to SEQ ID NO: 7177

SEQ ID NO: 88992 - DNA, 201 bp, Bos taurus; identical to SEQ ID NO: 7178

SEQ ID NO: 88993 - DNA, 201 bp, Bos taurus; identical to SEQ ID NO: 7179

SEQ ID NO: 88994 - DNA, 201 bp, Bos taurus; identical to SEQ ID NO: 7180

SEQ ID NO: 88995 - DNA, 201 bp, Bos taurus
agtctgactcaggcccttgtgtgtatatatatttttgtgtgtgtgtgttttaataaaaatgtaactgtataaatgaaaagaaaatgggagtaccctttcacctctatgtgtgccctccactcccattactaacaaaaacaatccttttaaaaatatcaaaaaatgctttgtttgcctccaggtctgatgggagatggcaaa

SEQ ID NO: 88996 - DNA, 201 bp, Bos taurus; identical to SEQ ID NO: 7181

SEQ ID NO: 88997 - DNA, 201 bp, Bos taurus; identical to SEQ ID NO: 7182

SEQ ID NO: 88998 - DNA, 201 bp, Bos taurus
acggtaggaaatttctgagtaaagagaaggctctatataaatccaaccgtggagacagagaatatggacaagcagattagaatgtataaaccacagtattgcaaatatgaagagcagatgatttttaatgtgatagtatgtttgtcagaaagcatcatctttctcttgccagacacttgatctgattgcataaacctgggt

SEQ ID NO: 88999 - DNA, 201 bp, Bos taurus
aaaacacagtatttttcatttacaatccaaaatgttttgaattaaatttcttttgacctagtacataactagtacaaacagaactctttaaggttacaacctacctgtgacctgtaagattaattttcagttctttattgtccttagcatgtctgcaatagtagtagaggtttgttctgggattgattcatatatttgtta

SEQ ID NO: 89000 - DNA, 201 bp, Bos taurus; identical to SEQ ID NO: 7183

SEQ ID NO: 89001 - DNA, 201 bp, Bos taurus
tggtagcgaactgggtactctgaactcctctaaagagctcaccctaaagtgccgctgaccacagagcaaatgcgctcacaaactcttgagtgcttatatttgtgcacgccaaaagaaagagggatcttggcccaagcattgtaacaggcttggagtttacttgtaaaaatcatcaactctctgcttaccacctcctcagcc

SEQ ID NO: 89002 - DNA, 201 bp, Bos taurus; identical to SEQ ID NO: 7184

SEQ ID NO: 89003 - DNA, 201 bp, Bos taurus; identical to SEQ ID NO: 7185

SEQ ID NO: 89004 - DNA, 201 bp, Bos taurus; identical to SEQ ID NO: 7186

SEQ ID NO: 89005 - DNA, 201 bp, Bos taurus; identical to SEQ ID NO: 7187

SEQ ID NO: 89006 - DNA, 201 bp, Bos taurus; identical to SEQ ID NO: 7188

SEQ ID NO: 89007 - DNA, 201 bp, Bos taurus; identical to SEQ ID NO: 7189

SEQ ID NO: 89008 - DNA, 201 bp, Bos taurus
aaagaaactgatccatcttcattttattatttttgatggcaagttttatgtaagcttggccacttaatctataaaaatgactcttgacccttctgtagaagaaacaggaacaacagcaaaataataacacttattggttactgaaataaatctgaactgcttcctctttttagcttctacactgctgtgaggaaagagtct

SEQ ID NO: 89009 - DNA, 201 bp, Bos taurus
ttatgggaagttcattcaagtgttttaaagttcctagtgtaaatcatggcacatgatccatgttcaataagtgttttttgcttgactgattataaaacccctggataaaaagattagctacttttatttgggttgtttgttgtcaagatagattgtttccgatttttctcttgtcatgcgtgtcatcagttgttattgaga

SEQ ID NO: 89010 - DNA, 201 bp, Bos taurus; identical to SEQ ID NO: 7190

SEQ ID NO: 89011 - DNA, 201 bp, Bos taurus; identical to SEQ ID NO: 7191

SEQ ID NO: 89012 - DNA, 201 bp, Bos taurus; identical to SEQ ID NO: 7192

SEQ ID NO: 89013 - DNA, 201 bp, Bos taurus; identical to SEQ ID NO: 7193

SEQ ID NO: 89014 - DNA, 201 bp, Bos taurus; identical to SEQ ID NO: 7194

SEQ ID NO: 89015 - DNA, 201 bp, Bos taurus; identical to SEQ ID NO: 7195

SEQ ID NO: 89016 - DNA, 201 bp, Bos taurus; identical to SEQ ID NO: 7196

SEQ ID NO: 89017 - DNA, 201 bp, Bos taurus; identical to SEQ ID NO: 7197

SEQ ID NO: 89018 - DNA, 201 bp, Bos taurus
ttcaataataaggtacacttttgatggctatcatggtttaaaatgagagagaaatatcttaaaagataacattccatgatgggacaaacatatttatcttctatatcatgactttaagtcaacagatataggagagaaaggtttgtgaaaaatccatggaactaagaataactgggccaatattttcagtctgcatgatat

SEQ ID NO: 89019 - DNA, 201 bp, Bos taurus; identical to SEQ ID NO: 7198

SEQ ID NO: 89020 - DNA, 201 bp, Bos taurus
actcactccaaacttctggctttgactatttgcagacacgggaagagccagcaagtggctctagaatcctcaatgctttgtcacgactcttcctggcctccgaagaatgtgttggaaactacgtgcaggattttcacagctgcatgcagtcgcttcatttccccagcatttgctagctgtcaactctcttcaaacactgca

SEQ ID NO: 89021 - DNA, 201 bp, Bos taurus
tggtgagttacctaattttagaagaaatattgttggatggcagataatgcttcagctttttatttatttttttttttttgagatcatttccacttttgaagaaagtagctgtctcctactcgtccacttgcatttcacgtgctaaaacttctttagaggaacactcaagccatgaaagtaatgttataaaatttataaagg

SEQ ID NO: 89022 - DNA, 201 bp, Bos taurus; identical to SEQ ID NO: 7199

SEQ ID NO: 89023 - DNA, 201 bp, Bos taurus
atgggggaaagaaatagtagattctaaagtgcaaaatattttgcctctgggcaaaattctacttttggatgagcatggtgttttcatctgtcaagtcttgcactacctacagacatactatcagcactgaaagtgagaagtcattcttaaagaatcttatactactgagctgtcccatgcttcctagctgcaaaaattatt

SEQ ID NO: 89024 - DNA, 201 bp, Bos taurus; identical to SEQ ID NO: 7200

SEQ ID NO: 89025 - DNA, 201 bp, Bos taurus
ggcaacctaagagggcccagtgatctgtgcctcctgacactcatgcccccatgtaactccttcccctgatataggctggagctagtgtcttgtctgtaacgaacagaatgcaggccaagtgatggaatgacacttctgaaattaggttataaaaagagtgtgacttccatcttggaatctttcactctcagccctcactct

SEQ ID NO: 89026 - DNA, 201 bp, Bos taurus; identical to SEQ ID NO: 7201

SEQ ID NO: 89027 - DNA, 201 bp, Bos taurus; identical to SEQ ID NO: 7202

SEQ ID NO: 89028 - DNA, 201 bp, Bos taurus; identical to SEQ ID NO: 7203

SEQ ID NO: 89029 - DNA, 201 bp, Bos taurus; identical to SEQ ID NO: 7204

SEQ ID NO: 89030 - DNA, 201 bp, Bos taurus; identical to SEQ ID NO: 7205

SEQ ID NO: 89031 - DNA, 201 bp, Bos taurus; identical to SEQ ID NO: 7206

SEQ ID NO: 89032 - DNA, 201 bp, Bos taurus; identical to SEQ ID NO: 7207

SEQ ID NO: 89033 - DNA, 201 bp, Bos taurus; identical to SEQ ID NO: 7208

SEQ ID NO: 89034 - DNA, 201 bp, Bos taurus; identical to SEQ ID NO: 7209

SEQ ID NO: 89035 - DNA, 201 bp, Bos taurus; identical to SEQ ID NO: 7210

SEQ ID NO: 89036 - DNA, 201 bp, Bos taurus; identical to SEQ ID NO: 7211

SEQ ID NO: 89037 - DNA, 201 bp, Bos taurus; identical to SEQ ID NO: 7212

SEQ ID NO: 89038 - DNA, 201 bp, Bos taurus
aaacatgcatttcttatgaacttctttgatggtgacctctgtgacttcatattttccaagttcataaactttatgagctgtttgatggcatttactctttttaattttatctttcattgtccccttcttaaatcctgtagctatttagtaagtttaagctggtccagtggaaaacatgttattgggtccagattaagtctc

SEQ ID NO: 89039 - DNA, 201 bp, Bos taurus
ggaatttgtgaccaacagtcaaatgttcctcagaggcatttttatcatcttgtagttgtgagacttcttgtaaagggactgaggaaggagccagaaccacagggcatgatcaggtccgagaagagctgtaaggaagtaataatgactttcacactcatgggcgacctggatttccacgcactatcaaccaagtttgtcact

SEQ ID NO: 89040 - DNA, 201 bp, Bos taurus
gcacaccttgggatgcctggaaatctctgctctgaggataaagcggtcatttccacggtctccgtgctgccttggccgtcggcaccctctgctgaagacatacgtgtcatagaggtgagtggagcacacgtttcttatgcttcccgtgaacctattaatgctgcagaggagaactagacatatagaagcagctgggttcta

SEQ ID NO: 89041 - DNA, 201 bp, Bos taurus; identical to SEQ ID NO: 7213

SEQ ID NO: 89042 - DNA, 201 bp, Bos taurus; identical to SEQ ID NO: 7214

SEQ ID NO: 89043 - DNA, 201 bp, Bos taurus
tcagaaaataaaaatagaaattagcagagcatcgggccttcaagttgttgctctatgtgaataaggacagtgcttggtggcttgttttcctcattcacaaggtgggggagaacgttggttggcctcttcacatcctttccacaccaaaattcaaacaaagaaagcagaacaaaacaatggagtagaaaacaaatttttaaa

SEQ ID NO: 89044 - DNA, 201 bp, Bos taurus
caaagaatttggacaaatggagtggttcttgtcttagcaaaatagaccaatttaaatattaaagaactggtattcttcttctgcaaatcctttcagccatcccaccactgggactttcccactgactatataacctcacagaatacctccatctcctctctaccttcctcttctttgattcaagctccaaaggatactgct

SEQ ID NO: 89045 - DNA, 201 bp, Bos taurus
gggtctctgcaattggttcctccctttgaaagcaattttgggtcatttgctctgagtttaggtagagaagttcctgcttagcactgaccaactttactctatcttaaagacattcaatcagataggccctccattatattggaggaattctaatcagacagaggtcaggaaacaaagcagaaagtaagggatgttggatgg

SEQ ID NO: 89046 - DNA, 201 bp, Bos taurus
caggtgagctgacttcttagcttccatcggttgccaggtgtggtacaactgcattcggatataggaagtgtggagcatgcagccttgtttgtcttcatgataacagcagcagatggccctactgggaactctcactggccattcaggttggacagctgaacccctgcattcacacaaagagagcaaatgacagagcttagg

SEQ ID NO: 89047 - DNA, 201 bp, Bos taurus; identical to SEQ ID NO: 7215

SEQ ID NO: 89048 - DNA, 201 bp, Bos taurus; identical to SEQ ID NO: 7216

SEQ ID NO: 89049 - DNA, 201 bp, Bos taurus
attcctgcaaatcgaaacctctcccctccctgaaccttgtccctttgtctgagtctttttcaaaacagatagattctaggccttcatggtgttaaatagcgctgtaaggaatttcagggggttatctccagcaatctgtcttttaggggttgcagtgcaaaggccaaaacccattactataaagtccttcttggaagacta

SEQ ID NO: 89050 - DNA, 201 bp, Bos taurus
tgcccaacgtagcataccacttttactctgtgggcacttagcaaatcctcgttgactaattggcaacaattcctggtctacttgtgggaaaacggggaggcaaaacaaattaaccaggccaccgtgcttcctcagtcacccgagggaagagttattagtggctacacacagtcactgaaaatagacatctggtcagaaaaa

SEQ ID NO: 89051 - DNA, 201 bp, Bos taurus; identical to SEQ ID NO: 7217

SEQ ID NO: 89052 - DNA, 201 bp, Bos taurus
gtaattttaattttggaggatacatcatagtttgatagaatgatattaaagaaaagcatatggtaggaagagtgaagagcacatgcaaaaatatggaaacgtgcaagaaaacgtgcattcagagatgggctacagtaattcaggagggctgcagcatagtgaaggaggtactgagatggggttgaaaaggtaagcaaagcc

SEQ ID NO: 89053 - DNA, 201 bp, Bos taurus; identical to SEQ ID NO: 7220

SEQ ID NO: 89054 - DNA, 201 bp, Bos taurus; identical to SEQ ID NO: 7221

SEQ ID NO: 89055 - DNA, 201 bp, Bos taurus
tgttttctggcccagggatcttctcactactcaacaagtctaactaatggagggtgagtcgtggcttgggtttaatataaagatgtaggataattagaatatagttggagcttcaaaagcaaggaaatttcattagagaatgttgatcagaagagtataaaatttactcaatagagaacatttacgtagggtaaaaccaaa

SEQ ID NO: 89056 - DNA, 201 bp, Bos taurus
tttaaagactaaaatagtaaaagccactttctcagggaggaagggagtcctacagcagtgaacaagatcaattttcagacctcaaagcttgtttgttggattcatacttgttcatcttggattggactgagttcaaattgaggacaagaaacaactttaggggaaaaaaagcaggggggtggggagccttgaaagtatttc

SEQ ID NO: 89057 - DNA, 201 bp, Bos taurus
gtttcctatattaatatggaaacttgaaatcagaaaatatacccattatagaaataaatagtacatataaaacaggccttgaagaaacaatgctaactaaataaatgttagaataattcattggctaatacatttgccatatagagcccacttttataacacagcataaactccagagctaactcctactaggataatttt

SEQ ID NO: 89058 - DNA, 201 bp, Bos taurus; identical to SEQ ID NO: 7223

SEQ ID NO: 89059 - DNA, 201 bp, Bos taurus; identical to SEQ ID NO: 7224

SEQ ID NO: 89060 - DNA, 201 bp, Bos taurus; identical to SEQ ID NO: 7226

SEQ ID NO: 89061 - DNA, 201 bp, Bos taurus; identical to SEQ ID NO: 7229

SEQ ID NO: 89062 - DNA, 201 bp, Bos taurus; identical to SEQ ID NO: 7234

SEQ ID NO: 89063 - DNA, 201 bp, Bos taurus; identical to SEQ ID NO: 7235

SEQ ID NO: 89064 - DNA, 201 bp, Bos taurus; identical to SEQ ID NO: 7237

SEQ ID NO: 89065 - DNA, 201 bp, Bos taurus; identical to SEQ ID NO: 7238

SEQ ID NO: 89066 - DNA, 201 bp, Bos taurus; identical to SEQ ID NO: 7239

SEQ ID NO: 89067 - DNA, 201 bp, Bos taurus; identical to SEQ ID NO: 7240

SEQ ID NO: 89068 - DNA, 201 bp, Bos taurus; identical to SEQ ID NO: 7241

SEQ ID NO: 89069 - DNA, 201 bp, Bos taurus; identical to SEQ ID NO: 7244

SEQ ID NO: 89070 - DNA, 201 bp, Bos taurus
ccatcttggggagaaggaagagttgttaaagcatcatctagactcgtagctctctgggcatggtttcattgctgtgtctgaaattgtatattatttgtttcttttcattttttttttacaagtttcttatatcactgtctcttgagatatcagtttttgatacttatttccttttatttcctcacatatgtactacctctt

SEQ ID NO: 89071 - DNA, 201 bp, Bos taurus; identical to SEQ ID NO: 7245

SEQ ID NO: 89072 - DNA, 201 bp, Bos taurus
caaaagaattatatgctatcagaacactgagttattatatatatgtgttcatcaaagaaaaatcattaatattcagaattatagtgtttaatgaatatacagtatcacatcttatgtatatttcaaaaacaaaaactgaaatctgtaactatgatgctttctttcccaatgacccaaagagtttcagttttattatatgtg

SEQ ID NO: 89073 - DNA, 201 bp, Bos taurus; identical to SEQ ID NO: 7247

SEQ ID NO: 89074 - DNA, 201 bp, Bos taurus; identical to SEQ ID NO: 7249

SEQ ID NO: 89075 - DNA, 201 bp, Bos taurus
ttagtctccttcaaaagtctgttgtgttgtatttgcctccacttcatcttccttcaatccatttgtcatagtgtagcttcagtggccttcccatataaacgaatcatgtcaagtctgtctgcctcatgcctaagagattccaacggcttcagattgccttcaggataaagcccaaactccttaatgtggccctcaagactt

SEQ ID NO: 89076 - DNA, 201 bp, Bos taurus
ttaccttcgcttttagaggtggttggtcctatttaagacacaaggtacttagaaagccttgctcagacacacatgtcccacccactgagtcattcaacatgcttctcaggtcttggtcttgatttccagttctggtaattgggcttatggctattttagacatcaagctgtcccattcctccaggaagcaagactgatttg

SEQ ID NO: 89077 - DNA, 201 bp, Bos taurus; identical to SEQ ID NO: 7253

SEQ ID NO: 89078 - DNA, 201 bp, Bos taurus; identical to SEQ ID NO: 7254

SEQ ID NO: 89079 - DNA, 201 bp, Bos taurus; identical to SEQ ID NO: 7256

SEQ ID NO: 89080 - DNA, 201 bp, Bos taurus; identical to SEQ ID NO: 7257

SEQ ID NO: 89081 - DNA, 201 bp, Bos taurus; identical to SEQ ID NO: 7259

SEQ ID NO: 89082 - DNA, 201 bp, Bos taurus; identical to SEQ ID NO: 7260

SEQ ID NO: 89083 - DNA, 201 bp, Bos taurus; identical to SEQ ID NO: 7261

SEQ ID NO: 89084 - DNA, 201 bp, Bos taurus; identical to SEQ ID NO: 7262

SEQ ID NO: 89085 - DNA, 201 bp, Bos taurus
tatttgaatgaattctttaaagcatgttagtattacaacattaagctaacatttattggttattaacagtggcccaggtattatactagacacagtacttaggttcaaatataaataggaaagttcctgctctgttgatggtctttatcaaatacagttgaaatggctacttggggcttccccggtggctcagtgggtaaa

SEQ ID NO: 89086 - DNA, 201 bp, Bos taurus
aaggattcaggtaaggcttggcaaggtcacacagctgggctatgatgtgtctaggatgccaatccacggactccttttccagagggcctgccattattgccagggggctgagcaccctcccgagtgtccttgacttgctggcacaccatctctttgcttcaggccaccttgcacggacccctgcatgagccaacttactgc

SEQ ID NO: 89087 - DNA, 201 bp, Bos taurus; identical to SEQ ID NO: 7265

SEQ ID NO: 89088 - DNA, 201 bp, Bos taurus; identical to SEQ ID NO: 7268

SEQ ID NO: 89089 - DNA, 201 bp, Bos taurus; identical to SEQ ID NO: 7269

SEQ ID NO: 89090 - DNA, 201 bp, Bos taurus; identical to SEQ ID NO: 7270

SEQ ID NO: 89091 - DNA, 201 bp, Bos taurus; identical to SEQ ID NO: 7273

SEQ ID NO: 89092 - DNA, 201 bp, Bos taurus; identical to SEQ ID NO: 7275

SEQ ID NO: 89093 - DNA, 201 bp, Bos taurus; identical to SEQ ID NO: 7276

SEQ ID NO: 89094 - DNA, 201 bp, Bos taurus; identical to SEQ ID NO: 7277

SEQ ID NO: 89095 - DNA, 201 bp, Bos taurus; identical to SEQ ID NO: 7278

SEQ ID NO: 89096 - DNA, 201 bp, Bos taurus; identical to SEQ ID NO: 7279

SEQ ID NO: 89097 - DNA, 201 bp, Bos taurus; identical to SEQ ID NO: 7281

SEQ ID NO: 89098 - DNA, 201 bp, Bos taurus; identical to SEQ ID NO: 7282

SEQ ID NO: 89099 - DNA, 201 bp, Bos taurus; identical to SEQ ID NO: 7283

SEQ ID NO: 89100 - DNA, 201 bp, Bos taurus; identical to SEQ ID NO: 7284

SEQ ID NO: 89101 - DNA, 201 bp, Bos taurus; identical to SEQ ID NO: 7285

SEQ ID NO: 89102 - DNA, 201 bp, Bos taurus; identical to SEQ ID NO: 7286

SEQ ID NO: 89103 - DNA, 201 bp, Bos taurus; identical to SEQ ID NO: 7287

SEQ ID NO: 89104 - DNA, 201 bp, Bos taurus; identical to SEQ ID NO: 7289

SEQ ID NO: 89105 - DNA, 201 bp, Bos taurus; identical to SEQ ID NO: 7290

SEQ ID NO: 89106 - DNA, 201 bp, Bos taurus; identical to SEQ ID NO: 7291

SEQ ID NO: 89107 - DNA, 201 bp, Bos taurus; identical to SEQ ID NO: 7292

SEQ ID NO: 89108 - DNA, 201 bp, Bos taurus; identical to SEQ ID NO: 7293

SEQ ID NO: 89109 - DNA, 201 bp, Bos taurus; identical to SEQ ID NO: 7294

SEQ ID NO: 89110 - DNA, 201 bp, Bos taurus
aaagggaaaaaaccctcagaaagtgtatgctgccatagtttaccatcctggttggcataaatagagaggaaatggagtcctgacatctttttcaggttacatggtatccctttctacatttccatatttttcctctagtcaaatgtttttcttgaaatactttattatttttttttaacgtagagatagaaggaatctttt

SEQ ID NO: 89111 - DNA, 201 bp, Bos taurus; identical to SEQ ID NO: 7295

SEQ ID NO: 89112 - DNA, 201 bp, Bos taurus; identical to SEQ ID NO: 7296

SEQ ID NO: 89113 - DNA, 201 bp, Bos taurus; identical to SEQ ID NO: 7297

SEQ ID NO: 89114 - DNA, 201 bp, Bos taurus; identical to SEQ ID NO: 7298

SEQ ID NO: 89115 - DNA, 201 bp, Bos taurus; identical to SEQ ID NO: 7299

SEQ ID NO: 89116 - DNA, 201 bp, Bos taurus; identical to SEQ ID NO: 7300

SEQ ID NO: 89117 - DNA, 201 bp, Bos taurus; identical to SEQ ID NO: 7301

SEQ ID NO: 89118 - DNA, 201 bp, Bos taurus; identical to SEQ ID NO: 7302

SEQ ID NO: 89119 - DNA, 201 bp, Bos taurus; identical to SEQ ID NO: 7303

SEQ ID NO: 89120 - DNA, 201 bp, Bos taurus
tgtgaggtgactgaggctcttgcagaggcaagtcctcaagcaaattggcactgcaaaatcctttagtatctgttttgaggggcaggcctgccagtggggcatatgaggtagaaccagcgctgtacttgtgattctggaggggtgccgggggagagctgggggtggccatggggtggaggggagccaggagctctgacagca

SEQ ID NO: 89121 - DNA, 201 bp, Bos taurus
aaagttatctttaaggcctttatcttaaactctgaattgcttaaaaaaccaaaggagaaaacataagtctaccagggattagaaagtgagaggctgatgctgctagacttcttgaggcccaggacagccctgcttccgagcctggacatgcccccctagaccagcccactgggacagagtgggatgttggttcccagaaga

SEQ ID NO: 89122 - DNA, 201 bp, Bos taurus; identical to SEQ ID NO: 7304

SEQ ID NO: 89123 - DNA, 201 bp, Bos taurus
atatttcatgtgggtttgtctagcctcctcatttccactgtggtttccctgagtgcagagaattgccagagttaagggctcttgtaggtctctcagcctcctctgagttctaactattctgtgacttttgctgactatgaaaccatctgtcagagtaagtttgctggttactccttctgagtttgtggataccagacacta

SEQ ID NO: 89124 - DNA, 201 bp, Bos taurus; identical to SEQ ID NO: 7306

SEQ ID NO: 89125 - DNA, 201 bp, Bos taurus; identical to SEQ ID NO: 7307

SEQ ID NO: 89126 - DNA, 201 bp, Bos taurus
attatgctgttgcctatccctttgccctttactgagattgccaatcaaaagcattcctttctcatgccttcaattcccttgacgtgcttgctttgtcataactgtcaagccccatccctggttaatctaagtctctacctattttctagcagtccccatgcagagaccttggctggaaaaaaacacatccttcattccttg

SEQ ID NO: 89127 - DNA, 201 bp, Bos taurus; identical to SEQ ID NO: 7308

SEQ ID NO: 89128 - DNA, 201 bp, Bos taurus; identical to SEQ ID NO: 7314

SEQ ID NO: 89129 - DNA, 201 bp, Bos taurus
gttgttcaggagatgtcgtgaaagattttccagcaaaactttacttttccttctcttttttactgagaagttctatttgaaacatcccaagctaagattataaccagattgccatttgcatgcataatgttgctcaacctgaaaaccttgaatcagtatctggctgtgtcccactgcttccccatcactgtctgttctgta

SEQ ID NO: 89130 - DNA, 201 bp, Bos taurus
gattttcagcaataattctaataaatactttgttcaatgttttaacagcccatcataggccaacttgttaaatcataatcataagtcaaagtgccttgatggtaaagtgtttggcttggcacctggtccacagtaaatggtggctggtctcatctcccataactgctgagaatctgtcttgatagttttgattatatttat

SEQ ID NO: 89131 - DNA, 201 bp, Bos taurus
cgttagaaataaaactggtttttatttaaaattatataaacctgagaatattttctagcattttatttttcatctttaaggcctttaaaatacaaagatattgattttaaaagccgaatcttatagtataagatcaccactgaagaaagcttgaaagatatgagttctgtaattattctcaaactgaatctgaggaaactc

SEQ ID NO: 89132 - DNA, 201 bp, Bos taurus
cacaaaagactgccagtttggagttaggcccacagcaagcaagagccttgtatcaagtccagtgtgcagtgtgaatgccttgccactgagctgtgtgatccgtcaggccatatagtggggtaatagatatttgtggtggaaaaatgcagcatgtagaatttatgccaagttcttctgggaaaagtgacagcacatgttcac

SEQ ID NO: 89133 - DNA, 201 bp, Bos taurus; identical to SEQ ID NO: 7315

SEQ ID NO: 89134 - DNA, 201 bp, Bos taurus; identical to SEQ ID NO: 7317

SEQ ID NO: 89135 - DNA, 201 bp, Bos taurus; identical to SEQ ID NO: 7318

SEQ ID NO: 89136 - DNA, 201 bp, Bos taurus; identical to SEQ ID NO: 7319

SEQ ID NO: 89137 - DNA, 201 bp, Bos taurus; identical to SEQ ID NO: 7320

SEQ ID NO: 89138 - DNA, 201 bp, Bos taurus; identical to SEQ ID NO: 7323

SEQ ID NO: 89139 - DNA, 201 bp, Bos taurus; identical to SEQ ID NO: 7324

SEQ ID NO: 89140 - DNA, 201 bp, Bos taurus
cctccaacgcagactccaggtcatggtgggcctggctaggccctcagtacttgaaaaggtcgatgaagtgctgcggggacacaggcgtgaagcagctgccatgcaggggtggcccgagtcctcgagtaataaagcaaggcggcagtccttccagaagaggatgctgcagtgccggcagaagtgcagggtgtctccatactg

SEQ ID NO: 89141 - DNA, 201 bp, Bos taurus
attggtggttgccacagaggaggctgggggatatataaaataagtaaatgtggtcaaaagacacaaatttccagttacaagataaataacccccagggatgtaatgtacagcatatatgtttcttaagttcaaaatccagcacaggtggattttcagtatctgaacacagtagtataatttaagaactagaataatgtaaa

SEQ ID NO: 89142 - DNA, 201 bp, Bos taurus; identical to SEQ ID NO: 7325

SEQ ID NO: 89143 - DNA, 201 bp, Bos taurus; identical to SEQ ID NO: 7326

SEQ ID NO: 89144 - DNA, 201 bp, Bos taurus; identical to SEQ ID NO: 7327

SEQ ID NO: 89145 - DNA, 201 bp, Bos taurus; identical to SEQ ID NO: 7328

SEQ ID NO: 89146 - DNA, 201 bp, Bos taurus
ttgtatgggccctccttcaattgcatgttcccaaatgaattgccatggtgtggaatatatgtgtgcacttagcttcctctgcgcaattacctctcagcgcttcttccttcatgctttcctgggcctattactcaatcctcctacctctgtcctgccagccgccctgagagctctactttcccccttttcaggtcatttcag

SEQ ID NO: 89147 - DNA, 201 bp, Bos taurus; identical to SEQ ID NO: 7330

SEQ ID NO: 89148 - DNA, 201 bp, Bos taurus; identical to SEQ ID NO: 7332

SEQ ID NO: 89149 - DNA, 201 bp, Bos taurus; identical to SEQ ID NO: 7333

SEQ ID NO: 89150 - DNA, 201 bp, Bos taurus; identical to SEQ ID NO: 7334

SEQ ID NO: 89151 - DNA, 201 bp, Bos taurus; identical to SEQ ID NO: 7335

SEQ ID NO: 89152 - DNA, 201 bp, Bos taurus; identical to SEQ ID NO: 7336

SEQ ID NO: 89153 - DNA, 201 bp, Bos taurus; identical to SEQ ID NO: 7337

SEQ ID NO: 89154 - DNA, 201 bp, Bos taurus; identical to SEQ ID NO: 7338

SEQ ID NO: 89155 - DNA, 201 bp, Bos taurus
gtttctggcagttttcataagctgacctcctgcgttgagagcgaagagtcttagccactggaccaccatggaactccaaaactttttaaacgtagggccctgatcggtcttctcagttttcttgaaatttccaaatcccaaatttctcatctgatcaattagaaaaggccttcagtgttccctctcccgcttcccgtgtga

SEQ ID NO: 89156 - DNA, 201 bp, Bos taurus
tttgtggcagcgctatcacgggcgtccctgacttctgagcctgtgagctccgagcctgtgcagtgtcggccatggccttggacttggttcttcatactcccgccttgatcacttaggaaggtgacctttcagcaaaaaagccagaaagtacaggccaggaatagactgtgacatgaaagagaagcccgtatggagagtgtt

SEQ ID NO: 89157 - DNA, 201 bp, Bos taurus; identical to SEQ ID NO: 7339

SEQ ID NO: 89158 - DNA, 201 bp, Bos taurus; identical to SEQ ID NO: 7340

SEQ ID NO: 89159 - DNA, 201 bp, Bos taurus
atggcttccccagcctgccaatacccctctgtggcttcccttgactctcagaggtccttcaacacagagggaggggccctggcaggaccagctctgcctgcctctcctgcttctacatcactccttactttgatgtcctgactctggccaactgggcttcttgattttgccctgctccatcctcccacagagcttttgtag

SEQ ID NO: 89160 - DNA, 201 bp, Bos taurus; identical to SEQ ID NO: 7345

SEQ ID NO: 89161 - DNA, 201 bp, Bos taurus; identical to SEQ ID NO: 7346

SEQ ID NO: 89162 - DNA, 201 bp, Bos taurus; identical to SEQ ID NO: 7347

SEQ ID NO: 89163 - DNA, 201 bp, Bos taurus; identical to SEQ ID NO: 7348

SEQ ID NO: 89164 - DNA, 201 bp, Bos taurus
gtttaagtcagtaacacgttgggatcttgcttaaatgttgtgatcttctcttttacagcaggatcttagttttttaaacggctctaaatcttaaatacacactctagaagttatcagaactggccctcccagcaaagcccttccctctgttgtgtgcaagtgtgtatgattctggcaggcagagccttagtgaggtgctga

SEQ ID NO: 89165 - DNA, 201 bp, Bos taurus
ttgcctctatctcagcccaatcagagaataatcatcttcttacaaacttaggaagaagggctagaggcacgaagaagcagcatataaaatccaaggggttaagcaaacttagttgctgacagtgtgtagaaacatatgtagacatagaaatagaggaaatggggatgtctctggtggtccagtggttaagaatcttcctgt

SEQ ID NO: 89166 - DNA, 201 bp, Bos taurus
aacacccacgtcatcatcacccaggtatggcctccctctccagctgctcctgctgtaaaccagttgactcagagcagaaatcaggtgcaggaagggtcagcgttgaggcctgcttccaggaatgtaggaccagtgatcagccagaattgtgcacccttaactgttttgtgtgtgtgataaaatacatatagcagaatctac

SEQ ID NO: 89167 - DNA, 201 bp, Bos taurus
tctggcctgggtccacagttgacttcctcagactcacagaagctcttattggacaagtgccggctatatagcaggcactgtgttaagcaaaggacatgccattgaatccttgaaacggcccagtgaggtagactctctcgtccttattcccattttacggatgaggagactaaggagcagagaggttaagttgcacagcct

SEQ ID NO: 89168 - DNA, 201 bp, Bos taurus; identical to SEQ ID NO: 7351

SEQ ID NO: 89169 - DNA, 201 bp, Bos taurus; identical to SEQ ID NO: 7354

SEQ ID NO: 89170 - DNA, 201 bp, Bos taurus; identical to SEQ ID NO: 7355

SEQ ID NO: 89171 - DNA, 201 bp, Bos taurus; identical to SEQ ID NO: 7358

SEQ ID NO: 89172 - DNA, 201 bp, Bos taurus
tggtttggggttaaagtatcacatttaaaagacttagttatgatcagtgggggaacacgttgtggccctatggctttgatctgttttctggagtggcctgcgaaactttggactccctaacgatctatttctcaatgaggtcagaaagcaagcagcttttaaaatctagttcctctaccaggggctctggggttttgaaac

SEQ ID NO: 89173 - DNA, 201 bp, Bos taurus; identical to SEQ ID NO: 7359

SEQ ID NO: 89174 - DNA, 201 bp, Bos taurus; identical to SEQ ID NO: 7360

SEQ ID NO: 89175 - DNA, 201 bp, Bos taurus; identical to SEQ ID NO: 7361

SEQ ID NO: 89176 - DNA, 201 bp, Bos taurus; identical to SEQ ID NO: 7362

SEQ ID NO: 89177 - DNA, 201 bp, Bos taurus; identical to SEQ ID NO: 7363

SEQ ID NO: 89178 - DNA, 201 bp, Bos taurus
gagaggattctaaaattttcctgtaaagatattcagacccagtgcttttcttaggagaaagactttgaccaactttctaatttattctatggttactggtgtagttaagttcatttactcttgtaccaatattgataattcatattgtttttagaagatcagacatattatgtagatttcatttttcttactacccatttt

SEQ ID NO: 89179 - DNA, 201 bp, Bos taurus; identical to SEQ ID NO: 7364

SEQ ID NO: 89180 - DNA, 201 bp, Bos taurus
tacacttatcagttgtcaagaatcaaagaatttgatgaagttgattgtctgtgtggcactacccttcatgagaaagagcagaagtcctcctgtgttcccttcaaaagggacaatatgcttctggagaagccctttccttactgagaaagcttggaaatcttctattaatttttcacctatatcttcctttgaaatatatcc

SEQ ID NO: 89181 - DNA, 201 bp, Bos taurus; identical to SEQ ID NO: 7366

SEQ ID NO: 89182 - DNA, 201 bp, Bos taurus
ccttggaattgggcaggcccataaacaaggctttgccatcaggtaggcccctggctgtgctcccctgttgggcaagattactggccagactctctgattaagagagccctccagctgaatcccacagtgagtgggtctagagactgtgtttcatggtcaagctgggttgttgtctaggctttcttgataagaaagccttgt

SEQ ID NO: 89183 - DNA, 201 bp, Bos taurus; identical to SEQ ID NO: 7367

SEQ ID NO: 89184 - DNA, 201 bp, Bos taurus
acaagtatattcttactgatcttaaaattgaaccataaggacaataaatttaaaaaaaaactgaaaatagctcagcattaaagataaaaataattgtaacttttagaatatgatatgatagcatatgatcagagcagtagcctttgacaaagagcccataaatttaaaaaccctaacaatattgcctagtctattgagagt

SEQ ID NO: 89185 - DNA, 201 bp, Bos taurus
ccacctgttttggcctctagtgtctcccttcctttataaaatttgtggtgactcaaaataagacagtgtcagtaagaattaatacatggtgaaatgagaggttggagtccggttttggtttgggccagaataacactgactgaagtgagatattttcttctggaacaggagacatatctgctgatgacaagtgacttcttg

SEQ ID NO: 89186 - DNA, 201 bp, Bos taurus; identical to SEQ ID NO: 7368

SEQ ID NO: 89187 - DNA, 201 bp, Bos taurus; identical to SEQ ID NO: 7369

SEQ ID NO: 89188 - DNA, 201 bp, Bos taurus; identical to SEQ ID NO: 7370

SEQ ID NO: 89189 - DNA, 201 bp, Bos taurus
ctagtttcacgatgcttttaaaattgtgtttttaaaaatttacgcttggtcttttgcttgtttccatcttatgtagtattcagttattattctaatactatactatttaattgctataatttatgtagccttttctctattgctgctgctgctgctaagttgcttcagtcgtgtccgactctgtgcgaccccatagatggc

SEQ ID NO: 89190 - DNA, 201 bp, Bos taurus; identical to SEQ ID NO: 7371

SEQ ID NO: 89191 - DNA, 201 bp, Bos taurus
ctgattgctttttattcctctttcctagatgaggtagaatagaagtaagatgagaaaacttagactgtatgtttttgtgagtgagagatgagagagaaaactttttagtttcatacttataaggtctaaaattaaatagcatacataattcaaactttaactatttttttcacttagcagtataaaattcttaacaccttt

SEQ ID NO: 89192 - DNA, 201 bp, Bos taurus; identical to SEQ ID NO: 7373

SEQ ID NO: 89193 - DNA, 201 bp, Bos taurus; identical to SEQ ID NO: 7374

SEQ ID NO: 89194 - DNA, 201 bp, Bos taurus
cattctttgggatttttgtactcttgttaggcagcagaaataatgaataatattctttgaactgagaaagacctttgagactgataaacaaagcagcaatgccatatagtgcaattatgaagtttattgtagataactcacttacagacaggattgggcagatgaagatctaaaggcatttgtagctacacttcacattgc

SEQ ID NO: 89195 - DNA, 201 bp, Bos taurus
attatctctaaacatattagactcctcaaaatgtattcttagaaaggataaattgatgaattactattctcagaggcaacatgacacttgattcttgattatctcttccagatgcagagtcaactgagaattaactacttgagtgtgaagaaggaaatatccaggtctcctttccatccaataatctccattccattgaaa

SEQ ID NO: 89196 - DNA, 201 bp, Bos taurus
aagatcacaaaactatctaatggaagcacttcaacaactcctttgtcctacttgatacgtcattctgcttttttatgtacttgatagaggcactcattttccttcaatactttaactggtgtctgttgaactatcctacaatttcaagttttcaaaggagagcatgtgatattaaataagaaattatggctaaattatctt

SEQ ID NO: 89197 - DNA, 201 bp, Bos taurus
ttgatgcaatcatcaataaaactttgtccacaataagtttatgtgaaaaaattatattacaccacagtagaaattatattttaagatttcaactgcaattatatttctttcttggcaaattaatgctgaaatttcttatggaaatatgaatggagtttgaaaaccaattcaacattttcaactcgactattccaaatgtct

SEQ ID NO: 89198 - DNA, 201 bp, Bos taurus; identical to SEQ ID NO: 7377

SEQ ID NO: 89199 - DNA, 201 bp, Bos taurus; identical to SEQ ID NO: 7378

SEQ ID NO: 89200 - DNA, 201 bp, Bos taurus; identical to SEQ ID NO: 7379

SEQ ID NO: 89201 - DNA, 201 bp, Bos taurus; identical to SEQ ID NO: 7380

SEQ ID NO: 89202 - DNA, 201 bp, Bos taurus; identical to SEQ ID NO: 7382

SEQ ID NO: 89203 - DNA, 201 bp, Bos taurus; identical to SEQ ID NO: 7383

SEQ ID NO: 89204 - DNA, 201 bp, Bos taurus; identical to SEQ ID NO: 7384

SEQ ID NO: 89205 - DNA, 201 bp, Bos taurus; identical to SEQ ID NO: 7385

SEQ ID NO: 89206 - DNA, 201 bp, Bos taurus; identical to SEQ ID NO: 7386

SEQ ID NO: 89207 - DNA, 201 bp, Bos taurus; identical to SEQ ID NO: 7387

SEQ ID NO: 89208 - DNA, 201 bp, Bos taurus; identical to SEQ ID NO: 7388

SEQ ID NO: 89209 - DNA, 201 bp, Bos taurus; identical to SEQ ID NO: 7390

SEQ ID NO: 89210 - DNA, 201 bp, Bos taurus; identical to SEQ ID NO: 7391

SEQ ID NO: 89211 - DNA, 201 bp, Bos taurus; identical to SEQ ID NO: 7392

SEQ ID NO: 89212 - DNA, 201 bp, Bos taurus; identical to SEQ ID NO: 7394

SEQ ID NO: 89213 - DNA, 201 bp, Bos taurus; identical to SEQ ID NO: 7395

SEQ ID NO: 89214 - DNA, 201 bp, Bos taurus
ccttgcactgcagccagacccagtgaccctggactgcagggcaggggttccctgtgtccttccctctggctttaatgccagcatccttgtagagtggagccgggccactgtgcttcattattgcctccaaagcaaaggtgttccacatcatccactctcctctgtagccacagaatcacggaatgatcttcggcctggaaa

SEQ ID NO: 89215 - DNA, 201 bp, Bos taurus
aatgtttagtaactaagtgtacatagttaaacaactagagagctgacatccagtaagtttggtgtgatatttggtttgtataatattatttcagcatactgttaaatcatgcagaattctttctggaaaagtattcaagaggatgccagaaaggccatgttaataataagtttctgtacttcagtagattttgagtgtgtt

SEQ ID NO: 89216 - DNA, 201 bp, Bos taurus
aaccacatgtggctaatagccaccataattaggcagtgcagttctagattatggatcctgtgtagtcatgtttttactccaaagtggatttggtgaaaataataatgtgcttatttacattaaggcattcaagttcttggcatataaatcattgatttgcagtgcattctaaactagcatttaaatgtaactcattcgtac

SEQ ID NO: 89217 - DNA, 201 bp, Bos taurus
ggccttccttctctctaaattgtttctcattcatccttttgcttttatatcagcatgtattgttggtaatataatattctttagactaacagatcccccccaaacctcattttattaaagcagccgttttattatctctcactgtttctttgggtcacgaattcaggaagggtgaggttttggctaggcatctctcatgtg

SEQ ID NO: 89218 - DNA, 201 bp, Bos taurus
gaaagtagctcgatgtaatgtgcctgatatggattactgtctcatattctcttctccacccatcccccatacccactcccagcattaaggttaccattctaaacagaaaaaaatatgtttaaggaattgtagcatacagtcaaatttatattattttataaaaatactgctgttgtgcagaggtagtgtgtcattggaaac

SEQ ID NO: 89219 - DNA, 201 bp, Bos taurus
tgtttggacttgttgagcttgggatgctcttgtctaacctgtgagtcacctgtgtctctcaggtagtgatgtatctagggagaaagtttaaaatgagggcaaggccctctaggatttgagaggtcgagctggggaggatgtcacagttactgagaagtggcagagagggaggcggaggatgggaggggctggcgtgggaca

SEQ ID NO: 89220 - DNA, 201 bp, Bos taurus; identical to SEQ ID NO: 7397

SEQ ID NO: 89221 - DNA, 201 bp, Bos taurus; identical to SEQ ID NO: 7398

SEQ ID NO: 89222 - DNA, 201 bp, Bos taurus; identical to SEQ ID NO: 7399

SEQ ID NO: 89223 - DNA, 201 bp, Bos taurus
gtcatgaggggagacatctcactctgttctgtttctcaccagattgcgcaaaagctgaggcaggccctcggccgcttcccggtgatgtaggacaggtggattgaacgtggagaaacgccgaagtgcttccttctgacttgggacaacgcaattggatttttttttccaccatcgtccaaaaagaaacaaaaaagaaaacca

SEQ ID NO: 89224 - DNA, 201 bp, Bos taurus; identical to SEQ ID NO: 7400

SEQ ID NO: 89225 - DNA, 201 bp, Bos taurus
catgactactggaaaaaccatagctttgactagacggacctttgtcagcaaagtaatgtctctgctttttaatatgcagtctaggttggtcataacttttattttgtgggggctgcatggctccaaaactttcctttaacctttaattgtgaaaattttcaaatgtacacaaaagtgaaaggaaaaatgaatctcctgtac

SEQ ID NO: 89226 - DNA, 201 bp, Bos taurus
ccactgccccaccctgctcacccagactgcctctgtgtgggtatggccctcctggttctggtgtagatgtctttttggtctgtgacccatttcttgcccttgcctacacctcacctgactctggccagcatcctctgacccaggcatggtcttgctgctgctggagccctggaaccagagagttggagctgaaagggatgg

SEQ ID NO: 89227 - DNA, 201 bp, Bos taurus; identical to SEQ ID NO: 7401

SEQ ID NO: 89228 - DNA, 201 bp, Bos taurus; identical to SEQ ID NO: 7402

SEQ ID NO: 89229 - DNA, 201 bp, Bos taurus; identical to SEQ ID NO: 7403

SEQ ID NO: 89230 - DNA, 201 bp, Bos taurus
ataaatggtatttgcaaaattatgaggccttccctggagtcaaagccttcagaactgactgtataggcactgcgtgagatgaaaggagctggggttatggaggatatccatatggggatatccggtccatatttctttctactctccaatgttgtttctcagtaaacattctaaaatctttgtaacacacctcttattagt

SEQ ID NO: 89231 - DNA, 201 bp, Bos taurus; identical to SEQ ID NO: 7406

SEQ ID NO: 89232 - DNA, 201 bp, Bos taurus
tgggaaacacatgggccagcaaccagctgcaagctggtggaaatgaatggaataagtagagcagatgggtgtgtaatgggcaagtagggaccgacagcagtgaaggagctcctcaatggccagagagaagtggggtgggcctgggaatagcgccaagaacgcttgagaccaaaggatttctaccttgacacatgggctctc

SEQ ID NO: 89233 - DNA, 201 bp, Bos taurus; identical to SEQ ID NO: 7407

SEQ ID NO: 89234 - DNA, 201 bp, Bos taurus
ttcagagtgacttcattaaacctgcaagagttgccggtcgctgtcacagagagggggaccaggtcaggcttggagaaggggccgcgatgtgtgatggaccgcacgatgccgcagagaagctgtcttgtctcccagtagagagcctgctgtccctccgtcgctgtgagcactcagcactcacctcgatgtctgcttgcctct

SEQ ID NO: 89235 - DNA, 201 bp, Bos taurus
agggctccccaggacccaggtggctgctggggcacacccattgtacccacacccactgctggggatggagccaggccccactgcaagggacagggcacatcggggaggacacttcctggaagaatgaggacttcagataaaaactaagtctgagaaacacaagattgcatttctcacacatttgaatttcgtggcctgaga

SEQ ID NO: 89236 - DNA, 201 bp, Bos taurus; identical to SEQ ID NO: 7409

SEQ ID NO: 89237 - DNA, 201 bp, Bos taurus; identical to SEQ ID NO: 7410

SEQ ID NO: 89238 - DNA, 201 bp, Bos taurus; identical to SEQ ID NO: 7411

SEQ ID NO: 89239 - DNA, 201 bp, Bos taurus; identical to SEQ ID NO: 7412

SEQ ID NO: 89240 - DNA, 201 bp, Bos taurus; identical to SEQ ID NO: 7413

SEQ ID NO: 89241 - DNA, 201 bp, Bos taurus; identical to SEQ ID NO: 7414

SEQ ID NO: 89242 - DNA, 201 bp, Bos taurus; identical to SEQ ID NO: 7415

SEQ ID NO: 89243 - DNA, 201 bp, Bos taurus; identical to SEQ ID NO: 7416

SEQ ID NO: 89244 - DNA, 201 bp, Bos taurus; identical to SEQ ID NO: 7417

SEQ ID NO: 89245 - DNA, 201 bp, Bos taurus; identical to SEQ ID NO: 7418

SEQ ID NO: 89246 - DNA, 201 bp, Bos taurus; identical to SEQ ID NO: 7419

SEQ ID NO: 89247 - DNA, 201 bp, Bos taurus
cttgcccggtccagcagccaggccgcggccggggtccacgctccggctgcagccgcccccaggagccacgcggctggggcaatcccccgttctccaggccgggacattttaacagcacaccgctcctccctgccctcagttacagttcgccctgcaccccagggctaaccggaacagaaagcgcctggcacagggaaggcc

SEQ ID NO: 89248 - DNA, 201 bp, Bos taurus; identical to SEQ ID NO: 7421

SEQ ID NO: 89249 - DNA, 201 bp, Bos taurus; identical to SEQ ID NO: 7422

SEQ ID NO: 89250 - DNA, 201 bp, Bos taurus; identical to SEQ ID NO: 7424

SEQ ID NO: 89251 - DNA, 201 bp, Bos taurus; identical to SEQ ID NO: 7425

SEQ ID NO: 89252 - DNA, 201 bp, Bos taurus; identical to SEQ ID NO: 7426

SEQ ID NO: 89253 - DNA, 201 bp, Bos taurus
tttctttttcccataggaatctgaagaactctttcaggatacacagtttttaaaaaagcattcttgccgagggtctttatatcaaaaatacatagctcctctcttcaccagaaacaatggaagctttccaggaagttattgtcagtgaccactggaggtggaaaacctccaaagaaccatccatagtctttacgaaatgac

SEQ ID NO: 89254 - DNA, 201 bp, Bos taurus
cctcatccaagtggagggtaatgcatttttgattgattctttaaggttttttttttttttccccccaaaattcccaaatttttgtgtgtgcagacctgccctcctactatgactaattcaaaatggccataataggttacaactgaagcaaagttgacatgagttgaagcagtcagactaaataatggggaaaacatttga

SEQ ID NO: 89255 - DNA, 201 bp, Bos taurus
ccctctgtgaaatacagttctattttgcatacacagtggtatgcaatggcattttatataaatggtatttcatcaataccaattacttgtcagatagcccgtttctttatgggccttataagatgatagtgataaaaataacaattggctggagttttcatgatgctgccaaaagtataaatcttgataacctaatgaatg

SEQ ID NO: 89256 - DNA, 201 bp, Bos taurus; identical to SEQ ID NO: 7430

SEQ ID NO: 89257 - DNA, 201 bp, Bos taurus; identical to SEQ ID NO: 7431

SEQ ID NO: 89258 - DNA, 201 bp, Bos taurus
tctctcccctagtttgtctccttccactgaagaaatttgctccaaagatgtaaacaatgtgaaggaaagaatacggagagcaggccacacgaataaccttgtttataggtttctgagcacagtttccaactaatgatatatatatatatatatatatatatatttatctataggatagatcatgaaatacatcacccgaca

SEQ ID NO: 89259 - DNA, 201 bp, Bos taurus; identical to SEQ ID NO: 7434

SEQ ID NO: 89260 - DNA, 201 bp, Bos taurus; identical to SEQ ID NO: 7435

SEQ ID NO: 89261 - DNA, 201 bp, Bos taurus; identical to SEQ ID NO: 7436

SEQ ID NO: 89262 - DNA, 201 bp, Bos taurus; identical to SEQ ID NO: 7437

SEQ ID NO: 89263 - DNA, 201 bp, Bos taurus; identical to SEQ ID NO: 7438

SEQ ID NO: 89264 - DNA, 201 bp, Bos taurus; identical to SEQ ID NO: 7440

SEQ ID NO: 89265 - DNA, 201 bp, Bos taurus; identical to SEQ ID NO: 7441

SEQ ID NO: 89266 - DNA, 201 bp, Bos taurus
cctcttcttccagaaaggactgaaagcctatcaggtgacatcaagacacggaaccaagcgaaacgctcgaggatggaaaacctccgtgtgtgttagcagagtgctttcagacgggccacagcagggctgctgctgtggtccaagggtcatcggcacgtgctgcgggtggaactgcgtcccttccaaaaatgtactgaaggc

SEQ ID NO: 89267 - DNA, 201 bp, Bos taurus; identical to SEQ ID NO: 7442

SEQ ID NO: 89268 - DNA, 201 bp, Bos taurus
tctaacctggtgtgtatttcgctctcgcgatttgtcacagcttgcatgagccgctttcacctgacaagtggccggcccactggacagctgagtctcagcataaaaggggaaagctcggtgccaccgcgcattggaagttcagcagcaccgacccggtggcttggacggggtcggggtggggcctccagcatctggagctgt

SEQ ID NO: 89269 - DNA, 201 bp, Bos taurus
gccccctgcctgcccacctccccctccaccctctctcgggcgtcttcagatgcccagggccctccaggtgcagctcagcgggcagaggccccgcctctccatgcagccaggtgcctgcactctgactctgcacatgaattcattcgggttcatctcctgaaatgctcccaggcgggccatcccaccgctccgtcctctgag

SEQ ID NO: 89270 - DNA, 201 bp, Bos taurus
tcttggcatcctgagaggcaaagagaagggcccgcttgagtagccccgagtcgccacggaggggagtgttggaaacagaaacgctgggtctccgtctgagtagctgcggggccagcaattactctgtttcaagagacttgctctcactttcgcccacagttaagagtcaagtggtcacgcgcagattccgaatctctgtcc

SEQ ID NO: 89271 - DNA, 201 bp, Bos taurus; identical to SEQ ID NO: 7443

SEQ ID NO: 89272 - DNA, 201 bp, Bos taurus; identical to SEQ ID NO: 7444

SEQ ID NO: 89273 - DNA, 201 bp, Bos taurus; identical to SEQ ID NO: 7445

SEQ ID NO: 89274 - DNA, 201 bp, Bos taurus
gagatagtgctcccgctcgaggatgataacgctgagcagcgaggtgccagtgccaggagatgaagagggtccatttcggagaattctcctccaaggctccaggccttggctatctcctaacgtaaacacggactcttaaaaatgtgaagaatctgcttaatgtgtaaaccgaggtgatgggggcgtaggcctttccatttg

SEQ ID NO: 89275 - DNA, 201 bp, Bos taurus; identical to SEQ ID NO: 7446

SEQ ID NO: 89276 - DNA, 201 bp, Bos taurus
ggaccctcttagctgaaagtctcttgcacgtgttcagtgggtaacggcagagctgagggccggcagcccatctccaggcccccgcaggggacgctatgcctcttccgtcctgtgtgtttggagagtttggagcgggtcgggctgcggtctctctccgccttctgcccctcggccaggtggcacatggagagaccagggcgt

SEQ ID NO: 89277 - DNA, 201 bp, Bos taurus; identical to SEQ ID NO: 7447

SEQ ID NO: 89278 - DNA, 201 bp, Bos taurus
gagtttccatgcccacggccgggcaggtccctccccccgacctcctagcgagcctcctgccagcgttatcacctcgtcactgtcattaggacgtttgctcgacctgtcctccaaggacccagggccctgtggtttcctcaattcagcgtatgtcatcaggggaatattagaccatctgccaaccagtaggcaagagcagca

SEQ ID NO: 89279 - DNA, 201 bp, Bos taurus
aggctgtgcttcgtacctacagcaggttgggaggcaggccctccaggggacactcttggcgtggtccccggaaacccaggggctcctacacaggccaacacgtacacggtgctgaaaacaaaaggagacgcagggtccctcctgcggatgcaggctcccacccggcgcccctccaccttcagtcacgtgaacgcaccacac

SEQ ID NO: 89280 - DNA, 201 bp, Bos taurus; identical to SEQ ID NO: 7449

SEQ ID NO: 89281 - DNA, 201 bp, Bos taurus; identical to SEQ ID NO: 7452

SEQ ID NO: 89282 - DNA, 201 bp, Bos taurus; identical to SEQ ID NO: 7453

SEQ ID NO: 89283 - DNA, 201 bp, Bos taurus; identical to SEQ ID NO: 7454

SEQ ID NO: 89284 - DNA, 201 bp, Bos taurus; identical to SEQ ID NO: 7455

SEQ ID NO: 89285 - DNA, 201 bp, Bos taurus
ggtctttgaagatttcacaggccacagggcgaagaagcccatttgccacaatgactgagtttgtgcaccaaactacctgagtcactcaggctctagaccccgtgctccgcaacaagggagtggcctctgttggccgcaactagagaaaggcttcacgtagcaaagaagacccagcgcagcaaaaaaaaaaaaagcgctcat

SEQ ID NO: 89286 - DNA, 201 bp, Bos taurus
acttgttattggaagaaaatcaagccttaagttaaaaagttttagaagtacctctaggagtatttaaatccctttccctataaatcaagtatgctttcttagtggtaaaagaatgaaaattagcaacttctagcattcagactatataatcagactgttagtatacagaatatgtaacttttagtgtagaaaatataaggc

SEQ ID NO: 89287 - DNA, 201 bp, Bos taurus; identical to SEQ ID NO: 7457

SEQ ID NO: 89288 - DNA, 201 bp, Bos taurus; identical to SEQ ID NO: 7458

SEQ ID NO: 89289 - DNA, 201 bp, Bos taurus
ccccgttctcatcaagcagggttctgctcaggtgccactttctctgaaggctctctcctaatctgaattaagcctgcatttcattgcaggagtttctgtatgttcctgcccacctcaccctgggagcaatatcagaagatgatgagggcgtgagtcttggtcatagataactcttgcttcaggtctcgcttccatgtgtta

SEQ ID NO: 89290 - DNA, 201 bp, Bos taurus
ggtagcaaacatggcagagaaggccagcaagacacaggctgaaatgtatttagtgggtttgacatccaaaagaaattggtgtcctttgtgggaaccaggtatagtagattgatggtgtctggccttggctcaagaaaaggaggggcgaggaggtaaagatgcagaaggccagaacaccggtattctttctagtgagaagga

SEQ ID NO: 89291 - DNA, 201 bp, Bos taurus
acagtcacccatgggggccctaaggctcccagtaacacttttcttaaggtccttcctgctacctcatcatcaaaacacataatggagagttgacaggagcggggccagatcaggtagggccttacagatcatcataaggagtttggattttaatttgtataagaagggaaacaactggaggatgtagaggagagtaagctg

SEQ ID NO: 89292 - DNA, 201 bp, Bos taurus
tggaaggtattgtcatggggcaaagggataaggaggagcggagtcatttgtttggcatggtttattcaaggaaggcctcatggagtgggcagtgtgagagaagatggtagaactctcaagacagaggagacaggcggcaacacacgcgatggcaatgcagatggctcagtgcagccactgcaggcctgagcactgcaggac

SEQ ID NO: 89293 - DNA, 201 bp, Bos taurus; identical to SEQ ID NO: 7461

SEQ ID NO: 89294 - DNA, 201 bp, Bos taurus; identical to SEQ ID NO: 7462

SEQ ID NO: 89295 - DNA, 201 bp, Bos taurus; identical to SEQ ID NO: 7463

SEQ ID NO: 89296 - DNA, 201 bp, Bos taurus; identical to SEQ ID NO: 7464

SEQ ID NO: 89297 - DNA, 201 bp, Bos taurus; identical to SEQ ID NO: 7465

SEQ ID NO: 89298 - DNA, 201 bp, Bos taurus
aggagcctggagagcatgtggcagtggattctagggtgctggaacaagggatttgaacaagggtgggagagatgagacatacagctcagatggccaaatgaattgctatgggcttaccatcaaagagctaggatctgaatgtgctggttcaagaagtggaaccctgagagacttaccctctgcaggcctaccaaatctaag

SEQ ID NO: 89299 - DNA, 201 bp, Bos taurus; identical to SEQ ID NO: 7466

SEQ ID NO: 89300 - DNA, 201 bp, Bos taurus
agttggtgatggacagggaggcctggagtgctgcagtccatggggtcacaaagaataggacatgactgagcgactgaactgaataagaaaagggcttattgtgggccttatgaattacgattctggagataaagatttcaggtaaaaccaaaagagtgttccagggatgagaaagaggggtttataaaggcagaagacatg

SEQ ID NO: 89301 - DNA, 201 bp, Bos taurus
ccccttaaatcgtttctccgttggggattacttattcccgtttgggggcctgggggaaatggggatctgtgtctatatctgtgttaaaactttgatccaataagacagtggagtttcactgttggccattttctccgtaatcccagtgaccttcaaggagataaacaggctgataagaaaatgcgagatctttaaactctg

SEQ ID NO: 89302 - DNA, 201 bp, Bos taurus; identical to SEQ ID NO: 7467

SEQ ID NO: 89303 - DNA, 201 bp, Bos taurus; identical to SEQ ID NO: 7468

SEQ ID NO: 89304 - DNA, 201 bp, Bos taurus; identical to SEQ ID NO: 7470

SEQ ID NO: 89305 - DNA, 201 bp, Bos taurus
cttggctcatggccgcttcctcacatcgcatcgccctcttgctttcactgttacatctcctcttggttctaatcctcctgcttccctcttacaaggactcctgtgaatacactggcccacccagataatcccacataaactccccacctcaagagcctcaacttaatcacatttgcacagttccttttatcacatgaggtc

SEQ ID NO: 89306 - DNA, 201 bp, Bos taurus
tatgacacaaatgaacttatttacaaaacagaaataaattcaccaacagagagaacagactgatggtggccaaggaggagggcctgggagagagatggggcgggcggctgtggttagaagatgtaagcttttatatggagagtggataaacaacaaggccctactgtatagcacagggaactatattcaacatcctgtgac

SEQ ID NO: 89307 - DNA, 201 bp, Bos taurus; identical to SEQ ID NO: 7471

SEQ ID NO: 89308 - DNA, 201 bp, Bos taurus; identical to SEQ ID NO: 7472

SEQ ID NO: 89309 - DNA, 201 bp, Bos taurus; identical to SEQ ID NO: 7475

SEQ ID NO: 89310 - DNA, 201 bp, Bos taurus; identical to SEQ ID NO: 7477

SEQ ID NO: 89311 - DNA, 201 bp, Bos taurus; identical to SEQ ID NO: 7478

SEQ ID NO: 89312 - DNA, 201 bp, Bos taurus; identical to SEQ ID NO: 7479

SEQ ID NO: 89313 - DNA, 201 bp, Bos taurus; identical to SEQ ID NO: 7481

SEQ ID NO: 89314 - DNA, 201 bp, Bos taurus
ggattttcctgtgttgttattgttcacatgatcgagatgttggcttcaggtatagctagatctagattctcaaacaatgttatgatttctttcaatatgactcaagtcttctttctctatggattatctcagaggatttggcccacaatggtcaccagcagcaatttattccccagccactccagaataacttacaagaaa

SEQ ID NO: 89315 - DNA, 201 bp, Bos taurus; identical to SEQ ID NO: 7485

SEQ ID NO: 89316 - DNA, 201 bp, Bos taurus; identical to SEQ ID NO: 7486

SEQ ID NO: 89317 - DNA, 201 bp, Bos taurus; identical to SEQ ID NO: 7487

SEQ ID NO: 89318 - DNA, 201 bp, Bos taurus; identical to SEQ ID NO: 7488

SEQ ID NO: 89319 - DNA, 201 bp, Bos taurus; identical to SEQ ID NO: 7490

SEQ ID NO: 89320 - DNA, 201 bp, Bos taurus; identical to SEQ ID NO: 7491

SEQ ID NO: 89321 - DNA, 201 bp, Bos taurus; identical to SEQ ID NO: 7492

SEQ ID NO: 89322 - DNA, 201 bp, Bos taurus; identical to SEQ ID NO: 7493

SEQ ID NO: 89323 - DNA, 201 bp, Bos taurus; identical to SEQ ID NO: 7495

SEQ ID NO: 89324 - DNA, 201 bp, Bos taurus; identical to SEQ ID NO: 7498

SEQ ID NO: 89325 - DNA, 201 bp, Bos taurus; identical to SEQ ID NO: 7499

SEQ ID NO: 89326 - DNA, 201 bp, Bos taurus; identical to SEQ ID NO: 7503

SEQ ID NO: 89327 - DNA, 201 bp, Bos taurus
cctggaaaacaatattttcagttgatctgaagccagggtccctacaggattaggtgtttgcctctgtctgcccacctgcctgctccttccttcaaccggtcgactggccacagcaaagggcagaagggattgtgcttctacagagtgcagacccccaagaagtcagagctggaagcgtccggttgcccactcctcacgggc

SEQ ID NO: 89328 - DNA, 201 bp, Bos taurus; identical to SEQ ID NO: 7506

SEQ ID NO: 89329 - DNA, 201 bp, Bos taurus; identical to SEQ ID NO: 7507

SEQ ID NO: 89330 - DNA, 201 bp, Bos taurus; identical to SEQ ID NO: 7508

SEQ ID NO: 89331 - DNA, 201 bp, Bos taurus; identical to SEQ ID NO: 7509

SEQ ID NO: 89332 - DNA, 201 bp, Bos taurus; identical to SEQ ID NO: 7510

SEQ ID NO: 89333 - DNA, 201 bp, Bos taurus; identical to SEQ ID NO: 7511

SEQ ID NO: 89334 - DNA, 201 bp, Bos taurus; identical to SEQ ID NO: 7512

SEQ ID NO: 89335 - DNA, 201 bp, Bos taurus
acagaacacttccttactctgtaagatggcccaccagatactctttctgtgaccgtgggattacaaataacaagagctggaaagtcaggtcttcttaaaaggggcagaatggcctcgaagcttctctgtgtttgttggcatgggaagagactgggtggtcaggaaacaacagctgtgacagaaataaaagagctggaaaca

SEQ ID NO: 89336 - DNA, 201 bp, Bos taurus; identical to SEQ ID NO: 7515

SEQ ID NO: 89337 - DNA, 201 bp, Bos taurus; identical to SEQ ID NO: 7516

SEQ ID NO: 89338 - DNA, 201 bp, Bos taurus; identical to SEQ ID NO: 7517

SEQ ID NO: 89339 - DNA, 201 bp, Bos taurus; identical to SEQ ID NO: 7518

SEQ ID NO: 89340 - DNA, 201 bp, Bos taurus; identical to SEQ ID NO: 7519

SEQ ID NO: 89341 - DNA, 201 bp, Bos taurus
tagcacgtggtaggtgctgtgatattgtgatataatcaggaatatttatttggtcttctacttgggtatgggaggcccagaagacttaatgctgacagctgaaatgtgtgggatgccagacagggaggagtgtggtgttgtgggattaggcccctagcctgggggatatctgacatccaggtaatgtcagaattaaactgt

SEQ ID NO: 89342 - DNA, 201 bp, Bos taurus
atttggccagtagagacgaaagtgcacaggagaaatgaaaacgataaagctagaagtgagacttgaacacagatggagttgtagaagaaatcactcattgtgcgaatgttggccctgctgctgttctagagcctctagatatgcagctagaggatctcagcacaggcaagcttatcatcgtaaacgaggaaggttgtaatg

SEQ ID NO: 89343 - DNA, 201 bp, Bos taurus; identical to SEQ ID NO: 7520

SEQ ID NO: 89344 - DNA, 201 bp, Bos taurus; identical to SEQ ID NO: 7521

SEQ ID NO: 89345 - DNA, 201 bp, Bos taurus
ttaactccctcttagttctgctcttaccttgacttgactagaacagactttttataacttctttaactgcctgcattttcccaactgggatccctacaaaagatttttctttaaacatagtagagcataaaagggtgtaggaaagtattcaaatagaatcacacaaactaacctctcctccctctcacctcccctctcttt

SEQ ID NO: 89346 - DNA, 201 bp, Bos taurus; identical to SEQ ID NO: 7522

SEQ ID NO: 89347 - DNA, 201 bp, Bos taurus; identical to SEQ ID NO: 7523

SEQ ID NO: 89348 - DNA, 201 bp, Bos taurus; identical to SEQ ID NO: 7525

SEQ ID NO: 89349 - DNA, 201 bp, Bos taurus; identical to SEQ ID NO: 7528

SEQ ID NO: 89350 - DNA, 201 bp, Bos taurus; identical to SEQ ID NO: 7532

SEQ ID NO: 89351 - DNA, 201 bp, Bos taurus; identical to SEQ ID NO: 7533

SEQ ID NO: 89352 - DNA, 201 bp, Bos taurus; identical to SEQ ID NO: 7534

SEQ ID NO: 89353 - DNA, 201 bp, Bos taurus
tcttgcccttctcttcagtagactcccttgttacaggtccttgcgctggggtgaagagtactctctgaaaagcgtactagatgaacagtgagctggcgagagctggcctccgagccctcctgcatttctactttccgtctcagcccaccggcgttttggatctcaataccaattttaccttttactctgagaaaccagaaa

SEQ ID NO: 89354 - DNA, 201 bp, Bos taurus
cagggctaaagaatcgctggctagagctctcggagggaggtgagaagggaccaagtcaacaactctcatttccatttcatctctgattggaaaggccaagtatcaaggtccagagagtaaacggagttccctttgactctctccttcacgtgtggctgagccccagagtggacgtgatttatacagggtgggccccagaga

SEQ ID NO: 89355 - DNA, 201 bp, Bos taurus
tggactctgaggcctcagccttcccattcccaggcaggcaacagctgtgcccccagcctccagcccctctaaagatgaagggagaaaacttactgtgttcggaggccattccatttctcacagagcaattctctccatctttccatttctttgcaaatcagggcacactcatctggcctggccaacccagaggctgcctga

SEQ ID NO: 89356 - DNA, 201 bp, Bos taurus; identical to SEQ ID NO: 7535

SEQ ID NO: 89357 - DNA, 201 bp, Bos taurus; identical to SEQ ID NO: 7538

SEQ ID NO: 89358 - DNA, 201 bp, Bos taurus
aagccaggaaaccaggaccataaaggaaaagacagattagaacatatcaggtatttaaatgtctccatggtcagaggccctgcaaacaagtctagagacaatcatagatgagaagtgtttgttacatacagatagataagagcttcacttttctcataccttcaagacccctcatgcagaattcctacaaactaattggga

SEQ ID NO: 89359 - DNA, 201 bp, Bos taurus; identical to SEQ ID NO: 7539

SEQ ID NO: 89360 - DNA, 201 bp, Bos taurus; identical to SEQ ID NO: 7540

SEQ ID NO: 89361 - DNA, 201 bp, Bos taurus; identical to SEQ ID NO: 7541

SEQ ID NO: 89362 - DNA, 201 bp, Bos taurus; identical to SEQ ID NO: 7542

SEQ ID NO: 89363 - DNA, 201 bp, Bos taurus
cagaaagaaggatacaagaatgttatggctttgtttgacactgtttgaaatgaggtttaatgaataaaggtttcaaagcctaagcaataatgttgaatcagtaggggagatcctggccagaaattcagggttaaacaaaaaactagcctttttttttttttttttactaagtttccaagtaagaacttcttagtattgcta

SEQ ID NO: 89364 - DNA, 201 bp, Bos taurus
agagtcctaactgaggagcagggcccagacgggtaagacaggactgaaaaccacttactcaggtgaaactacagagtgattttctgtcagcagttactcaattgggatttttcccagggccctaaagctcttcccatacatttctgaagtgacacaggacttccgttgatcatggtaggaacctggcctttttgcctacac

SEQ ID NO: 89365 - DNA, 201 bp, Bos taurus
aagagagaagaattaggcagattttataatcaggacaagaaagaattttaaaaaaccatacatctttatagatcatgactattgaaatgaaaatgtaaatggaggcaaagttgattttttcacataggaagcaggagaggaaaatcaactgaacctctaccaaactggacagaatttctcagtcacttgtaaaatatcttc

SEQ ID NO: 89366 - DNA, 201 bp, Bos taurus
gtgaaaggatgcctggtgtatttaggaggcactgcctgtgatcagtgtggtatggacagtgcgggagggttgagatgaggttgcaaaggcaggtaggctcgatcatggagggccctagcttgaggatatgagcagtggggagaatgtagagttagtaagaaggtgatggattagatgtggggaagaaggaaaggagtggtc

SEQ ID NO: 89367 - DNA, 201 bp, Bos taurus; identical to SEQ ID NO: 7544

SEQ ID NO: 89368 - DNA, 201 bp, Bos taurus
cgggtccactgaccatgatttccctgacgaggtctgaggaaaaggagagagaggcatagactaaaattaccaagaagtacactgaaagacatcactgactcgatggacgtgagtctgagcgaactccgggagttggtgatggacagagaggcctggtgtgctgcgattcatggggtcgcaaagagtcggacacgactgagc

SEQ ID NO: 89369 - DNA, 201 bp, Bos taurus; identical to SEQ ID NO: 7545

SEQ ID NO: 89370 - DNA, 201 bp, Bos taurus; identical to SEQ ID NO: 7547

SEQ ID NO: 89371 - DNA, 201 bp, Bos taurus; identical to SEQ ID NO: 7548

SEQ ID NO: 89372 - DNA, 201 bp, Bos taurus
caagaaacactgtcaaactcattctatgaagtgacaattaccctgatatcaaaacagacaaagatatcatacacaaaaaaagaaaatcacaggccaatattaccaatgttaccttactaattatgatgtttaagtaggaggatgtccttatttgtactaaatgcacactaaagaattagggggagttgaggcaccaggttg

SEQ ID NO: 89373 - DNA, 201 bp, Bos taurus
gccatggctggggttggggaggggcctggctgttaggacctgtgacgtgttccccagggggtgcaggcagggcaggcagtgagcgagccttggaccatgacggcctttacttgtgcctctattcgataccgtgcgttcagaccctaccaaagccttttcactctctcatggtcccaggtggtttcagctgtgtgtgtgtgt

SEQ ID NO: 89374 - DNA, 201 bp, Bos taurus; identical to SEQ ID NO: 7549

SEQ ID NO: 89375 - DNA, 201 bp, Bos taurus; identical to SEQ ID NO: 7550

SEQ ID NO: 89376 - DNA, 201 bp, Bos taurus
cccctttctgtgacttccttacctttacacttttcccaaactcccagcgagcatgtacgtcattgcaaccttgacccttcctgggagggaggagagcttccgatccccattgggtttgagggcctgtgtggggtctcctttgcgagtgaggattcatctttgaaggcagactttcctggtggctcagatgataaagaatct

SEQ ID NO: 89377 - DNA, 201 bp, Bos taurus
ccaaagcctggggcactgagtcacccatggggctgaactgccttgtgactaggggcttgtgagaaggtggaaggggtgggcaatacagggaaggtgagaggcaggacccaaaaaggcctcaatagggctgaaatgaacactgggctacgctgagtgcctaccaagcttaacagcctcagagacctctgttcacactggggt

SEQ ID NO: 89378 - DNA, 201 bp, Bos taurus
ggttcaccccaggcttgtttgtgtctaatttcctgggggcaaatgggccccttattttcactttgaggtttagggtttcccctagagttggtggaggaggcgggtctgtggagacagtccaggatgttttgcataagtgcggaaagtcttggagttggaagttaaagatgaggtcgaagtgaaggggtgaaggtgagccag

SEQ ID NO: 89379 - DNA, 201 bp, Bos taurus
gaaatttgtggtgacccagagggccaggaccgagagggaactcagagttgctgacccaatctctccttgtccaggtggaaggatccaggacaagagaggttcacggtggccaccaagagggcgagaactccaatccagcctcctgggctctttctactcctccaagcttcctccattagtttattaatagaacaagggagt

SEQ ID NO: 89380 - DNA, 201 bp, Bos taurus
agtagcagcacctgcatcacagagatgaagtgagaagtagatgagtaaacaggtgcaaagctgctgcaacagtacctggggcccagcaggtacttgataatgggagctgtgatcatcgccctcttgacacagaccacagccccctcccaccaggtgccactcactggggcctgaacgcacacaccttggagagctcccagg

SEQ ID NO: 89381 - DNA, 201 bp, Bos taurus; identical to SEQ ID NO: 7552

SEQ ID NO: 89382 - DNA, 201 bp, Bos taurus; identical to SEQ ID NO: 7554

SEQ ID NO: 89383 - DNA, 201 bp, Bos taurus; identical to SEQ ID NO: 7556

SEQ ID NO: 89384 - DNA, 201 bp, Bos taurus; identical to SEQ ID NO: 7558

SEQ ID NO: 89385 - DNA, 201 bp, Bos taurus
tcttgaatgaataagtgtgtttaggacttaatccctatctttaaatctagcaaagtatcttcagtagaatggtggatgaaggatttcaaccttaccttagtgttataaccagcagagaaaccttctctgcagagaaaccttctctgctgtgcatacctatagctcagcagtacatatgtaacagcagggcgttaagcaaac

SEQ ID NO: 89386 - DNA, 201 bp, Bos taurus
ggaatgcgttgttggagaagagtagaaaagaataaggagaggagaagaggagaggagatgagttgaagttattattgtgtggacatggaagttattgctgatagaactaggtgtggaaccaagggccagagtattcaatggtgaccatcgttatctccttccaatctcagccatgcatcctatgcccgtatcacagagatg

SEQ ID NO: 89387 - DNA, 201 bp, Bos taurus
catatataatgactgtatataatgttacattttgggttggccgaaaaattcgtttgggttgtctgtaacatggaaaaatccaaactttttggccaacccaatatctagtaacactgaaaccatctctaccgtgaactccaaaatctgtgtgggatcacaggggaaaccagctagccatggtcaacagctggccatgcaaaa

SEQ ID NO: 89388 - DNA, 201 bp, Bos taurus
ccactccaatattcttgcctggagaatcccatggacagaggagcatggagggctacagtccatggggtcgcaagagttgggtatgacttagcgactaaacttccactgaggacaaagcaaaatcctgagagcagcctctttgtgaaaacaaaacagtgattttggttttatacattagttgagtatgaatgaatggtagtg

SEQ ID NO: 89389 - DNA, 201 bp, Bos taurus; identical to SEQ ID NO: 7559

SEQ ID NO: 89390 - DNA, 201 bp, Bos taurus; identical to SEQ ID NO: 7560

SEQ ID NO: 89391 - DNA, 201 bp, Bos taurus; identical to SEQ ID NO: 7561

SEQ ID NO: 89392 - DNA, 201 bp, Bos taurus; identical to SEQ ID NO: 7562

SEQ ID NO: 89393 - DNA, 201 bp, Bos taurus; identical to SEQ ID NO: 7564

SEQ ID NO: 89394 - DNA, 201 bp, Bos taurus; identical to SEQ ID NO: 7565

SEQ ID NO: 89395 - DNA, 201 bp, Bos taurus
agtttaaaaaatcagtaaattgcacttgtgtttttcaaaaattatctatttggtttgcaattctatttacttatttatctttttggccatattgtgtggcttgcaggatcttaatccctgaccagggattgaacccgtatgctctgcattgagagcacagagtcttaaccactgggccgtcagggaagtggtttatactac

SEQ ID NO: 89396 - DNA, 201 bp, Bos taurus; identical to SEQ ID NO: 7566

SEQ ID NO: 89397 - DNA, 201 bp, Bos taurus; identical to SEQ ID NO: 7567

SEQ ID NO: 89398 - DNA, 201 bp, Bos taurus; identical to SEQ ID NO: 7569

SEQ ID NO: 89399 - DNA, 201 bp, Bos taurus
tggcatttttttctggcttaaagagtgttctgcccttgacttcattttcttctcattctatctaactctcctttgacattctcatattctacactggatgtaactctcacctggacactgcaatctatcttcaacctgtacctctccggtaagtatcaaatctacatctctattgagcagctccactgaatatcccaaagt

SEQ ID NO: 89400 - DNA, 201 bp, Bos taurus
atggccaagtaatcaacaaaggaggcaagaatatacaatggacatggcagtctcttcaaatggtgctgagaaaaccagacagctacatgtgaaagaatgaaaacattctctaacatggttatacaaaaataaaactcaaaatggactaaagacctatatgtaagactgaatactataaaatttctagaggaaaacatagca

SEQ ID NO: 89401 - DNA, 201 bp, Bos taurus; identical to SEQ ID NO: 7571

SEQ ID NO: 89402 - DNA, 201 bp, Bos taurus; identical to SEQ ID NO: 49008

SEQ ID NO: 89403 - DNA, 201 bp, Bos taurus; identical to SEQ ID NO: 7572

SEQ ID NO: 89404 - DNA, 201 bp, Bos taurus; identical to SEQ ID NO: 7573

SEQ ID NO: 89405 - DNA, 201 bp, Bos taurus; identical to SEQ ID NO: 7574

SEQ ID NO: 89406 - DNA, 201 bp, Bos taurus; identical to SEQ ID NO: 7575

SEQ ID NO: 89407 - DNA, 201 bp, Bos taurus; identical to SEQ ID NO: 7576

SEQ ID NO: 89408 - DNA, 201 bp, Bos taurus; identical to SEQ ID NO: 7577

SEQ ID NO: 89409 - DNA, 201 bp, Bos taurus; identical to SEQ ID NO: 7578

SEQ ID NO: 89410 - DNA, 201 bp, Bos taurus; identical to SEQ ID NO: 7579

SEQ ID NO: 89411 - DNA, 201 bp, Bos taurus; identical to SEQ ID NO: 7580

SEQ ID NO: 89412 - DNA, 201 bp, Bos taurus; identical to SEQ ID NO: 7581

SEQ ID NO: 89413 - DNA, 201 bp, Bos taurus; identical to SEQ ID NO: 7582

SEQ ID NO: 89414 - DNA, 201 bp, Bos taurus; identical to SEQ ID NO: 7583

SEQ ID NO: 89415 - DNA, 201 bp, Bos taurus; identical to SEQ ID NO: 7584

SEQ ID NO: 89416 - DNA, 201 bp, Bos taurus; identical to SEQ ID NO: 7585

SEQ ID NO: 89417 - DNA, 201 bp, Bos taurus; identical to SEQ ID NO: 7586

SEQ ID NO: 89418 - DNA, 201 bp, Bos taurus; identical to SEQ ID NO: 7587

SEQ ID NO: 89419 - DNA, 201 bp, Bos taurus; identical to SEQ ID NO: 7588

SEQ ID NO: 89420 - DNA, 201 bp, Bos taurus; identical to SEQ ID NO: 7589

SEQ ID NO: 89421 - DNA, 201 bp, Bos taurus; identical to SEQ ID NO: 7590

SEQ ID NO: 89422 - DNA, 201 bp, Bos taurus; identical to SEQ ID NO: 7591

SEQ ID NO: 89423 - DNA, 201 bp, Bos taurus; identical to SEQ ID NO: 7592

SEQ ID NO: 89424 - DNA, 201 bp, Bos taurus; identical to SEQ ID NO: 7593

SEQ ID NO: 89425 - DNA, 201 bp, Bos taurus; identical to SEQ ID NO: 7594

SEQ ID NO: 89426 - DNA, 201 bp, Bos taurus; identical to SEQ ID NO: 7595

SEQ ID NO: 89427 - DNA, 201 bp, Bos taurus; identical to SEQ ID NO: 7596

SEQ ID NO: 89428 - DNA, 201 bp, Bos taurus; identical to SEQ ID NO: 7597

SEQ ID NO: 89429 - DNA, 201 bp, Bos taurus; identical to SEQ ID NO: 7598

SEQ ID NO: 89430 - DNA, 201 bp, Bos taurus; identical to SEQ ID NO: 7599

SEQ ID NO: 89431 - DNA, 201 bp, Bos taurus; identical to SEQ ID NO: 7600

SEQ ID NO: 89432 - DNA, 201 bp, Bos taurus; identical to SEQ ID NO: 7601

SEQ ID NO: 89433 - DNA, 201 bp, Bos taurus; identical to SEQ ID NO: 7602

SEQ ID NO: 89434 - DNA, 201 bp, Bos taurus; identical to SEQ ID NO: 7603

SEQ ID NO: 89435 - DNA, 201 bp, Bos taurus; identical to SEQ ID NO: 7604

SEQ ID NO: 89436 - DNA, 201 bp, Bos taurus; identical to SEQ ID NO: 7605

SEQ ID NO: 89437 - DNA, 201 bp, Bos taurus; identical to SEQ ID NO: 7606

SEQ ID NO: 89438 - DNA, 201 bp, Bos taurus; identical to SEQ ID NO: 7607

SEQ ID NO: 89439 - DNA, 201 bp, Bos taurus; identical to SEQ ID NO: 7608

SEQ ID NO: 89440 - DNA, 201 bp, Bos taurus; identical to SEQ ID NO: 7609

SEQ ID NO: 89441 - DNA, 201 bp, Bos taurus; identical to SEQ ID NO: 7610

SEQ ID NO: 89442 - DNA, 201 bp, Bos taurus; identical to SEQ ID NO: 7611

SEQ ID NO: 89443 - DNA, 201 bp, Bos taurus; identical to SEQ ID NO: 7612

SEQ ID NO: 89444 - DNA, 201 bp, Bos taurus; identical to SEQ ID NO: 7614

SEQ ID NO: 89445 - DNA, 201 bp, Bos taurus; identical to SEQ ID NO: 7615

SEQ ID NO: 89446 - DNA, 201 bp, Bos taurus; identical to SEQ ID NO: 7616

SEQ ID NO: 89447 - DNA, 201 bp, Bos taurus; identical to SEQ ID NO: 7617

SEQ ID NO: 89448 - DNA, 201 bp, Bos taurus; identical to SEQ ID NO: 7618

SEQ ID NO: 89449 - DNA, 201 bp, Bos taurus; identical to SEQ ID NO: 7619

SEQ ID NO: 89450 - DNA, 201 bp, Bos taurus; identical to SEQ ID NO: 7620

SEQ ID NO: 89451 - DNA, 201 bp, Bos taurus; identical to SEQ ID NO: 7621

SEQ ID NO: 89452 - DNA, 201 bp, Bos taurus; identical to SEQ ID NO: 7622

SEQ ID NO: 89453 - DNA, 201 bp, Bos taurus; identical to SEQ ID NO: 7623

SEQ ID NO: 89454 - DNA, 201 bp, Bos taurus; identical to SEQ ID NO: 7624

SEQ ID NO: 89455 - DNA, 201 bp, Bos taurus; identical to SEQ ID NO: 7625

SEQ ID NO: 89456 - DNA, 201 bp, Bos taurus; identical to SEQ ID NO: 7626

SEQ ID NO: 89457 - DNA, 201 bp, Bos taurus; identical to SEQ ID NO: 7627

SEQ ID NO: 89458 - DNA, 201 bp, Bos taurus; identical to SEQ ID NO: 7628

SEQ ID NO: 89459 - DNA, 201 bp, Bos taurus; identical to SEQ ID NO: 7629

SEQ ID NO: 89460 - DNA, 201 bp, Bos taurus; identical to SEQ ID NO: 7630

SEQ ID NO: 89461 - DNA, 201 bp, Bos taurus; identical to SEQ ID NO: 7631

SEQ ID NO: 89462 - DNA, 201 bp, Bos taurus; identical to SEQ ID NO: 7632

SEQ ID NO: 89463 - DNA, 201 bp, Bos taurus; identical to SEQ ID NO: 7633

SEQ ID NO: 89464 - DNA, 201 bp, Bos taurus; identical to SEQ ID NO: 7634

SEQ ID NO: 89465 - DNA, 201 bp, Bos taurus; identical to SEQ ID NO: 7635

SEQ ID NO: 89466 - DNA, 201 bp, Bos taurus; identical to SEQ ID NO: 7636

SEQ ID NO: 89467 - DNA, 201 bp, Bos taurus; identical to SEQ ID NO: 7637

SEQ ID NO: 89468 - DNA, 201 bp, Bos taurus; identical to SEQ ID NO: 7638

SEQ ID NO: 89469 - DNA, 201 bp, Bos taurus; identical to SEQ ID NO: 7639

SEQ ID NO: 89470 - DNA, 201 bp, Bos taurus; identical to SEQ ID NO: 7640

SEQ ID NO: 89471 - DNA, 201 bp, Bos taurus; identical to SEQ ID NO: 7641

SEQ ID NO: 89472 - DNA, 201 bp, Bos taurus; identical to SEQ ID NO: 7642

SEQ ID NO: 89473 - DNA, 201 bp, Bos taurus; identical to SEQ ID NO: 7643

SEQ ID NO: 89474 - DNA, 201 bp, Bos taurus; identical to SEQ ID NO: 7644

SEQ ID NO: 89475 - DNA, 201 bp, Bos taurus; identical to SEQ ID NO: 7645

SEQ ID NO: 89476 - DNA, 201 bp, Bos taurus; identical to SEQ ID NO: 7646

SEQ ID NO: 89477 - DNA, 201 bp, Bos taurus; identical to SEQ ID NO: 7647

SEQ ID NO: 89478 - DNA, 201 bp, Bos taurus; identical to SEQ ID NO: 7648

SEQ ID NO: 89479 - DNA, 201 bp, Bos taurus; identical to SEQ ID NO: 7649

SEQ ID NO: 89480 - DNA, 201 bp, Bos taurus; identical to SEQ ID NO: 7651

SEQ ID NO: 89481 - DNA, 201 bp, Bos taurus; identical to SEQ ID NO: 7652

SEQ ID NO: 89482 - DNA, 201 bp, Bos taurus; identical to SEQ ID NO: 7653

SEQ ID NO: 89483 - DNA, 201 bp, Bos taurus; identical to SEQ ID NO: 7654

SEQ ID NO: 89484 - DNA, 201 bp, Bos taurus; identical to SEQ ID NO: 7655

SEQ ID NO: 89485 - DNA, 201 bp, Bos taurus; identical to SEQ ID NO: 7656

SEQ ID NO: 89486 - DNA, 201 bp, Bos taurus; identical to SEQ ID NO: 7657

SEQ ID NO: 89487 - DNA, 201 bp, Bos taurus; identical to SEQ ID NO: 7658

SEQ ID NO: 89488 - DNA, 201 bp, Bos taurus; identical to SEQ ID NO: 7659

SEQ ID NO: 89489 - DNA, 201 bp, Bos taurus; identical to SEQ ID NO: 7660

SEQ ID NO: 89490 - DNA, 201 bp, Bos taurus; identical to SEQ ID NO: 7661

SEQ ID NO: 89491 - DNA, 201 bp, Bos taurus; identical to SEQ ID NO: 7662

SEQ ID NO: 89492 - DNA, 201 bp, Bos taurus; identical to SEQ ID NO: 7663

SEQ ID NO: 89493 - DNA, 201 bp, Bos taurus; identical to SEQ ID NO: 7665

SEQ ID NO: 89494 - DNA, 201 bp, Bos taurus; identical to SEQ ID NO: 7666

SEQ ID NO: 89495 - DNA, 201 bp, Bos taurus; identical to SEQ ID NO: 7667

SEQ ID NO: 89496 - DNA, 201 bp, Bos taurus; identical to SEQ ID NO: 7668

SEQ ID NO: 89497 - DNA, 201 bp, Bos taurus; identical to SEQ ID NO: 7669

SEQ ID NO: 89498 - DNA, 201 bp, Bos taurus; identical to SEQ ID NO: 7670

SEQ ID NO: 89499 - DNA, 201 bp, Bos taurus; identical to SEQ ID NO: 7671

SEQ ID NO: 89500 - DNA, 201 bp, Bos taurus; identical to SEQ ID NO: 7672

SEQ ID NO: 89501 - DNA, 201 bp, Bos taurus; identical to SEQ ID NO: 7673

SEQ ID NO: 89502 - DNA, 201 bp, Bos taurus; identical to SEQ ID NO: 7674

SEQ ID NO: 89503 - DNA, 201 bp, Bos taurus; identical to SEQ ID NO: 7675

SEQ ID NO: 89504 - DNA, 201 bp, Bos taurus; identical to SEQ ID NO: 7677

SEQ ID NO: 89505 - DNA, 201 bp, Bos taurus; identical to SEQ ID NO: 7678

SEQ ID NO: 89506 - DNA, 201 bp, Bos taurus; identical to SEQ ID NO: 7679

SEQ ID NO: 89507 - DNA, 201 bp, Bos taurus; identical to SEQ ID NO: 7680

SEQ ID NO: 89508 - DNA, 201 bp, Bos taurus; identical to SEQ ID NO: 7681

SEQ ID NO: 89509 - DNA, 201 bp, Bos taurus; identical to SEQ ID NO: 7682

SEQ ID NO: 89510 - DNA, 201 bp, Bos taurus; identical to SEQ ID NO: 7683

SEQ ID NO: 89511 - DNA, 201 bp, Bos taurus; identical to SEQ ID NO: 7684

SEQ ID NO: 89512 - DNA, 201 bp, Bos taurus; identical to SEQ ID NO: 7685

SEQ ID NO: 89513 - DNA, 201 bp, Bos taurus; identical to SEQ ID NO: 7686

SEQ ID NO: 89514 - DNA, 201 bp, Bos taurus; identical to SEQ ID NO: 7687

SEQ ID NO: 89515 - DNA, 201 bp, Bos taurus; identical to SEQ ID NO: 7688

SEQ ID NO: 89516 - DNA, 201 bp, Bos taurus; identical to SEQ ID NO: 7689

SEQ ID NO: 89517 - DNA, 201 bp, Bos taurus; identical to SEQ ID NO: 7690

SEQ ID NO: 89518 - DNA, 201 bp, Bos taurus; identical to SEQ ID NO: 7691

SEQ ID NO: 89519 - DNA, 201 bp, Bos taurus; identical to SEQ ID NO: 7692

SEQ ID NO: 89520 - DNA, 201 bp, Bos taurus; identical to SEQ ID NO: 7693

SEQ ID NO: 89521 - DNA, 201 bp, Bos taurus; identical to SEQ ID NO: 7694

SEQ ID NO: 89522 - DNA, 201 bp, Bos taurus; identical to SEQ ID NO: 7695

SEQ ID NO: 89523 - DNA, 201 bp, Bos taurus; identical to SEQ ID NO: 7696

SEQ ID NO: 89524 - DNA, 201 bp, Bos taurus; identical to SEQ ID NO: 7697

SEQ ID NO: 89525 - DNA, 201 bp, Bos taurus; identical to SEQ ID NO: 7698

SEQ ID NO: 89526 - DNA, 201 bp, Bos taurus; identical to SEQ ID NO: 7699

SEQ ID NO: 89527 - DNA, 201 bp, Bos taurus; identical to SEQ ID NO: 7700

SEQ ID NO: 89528 - DNA, 201 bp, Bos taurus; identical to SEQ ID NO: 7701

SEQ ID NO: 89529 - DNA, 201 bp, Bos taurus; identical to SEQ ID NO: 7702

SEQ ID NO: 89530 - DNA, 201 bp, Bos taurus; identical to SEQ ID NO: 7703

SEQ ID NO: 89531 - DNA, 201 bp, Bos taurus; identical to SEQ ID NO: 7704

SEQ ID NO: 89532 - DNA, 201 bp, Bos taurus; identical to SEQ ID NO: 7705

SEQ ID NO: 89533 - DNA, 201 bp, Bos taurus; identical to SEQ ID NO: 7706

SEQ ID NO: 89534 - DNA, 201 bp, Bos taurus; identical to SEQ ID NO: 7707

SEQ ID NO: 89535 - DNA, 201 bp, Bos taurus; identical to SEQ ID NO: 7708

SEQ ID NO: 89536 - DNA, 201 bp, Bos taurus; identical to SEQ ID NO: 7709

SEQ ID NO: 89537 - DNA, 201 bp, Bos taurus; identical to SEQ ID NO: 7710

SEQ ID NO: 89538 - DNA, 201 bp, Bos taurus; identical to SEQ ID NO: 7711

SEQ ID NO: 89539 - DNA, 201 bp, Bos taurus; identical to SEQ ID NO: 7712

SEQ ID NO: 89540 - DNA, 201 bp, Bos taurus; identical to SEQ ID NO: 7713

SEQ ID NO: 89541 - DNA, 201 bp, Bos taurus; identical to SEQ ID NO: 7714

SEQ ID NO: 89542 - DNA, 201 bp, Bos taurus; identical to SEQ ID NO: 7715

SEQ ID NO: 89543 - DNA, 201 bp, Bos taurus; identical to SEQ ID NO: 7716

SEQ ID NO: 89544 - DNA, 201 bp, Bos taurus; identical to SEQ ID NO: 7717

SEQ ID NO: 89545 - DNA, 201 bp, Bos taurus; identical to SEQ ID NO: 7718

SEQ ID NO: 89546 - DNA, 201 bp, Bos taurus; identical to SEQ ID NO: 7719

SEQ ID NO: 89547 - DNA, 201 bp, Bos taurus; identical to SEQ ID NO: 7720

SEQ ID NO: 89548 - DNA, 201 bp, Bos taurus; identical to SEQ ID NO: 7721

SEQ ID NO: 89549 - DNA, 201 bp, Bos taurus; identical to SEQ ID NO: 7722

SEQ ID NO: 89550 - DNA, 201 bp, Bos taurus; identical to SEQ ID NO: 7723

SEQ ID NO: 89551 - DNA, 201 bp, Bos taurus; identical to SEQ ID NO: 7724

SEQ ID NO: 89552 - DNA, 201 bp, Bos taurus; identical to SEQ ID NO: 7725

SEQ ID NO: 89553 - DNA, 201 bp, Bos taurus; identical to SEQ ID NO: 7726

SEQ ID NO: 89554 - DNA, 201 bp, Bos taurus; identical to SEQ ID NO: 7727

SEQ ID NO: 89555 - DNA, 201 bp, Bos taurus; identical to SEQ ID NO: 7728

SEQ ID NO: 89556 - DNA, 201 bp, Bos taurus; identical to SEQ ID NO: 7729

SEQ ID NO: 89557 - DNA, 201 bp, Bos taurus; identical to SEQ ID NO: 7730

SEQ ID NO: 89558 - DNA, 201 bp, Bos taurus; identical to SEQ ID NO: 7731

SEQ ID NO: 89559 - DNA, 201 bp, Bos taurus; identical to SEQ ID NO: 7732

SEQ ID NO: 89560 - DNA, 201 bp, Bos taurus; identical to SEQ ID NO: 7733

SEQ ID NO: 89561 - DNA, 201 bp, Bos taurus; identical to SEQ ID NO: 7734

SEQ ID NO: 89562 - DNA, 201 bp, Bos taurus; identical to SEQ ID NO: 7736

SEQ ID NO: 89563 - DNA, 201 bp, Bos taurus; identical to SEQ ID NO: 7737

SEQ ID NO: 89564 - DNA, 201 bp, Bos taurus; identical to SEQ ID NO: 7738

SEQ ID NO: 89565 - DNA, 201 bp, Bos taurus; identical to SEQ ID NO: 7739

SEQ ID NO: 89566 - DNA, 201 bp, Bos taurus; identical to SEQ ID NO: 7740

SEQ ID NO: 89567 - DNA, 201 bp, Bos taurus; identical to SEQ ID NO: 7741

SEQ ID NO: 89568 - DNA, 201 bp, Bos taurus; identical to SEQ ID NO: 7742

SEQ ID NO: 89569 - DNA, 201 bp, Bos taurus; identical to SEQ ID NO: 7743

SEQ ID NO: 89570 - DNA, 201 bp, Bos taurus; identical to SEQ ID NO: 7744

SEQ ID NO: 89571 - DNA, 201 bp, Bos taurus; identical to SEQ ID NO: 7745

SEQ ID NO: 89572 - DNA, 201 bp, Bos taurus; identical to SEQ ID NO: 7746

SEQ ID NO: 89573 - DNA, 201 bp, Bos taurus; identical to SEQ ID NO: 7747

SEQ ID NO: 89574 - DNA, 201 bp, Bos taurus; identical to SEQ ID NO: 7748

SEQ ID NO: 89575 - DNA, 201 bp, Bos taurus; identical to SEQ ID NO: 7749

SEQ ID NO: 89576 - DNA, 201 bp, Bos taurus; identical to SEQ ID NO: 7750

SEQ ID NO: 89577 - DNA, 201 bp, Bos taurus; identical to SEQ ID NO: 7751

SEQ ID NO: 89578 - DNA, 201 bp, Bos taurus; identical to SEQ ID NO: 7752

SEQ ID NO: 89579 - DNA, 201 bp, Bos taurus; identical to SEQ ID NO: 7753

SEQ ID NO: 89580 - DNA, 201 bp, Bos taurus; identical to SEQ ID NO: 7754

SEQ ID NO: 89581 - DNA, 201 bp, Bos taurus; identical to SEQ ID NO: 7756

SEQ ID NO: 89582 - DNA, 201 bp, Bos taurus; identical to SEQ ID NO: 7757

SEQ ID NO: 89583 - DNA, 201 bp, Bos taurus; identical to SEQ ID NO: 7758

SEQ ID NO: 89584 - DNA, 201 bp, Bos taurus; identical to SEQ ID NO: 7759

SEQ ID NO: 89585 - DNA, 201 bp, Bos taurus; identical to SEQ ID NO: 7760

SEQ ID NO: 89586 - DNA, 201 bp, Bos taurus; identical to SEQ ID NO: 7761

SEQ ID NO: 89587 - DNA, 201 bp, Bos taurus; identical to SEQ ID NO: 7762

SEQ ID NO: 89588 - DNA, 201 bp, Bos taurus; identical to SEQ ID NO: 7763

SEQ ID NO: 89589 - DNA, 201 bp, Bos taurus; identical to SEQ ID NO: 7764

SEQ ID NO: 89590 - DNA, 201 bp, Bos taurus; identical to SEQ ID NO: 7765

SEQ ID NO: 89591 - DNA, 201 bp, Bos taurus; identical to SEQ ID NO: 7766

SEQ ID NO: 89592 - DNA, 201 bp, Bos taurus; identical to SEQ ID NO: 7767

SEQ ID NO: 89593 - DNA, 201 bp, Bos taurus; identical to SEQ ID NO: 7768

SEQ ID NO: 89594 - DNA, 201 bp, Bos taurus; identical to SEQ ID NO: 7769

SEQ ID NO: 89595 - DNA, 201 bp, Bos taurus; identical to SEQ ID NO: 7770

SEQ ID NO: 89596 - DNA, 201 bp, Bos taurus; identical to SEQ ID NO: 7771

SEQ ID NO: 89597 - DNA, 201 bp, Bos taurus; identical to SEQ ID NO: 7772

SEQ ID NO: 89598 - DNA, 201 bp, Bos taurus; identical to SEQ ID NO: 7773

SEQ ID NO: 89599 - DNA, 201 bp, Bos taurus; identical to SEQ ID NO: 7774

SEQ ID NO: 89600 - DNA, 201 bp, Bos taurus; identical to SEQ ID NO: 7775

SEQ ID NO: 89601 - DNA, 201 bp, Bos taurus; identical to SEQ ID NO: 7776

SEQ ID NO: 89602 - DNA, 201 bp, Bos taurus; identical to SEQ ID NO: 7777

SEQ ID NO: 89603 - DNA, 201 bp, Bos taurus; identical to SEQ ID NO: 7778

SEQ ID NO: 89604 - DNA, 201 bp, Bos taurus; identical to SEQ ID NO: 7779

SEQ ID NO: 89605 - DNA, 201 bp, Bos taurus; identical to SEQ ID NO: 7780

SEQ ID NO: 89606 - DNA, 201 bp, Bos taurus; identical to SEQ ID NO: 7781

SEQ ID NO: 89607 - DNA, 201 bp, Bos taurus; identical to SEQ ID NO: 7782

SEQ ID NO: 89608 - DNA, 201 bp, Bos taurus; identical to SEQ ID NO: 7783

SEQ ID NO: 89609 - DNA, 201 bp, Bos taurus; identical to SEQ ID NO: 7784

SEQ ID NO: 89610 - DNA, 201 bp, Bos taurus; identical to SEQ ID NO: 7785

SEQ ID NO: 89611 - DNA, 201 bp, Bos taurus; identical to SEQ ID NO: 7786

SEQ ID NO: 89612 - DNA, 201 bp, Bos taurus; identical to SEQ ID NO: 7787

SEQ ID NO: 89613 - DNA, 201 bp, Bos taurus; identical to SEQ ID NO: 7788

SEQ ID NO: 89614 - DNA, 201 bp, Bos taurus; identical to SEQ ID NO: 7789

SEQ ID NO: 89615 - DNA, 201 bp, Bos taurus; identical to SEQ ID NO: 7791

SEQ ID NO: 89616 - DNA, 201 bp, Bos taurus; identical to SEQ ID NO: 7792

SEQ ID NO: 89617 - DNA, 201 bp, Bos taurus; identical to SEQ ID NO: 7793

SEQ ID NO: 89618 - DNA, 201 bp, Bos taurus; identical to SEQ ID NO: 7794

SEQ ID NO: 89619 - DNA, 201 bp, Bos taurus; identical to SEQ ID NO: 7795

SEQ ID NO: 89620 - DNA, 201 bp, Bos taurus; identical to SEQ ID NO: 7796

SEQ ID NO: 89621 - DNA, 201 bp, Bos taurus; identical to SEQ ID NO: 7797

SEQ ID NO: 89622 - DNA, 201 bp, Bos taurus; identical to SEQ ID NO: 7798

SEQ ID NO: 89623 - DNA, 201 bp, Bos taurus; identical to SEQ ID NO: 7799

SEQ ID NO: 89624 - DNA, 201 bp, Bos taurus; identical to SEQ ID NO: 7800

SEQ ID NO: 89625 - DNA, 201 bp, Bos taurus; identical to SEQ ID NO: 7801

SEQ ID NO: 89626 - DNA, 201 bp, Bos taurus; identical to SEQ ID NO: 7802

SEQ ID NO: 89627 - DNA, 201 bp, Bos taurus; identical to SEQ ID NO: 7803

SEQ ID NO: 89628 - DNA, 201 bp, Bos taurus; identical to SEQ ID NO: 7804

SEQ ID NO: 89629 - DNA, 201 bp, Bos taurus; identical to SEQ ID NO: 7805

SEQ ID NO: 89630 - DNA, 201 bp, Bos taurus; identical to SEQ ID NO: 7806

SEQ ID NO: 89631 - DNA, 201 bp, Bos taurus; identical to SEQ ID NO: 7808

SEQ ID NO: 89632 - DNA, 201 bp, Bos taurus; identical to SEQ ID NO: 7809

SEQ ID NO: 89633 - DNA, 201 bp, Bos taurus; identical to SEQ ID NO: 7810

SEQ ID NO: 89634 - DNA, 201 bp, Bos taurus; identical to SEQ ID NO: 7812

SEQ ID NO: 89635 - DNA, 201 bp, Bos taurus
tgtcagctacaggtcataaagctttatagactcatgacctctgatctctgaccctgtgatttattttctctgagcagaagtgtgacccctcctccatctgcgaaaaatgaggcaacgtggttgggtggcttctgccattcatcaggcagtgaaatgtgtctggttctcaattttccatctgcactcttgcttcaggccaac

SEQ ID NO: 89636 - DNA, 201 bp, Bos taurus; identical to SEQ ID NO: 7814

SEQ ID NO: 89637 - DNA, 201 bp, Bos taurus
cactggagcaagatgggccatactgggtacttggcatgggtctgggcatatactgaagtagttctggcatgccagtcagaactccaaatcagtcctgatctgccaatgctaggaatggccaccctcaccctgttcaggtcctatccagctccatcccccttgattgtacattttcttctttggaaacagcagcctttgccc

SEQ ID NO: 89638 - DNA, 201 bp, Bos taurus
aatctctatatcttacaagtttgcttacatagttcttttgatttttgtgaagatttagaaacaaagaaataagggtggccaacaaagaaaaatttcattctattggagcttagagtatgtgtattggtggggagaggacacagcaagtagtgataaatgggcaacaggcactgaatataaggcatagaaagaggcctgaac

SEQ ID NO: 89639 - DNA, 201 bp, Bos taurus
ctccatggactgcagcctaccaggctcctccgtccatgggattttccaggcaagagtactggagtggggtgccattgccttctcccctgtataaagctaggactcttgaaaggctgtctcagtgcagtggggctggagatgagctccactcatcagctcagggagcactcccacaagaaacagcaggtccaggcctgtctc

SEQ ID NO: 89640 - DNA, 201 bp, Bos taurus
cagcttggagcattccggcatgaccaagaatcctgaagagaccccagactcaggtgctgaggatcactatacttggcctctgtctgagctgctggaggtgggacaggtcatatagcctgtgtcaaccagggagaggtaagctgtttgagcacaccaagcactggccccaggctacagttggaaattactagactgttttaa

SEQ ID NO: 89641 - DNA, 201 bp, Bos taurus
gtgagaaccacaaaccctgatctacaacagtggaaatggaggcccagtgcagtgaggatcagtgaggggtggtgaaggtagcaggaggaggcctgcagtgcggctcccagattcccacatgtggcatgccttcacgtgatggagaattccacactccccggtcagaaagggatgtgaacaggctggtttaggggggctgca

SEQ ID NO: 89642 - DNA, 201 bp, Bos taurus
cctccacggagctggaggccggacccgcgggtgaggccgggccgcacacatggtcgccgtccgggtcttgggcccgggctcgggcccccgtggcctgcagtagcgttcggaaggcaagctcgatgcggagcgagtcgtagccgatgaagggcttccaggtcttcttgtcctccttgtagaaccagcgcacctcctccgggc

SEQ ID NO: 89643 - DNA, 201 bp, Bos taurus; identical to SEQ ID NO: 7818

SEQ ID NO: 89644 - DNA, 201 bp, Bos taurus
attttcctctcacatagattcagtctttgcttttttgaaagactttggattctggttatcaagttaccataggtctcctatagagaagaaaatctatatacatagcaattaaatatgatattttgtagtaagattttctgaattacagattaggattcattttttccccctttattcagggagtagaaacagaataaggga

SEQ ID NO: 89645 - DNA, 201 bp, Bos taurus
ccacacaactgagtgactcaggctggatttgaactcatctgtgtcaaactctgatcctcctaatcctaactactctctgcacctcagtctgcacctgttctccacctctgtctttacttcctcattcccagcctgggttgacagggcagatccttccatgtgaaactctctcctctacagactcgactcttccaagcctgt

SEQ ID NO: 89646 - DNA, 201 bp, Bos taurus; identical to SEQ ID NO: 7819

SEQ ID NO: 89647 - DNA, 201 bp, Bos taurus; identical to SEQ ID NO: 7820

SEQ ID NO: 89648 - DNA, 201 bp, Bos taurus
tccttaagaatctagactatcatgtgatccagcattcacactcctatgcatatatctggagaagaacatggtttaaatggaagcatgagcccaaattttcgttgcagcgctatttacaataaccaagacatggaagcaacctaaatgttcattgacacaggaatggataaagaaaatgtggtatatacatacaatggaata

SEQ ID NO: 89649 - DNA, 201 bp, Bos taurus; identical to SEQ ID NO: 7822

SEQ ID NO: 89650 - DNA, 201 bp, Bos taurus; identical to SEQ ID NO: 7823

SEQ ID NO: 89651 - DNA, 201 bp, Bos taurus; identical to SEQ ID NO: 7824

SEQ ID NO: 89652 - DNA, 201 bp, Bos taurus; identical to SEQ ID NO: 7825

SEQ ID NO: 89653 - DNA, 201 bp, Bos taurus
cacaagaggaattgctgggtcaaaggatatgtatatctgtgattttgagagatgtcgccgaacttccctccaatatgggtgtaccacctgaccccaggccccaccactggcaggaaatggaatccggggtctcctgactccacaaccaaggctcccacccctgccccacaccctacttcgacaaaccctcaaagttacaac

SEQ ID NO: 89654 - DNA, 201 bp, Bos taurus; identical to SEQ ID NO: 7827

SEQ ID NO: 89655 - DNA, 201 bp, Bos taurus; identical to SEQ ID NO: 7828

SEQ ID NO: 89656 - DNA, 201 bp, Bos taurus
tacaagagaaactcatcttttgtgtatttacaatcattgctatttaggggtttggattgtatgaagttaaacctaaacacaatgaataatagcagacaacttttggccatagtcctcttcactccaactcgagctcccatctccctccaaacattgtcgttctcctgcaacttccactcttctcaaggttagctctgtttg

SEQ ID NO: 89657 - DNA, 201 bp, Bos taurus; identical to SEQ ID NO: 7829

SEQ ID NO: 89658 - DNA, 201 bp, Bos taurus; identical to SEQ ID NO: 7830

SEQ ID NO: 89659 - DNA, 201 bp, Bos taurus; identical to SEQ ID NO: 7831

SEQ ID NO: 89660 - DNA, 201 bp, Bos taurus; identical to SEQ ID NO: 7832

SEQ ID NO: 89661 - DNA, 201 bp, Bos taurus
gggtgaaggtaagagaagacgcctaacagccaagaggcagggcagtgaaggtctaggagctgcatcccagtttgccaccatcttgccatatgatgctggacaagtcccctcacccatctggtctccagcccttctgcgttctcagtgacaatctacagtccttttcccttctgtctggcagagatcccaaatctggggcct

SEQ ID NO: 89662 - DNA, 201 bp, Bos taurus; identical to SEQ ID NO: 7834

SEQ ID NO: 89663 - DNA, 201 bp, Bos taurus; identical to SEQ ID NO: 7835

SEQ ID NO: 89664 - DNA, 201 bp, Bos taurus; identical to SEQ ID NO: 7836

SEQ ID NO: 89665 - DNA, 201 bp, Bos taurus; identical to SEQ ID NO: 7839

SEQ ID NO: 89666 - DNA, 201 bp, Bos taurus; identical to SEQ ID NO: 7840

SEQ ID NO: 89667 - DNA, 201 bp, Bos taurus; identical to SEQ ID NO: 7841

SEQ ID NO: 89668 - DNA, 201 bp, Bos taurus; identical to SEQ ID NO: 7842

SEQ ID NO: 89669 - DNA, 201 bp, Bos taurus; identical to SEQ ID NO: 7843

SEQ ID NO: 89670 - DNA, 201 bp, Bos taurus; identical to SEQ ID NO: 7844

SEQ ID NO: 89671 - DNA, 201 bp, Bos taurus; identical to SEQ ID NO: 7845

SEQ ID NO: 89672 - DNA, 201 bp, Bos taurus; identical to SEQ ID NO: 7846

SEQ ID NO: 89673 - DNA, 201 bp, Bos taurus; identical to SEQ ID NO: 7847

SEQ ID NO: 89674 - DNA, 201 bp, Bos taurus; identical to SEQ ID NO: 7850

SEQ ID NO: 89675 - DNA, 201 bp, Bos taurus; identical to SEQ ID NO: 7851

SEQ ID NO: 89676 - DNA, 201 bp, Bos taurus; identical to SEQ ID NO: 7852

SEQ ID NO: 89677 - DNA, 201 bp, Bos taurus; identical to SEQ ID NO: 7853

SEQ ID NO: 89678 - DNA, 201 bp, Bos taurus; identical to SEQ ID NO: 7854

SEQ ID NO: 89679 - DNA, 201 bp, Bos taurus; identical to SEQ ID NO: 7855

SEQ ID NO: 89680 - DNA, 201 bp, Bos taurus; identical to SEQ ID NO: 7856

SEQ ID NO: 89681 - DNA, 201 bp, Bos taurus; identical to SEQ ID NO: 7857

SEQ ID NO: 89682 - DNA, 201 bp, Bos taurus; identical to SEQ ID NO: 7858

SEQ ID NO: 89683 - DNA, 201 bp, Bos taurus; identical to SEQ ID NO: 7859

SEQ ID NO: 89684 - DNA, 201 bp, Bos taurus; identical to SEQ ID NO: 7860

SEQ ID NO: 89685 - DNA, 201 bp, Bos taurus; identical to SEQ ID NO: 7862

SEQ ID NO: 89686 - DNA, 201 bp, Bos taurus; identical to SEQ ID NO: 7863

SEQ ID NO: 89687 - DNA, 201 bp, Bos taurus; identical to SEQ ID NO: 7864

SEQ ID NO: 89688 - DNA, 201 bp, Bos taurus; identical to SEQ ID NO: 7865

SEQ ID NO: 89689 - DNA, 201 bp, Bos taurus; identical to SEQ ID NO: 7866

SEQ ID NO: 89690 - DNA, 201 bp, Bos taurus; identical to SEQ ID NO: 7867

SEQ ID NO: 89691 - DNA, 201 bp, Bos taurus; identical to SEQ ID NO: 7870

SEQ ID NO: 89692 - DNA, 201 bp, Bos taurus; identical to SEQ ID NO: 7871

SEQ ID NO: 89693 - DNA, 201 bp, Bos taurus; identical to SEQ ID NO: 7872

SEQ ID NO: 89694 - DNA, 201 bp, Bos taurus; identical to SEQ ID NO: 7873

SEQ ID NO: 89695 - DNA, 201 bp, Bos taurus; identical to SEQ ID NO: 7877

SEQ ID NO: 89696 - DNA, 201 bp, Bos taurus; identical to SEQ ID NO: 7878

SEQ ID NO: 89697 - DNA, 201 bp, Bos taurus; identical to SEQ ID NO: 7880

SEQ ID NO: 89698 - DNA, 201 bp, Bos taurus; identical to SEQ ID NO: 7881

SEQ ID NO: 89699 - DNA, 201 bp, Bos taurus; identical to SEQ ID NO: 7882

SEQ ID NO: 89700 - DNA, 201 bp, Bos taurus; identical to SEQ ID NO: 7883

SEQ ID NO: 89701 - DNA, 201 bp, Bos taurus; identical to SEQ ID NO: 7884

SEQ ID NO: 89702 - DNA, 201 bp, Bos taurus; identical to SEQ ID NO: 7885

SEQ ID NO: 89703 - DNA, 201 bp, Bos taurus; identical to SEQ ID NO: 7886

SEQ ID NO: 89704 - DNA, 201 bp, Bos taurus; identical to SEQ ID NO: 7887

SEQ ID NO: 89705 - DNA, 201 bp, Bos taurus; identical to SEQ ID NO: 7889

SEQ ID NO: 89706 - DNA, 201 bp, Bos taurus; identical to SEQ ID NO: 7890

SEQ ID NO: 89707 - DNA, 201 bp, Bos taurus; identical to SEQ ID NO: 7891

SEQ ID NO: 89708 - DNA, 201 bp, Bos taurus; identical to SEQ ID NO: 7892

SEQ ID NO: 89709 - DNA, 201 bp, Bos taurus; identical to SEQ ID NO: 7893

SEQ ID NO: 89710 - DNA, 201 bp, Bos taurus; identical to SEQ ID NO: 7894

SEQ ID NO: 89711 - DNA, 201 bp, Bos taurus; identical to SEQ ID NO: 49328

SEQ ID NO: 89712 - DNA, 201 bp, Bos taurus; identical to SEQ ID NO: 7895

SEQ ID NO: 89713 - DNA, 201 bp, Bos taurus; identical to SEQ ID NO: 7896

SEQ ID NO: 89714 - DNA, 201 bp, Bos taurus; identical to SEQ ID NO: 7897

SEQ ID NO: 89715 - DNA, 201 bp, Bos taurus; identical to SEQ ID NO: 7898

SEQ ID NO: 89716 - DNA, 201 bp, Bos taurus
tggagtccgagatggaggcgaagctcctccaaacagatgggggtgcagattcccaagaggagggacggggagggaagtgtgttgggggcccaggaactgtctcctgtgaccggcagttaagcttaccctgagggtctgtgtatgtgaaccctgaccggctgagccacaaccgctgcagggtggaaggccagcccagctgca

SEQ ID NO: 89717 - DNA, 201 bp, Bos taurus
tgctgtttgaaggccatcaggaaggaagaattctcatgcagaggaggtcaggtttttctactctatttggccttcaattgactggatgaggcccactcacgttaaagagggcaagctgcttcacttcgtcaggtcatttagatgttaatctcatctgaaaaacactttcacggacatctccagaataattcttgacaaatg

SEQ ID NO: 89718 - DNA, 201 bp, Bos taurus; identical to SEQ ID NO: 7901

SEQ ID NO: 89719 - DNA, 201 bp, Bos taurus
tgacaagaatgacttatttcagccagtctggtgcactgcacggggtcccacatcaggaattccatggggaagtttcctcaggcttgagaagggaagggagaagaggggaggagcggctggccatgggcatgcaagtgtatccaagactggtcagctggtatccggccagtgcctggagctgttggggtgaggactctcctg

SEQ ID NO: 89720 - DNA, 201 bp, Bos taurus; identical to SEQ ID NO: 7905

SEQ ID NO: 89721 - DNA, 201 bp, Bos taurus
gtaaccaggccacaggcactcctgccatctcgacgggactctgcctctgggggatggccccttttgatgaaaaattggccccatttcctccactgagaatatgcattcagactttcaaagagatgttccaggttgctgtagggaacagagttgtgaggtcatggcagtgcgtcagggccatgccagaccatgtacaagacg

SEQ ID NO: 89722 - DNA, 201 bp, Bos taurus; identical to SEQ ID NO: 7907

SEQ ID NO: 89723 - DNA, 201 bp, Bos taurus; identical to SEQ ID NO: 7909

SEQ ID NO: 89724 - DNA, 201 bp, Bos taurus; identical to SEQ ID NO: 7911

SEQ ID NO: 89725 - DNA, 201 bp, Bos taurus
aggcaggcttggggagtcagggaggccacgatggctttctcccagcgctcttcagtgagggattaaacttgtatctaggggtaactgagatcagtaagtgaaaaatcatagagaagacgtttggccccttgtaaggaggatattccagagctgtcagcctgccctggggaactgtagacggactcatgagggagaaggttc

SEQ ID NO: 89726 - DNA, 201 bp, Bos taurus; identical to SEQ ID NO: 7912

SEQ ID NO: 89727 - DNA, 201 bp, Bos taurus; identical to SEQ ID NO: 7913

SEQ ID NO: 89728 - DNA, 201 bp, Bos taurus; identical to SEQ ID NO: 7914

SEQ ID NO: 89729 - DNA, 201 bp, Bos taurus; identical to SEQ ID NO: 7915

SEQ ID NO: 89730 - DNA, 201 bp, Bos taurus; identical to SEQ ID NO: 7916

SEQ ID NO: 89731 - DNA, 201 bp, Bos taurus; identical to SEQ ID NO: 7917

SEQ ID NO: 89732 - DNA, 201 bp, Bos taurus; identical to SEQ ID NO: 7919

SEQ ID NO: 89733 - DNA, 201 bp, Bos taurus; identical to SEQ ID NO: 7920

SEQ ID NO: 89734 - DNA, 201 bp, Bos taurus; identical to SEQ ID NO: 7922

SEQ ID NO: 89735 - DNA, 201 bp, Bos taurus
gacgtcccaggaattcagctctttgtctctggatggcccttgggttagtggaagggtcggggaaccagtaattctgtccctgctctgaggatacaactccattccaaggccaggctgtgtatgacagcccctgtcagccacagtaagcgttgtccatctcacatctcactcccacggaccagggtggggtgggcttggggg

SEQ ID NO: 89736 - DNA, 201 bp, Bos taurus; identical to SEQ ID NO: 7924

SEQ ID NO: 89737 - DNA, 201 bp, Bos taurus; identical to SEQ ID NO: 7926

SEQ ID NO: 89738 - DNA, 201 bp, Bos taurus; identical to SEQ ID NO: 7928

SEQ ID NO: 89739 - DNA, 201 bp, Bos taurus; identical to SEQ ID NO: 7929

SEQ ID NO: 89740 - DNA, 201 bp, Bos taurus; identical to SEQ ID NO: 7930

SEQ ID NO: 89741 - DNA, 201 bp, Bos taurus; identical to SEQ ID NO: 7937

SEQ ID NO: 89742 - DNA, 201 bp, Bos taurus
gaaaacagccacataacattgtgattaagttcatatttttaaagagattcatcctgaagtatgaaagactgaaacaccatgatactcagactttagtttacaacgactcagcataaaatgagaagggagaagcagttaagatgaaataagtgtgacacgattccgataatctgggtaatgtgtacacatggtggacagact

SEQ ID NO: 89743 - DNA, 201 bp, Bos taurus
gccagattgagagagtcatcaagaaaaaaaaggggggcgagcttcatgctgtcttggatcaaacgctattgttctgtctccggactgtggcctgtactcatggtgccttcagcccgttccaggaggctgggaggatgggcaaggatgtgaggactgtgttatctccagggcctctggctgggaaaccccacctattgccct

SEQ ID NO: 89744 - DNA, 201 bp, Bos taurus
atacccctccagggggcacgactcatggctttgtttacacaagaactctttctgggttggtccagaaccaacttgcacaaccatgagtggccttcctgatgagaaaccctccttgtctgttaaatatacatgaattcttatgagcttctccatccatcccttagaaaagaagtgcttcactcactagaatttcttttctat

SEQ ID NO: 89745 - DNA, 201 bp, Bos taurus
actcaagtggaggccaggaagaatcctagaaagaggaagctagagaaaactggggtgtgtaaagtcatcagtccagagagtaaaccgagtgagaagcctggactaaggccaaggtgaggacaactgagggatccagcaggaatgaagctgaaagggagaagcaaacaagacaggagacagtcaaacggctgagaagccaag

SEQ ID NO: 89746 - DNA, 201 bp, Bos taurus; identical to SEQ ID NO: 7941

SEQ ID NO: 89747 - DNA, 201 bp, Bos taurus; identical to SEQ ID NO: 7942

SEQ ID NO: 89748 - DNA, 201 bp, Bos taurus; identical to SEQ ID NO: 7943

SEQ ID NO: 89749 - DNA, 201 bp, Bos taurus; identical to SEQ ID NO: 7944

SEQ ID NO: 89750 - DNA, 201 bp, Bos taurus
aggatgtagtttcctttattttctaagtaaaactgagctgtaacacagagctgtaacactgtctgagagctctgatgcactgagggccttaatgtccatcgcttcaaatttttgttgtgacgaggagattacattcccctgacaattggatagttgctgattgtttatcaggccctgaacaagacaataccatagtgcttc

SEQ ID NO: 89751 - DNA, 201 bp, Bos taurus
cccatggactataacatgccagcctcccctgtccttcattgtctcctaagcttgctcagattggtgtttttgagtcattgagttggtcatgctattcagctgtcttaccctctgccacccccttctcttttctgttcaatctttcccaacttcagggtctttttctatcaatcggctctttctatcagatggccaaagtat

SEQ ID NO: 89752 - DNA, 201 bp, Bos taurus; identical to SEQ ID NO: 7945

SEQ ID NO: 89753 - DNA, 201 bp, Bos taurus; identical to SEQ ID NO: 7948

SEQ ID NO: 89754 - DNA, 201 bp, Bos taurus
ggaggcctcagctggcccccgaggatgctatagaactgaaatgacctttcagatttgtgagtcatggtgggggggctagggcacagtttacatacttcctctctgccaacctgtccttggatatgggctgcctgggacaagaatgtaaccttgagtaatggggccgtcgctagaaagggctgagggtagcagtggaggtag

SEQ ID NO: 89755 - DNA, 201 bp, Bos taurus; identical to SEQ ID NO: 7949

SEQ ID NO: 89756 - DNA, 201 bp, Bos taurus
cctgaagcctgttcctctcctctgatcccggtttccatacaagccttcctgctgctggtgacaggaccggctccttcggacagcaggtttatagcgttcagcttcaccacgacagtcagaggcagtggtcccagggtttactttacctttcccctctcggggagaattatttgcatttttgcagaaggtgccggttggtcc

SEQ ID NO: 89757 - DNA, 201 bp, Bos taurus
ctggtcaagggcagttcccaggagaaggctgtagtccttagaagctagagatggccaggcacaccaggggtgtgggggccaatggatctgagcaggacaccagcaccatctactacagagaggggctatgaggcagggtccggtgggggcctcagtctctgcgcctccttgtgggtctctctggaatttgatggtggattt

SEQ ID NO: 89758 - DNA, 201 bp, Bos taurus; identical to SEQ ID NO: 7952

SEQ ID NO: 89759 - DNA, 201 bp, Bos taurus; identical to SEQ ID NO: 7953

SEQ ID NO: 89760 - DNA, 201 bp, Bos taurus
attagaatgtagacacctttgagggccactattctgcttaccataggacctccatgtcccatcccagcagagattcagtggtcccataactggttggatcgttgggtcttttcaagtaggacaaagattcaggcaccattgggcacaacagtaacattcttcaaaccccctaagagcacaccacatgttaattgtttgctt

SEQ ID NO: 89761 - DNA, 201 bp, Bos taurus; identical to SEQ ID NO: 7956

SEQ ID NO: 89762 - DNA, 201 bp, Bos taurus; identical to SEQ ID NO: 7957

SEQ ID NO: 89763 - DNA, 201 bp, Bos taurus; identical to SEQ ID NO: 7958

SEQ ID NO: 89764 - DNA, 201 bp, Bos taurus; identical to SEQ ID NO: 7959

SEQ ID NO: 89765 - DNA, 201 bp, Bos taurus; identical to SEQ ID NO: 7960

SEQ ID NO: 89766 - DNA, 201 bp, Bos taurus; identical to SEQ ID NO: 7961

SEQ ID NO: 89767 - DNA, 201 bp, Bos taurus; identical to SEQ ID NO: 7967

SEQ ID NO: 89768 - DNA, 201 bp, Bos taurus; identical to SEQ ID NO: 7968

SEQ ID NO: 89769 - DNA, 201 bp, Bos taurus
tctcagcctctatgatggtgagagataaattcctgttgtgtaagccacactgtctatggcgtttcgtatggcagccatgaagatttagacaggtggcttacctggccctgctgtaggacaggagagctcccttacactggtggaggaagactgcatggaggaggcagggttttggggcttcctgaatgaagacagggtgtg

SEQ ID NO: 89770 - DNA, 201 bp, Bos taurus; identical to SEQ ID NO: 7970

SEQ ID NO: 89771 - DNA, 201 bp, Bos taurus; identical to SEQ ID NO: 7973

SEQ ID NO: 89772 - DNA, 201 bp, Bos taurus; identical to SEQ ID NO: 7974

SEQ ID NO: 89773 - DNA, 201 bp, Bos taurus; identical to SEQ ID NO: 7975

SEQ ID NO: 89774 - DNA, 201 bp, Bos taurus; identical to SEQ ID NO: 7976

SEQ ID NO: 89775 - DNA, 201 bp, Bos taurus
taggaacacctaggccctttatttagatctgtgactttgagattcttacttggatcctctggcttccttgttctgaaaaaataaaatgaggcaattgtgtttcatgctctcccagggcccattcaattataaaactctgtgattctcaaatgtcatcagcttggcaatgtcttcccttatcctgagtagaggggtaaaggt

SEQ ID NO: 89776 - DNA, 201 bp, Bos taurus; identical to SEQ ID NO: 7981

SEQ ID NO: 89777 - DNA, 201 bp, Bos taurus; identical to SEQ ID NO: 7982

SEQ ID NO: 89778 - DNA, 201 bp, Bos taurus; identical to SEQ ID NO: 7983

SEQ ID NO: 89779 - DNA, 201 bp, Bos taurus
ggagcaaccaggaccatgtgccacagctactgagtcagtgctctagagcctctgagcggcagttactgagcccaagggccacaactgctgaaggctgtgccgtataacctgtgctccacaaaaggaaaagctaaggcaatacgaagcccatgcaccatagtagctggccacaactagagaaagcctacgcacagcagcaaa

SEQ ID NO: 89780 - DNA, 201 bp, Bos taurus; identical to SEQ ID NO: 7984

SEQ ID NO: 89781 - DNA, 201 bp, Bos taurus; identical to SEQ ID NO: 7985

SEQ ID NO: 89782 - DNA, 201 bp, Bos taurus
gtgaatgtgaatagttatttctcctccgtttataagattagtgtgtcatcctagaaagctctggtgaatcgttttctctgggtttgttagatgtgaagcccagagctgaccaggcttatcagttcgtggaaaggctcctcctttgttcttcaagactgtttgatttatttcctgttacttctgttcgtattctctacttat

SEQ ID NO: 89783 - DNA, 201 bp, Bos taurus
aatggactttgctagtattgactattcattctttccttgtgaaatgtctgaatgtgctcattttcatactttaagtcatcatcaattacagagttgcaggcgcttttcttgtgggctacctccagcagctgtcagtgaaaccgagcagctgctcggtagatagtgaagaggttccctcctcgcacgtcctcctgttttcgt

SEQ ID NO: 89784 - DNA, 201 bp, Bos taurus
gaaaacagatagtctatatgagatagcccatccttgagtggcttgatgtctggcaattaatgttagagcaaaaaattaagacccagttattttcatttctcaagggcatgacaatgagtctctcaatccaccatattaaaccactggaaatcatatataacagaatcttttcttcattaaaacttggtttaaggggacaaa

SEQ ID NO: 89785 - DNA, 201 bp, Bos taurus; identical to SEQ ID NO: 7986

SEQ ID NO: 89786 - DNA, 201 bp, Bos taurus; identical to SEQ ID NO: 7987

SEQ ID NO: 89787 - DNA, 201 bp, Bos taurus; identical to SEQ ID NO: 7988

SEQ ID NO: 89788 - DNA, 201 bp, Bos taurus; identical to SEQ ID NO: 7991

SEQ ID NO: 89789 - DNA, 201 bp, Bos taurus; identical to SEQ ID NO: 7992

SEQ ID NO: 89790 - DNA, 201 bp, Bos taurus; identical to SEQ ID NO: 7993

SEQ ID NO: 89791 - DNA, 201 bp, Bos taurus; identical to SEQ ID NO: 7994

SEQ ID NO: 89792 - DNA, 201 bp, Bos taurus; identical to SEQ ID NO: 7995

SEQ ID NO: 89793 - DNA, 201 bp, Bos taurus; identical to SEQ ID NO: 7996

SEQ ID NO: 89794 - DNA, 201 bp, Bos taurus; identical to SEQ ID NO: 7997

SEQ ID NO: 89795 - DNA, 201 bp, Bos taurus; identical to SEQ ID NO: 7999

SEQ ID NO: 89796 - DNA, 201 bp, Bos taurus; identical to SEQ ID NO: 8000

SEQ ID NO: 89797 - DNA, 201 bp, Bos taurus; identical to SEQ ID NO: 8001

SEQ ID NO: 89798 - DNA, 201 bp, Bos taurus; identical to SEQ ID NO: 8003

SEQ ID NO: 89799 - DNA, 201 bp, Bos taurus; identical to SEQ ID NO: 8004

SEQ ID NO: 89800 - DNA, 201 bp, Bos taurus; identical to SEQ ID NO: 8011

SEQ ID NO: 89801 - DNA, 201 bp, Bos taurus; identical to SEQ ID NO: 8013

SEQ ID NO: 89802 - DNA, 201 bp, Bos taurus; identical to SEQ ID NO: 8014

SEQ ID NO: 89803 - DNA, 201 bp, Bos taurus; identical to SEQ ID NO: 8017

SEQ ID NO: 89804 - DNA, 201 bp, Bos taurus; identical to SEQ ID NO: 8018

SEQ ID NO: 89805 - DNA, 201 bp, Bos taurus; identical to SEQ ID NO: 8019

SEQ ID NO: 89806 - DNA, 201 bp, Bos taurus; identical to SEQ ID NO: 8020

SEQ ID NO: 89807 - DNA, 201 bp, Bos taurus; identical to SEQ ID NO: 8021

SEQ ID NO: 89808 - DNA, 201 bp, Bos taurus; identical to SEQ ID NO: 8022

SEQ ID NO: 89809 - DNA, 201 bp, Bos taurus; identical to SEQ ID NO: 8023

SEQ ID NO: 89810 - DNA, 201 bp, Bos taurus; identical to SEQ ID NO: 8024

SEQ ID NO: 89811 - DNA, 201 bp, Bos taurus; identical to SEQ ID NO: 8025

SEQ ID NO: 89812 - DNA, 201 bp, Bos taurus; identical to SEQ ID NO: 8026

SEQ ID NO: 89813 - DNA, 201 bp, Bos taurus; identical to SEQ ID NO: 8028

SEQ ID NO: 89814 - DNA, 201 bp, Bos taurus; identical to SEQ ID NO: 8029

SEQ ID NO: 89815 - DNA, 201 bp, Bos taurus; identical to SEQ ID NO: 8030

SEQ ID NO: 89816 - DNA, 201 bp, Bos taurus; identical to SEQ ID NO: 8031

SEQ ID NO: 89817 - DNA, 201 bp, Bos taurus; identical to SEQ ID NO: 8032

SEQ ID NO: 89818 - DNA, 201 bp, Bos taurus; identical to SEQ ID NO: 8033

SEQ ID NO: 89819 - DNA, 201 bp, Bos taurus; identical to SEQ ID NO: 8034

SEQ ID NO: 89820 - DNA, 201 bp, Bos taurus; identical to SEQ ID NO: 8035

SEQ ID NO: 89821 - DNA, 201 bp, Bos taurus; identical to SEQ ID NO: 8037

SEQ ID NO: 89822 - DNA, 201 bp, Bos taurus; identical to SEQ ID NO: 8038

SEQ ID NO: 89823 - DNA, 201 bp, Bos taurus; identical to SEQ ID NO: 8039

SEQ ID NO: 89824 - DNA, 201 bp, Bos taurus; identical to SEQ ID NO: 49482

SEQ ID NO: 89825 - DNA, 201 bp, Bos taurus; identical to SEQ ID NO: 8041

SEQ ID NO: 89826 - DNA, 201 bp, Bos taurus
cctaagcatggaaatttcaggattatgggagaattgattatgaatcattgacatctaagacattggatttcatggagaattataaaaagatgagcaaaaaggggaaaaagaaattgaaaaataaaatttatgtttttctaggtaatatatgttaacacaatccttgtctcttttcactgcaataattacaagttcaaaaaa

SEQ ID NO: 89827 - DNA, 201 bp, Bos taurus; identical to SEQ ID NO: 8043

SEQ ID NO: 89828 - DNA, 201 bp, Bos taurus; identical to SEQ ID NO: 8044

SEQ ID NO: 89829 - DNA, 201 bp, Bos taurus; identical to SEQ ID NO: 8045

SEQ ID NO: 89830 - DNA, 201 bp, Bos taurus; identical to SEQ ID NO: 8046

SEQ ID NO: 89831 - DNA, 201 bp, Bos taurus; identical to SEQ ID NO: 8047

SEQ ID NO: 89832 - DNA, 201 bp, Bos taurus; identical to SEQ ID NO: 8048

SEQ ID NO: 89833 - DNA, 201 bp, Bos taurus; identical to SEQ ID NO: 8049

SEQ ID NO: 89834 - DNA, 201 bp, Bos taurus
caggaaaaaaaagaaacaaagacaaaaaaggcaagaggattccaactgaaatttgacaacaatgactatatgaagtattccagcttcttgaattggttaatgaggaaatgcactgggaaaaatgtttcagaagcaaattgattaggcatctcacagaataaacgatgtgactgttggaaatttaaaggtcaagagtaaact

SEQ ID NO: 89835 - DNA, 201 bp, Bos taurus; identical to SEQ ID NO: 8050

SEQ ID NO: 89836 - DNA, 201 bp, Bos taurus; identical to SEQ ID NO: 8051

SEQ ID NO: 89837 - DNA, 201 bp, Bos taurus; identical to SEQ ID NO: 8052

SEQ ID NO: 89838 - DNA, 201 bp, Bos taurus; identical to SEQ ID NO: 8053

SEQ ID NO: 89839 - DNA, 201 bp, Bos taurus; identical to SEQ ID NO: 8054

SEQ ID NO: 89840 - DNA, 201 bp, Bos taurus; identical to SEQ ID NO: 8055

SEQ ID NO: 89841 - DNA, 201 bp, Bos taurus; identical to SEQ ID NO: 8056

SEQ ID NO: 89842 - DNA, 201 bp, Bos taurus; identical to SEQ ID NO: 8057

SEQ ID NO: 89843 - DNA, 201 bp, Bos taurus; identical to SEQ ID NO: 8058

SEQ ID NO: 89844 - DNA, 201 bp, Bos taurus; identical to SEQ ID NO: 8059

SEQ ID NO: 89845 - DNA, 201 bp, Bos taurus; identical to SEQ ID NO: 8060

SEQ ID NO: 89846 - DNA, 201 bp, Bos taurus; identical to SEQ ID NO: 8061

SEQ ID NO: 89847 - DNA, 201 bp, Bos taurus; identical to SEQ ID NO: 8062

SEQ ID NO: 89848 - DNA, 201 bp, Bos taurus; identical to SEQ ID NO: 8063

SEQ ID NO: 89849 - DNA, 201 bp, Bos taurus; identical to SEQ ID NO: 8064

SEQ ID NO: 89850 - DNA, 201 bp, Bos taurus; identical to SEQ ID NO: 8065

SEQ ID NO: 89851 - DNA, 201 bp, Bos taurus; identical to SEQ ID NO: 8066

SEQ ID NO: 89852 - DNA, 201 bp, Bos taurus; identical to SEQ ID NO: 8067

SEQ ID NO: 89853 - DNA, 201 bp, Bos taurus; identical to SEQ ID NO: 8068

SEQ ID NO: 89854 - DNA, 201 bp, Bos taurus; identical to SEQ ID NO: 8069

SEQ ID NO: 89855 - DNA, 201 bp, Bos taurus; identical to SEQ ID NO: 8070

SEQ ID NO: 89856 - DNA, 201 bp, Bos taurus; identical to SEQ ID NO: 8071

SEQ ID NO: 89857 - DNA, 201 bp, Bos taurus; identical to SEQ ID NO: 8072

SEQ ID NO: 89858 - DNA, 201 bp, Bos taurus; identical to SEQ ID NO: 8073

SEQ ID NO: 89859 - DNA, 201 bp, Bos taurus; identical to SEQ ID NO: 8074

SEQ ID NO: 89860 - DNA, 201 bp, Bos taurus; identical to SEQ ID NO: 8075

SEQ ID NO: 89861 - DNA, 201 bp, Bos taurus; identical to SEQ ID NO: 8076

SEQ ID NO: 89862 - DNA, 201 bp, Bos taurus; identical to SEQ ID NO: 8077

SEQ ID NO: 89863 - DNA, 201 bp, Bos taurus; identical to SEQ ID NO: 8078

SEQ ID NO: 89864 - DNA, 201 bp, Bos taurus; identical to SEQ ID NO: 8079

SEQ ID NO: 89865 - DNA, 201 bp, Bos taurus; identical to SEQ ID NO: 8080

SEQ ID NO: 89866 - DNA, 201 bp, Bos taurus; identical to SEQ ID NO: 8081

SEQ ID NO: 89867 - DNA, 201 bp, Bos taurus; identical to SEQ ID NO: 8082

SEQ ID NO: 89868 - DNA, 201 bp, Bos taurus; identical to SEQ ID NO: 8083

SEQ ID NO: 89869 - DNA, 201 bp, Bos taurus; identical to SEQ ID NO: 8084

SEQ ID NO: 89870 - DNA, 201 bp, Bos taurus; identical to SEQ ID NO: 8085

SEQ ID NO: 89871 - DNA, 201 bp, Bos taurus; identical to SEQ ID NO: 8086

SEQ ID NO: 89872 - DNA, 201 bp, Bos taurus; identical to SEQ ID NO: 8087

SEQ ID NO: 89873 - DNA, 201 bp, Bos taurus; identical to SEQ ID NO: 8088

SEQ ID NO: 89874 - DNA, 201 bp, Bos taurus; identical to SEQ ID NO: 8089

SEQ ID NO: 89875 - DNA, 201 bp, Bos taurus; identical to SEQ ID NO: 8090

SEQ ID NO: 89876 - DNA, 201 bp, Bos taurus; identical to SEQ ID NO: 8091

SEQ ID NO: 89877 - DNA, 201 bp, Bos taurus; identical to SEQ ID NO: 8092

SEQ ID NO: 89878 - DNA, 201 bp, Bos taurus; identical to SEQ ID NO: 8093

SEQ ID NO: 89879 - DNA, 201 bp, Bos taurus; identical to SEQ ID NO: 8094

SEQ ID NO: 89880 - DNA, 201 bp, Bos taurus; identical to SEQ ID NO: 8095

SEQ ID NO: 89881 - DNA, 201 bp, Bos taurus; identical to SEQ ID NO: 8096

SEQ ID NO: 89882 - DNA, 201 bp, Bos taurus; identical to SEQ ID NO: 8097

SEQ ID NO: 89883 - DNA, 201 bp, Bos taurus; identical to SEQ ID NO: 8098

SEQ ID NO: 89884 - DNA, 201 bp, Bos taurus; identical to SEQ ID NO: 8101

SEQ ID NO: 89885 - DNA, 201 bp, Bos taurus; identical to SEQ ID NO: 8102

SEQ ID NO: 89886 - DNA, 201 bp, Bos taurus; identical to SEQ ID NO: 8103

SEQ ID NO: 89887 - DNA, 201 bp, Bos taurus; identical to SEQ ID NO: 8104

SEQ ID NO: 89888 - DNA, 201 bp, Bos taurus; identical to SEQ ID NO: 8105

SEQ ID NO: 89889 - DNA, 201 bp, Bos taurus; identical to SEQ ID NO: 8106

SEQ ID NO: 89890 - DNA, 201 bp, Bos taurus; identical to SEQ ID NO: 8107

SEQ ID NO: 89891 - DNA, 201 bp, Bos taurus; identical to SEQ ID NO: 8108

SEQ ID NO: 89892 - DNA, 201 bp, Bos taurus; identical to SEQ ID NO: 8109

SEQ ID NO: 89893 - DNA, 201 bp, Bos taurus; identical to SEQ ID NO: 8110

SEQ ID NO: 89894 - DNA, 201 bp, Bos taurus; identical to SEQ ID NO: 8111

SEQ ID NO: 89895 - DNA, 201 bp, Bos taurus; identical to SEQ ID NO: 8116

SEQ ID NO: 89896 - DNA, 201 bp, Bos taurus; identical to SEQ ID NO: 8117

SEQ ID NO: 89897 - DNA, 201 bp, Bos taurus; identical to SEQ ID NO: 8120

SEQ ID NO: 89898 - DNA, 201 bp, Bos taurus; identical to SEQ ID NO: 8123

SEQ ID NO: 89899 - DNA, 201 bp, Bos taurus; identical to SEQ ID NO: 8124

SEQ ID NO: 89900 - DNA, 201 bp, Bos taurus
cactaataaccatcttcacctggttggatcctgctcatcctttcaatcccagcatcactgtcactgcctcagagaggccctcaactgtcctcaccccatgggaggttttattcccagtcccttgttgttgtcgcgaagttgtgtctctttggctctttgtaaccccatgacctgcagcatgccaggcctccctgttcatca

SEQ ID NO: 89901 - DNA, 201 bp, Bos taurus; identical to SEQ ID NO: 8127

SEQ ID NO: 89902 - DNA, 201 bp, Bos taurus; identical to SEQ ID NO: 8128

SEQ ID NO: 89903 - DNA, 201 bp, Bos taurus
tgacatcagagaggcagtaagggttcttaagcaaggaggatgaagtgacccgatcattttggttgtcctatggaaactgtgttaaggagggcaatgagatgattagctaagaatacatcaatgctttgtatgaccagtgaagaataaattacagtaattcagaggtggtggtctcaaccacagaagcttcaatgagaatgg

SEQ ID NO: 89904 - DNA, 201 bp, Bos taurus; identical to SEQ ID NO: 8129

SEQ ID NO: 89905 - DNA, 201 bp, Bos taurus
agtgcaagggcctgggcctcggagccaaacccacgattatcaggttgattctacttccgtcggtcccccccatacactggctcaataaaaaatgtggagctgaggtaggagacggtgggcctctgccctggacacctggtgtttgtcaagtggagtaaaactgaacctctgttctcactcagacactccaaggacaaagct

SEQ ID NO: 89906 - DNA, 201 bp, Bos taurus; identical to SEQ ID NO: 8131

SEQ ID NO: 89907 - DNA, 201 bp, Bos taurus; identical to SEQ ID NO: 8132

SEQ ID NO: 89908 - DNA, 201 bp, Bos taurus; identical to SEQ ID NO: 8133

SEQ ID NO: 89909 - DNA, 201 bp, Bos taurus; identical to SEQ ID NO: 8134

SEQ ID NO: 89910 - DNA, 201 bp, Bos taurus; identical to SEQ ID NO: 8135

SEQ ID NO: 89911 - DNA, 201 bp, Bos taurus; identical to SEQ ID NO: 8136

SEQ ID NO: 89912 - DNA, 201 bp, Bos taurus; identical to SEQ ID NO: 8137

SEQ ID NO: 89913 - DNA, 201 bp, Bos taurus
tcatccttctgcctccggaagttaagcgccacaaggtcagaatttgttcacgttcgttccatcaaatggctatgggagttgaggaatctttcttgaataagtgaatgaataaataaatcccttttctgtgtccagcatctcatctgatccattcaattccttaacaatttcctttaacttttgtcactatgtccacctttc

SEQ ID NO: 89914 - DNA, 201 bp, Bos taurus
tcccttcctgggcattcccaaagggcaatgccatcatctgggtcaggacaagcccatctcatttcttcctactgatgtatccctgcacatacttgaacatcaaaaagaaaataatctggcagctgttttctttacaaaagccatttccaaaattaacaatttattatgcttgtgacaaaaataattcatctgctttgcaga

SEQ ID NO: 89915 - DNA, 201 bp, Bos taurus; identical to SEQ ID NO: 8138

SEQ ID NO: 89916 - DNA, 201 bp, Bos taurus; identical to SEQ ID NO: 8140

SEQ ID NO: 89917 - DNA, 201 bp, Bos taurus
gtcattccataattcactgcaaatcagtaaagtaattaaacagcttatgttaatgaccccgtgtcccaggcacattgtgaggccctgggaatacagttcagttcagttcagtctctcagtcgtgtctgactctgcaaccccatggaatgcagcacaccaggcctccctgtccatcagcaactaccggagcttgcttaaact

SEQ ID NO: 89918 - DNA, 201 bp, Bos taurus
gctgcggcggcgctacctggactggaggaagaagaggctgcaagataagctagcggcgacgcagaagaagctggatctggcctgagatccccgccctgttggtccccgccgactcccgcgcgaccacctcgagggcatctaccctgtcccgtgcggggcctcggccatagctaggcccgtctcacgccctgcgcccgcagt

SEQ ID NO: 89919 - DNA, 201 bp, Bos taurus
ctcattaaaaaaaaaaaaaaatccctagctctcaaagtccatatcaggcccagagaagtaagagttaaattggcataagctgcacctcacattgcgagcatgcgtgactgcatccgtggcccagcgcgtgtcgttgccaagcagactcgcagcgatcagtgtgcagcggctgactcctctagtccaagactgacaaacttt

SEQ ID NO: 89920 - DNA, 201 bp, Bos taurus; identical to SEQ ID NO: 8141

SEQ ID NO: 89921 - DNA, 201 bp, Bos taurus
gcatcaaacctgagccccctgcattggaagcctgaggtcttaaccactggcccaccagggaagtcctaaggctgactgctttttacttccccaaaaaccttaatcaacttaaatctaacttaggcctgtccattttggtgttttcaaaatgagttcaggcaaaggtgagcaaaaacagggggcaggatgaaactggtacag

SEQ ID NO: 89922 - DNA, 201 bp, Bos taurus
aggcacctggtcgcatggaagttaccgtgaagctgtaggtggaggttgaagggagaagataatacagcaagagtagaggccatggtcatggcactcaagagtagagggcacccagttcatgatggacagctcagattacaagggaatttggcccatagccaagcattcaggttctgctttgtttgttttttcttttatttt

SEQ ID NO: 89923 - DNA, 201 bp, Bos taurus; identical to SEQ ID NO: 8142

SEQ ID NO: 89924 - DNA, 201 bp, Bos taurus; identical to SEQ ID NO: 8143

SEQ ID NO: 89925 - DNA, 201 bp, Bos taurus; identical to SEQ ID NO: 8144

SEQ ID NO: 89926 - DNA, 201 bp, Bos taurus; identical to SEQ ID NO: 8145

SEQ ID NO: 89927 - DNA, 201 bp, Bos taurus; identical to SEQ ID NO: 8146

SEQ ID NO: 89928 - DNA, 201 bp, Bos taurus; identical to SEQ ID NO: 8147

SEQ ID NO: 89929 - DNA, 201 bp, Bos taurus; identical to SEQ ID NO: 8148

SEQ ID NO: 89930 - DNA, 201 bp, Bos taurus; identical to SEQ ID NO: 8149

SEQ ID NO: 89931 - DNA, 201 bp, Bos taurus; identical to SEQ ID NO: 8150

SEQ ID NO: 89932 - DNA, 201 bp, Bos taurus; identical to SEQ ID NO: 8151

SEQ ID NO: 89933 - DNA, 201 bp, Bos taurus; identical to SEQ ID NO: 8152

SEQ ID NO: 89934 - DNA, 201 bp, Bos taurus; identical to SEQ ID NO: 8153

SEQ ID NO: 89935 - DNA, 201 bp, Bos taurus; identical to SEQ ID NO: 8154

SEQ ID NO: 89936 - DNA, 201 bp, Bos taurus; identical to SEQ ID NO: 8155

SEQ ID NO: 89937 - DNA, 201 bp, Bos taurus; identical to SEQ ID NO: 8156

SEQ ID NO: 89938 - DNA, 201 bp, Bos taurus; identical to SEQ ID NO: 8157

SEQ ID NO: 89939 - DNA, 201 bp, Bos taurus; identical to SEQ ID NO: 8158

SEQ ID NO: 89940 - DNA, 201 bp, Bos taurus; identical to SEQ ID NO: 8159

SEQ ID NO: 89941 - DNA, 201 bp, Bos taurus; identical to SEQ ID NO: 8160

SEQ ID NO: 89942 - DNA, 201 bp, Bos taurus; identical to SEQ ID NO: 8161

SEQ ID NO: 89943 - DNA, 201 bp, Bos taurus; identical to SEQ ID NO: 8162

SEQ ID NO: 89944 - DNA, 201 bp, Bos taurus; identical to SEQ ID NO: 8163

SEQ ID NO: 89945 - DNA, 201 bp, Bos taurus; identical to SEQ ID NO: 8164

SEQ ID NO: 89946 - DNA, 201 bp, Bos taurus; identical to SEQ ID NO: 8166

SEQ ID NO: 89947 - DNA, 201 bp, Bos taurus; identical to SEQ ID NO: 8167

SEQ ID NO: 89948 - DNA, 201 bp, Bos taurus; identical to SEQ ID NO: 8168

SEQ ID NO: 89949 - DNA, 201 bp, Bos taurus; identical to SEQ ID NO: 8169

SEQ ID NO: 89950 - DNA, 201 bp, Bos taurus; identical to SEQ ID NO: 8170

SEQ ID NO: 89951 - DNA, 201 bp, Bos taurus; identical to SEQ ID NO: 8171

SEQ ID NO: 89952 - DNA, 201 bp, Bos taurus; identical to SEQ ID NO: 8172

SEQ ID NO: 89953 - DNA, 201 bp, Bos taurus; identical to SEQ ID NO: 8173

SEQ ID NO: 89954 - DNA, 201 bp, Bos taurus; identical to SEQ ID NO: 8174

SEQ ID NO: 89955 - DNA, 201 bp, Bos taurus; identical to SEQ ID NO: 8175

SEQ ID NO: 89956 - DNA, 201 bp, Bos taurus; identical to SEQ ID NO: 8176

SEQ ID NO: 89957 - DNA, 201 bp, Bos taurus; identical to SEQ ID NO: 8177

SEQ ID NO: 89958 - DNA, 201 bp, Bos taurus; identical to SEQ ID NO: 8178

SEQ ID NO: 89959 - DNA, 201 bp, Bos taurus; identical to SEQ ID NO: 8179

SEQ ID NO: 89960 - DNA, 201 bp, Bos taurus; identical to SEQ ID NO: 8180

SEQ ID NO: 89961 - DNA, 201 bp, Bos taurus; identical to SEQ ID NO: 8181

SEQ ID NO: 89962 - DNA, 201 bp, Bos taurus; identical to SEQ ID NO: 8182

SEQ ID NO: 89963 - DNA, 201 bp, Bos taurus; identical to SEQ ID NO: 8183

SEQ ID NO: 89964 - DNA, 201 bp, Bos taurus; identical to SEQ ID NO: 8184

SEQ ID NO: 89965 - DNA, 201 bp, Bos taurus; identical to SEQ ID NO: 8185

SEQ ID NO: 89966 - DNA, 201 bp, Bos taurus; identical to SEQ ID NO: 8186

SEQ ID NO: 89967 - DNA, 201 bp, Bos taurus; identical to SEQ ID NO: 8187

SEQ ID NO: 89968 - DNA, 201 bp, Bos taurus; identical to SEQ ID NO: 8188

SEQ ID NO: 89969 - DNA, 201 bp, Bos taurus; identical to SEQ ID NO: 8189

SEQ ID NO: 89970 - DNA, 201 bp, Bos taurus; identical to SEQ ID NO: 8190

SEQ ID NO: 89971 - DNA, 201 bp, Bos taurus; identical to SEQ ID NO: 8191

SEQ ID NO: 89972 - DNA, 201 bp, Bos taurus; identical to SEQ ID NO: 8192

SEQ ID NO: 89973 - DNA, 201 bp, Bos taurus; identical to SEQ ID NO: 8193

SEQ ID NO: 89974 - DNA, 201 bp, Bos taurus; identical to SEQ ID NO: 8195

SEQ ID NO: 89975 - DNA, 201 bp, Bos taurus; identical to SEQ ID NO: 8196

SEQ ID NO: 89976 - DNA, 201 bp, Bos taurus; identical to SEQ ID NO: 8197

SEQ ID NO: 89977 - DNA, 201 bp, Bos taurus; identical to SEQ ID NO: 8198

SEQ ID NO: 89978 - DNA, 201 bp, Bos taurus; identical to SEQ ID NO: 8199

SEQ ID NO: 89979 - DNA, 201 bp, Bos taurus; identical to SEQ ID NO: 8200

SEQ ID NO: 89980 - DNA, 201 bp, Bos taurus; identical to SEQ ID NO: 8201

SEQ ID NO: 89981 - DNA, 201 bp, Bos taurus; identical to SEQ ID NO: 8202

SEQ ID NO: 89982 - DNA, 201 bp, Bos taurus; identical to SEQ ID NO: 8203

SEQ ID NO: 89983 - DNA, 201 bp, Bos taurus; identical to SEQ ID NO: 8204

SEQ ID NO: 89984 - DNA, 201 bp, Bos taurus; identical to SEQ ID NO: 8206

SEQ ID NO: 89985 - DNA, 201 bp, Bos taurus; identical to SEQ ID NO: 8207

SEQ ID NO: 89986 - DNA, 201 bp, Bos taurus
cttgtggcctgcctgcatcatctcctctgagcctttccttcctccccagcagcctccctgctcgcctgtcctccgcagggcgactcctgggaggaggaggaatttggtccctgggctccttggccttctgtttgtctcccctctttcccttaccttctctattcgcttggtccttaggaaaaaaagagaagccaaaatgtg

SEQ ID NO: 89987 - DNA, 201 bp, Bos taurus; identical to SEQ ID NO: 8208

SEQ ID NO: 89988 - DNA, 201 bp, Bos taurus; identical to SEQ ID NO: 8209

SEQ ID NO: 89989 - DNA, 201 bp, Bos taurus; identical to SEQ ID NO: 8210

SEQ ID NO: 89990 - DNA, 201 bp, Bos taurus; identical to SEQ ID NO: 8211

SEQ ID NO: 89991 - DNA, 201 bp, Bos taurus; identical to SEQ ID NO: 8212

SEQ ID NO: 89992 - DNA, 201 bp, Bos taurus
attacttaatgaccaatcagatatggttcattggtagtaagtgtagaaacatgttgtctgaagatgtagtttaattagtatcctcctaaaaacatgtcccctgtgaccattggatgtaatcattattttatgtatttaactgtgaaattcatatttactcagcaggccaagagaacagcgttttacttctcaaagctgttt

SEQ ID NO: 89993 - DNA, 201 bp, Bos taurus
actgcaatgaagtcagataccgattcagtaagaaaactacaataggcagaaagaaaacaatgccagaattaaatctatgaggccattttatgtaaacagatcatttcaagcaaatagtttaataccaagtagtaatacctgatagaactattttttcagtaacacatcatttcaaattactgtacattttggtgggagtgg

SEQ ID NO: 89994 - DNA, 201 bp, Bos taurus
ttggactaataactctttccttcagaacttctctgactttatcattacttttgacctttccccttccagcgtaacagccctaaagacttcagctacactcagtgtggcaatcagttccagctttcttgttttttgctgggttctggtctcacaataaacctagaattgccctgtcacaagctacaaatttctcttccattt

SEQ ID NO: 89995 - DNA, 201 bp, Bos taurus; identical to SEQ ID NO: 8213

SEQ ID NO: 89996 - DNA, 201 bp, Bos taurus; identical to SEQ ID NO: 8214

SEQ ID NO: 89997 - DNA, 201 bp, Bos taurus
aagctcactgtataaatgcatgttctttactgaggccatccgggagaaataacttccccacatgcttcactgaggtctgtgcccagtcaaccgaagacccactggagcaagggaggccaatttaggagaatcaaactcttaagaagatcaaccaacttcccttaatagaccttcattctttttacactttctgcctattaa

SEQ ID NO: 89998 - DNA, 201 bp, Bos taurus; identical to SEQ ID NO: 8215

SEQ ID NO: 89999 - DNA, 201 bp, Bos taurus; identical to SEQ ID NO: 8216

SEQ ID NO: 90000 - DNA, 201 bp, Bos taurus; identical to SEQ ID NO: 8217

SEQ ID NO: 90001 - DNA, 201 bp, Bos taurus; identical to SEQ ID NO: 8218

SEQ ID NO: 90002 - DNA, 201 bp, Bos taurus; identical to SEQ ID NO: 8219

SEQ ID NO: 90003 - DNA, 201 bp, Bos taurus; identical to SEQ ID NO: 8220

SEQ ID NO: 90004 - DNA, 201 bp, Bos taurus; identical to SEQ ID NO: 8221

SEQ ID NO: 90005 - DNA, 201 bp, Bos taurus
gtggacctggtctggccccaaacctctggactgtgctgtgctgcccagaccatgccccagcctggaaagaatatggtaagtgtggtgggtgtgggagtgatagggaccagcaccccggccccagcccccagatgcagggctgaggcagcaggtgaattcagggtccccctacccagccaggtctgggtctaacctgaatgg

SEQ ID NO: 90006 - DNA, 201 bp, Bos taurus; identical to SEQ ID NO: 8222

SEQ ID NO: 90007 - DNA, 201 bp, Bos taurus; identical to SEQ ID NO: 8223

SEQ ID NO: 90008 - DNA, 201 bp, Bos taurus; identical to SEQ ID NO: 8224

SEQ ID NO: 90009 - DNA, 201 bp, Bos taurus
ggaaaagccttggcacccagtgaaggggctgcaggggcctgctgcaatggatgcatgaagggacagtgttggcaagacagacagacagaagtgagggaagaaaggtgggaaggtggccagagcaagtgaaaggaagcttccactgggaaagtgggagagggctgctttagctgcttcatttttttaagacttttttttttt

SEQ ID NO: 90010 - DNA, 201 bp, Bos taurus
tacatacctgtcaataattgctttaaggaaagatggattaaatgctccaatcaaaagacatagaatggctgaatgggtaaaacacaagaatcatacacactctgcctccaagagattcacttgagacctaaagatacacagagactggaagtgaaggtctggaaaaggtattctatgaaacagcaaaagaaaagttggggt

SEQ ID NO: 90011 - DNA, 201 bp, Bos taurus; identical to SEQ ID NO: 8225

SEQ ID NO: 90012 - DNA, 201 bp, Bos taurus; identical to SEQ ID NO: 8226

SEQ ID NO: 90013 - DNA, 201 bp, Bos taurus
ttaaggaaaggtgatattttaggtaaaacaaactatacaacagcaatatggaaataaaaagttgcgaagtatttggggagaatgacaggctgactcaattcgagtgaattcacaagtgaatcaagaaatggatggaggagttggtcagaagaaaatgagtatagtttttgttggattttatgtgaaaatataatgataagt

SEQ ID NO: 90014 - DNA, 201 bp, Bos taurus; identical to SEQ ID NO: 8228

SEQ ID NO: 90015 - DNA, 201 bp, Bos taurus; identical to SEQ ID NO: 8229

SEQ ID NO: 90016 - DNA, 201 bp, Bos taurus
acatccactggagaggtgacacacccctgtcctcacaggaacccaggacctactaaagctttctgaggcaggtatttccgctagccgcaaattggtgctgtctcataccattacaccaaacgcctgttcccaacttactggacactccccaagccctcttcgatgaaggacctcctaattaagaacatgcccctccaaaac

SEQ ID NO: 90017 - DNA, 201 bp, Bos taurus
ccaaaactgccatcccctttgctcttcaccctgctggccctctgccgggtgtcccaggctgttcaaaactgctagaggaaacttagcccttcagactgccatcactgacggtttatgaggccctcaaagcggtccactatgcccactgctatcttctgagcctcctcaaggcttgctagctttcacaaactgctgtaaagt

SEQ ID NO: 90018 - DNA, 201 bp, Bos taurus
aagccaagaagcctatgtagacaaaatttattatttatttactaatcttccacccaaacccaaactttgcttaaattcctaactaattaagcacccaaacttaagtttcttcttcctgccaattcctctcaaaattattgtttcttttctaaaaagtataaaagctgtcttctttggctacttcttaggtcccatttcaat

SEQ ID NO: 90019 - DNA, 201 bp, Bos taurus; identical to SEQ ID NO: 8231

SEQ ID NO: 90020 - DNA, 201 bp, Bos taurus; identical to SEQ ID NO: 8232

SEQ ID NO: 90021 - DNA, 201 bp, Bos taurus
gaccactcacacctccttcatccctgcttcttttacctgaagtctgggcaacctgcagcatcattttatatcagacttcctagaacacagtctatctctttaggaagagtcatttcagctcgatcaggtcttgtcactcgcctgctctgtgctgggtactgtgtaagcatactacacaaagtagcctgctgctgcctcata

SEQ ID NO: 90022 - DNA, 201 bp, Bos taurus; identical to SEQ ID NO: 8234

SEQ ID NO: 90023 - DNA, 201 bp, Bos taurus
tcggggaaatataatgattccgttcaccagggatgtaggatgtaaaggaaagagggtccaaagtgaagagggcctatgtgtcttgtaaaaggtcctggcctttattctgagggtaatgagttctcctgagaagtctgatgcgggcacatatcatgatcagaaataagctagaagagactgaatgactgggagcaagagatg

SEQ ID NO: 90024 - DNA, 201 bp, Bos taurus
gtagccctccactgcatgtggcctgaatatttaatgaacagacaaggaggaatccagactacacccaggcaaagtaacttagaaccataaaggggtgagagagaacagttgggcagagaaggccattgtggtagaacccacagagttggtagctaaactctaacagtgttccatgtctagaaggaacccacagagattatg

SEQ ID NO: 90025 - DNA, 201 bp, Bos taurus; identical to SEQ ID NO: 8235

SEQ ID NO: 90026 - DNA, 201 bp, Bos taurus
cgggaccatccacatactcatcgttgaggccgcatctccggctggtggggttcccgtacttccggagggtgtcggtgagctcctggtagagggtgtctccgaggctgcgggggatgccctcccaggccaggatgaggatgacgatcacggcattctggcagtggtggcccgcccggtgccgcaccaggcagagcagcttct

SEQ ID NO: 90027 - DNA, 201 bp, Bos taurus
gacgcctggttcctgcacacactcctgccctggcccacacacacgtgcacacactcaggggttcgccacgttcagaggtgaggaaactgtggccctcggaactgaactgacctgctctagggcacacatctacccaggggcaacgctggctacagcgcagccacggggtcagagagctgcggcctgagagcccacgcagcc

SEQ ID NO: 90028 - DNA, 201 bp, Bos taurus
gtgttcagatgagcagagtgtccacaaagaacaatgccagctaaggtagggctgagacaaggtgaaggagtgccttgaatactgagttgggggttacacgatagttggcgataaacatgaccatacaaagtttctgacgaggggggcttcctggtggctcaatggtaaagaatctgcctgccaatgtagaagtagtgggtt

SEQ ID NO: 90029 - DNA, 201 bp, Bos taurus; identical to SEQ ID NO: 8236

SEQ ID NO: 90030 - DNA, 201 bp, Bos taurus; identical to SEQ ID NO: 8237

SEQ ID NO: 90031 - DNA, 201 bp, Bos taurus; identical to SEQ ID NO: 8238

SEQ ID NO: 90032 - DNA, 201 bp, Bos taurus
agtggctcatatttccctgagaaagatacccagaaaccaagcaaatgaggcgagcagagactcacagacaacttgagagaactcccaggagggaaagctgactttctctgtgtatgtcctcagtgaatgaaattcccacaacaagattaatacaactgaaaaagatgctgcaaacatttctctctgactttattattaaga

SEQ ID NO: 90033 - DNA, 201 bp, Bos taurus; identical to SEQ ID NO: 8239

SEQ ID NO: 90034 - DNA, 201 bp, Bos taurus; identical to SEQ ID NO: 8240

SEQ ID NO: 90035 - DNA, 201 bp, Bos taurus; identical to SEQ ID NO: 8241

SEQ ID NO: 90036 - DNA, 201 bp, Bos taurus; identical to SEQ ID NO: 8242

SEQ ID NO: 90037 - DNA, 201 bp, Bos taurus
ccaaggctgaggctggcaggaagcaggcttggagcgggcagcttgtcgtatcaccaggaggatttggggggcagttgcagagactagttagcaagggtctaactaaactctggcctcaaatactgacctgctcactttctgttgaacttaagcaagttagagcaatcaaccaacatgaaaagcaaatgtattaagtctaga

SEQ ID NO: 90038 - DNA, 201 bp, Bos taurus
gtttgagcatttgtcaggaggggaagctccgcctgtggcccgtgtttggtttttacttgccccaaatggtagggaggactgaccagccacaaggcaagatgggctacagctacaggccactggagtctcccctggggggggtccctcacctcctccccctctcttctcccacgtcccttccccctccccagttgtcaccct

SEQ ID NO: 90039 - DNA, 201 bp, Bos taurus; identical to SEQ ID NO: 8243

SEQ ID NO: 90040 - DNA, 201 bp, Bos taurus; identical to SEQ ID NO: 8244

SEQ ID NO: 90041 - DNA, 201 bp, Bos taurus
tctgatgggttctactttgcactgcaagcaacagcatacgcctcaggagaaggactccgctcttgtattattgatagggaagctgagagagggggaggaacgtctagtcaatatgttggatccttgttggtcagagaaatgatttggttaggggaattctcttatcaatgccacttatattggctaaagagacctcgtctt

SEQ ID NO: 90042 - DNA, 201 bp, Bos taurus; identical to SEQ ID NO: 8245

SEQ ID NO: 90043 - DNA, 201 bp, Bos taurus; identical to SEQ ID NO: 8246

SEQ ID NO: 90044 - DNA, 201 bp, Bos taurus; identical to SEQ ID NO: 8247

SEQ ID NO: 90045 - DNA, 201 bp, Bos taurus
gcagccaagcgtcatcccaccaggccctgcagcagggttctcagcggtgtttctctggaaacacctacatgctcttttcctctacctttgagatcaaacacgcagttttgaagtggccagtggccaagattaggctcagtgaagctgaaggagttgggattaggtaagtctgaggacagatttagcggtgagtcttggcca

SEQ ID NO: 90046 - DNA, 201 bp, Bos taurus; identical to SEQ ID NO: 8248

SEQ ID NO: 90047 - DNA, 201 bp, Bos taurus
catagatgtatccatgtgttcacttttagcaaatactggcaaacatctactgctaaggaccactgccaaaaataattcttacaaattcacactaccccagcagtgtctgagagttctagttgctctgtatctttgcaaaattttttatttttagcctgttgggtgtgtttttcatttgcattttccttatgactaatgata

SEQ ID NO: 90048 - DNA, 201 bp, Bos taurus
tgtgctttcttctgcctggaatctcacagttcgtgtccttctttcgagttttcctctacaagctcatctcaaacccagccttaccccagggaggatggcacgtttgaggcccctccccataccatgtgagtttcccagaccctcaacaggcagcctgagttcccaaggaaatggaaggtggtggggaagggctccaagggg

SEQ ID NO: 90049 - DNA, 201 bp, Bos taurus
aaatgcacccacatcccacattaaatagaatgattttgctataaaatacttggaaagaatttttataattttgcttttgaaattatttggctgaagtttactcatttagtttacgatctgctctgacttcccagccctcctcacgcatactcaggaatctgtaaggcgagggaatcgaaggtacaaattgttttcaaatgg

SEQ ID NO: 90050 - DNA, 201 bp, Bos taurus
actgcctaatactcatccagacccatggtcagaatccaagcttacaccttgggacatagcctctcacagaccattttcagagttgctccctggtcctgccgtggttcatggttcaggcctctccctaaaggcttcccctttctgaccctaccgtttttttcacattttgaccttgtattgtctcctttcaaagccctcacc

SEQ ID NO: 90051 - DNA, 201 bp, Bos taurus
tctgggagcctggggcacctcttgtaatcccgcggcccgtgtctacatggaagagaatggggctgggactttggcacctgataggccaaggcccaggccagcccctcttccccaaggagaagctactggcacttgcagggacagacagaagtgggtgagggaatctggaagggtctgaggcctccaagtccacaaatcatc

SEQ ID NO: 90052 - DNA, 201 bp, Bos taurus; identical to SEQ ID NO: 8249

SEQ ID NO: 90053 - DNA, 201 bp, Bos taurus; identical to SEQ ID NO: 8250

SEQ ID NO: 90054 - DNA, 201 bp, Bos taurus
tagctgacaacatagcagccattctgatttgtggtcccacttttgtaaccaagcattttccccatctctggaagctttggggacattttatttgtctccactagactagaatttcacagtgatgtgacttggtgtgggaggatcaaagtcatgaacatgaaatatcaaaataagatggttagagaaacactgtgcttttgg

SEQ ID NO: 90055 - DNA, 201 bp, Bos taurus; identical to SEQ ID NO: 8251

SEQ ID NO: 90056 - DNA, 201 bp, Bos taurus; identical to SEQ ID NO: 8252

SEQ ID NO: 90057 - DNA, 201 bp, Bos taurus
gcgccaggagaggccaggccggatttcccttcctttgactcagaaaggggcttgaaagaaagattgagagaccgcagcgaagatatgtgtgcaaaagtgtatgtgcgcgggggagggccctgaccccctcccctaaaacgctagaacagcagccggcttcccctttgtgcgccgcgtgcaactgtgagcaagggtgcgtcg

SEQ ID NO: 90058 - DNA, 201 bp, Bos taurus; identical to SEQ ID NO: 8253

SEQ ID NO: 90059 - DNA, 201 bp, Bos taurus
gggtcctatccttgacatggccagggaatctgagacacatttctagagttctttctctgcattactctgcattactttatactctggcctttttgggtgtcttcatggtctcccgtcttgtggctctcttctttgtgggtaagctcctgggcgacctgagccccactgactttctctccttcctgcacacaggccccaaag

SEQ ID NO: 90060 - DNA, 201 bp, Bos taurus
aaagggttcatacctgtgagtagagagctgaacccaaagggaaaggggtcaaagggcctcacccatgaccagtgatggtcgctgtctatgcaaaagtgtgcttccagtcataaaataactcacacagggcatggcaggcttttctggagtgtttaactggttttcatacaaggcacctttttcatggagtgactttaatca

SEQ ID NO: 90061 - DNA, 201 bp, Bos taurus
ttttatctgtagttaataattgccttggccctttgtttacttagggttttttttttttttttgtacttaattgctaactcaccccacaatttccaaaagcgtctcagaatatttttctacaaggccatcaacatcagccaatctaattctttctttctttcttttccctttttttctgttgaagccatccgtcatgaagac

SEQ ID NO: 90062 - DNA, 201 bp, Bos taurus
ttctcagacatttgcttcgggtgggacattggagggatacatgcctcaggctggaggttgggagctctgcgtgttagacccatctggtctcagttctgccgtgtcctcaggcaagttattcatctggtttctgtttggatgttggccttgacttaggaatgacctgtgaagtttttcacatgaccactctgatggattgat

SEQ ID NO: 90063 - DNA, 201 bp, Bos taurus; identical to SEQ ID NO: 8254

SEQ ID NO: 90064 - DNA, 201 bp, Bos taurus
gtagaggatctaaatagacatttctccaaagaagacatacgtatggccaacaggtatatgaaaagatgttcaacatcactaattattagaaaaatacaaatcaagaccacaatgatatgtggcctcccacctgtcagagtagctattagtattattgaaaaaacaagaaataacaaatgttggataggatatggagacaag

SEQ ID NO: 90065 - DNA, 201 bp, Bos taurus; identical to SEQ ID NO: 8255

SEQ ID NO: 90066 - DNA, 201 bp, Bos taurus; identical to SEQ ID NO: 8256

SEQ ID NO: 90067 - DNA, 201 bp, Bos taurus
aacaaaatagaaggccagtgcaagtgaaagtattaacgacccaattaattgataacatattgatgtattgccttctgtgacggttaactttatatgtaaacttgtctgggccatgtggagcccagatattagggtgtttctgtgagaatgttttttggatgagattaacatttaaatacagacttgagtaaaacagattgc

SEQ ID NO: 90068 - DNA, 201 bp, Bos taurus; identical to SEQ ID NO: 8257

SEQ ID NO: 90069 - DNA, 201 bp, Bos taurus; identical to SEQ ID NO: 8259

SEQ ID NO: 90070 - DNA, 201 bp, Bos taurus; identical to SEQ ID NO: 8260

SEQ ID NO: 90071 - DNA, 201 bp, Bos taurus
ggttgccatgccctcctccaggggatcctcccaacccagggatcaagcccaggtctcccacattgcaggtggattctttaccgacttaaccatcagggaaacccaacttcattaggtatctgtttttagatgtggtgaaagggttttcagcggaaatctattcagatttgcattataaaaaaagatcgacttgcagcgtag

SEQ ID NO: 90072 - DNA, 201 bp, Bos taurus
ggacatcaattgggtgtcctacaatttaattcaattctgacactacgtggagttagtacaaaccccatacatgaagagcttagtcctgtaagactgcctcacttttctgattctgatttcaagtctgatacttctgactgaatggctataaactaggcgttttcatgacctccttctcagctcaggtttgatcatttgcta

SEQ ID NO: 90073 - DNA, 201 bp, Bos taurus
tctttttaattgatttttaagcctcagttcctttcttagttcatcaaacctgctgattctatttgcatcatcagtgtatttgttttgccgctagatggcagtaatgtacctttgaaccctgtggcctctgagttctcagaatcggggatctgaaggagccttggaatttttgcttaatccccaccccccacccatttaaca

SEQ ID NO: 90074 - DNA, 201 bp, Bos taurus; identical to SEQ ID NO: 8261

SEQ ID NO: 90075 - DNA, 201 bp, Bos taurus; identical to SEQ ID NO: 8262

SEQ ID NO: 90076 - DNA, 201 bp, Bos taurus; identical to SEQ ID NO: 8263

SEQ ID NO: 90077 - DNA, 201 bp, Bos taurus
gtttaaaggcttttccaagaactatgtttccaaagagcgttaataataactttggaacatcctacgagtgaggcacagtgcgtagtcaccgcctttggtttgggcgggccagggatctcctcctgcttttggcactgcttctgtcaatcgcactggacgagttactgcagtttcctttgtcccaagttgagaactcttttg

SEQ ID NO: 90078 - DNA, 201 bp, Bos taurus
aaaccacctttcctacccctggtctgtggaaacactgtcttccatgaagaaattggtccctggtgccgaaaagttttgggaccactgatttagagggaaacggttttgaaaataatgagaaagctcctttttggtggtgagagagaaatataccctttaaaatgatcgtctgtcctgtgattctaagaggaatgtagaact

SEQ ID NO: 90079 - DNA, 201 bp, Bos taurus; identical to SEQ ID NO: 8264

SEQ ID NO: 90080 - DNA, 201 bp, Bos taurus; identical to SEQ ID NO: 8265

SEQ ID NO: 90081 - DNA, 201 bp, Bos taurus
aggattcagcagatatcctagggagttctggacctggagttatcctttggagatgtcctgaatcaagataagaggactaggcctttatcctctctaagtctcagctgcccaggaaggggacaatgcctttgatgaggcaactctctttagctgagacaatctgtgtgtctctgtggggcctgaaggctgggggctgtctca

SEQ ID NO: 90082 - DNA, 201 bp, Bos taurus; identical to SEQ ID NO: 8266

SEQ ID NO: 90083 - DNA, 201 bp, Bos taurus; identical to SEQ ID NO: 8267

SEQ ID NO: 90084 - DNA, 201 bp, Bos taurus; identical to SEQ ID NO: 8268

SEQ ID NO: 90085 - DNA, 201 bp, Bos taurus; identical to SEQ ID NO: 8269

SEQ ID NO: 90086 - DNA, 201 bp, Bos taurus
gtatcctgaatagattgaaaaatgttaaatcaagtgaatttatgttaaagaaataagtgagttcacataatttaaaaattcctcaaccattaaaatgttctctggactttactatttagagttagatttagttcattgctagttgagttctttaaacccctcattcatttagttccataatatcagtatgaaaagtgcatc

SEQ ID NO: 90087 - DNA, 201 bp, Bos taurus; identical to SEQ ID NO: 8270

SEQ ID NO: 90088 - DNA, 201 bp, Bos taurus; identical to SEQ ID NO: 8271

SEQ ID NO: 90089 - DNA, 201 bp, Bos taurus; identical to SEQ ID NO: 8272

SEQ ID NO: 90090 - DNA, 201 bp, Bos taurus
ctgttagaaaaaaaaatttagctccccaaaaatgtgttgtgaatcatgtaccatattctcaatgtttccatcaatttaaaatgtgttgctagtaatgcacataaatggcttaaacatgaaaaccaaatgacatgatgatatacagctgtgcctacattgtatatatcttttatgacatgtttcacttgctttactctatgg

SEQ ID NO: 90091 - DNA, 201 bp, Bos taurus; identical to SEQ ID NO: 8273

SEQ ID NO: 90092 - DNA, 201 bp, Bos taurus; identical to SEQ ID NO: 8274

SEQ ID NO: 90093 - DNA, 201 bp, Bos taurus
atagatgtggaagattggaaaaccgttccaaaagatgtcaatatcttaatccccagaatctgtcagtatgttaccttaactggcaaaaggctcattaaagatgagactaaattaaggattttgagatgtggagattatctcagattatcttgacctagtgtaatcataaagttcttataacaaggaatcagaaaagtcaga

SEQ ID NO: 90094 - DNA, 201 bp, Bos taurus; identical to SEQ ID NO: 8275

SEQ ID NO: 90095 - DNA, 201 bp, Bos taurus; identical to SEQ ID NO: 8276

SEQ ID NO: 90096 - DNA, 201 bp, Bos taurus
gttacaattataaacattaacagagtctaagaaaagtatttttacaagatattgtgctgtgtagtcattagttctggacctgaagaaaggccaattctccagtaagatacattgttgcacaagacttaaggaaagcaggagggagaatgttcacctccttcttaaagggccctaagctttaactttcccacaatcagttat

SEQ ID NO: 90097 - DNA, 201 bp, Bos taurus
ataattctgaaaaaagcactaacaaccttgaaatcgttactcttaatatagaacagggtaaggagtatgcctgaatggtggatctgttcaggcagaaagagactgggccattctcaaagtattcctttctgatccagtaatgtgcaatggatatatgacatggattccaatagaaatgaatcacaattgtgaagatggctt

SEQ ID NO: 90098 - DNA, 201 bp, Bos taurus; identical to SEQ ID NO: 8277

SEQ ID NO: 90099 - DNA, 201 bp, Bos taurus; identical to SEQ ID NO: 8278

SEQ ID NO: 90100 - DNA, 201 bp, Bos taurus; identical to SEQ ID NO: 8279

SEQ ID NO: 90101 - DNA, 201 bp, Bos taurus; identical to SEQ ID NO: 8280

SEQ ID NO: 90102 - DNA, 201 bp, Bos taurus
gggaaaagattttatagacaaaagtcaatgaataatagtttgtaaaaatatgaggttataataaagtacatcatgcaaacaaaaaataaaagtgataacagaataagaaagactgcaggtaaagaaaaaatttcaggtgttgggcaagaaaatcatggtatagaacaaatgggccaaattggaaaagggacctttaaaaag

SEQ ID NO: 90103 - DNA, 201 bp, Bos taurus
aacttggttgtggcccatgacctaagtaacattttaacatgtttaggtacattttcaaatattcctggacaggctagatgaatattttttacatatactctgttcttccaaatctccaaaccaatatataaagtatattgaaatacaaacttaacaactctcagttcagagtatgactctgaatcatagtgcatttctttg

SEQ ID NO: 90104 - DNA, 201 bp, Bos taurus
tagagcaaacaactgaacaaattttggggatcagtaatccaaaataaaagattagtatatattacccaagtcacaaattctttatagatttcctatcctgaaaaggaactgatctcaaaatatagaaaattcagaccagagtggggaaggaagaggaaacatctgaataaaatgaggagatgtgacatattctaaggattt

SEQ ID NO: 90105 - DNA, 201 bp, Bos taurus; identical to SEQ ID NO: 8281

SEQ ID NO: 90106 - DNA, 201 bp, Bos taurus
ttcaacatcatggtccatttaacttttggaatcatgtgctaccaaaaagcttgactaaaataatgttttgtaaacgagactctactttgaatgtagctaaatccattataagtggatttacttaaagctggtaaaaagaatctatacttgctaatgcaaagttgtcaacatagagcatatgcccaatcacaattcttgtga

SEQ ID NO: 90107 - DNA, 201 bp, Bos taurus; identical to SEQ ID NO: 8282

SEQ ID NO: 90108 - DNA, 201 bp, Bos taurus; identical to SEQ ID NO: 8283

SEQ ID NO: 90109 - DNA, 201 bp, Bos taurus; identical to SEQ ID NO: 8284

SEQ ID NO: 90110 - DNA, 201 bp, Bos taurus; identical to SEQ ID NO: 8285

SEQ ID NO: 90111 - DNA, 201 bp, Bos taurus; identical to SEQ ID NO: 8286

SEQ ID NO: 90112 - DNA, 201 bp, Bos taurus; identical to SEQ ID NO: 8287

SEQ ID NO: 90113 - DNA, 201 bp, Bos taurus
gaatgcaaagttattcccactccaacatgaaagttctctgggcttttcgatcttgtcacatttgaaagccatgtgctccagtagaatggcccctggactgtcctcagggtacccgtgttccggtccagctctgcccagaagatgtgtaacattaggcaaagtgcttaacctcttcgaatcctagtctctctgcctgtaata

SEQ ID NO: 90114 - DNA, 201 bp, Bos taurus
ttctacagacatgaaagctccctgtgcaggtggcttctgctcaggcagagaatggggcaagaaatgaacgagagaccagggccagtcgtgtctccccatcggaaatggctttctgatagtgccagctcttaaagtttcattaaggcacaggactgcacacagacagccagggcctgattcctacattggcctggactgcgg

SEQ ID NO: 90115 - DNA, 201 bp, Bos taurus
ggaggggagagaaaccaatcacaaccactggtgacttagatggccagatcagctggtttctaagtcctgcgtagcagagactatttccaaaacttctctatctgcccctgcactgtggccagcttagcaccgcccacccagcagacctgactcactgactaccaggaggaatgtggaggagctggcgccttctcacactgt

SEQ ID NO: 90116 - DNA, 201 bp, Bos taurus; identical to SEQ ID NO: 8288

SEQ ID NO: 90117 - DNA, 201 bp, Bos taurus; identical to SEQ ID NO: 8290

SEQ ID NO: 90118 - DNA, 201 bp, Bos taurus; identical to SEQ ID NO: 8291

SEQ ID NO: 90119 - DNA, 201 bp, Bos taurus; identical to SEQ ID NO: 8292

SEQ ID NO: 90120 - DNA, 201 bp, Bos taurus
cattacagtaaagcctgcttgaattgatgctttttagtactttctttttttctttttaaatgtagttgaacacacaaagtcatagctgaaggaactgatattttcaatgcctagtattgaggcattatgtaataggagaagtatgtgtctgctgtgtagctgatatgcctcataatggggagaggggctccgagagtgcag

SEQ ID NO: 90121 - DNA, 201 bp, Bos taurus; identical to SEQ ID NO: 8293

SEQ ID NO: 90122 - DNA, 201 bp, Bos taurus; identical to SEQ ID NO: 8294

SEQ ID NO: 90123 - DNA, 201 bp, Bos taurus; identical to SEQ ID NO: 8295

SEQ ID NO: 90124 - DNA, 201 bp, Bos taurus; identical to SEQ ID NO: 8296

SEQ ID NO: 90125 - DNA, 201 bp, Bos taurus; identical to SEQ ID NO: 8297

SEQ ID NO: 90126 - DNA, 201 bp, Bos taurus; identical to SEQ ID NO: 8298

SEQ ID NO: 90127 - DNA, 201 bp, Bos taurus; identical to SEQ ID NO: 8299

SEQ ID NO: 90128 - DNA, 201 bp, Bos taurus
attgcccccacaatcagtattatataataaaaaggcaaaaccattagagagcctaaattaatctttcatcagttacacatttcaccaagttattagtcaccatttattttgatgccaatcatagaaatacaagttgtacaaataactttactaaactggtaaagggaatcccctagattctacttatactggccagaagac

SEQ ID NO: 90129 - DNA, 201 bp, Bos taurus
aagttttaggaacattgtgtgtgtgtgtgtgtgtgtgtgtgtgtgtgtgtgcattttcttgcagagagagcccataacttttagaatattctcaaaggagcccatgattcagagacacttaaaaaaccattgtttcagactaaaaaatcactaagagagaaagtttcaaaaaagagaaatcttttttaatgaaaatgtcag

SEQ ID NO: 90130 - DNA, 201 bp, Bos taurus; identical to SEQ ID NO: 8300

SEQ ID NO: 90131 - DNA, 201 bp, Bos taurus
tgaaactgcatagcaattgtttatgaaattaacgtgcattgtgtcctgcctgtggcagctcttgaaaagctgtttttaaattatgaatttaggtaatttttgaaagagaaaaatttaatatgtaaaaagcttattttacttacaattcctttacatttatactaatgtaatagaaggacctcaaaatataccaattggata

SEQ ID NO: 90132 - DNA, 201 bp, Bos taurus; identical to SEQ ID NO: 8301

SEQ ID NO: 90133 - DNA, 201 bp, Bos taurus; identical to SEQ ID NO: 49724

SEQ ID NO: 90134 - DNA, 201 bp, Bos taurus; identical to SEQ ID NO: 8302

SEQ ID NO: 90135 - DNA, 201 bp, Bos taurus; identical to SEQ ID NO: 8303

SEQ ID NO: 90136 - DNA, 201 bp, Bos taurus; identical to SEQ ID NO: 8304

SEQ ID NO: 90137 - DNA, 201 bp, Bos taurus; identical to SEQ ID NO: 8305

SEQ ID NO: 90138 - DNA, 201 bp, Bos taurus; identical to SEQ ID NO: 8306

SEQ ID NO: 90139 - DNA, 201 bp, Bos taurus
tgagagggccaagctgggggcgtgcatgacggtgggctgagtgaaccccacccactcttatcccagaaatggctactgcgtgctgtggatgccccaggagaaaacagctcaggccctcgtcttcagaactttagctttccaggttattctccctccaaacaagcaaataggttaaaaacgatcttgctcttcttctacaac

SEQ ID NO: 90140 - DNA, 201 bp, Bos taurus
aaggaaatgctcagtagataacaattctctttcccatttctttactagtctcctgaaataatattttctgatggcatacatctttaaagaagtcctcagtgtgaccaagtaccaattggggagttaagaataagtctacaggagaaagataaacccactgtttattgcttattaaatgcaaaacattcccaattattatgg

SEQ ID NO: 90141 - DNA, 201 bp, Bos taurus
ctagggatgtgtcatggcctgggatctggacaggggaaaaagatatcttctcttggaattcataaggttgcttcttcactgaggtttagagttcaaatatatatcgaaaacaatgaggccattggagccctggggaaaataatccaatattgttgaaaggacactctttaaagtcatatggaactcccactgaagatgatc

SEQ ID NO: 90142 - DNA, 201 bp, Bos taurus; identical to SEQ ID NO: 8307

SEQ ID NO: 90143 - DNA, 201 bp, Bos taurus; identical to SEQ ID NO: 8308

SEQ ID NO: 90144 - DNA, 201 bp, Bos taurus; identical to SEQ ID NO: 8309

SEQ ID NO: 90145 - DNA, 201 bp, Bos taurus
tgatgagaaatctaaactttgcccacatgaccaaaattgatatcccagactcacaggctcaagaccagggcacaacaattgagtcaaatgtccctgaacacggtgaattctacagagaggcatttgccctccttccctcagagagcaatgttaccaccctggatactctgtttttttccttcaatccttgacttggataag

SEQ ID NO: 90146 - DNA, 201 bp, Bos taurus
tcgtgcacaggcgagagaagaagatgcattttatttctgtatcatttccgacatgaaacagtattacctgcgactttatgattaaacaagtgctagctcacattacacagctcttaatgactagatttgtagatttgtgctgcagtgtcttggggctgaacatacctgagtgtgatatcctatgcttcaacacatcctatt

SEQ ID NO: 90147 - DNA, 201 bp, Bos taurus; identical to SEQ ID NO: 8310

SEQ ID NO: 90148 - DNA, 201 bp, Bos taurus; identical to SEQ ID NO: 8311

SEQ ID NO: 90149 - DNA, 201 bp, Bos taurus; identical to SEQ ID NO: 8312

SEQ ID NO: 90150 - DNA, 201 bp, Bos taurus; identical to SEQ ID NO: 8313

SEQ ID NO: 90151 - DNA, 201 bp, Bos taurus
agcgtgccaaaagcatactttttgggggggttgccaaagccaaaagttatgcattctcagcttcgattttcatataaaaactgagagtgtgttaattgtattattgtttctgaaaactgggagttgatcttccacaaggatagtagtagtagcagaaaacatgcatgacactaagtcaactccgtcacatccgaccctttg

SEQ ID NO: 90152 - DNA, 201 bp, Bos taurus
cccattcccttaaagaaagcaaaaaaaaaatcataaataatatacttctccttcaagattaccctgacatgtaagataaatgctgatactgtttctcatgggtctgactttcagtttcttgtgactcagtcaaggtctggcaactatttcctcctcattcaatgctctttggctctataaccaaaacaaaactggatttac

SEQ ID NO: 90153 - DNA, 201 bp, Bos taurus; identical to SEQ ID NO: 8314

SEQ ID NO: 90154 - DNA, 201 bp, Bos taurus; identical to SEQ ID NO: 8315

SEQ ID NO: 90155 - DNA, 201 bp, Bos taurus; identical to SEQ ID NO: 8316

SEQ ID NO: 90156 - DNA, 201 bp, Bos taurus; identical to SEQ ID NO: 8317

SEQ ID NO: 90157 - DNA, 201 bp, Bos taurus
cagtgataagagtgccctttggaaggaagaggggtgatgccagcttggcacccaggaagattgtgatgaactggcatgagttgagtctggctatccactcttcccttgttcctacccatgcttccaaacctccttttccagggatgctatgagcttcccaggattcttacaataaattatctttgcatagccatatcatag

SEQ ID NO: 90158 - DNA, 201 bp, Bos taurus; identical to SEQ ID NO: 8318

SEQ ID NO: 90159 - DNA, 201 bp, Bos taurus
tatatctgattcacactcagatagatgtagaaacatggctcatttaaaatagcataattatatgttacaaaaatagcattcatttattctttgttttccatggttaagatactgttagagtcacaggattatgtgaggctctatgggaaacattttatagggatgcatgctgacattctggtttatccccagtatgtcctg

SEQ ID NO: 90160 - DNA, 201 bp, Bos taurus
tgaaataagataagactgttgaaagataaataattttcttggaatagcagaggcatgcatgaaactaacaacacagattataaattttttgaggcattaagatatatttaatagatagcaagggtttccctagtggctcaaatggtaaagaatctgcctgcaatgcaggagaccttggtttgatccctgggtcaggaagat

SEQ ID NO: 90161 - DNA, 201 bp, Bos taurus; identical to SEQ ID NO: 8319

SEQ ID NO: 90162 - DNA, 201 bp, Bos taurus; identical to SEQ ID NO: 8320

SEQ ID NO: 90163 - DNA, 201 bp, Bos taurus; identical to SEQ ID NO: 8321

SEQ ID NO: 90164 - DNA, 201 bp, Bos taurus; identical to SEQ ID NO: 8322

SEQ ID NO: 90165 - DNA, 201 bp, Bos taurus
gcttaagtcagagagagagagattaatttgaactccacaaatggcaaatcttgaagactgcagagaaaattatctgctggtataaatcttattaagtctatctgtttatgatgttttactttctaattattcactttaatgctttatctcctatgatttttttcaacatttgttcagtaaagcttgtagactcagactttg

SEQ ID NO: 90166 - DNA, 201 bp, Bos taurus
agtgggatttgagttgtactctgaagttcaaattacctgcttctctggcctacaacactctaaccctactgtggtgataaaaattcctcctatagtaatttctgagtgttggtctctgcttttaatgcttttgcatatcgctgcaggagagcctacattttaagaccttacaacctctttctaagtgagtttttcaaatat

SEQ ID NO: 90167 - DNA, 201 bp, Bos taurus
tctaggtgttagaatcttaatttcatttctcctcttctaagtttttggcctttgcagattcttagagagttgcctccatctgttaatatattttttgtagatatggggcataatatagttgggctagatgctcttgcaagtatcaaaaacaaataccaaacttttaaacagcacctttaagttcttgttttgatgtctcat

SEQ ID NO: 90168 - DNA, 201 bp, Bos taurus; identical to SEQ ID NO: 8323

SEQ ID NO: 90169 - DNA, 201 bp, Bos taurus; identical to SEQ ID NO: 8324

SEQ ID NO: 90170 - DNA, 201 bp, Bos taurus
ctcatatcattttctcctcctcccttggctcttcatatgcagctccactccatcacttgcagagtaagataaccgtgttcacacgtctctctctcactgcataggcccaaagagagactttgtcttattcttctgtgaagtaaaagtcactcaatcatgtctgactatttgcaacccaatggactatatagtccatggaat

SEQ ID NO: 90171 - DNA, 201 bp, Bos taurus; identical to SEQ ID NO: 8325

SEQ ID NO: 90172 - DNA, 201 bp, Bos taurus
agatcttgagtcccaagtcaacacctccctcctataagcccattctctttaccaacaggaaattcagtatttctaaaagtatcttccttcatcaagctcgaaattgcagctagttaagtgtttctacctctgagtccataagatttgaaccttttaatactttaatgagaaagcattaaaacacaggtcaataggaaataa

SEQ ID NO: 90173 - DNA, 201 bp, Bos taurus; identical to SEQ ID NO: 8326

SEQ ID NO: 90174 - DNA, 201 bp, Bos taurus; identical to SEQ ID NO: 8327

SEQ ID NO: 90175 - DNA, 201 bp, Bos taurus; identical to SEQ ID NO: 8328

SEQ ID NO: 90176 - DNA, 201 bp, Bos taurus; identical to SEQ ID NO: 8329

SEQ ID NO: 90177 - DNA, 201 bp, Bos taurus; identical to SEQ ID NO: 8330

SEQ ID NO: 90178 - DNA, 201 bp, Bos taurus; identical to SEQ ID NO: 8331

SEQ ID NO: 90179 - DNA, 201 bp, Bos taurus; identical to SEQ ID NO: 8332

SEQ ID NO: 90180 - DNA, 201 bp, Bos taurus
aaaacaaaactcctaaacttctttttaaagaaaaattgtaataaattaaattatagggttagtataagaaatgtaacattcttcagtgcagtaataatacacttcagtttatcagatacatgaaaaaaacgattttttaacataatattagaacttaccatttctcatctcatatatactcttgctttcttaaaggaatag

SEQ ID NO: 90181 - DNA, 201 bp, Bos taurus; identical to SEQ ID NO: 8333

SEQ ID NO: 90182 - DNA, 201 bp, Bos taurus
aggggacttctctgttggaaatttttttttttaagcagagatctgatttcttgttgttagtgacagtcatctagattaaaatgtatttcagggctgtccagttttttaaaatacaaaccaccccaacttctagaatatgtgtttttgacatcctctttgcttattttcagctgagaaaaaagccccgactgcccctgtttg

SEQ ID NO: 90183 - DNA, 201 bp, Bos taurus; identical to SEQ ID NO: 8334

SEQ ID NO: 90184 - DNA, 201 bp, Bos taurus
agtgccctacccaagcacctccactccacccctgcctgcctgccacctgcctccatctccccctctccttcagagtgcaggaatgtgtgaagagccacagtatggccttcctgcctggcaaggtacccacaggaaacactcctatttctgagctgacttctttccagcactccacccagctctccttttctgagaaccccg

SEQ ID NO: 90185 - DNA, 201 bp, Bos taurus
gctcctcaaggatggggcacatcttccacatgtatgtgtagagcagagcagaaagaaatgaggcaaaaagaagaaaataaagccaagaaatgacagtaacgtgttatatggacggggagtcatgtgcttatttcttctcttcctgttttccatattttctagcatgtggattatttttaaactttttttaacaaatcagtt

SEQ ID NO: 90186 - DNA, 201 bp, Bos taurus; identical to SEQ ID NO: 8335

SEQ ID NO: 90187 - DNA, 201 bp, Bos taurus
aacccaatgtattccagagtaatgaacagacatgtaatgtgccatcatggagctatgcactaatgctaagggacccagaggaggagcaaccattagcctacgggcaagaagtacttgtaaggccagagtaggaattaccaggtggagtcaaaggggagatgatcagcatcagatactaaggtgcaagcaacataagggagt

SEQ ID NO: 90188 - DNA, 201 bp, Bos taurus
gcatttaatcatcacttgtcttcaacagttaatcaacataagcttatttcattgacaccctgctttgtccacctcagaccccaactcaaatctcagcacacactttgtttgtaaatacatcttttttaacctaatatttatttatatgaataggcttagtttgtctgatctattgattactaatgttaattatttctgtta

SEQ ID NO: 90189 - DNA, 201 bp, Bos taurus; identical to SEQ ID NO: 8336

SEQ ID NO: 90190 - DNA, 201 bp, Bos taurus; identical to SEQ ID NO: 8337

SEQ ID NO: 90191 - DNA, 201 bp, Bos taurus; identical to SEQ ID NO: 8338

SEQ ID NO: 90192 - DNA, 201 bp, Bos taurus; identical to SEQ ID NO: 8339

SEQ ID NO: 90193 - DNA, 201 bp, Bos taurus; identical to SEQ ID NO: 8340

SEQ ID NO: 90194 - DNA, 201 bp, Bos taurus; identical to SEQ ID NO: 8342

SEQ ID NO: 90195 - DNA, 201 bp, Bos taurus
cctctgaaacccactgcatactgtaaaccagaggtggcccaaagagatgcaaagtcagatgcaccggatagaaatataaacctggtgtgggtcttggaagaaccctaatgtggcccactcaacagagcttccaggtaaactaaaaggatgagttacctgtccagcaatgaggatacagggaaagaagatcaggcatctgaa

SEQ ID NO: 90196 - DNA, 201 bp, Bos taurus; identical to SEQ ID NO: 8343

SEQ ID NO: 90197 - DNA, 201 bp, Bos taurus
agtccaatctttgctactatgaaccataaaagaggtatcatctataaacacacaacaaaatttttgtctttatgcatcaggggccttaaaaataataacatatgatccacttctgagaaatgatcctaagtaaataatctgaaaaacaaataggctaggaggtaaagatgtgaattatgatgactacttacaatagtgaaa

SEQ ID NO: 90198 - DNA, 201 bp, Bos taurus
aacagtttgaaaaattacttaactgttttttgtgtgtgtaaaaaaaaaaaaaaaaagtgtaaaactggtgatatctactctttcctcccaggatttttggagaatgttagaacttgcataggaaactgtgaaaaattattgttgcttttcataatcaagtctaaacctcatgaatttgggttcttctccagtctctccttg

SEQ ID NO: 90199 - DNA, 201 bp, Bos taurus; identical to SEQ ID NO: 8344

SEQ ID NO: 90200 - DNA, 201 bp, Bos taurus; identical to SEQ ID NO: 8345

SEQ ID NO: 90201 - DNA, 201 bp, Bos taurus
cacgcgttctacgtaactcccaactagcacgagctctaagcagattccaccatatttattgtggtcaagaatggatttttctccttctgagatcattattgctcaaaatacaaatcttttggatctttgctagtcttcagaactcgagatgaaacaggagagaggagaacaaaaaggggcagggtcgcgctagatctgcca

SEQ ID NO: 90202 - DNA, 201 bp, Bos taurus
tatggaagtcaatttgccgagttcaaggctgtgttttttctgatctcaaatcacctagcaactttagattcaggcagaagttgaagtttattttactaaatatggaaaagcttttaaaccaacatttttgaggtaaatctgtagcaaaagtgaggccacctgctgttaaggagagtgcttacacatttgagcacatttctg

SEQ ID NO: 90203 - DNA, 201 bp, Bos taurus
tggtctcacctgaaaccatgagccctgatagcaggtttctcctgtggtaggcagaattctaaaaagccctcatgattcctggcccttggtgtacacatacgttttctcaggtattcaaacactactctagatgttgctgtggaaggattttgcactcataattaaggttccaaatcagttggccttcaggcagggaaataa

SEQ ID NO: 90204 - DNA, 201 bp, Bos taurus; identical to SEQ ID NO: 8346

SEQ ID NO: 90205 - DNA, 201 bp, Bos taurus; identical to SEQ ID NO: 8347

SEQ ID NO: 90206 - DNA, 201 bp, Bos taurus
tttttaacagaagttttaacagccagcactctgtttgccctatgctttttcctctttgcaacaacaaatccaaaatgttgacagaggctgtttcctcatttctgggccccaaactgaagccaagatatggcaaagactcagctggcagaggacatacattatgagcaagaaataaactttatcatttgacactactggaaa

SEQ ID NO: 90207 - DNA, 201 bp, Bos taurus
gaaagaagaccactgtctatgaccaggaagccctcagaagacactttctgctagcactttgatcttggacttcctacttcttgaaccataagaaataaattcctgttgtttagaagccaccaagtctatggtattttactacttcagcccaaacacagctctacttagccttagatctcatctcattgtcacctcctcaag

SEQ ID NO: 90208 - DNA, 201 bp, Bos taurus; identical to SEQ ID NO: 8348

SEQ ID NO: 90209 - DNA, 201 bp, Bos taurus; identical to SEQ ID NO: 8349

SEQ ID NO: 90210 - DNA, 201 bp, Bos taurus; identical to SEQ ID NO: 8350

SEQ ID NO: 90211 - DNA, 201 bp, Bos taurus; identical to SEQ ID NO: 8351

SEQ ID NO: 90212 - DNA, 201 bp, Bos taurus; identical to SEQ ID NO: 8352

SEQ ID NO: 90213 - DNA, 201 bp, Bos taurus; identical to SEQ ID NO: 8353

SEQ ID NO: 90214 - DNA, 201 bp, Bos taurus; identical to SEQ ID NO: 8354

SEQ ID NO: 90215 - DNA, 201 bp, Bos taurus; identical to SEQ ID NO: 8355

SEQ ID NO: 90216 - DNA, 201 bp, Bos taurus
ggtttaaaggtcctgctctcaccagggccaggctagaccgtgcagcgcctaacacaatggggtgggggaggcagtgaggtaacacaagcctgtgctgggggtgggtgtagccaaggccaaatacttcatgtaggtgcaacctgcataactgcacacggagagcttggttctcctgcagctcatcctccacgtttgtgccaa

SEQ ID NO: 90217 - DNA, 201 bp, Bos taurus; identical to SEQ ID NO: 8357

SEQ ID NO: 90218 - DNA, 201 bp, Bos taurus; identical to SEQ ID NO: 8358

SEQ ID NO: 90219 - DNA, 201 bp, Bos taurus; identical to SEQ ID NO: 8359

SEQ ID NO: 90220 - DNA, 201 bp, Bos taurus; identical to SEQ ID NO: 8360

SEQ ID NO: 90221 - DNA, 201 bp, Bos taurus
tttgcagccgagcagccagcacagggcctagctcattcctggcattcagaaaattttcaatgaatgactgagtttgcaattcaaaagggcccacaaagatgacatcttttaaggagtctgtccagctaacaaagacacccttttctcatagaactgaccctagacaccaactggactggagatggacatctgatctgagct

SEQ ID NO: 90222 - DNA, 201 bp, Bos taurus; identical to SEQ ID NO: 8361

SEQ ID NO: 90223 - DNA, 201 bp, Bos taurus
agtccaaggaggagcatgttgagtgttgtggggccaggttctgaaaacaagaatgttgttgtacatgaaaataattacacaaggggttaccatttttactgttatgttccaggccaagagatttgccatcgtgctttgatttaattctgttttaacggtttcgaaatgtaggtggcattcagttttatcaaagaggaagtt

SEQ ID NO: 90224 - DNA, 201 bp, Bos taurus
tacagaagcaggccacaggccagatttcctccctgggctatagcctgctgacccctgctctagatcagcactgtccagtagaaatataatttgaaccatgcatgtaatttaaaattttctagtggccacatttaaaaaataaaaagaagcagatgaaatgaattctactacaatattttaccagttatatccaaacttgtt

SEQ ID NO: 90225 - DNA, 201 bp, Bos taurus; identical to SEQ ID NO: 8362

SEQ ID NO: 90226 - DNA, 201 bp, Bos taurus; identical to SEQ ID NO: 8363

SEQ ID NO: 90227 - DNA, 201 bp, Bos taurus; identical to SEQ ID NO: 8364

SEQ ID NO: 90228 - DNA, 201 bp, Bos taurus; identical to SEQ ID NO: 8365

SEQ ID NO: 90229 - DNA, 201 bp, Bos taurus
agtccatcacatactataagggggctggcatcaatatgtgcactcactctggtccttgtgaccaagtccatcatcagccccacaaatagctgcttctcaatcatccctcagagcctagaagcaggatctgtgctatctgagcaaggaattctgtgatgctggagacctagaggagtcttgagtaggagagagtgtgggctc

SEQ ID NO: 90230 - DNA, 201 bp, Bos taurus; identical to SEQ ID NO: 8366

SEQ ID NO: 90231 - DNA, 201 bp, Bos taurus
ccatggggtggcaaaaagttggacacaactgagcaactagtgactgactgactgactcaaagaacagccttcccagaacaatgatccagccccaaatatcagtacttctgagtgtttgatacgtgaattttaacatcttgaacatgtgcccttggacctgcctgctgcaggatgctgaaccaggaaagtataaagtcccag

SEQ ID NO: 90232 - DNA, 201 bp, Bos taurus; identical to SEQ ID NO: 8367

SEQ ID NO: 90233 - DNA, 201 bp, Bos taurus; identical to SEQ ID NO: 8368

SEQ ID NO: 90234 - DNA, 201 bp, Bos taurus; identical to SEQ ID NO: 8369

SEQ ID NO: 90235 - DNA, 201 bp, Bos taurus; identical to SEQ ID NO: 8370

SEQ ID NO: 90236 - DNA, 201 bp, Bos taurus; identical to SEQ ID NO: 8371

SEQ ID NO: 90237 - DNA, 201 bp, Bos taurus; identical to SEQ ID NO: 8372

SEQ ID NO: 90238 - DNA, 201 bp, Bos taurus; identical to SEQ ID NO: 8373

SEQ ID NO: 90239 - DNA, 201 bp, Bos taurus; identical to SEQ ID NO: 8374

SEQ ID NO: 90240 - DNA, 201 bp, Bos taurus; identical to SEQ ID NO: 8375

SEQ ID NO: 90241 - DNA, 201 bp, Bos taurus; identical to SEQ ID NO: 8376

SEQ ID NO: 90242 - DNA, 201 bp, Bos taurus; identical to SEQ ID NO: 8377

SEQ ID NO: 90243 - DNA, 201 bp, Bos taurus; identical to SEQ ID NO: 8378

SEQ ID NO: 90244 - DNA, 201 bp, Bos taurus
ttctttaccattttagccaccaaggaagccaattatcttctttattagttagttatcaattaagtacagaataaaaaaaatcatatataaatacaatgtgaaacaacacacatacatgcattaacacacacagaaccatgaaggaaataaaggataaatcactctttgactccacttttccagtgctctcccaggcctttt

SEQ ID NO: 90245 - DNA, 201 bp, Bos taurus; identical to SEQ ID NO: 8379

SEQ ID NO: 90246 - DNA, 201 bp, Bos taurus; identical to SEQ ID NO: 8380

SEQ ID NO: 90247 - DNA, 201 bp, Bos taurus; identical to SEQ ID NO: 8381

SEQ ID NO: 90248 - DNA, 201 bp, Bos taurus; identical to SEQ ID NO: 8382

SEQ ID NO: 90249 - DNA, 201 bp, Bos taurus
ccaacgcagaggcaaaatctctcatgtgggccaaagggagtccttcatcactttggcaaattgcccgagtgctccgagatccttttcctctgtaagacgtggctaaggccctctgtccctcagtacattttacacccgatcctttgtagttgtctgggctattgaagatcatatgaataatgtatgtcacacaggagggaa

SEQ ID NO: 90250 - DNA, 201 bp, Bos taurus
aaaaataagatttatttatttattttggcatctgtgtcagtacaggctggttcataaaagcacgtggtcgaaatggatatgctgtgactgaggaagctgaatttcaaaaccagctgctctgtctctgggattattgctatgtcagctcggatcaaccttctgtcatcaaaggacgttctcatgggaggctaagcacccaat

SEQ ID NO: 90251 - DNA, 201 bp, Bos taurus
aaaggacttggaactgctccacatctcagttttctcctctgcaaaatgggcatatccccttctgctctaccttctgatcaagattttaggaaggccaaattaaggaatatttggtaactatcaaataccacacaggtgtttttagagacaccttcctagtgtgatttcaggaatgcaagataaggctctctacctgcccac

SEQ ID NO: 90252 - DNA, 201 bp, Bos taurus; identical to SEQ ID NO: 8383

SEQ ID NO: 90253 - DNA, 201 bp, Bos taurus; identical to SEQ ID NO: 8384

SEQ ID NO: 90254 - DNA, 201 bp, Bos taurus; identical to SEQ ID NO: 8385

SEQ ID NO: 90255 - DNA, 201 bp, Bos taurus; identical to SEQ ID NO: 8386

SEQ ID NO: 90256 - DNA, 201 bp, Bos taurus; identical to SEQ ID NO: 8387

SEQ ID NO: 90257 - DNA, 201 bp, Bos taurus
caacataatgcagagaggtttatatgaagctgctctgtaccaacacattcctaaataacagaagaagaaaacagttctagaggatattctacagagtctataagcatttcccctagtcacaggatgtcagtgtgataaaaggcacattaaggaggaaaggatctgcctttctcaaccctacagactgttcactgtaaaaat

SEQ ID NO: 90258 - DNA, 201 bp, Bos taurus; identical to SEQ ID NO: 8388

SEQ ID NO: 90259 - DNA, 201 bp, Bos taurus
taattgaactgaaatcagaagacctgaattatcatcattgttcattctctgactaatcatgtcatttatattctctaggccccttcgttatttaagaaacatatacaataaaaacgattgctttctatatcttttggagttgtttaaagattatgctgaaatgctttgaattataaaataagatataaaatatgagattca

SEQ ID NO: 90260 - DNA, 201 bp, Bos taurus
aataacactaagcaggctacgtaagttcttacagtttctgattagcaaataaaatttgcttaatttggtactactgtacattctagatttggaaaagttaataaaggccatctagtctggactcttcactttatacataaggaatcatgctaagagagagggtaaggaccttgcctaagatcacaaatgatgttgggcaat

SEQ ID NO: 90261 - DNA, 201 bp, Bos taurus; identical to SEQ ID NO: 8390

SEQ ID NO: 90262 - DNA, 201 bp, Bos taurus; identical to SEQ ID NO: 8391

SEQ ID NO: 90263 - DNA, 201 bp, Bos taurus; identical to SEQ ID NO: 8392

SEQ ID NO: 90264 - DNA, 201 bp, Bos taurus; identical to SEQ ID NO: 8393

SEQ ID NO: 90265 - DNA, 201 bp, Bos taurus
gcagattcgcagttatatttgggtgtgggtccagggaatcccttaatctccacttccagaatacattcattttgtgtcttgaacaatccaccagacccattgcttctcaaatcaccacacttggcagtggtggggggtatgcagaggggctagagttggtaaaagacagaagaaaaatactaagtgggcagggaatgtcac

SEQ ID NO: 90266 - DNA, 201 bp, Bos taurus
tgtctacctggtctaccctgtgaaggggtagatctataattggaattctctcttaacacctttgtttttcatgctattctaaagctcctgtggatccaagcatctgctacaggaaaagaatcatgtcaaatcgttatggtactaatggtacagagaatagcatgacaaagatgtactgaggcattctcttatttgggactg

SEQ ID NO: 90267 - DNA, 201 bp, Bos taurus
aaagtgcattctcttttcactgttaattaaggcacagggccacaggcaataccatcgatcctgtctagtcataaggcatttctctgagttcttactaatacagagaactaggcttaaccaaaggaacttctgttatgcaaatccaagtcatgcccaaagtgtaatcaaatcctgatgaccaaaaatagtcttctcataaga

SEQ ID NO: 90268 - DNA, 201 bp, Bos taurus; identical to SEQ ID NO: 8394

SEQ ID NO: 90269 - DNA, 201 bp, Bos taurus
taagagggcggagaggcccgaaacaggttttcacctggaccctacgcgacacaagctctccagagaaggaaggccgcatgcacaggccccggcctgcctcgcccttcctccccgtaccctgcccaggccaaggccccagggctccagcgtcatcgggccttaccttggctgcagtccttgccacggaagccagttcgcgag

SEQ ID NO: 90270 - DNA, 201 bp, Bos taurus; identical to SEQ ID NO: 49817

SEQ ID NO: 90271 - DNA, 201 bp, Bos taurus; identical to SEQ ID NO: 8395

SEQ ID NO: 90272 - DNA, 201 bp, Bos taurus
catagctaggattgcctttggcataatatagacataaaaatgatatacttttcaccttataaatagtttctatctaggtggaggagacaggctaattaacgaggccagcgattcatagattaagatggaacaatatcatattggtcaaaatgtatattgtataattctgaattgagtgatctgcaaatcagaagcaaaaac

SEQ ID NO: 90273 - DNA, 201 bp, Bos taurus; identical to SEQ ID NO: 8396

SEQ ID NO: 90274 - DNA, 201 bp, Bos taurus; identical to SEQ ID NO: 8397

SEQ ID NO: 90275 - DNA, 201 bp, Bos taurus
agtatttctactaagagaaaggtgctaaaatcccaaatcagatatttggatttaatgaatttttatatatgttctgattcattagctgccattcccatcttctcattaatatgatatgagatactcagatttttttatttgctttctttttcttattggggccaagactgaataaagaatattgtgtcagatattttgcaa

SEQ ID NO: 90276 - DNA, 201 bp, Bos taurus; identical to SEQ ID NO: 8398

SEQ ID NO: 90277 - DNA, 201 bp, Bos taurus; identical to SEQ ID NO: 8399

SEQ ID NO: 90278 - DNA, 201 bp, Bos taurus
gaattctccaggccagaatactggcatgggtagccattccctttcttcaagggatcttcccaactcagggatcgaatccaggtctcccgcattgaaggccaattctttaccaactgaaggattagggaagccctatcactctctcagttcagttcagtcactcagtcttgtccaactctttgcgaccccatggactgcagc

SEQ ID NO: 90279 - DNA, 201 bp, Bos taurus; identical to SEQ ID NO: 8400

SEQ ID NO: 90280 - DNA, 201 bp, Bos taurus; identical to SEQ ID NO: 8401

SEQ ID NO: 90281 - DNA, 201 bp, Bos taurus
aaacaagtggtctggggacacatgaagtttccaccattttatttgtagtttatttattaagagcaaaaaacagcaagtaaaatagggccctgtctgaaaatggacacccaagaatgccaagagactgagagcatgctcaataatgcagagtagcagtcgtgctcggcaaatccattccatggcccactcgtttctgtctgc

SEQ ID NO: 90282 - DNA, 201 bp, Bos taurus; identical to SEQ ID NO: 8402

SEQ ID NO: 90283 - DNA, 201 bp, Bos taurus
aatctttccacaacagtactatagacctgctagtactaagataataatcaaactgaaagtgcttcttcaaacaaatatttctatgaccaaacaagaaatataattaggcgaatatacctccaacaatatagttgttgctgttcagttgctaagtagtgtctgactcttggcaaccgcatggactgcagcatgccaggctcc

SEQ ID NO: 90284 - DNA, 201 bp, Bos taurus
tgagccacaaaagatcaagagaattatgaatcatataaaacaagggtatagaaagtataaagaacgacagaaatgtcaaacctgctttggaaacttttaagattaacctacaataccaggttcactggtacagatatgaagatgctactgtcagcagcaaaagaaagctcacttcacccttcaagactagaaatgttcata

SEQ ID NO: 90285 - DNA, 201 bp, Bos taurus
caaaagaatgttctttagtattttctttaatttaggcctgctggtgattcaaaactgttttagattttttttgtctccatgtttttttattttaccttcattcttgaaaaatatctttgctgtgagtagaattctaacttgccatttattttttcagttccttgtggatgccatgacagtgttttggcatccattgcttta

SEQ ID NO: 90286 - DNA, 201 bp, Bos taurus
ctctgtgtttctccactgcttccctttcctcacccacctgcttctccacttcaaccttctcctcctggttcgctgcttctgagaacatggggcccctttcggtctttgctttcgcagccttccatccagccgtcagctcagactctgatctcccagtgtcacaggtttctagggccttctccccaccagtttcacactgaa

SEQ ID NO: 90287 - DNA, 201 bp, Bos taurus; identical to SEQ ID NO: 8406

SEQ ID NO: 90288 - DNA, 201 bp, Bos taurus; identical to SEQ ID NO: 8407

SEQ ID NO: 90289 - DNA, 201 bp, Bos taurus; identical to SEQ ID NO: 8410

SEQ ID NO: 90290 - DNA, 201 bp, Bos taurus; identical to SEQ ID NO: 8411

SEQ ID NO: 90291 - DNA, 201 bp, Bos taurus
tgtattgattattgtctatggattaatgtaagtgaaataaaaaactaaccacaaggtcatttgaattatgacatgcatttagctgtatgaaatgaggaggtcaaagcttgataaacttcagtaaataattttatcaccctccaccccctttagaggtaggaaaaggaattttactcagtacaactgccttttgagcagtga

SEQ ID NO: 90292 - DNA, 201 bp, Bos taurus
agatacttttttcccagagttagctggaagtttatttcaatatttgagtacagtagggactttgtacattttgttccttacagtatgctagcacagagaatggttcctggcacatgataggtactcattaaacacttatatactgaatggacattaattaggatttttttgtgtgtgcagattcttatgtatcattagaaa

SEQ ID NO: 90293 - DNA, 201 bp, Bos taurus
acatgtgctcttcatctggggcagccctgcatttaactggcttgttcacacttctgcttaagcttctgtggaacaaaggtgactttttacaaagtttgaacacccatgatctaacccagagaggccaacagaagcaacatttggatgcatgagctgggtttctggaccagagaatagatggtcccagatgacaccatttct

SEQ ID NO: 90294 - DNA, 201 bp, Bos taurus
ggagttggtgatggacagggaggcctggcgtgctgcgattcatggggtcgcaaagagttggacacaactgagtgactgatctgatctgatggtggttttgctattttggccgccatttagtctcaggctctgtttccttcacaattgctcatttacagtgggttctactgtttcttttcccttctctgttcttactgttgt

SEQ ID NO: 90295 - DNA, 201 bp, Bos taurus
aggtctgttaaggttaggactgctgtcttttgcagactctcactttaagccaagtctttgcccagcagaccacaatgcaacaaagaggatttggggcccagtgtacttggttttgccaaatattcactgctctgataaatcatctattagctaagctaactttggggaattatctatggaatttaattctatttgctggcc

SEQ ID NO: 90296 - DNA, 201 bp, Bos taurus; identical to SEQ ID NO: 8415

SEQ ID NO: 90297 - DNA, 201 bp, Bos taurus
acacataggagcatccctggtatcttattatttagaaagagaaaatacaccatttgtgcaacatgatagagtaagagtttgttctttttcctctggtaaaaaagtttgattaaatttctcataagttggtctattttgggctgcagtcatgaaatttttgtgaagggcaagtctgggaaaaaaatgaacactgaatttgaa

SEQ ID NO: 90298 - DNA, 201 bp, Bos taurus; identical to SEQ ID NO: 8417

SEQ ID NO: 90299 - DNA, 201 bp, Bos taurus; identical to SEQ ID NO: 8418

SEQ ID NO: 90300 - DNA, 201 bp, Bos taurus
gtgttcatatttcatttcttccaatgttacacatgtgaaaaaacactagggatttcccttgtgatccagtggctgactctgcactcccagtgccatgggttccagtttaatccctggtcagggactagatcccagatgccttaactaagagtttgtatacagcaatggaaagattccacaggccacaaggaaaatcgaaga

SEQ ID NO: 90301 - DNA, 201 bp, Bos taurus
tttatgttggtccattcaagtgagtgcattttctatgattctgcaggaagggctttatagtttttaaaaggggtcaaggcaggaacactgatttaaatacactgctgtcaatttggcctcacatatctgcattcatatatcccaggagtttaaacaaataggcaaaggcttttcattgacacaatgtctgttcaaataaaa

SEQ ID NO: 90302 - DNA, 201 bp, Bos taurus
caataacttaattgtatctgttatgagccttctattctacaagaaggagtgagaaggtttgatatgcacacttgtgtgtagggagagatggatagtaaaaaaagttagaaagaaggaatataagcggggaagttgactcaggcatgaagtgatttaattccatcttgtggcaagggagtatgtaaacatgaagctaagagt

SEQ ID NO: 90303 - DNA, 201 bp, Bos taurus; identical to SEQ ID NO: 8419

SEQ ID NO: 90304 - DNA, 201 bp, Bos taurus; identical to SEQ ID NO: 8421

SEQ ID NO: 90305 - DNA, 201 bp, Bos taurus; identical to SEQ ID NO: 8422

SEQ ID NO: 90306 - DNA, 201 bp, Bos taurus; identical to SEQ ID NO: 8424

SEQ ID NO: 90307 - DNA, 201 bp, Bos taurus; identical to SEQ ID NO: 8425

SEQ ID NO: 90308 - DNA, 201 bp, Bos taurus; identical to SEQ ID NO: 8426

SEQ ID NO: 90309 - DNA, 201 bp, Bos taurus; identical to SEQ ID NO: 8427

SEQ ID NO: 90310 - DNA, 201 bp, Bos taurus; identical to SEQ ID NO: 8428

SEQ ID NO: 90311 - DNA, 201 bp, Bos taurus; identical to SEQ ID NO: 8429

SEQ ID NO: 90312 - DNA, 201 bp, Bos taurus; identical to SEQ ID NO: 8431

SEQ ID NO: 90313 - DNA, 201 bp, Bos taurus; identical to SEQ ID NO: 8432

SEQ ID NO: 90314 - DNA, 201 bp, Bos taurus
caaattcctgaccttgtaaaatttatagtcaagaaacagataacaagcaaaataaataaatgaatcacatgctatttcatgtgataaatgcaatgagaaatgatccatttattggttcagttcagttcagccactcagtcaggtccgattttttgcaacccatggactgtgtcacgccaggtctccttgtccatcaccaac

SEQ ID NO: 90315 - DNA, 201 bp, Bos taurus; identical to SEQ ID NO: 8434

SEQ ID NO: 90316 - DNA, 201 bp, Bos taurus; identical to SEQ ID NO: 8435

SEQ ID NO: 90317 - DNA, 201 bp, Bos taurus; identical to SEQ ID NO: 8436

SEQ ID NO: 90318 - DNA, 201 bp, Bos taurus; identical to SEQ ID NO: 8437

SEQ ID NO: 90319 - DNA, 201 bp, Bos taurus
cttatattctcttgaaaaggcccaggtctccagatcccaggatgagatttgagatttatgctgatttcctctgtgcgtccaccctctgtcctgtggaccccggccacaaccctcccctctgatggcagcgaggtccccgatgctgggcccatggcagctcagatgtacgtgcttctgcttatggaaggcgaggctcttcac

SEQ ID NO: 90320 - DNA, 201 bp, Bos taurus
accacttcctgataacagtgacttcggtgggatttccggtggcatttcccacaatagttatgctgtttgacttattctttcggttgctatttatactcctgatctttatgctttactgactgagtcactcgggtataaagcttttcttacctaaaatcagactaagagaatatccaatgggtgcctgagcccacgccaagc

SEQ ID NO: 90321 - DNA, 201 bp, Bos taurus
cctgctgtgtgcatcggaatcacctggagggctttccaaacacaggctgctgcctcccatctcaagcttctgattcagtaggtctgggctgtggcccagctaatagtttcacctcacatactgttggtgtgttctggggaccccccacttgagaaccactggcttagattgtgagttggccacaaattaggttctcaccta

SEQ ID NO: 90322 - DNA, 201 bp, Bos taurus
ggccaatacccataacagctacttctttaggacaaaatacagcagtcaaaagtctctctctctctgtgttgctgtaatgaagaaataaaagaaccagactatttttcaaggtaggcctcaactatccagcttccacaggtaaaatactgcttttgccatctgatcccatgatctaggctcactaaagcaactttctctgca

SEQ ID NO: 90323 - DNA, 201 bp, Bos taurus
tgcactccctgaatagaattcaatttagagaagttaacactcaggttatctcttagaggatattgggagttttccaggcagtcaggaaggacaacgcgtgaagaggtgatgaacagaaataatcacaaatgactctgcatatctaagacgaagaggtgtttggatataagagaaggtgagggcgatttacaaggttcagat

SEQ ID NO: 90324 - DNA, 201 bp, Bos taurus
gctgcccattggactcatttgaagacctgaggcctgggtgccttccaggggcactgggacttttttaaagatattacttcttttataattaaaaaatttattatttatgtatttttggccgtgctgggtcttcgttgctgggcgtggactttttctagttgcagcgctactgattgcgttgccttctcttgttgtggagca

SEQ ID NO: 90325 - DNA, 201 bp, Bos taurus; identical to SEQ ID NO: 8445

SEQ ID NO: 90326 - DNA, 201 bp, Bos taurus; identical to SEQ ID NO: 8446

SEQ ID NO: 90327 - DNA, 201 bp, Bos taurus; identical to SEQ ID NO: 8447

SEQ ID NO: 90328 - DNA, 201 bp, Bos taurus; identical to SEQ ID NO: 8448

SEQ ID NO: 90329 - DNA, 201 bp, Bos taurus
cagaactgtgagccgaggtaggaataggccacctggaaatccacctaaatgtcctcctgccccaagaatactgcgtgaagcctgtcagcctctaggatctctccatggaaaagggattttgttggccaaattgaggtcaggtgaaagagatcagggaacaccagtgatggtttaagtgttacactaactggaaggttaact

SEQ ID NO: 90330 - DNA, 201 bp, Bos taurus; identical to SEQ ID NO: 8450

SEQ ID NO: 90331 - DNA, 201 bp, Bos taurus; identical to SEQ ID NO: 8452

SEQ ID NO: 90332 - DNA, 201 bp, Bos taurus; identical to SEQ ID NO: 8453

SEQ ID NO: 90333 - DNA, 201 bp, Bos taurus
atcagaatggccaagtaaaatgtttccaggtttaaaaataggcacttacacaaaggcatgttttttaatcccaacgtttttgatgacattatctactctatgtccagcacgacgatgcagaaggccacttatttcactacttcacaaatcagaaattatctcattatgcttctatttatgtcttcttccacccagactttt

SEQ ID NO: 90334 - DNA, 201 bp, Bos taurus
acacttctaagaagttcagggaagggcctcatgaaaagagtagccctggatctgagtgtagaataggggttctcagccaggggctctttggcccccagagaacatttgccagtctctagaggcatttaaaaaaatttcatgtatttatttagctgtaccaggtcttagttgcagcatgtgggatctggttccctggccagg

SEQ ID NO: 90335 - DNA, 201 bp, Bos taurus; identical to SEQ ID NO: 8455

SEQ ID NO: 90336 - DNA, 201 bp, Bos taurus; identical to SEQ ID NO: 8456

SEQ ID NO: 90337 - DNA, 201 bp, Bos taurus; identical to SEQ ID NO: 8457

SEQ ID NO: 90338 - DNA, 201 bp, Bos taurus; identical to SEQ ID NO: 8458

SEQ ID NO: 90339 - DNA, 201 bp, Bos taurus; identical to SEQ ID NO: 8459

SEQ ID NO: 90340 - DNA, 201 bp, Bos taurus
acaacgctcatcacaggctgcaccaatgctgcgggtctggtggtggtgggaaacttccaggtacacccgcctgccggcctttcagcttcctctagagggacagcgatgggggcaggggatgaagaggtggaggggaggggctgatctgtgctccctctctgggcccaggtggaccacgctaagtctctgcactatgtcgga

SEQ ID NO: 90341 - DNA, 201 bp, Bos taurus
ggtcccctcacagcaaacaagttattaggtgtttctgccaggagcttccttccactccaagcccacctggcctggccagggccctgtcctttccacccccgggatgtctctccttccagtgactcagaactctcacctgcatggatgatgactctggccagggctgtggccacctcaggcctgacccttcaggcagccaaa

SEQ ID NO: 90342 - DNA, 201 bp, Bos taurus; identical to SEQ ID NO: 8460

SEQ ID NO: 90343 - DNA, 201 bp, Bos taurus; identical to SEQ ID NO: 8461

SEQ ID NO: 90344 - DNA, 201 bp, Bos taurus; identical to SEQ ID NO: 8462

SEQ ID NO: 90345 - DNA, 201 bp, Bos taurus; identical to SEQ ID NO: 8463

SEQ ID NO: 90346 - DNA, 201 bp, Bos taurus; identical to SEQ ID NO: 8465

SEQ ID NO: 90347 - DNA, 201 bp, Bos taurus; identical to SEQ ID NO: 8466

SEQ ID NO: 90348 - DNA, 201 bp, Bos taurus; identical to SEQ ID NO: 8468

SEQ ID NO: 90349 - DNA, 201 bp, Bos taurus; identical to SEQ ID NO: 8469

SEQ ID NO: 90350 - DNA, 201 bp, Bos taurus; identical to SEQ ID NO: 8470

SEQ ID NO: 90351 - DNA, 201 bp, Bos taurus; identical to SEQ ID NO: 8472

SEQ ID NO: 90352 - DNA, 201 bp, Bos taurus; identical to SEQ ID NO: 8473

SEQ ID NO: 90353 - DNA, 201 bp, Bos taurus; identical to SEQ ID NO: 8476

SEQ ID NO: 90354 - DNA, 201 bp, Bos taurus; identical to SEQ ID NO: 8478

SEQ ID NO: 90355 - DNA, 201 bp, Bos taurus; identical to SEQ ID NO: 8480

SEQ ID NO: 90356 - DNA, 201 bp, Bos taurus
ccatgaagttttaatgctctattatatatcctttagttggatgtgaggtgctaaaatcccagaaaatagagggatctaccttgaatcagatagggataggttaggaaaataaagcttactggtggatatgatgtctaagctcactttgatggactgaacagaacattgttggtgcctagatggttaagaatgctgaagaag

SEQ ID NO: 90357 - DNA, 201 bp, Bos taurus; identical to SEQ ID NO: 8481

SEQ ID NO: 90358 - DNA, 201 bp, Bos taurus; identical to SEQ ID NO: 8482

SEQ ID NO: 90359 - DNA, 201 bp, Bos taurus; identical to SEQ ID NO: 8483

SEQ ID NO: 90360 - DNA, 201 bp, Bos taurus
gacaggtaaggatatcttgggcctgtactgggatgatatggagaaaggacaagtttgagacagaattcccaggcagaattggagagtgtgacagagaccacctttttcacttggcctcagtctcttgagttctgctagagactcaggtgcctttcatatctttttttttttttttttttttttaacatataaagtataaac

SEQ ID NO: 90361 - DNA, 201 bp, Bos taurus
aaggagaggaggcctggggtaagcctttctgataaataactatgttgatttccacagcaaaagggagggttagaactgggaagggactgaacaagacgctcagtaaaatgtctttttcatggtggcctccctgcttacctgatgttgtagaaatcatgaagcaataaaaccctttgagaatccatgagccagtcataattt

SEQ ID NO: 90362 - DNA, 201 bp, Bos taurus; identical to SEQ ID NO: 8485

SEQ ID NO: 90363 - DNA, 201 bp, Bos taurus; identical to SEQ ID NO: 8486

SEQ ID NO: 90364 - DNA, 201 bp, Bos taurus; identical to SEQ ID NO: 8487

SEQ ID NO: 90365 - DNA, 201 bp, Bos taurus; identical to SEQ ID NO: 8488

SEQ ID NO: 90366 - DNA, 201 bp, Bos taurus; identical to SEQ ID NO: 8489

SEQ ID NO: 90367 - DNA, 201 bp, Bos taurus
tcataaactttctttttccataattcctggatgccacatgcataatttgggttcattttgataatattctaagttaatatccttaatattggttggaacctgtgattgccaaggtgaactaagtggcttgtagatatattggttagcacaaggaaatgaattgttaacacctttaatgctgttaaatcaaccaccaaaggc

SEQ ID NO: 90368 - DNA, 201 bp, Bos taurus; identical to SEQ ID NO: 8490

SEQ ID NO: 90369 - DNA, 201 bp, Bos taurus
cacacagacttgtcaagcatttgggtgttttcttcttggctggtgaattgtctttctttgaagggctgttcctttctgctcttgcccccagtaattgcctcagtgattatgcccttatgtctaagtgtttccaacctttactgccaaagaaaagattaggaaaggatagctctagagtttaggttttttgtaattttcttt

SEQ ID NO: 90370 - DNA, 201 bp, Bos taurus; identical to SEQ ID NO: 8491

SEQ ID NO: 90371 - DNA, 201 bp, Bos taurus; identical to SEQ ID NO: 8492

SEQ ID NO: 90372 - DNA, 201 bp, Bos taurus
aatcacttgaaaaactagaaaagatataaaaagtaaatgagaattgtggagctgagtcacactgagaataggattatggatagacgaatcataattcctgatactgcagtatctgaaaatggcctattttctttccatcccatgtttaattgagttactctatgaggttcctaaatacctgtcaacaaattggtctcccat

SEQ ID NO: 90373 - DNA, 201 bp, Bos taurus; identical to SEQ ID NO: 8493

SEQ ID NO: 90374 - DNA, 201 bp, Bos taurus; identical to SEQ ID NO: 8494

SEQ ID NO: 90375 - DNA, 201 bp, Bos taurus; identical to SEQ ID NO: 8495

SEQ ID NO: 90376 - DNA, 201 bp, Bos taurus; identical to SEQ ID NO: 8496

SEQ ID NO: 90377 - DNA, 201 bp, Bos taurus
taaatataaagaagcatggttttctttatattgtttaaataacttgatagaaataatatcactaaaacctacactaaatcaggttttcagtaacctggaaaaaattatgcagctacagctatattgtttttcaattattagtgggtaaaatactatggtaagaatccctcctgaaccatgccaccacttggatacccagct

SEQ ID NO: 90378 - DNA, 201 bp, Bos taurus; identical to SEQ ID NO: 8498

SEQ ID NO: 90379 - DNA, 201 bp, Bos taurus; identical to SEQ ID NO: 8499

SEQ ID NO: 90380 - DNA, 201 bp, Bos taurus; identical to SEQ ID NO: 8500

SEQ ID NO: 90381 - DNA, 201 bp, Bos taurus; identical to SEQ ID NO: 8501

SEQ ID NO: 90382 - DNA, 201 bp, Bos taurus; identical to SEQ ID NO: 8502

SEQ ID NO: 90383 - DNA, 201 bp, Bos taurus; identical to SEQ ID NO: 8503

SEQ ID NO: 90384 - DNA, 201 bp, Bos taurus; identical to SEQ ID NO: 8504

SEQ ID NO: 90385 - DNA, 201 bp, Bos taurus; identical to SEQ ID NO: 8505

SEQ ID NO: 90386 - DNA, 201 bp, Bos taurus; identical to SEQ ID NO: 8506

SEQ ID NO: 90387 - DNA, 201 bp, Bos taurus; identical to SEQ ID NO: 8507

SEQ ID NO: 90388 - DNA, 201 bp, Bos taurus; identical to SEQ ID NO: 8508

SEQ ID NO: 90389 - DNA, 201 bp, Bos taurus; identical to SEQ ID NO: 8509

SEQ ID NO: 90390 - DNA, 201 bp, Bos taurus; identical to SEQ ID NO: 8510

SEQ ID NO: 90391 - DNA, 201 bp, Bos taurus
tcagttttttctcaggttataatttattacaaagaattatatataattcccagtgatatagagtaaatcattgttgcttgtacaactcatacaagaagtttatatagctcaatatataaaataggtattttgtatacagggtcttgtatctgtgaatctgatagccctaatttgtctctctctctccctctttctccattt

SEQ ID NO: 90392 - DNA, 201 bp, Bos taurus; identical to SEQ ID NO: 8511

SEQ ID NO: 90393 - DNA, 201 bp, Bos taurus; identical to SEQ ID NO: 8512

SEQ ID NO: 90394 - DNA, 201 bp, Bos taurus; identical to SEQ ID NO: 8513

SEQ ID NO: 90395 - DNA, 201 bp, Bos taurus
gactgagaagaataccattcttttcaagggcatatttatctgggaaaatcttctcttaagcaatttgaaaagaaagcttttcattcactgtcttcaaacatgctcagatctacttcatgtagaaaactcctcctctgcttgatttcaaagttctttctaaaaaagtccatctttctttctgtttcttactgccaaacttct

SEQ ID NO: 90396 - DNA, 201 bp, Bos taurus
cacctttaaaactgagatactagagtttcctggtggtccagtagttaggactccatgctttcactgtagtgagccttggttccattcctggtcaggaaacgaagatcctgaaagccacatggcaaagccaaaaaaaaaacctgcgataccaatacctgctcctgcctatcacaaagggcagctaggaaagacaaatgaatt

SEQ ID NO: 90397 - DNA, 201 bp, Bos taurus; identical to SEQ ID NO: 8514

SEQ ID NO: 90398 - DNA, 201 bp, Bos taurus; identical to SEQ ID NO: 8515

SEQ ID NO: 90399 - DNA, 201 bp, Bos taurus; identical to SEQ ID NO: 8516

SEQ ID NO: 90400 - DNA, 201 bp, Bos taurus; identical to SEQ ID NO: 8517

SEQ ID NO: 90401 - DNA, 201 bp, Bos taurus; identical to SEQ ID NO: 8518

SEQ ID NO: 90402 - DNA, 201 bp, Bos taurus; identical to SEQ ID NO: 8519

SEQ ID NO: 90403 - DNA, 201 bp, Bos taurus; identical to SEQ ID NO: 8520

SEQ ID NO: 90404 - DNA, 201 bp, Bos taurus; identical to SEQ ID NO: 8522

SEQ ID NO: 90405 - DNA, 201 bp, Bos taurus
ccacagccctcacaatctcctctgggctcttggctccccatcttttgaattctgaggatgcagcttgttggaggatctccggccactgcccctggtgccaccctctctcatcctcaaggcaccacctctcctggggtgctgctgcctatgtgtcaggagcacctgatgatgactcaggcccctcttcccttctgcactatg

SEQ ID NO: 90406 - DNA, 201 bp, Bos taurus; identical to SEQ ID NO: 8524

SEQ ID NO: 90407 - DNA, 201 bp, Bos taurus
tataaaccaataaattttcaattattttaaaaaataaaatgttgcttgcaatgaagagagtatgtctaatacaaaggttaaaagactggcccagagttgcccagccagtaagagaaaatggctagagcttgaatccggggttgtctggttccaaagcctaggcccttacctttggcccacactatagctacactcatttag

SEQ ID NO: 90408 - DNA, 201 bp, Bos taurus; identical to SEQ ID NO: 8525

SEQ ID NO: 90409 - DNA, 201 bp, Bos taurus; identical to SEQ ID NO: 8526

SEQ ID NO: 90410 - DNA, 201 bp, Bos taurus; identical to SEQ ID NO: 8527

SEQ ID NO: 90411 - DNA, 201 bp, Bos taurus; identical to SEQ ID NO: 8528

SEQ ID NO: 90412 - DNA, 201 bp, Bos taurus; identical to SEQ ID NO: 8529

SEQ ID NO: 90413 - DNA, 201 bp, Bos taurus; identical to SEQ ID NO: 8530

SEQ ID NO: 90414 - DNA, 201 bp, Bos taurus; identical to SEQ ID NO: 8531

SEQ ID NO: 90415 - DNA, 201 bp, Bos taurus; identical to SEQ ID NO: 8532

SEQ ID NO: 90416 - DNA, 201 bp, Bos taurus; identical to SEQ ID NO: 8533

SEQ ID NO: 90417 - DNA, 201 bp, Bos taurus; identical to SEQ ID NO: 8534

SEQ ID NO: 90418 - DNA, 201 bp, Bos taurus
ttgtatagaaagtcacaatcagtgggagaattaaggaaccaatgaaaaaaataacatctcttttccagctcacaaagtcctagagagttgttttgagggcgcaggccactaggactaatgccagacattaagaggattctggtaattcctctagttcagccttcctgtttaccaagcaacttgctggcttccgtgtggctt

SEQ ID NO: 90419 - DNA, 201 bp, Bos taurus; identical to SEQ ID NO: 8536

SEQ ID NO: 90420 - DNA, 201 bp, Bos taurus
tatcaggaaagcaacaaagattacacacattattttataaaccagcacacaaaggtttaaaacagttctgaaaatgaagttagctgtcttgagtcaagggaataaaaaaaaagtcagtattgaccatttacaatctctgacctttgtggagacggtaagaatctgttgtagtgcagctacatacagtacaattcaggcaat

SEQ ID NO: 90421 - DNA, 201 bp, Bos taurus; identical to SEQ ID NO: 8537

SEQ ID NO: 90422 - DNA, 201 bp, Bos taurus
aaggaaggcacgggtcccgcgaggggaggtggggccgccggacagcccctccagcgaagagccctgagctttgttcgcctcgggcccgcgggccgggcacgcactcttgtgcacgcgcgcacacacagatatacacaaagatatacacagagacacacagagatatacacacaagggccccgcagcgcgctgccccgcagg

SEQ ID NO: 90423 - DNA, 201 bp, Bos taurus
agaggacattattttattagcgggtaactaacttgttggtcagttctgctctgcactgtcagctctgctttcaggacttgctcactggttttaccctttgccatctggtttgctgtcatggtgttgatacctggatcactgtgggtgctacaagagtgcagttctgtgaccaggagcttcagtcacctgggagcttgctgg

SEQ ID NO: 90424 - DNA, 201 bp, Bos taurus
aagtaattctctaaggtgaggggtgggccagggttcaaaaccaggttatcaaactctgaagttcacacttttaatggcaatgtctttgatgattattagacagggccatgggtttcttgcttgataacagaggagactgaaatggagtgtgtacttcttgcccatttgagggatggcatgggacacaggataaagatgggc

SEQ ID NO: 90425 - DNA, 201 bp, Bos taurus; identical to SEQ ID NO: 8540

SEQ ID NO: 90426 - DNA, 201 bp, Bos taurus
atggggatagggaggaaaaacccagacccaaggaaagggctgagcagggccctggggcatagccttcgatggaagccaagttttatttagctagtccctcgtgtgaagagccagcccaccttatggccagccgaaagcagcacaagcatttctgctcaaactgcccaccgtcccctcatcagctcatgctcagcccctctc

SEQ ID NO: 90427 - DNA, 201 bp, Bos taurus; identical to SEQ ID NO: 8541

SEQ ID NO: 90428 - DNA, 201 bp, Bos taurus; identical to SEQ ID NO: 8542

SEQ ID NO: 90429 - DNA, 201 bp, Bos taurus; identical to SEQ ID NO: 8543

SEQ ID NO: 90430 - DNA, 201 bp, Bos taurus; identical to SEQ ID NO: 8544

SEQ ID NO: 90431 - DNA, 201 bp, Bos taurus
cactgctgccacgcacacttaggccccctcactgtcctccgtctgcagggcaaacactcatgagtccagaaagccaccttaggctcagtgctcccaagatgctttcggatgagtgctgtgtggccacgtggaggcacgctctgtactcatgataaaacaaggtattgagttgcccggggcatatttagggctttttttttt

SEQ ID NO: 90432 - DNA, 201 bp, Bos taurus
tcgggctagggcgcagccgaggctggtgggccaggagcgggagacggagggcctccgtctgcaggtgctggaggtggtggctgctgctgcggcggagggggatacatgccgttaggtgccgtgaggggtacccggggtcctaagatgtttcctgggattggaggcataccaggaggggtggggccactcccaggggggtgg

SEQ ID NO: 90433 - DNA, 201 bp, Bos taurus; identical to SEQ ID NO: 8545

SEQ ID NO: 90434 - DNA, 201 bp, Bos taurus; identical to SEQ ID NO: 8547

SEQ ID NO: 90435 - DNA, 201 bp, Bos taurus; identical to SEQ ID NO: 8548

SEQ ID NO: 90436 - DNA, 201 bp, Bos taurus; identical to SEQ ID NO: 8549

SEQ ID NO: 90437 - DNA, 201 bp, Bos taurus; identical to SEQ ID NO: 8550

SEQ ID NO: 90438 - DNA, 201 bp, Bos taurus; identical to SEQ ID NO: 8551

SEQ ID NO: 90439 - DNA, 201 bp, Bos taurus; identical to SEQ ID NO: 8552

SEQ ID NO: 90440 - DNA, 201 bp, Bos taurus; identical to SEQ ID NO: 8553

SEQ ID NO: 90441 - DNA, 201 bp, Bos taurus; identical to SEQ ID NO: 8554

SEQ ID NO: 90442 - DNA, 201 bp, Bos taurus; identical to SEQ ID NO: 8555

SEQ ID NO: 90443 - DNA, 201 bp, Bos taurus; identical to SEQ ID NO: 8556

SEQ ID NO: 90444 - DNA, 201 bp, Bos taurus; identical to SEQ ID NO: 8557

SEQ ID NO: 90445 - DNA, 201 bp, Bos taurus; identical to SEQ ID NO: 8558

SEQ ID NO: 90446 - DNA, 201 bp, Bos taurus; identical to SEQ ID NO: 8559

SEQ ID NO: 90447 - DNA, 201 bp, Bos taurus; identical to SEQ ID NO: 8560

SEQ ID NO: 90448 - DNA, 201 bp, Bos taurus; identical to SEQ ID NO: 8561

SEQ ID NO: 90449 - DNA, 201 bp, Bos taurus; identical to SEQ ID NO: 8562

SEQ ID NO: 90450 - DNA, 201 bp, Bos taurus; identical to SEQ ID NO: 8563

SEQ ID NO: 90451 - DNA, 201 bp, Bos taurus; identical to SEQ ID NO: 8564

SEQ ID NO: 90452 - DNA, 201 bp, Bos taurus; identical to SEQ ID NO: 8565

SEQ ID NO: 90453 - DNA, 201 bp, Bos taurus; identical to SEQ ID NO: 8566

SEQ ID NO: 90454 - DNA, 201 bp, Bos taurus; identical to SEQ ID NO: 8568

SEQ ID NO: 90455 - DNA, 201 bp, Bos taurus; identical to SEQ ID NO: 8569

SEQ ID NO: 90456 - DNA, 201 bp, Bos taurus; identical to SEQ ID NO: 8570

SEQ ID NO: 90457 - DNA, 201 bp, Bos taurus; identical to SEQ ID NO: 8571

SEQ ID NO: 90458 - DNA, 201 bp, Bos taurus; identical to SEQ ID NO: 8572

SEQ ID NO: 90459 - DNA, 201 bp, Bos taurus; identical to SEQ ID NO: 8573

SEQ ID NO: 90460 - DNA, 201 bp, Bos taurus; identical to SEQ ID NO: 8574

SEQ ID NO: 90461 - DNA, 201 bp, Bos taurus; identical to SEQ ID NO: 8575

SEQ ID NO: 90462 - DNA, 201 bp, Bos taurus; identical to SEQ ID NO: 8576

SEQ ID NO: 90463 - DNA, 201 bp, Bos taurus; identical to SEQ ID NO: 8577

SEQ ID NO: 90464 - DNA, 201 bp, Bos taurus; identical to SEQ ID NO: 8578

SEQ ID NO: 90465 - DNA, 201 bp, Bos taurus; identical to SEQ ID NO: 8579

SEQ ID NO: 90466 - DNA, 201 bp, Bos taurus; identical to SEQ ID NO: 8580

SEQ ID NO: 90467 - DNA, 201 bp, Bos taurus; identical to SEQ ID NO: 8581

SEQ ID NO: 90468 - DNA, 201 bp, Bos taurus; identical to SEQ ID NO: 8582

SEQ ID NO: 90469 - DNA, 201 bp, Bos taurus; identical to SEQ ID NO: 8583

SEQ ID NO: 90470 - DNA, 201 bp, Bos taurus; identical to SEQ ID NO: 8584

SEQ ID NO: 90471 - DNA, 201 bp, Bos taurus; identical to SEQ ID NO: 8585

SEQ ID NO: 90472 - DNA, 201 bp, Bos taurus; identical to SEQ ID NO: 8586

SEQ ID NO: 90473 - DNA, 201 bp, Bos taurus; identical to SEQ ID NO: 8587

SEQ ID NO: 90474 - DNA, 201 bp, Bos taurus; identical to SEQ ID NO: 8588

SEQ ID NO: 90475 - DNA, 201 bp, Bos taurus; identical to SEQ ID NO: 8589

SEQ ID NO: 90476 - DNA, 201 bp, Bos taurus; identical to SEQ ID NO: 8590

SEQ ID NO: 90477 - DNA, 201 bp, Bos taurus; identical to SEQ ID NO: 8591

SEQ ID NO: 90478 - DNA, 201 bp, Bos taurus; identical to SEQ ID NO: 8592

SEQ ID NO: 90479 - DNA, 201 bp, Bos taurus; identical to SEQ ID NO: 8593

SEQ ID NO: 90480 - DNA, 201 bp, Bos taurus; identical to SEQ ID NO: 8594

SEQ ID NO: 90481 - DNA, 201 bp, Bos taurus; identical to SEQ ID NO: 8595

SEQ ID NO: 90482 - DNA, 201 bp, Bos taurus; identical to SEQ ID NO: 8596

SEQ ID NO: 90483 - DNA, 201 bp, Bos taurus; identical to SEQ ID NO: 8597

SEQ ID NO: 90484 - DNA, 201 bp, Bos taurus; identical to SEQ ID NO: 8598

SEQ ID NO: 90485 - DNA, 201 bp, Bos taurus; identical to SEQ ID NO: 8599

SEQ ID NO: 90486 - DNA, 201 bp, Bos taurus; identical to SEQ ID NO: 8600

SEQ ID NO: 90487 - DNA, 201 bp, Bos taurus; identical to SEQ ID NO: 8601

SEQ ID NO: 90488 - DNA, 201 bp, Bos taurus; identical to SEQ ID NO: 8602

SEQ ID NO: 90489 - DNA, 201 bp, Bos taurus; identical to SEQ ID NO: 8603

SEQ ID NO: 90490 - DNA, 201 bp, Bos taurus; identical to SEQ ID NO: 8604

SEQ ID NO: 90491 - DNA, 201 bp, Bos taurus; identical to SEQ ID NO: 8605

SEQ ID NO: 90492 - DNA, 201 bp, Bos taurus; identical to SEQ ID NO: 8606

SEQ ID NO: 90493 - DNA, 201 bp, Bos taurus; identical to SEQ ID NO: 8607

SEQ ID NO: 90494 - DNA, 201 bp, Bos taurus; identical to SEQ ID NO: 8608

SEQ ID NO: 90495 - DNA, 201 bp, Bos taurus; identical to SEQ ID NO: 8609

SEQ ID NO: 90496 - DNA, 201 bp, Bos taurus; identical to SEQ ID NO: 8610

SEQ ID NO: 90497 - DNA, 201 bp, Bos taurus; identical to SEQ ID NO: 8611

SEQ ID NO: 90498 - DNA, 201 bp, Bos taurus; identical to SEQ ID NO: 8612

SEQ ID NO: 90499 - DNA, 201 bp, Bos taurus; identical to SEQ ID NO: 8613

SEQ ID NO: 90500 - DNA, 201 bp, Bos taurus; identical to SEQ ID NO: 8614

SEQ ID NO: 90501 - DNA, 201 bp, Bos taurus; identical to SEQ ID NO: 8615

SEQ ID NO: 90502 - DNA, 201 bp, Bos taurus; identical to SEQ ID NO: 8616

SEQ ID NO: 90503 - DNA, 201 bp, Bos taurus; identical to SEQ ID NO: 8617

SEQ ID NO: 90504 - DNA, 201 bp, Bos taurus; identical to SEQ ID NO: 8618

SEQ ID NO: 90505 - DNA, 201 bp, Bos taurus; identical to SEQ ID NO: 8619

SEQ ID NO: 90506 - DNA, 201 bp, Bos taurus; identical to SEQ ID NO: 8620

SEQ ID NO: 90507 - DNA, 201 bp, Bos taurus; identical to SEQ ID NO: 8621

SEQ ID NO: 90508 - DNA, 201 bp, Bos taurus; identical to SEQ ID NO: 8622

SEQ ID NO: 90509 - DNA, 201 bp, Bos taurus; identical to SEQ ID NO: 8623

SEQ ID NO: 90510 - DNA, 201 bp, Bos taurus; identical to SEQ ID NO: 8624

SEQ ID NO: 90511 - DNA, 201 bp, Bos taurus; identical to SEQ ID NO: 8626

SEQ ID NO: 90512 - DNA, 201 bp, Bos taurus
ataggaatccctctgttggctctagggtaaaatccttcttgacttcttctagcttctgatggcctaaggaattctttggtgtccttagctgtggccacaatgctccaatctctgactccatcttcatatctgttcttctctaaggatacctaccattgcatttaggggccacctagacaatctaggataaaatcttcacct

SEQ ID NO: 90513 - DNA, 201 bp, Bos taurus; identical to SEQ ID NO: 8627

SEQ ID NO: 90514 - DNA, 201 bp, Bos taurus; identical to SEQ ID NO: 8628

SEQ ID NO: 90515 - DNA, 201 bp, Bos taurus; identical to SEQ ID NO: 8630

SEQ ID NO: 90516 - DNA, 201 bp, Bos taurus; identical to SEQ ID NO: 8631

SEQ ID NO: 90517 - DNA, 201 bp, Bos taurus
ggagagatggcagagccagacgctggggtcggccgtaggggcaggagtggacacttttcttttgatcccactccagccgcatttcacagtcctttggggctagggtgagctgggtgttccagcagggccacatctctgtgcctgattcatctttggagagctggttattgtaccgtttgatcgcatctgcatgcgacccct

SEQ ID NO: 90518 - DNA, 201 bp, Bos taurus
agtattggagtttcagctttagcatcagtccttccaatgaacacccaggactgatctcctttagaatggattggttgtagaaagtggtaataaagttccagtgaaggaaagaagtcaatgggccattggaacagaacagaaccagcctgagaggagttagaatttgttaccataaaaaggtagaaattgagatggagggtg

SEQ ID NO: 90519 - DNA, 201 bp, Bos taurus; identical to SEQ ID NO: 8632

SEQ ID NO: 90520 - DNA, 201 bp, Bos taurus; identical to SEQ ID NO: 8634

SEQ ID NO: 90521 - DNA, 201 bp, Bos taurus
cccaacacagaaatgcccagatggcctgctttgtcctctcccctcctcagccatcctctccccgctgcagggagtacttcactctgggtaccagcttgattctttcctgactctagggcccattacccacacctagttcttggtgctttcgagctccaaaaggacagagacaatgtctgtttttctgcctgctgtgtcctc

SEQ ID NO: 90522 - DNA, 201 bp, Bos taurus; identical to SEQ ID NO: 8637

SEQ ID NO: 90523 - DNA, 201 bp, Bos taurus
agatgcagaatcaagttaagaggagaagaaagcagttctgtcttgaatattatcgttaaatttaaaaaccctgggaaagaggatttacagttgcggcattcggcctctatgttacacactctccaattatggtgcagctcttctctggtggctcaggcagtaaagaatctgcctgcaataagggagcccaggttcaatccc

SEQ ID NO: 90524 - DNA, 201 bp, Bos taurus; identical to SEQ ID NO: 8638

SEQ ID NO: 90525 - DNA, 201 bp, Bos taurus
aaaaaccatatcatctcttacctaccatactgcaatagatcctcatttttcctccttccaagcttcccctttccacctgtctcacatccacgaggtggccatgatctgcttaaaactgaaatatgaccatgtcatgtttcctattaaggtcctccagtgtcttcccattgtttatagactaacatccaagatcttcaggct

SEQ ID NO: 90526 - DNA, 201 bp, Bos taurus
ttttaaccataatcatgaccaactgagataagggtttgtaaaccatggccttgattataggaagagctttctctttggtgttcttgatacttagagtattggaataatcttttacttttacaaccctaacacgttacttttgaaatctctagacatttattagcattcaactttattttcaaataaacaacaatatatacc

SEQ ID NO: 90527 - DNA, 201 bp, Bos taurus
catgccaattacacaacatcatgcagttctttcactataaatggaatgaactggatattcctatcgtgagtgccttgatttcttgcccaaaagtcttgtctcactgttctcacttctggagtacttccctgtgttttaattaaatactattttactttcagaggtaattttgacacttgcatgcgaccatgcctccaagct

SEQ ID NO: 90528 - DNA, 201 bp, Bos taurus; identical to SEQ ID NO: 8639

SEQ ID NO: 90529 - DNA, 201 bp, Bos taurus; identical to SEQ ID NO: 8641

SEQ ID NO: 90530 - DNA, 201 bp, Bos taurus; identical to SEQ ID NO: 8642

SEQ ID NO: 90531 - DNA, 201 bp, Bos taurus; identical to SEQ ID NO: 8643

SEQ ID NO: 90532 - DNA, 201 bp, Bos taurus; identical to SEQ ID NO: 8644

SEQ ID NO: 90533 - DNA, 201 bp, Bos taurus; identical to SEQ ID NO: 8646

SEQ ID NO: 90534 - DNA, 201 bp, Bos taurus; identical to SEQ ID NO: 8647

SEQ ID NO: 90535 - DNA, 201 bp, Bos taurus; identical to SEQ ID NO: 8652

SEQ ID NO: 90536 - DNA, 201 bp, Bos taurus; identical to SEQ ID NO: 8653

SEQ ID NO: 90537 - DNA, 201 bp, Bos taurus; identical to SEQ ID NO: 8654

SEQ ID NO: 90538 - DNA, 201 bp, Bos taurus; identical to SEQ ID NO: 8655

SEQ ID NO: 90539 - DNA, 201 bp, Bos taurus; identical to SEQ ID NO: 8657

SEQ ID NO: 90540 - DNA, 201 bp, Bos taurus; identical to SEQ ID NO: 8658

SEQ ID NO: 90541 - DNA, 201 bp, Bos taurus; identical to SEQ ID NO: 8659

SEQ ID NO: 90542 - DNA, 201 bp, Bos taurus; identical to SEQ ID NO: 8660

SEQ ID NO: 90543 - DNA, 201 bp, Bos taurus; identical to SEQ ID NO: 8664

SEQ ID NO: 90544 - DNA, 201 bp, Bos taurus; identical to SEQ ID NO: 8666

SEQ ID NO: 90545 - DNA, 201 bp, Bos taurus; identical to SEQ ID NO: 8667

SEQ ID NO: 90546 - DNA, 201 bp, Bos taurus; identical to SEQ ID NO: 8668

SEQ ID NO: 90547 - DNA, 201 bp, Bos taurus
agaaataatgtaatttactgaaagggagaggagaggagcaggtgtggaggggaagatggcttctgctttaggcatttctgcctttgatgagtctgtgcaacatccaagtagcagtatctttggcctcatctttatgcatgaataattcagagatgagaatgatttgcttaattaagaacatgcatcaaaatagtggcagat

SEQ ID NO: 90548 - DNA, 201 bp, Bos taurus
ggacttcccccatgtcctgggtctccccagatggctctctaggggtctggcggggacccaaccaccacaactgccatcacggcccagagtcacttgcacccgtagagacggagagacaagtgggctggaggtccctgtggggaaggggtgatgctggctgggcccttcagagcccttgccgcccccccacccccgaccgga

SEQ ID NO: 90549 - DNA, 201 bp, Bos taurus
tttcataaagagccagatagtaaatattttaggcttcgagggccttgtagatgctgctgcaactattcagctcaggtgttctgaggcaaaagcagccatacacagtatacatgtaaatggccatgagtgtggtcaaacaaaatttgatggacagaagcaaagcagggagcaagatttatcctacaggctttggtttgatta

SEQ ID NO: 90550 - DNA, 201 bp, Bos taurus
cttgcctggaatagaagtaccaaatgtttatcatttaatgaaatagagaacatgaagcagtggtctctgtttgaagaaaactattcacatttctttattgtttggatttgcaagtgctttcccaggtacattatttcatcaagtcctggatttaaaaaaaaataaaaaatatgatttaactgttgttttcatcaagcccag

SEQ ID NO: 90551 - DNA, 201 bp, Bos taurus; identical to SEQ ID NO: 8672

SEQ ID NO: 90552 - DNA, 201 bp, Bos taurus; identical to SEQ ID NO: 8675

SEQ ID NO: 90553 - DNA, 201 bp, Bos taurus; identical to SEQ ID NO: 8676

SEQ ID NO: 90554 - DNA, 201 bp, Bos taurus; identical to SEQ ID NO: 8677

SEQ ID NO: 90555 - DNA, 201 bp, Bos taurus
agaaccaaagaaatgaggccaactggggaaaccagaaaactggaggaatattcagaccagttcacaaactgaaatcggggagttgagagaacactgcacagccctcccaggggcccccggatacttcccggtcaccgtgaacctcaaaccagctgcagcgtctgtggccaggacgacagacaaggatggtgggaaatccag

SEQ ID NO: 90556 - DNA, 201 bp, Bos taurus
cctacaagcaggccagacaagtagatgttaagcttcccttttccagacatcactgtccactgagggagtagggagcatggacacagcatggtcccctcaaatcagcagacaggggccaggtcctgagcaggacccgagtcttcctgaactcctatgctattccccatttgcacagcatcccttgatacatctggtctgtac

SEQ ID NO: 90557 - DNA, 201 bp, Bos taurus; identical to SEQ ID NO: 8679

SEQ ID NO: 90558 - DNA, 201 bp, Bos taurus
tcaggccctgtaggtggtcagagagggaaaagtagatggacccacttgaggcaggagcgctgttcaggctgcatgctgcatttacatgcagctgtccactcgacacatggcctcagaaatatagtgcaagaccttgggggagtgctctgacagagtgcgctttttttcctgcttaatttctctaaaatgcaatgggtggtt

SEQ ID NO: 90559 - DNA, 201 bp, Bos taurus; identical to SEQ ID NO: 8683

SEQ ID NO: 90560 - DNA, 201 bp, Bos taurus; identical to SEQ ID NO: 8684

SEQ ID NO: 90561 - DNA, 201 bp, Bos taurus; identical to SEQ ID NO: 8686

SEQ ID NO: 90562 - DNA, 201 bp, Bos taurus; identical to SEQ ID NO: 8687

SEQ ID NO: 90563 - DNA, 201 bp, Bos taurus; identical to SEQ ID NO: 8688

SEQ ID NO: 90564 - DNA, 201 bp, Bos taurus; identical to SEQ ID NO: 8689

SEQ ID NO: 90565 - DNA, 201 bp, Bos taurus; identical to SEQ ID NO: 8690

SEQ ID NO: 90566 - DNA, 201 bp, Bos taurus; identical to SEQ ID NO: 8691

SEQ ID NO: 90567 - DNA, 201 bp, Bos taurus; identical to SEQ ID NO: 8692

SEQ ID NO: 90568 - DNA, 201 bp, Bos taurus; identical to SEQ ID NO: 8694

SEQ ID NO: 90569 - DNA, 201 bp, Bos taurus; identical to SEQ ID NO: 8695

SEQ ID NO: 90570 - DNA, 201 bp, Bos taurus; identical to SEQ ID NO: 8697

SEQ ID NO: 90571 - DNA, 201 bp, Bos taurus
gtcgcttggccccttgggagcgattgattcccagccagcttgagacaggtttggtggagaacgtgacaggtactgtggggtgtgtgggggaaaggggggcggggtaagtgccttgccaaggcccctgggctttgacttactgtgcttcccagggcttttcttgggatgaagagagtggttgctgaattaaagaggaagatc

SEQ ID NO: 90572 - DNA, 201 bp, Bos taurus
gcaaaagactgatgcagggtaggccagagatgatgaggtctgagctgggaggacagacggaggacaaacaagagggatttgggagttctggggatggaggtgcctgtctccgggaggccctgcctctgcacctggggtggggtccgttgggaccagtgttgcaaacagtccacctgcatccttcacaagcccctgcagcaa

SEQ ID NO: 90573 - DNA, 201 bp, Bos taurus; identical to SEQ ID NO: 8698

SEQ ID NO: 90574 - DNA, 201 bp, Bos taurus; identical to SEQ ID NO: 8699

SEQ ID NO: 90575 - DNA, 201 bp, Bos taurus; identical to SEQ ID NO: 8700

SEQ ID NO: 90576 - DNA, 201 bp, Bos taurus; identical to SEQ ID NO: 8701

SEQ ID NO: 90577 - DNA, 201 bp, Bos taurus; identical to SEQ ID NO: 8706

SEQ ID NO: 90578 - DNA, 201 bp, Bos taurus; identical to SEQ ID NO: 8707

SEQ ID NO: 90579 - DNA, 201 bp, Bos taurus; identical to SEQ ID NO: 8708

SEQ ID NO: 90580 - DNA, 201 bp, Bos taurus; identical to SEQ ID NO: 8709

SEQ ID NO: 90581 - DNA, 201 bp, Bos taurus; identical to SEQ ID NO: 8710

SEQ ID NO: 90582 - DNA, 201 bp, Bos taurus; identical to SEQ ID NO: 8712

SEQ ID NO: 90583 - DNA, 201 bp, Bos taurus; identical to SEQ ID NO: 8714

SEQ ID NO: 90584 - DNA, 201 bp, Bos taurus; identical to SEQ ID NO: 8715

SEQ ID NO: 90585 - DNA, 201 bp, Bos taurus; identical to SEQ ID NO: 8716

SEQ ID NO: 90586 - DNA, 201 bp, Bos taurus; identical to SEQ ID NO: 8717

SEQ ID NO: 90587 - DNA, 201 bp, Bos taurus; identical to SEQ ID NO: 8719

SEQ ID NO: 90588 - DNA, 201 bp, Bos taurus; identical to SEQ ID NO: 8720

SEQ ID NO: 90589 - DNA, 201 bp, Bos taurus; identical to SEQ ID NO: 8722

SEQ ID NO: 90590 - DNA, 201 bp, Bos taurus; identical to SEQ ID NO: 8723

SEQ ID NO: 90591 - DNA, 201 bp, Bos taurus; identical to SEQ ID NO: 8724

SEQ ID NO: 90592 - DNA, 201 bp, Bos taurus; identical to SEQ ID NO: 8725

SEQ ID NO: 90593 - DNA, 201 bp, Bos taurus; identical to SEQ ID NO: 8728

SEQ ID NO: 90594 - DNA, 201 bp, Bos taurus; identical to SEQ ID NO: 8730

SEQ ID NO: 90595 - DNA, 201 bp, Bos taurus; identical to SEQ ID NO: 8731

SEQ ID NO: 90596 - DNA, 201 bp, Bos taurus; identical to SEQ ID NO: 8735

SEQ ID NO: 90597 - DNA, 201 bp, Bos taurus; identical to SEQ ID NO: 8739

SEQ ID NO: 90598 - DNA, 201 bp, Bos taurus; identical to SEQ ID NO: 8740

SEQ ID NO: 90599 - DNA, 201 bp, Bos taurus; identical to SEQ ID NO: 8741

SEQ ID NO: 90600 - DNA, 201 bp, Bos taurus; identical to SEQ ID NO: 8745

SEQ ID NO: 90601 - DNA, 201 bp, Bos taurus; identical to SEQ ID NO: 8746

SEQ ID NO: 90602 - DNA, 201 bp, Bos taurus; identical to SEQ ID NO: 8747

SEQ ID NO: 90603 - DNA, 201 bp, Bos taurus; identical to SEQ ID NO: 8748

SEQ ID NO: 90604 - DNA, 201 bp, Bos taurus; identical to SEQ ID NO: 8749

SEQ ID NO: 90605 - DNA, 201 bp, Bos taurus; identical to SEQ ID NO: 8750

SEQ ID NO: 90606 - DNA, 201 bp, Bos taurus; identical to SEQ ID NO: 8751

SEQ ID NO: 90607 - DNA, 201 bp, Bos taurus; identical to SEQ ID NO: 8752

SEQ ID NO: 90608 - DNA, 201 bp, Bos taurus; identical to SEQ ID NO: 8753

SEQ ID NO: 90609 - DNA, 201 bp, Bos taurus; identical to SEQ ID NO: 8754

SEQ ID NO: 90610 - DNA, 201 bp, Bos taurus; identical to SEQ ID NO: 8756

SEQ ID NO: 90611 - DNA, 201 bp, Bos taurus; identical to SEQ ID NO: 8758

SEQ ID NO: 90612 - DNA, 201 bp, Bos taurus; identical to SEQ ID NO: 8759

SEQ ID NO: 90613 - DNA, 201 bp, Bos taurus; identical to SEQ ID NO: 8760

SEQ ID NO: 90614 - DNA, 201 bp, Bos taurus; identical to SEQ ID NO: 8761

SEQ ID NO: 90615 - DNA, 201 bp, Bos taurus; identical to SEQ ID NO: 8762

SEQ ID NO: 90616 - DNA, 201 bp, Bos taurus; identical to SEQ ID NO: 8763

SEQ ID NO: 90617 - DNA, 201 bp, Bos taurus; identical to SEQ ID NO: 8764

SEQ ID NO: 90618 - DNA, 201 bp, Bos taurus; identical to SEQ ID NO: 8765

SEQ ID NO: 90619 - DNA, 201 bp, Bos taurus; identical to SEQ ID NO: 8766

SEQ ID NO: 90620 - DNA, 201 bp, Bos taurus
agacctagagaaccaacttatgattatggtggcagggatagtagggcgtttgtaggattgacatgtacacattgcaatatttaaaatggataaccaataagaacctactgtatatgcagggaaccctgctcagtattatataacaacctaaatggggaaataatttggaaaagaatcaatacatgtatatgtgtaattgga

SEQ ID NO: 90621 - DNA, 201 bp, Bos taurus; identical to SEQ ID NO: 8767

SEQ ID NO: 90622 - DNA, 201 bp, Bos taurus; identical to SEQ ID NO: 8768

SEQ ID NO: 90623 - DNA, 201 bp, Bos taurus; identical to SEQ ID NO: 8769

SEQ ID NO: 90624 - DNA, 201 bp, Bos taurus; identical to SEQ ID NO: 8770

SEQ ID NO: 90625 - DNA, 201 bp, Bos taurus; identical to SEQ ID NO: 8771

SEQ ID NO: 90626 - DNA, 201 bp, Bos taurus; identical to SEQ ID NO: 8772

SEQ ID NO: 90627 - DNA, 201 bp, Bos taurus; identical to SEQ ID NO: 8773

SEQ ID NO: 90628 - DNA, 201 bp, Bos taurus; identical to SEQ ID NO: 8774

SEQ ID NO: 90629 - DNA, 201 bp, Bos taurus; identical to SEQ ID NO: 8775

SEQ ID NO: 90630 - DNA, 201 bp, Bos taurus; identical to SEQ ID NO: 8776

SEQ ID NO: 90631 - DNA, 201 bp, Bos taurus; identical to SEQ ID NO: 8777

SEQ ID NO: 90632 - DNA, 201 bp, Bos taurus; identical to SEQ ID NO: 8778

SEQ ID NO: 90633 - DNA, 201 bp, Bos taurus; identical to SEQ ID NO: 8779

SEQ ID NO: 90634 - DNA, 201 bp, Bos taurus; identical to SEQ ID NO: 8780

SEQ ID NO: 90635 - DNA, 201 bp, Bos taurus; identical to SEQ ID NO: 8781

SEQ ID NO: 90636 - DNA, 201 bp, Bos taurus; identical to SEQ ID NO: 8782

SEQ ID NO: 90637 - DNA, 201 bp, Bos taurus
gaggagctgggaggctggtcagcagagatcgcgggacttcggctggttaaggatgggcagagagccttcacccgcctctgagggcctgcaggtgcccctaccccaaatctcatccttgtccaggggcgttctgcctaagccagtgccaccactgacctaggagccaggggcatccccacacctcccaggcctgtctctgat

SEQ ID NO: 90638 - DNA, 201 bp, Bos taurus; identical to SEQ ID NO: 8783

SEQ ID NO: 90639 - DNA, 201 bp, Bos taurus; identical to SEQ ID NO: 8784

SEQ ID NO: 90640 - DNA, 201 bp, Bos taurus
ctataaattgtaaggtacatgaataaaacgcaaaaagcatgccgccagtcttcgtaaccaacatcgccacatcatgaccaatctgttcattttggaactacgatgtaatggcctccagagagggacgggggtggcgggggtggggtggtgcttctcacctggggggtcctctccctgcaccgtcttctgctgcttctgtct

SEQ ID NO: 90641 - DNA, 201 bp, Bos taurus
gcctcacccagaggcaccgggcagtcggccccaggggccaccctccgcctccgaaagcagcaccagcaggggcagtggaaccccagacacaccacgaaacggcaccgcaaaggccctgagcagtgcactgccgctggaaccgcagtccacacggtggcccgggacctgcgtgcggagcctacgcggggagactgcctacta

SEQ ID NO: 90642 - DNA, 201 bp, Bos taurus; identical to SEQ ID NO: 8785

SEQ ID NO: 90643 - DNA, 201 bp, Bos taurus; identical to SEQ ID NO: 8787

SEQ ID NO: 90644 - DNA, 201 bp, Bos taurus; identical to SEQ ID NO: 8788

SEQ ID NO: 90645 - DNA, 201 bp, Bos taurus; identical to SEQ ID NO: 8789

SEQ ID NO: 90646 - DNA, 201 bp, Bos taurus; identical to SEQ ID NO: 8790

SEQ ID NO: 90647 - DNA, 201 bp, Bos taurus; identical to SEQ ID NO: 8791

SEQ ID NO: 90648 - DNA, 201 bp, Bos taurus; identical to SEQ ID NO: 8792

SEQ ID NO: 90649 - DNA, 201 bp, Bos taurus; identical to SEQ ID NO: 8793

SEQ ID NO: 90650 - DNA, 201 bp, Bos taurus; identical to SEQ ID NO: 8794

SEQ ID NO: 90651 - DNA, 201 bp, Bos taurus; identical to SEQ ID NO: 8795

SEQ ID NO: 90652 - DNA, 201 bp, Bos taurus; identical to SEQ ID NO: 8796

SEQ ID NO: 90653 - DNA, 201 bp, Bos taurus; identical to SEQ ID NO: 8797

SEQ ID NO: 90654 - DNA, 201 bp, Bos taurus; identical to SEQ ID NO: 8798

SEQ ID NO: 90655 - DNA, 201 bp, Bos taurus; identical to SEQ ID NO: 8799

SEQ ID NO: 90656 - DNA, 201 bp, Bos taurus; identical to SEQ ID NO: 8800

SEQ ID NO: 90657 - DNA, 201 bp, Bos taurus; identical to SEQ ID NO: 8801

SEQ ID NO: 90658 - DNA, 201 bp, Bos taurus; identical to SEQ ID NO: 50227

SEQ ID NO: 90659 - DNA, 201 bp, Bos taurus; identical to SEQ ID NO: 8802

SEQ ID NO: 90660 - DNA, 201 bp, Bos taurus; identical to SEQ ID NO: 8803

SEQ ID NO: 90661 - DNA, 201 bp, Bos taurus; identical to SEQ ID NO: 8804

SEQ ID NO: 90662 - DNA, 201 bp, Bos taurus; identical to SEQ ID NO: 8805

SEQ ID NO: 90663 - DNA, 201 bp, Bos taurus; identical to SEQ ID NO: 8806

SEQ ID NO: 90664 - DNA, 201 bp, Bos taurus; identical to SEQ ID NO: 8807

SEQ ID NO: 90665 - DNA, 201 bp, Bos taurus; identical to SEQ ID NO: 8808

SEQ ID NO: 90666 - DNA, 201 bp, Bos taurus; identical to SEQ ID NO: 8809

SEQ ID NO: 90667 - DNA, 201 bp, Bos taurus
ggagatgagtgttaaatcattaccaaaaaaaaagaagaagaaagaaatctagaaaactgtctttcagttcttgtttcatgggcaattcattttcttgctacgtaagtcaatttaacttgagatatccagatacctacagcctcaagaatcctaaataagccattgttatgtgctctagaatgcctctagaatacctgtcat

SEQ ID NO: 90668 - DNA, 201 bp, Bos taurus; identical to SEQ ID NO: 8810

SEQ ID NO: 90669 - DNA, 201 bp, Bos taurus; identical to SEQ ID NO: 8811

SEQ ID NO: 90670 - DNA, 201 bp, Bos taurus; identical to SEQ ID NO: 8812

SEQ ID NO: 90671 - DNA, 201 bp, Bos taurus; identical to SEQ ID NO: 8813

SEQ ID NO: 90672 - DNA, 201 bp, Bos taurus; identical to SEQ ID NO: 8814

SEQ ID NO: 90673 - DNA, 201 bp, Bos taurus; identical to SEQ ID NO: 8815

SEQ ID NO: 90674 - DNA, 201 bp, Bos taurus; identical to SEQ ID NO: 8818

SEQ ID NO: 90675 - DNA, 201 bp, Bos taurus; identical to SEQ ID NO: 8819

SEQ ID NO: 90676 - DNA, 201 bp, Bos taurus; identical to SEQ ID NO: 8820

SEQ ID NO: 90677 - DNA, 201 bp, Bos taurus; identical to SEQ ID NO: 8821

SEQ ID NO: 90678 - DNA, 201 bp, Bos taurus; identical to SEQ ID NO: 8824

SEQ ID NO: 90679 - DNA, 201 bp, Bos taurus
aggagtacaggaatgcatttttaaggtagttgtgaagaatttctaggaagcagtcatgcaataaagctgagtattgcctctttttaaggttaagtaaagtcctaactggagaaggcaatggcaccccaccccagtactcttgcctggaaaatcccatggacggaggagcctggtaggctgcagtccatggggtcgctaaga

SEQ ID NO: 90680 - DNA, 201 bp, Bos taurus; identical to SEQ ID NO: 8825

SEQ ID NO: 90681 - DNA, 201 bp, Bos taurus; identical to SEQ ID NO: 8827

SEQ ID NO: 90682 - DNA, 201 bp, Bos taurus
tgaggaacctcaagatctgcagtcaacgagtcagagacccagaagacccagaactgtagtttcatttgtgttcaaaggcctgagaaccagggatgctgagagtgtgagttcccatctgagggcagaaaatggatgtcccagctccagcaatcaggaaggagaggttccctcttcctcagcatttctgttccactcaggcct

SEQ ID NO: 90683 - DNA, 201 bp, Bos taurus; identical to SEQ ID NO: 8829

SEQ ID NO: 90684 - DNA, 201 bp, Bos taurus; identical to SEQ ID NO: 8830

SEQ ID NO: 90685 - DNA, 201 bp, Bos taurus; identical to SEQ ID NO: 8831

SEQ ID NO: 90686 - DNA, 201 bp, Bos taurus; identical to SEQ ID NO: 8832

SEQ ID NO: 90687 - DNA, 201 bp, Bos taurus; identical to SEQ ID NO: 8833

SEQ ID NO: 90688 - DNA, 201 bp, Bos taurus
ctccccgctcagtcttctctagcatcaccctggcagtgagttgaatcatcttgctacagcctggcaagagtggaagtctaggttcaacacttggcctttgatgggatgcagttgcaacttggtctgtggtattcacccagaaaaaaagtggttaaaagtcccctgtcttgtttagctgcctctttcttggtcttttggcca

SEQ ID NO: 90689 - DNA, 201 bp, Bos taurus; identical to SEQ ID NO: 8834

SEQ ID NO: 90690 - DNA, 201 bp, Bos taurus; identical to SEQ ID NO: 8835

SEQ ID NO: 90691 - DNA, 201 bp, Bos taurus
agagttcccattcagataaagcaagctttgaacaagaagtgaggaaacttgcttggaagagtgaagacagacgtatggctttctactctttatttacgtggggccagttaaaatctctgttccctcatatgtaaagtggacttgatatatatctttgaaggtattaataattagaaattacataatgtttgtgaagtacat

SEQ ID NO: 90692 - DNA, 201 bp, Bos taurus; identical to SEQ ID NO: 8836

SEQ ID NO: 90693 - DNA, 201 bp, Bos taurus; identical to SEQ ID NO: 8838

SEQ ID NO: 90694 - DNA, 201 bp, Bos taurus; identical to SEQ ID NO: 8839

SEQ ID NO: 90695 - DNA, 201 bp, Bos taurus; identical to SEQ ID NO: 8840

SEQ ID NO: 90696 - DNA, 201 bp, Bos taurus; identical to SEQ ID NO: 8841

SEQ ID NO: 90697 - DNA, 201 bp, Bos taurus; identical to SEQ ID NO: 8842

SEQ ID NO: 90698 - DNA, 201 bp, Bos taurus; identical to SEQ ID NO: 8843

SEQ ID NO: 90699 - DNA, 201 bp, Bos taurus
ttcctaagggccagccattttctggttgtccagacacaaaggtgcagagacaacactgtggacccagacagggctcacaaaaagagcataccttctggaattagaaagctgatgactctcccaatacttttcagacagtggcataggtggggggtgagactagaggacgggaggaaaaataagtaggaagaatgtttgaag

SEQ ID NO: 90700 - DNA, 201 bp, Bos taurus; identical to SEQ ID NO: 8844

SEQ ID NO: 90701 - DNA, 201 bp, Bos taurus; identical to SEQ ID NO: 8847

SEQ ID NO: 90702 - DNA, 201 bp, Bos taurus; identical to SEQ ID NO: 8850

SEQ ID NO: 90703 - DNA, 201 bp, Bos taurus; identical to SEQ ID NO: 8852

SEQ ID NO: 90704 - DNA, 201 bp, Bos taurus; identical to SEQ ID NO: 8853

SEQ ID NO: 90705 - DNA, 201 bp, Bos taurus; identical to SEQ ID NO: 8854

SEQ ID NO: 90706 - DNA, 201 bp, Bos taurus
cttattctcagcaattaaccttagctcttgccttacagagaaattagacaccatcagatcccacccccctttctcattctgaaatcccacaccttcaaacatgtcctaattttcacctaaatattttccttctctttcttcacaggagatgtttggaactagcacgcgtgccccacttccgtgccccgggtgatctctgta

SEQ ID NO: 90707 - DNA, 201 bp, Bos taurus; identical to SEQ ID NO: 8855

SEQ ID NO: 90708 - DNA, 201 bp, Bos taurus
gcctaagtgctctgttgctttgtgctttattttattatattgtagggaaacgtatatagcttcaattagtttcatactattaggcttgtgataaagaccaagttctgttctggttgccttacagttaatttatttaattttcatgatgacacactgagaaaggcactgttattagccccattttaaagatgaggaataaat

SEQ ID NO: 90709 - DNA, 201 bp, Bos taurus
tgctttttctgagggaaaatataagccaaagaacaatcaagtcacttgaaaagggacttttgtaaggcaacacaaatgtaaaggagagacgtcctttaacgaaagtcccataggaggataattctattactttatattaactcttcatatatttcagaagactattcaaaattttaaaaggttttgaaatacatttctaca

SEQ ID NO: 90710 - DNA, 201 bp, Bos taurus
ccagaaatatctggcaatgtgtgaaaaggccgatagaatagcacagtgggaaagagcttggtctcacactccacccttttcaagatgaactaccttgggaagtttaacctatcttggcctgtgggggttgttgtgggaattaaataagatgttgacaaatactcaatttgaatacaccgttacttcccttggctgccacag

SEQ ID NO: 90711 - DNA, 201 bp, Bos taurus; identical to SEQ ID NO: 8856

SEQ ID NO: 90712 - DNA, 201 bp, Bos taurus; identical to SEQ ID NO: 8857

SEQ ID NO: 90713 - DNA, 201 bp, Bos taurus; identical to SEQ ID NO: 8858

SEQ ID NO: 90714 - DNA, 201 bp, Bos taurus
cataactcttttgtgtaacacttaaccataaaatctcagtgacaggcaacaaatatacctgttgctcacacatctgtgattggctgggtttctgctgatccaggcaatgcttgatcaggcggtggtttcaattcaggttagatctctgtgttactcagttttctgagacccaagaaatattcttctcatgctaatgtcaga

SEQ ID NO: 90715 - DNA, 201 bp, Bos taurus
agacaattcttacctactagcatgtctgctaaaggtatgtctgagactgttagagagtgccacattcctcctcgggtgatttattctgatgggccagaaagctccgggtcactaatagtgagaagactgtcatatgttttcaatgaaaaggaaaaagacctttggtgatttccctggtggcccactggttaaaacttcacc

SEQ ID NO: 90716 - DNA, 201 bp, Bos taurus; identical to SEQ ID NO: 8859

SEQ ID NO: 90717 - DNA, 201 bp, Bos taurus; identical to SEQ ID NO: 8861

SEQ ID NO: 90718 - DNA, 201 bp, Bos taurus; identical to SEQ ID NO: 8864

SEQ ID NO: 90719 - DNA, 201 bp, Bos taurus; identical to SEQ ID NO: 8865

SEQ ID NO: 90720 - DNA, 201 bp, Bos taurus
ggctctggcgcctcctcgctctcttttcgctgacgccgagaccgctgtgtccctgaaaagactgccgcgctgatttaagtcagccctgctccgcggtgcctcctccctttatcgcgtagacagtgcctgactcacccggttccagttccacgccctttctccgcctcagctcgccctcacaggacctacaaactggaacca

SEQ ID NO: 90721 - DNA, 201 bp, Bos taurus
atgtatctttttatttttttctttttattatgaaaaatttcaaacaagctcaaaaatagaacagtaaaacaaccccctgtgcattcatcatgaattctcaatgttaatcaactcgattttacttgccctcctccaccttttcatactaactggattaatttaaacaaataaaaaaatgtcataattttcatatgtaaacat

SEQ ID NO: 90722 - DNA, 201 bp, Bos taurus; identical to SEQ ID NO: 8867

SEQ ID NO: 90723 - DNA, 201 bp, Bos taurus
atttatagttcagatgctaatgccaagagtgacatacaagtaacatgacaacgggtcacattacttacaagaaccactcatgaaacaaattaattttctcccaggacacaaatttcccacttttcatgctatgctatttccttttggtggagctgcccacactcaaccaaatgaaaacatcctggacagatacagtcaagt

SEQ ID NO: 90724 - DNA, 201 bp, Bos taurus; identical to SEQ ID NO: 8868

SEQ ID NO: 90725 - DNA, 201 bp, Bos taurus; identical to SEQ ID NO: 8870

SEQ ID NO: 90726 - DNA, 201 bp, Bos taurus; identical to SEQ ID NO: 8871

SEQ ID NO: 90727 - DNA, 201 bp, Bos taurus; identical to SEQ ID NO: 8872

SEQ ID NO: 90728 - DNA, 201 bp, Bos taurus; identical to SEQ ID NO: 8873

SEQ ID NO: 90729 - DNA, 201 bp, Bos taurus; identical to SEQ ID NO: 8874

SEQ ID NO: 90730 - DNA, 201 bp, Bos taurus; identical to SEQ ID NO: 8875

SEQ ID NO: 90731 - DNA, 201 bp, Bos taurus
ttctcgtagtgcttgctggaaaaggccaacacccgtgtgttttattgatgcacggcagaacctcagtctaaaagcaccaggtctgcctcgtggcatttgcggagggtgttttaaacgcatagttccagagtcaagaacattgtctcttcgactcagtgaatgcattattaaaggacttttgctgtgcccagcacggggtgg

SEQ ID NO: 90732 - DNA, 201 bp, Bos taurus
tagcccagcaaacagcaggcctacttgggcttaatctgtggcactttcttgtaaccagagctgtctaacaatgggactatttgtcctataaagtagtaacataactgaacaggactctacggggccttcctgggacagacctgctccatatcctctgctttagctcctctctgaagtgcttagataacagtatttgactgc

SEQ ID NO: 90733 - DNA, 201 bp, Bos taurus; identical to SEQ ID NO: 8877

SEQ ID NO: 90734 - DNA, 201 bp, Bos taurus
cagactccctctctggggtccatctgcatctggattatgccttgcagacctgatcttctcccacttacacgtacaatgtgctactcttgttgcatgaggtgtgtttatcacctgaaacaactcgcaggttacaatcaatcacgattcagaaacacatatttctcagcgtcgttagtggaaacaaatgtctgcaacaactaa

SEQ ID NO: 90735 - DNA, 201 bp, Bos taurus; identical to SEQ ID NO: 8878

SEQ ID NO: 90736 - DNA, 201 bp, Bos taurus; identical to SEQ ID NO: 8879

SEQ ID NO: 90737 - DNA, 201 bp, Bos taurus; identical to SEQ ID NO: 8880

SEQ ID NO: 90738 - DNA, 201 bp, Bos taurus
tgttttcttattgctgagttttaaaattttactttatattttaaataatggttctttaccaggtttgtcttttgcaaatattttctttcagtcaatggctcgtcttatcactctcttgacagtgtctattacagagcaaacatttttaattttaatgacgtctagctcttcaattatttctttcatgagttgtgcctttgg

SEQ ID NO: 90739 - DNA, 201 bp, Bos taurus; identical to SEQ ID NO: 8881

SEQ ID NO: 90740 - DNA, 201 bp, Bos taurus; identical to SEQ ID NO: 8882

SEQ ID NO: 90741 - DNA, 201 bp, Bos taurus; identical to SEQ ID NO: 8883

SEQ ID NO: 90742 - DNA, 201 bp, Bos taurus; identical to SEQ ID NO: 8884

SEQ ID NO: 90743 - DNA, 201 bp, Bos taurus; identical to SEQ ID NO: 8885

SEQ ID NO: 90744 - DNA, 201 bp, Bos taurus; identical to SEQ ID NO: 8886

SEQ ID NO: 90745 - DNA, 201 bp, Bos taurus; identical to SEQ ID NO: 8887

SEQ ID NO: 90746 - DNA, 201 bp, Bos taurus; identical to SEQ ID NO: 8889

SEQ ID NO: 90747 - DNA, 201 bp, Bos taurus; identical to SEQ ID NO: 8890

SEQ ID NO: 90748 - DNA, 201 bp, Bos taurus; identical to SEQ ID NO: 8891

SEQ ID NO: 90749 - DNA, 201 bp, Bos taurus; identical to SEQ ID NO: 8892

SEQ ID NO: 90750 - DNA, 201 bp, Bos taurus; identical to SEQ ID NO: 8893

SEQ ID NO: 90751 - DNA, 201 bp, Bos taurus; identical to SEQ ID NO: 8894

SEQ ID NO: 90752 - DNA, 201 bp, Bos taurus; identical to SEQ ID NO: 8895

SEQ ID NO: 90753 - DNA, 201 bp, Bos taurus; identical to SEQ ID NO: 8896

SEQ ID NO: 90754 - DNA, 201 bp, Bos taurus; identical to SEQ ID NO: 8897

SEQ ID NO: 90755 - DNA, 201 bp, Bos taurus; identical to SEQ ID NO: 8898

SEQ ID NO: 90756 - DNA, 201 bp, Bos taurus; identical to SEQ ID NO: 8899

SEQ ID NO: 90757 - DNA, 201 bp, Bos taurus; identical to SEQ ID NO: 8900

SEQ ID NO: 90758 - DNA, 201 bp, Bos taurus; identical to SEQ ID NO: 8901

SEQ ID NO: 90759 - DNA, 201 bp, Bos taurus; identical to SEQ ID NO: 8902

SEQ ID NO: 90760 - DNA, 201 bp, Bos taurus; identical to SEQ ID NO: 8903

SEQ ID NO: 90761 - DNA, 201 bp, Bos taurus; identical to SEQ ID NO: 8904

SEQ ID NO: 90762 - DNA, 201 bp, Bos taurus; identical to SEQ ID NO: 8905

SEQ ID NO: 90763 - DNA, 201 bp, Bos taurus; identical to SEQ ID NO: 8906

SEQ ID NO: 90764 - DNA, 201 bp, Bos taurus; identical to SEQ ID NO: 8907

SEQ ID NO: 90765 - DNA, 201 bp, Bos taurus; identical to SEQ ID NO: 8908

SEQ ID NO: 90766 - DNA, 201 bp, Bos taurus; identical to SEQ ID NO: 8909

SEQ ID NO: 90767 - DNA, 201 bp, Bos taurus; identical to SEQ ID NO: 8910

SEQ ID NO: 90768 - DNA, 201 bp, Bos taurus; identical to SEQ ID NO: 8911

SEQ ID NO: 90769 - DNA, 201 bp, Bos taurus; identical to SEQ ID NO: 8912

SEQ ID NO: 90770 - DNA, 201 bp, Bos taurus; identical to SEQ ID NO: 8913

SEQ ID NO: 90771 - DNA, 201 bp, Bos taurus; identical to SEQ ID NO: 8914

SEQ ID NO: 90772 - DNA, 201 bp, Bos taurus; identical to SEQ ID NO: 8915

SEQ ID NO: 90773 - DNA, 201 bp, Bos taurus; identical to SEQ ID NO: 8916

SEQ ID NO: 90774 - DNA, 201 bp, Bos taurus; identical to SEQ ID NO: 8917

SEQ ID NO: 90775 - DNA, 201 bp, Bos taurus; identical to SEQ ID NO: 8918

SEQ ID NO: 90776 - DNA, 201 bp, Bos taurus; identical to SEQ ID NO: 8919

SEQ ID NO: 90777 - DNA, 201 bp, Bos taurus; identical to SEQ ID NO: 8920

SEQ ID NO: 90778 - DNA, 201 bp, Bos taurus; identical to SEQ ID NO: 8922

SEQ ID NO: 90779 - DNA, 201 bp, Bos taurus; identical to SEQ ID NO: 8923

SEQ ID NO: 90780 - DNA, 201 bp, Bos taurus; identical to SEQ ID NO: 8924

SEQ ID NO: 90781 - DNA, 201 bp, Bos taurus; identical to SEQ ID NO: 8925

SEQ ID NO: 90782 - DNA, 201 bp, Bos taurus; identical to SEQ ID NO: 8926

SEQ ID NO: 90783 - DNA, 201 bp, Bos taurus; identical to SEQ ID NO: 8927

SEQ ID NO: 90784 - DNA, 201 bp, Bos taurus; identical to SEQ ID NO: 8928

SEQ ID NO: 90785 - DNA, 201 bp, Bos taurus; identical to SEQ ID NO: 8929

SEQ ID NO: 90786 - DNA, 201 bp, Bos taurus; identical to SEQ ID NO: 8930

SEQ ID NO: 90787 - DNA, 201 bp, Bos taurus; identical to SEQ ID NO: 8931

SEQ ID NO: 90788 - DNA, 201 bp, Bos taurus; identical to SEQ ID NO: 8932

SEQ ID NO: 90789 - DNA, 201 bp, Bos taurus; identical to SEQ ID NO: 8933

SEQ ID NO: 90790 - DNA, 201 bp, Bos taurus; identical to SEQ ID NO: 8934

SEQ ID NO: 90791 - DNA, 201 bp, Bos taurus; identical to SEQ ID NO: 8935

SEQ ID NO: 90792 - DNA, 201 bp, Bos taurus; identical to SEQ ID NO: 8936

SEQ ID NO: 90793 - DNA, 201 bp, Bos taurus; identical to SEQ ID NO: 8937

SEQ ID NO: 90794 - DNA, 201 bp, Bos taurus; identical to SEQ ID NO: 8938

SEQ ID NO: 90795 - DNA, 201 bp, Bos taurus; identical to SEQ ID NO: 8939

SEQ ID NO: 90796 - DNA, 201 bp, Bos taurus; identical to SEQ ID NO: 8940

SEQ ID NO: 90797 - DNA, 201 bp, Bos taurus; identical to SEQ ID NO: 8941

SEQ ID NO: 90798 - DNA, 201 bp, Bos taurus; identical to SEQ ID NO: 8942

SEQ ID NO: 90799 - DNA, 201 bp, Bos taurus; identical to SEQ ID NO: 8943

SEQ ID NO: 90800 - DNA, 201 bp, Bos taurus; identical to SEQ ID NO: 8944

SEQ ID NO: 90801 - DNA, 201 bp, Bos taurus; identical to SEQ ID NO: 8945

SEQ ID NO: 90802 - DNA, 201 bp, Bos taurus; identical to SEQ ID NO: 8946

SEQ ID NO: 90803 - DNA, 201 bp, Bos taurus; identical to SEQ ID NO: 8947

SEQ ID NO: 90804 - DNA, 201 bp, Bos taurus; identical to SEQ ID NO: 8948

SEQ ID NO: 90805 - DNA, 201 bp, Bos taurus; identical to SEQ ID NO: 8949

SEQ ID NO: 90806 - DNA, 201 bp, Bos taurus; identical to SEQ ID NO: 8950

SEQ ID NO: 90807 - DNA, 201 bp, Bos taurus; identical to SEQ ID NO: 8951

SEQ ID NO: 90808 - DNA, 201 bp, Bos taurus; identical to SEQ ID NO: 8952

SEQ ID NO: 90809 - DNA, 201 bp, Bos taurus; identical to SEQ ID NO: 8955

SEQ ID NO: 90810 - DNA, 201 bp, Bos taurus; identical to SEQ ID NO: 8956

SEQ ID NO: 90811 - DNA, 201 bp, Bos taurus; identical to SEQ ID NO: 8957

SEQ ID NO: 90812 - DNA, 201 bp, Bos taurus; identical to SEQ ID NO: 8958

SEQ ID NO: 90813 - DNA, 201 bp, Bos taurus; identical to SEQ ID NO: 8960

SEQ ID NO: 90814 - DNA, 201 bp, Bos taurus; identical to SEQ ID NO: 8961

SEQ ID NO: 90815 - DNA, 201 bp, Bos taurus; identical to SEQ ID NO: 8962

SEQ ID NO: 90816 - DNA, 201 bp, Bos taurus; identical to SEQ ID NO: 8963

SEQ ID NO: 90817 - DNA, 201 bp, Bos taurus; identical to SEQ ID NO: 8964

SEQ ID NO: 90818 - DNA, 201 bp, Bos taurus; identical to SEQ ID NO: 8965

SEQ ID NO: 90819 - DNA, 201 bp, Bos taurus; identical to SEQ ID NO: 8966

SEQ ID NO: 90820 - DNA, 201 bp, Bos taurus; identical to SEQ ID NO: 8967

SEQ ID NO: 90821 - DNA, 201 bp, Bos taurus; identical to SEQ ID NO: 8968

SEQ ID NO: 90822 - DNA, 201 bp, Bos taurus; identical to SEQ ID NO: 8971

SEQ ID NO: 90823 - DNA, 201 bp, Bos taurus; identical to SEQ ID NO: 8972

SEQ ID NO: 90824 - DNA, 201 bp, Bos taurus; identical to SEQ ID NO: 8973

SEQ ID NO: 90825 - DNA, 201 bp, Bos taurus; identical to SEQ ID NO: 8974

SEQ ID NO: 90826 - DNA, 201 bp, Bos taurus; identical to SEQ ID NO: 8975

SEQ ID NO: 90827 - DNA, 201 bp, Bos taurus; identical to SEQ ID NO: 8976

SEQ ID NO: 90828 - DNA, 201 bp, Bos taurus; identical to SEQ ID NO: 8977

SEQ ID NO: 90829 - DNA, 201 bp, Bos taurus; identical to SEQ ID NO: 8979

SEQ ID NO: 90830 - DNA, 201 bp, Bos taurus; identical to SEQ ID NO: 8982

SEQ ID NO: 90831 - DNA, 201 bp, Bos taurus; identical to SEQ ID NO: 8983

SEQ ID NO: 90832 - DNA, 201 bp, Bos taurus; identical to SEQ ID NO: 8984

SEQ ID NO: 90833 - DNA, 201 bp, Bos taurus
tccacaaagtttgacagagggtgatgaatctgcactcctttctcctggcagtcactgacagcagagcccaccagtaacttcaactatcacctaaagaggtgtcatgattttctgtattttctaatttcctatatccctaaactaagaggcaatggtaaagccttcctgtgagtaagctgatacacattttgtccttgtgta

SEQ ID NO: 90834 - DNA, 201 bp, Bos taurus; identical to SEQ ID NO: 8985

SEQ ID NO: 90835 - DNA, 201 bp, Bos taurus; identical to SEQ ID NO: 8986

SEQ ID NO: 90836 - DNA, 201 bp, Bos taurus; identical to SEQ ID NO: 8987

SEQ ID NO: 90837 - DNA, 201 bp, Bos taurus
gctcttgggtgacacaactagacttcaaagacaggtagcccagcttgcaagtcgaggcctgtacgctgtgaccccccacactgcagcttctgtttctatcgggcatcattaaggaggcagcacttggcttgtttctgtagatgaagtatgagacaagatttttttaagttttgataaatgaactgtttttctactttctaa

SEQ ID NO: 90838 - DNA, 201 bp, Bos taurus; identical to SEQ ID NO: 8988

SEQ ID NO: 90839 - DNA, 201 bp, Bos taurus; identical to SEQ ID NO: 8989

SEQ ID NO: 90840 - DNA, 201 bp, Bos taurus; identical to SEQ ID NO: 8990

SEQ ID NO: 90841 - DNA, 201 bp, Bos taurus; identical to SEQ ID NO: 8991

SEQ ID NO: 90842 - DNA, 201 bp, Bos taurus; identical to SEQ ID NO: 8992

SEQ ID NO: 90843 - DNA, 201 bp, Bos taurus
agaagcccagctcctgcctttaatgtggccggaagccatgcccttgggctggagcggggagctggaggaggtggagaaaatgaagcctgcactgggctgcgctcagactagggcagacggccacccactcagaagaggctggaaagaaactcgcagagtgtctggaggaaggcgggggtgggtccttttaaacagaaagtc

SEQ ID NO: 90844 - DNA, 201 bp, Bos taurus; identical to SEQ ID NO: 8993

SEQ ID NO: 90845 - DNA, 201 bp, Bos taurus; identical to SEQ ID NO: 8994

SEQ ID NO: 90846 - DNA, 201 bp, Bos taurus; identical to SEQ ID NO: 8995

SEQ ID NO: 90847 - DNA, 201 bp, Bos taurus; identical to SEQ ID NO: 8996

SEQ ID NO: 90848 - DNA, 201 bp, Bos taurus
ctgagagtgaccttgggtcacgtatctttgccaggacctatgtgcatgtcttggaaaggagttgggattgatgcttggctcaggggaaaggctaccttgtcatataggggcccactgggtagtcattcatgaaaaagcagccattcgggtgaaaaagaagaaacaaggccaagcggtctgtactcctaagagcagacggct

SEQ ID NO: 90849 - DNA, 201 bp, Bos taurus
acaaataaaactttgtgtagcacacgtatatagccagactcaaggaggcagctgacttgggataactttttttttctgtctaaaaatcaaaatcatgacatgaggcaccaacatctgggaagatctctacatccttctgaacacaacagtccagtccttctaggttcctggcatcaatatcaactctgagagggtgactgt

SEQ ID NO: 90850 - DNA, 201 bp, Bos taurus; identical to SEQ ID NO: 8997

SEQ ID NO: 90851 - DNA, 201 bp, Bos taurus; identical to SEQ ID NO: 8998

SEQ ID NO: 90852 - DNA, 201 bp, Bos taurus; identical to SEQ ID NO: 9001

SEQ ID NO: 90853 - DNA, 201 bp, Bos taurus
ctcggcggggagaactgtgttgcttgttcaatcacgcgagcactgtcctcgtgtggagctgtgggaagcttgggtttggggattagctgatctgtgcgtcagttgtggctggtttcagagggcaggtgtggcgttggtgtgagatgcacacccagtgatgggggtgcctctgaaactttctgtgtggctgcatgcttgtgc

SEQ ID NO: 90854 - DNA, 201 bp, Bos taurus
catagagggctccagcttggggcatgctgtggacccgccctccccccgccacacacacacttcttactcaggctctgcagcaggagcaccgacggaggccagttcacacacgacactaacctagggcgagggtatctgctcctcacaggggatggagccagagccctagatctgctgtggccactgccttcccaagaagag

SEQ ID NO: 90855 - DNA, 201 bp, Bos taurus
gtgcttgggatggcaaagagtagactgagcaactacatatgcacacacacacacactctccataaatgaccagcgtgtagttcaggcttccttacagacaactttatcacatttgatttctgctccaaagttgatgaatgtcgggcaaattttttgccgcatgaatgcagtgagtgcttggatgacatttttatacacacc

SEQ ID NO: 90856 - DNA, 201 bp, Bos taurus
tccatggagtcacaaagagtcagacatgactaagtgactaacacattgggcatagggatttgggggtgtaattgtaaggagttaatctgtacaagatgcaaatcctggcacctggcacttagtgagtaactgctgggggatgtcattgttgctgttgttacagcaccttacagtttacgaggcgcttctatcaatattaca

SEQ ID NO: 90857 - DNA, 201 bp, Bos taurus; identical to SEQ ID NO: 9006

SEQ ID NO: 90858 - DNA, 201 bp, Bos taurus; identical to SEQ ID NO: 9007

SEQ ID NO: 90859 - DNA, 201 bp, Bos taurus; identical to SEQ ID NO: 9008

SEQ ID NO: 90860 - DNA, 201 bp, Bos taurus; identical to SEQ ID NO: 9009

SEQ ID NO: 90861 - DNA, 201 bp, Bos taurus; identical to SEQ ID NO: 9010

SEQ ID NO: 90862 - DNA, 201 bp, Bos taurus; identical to SEQ ID NO: 9011

SEQ ID NO: 90863 - DNA, 201 bp, Bos taurus; identical to SEQ ID NO: 9012

SEQ ID NO: 90864 - DNA, 201 bp, Bos taurus; identical to SEQ ID NO: 9013

SEQ ID NO: 90865 - DNA, 201 bp, Bos taurus; identical to SEQ ID NO: 9014

SEQ ID NO: 90866 - DNA, 201 bp, Bos taurus; identical to SEQ ID NO: 9015

SEQ ID NO: 90867 - DNA, 201 bp, Bos taurus; identical to SEQ ID NO: 9016

SEQ ID NO: 90868 - DNA, 201 bp, Bos taurus; identical to SEQ ID NO: 9017

SEQ ID NO: 90869 - DNA, 201 bp, Bos taurus; identical to SEQ ID NO: 9018

SEQ ID NO: 90870 - DNA, 201 bp, Bos taurus; identical to SEQ ID NO: 9019

SEQ ID NO: 90871 - DNA, 201 bp, Bos taurus; identical to SEQ ID NO: 9020

SEQ ID NO: 90872 - DNA, 201 bp, Bos taurus; identical to SEQ ID NO: 9021

SEQ ID NO: 90873 - DNA, 201 bp, Bos taurus; identical to SEQ ID NO: 9022

SEQ ID NO: 90874 - DNA, 201 bp, Bos taurus; identical to SEQ ID NO: 9023

SEQ ID NO: 90875 - DNA, 201 bp, Bos taurus; identical to SEQ ID NO: 9024

SEQ ID NO: 90876 - DNA, 201 bp, Bos taurus; identical to SEQ ID NO: 9025

SEQ ID NO: 90877 - DNA, 201 bp, Bos taurus; identical to SEQ ID NO: 9026

SEQ ID NO: 90878 - DNA, 201 bp, Bos taurus; identical to SEQ ID NO: 9027

SEQ ID NO: 90879 - DNA, 201 bp, Bos taurus; identical to SEQ ID NO: 9028

SEQ ID NO: 90880 - DNA, 201 bp, Bos taurus; identical to SEQ ID NO: 9029

SEQ ID NO: 90881 - DNA, 201 bp, Bos taurus; identical to SEQ ID NO: 9030

SEQ ID NO: 90882 - DNA, 201 bp, Bos taurus; identical to SEQ ID NO: 9031

SEQ ID NO: 90883 - DNA, 201 bp, Bos taurus; identical to SEQ ID NO: 9032

SEQ ID NO: 90884 - DNA, 201 bp, Bos taurus; identical to SEQ ID NO: 9033

SEQ ID NO: 90885 - DNA, 201 bp, Bos taurus; identical to SEQ ID NO: 9034

SEQ ID NO: 90886 - DNA, 201 bp, Bos taurus; identical to SEQ ID NO: 9036

SEQ ID NO: 90887 - DNA, 201 bp, Bos taurus; identical to SEQ ID NO: 9037

SEQ ID NO: 90888 - DNA, 201 bp, Bos taurus; identical to SEQ ID NO: 9038

SEQ ID NO: 90889 - DNA, 201 bp, Bos taurus; identical to SEQ ID NO: 9039

SEQ ID NO: 90890 - DNA, 201 bp, Bos taurus; identical to SEQ ID NO: 9041

SEQ ID NO: 90891 - DNA, 201 bp, Bos taurus; identical to SEQ ID NO: 9042

SEQ ID NO: 90892 - DNA, 201 bp, Bos taurus; identical to SEQ ID NO: 9043

SEQ ID NO: 90893 - DNA, 201 bp, Bos taurus; identical to SEQ ID NO: 9044

SEQ ID NO: 90894 - DNA, 201 bp, Bos taurus
acatttatagactaactctgagctaataacatgatcaggtcttttgaagaaatattaaggtgtatagttatgtggaaaaagtcctaagacagagagagatctgacctcctagagtttgggatccttggaaacctacctatcagtgtgaagacagtaaacacaaactagcaaggatataaattcctgttgctgaccatttga

SEQ ID NO: 90895 - DNA, 201 bp, Bos taurus; identical to SEQ ID NO: 9045

SEQ ID NO: 90896 - DNA, 201 bp, Bos taurus
cccactccagtattctagcctgggaaatcccatgaacagaggaacgtggtgggctaccatccacggggtcacgtagagtcagataggactttgtgattaagcaacaacaaattagagcctcaaaagtttcttccatttattttaggtgaatttatgagtttgctttgtttttattttattatcaagcatagggtctacata

SEQ ID NO: 90897 - DNA, 201 bp, Bos taurus; identical to SEQ ID NO: 9048

SEQ ID NO: 90898 - DNA, 201 bp, Bos taurus
tcaattacatgccccattaaaaagtgaatgcaaaataataccattgaattccagcttccgaagcaggcttaagatcagatgcattgtgttaatttggaatttcctgtaattgaaatgttggacccatttatgacattgataatattcttttatattttcaaaatagttttttctcatgtctttattataaaaattgtcata

SEQ ID NO: 90899 - DNA, 201 bp, Bos taurus; identical to SEQ ID NO: 9049

SEQ ID NO: 90900 - DNA, 201 bp, Bos taurus
tctagtattctagacatatattctatattataattatgccttacatgttaaggcataattatgtgctgttcttagttgctcattcgtgtctgacattttgcgaccccaaagagggatctactctttgacagtctgccagggtcctctgtccatggggattctccaggcaagactactagagtgtattgccatgccttccta

SEQ ID NO: 90901 - DNA, 201 bp, Bos taurus
ccttaggccaagctatcagacaactgaagacatatcacccaccagaagacagtctgcctctcaacctcctgagtccacaactatcccaggataaagttatgtccaccagagggcccaggacccagctccacacaccatggggccagcactagctctaggacagccatagccatgcagccagagaccccaagactcagatat

SEQ ID NO: 90902 - DNA, 201 bp, Bos taurus; identical to SEQ ID NO: 9050

SEQ ID NO: 90903 - DNA, 201 bp, Bos taurus; identical to SEQ ID NO: 9051

SEQ ID NO: 90904 - DNA, 201 bp, Bos taurus; identical to SEQ ID NO: 9052

SEQ ID NO: 90905 - DNA, 201 bp, Bos taurus; identical to SEQ ID NO: 9053

SEQ ID NO: 90906 - DNA, 201 bp, Bos taurus; identical to SEQ ID NO: 9054

SEQ ID NO: 90907 - DNA, 201 bp, Bos taurus; identical to SEQ ID NO: 9055

SEQ ID NO: 90908 - DNA, 201 bp, Bos taurus; identical to SEQ ID NO: 9056

SEQ ID NO: 90909 - DNA, 201 bp, Bos taurus; identical to SEQ ID NO: 9057

SEQ ID NO: 90910 - DNA, 201 bp, Bos taurus; identical to SEQ ID NO: 9058

SEQ ID NO: 90911 - DNA, 201 bp, Bos taurus; identical to SEQ ID NO: 9059

SEQ ID NO: 90912 - DNA, 201 bp, Bos taurus
taagtccatttatgcattatgtagactcatcaataagtggaaaaatattgaaacagacttcactatgcctttctaaatttttttgctccattacctgtgtcatttgttctgtatagaattaggactgtcacatattcataaaatttgccttaaattattatgtaatgtgtcttttcaatgactttagtactctgaatatta

SEQ ID NO: 90913 - DNA, 201 bp, Bos taurus; identical to SEQ ID NO: 9061

SEQ ID NO: 90914 - DNA, 201 bp, Bos taurus; identical to SEQ ID NO: 9062

SEQ ID NO: 90915 - DNA, 201 bp, Bos taurus; identical to SEQ ID NO: 9063

SEQ ID NO: 90916 - DNA, 201 bp, Bos taurus; identical to SEQ ID NO: 9065

SEQ ID NO: 90917 - DNA, 201 bp, Bos taurus; identical to SEQ ID NO: 9066

SEQ ID NO: 90918 - DNA, 201 bp, Bos taurus
acagaaaactagtatatgttattattcatactgtaatcattttatttacatatttggagtcgagtcagaaatacatgctcaaatactcttactactactactaaatattcttaagtggtgcatttttcccatagtcccctgttatgatcactaaagtttttaatcttctgtatgcacaataaagatgttatgttacattat

SEQ ID NO: 90919 - DNA, 201 bp, Bos taurus; identical to SEQ ID NO: 9068

SEQ ID NO: 90920 - DNA, 201 bp, Bos taurus; identical to SEQ ID NO: 9069

SEQ ID NO: 90921 - DNA, 201 bp, Bos taurus; identical to SEQ ID NO: 9070

SEQ ID NO: 90922 - DNA, 201 bp, Bos taurus; identical to SEQ ID NO: 9071

SEQ ID NO: 90923 - DNA, 201 bp, Bos taurus; identical to SEQ ID NO: 9072

SEQ ID NO: 90924 - DNA, 201 bp, Bos taurus
catactactactgatttcattcaagtggcttaagagttctctcctggactattaaaatcacaggataaatagccaccatatttacatttactttctattctccaggttgctgctgcagtgaaatttttaacatccaatctacacatgatacttgcttgtctccatcatccttcttttgacagaatattgtccacacaattt

SEQ ID NO: 90925 - DNA, 201 bp, Bos taurus; identical to SEQ ID NO: 9073

SEQ ID NO: 90926 - DNA, 201 bp, Bos taurus; identical to SEQ ID NO: 9075

SEQ ID NO: 90927 - DNA, 201 bp, Bos taurus
aggggaaactaggggcttacaaaattatgtgattttcatccttatacataattggtgtcaaatataaacattttagctccaagacttgtaatcctaacctcgtactcagatcactaaactgcatgtacttcagaacattccaaacataaactcttacctggtaaggacctgaaagcttttctagtccagcccttggattgt

SEQ ID NO: 90928 - DNA, 201 bp, Bos taurus
tacctttggagaatgtatacccagattttacaaatcacctcttaaaaaatgtctcatttaaggaataataattcacgtgtagccctaggaaataaagacaccctctcatcgtgtcacatcctcccttccttctgtgcaccttgtaaacttcctgccagcctgcaaggcttatttcttgctgtgtacctgccttatcctccc

SEQ ID NO: 90929 - DNA, 201 bp, Bos taurus
acctatggtgctcattagtaaatgtgtagaaatgcttctcctggttattagtcatatctcggattcgtttgtataccggagcactcctatttctcacttcttggagaactgtctgtagcacgatgacattcctgatggcagggtcctcaaggacatcaatcttttaagtaaataaataaatggttattttttcccatgttc

SEQ ID NO: 90930 - DNA, 201 bp, Bos taurus
gtgttccaaaaatgccagtgaggcataatttgaattttcatttaaaacaattttgttttattgtaatgagaccctcttgaagtaattagtagaaacaacccctggacatgaaactagttttgagattcactttctttgatataagtcagtttcttaagacatagatccataatgccagtttcccataaaaattagtttgaa

SEQ ID NO: 90931 - DNA, 201 bp, Bos taurus; identical to SEQ ID NO: 9077

SEQ ID NO: 90932 - DNA, 201 bp, Bos taurus; identical to SEQ ID NO: 9078

SEQ ID NO: 90933 - DNA, 201 bp, Bos taurus; identical to SEQ ID NO: 9079

SEQ ID NO: 90934 - DNA, 201 bp, Bos taurus; identical to SEQ ID NO: 9080

SEQ ID NO: 90935 - DNA, 201 bp, Bos taurus; identical to SEQ ID NO: 9081

SEQ ID NO: 90936 - DNA, 201 bp, Bos taurus; identical to SEQ ID NO: 9082

SEQ ID NO: 90937 - DNA, 201 bp, Bos taurus; identical to SEQ ID NO: 9083

SEQ ID NO: 90938 - DNA, 201 bp, Bos taurus; identical to SEQ ID NO: 9084

SEQ ID NO: 90939 - DNA, 201 bp, Bos taurus; identical to SEQ ID NO: 9085

SEQ ID NO: 90940 - DNA, 201 bp, Bos taurus; identical to SEQ ID NO: 9086

SEQ ID NO: 90941 - DNA, 201 bp, Bos taurus; identical to SEQ ID NO: 9087

SEQ ID NO: 90942 - DNA, 201 bp, Bos taurus; identical to SEQ ID NO: 9088

SEQ ID NO: 90943 - DNA, 201 bp, Bos taurus; identical to SEQ ID NO: 9090

SEQ ID NO: 90944 - DNA, 201 bp, Bos taurus; identical to SEQ ID NO: 9092

SEQ ID NO: 90945 - DNA, 201 bp, Bos taurus; identical to SEQ ID NO: 9093

SEQ ID NO: 90946 - DNA, 201 bp, Bos taurus
aagctccaaaaaaagaaaacaaagaaacaaaacacattctagtcacataatttcatacatgaaagtgaaagaatggagaacaggccaatgacttgttctgctttttcaccatggagggaaagtagttctggggcgtccccaagagatttacattatgtctgattggccagaatgaaggcacatatccacttctagctggaa

SEQ ID NO: 90947 - DNA, 201 bp, Bos taurus; identical to SEQ ID NO: 9096

SEQ ID NO: 90948 - DNA, 201 bp, Bos taurus
ctccaaaaacagatgaatgagaaagctgatggccaagtctaaggggctaaactctggaaactgctcccctcagcgctcacactcaagatgggaactcagattgacaagaaactgctagacatgaaatcaaacttgagcagaacaggaaaaggaaagagaaggtccagagaaaagaagaaaagaataagccaggaaatctca

SEQ ID NO: 90949 - DNA, 201 bp, Bos taurus; identical to SEQ ID NO: 9097

SEQ ID NO: 90950 - DNA, 201 bp, Bos taurus; identical to SEQ ID NO: 9098

SEQ ID NO: 90951 - DNA, 201 bp, Bos taurus; identical to SEQ ID NO: 9099

SEQ ID NO: 90952 - DNA, 201 bp, Bos taurus; identical to SEQ ID NO: 9100

SEQ ID NO: 90953 - DNA, 201 bp, Bos taurus; identical to SEQ ID NO: 9101

SEQ ID NO: 90954 - DNA, 201 bp, Bos taurus; identical to SEQ ID NO: 9102

SEQ ID NO: 90955 - DNA, 201 bp, Bos taurus
gttttattatattccagagactggtatccatcaggctgatcattaatgagtattctcactacctacatcttcgttcccatatttcaactgctttatatgatgtctgatgaaaaaaaaaagtttctatattattagctatactgttttttttttttcttaaaaattctgtacccactcttgaagagtcagtaattatttctt

SEQ ID NO: 90956 - DNA, 201 bp, Bos taurus; identical to SEQ ID NO: 9103

SEQ ID NO: 90957 - DNA, 201 bp, Bos taurus; identical to SEQ ID NO: 9104

SEQ ID NO: 90958 - DNA, 201 bp, Bos taurus
cagtttcttggtcttgaaacagtaattcataagggttttctgttattgctgcttcagtttatattgcttactttacagactggtgctgcatgttattaaacgttccttttgtaagtgcctgtgactgtactaccagaggagatttggagggagtcacgattgcatcgaagcagaaggaaatgccattcacttttggatttt

SEQ ID NO: 90959 - DNA, 201 bp, Bos taurus
cccagcatatgtagtctaagagagaaaggaaaaatggcaacaagggggaaggtgggaaatttttaaataatgggtaacacatgataaggactattctaaagaccttgcatgtacagttcatggggtgttggaaaggaaggaattttcctttactttccctggttcttctggctggtttaagaattaaattgacatgagaca

SEQ ID NO: 90960 - DNA, 201 bp, Bos taurus; identical to SEQ ID NO: 9108

SEQ ID NO: 90961 - DNA, 201 bp, Bos taurus
ccaggccccgtcaaaacctctaccagaagttctccagcagctcttcctgaactttatgggtaagttcaaggcaaaggttccaggaagtcatattttagcccgcctctggcccaagccccagtgcagcatgatcagtagtgagccgaacactgcattttcatctccatctggcttgtgtgtcgaacacacaattgattctga

SEQ ID NO: 90962 - DNA, 201 bp, Bos taurus
aaatgaaaatatctcctgctatatcaataaacaagaaatgtcacagtcatcagtggtttctggcctccaaatgtgaatgagggcccccaaaactgtgatccgtcagatgctgccatgccccatgattgctgaagatctgggggaatgcaaaaagcaaggtaaacaaggaaaccggagtggccctagatagctgaggtgcat

SEQ ID NO: 90963 - DNA, 201 bp, Bos taurus; identical to SEQ ID NO: 9109

SEQ ID NO: 90964 - DNA, 201 bp, Bos taurus; identical to SEQ ID NO: 9110

SEQ ID NO: 90965 - DNA, 201 bp, Bos taurus; identical to SEQ ID NO: 9112

SEQ ID NO: 90966 - DNA, 201 bp, Bos taurus; identical to SEQ ID NO: 9113

SEQ ID NO: 90967 - DNA, 201 bp, Bos taurus; identical to SEQ ID NO: 9114

SEQ ID NO: 90968 - DNA, 201 bp, Bos taurus
gaatgaagggctgaggtgagactctgaaagatgaacttgagtggagaggtcaggtctggctcacgggtcaccaccaatctgagttacatccctaactgccagtccagagctcttccccagagccgtgaaacgtcccatgatccatcatacaggccacacgctgaggccttcaaggaccaagatttggacacaggcacaccc

SEQ ID NO: 90969 - DNA, 201 bp, Bos taurus; identical to SEQ ID NO: 9116

SEQ ID NO: 90970 - DNA, 201 bp, Bos taurus; identical to SEQ ID NO: 9117

SEQ ID NO: 90971 - DNA, 201 bp, Bos taurus; identical to SEQ ID NO: 9118

SEQ ID NO: 90972 - DNA, 201 bp, Bos taurus; identical to SEQ ID NO: 9119

SEQ ID NO: 90973 - DNA, 201 bp, Bos taurus; identical to SEQ ID NO: 9120

SEQ ID NO: 90974 - DNA, 201 bp, Bos taurus; identical to SEQ ID NO: 9121

SEQ ID NO: 90975 - DNA, 201 bp, Bos taurus; identical to SEQ ID NO: 9122

SEQ ID NO: 90976 - DNA, 201 bp, Bos taurus; identical to SEQ ID NO: 9123

SEQ ID NO: 90977 - DNA, 201 bp, Bos taurus; identical to SEQ ID NO: 9124

SEQ ID NO: 90978 - DNA, 201 bp, Bos taurus; identical to SEQ ID NO: 9125

SEQ ID NO: 90979 - DNA, 201 bp, Bos taurus; identical to SEQ ID NO: 9126

SEQ ID NO: 90980 - DNA, 201 bp, Bos taurus; identical to SEQ ID NO: 9127

SEQ ID NO: 90981 - DNA, 201 bp, Bos taurus; identical to SEQ ID NO: 9128

SEQ ID NO: 90982 - DNA, 201 bp, Bos taurus; identical to SEQ ID NO: 9129

SEQ ID NO: 90983 - DNA, 201 bp, Bos taurus; identical to SEQ ID NO: 9130

SEQ ID NO: 90984 - DNA, 201 bp, Bos taurus; identical to SEQ ID NO: 9131

SEQ ID NO: 90985 - DNA, 201 bp, Bos taurus; identical to SEQ ID NO: 9132

SEQ ID NO: 90986 - DNA, 201 bp, Bos taurus; identical to SEQ ID NO: 9133

SEQ ID NO: 90987 - DNA, 201 bp, Bos taurus; identical to SEQ ID NO: 9134

SEQ ID NO: 90988 - DNA, 201 bp, Bos taurus; identical to SEQ ID NO: 9135

SEQ ID NO: 90989 - DNA, 201 bp, Bos taurus; identical to SEQ ID NO: 9136

SEQ ID NO: 90990 - DNA, 201 bp, Bos taurus; identical to SEQ ID NO: 9137

SEQ ID NO: 90991 - DNA, 201 bp, Bos taurus; identical to SEQ ID NO: 9138

SEQ ID NO: 90992 - DNA, 201 bp, Bos taurus; identical to SEQ ID NO: 9139

SEQ ID NO: 90993 - DNA, 201 bp, Bos taurus; identical to SEQ ID NO: 9140

SEQ ID NO: 90994 - DNA, 201 bp, Bos taurus; identical to SEQ ID NO: 9141

SEQ ID NO: 90995 - DNA, 201 bp, Bos taurus; identical to SEQ ID NO: 9142

SEQ ID NO: 90996 - DNA, 201 bp, Bos taurus; identical to SEQ ID NO: 9143

SEQ ID NO: 90997 - DNA, 201 bp, Bos taurus; identical to SEQ ID NO: 9144

SEQ ID NO: 90998 - DNA, 201 bp, Bos taurus; identical to SEQ ID NO: 9145

SEQ ID NO: 90999 - DNA, 201 bp, Bos taurus; identical to SEQ ID NO: 9146

SEQ ID NO: 91000 - DNA, 201 bp, Bos taurus; identical to SEQ ID NO: 9147

SEQ ID NO: 91001 - DNA, 201 bp, Bos taurus; identical to SEQ ID NO: 9148

SEQ ID NO: 91002 - DNA, 201 bp, Bos taurus; identical to SEQ ID NO: 9149

SEQ ID NO: 91003 - DNA, 201 bp, Bos taurus; identical to SEQ ID NO: 9150

SEQ ID NO: 91004 - DNA, 201 bp, Bos taurus; identical to SEQ ID NO: 9151

SEQ ID NO: 91005 - DNA, 201 bp, Bos taurus; identical to SEQ ID NO: 9152

SEQ ID NO: 91006 - DNA, 201 bp, Bos taurus; identical to SEQ ID NO: 9153

SEQ ID NO: 91007 - DNA, 201 bp, Bos taurus; identical to SEQ ID NO: 9154

SEQ ID NO: 91008 - DNA, 201 bp, Bos taurus; identical to SEQ ID NO: 9155

SEQ ID NO: 91009 - DNA, 201 bp, Bos taurus; identical to SEQ ID NO: 9156

SEQ ID NO: 91010 - DNA, 201 bp, Bos taurus; identical to SEQ ID NO: 9157

SEQ ID NO: 91011 - DNA, 201 bp, Bos taurus; identical to SEQ ID NO: 9158

SEQ ID NO: 91012 - DNA, 201 bp, Bos taurus; identical to SEQ ID NO: 9159

SEQ ID NO: 91013 - DNA, 201 bp, Bos taurus; identical to SEQ ID NO: 9160

SEQ ID NO: 91014 - DNA, 201 bp, Bos taurus; identical to SEQ ID NO: 9161

SEQ ID NO: 91015 - DNA, 201 bp, Bos taurus; identical to SEQ ID NO: 9162

SEQ ID NO: 91016 - DNA, 201 bp, Bos taurus; identical to SEQ ID NO: 9163

SEQ ID NO: 91017 - DNA, 201 bp, Bos taurus; identical to SEQ ID NO: 9164

SEQ ID NO: 91018 - DNA, 201 bp, Bos taurus; identical to SEQ ID NO: 9165

SEQ ID NO: 91019 - DNA, 201 bp, Bos taurus; identical to SEQ ID NO: 9166

SEQ ID NO: 91020 - DNA, 201 bp, Bos taurus; identical to SEQ ID NO: 9169

SEQ ID NO: 91021 - DNA, 201 bp, Bos taurus; identical to SEQ ID NO: 9170

SEQ ID NO: 91022 - DNA, 201 bp, Bos taurus; identical to SEQ ID NO: 9171

SEQ ID NO: 91023 - DNA, 201 bp, Bos taurus; identical to SEQ ID NO: 9172

SEQ ID NO: 91024 - DNA, 201 bp, Bos taurus; identical to SEQ ID NO: 9173

SEQ ID NO: 91025 - DNA, 201 bp, Bos taurus; identical to SEQ ID NO: 9174

SEQ ID NO: 91026 - DNA, 201 bp, Bos taurus; identical to SEQ ID NO: 9175

SEQ ID NO: 91027 - DNA, 201 bp, Bos taurus; identical to SEQ ID NO: 9176

SEQ ID NO: 91028 - DNA, 201 bp, Bos taurus; identical to SEQ ID NO: 9177

SEQ ID NO: 91029 - DNA, 201 bp, Bos taurus; identical to SEQ ID NO: 9178

SEQ ID NO: 91030 - DNA, 201 bp, Bos taurus; identical to SEQ ID NO: 9179

SEQ ID NO: 91031 - DNA, 201 bp, Bos taurus; identical to SEQ ID NO: 9180

SEQ ID NO: 91032 - DNA, 201 bp, Bos taurus; identical to SEQ ID NO: 9181

SEQ ID NO: 91033 - DNA, 201 bp, Bos taurus; identical to SEQ ID NO: 9182

SEQ ID NO: 91034 - DNA, 201 bp, Bos taurus; identical to SEQ ID NO: 9183

SEQ ID NO: 91035 - DNA, 201 bp, Bos taurus; identical to SEQ ID NO: 9184

SEQ ID NO: 91036 - DNA, 201 bp, Bos taurus; identical to SEQ ID NO: 9185

SEQ ID NO: 91037 - DNA, 201 bp, Bos taurus; identical to SEQ ID NO: 9186

SEQ ID NO: 91038 - DNA, 201 bp, Bos taurus; identical to SEQ ID NO: 9187

SEQ ID NO: 91039 - DNA, 201 bp, Bos taurus; identical to SEQ ID NO: 9188

SEQ ID NO: 91040 - DNA, 201 bp, Bos taurus; identical to SEQ ID NO: 9189

SEQ ID NO: 91041 - DNA, 201 bp, Bos taurus; identical to SEQ ID NO: 9190

SEQ ID NO: 91042 - DNA, 201 bp, Bos taurus; identical to SEQ ID NO: 9191

SEQ ID NO: 91043 - DNA, 201 bp, Bos taurus; identical to SEQ ID NO: 9192

SEQ ID NO: 91044 - DNA, 201 bp, Bos taurus; identical to SEQ ID NO: 9193

SEQ ID NO: 91045 - DNA, 201 bp, Bos taurus; identical to SEQ ID NO: 9194

SEQ ID NO: 91046 - DNA, 201 bp, Bos taurus; identical to SEQ ID NO: 9195

SEQ ID NO: 91047 - DNA, 201 bp, Bos taurus; identical to SEQ ID NO: 9196

SEQ ID NO: 91048 - DNA, 201 bp, Bos taurus; identical to SEQ ID NO: 9197

SEQ ID NO: 91049 - DNA, 201 bp, Bos taurus; identical to SEQ ID NO: 9199

SEQ ID NO: 91050 - DNA, 201 bp, Bos taurus; identical to SEQ ID NO: 9200

SEQ ID NO: 91051 - DNA, 201 bp, Bos taurus; identical to SEQ ID NO: 9201

SEQ ID NO: 91052 - DNA, 201 bp, Bos taurus; identical to SEQ ID NO: 9202

SEQ ID NO: 91053 - DNA, 201 bp, Bos taurus; identical to SEQ ID NO: 9203

SEQ ID NO: 91054 - DNA, 201 bp, Bos taurus; identical to SEQ ID NO: 9204

SEQ ID NO: 91055 - DNA, 201 bp, Bos taurus; identical to SEQ ID NO: 9205

SEQ ID NO: 91056 - DNA, 201 bp, Bos taurus; identical to SEQ ID NO: 9206

SEQ ID NO: 91057 - DNA, 201 bp, Bos taurus; identical to SEQ ID NO: 9207

SEQ ID NO: 91058 - DNA, 201 bp, Bos taurus; identical to SEQ ID NO: 9208

SEQ ID NO: 91059 - DNA, 201 bp, Bos taurus; identical to SEQ ID NO: 9209

SEQ ID NO: 91060 - DNA, 201 bp, Bos taurus; identical to SEQ ID NO: 9210

SEQ ID NO: 91061 - DNA, 201 bp, Bos taurus; identical to SEQ ID NO: 9211

SEQ ID NO: 91062 - DNA, 201 bp, Bos taurus; identical to SEQ ID NO: 9212

SEQ ID NO: 91063 - DNA, 201 bp, Bos taurus; identical to SEQ ID NO: 9213

SEQ ID NO: 91064 - DNA, 201 bp, Bos taurus; identical to SEQ ID NO: 9214

SEQ ID NO: 91065 - DNA, 201 bp, Bos taurus; identical to SEQ ID NO: 9215

SEQ ID NO: 91066 - DNA, 201 bp, Bos taurus; identical to SEQ ID NO: 9216

SEQ ID NO: 91067 - DNA, 201 bp, Bos taurus; identical to SEQ ID NO: 9217

SEQ ID NO: 91068 - DNA, 201 bp, Bos taurus; identical to SEQ ID NO: 9218

SEQ ID NO: 91069 - DNA, 201 bp, Bos taurus; identical to SEQ ID NO: 9219

SEQ ID NO: 91070 - DNA, 201 bp, Bos taurus; identical to SEQ ID NO: 9220

SEQ ID NO: 91071 - DNA, 201 bp, Bos taurus; identical to SEQ ID NO: 9221

SEQ ID NO: 91072 - DNA, 201 bp, Bos taurus; identical to SEQ ID NO: 9222

SEQ ID NO: 91073 - DNA, 201 bp, Bos taurus; identical to SEQ ID NO: 9223

SEQ ID NO: 91074 - DNA, 201 bp, Bos taurus; identical to SEQ ID NO: 9224

SEQ ID NO: 91075 - DNA, 201 bp, Bos taurus; identical to SEQ ID NO: 9225

SEQ ID NO: 91076 - DNA, 201 bp, Bos taurus; identical to SEQ ID NO: 9226

SEQ ID NO: 91077 - DNA, 201 bp, Bos taurus
aagcaaatcagcacatttttagccagtagaaaatataaatgaatttaaaaatcaggatgcattaattgaatgcactcaattataatttaagttcctaactaaagttttccgtctttagatttgggtattccaggctaccctttacttcatggatgctaatattaatagatgaacttagaagcaaaatcaagaccttatcca

SEQ ID NO: 91078 - DNA, 201 bp, Bos taurus; identical to SEQ ID NO: 9228

SEQ ID NO: 91079 - DNA, 201 bp, Bos taurus
cactgctaagctctcccatccccaaacaccccccttctttgaggttccatgctaatacctgctagctttcagtggttctctgcatgcagccaggccggtcgtgggatgaaatgccactctacaagggagtttataattccagcacatctcgagtagcgggaacaaattctagttgtgtctatctccttggtaacttgaaca

SEQ ID NO: 91080 - DNA, 201 bp, Bos taurus; identical to SEQ ID NO: 9229

SEQ ID NO: 91081 - DNA, 201 bp, Bos taurus; identical to SEQ ID NO: 9230

SEQ ID NO: 91082 - DNA, 201 bp, Bos taurus; identical to SEQ ID NO: 9231

SEQ ID NO: 91083 - DNA, 201 bp, Bos taurus; identical to SEQ ID NO: 9232

SEQ ID NO: 91084 - DNA, 201 bp, Bos taurus; identical to SEQ ID NO: 9233

SEQ ID NO: 91085 - DNA, 201 bp, Bos taurus
tgaataattcaccaattttgttttctactatgtgccttaaagatacctcactagtaaaactggtatctggcacaacagaatgacataggcagactgtaatattgtagtgacagtaatgaggttgactgttacacttatttaaactctgagtattaaatgttgcatcctaattatttatatagaacattggtccaataacaa

SEQ ID NO: 91086 - DNA, 201 bp, Bos taurus; identical to SEQ ID NO: 9234

SEQ ID NO: 91087 - DNA, 201 bp, Bos taurus
cgcgccgagcgcggagcccgggccagcctccgcgcggcgcggcgggccaggcacgggccgcttcccactcctcggtcctctgggcctccgcccgggacttgcaactaacttcgcccaagtttcctgcgccggcgccgccgcgcccctgtcggcgcgctagcttcggagcgtgcgcccgcgtgtgctccgcggccagagccc

SEQ ID NO: 91088 - DNA, 201 bp, Bos taurus; identical to SEQ ID NO: 9235

SEQ ID NO: 91089 - DNA, 201 bp, Bos taurus
ctcttcaccgtccccaagcttcctggcatcagctcacattttttgcaaactgcccgagaccaagtgtcctacctcttccagctctagccctcagctggaagccgatttattaaatagctgcacaaggtttggaaggttgcccgggatgttcccatccggacaaaaaaagagaatccagtgagacaaaactgagatcctggg

SEQ ID NO: 91090 - DNA, 201 bp, Bos taurus; identical to SEQ ID NO: 9236

SEQ ID NO: 91091 - DNA, 201 bp, Bos taurus; identical to SEQ ID NO: 9237

SEQ ID NO: 91092 - DNA, 201 bp, Bos taurus
ggaaataagccacacttttctgaaatgaagagatcaagcaattattcagtaactattaagtgctgactttttaaaagcaaaaaactgaggctgggtcacaggaggaatatttaagaacctctgtatggtttagaaacctagaaagagtttctgccataagtagcttagaatcaattttagaactagggcaaatatacaaaa

SEQ ID NO: 91093 - DNA, 201 bp, Bos taurus
ccaagactatctaagataggattccttacttaagtgaactgattatgcactttaatcatttttacaaaatatctacacagtaacagcttgactacttttttactgagtaactgtggaatgctgcctggccaaaccgacacataaactgaccctggtagcttggtggttaggattccaagctttcactgccatggcctgggg

SEQ ID NO: 91094 - DNA, 201 bp, Bos taurus; identical to SEQ ID NO: 9238

SEQ ID NO: 91095 - DNA, 201 bp, Bos taurus; identical to SEQ ID NO: 9239

SEQ ID NO: 91096 - DNA, 201 bp, Bos taurus; identical to SEQ ID NO: 9240

SEQ ID NO: 91097 - DNA, 201 bp, Bos taurus; identical to SEQ ID NO: 9241

SEQ ID NO: 91098 - DNA, 201 bp, Bos taurus; identical to SEQ ID NO: 9242

SEQ ID NO: 91099 - DNA, 201 bp, Bos taurus
tgtggttacttgtgtactgattgtccaccactaggttataagccctgtgaggacatgggttgaacaatttctatctctggcctagaagataaaaatctgttaagtccatgttctataaggtgtatgttgaatttgggaggtttttgttgagatgaatgaatgggagcaaagaagactacagggcctgatctaccacccttg

SEQ ID NO: 91100 - DNA, 201 bp, Bos taurus; identical to SEQ ID NO: 9243

SEQ ID NO: 91101 - DNA, 201 bp, Bos taurus
catgacatcatataccagaaacaaagtccatcctaaattatgtattacaaactctacttttgaaaatacgataggaaagagttcaatttaatctaccactaagtgagtagataattgattgacccaaaccttttgggcaaactaggcttatctttgtgatacttatttgagtttgaattttcttgaaggaatgaagtcctg

SEQ ID NO: 91102 - DNA, 201 bp, Bos taurus; identical to SEQ ID NO: 9244

SEQ ID NO: 91103 - DNA, 201 bp, Bos taurus
ctgcattggcaggcagactctttacccctgggccacttgggaagctcaggtgacccacaggtacattcaaacatggaaagcactggccccaactacagacaaatgaatggacagatgggggagaagaaacgtgacaagttaggaaggcttcttggaggaggcctctagcgatgaaagcagctgccatttgggaagaaatga

SEQ ID NO: 91104 - DNA, 201 bp, Bos taurus; identical to SEQ ID NO: 9248

SEQ ID NO: 91105 - DNA, 201 bp, Bos taurus; identical to SEQ ID NO: 9249

SEQ ID NO: 91106 - DNA, 201 bp, Bos taurus; identical to SEQ ID NO: 9250

SEQ ID NO: 91107 - DNA, 201 bp, Bos taurus; identical to SEQ ID NO: 9251

SEQ ID NO: 91108 - DNA, 201 bp, Bos taurus; identical to SEQ ID NO: 9252

SEQ ID NO: 91109 - DNA, 201 bp, Bos taurus
gacaattagaacaggtgcatcggagcccatggtgtgagagcctgataaaagaaatggtaagggtgtggactcaattagctgggcaggaatgagaactgactggcccctagccatgacctcgaaagtggatcaagatggcatttaaaacaaagaaactatattacagcaaatatagggcctttataattgcttaagtaccta

SEQ ID NO: 91110 - DNA, 201 bp, Bos taurus; identical to SEQ ID NO: 9253

SEQ ID NO: 91111 - DNA, 201 bp, Bos taurus
ggaaaggattttcacaaatgaaaggacgctcctcagaaggaggaaggttcagcatttgtgagaaacatatccatcctctataacgggatttcctccaatgtggccactctgctgatttctgtcatcacaatgatttttgtcaacttttgacattcccataagtggagctgcacggtacccgctcttgtgtctgccttcttt

SEQ ID NO: 91112 - DNA, 201 bp, Bos taurus; identical to SEQ ID NO: 9254

SEQ ID NO: 91113 - DNA, 201 bp, Bos taurus; identical to SEQ ID NO: 9255

SEQ ID NO: 91114 - DNA, 201 bp, Bos taurus
ggtgggtttcagatgacctggtggccctctgctacctggggcggcaggacctggagggaggctgtggatgcgtggaaggaattcctgcgaggtcagtacacagcatttctccttccacatggccaggaggagcagagggatagaaaacaaagccagagccacagggaggcagcgaacagagcttgctggtgagcaaggcac

SEQ ID NO: 91115 - DNA, 201 bp, Bos taurus
cagttggcccagggtcacctgccctcgcggtgtttggcacaacccaggtcatctatactttgacaagtgcagccgcttcggccagtccactatgggagccgcacacacacgaaggggctacttctcaagagtctctgtcttcagtaaagcagcaaggccatgaaaagatggaggcggttgagaagccgtaaaccggagtgt

SEQ ID NO: 91116 - DNA, 201 bp, Bos taurus
gttggccaacacccactgcctgcagtgctcatgctctctccagcctgggtggttgcccctctgcttcattagagctgagctaaccgtatttattggcatcggcttttcattctcaaggataaacaccttggaatgagaatcaggaatctgggctttccagacttgctcttaatagcttggatgcagccaaagatcagcttc

SEQ ID NO: 91117 - DNA, 201 bp, Bos taurus; identical to SEQ ID NO: 9256

SEQ ID NO: 91118 - DNA, 201 bp, Bos taurus; identical to SEQ ID NO: 9257

SEQ ID NO: 91119 - DNA, 201 bp, Bos taurus
caatgatgtggctgctgctgaatcacagctgtggggggcggggggagagaaaaatctcatctttactttctggattcgtctttctctttgataatggcccattttgagccataaagctattataatagtagggatcacgtctctgggatttttgcccatgccactcattcagatgtcattggaagagccaccctggtgctt

SEQ ID NO: 91120 - DNA, 201 bp, Bos taurus; identical to SEQ ID NO: 9258

SEQ ID NO: 91121 - DNA, 201 bp, Bos taurus
ataacagaataatatatatatatataatagaataataatataataacagaataaaccagtctttgagaattttctgggaaagttagaaatgagtgaggagttaacattttgaatacattcagattaaagcagaggcttcgtactgtctcaaggagggaggagtttaggggagttgattctgtctttgacagactttcagca

SEQ ID NO: 91122 - DNA, 201 bp, Bos taurus; identical to SEQ ID NO: 9259

SEQ ID NO: 91123 - DNA, 201 bp, Bos taurus; identical to SEQ ID NO: 9260

SEQ ID NO: 91124 - DNA, 201 bp, Bos taurus
gacagaggagcctggcaggctacagtccatggggtcgcaagagtcggacatgacttaagaactgaaccaccaccaccatgccgtagggtatacagtagtataaacggaacgttgtaacatgaaacttacataatgctataagtcaatgttacctcagtaaaacaaagtgtttaaaaactgaagtgaatattgaaataaaga

SEQ ID NO: 91125 - DNA, 201 bp, Bos taurus; identical to SEQ ID NO: 9262

SEQ ID NO: 91126 - DNA, 201 bp, Bos taurus; identical to SEQ ID NO: 9263

SEQ ID NO: 91127 - DNA, 201 bp, Bos taurus; identical to SEQ ID NO: 9264

SEQ ID NO: 91128 - DNA, 201 bp, Bos taurus; identical to SEQ ID NO: 9265

SEQ ID NO: 91129 - DNA, 201 bp, Bos taurus; identical to SEQ ID NO: 9267

SEQ ID NO: 91130 - DNA, 201 bp, Bos taurus; identical to SEQ ID NO: 9268

SEQ ID NO: 91131 - DNA, 201 bp, Bos taurus
tgggaaatccccatggatggaggagcctggagggatacagtccatggagttgcaaagaggcagacatgactgagcacacatgtgctctttaaaggccttgtctacaagtatggttgcattgggggggtcagggacttcagcatatgaacttgggggtggggggtacatgcttcagtctatagcagcaccccttcctgagca

SEQ ID NO: 91132 - DNA, 201 bp, Bos taurus; identical to SEQ ID NO: 9269

SEQ ID NO: 91133 - DNA, 201 bp, Bos taurus
tcttgaccttcagtgggcatccctaaccttctaaagctgaccttcaaagttccgtttcccccacagcccttcccaggccaaaccaccccacttgatggctctttctgtagcttctaatcccttaagcaccacttacagatggactcgcttgcacttttaatggtaggtcatttgcacgagttaacctgaccccaacccagc

SEQ ID NO: 91134 - DNA, 201 bp, Bos taurus; identical to SEQ ID NO: 9270

SEQ ID NO: 91135 - DNA, 201 bp, Bos taurus
agagatgggcctattgctggggaactaaatgtgattttagtagcttttattgaaaccgttaactctacctggtaaattgctactgtattctttattcagttcttgtagtcacaaggatattaaaattccatactttaatttgtctctttctctgaggtactggtgatctgtttcatgtccccttgaattaattgatatcct

SEQ ID NO: 91136 - DNA, 201 bp, Bos taurus; identical to SEQ ID NO: 9271

SEQ ID NO: 91137 - DNA, 201 bp, Bos taurus; identical to SEQ ID NO: 9272

SEQ ID NO: 91138 - DNA, 201 bp, Bos taurus; identical to SEQ ID NO: 9273

SEQ ID NO: 91139 - DNA, 201 bp, Bos taurus; identical to SEQ ID NO: 9274

SEQ ID NO: 91140 - DNA, 201 bp, Bos taurus; identical to SEQ ID NO: 9275

SEQ ID NO: 91141 - DNA, 201 bp, Bos taurus; identical to SEQ ID NO: 9276

SEQ ID NO: 91142 - DNA, 201 bp, Bos taurus; identical to SEQ ID NO: 9277

SEQ ID NO: 91143 - DNA, 201 bp, Bos taurus; identical to SEQ ID NO: 9278

SEQ ID NO: 91144 - DNA, 201 bp, Bos taurus
gccagtgcagatttgagggtggcagaagggtgctgaggatttaacatcactgccgcatttctcattctggaggagaccaagccatggctgttggaagtccatcaggtgggaatgagcacaggccaggagtccctggagcagccgaaggatgtttgcggaggtccacacttgcacaccctccagccttctcgacatgtcctc

SEQ ID NO: 91145 - DNA, 201 bp, Bos taurus
gtaaagctgaaaaattaaaataaagtaaaaagaatggccaattgtttattcagatggaaataggctaaaaattcaataatatcttgggcctgtttccttgtcattatttatagatgcaaggaaatctgttacaatctgggatgcagtctaaggtttaaacgacagattataaaaagaattaggccttggtcaggtcaattc

SEQ ID NO: 91146 - DNA, 201 bp, Bos taurus
acacgactgatgcgacgcagcagcagcagcagcagcagcagcgcgtatatgtggactccaaaggagcaaaacgaaaccactgaccccccaacgaaagtcacagaaaaaagggatcagactcatgactaccagaggcagggatggctaggcggggcagggagtggaggaatgtgggcagaggtacaaacttcctgttttaag

SEQ ID NO: 91147 - DNA, 201 bp, Bos taurus; identical to SEQ ID NO: 9279

SEQ ID NO: 91148 - DNA, 201 bp, Bos taurus; identical to SEQ ID NO: 9280

SEQ ID NO: 91149 - DNA, 201 bp, Bos taurus; identical to SEQ ID NO: 9281

SEQ ID NO: 91150 - DNA, 201 bp, Bos taurus; identical to SEQ ID NO: 9282

SEQ ID NO: 91151 - DNA, 201 bp, Bos taurus; identical to SEQ ID NO: 9283

SEQ ID NO: 91152 - DNA, 201 bp, Bos taurus; identical to SEQ ID NO: 9284

SEQ ID NO: 91153 - DNA, 201 bp, Bos taurus; identical to SEQ ID NO: 9287

SEQ ID NO: 91154 - DNA, 201 bp, Bos taurus; identical to SEQ ID NO: 9288

SEQ ID NO: 91155 - DNA, 201 bp, Bos taurus; identical to SEQ ID NO: 9289

SEQ ID NO: 91156 - DNA, 201 bp, Bos taurus; identical to SEQ ID NO: 9290

SEQ ID NO: 91157 - DNA, 201 bp, Bos taurus; identical to SEQ ID NO: 9291

SEQ ID NO: 91158 - DNA, 201 bp, Bos taurus; identical to SEQ ID NO: 9292

SEQ ID NO: 91159 - DNA, 201 bp, Bos taurus; identical to SEQ ID NO: 9295

SEQ ID NO: 91160 - DNA, 201 bp, Bos taurus; identical to SEQ ID NO: 9296

SEQ ID NO: 91161 - DNA, 201 bp, Bos taurus; identical to SEQ ID NO: 9297

SEQ ID NO: 91162 - DNA, 201 bp, Bos taurus
taaagatggctgccaagaatctcatccttggttactcaattgaacactaatctaggtgcttctgggaaggggctgtacagatgtaatgaaggccccaggtgagctaagcttagagtgtggagaccactactcagtcaggggagagtccttgacaagcacaggttgtctctggcccattgtggggaggtcctgataagggac

SEQ ID NO: 91163 - DNA, 201 bp, Bos taurus; identical to SEQ ID NO: 9298

SEQ ID NO: 91164 - DNA, 201 bp, Bos taurus; identical to SEQ ID NO: 9300

SEQ ID NO: 91165 - DNA, 201 bp, Bos taurus; identical to SEQ ID NO: 9302

SEQ ID NO: 91166 - DNA, 201 bp, Bos taurus; identical to SEQ ID NO: 9304

SEQ ID NO: 91167 - DNA, 201 bp, Bos taurus; identical to SEQ ID NO: 9305

SEQ ID NO: 91168 - DNA, 201 bp, Bos taurus
ttgttccagtcactttcattccatgagggtttcatcatctacaatatgtgccctcacccatggatcctgtaatgcgaccaagcccttaacacatactcaatgggaagtagttttgcaagttacacatattttcatttttatgtaattaatgtttctttctatctacatttcaacaaggaacattttaaggacaggatgtca

SEQ ID NO: 91169 - DNA, 201 bp, Bos taurus; identical to SEQ ID NO: 9306

SEQ ID NO: 91170 - DNA, 201 bp, Bos taurus; identical to SEQ ID NO: 9307

SEQ ID NO: 91171 - DNA, 201 bp, Bos taurus; identical to SEQ ID NO: 9308

SEQ ID NO: 91172 - DNA, 201 bp, Bos taurus; identical to SEQ ID NO: 9309

SEQ ID NO: 91173 - DNA, 201 bp, Bos taurus; identical to SEQ ID NO: 9310

SEQ ID NO: 91174 - DNA, 201 bp, Bos taurus; identical to SEQ ID NO: 9311

SEQ ID NO: 91175 - DNA, 201 bp, Bos taurus; identical to SEQ ID NO: 9312

SEQ ID NO: 91176 - DNA, 201 bp, Bos taurus; identical to SEQ ID NO: 9313

SEQ ID NO: 91177 - DNA, 201 bp, Bos taurus; identical to SEQ ID NO: 9314

SEQ ID NO: 91178 - DNA, 201 bp, Bos taurus; identical to SEQ ID NO: 9315

SEQ ID NO: 91179 - DNA, 201 bp, Bos taurus; identical to SEQ ID NO: 9318

SEQ ID NO: 91180 - DNA, 201 bp, Bos taurus; identical to SEQ ID NO: 9320

SEQ ID NO: 91181 - DNA, 201 bp, Bos taurus; identical to SEQ ID NO: 9322

SEQ ID NO: 91182 - DNA, 201 bp, Bos taurus; identical to SEQ ID NO: 9323

SEQ ID NO: 91183 - DNA, 201 bp, Bos taurus; identical to SEQ ID NO: 9324

SEQ ID NO: 91184 - DNA, 201 bp, Bos taurus; identical to SEQ ID NO: 9325

SEQ ID NO: 91185 - DNA, 201 bp, Bos taurus; identical to SEQ ID NO: 9327

SEQ ID NO: 91186 - DNA, 201 bp, Bos taurus; identical to SEQ ID NO: 9328

SEQ ID NO: 91187 - DNA, 201 bp, Bos taurus; identical to SEQ ID NO: 9331

SEQ ID NO: 91188 - DNA, 201 bp, Bos taurus
gtaaccttgctctttggctcatcggattattcgtggtcttgaaatactattttatgcagatgccagccggtctgctggcatgccacatgtgcctgagtgacagagaatggtgactttgaaaggtgtttcacatgctaaatgaatgtcctcttcctaccggattctgaaataattccagtgtgatccaaatgctgatagtat

SEQ ID NO: 91189 - DNA, 201 bp, Bos taurus
taagacagagactttgacacatgtttgtagaatccattataggtgttttgggtcatgtttataggaaatagaaaggggtgatgttcaggtccacggcagagaactcacttttattaatcattatattaataagataaagatttgacagcaacagttccatctatgattttgagttgccaagagaaaaatctgtcttccatt

SEQ ID NO: 91190 - DNA, 201 bp, Bos taurus; identical to SEQ ID NO: 9335

SEQ ID NO: 91191 - DNA, 201 bp, Bos taurus
tagagcagatcactgtggttgaaacaaaactggggccggggggatatgttaggaaaggaagaatagcatctaaaaggctaagcctaatgagatgggaggagcttcccaggggcaaagaactggcctgccaatgcaggaaacataagagatgcaggttcgatccctggatcgggaagatcctctggaggagggcatgacaac

SEQ ID NO: 91192 - DNA, 201 bp, Bos taurus; identical to SEQ ID NO: 9336

SEQ ID NO: 91193 - DNA, 201 bp, Bos taurus
gcacccaggactcccctggtggcccaggggttgggactctgagcttccactgcggggggcttgggtctgatccctgatgggaaaactaagatccctcatgctgcacggccaagaaaataactaaaatcaaataacaaaaagacatcaagacaataaagaaaataacaaaacagcatcctgtatgcctgcaatgattctacg

SEQ ID NO: 91194 - DNA, 201 bp, Bos taurus; identical to SEQ ID NO: 9342

SEQ ID NO: 91195 - DNA, 201 bp, Bos taurus; identical to SEQ ID NO: 9343

SEQ ID NO: 91196 - DNA, 201 bp, Bos taurus; identical to SEQ ID NO: 9344

SEQ ID NO: 91197 - DNA, 201 bp, Bos taurus; identical to SEQ ID NO: 9345

SEQ ID NO: 91198 - DNA, 201 bp, Bos taurus; identical to SEQ ID NO: 9346

SEQ ID NO: 91199 - DNA, 201 bp, Bos taurus; identical to SEQ ID NO: 9347

SEQ ID NO: 91200 - DNA, 201 bp, Bos taurus; identical to SEQ ID NO: 9348

SEQ ID NO: 91201 - DNA, 201 bp, Bos taurus; identical to SEQ ID NO: 9349

SEQ ID NO: 91202 - DNA, 201 bp, Bos taurus; identical to SEQ ID NO: 9350

SEQ ID NO: 91203 - DNA, 201 bp, Bos taurus; identical to SEQ ID NO: 9351

SEQ ID NO: 91204 - DNA, 201 bp, Bos taurus; identical to SEQ ID NO: 9352

SEQ ID NO: 91205 - DNA, 201 bp, Bos taurus; identical to SEQ ID NO: 9353

SEQ ID NO: 91206 - DNA, 201 bp, Bos taurus; identical to SEQ ID NO: 9354

SEQ ID NO: 91207 - DNA, 201 bp, Bos taurus; identical to SEQ ID NO: 9355

SEQ ID NO: 91208 - DNA, 201 bp, Bos taurus; identical to SEQ ID NO: 9356

SEQ ID NO: 91209 - DNA, 201 bp, Bos taurus; identical to SEQ ID NO: 9357

SEQ ID NO: 91210 - DNA, 201 bp, Bos taurus; identical to SEQ ID NO: 9358

SEQ ID NO: 91211 - DNA, 201 bp, Bos taurus; identical to SEQ ID NO: 9359

SEQ ID NO: 91212 - DNA, 201 bp, Bos taurus; identical to SEQ ID NO: 9361

SEQ ID NO: 91213 - DNA, 201 bp, Bos taurus; identical to SEQ ID NO: 9362

SEQ ID NO: 91214 - DNA, 201 bp, Bos taurus; identical to SEQ ID NO: 9363

SEQ ID NO: 91215 - DNA, 201 bp, Bos taurus; identical to SEQ ID NO: 9365

SEQ ID NO: 91216 - DNA, 201 bp, Bos taurus; identical to SEQ ID NO: 9366

SEQ ID NO: 91217 - DNA, 201 bp, Bos taurus; identical to SEQ ID NO: 9371

SEQ ID NO: 91218 - DNA, 201 bp, Bos taurus; identical to SEQ ID NO: 9373

SEQ ID NO: 91219 - DNA, 201 bp, Bos taurus; identical to SEQ ID NO: 9374

SEQ ID NO: 91220 - DNA, 201 bp, Bos taurus; identical to SEQ ID NO: 9375

SEQ ID NO: 91221 - DNA, 201 bp, Bos taurus; identical to SEQ ID NO: 9376

SEQ ID NO: 91222 - DNA, 201 bp, Bos taurus; identical to SEQ ID NO: 9377

SEQ ID NO: 91223 - DNA, 201 bp, Bos taurus; identical to SEQ ID NO: 9378

SEQ ID NO: 91224 - DNA, 201 bp, Bos taurus; identical to SEQ ID NO: 9379

SEQ ID NO: 91225 - DNA, 201 bp, Bos taurus; identical to SEQ ID NO: 9380

SEQ ID NO: 91226 - DNA, 201 bp, Bos taurus; identical to SEQ ID NO: 9381

SEQ ID NO: 91227 - DNA, 201 bp, Bos taurus; identical to SEQ ID NO: 9382

SEQ ID NO: 91228 - DNA, 201 bp, Bos taurus; identical to SEQ ID NO: 9383

SEQ ID NO: 91229 - DNA, 201 bp, Bos taurus; identical to SEQ ID NO: 9384

SEQ ID NO: 91230 - DNA, 201 bp, Bos taurus; identical to SEQ ID NO: 9385

SEQ ID NO: 91231 - DNA, 201 bp, Bos taurus; identical to SEQ ID NO: 9386

SEQ ID NO: 91232 - DNA, 201 bp, Bos taurus; identical to SEQ ID NO: 9387

SEQ ID NO: 91233 - DNA, 201 bp, Bos taurus; identical to SEQ ID NO: 9388

SEQ ID NO: 91234 - DNA, 201 bp, Bos taurus; identical to SEQ ID NO: 9389

SEQ ID NO: 91235 - DNA, 201 bp, Bos taurus; identical to SEQ ID NO: 9390

SEQ ID NO: 91236 - DNA, 201 bp, Bos taurus; identical to SEQ ID NO: 9391

SEQ ID NO: 91237 - DNA, 201 bp, Bos taurus; identical to SEQ ID NO: 9392

SEQ ID NO: 91238 - DNA, 201 bp, Bos taurus; identical to SEQ ID NO: 9393

SEQ ID NO: 91239 - DNA, 201 bp, Bos taurus; identical to SEQ ID NO: 9396

SEQ ID NO: 91240 - DNA, 201 bp, Bos taurus; identical to SEQ ID NO: 9397

SEQ ID NO: 91241 - DNA, 201 bp, Bos taurus; identical to SEQ ID NO: 9398

SEQ ID NO: 91242 - DNA, 201 bp, Bos taurus; identical to SEQ ID NO: 9399

SEQ ID NO: 91243 - DNA, 201 bp, Bos taurus; identical to SEQ ID NO: 9400

SEQ ID NO: 91244 - DNA, 201 bp, Bos taurus; identical to SEQ ID NO: 9403

SEQ ID NO: 91245 - DNA, 201 bp, Bos taurus; identical to SEQ ID NO: 9404

SEQ ID NO: 91246 - DNA, 201 bp, Bos taurus; identical to SEQ ID NO: 9405

SEQ ID NO: 91247 - DNA, 201 bp, Bos taurus; identical to SEQ ID NO: 9407

SEQ ID NO: 91248 - DNA, 201 bp, Bos taurus
agagacccagagagaacgccagacgcccagagggccctgaccgtccaggcgcactagcctacagagcccgagagggctgccaaggccaacgcaagaacctcagaaaagaggaagccacacagttcccggcactcacagaggggagagtaagtcagctcccaccagcccgagtgaggacaccaggaaaagtctcagaaggta

SEQ ID NO: 91249 - DNA, 201 bp, Bos taurus
gagttggacacaactgacctctaacacttttacttttcatataatcgaacagacaagttatcttcattttaatagtatcaggacaaaaagttccaaattcgttcctgaatcttaaacataaggcaaaaatctcttcttataattacataaaaggtggacctataacttaaaatgtggaaacgttgatggtgtcatcttact

SEQ ID NO: 91250 - DNA, 201 bp, Bos taurus; identical to SEQ ID NO: 9415

SEQ ID NO: 91251 - DNA, 201 bp, Bos taurus; identical to SEQ ID NO: 9417

SEQ ID NO: 91252 - DNA, 201 bp, Bos taurus; identical to SEQ ID NO: 9418

SEQ ID NO: 91253 - DNA, 201 bp, Bos taurus
tactacattctgcctggccccttactacttttgagagcttatgtgtaatggcttaaaccttatttaagccattaatggttctcaaccaggagttactttccccttccaaaggccttctggcaatgtctggaggcattttggtttgccaaaccagtgggtgggatgtggagaggaaggagccaccactagcttctaggggct

SEQ ID NO: 91254 - DNA, 201 bp, Bos taurus
tcttaatttataaaaattcatacaaatcagtaagaacaaaatatataaataacccaagaatatggcaagtcactgaaaaagaagtatacctttataaaaatataaaatgaccatcttcagtctcataaagaaacacaagtcaaacaataatgagatgccatattttgattaaatgtatattttgattgattatcagattga

SEQ ID NO: 91255 - DNA, 201 bp, Bos taurus
attgtcagaaaatgtccttgtgtcagatggggccacagcttatagtgaaaacaagcctcttagtgcttctgcagcatatgaagagacagctccactttattagtgagattacactggccaaggatgactggctgtctcaatcacctgcaggccaatcatgaagcaattgccagggtcactgggcaacccagtccaattcag

SEQ ID NO: 91256 - DNA, 201 bp, Bos taurus
tgatgtggttgagaaggatggcgtggatgtggatgaaccacagaggggagagggaagggagtcagggccgtcctttttcctcaaatggcccttcttttggggtcccgtagtcagtgagcttggtcatcaggtcgttcagagcctccttgtccaggaagcagtatgactgagggcctttttctcaaccctgcagttggctcc

SEQ ID NO: 91257 - DNA, 201 bp, Bos taurus; identical to SEQ ID NO: 9419

SEQ ID NO: 91258 - DNA, 201 bp, Bos taurus; identical to SEQ ID NO: 9420

SEQ ID NO: 91259 - DNA, 201 bp, Bos taurus; identical to SEQ ID NO: 9421

SEQ ID NO: 91260 - DNA, 201 bp, Bos taurus; identical to SEQ ID NO: 9422

SEQ ID NO: 91261 - DNA, 201 bp, Bos taurus
gaagagatggccccagcacgtctgcactcggagagccatgtggactgggtgtggctccaggtcaggaggctcaaggtctaagaggaccaaggaggtgggtaaatgagaggccacagcttcagaagggagccactcaagcctcactccagtcaaccgaaggggaaccagtgcaatgcaacattgctcatcacctgcatcctg

SEQ ID NO: 91262 - DNA, 201 bp, Bos taurus
agctgtctagtttcgtgtggcatgtctcatgcaattcatccgatgtcagctgaggctgcatcatgtgaagattcggctggtttggaatattcaagttgattcattcatgtggccagctgtggacagtgctgcttaggtgaggctgtgaactgaaatacctccatggggctttggcattcacagtgtggcagctggctctaa

SEQ ID NO: 91263 - DNA, 201 bp, Bos taurus; identical to SEQ ID NO: 9423

SEQ ID NO: 91264 - DNA, 201 bp, Bos taurus
aaagcggtgaccgatcgttatttgatcactagcttcacatgctgctctgacttctccctgaactgatacgtcctggaaatggccttaaaacactgcacacccttcactaaaattaaaaataaaaagagagaacaacattttccttttaatatccagtggcctgctgttttatttttttactctgtaactgtccaacatatc

SEQ ID NO: 91265 - DNA, 201 bp, Bos taurus
accccaaattcatatgttgaagccctagtacctcaaaatgtaactgtatttggagaggggaccttgagagaggaagttaagttataatgaggtcatataggtaggccctgacgctacataactggtatctttataagaaacggaaaccaggacgcagacgaacacagagggaagtccacatgaagccaaagggaaagacgg

SEQ ID NO: 91266 - DNA, 201 bp, Bos taurus
catggacatgggcatgaacagtcccatcacctggcattgacaatggcatgtggaggagctcagtgacgatttagtggctgaatggatggagaggttgagccaagagtggcacccccaacattagctacactagaagccttccctgctgctgccaagtcgcttcagtcgtgtctgactctgtgcgaccccatagacggcagc

SEQ ID NO: 91267 - DNA, 201 bp, Bos taurus
gccccacctccaggtcttttgatttccatagatctggggcaggggggtgggaggctgagggaggaggtgaaggcttttcctccctaaaaagtctccagatgctgctgctgctggcccaggtcacactgagagcagaccctcagtacaagattgctaatacttcagacactcaccccaccctacaccttctctttttattct

SEQ ID NO: 91268 - DNA, 201 bp, Bos taurus
tcccatcatttcagatgtgaatttctctacctgaatccaaggcccatcctgcatctggctccaggcaacctgtctaacctgatatcccccgtgtgtccctttggtgccagctggccttttcaccaattataatatgctagccagttcctcttgatgttggcttctggaaaaccattcctttgccatcttccctgtgtcctt

SEQ ID NO: 91269 - DNA, 201 bp, Bos taurus
ctatgccaaaaaataacatttgggatagttgtctttaaaggactctgttatttatagctttcgttttgataacatttggtcagttcattttaatagttgggaaagcggaagtgtatgtgagctttttgtaaaggatttaaaagattacctagtctctgtttagccttagtgaactgtgaaggccttaattttgtacaataa

SEQ ID NO: 91270 - DNA, 201 bp, Bos taurus; identical to SEQ ID NO: 9425

SEQ ID NO: 91271 - DNA, 201 bp, Bos taurus; identical to SEQ ID NO: 9427

SEQ ID NO: 91272 - DNA, 201 bp, Bos taurus; identical to SEQ ID NO: 9428

SEQ ID NO: 91273 - DNA, 201 bp, Bos taurus; identical to SEQ ID NO: 9429

SEQ ID NO: 91274 - DNA, 201 bp, Bos taurus; identical to SEQ ID NO: 9430

SEQ ID NO: 91275 - DNA, 201 bp, Bos taurus; identical to SEQ ID NO: 9431

SEQ ID NO: 91276 - DNA, 201 bp, Bos taurus
gaggctgccaacctgagatcaaggggctggcagtgaggggtggcgagggaggatctgtttcaggctctctccttggctcgttgacgatggccatcttcttcctgtgtcttttcacatcatcttccacttatgcaggtctctgtgtccccatttcctcttataaggacaccagtcatgtgggattagggcccaccccaaggc

SEQ ID NO: 91277 - DNA, 201 bp, Bos taurus
gaaattggatttcctccctatctagtgggaaagggagcttagattaatttttagaaagggaaacataaatagagcatttcttaaagtctgcctgttgttatatattcaaagctgctccataaggaatgaaaagcatttgcttgtatctgacagctaggaggtcataggtgcagtttcagcagagtttgggggtgaaatcta

SEQ ID NO: 91278 - DNA, 201 bp, Bos taurus; identical to SEQ ID NO: 9432

SEQ ID NO: 91279 - DNA, 201 bp, Bos taurus
attgacagatgtggtgcttcctgtcaaggaagttatgaaggcaccataagagaacccctgaagatggtcctgaagaggccgctcctggactgacaagggaagagtcggcatggagaggagagtgccagctgaaggggattggatattcgctggcccagaagcagaagagcggaagggaggggaaggtgcccctcgaactgg

SEQ ID NO: 91280 - DNA, 201 bp, Bos taurus; identical to SEQ ID NO: 9433

SEQ ID NO: 91281 - DNA, 201 bp, Bos taurus
ctctgtgatttgcagctgtaggggcttaatcacacttctccagcttttatagtttatttaaaatgttttagagaagaagtttggcttgtctgtgggcaactggatggcccacttccagggggtaatgggatggttcctttctgctagtccagatactgtactgccaaggggcataggtggcaattcgaggacaaatcttac

SEQ ID NO: 91282 - DNA, 201 bp, Bos taurus
gggccccggggacagacgctttggctcttcttgcccctggcgctcctgtaaccagagggtctcacctgcagtgtggacatctcccctcccctcccgttcaaggcaggggcttgggggcctggcggccccactgctagtgggaaaggcctcggacctcagctacgaaggcagctcaggaggctccgaggggacgcaccccga

SEQ ID NO: 91283 - DNA, 201 bp, Bos taurus; identical to SEQ ID NO: 9435

SEQ ID NO: 91284 - DNA, 201 bp, Bos taurus; identical to SEQ ID NO: 9436

SEQ ID NO: 91285 - DNA, 201 bp, Bos taurus; identical to SEQ ID NO: 9437

SEQ ID NO: 91286 - DNA, 201 bp, Bos taurus
ttggctcctgttactactgtttttgtggatattatggccatgtttccatagtaagaattgccctcagctaccgtatatagaaggcaggcaaatgataacatagcaagtagatgaaaggccaaatgcgggaaatttttaatttgtcacgtctattaataatctggtttcccaggtggcgctagaggtaaagaatctgtctgc

SEQ ID NO: 91287 - DNA, 201 bp, Bos taurus; identical to SEQ ID NO: 9438

SEQ ID NO: 91288 - DNA, 201 bp, Bos taurus; identical to SEQ ID NO: 9439

SEQ ID NO: 91289 - DNA, 201 bp, Bos taurus; identical to SEQ ID NO: 50813

SEQ ID NO: 91290 - DNA, 201 bp, Bos taurus
tcagcggaggtggccagcaggagcaagaacatctgcttttctctctctctgctgggcatccaccaggatggttgtgtgtgccagatgctgcatggatgctgatcagatagttggccaggcttgtgtttttgttttaatttccattttgctatagattgaatgtttgtcccacctccccacacaaaaaaattatatgttgaa

SEQ ID NO: 91291 - DNA, 201 bp, Bos taurus; identical to SEQ ID NO: 9440

SEQ ID NO: 91292 - DNA, 201 bp, Bos taurus; identical to SEQ ID NO: 9441

SEQ ID NO: 91293 - DNA, 201 bp, Bos taurus
gaagaatctttaatatgattagtattattaaagacagggcaatttgttttattctgcttttcaagttaagtctaagagcatgtactattttatgatttcaatagattggggcaaatctttaaaaatagggaaagtatgttgaatcctaagatttggcagtgttctaaatcatttgacatgattgaactcatttaattatct

SEQ ID NO: 91294 - DNA, 201 bp, Bos taurus; identical to SEQ ID NO: 9442

SEQ ID NO: 91295 - DNA, 201 bp, Bos taurus; identical to SEQ ID NO: 9443

SEQ ID NO: 91296 - DNA, 201 bp, Bos taurus; identical to SEQ ID NO: 9444

SEQ ID NO: 91297 - DNA, 201 bp, Bos taurus; identical to SEQ ID NO: 9445

SEQ ID NO: 91298 - DNA, 201 bp, Bos taurus
ttttataggtggcatggtaaagcattttacctcatgtcaactagctggttagtcaagcactggactacacgtgtggccgttattgtcagccagcctctcgagtcttcagtctcctcatctgtaaagtgaaagctcggactacagcagggatggccacgtctggctccttgtgtaaacaaagctttgttgaaaccccgccat

SEQ ID NO: 91299 - DNA, 201 bp, Bos taurus; identical to SEQ ID NO: 9446

SEQ ID NO: 91300 - DNA, 201 bp, Bos taurus; identical to SEQ ID NO: 9447

SEQ ID NO: 91301 - DNA, 201 bp, Bos taurus; identical to SEQ ID NO: 9448

SEQ ID NO: 91302 - DNA, 201 bp, Bos taurus; identical to SEQ ID NO: 9449

SEQ ID NO: 91303 - DNA, 201 bp, Bos taurus; identical to SEQ ID NO: 9450

SEQ ID NO: 91304 - DNA, 201 bp, Bos taurus
ctcagagaaacggccagttttcgagggacgtttgcctgttgtgactgtgtcattactgtgtttttgtccctcgtggcgggaagagttcatctcacatctgtagctgccagcgcaccacggcccctaggataaacgcttgttggttgaagtgctccacagcgatgcccccacccctcctcatccccagatgctgccgtctcc

SEQ ID NO: 91305 - DNA, 201 bp, Bos taurus; identical to SEQ ID NO: 9452

SEQ ID NO: 91306 - DNA, 201 bp, Bos taurus; identical to SEQ ID NO: 9454

SEQ ID NO: 91307 - DNA, 201 bp, Bos taurus; identical to SEQ ID NO: 9455

SEQ ID NO: 91308 - DNA, 201 bp, Bos taurus; identical to SEQ ID NO: 9456

SEQ ID NO: 91309 - DNA, 201 bp, Bos taurus; identical to SEQ ID NO: 9457

SEQ ID NO: 91310 - DNA, 201 bp, Bos taurus; identical to SEQ ID NO: 9458

SEQ ID NO: 91311 - DNA, 201 bp, Bos taurus; identical to SEQ ID NO: 9459

SEQ ID NO: 91312 - DNA, 201 bp, Bos taurus; identical to SEQ ID NO: 9464

SEQ ID NO: 91313 - DNA, 201 bp, Bos taurus; identical to SEQ ID NO: 9465

SEQ ID NO: 91314 - DNA, 201 bp, Bos taurus; identical to SEQ ID NO: 9466

SEQ ID NO: 91315 - DNA, 201 bp, Bos taurus; identical to SEQ ID NO: 9467

SEQ ID NO: 91316 - DNA, 201 bp, Bos taurus; identical to SEQ ID NO: 9468

SEQ ID NO: 91317 - DNA, 201 bp, Bos taurus
ttaggaatgttatattacatctggctcagagacggttggctgttgatggttaaatttaggccgaaatccacgaggagctaattgatgatctgtactgaccgttaagcttggatcaaatctgtctagagaaatttatgcttagatagtgcatctagctgttgcagggctgagaataggagaacaggggatttctttataaac

SEQ ID NO: 91318 - DNA, 201 bp, Bos taurus; identical to SEQ ID NO: 9471

SEQ ID NO: 91319 - DNA, 201 bp, Bos taurus; identical to SEQ ID NO: 9472

SEQ ID NO: 91320 - DNA, 201 bp, Bos taurus; identical to SEQ ID NO: 9473

SEQ ID NO: 91321 - DNA, 201 bp, Bos taurus; identical to SEQ ID NO: 9474

SEQ ID NO: 91322 - DNA, 201 bp, Bos taurus; identical to SEQ ID NO: 9475

SEQ ID NO: 91323 - DNA, 201 bp, Bos taurus; identical to SEQ ID NO: 9478

SEQ ID NO: 91324 - DNA, 201 bp, Bos taurus
gagcccaagagaggctgcagggtatacctaatatatagatcaaccaagagaatccttgttctgtgtcagggcctcaagataggcctgtgactggtaaggacactgagaggaggacaaagcagtgactctttgatgctttctagatgcgccaggaaaactgagttagttatgtggggcccacagcaagaaagccaatctctg

SEQ ID NO: 91325 - DNA, 201 bp, Bos taurus
tttgggtatttatcttgaatttaaatccatggtcatcaacatcaggatagataacagctttcctataaaactttgtttcaggcacatttttatgctgcctgtctctacccgtctatctctctgtctgtctgtctctccatccatccatctaatcagcgaatcctcttttctgtgagaaaatatcaatattattattatctc

SEQ ID NO: 91326 - DNA, 201 bp, Bos taurus; identical to SEQ ID NO: 9482

SEQ ID NO: 91327 - DNA, 201 bp, Bos taurus; identical to SEQ ID NO: 9483

SEQ ID NO: 91328 - DNA, 201 bp, Bos taurus; identical to SEQ ID NO: 9484

SEQ ID NO: 91329 - DNA, 201 bp, Bos taurus; identical to SEQ ID NO: 9485

SEQ ID NO: 91330 - DNA, 201 bp, Bos taurus; identical to SEQ ID NO: 9487

SEQ ID NO: 91331 - DNA, 201 bp, Bos taurus
gaagggtcagtttgccatgatcaagatgtttagtgaagggagtttgggggagaatgtatacctgtatacctcaaaggctgagttcctttgctgtgcacgcgaaattatcacaacattgttaatcagctacactccaacataaaataaaaatttaaagaaatgcttactgaagatgaggaggtataagcaggatgaaagaac

SEQ ID NO: 91332 - DNA, 201 bp, Bos taurus; identical to SEQ ID NO: 9488

SEQ ID NO: 91333 - DNA, 201 bp, Bos taurus; identical to SEQ ID NO: 9489

SEQ ID NO: 91334 - DNA, 201 bp, Bos taurus
tcctaagaggtagccctcgacttcatgattcaaggaagcatttccttccaggtggcaatattgaaagagagaaggaaaaatagagatggccagcaggtgctgggtcttaaggaaggtttgtggacaccagcactcagttcttccattgggtcccattggttagaaccttgccacatggccatatctgagtacaaagagccc

SEQ ID NO: 91335 - DNA, 201 bp, Bos taurus; identical to SEQ ID NO: 9490

SEQ ID NO: 91336 - DNA, 201 bp, Bos taurus
tcagatgttaagagcggtggctggcctaggattttcataatcaaattacatagcactagtggaactctttctgggaatccaggccaatctctgaaggctataattccaagtaacatggagaaattagagaaagacgttttcattagcatgaagctttagacttgtggccaaaaatttgaaaggaaacgcaaaatccaatca

SEQ ID NO: 91337 - DNA, 201 bp, Bos taurus; identical to SEQ ID NO: 9492

SEQ ID NO: 91338 - DNA, 201 bp, Bos taurus; identical to SEQ ID NO: 9493

SEQ ID NO: 91339 - DNA, 201 bp, Bos taurus; identical to SEQ ID NO: 9494

SEQ ID NO: 91340 - DNA, 201 bp, Bos taurus
agagctggagagaattgtacctgctttgctactaaccccaaaaccaagtggcatccatattaaaatttcatattttaaaaatctaatcatggaagtttgcattctggcctgatttctttcccctttttggtctcacagcaaagtgacttggaatcctagccaaaatatttagttaaaaactggagatgattagagttcgtc

SEQ ID NO: 91341 - DNA, 201 bp, Bos taurus
ccagctgcaaccaagaaattggaaggcctcagagaatgaaaggtaaactttccgaaagcctcagtctctttttcaaccccgcaggaagcggtttacgtctagggtattggatagcagtttgggcccagttaacacatctctcccaccacaaatcaccctgtcgcatactcagatgacattggccaaataaactcggggatc

SEQ ID NO: 91342 - DNA, 201 bp, Bos taurus; identical to SEQ ID NO: 9495

SEQ ID NO: 91343 - DNA, 201 bp, Bos taurus
gaaaaccctgtaagtttttttgtgacatgacacaaaaatgttttatttctcatgcatacaaagtctgttgtttgcgatgactttatgatttaggccacatccatggtgtggtgatgccatcataacatgtggattccaagtcgtcatgacaggggaagaaagagctaatggttcctcacagctcttacatatgttggccca

SEQ ID NO: 91344 - DNA, 201 bp, Bos taurus; identical to SEQ ID NO: 9498

SEQ ID NO: 91345 - DNA, 201 bp, Bos taurus; identical to SEQ ID NO: 9499

SEQ ID NO: 91346 - DNA, 201 bp, Bos taurus; identical to SEQ ID NO: 9501

SEQ ID NO: 91347 - DNA, 201 bp, Bos taurus; identical to SEQ ID NO: 9502

SEQ ID NO: 91348 - DNA, 201 bp, Bos taurus; identical to SEQ ID NO: 9503

SEQ ID NO: 91349 - DNA, 201 bp, Bos taurus; identical to SEQ ID NO: 9504

SEQ ID NO: 91350 - DNA, 201 bp, Bos taurus; identical to SEQ ID NO: 50896

SEQ ID NO: 91351 - DNA, 201 bp, Bos taurus; identical to SEQ ID NO: 9508

SEQ ID NO: 91352 - DNA, 201 bp, Bos taurus; identical to SEQ ID NO: 9509

SEQ ID NO: 91353 - DNA, 201 bp, Bos taurus; identical to SEQ ID NO: 9511

SEQ ID NO: 91354 - DNA, 201 bp, Bos taurus; identical to SEQ ID NO: 9512

SEQ ID NO: 91355 - DNA, 201 bp, Bos taurus; identical to SEQ ID NO: 9513

SEQ ID NO: 91356 - DNA, 201 bp, Bos taurus
gggggggcggttcaggatgaatcaagcacactaccttcattgtgcactttttctctattattattattattacgacataataataataataataataataatattattattataactcgaaggttgaggatccctgttctagagcaaagggaagagggaaagtgttggaaggagagcattctagagatggctatattttca

SEQ ID NO: 91357 - DNA, 201 bp, Bos taurus
cgggtaaaataaaactgtcaggtctctgcagagtgccacaagtaaatgcaccatgggccaatctgtctactagatcttagtgacgtttatcatcaaacccgcctgcttttctgaaaaatggaaacttatttaatcatcgtgaaaacagcaagaagccgaataattattgcaatgatggcaatcgttggaaatgcaatagac

SEQ ID NO: 91358 - DNA, 201 bp, Bos taurus; identical to SEQ ID NO: 9514

SEQ ID NO: 91359 - DNA, 201 bp, Bos taurus; identical to SEQ ID NO: 9515

SEQ ID NO: 91360 - DNA, 201 bp, Bos taurus; identical to SEQ ID NO: 9516

SEQ ID NO: 91361 - DNA, 201 bp, Bos taurus; identical to SEQ ID NO: 9517

SEQ ID NO: 91362 - DNA, 201 bp, Bos taurus; identical to SEQ ID NO: 9518

SEQ ID NO: 91363 - DNA, 201 bp, Bos taurus; identical to SEQ ID NO: 9520

SEQ ID NO: 91364 - DNA, 201 bp, Bos taurus; identical to SEQ ID NO: 9521

SEQ ID NO: 91365 - DNA, 201 bp, Bos taurus; identical to SEQ ID NO: 9522

SEQ ID NO: 91366 - DNA, 201 bp, Bos taurus; identical to SEQ ID NO: 9523

SEQ ID NO: 91367 - DNA, 201 bp, Bos taurus; identical to SEQ ID NO: 9525

SEQ ID NO: 91368 - DNA, 201 bp, Bos taurus; identical to SEQ ID NO: 9526

SEQ ID NO: 91369 - DNA, 201 bp, Bos taurus; identical to SEQ ID NO: 9527

SEQ ID NO: 91370 - DNA, 201 bp, Bos taurus; identical to SEQ ID NO: 9528

SEQ ID NO: 91371 - DNA, 201 bp, Bos taurus; identical to SEQ ID NO: 9529

SEQ ID NO: 91372 - DNA, 201 bp, Bos taurus; identical to SEQ ID NO: 9530

SEQ ID NO: 91373 - DNA, 201 bp, Bos taurus
tgacacaaaaggtactctgtagataatactgaaaaacattgtcagggaaagtgcaaagttgatatttgtgtccctgttatgcagaaggggccctagagagttgaagactaactaaagctgtgtgcttctgggtaggacaagattcataccatctgcctgggtctgggcctcagtgctctctgcaataccatgctgtctcct

SEQ ID NO: 91374 - DNA, 201 bp, Bos taurus
cagaggacccattttcaaagaactaaacgagaaaaaaagcattaaatattgatgttgaggtgtttacaataagaagctgtggtccagccactatcctacagcgtaatcactaactggcaaactccggacctcacaaagtcttgctagtttccagcgccttttctactgcctctctcctaaatgcagcagacaaggaaggca

SEQ ID NO: 91375 - DNA, 201 bp, Bos taurus
aaggtccttcccttcatctctgcccttaaaaatcctaaccctccttctagacccatcccaaatttcacttcccctgcaatgtgcctttccagacactccagcctccttgaaccatctttcgtgtgtctctctttggggcacttacattcagccttgcagtgtgtgtgacggctggttccatcaaaagccctgcctcacctc

SEQ ID NO: 91376 - DNA, 201 bp, Bos taurus
tctggagcgaagcagggtgattgagcagatgtgcagtgaggaggcctaaattatgctagacctgactggcctgctaactggccatgtgaccttgattagacgacttcttttccttgactgtggtttccccggaagaaatgtaaatggatggggccaaatcagcgttttcaaaacttctaaagacaaagtggccagtaagct

SEQ ID NO: 91377 - DNA, 201 bp, Bos taurus; identical to SEQ ID NO: 9531

SEQ ID NO: 91378 - DNA, 201 bp, Bos taurus; identical to SEQ ID NO: 9532

SEQ ID NO: 91379 - DNA, 201 bp, Bos taurus; identical to SEQ ID NO: 9533

SEQ ID NO: 91380 - DNA, 201 bp, Bos taurus; identical to SEQ ID NO: 9534

SEQ ID NO: 91381 - DNA, 201 bp, Bos taurus; identical to SEQ ID NO: 9535

SEQ ID NO: 91382 - DNA, 201 bp, Bos taurus; identical to SEQ ID NO: 9536

SEQ ID NO: 91383 - DNA, 201 bp, Bos taurus; identical to SEQ ID NO: 9537

SEQ ID NO: 91384 - DNA, 201 bp, Bos taurus; identical to SEQ ID NO: 9538

SEQ ID NO: 91385 - DNA, 201 bp, Bos taurus; identical to SEQ ID NO: 9539

SEQ ID NO: 91386 - DNA, 201 bp, Bos taurus; identical to SEQ ID NO: 9540

SEQ ID NO: 91387 - DNA, 201 bp, Bos taurus; identical to SEQ ID NO: 9542

SEQ ID NO: 91388 - DNA, 201 bp, Bos taurus; identical to SEQ ID NO: 9543

SEQ ID NO: 91389 - DNA, 201 bp, Bos taurus; identical to SEQ ID NO: 9544

SEQ ID NO: 91390 - DNA, 201 bp, Bos taurus; identical to SEQ ID NO: 9545

SEQ ID NO: 91391 - DNA, 201 bp, Bos taurus; identical to SEQ ID NO: 9547

SEQ ID NO: 91392 - DNA, 201 bp, Bos taurus; identical to SEQ ID NO: 9549

SEQ ID NO: 91393 - DNA, 201 bp, Bos taurus; identical to SEQ ID NO: 9550

SEQ ID NO: 91394 - DNA, 201 bp, Bos taurus; identical to SEQ ID NO: 9551

SEQ ID NO: 91395 - DNA, 201 bp, Bos taurus; identical to SEQ ID NO: 9552

SEQ ID NO: 91396 - DNA, 201 bp, Bos taurus; identical to SEQ ID NO: 9553

SEQ ID NO: 91397 - DNA, 201 bp, Bos taurus; identical to SEQ ID NO: 9554

SEQ ID NO: 91398 - DNA, 201 bp, Bos taurus; identical to SEQ ID NO: 9555

SEQ ID NO: 91399 - DNA, 201 bp, Bos taurus; identical to SEQ ID NO: 9556

SEQ ID NO: 91400 - DNA, 201 bp, Bos taurus; identical to SEQ ID NO: 9557

SEQ ID NO: 91401 - DNA, 201 bp, Bos taurus; identical to SEQ ID NO: 9558

SEQ ID NO: 91402 - DNA, 201 bp, Bos taurus; identical to SEQ ID NO: 9559

SEQ ID NO: 91403 - DNA, 201 bp, Bos taurus; identical to SEQ ID NO: 9560

SEQ ID NO: 91404 - DNA, 201 bp, Bos taurus; identical to SEQ ID NO: 9561

SEQ ID NO: 91405 - DNA, 201 bp, Bos taurus; identical to SEQ ID NO: 9562

SEQ ID NO: 91406 - DNA, 201 bp, Bos taurus; identical to SEQ ID NO: 9563

SEQ ID NO: 91407 - DNA, 201 bp, Bos taurus; identical to SEQ ID NO: 9564

SEQ ID NO: 91408 - DNA, 201 bp, Bos taurus; identical to SEQ ID NO: 9565

SEQ ID NO: 91409 - DNA, 201 bp, Bos taurus; identical to SEQ ID NO: 9566

SEQ ID NO: 91410 - DNA, 201 bp, Bos taurus; identical to SEQ ID NO: 9567

SEQ ID NO: 91411 - DNA, 201 bp, Bos taurus; identical to SEQ ID NO: 9568

SEQ ID NO: 91412 - DNA, 201 bp, Bos taurus
ggagctggcctgcccctttggccccttggatgagattccagcccttaggacgagaggtcaggatcaagagctggaggagccagatgaggctttgttatttgatgcagacagtgctgtttcaaggcccacgggacagtatacctgagcctgggaagatggtcttgtgttttaattctacatttgacccttgttcagtcagtc

SEQ ID NO: 91413 - DNA, 201 bp, Bos taurus; identical to SEQ ID NO: 9569

SEQ ID NO: 91414 - DNA, 201 bp, Bos taurus
atcaggaatattgaatggactctgaacaccagaaggaaggtttaaaacaacactgaactatgaaaaattaatagtcatgctcatggaccgattcattcacgtattgcaatcacgaagatttttttcccattctcaggaatcatctaaagcagacaacatctgaataacttcatagtgcttttcaggtctactttatccttc

SEQ ID NO: 91415 - DNA, 201 bp, Bos taurus; identical to SEQ ID NO: 9570

SEQ ID NO: 91416 - DNA, 201 bp, Bos taurus; identical to SEQ ID NO: 9572

SEQ ID NO: 91417 - DNA, 201 bp, Bos taurus; identical to SEQ ID NO: 9574

SEQ ID NO: 91418 - DNA, 201 bp, Bos taurus; identical to SEQ ID NO: 9576

SEQ ID NO: 91419 - DNA, 201 bp, Bos taurus
tgagaacagaggtacaagtcagtgccttccgggaaggcggttgccatggttccagggaagtggatcaggggctgcggccatggggagagagaagaaagacacagtaaaagacccgtggcagatggcagcatctcccgtccatgggctcttccacagtgagacctcgacacacccctaccaagaagtgaggcctgagtctct

SEQ ID NO: 91420 - DNA, 201 bp, Bos taurus
aaacacctaaactccccatcttttctgtcttcccttgtcccaccgtccttgctgtagatggcagattttgttgcctaaaaagggccacagagacatggacggttctcattagctcatctagaaccatcctcccaccaaaggggaagactcatttccctcccctcaatgtggactggccttaggacttgcctctgacagaaa

SEQ ID NO: 91421 - DNA, 201 bp, Bos taurus; identical to SEQ ID NO: 9578

SEQ ID NO: 91422 - DNA, 201 bp, Bos taurus
tctacttcccacactggtcacaccacacctactgctaaagtcaacatcagcctactcagcgcctttgtgtaattagaataaggcaaccactcctctgggcagatatgactctcagtcatgcagctggagggcagaaagaaggacgggtttcaggcccactagcccttcactggggtgccatttttgcagtgcacaacatgt

SEQ ID NO: 91423 - DNA, 201 bp, Bos taurus
aaacacatgccaacatagctaagggtctacagtgtgtgcaattacacgtggttcaaaggatagaaagaagagcttgttcacttggacacataagagagaccctggagcaaaacactaattatcagtgagtctgataaatacagtattggtgttgtccaattaaaaaatatgtacaacctaaacccactttagtattcttgc

SEQ ID NO: 91424 - DNA, 201 bp, Bos taurus; identical to SEQ ID NO: 9579

SEQ ID NO: 91425 - DNA, 201 bp, Bos taurus; identical to SEQ ID NO: 9581

SEQ ID NO: 91426 - DNA, 201 bp, Bos taurus; identical to SEQ ID NO: 9585

SEQ ID NO: 91427 - DNA, 201 bp, Bos taurus; identical to SEQ ID NO: 9588

SEQ ID NO: 91428 - DNA, 201 bp, Bos taurus; identical to SEQ ID NO: 9590

SEQ ID NO: 91429 - DNA, 201 bp, Bos taurus
actcctggacactgattcatagccatccacttcctcccaagctcagcaaaccaccaggtcctctgggaaatggattagtcacagcccagccaggcaccttgcgtgccatggtcggtattagctccaacagtcatgcgtttaggaggaaaaggtaaaaactgctgcaccatcttcctttggggaaggaataaggccttagtt

SEQ ID NO: 91430 - DNA, 201 bp, Bos taurus; identical to SEQ ID NO: 9591

SEQ ID NO: 91431 - DNA, 201 bp, Bos taurus; identical to SEQ ID NO: 9592

SEQ ID NO: 91432 - DNA, 201 bp, Bos taurus; identical to SEQ ID NO: 9593

SEQ ID NO: 91433 - DNA, 201 bp, Bos taurus; identical to SEQ ID NO: 9594

SEQ ID NO: 91434 - DNA, 201 bp, Bos taurus; identical to SEQ ID NO: 9595

SEQ ID NO: 91435 - DNA, 201 bp, Bos taurus
ctaaacttctcgaagacagtgggtccttctcttctctgtacactcctccttgctttggtcaacgaagtgtcttctgggatgatccatggccccaagtcacctagtgggttttttgcctttacatagtacatacaattgagcatgatttgaccttgaacctttgatcctgttccagcatttctacagctctcagtgtggcca

SEQ ID NO: 91436 - DNA, 201 bp, Bos taurus; identical to SEQ ID NO: 9596

SEQ ID NO: 91437 - DNA, 201 bp, Bos taurus; identical to SEQ ID NO: 9597

SEQ ID NO: 91438 - DNA, 201 bp, Bos taurus; identical to SEQ ID NO: 9598

SEQ ID NO: 91439 - DNA, 201 bp, Bos taurus; identical to SEQ ID NO: 9599

SEQ ID NO: 91440 - DNA, 201 bp, Bos taurus; identical to SEQ ID NO: 9601

SEQ ID NO: 91441 - DNA, 201 bp, Bos taurus; identical to SEQ ID NO: 9602

SEQ ID NO: 91442 - DNA, 201 bp, Bos taurus; identical to SEQ ID NO: 9603

SEQ ID NO: 91443 - DNA, 201 bp, Bos taurus; identical to SEQ ID NO: 9605

SEQ ID NO: 91444 - DNA, 201 bp, Bos taurus; identical to SEQ ID NO: 9606

SEQ ID NO: 91445 - DNA, 201 bp, Bos taurus; identical to SEQ ID NO: 9607

SEQ ID NO: 91446 - DNA, 201 bp, Bos taurus; identical to SEQ ID NO: 9608

SEQ ID NO: 91447 - DNA, 201 bp, Bos taurus; identical to SEQ ID NO: 9609

SEQ ID NO: 91448 - DNA, 201 bp, Bos taurus
gtgctgcaggccatgggatcacaaagactgaacaacaacaagctgaaataagtgtaccaccctcctccttcctgcagcaaagaacattcaccacaggccaccttcaaataacattcgtctccaatctttgaaaatgaacatcgttttccatgttttggggggcaacatttgcctttcccatgagcagtctgctcttcagtc

SEQ ID NO: 91449 - DNA, 201 bp, Bos taurus; identical to SEQ ID NO: 9610

SEQ ID NO: 91450 - DNA, 201 bp, Bos taurus; identical to SEQ ID NO: 9611

SEQ ID NO: 91451 - DNA, 201 bp, Bos taurus
aagagcccaagcgctgcaacaaaaacccagtgcagccaaaataaagtaaaatcatcatgatgatttggtgacttctcttcattttctgtttaggcttccacgcctgcagatagatgcagtcaacacaagctggatgatatcgatgctattttaattgtagcttccattcatatgtaaaagaggagtattttgttttgttta

SEQ ID NO: 91452 - DNA, 201 bp, Bos taurus; identical to SEQ ID NO: 9612

SEQ ID NO: 91453 - DNA, 201 bp, Bos taurus; identical to SEQ ID NO: 9613

SEQ ID NO: 91454 - DNA, 201 bp, Bos taurus; identical to SEQ ID NO: 9614

SEQ ID NO: 91455 - DNA, 201 bp, Bos taurus; identical to SEQ ID NO: 9615

SEQ ID NO: 91456 - DNA, 201 bp, Bos taurus; identical to SEQ ID NO: 9616

SEQ ID NO: 91457 - DNA, 201 bp, Bos taurus; identical to SEQ ID NO: 9617

SEQ ID NO: 91458 - DNA, 201 bp, Bos taurus; identical to SEQ ID NO: 9619

SEQ ID NO: 91459 - DNA, 201 bp, Bos taurus; identical to SEQ ID NO: 9620

SEQ ID NO: 91460 - DNA, 201 bp, Bos taurus; identical to SEQ ID NO: 9621

SEQ ID NO: 91461 - DNA, 201 bp, Bos taurus; identical to SEQ ID NO: 9622

SEQ ID NO: 91462 - DNA, 201 bp, Bos taurus; identical to SEQ ID NO: 9623

SEQ ID NO: 91463 - DNA, 201 bp, Bos taurus; identical to SEQ ID NO: 9624

SEQ ID NO: 91464 - DNA, 201 bp, Bos taurus; identical to SEQ ID NO: 9625

SEQ ID NO: 91465 - DNA, 201 bp, Bos taurus
atgctgtctcccctccatccccaggcctccgggcagccgccccccgacaggggcacaggggcccctaaggtttgggccatgctccaagggccgcagccatccaggtgtggctgaaggactggatcctctactgttctgtctgtcctcccccagacagcctgggggtgtcatgagtccacccaagactgccccctgctgtcc

SEQ ID NO: 91466 - DNA, 201 bp, Bos taurus; identical to SEQ ID NO: 9627

SEQ ID NO: 91467 - DNA, 201 bp, Bos taurus
agaaagagggcttctgtcacatttaagggccagcaagttggctgatgtgggtggagtttagtgagggagggaaaaaggagctgaagataaggtcagaaagtcagagggcctagggggtctgtgtcctgtaggcttttgaaatatcttcaggcttagagaaacagacaatgatatttcaggtttcaagcagggtagttacat

SEQ ID NO: 91468 - DNA, 201 bp, Bos taurus
ctctctcctggcccattgttgttggacctggggtgaaccctgagattggtgggtagtgtctgaggacaatctattttccagtggccccattgtttataggtggggcagggtttggtgggtggctggggatttgggcaagacttagcccagtgtctcgtttggttatatctaaagtaggggcctggagggttaggtcccata

SEQ ID NO: 91469 - DNA, 201 bp, Bos taurus; identical to SEQ ID NO: 9631

SEQ ID NO: 91470 - DNA, 201 bp, Bos taurus; identical to SEQ ID NO: 9633

SEQ ID NO: 91471 - DNA, 201 bp, Bos taurus
gtgccacctcctgggcctttggggaagcgctacacctggctgtccggatgctggctggagcagggatgggtgctgggccatcagggagcccctgaggggcgcttagtgctggcaggttaacatcttgatgcgaagttgcatcacaggggaaacaccccaggcctctggaaacatccctccacagctggcaggtgtgtgggg

SEQ ID NO: 91472 - DNA, 201 bp, Bos taurus
caaaggcttcatttctcaaagcttttaattcgttgctttaaaaaattgtcttaacaactacttatattcttctttgatttggcaaacttctttttcagtcatgtgaaaaccaagttccaattgggcatggtgggcttctcacaaattccaaaatagtgaagtacaaattaaaagagatgtattaaaagcaactctcattac

SEQ ID NO: 91473 - DNA, 201 bp, Bos taurus
cctagaaaagagtttcataagcggccgcatcatcagtcccttgtggggaccgcacaggatccccttactacttgcgcagcagatgtgcgtcgagtggacacagggaaaagaggttaagtcaaggccgtcccgtacaccctgagcagcctgacagtggtgtactcctggctgccctggacagaaggcaatggcaacccactc

SEQ ID NO: 91474 - DNA, 201 bp, Bos taurus
gagtgaaaatgcaatgagaccttgactggtgagaagctccccttagagaaggatgatttatggtgagaaaacacaaacacaggctgggtcaaaaaatgtcgaaaaagattaaaagttaaggcatgtatgctcacaatggagaaggcaatggcaccccactccagtactcttgcctggaaaatcccatggacggaggagcct

SEQ ID NO: 91475 - DNA, 201 bp, Bos taurus; identical to SEQ ID NO: 9640

SEQ ID NO: 91476 - DNA, 201 bp, Bos taurus; identical to SEQ ID NO: 9641

SEQ ID NO: 91477 - DNA, 201 bp, Bos taurus; identical to SEQ ID NO: 9644

SEQ ID NO: 91478 - DNA, 201 bp, Bos taurus; identical to SEQ ID NO: 9645

SEQ ID NO: 91479 - DNA, 201 bp, Bos taurus; identical to SEQ ID NO: 9646

SEQ ID NO: 91480 - DNA, 201 bp, Bos taurus; identical to SEQ ID NO: 9647

SEQ ID NO: 91481 - DNA, 201 bp, Bos taurus
tgccagccattctttaagttataagcaatcaacattgttaatttactcagatttctatattctgaacagactgaggcaaaaggccaccggctacatcccggcaagactagggggaaaaaacagagttgcagcctgaatgtctgctaagcgatggtacaacatgaagaggccacacgtctgaactccccactgggcacgggc

SEQ ID NO: 91482 - DNA, 201 bp, Bos taurus
atcttttctgcatgtgctgtatatggctggacaaggatgccctaagatattaatacccacatgttgctatgtggcacactctggagtctgccagggtctccacttgaaatgctgacagtggggcccacgtgcctatatgcgggtagtgataacacatgggcagactacatatgccaggcaagtaatcaagaaaacttacac

SEQ ID NO: 91483 - DNA, 201 bp, Bos taurus; identical to SEQ ID NO: 9649

SEQ ID NO: 91484 - DNA, 201 bp, Bos taurus; identical to SEQ ID NO: 9650

SEQ ID NO: 91485 - DNA, 201 bp, Bos taurus; identical to SEQ ID NO: 9651

SEQ ID NO: 91486 - DNA, 201 bp, Bos taurus; identical to SEQ ID NO: 9652

SEQ ID NO: 91487 - DNA, 201 bp, Bos taurus; identical to SEQ ID NO: 9653

SEQ ID NO: 91488 - DNA, 201 bp, Bos taurus; identical to SEQ ID NO: 9654

SEQ ID NO: 91489 - DNA, 201 bp, Bos taurus; identical to SEQ ID NO: 9655

SEQ ID NO: 91490 - DNA, 201 bp, Bos taurus; identical to SEQ ID NO: 9656

SEQ ID NO: 91491 - DNA, 201 bp, Bos taurus; identical to SEQ ID NO: 9657

SEQ ID NO: 91492 - DNA, 201 bp, Bos taurus; identical to SEQ ID NO: 9658

SEQ ID NO: 91493 - DNA, 201 bp, Bos taurus; identical to SEQ ID NO: 9659

SEQ ID NO: 91494 - DNA, 201 bp, Bos taurus; identical to SEQ ID NO: 9661

SEQ ID NO: 91495 - DNA, 201 bp, Bos taurus; identical to SEQ ID NO: 9662

SEQ ID NO: 91496 - DNA, 201 bp, Bos taurus; identical to SEQ ID NO: 9663

SEQ ID NO: 91497 - DNA, 201 bp, Bos taurus; identical to SEQ ID NO: 9664

SEQ ID NO: 91498 - DNA, 201 bp, Bos taurus; identical to SEQ ID NO: 9667

SEQ ID NO: 91499 - DNA, 201 bp, Bos taurus; identical to SEQ ID NO: 9668

SEQ ID NO: 91500 - DNA, 201 bp, Bos taurus; identical to SEQ ID NO: 9669

SEQ ID NO: 91501 - DNA, 201 bp, Bos taurus; identical to SEQ ID NO: 9670

SEQ ID NO: 91502 - DNA, 201 bp, Bos taurus; identical to SEQ ID NO: 9671

SEQ ID NO: 91503 - DNA, 201 bp, Bos taurus; identical to SEQ ID NO: 9672

SEQ ID NO: 91504 - DNA, 201 bp, Bos taurus; identical to SEQ ID NO: 9673

SEQ ID NO: 91505 - DNA, 201 bp, Bos taurus; identical to SEQ ID NO: 9674

SEQ ID NO: 91506 - DNA, 201 bp, Bos taurus; identical to SEQ ID NO: 9675

SEQ ID NO: 91507 - DNA, 201 bp, Bos taurus; identical to SEQ ID NO: 9676

SEQ ID NO: 91508 - DNA, 201 bp, Bos taurus; identical to SEQ ID NO: 9677

SEQ ID NO: 91509 - DNA, 201 bp, Bos taurus; identical to SEQ ID NO: 9678

SEQ ID NO: 91510 - DNA, 201 bp, Bos taurus; identical to SEQ ID NO: 9679

SEQ ID NO: 91511 - DNA, 201 bp, Bos taurus; identical to SEQ ID NO: 9680

SEQ ID NO: 91512 - DNA, 201 bp, Bos taurus; identical to SEQ ID NO: 9681

SEQ ID NO: 91513 - DNA, 201 bp, Bos taurus; identical to SEQ ID NO: 51070

SEQ ID NO: 91514 - DNA, 201 bp, Bos taurus; identical to SEQ ID NO: 9683

SEQ ID NO: 91515 - DNA, 201 bp, Bos taurus
agccctcttgtgtgcccttcatctgacctcatatccccgatagctctccaccagtgcattcccctggcctgctcatgaccgtggcctgctcttgtccccccaccccttgcatcttctcagtgttcctcgcctgaccttgcatgtaataccctttcctggcctcagattctgcagaatgtctgctgctagtgactctggcct

SEQ ID NO: 91516 - DNA, 201 bp, Bos taurus; identical to SEQ ID NO: 9684

SEQ ID NO: 91517 - DNA, 201 bp, Bos taurus; identical to SEQ ID NO: 9685

SEQ ID NO: 91518 - DNA, 201 bp, Bos taurus; identical to SEQ ID NO: 9686

SEQ ID NO: 91519 - DNA, 201 bp, Bos taurus; identical to SEQ ID NO: 9687

SEQ ID NO: 91520 - DNA, 201 bp, Bos taurus; identical to SEQ ID NO: 9689

SEQ ID NO: 91521 - DNA, 201 bp, Bos taurus
aaatgtacattagggtgcatatttaaaatgtttttactgatgggaatatgattaaaacattttaaaacatgactgatttttaagcctggtgaaattgggagagaatattagatctggaaggaatttcaaaggccttcagttcccccatcattccctctctcatttgatgtgcaaatctctctgttacattagattgcctcc

SEQ ID NO: 91522 - DNA, 201 bp, Bos taurus
tttggccagagatcttgtggtttccctcctaggtcctcttcccaccctgctccctgctctttgtcctgggaggttgctcttcagggatcatgtcaatgacttcccttgtcctctggccttcagctggacctggcccatggggagcaatggcaggctgtgggagggaggaggcgaggttagggtatctgttccccagctcta

SEQ ID NO: 91523 - DNA, 201 bp, Bos taurus
actgctgtgtctgactgtccccaactgcagtggcctcttgcttcctgtccccctcttgcctcctccctgaccctctcctctccatcctcaccatggccacaagagtgtgcttttaatttacaaattggatcctcccacacctctgctctcagcccaccagtgtgctgcacacggattgcaatcccacctctttactgtgac

SEQ ID NO: 91524 - DNA, 201 bp, Bos taurus
cacccaccacctccatccaggtaagcatcacccgttcaaatgaaccccagctgttgggaccgcctgctctgacattctgcgtctccatgtggcctaaggttctcaggctccagctgctcaagaaggtcctctggactacactgtgaggaccagggagtcctttgcatggccctctgcactgaggcccaggccctgtgacac

SEQ ID NO: 91525 - DNA, 201 bp, Bos taurus; identical to SEQ ID NO: 9690

SEQ ID NO: 91526 - DNA, 201 bp, Bos taurus; identical to SEQ ID NO: 9691

SEQ ID NO: 91527 - DNA, 201 bp, Bos taurus; identical to SEQ ID NO: 9692

SEQ ID NO: 91528 - DNA, 201 bp, Bos taurus; identical to SEQ ID NO: 9693

SEQ ID NO: 91529 - DNA, 201 bp, Bos taurus; identical to SEQ ID NO: 9695

SEQ ID NO: 91530 - DNA, 201 bp, Bos taurus; identical to SEQ ID NO: 9696

SEQ ID NO: 91531 - DNA, 201 bp, Bos taurus; identical to SEQ ID NO: 9698

SEQ ID NO: 91532 - DNA, 201 bp, Bos taurus
agctccaccacctcctgcaggtgaggttgctcccatgtcatggagacccacctgtctgtcttctgaccctgggtggcctttgggccagccggtgggcagccggtcccactcctgtccttggcactgctctcccaagcaggaaatggatcccggcagctgcggtcctacagggcaggaaggcggcctcggggagggcttttc

SEQ ID NO: 91533 - DNA, 201 bp, Bos taurus
tttgggccccgccaggcctggccctggttctcatctatgacatggcgtgacagctcacaggaatcgccccccgctcaccaggcagctgtgagccttaaagaagttaaaacacagaagctcctggcccagtcaggtgtgtgggagaccctcagggaatctagtgacagtggtgccgatgacagtgtcaaaagcagccggagc

SEQ ID NO: 91534 - DNA, 201 bp, Bos taurus
ggccacgaagacgcagtggtccctgagtgtccatgcagggcacgagtgtgtatcatcaatgctggcatctgagactctgctctgaactcaggggtgttcttgtcctcctgtagagggccttggtggcacttgaacttgggctcctgtaaggagccctgctggacccctggggctccctgcagggactgctgcatgggaggg

SEQ ID NO: 91535 - DNA, 201 bp, Bos taurus
atgccctggcaggcgtcactcaccaatcccagggcccttgccctaaatcctgaccctctgctgtccagagccccgggcagctcctggtggcagtaacacttgtcctctcagcctgggtcacccttgatggagggtggacgaagcagagtcctgagctgcgggctgcgggaggagcatggagaccgtggggctgggcctcac

SEQ ID NO: 91536 - DNA, 201 bp, Bos taurus
gggccaccagctggggggcactcatagggtgtctgagaagggcactgacagcacagaagcctggtttcccagacgatccttactggagggtccctggtgtggcaaggaaacagctggagtgatggagcaggggggcccggggggactcaggccaggcgagggagagggtcaccaagcaggggtggggcaaggatctgtgcg

SEQ ID NO: 91537 - DNA, 201 bp, Bos taurus
aatgaaattttccctgagtagtccgtttttttctttcagctctgttttttctaaagttaatttctgtcaccttcttgaataggccaagcaaatccagatacgtataactaaatttaatagaatgacagacgaacagggaaagcgattctaagaattttagctactttacatttccctatctcctgaggcctagtttagtgc

SEQ ID NO: 91538 - DNA, 201 bp, Bos taurus; identical to SEQ ID NO: 9699

SEQ ID NO: 91539 - DNA, 201 bp, Bos taurus
gtctccatggtgagtggagggtgtgccccaaagcccagaggacccatcacttctacctgcagctgacggctgacaatgaccaaagaaaggatccatcctacgggctaccagtgtggcctgagaacttacacgagggtaaatcagagaatgactcttacggaccattcagagctgtggagagcaacctggtccatttcagac

SEQ ID NO: 91540 - DNA, 201 bp, Bos taurus; identical to SEQ ID NO: 9700

SEQ ID NO: 91541 - DNA, 201 bp, Bos taurus; identical to SEQ ID NO: 9703

SEQ ID NO: 91542 - DNA, 201 bp, Bos taurus; identical to SEQ ID NO: 9706

SEQ ID NO: 91543 - DNA, 201 bp, Bos taurus; identical to SEQ ID NO: 9708

SEQ ID NO: 91544 - DNA, 201 bp, Bos taurus; identical to SEQ ID NO: 9711

SEQ ID NO: 91545 - DNA, 201 bp, Bos taurus; identical to SEQ ID NO: 9712

SEQ ID NO: 91546 - DNA, 201 bp, Bos taurus; identical to SEQ ID NO: 9713

SEQ ID NO: 91547 - DNA, 201 bp, Bos taurus
aatgtccccgtctctgaggtttcccagctgatgctcagcacccttatctttgccctcaaagcctcaaaactccagggaaataacaataactgaaaagaaaccaaacaaaaggctaagcctacaataaacccaaggaaactgtagcaggtttctgataagacccagagagatttcaaggccagagaaaagctgaaaacactt

SEQ ID NO: 91548 - DNA, 201 bp, Bos taurus; identical to SEQ ID NO: 9714

SEQ ID NO: 91549 - DNA, 201 bp, Bos taurus; identical to SEQ ID NO: 9716

SEQ ID NO: 91550 - DNA, 201 bp, Bos taurus; identical to SEQ ID NO: 9717

SEQ ID NO: 91551 - DNA, 201 bp, Bos taurus
gggccatccctgagctgggccctcagaaggccttggactggctgcagaggagaaaactgccgaggagcccagtaaagggagacgctgggcaaaggaaagcatgcatgacaagaaggcccgaggctgtctgcagcccccaggaccacagtgtcagaagtaagagccaaaacctaagctttcaaagttcctgccactgcagtc

SEQ ID NO: 91552 - DNA, 201 bp, Bos taurus; identical to SEQ ID NO: 9718

SEQ ID NO: 91553 - DNA, 201 bp, Bos taurus; identical to SEQ ID NO: 9720

SEQ ID NO: 91554 - DNA, 201 bp, Bos taurus
gctccatgcaggggcctctgaaggcagggccaggggcttgtgcttttgggacaacctgtgaggaactgtggaacacgtgcctagaccctctggaggctcctggatgaagattctagaggcctgtcccaggccagcgctagctccaatgttaccttctactctcccaacccaccagaaagctccctgctgggaagtcctttg

SEQ ID NO: 91555 - DNA, 201 bp, Bos taurus
cagagcctttctggaaagtccagtggacacccactgtggtgtggtgctgagagtgggtggtcagggaggaccttggaaaccagacagaggtcagaggtgacggtgccctggagctgagataggcctgttccccttccttctggtgtgagcaccccaattctgttcttaggccctgctcttccctcacaagtgctctgggct

SEQ ID NO: 91556 - DNA, 201 bp, Bos taurus
agagaaaggggctggaccccgtgtgagttatgaaagggaagaccagatgagaggagataacagcttcaatgccttgcttttattatacaaatctgcacttccagttggaagaaaagattttttttttctattggtggttatttgcttaagagaattggagacctgagagctgtctcggtggatgattaatgggaaaaaatt

SEQ ID NO: 91557 - DNA, 201 bp, Bos taurus; identical to SEQ ID NO: 9723

SEQ ID NO: 91558 - DNA, 201 bp, Bos taurus; identical to SEQ ID NO: 9724

SEQ ID NO: 91559 - DNA, 201 bp, Bos taurus; identical to SEQ ID NO: 9725

SEQ ID NO: 91560 - DNA, 201 bp, Bos taurus; identical to SEQ ID NO: 9726

SEQ ID NO: 91561 - DNA, 201 bp, Bos taurus
ggccagcccatcttgcatttactcaacctgcttttgcagccctggaaaatatgtaaataaatgggtaatgctgttccaataaaactttatttacaaaagcgggtgatagggtggagttggcccacaagccctagtttgccaagcctggtttagcccaacaggaactgagatgcacaaattgaagcaagctgacctcttcac

SEQ ID NO: 91562 - DNA, 201 bp, Bos taurus
ctgcttccctcagtttcttgtgcctcattctccaccaagcgtccatcacaggcagcagtggcccaactcaagggcatccttacagctactttcttggccagcatcttcatctgccagggaaggactctgattggtcagtttgggtcttggatccacccttagaccaatcatcatgcccaaagaaatgggacactcccattg

SEQ ID NO: 91563 - DNA, 201 bp, Bos taurus
gtccagggcaggcttcggtgcccatggacagctttccctacagctgaccgcaaagccagctctgagagccattctgtcaccttcctctatttgccttggagccagctcgggagatggtgtgacacacccacacaaagcttggcagtgcttctcggcttggcaagcgctggcggagatgcgcagaggtgttcgtgaagggga

SEQ ID NO: 91564 - DNA, 201 bp, Bos taurus
ctcgctgtcagcaggctgaagcagagcttcccaacccaggtttgcctgaatcagctgaagcagagcaaatgtgagaataaatgcttgttgttgaaagaaagaaatcaggaagaatcaggccaagtaacacagagctcagtgaggcagggaagggccagtggtctggtgtctcaacagtaagcaaattcctggagggcagga

SEQ ID NO: 91565 - DNA, 201 bp, Bos taurus; identical to SEQ ID NO: 9728

SEQ ID NO: 91566 - DNA, 201 bp, Bos taurus
tgcaagctccctgagccctgacgtttagggttttacggaggatccatttcacggttgtgattgagtaaatcattggccattggtgattaactcacttttcagctcctctctcctccctggaggtcagaccaaccttctaatcattccaagatctctttggccacagtccccttcctgaagccatcaagggcccccaacatg

SEQ ID NO: 91567 - DNA, 201 bp, Bos taurus; identical to SEQ ID NO: 9730

SEQ ID NO: 91568 - DNA, 201 bp, Bos taurus; identical to SEQ ID NO: 9732

SEQ ID NO: 91569 - DNA, 201 bp, Bos taurus
tcaaatttatatatcccattaaacatctttcctgaatttcagatccacatattcaactacctacctgctgtcttggatgtgtaacagtcatctcaaaacttatgtccaaaacctaatttactttcctttaccttgcccctttaagcttgccattctctatgctatactaagtcacttcagtcgtgtccgactctgtgcgac

SEQ ID NO: 91570 - DNA, 201 bp, Bos taurus
gacaggccacagagatgacatggtcttttgctccgggtgagccgggagtcactcaaaagtaatgcccagaactccagcccaggctgtgcctctgagtaagcgagggccctcctgggcctcagtggccttacctgagaaatgggacttgattgtgtgtttgtgttagacactcacgccagctccgtggggggtggagggcac

SEQ ID NO: 91571 - DNA, 201 bp, Bos taurus; identical to SEQ ID NO: 9733

SEQ ID NO: 91572 - DNA, 201 bp, Bos taurus
tcagtttcgagctgagtggagaaaaaactgccaagctcaggctggtggagaaagcaaacccacacaggtaagcagtcacaggcctgtgtacagaatgagatgttattgttgctcatatgctgagtcaagataaggatacaagcatcctcaagctccctgtgatctgggggccattaatgatagtttgtatacctccttatt

SEQ ID NO: 91573 - DNA, 201 bp, Bos taurus
cacagtaatcctcatttctaggaatctaaatatacacaaactatgcacaaagttattcattgcagcttcatttgtattaacaaaagattggaatcaacccgaatgaataaacaaggatacatttccttctgcatatcaaatgaccccaatctggtgaaacacaaccaccacaggctttattttgctcacggattctgtagg

SEQ ID NO: 91574 - DNA, 201 bp, Bos taurus
ttgaaagaggtcttttccctcctccactccactgatcctctggggcaacactgcctctgttttgcagcccgtgagttacctgccttggccaatgtagggcgggaaccttgcctttccatccagccccagccactgctccctcccctctacctgtagctctgcctctgctttggcccatgatgcatctgggtcctgccgccc

SEQ ID NO: 91575 - DNA, 201 bp, Bos taurus
gaaatgagaaaaatcctgtgccggcttagaacatgcctgtcacggataaatagcaggggctcagtaaatggtagctattcccttgcaaaccaaatctcccgtggagaccaagctaggacatgaggaaagaatgggggctctgcgaaagctgaagctctctcctctctaccttgcggtggccacagaggcccctctcaaaag

SEQ ID NO: 91576 - DNA, 201 bp, Bos taurus; identical to SEQ ID NO: 9734

SEQ ID NO: 91577 - DNA, 201 bp, Bos taurus; identical to SEQ ID NO: 9735

SEQ ID NO: 91578 - DNA, 201 bp, Bos taurus; identical to SEQ ID NO: 9736

SEQ ID NO: 91579 - DNA, 201 bp, Bos taurus; identical to SEQ ID NO: 9738

SEQ ID NO: 91580 - DNA, 201 bp, Bos taurus; identical to SEQ ID NO: 9739

SEQ ID NO: 91581 - DNA, 201 bp, Bos taurus; identical to SEQ ID NO: 9744

SEQ ID NO: 91582 - DNA, 201 bp, Bos taurus; identical to SEQ ID NO: 9748

SEQ ID NO: 91583 - DNA, 201 bp, Bos taurus; identical to SEQ ID NO: 9749

SEQ ID NO: 91584 - DNA, 201 bp, Bos taurus; identical to SEQ ID NO: 9751

SEQ ID NO: 91585 - DNA, 201 bp, Bos taurus; identical to SEQ ID NO: 9754

SEQ ID NO: 91586 - DNA, 201 bp, Bos taurus; identical to SEQ ID NO: 9758

SEQ ID NO: 91587 - DNA, 201 bp, Bos taurus; identical to SEQ ID NO: 9760

SEQ ID NO: 91588 - DNA, 201 bp, Bos taurus; identical to SEQ ID NO: 9761

SEQ ID NO: 91589 - DNA, 201 bp, Bos taurus; identical to SEQ ID NO: 9762

SEQ ID NO: 91590 - DNA, 201 bp, Bos taurus; identical to SEQ ID NO: 9763

SEQ ID NO: 91591 - DNA, 201 bp, Bos taurus; identical to SEQ ID NO: 9766

SEQ ID NO: 91592 - DNA, 201 bp, Bos taurus; identical to SEQ ID NO: 9767

SEQ ID NO: 91593 - DNA, 201 bp, Bos taurus; identical to SEQ ID NO: 9768

SEQ ID NO: 91594 - DNA, 201 bp, Bos taurus; identical to SEQ ID NO: 9769

SEQ ID NO: 91595 - DNA, 201 bp, Bos taurus; identical to SEQ ID NO: 9771

SEQ ID NO: 91596 - DNA, 201 bp, Bos taurus; identical to SEQ ID NO: 9772

SEQ ID NO: 91597 - DNA, 201 bp, Bos taurus; identical to SEQ ID NO: 9773

SEQ ID NO: 91598 - DNA, 201 bp, Bos taurus; identical to SEQ ID NO: 9774

SEQ ID NO: 91599 - DNA, 201 bp, Bos taurus; identical to SEQ ID NO: 9775

SEQ ID NO: 91600 - DNA, 201 bp, Bos taurus; identical to SEQ ID NO: 9776

SEQ ID NO: 91601 - DNA, 201 bp, Bos taurus; identical to SEQ ID NO: 9777

SEQ ID NO: 91602 - DNA, 201 bp, Bos taurus; identical to SEQ ID NO: 9778

SEQ ID NO: 91603 - DNA, 201 bp, Bos taurus; identical to SEQ ID NO: 9779

SEQ ID NO: 91604 - DNA, 201 bp, Bos taurus; identical to SEQ ID NO: 9780

SEQ ID NO: 91605 - DNA, 201 bp, Bos taurus; identical to SEQ ID NO: 9781

SEQ ID NO: 91606 - DNA, 201 bp, Bos taurus; identical to SEQ ID NO: 9782

SEQ ID NO: 91607 - DNA, 201 bp, Bos taurus; identical to SEQ ID NO: 9783

SEQ ID NO: 91608 - DNA, 201 bp, Bos taurus; identical to SEQ ID NO: 9785

SEQ ID NO: 91609 - DNA, 201 bp, Bos taurus; identical to SEQ ID NO: 9786

SEQ ID NO: 91610 - DNA, 201 bp, Bos taurus; identical to SEQ ID NO: 9787

SEQ ID NO: 91611 - DNA, 201 bp, Bos taurus; identical to SEQ ID NO: 9790

SEQ ID NO: 91612 - DNA, 201 bp, Bos taurus; identical to SEQ ID NO: 9796

SEQ ID NO: 91613 - DNA, 201 bp, Bos taurus; identical to SEQ ID NO: 9799

SEQ ID NO: 91614 - DNA, 201 bp, Bos taurus; identical to SEQ ID NO: 9801

SEQ ID NO: 91615 - DNA, 201 bp, Bos taurus; identical to SEQ ID NO: 9804

SEQ ID NO: 91616 - DNA, 201 bp, Bos taurus; identical to SEQ ID NO: 9805

SEQ ID NO: 91617 - DNA, 201 bp, Bos taurus; identical to SEQ ID NO: 9810

SEQ ID NO: 91618 - DNA, 201 bp, Bos taurus; identical to SEQ ID NO: 9812

SEQ ID NO: 91619 - DNA, 201 bp, Bos taurus; identical to SEQ ID NO: 9813

SEQ ID NO: 91620 - DNA, 201 bp, Bos taurus; identical to SEQ ID NO: 9814

SEQ ID NO: 91621 - DNA, 201 bp, Bos taurus; identical to SEQ ID NO: 9815

SEQ ID NO: 91622 - DNA, 201 bp, Bos taurus; identical to SEQ ID NO: 9817

SEQ ID NO: 91623 - DNA, 201 bp, Bos taurus; identical to SEQ ID NO: 9818

SEQ ID NO: 91624 - DNA, 201 bp, Bos taurus; identical to SEQ ID NO: 9819

SEQ ID NO: 91625 - DNA, 201 bp, Bos taurus; identical to SEQ ID NO: 9822

SEQ ID NO: 91626 - DNA, 201 bp, Bos taurus; identical to SEQ ID NO: 9823

SEQ ID NO: 91627 - DNA, 201 bp, Bos taurus; identical to SEQ ID NO: 9825

SEQ ID NO: 91628 - DNA, 201 bp, Bos taurus; identical to SEQ ID NO: 9826

SEQ ID NO: 91629 - DNA, 201 bp, Bos taurus; identical to SEQ ID NO: 9828

SEQ ID NO: 91630 - DNA, 201 bp, Bos taurus; identical to SEQ ID NO: 9831

SEQ ID NO: 91631 - DNA, 201 bp, Bos taurus; identical to SEQ ID NO: 9832

SEQ ID NO: 91632 - DNA, 201 bp, Bos taurus; identical to SEQ ID NO: 9834

SEQ ID NO: 91633 - DNA, 201 bp, Bos taurus
gtgacaacctctggtggcctgaatccaaagaagagaaacacagaggaagtggcaggtataacaggcacacattaggggaaggagatgggctccctgagatgtacagagaaagggggccatccccatggcggtggctttggttcccagaagcggagtgagtgtgtggggcttttgaactggatgaaaagcatctctggatta

SEQ ID NO: 91634 - DNA, 201 bp, Bos taurus; identical to SEQ ID NO: 9838

SEQ ID NO: 91635 - DNA, 201 bp, Bos taurus; identical to SEQ ID NO: 9839

SEQ ID NO: 91636 - DNA, 201 bp, Bos taurus; identical to SEQ ID NO: 9840

SEQ ID NO: 91637 - DNA, 201 bp, Bos taurus; identical to SEQ ID NO: 9841

SEQ ID NO: 91638 - DNA, 201 bp, Bos taurus; identical to SEQ ID NO: 9844

SEQ ID NO: 91639 - DNA, 201 bp, Bos taurus; identical to SEQ ID NO: 9845

SEQ ID NO: 91640 - DNA, 201 bp, Bos taurus
ttctctctggtaaccactgctttgtacctatatgctcatatctacagttttagaaggaactttttggatcatatccaagttcactttccagcagagacacaggggccttgtagaccaaggggcagaggagcagtgactacctgcctgcctgctaacctggagcttctcccatcacactcctgactcaagaagtttccttgg

SEQ ID NO: 91641 - DNA, 201 bp, Bos taurus; identical to SEQ ID NO: 9846

SEQ ID NO: 91642 - DNA, 201 bp, Bos taurus
acatgttggtgtctattcttctagatttcctctgtatgcttgaacacacacatttaataaaaatgagagtgggcttaataaggcgggacaaggaggggccagcactcagtgagtcagcagctggtgtccttgaaggtgaggaagaggaaaacggaaaaaaaaaaaaaaaaagccaaacacaaaaatccagtggaggggaag

SEQ ID NO: 91643 - DNA, 201 bp, Bos taurus
tgaaaggagtggagggtgttggtgcaaactgccagtttcttaaccctctgcgttcaccaccctcgcccctctcttccgtctcccagaggcctgtgggcacaaccattctcccctgctaccttcagctacatgtctaggatgcatcgaacaccagaagcacttctgtggatcgcaggttccaggatctagccaggggtgtat

SEQ ID NO: 91644 - DNA, 201 bp, Bos taurus; identical to SEQ ID NO: 9847

SEQ ID NO: 91645 - DNA, 201 bp, Bos taurus; identical to SEQ ID NO: 9848

SEQ ID NO: 91646 - DNA, 201 bp, Bos taurus; identical to SEQ ID NO: 9850

SEQ ID NO: 91647 - DNA, 201 bp, Bos taurus; identical to SEQ ID NO: 9851

SEQ ID NO: 91648 - DNA, 201 bp, Bos taurus; identical to SEQ ID NO: 9853

SEQ ID NO: 91649 - DNA, 201 bp, Bos taurus; identical to SEQ ID NO: 9854

SEQ ID NO: 91650 - DNA, 201 bp, Bos taurus
tcacgctttttttttgttttggccgtgccattggcctgtaggaatcttagttccccgaccagcgatccaacccgcgcccctggcagtggaggcgcggagttttaaccgctgggccgccagagaagaccctcacacttttcttaaattatctttttgtttgtttttcatacaaccctctatcctaggatatccgctctattt

SEQ ID NO: 91651 - DNA, 201 bp, Bos taurus; identical to SEQ ID NO: 9855

SEQ ID NO: 91652 - DNA, 201 bp, Bos taurus; identical to SEQ ID NO: 9856

SEQ ID NO: 91653 - DNA, 201 bp, Bos taurus
ttagttctcaagctgtgcaggcaacagatgccagtgggctctactggtctgtctagtacaccagccaccggccccacgtggccgctgagcacttgaaatgcggattagtataattgaggaatgaactttaacttcctgtcattttaattgatttcagagtggccggcacttgccatgttagatagcacagctctccgatct

SEQ ID NO: 91654 - DNA, 201 bp, Bos taurus; identical to SEQ ID NO: 9857

SEQ ID NO: 91655 - DNA, 201 bp, Bos taurus; identical to SEQ ID NO: 9858

SEQ ID NO: 91656 - DNA, 201 bp, Bos taurus; identical to SEQ ID NO: 9859

SEQ ID NO: 91657 - DNA, 201 bp, Bos taurus; identical to SEQ ID NO: 9860

SEQ ID NO: 91658 - DNA, 201 bp, Bos taurus; identical to SEQ ID NO: 9862

SEQ ID NO: 91659 - DNA, 201 bp, Bos taurus; identical to SEQ ID NO: 9863

SEQ ID NO: 91660 - DNA, 201 bp, Bos taurus; identical to SEQ ID NO: 9865

SEQ ID NO: 91661 - DNA, 201 bp, Bos taurus; identical to SEQ ID NO: 9866

SEQ ID NO: 91662 - DNA, 201 bp, Bos taurus; identical to SEQ ID NO: 9867

SEQ ID NO: 91663 - DNA, 201 bp, Bos taurus; identical to SEQ ID NO: 9869

SEQ ID NO: 91664 - DNA, 201 bp, Bos taurus; identical to SEQ ID NO: 9870

SEQ ID NO: 91665 - DNA, 201 bp, Bos taurus; identical to SEQ ID NO: 9872

SEQ ID NO: 91666 - DNA, 201 bp, Bos taurus; identical to SEQ ID NO: 9873

SEQ ID NO: 91667 - DNA, 201 bp, Bos taurus
gtttcaagcagtgtgggcatgtcggccgtcctgctcaagctcgggtttaaagagtcactggtccagtcaaaaatggcagctggcaccagccccttcgtggtagcgtaggccacccactcacacacacccatgaggatcagtgttaccttagtttcctggcccttgactgtcagatatttttggaaagtgagaatttttaaa

SEQ ID NO: 91668 - DNA, 201 bp, Bos taurus; identical to SEQ ID NO: 9874

SEQ ID NO: 91669 - DNA, 201 bp, Bos taurus; identical to SEQ ID NO: 9875

SEQ ID NO: 91670 - DNA, 201 bp, Bos taurus; identical to SEQ ID NO: 9876

SEQ ID NO: 91671 - DNA, 201 bp, Bos taurus; identical to SEQ ID NO: 9877

SEQ ID NO: 91672 - DNA, 201 bp, Bos taurus; identical to SEQ ID NO: 9878

SEQ ID NO: 91673 - DNA, 201 bp, Bos taurus; identical to SEQ ID NO: 9879

SEQ ID NO: 91674 - DNA, 201 bp, Bos taurus; identical to SEQ ID NO: 9880

SEQ ID NO: 91675 - DNA, 201 bp, Bos taurus; identical to SEQ ID NO: 9881

SEQ ID NO: 91676 - DNA, 201 bp, Bos taurus; identical to SEQ ID NO: 9884

SEQ ID NO: 91677 - DNA, 201 bp, Bos taurus; identical to SEQ ID NO: 9885

SEQ ID NO: 91678 - DNA, 201 bp, Bos taurus; identical to SEQ ID NO: 9886

SEQ ID NO: 91679 - DNA, 201 bp, Bos taurus
ccccgggcctccaccgggcagaagctgccttcaaacagcacctgcatcttgcttacacccatagggaagagcacacggccgggtggcactggcaccccatttcatgtctgtgcagacatcactaatcaatcggtgattctctctgagcccaacttggcctctagacaggcagccactgtcaaccaattccaacaggcacca

SEQ ID NO: 91680 - DNA, 201 bp, Bos taurus
gcaagaacactggagtgggttgccactgccttctccgaatgagctgcctacttactctcaaaaaacatccaacttctgcccacatgatgccaaggccctgcgtgaactgtcccctgatctctgttctttcacttattctgctttaccgcactcaccgtcttccccagctcacaaaacatgccagactcctgcttgcctcag

SEQ ID NO: 91681 - DNA, 201 bp, Bos taurus; identical to SEQ ID NO: 9887

SEQ ID NO: 91682 - DNA, 201 bp, Bos taurus; identical to SEQ ID NO: 9889

SEQ ID NO: 91683 - DNA, 201 bp, Bos taurus; identical to SEQ ID NO: 9891

SEQ ID NO: 91684 - DNA, 201 bp, Bos taurus; identical to SEQ ID NO: 9892

SEQ ID NO: 91685 - DNA, 201 bp, Bos taurus; identical to SEQ ID NO: 9893

SEQ ID NO: 91686 - DNA, 201 bp, Bos taurus; identical to SEQ ID NO: 9894

SEQ ID NO: 91687 - DNA, 201 bp, Bos taurus; identical to SEQ ID NO: 9895

SEQ ID NO: 91688 - DNA, 201 bp, Bos taurus; identical to SEQ ID NO: 9896

SEQ ID NO: 91689 - DNA, 201 bp, Bos taurus
aataaattagaaaaataaagccttcctccactcaacccccacccccttccccacgcagccagccactgcggggctggatacagaccagggtttgggccccggttgagctggcttcctctctatccccacgcctgacttgctgtgtgacctcaggcaagtcactcagcctctctgggccttgtgtcttcatctgtaactggg

SEQ ID NO: 91690 - DNA, 201 bp, Bos taurus
ggtgctcctcgaggccaggctgcgggtcccagtatctggagagccagcctctgtgcatttctgagtcccggggtccgcagcagcacatgctcaggcatggcgggcccaaggcaggacccactgtgttcgcagagtctgtgtgggttggggcctagctggctgtttgccttctccaagttttcttttttaaagtcacctttt

SEQ ID NO: 91691 - DNA, 201 bp, Bos taurus; identical to SEQ ID NO: 9898

SEQ ID NO: 91692 - DNA, 201 bp, Bos taurus; identical to SEQ ID NO: 9899

SEQ ID NO: 91693 - DNA, 201 bp, Bos taurus; identical to SEQ ID NO: 9900

SEQ ID NO: 91694 - DNA, 201 bp, Bos taurus; identical to SEQ ID NO: 9901

SEQ ID NO: 91695 - DNA, 201 bp, Bos taurus; identical to SEQ ID NO: 9902

SEQ ID NO: 91696 - DNA, 201 bp, Bos taurus; identical to SEQ ID NO: 9903

SEQ ID NO: 91697 - DNA, 201 bp, Bos taurus; identical to SEQ ID NO: 9904

SEQ ID NO: 91698 - DNA, 201 bp, Bos taurus; identical to SEQ ID NO: 9905

SEQ ID NO: 91699 - DNA, 201 bp, Bos taurus; identical to SEQ ID NO: 9906

SEQ ID NO: 91700 - DNA, 201 bp, Bos taurus
cgaaggcttccaaacttctgtcccttagaggaggtgcccttttatttcacaattcggttcacaccatcatactcactggcaactaaacaaaagcttcccccgaacaatacttaccccatgcactcttatctatcctcctgtctggggttactttgtttaaatgctggtcataactcattaaacagatttcctgtcccatcg

SEQ ID NO: 91701 - DNA, 201 bp, Bos taurus; identical to SEQ ID NO: 9907

SEQ ID NO: 91702 - DNA, 201 bp, Bos taurus; identical to SEQ ID NO: 9908

SEQ ID NO: 91703 - DNA, 201 bp, Bos taurus; identical to SEQ ID NO: 9909

SEQ ID NO: 91704 - DNA, 201 bp, Bos taurus
caggcaacaagcagaaatgcccagtgtgttcaggacaccgtccggcccctcgctcctgccctgccatggagacatggatgctccacataccccaggcggtgtagctgtgagatgcgggacagtggcctggcgtgcctcagagtttccatgagtgaggaattaacttgcacttgactttagatactgagatttcaggggcca

SEQ ID NO: 91705 - DNA, 201 bp, Bos taurus; identical to SEQ ID NO: 9910

SEQ ID NO: 91706 - DNA, 201 bp, Bos taurus; identical to SEQ ID NO: 9911

SEQ ID NO: 91707 - DNA, 201 bp, Bos taurus; identical to SEQ ID NO: 9912

SEQ ID NO: 91708 - DNA, 201 bp, Bos taurus; identical to SEQ ID NO: 9914

SEQ ID NO: 91709 - DNA, 201 bp, Bos taurus; identical to SEQ ID NO: 9915

SEQ ID NO: 91710 - DNA, 201 bp, Bos taurus; identical to SEQ ID NO: 9917

SEQ ID NO: 91711 - DNA, 201 bp, Bos taurus; identical to SEQ ID NO: 9918

SEQ ID NO: 91712 - DNA, 201 bp, Bos taurus; identical to SEQ ID NO: 9919

SEQ ID NO: 91713 - DNA, 201 bp, Bos taurus; identical to SEQ ID NO: 9920

SEQ ID NO: 91714 - DNA, 201 bp, Bos taurus
acgctggccgttcacactttttctcaaaaatgctaccgcgtagcgtcttatcttcctgatacgctcatgaaacagaccctggatgacaacagatgctgggtgttggtggcctgccagccactgcgggcctagggatctgtgatgtcgggggtcttgggaccgtatttcgtatggagcagttattggagccttactgagacc

SEQ ID NO: 91715 - DNA, 201 bp, Bos taurus; identical to SEQ ID NO: 9923

SEQ ID NO: 91716 - DNA, 201 bp, Bos taurus; identical to SEQ ID NO: 9924

SEQ ID NO: 91717 - DNA, 201 bp, Bos taurus; identical to SEQ ID NO: 9925

SEQ ID NO: 91718 - DNA, 201 bp, Bos taurus; identical to SEQ ID NO: 9926

SEQ ID NO: 91719 - DNA, 201 bp, Bos taurus; identical to SEQ ID NO: 9928

SEQ ID NO: 91720 - DNA, 201 bp, Bos taurus; identical to SEQ ID NO: 9929

SEQ ID NO: 91721 - DNA, 201 bp, Bos taurus; identical to SEQ ID NO: 9930

SEQ ID NO: 91722 - DNA, 201 bp, Bos taurus; identical to SEQ ID NO: 9931

SEQ ID NO: 91723 - DNA, 201 bp, Bos taurus; identical to SEQ ID NO: 9932

SEQ ID NO: 91724 - DNA, 201 bp, Bos taurus
ggataaaatgtgatttcatcagatcggccagaacatgagtaactaccagagtcattcattaccaaggaaggttgatactgacctccacatatgaactgtcctttccttaaatgaagttgtcttctgatttttttttttctggttctaacaaggaacatgttgcccaaacttctcctaagtacattccaggctagttgatga

SEQ ID NO: 91725 - DNA, 201 bp, Bos taurus; identical to SEQ ID NO: 9936

SEQ ID NO: 91726 - DNA, 201 bp, Bos taurus; identical to SEQ ID NO: 9939

SEQ ID NO: 91727 - DNA, 201 bp, Bos taurus; identical to SEQ ID NO: 9940

SEQ ID NO: 91728 - DNA, 201 bp, Bos taurus; identical to SEQ ID NO: 9943

SEQ ID NO: 91729 - DNA, 201 bp, Bos taurus
ccttaggttaaggtttcctttctgcttttgatgaaaatcatagtgtatgggaaacctttgaaagaacacccagctccaggcctcaccccagcccagatggcgcttagaggctctgagttagtaggttttggtgctgtgggtgggcgagcacagtgggaggtttagaactcccgctgtgcatcagctccgggctctgtgatg

SEQ ID NO: 91730 - DNA, 201 bp, Bos taurus; identical to SEQ ID NO: 9944

SEQ ID NO: 91731 - DNA, 201 bp, Bos taurus; identical to SEQ ID NO: 9945

SEQ ID NO: 91732 - DNA, 201 bp, Bos taurus; identical to SEQ ID NO: 9947

SEQ ID NO: 91733 - DNA, 201 bp, Bos taurus; identical to SEQ ID NO: 9949

SEQ ID NO: 91734 - DNA, 201 bp, Bos taurus; identical to SEQ ID NO: 9950

SEQ ID NO: 91735 - DNA, 201 bp, Bos taurus; identical to SEQ ID NO: 9952

SEQ ID NO: 91736 - DNA, 201 bp, Bos taurus; identical to SEQ ID NO: 9953

SEQ ID NO: 91737 - DNA, 201 bp, Bos taurus; identical to SEQ ID NO: 9954

SEQ ID NO: 91738 - DNA, 201 bp, Bos taurus; identical to SEQ ID NO: 9955

SEQ ID NO: 91739 - DNA, 201 bp, Bos taurus; identical to SEQ ID NO: 9956

SEQ ID NO: 91740 - DNA, 201 bp, Bos taurus; identical to SEQ ID NO: 9957

SEQ ID NO: 91741 - DNA, 201 bp, Bos taurus; identical to SEQ ID NO: 9958

SEQ ID NO: 91742 - DNA, 201 bp, Bos taurus; identical to SEQ ID NO: 9959

SEQ ID NO: 91743 - DNA, 201 bp, Bos taurus; identical to SEQ ID NO: 9960

SEQ ID NO: 91744 - DNA, 201 bp, Bos taurus; identical to SEQ ID NO: 9961

SEQ ID NO: 91745 - DNA, 201 bp, Bos taurus; identical to SEQ ID NO: 9962

SEQ ID NO: 91746 - DNA, 201 bp, Bos taurus; identical to SEQ ID NO: 9963

SEQ ID NO: 91747 - DNA, 201 bp, Bos taurus; identical to SEQ ID NO: 9964

SEQ ID NO: 91748 - DNA, 201 bp, Bos taurus; identical to SEQ ID NO: 9965

SEQ ID NO: 91749 - DNA, 201 bp, Bos taurus; identical to SEQ ID NO: 9966

SEQ ID NO: 91750 - DNA, 201 bp, Bos taurus; identical to SEQ ID NO: 9967

SEQ ID NO: 91751 - DNA, 201 bp, Bos taurus; identical to SEQ ID NO: 9968

SEQ ID NO: 91752 - DNA, 201 bp, Bos taurus; identical to SEQ ID NO: 9969

SEQ ID NO: 91753 - DNA, 201 bp, Bos taurus; identical to SEQ ID NO: 9970

SEQ ID NO: 91754 - DNA, 201 bp, Bos taurus; identical to SEQ ID NO: 9971

SEQ ID NO: 91755 - DNA, 201 bp, Bos taurus; identical to SEQ ID NO: 9972

SEQ ID NO: 91756 - DNA, 201 bp, Bos taurus; identical to SEQ ID NO: 9973

SEQ ID NO: 91757 - DNA, 201 bp, Bos taurus; identical to SEQ ID NO: 9974

SEQ ID NO: 91758 - DNA, 201 bp, Bos taurus; identical to SEQ ID NO: 9975

SEQ ID NO: 91759 - DNA, 201 bp, Bos taurus; identical to SEQ ID NO: 9976

SEQ ID NO: 91760 - DNA, 201 bp, Bos taurus; identical to SEQ ID NO: 9977

SEQ ID NO: 91761 - DNA, 201 bp, Bos taurus; identical to SEQ ID NO: 9978

SEQ ID NO: 91762 - DNA, 201 bp, Bos taurus; identical to SEQ ID NO: 9979

SEQ ID NO: 91763 - DNA, 201 bp, Bos taurus; identical to SEQ ID NO: 9980

SEQ ID NO: 91764 - DNA, 201 bp, Bos taurus; identical to SEQ ID NO: 9981

SEQ ID NO: 91765 - DNA, 201 bp, Bos taurus; identical to SEQ ID NO: 9982

SEQ ID NO: 91766 - DNA, 201 bp, Bos taurus; identical to SEQ ID NO: 9983

SEQ ID NO: 91767 - DNA, 201 bp, Bos taurus; identical to SEQ ID NO: 9984

SEQ ID NO: 91768 - DNA, 201 bp, Bos taurus; identical to SEQ ID NO: 9985

SEQ ID NO: 91769 - DNA, 201 bp, Bos taurus; identical to SEQ ID NO: 9986

SEQ ID NO: 91770 - DNA, 201 bp, Bos taurus; identical to SEQ ID NO: 9987

SEQ ID NO: 91771 - DNA, 201 bp, Bos taurus; identical to SEQ ID NO: 9988

SEQ ID NO: 91772 - DNA, 201 bp, Bos taurus; identical to SEQ ID NO: 9989

SEQ ID NO: 91773 - DNA, 201 bp, Bos taurus; identical to SEQ ID NO: 9990

SEQ ID NO: 91774 - DNA, 201 bp, Bos taurus; identical to SEQ ID NO: 9991

SEQ ID NO: 91775 - DNA, 201 bp, Bos taurus; identical to SEQ ID NO: 9992

SEQ ID NO: 91776 - DNA, 201 bp, Bos taurus; identical to SEQ ID NO: 9993

SEQ ID NO: 91777 - DNA, 201 bp, Bos taurus; identical to SEQ ID NO: 9994

SEQ ID NO: 91778 - DNA, 201 bp, Bos taurus; identical to SEQ ID NO: 9995

SEQ ID NO: 91779 - DNA, 201 bp, Bos taurus; identical to SEQ ID NO: 9996

SEQ ID NO: 91780 - DNA, 201 bp, Bos taurus; identical to SEQ ID NO: 9997

SEQ ID NO: 91781 - DNA, 201 bp, Bos taurus; identical to SEQ ID NO: 9998

SEQ ID NO: 91782 - DNA, 201 bp, Bos taurus; identical to SEQ ID NO: 9999

SEQ ID NO: 91783 - DNA, 201 bp, Bos taurus; identical to SEQ ID NO: 10000

SEQ ID NO: 91784 - DNA, 201 bp, Bos taurus; identical to SEQ ID NO: 10001

SEQ ID NO: 91785 - DNA, 201 bp, Bos taurus; identical to SEQ ID NO: 10002

SEQ ID NO: 91786 - DNA, 201 bp, Bos taurus; identical to SEQ ID NO: 10003

SEQ ID NO: 91787 - DNA, 201 bp, Bos taurus; identical to SEQ ID NO: 10004

SEQ ID NO: 91788 - DNA, 201 bp, Bos taurus; identical to SEQ ID NO: 10005

SEQ ID NO: 91789 - DNA, 201 bp, Bos taurus; identical to SEQ ID NO: 10006

SEQ ID NO: 91790 - DNA, 201 bp, Bos taurus; identical to SEQ ID NO: 10007

SEQ ID NO: 91791 - DNA, 201 bp, Bos taurus; identical to SEQ ID NO: 10008

SEQ ID NO: 91792 - DNA, 201 bp, Bos taurus; identical to SEQ ID NO: 10009

SEQ ID NO: 91793 - DNA, 201 bp, Bos taurus; identical to SEQ ID NO: 10010

SEQ ID NO: 91794 - DNA, 201 bp, Bos taurus; identical to SEQ ID NO: 10011

SEQ ID NO: 91795 - DNA, 201 bp, Bos taurus; identical to SEQ ID NO: 10012

SEQ ID NO: 91796 - DNA, 201 bp, Bos taurus; identical to SEQ ID NO: 10013

SEQ ID NO: 91797 - DNA, 201 bp, Bos taurus; identical to SEQ ID NO: 10014

SEQ ID NO: 91798 - DNA, 201 bp, Bos taurus; identical to SEQ ID NO: 10015

SEQ ID NO: 91799 - DNA, 201 bp, Bos taurus; identical to SEQ ID NO: 10016

SEQ ID NO: 91800 - DNA, 201 bp, Bos taurus; identical to SEQ ID NO: 10017

SEQ ID NO: 91801 - DNA, 201 bp, Bos taurus; identical to SEQ ID NO: 10018

SEQ ID NO: 91802 - DNA, 201 bp, Bos taurus; identical to SEQ ID NO: 10019

SEQ ID NO: 91803 - DNA, 201 bp, Bos taurus; identical to SEQ ID NO: 10020

SEQ ID NO: 91804 - DNA, 201 bp, Bos taurus; identical to SEQ ID NO: 10021

SEQ ID NO: 91805 - DNA, 201 bp, Bos taurus; identical to SEQ ID NO: 10022

SEQ ID NO: 91806 - DNA, 201 bp, Bos taurus; identical to SEQ ID NO: 10023

SEQ ID NO: 91807 - DNA, 201 bp, Bos taurus; identical to SEQ ID NO: 10024

SEQ ID NO: 91808 - DNA, 201 bp, Bos taurus; identical to SEQ ID NO: 10025

SEQ ID NO: 91809 - DNA, 201 bp, Bos taurus; identical to SEQ ID NO: 10026

SEQ ID NO: 91810 - DNA, 201 bp, Bos taurus; identical to SEQ ID NO: 10027

SEQ ID NO: 91811 - DNA, 201 bp, Bos taurus; identical to SEQ ID NO: 10028

SEQ ID NO: 91812 - DNA, 201 bp, Bos taurus; identical to SEQ ID NO: 10029

SEQ ID NO: 91813 - DNA, 201 bp, Bos taurus; identical to SEQ ID NO: 10030

SEQ ID NO: 91814 - DNA, 201 bp, Bos taurus; identical to SEQ ID NO: 10031

SEQ ID NO: 91815 - DNA, 201 bp, Bos taurus; identical to SEQ ID NO: 10032

SEQ ID NO: 91816 - DNA, 201 bp, Bos taurus; identical to SEQ ID NO: 10033

SEQ ID NO: 91817 - DNA, 201 bp, Bos taurus; identical to SEQ ID NO: 10034

SEQ ID NO: 91818 - DNA, 201 bp, Bos taurus; identical to SEQ ID NO: 10035

SEQ ID NO: 91819 - DNA, 201 bp, Bos taurus; identical to SEQ ID NO: 10036

SEQ ID NO: 91820 - DNA, 201 bp, Bos taurus; identical to SEQ ID NO: 10037

SEQ ID NO: 91821 - DNA, 201 bp, Bos taurus; identical to SEQ ID NO: 10038

SEQ ID NO: 91822 - DNA, 201 bp, Bos taurus; identical to SEQ ID NO: 10039

SEQ ID NO: 91823 - DNA, 201 bp, Bos taurus; identical to SEQ ID NO: 10040

SEQ ID NO: 91824 - DNA, 201 bp, Bos taurus; identical to SEQ ID NO: 10041

SEQ ID NO: 91825 - DNA, 201 bp, Bos taurus; identical to SEQ ID NO: 10042

SEQ ID NO: 91826 - DNA, 201 bp, Bos taurus; identical to SEQ ID NO: 10043

SEQ ID NO: 91827 - DNA, 201 bp, Bos taurus; identical to SEQ ID NO: 10044

SEQ ID NO: 91828 - DNA, 201 bp, Bos taurus; identical to SEQ ID NO: 10045

SEQ ID NO: 91829 - DNA, 201 bp, Bos taurus; identical to SEQ ID NO: 10046

SEQ ID NO: 91830 - DNA, 201 bp, Bos taurus; identical to SEQ ID NO: 10047

SEQ ID NO: 91831 - DNA, 201 bp, Bos taurus; identical to SEQ ID NO: 10048

SEQ ID NO: 91832 - DNA, 201 bp, Bos taurus; identical to SEQ ID NO: 10049

SEQ ID NO: 91833 - DNA, 201 bp, Bos taurus; identical to SEQ ID NO: 10050

SEQ ID NO: 91834 - DNA, 201 bp, Bos taurus; identical to SEQ ID NO: 10051

SEQ ID NO: 91835 - DNA, 201 bp, Bos taurus; identical to SEQ ID NO: 10052

SEQ ID NO: 91836 - DNA, 201 bp, Bos taurus; identical to SEQ ID NO: 10053

SEQ ID NO: 91837 - DNA, 201 bp, Bos taurus; identical to SEQ ID NO: 10054

SEQ ID NO: 91838 - DNA, 201 bp, Bos taurus; identical to SEQ ID NO: 10055

SEQ ID NO: 91839 - DNA, 201 bp, Bos taurus; identical to SEQ ID NO: 10056

SEQ ID NO: 91840 - DNA, 201 bp, Bos taurus; identical to SEQ ID NO: 10057

SEQ ID NO: 91841 - DNA, 201 bp, Bos taurus; identical to SEQ ID NO: 10058

SEQ ID NO: 91842 - DNA, 201 bp, Bos taurus; identical to SEQ ID NO: 10059

SEQ ID NO: 91843 - DNA, 201 bp, Bos taurus; identical to SEQ ID NO: 10060

SEQ ID NO: 91844 - DNA, 201 bp, Bos taurus; identical to SEQ ID NO: 10061

SEQ ID NO: 91845 - DNA, 201 bp, Bos taurus; identical to SEQ ID NO: 10062

SEQ ID NO: 91846 - DNA, 201 bp, Bos taurus; identical to SEQ ID NO: 10063

SEQ ID NO: 91847 - DNA, 201 bp, Bos taurus; identical to SEQ ID NO: 10064

SEQ ID NO: 91848 - DNA, 201 bp, Bos taurus; identical to SEQ ID NO: 10065

SEQ ID NO: 91849 - DNA, 201 bp, Bos taurus; identical to SEQ ID NO: 10066

SEQ ID NO: 91850 - DNA, 201 bp, Bos taurus; identical to SEQ ID NO: 10067

SEQ ID NO: 91851 - DNA, 201 bp, Bos taurus; identical to SEQ ID NO: 10068

SEQ ID NO: 91852 - DNA, 201 bp, Bos taurus; identical to SEQ ID NO: 10069

SEQ ID NO: 91853 - DNA, 201 bp, Bos taurus; identical to SEQ ID NO: 10070

SEQ ID NO: 91854 - DNA, 201 bp, Bos taurus; identical to SEQ ID NO: 10071

SEQ ID NO: 91855 - DNA, 201 bp, Bos taurus; identical to SEQ ID NO: 10072

SEQ ID NO: 91856 - DNA, 201 bp, Bos taurus; identical to SEQ ID NO: 10073

SEQ ID NO: 91857 - DNA, 201 bp, Bos taurus; identical to SEQ ID NO: 10074

SEQ ID NO: 91858 - DNA, 201 bp, Bos taurus; identical to SEQ ID NO: 10075

SEQ ID NO: 91859 - DNA, 201 bp, Bos taurus; identical to SEQ ID NO: 10076

SEQ ID NO: 91860 - DNA, 201 bp, Bos taurus; identical to SEQ ID NO: 10077

SEQ ID NO: 91861 - DNA, 201 bp, Bos taurus; identical to SEQ ID NO: 10078

SEQ ID NO: 91862 - DNA, 201 bp, Bos taurus; identical to SEQ ID NO: 10079

SEQ ID NO: 91863 - DNA, 201 bp, Bos taurus; identical to SEQ ID NO: 10080

SEQ ID NO: 91864 - DNA, 201 bp, Bos taurus; identical to SEQ ID NO: 10081

SEQ ID NO: 91865 - DNA, 201 bp, Bos taurus; identical to SEQ ID NO: 10082

SEQ ID NO: 91866 - DNA, 201 bp, Bos taurus; identical to SEQ ID NO: 10083

SEQ ID NO: 91867 - DNA, 201 bp, Bos taurus; identical to SEQ ID NO: 10084

SEQ ID NO: 91868 - DNA, 201 bp, Bos taurus; identical to SEQ ID NO: 10085

SEQ ID NO: 91869 - DNA, 201 bp, Bos taurus; identical to SEQ ID NO: 10086

SEQ ID NO: 91870 - DNA, 201 bp, Bos taurus; identical to SEQ ID NO: 10087

SEQ ID NO: 91871 - DNA, 201 bp, Bos taurus; identical to SEQ ID NO: 10088

SEQ ID NO: 91872 - DNA, 201 bp, Bos taurus; identical to SEQ ID NO: 10089

SEQ ID NO: 91873 - DNA, 201 bp, Bos taurus; identical to SEQ ID NO: 10090

SEQ ID NO: 91874 - DNA, 201 bp, Bos taurus; identical to SEQ ID NO: 10091

SEQ ID NO: 91875 - DNA, 201 bp, Bos taurus; identical to SEQ ID NO: 10092

SEQ ID NO: 91876 - DNA, 201 bp, Bos taurus; identical to SEQ ID NO: 10093

SEQ ID NO: 91877 - DNA, 201 bp, Bos taurus; identical to SEQ ID NO: 10094

SEQ ID NO: 91878 - DNA, 201 bp, Bos taurus; identical to SEQ ID NO: 10095

SEQ ID NO: 91879 - DNA, 201 bp, Bos taurus; identical to SEQ ID NO: 10096

SEQ ID NO: 91880 - DNA, 201 bp, Bos taurus; identical to SEQ ID NO: 10097

SEQ ID NO: 91881 - DNA, 201 bp, Bos taurus; identical to SEQ ID NO: 10098

SEQ ID NO: 91882 - DNA, 201 bp, Bos taurus; identical to SEQ ID NO: 10099

SEQ ID NO: 91883 - DNA, 201 bp, Bos taurus; identical to SEQ ID NO: 10100

SEQ ID NO: 91884 - DNA, 201 bp, Bos taurus; identical to SEQ ID NO: 10101

SEQ ID NO: 91885 - DNA, 201 bp, Bos taurus; identical to SEQ ID NO: 10102

SEQ ID NO: 91886 - DNA, 201 bp, Bos taurus; identical to SEQ ID NO: 10103

SEQ ID NO: 91887 - DNA, 201 bp, Bos taurus; identical to SEQ ID NO: 10104

SEQ ID NO: 91888 - DNA, 201 bp, Bos taurus; identical to SEQ ID NO: 10106

SEQ ID NO: 91889 - DNA, 201 bp, Bos taurus; identical to SEQ ID NO: 10107

SEQ ID NO: 91890 - DNA, 201 bp, Bos taurus; identical to SEQ ID NO: 10108

SEQ ID NO: 91891 - DNA, 201 bp, Bos taurus; identical to SEQ ID NO: 10109

SEQ ID NO: 91892 - DNA, 201 bp, Bos taurus; identical to SEQ ID NO: 10110

SEQ ID NO: 91893 - DNA, 201 bp, Bos taurus; identical to SEQ ID NO: 10111

SEQ ID NO: 91894 - DNA, 201 bp, Bos taurus; identical to SEQ ID NO: 10112

SEQ ID NO: 91895 - DNA, 201 bp, Bos taurus; identical to SEQ ID NO: 10113

SEQ ID NO: 91896 - DNA, 201 bp, Bos taurus; identical to SEQ ID NO: 51462

SEQ ID NO: 91897 - DNA, 201 bp, Bos taurus; identical to SEQ ID NO: 10114

SEQ ID NO: 91898 - DNA, 201 bp, Bos taurus; identical to SEQ ID NO: 10115

SEQ ID NO: 91899 - DNA, 201 bp, Bos taurus; identical to SEQ ID NO: 10116

SEQ ID NO: 91900 - DNA, 201 bp, Bos taurus; identical to SEQ ID NO: 10117

SEQ ID NO: 91901 - DNA, 201 bp, Bos taurus; identical to SEQ ID NO: 10118

SEQ ID NO: 91902 - DNA, 201 bp, Bos taurus; identical to SEQ ID NO: 10119

SEQ ID NO: 91903 - DNA, 201 bp, Bos taurus; identical to SEQ ID NO: 10120

SEQ ID NO: 91904 - DNA, 201 bp, Bos taurus; identical to SEQ ID NO: 10122

SEQ ID NO: 91905 - DNA, 201 bp, Bos taurus; identical to SEQ ID NO: 10123

SEQ ID NO: 91906 - DNA, 201 bp, Bos taurus; identical to SEQ ID NO: 10129

SEQ ID NO: 91907 - DNA, 201 bp, Bos taurus; identical to SEQ ID NO: 10130

SEQ ID NO: 91908 - DNA, 201 bp, Bos taurus; identical to SEQ ID NO: 10131

SEQ ID NO: 91909 - DNA, 201 bp, Bos taurus; identical to SEQ ID NO: 10132

SEQ ID NO: 91910 - DNA, 201 bp, Bos taurus; identical to SEQ ID NO: 10134

SEQ ID NO: 91911 - DNA, 201 bp, Bos taurus; identical to SEQ ID NO: 10136

SEQ ID NO: 91912 - DNA, 201 bp, Bos taurus; identical to SEQ ID NO: 10137

SEQ ID NO: 91913 - DNA, 201 bp, Bos taurus; identical to SEQ ID NO: 10138

SEQ ID NO: 91914 - DNA, 201 bp, Bos taurus; identical to SEQ ID NO: 10140

SEQ ID NO: 91915 - DNA, 201 bp, Bos taurus; identical to SEQ ID NO: 10141

SEQ ID NO: 91916 - DNA, 201 bp, Bos taurus; identical to SEQ ID NO: 10142

SEQ ID NO: 91917 - DNA, 201 bp, Bos taurus; identical to SEQ ID NO: 10146

SEQ ID NO: 91918 - DNA, 201 bp, Bos taurus; identical to SEQ ID NO: 10149

SEQ ID NO: 91919 - DNA, 201 bp, Bos taurus
agaaattgctctaaaactccaggtccccatggaaaccattggaaagactgcctattgactctacatgtgatgctgctacgactgctcccttgataacaaacggatgctattaaaagcctggctcaaatggaagcctgctatagctcatggcgagagccacattctctttggactgacagggcgaaaagaaatcaccctctg

SEQ ID NO: 91920 - DNA, 201 bp, Bos taurus
cttttaaccattgtcttgcttaatatggtggtgatttactttaattttttttcttttttggttgccttggataggatactgtggtgcagatatcaagtcagtatgctctgaagctgctttatgtgctctgcgtcgacgctacccacagatctataccactagtgagaaactgcaattggatctctcttcaattaatatctc

SEQ ID NO: 91921 - DNA, 201 bp, Bos taurus; identical to SEQ ID NO: 10150

SEQ ID NO: 91922 - DNA, 201 bp, Bos taurus; identical to SEQ ID NO: 10151

SEQ ID NO: 91923 - DNA, 201 bp, Bos taurus
acatacagatggctaacaaacacatgaaaagatgctcaacatcactcattatcagagaaatgcaaatcaaaaccactatgaggtaccatttcacaccagtgagaatggctgcaatcctttggtctcttttgattctgtgatgtttattctacttctcattgattttctgtgactcttgctgttgcttttgttctggcttct

SEQ ID NO: 91924 - DNA, 201 bp, Bos taurus
ttaactagtaggagcccattgtattgagatcgccataaagtttgtttggatttttccataagatggtgtgaaaaacccgaatgaacattttggccaacccgatagttctcctgaataaaaatctctagacaaaggggtttgtcacagtctggtcaagaaaacagaaaacactttgtatgtttcaaaaaaaaaaaaaaaaaa

SEQ ID NO: 91925 - DNA, 201 bp, Bos taurus; identical to SEQ ID NO: 10154

SEQ ID NO: 91926 - DNA, 201 bp, Bos taurus; identical to SEQ ID NO: 10155

SEQ ID NO: 91927 - DNA, 201 bp, Bos taurus; identical to SEQ ID NO: 10156

SEQ ID NO: 91928 - DNA, 201 bp, Bos taurus; identical to SEQ ID NO: 10157

SEQ ID NO: 91929 - DNA, 201 bp, Bos taurus; identical to SEQ ID NO: 10159

SEQ ID NO: 91930 - DNA, 201 bp, Bos taurus; identical to SEQ ID NO: 10160

SEQ ID NO: 91931 - DNA, 201 bp, Bos taurus; identical to SEQ ID NO: 10162

SEQ ID NO: 91932 - DNA, 201 bp, Bos taurus; identical to SEQ ID NO: 10163

SEQ ID NO: 91933 - DNA, 201 bp, Bos taurus
tctggcaggctatagcccatggggtcacaaaaagttgagcacaactgagtgattttcactttcaatgggttgaacagtggcctcaaaggatatgtccccccagaacatgtgaataagacatatctggggaaagggtctttgcagatgcatttaaagatgttgaggtgagctcatcttgggtgtgggtggccctcaatcaat

SEQ ID NO: 91934 - DNA, 201 bp, Bos taurus; identical to SEQ ID NO: 10165

SEQ ID NO: 91935 - DNA, 201 bp, Bos taurus; identical to SEQ ID NO: 10166

SEQ ID NO: 91936 - DNA, 201 bp, Bos taurus; identical to SEQ ID NO: 10168

SEQ ID NO: 91937 - DNA, 201 bp, Bos taurus; identical to SEQ ID NO: 10169

SEQ ID NO: 91938 - DNA, 201 bp, Bos taurus
tccatcctgcatttcataacctgacctgtggccccagaatcatgctttatctccaaggaggactcatttcaagcaggggttttcttcatgttcctagaacaggaatgtcaagtgccaggcctactcagacttcccgagtctgggatgcaaagctcctgtatccaccttccagctgtgatcagagtagcaaaggtagcaaag

SEQ ID NO: 91939 - DNA, 201 bp, Bos taurus; identical to SEQ ID NO: 10170

SEQ ID NO: 91940 - DNA, 201 bp, Bos taurus
cggcccactaccgcctggcgggtggcgctgggaagcagatcgtccctgctgaacttccggtacacgctttccagaaggcccaactgcgtggcacatgaactcctaagaacaaaggaaaattacatgcacatgccggctttaaacgaatactccacgagggcccactatgctacaagtaaatgctaatgattatgaattaga

SEQ ID NO: 91941 - DNA, 201 bp, Bos taurus
caggtggccgccttcttggagagccctcgcctgcccccaccagagagaagcagctcttgggagaaaatcaggctaagtcacattcacatcagaggtgcccggggcctggctccccatgctgagcaggagtgacctctgccatggggacccatcccccgatgggctggcctactcttctgctctttcctccacacgggcagt

SEQ ID NO: 91942 - DNA, 201 bp, Bos taurus
gtgtttcaaacgttacataaagaggcacttggctggttaactggctcagttctgcctgggtttcgtctcaggaagcatttaagctcgctccccaggactgtacccctagtaaacaccctgctttaagggccctccgcacacgtaggctcattgttcctcctgagaaccaccagtttataaaaatcacaaacacattgtgtt

SEQ ID NO: 91943 - DNA, 201 bp, Bos taurus
gctggggtccttgggctgggtccctccctgcctctgtaagggccacacggtcacttgtgtgtgtgctgcgggatcatgtggcctctgcttctccttctgcgcacggaagtctgtgtctggcaccgctctatcctctgtgtgagggtccagctcgtcctctctgggaaggacttccaacatgcccccatgactgttcctcac

SEQ ID NO: 91944 - DNA, 201 bp, Bos taurus
cctttggcgttgcgaggggcagctcgggattcatgtaccagcctgaggccgggtacatgggggaagctgcctggaggcctgggctgcagccaggctgaatcagctgtgtctgtggacacctagaccagtctctgtggctgagaaccacggccagctgtcttttcccaggtctgtgcttggtgatctgggctcagcttggtt

SEQ ID NO: 91945 - DNA, 201 bp, Bos taurus
agttttttatgtcttctacaagtgaactttgctggttagagaaataaaacaatctatttccttatcttctctcatcttttccagattgaaattcattaaacccggctttcctgaacataaatcaataccatgtgggatgttatttattgtcagtaacaaagtggagtgtgtggtatggcataggatgtgatcagaagacac

SEQ ID NO: 91946 - DNA, 201 bp, Bos taurus; identical to SEQ ID NO: 10171

SEQ ID NO: 91947 - DNA, 201 bp, Bos taurus; identical to SEQ ID NO: 10173

SEQ ID NO: 91948 - DNA, 201 bp, Bos taurus; identical to SEQ ID NO: 10174

SEQ ID NO: 91949 - DNA, 201 bp, Bos taurus; identical to SEQ ID NO: 10176

SEQ ID NO: 91950 - DNA, 201 bp, Bos taurus; identical to SEQ ID NO: 10177

SEQ ID NO: 91951 - DNA, 201 bp, Bos taurus; identical to SEQ ID NO: 10180

SEQ ID NO: 91952 - DNA, 201 bp, Bos taurus; identical to SEQ ID NO: 10181

SEQ ID NO: 91953 - DNA, 201 bp, Bos taurus
gggagcccgtgcagcctgagtgaggctcacacaaaacccagttcacaaggaaccagtggggaagcacaagcgcaagcagtcttcccggccgtcacagaccatccactttggacggaacaatggctgcttttgttcttgccgtcctgtttgttggctttcgtgtcctcagctgtgacactggtggatccggcctgatcgatg

SEQ ID NO: 91954 - DNA, 201 bp, Bos taurus; identical to SEQ ID NO: 10184

SEQ ID NO: 91955 - DNA, 201 bp, Bos taurus; identical to SEQ ID NO: 10186

SEQ ID NO: 91956 - DNA, 201 bp, Bos taurus; identical to SEQ ID NO: 10187

SEQ ID NO: 91957 - DNA, 201 bp, Bos taurus; identical to SEQ ID NO: 10188

SEQ ID NO: 91958 - DNA, 201 bp, Bos taurus; identical to SEQ ID NO: 10189

SEQ ID NO: 91959 - DNA, 201 bp, Bos taurus
ccccatctgatcctgtgatgatgtcaaccattctacccaaggagtttgtaattatttcaggaggaaagcttctaattagcaccaaacagttttccagcagtagctggaacatccacatccaggacacaggaagccaaatggaaggagggatccagacaaggatgcacacagaggcacagacaaggatgcacacagagggat

SEQ ID NO: 91960 - DNA, 201 bp, Bos taurus; identical to SEQ ID NO: 10190

SEQ ID NO: 91961 - DNA, 201 bp, Bos taurus; identical to SEQ ID NO: 10191

SEQ ID NO: 91962 - DNA, 201 bp, Bos taurus; identical to SEQ ID NO: 10192

SEQ ID NO: 91963 - DNA, 201 bp, Bos taurus; identical to SEQ ID NO: 10193

SEQ ID NO: 91964 - DNA, 201 bp, Bos taurus; identical to SEQ ID NO: 10194

SEQ ID NO: 91965 - DNA, 201 bp, Bos taurus; identical to SEQ ID NO: 10197

SEQ ID NO: 91966 - DNA, 201 bp, Bos taurus; identical to SEQ ID NO: 10199

SEQ ID NO: 91967 - DNA, 201 bp, Bos taurus
gaaatccaagtaaattaaaaggaacagaagctggaaatatgcaggcatatttgtggctggagtcattccactccttgtacattatgtggtttacctcagcgtgtggaaaaatacagtaagtgcttcattgtatggggggtagttgtattgtgtaacttagacggtttattctttcttggaaatattttatgataaacacat

SEQ ID NO: 91968 - DNA, 201 bp, Bos taurus; identical to SEQ ID NO: 10200

SEQ ID NO: 91969 - DNA, 201 bp, Bos taurus
tacgtgaagtgttcttaaattttaaactaataagtagtgactttattggcacttagccatgtctgtgagtaggacggccgtgtggttctgagggtatgtcatggagagtgcgacttctgttttctgcttgtgccttgttgccgtgatgtatacaaacggcctccagattccagtctcctcccgggtcagtaaggtgatgac

SEQ ID NO: 91970 - DNA, 201 bp, Bos taurus; identical to SEQ ID NO: 10201

SEQ ID NO: 91971 - DNA, 201 bp, Bos taurus
ttctaactctagaaaggtaaatggggccacagcacagtgacagcatcctctggtttatatcacaacctggaagcagtacggaagctatttaagattcagaaggagaaattgcaacactcgatttcttctctctatattcctgctttgagtgggcagggcaattcagggggtcgactgatgtgatcggcaggaatgcgcttt

SEQ ID NO: 91972 - DNA, 201 bp, Bos taurus; identical to SEQ ID NO: 10202

SEQ ID NO: 91973 - DNA, 201 bp, Bos taurus; identical to SEQ ID NO: 10203

SEQ ID NO: 91974 - DNA, 201 bp, Bos taurus; identical to SEQ ID NO: 10204

SEQ ID NO: 91975 - DNA, 201 bp, Bos taurus; identical to SEQ ID NO: 10205

SEQ ID NO: 91976 - DNA, 201 bp, Bos taurus; identical to SEQ ID NO: 10206

SEQ ID NO: 91977 - DNA, 201 bp, Bos taurus
tcattcttctttctccggggtctagaacccaccttgcccagagaagagtttcagaaaactttgttgctatggaaggaagtgtggaatgaacagcctgagacaggctggcatcattactttctgtggtatgtgattcctttgtattgctaattctattatcaatatttattggaattaatcagatgatgatgttctgactag

SEQ ID NO: 91978 - DNA, 201 bp, Bos taurus
ttaaactctataattcatctgtattttcattcagttactcattcattcatataaaactgagcttttgtcatatgtaaaacattgtgtcatgtttatactgtaagatatgtaaatcctaatatggaagatatattcattgtctttatggaattcacagtttacaatagaaaattgatacccacagatacaatagtacaacat

SEQ ID NO: 91979 - DNA, 201 bp, Bos taurus
ttctgctccccctgccagtacctccaatacctgctgcagggagcctgatgacacccagtcacattcagagctggtaggtagccttttggttcacttagcaatggggctggagcagtatttccaaccttagaatctgctgctactacaacccacagaggccagacaggcattgtgtctgctttgtgaaaggaaaggcaagat

SEQ ID NO: 91980 - DNA, 201 bp, Bos taurus; identical to SEQ ID NO: 10210

SEQ ID NO: 91981 - DNA, 201 bp, Bos taurus; identical to SEQ ID NO: 10211

SEQ ID NO: 91982 - DNA, 201 bp, Bos taurus; identical to SEQ ID NO: 10216

SEQ ID NO: 91983 - DNA, 201 bp, Bos taurus; identical to SEQ ID NO: 10217

SEQ ID NO: 91984 - DNA, 201 bp, Bos taurus; identical to SEQ ID NO: 10219

SEQ ID NO: 91985 - DNA, 201 bp, Bos taurus; identical to SEQ ID NO: 10220

SEQ ID NO: 91986 - DNA, 201 bp, Bos taurus; identical to SEQ ID NO: 10222

SEQ ID NO: 91987 - DNA, 201 bp, Bos taurus; identical to SEQ ID NO: 10226

SEQ ID NO: 91988 - DNA, 201 bp, Bos taurus; identical to SEQ ID NO: 10228

SEQ ID NO: 91989 - DNA, 201 bp, Bos taurus; identical to SEQ ID NO: 10229

SEQ ID NO: 91990 - DNA, 201 bp, Bos taurus; identical to SEQ ID NO: 10231

SEQ ID NO: 91991 - DNA, 201 bp, Bos taurus; identical to SEQ ID NO: 10232

SEQ ID NO: 91992 - DNA, 201 bp, Bos taurus; identical to SEQ ID NO: 10233

SEQ ID NO: 91993 - DNA, 201 bp, Bos taurus; identical to SEQ ID NO: 10236

SEQ ID NO: 91994 - DNA, 201 bp, Bos taurus; identical to SEQ ID NO: 10239

SEQ ID NO: 91995 - DNA, 201 bp, Bos taurus; identical to SEQ ID NO: 10240

SEQ ID NO: 91996 - DNA, 201 bp, Bos taurus; identical to SEQ ID NO: 10242

SEQ ID NO: 91997 - DNA, 201 bp, Bos taurus
tggccactgccttcattgagcttgaggttaaagggccaggattaccctcctctgaagatgatatgtaaatattggactggacacattaatgtatttcccaaaaccaaaactctggctggagattaaaggttgtatttaaggacatctgaattagggaaagaatctgtgaaaactaggaatgagttttaaacagcctttttt

SEQ ID NO: 91998 - DNA, 201 bp, Bos taurus
aatatttttttaaagtctattcaaactgagtctcataggagggcccactccaaactgtcatcataaggaaagttaacaatattgaacaaacctatacaaacgtgtgttgagaaagttattaaaaatataaaagaacattttctggagagcctgttcctaagggaaaagggctatattgtgtcccaaaaaacttcctttccc

SEQ ID NO: 91999 - DNA, 201 bp, Bos taurus
actggcccactcgcattcttctcttctttctgaggatggttggtggagtgctaaacttaggcacacttggggaggtcaaaggaacagcctcgccgtctgccccattacaaccgtttcttttcccttcgagtacaagactgacgttaaactgacattccatggcaccttcgttgtgctgaattcgcattagtttaactgggg

SEQ ID NO: 92000 - DNA, 201 bp, Bos taurus
tctggtgtttgaaaaagcaaataagctggttattccccttttccaagcatcctacttttcccctctctgatttatagttgccattgaacacatggctctcatggttgtgttgacttttcttgtctcttcctgatcattcgagatcatttttaaggactgccaatcactgtaggttttcattctaagtgaactcaattaagc

SEQ ID NO: 92001 - DNA, 201 bp, Bos taurus
catggaaataatgaagaatgttccaggcagaaggattagcaagtgcaaaggccctaaggcaggagccagcctagtacatctgataaaccatgaggccactatggctagaacagacagagcaaaggcttagtgacaagaagtagagtccctgagatgggctcagaacgattgtaggggccagtctacatagggttgtgtggt

SEQ ID NO: 92002 - DNA, 201 bp, Bos taurus; identical to SEQ ID NO: 10243

SEQ ID NO: 92003 - DNA, 201 bp, Bos taurus
cacttcaaaaccctgacttatgttctggccacgccctggggagcaggtactcaatacagatgccttcatgcctgggaccctctcagctctagtaagcagatggtatagataggaaggcccaggctgagcacagaaagtgaaaaacaacgtgaaagccagtcagctgacagtgtgattaaacgtaggaggctcatccaccca

SEQ ID NO: 92004 - DNA, 201 bp, Bos taurus; identical to SEQ ID NO: 10244

SEQ ID NO: 92005 - DNA, 201 bp, Bos taurus; identical to SEQ ID NO: 10245

SEQ ID NO: 92006 - DNA, 201 bp, Bos taurus; identical to SEQ ID NO: 10246

SEQ ID NO: 92007 - DNA, 201 bp, Bos taurus; identical to SEQ ID NO: 10247

SEQ ID NO: 92008 - DNA, 201 bp, Bos taurus; identical to SEQ ID NO: 10248

SEQ ID NO: 92009 - DNA, 201 bp, Bos taurus; identical to SEQ ID NO: 10249

SEQ ID NO: 92010 - DNA, 201 bp, Bos taurus; identical to SEQ ID NO: 10250

SEQ ID NO: 92011 - DNA, 201 bp, Bos taurus; identical to SEQ ID NO: 10251

SEQ ID NO: 92012 - DNA, 201 bp, Bos taurus; identical to SEQ ID NO: 10252

SEQ ID NO: 92013 - DNA, 201 bp, Bos taurus; identical to SEQ ID NO: 10253

SEQ ID NO: 92014 - DNA, 201 bp, Bos taurus; identical to SEQ ID NO: 10254

SEQ ID NO: 92015 - DNA, 201 bp, Bos taurus; identical to SEQ ID NO: 10256

SEQ ID NO: 92016 - DNA, 201 bp, Bos taurus; identical to SEQ ID NO: 10257

SEQ ID NO: 92017 - DNA, 201 bp, Bos taurus; identical to SEQ ID NO: 10258

SEQ ID NO: 92018 - DNA, 201 bp, Bos taurus; identical to SEQ ID NO: 10260

SEQ ID NO: 92019 - DNA, 201 bp, Bos taurus; identical to SEQ ID NO: 10261

SEQ ID NO: 92020 - DNA, 201 bp, Bos taurus; identical to SEQ ID NO: 10262

SEQ ID NO: 92021 - DNA, 201 bp, Bos taurus; identical to SEQ ID NO: 10263

SEQ ID NO: 92022 - DNA, 201 bp, Bos taurus; identical to SEQ ID NO: 10264

SEQ ID NO: 92023 - DNA, 201 bp, Bos taurus; identical to SEQ ID NO: 10265

SEQ ID NO: 92024 - DNA, 201 bp, Bos taurus; identical to SEQ ID NO: 10268

SEQ ID NO: 92025 - DNA, 201 bp, Bos taurus; identical to SEQ ID NO: 10270

SEQ ID NO: 92026 - DNA, 201 bp, Bos taurus; identical to SEQ ID NO: 10271

SEQ ID NO: 92027 - DNA, 201 bp, Bos taurus; identical to SEQ ID NO: 10272

SEQ ID NO: 92028 - DNA, 201 bp, Bos taurus; identical to SEQ ID NO: 10273

SEQ ID NO: 92029 - DNA, 201 bp, Bos taurus; identical to SEQ ID NO: 10275

SEQ ID NO: 92030 - DNA, 201 bp, Bos taurus; identical to SEQ ID NO: 10276

SEQ ID NO: 92031 - DNA, 201 bp, Bos taurus; identical to SEQ ID NO: 10277

SEQ ID NO: 92032 - DNA, 201 bp, Bos taurus; identical to SEQ ID NO: 10278

SEQ ID NO: 92033 - DNA, 201 bp, Bos taurus; identical to SEQ ID NO: 10279

SEQ ID NO: 92034 - DNA, 201 bp, Bos taurus; identical to SEQ ID NO: 10280

SEQ ID NO: 92035 - DNA, 201 bp, Bos taurus; identical to SEQ ID NO: 10282

SEQ ID NO: 92036 - DNA, 201 bp, Bos taurus; identical to SEQ ID NO: 10283

SEQ ID NO: 92037 - DNA, 201 bp, Bos taurus; identical to SEQ ID NO: 10284

SEQ ID NO: 92038 - DNA, 201 bp, Bos taurus; identical to SEQ ID NO: 10285

SEQ ID NO: 92039 - DNA, 201 bp, Bos taurus; identical to SEQ ID NO: 10286

SEQ ID NO: 92040 - DNA, 201 bp, Bos taurus; identical to SEQ ID NO: 10287

SEQ ID NO: 92041 - DNA, 201 bp, Bos taurus; identical to SEQ ID NO: 10288

SEQ ID NO: 92042 - DNA, 201 bp, Bos taurus; identical to SEQ ID NO: 10289

SEQ ID NO: 92043 - DNA, 201 bp, Bos taurus; identical to SEQ ID NO: 10290

SEQ ID NO: 92044 - DNA, 201 bp, Bos taurus; identical to SEQ ID NO: 10291

SEQ ID NO: 92045 - DNA, 201 bp, Bos taurus; identical to SEQ ID NO: 10292

SEQ ID NO: 92046 - DNA, 201 bp, Bos taurus; identical to SEQ ID NO: 10293

SEQ ID NO: 92047 - DNA, 201 bp, Bos taurus; identical to SEQ ID NO: 10294

SEQ ID NO: 92048 - DNA, 201 bp, Bos taurus; identical to SEQ ID NO: 10295

SEQ ID NO: 92049 - DNA, 201 bp, Bos taurus; identical to SEQ ID NO: 10296

SEQ ID NO: 92050 - DNA, 201 bp, Bos taurus; identical to SEQ ID NO: 10298

SEQ ID NO: 92051 - DNA, 201 bp, Bos taurus; identical to SEQ ID NO: 10299

SEQ ID NO: 92052 - DNA, 201 bp, Bos taurus; identical to SEQ ID NO: 10300

SEQ ID NO: 92053 - DNA, 201 bp, Bos taurus; identical to SEQ ID NO: 10304

SEQ ID NO: 92054 - DNA, 201 bp, Bos taurus; identical to SEQ ID NO: 10305

SEQ ID NO: 92055 - DNA, 201 bp, Bos taurus; identical to SEQ ID NO: 10306

SEQ ID NO: 92056 - DNA, 201 bp, Bos taurus; identical to SEQ ID NO: 10307

SEQ ID NO: 92057 - DNA, 201 bp, Bos taurus; identical to SEQ ID NO: 10308

SEQ ID NO: 92058 - DNA, 201 bp, Bos taurus; identical to SEQ ID NO: 10309

SEQ ID NO: 92059 - DNA, 201 bp, Bos taurus; identical to SEQ ID NO: 10310

SEQ ID NO: 92060 - DNA, 201 bp, Bos taurus; identical to SEQ ID NO: 10311

SEQ ID NO: 92061 - DNA, 201 bp, Bos taurus; identical to SEQ ID NO: 10312

SEQ ID NO: 92062 - DNA, 201 bp, Bos taurus; identical to SEQ ID NO: 10313

SEQ ID NO: 92063 - DNA, 201 bp, Bos taurus; identical to SEQ ID NO: 10315

SEQ ID NO: 92064 - DNA, 201 bp, Bos taurus; identical to SEQ ID NO: 10316

SEQ ID NO: 92065 - DNA, 201 bp, Bos taurus; identical to SEQ ID NO: 10320

SEQ ID NO: 92066 - DNA, 201 bp, Bos taurus; identical to SEQ ID NO: 10322

SEQ ID NO: 92067 - DNA, 201 bp, Bos taurus; identical to SEQ ID NO: 10323

SEQ ID NO: 92068 - DNA, 201 bp, Bos taurus; identical to SEQ ID NO: 10324

SEQ ID NO: 92069 - DNA, 201 bp, Bos taurus; identical to SEQ ID NO: 10325

SEQ ID NO: 92070 - DNA, 201 bp, Bos taurus; identical to SEQ ID NO: 10326

SEQ ID NO: 92071 - DNA, 201 bp, Bos taurus; identical to SEQ ID NO: 10328

SEQ ID NO: 92072 - DNA, 201 bp, Bos taurus; identical to SEQ ID NO: 10329

SEQ ID NO: 92073 - DNA, 201 bp, Bos taurus; identical to SEQ ID NO: 10332

SEQ ID NO: 92074 - DNA, 201 bp, Bos taurus; identical to SEQ ID NO: 10333

SEQ ID NO: 92075 - DNA, 201 bp, Bos taurus; identical to SEQ ID NO: 10334

SEQ ID NO: 92076 - DNA, 201 bp, Bos taurus; identical to SEQ ID NO: 10335

SEQ ID NO: 92077 - DNA, 201 bp, Bos taurus; identical to SEQ ID NO: 10336

SEQ ID NO: 92078 - DNA, 201 bp, Bos taurus; identical to SEQ ID NO: 10338

SEQ ID NO: 92079 - DNA, 201 bp, Bos taurus; identical to SEQ ID NO: 10339

SEQ ID NO: 92080 - DNA, 201 bp, Bos taurus; identical to SEQ ID NO: 10340

SEQ ID NO: 92081 - DNA, 201 bp, Bos taurus; identical to SEQ ID NO: 10341

SEQ ID NO: 92082 - DNA, 201 bp, Bos taurus; identical to SEQ ID NO: 10343

SEQ ID NO: 92083 - DNA, 201 bp, Bos taurus; identical to SEQ ID NO: 10346

SEQ ID NO: 92084 - DNA, 201 bp, Bos taurus; identical to SEQ ID NO: 10348

SEQ ID NO: 92085 - DNA, 201 bp, Bos taurus; identical to SEQ ID NO: 10349

SEQ ID NO: 92086 - DNA, 201 bp, Bos taurus; identical to SEQ ID NO: 10350

SEQ ID NO: 92087 - DNA, 201 bp, Bos taurus; identical to SEQ ID NO: 10351

SEQ ID NO: 92088 - DNA, 201 bp, Bos taurus; identical to SEQ ID NO: 10352

SEQ ID NO: 92089 - DNA, 201 bp, Bos taurus; identical to SEQ ID NO: 10355

SEQ ID NO: 92090 - DNA, 201 bp, Bos taurus; identical to SEQ ID NO: 10356

SEQ ID NO: 92091 - DNA, 201 bp, Bos taurus; identical to SEQ ID NO: 10360

SEQ ID NO: 92092 - DNA, 201 bp, Bos taurus; identical to SEQ ID NO: 10361

SEQ ID NO: 92093 - DNA, 201 bp, Bos taurus; identical to SEQ ID NO: 10366

SEQ ID NO: 92094 - DNA, 201 bp, Bos taurus; identical to SEQ ID NO: 10367

SEQ ID NO: 92095 - DNA, 201 bp, Bos taurus; identical to SEQ ID NO: 10368

SEQ ID NO: 92096 - DNA, 201 bp, Bos taurus; identical to SEQ ID NO: 10371

SEQ ID NO: 92097 - DNA, 201 bp, Bos taurus; identical to SEQ ID NO: 10372

SEQ ID NO: 92098 - DNA, 201 bp, Bos taurus; identical to SEQ ID NO: 10373

SEQ ID NO: 92099 - DNA, 201 bp, Bos taurus
tcgaaagcagaccctctaagcgtgtgtcttcctcccctcaccctttgggagttgcgtgacctcatttgccgtccttaccgcggttgggcccacaggactttgcaggcgtgtccctaagttcatccatggaaacaccccttgccctccttaccttttttaggcccacaggactttgtggtgtgtccttaaattcatccatga

SEQ ID NO: 92100 - DNA, 201 bp, Bos taurus; identical to SEQ ID NO: 10374

SEQ ID NO: 92101 - DNA, 201 bp, Bos taurus; identical to SEQ ID NO: 10375

SEQ ID NO: 92102 - DNA, 201 bp, Bos taurus
atatcagtgtttgtttctttcctattaacttggagatgattacaaatctgactgtgtattttgataattggtatacattcaacactcaaaatatctgtaaatgaaaagagagaaataaagaaggaagggaggaggaaagataggttaggaatagaaatagctgtaatatatttatagcatgtaacccatttaagggaaaag

SEQ ID NO: 92103 - DNA, 201 bp, Bos taurus; identical to SEQ ID NO: 10376

SEQ ID NO: 92104 - DNA, 201 bp, Bos taurus; identical to SEQ ID NO: 10377

SEQ ID NO: 92105 - DNA, 201 bp, Bos taurus
aaagctgtatgagccaaaagtcaatggaatgacatctctgaagtcctgggaaggaagggggaggaaagtttactggcgaccattcaataatctgtcaaatatcatttaaaaataaaaattaaatggagatttttcaaaaaattaatttttaattatcagcaaaatttatcacaaataatggtaataaccattctcaaggca

SEQ ID NO: 92106 - DNA, 201 bp, Bos taurus; identical to SEQ ID NO: 10378

SEQ ID NO: 92107 - DNA, 201 bp, Bos taurus; identical to SEQ ID NO: 10379

SEQ ID NO: 92108 - DNA, 201 bp, Bos taurus; identical to SEQ ID NO: 10380

SEQ ID NO: 92109 - DNA, 201 bp, Bos taurus; identical to SEQ ID NO: 10381

SEQ ID NO: 92110 - DNA, 201 bp, Bos taurus
cccccttggcagatgaattcttacttctgcaccatgtgggaagccccttgcctgagtcaaatattaagtattaatatatagctggcccttactttccaggctgctcaatggtaaagaatctgcgcgccaagcaggagaggcaggttcaatccttagtggagaagatactctagggaaggaaatggcaaccaactccaatat

SEQ ID NO: 92111 - DNA, 201 bp, Bos taurus; identical to SEQ ID NO: 10382

SEQ ID NO: 92112 - DNA, 201 bp, Bos taurus; identical to SEQ ID NO: 10383

SEQ ID NO: 92113 - DNA, 201 bp, Bos taurus; identical to SEQ ID NO: 10384

SEQ ID NO: 92114 - DNA, 201 bp, Bos taurus; identical to SEQ ID NO: 10385

SEQ ID NO: 92115 - DNA, 201 bp, Bos taurus
acaaagctggaagtatcacactccttgacttcaaattatattacaaaaccatagtaatccaaacagcaaggtactggatgcactgaatgactggcctggcgctgcagattgagaggagagcctgaaggtgcaggggaaattatgaagccacttctgttagtgaacctcaaaaaatctgaggcagaatggccaaaatgacag

SEQ ID NO: 92116 - DNA, 201 bp, Bos taurus; identical to SEQ ID NO: 10386

SEQ ID NO: 92117 - DNA, 201 bp, Bos taurus; identical to SEQ ID NO: 10387

SEQ ID NO: 92118 - DNA, 201 bp, Bos taurus; identical to SEQ ID NO: 10388

SEQ ID NO: 92119 - DNA, 201 bp, Bos taurus
tctgtttggttcatggtttccagctttattttatataccttaactgaggtggaaacataacacagatgtcttttatactgtctaagaggtatgaaatgttggcaaattttgtaatcaatttactatgattctacttaaacatattgtatcttttctgtagctctttgtggagggaatataactgcaatgaatggaaccatt

SEQ ID NO: 92120 - DNA, 201 bp, Bos taurus
tagtcagttcaacttatttaaattacttttgctgtgaggtttggaagtggagatagaaagcaagagaaaccactttaaataaaggttccaatgtggattgtaagtagcttctgttctaaccactagaatcattaaactttattgaacacatatgaagaatgaagatctaagggaataaacaaaagaaaagttgtaaatagt

SEQ ID NO: 92121 - DNA, 201 bp, Bos taurus; identical to SEQ ID NO: 10389

SEQ ID NO: 92122 - DNA, 201 bp, Bos taurus; identical to SEQ ID NO: 10390

SEQ ID NO: 92123 - DNA, 201 bp, Bos taurus; identical to SEQ ID NO: 10391

SEQ ID NO: 92124 - DNA, 201 bp, Bos taurus
tattttttcatatttattttaatgactgtcaaactctattcctctcttacaggataacttattgctaaattcaatgcatattttactggcttcaattttttggtcactgcttgttacagtaatggtatttcttcttgcccttgcttctgtcttatcatttggatcattcttccgaacccttactaatgatcttcactattc

SEQ ID NO: 92125 - DNA, 201 bp, Bos taurus; identical to SEQ ID NO: 10392

SEQ ID NO: 92126 - DNA, 201 bp, Bos taurus; identical to SEQ ID NO: 10393

SEQ ID NO: 92127 - DNA, 201 bp, Bos taurus
ggccagagaggccttctgattgccagctacaagagggtcaaaaaaaaaaaaaactctgatagagccataattcctgtagcagagacagtccatgtccctggacagttggccctgccagggtccccataacccaataatagtaggagacattaacaccccactcacaccaatggacaggtcatcaaaacagaaaattaataa

SEQ ID NO: 92128 - DNA, 201 bp, Bos taurus; identical to SEQ ID NO: 10394

SEQ ID NO: 92129 - DNA, 201 bp, Bos taurus; identical to SEQ ID NO: 10395

SEQ ID NO: 92130 - DNA, 201 bp, Bos taurus; identical to SEQ ID NO: 10396

SEQ ID NO: 92131 - DNA, 201 bp, Bos taurus
agtggtgaggaaaaaaccaaatctgcaaaattatccttcaaaactgagagagaaataaaaacttatagaccaaccaaagttggaggaatttgtagcctgttgatccaacttgcaagaagtgttaaatgtttttttaataagaaggaaaacggcataaggggagactgaatctacataaagaatggaagagcaccaaagaag

SEQ ID NO: 92132 - DNA, 201 bp, Bos taurus
ctcaaattgttgaacatctaactacttgaaatatagcccaatcagatatacagcatttagagtctgccttctttccatatcacatgaaatttcacccaacatctgttagtcatacaaggacagaccatttagctatagaaaaccatcaactgttactgtccttcagagccctctgattcagagtttcccccccctgctgtt

SEQ ID NO: 92133 - DNA, 201 bp, Bos taurus; identical to SEQ ID NO: 10397

SEQ ID NO: 92134 - DNA, 201 bp, Bos taurus; identical to SEQ ID NO: 10398

SEQ ID NO: 92135 - DNA, 201 bp, Bos taurus; identical to SEQ ID NO: 10399

SEQ ID NO: 92136 - DNA, 201 bp, Bos taurus; identical to SEQ ID NO: 10400

SEQ ID NO: 92137 - DNA, 201 bp, Bos taurus
actttcttccattagagaaaagctaaagaagagatgtagagacttacttggccagctgttgcttagcaaagaaaaaacattattctacattgatgtcacataaaagcaactaccagaactcacggctcttactaaagctaaaattatatttcctgctatcaatcatagggaaatatggtggatctgacactaaaaatatca

SEQ ID NO: 92138 - DNA, 201 bp, Bos taurus
aatttcctactttattttcaaacattccctgagtcacatcactctagatttacatagctatggaaatacaccagtatatgccagccattatgtttaataacgtttttgttgttttaagatatgctcacatatccacatatccactaaaattgtttgataagaaaatttaaatctttaacactgctcaaaatgactattaaa

SEQ ID NO: 92139 - DNA, 201 bp, Bos taurus; identical to SEQ ID NO: 10401

SEQ ID NO: 92140 - DNA, 201 bp, Bos taurus
tagctggtaaaatgttatttctgggggtgtcttaagggtgtttcaggaaaagactaacatttgattcagtagactgagtaaagctatctcctctccaacatagagaggcatcatctaatagagtaagggccagattagaacaaaaatttcatggaagagtaaatttccactctcttcttgaactgaatgttcacctttttc

SEQ ID NO: 92141 - DNA, 201 bp, Bos taurus
cacaaagatcaacagtgttcactgttgagccaaccatctctgagaaaataatgatatatctaaaatttgtttttggtagcctttcaatttattcttttcattgttcaaatctccctccatttggacaccctctgctcaggtgctaaagtccaggctttttgtccaccttagctgaagtattcctggcaagccctctccttc

SEQ ID NO: 92142 - DNA, 201 bp, Bos taurus
tgtaagatcctgaagaaaaggacctggcttagccatgtccaaacttctgacacatagaaatgatgaggctgtttaagtgtgctgttttaaaccacgtcatctgtggcccaatttttaactaataatctttccacatagaataaaaaatctacacttatgtaaatctcttctgagtgaaaagaccatctttttccaaatatt

SEQ ID NO: 92143 - DNA, 201 bp, Bos taurus; identical to SEQ ID NO: 10402

SEQ ID NO: 92144 - DNA, 201 bp, Bos taurus
gaggggaattagcaatattgtcgacatgccaaacatatattgaggcttccaaaagtattactgttacagcaaacaagacccaaagtcatcaccctatcttacgtgtgttccccaaatatgttgtgttccactgataagggcattaataactaaaggggtttgaataaaataaaatcagaaacatatttatatcttatttct

SEQ ID NO: 92145 - DNA, 201 bp, Bos taurus; identical to SEQ ID NO: 10403

SEQ ID NO: 92146 - DNA, 201 bp, Bos taurus
tgggattctccaggaaagaatgctggagtgggctgccatttcctcctccaggggatcttcccaatccagggatagaacccatgtctcctgcactgcaggcagattcttcaccgctaaggcccaagggaagccttgtttcaataatcatcataagaataatcatatcttaatgaaggttaaaaaccctgtgtgtaggcacag

SEQ ID NO: 92147 - DNA, 201 bp, Bos taurus; identical to SEQ ID NO: 10404

SEQ ID NO: 92148 - DNA, 201 bp, Bos taurus; identical to SEQ ID NO: 10405

SEQ ID NO: 92149 - DNA, 201 bp, Bos taurus; identical to SEQ ID NO: 10406

SEQ ID NO: 92150 - DNA, 201 bp, Bos taurus; identical to SEQ ID NO: 10407

SEQ ID NO: 92151 - DNA, 201 bp, Bos taurus
atgtgatttaaaaaacaaatttaaaaagatatttagtaaagtctttctgaccccagttttatctgtcctttccctctattatttcttttttactagtttcctgatatattcttccagaggtggatttgtgtgtatgtgtttgatttttatttttctggccagtataagcataaagtgatatatttgtttaaaaaatacaaa

SEQ ID NO: 92152 - DNA, 201 bp, Bos taurus
ccaattcttcctaattaccaggcagtaaagtaggggactattcattgcctgatttattatacagtttgatctttatgtttgttgctagtccccacagactgcactcagatagtataaattaaaccataaggccctcgtattttctaggagagctgtggctctgtcagcatccattctttctctccaaaatggtagtaggtt

SEQ ID NO: 92153 - DNA, 201 bp, Bos taurus; identical to SEQ ID NO: 10408

SEQ ID NO: 92154 - DNA, 201 bp, Bos taurus
ggtgccattgccttctctgtctcatgatctacaacttccaatttgttcttcctcactctacctactttcctctttccttctcctcttcctcctcatttccgtgtctgtctgtctgtctctctccaacccttacctcccagtgtcagccacagtctcagcaaagtttcctcccttcactcaggtactcatctgctgaacacc

SEQ ID NO: 92155 - DNA, 201 bp, Bos taurus
acttcaaaaattaagacttataagaatacttttagaattacaatgcttacaaggcaaatagtgtaatatagcttctatacataataaaaaaagctgacctatatgtgttttaactctatattctagtgtataggtgaatatttcctcaagtataagcacatgtaggtccttgacttcctttacttttcctttccttggagc

SEQ ID NO: 92156 - DNA, 201 bp, Bos taurus; identical to SEQ ID NO: 10409

SEQ ID NO: 92157 - DNA, 201 bp, Bos taurus
ctaaatatctttttactatggtttcttagtaattctgatgatgcccaatgcaaatatgtttctgttcccaatgacattttaatactttcttcaaggaattgttgaaatatttaacaatagtaaattaactaaacatatttttcctttcctttcttttaagaaaaatagctgtctttttgttaaatttttactactattagt

SEQ ID NO: 92158 - DNA, 201 bp, Bos taurus; identical to SEQ ID NO: 10410

SEQ ID NO: 92159 - DNA, 201 bp, Bos taurus; identical to SEQ ID NO: 10411

SEQ ID NO: 92160 - DNA, 201 bp, Bos taurus; identical to SEQ ID NO: 10412

SEQ ID NO: 92161 - DNA, 201 bp, Bos taurus
ctccagaagaagctgaaaggtggattgtaaatttgattagaaatgcaaggctggatgccaagattgattctaaattagtgagtgttgtctgtgctatgtactagatgtcagttgctgattattttatacttttgggggagtttttgttaggacattcattctagaatttttgttttaatatataatagtttttttgaaggc

SEQ ID NO: 92162 - DNA, 201 bp, Bos taurus; identical to SEQ ID NO: 10415

SEQ ID NO: 92163 - DNA, 201 bp, Bos taurus; identical to SEQ ID NO: 10416

SEQ ID NO: 92164 - DNA, 201 bp, Bos taurus; identical to SEQ ID NO: 10418

SEQ ID NO: 92165 - DNA, 201 bp, Bos taurus; identical to SEQ ID NO: 10419

SEQ ID NO: 92166 - DNA, 201 bp, Bos taurus; identical to SEQ ID NO: 10422

SEQ ID NO: 92167 - DNA, 201 bp, Bos taurus; identical to SEQ ID NO: 10423

SEQ ID NO: 92168 - DNA, 201 bp, Bos taurus; identical to SEQ ID NO: 10424

SEQ ID NO: 92169 - DNA, 201 bp, Bos taurus; identical to SEQ ID NO: 10425

SEQ ID NO: 92170 - DNA, 201 bp, Bos taurus; identical to SEQ ID NO: 10428

SEQ ID NO: 92171 - DNA, 201 bp, Bos taurus; identical to SEQ ID NO: 10430

SEQ ID NO: 92172 - DNA, 201 bp, Bos taurus; identical to SEQ ID NO: 10432

SEQ ID NO: 92173 - DNA, 201 bp, Bos taurus; identical to SEQ ID NO: 10434

SEQ ID NO: 92174 - DNA, 201 bp, Bos taurus; identical to SEQ ID NO: 10435

SEQ ID NO: 92175 - DNA, 201 bp, Bos taurus; identical to SEQ ID NO: 10436

SEQ ID NO: 92176 - DNA, 201 bp, Bos taurus; identical to SEQ ID NO: 10438

SEQ ID NO: 92177 - DNA, 201 bp, Bos taurus; identical to SEQ ID NO: 10440

SEQ ID NO: 92178 - DNA, 201 bp, Bos taurus; identical to SEQ ID NO: 10446

SEQ ID NO: 92179 - DNA, 201 bp, Bos taurus; identical to SEQ ID NO: 10447

SEQ ID NO: 92180 - DNA, 201 bp, Bos taurus; identical to SEQ ID NO: 10448

SEQ ID NO: 92181 - DNA, 201 bp, Bos taurus; identical to SEQ ID NO: 10449

SEQ ID NO: 92182 - DNA, 201 bp, Bos taurus; identical to SEQ ID NO: 10450

SEQ ID NO: 92183 - DNA, 201 bp, Bos taurus; identical to SEQ ID NO: 10451

SEQ ID NO: 92184 - DNA, 201 bp, Bos taurus; identical to SEQ ID NO: 10452

SEQ ID NO: 92185 - DNA, 201 bp, Bos taurus; identical to SEQ ID NO: 10453

SEQ ID NO: 92186 - DNA, 201 bp, Bos taurus; identical to SEQ ID NO: 10454

SEQ ID NO: 92187 - DNA, 201 bp, Bos taurus; identical to SEQ ID NO: 10455

SEQ ID NO: 92188 - DNA, 201 bp, Bos taurus; identical to SEQ ID NO: 10456

SEQ ID NO: 92189 - DNA, 201 bp, Bos taurus; identical to SEQ ID NO: 10457

SEQ ID NO: 92190 - DNA, 201 bp, Bos taurus; identical to SEQ ID NO: 10458

SEQ ID NO: 92191 - DNA, 201 bp, Bos taurus; identical to SEQ ID NO: 10463

SEQ ID NO: 92192 - DNA, 201 bp, Bos taurus; identical to SEQ ID NO: 10464

SEQ ID NO: 92193 - DNA, 201 bp, Bos taurus; identical to SEQ ID NO: 10469

SEQ ID NO: 92194 - DNA, 201 bp, Bos taurus; identical to SEQ ID NO: 10471

SEQ ID NO: 92195 - DNA, 201 bp, Bos taurus; identical to SEQ ID NO: 10478

SEQ ID NO: 92196 - DNA, 201 bp, Bos taurus; identical to SEQ ID NO: 10485

SEQ ID NO: 92197 - DNA, 201 bp, Bos taurus; identical to SEQ ID NO: 10486

SEQ ID NO: 92198 - DNA, 201 bp, Bos taurus; identical to SEQ ID NO: 10487

SEQ ID NO: 92199 - DNA, 201 bp, Bos taurus; identical to SEQ ID NO: 10488

SEQ ID NO: 92200 - DNA, 201 bp, Bos taurus; identical to SEQ ID NO: 10489

SEQ ID NO: 92201 - DNA, 201 bp, Bos taurus; identical to SEQ ID NO: 10490

SEQ ID NO: 92202 - DNA, 201 bp, Bos taurus; identical to SEQ ID NO: 10491

SEQ ID NO: 92203 - DNA, 201 bp, Bos taurus; identical to SEQ ID NO: 10493

SEQ ID NO: 92204 - DNA, 201 bp, Bos taurus; identical to SEQ ID NO: 10494

SEQ ID NO: 92205 - DNA, 201 bp, Bos taurus; identical to SEQ ID NO: 10495

SEQ ID NO: 92206 - DNA, 201 bp, Bos taurus; identical to SEQ ID NO: 10496

SEQ ID NO: 92207 - DNA, 201 bp, Bos taurus; identical to SEQ ID NO: 10497

SEQ ID NO: 92208 - DNA, 201 bp, Bos taurus; identical to SEQ ID NO: 10498

SEQ ID NO: 92209 - DNA, 201 bp, Bos taurus; identical to SEQ ID NO: 10500

SEQ ID NO: 92210 - DNA, 201 bp, Bos taurus; identical to SEQ ID NO: 10501

SEQ ID NO: 92211 - DNA, 201 bp, Bos taurus; identical to SEQ ID NO: 10502

SEQ ID NO: 92212 - DNA, 201 bp, Bos taurus; identical to SEQ ID NO: 10503

SEQ ID NO: 92213 - DNA, 201 bp, Bos taurus; identical to SEQ ID NO: 10504

SEQ ID NO: 92214 - DNA, 201 bp, Bos taurus; identical to SEQ ID NO: 10505

SEQ ID NO: 92215 - DNA, 201 bp, Bos taurus; identical to SEQ ID NO: 10509

SEQ ID NO: 92216 - DNA, 201 bp, Bos taurus; identical to SEQ ID NO: 10511

SEQ ID NO: 92217 - DNA, 201 bp, Bos taurus; identical to SEQ ID NO: 10516

SEQ ID NO: 92218 - DNA, 201 bp, Bos taurus; identical to SEQ ID NO: 10517

SEQ ID NO: 92219 - DNA, 201 bp, Bos taurus; identical to SEQ ID NO: 10519

SEQ ID NO: 92220 - DNA, 201 bp, Bos taurus; identical to SEQ ID NO: 10523

SEQ ID NO: 92221 - DNA, 201 bp, Bos taurus; identical to SEQ ID NO: 10526

SEQ ID NO: 92222 - DNA, 201 bp, Bos taurus; identical to SEQ ID NO: 10527

SEQ ID NO: 92223 - DNA, 201 bp, Bos taurus; identical to SEQ ID NO: 10529

SEQ ID NO: 92224 - DNA, 201 bp, Bos taurus; identical to SEQ ID NO: 10532

SEQ ID NO: 92225 - DNA, 201 bp, Bos taurus; identical to SEQ ID NO: 10533

SEQ ID NO: 92226 - DNA, 201 bp, Bos taurus; identical to SEQ ID NO: 10535

SEQ ID NO: 92227 - DNA, 201 bp, Bos taurus; identical to SEQ ID NO: 10536

SEQ ID NO: 92228 - DNA, 201 bp, Bos taurus; identical to SEQ ID NO: 10538

SEQ ID NO: 92229 - DNA, 201 bp, Bos taurus; identical to SEQ ID NO: 10542

SEQ ID NO: 92230 - DNA, 201 bp, Bos taurus
ttccataatttaaaaaacaataagaaagtaatagccttaaagaaaaggcaaaccaaaattttaaataaaaaactgcaatgaaaacaaaacaagaaatgaagaggctaatgtgcacaaagttcctacaactatgccagcacaaattgatcaataaatgtgagctcttgtgattcatgcagtacatatatatattaagcacca

SEQ ID NO: 92231 - DNA, 201 bp, Bos taurus; identical to SEQ ID NO: 10544

SEQ ID NO: 92232 - DNA, 201 bp, Bos taurus; identical to SEQ ID NO: 10548

SEQ ID NO: 92233 - DNA, 201 bp, Bos taurus
aatgttataagctaaattttcttgaaaaaaaatattataaactaggataaattatcagttatcagttattaatacatttccttttgagatcttgtgtcaacgtccgaagggaaataaaaacctgcctaggccccagaacttgcccagtgttcatgtatatgactgtggcatttcttaatatctgttaattggctgattaag

SEQ ID NO: 92234 - DNA, 201 bp, Bos taurus; identical to SEQ ID NO: 10549

SEQ ID NO: 92235 - DNA, 201 bp, Bos taurus
ctgttcggggagctaagatcacatatgccacgtggccaggcaaaaacaaaaagctatccttctatctagcctgtttcctggctttttgcagggctgaaatttttaactttggccacgtggctacgatgaggctctaaaatatagtactgcaatttataaaagtgaagttagttctcttcttggtatctgctgagtatcctt

SEQ ID NO: 92236 - DNA, 201 bp, Bos taurus; identical to SEQ ID NO: 10550

SEQ ID NO: 92237 - DNA, 201 bp, Bos taurus
aaaaatgtttccattctaaaaacttagtacttcttcaaaaaattgtttagaaattaaatgttggctgtctcaagtcagtgaaatcaatgaaggttagatatcaaatttataataaagattatagtaaatgagaaaaggagttttagttaatttatgtcctacttgacgaactgcatgccaaatatataaaacatatagaaa

SEQ ID NO: 92238 - DNA, 201 bp, Bos taurus; identical to SEQ ID NO: 10551

SEQ ID NO: 92239 - DNA, 201 bp, Bos taurus
gggaagaagggttccagggcagttgctgcatggtgttttctaaagacgggggtacacaggtaggcacacccaccaccacccccaaaaccccacccagtaggtagcatagggccaactgagctcatctcctgaagtgctccgggtaatcattcactcattcattcattcaacagactgagcacccactgtgcgtcaggcatt

SEQ ID NO: 92240 - DNA, 201 bp, Bos taurus
aacttctctagattgaaaagaaatgcattttttgcaattatttgggataatttcctttgggcaaatacatcttggtggaaagtaggaggaaagttctaacgtagaggcagtgatagaagataggagcctggagatatccattccactgtggatttgacacatgtacaaggaaaccctaaagttacctatatataggaagga

SEQ ID NO: 92241 - DNA, 201 bp, Bos taurus
tttgatacaacaagcggccagggtactaatcttggtttctgaatacaaacaataggcttttttttatctaaatttaaatagaaaccagtttattagaagatgtaaaaaaaaaactgtcagagggccatggaaccttgtttcaaaactcaagtcaggaacttccctggtagtccagtggctaagatcctgagctctcagtgc

SEQ ID NO: 92242 - DNA, 201 bp, Bos taurus
taagagctataaagaaatcacgttttctaattaaaagtacaatttagaagattaaaaacaatggaacagatccttgaaaatgtatataaaaattcaaatagttagctccttgtcaagccctcctgcagtttgagtgcatattttctttcaataatggttaaaaatatccaaccaaacagaaggcaccagggagctcagtct

SEQ ID NO: 92243 - DNA, 201 bp, Bos taurus; identical to SEQ ID NO: 10554

SEQ ID NO: 92244 - DNA, 201 bp, Bos taurus
aggagatattaaggctaaactatattgtacaaatcaatatctaatcaattcaaaatgattgatgaccataaaagcagaggaataagaaggatctctctctctccacatgcaagcaccaaagacaggccaagggaggacacggagagaaggcacctctgtgcaagttaggaagagcacctccaccagaaactgaatcaactc

SEQ ID NO: 92245 - DNA, 201 bp, Bos taurus; identical to SEQ ID NO: 10555

SEQ ID NO: 92246 - DNA, 201 bp, Bos taurus; identical to SEQ ID NO: 10556

SEQ ID NO: 92247 - DNA, 201 bp, Bos taurus; identical to SEQ ID NO: 10557

SEQ ID NO: 92248 - DNA, 201 bp, Bos taurus; identical to SEQ ID NO: 10558

SEQ ID NO: 92249 - DNA, 201 bp, Bos taurus
agaatacacaccatggagtagggatcctgtttcaaaggaagcttctgatgtatttggagaatctctgatagtgctgagaatgccaggaatgggggttgataccctagcccaagtctcttgttttacactcttatttttcagtgtcacagacatttgttgctgtttagttgctacgtaatgtatgactctcttgcgacccca

SEQ ID NO: 92250 - DNA, 201 bp, Bos taurus; identical to SEQ ID NO: 10559

SEQ ID NO: 92251 - DNA, 201 bp, Bos taurus; identical to SEQ ID NO: 10560

SEQ ID NO: 92252 - DNA, 201 bp, Bos taurus; identical to SEQ ID NO: 10561

SEQ ID NO: 92253 - DNA, 201 bp, Bos taurus; identical to SEQ ID NO: 10562

SEQ ID NO: 92254 - DNA, 201 bp, Bos taurus; identical to SEQ ID NO: 10563

SEQ ID NO: 92255 - DNA, 201 bp, Bos taurus
ggagtgagagagagtctcagagaaaagttgttcacggttattctgacaggtcttgaggagaaaaataatctgtgaagacttcaggtgtaggtcagaggcgagctgcctttgaacactggtgtctgggagtcctcactgacttttcaagtcagagtgagtgtgaccacaacatttcttttgggagaacagtgagttagtttt

SEQ ID NO: 92256 - DNA, 201 bp, Bos taurus
aaagaatatgtcaggagccaacaagttcatagcttgtgcctaaaaagtatctctaatattctataaactatgaattccaacagataaatgttcattttggttgcaagttagtgggtgcttacaaagtgctgactatgggacattcattacccttaggcactgaagcgtcctgaagggcaggcttatttcccattttccaga

SEQ ID NO: 92257 - DNA, 201 bp, Bos taurus; identical to SEQ ID NO: 10564

SEQ ID NO: 92258 - DNA, 201 bp, Bos taurus; identical to SEQ ID NO: 10565

SEQ ID NO: 92259 - DNA, 201 bp, Bos taurus; identical to SEQ ID NO: 10566

SEQ ID NO: 92260 - DNA, 201 bp, Bos taurus; identical to SEQ ID NO: 10567

SEQ ID NO: 92261 - DNA, 201 bp, Bos taurus; identical to SEQ ID NO: 10568

SEQ ID NO: 92262 - DNA, 201 bp, Bos taurus; identical to SEQ ID NO: 10569

SEQ ID NO: 92263 - DNA, 201 bp, Bos taurus; identical to SEQ ID NO: 10571

SEQ ID NO: 92264 - DNA, 201 bp, Bos taurus
gctacgtctgaaagtataaaataccgaaaggttttgcctcttttcatttgcatttcacttgttaagcactcggaggtgaggatcagccttgttatagaggcggtgataaagtggcactgagtgcaaactcagcacatgtgagacacatgaatattcaggacgtgtgtacggagcacctgggtgtgtaagaagggcacccat

SEQ ID NO: 92265 - DNA, 201 bp, Bos taurus; identical to SEQ ID NO: 10572

SEQ ID NO: 92266 - DNA, 201 bp, Bos taurus; identical to SEQ ID NO: 10573

SEQ ID NO: 92267 - DNA, 201 bp, Bos taurus; identical to SEQ ID NO: 10574

SEQ ID NO: 92268 - DNA, 201 bp, Bos taurus
gccatagataattcacaggtggattctaattattgattgtggataataagaaagaatccagtcctccaagttagaaactttcaagttcgattggttctttctgctccaggccaagaagcctgccatccacaacagaagtctctggatctgtaaccagagggtaagctatgagcactgtgatacgccaatcatagcagatga

SEQ ID NO: 92269 - DNA, 201 bp, Bos taurus
taatagaggataccagcataccttcccagcttttattttatagataaggacattaaaaccaaccaatatctgagaatgttaatgtttcataatatacccaactcaggccataaaatcaaaaaacaagctacacaaagcaagtcagtgttaccaacagctcgcaattcagacgtgcgcaagtgcctctagatttttgctcat

SEQ ID NO: 92270 - DNA, 201 bp, Bos taurus; identical to SEQ ID NO: 10578

SEQ ID NO: 92271 - DNA, 201 bp, Bos taurus; identical to SEQ ID NO: 10579

SEQ ID NO: 92272 - DNA, 201 bp, Bos taurus; identical to SEQ ID NO: 10580

SEQ ID NO: 92273 - DNA, 201 bp, Bos taurus; identical to SEQ ID NO: 10581

SEQ ID NO: 92274 - DNA, 201 bp, Bos taurus; identical to SEQ ID NO: 10582

SEQ ID NO: 92275 - DNA, 201 bp, Bos taurus; identical to SEQ ID NO: 10583

SEQ ID NO: 92276 - DNA, 201 bp, Bos taurus; identical to SEQ ID NO: 10584

SEQ ID NO: 92277 - DNA, 201 bp, Bos taurus; identical to SEQ ID NO: 10585

SEQ ID NO: 92278 - DNA, 201 bp, Bos taurus; identical to SEQ ID NO: 10586

SEQ ID NO: 92279 - DNA, 201 bp, Bos taurus; identical to SEQ ID NO: 10587

SEQ ID NO: 92280 - DNA, 201 bp, Bos taurus; identical to SEQ ID NO: 10588

SEQ ID NO: 92281 - DNA, 201 bp, Bos taurus; identical to SEQ ID NO: 10589

SEQ ID NO: 92282 - DNA, 201 bp, Bos taurus; identical to SEQ ID NO: 10590

SEQ ID NO: 92283 - DNA, 201 bp, Bos taurus; identical to SEQ ID NO: 10593

SEQ ID NO: 92284 - DNA, 201 bp, Bos taurus; identical to SEQ ID NO: 10594

SEQ ID NO: 92285 - DNA, 201 bp, Bos taurus; identical to SEQ ID NO: 10595

SEQ ID NO: 92286 - DNA, 201 bp, Bos taurus; identical to SEQ ID NO: 10596

SEQ ID NO: 92287 - DNA, 201 bp, Bos taurus; identical to SEQ ID NO: 10597

SEQ ID NO: 92288 - DNA, 201 bp, Bos taurus; identical to SEQ ID NO: 10599

SEQ ID NO: 92289 - DNA, 201 bp, Bos taurus; identical to SEQ ID NO: 10600

SEQ ID NO: 92290 - DNA, 201 bp, Bos taurus; identical to SEQ ID NO: 10601

SEQ ID NO: 92291 - DNA, 201 bp, Bos taurus; identical to SEQ ID NO: 10602

SEQ ID NO: 92292 - DNA, 201 bp, Bos taurus; identical to SEQ ID NO: 10603

SEQ ID NO: 92293 - DNA, 201 bp, Bos taurus; identical to SEQ ID NO: 10604

SEQ ID NO: 92294 - DNA, 201 bp, Bos taurus; identical to SEQ ID NO: 10605

SEQ ID NO: 92295 - DNA, 201 bp, Bos taurus; identical to SEQ ID NO: 10606

SEQ ID NO: 92296 - DNA, 201 bp, Bos taurus; identical to SEQ ID NO: 10607

SEQ ID NO: 92297 - DNA, 201 bp, Bos taurus; identical to SEQ ID NO: 10609

SEQ ID NO: 92298 - DNA, 201 bp, Bos taurus; identical to SEQ ID NO: 10611

SEQ ID NO: 92299 - DNA, 201 bp, Bos taurus; identical to SEQ ID NO: 10612

SEQ ID NO: 92300 - DNA, 201 bp, Bos taurus; identical to SEQ ID NO: 10616

SEQ ID NO: 92301 - DNA, 201 bp, Bos taurus; identical to SEQ ID NO: 10617

SEQ ID NO: 92302 - DNA, 201 bp, Bos taurus; identical to SEQ ID NO: 10619

SEQ ID NO: 92303 - DNA, 201 bp, Bos taurus; identical to SEQ ID NO: 10620

SEQ ID NO: 92304 - DNA, 201 bp, Bos taurus; identical to SEQ ID NO: 10621

SEQ ID NO: 92305 - DNA, 201 bp, Bos taurus; identical to SEQ ID NO: 10622

SEQ ID NO: 92306 - DNA, 201 bp, Bos taurus; identical to SEQ ID NO: 10623

SEQ ID NO: 92307 - DNA, 201 bp, Bos taurus; identical to SEQ ID NO: 10624

SEQ ID NO: 92308 - DNA, 201 bp, Bos taurus; identical to SEQ ID NO: 10625

SEQ ID NO: 92309 - DNA, 201 bp, Bos taurus; identical to SEQ ID NO: 10626

SEQ ID NO: 92310 - DNA, 201 bp, Bos taurus; identical to SEQ ID NO: 10627

SEQ ID NO: 92311 - DNA, 201 bp, Bos taurus; identical to SEQ ID NO: 10628

SEQ ID NO: 92312 - DNA, 201 bp, Bos taurus; identical to SEQ ID NO: 10629

SEQ ID NO: 92313 - DNA, 201 bp, Bos taurus; identical to SEQ ID NO: 10630

SEQ ID NO: 92314 - DNA, 201 bp, Bos taurus; identical to SEQ ID NO: 10631

SEQ ID NO: 92315 - DNA, 201 bp, Bos taurus; identical to SEQ ID NO: 10632

SEQ ID NO: 92316 - DNA, 201 bp, Bos taurus; identical to SEQ ID NO: 10633

SEQ ID NO: 92317 - DNA, 201 bp, Bos taurus; identical to SEQ ID NO: 10634

SEQ ID NO: 92318 - DNA, 201 bp, Bos taurus; identical to SEQ ID NO: 10635

SEQ ID NO: 92319 - DNA, 201 bp, Bos taurus; identical to SEQ ID NO: 10636

SEQ ID NO: 92320 - DNA, 201 bp, Bos taurus; identical to SEQ ID NO: 10638

SEQ ID NO: 92321 - DNA, 201 bp, Bos taurus; identical to SEQ ID NO: 10640

SEQ ID NO: 92322 - DNA, 201 bp, Bos taurus; identical to SEQ ID NO: 10645

SEQ ID NO: 92323 - DNA, 201 bp, Bos taurus; identical to SEQ ID NO: 10647

SEQ ID NO: 92324 - DNA, 201 bp, Bos taurus; identical to SEQ ID NO: 10649

SEQ ID NO: 92325 - DNA, 201 bp, Bos taurus; identical to SEQ ID NO: 10650

SEQ ID NO: 92326 - DNA, 201 bp, Bos taurus; identical to SEQ ID NO: 10651

SEQ ID NO: 92327 - DNA, 201 bp, Bos taurus; identical to SEQ ID NO: 10652

SEQ ID NO: 92328 - DNA, 201 bp, Bos taurus; identical to SEQ ID NO: 10653

SEQ ID NO: 92329 - DNA, 201 bp, Bos taurus; identical to SEQ ID NO: 10654

SEQ ID NO: 92330 - DNA, 201 bp, Bos taurus; identical to SEQ ID NO: 10655

SEQ ID NO: 92331 - DNA, 201 bp, Bos taurus
agcatcctagaactaacaccaacaaaagatgtgattggaatgaaaaggtaggaagtcaagaggtacctggaaagtatagtaggtaaattgtactgagattcggattctagacccagctttatgatttcatgggagattcttacagttactcaatttctatctaagccttaatttctgaaaatattatgtttgggaagcatg

SEQ ID NO: 92332 - DNA, 201 bp, Bos taurus; identical to SEQ ID NO: 10656

SEQ ID NO: 92333 - DNA, 201 bp, Bos taurus; identical to SEQ ID NO: 10657

SEQ ID NO: 92334 - DNA, 201 bp, Bos taurus; identical to SEQ ID NO: 10658

SEQ ID NO: 92335 - DNA, 201 bp, Bos taurus; identical to SEQ ID NO: 10660

SEQ ID NO: 92336 - DNA, 201 bp, Bos taurus; identical to SEQ ID NO: 10661

SEQ ID NO: 92337 - DNA, 201 bp, Bos taurus; identical to SEQ ID NO: 10662

SEQ ID NO: 92338 - DNA, 201 bp, Bos taurus; identical to SEQ ID NO: 10663

SEQ ID NO: 92339 - DNA, 201 bp, Bos taurus; identical to SEQ ID NO: 10665

SEQ ID NO: 92340 - DNA, 201 bp, Bos taurus
atttggaggaaaatgattcagaactttaaaatccacacagaagaactttgggatctatagaataagaaatataaaactattttaacttcttgaaaaatggctatcaagatagatttggaaaaattcatatgtgagacaactaaagaggatacctgagtgaagtcagcaaaattttgaaagttctatatggtggtacaaaat

SEQ ID NO: 92341 - DNA, 201 bp, Bos taurus; identical to SEQ ID NO: 10668

SEQ ID NO: 92342 - DNA, 201 bp, Bos taurus; identical to SEQ ID NO: 10669

SEQ ID NO: 92343 - DNA, 201 bp, Bos taurus
tctctctctcaaaataccttattgtattatattaaccctttttgttaagatgatgtgagatgacaaacacctgtgtgataattccaagttaagtgaatggtgtggcattgttacttagcattaacctactactgagctgatgataagaggagaggagaatcaaggggagaatcattcgctccagttgatccttggtcacag

SEQ ID NO: 92344 - DNA, 201 bp, Bos taurus
ttgctatgaaacaaagaaaagtaatggaaccttaaagctgatatcaaacttactttggaaaaacttctagttcatgaagtaggaagcaaccttgtatattgatgaaggtatttctctagaatgttgttttaaagtcttagaaagtagattgttaaagccaataagtatgataagtagcatggccattaaaagacaggttaa

SEQ ID NO: 92345 - DNA, 201 bp, Bos taurus
ttaacatatcagagagatacaggtattaagaaggtgctattaagaatattgtcataataattgaaaagaaatgagtacaggctgtttaactgcattttcttttatatattctagatgttaaagtttagagacttatctgtggggtaggtgactaatagagcattgtgatatgaaattcaacttatctaaacagtgatttct

SEQ ID NO: 92346 - DNA, 201 bp, Bos taurus; identical to SEQ ID NO: 10670

SEQ ID NO: 92347 - DNA, 201 bp, Bos taurus
ctttgttggcaaagtaatgcctatggctaattcatgttgaagtttgatagtatacatttctagtgaagtcatctggacttattacatattgcttttgttgcatgcaaatgaggaggcaagatcttaaaatacaaatgcaaattctatactagatatacgtctcctcggattatctatttcaccttatggtgatttgatact

SEQ ID NO: 92348 - DNA, 201 bp, Bos taurus
cccattttaatcctactgctgtttattcttttactaatctgccatttttatatccataatctttttatgcttctttcaccccctatgaatctattatccataaatcaagagacataaatacaaagaattttgctactttgcatgtgttgaagtttcattcaatagcattctcattttggggaagaaaaaccctgcttttcc

SEQ ID NO: 92349 - DNA, 201 bp, Bos taurus
tctagtggaagtgggactgaggttttctgactggagtggcaccgggtttgagttctatagggcttgttgttttgcaagcccagggcggcacgggtggggaaatttggggggtggttgtcttctgcccagacctcagggaattgttgagttaatggtccctctcaaccgtttagcccttctggcttcccgtccaggagattg

SEQ ID NO: 92350 - DNA, 201 bp, Bos taurus
agaggacaggttgacaccatggcctgtttttccccagctgatttcctctgtgggaggtagcgttaagatatgagatggcagaggaaggagggaaggcccgcagtattgctgccacccctatcaccatccctacctcacaccagcctctcctgaggctgcatttaaaattttggccatgagttttccatggtttccactcta

SEQ ID NO: 92351 - DNA, 201 bp, Bos taurus; identical to SEQ ID NO: 10671

SEQ ID NO: 92352 - DNA, 201 bp, Bos taurus; identical to SEQ ID NO: 10672

SEQ ID NO: 92353 - DNA, 201 bp, Bos taurus; identical to SEQ ID NO: 10673

SEQ ID NO: 92354 - DNA, 201 bp, Bos taurus
agagaattcatgcccccccccccttccaagactttcaagatcacatttttatttatattaaggtcacatttcttaaaaaagaacaaaatgtgagccaagtgaaggacgtctgcaggctaaaaaatattcaagtttttcccttgcaaagctagatattttgtttgatcattcagctgccacctgcatcacacccccagctct

SEQ ID NO: 92355 - DNA, 201 bp, Bos taurus; identical to SEQ ID NO: 10674

SEQ ID NO: 92356 - DNA, 201 bp, Bos taurus
tttatttcatcttcattttaaaggatgacttcataatttacaaaattctgggtcagtggttattttctcccagcactttactctattcctttcttttctttcttgcatggtttcagaggattagtcagatgcagtttctgttacggttcctccctagataaggtttctgtggtttttgctgagatatcctaaagcacagaa

SEQ ID NO: 92357 - DNA, 201 bp, Bos taurus
atatctgaggttattgaaatccttcaataaaaaaattaattaaaaagtaaaagaagatggataactcaaaaataaaataaaagtttttaaaaatgaaatggagagagaaaaccaaaccactgcaccttcaccagaaaattgttatcaacagtaaatttcactcactgttaaactagattctaaccgggttctgagtcatta

SEQ ID NO: 92358 - DNA, 201 bp, Bos taurus
gggaccagaatagtagagcagtgattgcagttaggctctgagaaggggtgcattttgatctgggatttgaggacagtgaaagaaatacactggttgaaaaaaaagaccctctttgagattgaaatggcatatggggagagatgacaaatgcagagaaccagtcatgtataaggaagtattttatcctctagaaatccaact

SEQ ID NO: 92359 - DNA, 201 bp, Bos taurus; identical to SEQ ID NO: 10675

SEQ ID NO: 92360 - DNA, 201 bp, Bos taurus; identical to SEQ ID NO: 10676

SEQ ID NO: 92361 - DNA, 201 bp, Bos taurus; identical to SEQ ID NO: 10677

SEQ ID NO: 92362 - DNA, 201 bp, Bos taurus; identical to SEQ ID NO: 10678

SEQ ID NO: 92363 - DNA, 201 bp, Bos taurus; identical to SEQ ID NO: 10679

SEQ ID NO: 92364 - DNA, 201 bp, Bos taurus; identical to SEQ ID NO: 10680

SEQ ID NO: 92365 - DNA, 201 bp, Bos taurus; identical to SEQ ID NO: 10681

SEQ ID NO: 92366 - DNA, 201 bp, Bos taurus; identical to SEQ ID NO: 10682

SEQ ID NO: 92367 - DNA, 201 bp, Bos taurus
cctgaggctgtggccttgatgagcgggggaaggaggcagaaagtctgcaggagacaaatttggacgtaggtctggggaggaggaagtcagaagcaaagacaaccataaagctgtatgatcaattgaaactgataagtttgcaaataaagatgagtgcattcactcagtttgggggcattcatgtttgcaatcaggttgtct

SEQ ID NO: 92368 - DNA, 201 bp, Bos taurus; identical to SEQ ID NO: 10683

SEQ ID NO: 92369 - DNA, 201 bp, Bos taurus; identical to SEQ ID NO: 10684

SEQ ID NO: 92370 - DNA, 201 bp, Bos taurus
gtatttgagcaaggcctccggtgactctgatgcttgttcaagcttgggaacggctgatccagaccacacgtaacgaggtattaaagagtgacagggaaacggcgaggaggggcgtggaaagtgaggccatgaggttatctggtgaagtaaagccctgggggaccatgaggagtgcaggggctgagggctgcaggaggaagg

SEQ ID NO: 92371 - DNA, 201 bp, Bos taurus; identical to SEQ ID NO: 10685

SEQ ID NO: 92372 - DNA, 201 bp, Bos taurus; identical to SEQ ID NO: 10686

SEQ ID NO: 92373 - DNA, 201 bp, Bos taurus
tggcactattcacattttggctcagataacgcattatctggggggagggggacctgtcctatacattataggatgtttagtagtaatcttggcctctagacaccagtatctcttgtcattgtgagaatcaaaagtgtccgtagacgctgacaaatgtcttctgcagggtaaattgccctagattaagaaccactgaggaac

SEQ ID NO: 92374 - DNA, 201 bp, Bos taurus; identical to SEQ ID NO: 10688

SEQ ID NO: 92375 - DNA, 201 bp, Bos taurus; identical to SEQ ID NO: 10689

SEQ ID NO: 92376 - DNA, 201 bp, Bos taurus; identical to SEQ ID NO: 10691

SEQ ID NO: 92377 - DNA, 201 bp, Bos taurus; identical to SEQ ID NO: 10692

SEQ ID NO: 92378 - DNA, 201 bp, Bos taurus
atcttcattcccctggcctgtacctaggaacccaatcagagcctcaaagcatttggggttgactggctggagtgaaatggactgtcatcagtggagcatcctccctggaactcctggccagaggtatcccatgggcctactaggaccagacctcagaccttctgatcttaccacaatcttgccatagtcactagctgaagc

SEQ ID NO: 92379 - DNA, 201 bp, Bos taurus
cttcagggctgaaatgtaccaaatctctttaggttttaggatctttgcctgttattttcattctacctcccactcctctaagtacaactgtgccacccctctccacgtagccaaaatcattccttcttcagcactaagctcaaagattatttaagggcgatttcatgtccctgacttggtcaaccctacccctctactgcc

SEQ ID NO: 92380 - DNA, 201 bp, Bos taurus
gggccctctcagctgaaagaggccctgagggagcaaatcttaagctcaggacccacatagccataagggtccccagaaggtagattcaggcccaggtccctagaagactcgctggggccaagtgggcagtgaagacactggccatgttcccctccagtctctgatcccctgaaggtttctcaccatccccactgattccca

SEQ ID NO: 92381 - DNA, 201 bp, Bos taurus
aacaagtcatttcacttaagtatctagggtaaaagttctctttatatgaattggtaatattgatttccatcattgtcattaattacttcaatatttggatctatttacattttacactgtattttttaactacgcctttttattctcttttcctatttctttatattgatctgtttctttaatccttcttttctcttttac

SEQ ID NO: 92382 - DNA, 201 bp, Bos taurus
aacaacaatcaacaaagaagatattctacatccaaagataagaagaatccacaatgagacagcaggaagagtgcatctgcaacacaatcaaattccattctgactgaatgggcaacccacaaactggaaaatacatcacagagtttctcccacaggactgagagttctgagccccagatcaggctccccagtctgcaagcc

SEQ ID NO: 92383 - DNA, 201 bp, Bos taurus
tgataaggattttgcatctgcaaagcacatttcttatcagccccatcttggcgctcctgctctccactgcagaaccaggccacaggaacgcatctcacaccacaagcagcttacctaattacattaaactgtatttcatcggttgtggagcccacgagccacccagcatcgtcagcacaggcagcgggagcaggagtacct

SEQ ID NO: 92384 - DNA, 201 bp, Bos taurus
agtgtatcaggttgtcatgtatatcccttgaggaggaaccaggaccctgcctcatggctgcactagttttcttgactgtctttcctttgtttctgttatcccttaaacgccttactcccctaactcataactgtttgaatctgcctttggaactcaaggaagctctgagaggctgaaacattcctacaaacaagaaacagg

SEQ ID NO: 92385 - DNA, 201 bp, Bos taurus; identical to SEQ ID NO: 10693

SEQ ID NO: 92386 - DNA, 201 bp, Bos taurus
atgagccaattggtcagtaagccaaatggatttgtgaacactctgtaatgttatacaaatgagtgaagttttgtgattatgatatgtaccctggaagccaagccaccattttcacattttgattagaataatgttacagtgtctaattatttttctgatgtgatagagaaagagtctcagggaatcggttttcaagattta

SEQ ID NO: 92387 - DNA, 201 bp, Bos taurus; identical to SEQ ID NO: 10694

SEQ ID NO: 92388 - DNA, 201 bp, Bos taurus; identical to SEQ ID NO: 10697

SEQ ID NO: 92389 - DNA, 201 bp, Bos taurus; identical to SEQ ID NO: 10700

SEQ ID NO: 92390 - DNA, 201 bp, Bos taurus; identical to SEQ ID NO: 10702

SEQ ID NO: 92391 - DNA, 201 bp, Bos taurus; identical to SEQ ID NO: 10703

SEQ ID NO: 92392 - DNA, 201 bp, Bos taurus
ccataggtcaaattcgtgtgtaaaaatagtcttcttataacttaccaggggcctagtacacagggtggaaggaggaagattttcctgggcaaaagggaggcgggagagtgcagagtgcatgaaggccacctgaataagcactaacatagtatgcatgggaaccttggaacaggctagaaaagagtccttaatggggagctt

SEQ ID NO: 92393 - DNA, 201 bp, Bos taurus; identical to SEQ ID NO: 10704

SEQ ID NO: 92394 - DNA, 201 bp, Bos taurus; identical to SEQ ID NO: 10705

SEQ ID NO: 92395 - DNA, 201 bp, Bos taurus
ttccatcacctccactagctttgttcatagtgatgctttctaaggcccacttgacttcacattccaggatgtctggctctaggtcagtgatcacaccatcgtgattatctaggtacttaaaaggccaggaacacaagatggtgtccattattccaataaatgcccttagcttctctatgacatgaactaaaataatcttag

SEQ ID NO: 92396 - DNA, 201 bp, Bos taurus; identical to SEQ ID NO: 10706

SEQ ID NO: 92397 - DNA, 201 bp, Bos taurus
tgacaaaaaggtgcagttaattcttcaaaaagctaaaaaaataaaaaaaacttctcaataattttgcaaattggtcattcagcaaataggcctctttccatagtagggcagatactttgataagtataccatgaagtgtatcagttcagttcagttgctcagtcgtggccaactctttgcgaccccatgggctgcagcacg

SEQ ID NO: 92398 - DNA, 201 bp, Bos taurus; identical to SEQ ID NO: 10707

SEQ ID NO: 92399 - DNA, 201 bp, Bos taurus; identical to SEQ ID NO: 10708

SEQ ID NO: 92400 - DNA, 201 bp, Bos taurus
gggtgatctgaacagttcagtgagcaatgaactatttcttgtcttccctacacacctgaaccactaacttgtggagacataccccaaagacggtggcccttcaaggcaaaaaggaaattatttctacccctgccccttgcatctacatcctattatcacaaggtttcgaccactggacgagctaaagcttcccattatcgt

SEQ ID NO: 92401 - DNA, 201 bp, Bos taurus
tgaattattttcttctaatattaataactaatttatgggtagtgtggttaaagtaattttaaactttgttttctggattgctggatcctttttaattagcatgtgttatttttacaaaagcaatagagcggtttttctataaaacaaacaaaaaagctaatttgctaagatgttaacagtaattgattctgggtgcagata

SEQ ID NO: 92402 - DNA, 201 bp, Bos taurus; identical to SEQ ID NO: 10709

SEQ ID NO: 92403 - DNA, 201 bp, Bos taurus; identical to SEQ ID NO: 10710

SEQ ID NO: 92404 - DNA, 201 bp, Bos taurus; identical to SEQ ID NO: 10711

SEQ ID NO: 92405 - DNA, 201 bp, Bos taurus; identical to SEQ ID NO: 10716

SEQ ID NO: 92406 - DNA, 201 bp, Bos taurus; identical to SEQ ID NO: 10717

SEQ ID NO: 92407 - DNA, 201 bp, Bos taurus
acacctggccaggtggggaaacagtcccacctactgtcaggcataatgcccaaagacgagcccacagccaccccagaatactacactgtccaccagagggcgcagcacctggccccacacaccagggcaccagcactaatcccaggacccccagggccctgcaagcagagacctaggacccagctctgcctaccagtgttc

SEQ ID NO: 92408 - DNA, 201 bp, Bos taurus; identical to SEQ ID NO: 10718

SEQ ID NO: 92409 - DNA, 201 bp, Bos taurus; identical to SEQ ID NO: 10719

SEQ ID NO: 92410 - DNA, 201 bp, Bos taurus; identical to SEQ ID NO: 10720

SEQ ID NO: 92411 - DNA, 201 bp, Bos taurus
ctgggaggggaaaggggtatgtcatccaaacagcccggagggcactgtctgagctggtgattagagacacaaaaacaagggtctccagactgtctggcctgttttgggtaggggttgggaaaacggcttttggatgcagagatgcctaaagccctggtctgcccactgaaattggcctctgattctgagggatcgagaatg

SEQ ID NO: 92412 - DNA, 201 bp, Bos taurus; identical to SEQ ID NO: 10724

SEQ ID NO: 92413 - DNA, 201 bp, Bos taurus; identical to SEQ ID NO: 10725

SEQ ID NO: 92414 - DNA, 201 bp, Bos taurus
gcacttagataaaatctacactctttattttagtccacaaaacctctggccaagccccaatcacctctcccaccccatccgtggccattctcccttctgccaactctctttcagttacagtagtctctttccctgcctcacactccccaagctgttccaacctcaagacttttgtactagctgtttcctttgcctagaatg

SEQ ID NO: 92415 - DNA, 201 bp, Bos taurus; identical to SEQ ID NO: 10726

SEQ ID NO: 92416 - DNA, 201 bp, Bos taurus; identical to SEQ ID NO: 10728

SEQ ID NO: 92417 - DNA, 201 bp, Bos taurus; identical to SEQ ID NO: 10730

SEQ ID NO: 92418 - DNA, 201 bp, Bos taurus; identical to SEQ ID NO: 10731

SEQ ID NO: 92419 - DNA, 201 bp, Bos taurus; identical to SEQ ID NO: 10732

SEQ ID NO: 92420 - DNA, 201 bp, Bos taurus; identical to SEQ ID NO: 10733

SEQ ID NO: 92421 - DNA, 201 bp, Bos taurus; identical to SEQ ID NO: 10735

SEQ ID NO: 92422 - DNA, 201 bp, Bos taurus
gttgaggagggaggatgatgtggcctttaatcaaagggcggaatgaggctggtgaatgtggtgggtggtcgtagggaggcaggccctccagggtgctcagcatggctttgagcacatttcttctcctcagacttctgtttccacctcttctggaagatgcagacagaactctgagcctccagttccaacctgggagtgcct

SEQ ID NO: 92423 - DNA, 201 bp, Bos taurus; identical to SEQ ID NO: 10736

SEQ ID NO: 92424 - DNA, 201 bp, Bos taurus
gtggggcaggaggtggcgctcccatgccctctccaagtgtaccatctccgatacctccatgggttccccagcccagaagctctctgaatccctgtacttccggaatcttatggaggcctcatcacttaggtgtgtgtgtttgtattagccactcagtcatgtccaactctctgtgacctcatggactgtagccctccaggc

SEQ ID NO: 92425 - DNA, 201 bp, Bos taurus; identical to SEQ ID NO: 10737

SEQ ID NO: 92426 - DNA, 201 bp, Bos taurus; identical to SEQ ID NO: 10739

SEQ ID NO: 92427 - DNA, 201 bp, Bos taurus
ttatatcaatggatgcagaaaagcattttataaaattcaacattcatttatgataaaaactctcaatagagtgggcaaggagggaacatacctcagcataatataggccatatgagacaaacccatgcagatgtaggagacatgagttctatccccgggtcaggaagactccctggagcaggaaatggcacccaactccaa

SEQ ID NO: 92428 - DNA, 201 bp, Bos taurus
acaatgaagactttttaaaactgttcattgtatgcagttttaaaggttactttccatgtgtagttattacaagatattggcagccttccccacgccatacggtatatccttgagcccttcttacagccagtagcttgtacctcccacccctacagttaagaatttaactgttctttcagattttttctgtctatataaaca

SEQ ID NO: 92429 - DNA, 201 bp, Bos taurus; identical to SEQ ID NO: 10740

SEQ ID NO: 92430 - DNA, 201 bp, Bos taurus; identical to SEQ ID NO: 10741

SEQ ID NO: 92431 - DNA, 201 bp, Bos taurus; identical to SEQ ID NO: 10742

SEQ ID NO: 92432 - DNA, 201 bp, Bos taurus; identical to SEQ ID NO: 10743

SEQ ID NO: 92433 - DNA, 201 bp, Bos taurus; identical to SEQ ID NO: 10744

SEQ ID NO: 92434 - DNA, 201 bp, Bos taurus; identical to SEQ ID NO: 10745

SEQ ID NO: 92435 - DNA, 201 bp, Bos taurus; identical to SEQ ID NO: 10746

SEQ ID NO: 92436 - DNA, 201 bp, Bos taurus; identical to SEQ ID NO: 10747

SEQ ID NO: 92437 - DNA, 201 bp, Bos taurus; identical to SEQ ID NO: 10748

SEQ ID NO: 92438 - DNA, 201 bp, Bos taurus
acggtcctgcaagggaacggggagtgccatgcgggaaactgaggcccagacagtcaaaagacttgtccaaggtcagagcaaggactgagagcatctgagctctgaggggaccactctggctcaggccctgctgggaggcactgtgccacctgctcccaagcttcgggaaagaggtgagcttctggccttctgctcaggagg

SEQ ID NO: 92439 - DNA, 201 bp, Bos taurus; identical to SEQ ID NO: 10749

SEQ ID NO: 92440 - DNA, 201 bp, Bos taurus; identical to SEQ ID NO: 10750

SEQ ID NO: 92441 - DNA, 201 bp, Bos taurus; identical to SEQ ID NO: 10751

SEQ ID NO: 92442 - DNA, 201 bp, Bos taurus; identical to SEQ ID NO: 10752

SEQ ID NO: 92443 - DNA, 201 bp, Bos taurus
agaagggaaggggggatacaggaaggaccagctccatgttccctgaagttgctaaccaggaggctcaccgcttggccagttctggcctcctggctttgtctggtggcttgagaagacggagggagagtactgattacttggaagggtttgtgtcttagggggctggggtcacaggagtccatcatctcttacagacagagg

SEQ ID NO: 92444 - DNA, 201 bp, Bos taurus
ggacctctttcgttcggtggtctgtgtctggtctcgcgggtcttgtctggtatattggggttggcactaaacgcatcaccaacggctgcgtgtcctcatttacaggcctctgatccgtgggcctcagctgcttcgctctgcaggtttgcgatttccctttccaggggggaaaaaaaatccttaaaaaatgctttgggaagg

SEQ ID NO: 92445 - DNA, 201 bp, Bos taurus; identical to SEQ ID NO: 10753

SEQ ID NO: 92446 - DNA, 201 bp, Bos taurus; identical to SEQ ID NO: 10754

SEQ ID NO: 92447 - DNA, 201 bp, Bos taurus
actctaggctctcctcctacctgcccttctaaagctctttctgtaactaagcaggagtctaggagccttcctgggacagactcctcccctaaaacctcttacgtagctcctccctgatgcacatttcctaagttgtttcacagaggctaaaaacctcaactagatggaagaaatgaactacttgatgaccttgagctggaa

SEQ ID NO: 92448 - DNA, 201 bp, Bos taurus; identical to SEQ ID NO: 10755

SEQ ID NO: 92449 - DNA, 201 bp, Bos taurus; identical to SEQ ID NO: 10757

SEQ ID NO: 92450 - DNA, 201 bp, Bos taurus; identical to SEQ ID NO: 10758

SEQ ID NO: 92451 - DNA, 201 bp, Bos taurus; identical to SEQ ID NO: 10759

SEQ ID NO: 92452 - DNA, 201 bp, Bos taurus
atgaaggcgagagaagggggcaggcaggcttcatttctcagttctttttcctaggcaaaaagggaattaagagtcagtctacgcgggcctgggggaatcaacactcaggattcagagagccggcagacacagagggtcaactttctagtgcgggagcaggagagtgatctggccgcgaggctgggaagggcagcgggttgc

SEQ ID NO: 92453 - DNA, 201 bp, Bos taurus; identical to SEQ ID NO: 10760

SEQ ID NO: 92454 - DNA, 201 bp, Bos taurus; identical to SEQ ID NO: 10762

SEQ ID NO: 92455 - DNA, 201 bp, Bos taurus
gtactgttgtgagagtgaaaagcaaagcccatcgcaaggggcccggcacctgcacgctcgtaaagacaacaggagcagcagttgcagtcacagtagctgtgacgggaaacagcccacaggccacattttaagaagtacaaattaactaattaatttcagactaaagcaggtcataaacgctaagacgaccgagatggtgat

SEQ ID NO: 92456 - DNA, 201 bp, Bos taurus; identical to SEQ ID NO: 10767

SEQ ID NO: 92457 - DNA, 201 bp, Bos taurus; identical to SEQ ID NO: 10769

SEQ ID NO: 92458 - DNA, 201 bp, Bos taurus
tggccccctgtcaaagctaaatcaatactcccttttttctctgcaagaacatctcagtaatcctaattggtcactatggcaaccccatctgcagctcttcgtggcctcaatgaagagacagaaggatgagatggggtgagatggaggttaagcctacttattgtataatgctctgcctttgatatcacctagatccacatg

SEQ ID NO: 92459 - DNA, 201 bp, Bos taurus; identical to SEQ ID NO: 10770

SEQ ID NO: 92460 - DNA, 201 bp, Bos taurus; identical to SEQ ID NO: 10771

SEQ ID NO: 92461 - DNA, 201 bp, Bos taurus
atggtggggagacatatatctcaattcattctcactcagggacccaggctgacagcatctccagcatctcaaatgtatcagtcacaacagcagaaaggaatcacagtgaagtacatatcatctcttaaggcctctgtccaaagacaatcttctactcacattttgttttcaaaagcaaatcacactgcaatgcctaacttc

SEQ ID NO: 92462 - DNA, 201 bp, Bos taurus
caaagttacagggaacaggccagtgtggaggcagggcagggcagggtgaggccgtcctgatggccactagagacatcctggccagcggtgtcctagccccgggaactttccagagggtgttgctgccacacacacctgttctggcagctggctgggatggggcttgtctggatatgagtgtggggcggtgggtacctcata

SEQ ID NO: 92463 - DNA, 201 bp, Bos taurus; identical to SEQ ID NO: 10775

SEQ ID NO: 92464 - DNA, 201 bp, Bos taurus
ggtcacatcctagcctagatcggatagaacaggaatagcaggttaaaatagaaagtgaagtcagagaatctgaaagagatgggagacaggcagaagagacgagaagttttcaggccatataagcttaaaggggcttccctgatggttcaaatgataaagagtttgcctgcaatgcagaagacctgagttcgatccctggat

SEQ ID NO: 92465 - DNA, 201 bp, Bos taurus; identical to SEQ ID NO: 10777

SEQ ID NO: 92466 - DNA, 201 bp, Bos taurus; identical to SEQ ID NO: 10779

SEQ ID NO: 92467 - DNA, 201 bp, Bos taurus; identical to SEQ ID NO: 10780

SEQ ID NO: 92468 - DNA, 201 bp, Bos taurus; identical to SEQ ID NO: 10781

SEQ ID NO: 92469 - DNA, 201 bp, Bos taurus; identical to SEQ ID NO: 10782

SEQ ID NO: 92470 - DNA, 201 bp, Bos taurus; identical to SEQ ID NO: 10783

SEQ ID NO: 92471 - DNA, 201 bp, Bos taurus; identical to SEQ ID NO: 10784

SEQ ID NO: 92472 - DNA, 201 bp, Bos taurus; identical to SEQ ID NO: 10785

SEQ ID NO: 92473 - DNA, 201 bp, Bos taurus; identical to SEQ ID NO: 10787

SEQ ID NO: 92474 - DNA, 201 bp, Bos taurus; identical to SEQ ID NO: 10789

SEQ ID NO: 92475 - DNA, 201 bp, Bos taurus; identical to SEQ ID NO: 10790

SEQ ID NO: 92476 - DNA, 201 bp, Bos taurus
tggatcccagcccgcttggtgccgtgggagtggtggccggtgggggagccggaggtccctcagcagatgccacctccccactccaggtttaccgctccaagatggatggcgaggccaccagccccctgccccgcacccgcagtgggccactcccctcctcctctggctcgtcgtcttcctcctcccagctcagcgtggcta

SEQ ID NO: 92477 - DNA, 201 bp, Bos taurus; identical to SEQ ID NO: 10791

SEQ ID NO: 92478 - DNA, 201 bp, Bos taurus; identical to SEQ ID NO: 10792

SEQ ID NO: 92479 - DNA, 201 bp, Bos taurus; identical to SEQ ID NO: 10793

SEQ ID NO: 92480 - DNA, 201 bp, Bos taurus; identical to SEQ ID NO: 10794

SEQ ID NO: 92481 - DNA, 201 bp, Bos taurus
cctggacttctctttttttgtgggagatatgaggaccattaaatgagggatctctgaagacaaagcctaatgagttcactacccagctcacagtaggtacttgaaagatgtgtaatgaatacacaaggaaggcacacagccagaagggattcatgggtgctgattttcccatgttcccagctccatggcacccgagtatgg

SEQ ID NO: 92482 - DNA, 201 bp, Bos taurus
gatacacctacctccctttaggtaaatagtagatttggcagtctgccgtctcagcatttatctgttactaccagtagtggtatatgcctgtgggtggccatgctgcccctaactctctttgtgcccctagccctgctctgcgtgttgtgccatccttcggttcttttgcttctcatgcagactcttaacaccagggcccag

SEQ ID NO: 92483 - DNA, 201 bp, Bos taurus
aggaggcaccctggccgggagagcaggctggggccctggctatagctctgctgcacaagacagggacaggacgggcactcacatggctgcgagtctcctcgttgccaaaggaacggcctgaactgaatggccctttcatggggcagtgggaggccagccgattggctgtgatcccccgtgcccctccctgcccagcgtggg

SEQ ID NO: 92484 - DNA, 201 bp, Bos taurus
tctagccaggcccggatttccttacctagcagttggcatgccctcaggtaggggcttaaaccatggcaacacacatgtcccactcagactggggacaaacgctgtcgttcctttggggccatgttgtctccttcttttgtcctgcagcagtccttggccctgggaaatcccaggcaaagtgtatcatctctctggcctcag

SEQ ID NO: 92485 - DNA, 201 bp, Bos taurus
ccttcgctctcctttcccctcatggaagacatagagacagcaggccatttcttcaattctgtctttatcaccaggaaggcgcttttaatcaaatcctaagctgagtggcaggaggcagaggggccttcccattctgccttcactaactctattccagagagtaactggggagtctcgaatcctgcttgcatcacattaaca

SEQ ID NO: 92486 - DNA, 201 bp, Bos taurus; identical to SEQ ID NO: 10798

SEQ ID NO: 92487 - DNA, 201 bp, Bos taurus; identical to SEQ ID NO: 10799

SEQ ID NO: 92488 - DNA, 201 bp, Bos taurus; identical to SEQ ID NO: 10801

SEQ ID NO: 92489 - DNA, 201 bp, Bos taurus; identical to SEQ ID NO: 10803

SEQ ID NO: 92490 - DNA, 201 bp, Bos taurus; identical to SEQ ID NO: 10805

SEQ ID NO: 92491 - DNA, 201 bp, Bos taurus; identical to SEQ ID NO: 10806

SEQ ID NO: 92492 - DNA, 201 bp, Bos taurus; identical to SEQ ID NO: 10807

SEQ ID NO: 92493 - DNA, 201 bp, Bos taurus
agggtatgagaagaacatggagggtgggcagaggccaggccttgtagggcccggtgggtgtggagggcttagtatgaaggaccctggtctttatccttaagagttgaagggtctcagcaggggccagtgtgaccatagttgaggctttgtagagatggctggctgctgccaagtgtctaacagaacaaacagaggccctgg

SEQ ID NO: 92494 - DNA, 201 bp, Bos taurus; identical to SEQ ID NO: 10808

SEQ ID NO: 92495 - DNA, 201 bp, Bos taurus; identical to SEQ ID NO: 10809

SEQ ID NO: 92496 - DNA, 201 bp, Bos taurus; identical to SEQ ID NO: 10810

SEQ ID NO: 92497 - DNA, 201 bp, Bos taurus; identical to SEQ ID NO: 10813

SEQ ID NO: 92498 - DNA, 201 bp, Bos taurus; identical to SEQ ID NO: 10814

SEQ ID NO: 92499 - DNA, 201 bp, Bos taurus
tttccattggatccttcatcattatggacaattatctaaatcacaatctccaccctttagagtggatactatataaatgctatgattagtactttgttatctagatgcacatatttcccaactctaaaaatcttctatcatcagaataatggagacacaatcgagtaaataaaaccaacctttgtaatcttctgaccagaa

SEQ ID NO: 92500 - DNA, 201 bp, Bos taurus
atttatatgaccctgacttatatttgtttacccatttctctctcccactggccaatgaactctacggaaatatggattctttgtttgtaatggccagaacatagtacagtgtccagtgtagagtaaaaatttcctggaattttctctcttccttccttcctcattgacctccagcactggcaatttggccatgccttctat

SEQ ID NO: 92501 - DNA, 201 bp, Bos taurus; identical to SEQ ID NO: 10816

SEQ ID NO: 92502 - DNA, 201 bp, Bos taurus; identical to SEQ ID NO: 10817

SEQ ID NO: 92503 - DNA, 201 bp, Bos taurus; identical to SEQ ID NO: 10818

SEQ ID NO: 92504 - DNA, 201 bp, Bos taurus; identical to SEQ ID NO: 10819

SEQ ID NO: 92505 - DNA, 201 bp, Bos taurus; identical to SEQ ID NO: 10820

SEQ ID NO: 92506 - DNA, 201 bp, Bos taurus; identical to SEQ ID NO: 10821

SEQ ID NO: 92507 - DNA, 201 bp, Bos taurus
aatgtttccaaactcctaagacacttccctcctgtttttatctcaaccagcaagactaatgtatatgagcagaagagtacgtctctctcatgcacacagacctacttccctcagtgattcagatcctgacatggcagagtctctcaaagagctctgcttctccattcaagaagccccagttcacacaggaatcaggcaatg

SEQ ID NO: 92508 - DNA, 201 bp, Bos taurus; identical to SEQ ID NO: 10823

SEQ ID NO: 92509 - DNA, 201 bp, Bos taurus; identical to SEQ ID NO: 10826

SEQ ID NO: 92510 - DNA, 201 bp, Bos taurus; identical to SEQ ID NO: 10827

SEQ ID NO: 92511 - DNA, 201 bp, Bos taurus; identical to SEQ ID NO: 10830

SEQ ID NO: 92512 - DNA, 201 bp, Bos taurus; identical to SEQ ID NO: 10831

SEQ ID NO: 92513 - DNA, 201 bp, Bos taurus; identical to SEQ ID NO: 10834

SEQ ID NO: 92514 - DNA, 201 bp, Bos taurus; identical to SEQ ID NO: 10835

SEQ ID NO: 92515 - DNA, 201 bp, Bos taurus; identical to SEQ ID NO: 10836

SEQ ID NO: 92516 - DNA, 201 bp, Bos taurus; identical to SEQ ID NO: 10837

SEQ ID NO: 92517 - DNA, 201 bp, Bos taurus; identical to SEQ ID NO: 10839

SEQ ID NO: 92518 - DNA, 201 bp, Bos taurus; identical to SEQ ID NO: 10840

SEQ ID NO: 92519 - DNA, 201 bp, Bos taurus; identical to SEQ ID NO: 10841

SEQ ID NO: 92520 - DNA, 201 bp, Bos taurus; identical to SEQ ID NO: 10843

SEQ ID NO: 92521 - DNA, 201 bp, Bos taurus; identical to SEQ ID NO: 10844

SEQ ID NO: 92522 - DNA, 201 bp, Bos taurus; identical to SEQ ID NO: 10846

SEQ ID NO: 92523 - DNA, 201 bp, Bos taurus
tcctttcactgctcttggttaccttgctttttcctgaacaattggcttccagtaatacactttggggataccgaaagtcaagcctcaccagggccctggtagtcactcagcatctgaaccccaaagtccagcatcagccttgtagggttgagacgtgccctgcaaagaccatgctggcccctgaagcagtgctctgtctac

SEQ ID NO: 92524 - DNA, 201 bp, Bos taurus
tagtccaaaaaaaataaaagaaaaaaccaaaaaagtgaagcccactactcaactgcatcaaactcagacctctactgggcctttgaaagcagattagttacggggctcattgggacagaggcatttggtcactgagaaataaaaccaatgacttcttggatccatgaggcccccttctgttctctccttccagcctgttct

SEQ ID NO: 92525 - DNA, 201 bp, Bos taurus
caaacgtgcatacagcaactatggactatactgtccttgcaaattggtcacaactagaaaatgagtatgtagttagaggcagtgctactgtcctgtgccctgatgtggatctcaaaccattagtcctctctgaaaaatactatttttgccctcactctactagatcaacactgaggagcattctaccaagatgtcagctgg

SEQ ID NO: 92526 - DNA, 201 bp, Bos taurus; identical to SEQ ID NO: 10849

SEQ ID NO: 92527 - DNA, 201 bp, Bos taurus
gtctttgatttcattttcatgtatctgcatgtgtactttattttcctgccaggaagtcatgatgaaatggtgttggaaaattttgcgccctgacatcttcgaatatttactcttctcctcttctggaattccagtctggtatatattgaaccaattgactcggtatttagtttttcttaacttcacttccatattgtcgat

SEQ ID NO: 92528 - DNA, 201 bp, Bos taurus
ctgattggcagggacagtaagtgctggggctttgagagagagcctgttgtgggctggagcactgaggaagtctcccagggcaggtgggccagagccagcaagtggctagaggggaagtaacagagtgtctaaaaagacagtgcacctgatcggtgtggggcagggggttgaggagatcactctttatatcaggggccatcc

SEQ ID NO: 92529 - DNA, 201 bp, Bos taurus
atgataacatgaaaacatcaaatctgcatggtgatgcatagtttgacattgctaattatctatggtatttccatctgagtcataggaaatgtgaggttaacttcattccctatgctgacttttcacaccacctaccttcaacctgaccacctaatgcttaatgggaatatgacaaggttagaaaaaacaaaaaaacatgtg

SEQ ID NO: 92530 - DNA, 201 bp, Bos taurus; identical to SEQ ID NO: 10852

SEQ ID NO: 92531 - DNA, 201 bp, Bos taurus; identical to SEQ ID NO: 10853

SEQ ID NO: 92532 - DNA, 201 bp, Bos taurus; identical to SEQ ID NO: 10855

SEQ ID NO: 92533 - DNA, 201 bp, Bos taurus; identical to SEQ ID NO: 10856

SEQ ID NO: 92534 - DNA, 201 bp, Bos taurus
ggccagaggccatctaggagagaggacttgggactggaaagtgcaatgagggaaaggcaagccaacacaggtgaatcagacacgtgtttgtgtgcttgtgggcacacatgtggccagcagaatagcaaggatagctgcttgtgtttgctgacatctggggcatgggtgcactgggaggctctcctaaaagtatctgaggta

SEQ ID NO: 92535 - DNA, 201 bp, Bos taurus; identical to SEQ ID NO: 10858

SEQ ID NO: 92536 - DNA, 201 bp, Bos taurus; identical to SEQ ID NO: 10859

SEQ ID NO: 92537 - DNA, 201 bp, Bos taurus; identical to SEQ ID NO: 10860

SEQ ID NO: 92538 - DNA, 201 bp, Bos taurus; identical to SEQ ID NO: 10861

SEQ ID NO: 92539 - DNA, 201 bp, Bos taurus
aactattaccaaaaaacacatggaaaattcaacagttgctatatgctgtcatttaaaacatttttactcatctctaacagcagaaagtctgggggttggtaagtaggagggaagaaagttgtttctgaaagatcaagagcttagtagctcaatatcccacaggagagcttgaagcaaaagagtaggtcaactcttaagata

SEQ ID NO: 92540 - DNA, 201 bp, Bos taurus; identical to SEQ ID NO: 10863

SEQ ID NO: 92541 - DNA, 201 bp, Bos taurus
tgcgtgctcactgatggacttcccacaaaacccccagctccctgtaaggacccctgtgtggccacctctgcctccccacaacatacaaggagctggccctagacacagcacctgctccaattctccatcatattctcaacttgaggtttactatggggaggaatgtggagttgctctggtctgttcctatggtggtggcct

SEQ ID NO: 92542 - DNA, 201 bp, Bos taurus
agatgtcacgtaaatgcagaatttgggcgatcggaaatgatcacccaggctctcaggagcctgaagatgagttgcgaggacagactgatcacacagaaccggtggccctctcgggggtgccaagaggatattgcttagacaatggcctttctccttgtgagtttaacagcagccttatttagaaggtgaagaaatctagga

SEQ ID NO: 92543 - DNA, 201 bp, Bos taurus; identical to SEQ ID NO: 10864

SEQ ID NO: 92544 - DNA, 201 bp, Bos taurus; identical to SEQ ID NO: 10866

SEQ ID NO: 92545 - DNA, 201 bp, Bos taurus
aagcaggcagatagtttcctacttctgttaatatcacaaggtcctggggaaggcctgcgatccgttggttccaagtgagaaaagcaggcagggaaactgggtgctgtcacaggctgaaagcagggccagcaagccaggggctggcggtaagcctgggagaatgttcagggcaggatcgggcagacatgtcagagaagaaag

SEQ ID NO: 92546 - DNA, 201 bp, Bos taurus
acaaggtgtcaaaggcatcacgttctgaaaaaaagagaaagcaaatagagcccagagctagtgccgccccaggccccaggccccagcctctacagaccagcggtcaactccaggtgagaattctctgggggataaattgtgctggaaacttgggaaactgcttaggcagaggtttggggtggactcttatcttgggggcct

SEQ ID NO: 92547 - DNA, 201 bp, Bos taurus
ccactggctgttgtataaaatccactttttgttgcacttcacaatccaatcaagaaaatgttcattgctgttgcacagaataaggtgacaacttaaacagcgattttttaaattttctgtcagctcatgaggtcagctcacttatcaagttttttcacctttccaatttgcttcaaatacctaacgaacatgctgagttct

SEQ ID NO: 92548 - DNA, 201 bp, Bos taurus
agtaggagggtctagagcacttttctttgagaagtaaggagctttataagggtagttttgtcaaactcagttcttggcctggggcaggccagttggcagtccagaagacttaactctccaaggaaataaaaactctactaagaagcccaacgtgttagtcctgagggccagacatctttcagagattacacctgtgtacgc

SEQ ID NO: 92549 - DNA, 201 bp, Bos taurus; identical to SEQ ID NO: 10868

SEQ ID NO: 92550 - DNA, 201 bp, Bos taurus; identical to SEQ ID NO: 10870

SEQ ID NO: 92551 - DNA, 201 bp, Bos taurus
ctttgctaaaatagcaataagactgactttcacccacggacgctcaatgcctccagaagaactggctgctcattttctgagctctgggcctgttgacaacgctctactgaaacaaattgaaatttctatcatcaattcacttcgaaatgtcataaagccgcttaggcctcggctggctgagcagtaaagcaggccctcttg

SEQ ID NO: 92552 - DNA, 201 bp, Bos taurus; identical to SEQ ID NO: 10871

SEQ ID NO: 92553 - DNA, 201 bp, Bos taurus; identical to SEQ ID NO: 10872

SEQ ID NO: 92554 - DNA, 201 bp, Bos taurus; identical to SEQ ID NO: 10873

SEQ ID NO: 92555 - DNA, 201 bp, Bos taurus
ataaggagactgtttgtgggcctcaatagcctctgcagtgccagagtctatcaggagaaggacccatgaggaacccaggtgagctggagccaggatgcccggatcctgtgagaggcccattagcgcaggatttcagaacatggactctggagtaaggccaacctgggctgaagtcatagctcttccatatgctggtcaaga

SEQ ID NO: 92556 - DNA, 201 bp, Bos taurus; identical to SEQ ID NO: 10874

SEQ ID NO: 92557 - DNA, 201 bp, Bos taurus; identical to SEQ ID NO: 10875

SEQ ID NO: 92558 - DNA, 201 bp, Bos taurus
cacgactgagcatctaagcacagcacacaactactccaaactagctatcaataccctagaaggtgagggctgacagaggctctatggctgcctggctctatggctgccactgatgcttcagtcaggggaggaatttctcctatgggagttccagttgcagccaatttctccctaaagtggccaaatgttggttaccacatc

SEQ ID NO: 92559 - DNA, 201 bp, Bos taurus
tggtacaacagctaaaggttgcaagtcaagtaagcagtaaaatcaaggttagagaagttttcaatgatccaaacgttgttggactaagaataaagggtgtagactgttgccccagaaagaggtttagagccatcaggtgacatcaggacaccagccattaggttgagcaacatttgggtactggatttagaatgacttgga

SEQ ID NO: 92560 - DNA, 201 bp, Bos taurus
ggagcgtggcagtagaatttctgtacttctctcatgcccttaacagctggattactggaactgctgccttaaccaccaccagatataatgtgacccaaccggtccatgtatttagccttagtttttacaagaatgggtcaggtttgtaggatgatgagaaggacagaaatatataggaaaatcacagattaagaaacaatc

SEQ ID NO: 92561 - DNA, 201 bp, Bos taurus
cctacctgacagactattaaacttcctttaccaaatctacttcctcccccagctacagaaacatacccatggttctgtcctcggccctcgcttctcccactaccgtctctttcttcctgacctaaccgactcccacggcttccctgtctctgtctccagccctggcctctcacggctctgaacgtactcttccagttgaaa

SEQ ID NO: 92562 - DNA, 201 bp, Bos taurus; identical to SEQ ID NO: 10879

SEQ ID NO: 92563 - DNA, 201 bp, Bos taurus; identical to SEQ ID NO: 10880

SEQ ID NO: 92564 - DNA, 201 bp, Bos taurus; identical to SEQ ID NO: 10882

SEQ ID NO: 92565 - DNA, 201 bp, Bos taurus
gaccatgggagcagaacgttgtaaacagaggctatggcaggggcatagcaatgggatagcatgatttgtagtagctggtagttaggatctttggttgcaaaaatcacattatcttaagtgatagacttctccaaggcaacgtggaagaataaagaagacaggaatctcagtcacataggactaagaccttgtgggggatta

SEQ ID NO: 92566 - DNA, 201 bp, Bos taurus
ctttgagctggtcttcatgcaggcctctcatctggaagtgggaccatggaccctatctctctgctctgagcccttgaagcaacatcttctgatgtctcatgatcttacggccaagtcgactatagcccaagtcagacttggtgtcactctgcgccctctaatcatcagatgcatttagcaatctttgagaatgcagattct

SEQ ID NO: 92567 - DNA, 201 bp, Bos taurus
agaaggtttttaaaaaaacaaaaaactagagacacaacagcatgtctgttgtgctgatgtgaaagactagcagagagagaaaaatcgtaatgtaggaaaggaagggcagaatgacgggaataacgcccttgatttgctgagagaagagggagctggtgagcaaagtggagggaggagccttggctggatgctctgagggtt

SEQ ID NO: 92568 - DNA, 201 bp, Bos taurus; identical to SEQ ID NO: 10884

SEQ ID NO: 92569 - DNA, 201 bp, Bos taurus; identical to SEQ ID NO: 10886

SEQ ID NO: 92570 - DNA, 201 bp, Bos taurus; identical to SEQ ID NO: 10887

SEQ ID NO: 92571 - DNA, 201 bp, Bos taurus; identical to SEQ ID NO: 10888

SEQ ID NO: 92572 - DNA, 201 bp, Bos taurus; identical to SEQ ID NO: 10889

SEQ ID NO: 92573 - DNA, 201 bp, Bos taurus; identical to SEQ ID NO: 10890

SEQ ID NO: 92574 - DNA, 201 bp, Bos taurus; identical to SEQ ID NO: 10891

SEQ ID NO: 92575 - DNA, 201 bp, Bos taurus
ttcctcacacacgctgagagatcttccctgcctcaggacctttgtacttgctctttgttctgcctggtgggattttccttctcatcctgcaggtctcagctcctcagagaaggcctaccctgactgcctgatctaaaccagctccaaaacaggaggtaggtttctgtctacttcctgttttgtttccttcaaaggtcttat

SEQ ID NO: 92576 - DNA, 201 bp, Bos taurus; identical to SEQ ID NO: 10892

SEQ ID NO: 92577 - DNA, 201 bp, Bos taurus; identical to SEQ ID NO: 10894

SEQ ID NO: 92578 - DNA, 201 bp, Bos taurus
gccatggccagggtcacaatcccagcccccacctcctcctctctccatcccagccttcccaatcacagagcaaacactgaggctgtaggccatgtactcatagaacaccagaactatgagtgcttcagtaaccagtccacctccttctactacaggggaaataggcccagagaaccaagggactagcccagaaacagaatg

SEQ ID NO: 92579 - DNA, 201 bp, Bos taurus; identical to SEQ ID NO: 10895

SEQ ID NO: 92580 - DNA, 201 bp, Bos taurus; identical to SEQ ID NO: 10896

SEQ ID NO: 92581 - DNA, 201 bp, Bos taurus
ctccccttgaggcccacgcatgtgagcatctgtagtgaggttcacccttaataggtgatctgggaaagaaactcctatggattctgggagtaagctagaggctgtttgggccaggaatttgaaggtcttgttacttggatggtcttaaaggagtggataggatggactctgggtggacacatccctgtggccttgtccagt

SEQ ID NO: 92582 - DNA, 201 bp, Bos taurus
tttgcttgcttacattttattcctcccaattaatacatagtctcctcgaaatggtgtttattcctgtatcacaaataactagtgtttgggactaatatgtactggagaaaacctgttactagaatttatacatgacttgtataatgcatatgccaggtggaatatacttcccaattcctttgtacaatatttatggagctt

SEQ ID NO: 92583 - DNA, 201 bp, Bos taurus
gtgatcaatttctttgctccagtaagtggcctaatagggattccaagccaggactgtctgaaatcagaacttggtgctcctaaccactatactatactgcttctgcatgtgctcttggcccaaaaaagaaatatcatagcagaagcagatgtggggagggtgtgaggggtacagatgaattaagtttatatcaggtaactt

SEQ ID NO: 92584 - DNA, 201 bp, Bos taurus; identical to SEQ ID NO: 10897

SEQ ID NO: 92585 - DNA, 201 bp, Bos taurus
gatctcatttctattacgctccctctcagccccattattctcccacactgcttacctcactccttgtacaggcttcctacaggcctcagtgttggctgttcctcagcctgtatttctacatggcttgctccctaatctctttcaagtgtttgctcaaatgttttaatgctcctcaaggcctaccattacctatattaaaat

SEQ ID NO: 92586 - DNA, 201 bp, Bos taurus; identical to SEQ ID NO: 10898

SEQ ID NO: 92587 - DNA, 201 bp, Bos taurus
gctaaaagaatgtgatgggggagcacagcccaggggtcatcatcagtacttggtggtgatcaagtactacatcctcagtacttcagctgagggctgggtcatgcctgttcttcttgttgttccctcattactctgtacatgtacagtgtgtgcactgtgtggcatacatgtgtattataaaaatgaaaccttggtaaatct

SEQ ID NO: 92588 - DNA, 201 bp, Bos taurus
caaggagtgataggccaaaagaagacaggagttaaaacaaaagaacaggattttgcaaacagtattgcattagacaaaagtatgtacaggcattcttttatattctaaagtagcctatagagtggggcaccatcaatacagccttaagaactgacttgagctctgagtacaactcatggaagcgagtgtaaagagatctgc

SEQ ID NO: 92589 - DNA, 201 bp, Bos taurus; identical to SEQ ID NO: 10901

SEQ ID NO: 92590 - DNA, 201 bp, Bos taurus; identical to SEQ ID NO: 10902

SEQ ID NO: 92591 - DNA, 201 bp, Bos taurus
ccacttcctccgccaccaacacacactgccacgggaaggcctggactaagtccagccagtgctggacatacatcttcacgggcaactggctttcctggggcaactggttttcctgcttgaaggccttgtctagggacgggcccagagcaagacgggcagccacgcagtcctgcagattgtgcaccagtgccaaacgcagac

SEQ ID NO: 92592 - DNA, 201 bp, Bos taurus; identical to SEQ ID NO: 10903

SEQ ID NO: 92593 - DNA, 201 bp, Bos taurus; identical to SEQ ID NO: 10904

SEQ ID NO: 92594 - DNA, 201 bp, Bos taurus; identical to SEQ ID NO: 10905

SEQ ID NO: 92595 - DNA, 201 bp, Bos taurus; identical to SEQ ID NO: 10906

SEQ ID NO: 92596 - DNA, 201 bp, Bos taurus
tgtccaacaaagtgaagtaggaattccttttggaggaagtttgtagcctttgttcttgggtaagtttctaggggtaactcttaggatggcctgtctcagatggtggactgactgcctgcaggtctgatgtgctgcccagcagctacttccctggtggggtgagctcacagtttctgatgttgtttcaggcccagtgctgtc

SEQ ID NO: 92597 - DNA, 201 bp, Bos taurus; identical to SEQ ID NO: 10907

SEQ ID NO: 92598 - DNA, 201 bp, Bos taurus; identical to SEQ ID NO: 10908

SEQ ID NO: 92599 - DNA, 201 bp, Bos taurus; identical to SEQ ID NO: 10909

SEQ ID NO: 92600 - DNA, 201 bp, Bos taurus
gcttctgattccaaaaccagttgcagtctcattgctaatatagtgctgagatttaccttgaaatagcaccgaagtctattgttgttttggatagagagaagaactgcttggaatttccattaggaacaaagaagacagagttctttaaatttgttggactgcattattattccaatatattaaatataatttctttcattt

SEQ ID NO: 92601 - DNA, 201 bp, Bos taurus; identical to SEQ ID NO: 10911

SEQ ID NO: 92602 - DNA, 201 bp, Bos taurus; identical to SEQ ID NO: 10912

SEQ ID NO: 92603 - DNA, 201 bp, Bos taurus
cctgaggaaccttactggtccccatatcaaaagaacagacaaagccaatggattgtctaaacttagttttactacttttcttgacccataaagaatatcacggatattttatatcccttcccaatcatacatacaagcactgacatatttgagttaggatggtctttgaaaaatcattagaccttaaaattattcatgaag

SEQ ID NO: 92604 - DNA, 201 bp, Bos taurus
tcacaggtttggtattgacatgacaatcaaaaaaaaaacaaacaaacaagtcttaaataagaaagtgctttgaaaagtgtgaagcaccaattaatctgacgggtcattataatatgattatcacaagctagctggagagaagattaatgtccatgaaacaattagaaggtgaaacagtatagttaattaggcaccaaatga

SEQ ID NO: 92605 - DNA, 201 bp, Bos taurus; identical to SEQ ID NO: 10916

SEQ ID NO: 92606 - DNA, 201 bp, Bos taurus
tgcagactgcatgagggagctgtctatcccatgttcacttagctaggaccacagtatagatggggctgaggcagactccatggccatctgggtacagcccaacccaaggatccctccccttacagttctccactgtctatgttgttggtctcctgcaagaggccctgcagagttaagcttgcttggtcatttggtgcttct

SEQ ID NO: 92607 - DNA, 201 bp, Bos taurus
gccaaaggaagcaccgttgtgcagcaagcagccaggctgagaacaggctagggatcttgggaagaggctggaagcctccaagacaggctagacctccacgctgtcaggcctcctaaggacctaagctgaagcatgggtccaaagtgctctacctgctcagcctctggccagccagcaaagaagagcttcccaaggaggctg

SEQ ID NO: 92608 - DNA, 201 bp, Bos taurus
ggtgacttgaagttgaatccaaagaacatttaccatttcagaaatcctaggccctttctgaatgctaaatctactctgccttgctctctaaatggagcaacaaagcctggaagacagcacatctgtttaccacatggtttactgaatattttaagcccacaagtgatatctattgctccaaaaatgattcctttcaaaata

SEQ ID NO: 92609 - DNA, 201 bp, Bos taurus; identical to SEQ ID NO: 10918

SEQ ID NO: 92610 - DNA, 201 bp, Bos taurus; identical to SEQ ID NO: 10919

SEQ ID NO: 92611 - DNA, 201 bp, Bos taurus; identical to SEQ ID NO: 10920

SEQ ID NO: 92612 - DNA, 201 bp, Bos taurus; identical to SEQ ID NO: 10921

SEQ ID NO: 92613 - DNA, 201 bp, Bos taurus
aaacatgatctccaataaaactaggaaacatgaaatgtaagtggaagagaggcctgaggagagacaattaaattggagaaagagggtaaaatataaggcatgaggttacaaaactcaaaaagatgtggggagtacatttcttcaactgcacttactgaggtataaaatttaaaccacattcccaacaacaagaacaaggga

SEQ ID NO: 92614 - DNA, 201 bp, Bos taurus
gtcttttgagcatctttccatgtgcttatttccatcatataccttcttggtggaatatctgttcatatctattgtccatttttgattgggtggtttgttttcttattactgagttttcacagtaattttgttttttgctttggccttttatagttgttctggatagaactccttctatggatactgattttgatagcttct

SEQ ID NO: 92615 - DNA, 201 bp, Bos taurus
gggggtggggaatgaaaaccctaagggaaccatggacaggcccaggccccatctctggatcctggtcagactgcctggcccctttttgtggacattgagccttgctgttcagtgggcaggtcaccctccttgagggtgggttcccgaccctgttgccttatactattttcagcccaagtaagagcaggattttccactcct

SEQ ID NO: 92616 - DNA, 201 bp, Bos taurus; identical to SEQ ID NO: 10922

SEQ ID NO: 92617 - DNA, 201 bp, Bos taurus
ggcttacacacccactgtgttccctgcagagtgaggaacctaaaaaccctgaaccttggactaatttggtcactgccggttctcagtgctctcacggcccgctctgaactctctctctttgtttctccctcctgtctctagttttttctagtcctggctctggtgtctctcacagaggctgcagtcagtgggcagggagag

SEQ ID NO: 92618 - DNA, 201 bp, Bos taurus; identical to SEQ ID NO: 10923

SEQ ID NO: 92619 - DNA, 201 bp, Bos taurus
aaccctgaacagcttccaaactataggtcctagttccaccctcacagaacatgtctgtttcccctgctccagcacaacaatccacagatatgatatcagtcattcttcctgaattttttcttgttcaaatccagactcaattctttcaactcttccccatcctaaccacccatctttggccagaattcccaatttataaat

SEQ ID NO: 92620 - DNA, 201 bp, Bos taurus
ctgggctaccataaggatcaaatgaggactattccttattgcactcaactctaatctaatgattaaccttgtctttctggaacacacagaaaactaggaagtaagtttaaagaaagcctctttagaaccaaaataactgcctctcattcttcacactttattactgataccagtagagttcctggagcctcaatcttcctt

SEQ ID NO: 92621 - DNA, 201 bp, Bos taurus
ccagtggatctttccgacccaggaatcgaaccgggttctcctgcattgcaggaggattatttaccaactgagctatcagggaaaccgataatacatagtatggcagatcaaatagccgaattgtctgcaaattattggggcaaaacagagatggcagtgaaagtgacatttgagctgtaataagaacggaaactgagagga

SEQ ID NO: 92622 - DNA, 201 bp, Bos taurus; identical to SEQ ID NO: 10925

SEQ ID NO: 92623 - DNA, 201 bp, Bos taurus
tgctgagtagtatttcactgtatggaggtgccaggttttctttaacctttcactactttttagttggtgttgtttgggttggatgtttggtttattttcaagttctttattgcaaataaagctgctatgaacactattcttggtaaagacagtattggattaaatacgatccttggtttatgatacaatgtcatcactggt

SEQ ID NO: 92624 - DNA, 201 bp, Bos taurus; identical to SEQ ID NO: 10926

SEQ ID NO: 92625 - DNA, 201 bp, Bos taurus; identical to SEQ ID NO: 10927

SEQ ID NO: 92626 - DNA, 201 bp, Bos taurus; identical to SEQ ID NO: 10928

SEQ ID NO: 92627 - DNA, 201 bp, Bos taurus; identical to SEQ ID NO: 10929

SEQ ID NO: 92628 - DNA, 201 bp, Bos taurus; identical to SEQ ID NO: 10932

SEQ ID NO: 92629 - DNA, 201 bp, Bos taurus; identical to SEQ ID NO: 10934

SEQ ID NO: 92630 - DNA, 201 bp, Bos taurus
ggttttcatggctaaatggtaaaaaaaaattcacaaagacctgtgtggtctgtgtcctgagggaagagaacaagggggcgtatggcagtcaatggccagacggtggggagccagaccagctgtgctgagcagccccttctcattcctccattcttcaggccaagagtcaggccgggaaggtctgggcaggacaaaggctta

SEQ ID NO: 92631 - DNA, 201 bp, Bos taurus; identical to SEQ ID NO: 10936

SEQ ID NO: 92632 - DNA, 201 bp, Bos taurus
tctgggtatggtgtcccatgtataaagatgcagagcaaatattaggattgatgtttgaaagagatttggaggttctgtgggccgtgtagtatggcacatatacatatcttagcacagaggtgtaaagcctttagtagtgcaaggcagggacaggccttcatctggaggcaggcactcttctggatacagaagagaagcgtg

SEQ ID NO: 92633 - DNA, 201 bp, Bos taurus; identical to SEQ ID NO: 10937

SEQ ID NO: 92634 - DNA, 201 bp, Bos taurus; identical to SEQ ID NO: 10938

SEQ ID NO: 92635 - DNA, 201 bp, Bos taurus
caactaccatgtatctaagaggggaagactgttccaggccaagaagtaggaaaacatgaaggtaggcgtgtacttgaggttttcaaggaatggctaagaatttagtatggccggagtggagtgagtggtttgagattttgacaagcttgacagagatagggaaaaaggaactgaggatcaggacagcagaggaaatgacct

SEQ ID NO: 92636 - DNA, 201 bp, Bos taurus
agcacacactccaggcgcttgttcaacagaggctgagttttctgcacagacgctggtgggaggcccacgctaggatgccccaccaacggccctcggccccatatcagctctgtgaccacaggaaaggtccttcccatcttggaatttcctcatctgcaaaacagattgagagcccagaagactaatctccaggttccctcc

SEQ ID NO: 92637 - DNA, 201 bp, Bos taurus
tggttgaagggctggggaggcccccacacaggacactttggctccaggaaggagccccgtgttcacaatagggaagagagccaagaaagtaggaagagaccgggacagtgggcctggagagtgtggcggggttgggaaggattccagagccttgacagaagtgccaggacagtcacaggggaaggtgcccagctctctgga

SEQ ID NO: 92638 - DNA, 201 bp, Bos taurus; identical to SEQ ID NO: 10939

SEQ ID NO: 92639 - DNA, 201 bp, Bos taurus
aaccatagaaacggggtgggaaggactgtggcaccctggacccccaacttagtttctgctgccctttttactgaacacctgctgcaggccagtccttcatctcctgtggcaaatgagggtaaagataaccacagacagcctcaggtatctttagtctcaactactgacttggaaactgaggctcagagaggttaaataact

SEQ ID NO: 92640 - DNA, 201 bp, Bos taurus
cacccacagagctgaggatgtccagggccatgttgaccatctcagcagcgtgccggctcccgttgtgcctgggcactcccgaggccaccatgtaagcatctccgatggtctccacctagaagtcatagccttcatgctccagtacaagcactcccctccctggactgatccacgtgccacacaaggctgcctctcaagaac

SEQ ID NO: 92641 - DNA, 201 bp, Bos taurus; identical to SEQ ID NO: 10940

SEQ ID NO: 92642 - DNA, 201 bp, Bos taurus; identical to SEQ ID NO: 10941

SEQ ID NO: 92643 - DNA, 201 bp, Bos taurus; identical to SEQ ID NO: 10942

SEQ ID NO: 92644 - DNA, 201 bp, Bos taurus; identical to SEQ ID NO: 10943

SEQ ID NO: 92645 - DNA, 201 bp, Bos taurus; identical to SEQ ID NO: 10944

SEQ ID NO: 92646 - DNA, 201 bp, Bos taurus; identical to SEQ ID NO: 10946

SEQ ID NO: 92647 - DNA, 201 bp, Bos taurus
tgtatctatctctaggtacaattgggaccctgaaaatgtaaagaagctgaggaaagaaggatgtgtgagccgtaaaggatatgaaacccaaagtttggctgcaaaagctgggtcacgaagccattactaaccgccatctcagcaacagtgcagaacacaggactatatctgcctgaagccctctttatccaggagaattaa

SEQ ID NO: 92648 - DNA, 201 bp, Bos taurus; identical to SEQ ID NO: 10951

SEQ ID NO: 92649 - DNA, 201 bp, Bos taurus; identical to SEQ ID NO: 10952

SEQ ID NO: 92650 - DNA, 201 bp, Bos taurus; identical to SEQ ID NO: 10953

SEQ ID NO: 92651 - DNA, 201 bp, Bos taurus
catattttgcttcagagtttagagatgccaaccataattaaacccagatgcacacatccagtcgctgcttactgtaaaaggggaaaagctctaggcccaattttaaattttctcaaactgcccaattttttaatgtcaaagaagaaaataaaaaccctcatccttaatatttatccgagaatgaacaacattgaggaagaa

SEQ ID NO: 92652 - DNA, 201 bp, Bos taurus; identical to SEQ ID NO: 10954

SEQ ID NO: 92653 - DNA, 201 bp, Bos taurus; identical to SEQ ID NO: 10955

SEQ ID NO: 92654 - DNA, 201 bp, Bos taurus
cagaagcctctttggaactcagaagaaagtgaagaactcctttctgtttctaggtggtcgaaacagtaccatgctttctgagaccaccacttaatgactttgatgaaccctgctgagatgttctcaggctgcttggggtcaaatgccatctcctctcactttcagcttcatgtttcacaatcaaccatgtttccttacaga

SEQ ID NO: 92655 - DNA, 201 bp, Bos taurus; identical to SEQ ID NO: 10956

SEQ ID NO: 92656 - DNA, 201 bp, Bos taurus
gttagtccaaagggctggtcagggctgcagtgcacggtaaccttcattgaactggatatattggcagtttgcaccagaggtagtctcagctgcattgagggaggtcacgtttaaaacaccatctctccctgtcaatgccacttggcctaatcacacgctgtcaccaaagagaaatgactacagtgatagatctcttggcag

SEQ ID NO: 92657 - DNA, 201 bp, Bos taurus; identical to SEQ ID NO: 10959

SEQ ID NO: 92658 - DNA, 201 bp, Bos taurus; identical to SEQ ID NO: 10960

SEQ ID NO: 92659 - DNA, 201 bp, Bos taurus; identical to SEQ ID NO: 10962

SEQ ID NO: 92660 - DNA, 201 bp, Bos taurus; identical to SEQ ID NO: 10965

SEQ ID NO: 92661 - DNA, 201 bp, Bos taurus; identical to SEQ ID NO: 10966

SEQ ID NO: 92662 - DNA, 201 bp, Bos taurus; identical to SEQ ID NO: 10967

SEQ ID NO: 92663 - DNA, 201 bp, Bos taurus; identical to SEQ ID NO: 10968

SEQ ID NO: 92664 - DNA, 201 bp, Bos taurus; identical to SEQ ID NO: 10969

SEQ ID NO: 92665 - DNA, 201 bp, Bos taurus
ctagttacatacaaaattcatgtagaatcacaattagtcacatggtagtcaaagatttcatacatcactgaaatttctggaatcatatatccattttctgagtccaatgaatgcctgcctcatcttcattatgtcaataccatttaccattaatatgagcctaaaatacatatgtgcctcagaatgacccacttcaaacat

SEQ ID NO: 92666 - DNA, 201 bp, Bos taurus; identical to SEQ ID NO: 10972

SEQ ID NO: 92667 - DNA, 201 bp, Bos taurus; identical to SEQ ID NO: 10973

SEQ ID NO: 92668 - DNA, 201 bp, Bos taurus; identical to SEQ ID NO: 10975

SEQ ID NO: 92669 - DNA, 201 bp, Bos taurus; identical to SEQ ID NO: 10976

SEQ ID NO: 92670 - DNA, 201 bp, Bos taurus; identical to SEQ ID NO: 10977

SEQ ID NO: 92671 - DNA, 201 bp, Bos taurus; identical to SEQ ID NO: 10978

SEQ ID NO: 92672 - DNA, 201 bp, Bos taurus; identical to SEQ ID NO: 10979

SEQ ID NO: 92673 - DNA, 201 bp, Bos taurus
tcatatctttagtgctagaaatcgggttgatcaaatcataaaagttttaacagaactttagaaattggataagccttttggattatctggtttaacttcccgctcattgaagctctctataagaaaccctgcaagataatttttaaatctataaatctgtaaattaaggaaatagaacttcctgggactgatctgaatgac

SEQ ID NO: 92674 - DNA, 201 bp, Bos taurus
tttagtgcagatcccttaaggaaatacgggctaatgaaactgacttgatgatattgccaagtgttaggaatggcatttttaaaaggggagaaaatggacaaaagactcctttgttgtcacttggctgtgatttgtggtattgattctggcctttggctgaatcttgaactaagtgcagcggaggtccaagtaccttaacct

SEQ ID NO: 92675 - DNA, 201 bp, Bos taurus; identical to SEQ ID NO: 10980

SEQ ID NO: 92676 - DNA, 201 bp, Bos taurus
tactctttgcgactccatggactgtagcccaccaggctcctcagtccatggaattctccaggcaagagtactggagtgggttgccatttccttctccatggaactgctaggaagaagcaaaaatagtctacagggaggagacaaagggaggcaggacaagggtagaaacaagctgcatcatctctttccagtcataaatat

SEQ ID NO: 92677 - DNA, 201 bp, Bos taurus; identical to SEQ ID NO: 10982

SEQ ID NO: 92678 - DNA, 201 bp, Bos taurus; identical to SEQ ID NO: 10983

SEQ ID NO: 92679 - DNA, 201 bp, Bos taurus; identical to SEQ ID NO: 10984

SEQ ID NO: 92680 - DNA, 201 bp, Bos taurus
tttgagaatctgctatatgaggaggcactggtgatgcagaaatgaataagacattatttctattttaaggagctcactatttaataattaaagggatttgcccaatctgtattacagggtaaattcagttgagtaaatccagttggctaaatatgaatttcaaaattgatcagaagtagaaaagacctctgtcaaagactt

SEQ ID NO: 92681 - DNA, 201 bp, Bos taurus
taaaaggaaacatatgttttattatgctcttttagattggatatgaatatgtatggttaccataaccatgggccaagaagaaaactggttatggtagatataacattctgatactctctaactcaaaggacatggtattattcagaaccatatataaatatcaaaagcaaaatgtacttatttctagatacccttttcaaa

SEQ ID NO: 92682 - DNA, 201 bp, Bos taurus; identical to SEQ ID NO: 10985

SEQ ID NO: 92683 - DNA, 201 bp, Bos taurus
tgtttcaaatacttttgcatgaatatgtattatcttcatattttttaaaaaatgttctgaaatcctgggcaaaaataagttaggaggccttctcgtttggcccaatgttttcatgggacagtacgatgggccctggtgacaacactcttctccctgggggtgctgggccctgtgggggcccccaaggccatccaacttggt

SEQ ID NO: 92684 - DNA, 201 bp, Bos taurus; identical to SEQ ID NO: 10986

SEQ ID NO: 92685 - DNA, 201 bp, Bos taurus; identical to SEQ ID NO: 10988

SEQ ID NO: 92686 - DNA, 201 bp, Bos taurus
cttattgataaaaatataattaaactaagatatatggctaaaacttatattcagatatagtatcttacaattctgtaaatttaaaaagggttggttttctagaagtttttcttctgtcaaggttacaaagtagaacaaacttctatgtctttccacatttttcaacaactgaaaccatggagccattgtaatcagctaagt

SEQ ID NO: 92687 - DNA, 201 bp, Bos taurus; identical to SEQ ID NO: 10989

SEQ ID NO: 92688 - DNA, 201 bp, Bos taurus; identical to SEQ ID NO: 10991

SEQ ID NO: 92689 - DNA, 201 bp, Bos taurus; identical to SEQ ID NO: 10992

SEQ ID NO: 92690 - DNA, 201 bp, Bos taurus; identical to SEQ ID NO: 10993

SEQ ID NO: 92691 - DNA, 201 bp, Bos taurus; identical to SEQ ID NO: 10994

SEQ ID NO: 92692 - DNA, 201 bp, Bos taurus; identical to SEQ ID NO: 10996

SEQ ID NO: 92693 - DNA, 201 bp, Bos taurus; identical to SEQ ID NO: 10998

SEQ ID NO: 92694 - DNA, 201 bp, Bos taurus; identical to SEQ ID NO: 10999

SEQ ID NO: 92695 - DNA, 201 bp, Bos taurus; identical to SEQ ID NO: 11000

SEQ ID NO: 92696 - DNA, 201 bp, Bos taurus; identical to SEQ ID NO: 11002

SEQ ID NO: 92697 - DNA, 201 bp, Bos taurus; identical to SEQ ID NO: 11003

SEQ ID NO: 92698 - DNA, 201 bp, Bos taurus
gagagagagacattagcaacactaattttttcattgggaggcttatcgcatgattcaacaaatgtttgtctaccaaacatttgctcttcccatctttctgtgaattgctgtccttccctttcaagtgccagacccctacactcctctccttagctcaaagttggcctataagcctctattcccgggctgcatgggaagagt

SEQ ID NO: 92699 - DNA, 201 bp, Bos taurus; identical to SEQ ID NO: 11005

SEQ ID NO: 92700 - DNA, 201 bp, Bos taurus; identical to SEQ ID NO: 11006

SEQ ID NO: 92701 - DNA, 201 bp, Bos taurus; identical to SEQ ID NO: 11007

SEQ ID NO: 92702 - DNA, 201 bp, Bos taurus; identical to SEQ ID NO: 11008

SEQ ID NO: 92703 - DNA, 201 bp, Bos taurus; identical to SEQ ID NO: 11009

SEQ ID NO: 92704 - DNA, 201 bp, Bos taurus; identical to SEQ ID NO: 11010

SEQ ID NO: 92705 - DNA, 201 bp, Bos taurus; identical to SEQ ID NO: 11011

SEQ ID NO: 92706 - DNA, 201 bp, Bos taurus; identical to SEQ ID NO: 11012

SEQ ID NO: 92707 - DNA, 201 bp, Bos taurus
ccaatagcaatagctgtctgggcccaggctttcatgcgcttatcaagctatttggaaggaactgaggcttggaaaggagatgtgacttaacagtgggctcaggctgggccggcagagagaggaaggacaaagaggaggcggggagactcttctggtgccccaccagcaaaggcggtgggctccggaggacaatgtggacat

SEQ ID NO: 92708 - DNA, 201 bp, Bos taurus; identical to SEQ ID NO: 11017

SEQ ID NO: 92709 - DNA, 201 bp, Bos taurus
ccaatcttccctttgagcttgccaataattcctcttctcgtttatgtctttcaccatccttctacccggataactgaaactgaagtggcctctgtgaaacggaattagtgtggaagggacaaaaaggtaaagggttgtttcagtgcttcaccccacgcacttcactcaccttacggtcacaatctggcctccgtctaggac

SEQ ID NO: 92710 - DNA, 201 bp, Bos taurus
cctgtaagagcttgcacttcatactttatcacattcaaattgcctccttaacgtttgaatatcttccccattaggctttaaactctgtgagggaaggcccgtatctactcctggatccaatatttattaggtgctcattcagatttcattggggcttccctggtagcttagctggttaagaatctgcctgcaatgcaggag

SEQ ID NO: 92711 - DNA, 201 bp, Bos taurus; identical to SEQ ID NO: 11018

SEQ ID NO: 92712 - DNA, 201 bp, Bos taurus
agaaaagaaagctgggcgaatgacatttatctccccatcccccagacgaggaaccctaaggatgggagaagttaggtatccccatggccagacagccaggaagtcggaaggtggcagatgactgttctagctgtagagcagtggttgccatgggacgtcggagtcccctctcagtatgggtctcaaccttagagtcaccag

SEQ ID NO: 92713 - DNA, 201 bp, Bos taurus
catcccagaacacttagtagtaaatctctcctaagctgtcatcaactgatcccaacgcaagaattcagaaatttgcaaagattttctcctttatccttttgctcaactacaactgacagtcccaagcaaagatgcaccccataactttgacaatgaaataattgagaaactaatgtacaaacagattcttctattttgggt

SEQ ID NO: 92714 - DNA, 201 bp, Bos taurus; identical to SEQ ID NO: 11020

SEQ ID NO: 92715 - DNA, 201 bp, Bos taurus; identical to SEQ ID NO: 11021

SEQ ID NO: 92716 - DNA, 201 bp, Bos taurus; identical to SEQ ID NO: 11025

SEQ ID NO: 92717 - DNA, 201 bp, Bos taurus
ctatttgaagattttcttcattgagactgactgtaagggttttacaatcctatctctgaaatattgtttcaactgccttggtgatccttttgatgcaagatggtagttggtctgagcacctaaaaagacagctatgctgctgctaagtcgcttcagtcatgtccaactctgtgcgaccccatagatggcagcccaccaggc

SEQ ID NO: 92718 - DNA, 201 bp, Bos taurus; identical to SEQ ID NO: 11028

SEQ ID NO: 92719 - DNA, 201 bp, Bos taurus; identical to SEQ ID NO: 11029

SEQ ID NO: 92720 - DNA, 201 bp, Bos taurus; identical to SEQ ID NO: 11030

SEQ ID NO: 92721 - DNA, 201 bp, Bos taurus; identical to SEQ ID NO: 11031

SEQ ID NO: 92722 - DNA, 201 bp, Bos taurus; identical to SEQ ID NO: 11033

SEQ ID NO: 92723 - DNA, 201 bp, Bos taurus
ttacttttaattatatttttattctgttgcttttagaagggagaagttggttataaatgctgttttaaacctcttctgttattttgtgaagtcttaaaccatgttcccatacttgagagatttccttattcttttatttttatctgaacattctctcttttttcttctcctgctttggctttgttcaattttaaatcagtt

SEQ ID NO: 92724 - DNA, 201 bp, Bos taurus; identical to SEQ ID NO: 11036

SEQ ID NO: 92725 - DNA, 201 bp, Bos taurus; identical to SEQ ID NO: 11037

SEQ ID NO: 92726 - DNA, 201 bp, Bos taurus; identical to SEQ ID NO: 52275

SEQ ID NO: 92727 - DNA, 201 bp, Bos taurus; identical to SEQ ID NO: 11038

SEQ ID NO: 92728 - DNA, 201 bp, Bos taurus; identical to SEQ ID NO: 11041

SEQ ID NO: 92729 - DNA, 201 bp, Bos taurus; identical to SEQ ID NO: 11043

SEQ ID NO: 92730 - DNA, 201 bp, Bos taurus; identical to SEQ ID NO: 11045

SEQ ID NO: 92731 - DNA, 201 bp, Bos taurus; identical to SEQ ID NO: 11047

SEQ ID NO: 92732 - DNA, 201 bp, Bos taurus; identical to SEQ ID NO: 11048

SEQ ID NO: 92733 - DNA, 201 bp, Bos taurus
ctatagaaattatttagtatgtcaatctttgccatttaagagctgatcaggatatcctagtgaatgaaatgaagctgtctctcctgtttgtcccacataagcaaacacttcatggaaactttggagactggcactggaaaagaaatttggatgattatcccatgcttctcatagttaaagattgtttactatgaaaaaact

SEQ ID NO: 92734 - DNA, 201 bp, Bos taurus
ctatcttttaatccagtaacagctattctttccatttcatgctgaaaatttctgatgattaggaatctatggaaaatagtagttaaaatagcattattaagactatcacatgaaagagacattctaatttcagagaagttacagtgtgaaaagaaaatatttctaagaaataaacaaaatttctgaacattttaatgacag

SEQ ID NO: 92735 - DNA, 201 bp, Bos taurus
taaatggacaataagaaaatacattcatccacatatccatgcttgtatgtttgtgggtacataaacaaaaggaatatcgtggtacaaaataaaactaaagtcagagaacaacacaactttttatcaaataagtaatatatctattacacatacacccaaattgattcttaattatatgcattcaatttaaaaaaaaaagtg

SEQ ID NO: 92736 - DNA, 201 bp, Bos taurus
ttgttattgagagacttttaaatggctgcgtcctcagattaaaagcagtatacatgtgtctctactacatggtacttaatatttactaagctttctttcctttcaactcataaaagtactagttaaaatcatcttctcaggaaacatcacaatgcaggatgctgcagaagtaaaacagtttaaatcatttacatctcatgt

SEQ ID NO: 92737 - DNA, 201 bp, Bos taurus
tgttcctctttaggaaagtcagaaagcaaaccagtattgtggctatctgagaattcattgccccttaattctttatcaagggtccaatataaatctcagtaagagattatgtacatgtcagatccatttatataacagctgagtcgatttggagacataaagctaaaataagaacatctcaggaagctgtctgtatatatt

SEQ ID NO: 92738 - DNA, 201 bp, Bos taurus
taccataggaaggaaaaatatcctatgaatcacagaaagagacttctcagagcaaagatataaaatcttttcagaaatattaataaatttaatagaaacacgacttttgaatattccaatgaacatggattagtaggtattaattttgcagtcaaaaaatagagaatacgtttatttcaagttcttgtggctcattttcca

SEQ ID NO: 92739 - DNA, 201 bp, Bos taurus
cttttgatgacacatgtcacatcccttttcaatgatgtctcagcactttgctgttttgtggaaaattttagaacaatcctaactcctttaatatacttggcagaatcaagccatttcaagccaccatctttttcctgtgccattttcatggatattttgatagctctaaatccaaatacagataatcctatctgtcagatc

SEQ ID NO: 92740 - DNA, 201 bp, Bos taurus
aaactggatgggaccctcaagaaactcatcctaaggaccactcttctaccttcaagaaacttacttgcttcccagttctgtagaaccaccactaccaccatatcactcaaagagacacagttgataatgcttgcctgagagcattctagaagttgtatgaaatcctgtatttaaaagctatttcttttttgttattgtttg

SEQ ID NO: 92741 - DNA, 201 bp, Bos taurus; identical to SEQ ID NO: 11050

SEQ ID NO: 92742 - DNA, 201 bp, Bos taurus; identical to SEQ ID NO: 11051

SEQ ID NO: 92743 - DNA, 201 bp, Bos taurus; identical to SEQ ID NO: 11053

SEQ ID NO: 92744 - DNA, 201 bp, Bos taurus; identical to SEQ ID NO: 11054

SEQ ID NO: 92745 - DNA, 201 bp, Bos taurus; identical to SEQ ID NO: 11055

SEQ ID NO: 92746 - DNA, 201 bp, Bos taurus; identical to SEQ ID NO: 11057

SEQ ID NO: 92747 - DNA, 201 bp, Bos taurus; identical to SEQ ID NO: 11059

SEQ ID NO: 92748 - DNA, 201 bp, Bos taurus; identical to SEQ ID NO: 11063

SEQ ID NO: 92749 - DNA, 201 bp, Bos taurus; identical to SEQ ID NO: 11065

SEQ ID NO: 92750 - DNA, 201 bp, Bos taurus; identical to SEQ ID NO: 11066

SEQ ID NO: 92751 - DNA, 201 bp, Bos taurus; identical to SEQ ID NO: 11067

SEQ ID NO: 92752 - DNA, 201 bp, Bos taurus
ctcctttccttcccaactcctagttttcaggtaaggtgtcctgatcatttttcttcacatatccccttcatcttatccatatgattaaaaagggaacagtcgtattttttctggctggactctgactcctggatgcgatttatagacaacagacagacaatagacactccagactggattaatcgaaagtcatccctgaaa

SEQ ID NO: 92753 - DNA, 201 bp, Bos taurus; identical to SEQ ID NO: 11068

SEQ ID NO: 92754 - DNA, 201 bp, Bos taurus; identical to SEQ ID NO: 11069

SEQ ID NO: 92755 - DNA, 201 bp, Bos taurus; identical to SEQ ID NO: 11070

SEQ ID NO: 92756 - DNA, 201 bp, Bos taurus; identical to SEQ ID NO: 11072

SEQ ID NO: 92757 - DNA, 201 bp, Bos taurus; identical to SEQ ID NO: 11073

SEQ ID NO: 92758 - DNA, 201 bp, Bos taurus; identical to SEQ ID NO: 11075

SEQ ID NO: 92759 - DNA, 201 bp, Bos taurus; identical to SEQ ID NO: 11076

SEQ ID NO: 92760 - DNA, 201 bp, Bos taurus; identical to SEQ ID NO: 11077

SEQ ID NO: 92761 - DNA, 201 bp, Bos taurus
gggccaatattctggtttctctttagattgtataaatctttcaccttcttaaaacatgtggactttacaatcatttcaaagttttctatgagatggaaagcaagggaggaagggcccttgaacatttaatgttaatcatatacttcataccatatataaattaatgttcagagtttgttgtgcctctcaaggcctgcacaa

SEQ ID NO: 92762 - DNA, 201 bp, Bos taurus; identical to SEQ ID NO: 11080

SEQ ID NO: 92763 - DNA, 201 bp, Bos taurus
tactgtatggggcatttgttaccaagaggaccagtttcactggaaggagtgggtccttgattagctcatcaaggaggccaaatagatggaaagaaaataacacatgaagtcaccaagcctgggagacctgagccacgtagagagatgagagccctctctgtgtgagccctctgtggcctggagctgacaagacttgctgat

SEQ ID NO: 92764 - DNA, 201 bp, Bos taurus
aaagcagacctaatgaggctcacagagcctgatgactcgtccaaggtcgcataatgggcaagttgtgtaaacaagcaggaacccgggtcttctacccacagagtgtcttgactggcttatgcagtattatgggagccattgagcctcctccaggctgaaacatttccactcttctgagcatatggtacaagcttgagacaa

SEQ ID NO: 92765 - DNA, 201 bp, Bos taurus; identical to SEQ ID NO: 11083

SEQ ID NO: 92766 - DNA, 201 bp, Bos taurus; identical to SEQ ID NO: 11084

SEQ ID NO: 92767 - DNA, 201 bp, Bos taurus; identical to SEQ ID NO: 11085

SEQ ID NO: 92768 - DNA, 201 bp, Bos taurus
tcgcaaaagagtcagacacgactaagcggctaaacaacaccaacagggagaaggcagtttgtcaaatgtgatgttcgcggagcctctgcctggccgtccagcttcgaggcatccaggctgtggaagtgcttgaaaacatccacacagaaatgagtgcaccaaggggcccatggccacaaggtggtaacagccagaaatgga

SEQ ID NO: 92769 - DNA, 201 bp, Bos taurus; identical to SEQ ID NO: 11086

SEQ ID NO: 92770 - DNA, 201 bp, Bos taurus; identical to SEQ ID NO: 11087

SEQ ID NO: 92771 - DNA, 201 bp, Bos taurus; identical to SEQ ID NO: 11088

SEQ ID NO: 92772 - DNA, 201 bp, Bos taurus; identical to SEQ ID NO: 11089

SEQ ID NO: 92773 - DNA, 201 bp, Bos taurus; identical to SEQ ID NO: 11090

SEQ ID NO: 92774 - DNA, 201 bp, Bos taurus; identical to SEQ ID NO: 11091

SEQ ID NO: 92775 - DNA, 201 bp, Bos taurus
cttcctgtgaaccgtggatcaggctgttcttctcacaatggatctgcaaggtgggagccctaggaagctgacccctgggcgctaacgggtaggactggcccgggagttaatggacatgactttagggaagtgagggtgtccttcagaactggtttgtgagcttgggggtggaggacacagctgaggctgactctacaaagg

SEQ ID NO: 92776 - DNA, 201 bp, Bos taurus
gcttaggcctttgatatcatggtctgccccacatctaagagttaagagttattcttgccaggcagctgtttttgaagttcctcggaatgttaagcagtgcgtgaggccccattcaagctcttgatcagggaaatggagagatgatcatcgtgaacttaaagctggggctctgggatcagctgctgcctgcctacaaaacct

SEQ ID NO: 92777 - DNA, 201 bp, Bos taurus; identical to SEQ ID NO: 11092

SEQ ID NO: 92778 - DNA, 201 bp, Bos taurus
gttcatctgaagctttcctgggctgaaatatctggcagactgtgggcaggaggcctctgtttctcactgccttggcctctctgcaggacagcttgacttacattttgatgcggctctgggctttcaccagggtgagtgatccaaggaagagcagggaggaggccacagtgccttttgtgacacagtcctaaaagtgacacc

SEQ ID NO: 92779 - DNA, 201 bp, Bos taurus; identical to SEQ ID NO: 11093

SEQ ID NO: 92780 - DNA, 201 bp, Bos taurus
catcgtgttaatgtcccatgtcccacctcctcaggactctgttccgggcactctaaagaggactgtaggaactccacggtgctcttggcagggtctgtgattggcctcctgcttcctctgaggctgaggacccctggagaggtgggtcagtggcatccgctccatccgctctgccacctgaaatgagagtgatgaggaagc

SEQ ID NO: 92781 - DNA, 201 bp, Bos taurus; identical to SEQ ID NO: 11094

SEQ ID NO: 92782 - DNA, 201 bp, Bos taurus; identical to SEQ ID NO: 11095

SEQ ID NO: 92783 - DNA, 201 bp, Bos taurus; identical to SEQ ID NO: 11096

SEQ ID NO: 92784 - DNA, 201 bp, Bos taurus
taaaatttccttcaacttttagcagacaagcacataacccaaaatggaagaagccaagttgattttcttggtatatgatgaaagaaatgctagttgctaaaagggaaaaaaaatctgaagaaacaaactccatattgtaggagcttaaaatctggggaagaggacgagagctacaaacaggaaaacagttacagaaaatac

SEQ ID NO: 92785 - DNA, 201 bp, Bos taurus
tctatggggtcgcacagagtcaacttagcagcagtagcagcagtctctactttgaaggactgtgtatgtgtgccagggagagatttctgggagggaggcacaggcccagcagggattattcacaggggatatctaatagcagaggtctcttggaaatgcagagccttaattcttctccaaggaatagtaatataacagata

SEQ ID NO: 92786 - DNA, 201 bp, Bos taurus
ggccctcagtccgctcgagagggggcagctggctgccactcgcggccatgccctcaaaggtgccggggacctgccaggaggcgctggcctcgccagaggagtagttaggtgtgcttctttcccagcgcagagtgtcgttgttgaaggtcagcagattgtggcaagcgcggcagcggttcaagtggccacgggacaggttgg

SEQ ID NO: 92787 - DNA, 201 bp, Bos taurus; identical to SEQ ID NO: 11097

SEQ ID NO: 92788 - DNA, 201 bp, Bos taurus; identical to SEQ ID NO: 11098

SEQ ID NO: 92789 - DNA, 201 bp, Bos taurus; identical to SEQ ID NO: 11101

SEQ ID NO: 92790 - DNA, 201 bp, Bos taurus; identical to SEQ ID NO: 11102

SEQ ID NO: 92791 - DNA, 201 bp, Bos taurus; identical to SEQ ID NO: 11103

SEQ ID NO: 92792 - DNA, 201 bp, Bos taurus; identical to SEQ ID NO: 11104

SEQ ID NO: 92793 - DNA, 201 bp, Bos taurus; identical to SEQ ID NO: 11105

SEQ ID NO: 92794 - DNA, 201 bp, Bos taurus; identical to SEQ ID NO: 11106

SEQ ID NO: 92795 - DNA, 201 bp, Bos taurus
aacagctcatttccatcattactgacatatccatagttactgactctccaatcagccggaggcattttataagacacatgacatcccgagcaacatccacgtctgtaagaggaaggtgacattcacgtctcaggtcaatgaagagctgctagttaatattatactaaaagatattaagaatacatgacaggtagctatcta

SEQ ID NO: 92796 - DNA, 201 bp, Bos taurus; identical to SEQ ID NO: 11107

SEQ ID NO: 92797 - DNA, 201 bp, Bos taurus
ctccttcctcatgacctttgccacgggtggagtacctcacgctggcccccaacatcttacctgtgcttctatttcctcatctgtataaaaaaagcagtgactataataatatccacattacaggcctgttgtgagaattaaatgaattaatgtatgtatagcaaatggcaagtactattgcaatgctagctataattatta

SEQ ID NO: 92798 - DNA, 201 bp, Bos taurus; identical to SEQ ID NO: 11112

SEQ ID NO: 92799 - DNA, 201 bp, Bos taurus; identical to SEQ ID NO: 11114

SEQ ID NO: 92800 - DNA, 201 bp, Bos taurus; identical to SEQ ID NO: 11115

SEQ ID NO: 92801 - DNA, 201 bp, Bos taurus; identical to SEQ ID NO: 11116

SEQ ID NO: 92802 - DNA, 201 bp, Bos taurus; identical to SEQ ID NO: 11117

SEQ ID NO: 92803 - DNA, 201 bp, Bos taurus; identical to SEQ ID NO: 11118

SEQ ID NO: 92804 - DNA, 201 bp, Bos taurus; identical to SEQ ID NO: 11119

SEQ ID NO: 92805 - DNA, 201 bp, Bos taurus; identical to SEQ ID NO: 11120

SEQ ID NO: 92806 - DNA, 201 bp, Bos taurus; identical to SEQ ID NO: 11121

SEQ ID NO: 92807 - DNA, 201 bp, Bos taurus; identical to SEQ ID NO: 11122

SEQ ID NO: 92808 - DNA, 201 bp, Bos taurus; identical to SEQ ID NO: 11123

SEQ ID NO: 92809 - DNA, 201 bp, Bos taurus; identical to SEQ ID NO: 11124

SEQ ID NO: 92810 - DNA, 201 bp, Bos taurus; identical to SEQ ID NO: 11125

SEQ ID NO: 92811 - DNA, 201 bp, Bos taurus
gtctgtgttcagacagtaatatttccttttatcttttttcatctttcttctcaattctcaatgacttatctttttctgttttaactgttactaatggtcatctccgctccttttatttccataatattttattcaccgctcactccgatacgtctttccttcagttgttctaaagccttttattttcctcacatccaaata

SEQ ID NO: 92812 - DNA, 201 bp, Bos taurus; identical to SEQ ID NO: 11126

SEQ ID NO: 92813 - DNA, 201 bp, Bos taurus; identical to SEQ ID NO: 11127

SEQ ID NO: 92814 - DNA, 201 bp, Bos taurus; identical to SEQ ID NO: 11129

SEQ ID NO: 92815 - DNA, 201 bp, Bos taurus
cgattgcttctccgggccaggcatgcgtcctgcttctcttttccccaaggtttctccagggttaaagatgaaaggggaaccttgatgaagctcctgaccccgggaggtggccacaatgggccttgtctttcccttggtgaataggctcccgtgtacccttgctgggtaaagtgtgtggtgtggggagccctgtgttcacag

SEQ ID NO: 92816 - DNA, 201 bp, Bos taurus; identical to SEQ ID NO: 11130

SEQ ID NO: 92817 - DNA, 201 bp, Bos taurus; identical to SEQ ID NO: 11131

SEQ ID NO: 92818 - DNA, 201 bp, Bos taurus; identical to SEQ ID NO: 11133

SEQ ID NO: 92819 - DNA, 201 bp, Bos taurus; identical to SEQ ID NO: 11134

SEQ ID NO: 92820 - DNA, 201 bp, Bos taurus
tcctgactgctttttacatgtattacacttgctcaaaacgtggatggaatatagaagcttacctgtctcttgaaaatagctgcaaatcctgaattttcaggctgatctaaagctcttcaagggtagaatttaaaaattctgtggaaggagctctctgtgtgatgctaaccaaagggtgtccttataattgtcacttacctt

SEQ ID NO: 92821 - DNA, 201 bp, Bos taurus; identical to SEQ ID NO: 11135

SEQ ID NO: 92822 - DNA, 201 bp, Bos taurus
ttaatatatcatgttcaagacttcaatagtctcacaggtaataggatacatagaacaagtaattcccacagagtgggatactgagaaagtcctctataaaaaataaagacatcagagagtaaaagtttaaagtgtaagtccagactaagaatatctgagtgcaaattctatctccgccttgtatgagatgaccgggtattg

SEQ ID NO: 92823 - DNA, 201 bp, Bos taurus; identical to SEQ ID NO: 11136

SEQ ID NO: 92824 - DNA, 201 bp, Bos taurus
aaagatcaaataaaggctttaaagcaggtaaccatgtttggcccagggtagatgcttaatgaatggcagctgtatcagtaatagtaacaatattattgtatactaggccaaagaagagagagagggacctggggggcacagggcgggtggtaaaaagatggactgattgaacgtgtgtatgaaataggtcacatcaggcag

SEQ ID NO: 92825 - DNA, 201 bp, Bos taurus; identical to SEQ ID NO: 11138

SEQ ID NO: 92826 - DNA, 201 bp, Bos taurus; identical to SEQ ID NO: 11141

SEQ ID NO: 92827 - DNA, 201 bp, Bos taurus
gaaactctggaagagggccacagggtgaacccagagtaacgttcttcccttccgaggtgaggaaggtttttgcagccctgagttgtccttcacgcctgtaaacgggagtggtgcccctggccgcggccaccctaccgtgtgatctatgatctcccctccgtttctgtcgtcctttcagccctcacagatggaccctcacct

SEQ ID NO: 92828 - DNA, 201 bp, Bos taurus
ctcaagtattctggcctggagaatcccgtgcacagaggagcctggcaggctacagtccacggggtcgcagtgtcagacatgactgaacagctaacactttcactttcaagggccaccaaattcaactcaactccttttattttatgccagaggcaattcagcattaaagagataaaaatcctgttctcccagcaatcccac

SEQ ID NO: 92829 - DNA, 201 bp, Bos taurus; identical to SEQ ID NO: 11142

SEQ ID NO: 92830 - DNA, 201 bp, Bos taurus; identical to SEQ ID NO: 11143

SEQ ID NO: 92831 - DNA, 201 bp, Bos taurus; identical to SEQ ID NO: 11144

SEQ ID NO: 92832 - DNA, 201 bp, Bos taurus
acagacacagaacgttgtccccctggcctgcagctcttgagccccgccggcttcctggggcgcgcctcctgctcctgctctggaggggaagcgactggcccggtgacacgatgtagctgatttccgagccaaaagtgacatttgggatggtctctggaagggggaatgttcagtggaagggtaacaaaggccttcagggga

SEQ ID NO: 92833 - DNA, 201 bp, Bos taurus; identical to SEQ ID NO: 11145

SEQ ID NO: 92834 - DNA, 201 bp, Bos taurus; identical to SEQ ID NO: 11146

SEQ ID NO: 92835 - DNA, 201 bp, Bos taurus; identical to SEQ ID NO: 11147

SEQ ID NO: 92836 - DNA, 201 bp, Bos taurus; identical to SEQ ID NO: 11148

SEQ ID NO: 92837 - DNA, 201 bp, Bos taurus
tcctcttgagatgacgggggaatcttgtggtttttttcgagctgtggggcgacgtgtgttgtttccctcaagttatgacggggtattcagggagcctctcatatggccccagggaagtccagtctccattcaagttacgagggggagcacggcattgctctcgagtcacggcatgggaatcgggcctcaagacacgttgaa

SEQ ID NO: 92838 - DNA, 201 bp, Bos taurus; identical to SEQ ID NO: 11149

SEQ ID NO: 92839 - DNA, 201 bp, Bos taurus; identical to SEQ ID NO: 11150

SEQ ID NO: 92840 - DNA, 201 bp, Bos taurus
atcttgcgatgacaggggaatcttgtagtttttttcgagctgtggcgagatgtgtggggtttctcacgagttacgacaggaaaatcagggagcctttcgtatggccacagggaagaccagtctccattagagttgcgagtgggagcgtggcattgctttcaaatcacggcaggggaattgggtctcataacgagttgaagg

SEQ ID NO: 92841 - DNA, 201 bp, Bos taurus; identical to SEQ ID NO: 11151

SEQ ID NO: 92842 - DNA, 201 bp, Bos taurus; identical to SEQ ID NO: 11152

SEQ ID NO: 92843 - DNA, 201 bp, Bos taurus
ccagttctttttccctttttcaagtctttatgaatttgtaacaatagtgcttctgttcagtgttttggccatttggcccctgcagcatgtgggaacttagcgccctgaccagggtctgagcccgcatcccctgcacaggaagatgaagtcccaagcaccggcccgcagggaggcctctaggcccaggccttatctccagcg

SEQ ID NO: 92844 - DNA, 201 bp, Bos taurus; identical to SEQ ID NO: 11153

SEQ ID NO: 92845 - DNA, 201 bp, Bos taurus
atagaaggcgccctcgggccatagaagaaagcctaactctctgatgctggcctttttttctccttacaatgctgaacggagatgaacgcatcggggcctcgtgtctagatatgaattttcctttgtgcagcgctagtcatgatgggaattccatagcaatttatcaccgtaatgactacagattctagagcatcagggtga

SEQ ID NO: 92846 - DNA, 201 bp, Bos taurus
gggaatgagaacctaatctgccttttcttaactaacccatcacccaacaaaactacagttatcccatttcaaaaataaattccaaggaaaaaattctgtacgtggaaacaagaaagcactgagagtgaggaggggaaggcagtcctagaaacgttgatttcagtgataccagctctgtcttgcagctggagcaagaggttt

SEQ ID NO: 92847 - DNA, 201 bp, Bos taurus; identical to SEQ ID NO: 11154

SEQ ID NO: 92848 - DNA, 201 bp, Bos taurus; identical to SEQ ID NO: 11155

SEQ ID NO: 92849 - DNA, 201 bp, Bos taurus; identical to SEQ ID NO: 11156

SEQ ID NO: 92850 - DNA, 201 bp, Bos taurus
gaggggtggggtgagtgccttttgtgtgtgggagggatgtgaacactagtggccagagggcagaggtagccagcctccacgatggcccccagtgatcctgttttcctggtggtcacacctttgtgtagtttcttgcacactgcaccactagcataaaagtgatggcatgccacttccgagatagcttatcaaagactatgg

SEQ ID NO: 92851 - DNA, 201 bp, Bos taurus
agttggtgatagacagggaggcctggcatgttgcagttcatggggttgcaaagagtcagacacaactgagtgactgaactgaactgagggccaggaaagcgctgtgctctttgacctattccagggaggaatcaagaggatcaaggcaacagcctctttggtgtatctggtctgttctgggtgggggacgtttctggagcc

SEQ ID NO: 92852 - DNA, 201 bp, Bos taurus
aataggaggtaggaaagcctacaactgcaggtaagggtaggagagccttgtgtgctctcgagtcagggtaatgcttcactgtgtgtatgtgagcacacgtgggcctgtctcccttgaaggaggaaatgccagcccgctccagtattctggctgagataatgccctggtcagaggagcctggtgggctacagtccacggggt

SEQ ID NO: 92853 - DNA, 201 bp, Bos taurus
gagtccataaaagaccccgagcctccaaacttttctaattattcataaaatatatttgcacgtcctgtaaactcaccgttggatgaaggctctgggcctcctagtctagatttggtctgatgagaccacctgggaaaagacagagatgctttcctcccaagagattctttcatctccttggcctcccaagggttaaccaac

SEQ ID NO: 92854 - DNA, 201 bp, Bos taurus; identical to SEQ ID NO: 11157

SEQ ID NO: 92855 - DNA, 201 bp, Bos taurus; identical to SEQ ID NO: 11158

SEQ ID NO: 92856 - DNA, 201 bp, Bos taurus; identical to SEQ ID NO: 11160

SEQ ID NO: 92857 - DNA, 201 bp, Bos taurus; identical to SEQ ID NO: 11161

SEQ ID NO: 92858 - DNA, 201 bp, Bos taurus; identical to SEQ ID NO: 11162

SEQ ID NO: 92859 - DNA, 201 bp, Bos taurus
tcagaatctgatttttatcaccatttttggagtctcagacaaatttaggatattaaacatgcaactttggaaacacagggcctgacacagaaactctgaaaagtttaagaactcaacgcattctacacctgatattcaaatttgctgtcagcctctaaatcagtgtttctgaaagtgtttgtggcccacctgcatcagaat

SEQ ID NO: 92860 - DNA, 201 bp, Bos taurus
tgccggtaggccccgctgctgatctgtttcaccagcatcttgtggtcctgcccatcaaagggcatggagccatgcaccaggatgtagaggagaacgcccagggaccagctgtccacctgagggagagacggggtcagccaggaggtcctcatgccgcagggcaaacggctccaggctccccttcagtacccacggagggga

SEQ ID NO: 92861 - DNA, 201 bp, Bos taurus; identical to SEQ ID NO: 11163

SEQ ID NO: 92862 - DNA, 201 bp, Bos taurus; identical to SEQ ID NO: 11164

SEQ ID NO: 92863 - DNA, 201 bp, Bos taurus; identical to SEQ ID NO: 11165

SEQ ID NO: 92864 - DNA, 201 bp, Bos taurus; identical to SEQ ID NO: 11166

SEQ ID NO: 92865 - DNA, 201 bp, Bos taurus
caactgcttcaaattgcttagttgttattattttcattggaggttcagtcacacatttggtaatgccaaaaacaactatcttgtaaaacaaacaaagtacgaaaaacatagctagccatattattaaagtcttaagtaagaatgaagccagaacttacactaggtgcatcccagtatattctcaagtcatctgacttagac

SEQ ID NO: 92866 - DNA, 201 bp, Bos taurus; identical to SEQ ID NO: 11167

SEQ ID NO: 92867 - DNA, 201 bp, Bos taurus; identical to SEQ ID NO: 11169

SEQ ID NO: 92868 - DNA, 201 bp, Bos taurus; identical to SEQ ID NO: 11170

SEQ ID NO: 92869 - DNA, 201 bp, Bos taurus
tgcaagtatgctctctgctaacaaaatagtaaacgcctgaaagattgtgaccataccttatattcttttgccattccctcattagttcaaatttggatgtagaacttactgactaaaaagttgggtcatgtggaattttcactaaacatgaaaatctataaattgatagtaaaattaacacagagaaatcttaaaacacta

SEQ ID NO: 92870 - DNA, 201 bp, Bos taurus; identical to SEQ ID NO: 11171

SEQ ID NO: 92871 - DNA, 201 bp, Bos taurus; identical to SEQ ID NO: 11172

SEQ ID NO: 92872 - DNA, 201 bp, Bos taurus
tgtttcggttctgttgtccagagctgttatctgttggaggactccctgcccattttgtaagcacacagctggcaggccctgttgcaatctcgctgccttcggatcagccctgccccggcagcaggcaggcagggggtgggggtggggggcctgggaaacacgcggccaaacagttgtggtgagtgtcaaaataaaagcccc

SEQ ID NO: 92873 - DNA, 201 bp, Bos taurus; identical to SEQ ID NO: 11173

SEQ ID NO: 92874 - DNA, 201 bp, Bos taurus; identical to SEQ ID NO: 11174

SEQ ID NO: 92875 - DNA, 201 bp, Bos taurus; identical to SEQ ID NO: 11175

SEQ ID NO: 92876 - DNA, 201 bp, Bos taurus
cagcccaagagagcaagtgaaccccaatgagatttggcctttgccccctcatgtccaaggcaggaacagtggaccaaagtggcaactctaaacattgggagcaactacaacctggaataaggccagatctgacactgaagtcaccctacacggcccacagcaggtccagagacctttctagaaacattagaggcctttggt

SEQ ID NO: 92877 - DNA, 201 bp, Bos taurus
caggctgtcacagcaatagaaatttatttttacagttctgaagcctggaagtcctagatttaggtctgatagcattcagtcacatggccttccctctgcacatgcatgaggttgagagagagtgagctctgtgatgtctcttcttataagaactctaatgctagtgaatcagggcccctcctttatcacttaatttagcct

SEQ ID NO: 92878 - DNA, 201 bp, Bos taurus
agtgggtagcctttcccttctccaggggatcttcgcaacccagggatctaacccaggtcttctgcattgcaggcagattctttaccagctgaaccacaagggaagaccctgaggcctgttactgagtcctatttgagccttaattcttggtagatcatacagggatcttgtctccagagagaagggcagtctggggtcttt

SEQ ID NO: 92879 - DNA, 201 bp, Bos taurus
aaaaaatggccacagatgcttcctgtccttgtatctacatctttaagaatccctccaatttgaggtagaagctttcttcatcctttgagtttgggctactctgtcatttgctttggccaatgggacaaaagtaacaaatatgatataagcagaaccttgcaaatcactttgtgcattagggttccccttgttgctgctctt

SEQ ID NO: 92880 - DNA, 201 bp, Bos taurus; identical to SEQ ID NO: 11176

SEQ ID NO: 92881 - DNA, 201 bp, Bos taurus; identical to SEQ ID NO: 11177

SEQ ID NO: 92882 - DNA, 201 bp, Bos taurus; identical to SEQ ID NO: 11179

SEQ ID NO: 92883 - DNA, 201 bp, Bos taurus; identical to SEQ ID NO: 11180

SEQ ID NO: 92884 - DNA, 201 bp, Bos taurus; identical to SEQ ID NO: 11181

SEQ ID NO: 92885 - DNA, 201 bp, Bos taurus; identical to SEQ ID NO: 11182

SEQ ID NO: 92886 - DNA, 201 bp, Bos taurus; identical to SEQ ID NO: 11183

SEQ ID NO: 92887 - DNA, 201 bp, Bos taurus; identical to SEQ ID NO: 11186

SEQ ID NO: 92888 - DNA, 201 bp, Bos taurus; identical to SEQ ID NO: 11187

SEQ ID NO: 92889 - DNA, 201 bp, Bos taurus; identical to SEQ ID NO: 11188

SEQ ID NO: 92890 - DNA, 201 bp, Bos taurus; identical to SEQ ID NO: 11189

SEQ ID NO: 92891 - DNA, 201 bp, Bos taurus; identical to SEQ ID NO: 11190

SEQ ID NO: 92892 - DNA, 201 bp, Bos taurus
ccattccaagtaattaacatgatttccttaatccttctatcctaccatcactccatcattctcaaacacatcaccacttcctcaaaatcagactgaaaaccagctgacaaactagccaatatattggagcttcacttaagttattctcttccacctacccaacaaattgctattctctgtgatccttccctgtagttaata

SEQ ID NO: 92893 - DNA, 201 bp, Bos taurus
tggtgctactgttattgcttaaacaaggataaagcagataatgaccagggagatacttcattgtacattatcataagccttacattgataaaccctgtagtacacactcaagggaagatgtcaaatagatcacaaagtggtacttgatagttagcctagtgaccatgactctatttgtaaatctcctgcacagctgggtca

SEQ ID NO: 92894 - DNA, 201 bp, Bos taurus
ctacatatagctaatgctatcacggaccacagaactttactgacacctagaacacaaattttctagcagcttcatggctgggcctcttatctatcatcaacagtaatgttctttgcatctgactgtaaaagtttccaagttacacagtctttccttgatcactttggcccaatttctcctagatcactatgcacaccacag

SEQ ID NO: 92895 - DNA, 201 bp, Bos taurus; identical to SEQ ID NO: 11191

SEQ ID NO: 92896 - DNA, 201 bp, Bos taurus; identical to SEQ ID NO: 11192

SEQ ID NO: 92897 - DNA, 201 bp, Bos taurus
ataacccactgttaattatagttaaacttccccaaagcatcctatttgtatacctttccatgtttaactaatctgcaatagggatattggtataagcttaccagggcaagtcaactctgtgattccctgcatgtttaaatgcagtgaaatataaagaatgaatgaaacatgaataaacaatatcatcatttaagtctctgc

SEQ ID NO: 92898 - DNA, 201 bp, Bos taurus; identical to SEQ ID NO: 11193

SEQ ID NO: 92899 - DNA, 201 bp, Bos taurus; identical to SEQ ID NO: 11194

SEQ ID NO: 92900 - DNA, 201 bp, Bos taurus; identical to SEQ ID NO: 11195

SEQ ID NO: 92901 - DNA, 201 bp, Bos taurus
ttgaaaatcctcaagtagaagctaagcaacaaacttcaggagaggtaatagcagaggagacagcatgggtgtgaatagggccatatgactcacacttctcccaaaaaaagcaatactctgattttatcagtcctcaaagattctcctatgggccaataccattgttatcttactggtattttttccctaaaaatttattcc

SEQ ID NO: 92902 - DNA, 201 bp, Bos taurus
gagaatatttcaggttagacttttactctctgtggccataaattccccccaaattgatagaccagcttcttggcttctgggcagttctgcaaacaggcaatcataggcaaatgctgtacagacataaagcctgaaaaccctggtcttttactcactggacttagtattatggtcaccaccaccatcgccagcatgtaactg

SEQ ID NO: 92903 - DNA, 201 bp, Bos taurus
tacagatagacattcaaggaattttagatccaaatgtgccatgtttatagtctaaattgtgagagttggaaagatggttttattttaggaactagtgagaaattgcttaaaaagcctcaatttgctttggagaacattgattgataagaattttgatgtgggtcttctttgtaacagagagacactgctgttagttaagca

SEQ ID NO: 92904 - DNA, 201 bp, Bos taurus
ctacaaataatatgcaccagaatcactggggagcttgccaagaataagtggtatctcttcacaaaaggaaactttgttatagaaagcatgtcatgtgatatatgaatctgtaccttttaaaaatacataagtatttttagggtgagtgattctagaaccacattttgaaaacaacttcttaaaaccattttcttattctga

SEQ ID NO: 92905 - DNA, 201 bp, Bos taurus; identical to SEQ ID NO: 11197

SEQ ID NO: 92906 - DNA, 201 bp, Bos taurus; identical to SEQ ID NO: 11198

SEQ ID NO: 92907 - DNA, 201 bp, Bos taurus; identical to SEQ ID NO: 11199

SEQ ID NO: 92908 - DNA, 201 bp, Bos taurus; identical to SEQ ID NO: 11200

SEQ ID NO: 92909 - DNA, 201 bp, Bos taurus; identical to SEQ ID NO: 11201

SEQ ID NO: 92910 - DNA, 201 bp, Bos taurus; identical to SEQ ID NO: 11202

SEQ ID NO: 92911 - DNA, 201 bp, Bos taurus; identical to SEQ ID NO: 11203

SEQ ID NO: 92912 - DNA, 201 bp, Bos taurus; identical to SEQ ID NO: 11204

SEQ ID NO: 92913 - DNA, 201 bp, Bos taurus; identical to SEQ ID NO: 11205

SEQ ID NO: 92914 - DNA, 201 bp, Bos taurus
aacactgctggcttattgaaatagcgggtggtatttttttgtccacaatattctttctatattccagatatttctagactgttattgcatttttaacatacacataagtcctacaaatttttaatcactttctcatgtaaatctcagttagctttttatttaaattttattgtgtacaggaatatgcttgagataatgtat

SEQ ID NO: 92915 - DNA, 201 bp, Bos taurus; identical to SEQ ID NO: 11207

SEQ ID NO: 92916 - DNA, 201 bp, Bos taurus
gtgacctgtaatgaaatcctggtaaacttagaaattataggcaatgtggatgtcctcagtaattttgttttctactctggccaggtattagttgtgggttgtttttttttttttctttagaaactactgaaatgatgatgtaacacctggatagaatctgtttaaaaaggaataactgaatgctaaatctttcaggccaga

SEQ ID NO: 92917 - DNA, 201 bp, Bos taurus
tccctggaccagcattgtaatatcagatgaactaagggcactagttctagcttcttctactttaatgtacttcatctgggccttccgatctcatatcagtactacagaggggcaactgcccacctactcaagagctaggttgatttctttatcaggtatgcacaggtaggcccatctgtaggaaggtaggtaggtatttcc

SEQ ID NO: 92918 - DNA, 201 bp, Bos taurus
ggaatattctggctattttggggaagggggtgggcatttccataaattgggccccggcccacactttgacctttccgattcgccttggaactgtcatggcgtctgtgggtgtcatttaacttgggaatatgttccaatgagcatatactgaggttcaagttctagtgggagttgactgtcatcttcctatttgatctgatc

SEQ ID NO: 92919 - DNA, 201 bp, Bos taurus
acacaacaaattcagctcaaggatctatgatatttcttccagttcccctggagattaacacttattattagtacttgttaaatttctgcaacatacattcgatcatgtatttgtggcactgataccatcagtaataattattagttttaagttaacttattgaaacatcacatgtgtatatttgtgtgtatatacacaata

SEQ ID NO: 92920 - DNA, 201 bp, Bos taurus; identical to SEQ ID NO: 11208

SEQ ID NO: 92921 - DNA, 201 bp, Bos taurus; identical to SEQ ID NO: 11209

SEQ ID NO: 92922 - DNA, 201 bp, Bos taurus; identical to SEQ ID NO: 11210

SEQ ID NO: 92923 - DNA, 201 bp, Bos taurus; identical to SEQ ID NO: 11211

SEQ ID NO: 92924 - DNA, 201 bp, Bos taurus; identical to SEQ ID NO: 11212

SEQ ID NO: 92925 - DNA, 201 bp, Bos taurus
agttaccaccactgttcactgtagttgatacattattctggatcccagaatgagagctttaatgagtagaactcccaggcctgctcatctatgcatatggcatgggcaggaagtaaattgtggtggttgttttaaatttgtcaagacagcataggctctattttgaattataaaccaaacttgaaaaattggccttcagtt

SEQ ID NO: 92926 - DNA, 201 bp, Bos taurus; identical to SEQ ID NO: 11213

SEQ ID NO: 92927 - DNA, 201 bp, Bos taurus; identical to SEQ ID NO: 11214

SEQ ID NO: 92928 - DNA, 201 bp, Bos taurus; identical to SEQ ID NO: 11215

SEQ ID NO: 92929 - DNA, 201 bp, Bos taurus; identical to SEQ ID NO: 11216

SEQ ID NO: 92930 - DNA, 201 bp, Bos taurus; identical to SEQ ID NO: 11218

SEQ ID NO: 92931 - DNA, 201 bp, Bos taurus; identical to SEQ ID NO: 11219

SEQ ID NO: 92932 - DNA, 201 bp, Bos taurus; identical to SEQ ID NO: 11220

SEQ ID NO: 92933 - DNA, 201 bp, Bos taurus
ctacatggcaaacggaggttgatgtttccaggttagtgagatgggcccagtgtaatataagggtccttacaagagagggccaggagggttcagaccaatcgtaaaatacatgaggacagaagccagaggctggtgtggtgtatggatgggccaaggaatgcaggtggcctctagaagctgaaaaaggcagaaaaagaggtt

SEQ ID NO: 92934 - DNA, 201 bp, Bos taurus
aaaaccaccttccttaagtattccattcttaactcctcctatatgtcaggtgggggagattttgactccatatggctcatctgggccagtcatggcactgcggaaaatttatttcaggtctcaatttaatgagagtctttcactttgaagtgccatcttttcccctaaattattgtgcagagagcatgtcctaggggtcat

SEQ ID NO: 92935 - DNA, 201 bp, Bos taurus; identical to SEQ ID NO: 11221

SEQ ID NO: 92936 - DNA, 201 bp, Bos taurus
gattactgcctgtagtcctgatccatggagattgggagagaatgaatatattttttaagctgctaaattttcaacaatcaaacaataatcaaatgacaaatcaggctgactttacctactaaaaattcccagattcatgaaaaagagtaaataaagatttcaagcttatggattggacagtattttaagaacccacggctt

SEQ ID NO: 92937 - DNA, 201 bp, Bos taurus
cgtagagtctcccctcatggcagcacctgactgtattggcgtaactgccagcggcttgggtttcatcccagagcagataagacacctcaggccaaaacaaggtgggaagtgaagagtaataaatctttataaatgcaggacactttaaaaacgcaattccagggtaaggtggaccgataaatccagtcgttggccaatgag

SEQ ID NO: 92938 - DNA, 201 bp, Bos taurus; identical to SEQ ID NO: 11222

SEQ ID NO: 92939 - DNA, 201 bp, Bos taurus; identical to SEQ ID NO: 11223

SEQ ID NO: 92940 - DNA, 201 bp, Bos taurus; identical to SEQ ID NO: 11226

SEQ ID NO: 92941 - DNA, 201 bp, Bos taurus; identical to SEQ ID NO: 11227

SEQ ID NO: 92942 - DNA, 201 bp, Bos taurus
agaattgattttaaaatattttttttcattactggaaaacataccttgaacacattctcatgtcaaagaatatagaactatgtcatttgctgtaatagtcgcataacttgtactgatttcagtgttggccatctggtgatgtccatgtggagagtcttctcttgtgttgctccaaaagggtttttgctatgaccagtgtgt

SEQ ID NO: 92943 - DNA, 201 bp, Bos taurus; identical to SEQ ID NO: 11228

SEQ ID NO: 92944 - DNA, 201 bp, Bos taurus
cagttgtgtctgaccctttgcgaccccatggactgcagcgtgccaggcttccctgtccatcacaattcccagagcttgctcaaactcatgtccatcgagtcggtgatgccaaagaagagtaaaagaacttaaaagggggggtaatgtttctacattccttttactggccaaatctccacactgctgctgctgctgctaagt

SEQ ID NO: 92945 - DNA, 201 bp, Bos taurus
caggcttttcccttctctgtctttcagccaccgccattttggacttcattttcctattctaactgcctaacattcctccctcaagaaatgggaggcccaatttttggaaataggggcgttgagggtgtctctggctacttcttgctgaacttggatggagaggggcattgggcctccactcttgctgttctcaagcctcag

SEQ ID NO: 92946 - DNA, 201 bp, Bos taurus
ttattagctgaagacacaactacatctctgataaactaagaaggcaaaaagaagataaattccaagtttctaaattgacaaaagaagaaacttgtcaggtataagatatagaatatacatagcttatgaaacagatttgtcaaaaatacagaactaaaagatacaattgccttaaagaaaggagaaaattatttgtgctta

SEQ ID NO: 92947 - DNA, 201 bp, Bos taurus
cccatggactgcagcctaccaggctccttcatccatgagatttttccaggcaagagtactggagtgggttgccattgtcttctccatgagcagaacataggcagcattaaatataggagaaaaatccataagtttaagaactatgaccaggaaagtcttttggatgtggtaactttcacacacaattgcttgaaaacaaga

SEQ ID NO: 92948 - DNA, 201 bp, Bos taurus; identical to SEQ ID NO: 11236

SEQ ID NO: 92949 - DNA, 201 bp, Bos taurus; identical to SEQ ID NO: 11237

SEQ ID NO: 92950 - DNA, 201 bp, Bos taurus; identical to SEQ ID NO: 11240

SEQ ID NO: 92951 - DNA, 201 bp, Bos taurus; identical to SEQ ID NO: 11241

SEQ ID NO: 92952 - DNA, 201 bp, Bos taurus
tagcaagccagaaggtgtgatgaatatccctgtttcattttgtttcctctttattcctgctctgagaatgattccagataaggagctgaatgatggcagtcgtggccaaataagaataaaatatgctaagaaaaatctagctttctggccagagaaaccagaaaagtgccccttgtggcccaaagaatgtatggcacaaaa

SEQ ID NO: 92953 - DNA, 201 bp, Bos taurus
caacaaaattgaagcccagagaagtttactgactcccccaaggccagcaagcctagttctctagcacaggatgaatactaacatggccctcctttctctttcttggggtgctctttacctatatgctcattttttggtttcttcaaactctagattgaattctttcaagtcccaagcctgtgaattaaataatttttgtga

SEQ ID NO: 92954 - DNA, 201 bp, Bos taurus
taaatgggcttcatgttcatcctggctctacaagaattttgatagcctggtgagaatcatttcaactgagttgtgaagtcattatggacccagtggatggagagtaggtttaattttgtgccctctaaagacatgctcaagtcgtagccctcataccagtgaatgtgaccatgtttggaaatagagccttggcagatatga

SEQ ID NO: 92955 - DNA, 201 bp, Bos taurus
aacataaaaaacagctcccttatattgcaaaatacttaccctgagacattatttcttttcaaatcataggtgaagcacagtgttggaactgtgactgttatatcaaattaacaagacaggtattagtggagactttaagaaagatcatgtcaaaccagatactaagtttgcattcactaaatggtcttcaatgctttattc

SEQ ID NO: 92956 - DNA, 201 bp, Bos taurus; identical to SEQ ID NO: 11242

SEQ ID NO: 92957 - DNA, 201 bp, Bos taurus; identical to SEQ ID NO: 11243

SEQ ID NO: 92958 - DNA, 201 bp, Bos taurus
atacataagcacccatctattttgatataatcactccatatagcctgttttataaatagagaatggaaagaatggggatgctcctgaagattcatggaagtcagtatagcatagccaagaagcccttggctaatcagcccctgtcctacccaactttatcttgcttggcagaagtagggcacaacaggagctctgttggct

SEQ ID NO: 92959 - DNA, 201 bp, Bos taurus; identical to SEQ ID NO: 11244

SEQ ID NO: 92960 - DNA, 201 bp, Bos taurus
aactccgggaactggtgatggacagggaggcctggcgtgcggcagtccatggggtcgcagagtcgcatatgactgagagactgaatgacccttgtgctgatagaaagaacactggccataccgtatcatggagagtaacaagagcttctcatcttccaagaatgttatacatatcatgatttagtatgtgtacaaagtaaa

SEQ ID NO: 92961 - DNA, 201 bp, Bos taurus; identical to SEQ ID NO: 11245

SEQ ID NO: 92962 - DNA, 201 bp, Bos taurus; identical to SEQ ID NO: 11246

SEQ ID NO: 92963 - DNA, 201 bp, Bos taurus
tattctgaagtcatatttttgtagtacaaactgttaaaaactttttactctttcaagtgctgagttttcttcagatgttttatgagttctgaatatgcaggtttttatagcagaaattgtacatcagacagaaattgtctattttaaactatctttctgcagtttctacttgggcaaacttttggtaaacagtcttaagaa

SEQ ID NO: 92964 - DNA, 201 bp, Bos taurus; identical to SEQ ID NO: 11247

SEQ ID NO: 92965 - DNA, 201 bp, Bos taurus
tctactctaatggaatgatgaaaggatgaaacaagataattaatgtaaaacacttagaataatgtgtggcgaattttaagaattgaatatattattattatgaaaaattaacaaacatttcatatattactggtataaaggcattgcattcaattggagagggtgaaaccagctgtttacattgtccacataacgtaatta

SEQ ID NO: 92966 - DNA, 201 bp, Bos taurus; identical to SEQ ID NO: 11249

SEQ ID NO: 92967 - DNA, 201 bp, Bos taurus; identical to SEQ ID NO: 11250

SEQ ID NO: 92968 - DNA, 201 bp, Bos taurus; identical to SEQ ID NO: 11251

SEQ ID NO: 92969 - DNA, 201 bp, Bos taurus; identical to SEQ ID NO: 11252

SEQ ID NO: 92970 - DNA, 201 bp, Bos taurus; identical to SEQ ID NO: 11253

SEQ ID NO: 92971 - DNA, 201 bp, Bos taurus; identical to SEQ ID NO: 11254

SEQ ID NO: 92972 - DNA, 201 bp, Bos taurus; identical to SEQ ID NO: 11255

SEQ ID NO: 92973 - DNA, 201 bp, Bos taurus; identical to SEQ ID NO: 11257

SEQ ID NO: 92974 - DNA, 201 bp, Bos taurus; identical to SEQ ID NO: 11259

SEQ ID NO: 92975 - DNA, 201 bp, Bos taurus; identical to SEQ ID NO: 11260

SEQ ID NO: 92976 - DNA, 201 bp, Bos taurus; identical to SEQ ID NO: 11263

SEQ ID NO: 92977 - DNA, 201 bp, Bos taurus; identical to SEQ ID NO: 11264

SEQ ID NO: 92978 - DNA, 201 bp, Bos taurus; identical to SEQ ID NO: 11266

SEQ ID NO: 92979 - DNA, 201 bp, Bos taurus; identical to SEQ ID NO: 11267

SEQ ID NO: 92980 - DNA, 201 bp, Bos taurus; identical to SEQ ID NO: 11268

SEQ ID NO: 92981 - DNA, 201 bp, Bos taurus; identical to SEQ ID NO: 11270

SEQ ID NO: 92982 - DNA, 201 bp, Bos taurus; identical to SEQ ID NO: 11271

SEQ ID NO: 92983 - DNA, 201 bp, Bos taurus; identical to SEQ ID NO: 11272

SEQ ID NO: 92984 - DNA, 201 bp, Bos taurus; identical to SEQ ID NO: 11273

SEQ ID NO: 92985 - DNA, 201 bp, Bos taurus; identical to SEQ ID NO: 11274

SEQ ID NO: 92986 - DNA, 201 bp, Bos taurus; identical to SEQ ID NO: 11275

SEQ ID NO: 92987 - DNA, 201 bp, Bos taurus; identical to SEQ ID NO: 11276

SEQ ID NO: 92988 - DNA, 201 bp, Bos taurus; identical to SEQ ID NO: 11277

SEQ ID NO: 92989 - DNA, 201 bp, Bos taurus; identical to SEQ ID NO: 11280

SEQ ID NO: 92990 - DNA, 201 bp, Bos taurus; identical to SEQ ID NO: 11281

SEQ ID NO: 92991 - DNA, 201 bp, Bos taurus; identical to SEQ ID NO: 11283

SEQ ID NO: 92992 - DNA, 201 bp, Bos taurus; identical to SEQ ID NO: 11284

SEQ ID NO: 92993 - DNA, 201 bp, Bos taurus; identical to SEQ ID NO: 11287

SEQ ID NO: 92994 - DNA, 201 bp, Bos taurus; identical to SEQ ID NO: 11288

SEQ ID NO: 92995 - DNA, 201 bp, Bos taurus; identical to SEQ ID NO: 11289

SEQ ID NO: 92996 - DNA, 201 bp, Bos taurus; identical to SEQ ID NO: 11290

SEQ ID NO: 92997 - DNA, 201 bp, Bos taurus; identical to SEQ ID NO: 11291

SEQ ID NO: 92998 - DNA, 201 bp, Bos taurus; identical to SEQ ID NO: 11292

SEQ ID NO: 92999 - DNA, 201 bp, Bos taurus; identical to SEQ ID NO: 11293

SEQ ID NO: 93000 - DNA, 201 bp, Bos taurus; identical to SEQ ID NO: 11295

SEQ ID NO: 93001 - DNA, 201 bp, Bos taurus; identical to SEQ ID NO: 11296

SEQ ID NO: 93002 - DNA, 201 bp, Bos taurus; identical to SEQ ID NO: 11297

SEQ ID NO: 93003 - DNA, 201 bp, Bos taurus; identical to SEQ ID NO: 11299

SEQ ID NO: 93004 - DNA, 201 bp, Bos taurus; identical to SEQ ID NO: 11300

SEQ ID NO: 93005 - DNA, 201 bp, Bos taurus; identical to SEQ ID NO: 11301

SEQ ID NO: 93006 - DNA, 201 bp, Bos taurus; identical to SEQ ID NO: 11302

SEQ ID NO: 93007 - DNA, 201 bp, Bos taurus; identical to SEQ ID NO: 11303

SEQ ID NO: 93008 - DNA, 201 bp, Bos taurus; identical to SEQ ID NO: 11304

SEQ ID NO: 93009 - DNA, 201 bp, Bos taurus; identical to SEQ ID NO: 11305

SEQ ID NO: 93010 - DNA, 201 bp, Bos taurus; identical to SEQ ID NO: 11306

SEQ ID NO: 93011 - DNA, 201 bp, Bos taurus; identical to SEQ ID NO: 11307

SEQ ID NO: 93012 - DNA, 201 bp, Bos taurus; identical to SEQ ID NO: 11308

SEQ ID NO: 93013 - DNA, 201 bp, Bos taurus; identical to SEQ ID NO: 11309

SEQ ID NO: 93014 - DNA, 201 bp, Bos taurus; identical to SEQ ID NO: 11310

SEQ ID NO: 93015 - DNA, 201 bp, Bos taurus; identical to SEQ ID NO: 11311

SEQ ID NO: 93016 - DNA, 201 bp, Bos taurus; identical to SEQ ID NO: 11313

SEQ ID NO: 93017 - DNA, 201 bp, Bos taurus; identical to SEQ ID NO: 52535

SEQ ID NO: 93018 - DNA, 201 bp, Bos taurus; identical to SEQ ID NO: 11314

SEQ ID NO: 93019 - DNA, 201 bp, Bos taurus; identical to SEQ ID NO: 11315

SEQ ID NO: 93020 - DNA, 201 bp, Bos taurus; identical to SEQ ID NO: 11316

SEQ ID NO: 93021 - DNA, 201 bp, Bos taurus; identical to SEQ ID NO: 11317

SEQ ID NO: 93022 - DNA, 201 bp, Bos taurus; identical to SEQ ID NO: 11318

SEQ ID NO: 93023 - DNA, 201 bp, Bos taurus; identical to SEQ ID NO: 11319

SEQ ID NO: 93024 - DNA, 201 bp, Bos taurus; identical to SEQ ID NO: 11320

SEQ ID NO: 93025 - DNA, 201 bp, Bos taurus; identical to SEQ ID NO: 11321

SEQ ID NO: 93026 - DNA, 201 bp, Bos taurus; identical to SEQ ID NO: 11322

SEQ ID NO: 93027 - DNA, 201 bp, Bos taurus; identical to SEQ ID NO: 11323

SEQ ID NO: 93028 - DNA, 201 bp, Bos taurus; identical to SEQ ID NO: 11324

SEQ ID NO: 93029 - DNA, 201 bp, Bos taurus; identical to SEQ ID NO: 11327

SEQ ID NO: 93030 - DNA, 201 bp, Bos taurus; identical to SEQ ID NO: 11328

SEQ ID NO: 93031 - DNA, 201 bp, Bos taurus; identical to SEQ ID NO: 11329

SEQ ID NO: 93032 - DNA, 201 bp, Bos taurus; identical to SEQ ID NO: 11330

SEQ ID NO: 93033 - DNA, 201 bp, Bos taurus
aatccttctttcctcacacaaagtagttctgctcagcatctgccctgtagactcagatatttccccctacagtccttatcaaaacggcttctcaacagaaggaattgtccccataagtcctttttataccagttcagaaaataaatgttttcctaccattatacactttctgtgctcagtggctctgtcttcccaccgttt

SEQ ID NO: 93034 - DNA, 201 bp, Bos taurus
cagagattactagaaaggccttcagcggaacaggcctccaaatgaccataacaagacaaagtcaccacagcaacatcctggtttctgtcaatcaaggatatgctcctacagtggttctggcctataattctgttcgctccctgtttcctcaactttctctcttggtttatttctactcatgtcaacaagacacaggctggt

SEQ ID NO: 93035 - DNA, 201 bp, Bos taurus
ctcccaggggatggccagggctaggtatcccctccaccagctcttctattgaaggcattttgtctagaaaacccttatggctcctggcttcttaagaacttatgacttctgctacagtggcccaaagtgagcccacgagggtccagtgtaggatgtggagacaagaggagggggtggatgggagctgtgtgtgtccagact

SEQ ID NO: 93036 - DNA, 201 bp, Bos taurus; identical to SEQ ID NO: 11333

SEQ ID NO: 93037 - DNA, 201 bp, Bos taurus
ccctactccttccttgcctgaggtgcctcagtgatgaagctgatgaaataagtgatgtggatttttcatgctgagggcccttttcttcctctctctccccgcctctgctctgagaacccctcctgcatcctctctggtggggacctgccaccacccgctactcatgcccaggagagtgaagccacactgggctgcccccag

SEQ ID NO: 93038 - DNA, 201 bp, Bos taurus; identical to SEQ ID NO: 11334

SEQ ID NO: 93039 - DNA, 201 bp, Bos taurus; identical to SEQ ID NO: 11335

SEQ ID NO: 93040 - DNA, 201 bp, Bos taurus; identical to SEQ ID NO: 11336

SEQ ID NO: 93041 - DNA, 201 bp, Bos taurus; identical to SEQ ID NO: 11337

SEQ ID NO: 93042 - DNA, 201 bp, Bos taurus
tatgagtcctaacccagcatcacaaagatttacttctatgttttcttccaagagtttgtagttttaggtcttccatttaagtccatgatccattttgagtcaatttttgtgtgtggtataagtaaggggacatcaagtcatccctgtgcagcttgttgaaaacattattctttccccatagaattgtttgggcacccttgt

SEQ ID NO: 93043 - DNA, 201 bp, Bos taurus; identical to SEQ ID NO: 11338

SEQ ID NO: 93044 - DNA, 201 bp, Bos taurus; identical to SEQ ID NO: 11339

SEQ ID NO: 93045 - DNA, 201 bp, Bos taurus
taaagataagctgagggaggggagctgtggggtgcatgctcagctcatggaaattcttctgattggttggtggtaagctaattgggagtcaacatcattaatcttttggttcccaactggcttggtttctatgtgcttatgagcaaaatatagctaacttcatccatttgcaggggatttcattagctgcagaaaaactca

SEQ ID NO: 93046 - DNA, 201 bp, Bos taurus; identical to SEQ ID NO: 11340

SEQ ID NO: 93047 - DNA, 201 bp, Bos taurus; identical to SEQ ID NO: 11341

SEQ ID NO: 93048 - DNA, 201 bp, Bos taurus
aagaggagcaagtaaaattctggaggtgggagaagggaaggggtgggtgcctgtgctttgaaattctgccctggaaaggcctcttcagtggatccccttccaacctgcccagtacaacaactggacctggcatgtgacaggcgctgtagacagatcgcatttcacacatgcagctgtaatatctggccacaggtgtttggt

SEQ ID NO: 93049 - DNA, 201 bp, Bos taurus; identical to SEQ ID NO: 11342

SEQ ID NO: 93050 - DNA, 201 bp, Bos taurus; identical to SEQ ID NO: 11343

SEQ ID NO: 93051 - DNA, 201 bp, Bos taurus; identical to SEQ ID NO: 11344

SEQ ID NO: 93052 - DNA, 201 bp, Bos taurus; identical to SEQ ID NO: 11345

SEQ ID NO: 93053 - DNA, 201 bp, Bos taurus
taaacaagaatttgaggtacacaaggtatagaatgaaaagtaactctgcctcttccaactagtttcttgctttagagagaacttttttatttttaattctgctgattattaccccagttttatatataatatgctaaaccttacttttgatgaatcttaagtaatctagtgtaccttcattgagaaaaataaaaaatttta

SEQ ID NO: 93054 - DNA, 201 bp, Bos taurus
agtctttcacttttggcaataattgtctccacatttactttatagagtcccctttggtggagcccacaggcggagaggaagcacaggattcataagatggcgggcgggtgagtgactgagaatttgggctgaaattggagaaaaaaaaaaagtggcagtggttacaccttaataagaggaatgaatttgaagtctaagttg

SEQ ID NO: 93055 - DNA, 201 bp, Bos taurus; identical to SEQ ID NO: 11346

SEQ ID NO: 93056 - DNA, 201 bp, Bos taurus
ggacttcataggaaagaagggagagttttagatggtgagatgaagggaagctgcctggagcttagtagagggagctagtgtcactcatacttctgctctaaaccttgagtacgtagacaattaatcaattgatgattgttaaaaaatattttcttagacagaagcagatttccaagctggccagatggttttcttactcat

SEQ ID NO: 93057 - DNA, 201 bp, Bos taurus; identical to SEQ ID NO: 11347

SEQ ID NO: 93058 - DNA, 201 bp, Bos taurus; identical to SEQ ID NO: 11348

SEQ ID NO: 93059 - DNA, 201 bp, Bos taurus
tgccgtaatgcgacttacgtctacttcggaaaaaacacatataacatacacacaggcagaggaaccatttctaaacactttcacaaagcagcttagtatgcggacggggtaaagagtaggagtgtctgggagtggttcccctgcattgtcagctaacccagtgattcttcaggggctctagtcaaaggactagttctatga

SEQ ID NO: 93060 - DNA, 201 bp, Bos taurus; identical to SEQ ID NO: 11349

SEQ ID NO: 93061 - DNA, 201 bp, Bos taurus; identical to SEQ ID NO: 11350

SEQ ID NO: 93062 - DNA, 201 bp, Bos taurus; identical to SEQ ID NO: 11351

SEQ ID NO: 93063 - DNA, 201 bp, Bos taurus; identical to SEQ ID NO: 11352

SEQ ID NO: 93064 - DNA, 201 bp, Bos taurus
tttttctagactagtaaaaggaaatataaagcacaaatattttgaaactcccagtggtattttgggtaagcgactcgaactaaatttgaggaaggaatgatactccttaattctcctcttttgaatcttaattctgtgcttctttttcattttcttgacaataaagttctttttcttcccaacagggctcttagactcttt

SEQ ID NO: 93065 - DNA, 201 bp, Bos taurus; identical to SEQ ID NO: 11353

SEQ ID NO: 93066 - DNA, 201 bp, Bos taurus; identical to SEQ ID NO: 11354

SEQ ID NO: 93067 - DNA, 201 bp, Bos taurus; identical to SEQ ID NO: 11355

SEQ ID NO: 93068 - DNA, 201 bp, Bos taurus; identical to SEQ ID NO: 11356

SEQ ID NO: 93069 - DNA, 201 bp, Bos taurus; identical to SEQ ID NO: 11357

SEQ ID NO: 93070 - DNA, 201 bp, Bos taurus; identical to SEQ ID NO: 11358

SEQ ID NO: 93071 - DNA, 201 bp, Bos taurus; identical to SEQ ID NO: 11359

SEQ ID NO: 93072 - DNA, 201 bp, Bos taurus; identical to SEQ ID NO: 11360

SEQ ID NO: 93073 - DNA, 201 bp, Bos taurus
tgactgcatcctccttgggccctttgtggcttgcgtagaggcagtggcgcagccctgtaatgacttttcggttcacagacctgtgtttaacttgctatctcttcacagtataaaaggtcagaggaagtgttctgcttcagagatcacctctgcacctgctagatgtgatgtggagctggaaggtgatcgtagcaagggcct

SEQ ID NO: 93074 - DNA, 201 bp, Bos taurus; identical to SEQ ID NO: 11361

SEQ ID NO: 93075 - DNA, 201 bp, Bos taurus; identical to SEQ ID NO: 11362

SEQ ID NO: 93076 - DNA, 201 bp, Bos taurus; identical to SEQ ID NO: 11363

SEQ ID NO: 93077 - DNA, 201 bp, Bos taurus; identical to SEQ ID NO: 11364

SEQ ID NO: 93078 - DNA, 201 bp, Bos taurus; identical to SEQ ID NO: 11365

SEQ ID NO: 93079 - DNA, 201 bp, Bos taurus
tgaggaatgttcagtgaagattaagcatttggctgtaagcaggggcatgggcttgtccatggatccacccacttttggcttgagtgcttataatgtcttctcacacccacaacctggactggtggtgttatgagcagtttctaattcctgcactggtctgtcggattaatgggatcctcttctatcctcactgtttgtctc

SEQ ID NO: 93080 - DNA, 201 bp, Bos taurus
tttcatttccctatggctagttaagggaaaccgggaagatggccacttggcagtctcagccgctatcctaggaagctggtttcagtctgcagggaagaatagaaagggggaatgggcctttccccagacaaaaacaaaaatcccagaatcagaatgaagaaccaagcagtagatattgctggagcttataaatccattcca

SEQ ID NO: 93081 - DNA, 201 bp, Bos taurus; identical to SEQ ID NO: 11366

SEQ ID NO: 93082 - DNA, 201 bp, Bos taurus
cagctctggaggctggaaggccgagataaggtgtctgcaggtctggctttgcctgagggctcggtgtttggtttacagacggccaaccttttcactgtgcgctcatgtggcttttctctggtgtggtgtctctctattttgtcctaatcgcctctttttataaggataccggtcagattggattggggcccaccccaaagg

SEQ ID NO: 93083 - DNA, 201 bp, Bos taurus
ctttattgtctttttaagactcttgaatctcttctaattctttcaaccatttttctagatttcctagatcactgaatggccaccagggcctatccttgtgtcccacacaccttgaaaacctcctgcttcctctgtgagcttgtacctgtacagctgagagctgttggtggaagcctctcaccatgcttcccaacctcacct

SEQ ID NO: 93084 - DNA, 201 bp, Bos taurus; identical to SEQ ID NO: 11367

SEQ ID NO: 93085 - DNA, 201 bp, Bos taurus
aaatctccgcagtctgcaggcatccaaggggcctgggtaaaatggcttgtcaggactgccccctaggcttaactatcccctcagctgaatgtgccttgcaggctccagtgggcctgagctgcagcaccgaccaaagcaaatgtgcataggcacaagccgccttctctgacctcagcaccagaggctgcattagcagggaaa

SEQ ID NO: 93086 - DNA, 201 bp, Bos taurus; identical to SEQ ID NO: 11368

SEQ ID NO: 93087 - DNA, 201 bp, Bos taurus
tgatgctaaatgttcagatcataccagcatgtactgcatatataacactgagaggagccttatttagcccagagctggttttggacctattgtttccaaattggtttctgagcagtaaaatagaggtgagtaaggttataaggcttctgtctagtcatcatcagaccattttactatacagtttcaaggagctgactacct

SEQ ID NO: 93088 - DNA, 201 bp, Bos taurus
caaggatgctcaccgccatgggctgactcatgttcttggctagagaagtggatgccagctcagtgtcctagaaagcctgctctccttctgtgaagttggagccctgaaatgtttatgccggagagctgggaaaagctggaagaataatttctaatatgctcatctcttattccctctcacccctatttccacctctagccc

SEQ ID NO: 93089 - DNA, 201 bp, Bos taurus
tggaatttgtctttttaatgagctctcgcacccccattcccaccaccatgatgttcatacataaccaaatctagaaccacaggccaaggggcatatccattccctgagaacaagtctgattcatattcttccctaactgagtgaagcagaataagacaaggttcctctgccctgtacctggtgtggccctggctcctgggc

SEQ ID NO: 93090 - DNA, 201 bp, Bos taurus; identical to SEQ ID NO: 11369

SEQ ID NO: 93091 - DNA, 201 bp, Bos taurus; identical to SEQ ID NO: 11370

SEQ ID NO: 93092 - DNA, 201 bp, Bos taurus; identical to SEQ ID NO: 11371

SEQ ID NO: 93093 - DNA, 201 bp, Bos taurus; identical to SEQ ID NO: 11372

SEQ ID NO: 93094 - DNA, 201 bp, Bos taurus
taaagggtcctcagtgacagttttaaagccccatcagtagagtaacattgaaaacctctgtagccatcttgaaattcttagagttaggtcattaatcttatttcctaaagttagagaagtcctatgtggcagagtcaaattctgacatcagtccggtggccctgttctgcatttctataatgtaattgtataaattcttta

SEQ ID NO: 93095 - DNA, 201 bp, Bos taurus; identical to SEQ ID NO: 11373

SEQ ID NO: 93096 - DNA, 201 bp, Bos taurus
catgaaggaggaactggctctactggatgggtccaatgtggtgtttaaacttctggggcccatactggtcaaacaggagctgggggaatctcgggccacagtgggtaaaaggctggactacatcacagctgagattaagtgatatgaatcccagctccgggatctagagcgtcagtcagaacaacagagggagacctttgc

SEQ ID NO: 93097 - DNA, 201 bp, Bos taurus; identical to SEQ ID NO: 11374

SEQ ID NO: 93098 - DNA, 201 bp, Bos taurus
catgtgtacattaccatgtgctgcctaattgctcttgattcttggttttcaaaagcaagttcacttttgaagcaggaaaaacagattcttaaattggctctcataagtattccaggaagtacacttcatttctcaactgtattgttactctgggaagacaaggtatagtcaactggctgctttgaagccatgaaatgcata

SEQ ID NO: 93099 - DNA, 201 bp, Bos taurus; identical to SEQ ID NO: 11375

SEQ ID NO: 93100 - DNA, 201 bp, Bos taurus; identical to SEQ ID NO: 11376

SEQ ID NO: 93101 - DNA, 201 bp, Bos taurus
tctttttttagaaaaccacagtttcatagcacaggtaagtgcaaaacctcctggtcaagctaggatattccccgggaattcccttaactgacctcatgtgttcttgcctctgggccttgactccaactaccctaaatttctttccattttcattgaataaaatcccagccatcctctgggatccaatcagacaacagcctt

SEQ ID NO: 93102 - DNA, 201 bp, Bos taurus
gtaaagctgcttaacgaagtgctagttggttggcaagaggtcagctgaatatggtgaatgaggcaaaacttcatagcccaatgtgttcaacttttgtaagcgttggttgtgtgctatgtggcccagcatcgtggagaagaactgggcccgttctgttgactaatgctggctgcagacgttgcagttttggatgcatctcat

SEQ ID NO: 93103 - DNA, 201 bp, Bos taurus
actaccctaaaaatgctctgtgctccacatattctccccttcccacgccataacccctaacaacctctaatctacttcagttttgccttttctagatggttatagagttggaatcatacagtatataacctttccagtctggcctctttcatttagtaatatgcgtttaggttcctctatgtcttttcatagcttgatggt

SEQ ID NO: 93104 - DNA, 201 bp, Bos taurus; identical to SEQ ID NO: 11379

SEQ ID NO: 93105 - DNA, 201 bp, Bos taurus
atgtgctgtggttcatggggtcacaaatagtcagacaggactgagcgactgaactgaactgaactttctaccatcatctaataagacactagaccttagagaaggaagaccagaatccttacttccttatctctgtacttctttggatcctgaattcatcaccctgattgaataactctggtggcaacctgccccttgctg

SEQ ID NO: 93106 - DNA, 201 bp, Bos taurus; identical to SEQ ID NO: 11380

SEQ ID NO: 93107 - DNA, 201 bp, Bos taurus
tggctacccactccagtattcttgcctgcagaattccatggacagaggagcctggtgggctatagtccatgaggttgcaatttgtcagacacgactgagcgattaacactaactaactaatgagcaaattaaaaccagtctttttggatgactcttataaaatataaagatgtgtaagtttaacaaaacctatgcctactt

SEQ ID NO: 93108 - DNA, 201 bp, Bos taurus; identical to SEQ ID NO: 11382

SEQ ID NO: 93109 - DNA, 201 bp, Bos taurus; identical to SEQ ID NO: 11383

SEQ ID NO: 93110 - DNA, 201 bp, Bos taurus; identical to SEQ ID NO: 11384

SEQ ID NO: 93111 - DNA, 201 bp, Bos taurus; identical to SEQ ID NO: 11386

SEQ ID NO: 93112 - DNA, 201 bp, Bos taurus; identical to SEQ ID NO: 11387

SEQ ID NO: 93113 - DNA, 201 bp, Bos taurus
tccctttttactgtcctttttactggctcatatacaagagaatctcactgtttgaaggaaaatttttctagatatctttggaattagaaaaatctttgacattgttcttctcattgaccatacccacctcctttcccattttaggggaagagacaggtgctaggtagaaagacagaagcaaataaatatatcctctttctt

SEQ ID NO: 93114 - DNA, 201 bp, Bos taurus; identical to SEQ ID NO: 11388

SEQ ID NO: 93115 - DNA, 201 bp, Bos taurus; identical to SEQ ID NO: 11389

SEQ ID NO: 93116 - DNA, 201 bp, Bos taurus; identical to SEQ ID NO: 11390

SEQ ID NO: 93117 - DNA, 201 bp, Bos taurus; identical to SEQ ID NO: 11391

SEQ ID NO: 93118 - DNA, 201 bp, Bos taurus; identical to SEQ ID NO: 11393

SEQ ID NO: 93119 - DNA, 201 bp, Bos taurus
caactaacatgcttagagcacagtgaacaagagggagtgtggctggaggtgagggcagagaggaggcgaccactaggtcctgcaatgccttgggaaggggtttgggttttcttaggaagccttcaaagaatttaagcaggcaggtgtcatggaatgctttaaaaatctctctgctatgcagagaataaattgtaagagtga

SEQ ID NO: 93120 - DNA, 201 bp, Bos taurus
ggaaggggtggggtgggagagcagggcaggagactgggagcagggcagggggcgagctgggggagcagggcagggcaggtagggccagcagtctctagaaccggctctggctttggctccaagtgaagctgggagctgttgttctgcaaagggaagtagaagtgacaggatctaacccaagtcacttagggccaggtcact

SEQ ID NO: 93121 - DNA, 201 bp, Bos taurus
gcagtttccagccccgactcagccgggtctagagttgggctgtaagacagggtccctcccagtctgctgggtcagcgtttagaggactcctgtcttggtttggcccaccttcagggtcccatctgcccctgccccacccaagcagctcatctcttatctgatgggtgggagaggtgtcaggagagttgaggggcagaacct

SEQ ID NO: 93122 - DNA, 201 bp, Bos taurus
ggtcaacaaatacaaatacttagggattcataatttaataaatgcaatatgagttttcttactttctcacaatgacaagttatcatgcagtttcatgcagtatgcaaagggttttaaaaatattttcaaaaatcttttctgttttattttcaatactttattttatattgagttttaacttgtaagtcctataaagtcatt

SEQ ID NO: 93123 - DNA, 201 bp, Bos taurus; identical to SEQ ID NO: 11397

SEQ ID NO: 93124 - DNA, 201 bp, Bos taurus; identical to SEQ ID NO: 11398

SEQ ID NO: 93125 - DNA, 201 bp, Bos taurus; identical to SEQ ID NO: 11401

SEQ ID NO: 93126 - DNA, 201 bp, Bos taurus; identical to SEQ ID NO: 11402

SEQ ID NO: 93127 - DNA, 201 bp, Bos taurus; identical to SEQ ID NO: 11403

SEQ ID NO: 93128 - DNA, 201 bp, Bos taurus; identical to SEQ ID NO: 11404

SEQ ID NO: 93129 - DNA, 201 bp, Bos taurus
gtcaggaggcctcggccccctccactccccagagggtacatacccgctgcagctccacctccatggtccctgcactctgtctccaaagcctgtgtctacacgaggcccagggtgggaccaggccttctgacccctgcaccaacggccacagccccgggcactccccggaaggagcatctagtgctgttttcctgggtttag

SEQ ID NO: 93130 - DNA, 201 bp, Bos taurus
tacattggctggagttctgatatccccagttctccggagaagcaggattttgatttagttacagaaaatgaattatttttattctttttttttttaaaaagagaagcattttgacagtctcaatgaacaatataatttcagagctgggccatcacccgaaccatcgaccttatttgacagactcaaaaaacaaaaacaaaa

SEQ ID NO: 93131 - DNA, 201 bp, Bos taurus
gaaaaggccttattgatgatataaagtttgtgtggtctggatacaagatcaaaccagccacaacattgccgtaagccaaagcctaattcagagcaaggtcttctccctttaattctatgaaggccaagaaagatgaggaagctgtagaaggaaagtatggaactaacagagattggattatgatgcttaaggaaagacgtt

SEQ ID NO: 93132 - DNA, 201 bp, Bos taurus
gctatgttcatgcctgcattcataaacagcccaggtcccctcattttcaaatattagattgtatataaaagtatcactgaaagagacaggggataccaaaccttggggatttctcataatatagaatgaaaaggttgttggaaaagctgagccgagaactctcaccatccccgctgttgttcctctcgctccggaagatac

SEQ ID NO: 93133 - DNA, 201 bp, Bos taurus; identical to SEQ ID NO: 11407

SEQ ID NO: 93134 - DNA, 201 bp, Bos taurus
agccgagagcatctgtggagtgaccggccctgatggggggtgcttgggtcatggtgcctgtcagctcctggttcagctttcacagggctggtttcacaggtgaagcctaagttcaggcctgaggtttccccttggacccatcctgttcactcctccaagacaagcacctctgtgcccgggcaggatgctggctttgcagcc

SEQ ID NO: 93135 - DNA, 201 bp, Bos taurus
ttgattcaatggatgttcttgatgtcgacatcggtggtggtattgacccaggaatttttcctgcacagagaatcagggatgaacgctgtcattctcccgagagaacaaatgtaccggagaatcacagatggtgacagacactaggctgaggcgactgactgggaggaatcatggagctgagagctgctccagggagcccat

SEQ ID NO: 93136 - DNA, 201 bp, Bos taurus
ggttgttgtgagtaataatgcaggaagcaatcagcaagtatactgccctagaagtgctgcacgttgtgggcccaggagggaagaaaggggcaagactctcaaaccatcatgggatgctgggacaggatgttggaggctttgccctgccatggcagctggtaagggctgctggggaagcaagctcttgggcccctggagctg

SEQ ID NO: 93137 - DNA, 201 bp, Bos taurus; identical to SEQ ID NO: 11408

SEQ ID NO: 93138 - DNA, 201 bp, Bos taurus; identical to SEQ ID NO: 11409

SEQ ID NO: 93139 - DNA, 201 bp, Bos taurus
agggccatcagcacaggccaccggtggcaaagatccaagtcacagcagctggggttctgctgaccgagttgtggctcctccctgtccacactcacggcatgaggccagcaggatatgtgacaagattttcctttcaggctgaatagtagaaagtcgttttggcttaggggtgcagggtgttaagagggtcaggagatcaga

SEQ ID NO: 93140 - DNA, 201 bp, Bos taurus
atcgtctcagaggcattgttttggttaggagggaagatgacaggactgcagccaaccaaagcagaaaggcggagaatggcaaggggcctgcggttttgtttacgaacgctcttctccaaggctgaacttcttggaaaggggtttattttgtttcacgctgacccagctccacttctaggtcattttaggatctcagttggt

SEQ ID NO: 93141 - DNA, 201 bp, Bos taurus; identical to SEQ ID NO: 11411

SEQ ID NO: 93142 - DNA, 201 bp, Bos taurus; identical to SEQ ID NO: 11412

SEQ ID NO: 93143 - DNA, 201 bp, Bos taurus; identical to SEQ ID NO: 11413

SEQ ID NO: 93144 - DNA, 201 bp, Bos taurus; identical to SEQ ID NO: 11414

SEQ ID NO: 93145 - DNA, 201 bp, Bos taurus; identical to SEQ ID NO: 11416

SEQ ID NO: 93146 - DNA, 201 bp, Bos taurus; identical to SEQ ID NO: 11417

SEQ ID NO: 93147 - DNA, 201 bp, Bos taurus; identical to SEQ ID NO: 11418

SEQ ID NO: 93148 - DNA, 201 bp, Bos taurus; identical to SEQ ID NO: 11419

SEQ ID NO: 93149 - DNA, 201 bp, Bos taurus; identical to SEQ ID NO: 11421

SEQ ID NO: 93150 - DNA, 201 bp, Bos taurus; identical to SEQ ID NO: 11422

SEQ ID NO: 93151 - DNA, 201 bp, Bos taurus; identical to SEQ ID NO: 11423

SEQ ID NO: 93152 - DNA, 201 bp, Bos taurus; identical to SEQ ID NO: 11424

SEQ ID NO: 93153 - DNA, 201 bp, Bos taurus; identical to SEQ ID NO: 11426

SEQ ID NO: 93154 - DNA, 201 bp, Bos taurus; identical to SEQ ID NO: 11427

SEQ ID NO: 93155 - DNA, 201 bp, Bos taurus; identical to SEQ ID NO: 11428

SEQ ID NO: 93156 - DNA, 201 bp, Bos taurus; identical to SEQ ID NO: 11429

SEQ ID NO: 93157 - DNA, 201 bp, Bos taurus; identical to SEQ ID NO: 11430

SEQ ID NO: 93158 - DNA, 201 bp, Bos taurus; identical to SEQ ID NO: 11431

SEQ ID NO: 93159 - DNA, 201 bp, Bos taurus; identical to SEQ ID NO: 11432

SEQ ID NO: 93160 - DNA, 201 bp, Bos taurus; identical to SEQ ID NO: 11433

SEQ ID NO: 93161 - DNA, 201 bp, Bos taurus; identical to SEQ ID NO: 11434

SEQ ID NO: 93162 - DNA, 201 bp, Bos taurus; identical to SEQ ID NO: 11435

SEQ ID NO: 93163 - DNA, 201 bp, Bos taurus; identical to SEQ ID NO: 11436

SEQ ID NO: 93164 - DNA, 201 bp, Bos taurus; identical to SEQ ID NO: 11437

SEQ ID NO: 93165 - DNA, 201 bp, Bos taurus; identical to SEQ ID NO: 11438

SEQ ID NO: 93166 - DNA, 201 bp, Bos taurus; identical to SEQ ID NO: 11439

SEQ ID NO: 93167 - DNA, 201 bp, Bos taurus; identical to SEQ ID NO: 11442

SEQ ID NO: 93168 - DNA, 201 bp, Bos taurus; identical to SEQ ID NO: 11444

SEQ ID NO: 93169 - DNA, 201 bp, Bos taurus; identical to SEQ ID NO: 11445

SEQ ID NO: 93170 - DNA, 201 bp, Bos taurus; identical to SEQ ID NO: 11446

SEQ ID NO: 93171 - DNA, 201 bp, Bos taurus; identical to SEQ ID NO: 11447

SEQ ID NO: 93172 - DNA, 201 bp, Bos taurus; identical to SEQ ID NO: 11448

SEQ ID NO: 93173 - DNA, 201 bp, Bos taurus; identical to SEQ ID NO: 11449

SEQ ID NO: 93174 - DNA, 201 bp, Bos taurus
ggcccggctggacatcaggggccaaaacagacccccagcacctgtgctactcagcttgaaaataaaatcatgaactaaggaccatatgggctttattttctggctgagctggatggccagaaccaaagcaccgacatggacgctttgtcatggccccacacagcccccacggaggaggcaggcagagagggccagcaaagt

SEQ ID NO: 93175 - DNA, 201 bp, Bos taurus
ccgcttccctggggccttagaaacaaatgtctcagggactcagaggtttttctggttaagcgccttaccgcccacatgcacaggccgcagccaatattttcaggtctttatagagtcttccttccactttctgattgatgctcctgttggatgagttttatgtgaagcgttctccaagcccccgtgagataaaaggcctgc

SEQ ID NO: 93176 - DNA, 201 bp, Bos taurus; identical to SEQ ID NO: 11452

SEQ ID NO: 93177 - DNA, 201 bp, Bos taurus; identical to SEQ ID NO: 11453

SEQ ID NO: 93178 - DNA, 201 bp, Bos taurus; identical to SEQ ID NO: 11454

SEQ ID NO: 93179 - DNA, 201 bp, Bos taurus; identical to SEQ ID NO: 11455

SEQ ID NO: 93180 - DNA, 201 bp, Bos taurus; identical to SEQ ID NO: 11457

SEQ ID NO: 93181 - DNA, 201 bp, Bos taurus
gccctgacagcagcgtctctgtctgagcatttggactcatggcctggctggcgggcttggcaaggagcctggacagcatgaggatcttccctgcagagcatgtgtttgacggtgctgtgcgggcctgcagggggacccaggtctccaggataggagaccttgcttcccaggaggaagctgggccatcaccatctgcagcca

SEQ ID NO: 93182 - DNA, 201 bp, Bos taurus; identical to SEQ ID NO: 11458

SEQ ID NO: 93183 - DNA, 201 bp, Bos taurus; identical to SEQ ID NO: 11460

SEQ ID NO: 93184 - DNA, 201 bp, Bos taurus
tgcacaccttcatgcaatgcaaaatttgcccctcatccacacagcacacatcgggtgtacccccacatacacgcgtgtggttgggcccctccagacgcttcccttgccctgcgaggaagaccgggaacgaagtccacagagaatatgaagtcccacctactggcctccctctgatccctttcgctctgtaggggaggggcc

SEQ ID NO: 93185 - DNA, 201 bp, Bos taurus
aggggaagaaaagagaaagggggttggtattcacaaggctgcgtgtcaaagcggctgccgagccttctctcctagaagaagtcaggactccttcccctgctcacctttggtcagcttctggccatttccgggcacttggagccgcgcctgcttgggaaagtgtcagaacaaggccgcctttctcaccgcccatctaagcta

SEQ ID NO: 93186 - DNA, 201 bp, Bos taurus
ggaaagcaccgcattggagcagttgagtatgaagtctgagctctgaggctttttctcttgggcaagtaacttcttattgttttcacatgtgaaacaggagggatacagtgaggactgaaagggataatgtctgggctgtgcttagcacaggatctgatggctggcaaggatgctataacaagtttgcaattattaactatt

SEQ ID NO: 93187 - DNA, 201 bp, Bos taurus; identical to SEQ ID NO: 11463

SEQ ID NO: 93188 - DNA, 201 bp, Bos taurus; identical to SEQ ID NO: 11464

SEQ ID NO: 93189 - DNA, 201 bp, Bos taurus; identical to SEQ ID NO: 11465

SEQ ID NO: 93190 - DNA, 201 bp, Bos taurus; identical to SEQ ID NO: 11466

SEQ ID NO: 93191 - DNA, 201 bp, Bos taurus; identical to SEQ ID NO: 11468

SEQ ID NO: 93192 - DNA, 201 bp, Bos taurus
gactggtgggtttggtaccaagtctgaagagtccggatgagccacggtcaaggatgtggtctcctttgaccctcagcacccagcccaggacctggcctctcggaggagctcaaggaaagaggaatattggtggagtgaaaggctgagtgagtgctagtggcagcctaggacacagagcaggacatctgagcaaaaaggcct

SEQ ID NO: 93193 - DNA, 201 bp, Bos taurus; identical to SEQ ID NO: 11469

SEQ ID NO: 93194 - DNA, 201 bp, Bos taurus
agtatttaagtgccaatctgttctctgcagccaaaggatatagcagctaggtggaatgaaaatctgtattcatatagggccattctgagcatctcttttatgcagatgcatcacaagaggagtgactagttaacattctctgatgtccttatcagggttcggccacatatttcctgaactgcctttgaaaacagggcttcc

SEQ ID NO: 93195 - DNA, 201 bp, Bos taurus
gcctggtccaccactcagtgatcaagatgagtgatctgagatgagtaccacacagaatctggctcagctacccatcacatcttagaatctagctccttcttacggcagggccctcaacttttgtcttttcccctctctgtggcacctcttcctggcttccatttagccaggtccttctctttcttccacaggtcctctttg

SEQ ID NO: 93196 - DNA, 201 bp, Bos taurus; identical to SEQ ID NO: 11471

SEQ ID NO: 93197 - DNA, 201 bp, Bos taurus; identical to SEQ ID NO: 11472

SEQ ID NO: 93198 - DNA, 201 bp, Bos taurus
gtcagtgacaccaccccaccatcttatttcagcacttggaactgatgtgggatgcaagctgtcaggagtcaaccagaaccagcaattttcacaactgctttgtcatttcccattagcccaagatctctttgtacctgctttgttttcttgcatcaagatccttcttcacagcaggaagatcttattaaaatatttccattt

SEQ ID NO: 93199 - DNA, 201 bp, Bos taurus
tctttgttctcagaagcttttacaaagcccttcccaatagacagggccctcaaggagacattcctggcctctttggccctcgttttaagacaaaaaaaaagattaaggagagagaaaagtctagtgactcaaaaatatatttttttctgtcagcacacacatactattggccagaagtagtaaaatataattatcataata

SEQ ID NO: 93200 - DNA, 201 bp, Bos taurus; identical to SEQ ID NO: 11475

SEQ ID NO: 93201 - DNA, 201 bp, Bos taurus
tccatggggtcgcaaggagtcggacacgactgagcgactgaacaagtcagtacatgaagcataggcctgcctaagacacagcaaagggccccagggtgacaggcagcagaagccagagtgacagccacttgagctccttctccgggtggaggcaagagatgaagaaggaaggttctggccagcacggactgtgcggccatg

SEQ ID NO: 93202 - DNA, 201 bp, Bos taurus
ttctttaaagagctcactaaagtaagtcattttttagtcagcagctctcaataggaaaaaaggttacatgattcctcatcctcaggatgccaaacagctcatttaacttgagtctccccagtggtctgacagcccgactgcccgcttcagcagaatctagtccaatctgctggggaaatggtaaaattctctccaccagaa

SEQ ID NO: 93203 - DNA, 201 bp, Bos taurus
cctgtgaaaaccattgccattgtaagttggaggtctatgactgaagagagcctctcagaccccagtttctcctttagccaccagacccaaaggattattactattggcacatttgatgagtcattagaataattccatctccttgttagcaccgatggcagtgcctgactcataaaaggtgctgggtgaatatctgttgaa

SEQ ID NO: 93204 - DNA, 201 bp, Bos taurus
ggcctggcatgttgcagtccacggggtctcaaagagtcagacacgactgagtgactgaactgatgaagcactttcttagcacatatccaggtgtaatattgtggggggcctgtgggtttgaaacttctttttaaattagcaagcaagattaaaacttctttttaatctcacttttcaagtgagatcttaaagggacccaat

SEQ ID NO: 93205 - DNA, 201 bp, Bos taurus
gggagaagaggcatgatctctcaagttatttcccctcaagtctcaacaacaagagtaccaacaatatgtactgagcatctacatgggccagacacaggattactgctgggtcaacactgataaataagatgcatgaggtcttataagccccctggagctggccaccccagaagaaataagaatgcacatcatttcaaattg

SEQ ID NO: 93206 - DNA, 201 bp, Bos taurus; identical to SEQ ID NO: 11476

SEQ ID NO: 93207 - DNA, 201 bp, Bos taurus; identical to SEQ ID NO: 11478

SEQ ID NO: 93208 - DNA, 201 bp, Bos taurus; identical to SEQ ID NO: 11479

SEQ ID NO: 93209 - DNA, 201 bp, Bos taurus; identical to SEQ ID NO: 11480

SEQ ID NO: 93210 - DNA, 201 bp, Bos taurus; identical to SEQ ID NO: 11482

SEQ ID NO: 93211 - DNA, 201 bp, Bos taurus; identical to SEQ ID NO: 11483

SEQ ID NO: 93212 - DNA, 201 bp, Bos taurus
tagttcatagaagctagttcatttagcagttgatgtggtgcttctcattttacttgtaagtttcattatgtttacatgctagtcatggtggaactttattattatgtgccattgagaatttatttttctagatagagaactttggtaatttttatacttgtgaaaatttcatttggaagaggagcatgatagtagatttta

SEQ ID NO: 93213 - DNA, 201 bp, Bos taurus; identical to SEQ ID NO: 11486

SEQ ID NO: 93214 - DNA, 201 bp, Bos taurus; identical to SEQ ID NO: 11487

SEQ ID NO: 93215 - DNA, 201 bp, Bos taurus; identical to SEQ ID NO: 11488

SEQ ID NO: 93216 - DNA, 201 bp, Bos taurus; identical to SEQ ID NO: 11491

SEQ ID NO: 93217 - DNA, 201 bp, Bos taurus; identical to SEQ ID NO: 11492

SEQ ID NO: 93218 - DNA, 201 bp, Bos taurus
gacaacctattttatagtgttcactgtctccgaggacaagctttagtgagcaccatgtttgcttcttatagtattaaaatagacaatgaaatctgcttctcagaagatcatttcaccaagtccctgttgctctgtggggaaaatttgtttcctcatttatattcatgtctctaaaagacaagtagaccttggatgaaattt

SEQ ID NO: 93219 - DNA, 201 bp, Bos taurus; identical to SEQ ID NO: 11493

SEQ ID NO: 93220 - DNA, 201 bp, Bos taurus
acagagcgagaagagttcaaggtccaggggcccagcctggagtaagggttgatgatgggtgccctggcgaggcaaagaaacttgcaaaaatgcctgagggacagatggccaaccagcttttcagaacaggaaatatctactgtttcatttgaagatgtgaatgctgccgtgtaaataagcaccttccaaatcgacatcgaa

SEQ ID NO: 93221 - DNA, 201 bp, Bos taurus
gatgccgtcagtagcaaggccagggtgaccatggagatgctagtcctgatctccctttaagattgttatcccattttatagatgaggaaacagaggctccaaggttgagtagctggcctagactcacacgagagctggactccactgtctttagttttggattcaacttcctcactgacctgaagggtctctgcccacact

SEQ ID NO: 93222 - DNA, 201 bp, Bos taurus
acaataagcagatattccatcatggaaagcattttattggaccactccagagcagacataaaatttcttttattcctatcttttcagcatcttgggacttagatttgtttgcacccaatctataaatccccattatggatcacagccttcttgtggtgaaagggcttgcataactcagtaaagctatgaaccatgctgtga

SEQ ID NO: 93223 - DNA, 201 bp, Bos taurus; identical to SEQ ID NO: 11497

SEQ ID NO: 93224 - DNA, 201 bp, Bos taurus; identical to SEQ ID NO: 11500

SEQ ID NO: 93225 - DNA, 201 bp, Bos taurus; identical to SEQ ID NO: 11502

SEQ ID NO: 93226 - DNA, 201 bp, Bos taurus; identical to SEQ ID NO: 11503

SEQ ID NO: 93227 - DNA, 201 bp, Bos taurus; identical to SEQ ID NO: 11507

SEQ ID NO: 93228 - DNA, 201 bp, Bos taurus; identical to SEQ ID NO: 11508

SEQ ID NO: 93229 - DNA, 201 bp, Bos taurus; identical to SEQ ID NO: 11509

SEQ ID NO: 93230 - DNA, 201 bp, Bos taurus
agcacgcacatatgactcatggggggaaaatattttaaatctggtgaatatggaagtccaagccatcctccatgaggccctctttattctgctgctaccagtcacttcatgcagcctttcagctgttgacttttttgggtgtagtcaggtaggcccctgagtgcaccaagcttcagggaatacatatcaagtttcttgggt

SEQ ID NO: 93231 - DNA, 201 bp, Bos taurus; identical to SEQ ID NO: 11510

SEQ ID NO: 93232 - DNA, 201 bp, Bos taurus
tatagaaaaaatactattagaaaagatatttgcaccctatgttcactgcagtattgtttacaatgcccaagatatggatgcaaactaagagtctatcaattagctgaatggattaaaaatatggagcatgcaaatatataaaggagtattgctcagccctaagtatgaaatcttgccatttgcaacaacatgagttgacct

SEQ ID NO: 93233 - DNA, 201 bp, Bos taurus; identical to SEQ ID NO: 11515

SEQ ID NO: 93234 - DNA, 201 bp, Bos taurus; identical to SEQ ID NO: 11516

SEQ ID NO: 93235 - DNA, 201 bp, Bos taurus
ttagaggaagctgtgtttctgatcatctatctgttcagaagagggagtgtacatatggagtgatgtacaccttagcatgcatgtagggtgatgtacacctcagtttgactgctgttggtatgtgtatctgcttggaagaggagacagcatatattaatgggattttttgtttgctcattttaaaatttgttaataagaaaa

SEQ ID NO: 93236 - DNA, 201 bp, Bos taurus; identical to SEQ ID NO: 11518

SEQ ID NO: 93237 - DNA, 201 bp, Bos taurus; identical to SEQ ID NO: 11519

SEQ ID NO: 93238 - DNA, 201 bp, Bos taurus; identical to SEQ ID NO: 11520

SEQ ID NO: 93239 - DNA, 201 bp, Bos taurus; identical to SEQ ID NO: 11521

SEQ ID NO: 93240 - DNA, 201 bp, Bos taurus; identical to SEQ ID NO: 11522

SEQ ID NO: 93241 - DNA, 201 bp, Bos taurus; identical to SEQ ID NO: 11525

SEQ ID NO: 93242 - DNA, 201 bp, Bos taurus; identical to SEQ ID NO: 11526

SEQ ID NO: 93243 - DNA, 201 bp, Bos taurus; identical to SEQ ID NO: 11527

SEQ ID NO: 93244 - DNA, 201 bp, Bos taurus; identical to SEQ ID NO: 11528

SEQ ID NO: 93245 - DNA, 201 bp, Bos taurus; identical to SEQ ID NO: 11529

SEQ ID NO: 93246 - DNA, 201 bp, Bos taurus
gctgccctctgctgtcgggacctgcttgttgtgtgaccttaccctcttcaggtattcattccacagaacctgtcaccctcctcacttctaggccactaccacacaagaccagcccgacaccctccagccaccccacctttcaccaggggagctggacgttcccagctggtctgcccagtggccccagagcctcagccctag

SEQ ID NO: 93247 - DNA, 201 bp, Bos taurus; identical to SEQ ID NO: 11530

SEQ ID NO: 93248 - DNA, 201 bp, Bos taurus; identical to SEQ ID NO: 11532

SEQ ID NO: 93249 - DNA, 201 bp, Bos taurus; identical to SEQ ID NO: 11533

SEQ ID NO: 93250 - DNA, 201 bp, Bos taurus; identical to SEQ ID NO: 11539

SEQ ID NO: 93251 - DNA, 201 bp, Bos taurus; identical to SEQ ID NO: 11540

SEQ ID NO: 93252 - DNA, 201 bp, Bos taurus; identical to SEQ ID NO: 11542

SEQ ID NO: 93253 - DNA, 201 bp, Bos taurus; identical to SEQ ID NO: 11544

SEQ ID NO: 93254 - DNA, 201 bp, Bos taurus; identical to SEQ ID NO: 11545

SEQ ID NO: 93255 - DNA, 201 bp, Bos taurus; identical to SEQ ID NO: 11546

SEQ ID NO: 93256 - DNA, 201 bp, Bos taurus; identical to SEQ ID NO: 11547

SEQ ID NO: 93257 - DNA, 201 bp, Bos taurus; identical to SEQ ID NO: 11550

SEQ ID NO: 93258 - DNA, 201 bp, Bos taurus; identical to SEQ ID NO: 11551

SEQ ID NO: 93259 - DNA, 201 bp, Bos taurus; identical to SEQ ID NO: 11553

SEQ ID NO: 93260 - DNA, 201 bp, Bos taurus; identical to SEQ ID NO: 11554

SEQ ID NO: 93261 - DNA, 201 bp, Bos taurus; identical to SEQ ID NO: 11559

SEQ ID NO: 93262 - DNA, 201 bp, Bos taurus; identical to SEQ ID NO: 11566

SEQ ID NO: 93263 - DNA, 201 bp, Bos taurus; identical to SEQ ID NO: 11567

SEQ ID NO: 93264 - DNA, 201 bp, Bos taurus; identical to SEQ ID NO: 11568

SEQ ID NO: 93265 - DNA, 201 bp, Bos taurus; identical to SEQ ID NO: 11571

SEQ ID NO: 93266 - DNA, 201 bp, Bos taurus; identical to SEQ ID NO: 11574

SEQ ID NO: 93267 - DNA, 201 bp, Bos taurus; identical to SEQ ID NO: 11576

SEQ ID NO: 93268 - DNA, 201 bp, Bos taurus; identical to SEQ ID NO: 11577

SEQ ID NO: 93269 - DNA, 201 bp, Bos taurus; identical to SEQ ID NO: 11578

SEQ ID NO: 93270 - DNA, 201 bp, Bos taurus; identical to SEQ ID NO: 11580

SEQ ID NO: 93271 - DNA, 201 bp, Bos taurus; identical to SEQ ID NO: 11581

SEQ ID NO: 93272 - DNA, 201 bp, Bos taurus; identical to SEQ ID NO: 11583

SEQ ID NO: 93273 - DNA, 201 bp, Bos taurus; identical to SEQ ID NO: 11584

SEQ ID NO: 93274 - DNA, 201 bp, Bos taurus; identical to SEQ ID NO: 11585

SEQ ID NO: 93275 - DNA, 201 bp, Bos taurus; identical to SEQ ID NO: 11587

SEQ ID NO: 93276 - DNA, 201 bp, Bos taurus; identical to SEQ ID NO: 11590

SEQ ID NO: 93277 - DNA, 201 bp, Bos taurus; identical to SEQ ID NO: 11592

SEQ ID NO: 93278 - DNA, 201 bp, Bos taurus; identical to SEQ ID NO: 11593

SEQ ID NO: 93279 - DNA, 201 bp, Bos taurus; identical to SEQ ID NO: 11594

SEQ ID NO: 93280 - DNA, 201 bp, Bos taurus; identical to SEQ ID NO: 11595

SEQ ID NO: 93281 - DNA, 201 bp, Bos taurus; identical to SEQ ID NO: 11599

SEQ ID NO: 93282 - DNA, 201 bp, Bos taurus; identical to SEQ ID NO: 11600

SEQ ID NO: 93283 - DNA, 201 bp, Bos taurus; identical to SEQ ID NO: 11601

SEQ ID NO: 93284 - DNA, 201 bp, Bos taurus; identical to SEQ ID NO: 11602

SEQ ID NO: 93285 - DNA, 201 bp, Bos taurus
gccagtagtctcacagcttttatgaaggagaaaatttttgaagtcgttactaattccagttgtattacccccaaagagtttatttaaaatgctttcacggttgtttggccatatagcattttacatctgaatatcagccagactcctaagcacagttggcatgcttcaccaattgtgaattattaatttaagtattaattt

SEQ ID NO: 93286 - DNA, 201 bp, Bos taurus; identical to SEQ ID NO: 11603

SEQ ID NO: 93287 - DNA, 201 bp, Bos taurus; identical to SEQ ID NO: 11604

SEQ ID NO: 93288 - DNA, 201 bp, Bos taurus; identical to SEQ ID NO: 11605

SEQ ID NO: 93289 - DNA, 201 bp, Bos taurus
atttggctgagagtgaagaatgaaatgaagtccataaagatatccctgaggtgaaggatgaaggaactgtatctctgggccactgggacaagagcaacttcaagaagaaagcaatcttagcatcctgtccaccagtccttccagatgctggagggagtgcctttctcttctggatcaggcctagatcagcccaagtagaag

SEQ ID NO: 93290 - DNA, 201 bp, Bos taurus; identical to SEQ ID NO: 11607

SEQ ID NO: 93291 - DNA, 201 bp, Bos taurus
gtggaattgattttttatgtcattcccccatggaaaagtggaattttcccttccttcccttgaaactgggctgggttgagagattggattgaccaatagaacacagaggaatgaagctctgggacttttgaagctaagtagtgggttggtacaaaagtaactgtggttctggaccatgaattttaaaccattataactagg

SEQ ID NO: 93292 - DNA, 201 bp, Bos taurus; identical to SEQ ID NO: 11610

SEQ ID NO: 93293 - DNA, 201 bp, Bos taurus; identical to SEQ ID NO: 11611

SEQ ID NO: 93294 - DNA, 201 bp, Bos taurus; identical to SEQ ID NO: 11612

SEQ ID NO: 93295 - DNA, 201 bp, Bos taurus; identical to SEQ ID NO: 11614

SEQ ID NO: 93296 - DNA, 201 bp, Bos taurus; identical to SEQ ID NO: 11615

SEQ ID NO: 93297 - DNA, 201 bp, Bos taurus; identical to SEQ ID NO: 11616

SEQ ID NO: 93298 - DNA, 201 bp, Bos taurus; identical to SEQ ID NO: 11617

SEQ ID NO: 93299 - DNA, 201 bp, Bos taurus; identical to SEQ ID NO: 11618

SEQ ID NO: 93300 - DNA, 201 bp, Bos taurus; identical to SEQ ID NO: 11619

SEQ ID NO: 93301 - DNA, 201 bp, Bos taurus; identical to SEQ ID NO: 11620

SEQ ID NO: 93302 - DNA, 201 bp, Bos taurus; identical to SEQ ID NO: 11621

SEQ ID NO: 93303 - DNA, 201 bp, Bos taurus; identical to SEQ ID NO: 11622

SEQ ID NO: 93304 - DNA, 201 bp, Bos taurus; identical to SEQ ID NO: 11623

SEQ ID NO: 93305 - DNA, 201 bp, Bos taurus; identical to SEQ ID NO: 11625

SEQ ID NO: 93306 - DNA, 201 bp, Bos taurus; identical to SEQ ID NO: 11627

SEQ ID NO: 93307 - DNA, 201 bp, Bos taurus; identical to SEQ ID NO: 11628

SEQ ID NO: 93308 - DNA, 201 bp, Bos taurus; identical to SEQ ID NO: 11629

SEQ ID NO: 93309 - DNA, 201 bp, Bos taurus; identical to SEQ ID NO: 11630

SEQ ID NO: 93310 - DNA, 201 bp, Bos taurus; identical to SEQ ID NO: 11631

SEQ ID NO: 93311 - DNA, 201 bp, Bos taurus; identical to SEQ ID NO: 11636

SEQ ID NO: 93312 - DNA, 201 bp, Bos taurus; identical to SEQ ID NO: 11637

SEQ ID NO: 93313 - DNA, 201 bp, Bos taurus; identical to SEQ ID NO: 11638

SEQ ID NO: 93314 - DNA, 201 bp, Bos taurus; identical to SEQ ID NO: 11639

SEQ ID NO: 93315 - DNA, 201 bp, Bos taurus; identical to SEQ ID NO: 11640

SEQ ID NO: 93316 - DNA, 201 bp, Bos taurus; identical to SEQ ID NO: 11642

SEQ ID NO: 93317 - DNA, 201 bp, Bos taurus; identical to SEQ ID NO: 11643

SEQ ID NO: 93318 - DNA, 201 bp, Bos taurus; identical to SEQ ID NO: 11644

SEQ ID NO: 93319 - DNA, 201 bp, Bos taurus
aaggagagccatcctagaaccgttctattgggtacagagacaagaggtagagaaaaaaattggcctgtgaatacttacaaagtaaatcagtgcttttaatttaaaaatttaataatgatataaaagtggtaaggaaaccatctggaaaccagcaccaattattggagctggcatcaaggaggatgggcctggtctggcctc

SEQ ID NO: 93320 - DNA, 201 bp, Bos taurus
aaaatgaggaagttaattgcaattgattgccaagtccctttgagttctagaagttctagactttgtaagatcccatccaacaaacatacatgggtcaggcgtggtgctgggccctgctgaaggggcaagaggaccggatgcccttccttcaagggactcacactgtaggagggagaacaggagtttctgcaagtagctggg

SEQ ID NO: 93321 - DNA, 201 bp, Bos taurus; identical to SEQ ID NO: 11647

SEQ ID NO: 93322 - DNA, 201 bp, Bos taurus; identical to SEQ ID NO: 11649

SEQ ID NO: 93323 - DNA, 201 bp, Bos taurus; identical to SEQ ID NO: 11650

SEQ ID NO: 93324 - DNA, 201 bp, Bos taurus; identical to SEQ ID NO: 11651

SEQ ID NO: 93325 - DNA, 201 bp, Bos taurus; identical to SEQ ID NO: 11655

SEQ ID NO: 93326 - DNA, 201 bp, Bos taurus; identical to SEQ ID NO: 11656

SEQ ID NO: 93327 - DNA, 201 bp, Bos taurus
ctgtcaagttggcacataaaattaaccatcacagtggctgacctgtccactgaagaatgttcagcagcatccttggcctctatccactccatgcaagaactgcctgtccagtagtaactacgtctccaaatgagccctgggaagaaaattcaccctccattgagagctgttgcctcagaggattccttctactggatatgg

SEQ ID NO: 93328 - DNA, 201 bp, Bos taurus; identical to SEQ ID NO: 11657

SEQ ID NO: 93329 - DNA, 201 bp, Bos taurus; identical to SEQ ID NO: 11658

SEQ ID NO: 93330 - DNA, 201 bp, Bos taurus; identical to SEQ ID NO: 11659

SEQ ID NO: 93331 - DNA, 201 bp, Bos taurus
agcttgttggagatgcgaaacctcaggccccactcccgaccgactgaatcagacctgcacgtcacagagccaggagactcacaagtgtattccagtctgaacacagaacaggcctccccattgctcctcgggactccaggcttgtccgccctgcctgcccagcagggtggcgagagccgtccggacaagaaccgtgccagg

SEQ ID NO: 93332 - DNA, 201 bp, Bos taurus; identical to SEQ ID NO: 11662

SEQ ID NO: 93333 - DNA, 201 bp, Bos taurus
acgatgttccctacactgtcgaatggggatctgtcagaatccgtttctctcatccttgattacgagccccttatggagaggaccgtgtatcctgagatgatgtgtactaaagcagaggacagtgttatccacatcgtcagtatttctcaaactttaatgggtgcacaaatcagtgagaggatcctgtcaaatgcagtttct

SEQ ID NO: 93334 - DNA, 201 bp, Bos taurus; identical to SEQ ID NO: 11663

SEQ ID NO: 93335 - DNA, 201 bp, Bos taurus; identical to SEQ ID NO: 11664

SEQ ID NO: 93336 - DNA, 201 bp, Bos taurus
tacagacagaggcagctctgggctcatgtgtgaggcccaggaggccagtattccaggcatctgtggagagaagggagggggaccctgagccccagtcatcccccaagactcaggctcctgtgtggccacatgtgaggacagtgggctagaaaggcgctgccccgggggtgtaccatgtctgacctctgcaacgaagtgaac

SEQ ID NO: 93337 - DNA, 201 bp, Bos taurus; identical to SEQ ID NO: 11665

SEQ ID NO: 93338 - DNA, 201 bp, Bos taurus; identical to SEQ ID NO: 11666

SEQ ID NO: 93339 - DNA, 201 bp, Bos taurus
aaggtgaagaccgtgaaagtgtctgctgaggaccctccaggtgaccaaggacatggactccagctcctgctaggagctcgtctagaactcctagacggccgtgtgggaactgctgcagggctgcaggggggtgacctgacacgccatgctcccagagagatatgccctccccttttggccctaaatcctggagaagaaata

SEQ ID NO: 93340 - DNA, 201 bp, Bos taurus
tataggtccgtatccttccccacttctttctaaattcatcatctcaaaactcacctctcttctaagaagtctcctatagcactatgctcagattattctcccagagtttgaaacacaaacatatcaggctgttttctctcagaagacacgggcccagagggcaggaatcagatgccttctttttctactaaactgtatact

SEQ ID NO: 93341 - DNA, 201 bp, Bos taurus; identical to SEQ ID NO: 11669

SEQ ID NO: 93342 - DNA, 201 bp, Bos taurus; identical to SEQ ID NO: 11672

SEQ ID NO: 93343 - DNA, 201 bp, Bos taurus; identical to SEQ ID NO: 11673

SEQ ID NO: 93344 - DNA, 201 bp, Bos taurus
catggccttgacaggagctcatcagcagatagggggcctcctaagctactcaaaatccacccagcttgagcgtttgtcgctgttgttattgtagatgcagtctagacttaaagggcgtctgggacctgggcttcggggtcaaggcagtccagtctccccatcagagcagacgcccttcctcccaggggcgtggggcggcct

SEQ ID NO: 93345 - DNA, 201 bp, Bos taurus
atcaagatcaacttattaattgaatttctccaggtagttacaatagctttttaaaaaaaatcataccatctttttcttgaaatatagtttatgtacaatattatgttgatttcagacgtactgcttaatgatttgacttttgcatacattatgaaatgaccaccacaataactctggtaaccatctgtcccccctcaaagt

SEQ ID NO: 93346 - DNA, 201 bp, Bos taurus; identical to SEQ ID NO: 11674

SEQ ID NO: 93347 - DNA, 201 bp, Bos taurus; identical to SEQ ID NO: 11675

SEQ ID NO: 93348 - DNA, 201 bp, Bos taurus
acatctggggcgtgtttatgaggagggacaggaaggctcctgcaacgggcctctcacgctgctcccggaggcgcagtgcaaagggaagcaggaaatgacaagcaaccataacttaaaccggccgtggcgcctgccctggttcacttcctaagtgaccactgcttaacaggccggcatctgagagaggacggtgtggtccta

SEQ ID NO: 93349 - DNA, 201 bp, Bos taurus
gccggtggaggacagcttgctgggaaggagcaacgtgcggcgagaggaccaccgctcggggtgttgcgtgagttgaaagaaggcctgggcataaagaattctaggcaatttaccaaggcagcaacagtcaagattgagttggagaacagtattacagttgagagagccaacctggggctagacttcctggtcacccatctt

SEQ ID NO: 93350 - DNA, 201 bp, Bos taurus; identical to SEQ ID NO: 11676

SEQ ID NO: 93351 - DNA, 201 bp, Bos taurus; identical to SEQ ID NO: 11679

SEQ ID NO: 93352 - DNA, 201 bp, Bos taurus; identical to SEQ ID NO: 11680

SEQ ID NO: 93353 - DNA, 201 bp, Bos taurus; identical to SEQ ID NO: 11681

SEQ ID NO: 93354 - DNA, 201 bp, Bos taurus; identical to SEQ ID NO: 11683

SEQ ID NO: 93355 - DNA, 201 bp, Bos taurus; identical to SEQ ID NO: 11684

SEQ ID NO: 93356 - DNA, 201 bp, Bos taurus; identical to SEQ ID NO: 11685

SEQ ID NO: 93357 - DNA, 201 bp, Bos taurus; identical to SEQ ID NO: 11686

SEQ ID NO: 93358 - DNA, 201 bp, Bos taurus; identical to SEQ ID NO: 11687

SEQ ID NO: 93359 - DNA, 201 bp, Bos taurus; identical to SEQ ID NO: 11688

SEQ ID NO: 93360 - DNA, 201 bp, Bos taurus; identical to SEQ ID NO: 11689

SEQ ID NO: 93361 - DNA, 201 bp, Bos taurus; identical to SEQ ID NO: 11690

SEQ ID NO: 93362 - DNA, 201 bp, Bos taurus
gcacgtatgattatcattattttattgcagaatgaggagcaatgctccctgtgatgagaggtgccagaactaacatctaagaccaagacggcagagcagcgccaggtgcagggtgcttttctgtagagccgtgcccagtttggcctcggtgtcctgcagctgtgactgcggtgctaacctctgttgtctccagatatgctg

SEQ ID NO: 93363 - DNA, 201 bp, Bos taurus; identical to SEQ ID NO: 11691

SEQ ID NO: 93364 - DNA, 201 bp, Bos taurus
gacaaatgcctctcctccatcctccagggcgacagcatcagtgaggaccctggtcgatggccgagacctcacgtggcctctgagcccttcttaacgttgttcttcagggctccaccaagaagtgaagtgatgtggcatgcaagatgcaatctctctttatccttgaagtaccagcgagagaaaatgggccaaagagacatc

SEQ ID NO: 93365 - DNA, 201 bp, Bos taurus
caggcaggaagctgtagaagtgttatcaatacgacaaatgaaatgtggatgcctctagagtcttatacaaccaccaaggcccctctcggaatcatacgtacatccatcgatacatacaattttgcatacaagctcataactggaagctgagatgtctcacttaggatactgtcacaaattacgtattttaaagacaaggca

SEQ ID NO: 93366 - DNA, 201 bp, Bos taurus; identical to SEQ ID NO: 11692

SEQ ID NO: 93367 - DNA, 201 bp, Bos taurus; identical to SEQ ID NO: 11693

SEQ ID NO: 93368 - DNA, 201 bp, Bos taurus; identical to SEQ ID NO: 11694

SEQ ID NO: 93369 - DNA, 201 bp, Bos taurus; identical to SEQ ID NO: 11695

SEQ ID NO: 93370 - DNA, 201 bp, Bos taurus; identical to SEQ ID NO: 11696

SEQ ID NO: 93371 - DNA, 201 bp, Bos taurus; identical to SEQ ID NO: 11697

SEQ ID NO: 93372 - DNA, 201 bp, Bos taurus; identical to SEQ ID NO: 11698

SEQ ID NO: 93373 - DNA, 201 bp, Bos taurus; identical to SEQ ID NO: 11699

SEQ ID NO: 93374 - DNA, 201 bp, Bos taurus; identical to SEQ ID NO: 11701

SEQ ID NO: 93375 - DNA, 201 bp, Bos taurus; identical to SEQ ID NO: 11702

SEQ ID NO: 93376 - DNA, 201 bp, Bos taurus; identical to SEQ ID NO: 11703

SEQ ID NO: 93377 - DNA, 201 bp, Bos taurus; identical to SEQ ID NO: 11704

SEQ ID NO: 93378 - DNA, 201 bp, Bos taurus; identical to SEQ ID NO: 11705

SEQ ID NO: 93379 - DNA, 201 bp, Bos taurus; identical to SEQ ID NO: 11706

SEQ ID NO: 93380 - DNA, 201 bp, Bos taurus; identical to SEQ ID NO: 11707

SEQ ID NO: 93381 - DNA, 201 bp, Bos taurus; identical to SEQ ID NO: 11710

SEQ ID NO: 93382 - DNA, 201 bp, Bos taurus; identical to SEQ ID NO: 11711

SEQ ID NO: 93383 - DNA, 201 bp, Bos taurus; identical to SEQ ID NO: 11712

SEQ ID NO: 93384 - DNA, 201 bp, Bos taurus; identical to SEQ ID NO: 11713

SEQ ID NO: 93385 - DNA, 201 bp, Bos taurus; identical to SEQ ID NO: 11714

SEQ ID NO: 93386 - DNA, 201 bp, Bos taurus; identical to SEQ ID NO: 11715

SEQ ID NO: 93387 - DNA, 201 bp, Bos taurus
ctccattccattccctctatttccttttggcaaagtggatgcctgaataaagaatacaataatttctagatctcattaggtgacaatacatggtttctgaacatacaagttagtggctcttcttgagatttctacagcaaataatgcctaaatatgagaacaaaccaaaagtgctgacagcaaatatatgccactgctgtg

SEQ ID NO: 93388 - DNA, 201 bp, Bos taurus; identical to SEQ ID NO: 11716

SEQ ID NO: 93389 - DNA, 201 bp, Bos taurus; identical to SEQ ID NO: 11717

SEQ ID NO: 93390 - DNA, 201 bp, Bos taurus; identical to SEQ ID NO: 11719

SEQ ID NO: 93391 - DNA, 201 bp, Bos taurus; identical to SEQ ID NO: 11720

SEQ ID NO: 93392 - DNA, 201 bp, Bos taurus; identical to SEQ ID NO: 11721

SEQ ID NO: 93393 - DNA, 201 bp, Bos taurus
gaggatatatacaccagactggacatgtcacctgccctcaatcagccccagggcttcttggcctctcgcagaatgagcaatactcctcactgaatgggaagttaatgtttgtttaaagataggtatttaaacaaacctcattagcttatataaaaacctcattttcattacaaacaaatataattactacttctgtggtct

SEQ ID NO: 93394 - DNA, 201 bp, Bos taurus; identical to SEQ ID NO: 11722

SEQ ID NO: 93395 - DNA, 201 bp, Bos taurus
tcagagccatgagtgcacccaccagatccgggtccgcgtgcaggcagccatcagcgtcagggggctttctctccactttcttctggcccacagttgctgtggcgggacgagcccgatagccacctccgctgatgggagggggcacaggtctcaggctgggggcctcttccttcttcttgtcatagggccgatgaccgcggg

SEQ ID NO: 93396 - DNA, 201 bp, Bos taurus
atgttcaagctaccgtacaactgtgctcatttcatctgctagaaaggtactggtcaaagtccttcaagctagcttaaacttgaaccaaaagcttccagatgtacaagctggatttagaaaagacagaggaatctgagatcaaattaccatcattcgctggatcatagagaaaacaagagaattccagaaaaacatctactt

SEQ ID NO: 93397 - DNA, 201 bp, Bos taurus; identical to SEQ ID NO: 11725

SEQ ID NO: 93398 - DNA, 201 bp, Bos taurus; identical to SEQ ID NO: 11726

SEQ ID NO: 93399 - DNA, 201 bp, Bos taurus; identical to SEQ ID NO: 11729

SEQ ID NO: 93400 - DNA, 201 bp, Bos taurus; identical to SEQ ID NO: 11730

SEQ ID NO: 93401 - DNA, 201 bp, Bos taurus
ctgttctcctgctctctgcacatcacctgcctgaccaggacctgtttccctgacaccctgcttacagggctgaccttcctacatacttgccccaggcctcggctagtgactgttcttatcaaagtgtggtgaggaacttgcccctcttctggcttccctggtaaccaatgaatcactctgatgccagcaccccctataact

SEQ ID NO: 93402 - DNA, 201 bp, Bos taurus; identical to SEQ ID NO: 11731

SEQ ID NO: 93403 - DNA, 201 bp, Bos taurus; identical to SEQ ID NO: 11732

SEQ ID NO: 93404 - DNA, 201 bp, Bos taurus; identical to SEQ ID NO: 11734

SEQ ID NO: 93405 - DNA, 201 bp, Bos taurus; identical to SEQ ID NO: 11735

SEQ ID NO: 93406 - DNA, 201 bp, Bos taurus; identical to SEQ ID NO: 11736

SEQ ID NO: 93407 - DNA, 201 bp, Bos taurus; identical to SEQ ID NO: 11737

SEQ ID NO: 93408 - DNA, 201 bp, Bos taurus; identical to SEQ ID NO: 11738

SEQ ID NO: 93409 - DNA, 201 bp, Bos taurus; identical to SEQ ID NO: 11739

SEQ ID NO: 93410 - DNA, 201 bp, Bos taurus; identical to SEQ ID NO: 11740

SEQ ID NO: 93411 - DNA, 201 bp, Bos taurus
cagtcccacagtttgctgggccctgggtccacccattagtaagctgctccagccttcagaccagcctcacccaccagagggggaacaccagccctgggacaacggcagtcctgtggcctgctatgacaggccccagtcaacatgtcagcaccagacctgggcctgggggagggggctgtcttgcccaccagcaggtcaaca

SEQ ID NO: 93412 - DNA, 201 bp, Bos taurus; identical to SEQ ID NO: 11741

SEQ ID NO: 93413 - DNA, 201 bp, Bos taurus; identical to SEQ ID NO: 11742

SEQ ID NO: 93414 - DNA, 201 bp, Bos taurus
gatcaaggataatgccaacagtggggaagctgttgatagtatgtgctcctgacaggacgtgacgagcacgagccctggcctctgtcatcttcctcctaaaaatggagtaactcagtctaatctcgagagtagcatcaggcaaacccaaactgaaggccattttacaaaatacctgaccagctctcataattgtcaaggcgc

SEQ ID NO: 93415 - DNA, 201 bp, Bos taurus
tttcagtggctgtgattccctgtgttgtacaatatgtctgtactgctgatctattttatacagtagtctgcctctcttagccccgtatctctaatctgtctctccccacttcggtctcctcactgtaaccactagtttgttttctgtatctgtaaatctatttctgttcagattccacgtataagcgatatcatacagcac

SEQ ID NO: 93416 - DNA, 201 bp, Bos taurus; identical to SEQ ID NO: 11744

SEQ ID NO: 93417 - DNA, 201 bp, Bos taurus; identical to SEQ ID NO: 11745

SEQ ID NO: 93418 - DNA, 201 bp, Bos taurus
gttctgcttctactcctgatcttgcctgagtcaagaacttcagaaaccttctggagatttgagtatggggaccatggcctggttggaatctgaagggacacggcacaaaccaggaaaaaattcctccaccatggtacatggggcagtggggcggccactggcctggcaactaaaccccagctggagcctgagacgctcttc

SEQ ID NO: 93419 - DNA, 201 bp, Bos taurus
ccaagggaggcagacagcaaacacttcacctgcagaggaatacaggcctgctctatcaaggtctcaccagtgaacctggcagatggaggagagatggaaagcaagggtgtggaaaagaggcctagaggaaggctctcagctgtgcaggaggaagctgcaagaatgctcatcccacttgtgtttgtgaaagagaaaaattga

SEQ ID NO: 93420 - DNA, 201 bp, Bos taurus
ggtccactcgtcatcatctaatacagagcagctcaattgggccgagtctgtgccaagcctcctcagagctcattggccaccctggtgacctgcctgcattggttgggacaccaaataccacagcatcagatgcggtgcaggtagcatgattggcccactaagtgcaagaaccaatctgggaacccaggaaggttgtgctag

SEQ ID NO: 93421 - DNA, 201 bp, Bos taurus; identical to SEQ ID NO: 11747

SEQ ID NO: 93422 - DNA, 201 bp, Bos taurus; identical to SEQ ID NO: 11748

SEQ ID NO: 93423 - DNA, 201 bp, Bos taurus; identical to SEQ ID NO: 11749

SEQ ID NO: 93424 - DNA, 201 bp, Bos taurus; identical to SEQ ID NO: 11751

SEQ ID NO: 93425 - DNA, 201 bp, Bos taurus; identical to SEQ ID NO: 11752

SEQ ID NO: 93426 - DNA, 201 bp, Bos taurus; identical to SEQ ID NO: 11753

SEQ ID NO: 93427 - DNA, 201 bp, Bos taurus
ggcggggaggcctcggggagcagctgctctgcgggccctgccccgggagacacacgagtcagaacgggtgcggccctgcggggccctgtccccccggccactgtggttctaaagatttctgaccatgattctcaaagaacaaaaaacggttacagttttaggaagaaaaaataaaaccagaaactctaccctcatagagga

SEQ ID NO: 93428 - DNA, 201 bp, Bos taurus
caacaccaaggtcatgccaccatgaatcctatggccagttatctcactctctcttctgtgaatacgcaaaacaaggggaaagatttagattttcactcatataacagtatggccaggccttagctgcacacacacaccctgcacgccttacctggaaccccatatctacaaaacatccaaagacagtgctcaagcaggccg

SEQ ID NO: 93429 - DNA, 201 bp, Bos taurus; identical to SEQ ID NO: 11754

SEQ ID NO: 93430 - DNA, 201 bp, Bos taurus
tacctaagaaacaaattaacagggagggagctatgtcttgttatactttttactcaagacttgaatgaatatattagttttaagactttaaatcagaaaggtcagcagtgataaagttccttagcagttcaattatttttgtatatattttaattgtgcttaacagaaattgctcctgttctgtcttgtttgttataatta

SEQ ID NO: 93431 - DNA, 201 bp, Bos taurus; identical to SEQ ID NO: 11755

SEQ ID NO: 93432 - DNA, 201 bp, Bos taurus; identical to SEQ ID NO: 11757

SEQ ID NO: 93433 - DNA, 201 bp, Bos taurus; identical to SEQ ID NO: 11758

SEQ ID NO: 93434 - DNA, 201 bp, Bos taurus; identical to SEQ ID NO: 11759

SEQ ID NO: 93435 - DNA, 201 bp, Bos taurus; identical to SEQ ID NO: 11760

SEQ ID NO: 93436 - DNA, 201 bp, Bos taurus; identical to SEQ ID NO: 11761

SEQ ID NO: 93437 - DNA, 201 bp, Bos taurus; identical to SEQ ID NO: 11762

SEQ ID NO: 93438 - DNA, 201 bp, Bos taurus; identical to SEQ ID NO: 11763

SEQ ID NO: 93439 - DNA, 201 bp, Bos taurus; identical to SEQ ID NO: 11764

SEQ ID NO: 93440 - DNA, 201 bp, Bos taurus
acttaacacctttttgaataacttatgacttagctttgtacttgctatacgtgatccagtcataatgtaaacacatttaatttaaatgtacttggtgtctctgaaaaggagcaatgtatattttttgagtatgtgaatgatgacagcatgaagagctatggcatcatgtcctctgagttatagtttaaaataaatatcatg

SEQ ID NO: 93441 - DNA, 201 bp, Bos taurus; identical to SEQ ID NO: 11765

SEQ ID NO: 93442 - DNA, 201 bp, Bos taurus; identical to SEQ ID NO: 11766

SEQ ID NO: 93443 - DNA, 201 bp, Bos taurus; identical to SEQ ID NO: 11767

SEQ ID NO: 93444 - DNA, 201 bp, Bos taurus; identical to SEQ ID NO: 11768

SEQ ID NO: 93445 - DNA, 201 bp, Bos taurus; identical to SEQ ID NO: 11769

SEQ ID NO: 93446 - DNA, 201 bp, Bos taurus; identical to SEQ ID NO: 11770

SEQ ID NO: 93447 - DNA, 201 bp, Bos taurus; identical to SEQ ID NO: 11772

SEQ ID NO: 93448 - DNA, 201 bp, Bos taurus; identical to SEQ ID NO: 11773

SEQ ID NO: 93449 - DNA, 201 bp, Bos taurus; identical to SEQ ID NO: 11774

SEQ ID NO: 93450 - DNA, 201 bp, Bos taurus
aactttcatcatagagtgccttgttacctgggagagttcacaacctgacggttcaagccagtttgttcgtcctcaccttcccccaccccgccctggccagagttgactggtcacacagtctttctctaggagttttcaaccaaacatcttaagattcagaaacagtcagcagcctttttctctaaccaggctgctgccaaa

SEQ ID NO: 93451 - DNA, 201 bp, Bos taurus; identical to SEQ ID NO: 11775

SEQ ID NO: 93452 - DNA, 201 bp, Bos taurus; identical to SEQ ID NO: 11776

SEQ ID NO: 93453 - DNA, 201 bp, Bos taurus
gcaatgggaccacagggatcagagcaagagaagggaacaatatgggggcagtttggcgcaagatcagcatagcatcagaaaataataatagtaataataacagaacaaggatcctagtgaactgaattcatctggtttttaaaatgctttaactatggaagtacattagggaaaaaaaaagatgtatagtagatattacaa

SEQ ID NO: 93454 - DNA, 201 bp, Bos taurus
tgactaggaactcaacgcattcggctcttggtaaatggatctcacatccttggtggattcttccaaaataatcatctaataatctaaggaaagatgatttggaatcctactctataagtgactgatgtgctagagtgagacatttcattaaatcgattattcactgagaaaatctgtgttcccatcttgtgccaaacacca

SEQ ID NO: 93455 - DNA, 201 bp, Bos taurus; identical to SEQ ID NO: 11777

SEQ ID NO: 93456 - DNA, 201 bp, Bos taurus; identical to SEQ ID NO: 11778

SEQ ID NO: 93457 - DNA, 201 bp, Bos taurus
ttgtcatttggctttgccaagttttatcttgttttatttttttacctaatataatacaataataaattctcctagtgtttaaatataacttggtttcttactagtgagggagcaatataaaaaatttaaattcaaaaaccctaatctgtcacaaaaatatttgttaaaaggaaaatctttgctcttttactatgtttggaa

SEQ ID NO: 93458 - DNA, 201 bp, Bos taurus; identical to SEQ ID NO: 11779

SEQ ID NO: 93459 - DNA, 201 bp, Bos taurus
gaaacttctcgccttaagcaggatcaatccaggacctaaagcttcaggagacctggaagtaggagtcctggaggatcaggggaagacccggacagtcctgaaaatagagacaatcatcccaggcctctttacgttctctcaatgagctaaaagtcagctgacattttccagtgacctaggctactaagatgaatgtgtgtg

SEQ ID NO: 93460 - DNA, 201 bp, Bos taurus; identical to SEQ ID NO: 11780

SEQ ID NO: 93461 - DNA, 201 bp, Bos taurus
ggcccggttatccctccttcttgaactacttctatcatctccagaagacagctcatcttccagctttgatggagaagagctcacttgctcccatccagtctgtggttcagtcttatatgtgaaagaaaaatatcactgaaagtaaaaggacatttaagatttccttctcctaaaagtttctttttaacgagttagcttcat

SEQ ID NO: 93462 - DNA, 201 bp, Bos taurus; identical to SEQ ID NO: 11781

SEQ ID NO: 93463 - DNA, 201 bp, Bos taurus; identical to SEQ ID NO: 11782

SEQ ID NO: 93464 - DNA, 201 bp, Bos taurus
ttgctttccttaactattaaatacctaacaccagaatatttaggaggactatgatgattaaacaccatgtgtcaaatataaaaactgagtgtgtataacacggtataattgagtgtataatagaaagaaaacaagaaatgagttatgactcacaaaaaaatgtaatcacaaattaaaattctaccaactataagccttttt

SEQ ID NO: 93465 - DNA, 201 bp, Bos taurus
gcatatcaaagctcactgacagctgtcatcaccacaatcctttctaacttttaacaaaaacctggaatctcattagagtatttacaggccaacagcttttgtttttaataaatcagattggttctgaccagtagcaaagacatggggagtgctctccagttcactgatgagcagctgatgacggctgtccccgggcacagt

SEQ ID NO: 93466 - DNA, 201 bp, Bos taurus
aatggaaaagccagtggggtgggagaaaaagcaagtaggtgtgaggttactgagccaagtagagcaagcgtatcacagaggggaaggtgaacggccacatcagacgctgccgccaggaaagaacaggaagacggagaactgacgctggaggcggcgctctgacaccacgatgaccctcacagaacacgcagcggagggtgg

SEQ ID NO: 93467 - DNA, 201 bp, Bos taurus
tcaaccttcatagagctgaagagttagggctgtgctctgcattaggctttcgcttaaggggacgttgtggatggtttgattcactaaaactttctccatatcagcaacaaggctgttttgctttcttatcattcatgtattcactggagtagcacttttaatttccttataagaacttttcctttgtattcacaacttgga

SEQ ID NO: 93468 - DNA, 201 bp, Bos taurus; identical to SEQ ID NO: 11783

SEQ ID NO: 93469 - DNA, 201 bp, Bos taurus; identical to SEQ ID NO: 11784

SEQ ID NO: 93470 - DNA, 201 bp, Bos taurus; identical to SEQ ID NO: 11785

SEQ ID NO: 93471 - DNA, 201 bp, Bos taurus; identical to SEQ ID NO: 11786

SEQ ID NO: 93472 - DNA, 201 bp, Bos taurus; identical to SEQ ID NO: 11787

SEQ ID NO: 93473 - DNA, 201 bp, Bos taurus; identical to SEQ ID NO: 11788

SEQ ID NO: 93474 - DNA, 201 bp, Bos taurus; identical to SEQ ID NO: 11789

SEQ ID NO: 93475 - DNA, 201 bp, Bos taurus; identical to SEQ ID NO: 11790

SEQ ID NO: 93476 - DNA, 201 bp, Bos taurus; identical to SEQ ID NO: 11791

SEQ ID NO: 93477 - DNA, 201 bp, Bos taurus; identical to SEQ ID NO: 11792

SEQ ID NO: 93478 - DNA, 201 bp, Bos taurus; identical to SEQ ID NO: 11795

SEQ ID NO: 93479 - DNA, 201 bp, Bos taurus; identical to SEQ ID NO: 11796

SEQ ID NO: 93480 - DNA, 201 bp, Bos taurus; identical to SEQ ID NO: 11797

SEQ ID NO: 93481 - DNA, 201 bp, Bos taurus; identical to SEQ ID NO: 11798

SEQ ID NO: 93482 - DNA, 201 bp, Bos taurus; identical to SEQ ID NO: 11802

SEQ ID NO: 93483 - DNA, 201 bp, Bos taurus; identical to SEQ ID NO: 11803

SEQ ID NO: 93484 - DNA, 201 bp, Bos taurus; identical to SEQ ID NO: 11804

SEQ ID NO: 93485 - DNA, 201 bp, Bos taurus; identical to SEQ ID NO: 11805

SEQ ID NO: 93486 - DNA, 201 bp, Bos taurus; identical to SEQ ID NO: 11806

SEQ ID NO: 93487 - DNA, 201 bp, Bos taurus; identical to SEQ ID NO: 11808

SEQ ID NO: 93488 - DNA, 201 bp, Bos taurus; identical to SEQ ID NO: 11809

SEQ ID NO: 93489 - DNA, 201 bp, Bos taurus; identical to SEQ ID NO: 11810

SEQ ID NO: 93490 - DNA, 201 bp, Bos taurus; identical to SEQ ID NO: 11812

SEQ ID NO: 93491 - DNA, 201 bp, Bos taurus; identical to SEQ ID NO: 11815

SEQ ID NO: 93492 - DNA, 201 bp, Bos taurus; identical to SEQ ID NO: 11818

SEQ ID NO: 93493 - DNA, 201 bp, Bos taurus; identical to SEQ ID NO: 11819

SEQ ID NO: 93494 - DNA, 201 bp, Bos taurus; identical to SEQ ID NO: 11820

SEQ ID NO: 93495 - DNA, 201 bp, Bos taurus; identical to SEQ ID NO: 11821

SEQ ID NO: 93496 - DNA, 201 bp, Bos taurus; identical to SEQ ID NO: 11822

SEQ ID NO: 93497 - DNA, 201 bp, Bos taurus; identical to SEQ ID NO: 11823

SEQ ID NO: 93498 - DNA, 201 bp, Bos taurus; identical to SEQ ID NO: 11824

SEQ ID NO: 93499 - DNA, 201 bp, Bos taurus; identical to SEQ ID NO: 11825

SEQ ID NO: 93500 - DNA, 201 bp, Bos taurus; identical to SEQ ID NO: 11826

SEQ ID NO: 93501 - DNA, 201 bp, Bos taurus; identical to SEQ ID NO: 11828

SEQ ID NO: 93502 - DNA, 201 bp, Bos taurus; identical to SEQ ID NO: 11829

SEQ ID NO: 93503 - DNA, 201 bp, Bos taurus; identical to SEQ ID NO: 11830

SEQ ID NO: 93504 - DNA, 201 bp, Bos taurus; identical to SEQ ID NO: 11831

SEQ ID NO: 93505 - DNA, 201 bp, Bos taurus; identical to SEQ ID NO: 11832

SEQ ID NO: 93506 - DNA, 201 bp, Bos taurus; identical to SEQ ID NO: 11833

SEQ ID NO: 93507 - DNA, 201 bp, Bos taurus; identical to SEQ ID NO: 11834

SEQ ID NO: 93508 - DNA, 201 bp, Bos taurus; identical to SEQ ID NO: 11837

SEQ ID NO: 93509 - DNA, 201 bp, Bos taurus; identical to SEQ ID NO: 11839

SEQ ID NO: 93510 - DNA, 201 bp, Bos taurus; identical to SEQ ID NO: 11840

SEQ ID NO: 93511 - DNA, 201 bp, Bos taurus; identical to SEQ ID NO: 11841

SEQ ID NO: 93512 - DNA, 201 bp, Bos taurus; identical to SEQ ID NO: 11842

SEQ ID NO: 93513 - DNA, 201 bp, Bos taurus; identical to SEQ ID NO: 11843

SEQ ID NO: 93514 - DNA, 201 bp, Bos taurus; identical to SEQ ID NO: 11846

SEQ ID NO: 93515 - DNA, 201 bp, Bos taurus; identical to SEQ ID NO: 11847

SEQ ID NO: 93516 - DNA, 201 bp, Bos taurus; identical to SEQ ID NO: 11850

SEQ ID NO: 93517 - DNA, 201 bp, Bos taurus; identical to SEQ ID NO: 11851

SEQ ID NO: 93518 - DNA, 201 bp, Bos taurus; identical to SEQ ID NO: 11852

SEQ ID NO: 93519 - DNA, 201 bp, Bos taurus; identical to SEQ ID NO: 11853

SEQ ID NO: 93520 - DNA, 201 bp, Bos taurus; identical to SEQ ID NO: 11855

SEQ ID NO: 93521 - DNA, 201 bp, Bos taurus; identical to SEQ ID NO: 11856

SEQ ID NO: 93522 - DNA, 201 bp, Bos taurus; identical to SEQ ID NO: 11857

SEQ ID NO: 93523 - DNA, 201 bp, Bos taurus; identical to SEQ ID NO: 11858

SEQ ID NO: 93524 - DNA, 201 bp, Bos taurus; identical to SEQ ID NO: 11859

SEQ ID NO: 93525 - DNA, 201 bp, Bos taurus; identical to SEQ ID NO: 11860

SEQ ID NO: 93526 - DNA, 201 bp, Bos taurus; identical to SEQ ID NO: 11861

SEQ ID NO: 93527 - DNA, 201 bp, Bos taurus; identical to SEQ ID NO: 11862

SEQ ID NO: 93528 - DNA, 201 bp, Bos taurus; identical to SEQ ID NO: 11863

SEQ ID NO: 93529 - DNA, 201 bp, Bos taurus; identical to SEQ ID NO: 11864

SEQ ID NO: 93530 - DNA, 201 bp, Bos taurus; identical to SEQ ID NO: 11867

SEQ ID NO: 93531 - DNA, 201 bp, Bos taurus
gttgtaaataatgctgcaatgacccctgaggtgcatgtgtctttttttttttttttttgcgtgtgtctttttgaattatgtttttctctgtatatggcccgtatctcccaccgtcactttaactgtacaactcttatcaggcttcacacagccttctttgccatcagacatgtgctacaaatgtgatcttagaagggagga

SEQ ID NO: 93532 - DNA, 201 bp, Bos taurus; identical to SEQ ID NO: 11870

SEQ ID NO: 93533 - DNA, 201 bp, Bos taurus; identical to SEQ ID NO: 11871

SEQ ID NO: 93534 - DNA, 201 bp, Bos taurus
agaggctccgggcatccttctcttccagccgcggcccgggtgaaggtcgcatgcagacgagctcgagagggcgcgaacgaagctgcggatgctgtgaagcggaggcgctgtctgccgcgggccggctggagctggagggtaaccggcgagcgcagcgcgctgacaaagcgggcgctaccaagcgaacccagtgagggggtg

SEQ ID NO: 93535 - DNA, 201 bp, Bos taurus; identical to SEQ ID NO: 11872

SEQ ID NO: 93536 - DNA, 201 bp, Bos taurus; identical to SEQ ID NO: 11873

SEQ ID NO: 93537 - DNA, 201 bp, Bos taurus; identical to SEQ ID NO: 11874

SEQ ID NO: 93538 - DNA, 201 bp, Bos taurus
acagcatgatattttcacacttccttctcctacccgactctcttataggagaattctagatttttaaaagtctcttaaagcatctgggctgaaatgacaacgcattagctaacagaccagtagaaatttgagtggatcttctaattattcttctgctttttacctttcacactttctctctccctgcatcttcctatccct

SEQ ID NO: 93539 - DNA, 201 bp, Bos taurus; identical to SEQ ID NO: 11875

SEQ ID NO: 93540 - DNA, 201 bp, Bos taurus
cttaagattagaaaacaatgctgggcccatttgaggtattccaggaagtgcggcactgtgtggctcctagacttttaggactatcttggattccttggtcgggaagaaggggaaagaactcataaatagctcatggggtttccagtggttatcttgggccaggaattgctcccgtggagtaagtcttggtggagtttagaa

SEQ ID NO: 93541 - DNA, 201 bp, Bos taurus; identical to SEQ ID NO: 11876

SEQ ID NO: 93542 - DNA, 201 bp, Bos taurus; identical to SEQ ID NO: 11877

SEQ ID NO: 93543 - DNA, 201 bp, Bos taurus
gctaacatttcaattaatgtcccttttgtctcactgagaaaaatcatttcacaatttattacactggattaaagagtgtatacattctggaggtagaacatgactaaaaggcaatctggcagaaaggatgtcgaaacagttggtatgtttaaattgttctgaattccttaaataaacgtttggggctgctttcccaagaga

SEQ ID NO: 93544 - DNA, 201 bp, Bos taurus
cttccactaaagtttttccattttaatatattgcccttgtaatttcagaaaagagtaaaatttttgcctgggttagagatattctcaattgatttataagtataaatttgggctgaattattcagataagccggcttctgctaagaatatctacatagatattaagttatttcctatgcataaaaagcaccttcaataaaa

SEQ ID NO: 93545 - DNA, 201 bp, Bos taurus; identical to SEQ ID NO: 11878

SEQ ID NO: 93546 - DNA, 201 bp, Bos taurus; identical to SEQ ID NO: 11880

SEQ ID NO: 93547 - DNA, 201 bp, Bos taurus; identical to SEQ ID NO: 11881

SEQ ID NO: 93548 - DNA, 201 bp, Bos taurus; identical to SEQ ID NO: 11882

SEQ ID NO: 93549 - DNA, 201 bp, Bos taurus; identical to SEQ ID NO: 11883

SEQ ID NO: 93550 - DNA, 201 bp, Bos taurus
cttctgctggttgtggaagcatgttccttgcaaaaagttgtcaagatgcctgaagaagtggtagttggttggcgagaagtcaagtgaatatggcaaatgaggccaaatctgttcaacttttgaaatatgtgttgtgcgacatatggtcgggcattgtcatgaagaagaattgggtcctttctgttgaacaatgaactgcag

SEQ ID NO: 93551 - DNA, 201 bp, Bos taurus; identical to SEQ ID NO: 11884

SEQ ID NO: 93552 - DNA, 201 bp, Bos taurus
tcaagtcaagatgaggtcactggggtgggccctcacccaatataactggtttacttgtaagaagaggaggagaacatagtatgatgacagattggagagatgcagatggaagcctggccacgagaagctaggaagaggcaaggaaggatcctacccagagtctcaaagggaggccagctctgcagacacctgattgtatgt

SEQ ID NO: 93553 - DNA, 201 bp, Bos taurus
gtagggattctttcaaccattaggcttttgtaacctcttacacctgcaatttatatcattgctatggtctgaatgtttgtgtatccccaaaagtcatatattgaaatcctaaccttctaaggtggggtcgttagaatatggggctttcaggaggcacttaagtcactgatgaattgcattgctgctgctgctgctgctgct

SEQ ID NO: 93554 - DNA, 201 bp, Bos taurus; identical to SEQ ID NO: 11886

SEQ ID NO: 93555 - DNA, 201 bp, Bos taurus; identical to SEQ ID NO: 11887

SEQ ID NO: 93556 - DNA, 201 bp, Bos taurus; identical to SEQ ID NO: 11889

SEQ ID NO: 93557 - DNA, 201 bp, Bos taurus; identical to SEQ ID NO: 11891

SEQ ID NO: 93558 - DNA, 201 bp, Bos taurus
ctttcatgttgctcagaaaagagttttacatgaccatagaaacaaataaataggtataaatataatcacttatttgtttgcatgtggataatatattattatgaatactttaagttccttccagcctatggctattgtataataccagagggagtagtacttgactttatgaaattgctctttgagaggtaacaactctgt

SEQ ID NO: 93559 - DNA, 201 bp, Bos taurus; identical to SEQ ID NO: 11893

SEQ ID NO: 93560 - DNA, 201 bp, Bos taurus; identical to SEQ ID NO: 11894

SEQ ID NO: 93561 - DNA, 201 bp, Bos taurus; identical to SEQ ID NO: 11895

SEQ ID NO: 93562 - DNA, 201 bp, Bos taurus; identical to SEQ ID NO: 11896

SEQ ID NO: 93563 - DNA, 201 bp, Bos taurus; identical to SEQ ID NO: 11897

SEQ ID NO: 93564 - DNA, 201 bp, Bos taurus; identical to SEQ ID NO: 11898

SEQ ID NO: 93565 - DNA, 201 bp, Bos taurus; identical to SEQ ID NO: 11899

SEQ ID NO: 93566 - DNA, 201 bp, Bos taurus; identical to SEQ ID NO: 11904

SEQ ID NO: 93567 - DNA, 201 bp, Bos taurus; identical to SEQ ID NO: 11905

SEQ ID NO: 93568 - DNA, 201 bp, Bos taurus; identical to SEQ ID NO: 11906

SEQ ID NO: 93569 - DNA, 201 bp, Bos taurus; identical to SEQ ID NO: 11907

SEQ ID NO: 93570 - DNA, 201 bp, Bos taurus; identical to SEQ ID NO: 11908

SEQ ID NO: 93571 - DNA, 201 bp, Bos taurus; identical to SEQ ID NO: 11909

SEQ ID NO: 93572 - DNA, 201 bp, Bos taurus; identical to SEQ ID NO: 11911

SEQ ID NO: 93573 - DNA, 201 bp, Bos taurus; identical to SEQ ID NO: 11914

SEQ ID NO: 93574 - DNA, 201 bp, Bos taurus; identical to SEQ ID NO: 11915

SEQ ID NO: 93575 - DNA, 201 bp, Bos taurus; identical to SEQ ID NO: 11916

SEQ ID NO: 93576 - DNA, 201 bp, Bos taurus; identical to SEQ ID NO: 11917

SEQ ID NO: 93577 - DNA, 201 bp, Bos taurus; identical to SEQ ID NO: 11918

SEQ ID NO: 93578 - DNA, 201 bp, Bos taurus; identical to SEQ ID NO: 11921

SEQ ID NO: 93579 - DNA, 201 bp, Bos taurus; identical to SEQ ID NO: 11922

SEQ ID NO: 93580 - DNA, 201 bp, Bos taurus; identical to SEQ ID NO: 11924

SEQ ID NO: 93581 - DNA, 201 bp, Bos taurus; identical to SEQ ID NO: 11927

SEQ ID NO: 93582 - DNA, 201 bp, Bos taurus; identical to SEQ ID NO: 11933

SEQ ID NO: 93583 - DNA, 201 bp, Bos taurus; identical to SEQ ID NO: 11934

SEQ ID NO: 93584 - DNA, 201 bp, Bos taurus; identical to SEQ ID NO: 11938

SEQ ID NO: 93585 - DNA, 201 bp, Bos taurus; identical to SEQ ID NO: 11939

SEQ ID NO: 93586 - DNA, 201 bp, Bos taurus; identical to SEQ ID NO: 11940

SEQ ID NO: 93587 - DNA, 201 bp, Bos taurus; identical to SEQ ID NO: 11941

SEQ ID NO: 93588 - DNA, 201 bp, Bos taurus; identical to SEQ ID NO: 11942

SEQ ID NO: 93589 - DNA, 201 bp, Bos taurus; identical to SEQ ID NO: 11943

SEQ ID NO: 93590 - DNA, 201 bp, Bos taurus; identical to SEQ ID NO: 11944

SEQ ID NO: 93591 - DNA, 201 bp, Bos taurus; identical to SEQ ID NO: 11945

SEQ ID NO: 93592 - DNA, 201 bp, Bos taurus; identical to SEQ ID NO: 11947

SEQ ID NO: 93593 - DNA, 201 bp, Bos taurus; identical to SEQ ID NO: 11948

SEQ ID NO: 93594 - DNA, 201 bp, Bos taurus; identical to SEQ ID NO: 11949

SEQ ID NO: 93595 - DNA, 201 bp, Bos taurus; identical to SEQ ID NO: 11950

SEQ ID NO: 93596 - DNA, 201 bp, Bos taurus; identical to SEQ ID NO: 11951

SEQ ID NO: 93597 - DNA, 201 bp, Bos taurus; identical to SEQ ID NO: 11952

SEQ ID NO: 93598 - DNA, 201 bp, Bos taurus; identical to SEQ ID NO: 11954

SEQ ID NO: 93599 - DNA, 201 bp, Bos taurus; identical to SEQ ID NO: 11955

SEQ ID NO: 93600 - DNA, 201 bp, Bos taurus; identical to SEQ ID NO: 11956

SEQ ID NO: 93601 - DNA, 201 bp, Bos taurus; identical to SEQ ID NO: 11960

SEQ ID NO: 93602 - DNA, 201 bp, Bos taurus; identical to SEQ ID NO: 11961

SEQ ID NO: 93603 - DNA, 201 bp, Bos taurus; identical to SEQ ID NO: 11965

SEQ ID NO: 93604 - DNA, 201 bp, Bos taurus; identical to SEQ ID NO: 11968

SEQ ID NO: 93605 - DNA, 201 bp, Bos taurus; identical to SEQ ID NO: 11969

SEQ ID NO: 93606 - DNA, 201 bp, Bos taurus; identical to SEQ ID NO: 11970

SEQ ID NO: 93607 - DNA, 201 bp, Bos taurus; identical to SEQ ID NO: 11971

SEQ ID NO: 93608 - DNA, 201 bp, Bos taurus; identical to SEQ ID NO: 11972

SEQ ID NO: 93609 - DNA, 201 bp, Bos taurus; identical to SEQ ID NO: 11974

SEQ ID NO: 93610 - DNA, 201 bp, Bos taurus; identical to SEQ ID NO: 11976

SEQ ID NO: 93611 - DNA, 201 bp, Bos taurus; identical to SEQ ID NO: 11978

SEQ ID NO: 93612 - DNA, 201 bp, Bos taurus; identical to SEQ ID NO: 11979

SEQ ID NO: 93613 - DNA, 201 bp, Bos taurus; identical to SEQ ID NO: 11986

SEQ ID NO: 93614 - DNA, 201 bp, Bos taurus; identical to SEQ ID NO: 11987

SEQ ID NO: 93615 - DNA, 201 bp, Bos taurus; identical to SEQ ID NO: 11988

SEQ ID NO: 93616 - DNA, 201 bp, Bos taurus; identical to SEQ ID NO: 11990

SEQ ID NO: 93617 - DNA, 201 bp, Bos taurus; identical to SEQ ID NO: 11993

SEQ ID NO: 93618 - DNA, 201 bp, Bos taurus; identical to SEQ ID NO: 11996

SEQ ID NO: 93619 - DNA, 201 bp, Bos taurus; identical to SEQ ID NO: 11997

SEQ ID NO: 93620 - DNA, 201 bp, Bos taurus; identical to SEQ ID NO: 11999

SEQ ID NO: 93621 - DNA, 201 bp, Bos taurus; identical to SEQ ID NO: 12000

SEQ ID NO: 93622 - DNA, 201 bp, Bos taurus; identical to SEQ ID NO: 12001

SEQ ID NO: 93623 - DNA, 201 bp, Bos taurus; identical to SEQ ID NO: 12002

SEQ ID NO: 93624 - DNA, 201 bp, Bos taurus; identical to SEQ ID NO: 12004

SEQ ID NO: 93625 - DNA, 201 bp, Bos taurus; identical to SEQ ID NO: 12005

SEQ ID NO: 93626 - DNA, 201 bp, Bos taurus; identical to SEQ ID NO: 12006

SEQ ID NO: 93627 - DNA, 201 bp, Bos taurus; identical to SEQ ID NO: 12010

SEQ ID NO: 93628 - DNA, 201 bp, Bos taurus; identical to SEQ ID NO: 12011

SEQ ID NO: 93629 - DNA, 201 bp, Bos taurus; identical to SEQ ID NO: 12012

SEQ ID NO: 93630 - DNA, 201 bp, Bos taurus; identical to SEQ ID NO: 12016

SEQ ID NO: 93631 - DNA, 201 bp, Bos taurus; identical to SEQ ID NO: 12017

SEQ ID NO: 93632 - DNA, 201 bp, Bos taurus; identical to SEQ ID NO: 12018

SEQ ID NO: 93633 - DNA, 201 bp, Bos taurus; identical to SEQ ID NO: 12019

SEQ ID NO: 93634 - DNA, 201 bp, Bos taurus; identical to SEQ ID NO: 12021

SEQ ID NO: 93635 - DNA, 201 bp, Bos taurus; identical to SEQ ID NO: 12022

SEQ ID NO: 93636 - DNA, 201 bp, Bos taurus; identical to SEQ ID NO: 12023

SEQ ID NO: 93637 - DNA, 201 bp, Bos taurus; identical to SEQ ID NO: 12024

SEQ ID NO: 93638 - DNA, 201 bp, Bos taurus; identical to SEQ ID NO: 12025

SEQ ID NO: 93639 - DNA, 201 bp, Bos taurus; identical to SEQ ID NO: 12026

SEQ ID NO: 93640 - DNA, 201 bp, Bos taurus; identical to SEQ ID NO: 12028

SEQ ID NO: 93641 - DNA, 201 bp, Bos taurus; identical to SEQ ID NO: 12029

SEQ ID NO: 93642 - DNA, 201 bp, Bos taurus; identical to SEQ ID NO: 12032

SEQ ID NO: 93643 - DNA, 201 bp, Bos taurus; identical to SEQ ID NO: 12033

SEQ ID NO: 93644 - DNA, 201 bp, Bos taurus; identical to SEQ ID NO: 12034

SEQ ID NO: 93645 - DNA, 201 bp, Bos taurus; identical to SEQ ID NO: 12035

SEQ ID NO: 93646 - DNA, 201 bp, Bos taurus; identical to SEQ ID NO: 12036

SEQ ID NO: 93647 - DNA, 201 bp, Bos taurus; identical to SEQ ID NO: 12037

SEQ ID NO: 93648 - DNA, 201 bp, Bos taurus; identical to SEQ ID NO: 12038

SEQ ID NO: 93649 - DNA, 201 bp, Bos taurus; identical to SEQ ID NO: 12039

SEQ ID NO: 93650 - DNA, 201 bp, Bos taurus; identical to SEQ ID NO: 12041

SEQ ID NO: 93651 - DNA, 201 bp, Bos taurus; identical to SEQ ID NO: 12042

SEQ ID NO: 93652 - DNA, 201 bp, Bos taurus; identical to SEQ ID NO: 12044

SEQ ID NO: 93653 - DNA, 201 bp, Bos taurus; identical to SEQ ID NO: 12045

SEQ ID NO: 93654 - DNA, 201 bp, Bos taurus; identical to SEQ ID NO: 12047

SEQ ID NO: 93655 - DNA, 201 bp, Bos taurus; identical to SEQ ID NO: 12049

SEQ ID NO: 93656 - DNA, 201 bp, Bos taurus; identical to SEQ ID NO: 12050

SEQ ID NO: 93657 - DNA, 201 bp, Bos taurus; identical to SEQ ID NO: 12051

SEQ ID NO: 93658 - DNA, 201 bp, Bos taurus; identical to SEQ ID NO: 12055

SEQ ID NO: 93659 - DNA, 201 bp, Bos taurus; identical to SEQ ID NO: 12056

SEQ ID NO: 93660 - DNA, 201 bp, Bos taurus
cttagcagaaacaggggctaaagattatttcatgtgttaattcagcagatacttttgatcacctactatgaatcagtgatgtgctgggccctcagatacagtactgggaaaaataaacagttataaaccagcacccattctaggctagggtgagaaacagaaaatacacaagtaaaaatagaacatgtcaggtggtaagtg

SEQ ID NO: 93661 - DNA, 201 bp, Bos taurus; identical to SEQ ID NO: 12057

SEQ ID NO: 93662 - DNA, 201 bp, Bos taurus; identical to SEQ ID NO: 12058

SEQ ID NO: 93663 - DNA, 201 bp, Bos taurus; identical to SEQ ID NO: 53167

SEQ ID NO: 93664 - DNA, 201 bp, Bos taurus; identical to SEQ ID NO: 12059

SEQ ID NO: 93665 - DNA, 201 bp, Bos taurus
gtctagggatatggcctagatggtgatgcttttccctggactataccaatctcagcaccaagagcactgcatcctgggaatctccctgatcctatgcaaatgaggccattagtctctttctcagagtatgtccatatcagcttcaaatggtaaaagcaggggacccagttgctgctttacaatggactccagtcaccccct

SEQ ID NO: 93666 - DNA, 201 bp, Bos taurus; identical to SEQ ID NO: 12060

SEQ ID NO: 93667 - DNA, 201 bp, Bos taurus; identical to SEQ ID NO: 12061

SEQ ID NO: 93668 - DNA, 201 bp, Bos taurus; identical to SEQ ID NO: 12062

SEQ ID NO: 93669 - DNA, 201 bp, Bos taurus; identical to SEQ ID NO: 12064

SEQ ID NO: 93670 - DNA, 201 bp, Bos taurus; identical to SEQ ID NO: 12065

SEQ ID NO: 93671 - DNA, 201 bp, Bos taurus; identical to SEQ ID NO: 12066

SEQ ID NO: 93672 - DNA, 201 bp, Bos taurus
tcccttcactatgtggccaataagggtcaggggagaatctcaatggggtaaaccatttcactatcataaacagatcacagagcactattacagacaggccgtttgtgtgcagtagcagaaaatgaccgggtgcaaaaggatacccgataaatgacagggagcgtgctacactggatctatgctggcctctttaacagtcta

SEQ ID NO: 93673 - DNA, 201 bp, Bos taurus; identical to SEQ ID NO: 12068

SEQ ID NO: 93674 - DNA, 201 bp, Bos taurus; identical to SEQ ID NO: 12069

SEQ ID NO: 93675 - DNA, 201 bp, Bos taurus; identical to SEQ ID NO: 12070

SEQ ID NO: 93676 - DNA, 201 bp, Bos taurus
acacagctactaagtggaagctaggttctaacaggaagaaagtgagctaatcatgttaaagtatcatggaacacatgagttacagcacattttgtctgcacagcagtttgtgtgtcctttttatctcaagagttcagagtggcttgtccccagggaccagtaagaagtggaggcacccagatcacctgggctccaatatgt

SEQ ID NO: 93677 - DNA, 201 bp, Bos taurus
gctggtcctggggcctgcgtaactctcaccacaggtgaggaggctgaagctacagacatttacagtcctgcagttctggagataaggtatcacagggctggttcccgctgaggcctctctccttggcatgcagacagctgtctcctccccatgccttcacatggtcgtccctgtgtgcctgtgtccttatctcctcctctt

SEQ ID NO: 93678 - DNA, 201 bp, Bos taurus; identical to SEQ ID NO: 12072

SEQ ID NO: 93679 - DNA, 201 bp, Bos taurus; identical to SEQ ID NO: 12073

SEQ ID NO: 93680 - DNA, 201 bp, Bos taurus; identical to SEQ ID NO: 12074

SEQ ID NO: 93681 - DNA, 201 bp, Bos taurus; identical to SEQ ID NO: 12075

SEQ ID NO: 93682 - DNA, 201 bp, Bos taurus; identical to SEQ ID NO: 12076

SEQ ID NO: 93683 - DNA, 201 bp, Bos taurus; identical to SEQ ID NO: 12077

SEQ ID NO: 93684 - DNA, 201 bp, Bos taurus; identical to SEQ ID NO: 12078

SEQ ID NO: 93685 - DNA, 201 bp, Bos taurus; identical to SEQ ID NO: 12079

SEQ ID NO: 93686 - DNA, 201 bp, Bos taurus; identical to SEQ ID NO: 12081

SEQ ID NO: 93687 - DNA, 201 bp, Bos taurus
aaggaaataaattgttggcaatattttgtgaggtcatttgggaacctcctctgtgtcttggtttaaaagttttgtgcttaagagtttgtgaaagtcagatggatcagcttgggcaacagcttaaggctcttttcctgaatatagcagctggaagaaaaaagcaaaatcagtgagaagattctgtggtcgcctcaagtgcca

SEQ ID NO: 93688 - DNA, 201 bp, Bos taurus; identical to SEQ ID NO: 12082

SEQ ID NO: 93689 - DNA, 201 bp, Bos taurus
accacaggcccttctcttagctgagagcgaggctactggagccacctggggacaagaacatgcctgggaggtaactgccagctcaccatccactagtcaggggacacatggcccctgcagagccaggagaagcctgtgcttttgccagcatgaatgagagccacaggtggcagctggccagcccgtgtgttggggaagcaa

SEQ ID NO: 93690 - DNA, 201 bp, Bos taurus; identical to SEQ ID NO: 12084

SEQ ID NO: 93691 - DNA, 201 bp, Bos taurus
tgcaccagctccaggacctggcctcacccactggtgagtggacaccagcccacagccaccacagcccaacagcctgccacgccaggggctagtccaacctccagaggccagcaccagacccaggacaccctgggccccttaaccagcccccttgggatcctgggccacccatcagctttgggagactgaggatcctgtagc

SEQ ID NO: 93692 - DNA, 201 bp, Bos taurus; identical to SEQ ID NO: 12085

SEQ ID NO: 93693 - DNA, 201 bp, Bos taurus; identical to SEQ ID NO: 12087

SEQ ID NO: 93694 - DNA, 201 bp, Bos taurus
tctacaaaggtgaagagtgttaaaggaaagagggggagaggggagagagggggccctcaggggcaggacagagggggccctcaggggcaggaaacagtatggagtgttaccaccccaattctgcagaggcaagagagggagagaggcagagcccgatggggcccggaaccttcaccgtgggcttgaacaaagggatcatgg

SEQ ID NO: 93695 - DNA, 201 bp, Bos taurus
tacctggccttgagtcttgctgtgtactgggggtgtgcttgcatgctagtcctttggtgttgtagcctttactgctgttgcgggatgtggatccaagggtcggcgtcactggccaagggaatactggagcagacggactgtgtggatgtgaggcaagagaccccgaaggggtggaatgtggggaaagagcgatctgccaag

SEQ ID NO: 93696 - DNA, 201 bp, Bos taurus
gatggtcatggaactcaaacctggccaattaaagcactgtatctttttggcctcgtgattggttcagggatagttgtggggcccaatcctggtcaataaccatcaggctgagaacttcaattcacactcgtgagggagagaaggttttgtttccactgggcctaaagcacagaggttgtcagctggggactctaagttagg

SEQ ID NO: 93697 - DNA, 201 bp, Bos taurus
ggattcgtcatctttgggggcccataagcccctcactctccagctccttgaaacccatggggacttggctgacctgtgctggctctgactagggtacctcgcctgggactgctgtgatgggccagcaaaaggggtggaccgaggagggatagaggaacccaggttgcaacagcttcacgcagaagcaccagatctttctcc

SEQ ID NO: 93698 - DNA, 201 bp, Bos taurus; identical to SEQ ID NO: 12088

SEQ ID NO: 93699 - DNA, 201 bp, Bos taurus; identical to SEQ ID NO: 12089

SEQ ID NO: 93700 - DNA, 201 bp, Bos taurus; identical to SEQ ID NO: 12090

SEQ ID NO: 93701 - DNA, 201 bp, Bos taurus; identical to SEQ ID NO: 12091

SEQ ID NO: 93702 - DNA, 201 bp, Bos taurus
ttgagatggttaactaaaggtagtttcctaatgctgcatccaaagtagaggttgctgtgtgtgaattcaatggaccataatgactgtggcccaggaaatcacatctctgtccccagtagagagtttttcttcctctcttatattagagagaactccaagggaactggatttctcagcatttcttctcctttttccggggag

SEQ ID NO: 93703 - DNA, 201 bp, Bos taurus; identical to SEQ ID NO: 12092

SEQ ID NO: 93704 - DNA, 201 bp, Bos taurus; identical to SEQ ID NO: 12095

SEQ ID NO: 93705 - DNA, 201 bp, Bos taurus; identical to SEQ ID NO: 12096

SEQ ID NO: 93706 - DNA, 201 bp, Bos taurus; identical to SEQ ID NO: 12098

SEQ ID NO: 93707 - DNA, 201 bp, Bos taurus; identical to SEQ ID NO: 12099

SEQ ID NO: 93708 - DNA, 201 bp, Bos taurus
aattacaaaatggccccattctcttcttatatctataccttttgtgtgtgactttgcaattttcccttcaaaagtagaagtctgttgccccactccttgaatttagcttggccctgggttttctttggccagcagtatatggcagaagtgacaatgtgctaattccaaagccaggtctcaggagacattgcacacttgcac

SEQ ID NO: 93709 - DNA, 201 bp, Bos taurus; identical to SEQ ID NO: 12100

SEQ ID NO: 93710 - DNA, 201 bp, Bos taurus; identical to SEQ ID NO: 12101

SEQ ID NO: 93711 - DNA, 201 bp, Bos taurus; identical to SEQ ID NO: 12102

SEQ ID NO: 93712 - DNA, 201 bp, Bos taurus
caggcagtccactggtgagttcttttatgggaagatcagctttctgagacagagccaagaggtaaagccaagctccgtgcagaaggggcccccgagggctgaccagctttccgtgccatggttaagatgaggctgagaggttggaagcaagcgactgcaggacagtctggccacagaattccaagtgtcactttgtgttag

SEQ ID NO: 93713 - DNA, 201 bp, Bos taurus; identical to SEQ ID NO: 12104

SEQ ID NO: 93714 - DNA, 201 bp, Bos taurus
catccaaccatctcatcccctgttgccctcttctcctggcctcaatctttcccagcatcagggtctttttcaatgagtcgactcttctcatcaggtggccgtatacactgagaaagtcttatttctctaggcaatcctcaggcgatcctgaggatttgatccctgatcagggaattaggatctcacatgacacagcatggc

SEQ ID NO: 93715 - DNA, 201 bp, Bos taurus
caggatgagtgccagagacattctaggatttctgtctccttggagtgagcaccgcctgactaagcaagtggaatctgatggacaggtggcctctcctaggagcagttggattcccttcactcagaacagctttgggtctcccagaactcacctgtgttcttaggaggcccccggatacagggtgtctgggggcaaaaactc

SEQ ID NO: 93716 - DNA, 201 bp, Bos taurus; identical to SEQ ID NO: 12105

SEQ ID NO: 93717 - DNA, 201 bp, Bos taurus
ttctttttctgaaaagtccaaagggtcagggccttgtccctgaccactggtctagagggtaggattcgacactctcactgccgtgacccaacccaatttctggccgggaaccaaagccctgcctcaagtcactgcaggccgagaccactctttctcagttcttgtgtccctcctgatgaccctgttcaaagtgactgctag

SEQ ID NO: 93718 - DNA, 201 bp, Bos taurus
tggcagaggcctggatgctgattaagtagctaactcggggaaattaaagatgctccagaaccttcatcttggcggctagagcctagctccgcaggtgacacggatgtcgctccctggcccagagatggatggtaaacagatggaaggaactcactgatggggccactctcttgctcaccccacccatgatacaaaattcag

SEQ ID NO: 93719 - DNA, 201 bp, Bos taurus; identical to SEQ ID NO: 12106

SEQ ID NO: 93720 - DNA, 201 bp, Bos taurus; identical to SEQ ID NO: 12107

SEQ ID NO: 93721 - DNA, 201 bp, Bos taurus; identical to SEQ ID NO: 12108

SEQ ID NO: 93722 - DNA, 201 bp, Bos taurus; identical to SEQ ID NO: 12109

SEQ ID NO: 93723 - DNA, 201 bp, Bos taurus; identical to SEQ ID NO: 12110

SEQ ID NO: 93724 - DNA, 201 bp, Bos taurus; identical to SEQ ID NO: 12111

SEQ ID NO: 93725 - DNA, 201 bp, Bos taurus; identical to SEQ ID NO: 12112

SEQ ID NO: 93726 - DNA, 201 bp, Bos taurus; identical to SEQ ID NO: 12113

SEQ ID NO: 93727 - DNA, 201 bp, Bos taurus; identical to SEQ ID NO: 12114

SEQ ID NO: 93728 - DNA, 201 bp, Bos taurus; identical to SEQ ID NO: 12115

SEQ ID NO: 93729 - DNA, 201 bp, Bos taurus; identical to SEQ ID NO: 12116

SEQ ID NO: 93730 - DNA, 201 bp, Bos taurus; identical to SEQ ID NO: 12117

SEQ ID NO: 93731 - DNA, 201 bp, Bos taurus; identical to SEQ ID NO: 12118

SEQ ID NO: 93732 - DNA, 201 bp, Bos taurus
aatcttcgcagccatttaaaaaaaaaaaatgaaattttccctctcatactgaggtgtaatcatcaagtctatcattttgcctaaaagattgtttttaatacagccagaatgtttggtggtcaagaaaaacagaaaagtattatttttatgcacaaagtcaagttacagtgtccagagacacagctttcctatagtgtagtc

SEQ ID NO: 93733 - DNA, 201 bp, Bos taurus; identical to SEQ ID NO: 12119

SEQ ID NO: 93734 - DNA, 201 bp, Bos taurus
tgtctttcaccattggctcccaaacacttgtccccctctttccagtgtggttaaattgattctaagaagcttattttttacatttgaacaactctgaaattggaatacatttttacactatagtgtcttattttaattggcagcgttttttcctcttagcattttatgactgtgcagggtcttcactgctgcgtgggcttt

SEQ ID NO: 93735 - DNA, 201 bp, Bos taurus; identical to SEQ ID NO: 12120

SEQ ID NO: 93736 - DNA, 201 bp, Bos taurus; identical to SEQ ID NO: 12121

SEQ ID NO: 93737 - DNA, 201 bp, Bos taurus; identical to SEQ ID NO: 12122

SEQ ID NO: 93738 - DNA, 201 bp, Bos taurus
acactggcccctgaagcggagctgagtgcatcaggcagcagatgggttcttccaaacagctggtctctgcagactctgacccaaagcgtgtgtgttgggaagaggccgttaatctgatttggggtcacggtcagagccgacagctccaaggacagaaacccgggaacttgagatgttgctcatggtgggctctttgaggct

SEQ ID NO: 93739 - DNA, 201 bp, Bos taurus; identical to SEQ ID NO: 12123

SEQ ID NO: 93740 - DNA, 201 bp, Bos taurus
gggtctaaacaatccttcattttcaaacctagtattatttttcccataaacatcctgttggaaaaaaatgggtccccattatactctaagtagtgtccctggagcctggacttggccttgctggctaattgagggacctcagtgacattggctggagtcactgctttcccttaaccactcagtacaggaagtctacaatct

SEQ ID NO: 93741 - DNA, 201 bp, Bos taurus; identical to SEQ ID NO: 12124

SEQ ID NO: 93742 - DNA, 201 bp, Bos taurus; identical to SEQ ID NO: 12125

SEQ ID NO: 93743 - DNA, 201 bp, Bos taurus; identical to SEQ ID NO: 12126

SEQ ID NO: 93744 - DNA, 201 bp, Bos taurus; identical to SEQ ID NO: 12127

SEQ ID NO: 93745 - DNA, 201 bp, Bos taurus; identical to SEQ ID NO: 12128

SEQ ID NO: 93746 - DNA, 201 bp, Bos taurus; identical to SEQ ID NO: 12129

SEQ ID NO: 93747 - DNA, 201 bp, Bos taurus; identical to SEQ ID NO: 12130

SEQ ID NO: 93748 - DNA, 201 bp, Bos taurus; identical to SEQ ID NO: 12131

SEQ ID NO: 93749 - DNA, 201 bp, Bos taurus; identical to SEQ ID NO: 12132

SEQ ID NO: 93750 - DNA, 201 bp, Bos taurus; identical to SEQ ID NO: 12133

SEQ ID NO: 93751 - DNA, 201 bp, Bos taurus; identical to SEQ ID NO: 12134

SEQ ID NO: 93752 - DNA, 201 bp, Bos taurus; identical to SEQ ID NO: 12135

SEQ ID NO: 93753 - DNA, 201 bp, Bos taurus; identical to SEQ ID NO: 12136

SEQ ID NO: 93754 - DNA, 201 bp, Bos taurus; identical to SEQ ID NO: 12137

SEQ ID NO: 93755 - DNA, 201 bp, Bos taurus; identical to SEQ ID NO: 12138

SEQ ID NO: 93756 - DNA, 201 bp, Bos taurus; identical to SEQ ID NO: 12139

SEQ ID NO: 93757 - DNA, 201 bp, Bos taurus; identical to SEQ ID NO: 12140

SEQ ID NO: 93758 - DNA, 201 bp, Bos taurus; identical to SEQ ID NO: 12141

SEQ ID NO: 93759 - DNA, 201 bp, Bos taurus; identical to SEQ ID NO: 12142

SEQ ID NO: 93760 - DNA, 201 bp, Bos taurus; identical to SEQ ID NO: 12143

SEQ ID NO: 93761 - DNA, 201 bp, Bos taurus; identical to SEQ ID NO: 12144

SEQ ID NO: 93762 - DNA, 201 bp, Bos taurus; identical to SEQ ID NO: 12145

SEQ ID NO: 93763 - DNA, 201 bp, Bos taurus; identical to SEQ ID NO: 12146

SEQ ID NO: 93764 - DNA, 201 bp, Bos taurus; identical to SEQ ID NO: 12147

SEQ ID NO: 93765 - DNA, 201 bp, Bos taurus; identical to SEQ ID NO: 12148

SEQ ID NO: 93766 - DNA, 201 bp, Bos taurus; identical to SEQ ID NO: 12149

SEQ ID NO: 93767 - DNA, 201 bp, Bos taurus; identical to SEQ ID NO: 12150

SEQ ID NO: 93768 - DNA, 201 bp, Bos taurus; identical to SEQ ID NO: 12151

SEQ ID NO: 93769 - DNA, 201 bp, Bos taurus; identical to SEQ ID NO: 12152

SEQ ID NO: 93770 - DNA, 201 bp, Bos taurus; identical to SEQ ID NO: 12153

SEQ ID NO: 93771 - DNA, 201 bp, Bos taurus; identical to SEQ ID NO: 12154

SEQ ID NO: 93772 - DNA, 201 bp, Bos taurus; identical to SEQ ID NO: 12155

SEQ ID NO: 93773 - DNA, 201 bp, Bos taurus; identical to SEQ ID NO: 12156

SEQ ID NO: 93774 - DNA, 201 bp, Bos taurus; identical to SEQ ID NO: 12157

SEQ ID NO: 93775 - DNA, 201 bp, Bos taurus; identical to SEQ ID NO: 12158

SEQ ID NO: 93776 - DNA, 201 bp, Bos taurus; identical to SEQ ID NO: 12159

SEQ ID NO: 93777 - DNA, 201 bp, Bos taurus; identical to SEQ ID NO: 12160

SEQ ID NO: 93778 - DNA, 201 bp, Bos taurus; identical to SEQ ID NO: 12161

SEQ ID NO: 93779 - DNA, 201 bp, Bos taurus; identical to SEQ ID NO: 12162

SEQ ID NO: 93780 - DNA, 201 bp, Bos taurus; identical to SEQ ID NO: 12163

SEQ ID NO: 93781 - DNA, 201 bp, Bos taurus; identical to SEQ ID NO: 12164

SEQ ID NO: 93782 - DNA, 201 bp, Bos taurus; identical to SEQ ID NO: 12165

SEQ ID NO: 93783 - DNA, 201 bp, Bos taurus; identical to SEQ ID NO: 12166

SEQ ID NO: 93784 - DNA, 201 bp, Bos taurus; identical to SEQ ID NO: 12167

SEQ ID NO: 93785 - DNA, 201 bp, Bos taurus; identical to SEQ ID NO: 12168

SEQ ID NO: 93786 - DNA, 201 bp, Bos taurus; identical to SEQ ID NO: 12169

SEQ ID NO: 93787 - DNA, 201 bp, Bos taurus; identical to SEQ ID NO: 12170

SEQ ID NO: 93788 - DNA, 201 bp, Bos taurus; identical to SEQ ID NO: 12171

SEQ ID NO: 93789 - DNA, 201 bp, Bos taurus; identical to SEQ ID NO: 12172

SEQ ID NO: 93790 - DNA, 201 bp, Bos taurus; identical to SEQ ID NO: 12173

SEQ ID NO: 93791 - DNA, 201 bp, Bos taurus; identical to SEQ ID NO: 12174

SEQ ID NO: 93792 - DNA, 201 bp, Bos taurus; identical to SEQ ID NO: 12175

SEQ ID NO: 93793 - DNA, 201 bp, Bos taurus
ttccggtccccagcctcgcggagaccaggccacccgctgggcctcctctggccatgcgtctccatggccctgtgctctggcccacactccagcacctggcgcgctgggacgtaagggtcaaataacctgagacacctcagacacgcgtagtggagaacagccccgctcgcaggctggcctaggcccagccacgccagctct

SEQ ID NO: 93794 - DNA, 201 bp, Bos taurus; identical to SEQ ID NO: 12176

SEQ ID NO: 93795 - DNA, 201 bp, Bos taurus; identical to SEQ ID NO: 12177

SEQ ID NO: 93796 - DNA, 201 bp, Bos taurus; identical to SEQ ID NO: 12178

SEQ ID NO: 93797 - DNA, 201 bp, Bos taurus; identical to SEQ ID NO: 12179

SEQ ID NO: 93798 - DNA, 201 bp, Bos taurus; identical to SEQ ID NO: 12180

SEQ ID NO: 93799 - DNA, 201 bp, Bos taurus; identical to SEQ ID NO: 12181

SEQ ID NO: 93800 - DNA, 201 bp, Bos taurus; identical to SEQ ID NO: 12182

SEQ ID NO: 93801 - DNA, 201 bp, Bos taurus; identical to SEQ ID NO: 12183

SEQ ID NO: 93802 - DNA, 201 bp, Bos taurus; identical to SEQ ID NO: 12184

SEQ ID NO: 93803 - DNA, 201 bp, Bos taurus; identical to SEQ ID NO: 12185

SEQ ID NO: 93804 - DNA, 201 bp, Bos taurus; identical to SEQ ID NO: 12186

SEQ ID NO: 93805 - DNA, 201 bp, Bos taurus; identical to SEQ ID NO: 12187

SEQ ID NO: 93806 - DNA, 201 bp, Bos taurus; identical to SEQ ID NO: 12188

SEQ ID NO: 93807 - DNA, 201 bp, Bos taurus; identical to SEQ ID NO: 12189

SEQ ID NO: 93808 - DNA, 201 bp, Bos taurus; identical to SEQ ID NO: 12190

SEQ ID NO: 93809 - DNA, 201 bp, Bos taurus; identical to SEQ ID NO: 12191

SEQ ID NO: 93810 - DNA, 201 bp, Bos taurus
aggtgaggcatcacatgaccttgctcatcaggtccaggggcagtcaccaataagagtctttcctggaaaccagtaactggtgagaggcaaggcatgacagtggtggcatggtggggtaaaggtccatgagcctccatgaagacccaagagctacccttttcccttcctttcctggatctttattgtccagctatatgctga

SEQ ID NO: 93811 - DNA, 201 bp, Bos taurus; identical to SEQ ID NO: 12192

SEQ ID NO: 93812 - DNA, 201 bp, Bos taurus
taatggatgtgtctcctttccctccccactctctggagtcagggacagggacaggatcccgtggagcttctgctgtggcccctctgcatcatgccccaacgatgctcttaggactttggcacggcagtgaccataactgtctatgatgatggccgagacggccaaagcctctctctgcagcccaaagggtccccagggccc

SEQ ID NO: 93813 - DNA, 201 bp, Bos taurus
tgttctttacaagcccccaagttcagcaaagctccaagcccttaaaaagaagtagaaaggcatcttgcaacacaattagagagattggttcaggggcctcacacacagcactccatccggcaaagcctcaaagggtcccgggtggaccatttgctggctttcatttctcaggggctgcttcagcaggtggccactagcagg

SEQ ID NO: 93814 - DNA, 201 bp, Bos taurus; identical to SEQ ID NO: 12193

SEQ ID NO: 93815 - DNA, 201 bp, Bos taurus; identical to SEQ ID NO: 12195

SEQ ID NO: 93816 - DNA, 201 bp, Bos taurus; identical to SEQ ID NO: 12198

SEQ ID NO: 93817 - DNA, 201 bp, Bos taurus; identical to SEQ ID NO: 12199

SEQ ID NO: 93818 - DNA, 201 bp, Bos taurus; identical to SEQ ID NO: 12200

SEQ ID NO: 93819 - DNA, 201 bp, Bos taurus; identical to SEQ ID NO: 12201

SEQ ID NO: 93820 - DNA, 201 bp, Bos taurus; identical to SEQ ID NO: 12202

SEQ ID NO: 93821 - DNA, 201 bp, Bos taurus; identical to SEQ ID NO: 12204

SEQ ID NO: 93822 - DNA, 201 bp, Bos taurus; identical to SEQ ID NO: 12205

SEQ ID NO: 93823 - DNA, 201 bp, Bos taurus
atcgtgatcgtcttcaagatgtggaaactaaggcttggagggagctgagggatttgccagaggtttctgtgtgccttcatttcctttgcaggatgggtggatgggtgtcctcctccttgcggggcccagaggagcttgggagcttgctcaaggtcacagagctggcatatagtgggaccccatgtctctgcccccagtgcc

SEQ ID NO: 93824 - DNA, 201 bp, Bos taurus; identical to SEQ ID NO: 12207

SEQ ID NO: 93825 - DNA, 201 bp, Bos taurus; identical to SEQ ID NO: 12208

SEQ ID NO: 93826 - DNA, 201 bp, Bos taurus; identical to SEQ ID NO: 12211

SEQ ID NO: 93827 - DNA, 201 bp, Bos taurus; identical to SEQ ID NO: 12212

SEQ ID NO: 93828 - DNA, 201 bp, Bos taurus; identical to SEQ ID NO: 12213

SEQ ID NO: 93829 - DNA, 201 bp, Bos taurus; identical to SEQ ID NO: 12214

SEQ ID NO: 93830 - DNA, 201 bp, Bos taurus; identical to SEQ ID NO: 12215

SEQ ID NO: 93831 - DNA, 201 bp, Bos taurus
gtttgtggtatgtttgtaggatagtttagttcccagacagctcatgtctcatttgatcttcctggacattttccttcgtggccatcgggttctgatgctacgtcacagaatcgcccagcaggaagctggtagtgagatgctctcagcctgcagggcaccctgttcatgtctccacaggcaagtctgtggccagccctgcct

SEQ ID NO: 93832 - DNA, 201 bp, Bos taurus; identical to SEQ ID NO: 12219

SEQ ID NO: 93833 - DNA, 201 bp, Bos taurus; identical to SEQ ID NO: 12220

SEQ ID NO: 93834 - DNA, 201 bp, Bos taurus; identical to SEQ ID NO: 12221

SEQ ID NO: 93835 - DNA, 201 bp, Bos taurus; identical to SEQ ID NO: 12222

SEQ ID NO: 93836 - DNA, 201 bp, Bos taurus; identical to SEQ ID NO: 12223

SEQ ID NO: 93837 - DNA, 201 bp, Bos taurus; identical to SEQ ID NO: 12224

SEQ ID NO: 93838 - DNA, 201 bp, Bos taurus
tgttcaacagtgaatatcccaggaatgtagcccagaggagagaggtgggttagagtttggggaaggttgtttagaaagagcaaagaaagcaaaaagaggcaagagagagacctggctgtttatgggcaaacaatggaccctggcccagaaccaggttcttgctccatcctcctgggtgggggatggtactgccatggaggt

SEQ ID NO: 93839 - DNA, 201 bp, Bos taurus; identical to SEQ ID NO: 12225

SEQ ID NO: 93840 - DNA, 201 bp, Bos taurus
tcccagctgtcctccctttcatcattcaagtggctgaagtctgaccacatttgcaatgtaggtaggagtattcttagagctcagctctgaattcgcagctttcctaattcatgtcttactcttcaccctcatttttatagaaaactctttactagaacttcatatagtactaagtactacataatacataaaatgaatttc

SEQ ID NO: 93841 - DNA, 201 bp, Bos taurus; identical to SEQ ID NO: 12228

SEQ ID NO: 93842 - DNA, 201 bp, Bos taurus
gagcttcccttccgagggctgccattctccccaggtcacaccccactgctgatccagccctggggcagctccaagcctccgggcatgagaaggggccctctggttttcctctgacctcccaggtccctgatcctggcttggacccagtcttaggtcccctctgaagcttcagttgagaagagcttgggactctggaggacc

SEQ ID NO: 93843 - DNA, 201 bp, Bos taurus; identical to SEQ ID NO: 12229

SEQ ID NO: 93844 - DNA, 201 bp, Bos taurus; identical to SEQ ID NO: 12231

SEQ ID NO: 93845 - DNA, 201 bp, Bos taurus; identical to SEQ ID NO: 12232

SEQ ID NO: 93846 - DNA, 201 bp, Bos taurus
cacggggtgactaagggaagtgggccgtggagtgtcctgtttcagcaggagcctggtgtcatgcatcaggccagggtgggggaggagtttggaccagcccgtgctgtacacgagtgagctttctcccaagtcaggcacccttatctgccatctgtaaatataagccatttgccaaagtccttgcccttctccctcctgtgg

SEQ ID NO: 93847 - DNA, 201 bp, Bos taurus; identical to SEQ ID NO: 12233

SEQ ID NO: 93848 - DNA, 201 bp, Bos taurus
catttggtaggaaaaggccatgtgtagttatttgctaacctgttgtgctacttccgaggatggtattattttgtttttgtttttgtttttttgacctggcgtggccttccttcattgcacctaatcgtgtttgtatccttccgagaggagcacaggtttttatgggtgttatgtttcaccagcaaaaacatgtgttgtgta

SEQ ID NO: 93849 - DNA, 201 bp, Bos taurus; identical to SEQ ID NO: 12234

SEQ ID NO: 93850 - DNA, 201 bp, Bos taurus
gggacttgagctctcagcaatttgtaattccccagctccgcccttttaaagatacatactcatgggtgaaatatgttgttgtgctttgggtttgattttattgcgggtaagaaactatttggatgtgtaagcccttggaatcaagggctgatgcctgaccgtgtgtggagagcatcctgcgtgtgaaaccaccagtgcaca

SEQ ID NO: 93851 - DNA, 201 bp, Bos taurus; identical to SEQ ID NO: 12235

SEQ ID NO: 93852 - DNA, 201 bp, Bos taurus; identical to SEQ ID NO: 12237

SEQ ID NO: 93853 - DNA, 201 bp, Bos taurus; identical to SEQ ID NO: 12238

SEQ ID NO: 93854 - DNA, 201 bp, Bos taurus
tcacacacacacacacaacttgggctggaatcttggcttcatcacttactagcattgagaaggtgaggaagccacttaccttttctaagctgcgggttccgcactcataaaatgggatgaggatgacggtactcgctgctggagttgtttagggggttagttcacgtaatgcatgtagagcacttagccgggagtcaggcg

SEQ ID NO: 93855 - DNA, 201 bp, Bos taurus; identical to SEQ ID NO: 12239

SEQ ID NO: 93856 - DNA, 201 bp, Bos taurus; identical to SEQ ID NO: 12240

SEQ ID NO: 93857 - DNA, 201 bp, Bos taurus; identical to SEQ ID NO: 12241

SEQ ID NO: 93858 - DNA, 201 bp, Bos taurus; identical to SEQ ID NO: 12242

SEQ ID NO: 93859 - DNA, 201 bp, Bos taurus; identical to SEQ ID NO: 12244

SEQ ID NO: 93860 - DNA, 201 bp, Bos taurus; identical to SEQ ID NO: 12247

SEQ ID NO: 93861 - DNA, 201 bp, Bos taurus
gaatgagtgattaaatgagcaggggatggatatggaggtgtgtatatttccaagcacattgtggggaatgaaacagccttgccgcccgacacacagtggagactggagttgagagggcgtgcctctgcagggcttggggaaggccagtgaccccgacctgagtcctggaggatgagcagaaggcttccatgcgaggagagt

SEQ ID NO: 93862 - DNA, 201 bp, Bos taurus
tgtgaggttaggatgagtggcttttttagggcgggtcctgggttgtgttggggtctagtttgacacccctggagaggccagtcttcctcctgaactcatttgtgcagccattctgatggggtacgtgtctctactgccagatggaagacttttccgggacccttctgtgccagcacttggtacccacatggccaaagaagt

SEQ ID NO: 93863 - DNA, 201 bp, Bos taurus; identical to SEQ ID NO: 12248

SEQ ID NO: 93864 - DNA, 201 bp, Bos taurus
ccctttggcaaaatgtggcccatggaacaatcagccagcccccgtgggtgttgaatggcagcgaacagatgttctctggagcccacttgacaaggaggcaagtgggaaggagggacatcctgggccctgcagggggcggaaccagcctgtgtgatttaacctgtgcctgtaaaatggtaaaactccatccaccttctccat

SEQ ID NO: 93865 - DNA, 201 bp, Bos taurus; identical to SEQ ID NO: 12249

SEQ ID NO: 93866 - DNA, 201 bp, Bos taurus; identical to SEQ ID NO: 12250

SEQ ID NO: 93867 - DNA, 201 bp, Bos taurus; identical to SEQ ID NO: 12251

SEQ ID NO: 93868 - DNA, 201 bp, Bos taurus; identical to SEQ ID NO: 12252

SEQ ID NO: 93869 - DNA, 201 bp, Bos taurus
tgatgtgggatacgcacgccaggagtttccctttgccggtgataatgtctgatgtgggatacgcacagaggagctgtaagggcctagcagagtgtcttattattgttgttgtttagttactccatcgtgtccgactctttgtaaccccacggactgtagccctcctctctccatgggatttcccaggccaagaatactgga

SEQ ID NO: 93870 - DNA, 201 bp, Bos taurus; identical to SEQ ID NO: 12253

SEQ ID NO: 93871 - DNA, 201 bp, Bos taurus; identical to SEQ ID NO: 12254

SEQ ID NO: 93872 - DNA, 201 bp, Bos taurus; identical to SEQ ID NO: 12255

SEQ ID NO: 93873 - DNA, 201 bp, Bos taurus; identical to SEQ ID NO: 12256

SEQ ID NO: 93874 - DNA, 201 bp, Bos taurus
ctcccccgaggcccagatggaggcacacaggctccgttaatagcttggctggagggcagatgaaatctggttcttcccagagcccttccttagaggatacggcaggtgtggccaggggagaggcggcactgggggaggagggtttgtgtgactagtttaggtaacaaggtggcgaagcccacctcaccccgtctccaggac

SEQ ID NO: 93875 - DNA, 201 bp, Bos taurus; identical to SEQ ID NO: 12257

SEQ ID NO: 93876 - DNA, 201 bp, Bos taurus; identical to SEQ ID NO: 12258

SEQ ID NO: 93877 - DNA, 201 bp, Bos taurus
taagagagactgtaaaaagaaagagaacttagacaacgaaggctccttgtctcacagaaagccccatccctaccaaggaatgtttctggcagatgcaggaacgaaaagagattctctggttaaacaggtttggtgagcattgtaaagaaagaatgaagcgactgtctttcctgcagggcaggttgccgtccttagcgtgtg

SEQ ID NO: 93878 - DNA, 201 bp, Bos taurus; identical to SEQ ID NO: 12259

SEQ ID NO: 93879 - DNA, 201 bp, Bos taurus; identical to SEQ ID NO: 12260

SEQ ID NO: 93880 - DNA, 201 bp, Bos taurus; identical to SEQ ID NO: 12261

SEQ ID NO: 93881 - DNA, 201 bp, Bos taurus; identical to SEQ ID NO: 12262

SEQ ID NO: 93882 - DNA, 201 bp, Bos taurus; identical to SEQ ID NO: 12263

SEQ ID NO: 93883 - DNA, 201 bp, Bos taurus; identical to SEQ ID NO: 12264

SEQ ID NO: 93884 - DNA, 201 bp, Bos taurus
tacttatcatcattcagaagaactctagttcccccttctcttgctcaccaccctcacacacacatgcagtgaattatacccctaggcgagtgggggagtgaaatggtggggtcctgcctgggtattaaaaaaaaaaaacctgtaatagaaaactccaccagtcatttttccctcctttttgtatccatgagcaggtgcaca

SEQ ID NO: 93885 - DNA, 201 bp, Bos taurus; identical to SEQ ID NO: 12265

SEQ ID NO: 93886 - DNA, 201 bp, Bos taurus; identical to SEQ ID NO: 12266

SEQ ID NO: 93887 - DNA, 201 bp, Bos taurus
tgccttttgcatctagacagttgtacagttttaactcagaagcacttgtgaatcctgagtatctcacagcctggaattatctagtctctacttaggaggaagaacatgggtctcttcctagcttttcttccttcagtaaacacagtgatcaaacaaatgaggaggtttcacttccactagctcaacagcctgtgtgcacga

SEQ ID NO: 93888 - DNA, 201 bp, Bos taurus; identical to SEQ ID NO: 12267

SEQ ID NO: 93889 - DNA, 201 bp, Bos taurus
aagcccataagccccttgcaactgcttctgcatcccagcactggctgagtgccacaactggccagggtgagcaccacagtatctaataaaccaccctgtcgtaactgactgaatcaggtgtggaaattttgactgaaagacagccaatcagctggataatcaatgacctgttttgtggtctggaatgaaaaaaagagcatc

SEQ ID NO: 93890 - DNA, 201 bp, Bos taurus; identical to SEQ ID NO: 12268

SEQ ID NO: 93891 - DNA, 201 bp, Bos taurus; identical to SEQ ID NO: 12269

SEQ ID NO: 93892 - DNA, 201 bp, Bos taurus
tatttttggaaacaaattatctgtgtttaggttagttcagtatacccaaaattttccaaagttcttctgagcggtaaattctttatgatggggccaagcagccaccaacacaggtacttactgcctctctctcagagccgatagcaaacttcctcttgctaatgatctttatggccactttcttacatgtcttcctctcga

SEQ ID NO: 93893 - DNA, 201 bp, Bos taurus
agacactttaccgtctgagccaccagggaagtaagtgctcaataaatgctcgttgctgatgtttgcttctttcgacttcttgtttttaacctcatgttctgctccatctgggttaatatacaatgaggtgcaatggacacaaacattcggtgcattgcatctcattgtattgaacatgtttattttaaaaacattgtcagc

SEQ ID NO: 93894 - DNA, 201 bp, Bos taurus; identical to SEQ ID NO: 12270

SEQ ID NO: 93895 - DNA, 201 bp, Bos taurus; identical to SEQ ID NO: 12271

SEQ ID NO: 93896 - DNA, 201 bp, Bos taurus; identical to SEQ ID NO: 12272

SEQ ID NO: 93897 - DNA, 201 bp, Bos taurus; identical to SEQ ID NO: 12273

SEQ ID NO: 93898 - DNA, 201 bp, Bos taurus; identical to SEQ ID NO: 12274

SEQ ID NO: 93899 - DNA, 201 bp, Bos taurus
cacgtggggcctgggtctggtcgtgcctcagtatcaggctcagcaccttgggagcttggcttgttaaataaaacccgcacagggagcccctcctgctgattgggctgcacaggccatgacacctcacccgccccaccctgcaactacgactctcgtctcattctctccttagacactcagacagctttcccaaatttacct

SEQ ID NO: 93900 - DNA, 201 bp, Bos taurus; identical to SEQ ID NO: 12275

SEQ ID NO: 93901 - DNA, 201 bp, Bos taurus; identical to SEQ ID NO: 12276

SEQ ID NO: 93902 - DNA, 201 bp, Bos taurus; identical to SEQ ID NO: 12277

SEQ ID NO: 93903 - DNA, 201 bp, Bos taurus; identical to SEQ ID NO: 12278

SEQ ID NO: 93904 - DNA, 201 bp, Bos taurus; identical to SEQ ID NO: 12279

SEQ ID NO: 93905 - DNA, 201 bp, Bos taurus; identical to SEQ ID NO: 12280

SEQ ID NO: 93906 - DNA, 201 bp, Bos taurus; identical to SEQ ID NO: 12281

SEQ ID NO: 93907 - DNA, 201 bp, Bos taurus; identical to SEQ ID NO: 12282

SEQ ID NO: 93908 - DNA, 201 bp, Bos taurus; identical to SEQ ID NO: 12283

SEQ ID NO: 93909 - DNA, 201 bp, Bos taurus
ccagccgtgagttaccacatccttcattcatcggataaacttgtaccaaggcccattatgcagccacgcagcaggctcctggccagacgtctggggcagcaacaggtcttgctctcagtaggcttactgactagcgactccaaaaaggtccgggccacctgggtgggcagatacttagggtgttacccagaaggttctctg

SEQ ID NO: 93910 - DNA, 201 bp, Bos taurus; identical to SEQ ID NO: 12284

SEQ ID NO: 93911 - DNA, 201 bp, Bos taurus
tcaacgaacccagggtccggcgcttggccagtgcctattaaatcttaacagatactaactagcgccaccgccactttaactgctggctccgattgggaacgtctgtgaagttggagacactgctttgagcctataagtgagccatcttacatgagaacacacaggcacgacacacaacattaggtaattctctcctgccgg

SEQ ID NO: 93912 - DNA, 201 bp, Bos taurus
accccaggtttctttttcagatttcacagcgagtactgccgtcccggcccatcattggatcccttctggctgctgtctcctgtcgtgttgatcccagccgcttctgcacccacgagggtccaaggccggggaatccccaggctccatcgctcccgtcccccacctcctagggcagccccagccccctgccccggcctctcg

SEQ ID NO: 93913 - DNA, 201 bp, Bos taurus; identical to SEQ ID NO: 12285

SEQ ID NO: 93914 - DNA, 201 bp, Bos taurus
cttgccattcggctgccccagtgatgctcagcttcatttccagcaccaccctcaatttcagccattgtcgatgcaggaactgctctgtgacagatgtccatacatagccctggcccttgactttcctcacaggctaccaccgttgaccatgtggtcactgacacggcagggaggaagtcttgggtgagaatgctgggacgt

SEQ ID NO: 93915 - DNA, 201 bp, Bos taurus; identical to SEQ ID NO: 12286

SEQ ID NO: 93916 - DNA, 201 bp, Bos taurus; identical to SEQ ID NO: 12287

SEQ ID NO: 93917 - DNA, 201 bp, Bos taurus
ctatagcttgctgggccaccaaatcccccgccggggccgccgccaccgccacctcttccctgccctggcgcgtgtctgggctctcatactctggggacggaggcttcatcaaccgcacatcgtcgctgcctttctccaccctagggagaacccagtgtttgccacacgtgttccaggctcccaggcgggctgcctgcccct

SEQ ID NO: 93918 - DNA, 201 bp, Bos taurus; identical to SEQ ID NO: 12288

SEQ ID NO: 93919 - DNA, 201 bp, Bos taurus; identical to SEQ ID NO: 12290

SEQ ID NO: 93920 - DNA, 201 bp, Bos taurus
aaggaagaaggcaggtacccagatgccttacatcagaaggtgggagcatgaaggaaggccctgcccctgctgccggcccccgtgccgggcacgtcaccactgtccagaactgagttctgtcctcactgcctgcctaaaaataggtgatgttgccacttcagaaataaggagccgagcagctggcctgagatcacccggggg

SEQ ID NO: 93921 - DNA, 201 bp, Bos taurus
gcgactgaacaagagggagcccgcaaacaagccagcagagaaccaaaggccatttacaaaagcagcagagtatgtgcccagagccttgtgccaaggcccgaatttcaaaacctaaggggctggaggaagaaggaaagcaggaactcatgctttccaaggacccactaaggtgccaggaagtggccttcccaccttccaccc

SEQ ID NO: 93922 - DNA, 201 bp, Bos taurus
atagttctggggaccgcacaaggctctggagagaaaagggcagagtagtaacagagggggccagggaaggcttggggcccactcacgcccagggatgtgctcgatgtgtgtgattcagcctcaatacaacctcccaggtcagtgctgtggccccccttcacgtcaggaggccaaggcgtggagcatcgccacggctgtgga

SEQ ID NO: 93923 - DNA, 201 bp, Bos taurus; identical to SEQ ID NO: 12291

SEQ ID NO: 93924 - DNA, 201 bp, Bos taurus
ccttcctgtgagaagtgttcccaaaggcaccgtggaaggcctcccgccccgtggagctggggtcttgagcacgccgaggggcagtgcgggggccggggcatgtgcatgactctgtgtcctttctcagcgggtgacacgagctttcctcctccacgtcaatgggcttctgaggccccacggcagaggcgcccgtggccggct

SEQ ID NO: 93925 - DNA, 201 bp, Bos taurus
tgcagacgcctgattcctgccgtggcagccacgtgcctgcaggtgagcggcaggggtgacgctgagcccgcagccccgggcctgaacgcagcaggaccgcgttatcctgcaagggtggaggcacctggaacccctctctcctgattcagggaaggaatctccttagagggggaaaggagctggcccggaggcatgcatgcc

SEQ ID NO: 93926 - DNA, 201 bp, Bos taurus; identical to SEQ ID NO: 12296

SEQ ID NO: 93927 - DNA, 201 bp, Bos taurus; identical to SEQ ID NO: 12297

SEQ ID NO: 93928 - DNA, 201 bp, Bos taurus; identical to SEQ ID NO: 12299

SEQ ID NO: 93929 - DNA, 201 bp, Bos taurus; identical to SEQ ID NO: 12300

SEQ ID NO: 93930 - DNA, 201 bp, Bos taurus; identical to SEQ ID NO: 12301

SEQ ID NO: 93931 - DNA, 201 bp, Bos taurus
acgaagccccagcaccgccagagcaagggacggattcgattataaaccagaataaacaagtacaagctcagccgagtcgcctctgtggtacgcccgggaccgacacgacctcgtaaatcgacgacctgagagcgccagtcgctccgtcgccgctgactcttcccgaccccgggggctgcagcccgccaggctcctctgtcc

SEQ ID NO: 93932 - DNA, 201 bp, Bos taurus
gtcatcagggtggggccctaagccaattaagccaatgtggctgtgtccttataagcaggtttcagagatacacagagccatccgggtccatgggcacagaaggcccaccctgtggaagggcatcaagggccgcccagctgccagccaaggagaggtccccgaggaagctgtgcctgctggcagcttcatcctggacttgca

SEQ ID NO: 93933 - DNA, 201 bp, Bos taurus; identical to SEQ ID NO: 12304

SEQ ID NO: 93934 - DNA, 201 bp, Bos taurus; identical to SEQ ID NO: 12306

SEQ ID NO: 93935 - DNA, 201 bp, Bos taurus; identical to SEQ ID NO: 12307

SEQ ID NO: 93936 - DNA, 201 bp, Bos taurus; identical to SEQ ID NO: 12309

SEQ ID NO: 93937 - DNA, 201 bp, Bos taurus
tggcttccggtggacgtgtgaaccggccccaggaggtccttgcatatttcccggagtcggtattcaaaccctagttacagaaaacacagaaccaggcacacgtcacagaaggccagaaagccgagcccaagctaaatcaccacgaacgcagagcccaagggaccaccgctccgtgcaccacctcctgcggcctgctgtctc

SEQ ID NO: 93938 - DNA, 201 bp, Bos taurus; identical to SEQ ID NO: 12311

SEQ ID NO: 93939 - DNA, 201 bp, Bos taurus; identical to SEQ ID NO: 12312

SEQ ID NO: 93940 - DNA, 201 bp, Bos taurus; identical to SEQ ID NO: 12313

SEQ ID NO: 93941 - DNA, 201 bp, Bos taurus; identical to SEQ ID NO: 12315

SEQ ID NO: 93942 - DNA, 201 bp, Bos taurus; identical to SEQ ID NO: 12316

SEQ ID NO: 93943 - DNA, 201 bp, Bos taurus; identical to SEQ ID NO: 12317

SEQ ID NO: 93944 - DNA, 201 bp, Bos taurus
aactgatttcagactttcagtcactcatgcctcctttcacaaatgctctctgctctgctgcgtcccagcgctgtggatgcacagaccctgacacgcctgtcggccttgcctcccgagctatccagtgaggaagaggagggaacactgcagtcacgcggttcctaacccagatgtattgaacagtcagtctctaacacaaaa

SEQ ID NO: 93945 - DNA, 201 bp, Bos taurus; identical to SEQ ID NO: 12318

SEQ ID NO: 93946 - DNA, 201 bp, Bos taurus; identical to SEQ ID NO: 12319

SEQ ID NO: 93947 - DNA, 201 bp, Bos taurus
catctacgacagcctgaccagcctcatgaccagccttgtcgcagttgagttggagaaagtggtgctgaagtccaccttcaaccgggtaacgtgaagagagtgcaggcctctgccctactgttttccctgaggaggaccagtctgtcccctccctactaccccaggccctgtgcacataggctcagtgctgccctgaagcag

SEQ ID NO: 93948 - DNA, 201 bp, Bos taurus; identical to SEQ ID NO: 12320

SEQ ID NO: 93949 - DNA, 201 bp, Bos taurus
ttgagcagagttcactatattaaatctttgctgccaagtacaagatgataaggattgtatttaaggttgtctgataagacattgacaggggcagggtagacactaattaatgcgaggcaacttgattattgacaggcaggacctggtattgtgggcatcaagtcggccatctggtctgtacttcctgcctccatctctggt

SEQ ID NO: 93950 - DNA, 201 bp, Bos taurus
ttatcagagtgacttaagtgcttttgtgccatttctaaaatgtgttggcaaagtcaagaatcagtcttctttattaaaactggcctctcatgagctgcctagaagctgtatgccagtccacagagctctcaagatcgactcaggtgccctgggaaagggccagagccttgagctggtatgaagcaaagggtatttggtgac

SEQ ID NO: 93951 - DNA, 201 bp, Bos taurus; identical to SEQ ID NO: 12323

SEQ ID NO: 93952 - DNA, 201 bp, Bos taurus
ccagtaagtcatttatggacgagaggtcggggcggtggggactgtgaagaactacaggggtgctgggctatgtggtgactcacacctggcctgcccctttcggggacactggaaggcatgcctgcggagttgctataaaagaatatcgaggacttccctgatggcccagtgcatcagaatccacagtggataagaatgcag

SEQ ID NO: 93953 - DNA, 201 bp, Bos taurus; identical to SEQ ID NO: 12324

SEQ ID NO: 93954 - DNA, 201 bp, Bos taurus
ctccactctccctaccccacaatctcccttgcccgccacgctcccagcaaccccagagctgccctctggattccaaccctgacataccccagggcccttgtacttgctgttcctctgcctagaatgctttttacccagttactatgacagctccttttcatccctcagatcccagctccccagagaggccttccctgatta

SEQ ID NO: 93955 - DNA, 201 bp, Bos taurus; identical to SEQ ID NO: 12325

SEQ ID NO: 93956 - DNA, 201 bp, Bos taurus; identical to SEQ ID NO: 12326

SEQ ID NO: 93957 - DNA, 201 bp, Bos taurus; identical to SEQ ID NO: 12327

SEQ ID NO: 93958 - DNA, 201 bp, Bos taurus; identical to SEQ ID NO: 12328

SEQ ID NO: 93959 - DNA, 201 bp, Bos taurus
ggtggcaggagccccattgcaccagcccactgcccaccccgagatgtttgcagctcaatgccaggacagagatgatcattttgcaacatttaaagatatcaaatcactatgtcgtgcacctggaacttatatagcactgtaggtcaattatataattaaaagtacaataaaatttcggagagaagaggagaagaggtggag

SEQ ID NO: 93960 - DNA, 201 bp, Bos taurus; identical to SEQ ID NO: 12330

SEQ ID NO: 93961 - DNA, 201 bp, Bos taurus
gacagcaatcaactgttcttttgcatggctcaagtcttacccttagcatttcacagcctgtgcatggcattgggagttgatggtgaaagtactgaccaccatttatcgtttactaagtgtgtcttgaatgtcagcttacagaatataacattttaaacagctggaagttttttaagaaggtaataaaaatggttttctatt

SEQ ID NO: 93962 - DNA, 201 bp, Bos taurus; identical to SEQ ID NO: 12332

SEQ ID NO: 93963 - DNA, 201 bp, Bos taurus; identical to SEQ ID NO: 12333

SEQ ID NO: 93964 - DNA, 201 bp, Bos taurus; identical to SEQ ID NO: 12334

SEQ ID NO: 93965 - DNA, 201 bp, Bos taurus; identical to SEQ ID NO: 12336

SEQ ID NO: 93966 - DNA, 201 bp, Bos taurus
agtgactaaacaccaccaccacattcctttgatgccaaggcagtgcattcactttacattccaccactgagattcatttccatgaagttttaaaaatgcacagacaacagatgccatattcttcttctgtagatctggtgagcaaaggctcatagtggcagatacgaggttgccctccctggtttattcacttcagaagcc

SEQ ID NO: 93967 - DNA, 201 bp, Bos taurus; identical to SEQ ID NO: 12337

SEQ ID NO: 93968 - DNA, 201 bp, Bos taurus; identical to SEQ ID NO: 12338

SEQ ID NO: 93969 - DNA, 201 bp, Bos taurus
tacatgtggaagcagctctaattacaagaaataactgcaggtgaatacaaggtagctcccccacctgacaatgaattttacagagacaaagccactctatgcaaaacaccaatgttttaatctccacaatgttgcagggaagagccaagttcaagaaagtcaacccaaggaaaagcacatttgacaaagacctgctaatag

SEQ ID NO: 93970 - DNA, 201 bp, Bos taurus; identical to SEQ ID NO: 12339

SEQ ID NO: 93971 - DNA, 201 bp, Bos taurus; identical to SEQ ID NO: 12340

SEQ ID NO: 93972 - DNA, 201 bp, Bos taurus; identical to SEQ ID NO: 12342

SEQ ID NO: 93973 - DNA, 201 bp, Bos taurus; identical to SEQ ID NO: 12343

SEQ ID NO: 93974 - DNA, 201 bp, Bos taurus; identical to SEQ ID NO: 12345

SEQ ID NO: 93975 - DNA, 201 bp, Bos taurus; identical to SEQ ID NO: 12346

SEQ ID NO: 93976 - DNA, 201 bp, Bos taurus; identical to SEQ ID NO: 12347

SEQ ID NO: 93977 - DNA, 201 bp, Bos taurus; identical to SEQ ID NO: 12348

SEQ ID NO: 93978 - DNA, 201 bp, Bos taurus; identical to SEQ ID NO: 12349

SEQ ID NO: 93979 - DNA, 201 bp, Bos taurus; identical to SEQ ID NO: 12350

SEQ ID NO: 93980 - DNA, 201 bp, Bos taurus; identical to SEQ ID NO: 12351

SEQ ID NO: 93981 - DNA, 201 bp, Bos taurus; identical to SEQ ID NO: 12352

SEQ ID NO: 93982 - DNA, 201 bp, Bos taurus; identical to SEQ ID NO: 12355

SEQ ID NO: 93983 - DNA, 201 bp, Bos taurus; identical to SEQ ID NO: 12356

SEQ ID NO: 93984 - DNA, 201 bp, Bos taurus; identical to SEQ ID NO: 12357

SEQ ID NO: 93985 - DNA, 201 bp, Bos taurus; identical to SEQ ID NO: 12358

SEQ ID NO: 93986 - DNA, 201 bp, Bos taurus; identical to SEQ ID NO: 12359

SEQ ID NO: 93987 - DNA, 201 bp, Bos taurus; identical to SEQ ID NO: 12360

SEQ ID NO: 93988 - DNA, 201 bp, Bos taurus; identical to SEQ ID NO: 12361

SEQ ID NO: 93989 - DNA, 201 bp, Bos taurus; identical to SEQ ID NO: 12364

SEQ ID NO: 93990 - DNA, 201 bp, Bos taurus; identical to SEQ ID NO: 12365

SEQ ID NO: 93991 - DNA, 201 bp, Bos taurus; identical to SEQ ID NO: 12368

SEQ ID NO: 93992 - DNA, 201 bp, Bos taurus; identical to SEQ ID NO: 12369

SEQ ID NO: 93993 - DNA, 201 bp, Bos taurus
tttcttaggcttagaaggattacatccatccatgagtaaacaacaaggatgagtccaagtggcttctgccccaccaacattccagggccccccgtcagagcgtatttttatcagtgaccaggaactgccttgtactgcctgggagccagttgagcggtgatctagggactagctctggagtcggcctgcttggatttctct

SEQ ID NO: 93994 - DNA, 201 bp, Bos taurus
ataatagtgacagaagtaaatgggataaatgccccccaaaagaggcaaagactcttaaattaggctgcaaaagcatgtcaggccaaaaaccacagatgagccttgaacagacaatgtggaggtttaggggtgctcaccctctgcatgcagtgggaaatctccctttggcctaaagttggatctctatatccatcatttctc

SEQ ID NO: 93995 - DNA, 201 bp, Bos taurus; identical to SEQ ID NO: 12371

SEQ ID NO: 93996 - DNA, 201 bp, Bos taurus
cccccataggatgtgtaaagggagagtagatccctaagtaaagtggaggtttcgtcaggaaggacagaggggaacagaagatgggtgggcattaaagatacataataacagaataccgaagtggccaccatcccatccgccttaaaatagaaaatacagccacaggtgaagatccctgcagtctcatgcacaattacattc

SEQ ID NO: 93997 - DNA, 201 bp, Bos taurus
cgtggagtcccagcccaagagagggggtggcaccttcagagctttgaacagggagctgacaagtctccacaaatcctgcaagtcacccagtgggaacagggtgtgagctacaggtaaggggacagcagagtactcaagagcactcaccctggggctggacagtctgggtctgatcccaggtctgcctactgagacgtgacc

SEQ ID NO: 93998 - DNA, 201 bp, Bos taurus; identical to SEQ ID NO: 12373

SEQ ID NO: 93999 - DNA, 201 bp, Bos taurus; identical to SEQ ID NO: 12376

SEQ ID NO: 94000 - DNA, 201 bp, Bos taurus; identical to SEQ ID NO: 12380

SEQ ID NO: 94001 - DNA, 201 bp, Bos taurus; identical to SEQ ID NO: 12381

SEQ ID NO: 94002 - DNA, 201 bp, Bos taurus; identical to SEQ ID NO: 12384

SEQ ID NO: 94003 - DNA, 201 bp, Bos taurus; identical to SEQ ID NO: 12385

SEQ ID NO: 94004 - DNA, 201 bp, Bos taurus; identical to SEQ ID NO: 12386

SEQ ID NO: 94005 - DNA, 201 bp, Bos taurus
gtgatgagaagagatggaagatcagagcaccttggtacctctcgttaccaagtaaaacatgcagggagctgggccaggcccttccgatcgctgtgtgccctctacgggctcctgccggatggcagggaagccagcacagccctttacctggacttggccgttgttttcctgatgcaggcgctccccaaggctgtcggggcg

SEQ ID NO: 94006 - DNA, 201 bp, Bos taurus; identical to SEQ ID NO: 12388

SEQ ID NO: 94007 - DNA, 201 bp, Bos taurus; identical to SEQ ID NO: 12390

SEQ ID NO: 94008 - DNA, 201 bp, Bos taurus; identical to SEQ ID NO: 12391

SEQ ID NO: 94009 - DNA, 201 bp, Bos taurus
ctgagctgttgtcagctgctgacttgcttagtctgaagatccaagaaagattcactcaaatgtctggcaccctggtgctgcttcgtgtggcctcttgtcagtgctgccttgggcttcctcagagctaatcaggggtctgatgtggtcattggcttccagagggatcagtctaagcaagtgaaagtcaagctatgtctttgt

SEQ ID NO: 94010 - DNA, 201 bp, Bos taurus
tgtgctctggatatagaaggcaggccgccaggaacccctgcagcagaagagactgaagaaggctagaaggggtgctcgagctgagagtagatggctggatgaaagggaagggccatccaggcagaagacgggagaggtgatgaggttcagcaccagggaaaagccctgaagtaggcctttgcacccgaggatgctgaggca

SEQ ID NO: 94011 - DNA, 201 bp, Bos taurus; identical to SEQ ID NO: 12392

SEQ ID NO: 94012 - DNA, 201 bp, Bos taurus
ggttttggaaagaataaaatttttattagtgttcatttcttctctgtctcctccccagcatggcgtggcatctgcctggcccagaatcccactaaagggagcctgtggggcactgtctggacacatttttggttgtcacaactggtttgggagctctactggcatctgttgggtaggggccagagatgctgctgagtattc

SEQ ID NO: 94013 - DNA, 201 bp, Bos taurus; identical to SEQ ID NO: 12393

SEQ ID NO: 94014 - DNA, 201 bp, Bos taurus; identical to SEQ ID NO: 12394

SEQ ID NO: 94015 - DNA, 201 bp, Bos taurus
cctctgagggcagaggcccagagggtcttcttccctgaattgagtctcaggtaactgatcccaaacatcctcgtggccatagatatgcatatgttgctcgtgtctggtcctgccctgccctgccctgtccctgctgcctgcctccatctgcctcatgcgtggctgtacagcgtgggtccagcacgggctctgcggcctcag

SEQ ID NO: 94016 - DNA, 201 bp, Bos taurus
tttagtgcctgtgggtgtggttcagctcagtgtggtgagaatttagtggatcagagcctgcaatggttcagcaagagaaccaggccagcgatctgtcagcgtggagatgaccaataaacttgtagagggtcagaaaaccacctggggaaggagactggctattgtgacggccaagcttttgctccccatcctgccctcagg

SEQ ID NO: 94017 - DNA, 201 bp, Bos taurus
tgagatgctgaactttgggtctctttcttccttagcaagtgttccgtcaattaaggcaaatgtgtgatgaacttttatcaaaagcaagactggccattgttacagaagttctgtctgtccaacacttcctggacctgctcctgcatcctctttatcattaaacaaacttctagaagccagtgcaaacatctgaaagtgctt

SEQ ID NO: 94018 - DNA, 201 bp, Bos taurus; identical to SEQ ID NO: 12395

SEQ ID NO: 94019 - DNA, 201 bp, Bos taurus
cctttctctccctcacagatgacgggaagttgtccttggaggagttccagctcttctttgcagatggcgtcctcaacgagagggaactggaggatctctttcacaccatcgactctgacaacaccaagtgagctcagtcccggcggctggaactgggaggtggcatcccccagtctccagtgtccactgccctgcaccgct

SEQ ID NO: 94020 - DNA, 201 bp, Bos taurus; identical to SEQ ID NO: 12396

SEQ ID NO: 94021 - DNA, 201 bp, Bos taurus
gaatagagtggcctgactttgtctcctgagctatgtgtgccctgaatggaataaaggaaaacagaacccagagctttcgatggccgtttttccttgggtcggtatctgaatgttgatacactaggtgagtcggttctagaatcttcaggaaagtgaaggtggcgcagccagggtcgaggaggggtggggctctggagggac

SEQ ID NO: 94022 - DNA, 201 bp, Bos taurus; identical to SEQ ID NO: 12399

SEQ ID NO: 94023 - DNA, 201 bp, Bos taurus; identical to SEQ ID NO: 12400

SEQ ID NO: 94024 - DNA, 201 bp, Bos taurus; identical to SEQ ID NO: 12401

SEQ ID NO: 94025 - DNA, 201 bp, Bos taurus; identical to SEQ ID NO: 12403

SEQ ID NO: 94026 - DNA, 201 bp, Bos taurus; identical to SEQ ID NO: 12404

SEQ ID NO: 94027 - DNA, 201 bp, Bos taurus
acaagtgacccgcgcactgtcctcggccgggcccgctcttggtagttctttttctggctgcatgaactcaggctgtgtgtgcagccaaagttaaactcaaaagggctggacacgtggcctgggcggggagccggagcagatggcaggccacctgttgaggggcggctgcaaatcagcgctcctgctcctccagtggccccc

SEQ ID NO: 94028 - DNA, 201 bp, Bos taurus
ccttggacctgaacgccctcacctctgaagcagcccctccacttcatcaacatgactgatgagtggcttgtaagtagggcggcgttcttaggggtccagctgggctgggccccagcgctcagatggcccgtggcccggtgtctgggtgccaagttcttggctggaaaagtttccagggcggctcagaaggacggagccagg

SEQ ID NO: 94029 - DNA, 201 bp, Bos taurus; identical to SEQ ID NO: 12407

SEQ ID NO: 94030 - DNA, 201 bp, Bos taurus
ggtgaagaagacacagcgtgtctgcagatggttgaactgcacaaagaaagggagagggacgttgagagtcctgttcagtggagaatgtggtggccctccctgtaccagttagctaactagcgctgcgtaacaaaccatcccgaatacagacgtgctgggctccgggagcagctgcgctgggtagctctggcccagcgcccc

SEQ ID NO: 94031 - DNA, 201 bp, Bos taurus
acactgtccccccttgctgaggcctggtcacctctttctggaaggaagtcagaggaaagcaagagtgcttatcggtcattttagttgctttcactcattttgttcattctgggccgatccggtggatgtggattcctgctctcccttaaagaggcagtgatgggaccaggacacgtccctgggaacgtgatgggttttgag

SEQ ID NO: 94032 - DNA, 201 bp, Bos taurus; identical to SEQ ID NO: 12411

SEQ ID NO: 94033 - DNA, 201 bp, Bos taurus; identical to SEQ ID NO: 12412

SEQ ID NO: 94034 - DNA, 201 bp, Bos taurus; identical to SEQ ID NO: 12413

SEQ ID NO: 94035 - DNA, 201 bp, Bos taurus; identical to SEQ ID NO: 12414

SEQ ID NO: 94036 - DNA, 201 bp, Bos taurus; identical to SEQ ID NO: 12415

SEQ ID NO: 94037 - DNA, 201 bp, Bos taurus; identical to SEQ ID NO: 12416

SEQ ID NO: 94038 - DNA, 201 bp, Bos taurus
ggtagcgaagccagagcatgccagcaatggccagggccacgcagagccagttgaagaagctgaagaagttgatgacggagaagatatctttggagaaggcatagagcagggtcatgatgcactgcaagcagagggcaggccatgagcctcaggatgagccagggggagggatgaccgcacgcaccccttcttagcagaaga

SEQ ID NO: 94039 - DNA, 201 bp, Bos taurus; identical to SEQ ID NO: 12417

SEQ ID NO: 94040 - DNA, 201 bp, Bos taurus; identical to SEQ ID NO: 12418

SEQ ID NO: 94041 - DNA, 201 bp, Bos taurus; identical to SEQ ID NO: 12420

SEQ ID NO: 94042 - DNA, 201 bp, Bos taurus; identical to SEQ ID NO: 12421

SEQ ID NO: 94043 - DNA, 201 bp, Bos taurus; identical to SEQ ID NO: 12422

SEQ ID NO: 94044 - DNA, 201 bp, Bos taurus; identical to SEQ ID NO: 12423

SEQ ID NO: 94045 - DNA, 201 bp, Bos taurus; identical to SEQ ID NO: 12424

SEQ ID NO: 94046 - DNA, 201 bp, Bos taurus; identical to SEQ ID NO: 12425

SEQ ID NO: 94047 - DNA, 201 bp, Bos taurus; identical to SEQ ID NO: 12426

SEQ ID NO: 94048 - DNA, 201 bp, Bos taurus; identical to SEQ ID NO: 12427

SEQ ID NO: 94049 - DNA, 201 bp, Bos taurus; identical to SEQ ID NO: 12428

SEQ ID NO: 94050 - DNA, 201 bp, Bos taurus; identical to SEQ ID NO: 12430

SEQ ID NO: 94051 - DNA, 201 bp, Bos taurus; identical to SEQ ID NO: 12431

SEQ ID NO: 94052 - DNA, 201 bp, Bos taurus
aaggcatactctctcaacacacgtagttccccccccgcccgcccccagaggtccctcctcttaaaatcacactgcccagtaagcaggccaatttgccaaataatcctttggctgagtgaccggtttgccagactgctgaggatgtttttgatgttttcctttcatctcacagccagaacccatgaacctgtgggcccagct

SEQ ID NO: 94053 - DNA, 201 bp, Bos taurus; identical to SEQ ID NO: 12432

SEQ ID NO: 94054 - DNA, 201 bp, Bos taurus; identical to SEQ ID NO: 12434

SEQ ID NO: 94055 - DNA, 201 bp, Bos taurus; identical to SEQ ID NO: 12436

SEQ ID NO: 94056 - DNA, 201 bp, Bos taurus; identical to SEQ ID NO: 12437

SEQ ID NO: 94057 - DNA, 201 bp, Bos taurus
aatataatttgattaagacattttacatgcctggtagtggtggttcatttgtagaaatgatttcagatctgaggaaaacagctacattgaaagagtttctaggcagtcgaaaaggacaatgtgaacaaaacttaattaggagtacaggctaatggaatcgagagggaggcaggatgaattcattacattaataataacctg

SEQ ID NO: 94058 - DNA, 201 bp, Bos taurus
gggaggaagggagagagcctctgtttgagggttcagctgtgtgtcaggccctgaagcaagtcttctcgatcaataacaaacgatcataaatgaagcttgccaggtgatgaatatatgctaggccctgggttaagtactctgtgcccattgaattcatgccctattttacagaagaagaaaaaggtaagtaacctattcagt

SEQ ID NO: 94059 - DNA, 201 bp, Bos taurus; identical to SEQ ID NO: 12442

SEQ ID NO: 94060 - DNA, 201 bp, Bos taurus; identical to SEQ ID NO: 12443

SEQ ID NO: 94061 - DNA, 201 bp, Bos taurus
ttgtgatctgagatgagagggcagcagcggctgaatcatgaactcctggggtacttgaactgattctctcgagcaccaccctccgtccaaagacccggccttgcaagaggaaatggatggaagagaattgagccaggaggtcagaactgctttgcttgcaaaggggagacgcccccaggctcgtgttggagcatccattgc

SEQ ID NO: 94062 - DNA, 201 bp, Bos taurus; identical to SEQ ID NO: 12445

SEQ ID NO: 94063 - DNA, 201 bp, Bos taurus; identical to SEQ ID NO: 12446

SEQ ID NO: 94064 - DNA, 201 bp, Bos taurus
attgattacagcttcctctctgtacccaccctatgacaactctggatggagttctggatttttgacgcatccattcattcactcattgatttcgttgaacaaagtttgagggacttttatggatcaagccttgttccatatcttggagattctgcatcaactaagctggaaaagattcttgtcttttcaagttcagatttg

SEQ ID NO: 94065 - DNA, 201 bp, Bos taurus; identical to SEQ ID NO: 12448

SEQ ID NO: 94066 - DNA, 201 bp, Bos taurus; identical to SEQ ID NO: 12449

SEQ ID NO: 94067 - DNA, 201 bp, Bos taurus; identical to SEQ ID NO: 12450

SEQ ID NO: 94068 - DNA, 201 bp, Bos taurus
ggctgagctgctacacacgcccggcttggccagccagggccgggcgccccgcagcatccattgtcgcactctcaaccaggcccaaaggctcagagagctttcaggtgacccatggtgcagctcctggggaggggaaccaaaattcacagccaggcccctccctgcccccaggccctgaggaaggtgagaaaaagatggagg

SEQ ID NO: 94069 - DNA, 201 bp, Bos taurus; identical to SEQ ID NO: 12451

SEQ ID NO: 94070 - DNA, 201 bp, Bos taurus; identical to SEQ ID NO: 12452

SEQ ID NO: 94071 - DNA, 201 bp, Bos taurus; identical to SEQ ID NO: 12453

SEQ ID NO: 94072 - DNA, 201 bp, Bos taurus; identical to SEQ ID NO: 12455

SEQ ID NO: 94073 - DNA, 201 bp, Bos taurus
accatctcggggacaggaagtgactggctctctctcctgtgtctccttgagggaaatagaccatcggctagaaagacccctagcccatcccacacccctttttgggcagaactgagagtaggccggctcaacaccagttatcggtgagagaaacagaattaccatgatggatttagattggttgatttgttctgaagctga

SEQ ID NO: 94074 - DNA, 201 bp, Bos taurus; identical to SEQ ID NO: 12458

SEQ ID NO: 94075 - DNA, 201 bp, Bos taurus; identical to SEQ ID NO: 12459

SEQ ID NO: 94076 - DNA, 201 bp, Bos taurus; identical to SEQ ID NO: 12460

SEQ ID NO: 94077 - DNA, 201 bp, Bos taurus
gtaaaacaggagatccttgggggcaagtcctgtgttttgatgaccatttggcccccaagtactcacctagaatatagtaggcctggagtaaatgtttgatgaaggaaggaaaggagaaaaggaaggaagggagagagggaaggaagaaggaaggagaaaagctcagggaacagtggagactatgtccttggcccagcgtgg

SEQ ID NO: 94078 - DNA, 201 bp, Bos taurus; identical to SEQ ID NO: 12461

SEQ ID NO: 94079 - DNA, 201 bp, Bos taurus; identical to SEQ ID NO: 12462

SEQ ID NO: 94080 - DNA, 201 bp, Bos taurus
gagggcctccttttcagaagaattctcctttggacaaaattccttccaggaatcttctatctagttttccatttcaccagccccctacattaagttaccctactccttccccatgatacatgaacttgagttgtgtactttaacttctgagagttaagtatcatgccaatggttcatcaacccactgatgtccactagcaa

SEQ ID NO: 94081 - DNA, 201 bp, Bos taurus; identical to SEQ ID NO: 12463

SEQ ID NO: 94082 - DNA, 201 bp, Bos taurus; identical to SEQ ID NO: 12464

SEQ ID NO: 94083 - DNA, 201 bp, Bos taurus; identical to SEQ ID NO: 12465

SEQ ID NO: 94084 - DNA, 201 bp, Bos taurus
ctctacttattttttcaattattataactagagctttcaagttaaagaaaacaatgctgttttcttcccaaagccagcctttccctgacacaaagtaacagtgagatactaaacattgccagcaattgttatgaaaatgcatttctcttgtatcctgttgtcatggcagctaaagatcaagacatgcctgctacatacagc

SEQ ID NO: 94085 - DNA, 201 bp, Bos taurus; identical to SEQ ID NO: 12468

SEQ ID NO: 94086 - DNA, 201 bp, Bos taurus
tttattccctgagacggtctgacccacagccgacactccgaaatggaaaagaccttccaggcagtcagcatttgagcacatttcccgcctgcggcctgtactgacctcacctcaagtcaaaactcacaggaacgctagacttggatgatccgggacatggaaactttcaatcctaaagtgtgccccctcctcactgagact

SEQ ID NO: 94087 - DNA, 201 bp, Bos taurus; identical to SEQ ID NO: 12472

SEQ ID NO: 94088 - DNA, 201 bp, Bos taurus
agtgaacgggcctgactattcttgttaaacttcacagaagcaggtgatgggactgatttgcctatgggctagagtggggttcacggacttgaatgcctgttgggggccaggcaggtatcttaatggagtcacgtggctgacggaactgccacttgtgccttgtctgaaagatgcagctacttcttacttatggccacttgt

SEQ ID NO: 94089 - DNA, 201 bp, Bos taurus; identical to SEQ ID NO: 12473

SEQ ID NO: 94090 - DNA, 201 bp, Bos taurus
ttgcacctgggaagcctgttatctcggtatcaaatgtgatggtaacatatcgttctggaactaagtaggagatacagcgtgaaccactggggtgacaggataggccaaccagttaggcgttacaaaaacaaagactggatcacagggagcccccagatcctcttcccatgattgcacacccctgctctgtatccagttacc

SEQ ID NO: 94091 - DNA, 201 bp, Bos taurus; identical to SEQ ID NO: 12474

SEQ ID NO: 94092 - DNA, 201 bp, Bos taurus; identical to SEQ ID NO: 12475

SEQ ID NO: 94093 - DNA, 201 bp, Bos taurus; identical to SEQ ID NO: 12478

SEQ ID NO: 94094 - DNA, 201 bp, Bos taurus; identical to SEQ ID NO: 12479

SEQ ID NO: 94095 - DNA, 201 bp, Bos taurus
cacagactgggcccaacctgcctttcacaattcctggggcacacactgctcttcttcacactgaagaagaccagaccctgccaaaatggctcatcttgaccgtaggaggcccccctcaccctgcaaccttactttgattcaatgatacccaagtatctctcaccctagggcagaatgctaacacaggagtccatgtgcctc

SEQ ID NO: 94096 - DNA, 201 bp, Bos taurus; identical to SEQ ID NO: 12481

SEQ ID NO: 94097 - DNA, 201 bp, Bos taurus; identical to SEQ ID NO: 12482

SEQ ID NO: 94098 - DNA, 201 bp, Bos taurus; identical to SEQ ID NO: 12483

SEQ ID NO: 94099 - DNA, 201 bp, Bos taurus; identical to SEQ ID NO: 12484

SEQ ID NO: 94100 - DNA, 201 bp, Bos taurus
tcctgatcttgactgtgttgtcttataatccaaccaaatttaactgacattgagcatttctgatctgaacagttaacatggaaatttggcccaaataactgtatatacattctgaacatgaactcggttcaggcatcagaaatgatggggaagacccctcccactaccatccagggagccaggcagggggcccctggtggg

SEQ ID NO: 94101 - DNA, 201 bp, Bos taurus
ttgcctagagaatcctatggacagaggagcctggcaggctacagtccacagggttgcaaagagtcggacacgactcacatgaaacgacagagcacacacgtgctaggcacctcacagaaaggcagtgggctgtagaattcgaccctgggtttgtcttttttcaaagcacgtgctcttaacttcccactaagcttcagaatg

SEQ ID NO: 94102 - DNA, 201 bp, Bos taurus; identical to SEQ ID NO: 12486

SEQ ID NO: 94103 - DNA, 201 bp, Bos taurus
agaacaaaatccctgttgtaatggaggtctgtgtgataataaagcccacgttatttgccatttttctaagggcagaggaactgggaagcagaagggcccaattcttgccttaaagtggtcaggagtccaccttgggaagatgccacagcttagaatagacatcaccaggattcagactcaggttgtcccatctgggggcct

SEQ ID NO: 94104 - DNA, 201 bp, Bos taurus; identical to SEQ ID NO: 12487

SEQ ID NO: 94105 - DNA, 201 bp, Bos taurus; identical to SEQ ID NO: 12488

SEQ ID NO: 94106 - DNA, 201 bp, Bos taurus; identical to SEQ ID NO: 12489

SEQ ID NO: 94107 - DNA, 201 bp, Bos taurus; identical to SEQ ID NO: 12490

SEQ ID NO: 94108 - DNA, 201 bp, Bos taurus
tgacttgtatgtcagcttcaggagaccagaggtttgttttacgtttactgccatatctctactactagaatagggcctgacacatagttcagttcagttccgtctctcagtcttgtccagctttttgtgaccccgtggattgcagcacaccaggcctccctgtccatcaccaagtcccagagtttactcaaactcatgtcc

SEQ ID NO: 94109 - DNA, 201 bp, Bos taurus; identical to SEQ ID NO: 12491

SEQ ID NO: 94110 - DNA, 201 bp, Bos taurus; identical to SEQ ID NO: 12492

SEQ ID NO: 94111 - DNA, 201 bp, Bos taurus; identical to SEQ ID NO: 12493

SEQ ID NO: 94112 - DNA, 201 bp, Bos taurus; identical to SEQ ID NO: 12494

SEQ ID NO: 94113 - DNA, 201 bp, Bos taurus; identical to SEQ ID NO: 12495

SEQ ID NO: 94114 - DNA, 201 bp, Bos taurus; identical to SEQ ID NO: 12496

SEQ ID NO: 94115 - DNA, 201 bp, Bos taurus
acagcaaggggatgacttcatggaggatctggggaccctgatggcccaatccctctcctctgtctaattcctgcatgccgccagcgaggcccaagggaatctgcatccctcttctgggagaggacagggagccagtttaaggcttgtgagctgagcacagaggatgctgttcatgtcacaagggacactgggccatcactg

SEQ ID NO: 94116 - DNA, 201 bp, Bos taurus
tctgggctctggtttccttatctgttaaaatgggtagttttgaggagaatgaaagctcttggcagtgtgcctggaagctgctaacaataatagaggccaaggttataatcaccattgaacagataaggaaacagaatccttcccagacttcagacttccaggaggggtcaagccaagccggcttcacctgtgggtgttagg

SEQ ID NO: 94117 - DNA, 201 bp, Bos taurus; identical to SEQ ID NO: 12499

SEQ ID NO: 94118 - DNA, 201 bp, Bos taurus; identical to SEQ ID NO: 12500

SEQ ID NO: 94119 - DNA, 201 bp, Bos taurus
ctggccctcccagttccctctgtgtggtcagaaggttgcctggggtaggggtaggggtggtctagtccaccctactggggctggagtttctgggagctccgtatgacagaggcccgtctggctggctacatctctgagtgacctggggaagtctaccccactacctggagcctcagtttcctgttctgtaaaatggggaca

SEQ ID NO: 94120 - DNA, 201 bp, Bos taurus; identical to SEQ ID NO: 12501

SEQ ID NO: 94121 - DNA, 201 bp, Bos taurus
ggaacctgcggcccagagaagcctagagagcggcccccaaccccatcctgaggtctccagcttccttggagcaccgtggtttcctcccaagtggcacatcgccccagggcctgtggtctctccctttgcagaagttcgtgagcacaaccatccggcccacactgatgccctaccctgagctctacaactgggacacctgtg

SEQ ID NO: 94122 - DNA, 201 bp, Bos taurus
cttagggctggcacgtgcccaccagcaacccactacagagagcagcagaaggaagccgacgccaccccggctgtgctaatcctcacaggaggtgcaccccagggccgtgacctcattaccaaagccgcctctaggtggcaatttctcccctgccttcataaagagcaaccccacactgggtggcctggtcctcacggcctt

SEQ ID NO: 94123 - DNA, 201 bp, Bos taurus; identical to SEQ ID NO: 12503

SEQ ID NO: 94124 - DNA, 201 bp, Bos taurus; identical to SEQ ID NO: 12504

SEQ ID NO: 94125 - DNA, 201 bp, Bos taurus; identical to SEQ ID NO: 12505

SEQ ID NO: 94126 - DNA, 201 bp, Bos taurus; identical to SEQ ID NO: 12506

SEQ ID NO: 94127 - DNA, 201 bp, Bos taurus; identical to SEQ ID NO: 12507

SEQ ID NO: 94128 - DNA, 201 bp, Bos taurus; identical to SEQ ID NO: 12509

SEQ ID NO: 94129 - DNA, 201 bp, Bos taurus; identical to SEQ ID NO: 12510

SEQ ID NO: 94130 - DNA, 201 bp, Bos taurus; identical to SEQ ID NO: 12512

SEQ ID NO: 94131 - DNA, 201 bp, Bos taurus; identical to SEQ ID NO: 12513

SEQ ID NO: 94132 - DNA, 201 bp, Bos taurus
tctccggccaagagggatgggaactcatgcagccaagagaaacaacatgtggtgaacgaaacatatcctttagtcttcatgtgggattctagttgacctcttttggccttagttctcaaatatcttagaggatttacagtagaggaagcttaagaggtaagatatgggcctcttgttaataaggctcatgaaagttagaac

SEQ ID NO: 94133 - DNA, 201 bp, Bos taurus
caccttttcctcctccacaggtgctcgggaaccacttctcaattgaattgtgctagatatattagatattggctgcaagtaacaaaacattcaactttgcgtagcttaaacaatgcattctttttcttggagaacaagaaatccctatgtgcatggtttgggtcagtgattgggcagcttacagatgtattcagtgatact

SEQ ID NO: 94134 - DNA, 201 bp, Bos taurus; identical to SEQ ID NO: 12517

SEQ ID NO: 94135 - DNA, 201 bp, Bos taurus; identical to SEQ ID NO: 12518

SEQ ID NO: 94136 - DNA, 201 bp, Bos taurus; identical to SEQ ID NO: 12519

SEQ ID NO: 94137 - DNA, 201 bp, Bos taurus; identical to SEQ ID NO: 12521

SEQ ID NO: 94138 - DNA, 201 bp, Bos taurus; identical to SEQ ID NO: 12522

SEQ ID NO: 94139 - DNA, 201 bp, Bos taurus; identical to SEQ ID NO: 12525

SEQ ID NO: 94140 - DNA, 201 bp, Bos taurus
atttatgctcaaacaatgaccaccaataagagtcattcagagaactgactttgggtataatgtaggtccattgctcgtactaattagtgaactagtgatttctgtcattctctctggtgttttaaagacaaggaagaaagactacattgtgcaaaatggagatttgtattctttttctttaaaataaagaaggtgtgtctc

SEQ ID NO: 94141 - DNA, 201 bp, Bos taurus; identical to SEQ ID NO: 12528

SEQ ID NO: 94142 - DNA, 201 bp, Bos taurus; identical to SEQ ID NO: 12530

SEQ ID NO: 94143 - DNA, 201 bp, Bos taurus; identical to SEQ ID NO: 12531

SEQ ID NO: 94144 - DNA, 201 bp, Bos taurus; identical to SEQ ID NO: 12532

SEQ ID NO: 94145 - DNA, 201 bp, Bos taurus; identical to SEQ ID NO: 12533

SEQ ID NO: 94146 - DNA, 201 bp, Bos taurus; identical to SEQ ID NO: 12534

SEQ ID NO: 94147 - DNA, 201 bp, Bos taurus; identical to SEQ ID NO: 12535

SEQ ID NO: 94148 - DNA, 201 bp, Bos taurus; identical to SEQ ID NO: 12537

SEQ ID NO: 94149 - DNA, 201 bp, Bos taurus; identical to SEQ ID NO: 12538

SEQ ID NO: 94150 - DNA, 201 bp, Bos taurus; identical to SEQ ID NO: 12539

SEQ ID NO: 94151 - DNA, 201 bp, Bos taurus; identical to SEQ ID NO: 12540

SEQ ID NO: 94152 - DNA, 201 bp, Bos taurus
tctatttctttattctgtgattgggccatactttgctgtctttgcatacttcataactagttgttgaaaacaaactttcaaatattataatgtgttaactgtgcaaaacatatacttctccttcctcagggtttgtctttttgtggcttactgttttattttgtgtgtgtgtgtgtgtatgatttttttaaaaatattttt

SEQ ID NO: 94153 - DNA, 201 bp, Bos taurus; identical to SEQ ID NO: 12541

SEQ ID NO: 94154 - DNA, 201 bp, Bos taurus
aagaggactatggttagcctagtgtcctgtatgtggtaaatgcttagtgattgagtctacggtcatttaaaataagaggcaaacgagacttctggcccatgttctgttgcattttactttaagaggtcaacctcaatctttcacttctattgcaaagccatctgtatatcctcctgttgaataaatgcctctgttatccat

SEQ ID NO: 94155 - DNA, 201 bp, Bos taurus; identical to SEQ ID NO: 12542

SEQ ID NO: 94156 - DNA, 201 bp, Bos taurus; identical to SEQ ID NO: 12543

SEQ ID NO: 94157 - DNA, 201 bp, Bos taurus; identical to SEQ ID NO: 12546

SEQ ID NO: 94158 - DNA, 201 bp, Bos taurus; identical to SEQ ID NO: 12547

SEQ ID NO: 94159 - DNA, 201 bp, Bos taurus; identical to SEQ ID NO: 12549

SEQ ID NO: 94160 - DNA, 201 bp, Bos taurus; identical to SEQ ID NO: 12550

SEQ ID NO: 94161 - DNA, 201 bp, Bos taurus
ggcctcagtttccccctctgtcaaatgggcaccctgacaacaccactttacagggggtgggaggctttcatgagatggagatagagcgtgcctctgatgctctgctgctgatcattacggcccacgtctcactctggtctttgaaaggaccactgagagcctgtattcctaacccgcagcccctgccttaactctggtgca

SEQ ID NO: 94162 - DNA, 201 bp, Bos taurus
tgatgggagacgctgagtccccactctcttagagatgattgctttggtgaaaaaacaaaggctctcttcatcagaccttggccagtccacacccacaaacgtgggactcttccagagaaatatccagattgtgaagcatgccaccacacggctagatgaccccacataacagagctgcacagagcccaccaccccaaccca

SEQ ID NO: 94163 - DNA, 201 bp, Bos taurus
atatggacacctggataattcacttaaaatgcaggtccccaggcccaactcacataaactgtgctacatgagatttggggtcaggctcagagttgcatctattaacaacaccccaggccatctggataatggtagtcaaaagactgtgctccaagaaacaataccacatgttcaatgctgctcttttttctcttatataat

SEQ ID NO: 94164 - DNA, 201 bp, Bos taurus; identical to SEQ ID NO: 12553

SEQ ID NO: 94165 - DNA, 201 bp, Bos taurus; identical to SEQ ID NO: 12554

SEQ ID NO: 94166 - DNA, 201 bp, Bos taurus; identical to SEQ ID NO: 12555

SEQ ID NO: 94167 - DNA, 201 bp, Bos taurus; identical to SEQ ID NO: 12556

SEQ ID NO: 94168 - DNA, 201 bp, Bos taurus; identical to SEQ ID NO: 12558

SEQ ID NO: 94169 - DNA, 201 bp, Bos taurus; identical to SEQ ID NO: 12559

SEQ ID NO: 94170 - DNA, 201 bp, Bos taurus
gcagcgggcgtcttgaggataggaggagagaagtcaggaacttcttctccactgctctctgctctggttcctatttcctcctgtggctgcatctctccatcctgcgggcctctttactctcatcagtccctcactgggttctggaaacaccctcccctcttcttagtccccttggtcctgggatagcctgcttcctgtctc

SEQ ID NO: 94171 - DNA, 201 bp, Bos taurus; identical to SEQ ID NO: 12560

SEQ ID NO: 94172 - DNA, 201 bp, Bos taurus; identical to SEQ ID NO: 12561

SEQ ID NO: 94173 - DNA, 201 bp, Bos taurus; identical to SEQ ID NO: 12562

SEQ ID NO: 94174 - DNA, 201 bp, Bos taurus; identical to SEQ ID NO: 12563

SEQ ID NO: 94175 - DNA, 201 bp, Bos taurus; identical to SEQ ID NO: 12564

SEQ ID NO: 94176 - DNA, 201 bp, Bos taurus; identical to SEQ ID NO: 12565

SEQ ID NO: 94177 - DNA, 201 bp, Bos taurus; identical to SEQ ID NO: 12566

SEQ ID NO: 94178 - DNA, 201 bp, Bos taurus; identical to SEQ ID NO: 12567

SEQ ID NO: 94179 - DNA, 201 bp, Bos taurus; identical to SEQ ID NO: 12568

SEQ ID NO: 94180 - DNA, 201 bp, Bos taurus; identical to SEQ ID NO: 12569

SEQ ID NO: 94181 - DNA, 201 bp, Bos taurus; identical to SEQ ID NO: 12570

SEQ ID NO: 94182 - DNA, 201 bp, Bos taurus; identical to SEQ ID NO: 12571

SEQ ID NO: 94183 - DNA, 201 bp, Bos taurus; identical to SEQ ID NO: 12572

SEQ ID NO: 94184 - DNA, 201 bp, Bos taurus; identical to SEQ ID NO: 12573

SEQ ID NO: 94185 - DNA, 201 bp, Bos taurus; identical to SEQ ID NO: 12574

SEQ ID NO: 94186 - DNA, 201 bp, Bos taurus; identical to SEQ ID NO: 12575

SEQ ID NO: 94187 - DNA, 201 bp, Bos taurus; identical to SEQ ID NO: 12576

SEQ ID NO: 94188 - DNA, 201 bp, Bos taurus; identical to SEQ ID NO: 12577

SEQ ID NO: 94189 - DNA, 201 bp, Bos taurus; identical to SEQ ID NO: 12578

SEQ ID NO: 94190 - DNA, 201 bp, Bos taurus; identical to SEQ ID NO: 12579

SEQ ID NO: 94191 - DNA, 201 bp, Bos taurus; identical to SEQ ID NO: 12580

SEQ ID NO: 94192 - DNA, 201 bp, Bos taurus; identical to SEQ ID NO: 12581

SEQ ID NO: 94193 - DNA, 201 bp, Bos taurus; identical to SEQ ID NO: 12582

SEQ ID NO: 94194 - DNA, 201 bp, Bos taurus; identical to SEQ ID NO: 12583

SEQ ID NO: 94195 - DNA, 201 bp, Bos taurus; identical to SEQ ID NO: 12585

SEQ ID NO: 94196 - DNA, 201 bp, Bos taurus
atgcacccttctgagttttacaattaggcaacttgttccataatctattgtttcactttttgaatagggaggaaacaacccaaatcatcaccaggtacctcagcatgaacaatggatgttctctttaggtgtaaagtatgtctgccaaggactgacagcaaaatggggatagatggtcacattcttgtattattttagggg

SEQ ID NO: 94197 - DNA, 201 bp, Bos taurus; identical to SEQ ID NO: 12587

SEQ ID NO: 94198 - DNA, 201 bp, Bos taurus
caccaagttggggatcaataagaaatcagcaaaaactaatttcaaagcagctacttgcagtatgaaacgttaagtgaagatatgacccaaagaggccaagatttagtttgaaagaatagttttataagaccatcatgtaaagtcctcttcctaaaggcaaagatgtctaacatgagtccattggcattttgctgaggccac

SEQ ID NO: 94199 - DNA, 201 bp, Bos taurus; identical to SEQ ID NO: 12588

SEQ ID NO: 94200 - DNA, 201 bp, Bos taurus; identical to SEQ ID NO: 12589

SEQ ID NO: 94201 - DNA, 201 bp, Bos taurus; identical to SEQ ID NO: 12591

SEQ ID NO: 94202 - DNA, 201 bp, Bos taurus; identical to SEQ ID NO: 12592

SEQ ID NO: 94203 - DNA, 201 bp, Bos taurus; identical to SEQ ID NO: 12593

SEQ ID NO: 94204 - DNA, 201 bp, Bos taurus; identical to SEQ ID NO: 12594

SEQ ID NO: 94205 - DNA, 201 bp, Bos taurus; identical to SEQ ID NO: 12596

SEQ ID NO: 94206 - DNA, 201 bp, Bos taurus; identical to SEQ ID NO: 12598

SEQ ID NO: 94207 - DNA, 201 bp, Bos taurus; identical to SEQ ID NO: 12599

SEQ ID NO: 94208 - DNA, 201 bp, Bos taurus
catttttagtgacccatctgagttttggcccctgccagaatatgagtgatggagaattaatgatagttttgcttattattttcctaacagatgtttctctatttaagaacatgctgaggcctatacttaatgttagagcaaatatcttttgagatggaggtgccttttaaccacttaatttttattggttttaactcagtc

SEQ ID NO: 94209 - DNA, 201 bp, Bos taurus; identical to SEQ ID NO: 12602

SEQ ID NO: 94210 - DNA, 201 bp, Bos taurus; identical to SEQ ID NO: 12603

SEQ ID NO: 94211 - DNA, 201 bp, Bos taurus; identical to SEQ ID NO: 12604

SEQ ID NO: 94212 - DNA, 201 bp, Bos taurus; identical to SEQ ID NO: 12606

SEQ ID NO: 94213 - DNA, 201 bp, Bos taurus
tcagtcaatcatgccgtccaaacccaagccatgggcccaagtttcacaataatctgggcatctggttaaaagtgcagaattcccagcctttctctgccaaatcaaggtccctaggcatgggcctgtgaatatgcattttaatagatttctcagtgaaaccagattagggtaactggtggcactgtcacctgatattggatt

SEQ ID NO: 94214 - DNA, 201 bp, Bos taurus; identical to SEQ ID NO: 12607

SEQ ID NO: 94215 - DNA, 201 bp, Bos taurus; identical to SEQ ID NO: 12608

SEQ ID NO: 94216 - DNA, 201 bp, Bos taurus; identical to SEQ ID NO: 12609

SEQ ID NO: 94217 - DNA, 201 bp, Bos taurus; identical to SEQ ID NO: 12611

SEQ ID NO: 94218 - DNA, 201 bp, Bos taurus; identical to SEQ ID NO: 12612

SEQ ID NO: 94219 - DNA, 201 bp, Bos taurus; identical to SEQ ID NO: 12614

SEQ ID NO: 94220 - DNA, 201 bp, Bos taurus; identical to SEQ ID NO: 12615

SEQ ID NO: 94221 - DNA, 201 bp, Bos taurus; identical to SEQ ID NO: 12616

SEQ ID NO: 94222 - DNA, 201 bp, Bos taurus
ggctgctcccgccttccagcacctcctaggtcattgtcaggaaccgccaccgggccaaggtcagcgcaacccttcccaggacaggaggttaggctggcctaggcaccacagggaggctcctttttattgctcacccagccacttgctgaaaaattaatctgcaaatgaatcacatttactgagaccttctggatcagataa

SEQ ID NO: 94223 - DNA, 201 bp, Bos taurus
agatccttagtggagatatttctggaaagaatgaatgtcctgagaagttatatacatataaagaagttttctttttttacttaggccaaatggagggctacgcaattatctctattttatagctgaaaaagttgaagcttagaggggtcccatggcctgcaggttagttcagatctgggatgagaaacacagactctgctt

SEQ ID NO: 94224 - DNA, 201 bp, Bos taurus; identical to SEQ ID NO: 12617

SEQ ID NO: 94225 - DNA, 201 bp, Bos taurus; identical to SEQ ID NO: 12618

SEQ ID NO: 94226 - DNA, 201 bp, Bos taurus; identical to SEQ ID NO: 12619

SEQ ID NO: 94227 - DNA, 201 bp, Bos taurus; identical to SEQ ID NO: 12620

SEQ ID NO: 94228 - DNA, 201 bp, Bos taurus; identical to SEQ ID NO: 12622

SEQ ID NO: 94229 - DNA, 201 bp, Bos taurus; identical to SEQ ID NO: 12623

SEQ ID NO: 94230 - DNA, 201 bp, Bos taurus; identical to SEQ ID NO: 12624

SEQ ID NO: 94231 - DNA, 201 bp, Bos taurus; identical to SEQ ID NO: 12626

SEQ ID NO: 94232 - DNA, 201 bp, Bos taurus; identical to SEQ ID NO: 12628

SEQ ID NO: 94233 - DNA, 201 bp, Bos taurus
attcagggaacattacaaagacatcctttccatcaggtttaagggacacaggcccagcacctgggagaagcccctgcacggctggagggtctgggaggacttaagactctgtcacttctaccttcggggaatagcctgggagctaagcagggtgagagagcacagagctgggacctgggggctttcacggaggaggggccg

SEQ ID NO: 94234 - DNA, 201 bp, Bos taurus; identical to SEQ ID NO: 12630

SEQ ID NO: 94235 - DNA, 201 bp, Bos taurus; identical to SEQ ID NO: 12631

SEQ ID NO: 94236 - DNA, 201 bp, Bos taurus; identical to SEQ ID NO: 12633

SEQ ID NO: 94237 - DNA, 201 bp, Bos taurus
agcagggcccagtgggggagggggaggggcaacacgagcctggcagacccgccacagccctcatgtagcaatggacagcgtggaacagagcaagtggtaatgtcgtggccaggcctgtagttcattttacctctgtcaaggaaaatttagaatagtagctgaactgaagagcacttctttttccttcaaatgatccttttg

SEQ ID NO: 94238 - DNA, 201 bp, Bos taurus; identical to SEQ ID NO: 12634

SEQ ID NO: 94239 - DNA, 201 bp, Bos taurus; identical to SEQ ID NO: 12635

SEQ ID NO: 94240 - DNA, 201 bp, Bos taurus; identical to SEQ ID NO: 12636

SEQ ID NO: 94241 - DNA, 201 bp, Bos taurus
aatttccagggagggagcctcaaatgggactccctgtgccaagtttagagccagcttctccgaggtgccttctgtgaggctgaatcctaaggcccggagccgcacaagtagatgattgtgggttctgaccccgagcaattgcatcggagtctctggaggggtcaatgaggccttggaaagaaaagaacaagttacccagga

SEQ ID NO: 94242 - DNA, 201 bp, Bos taurus; identical to SEQ ID NO: 12638

SEQ ID NO: 94243 - DNA, 201 bp, Bos taurus; identical to SEQ ID NO: 12639

SEQ ID NO: 94244 - DNA, 201 bp, Bos taurus; identical to SEQ ID NO: 12640

SEQ ID NO: 94245 - DNA, 201 bp, Bos taurus; identical to SEQ ID NO: 12641

SEQ ID NO: 94246 - DNA, 201 bp, Bos taurus; identical to SEQ ID NO: 12642

SEQ ID NO: 94247 - DNA, 201 bp, Bos taurus; identical to SEQ ID NO: 12643

SEQ ID NO: 94248 - DNA, 201 bp, Bos taurus; identical to SEQ ID NO: 12644

SEQ ID NO: 94249 - DNA, 201 bp, Bos taurus; identical to SEQ ID NO: 12646

SEQ ID NO: 94250 - DNA, 201 bp, Bos taurus; identical to SEQ ID NO: 12650

SEQ ID NO: 94251 - DNA, 201 bp, Bos taurus; identical to SEQ ID NO: 12652

SEQ ID NO: 94252 - DNA, 201 bp, Bos taurus; identical to SEQ ID NO: 12653

SEQ ID NO: 94253 - DNA, 201 bp, Bos taurus; identical to SEQ ID NO: 12654

SEQ ID NO: 94254 - DNA, 201 bp, Bos taurus; identical to SEQ ID NO: 12655

SEQ ID NO: 94255 - DNA, 201 bp, Bos taurus; identical to SEQ ID NO: 12656

SEQ ID NO: 94256 - DNA, 201 bp, Bos taurus; identical to SEQ ID NO: 12657

SEQ ID NO: 94257 - DNA, 201 bp, Bos taurus; identical to SEQ ID NO: 12658

SEQ ID NO: 94258 - DNA, 201 bp, Bos taurus; identical to SEQ ID NO: 12659

SEQ ID NO: 94259 - DNA, 201 bp, Bos taurus; identical to SEQ ID NO: 12660

SEQ ID NO: 94260 - DNA, 201 bp, Bos taurus; identical to SEQ ID NO: 12661

SEQ ID NO: 94261 - DNA, 201 bp, Bos taurus; identical to SEQ ID NO: 12662

SEQ ID NO: 94262 - DNA, 201 bp, Bos taurus; identical to SEQ ID NO: 12664

SEQ ID NO: 94263 - DNA, 201 bp, Bos taurus; identical to SEQ ID NO: 12665

SEQ ID NO: 94264 - DNA, 201 bp, Bos taurus; identical to SEQ ID NO: 12667

SEQ ID NO: 94265 - DNA, 201 bp, Bos taurus; identical to SEQ ID NO: 12668

SEQ ID NO: 94266 - DNA, 201 bp, Bos taurus; identical to SEQ ID NO: 12671

SEQ ID NO: 94267 - DNA, 201 bp, Bos taurus; identical to SEQ ID NO: 12672

SEQ ID NO: 94268 - DNA, 201 bp, Bos taurus; identical to SEQ ID NO: 12674

SEQ ID NO: 94269 - DNA, 201 bp, Bos taurus; identical to SEQ ID NO: 12675

SEQ ID NO: 94270 - DNA, 201 bp, Bos taurus; identical to SEQ ID NO: 12678

SEQ ID NO: 94271 - DNA, 201 bp, Bos taurus; identical to SEQ ID NO: 12680

SEQ ID NO: 94272 - DNA, 201 bp, Bos taurus; identical to SEQ ID NO: 12681

SEQ ID NO: 94273 - DNA, 201 bp, Bos taurus; identical to SEQ ID NO: 12682

SEQ ID NO: 94274 - DNA, 201 bp, Bos taurus; identical to SEQ ID NO: 12683

SEQ ID NO: 94275 - DNA, 201 bp, Bos taurus; identical to SEQ ID NO: 12684

SEQ ID NO: 94276 - DNA, 201 bp, Bos taurus; identical to SEQ ID NO: 12685

SEQ ID NO: 94277 - DNA, 201 bp, Bos taurus; identical to SEQ ID NO: 12686

SEQ ID NO: 94278 - DNA, 201 bp, Bos taurus; identical to SEQ ID NO: 12687

SEQ ID NO: 94279 - DNA, 201 bp, Bos taurus; identical to SEQ ID NO: 12688

SEQ ID NO: 94280 - DNA, 201 bp, Bos taurus; identical to SEQ ID NO: 12689

SEQ ID NO: 94281 - DNA, 201 bp, Bos taurus; identical to SEQ ID NO: 12690

SEQ ID NO: 94282 - DNA, 201 bp, Bos taurus; identical to SEQ ID NO: 12691

SEQ ID NO: 94283 - DNA, 201 bp, Bos taurus; identical to SEQ ID NO: 12692

SEQ ID NO: 94284 - DNA, 201 bp, Bos taurus; identical to SEQ ID NO: 12693

SEQ ID NO: 94285 - DNA, 201 bp, Bos taurus; identical to SEQ ID NO: 12695

SEQ ID NO: 94286 - DNA, 201 bp, Bos taurus; identical to SEQ ID NO: 12696

SEQ ID NO: 94287 - DNA, 201 bp, Bos taurus; identical to SEQ ID NO: 12697

SEQ ID NO: 94288 - DNA, 201 bp, Bos taurus; identical to SEQ ID NO: 12702

SEQ ID NO: 94289 - DNA, 201 bp, Bos taurus; identical to SEQ ID NO: 12705

SEQ ID NO: 94290 - DNA, 201 bp, Bos taurus; identical to SEQ ID NO: 12708

SEQ ID NO: 94291 - DNA, 201 bp, Bos taurus; identical to SEQ ID NO: 12709

SEQ ID NO: 94292 - DNA, 201 bp, Bos taurus; identical to SEQ ID NO: 12710

SEQ ID NO: 94293 - DNA, 201 bp, Bos taurus; identical to SEQ ID NO: 12711

SEQ ID NO: 94294 - DNA, 201 bp, Bos taurus; identical to SEQ ID NO: 12712

SEQ ID NO: 94295 - DNA, 201 bp, Bos taurus; identical to SEQ ID NO: 12713

SEQ ID NO: 94296 - DNA, 201 bp, Bos taurus; identical to SEQ ID NO: 12715

SEQ ID NO: 94297 - DNA, 201 bp, Bos taurus; identical to SEQ ID NO: 12716

SEQ ID NO: 94298 - DNA, 201 bp, Bos taurus; identical to SEQ ID NO: 12717

SEQ ID NO: 94299 - DNA, 201 bp, Bos taurus; identical to SEQ ID NO: 12718

SEQ ID NO: 94300 - DNA, 201 bp, Bos taurus; identical to SEQ ID NO: 12720

SEQ ID NO: 94301 - DNA, 201 bp, Bos taurus; identical to SEQ ID NO: 12721

SEQ ID NO: 94302 - DNA, 201 bp, Bos taurus; identical to SEQ ID NO: 12722

SEQ ID NO: 94303 - DNA, 201 bp, Bos taurus; identical to SEQ ID NO: 12724

SEQ ID NO: 94304 - DNA, 201 bp, Bos taurus; identical to SEQ ID NO: 12725

SEQ ID NO: 94305 - DNA, 201 bp, Bos taurus; identical to SEQ ID NO: 12726

SEQ ID NO: 94306 - DNA, 201 bp, Bos taurus; identical to SEQ ID NO: 12727

SEQ ID NO: 94307 - DNA, 201 bp, Bos taurus; identical to SEQ ID NO: 12728

SEQ ID NO: 94308 - DNA, 201 bp, Bos taurus; identical to SEQ ID NO: 12729

SEQ ID NO: 94309 - DNA, 201 bp, Bos taurus; identical to SEQ ID NO: 12730

SEQ ID NO: 94310 - DNA, 201 bp, Bos taurus; identical to SEQ ID NO: 12732

SEQ ID NO: 94311 - DNA, 201 bp, Bos taurus; identical to SEQ ID NO: 12733

SEQ ID NO: 94312 - DNA, 201 bp, Bos taurus; identical to SEQ ID NO: 12734

SEQ ID NO: 94313 - DNA, 201 bp, Bos taurus; identical to SEQ ID NO: 12735

SEQ ID NO: 94314 - DNA, 201 bp, Bos taurus; identical to SEQ ID NO: 12737

SEQ ID NO: 94315 - DNA, 201 bp, Bos taurus; identical to SEQ ID NO: 12738

SEQ ID NO: 94316 - DNA, 201 bp, Bos taurus; identical to SEQ ID NO: 12739

SEQ ID NO: 94317 - DNA, 201 bp, Bos taurus; identical to SEQ ID NO: 12740

SEQ ID NO: 94318 - DNA, 201 bp, Bos taurus; identical to SEQ ID NO: 12741

SEQ ID NO: 94319 - DNA, 201 bp, Bos taurus; identical to SEQ ID NO: 12742

SEQ ID NO: 94320 - DNA, 201 bp, Bos taurus; identical to SEQ ID NO: 12743

SEQ ID NO: 94321 - DNA, 201 bp, Bos taurus; identical to SEQ ID NO: 12744

SEQ ID NO: 94322 - DNA, 201 bp, Bos taurus; identical to SEQ ID NO: 12745

SEQ ID NO: 94323 - DNA, 201 bp, Bos taurus; identical to SEQ ID NO: 12747

SEQ ID NO: 94324 - DNA, 201 bp, Bos taurus; identical to SEQ ID NO: 12749

SEQ ID NO: 94325 - DNA, 201 bp, Bos taurus; identical to SEQ ID NO: 12750

SEQ ID NO: 94326 - DNA, 201 bp, Bos taurus; identical to SEQ ID NO: 12751

SEQ ID NO: 94327 - DNA, 201 bp, Bos taurus; identical to SEQ ID NO: 12752

SEQ ID NO: 94328 - DNA, 201 bp, Bos taurus; identical to SEQ ID NO: 12753

SEQ ID NO: 94329 - DNA, 201 bp, Bos taurus; identical to SEQ ID NO: 12754

SEQ ID NO: 94330 - DNA, 201 bp, Bos taurus; identical to SEQ ID NO: 12755

SEQ ID NO: 94331 - DNA, 201 bp, Bos taurus; identical to SEQ ID NO: 12756

SEQ ID NO: 94332 - DNA, 201 bp, Bos taurus; identical to SEQ ID NO: 12757

SEQ ID NO: 94333 - DNA, 201 bp, Bos taurus; identical to SEQ ID NO: 12758

SEQ ID NO: 94334 - DNA, 201 bp, Bos taurus; identical to SEQ ID NO: 12759

SEQ ID NO: 94335 - DNA, 201 bp, Bos taurus; identical to SEQ ID NO: 12760

SEQ ID NO: 94336 - DNA, 201 bp, Bos taurus; identical to SEQ ID NO: 12761

SEQ ID NO: 94337 - DNA, 201 bp, Bos taurus
accacatataagtcgtatcatgcactgtttgtctttctgtgtctggcttacttcccttagtgtgatcatcactaggtgggactctcgttggaaagacacagcctaccttccttgctgccaggggagtggggattactgtctactggtcacatggtccctacccgcaccgacactttctttttttagagtcacaggcctctt

SEQ ID NO: 94338 - DNA, 201 bp, Bos taurus; identical to SEQ ID NO: 12765

SEQ ID NO: 94339 - DNA, 201 bp, Bos taurus; identical to SEQ ID NO: 12766

SEQ ID NO: 94340 - DNA, 201 bp, Bos taurus; identical to SEQ ID NO: 12767

SEQ ID NO: 94341 - DNA, 201 bp, Bos taurus; identical to SEQ ID NO: 12770

SEQ ID NO: 94342 - DNA, 201 bp, Bos taurus; identical to SEQ ID NO: 12771

SEQ ID NO: 94343 - DNA, 201 bp, Bos taurus; identical to SEQ ID NO: 12772

SEQ ID NO: 94344 - DNA, 201 bp, Bos taurus; identical to SEQ ID NO: 12773

SEQ ID NO: 94345 - DNA, 201 bp, Bos taurus; identical to SEQ ID NO: 12775

SEQ ID NO: 94346 - DNA, 201 bp, Bos taurus; identical to SEQ ID NO: 12776

SEQ ID NO: 94347 - DNA, 201 bp, Bos taurus; identical to SEQ ID NO: 12777

SEQ ID NO: 94348 - DNA, 201 bp, Bos taurus
cacgaggctcccctgtccctgggattctccaggcaagaacactggagtgggttgccatttccttctccaatgcatgaaagtgaaaagtgaaagacactggtgattggcttatgccccaaacagccatcccaccagggtgcccttctggaccccaaagcttcccagggaccaccagttcaggaccacccccaccccggagct

SEQ ID NO: 94349 - DNA, 201 bp, Bos taurus
ggcccccgccctcctcactctccaggctgtggccacctggacccaccctttggaaacacagatccccaccttgtcaccaacccccagctccttgtggccccgaggagggatcccaaatgtgagtgcctataggcacttcatgatgatgtgagtgaggaaggtggaggggtttcgaggagaaacaccaggaccagcgaggtg

SEQ ID NO: 94350 - DNA, 201 bp, Bos taurus
ggggtgagtgtggccaccgaagggcagaccccaggatggccccctcttagggaactcatgcccaccgcaacagggagcatcccttcagggagctgaccaggactcctcccgatggggccctcagaacgtcaagagctctgtgatcgcccaaggaaccggagctctagcccagagagtgggagaggcttgcctgaggttaca

SEQ ID NO: 94351 - DNA, 201 bp, Bos taurus
ccaaaggcctgtagaccccacgcctgtcaccctagcagtggtgctgagagctgggctagaggtttgggggcatttctgttaggtgtttgtgcgtgagagcggggccagctctgggcagtatggagtccatctccaacccccagtcggtgtctaaaggggacaggccagagagggtgccacacccctagcctgcatgaccca

SEQ ID NO: 94352 - DNA, 201 bp, Bos taurus; identical to SEQ ID NO: 12778

SEQ ID NO: 94353 - DNA, 201 bp, Bos taurus; identical to SEQ ID NO: 12779

SEQ ID NO: 94354 - DNA, 201 bp, Bos taurus; identical to SEQ ID NO: 12780

SEQ ID NO: 94355 - DNA, 201 bp, Bos taurus
gccaggaaggctccctctgaccccaacgattccagacgtgaggccgagacccagcccgacctcagaccttagagttcatgtccagttgcagccctgggccgcagaacccagacttgcgacccaggctcagtcctaggatgccaggcttcatctcagccctggggctcacccgctcacctctccaactcctgaaagaagcca

SEQ ID NO: 94356 - DNA, 201 bp, Bos taurus; identical to SEQ ID NO: 12781

SEQ ID NO: 94357 - DNA, 201 bp, Bos taurus
tgtaaggcatgtggaaaggcctttagcggtaccacacaacttaatgaacaccaaagaatccacagtggtgggaagtcatataaatgtaatgaatatggaaaggcctttggccatcgttcacatcttcctcaacatcagaggatccaaactggtgagaaaccctaaaaatgtaatgaatgtgggaaggcctttaggcagggc

SEQ ID NO: 94358 - DNA, 201 bp, Bos taurus; identical to SEQ ID NO: 12782

SEQ ID NO: 94359 - DNA, 201 bp, Bos taurus; identical to SEQ ID NO: 12783

SEQ ID NO: 94360 - DNA, 201 bp, Bos taurus; identical to SEQ ID NO: 12784

SEQ ID NO: 94361 - DNA, 201 bp, Bos taurus
cccgcggcccctctctgtggcgtcagacggccaccttctcccagtaacctcgcacggtcttcaccgcgcgtgtccagactctgtcctcttatgagggtgctgatggttggattagggcccgccctaatgactgcaccttactttaactatctgcagactgaaaagactaaatctagactatctgaagactgagaagcctat

SEQ ID NO: 94362 - DNA, 201 bp, Bos taurus
tttctgttaatgaccaccgtgggcgtgcagttgttggcaaggctgtgcttgtcgctgctctgcggcggtgagtcagcgtatgcatgcgtgtacgtttacacgcaggccctctgttttggatttgcctcccattgaggtcgccagggagcactgagcagagctccccgtgctctgcagtctgctcatgttagtcacctgtgt

SEQ ID NO: 94363 - DNA, 201 bp, Bos taurus; identical to SEQ ID NO: 12785

SEQ ID NO: 94364 - DNA, 201 bp, Bos taurus; identical to SEQ ID NO: 12786

SEQ ID NO: 94365 - DNA, 201 bp, Bos taurus
cattgtggtgttggggaggccagggtcagagccagactctggtgtttagtccctgctttgcaccttaaaaactgtgtggtcctgggcagttacagactgcgtctgggcctcggggtgcgtctgggcctcggggtgctccttggtaaaccggagtaaggtggagtttacttcccggggctgcaacagggctaagtgggtaac

SEQ ID NO: 94366 - DNA, 201 bp, Bos taurus; identical to SEQ ID NO: 12788

SEQ ID NO: 94367 - DNA, 201 bp, Bos taurus; identical to SEQ ID NO: 12789

SEQ ID NO: 94368 - DNA, 201 bp, Bos taurus; identical to SEQ ID NO: 12790

SEQ ID NO: 94369 - DNA, 201 bp, Bos taurus; identical to SEQ ID NO: 12791

SEQ ID NO: 94370 - DNA, 201 bp, Bos taurus
aacattatcttgctgctcttcagtcacagggagccagaagcctgagggtcattctgtgaactccaacacctgtgatggaacacagtgaaaagactccaaaaacaggaagacggagatattaggcagccttgaatcatgtggccaagatgctgtctctctctccctcagaaaacacattttccctgcctctatactcactga

SEQ ID NO: 94371 - DNA, 201 bp, Bos taurus
tcccacattccccacactcataaggcctttcagtagtgtgaactcgctggtgtcgaatgagagtggctctttggctaaaggatttcccacactggacacagacataaggccttgctgtggtgtgaattctccgatgttgaaccaaggtgaagctttgtctaaagaatttcccacattcgctgcattcataaggcttttctc

SEQ ID NO: 94372 - DNA, 201 bp, Bos taurus
cacagtaaggttaatgggaagagctgaaatgcaagagagagaataaaagaagacaaagaagcttaccaggaccaggagggtacgtgtggctctggcctcgttggaaggtctgggggaaagtctgctgctgtgaatgtgctaagctcattgcttgtgcctgatcaggacaatgaccatggagccaccagtccatacaaagag

SEQ ID NO: 94373 - DNA, 201 bp, Bos taurus; identical to SEQ ID NO: 12792

SEQ ID NO: 94374 - DNA, 201 bp, Bos taurus
ggcaggtagaaactggtttgaggggtatacacaaagtatcagaatattgacatttacttattaaatacgtaaaatttaagtctactgcacaaccataaaacgagttttaaaatatgcaaaacctgtcgccatatgatcattcaactatggtagcattcttaaaagttatttttggctactgaacctgtaagaggggaaagt

SEQ ID NO: 94375 - DNA, 201 bp, Bos taurus
ctacaaagttgttttagggcaaaatgtcatggcctggaagccactcagaagacagggagtgctgagagaaacccctctggccactctgtgaaaatagaagaaaagtttacatccatcatcatcaagtaattatttccatccaaaagctgtcatcatctgggggacctctctgaaaaagagatccaagttgttgcctaaggc

SEQ ID NO: 94376 - DNA, 201 bp, Bos taurus
gcaggcaggttcctccgcctgtcaccctgccatgctccatcacactgtcagacacagggccccacccacgaccgcctcagccgcctggaccccggggccgcgcttcaggcacgtgagcaggcgccacgcacttcgggctttagtgtctggtgggatgagaatggtaagggcccaggggaccagcgtttacctgaggcggat

SEQ ID NO: 94377 - DNA, 201 bp, Bos taurus; identical to SEQ ID NO: 12793

SEQ ID NO: 94378 - DNA, 201 bp, Bos taurus
agccaccatgataggaagcccatgcactgcaactagaggaaagctcgcacagcaatgaaaacccagcacagccagaaacaatttttttaagcaaagatgttgtcatgagtgagtttatgctaagttgcttcagtcgtgactgactctgtgaccccatagactgtagcttgccaggctcctttctccatgggattttccaga

SEQ ID NO: 94379 - DNA, 201 bp, Bos taurus; identical to SEQ ID NO: 12795

SEQ ID NO: 94380 - DNA, 201 bp, Bos taurus; identical to SEQ ID NO: 12796

SEQ ID NO: 94381 - DNA, 201 bp, Bos taurus; identical to SEQ ID NO: 12798

SEQ ID NO: 94382 - DNA, 201 bp, Bos taurus; identical to SEQ ID NO: 12799

SEQ ID NO: 94383 - DNA, 201 bp, Bos taurus; identical to SEQ ID NO: 12801

SEQ ID NO: 94384 - DNA, 201 bp, Bos taurus; identical to SEQ ID NO: 12804

SEQ ID NO: 94385 - DNA, 201 bp, Bos taurus; identical to SEQ ID NO: 12805

SEQ ID NO: 94386 - DNA, 201 bp, Bos taurus; identical to SEQ ID NO: 12811

SEQ ID NO: 94387 - DNA, 201 bp, Bos taurus; identical to SEQ ID NO: 12813

SEQ ID NO: 94388 - DNA, 201 bp, Bos taurus; identical to SEQ ID NO: 12815

SEQ ID NO: 94389 - DNA, 201 bp, Bos taurus; identical to SEQ ID NO: 12818

SEQ ID NO: 94390 - DNA, 201 bp, Bos taurus; identical to SEQ ID NO: 12819

SEQ ID NO: 94391 - DNA, 201 bp, Bos taurus; identical to SEQ ID NO: 12820

SEQ ID NO: 94392 - DNA, 201 bp, Bos taurus; identical to SEQ ID NO: 12823

SEQ ID NO: 94393 - DNA, 201 bp, Bos taurus; identical to SEQ ID NO: 12824

SEQ ID NO: 94394 - DNA, 201 bp, Bos taurus; identical to SEQ ID NO: 12827

SEQ ID NO: 94395 - DNA, 201 bp, Bos taurus; identical to SEQ ID NO: 12830

SEQ ID NO: 94396 - DNA, 201 bp, Bos taurus; identical to SEQ ID NO: 12831

SEQ ID NO: 94397 - DNA, 201 bp, Bos taurus; identical to SEQ ID NO: 12835

SEQ ID NO: 94398 - DNA, 201 bp, Bos taurus; identical to SEQ ID NO: 12837

SEQ ID NO: 94399 - DNA, 201 bp, Bos taurus; identical to SEQ ID NO: 12838

SEQ ID NO: 94400 - DNA, 201 bp, Bos taurus; identical to SEQ ID NO: 12840

SEQ ID NO: 94401 - DNA, 201 bp, Bos taurus; identical to SEQ ID NO: 12841

SEQ ID NO: 94402 - DNA, 201 bp, Bos taurus; identical to SEQ ID NO: 12844

SEQ ID NO: 94403 - DNA, 201 bp, Bos taurus; identical to SEQ ID NO: 12845

SEQ ID NO: 94404 - DNA, 201 bp, Bos taurus; identical to SEQ ID NO: 12846

SEQ ID NO: 94405 - DNA, 201 bp, Bos taurus; identical to SEQ ID NO: 12847

SEQ ID NO: 94406 - DNA, 201 bp, Bos taurus; identical to SEQ ID NO: 12848

SEQ ID NO: 94407 - DNA, 201 bp, Bos taurus; identical to SEQ ID NO: 12849

SEQ ID NO: 94408 - DNA, 201 bp, Bos taurus; identical to SEQ ID NO: 12850

SEQ ID NO: 94409 - DNA, 201 bp, Bos taurus; identical to SEQ ID NO: 12851

SEQ ID NO: 94410 - DNA, 201 bp, Bos taurus; identical to SEQ ID NO: 12853

SEQ ID NO: 94411 - DNA, 201 bp, Bos taurus; identical to SEQ ID NO: 12854

SEQ ID NO: 94412 - DNA, 201 bp, Bos taurus; identical to SEQ ID NO: 12855

SEQ ID NO: 94413 - DNA, 201 bp, Bos taurus; identical to SEQ ID NO: 12856

SEQ ID NO: 94414 - DNA, 201 bp, Bos taurus; identical to SEQ ID NO: 12857

SEQ ID NO: 94415 - DNA, 201 bp, Bos taurus; identical to SEQ ID NO: 12858

SEQ ID NO: 94416 - DNA, 201 bp, Bos taurus; identical to SEQ ID NO: 12859

SEQ ID NO: 94417 - DNA, 201 bp, Bos taurus; identical to SEQ ID NO: 12860

SEQ ID NO: 94418 - DNA, 201 bp, Bos taurus; identical to SEQ ID NO: 12861

SEQ ID NO: 94419 - DNA, 201 bp, Bos taurus; identical to SEQ ID NO: 12862

SEQ ID NO: 94420 - DNA, 201 bp, Bos taurus; identical to SEQ ID NO: 12863

SEQ ID NO: 94421 - DNA, 201 bp, Bos taurus; identical to SEQ ID NO: 12864

SEQ ID NO: 94422 - DNA, 201 bp, Bos taurus
actgaaagtgatgatgagtgtcagttgcagggtgtacacaatgagaatgaggcactcctgatgaaagggacatggactggagaaatggccaggaggtgagggatgatggagatggagaggtggtagggaaatcaggtgggcttgcaggtttctgaggtggttgatagggccaggaactgagggaagaaacacaggaaaggg

SEQ ID NO: 94423 - DNA, 201 bp, Bos taurus; identical to SEQ ID NO: 12865

SEQ ID NO: 94424 - DNA, 201 bp, Bos taurus; identical to SEQ ID NO: 12866

SEQ ID NO: 94425 - DNA, 201 bp, Bos taurus
aggaagtactattgtgctcttgcctgtctcagggccctactgtgctaggataagcccatttttaccctgtttcatcatatcgtttccttcccaaggtcttgcaagggtctcggtggcccatggggatgcttttccagtggtcctatgctgacagtcgatgtagccacagaatgaacaaaatgcatcttcctgaaacaacat

SEQ ID NO: 94426 - DNA, 201 bp, Bos taurus
gtccctttgaggaaattttggttctcatttgggattgttcatttcaaaaaggagatcccgtctgtaaggctctgcttggactaaggtcacaggcttagtgggacttggaagcagccactctgagctttgtgctgtctgttgttttctggaataaggcttccgtctgctggcaaattttgttttgttttcagtccactagtg

SEQ ID NO: 94427 - DNA, 201 bp, Bos taurus
attggcaggtggattcttaaccactggaccacagggaagtccaatatgtatttcaaactgtgataagaacatatttatccctgatggtccagcggttagcacttggtattttcactgccatgccctgggttcaacccctggtcagagaactaagattctgcaagatgcaaggtatgatcaaaaaaaaaaacaaccatactt

SEQ ID NO: 94428 - DNA, 201 bp, Bos taurus
accagccatggggggcagttcagaagtccgggggctgccatgggagtgactccaggacgtaagggctgcctctcagggcctaaattctagcacaagagaagaaccttttctctgagctccacccccaccgaccctagcccagaaaactcccctccctttgggacagcagtggaactcagaccgggccacggctcctgtacg

SEQ ID NO: 94429 - DNA, 201 bp, Bos taurus
aacttgaggaagtgattcacagggaagggcaagggccacctagatgaataccttcgaggataacaacggaagaccatggggcgacagttaccgttccagcgactgggccgctgctgatacactggctccacaatgccagctgcatctttgaactttagggctctttaaggaaatggcacctgttcatcttccaaatcctct

SEQ ID NO: 94430 - DNA, 201 bp, Bos taurus; identical to SEQ ID NO: 12868

SEQ ID NO: 94431 - DNA, 201 bp, Bos taurus; identical to SEQ ID NO: 12869

SEQ ID NO: 94432 - DNA, 201 bp, Bos taurus; identical to SEQ ID NO: 12870

SEQ ID NO: 94433 - DNA, 201 bp, Bos taurus; identical to SEQ ID NO: 12871

SEQ ID NO: 94434 - DNA, 201 bp, Bos taurus; identical to SEQ ID NO: 12872

SEQ ID NO: 94435 - DNA, 201 bp, Bos taurus; identical to SEQ ID NO: 12873

SEQ ID NO: 94436 - DNA, 201 bp, Bos taurus
tacttcagtaagtggaagcaccagttactataatgatgggagtaggaataacaatgcaataatttttagttttattgaatattcgctatttcattgaatccaatgccattagttatgatgtgtattttaaaaattaattcattttaaggatggatatttttaatgtactgtttaacgcacttaaaaatcacttaggttctt

SEQ ID NO: 94437 - DNA, 201 bp, Bos taurus
agaagagtccagtcacgggagggagaatgctacagaggctagctttgcaatcctccagcactctgctgcagcagcaggccaggagagcagagaagctgctcggagcctgtgtaaactcagctctgtgggtcagtttatcttggctattgtgttgtctgaagagattttttgttgggagcctgggccttggggcctggcaga

SEQ ID NO: 94438 - DNA, 201 bp, Bos taurus
gagggccaactccttaatgcaggtggtagatggcattgatgtcaacctagctgatgctaatttaggaaaacaaccctgagataaagagttacagcaagaaaactctgtaatgagcctgctggcctagctggaatgatgagttttgatctattgcaggtcagagctatttggcttctggagcttcggggacaggcctgtggg

SEQ ID NO: 94439 - DNA, 201 bp, Bos taurus; identical to SEQ ID NO: 12874

SEQ ID NO: 94440 - DNA, 201 bp, Bos taurus; identical to SEQ ID NO: 12875

SEQ ID NO: 94441 - DNA, 201 bp, Bos taurus
tttaactgtcactggagggccctaacaggcccagggattctcaagtaggacctcgctctgaaactcgctgacagccaaggcgcagtcatccatgaccaccagagggtgccagatcgtcagcatagggagcgggcccaggcaatttggctgacctcggagactattcttggagaatgaactgagagaaggaaagagggccga

SEQ ID NO: 94442 - DNA, 201 bp, Bos taurus; identical to SEQ ID NO: 12876

SEQ ID NO: 94443 - DNA, 201 bp, Bos taurus
agtgaatttctctttactttccttgctgtcttactccctgaaaactatttcccacccccgaggccccagctatttccttttggtatgtggtttcacatatgctttgctacaggttgaaccatatgagattacaactattcaactatttttgacctctgaaaatgcagtttcatgtggttgaagctaatagaaacacacaca

SEQ ID NO: 94444 - DNA, 201 bp, Bos taurus
taaaattaacatccatttggtgaatgttgttgttaactagaattgtacagatcaagactgttttacaatagaggagtcatttgtggtcagtggggcataacatgtggttttagatgccaacgtgtaatgaaatgaaatttatgtcactcttttttgctttcttttctgtggactaatcatgaatctactatgtcactgaag

SEQ ID NO: 94445 - DNA, 201 bp, Bos taurus; identical to SEQ ID NO: 12877

SEQ ID NO: 94446 - DNA, 201 bp, Bos taurus; identical to SEQ ID NO: 12878

SEQ ID NO: 94447 - DNA, 201 bp, Bos taurus
atggcaacccactccagtattcttgcctgggaaagccctgggctacagtccgtggggtctcaaagagtcggacacaactgagtgactaagcacgcacaatgcaaaaacacaaagggcatgtttgaggagcagcataactgcagtggtagaaaatgaagcttcgtagaaaggtacagtttgggaacagccttgtaaaccctg

SEQ ID NO: 94448 - DNA, 201 bp, Bos taurus; identical to SEQ ID NO: 12879

SEQ ID NO: 94449 - DNA, 201 bp, Bos taurus; identical to SEQ ID NO: 12880

SEQ ID NO: 94450 - DNA, 201 bp, Bos taurus; identical to SEQ ID NO: 12881

SEQ ID NO: 94451 - DNA, 201 bp, Bos taurus; identical to SEQ ID NO: 12882

SEQ ID NO: 94452 - DNA, 201 bp, Bos taurus; identical to SEQ ID NO: 12883

SEQ ID NO: 94453 - DNA, 201 bp, Bos taurus
ggccacctgatgcaaagagccgattcactggaaaagatctgactcactggaaaagatactaatgctgggaaagactgaatgcaaaagaagaagagagtgtcggaggaagagaaggttagaaagcaccactaactcaatggacaagaatttgagcaaagtctgggagacagcattggacagaggagcctggcttgctacagc

SEQ ID NO: 94454 - DNA, 201 bp, Bos taurus; identical to SEQ ID NO: 12884

SEQ ID NO: 94455 - DNA, 201 bp, Bos taurus; identical to SEQ ID NO: 12885

SEQ ID NO: 94456 - DNA, 201 bp, Bos taurus; identical to SEQ ID NO: 12886

SEQ ID NO: 94457 - DNA, 201 bp, Bos taurus; identical to SEQ ID NO: 12887

SEQ ID NO: 94458 - DNA, 201 bp, Bos taurus; identical to SEQ ID NO: 12888

SEQ ID NO: 94459 - DNA, 201 bp, Bos taurus; identical to SEQ ID NO: 12889

SEQ ID NO: 94460 - DNA, 201 bp, Bos taurus; identical to SEQ ID NO: 12891

SEQ ID NO: 94461 - DNA, 201 bp, Bos taurus; identical to SEQ ID NO: 12892

SEQ ID NO: 94462 - DNA, 201 bp, Bos taurus; identical to SEQ ID NO: 12893

SEQ ID NO: 94463 - DNA, 201 bp, Bos taurus
agtttgcacatgtgagttgctttgaatgtttgttatgcttggactgcacctgactttagtgtgaattctttggtaatttttaatgagctttcatgtaatactgattattttgcttggcgttgagtctcagatctaccaggttctgtttttcttgaggctgttgagtaaatctgcctccggctaaatccaaaatgctgctat

SEQ ID NO: 94464 - DNA, 201 bp, Bos taurus; identical to SEQ ID NO: 12894

SEQ ID NO: 94465 - DNA, 201 bp, Bos taurus; identical to SEQ ID NO: 12895

SEQ ID NO: 94466 - DNA, 201 bp, Bos taurus
ttttactcacactacaacagatcacatttatataaaattagaaagaagggaataaacatacgaaaacataaaatcaagactcactttaaagggagcagaacatcaagaactctgttggggctctcatcaactttttttttttttttaaagaaatgctctgcactgatgtggtataatgtaaacatatgcatatataggttt

SEQ ID NO: 94467 - DNA, 201 bp, Bos taurus; identical to SEQ ID NO: 12896

SEQ ID NO: 94468 - DNA, 201 bp, Bos taurus; identical to SEQ ID NO: 12897

SEQ ID NO: 94469 - DNA, 201 bp, Bos taurus; identical to SEQ ID NO: 12898

SEQ ID NO: 94470 - DNA, 201 bp, Bos taurus; identical to SEQ ID NO: 12899

SEQ ID NO: 94471 - DNA, 201 bp, Bos taurus; identical to SEQ ID NO: 12900

SEQ ID NO: 94472 - DNA, 201 bp, Bos taurus
tgttctggcctggagaattccatggacagaatactccatggggtcacagagagtcacacacgactgagccaacgttcactcactcactcaagcaatcagttataaacccagactcactggccttgcaggagggtggactcagcttagagaagcaaatcaactgagttcctcagcaggatttccttgcgagtctacagacta

SEQ ID NO: 94473 - DNA, 201 bp, Bos taurus; identical to SEQ ID NO: 12901

SEQ ID NO: 94474 - DNA, 201 bp, Bos taurus
ggtttacaggacctgaggggggtcctgagggtggtgaacatctccaaggaagttcaggaggggctgtgtgtccatagatggcctcttccagagatggactcgattccacctggctgtcccaagagttggctcactacggggagaggggaagggtgctctgggatgcctcctgcaggcctcagaccctccttcttctgggag

SEQ ID NO: 94475 - DNA, 201 bp, Bos taurus
tctagggcctgagtctctgaaatctgccacacagaaggcaggaaaggtcaaggcaggcctgagtcattaccgtttttttgtgtgctttctgcctaataacgaaataacacctgaaatatctagcaatgcctaatatatccagcacagtgccgaacagctagtggaaaatcactgacaacttccctcgcctgccccatgtct

SEQ ID NO: 94476 - DNA, 201 bp, Bos taurus
gatagcaacagcaactactaaaataactgagtagactattacaggcatagaatatttgccttgaatttatccctcatggagtgggcagagttgcaggttgtcgatcgatggtgctctgatagtggagtaggtaggggcatactttccagtgtatgggctggtgtgtcttaatttggggtttcctgtactgcctaaagagga

SEQ ID NO: 94477 - DNA, 201 bp, Bos taurus
acttccagggaacagcgaggagagataagaaggcttcaatgaacaatgcgatcagaggaaaacaaaagaatggttaggactagcgatctcttcaagaaaactggagattcaggggaacttacaattatgtccacgtcacctcggggagggaagaacaggcataggagaaagcactgttctacttttaacttctattattta

SEQ ID NO: 94478 - DNA, 201 bp, Bos taurus; identical to SEQ ID NO: 12902

SEQ ID NO: 94479 - DNA, 201 bp, Bos taurus; identical to SEQ ID NO: 12903

SEQ ID NO: 94480 - DNA, 201 bp, Bos taurus; identical to SEQ ID NO: 12904

SEQ ID NO: 94481 - DNA, 201 bp, Bos taurus; identical to SEQ ID NO: 12905

SEQ ID NO: 94482 - DNA, 201 bp, Bos taurus; identical to SEQ ID NO: 12906

SEQ ID NO: 94483 - DNA, 201 bp, Bos taurus; identical to SEQ ID NO: 12907

SEQ ID NO: 94484 - DNA, 201 bp, Bos taurus
gttcatggaattctgtaatctactgggttgcctaatagatttgggtgtttccataacatcttatgggaaaagctgaacaaaatttttagccagcccaatcattggtggcttatagatcagtgtcttcccttacacggtgaatcctggaccatgtgtttctctttcctgtctgtccaacatacaccagggcctgcctcagtg

SEQ ID NO: 94485 - DNA, 201 bp, Bos taurus; identical to SEQ ID NO: 12908

SEQ ID NO: 94486 - DNA, 201 bp, Bos taurus; identical to SEQ ID NO: 12909

SEQ ID NO: 94487 - DNA, 201 bp, Bos taurus; identical to SEQ ID NO: 12910

SEQ ID NO: 94488 - DNA, 201 bp, Bos taurus; identical to SEQ ID NO: 12911

SEQ ID NO: 94489 - DNA, 201 bp, Bos taurus
tgcaggccacaactgagacctgaagcagccatttaatattttaatatgcatattgaaaataagagaaaagagccaaggtaagggaagaggtgactgagacaggacaatggcccaagccacctgcctacaaacgtttcctgaagtcctagtgagtgccagagccccagagagacagtaatgagccgtgggaagctggagtgc

SEQ ID NO: 94490 - DNA, 201 bp, Bos taurus; identical to SEQ ID NO: 12912

SEQ ID NO: 94491 - DNA, 201 bp, Bos taurus; identical to SEQ ID NO: 12913

SEQ ID NO: 94492 - DNA, 201 bp, Bos taurus; identical to SEQ ID NO: 12914

SEQ ID NO: 94493 - DNA, 201 bp, Bos taurus; identical to SEQ ID NO: 12915

SEQ ID NO: 94494 - DNA, 201 bp, Bos taurus; identical to SEQ ID NO: 12916

SEQ ID NO: 94495 - DNA, 201 bp, Bos taurus; identical to SEQ ID NO: 12917

SEQ ID NO: 94496 - DNA, 201 bp, Bos taurus
ggggagcaagtggaagatgattctgaaagcacttagcgccacggtagcatatggtataagcacatgatgaatgttggttaacagcattatctcacatcccgggtattggatagacttcagctgcaatagaagacactggcaaggcttgtgaggaaatgcagatgacatgcacagtttgagtgtttaccccagcatcatttg

SEQ ID NO: 94497 - DNA, 201 bp, Bos taurus; identical to SEQ ID NO: 12918

SEQ ID NO: 94498 - DNA, 201 bp, Bos taurus
ttttcatttttctgaaggatgaatttaagtgccagtgtagagtgaaatataccctctgaataaccacatcgtgtaagaggttggccttcagggagctgcctgctctcagcaggtgataacctgattctcccaggtatcggtctcttcatccagcaatacttccaggggccctgtagataagcagggcaccacgctgagtga

SEQ ID NO: 94499 - DNA, 201 bp, Bos taurus; identical to SEQ ID NO: 12919

SEQ ID NO: 94500 - DNA, 201 bp, Bos taurus; identical to SEQ ID NO: 12920

SEQ ID NO: 94501 - DNA, 201 bp, Bos taurus
ggtttggtggggcagaggtttttctgggaagaccaatccagcctctattctgccctgaccagcctatgtgactttggcctctgcagcttcctctgtgaaatgagagcaggagccaaatgactaatgggacttagctgcaaagttctccatccaagtgagcagtcaggggaaaataggacttaactactgcagatggcccat

SEQ ID NO: 94502 - DNA, 201 bp, Bos taurus; identical to SEQ ID NO: 12921

SEQ ID NO: 94503 - DNA, 201 bp, Bos taurus; identical to SEQ ID NO: 12922

SEQ ID NO: 94504 - DNA, 201 bp, Bos taurus; identical to SEQ ID NO: 12923

SEQ ID NO: 94505 - DNA, 201 bp, Bos taurus; identical to SEQ ID NO: 12924

SEQ ID NO: 94506 - DNA, 201 bp, Bos taurus
tctattttactgatgagaaaaccatggcagagaaagtaatttgctccaggtcaaacagccagtaagtggcagagcctaggtagaaacccaggccatctggctttggagcacctcctctcagccacaaagtcacggctgtgaaatgcaacaggtgagcacctctccaacagaacttccattgtgttcagctgagctcctgca

SEQ ID NO: 94507 - DNA, 201 bp, Bos taurus; identical to SEQ ID NO: 12925

SEQ ID NO: 94508 - DNA, 201 bp, Bos taurus; identical to SEQ ID NO: 12926

SEQ ID NO: 94509 - DNA, 201 bp, Bos taurus
tcatcaacgggaaagtcttatatgtgatcttaaaaaaataaaaacagtatactacaggtatagtatgtgcctgataaaagaaattttagccctgtgctgaggacaaggcctggctttaaaaaaaaaaaatcttgagttaaattgtcacgtaccatccttatgttgtatctgaatacaaattacagatagagctgtaagagg

SEQ ID NO: 94510 - DNA, 201 bp, Bos taurus; identical to SEQ ID NO: 12927

SEQ ID NO: 94511 - DNA, 201 bp, Bos taurus
agtagaactggtcagattgcctacaaaatttaaatctctgatctttgttttcttgcccaagtattgaggaaatattttgtgatttcagcctgtcacatatttaacctaggatgaagatatcaataacttaaaggtaaatactaataaaaattctttaaacatagaaaatcaatagtttatcttctccatggctaaacaacc

SEQ ID NO: 94512 - DNA, 201 bp, Bos taurus; identical to SEQ ID NO: 12929

SEQ ID NO: 94513 - DNA, 201 bp, Bos taurus
gctcaggtcaggagcagagataggaaagcccagaaagtcagatttgtttcttagcagacttcactttctgaactaagtggaaacatttcaaaaaacttaacattatatggccctcacactgacccagagaattgctggtgggagccctgatgaaaataccagcttctctggtgaaaatcatcacctgagaacacataagag

SEQ ID NO: 94514 - DNA, 201 bp, Bos taurus; identical to SEQ ID NO: 12930

SEQ ID NO: 94515 - DNA, 201 bp, Bos taurus
cttggtacagtcatgaaggccctggtgtcagatgggctagtcccagctctgcctctatcagcctcaagtttttcatctatatggtgcggataatgcaatatgatctcctagagttgttgagagaacgaaaattaacgcacacaagcgtttaacacagggcctgatacaaagtaaagctcaacaaatatcagtagctacaag

SEQ ID NO: 94516 - DNA, 201 bp, Bos taurus; identical to SEQ ID NO: 12931

SEQ ID NO: 94517 - DNA, 201 bp, Bos taurus; identical to SEQ ID NO: 12932

SEQ ID NO: 94518 - DNA, 201 bp, Bos taurus; identical to SEQ ID NO: 12933

SEQ ID NO: 94519 - DNA, 201 bp, Bos taurus; identical to SEQ ID NO: 12934

SEQ ID NO: 94520 - DNA, 201 bp, Bos taurus; identical to SEQ ID NO: 12935

SEQ ID NO: 94521 - DNA, 201 bp, Bos taurus
gctgtatctgctacagcctctgcttagcgagggctccctgccaagcacgttgcatggtaggaaatatgactcctattttaaagctaaggaaactgaggcccggatgaaagcaaatcccatccttaaggctgtactgggactcgaccctgggtgtgcccagtcctagacttgtattctgctgtcctggtgtgaatcaaacca

SEQ ID NO: 94522 - DNA, 201 bp, Bos taurus; identical to SEQ ID NO: 12936

SEQ ID NO: 94523 - DNA, 201 bp, Bos taurus; identical to SEQ ID NO: 12937

SEQ ID NO: 94524 - DNA, 201 bp, Bos taurus; identical to SEQ ID NO: 12938

SEQ ID NO: 94525 - DNA, 201 bp, Bos taurus; identical to SEQ ID NO: 12939

SEQ ID NO: 94526 - DNA, 201 bp, Bos taurus; identical to SEQ ID NO: 12940

SEQ ID NO: 94527 - DNA, 201 bp, Bos taurus
aagtatttctatattatatgctaatataggaagtcaggcattgttatagcagttacaaattacataattttatacaaggctagtctttgtggttgttgtttagtcgctaagtcgtgtccgactcgttgcaaccccatggactgtagcccactaggctcctcagtccacgggatttcccagacaagaatactggagtgagtt

SEQ ID NO: 94528 - DNA, 201 bp, Bos taurus; identical to SEQ ID NO: 12941

SEQ ID NO: 94529 - DNA, 201 bp, Bos taurus; identical to SEQ ID NO: 12942

SEQ ID NO: 94530 - DNA, 201 bp, Bos taurus; identical to SEQ ID NO: 12943

SEQ ID NO: 94531 - DNA, 201 bp, Bos taurus; identical to SEQ ID NO: 12944

SEQ ID NO: 94532 - DNA, 201 bp, Bos taurus; identical to SEQ ID NO: 12945

SEQ ID NO: 94533 - DNA, 201 bp, Bos taurus; identical to SEQ ID NO: 12946

SEQ ID NO: 94534 - DNA, 201 bp, Bos taurus; identical to SEQ ID NO: 12947

SEQ ID NO: 94535 - DNA, 201 bp, Bos taurus
cccgcctggcaccgtgatatgtgcaggagtccaggggcggtgttttcagtgttagccatgcgctcatgagtcaggtgggcctggagcagacagatgccagtggggtgttgataaggagctccagggggttcctgggcagcacggcagtggaggcctctggggggaccacctggtgctcgtccaggtaaagtgccacctagg

SEQ ID NO: 94536 - DNA, 201 bp, Bos taurus; identical to SEQ ID NO: 12948

SEQ ID NO: 94537 - DNA, 201 bp, Bos taurus; identical to SEQ ID NO: 12949

SEQ ID NO: 94538 - DNA, 201 bp, Bos taurus; identical to SEQ ID NO: 12950

SEQ ID NO: 94539 - DNA, 201 bp, Bos taurus; identical to SEQ ID NO: 12951

SEQ ID NO: 94540 - DNA, 201 bp, Bos taurus; identical to SEQ ID NO: 12953

SEQ ID NO: 94541 - DNA, 201 bp, Bos taurus; identical to SEQ ID NO: 12954

SEQ ID NO: 94542 - DNA, 201 bp, Bos taurus; identical to SEQ ID NO: 12955

SEQ ID NO: 94543 - DNA, 201 bp, Bos taurus; identical to SEQ ID NO: 12956

SEQ ID NO: 94544 - DNA, 201 bp, Bos taurus; identical to SEQ ID NO: 12957

SEQ ID NO: 94545 - DNA, 201 bp, Bos taurus; identical to SEQ ID NO: 12958

SEQ ID NO: 94546 - DNA, 201 bp, Bos taurus; identical to SEQ ID NO: 12959

SEQ ID NO: 94547 - DNA, 201 bp, Bos taurus; identical to SEQ ID NO: 12960

SEQ ID NO: 94548 - DNA, 201 bp, Bos taurus
gatccatctcctagaagggagagggggcagtccataggagggctggcgtcttatccagctgccccagaaaaggctggcttcacatctttccaggccagcagcagctctgtgggtgctgcagagaacctgcagaactttctctgccctggtgtggctgggctgtgggggccgggcctcacctgaggcagagctggtgccacc

SEQ ID NO: 94549 - DNA, 201 bp, Bos taurus
gatgcccgcccagcaggctgagccaccaaagctccgggatcagggggaacaaaagccaagggaaagcagagtgctgacagggccagaggccgctggccgcagggctataaaaagcaggagccaccgaggaagcggcaccagatggagacccagactgtgcagcaggagctgggtgagtaaggccccaaggggtgctctggc

SEQ ID NO: 94550 - DNA, 201 bp, Bos taurus
agtggaggctgcagcgctgtgggcagggcaaggggaattcagggcctctgcttgcttgctccccagcttcgacttagctgtaacagttctctcttccttttgtagcccctcgtactggccgcatggggcttagcgctggagatggcgtgggtggagccggcccgggctgcccactggctgaagaggaggcagtggcggaag

SEQ ID NO: 94551 - DNA, 201 bp, Bos taurus; identical to SEQ ID NO: 12961

SEQ ID NO: 94552 - DNA, 201 bp, Bos taurus
agagttgacaaagctatttctcaatttgagtggatgtgctggtaaataccaccatacataacgtatctgtaaaacgcagacattcaggagtttgcagttactaacccaccgcctcttgtttgtcactcaaagtctcttggatcttattgcttcttgtaaattggcagagcggccttgagctccttctggctgctgtatggt

SEQ ID NO: 94553 - DNA, 201 bp, Bos taurus; identical to SEQ ID NO: 12963

SEQ ID NO: 94554 - DNA, 201 bp, Bos taurus; identical to SEQ ID NO: 12964

SEQ ID NO: 94555 - DNA, 201 bp, Bos taurus; identical to SEQ ID NO: 12965

SEQ ID NO: 94556 - DNA, 201 bp, Bos taurus; identical to SEQ ID NO: 12966

SEQ ID NO: 94557 - DNA, 201 bp, Bos taurus; identical to SEQ ID NO: 12967

SEQ ID NO: 94558 - DNA, 201 bp, Bos taurus; identical to SEQ ID NO: 12968

SEQ ID NO: 94559 - DNA, 201 bp, Bos taurus; identical to SEQ ID NO: 12969

SEQ ID NO: 94560 - DNA, 201 bp, Bos taurus
agcctctgggcagggacatcctaaatagcattaaaaatgagccaaggcatcactggattcgtgaaataagcactctgccctgctcacttctctggcatccgtttttactcatcctgaacagtgggtgagtggctgttgtcaaggctgcttcctccgctcaaaacatttcaaaacgctcctacaaggacttccctggtgatc

SEQ ID NO: 94561 - DNA, 201 bp, Bos taurus; identical to SEQ ID NO: 12970

SEQ ID NO: 94562 - DNA, 201 bp, Bos taurus
tggggactgactcttaaccactgcatgcacctcccttttcaacactcagcagtgccctgagcacttgagagcttggaaatgcattatagggggtaaggggctatgaagagaaggacgctgtagggggagatgctctaggagaaggatgtgttgttttaatataggggccacctaagagaatcacggggcagggaggatgca

SEQ ID NO: 94563 - DNA, 201 bp, Bos taurus; identical to SEQ ID NO: 12971

SEQ ID NO: 94564 - DNA, 201 bp, Bos taurus; identical to SEQ ID NO: 12972

SEQ ID NO: 94565 - DNA, 201 bp, Bos taurus; identical to SEQ ID NO: 12973

SEQ ID NO: 94566 - DNA, 201 bp, Bos taurus; identical to SEQ ID NO: 12974

SEQ ID NO: 94567 - DNA, 201 bp, Bos taurus; identical to SEQ ID NO: 12975

SEQ ID NO: 94568 - DNA, 201 bp, Bos taurus; identical to SEQ ID NO: 12976

SEQ ID NO: 94569 - DNA, 201 bp, Bos taurus
cagagagagtaaacaggattctgtctatggccagggctttctgggaacacacctgtataagcagcagccattcccaacagaaccgaattctcaggaaatccggacagagccagggctgggcctttgtttggttttctgaccatgtgggaagcctgaggcctggtggccagccacgccctgcctctccgcctctgcatcctt

SEQ ID NO: 94570 - DNA, 201 bp, Bos taurus
aagcaaaatattactttcacaatcatcaaactagcatgagcaaaaaaaccaaaaaccatgtaaaagacaaagtaaattaagagcccagaacaagaggatccagaatataaattgtatggaaccaaaatgccaagtataatttagtatggcttggaggcatctctctcatgtaagagaattaggcatgagcacctacccatt

SEQ ID NO: 94571 - DNA, 201 bp, Bos taurus; identical to SEQ ID NO: 12977

SEQ ID NO: 94572 - DNA, 201 bp, Bos taurus
gcaccgaaataaaaatgcaatatttcattcttacaatgaaatgttctaagaatgcttatttcctgttttcaggggcctaaaatgagagattttatctaacatttatagtgttcctcggatcaagccatcaccggctatctatgcacatacagtcaaggaacacaaaaacagaagctccggtcctgaatgatttctttttag

SEQ ID NO: 94573 - DNA, 201 bp, Bos taurus; identical to SEQ ID NO: 12978

SEQ ID NO: 94574 - DNA, 201 bp, Bos taurus; identical to SEQ ID NO: 12979

SEQ ID NO: 94575 - DNA, 201 bp, Bos taurus; identical to SEQ ID NO: 12980

SEQ ID NO: 94576 - DNA, 201 bp, Bos taurus
ggaaaagcagtccagaagctcccagttaaggaaactctctaagtgtaactggtttcattgggctgctttccttgaatgggacagacttgtgctgggaagattggaactccacttctgtacctagatttgggctaaaaaggcttgtaactcatccctctacacagggctcttgtaattcccctctctacacttcctctagta

SEQ ID NO: 94577 - DNA, 201 bp, Bos taurus
gaaacagtttagaaaaggggaaatggagaggtcaagaaaaattgcatcagtggtggcagggctgggttgcattaatcattcccaacactgtcccttggtgatcctgcacccagtatccaacagtcagccctgaagtgggtgatggtggtggcggcggcaagtgacaggcagaatgtttttgaagaggtcattgcttacact

SEQ ID NO: 94578 - DNA, 201 bp, Bos taurus
gagcagagatggccttaccttctggggtaggtacccagagcgccagggaatcccttctctcctaacaaggactgccagctatgcagtgtgaaggaaggggtaggggcctgctcttccagcccggcggggtgagaggagaggcctttgagagctcatgcagctagcacaccctccatgcagtttctggatagtttccatcac

SEQ ID NO: 94579 - DNA, 201 bp, Bos taurus; identical to SEQ ID NO: 12981

SEQ ID NO: 94580 - DNA, 201 bp, Bos taurus; identical to SEQ ID NO: 12982

SEQ ID NO: 94581 - DNA, 201 bp, Bos taurus; identical to SEQ ID NO: 12983

SEQ ID NO: 94582 - DNA, 201 bp, Bos taurus; identical to SEQ ID NO: 12984

SEQ ID NO: 94583 - DNA, 201 bp, Bos taurus; identical to SEQ ID NO: 12985

SEQ ID NO: 94584 - DNA, 201 bp, Bos taurus
taaaatattttttaaagacttatgatagagcaacgtatgggttttctcaaaaacacatgaagtacttagatctaatggcagatctaataatttcatacttttgaggtagtgatagatataaacaatatttcaacatattgcaataatcaccaaaagatctgaaaatagctcatttctctggtaatgaaggcaatttgttgc

SEQ ID NO: 94585 - DNA, 201 bp, Bos taurus; identical to SEQ ID NO: 12986

SEQ ID NO: 94586 - DNA, 201 bp, Bos taurus; identical to SEQ ID NO: 12987

SEQ ID NO: 94587 - DNA, 201 bp, Bos taurus; identical to SEQ ID NO: 12988

SEQ ID NO: 94588 - DNA, 201 bp, Bos taurus
ggacagaagagcctggtgggcttcagtccatggggtcgagactgagtgactttcacttcatataccaacatatggcatgacacaagtcaggaggtggtgggcccgagacggcttcaaattctgccatgtttgcttgtgatgacacagacccccagatgtagctcgtgtcttccaaggagtcattcagcacccagaggtggg

SEQ ID NO: 94589 - DNA, 201 bp, Bos taurus
aaagagaagttgatatttaaccattcccataccaatctctcatagttttatttatacaatactaagaaaacattttaaaagggaaagatattctgaaaccgttttattctaaggaaaacaaaatttctgactctctccaactcgggaactgactatataacaaaaatataactgacaataattggccatctgaaattttct

SEQ ID NO: 94590 - DNA, 201 bp, Bos taurus; identical to SEQ ID NO: 12989

SEQ ID NO: 94591 - DNA, 201 bp, Bos taurus; identical to SEQ ID NO: 12990

SEQ ID NO: 94592 - DNA, 201 bp, Bos taurus
tgttgacactcagcaagggccagtatatttaaatcattcactctcctcaccacgcctcctggtctctctaccatgagactgaatagcgtgaccttgttcccgtgggtctgcagtgaaacagtggccttgggcccagcaatggggctggccaagcagaaagccgtcggtcccatcatcgggcccagcacagagcaagtctca

SEQ ID NO: 94593 - DNA, 201 bp, Bos taurus; identical to SEQ ID NO: 12991

SEQ ID NO: 94594 - DNA, 201 bp, Bos taurus; identical to SEQ ID NO: 12992

SEQ ID NO: 94595 - DNA, 201 bp, Bos taurus; identical to SEQ ID NO: 12993

SEQ ID NO: 94596 - DNA, 201 bp, Bos taurus
tgaactgaagggtcttgaggagcagtgtggccccgcagacactctcctccgtgctctttctgcagtgagcacagatgatgctctgttcggcttctgctctcgcaggccggaggtacccactgatgctcaagccttgtactcccaagcgctctgccgactcctggcgggtgcagaggaacttcaccatcaaatactggaaag

SEQ ID NO: 94597 - DNA, 201 bp, Bos taurus
aagtaaatcaacaaactttttccatttgatccattactctttcttttagaaggaatctaatccaagaccatgtatataacaaacacaataaacctatcataaaaattccaacacaatttcactgagaactacatcttatgaccttgaaaacgtcagtgacaggctgtcatacttgcaaatgtaaaaccagataaacttacc

SEQ ID NO: 94598 - DNA, 201 bp, Bos taurus; identical to SEQ ID NO: 12994

SEQ ID NO: 94599 - DNA, 201 bp, Bos taurus; identical to SEQ ID NO: 12995

SEQ ID NO: 94600 - DNA, 201 bp, Bos taurus; identical to SEQ ID NO: 12996

SEQ ID NO: 94601 - DNA, 201 bp, Bos taurus; identical to SEQ ID NO: 12997

SEQ ID NO: 94602 - DNA, 201 bp, Bos taurus; identical to SEQ ID NO: 12998

SEQ ID NO: 94603 - DNA, 201 bp, Bos taurus; identical to SEQ ID NO: 12999

SEQ ID NO: 94604 - DNA, 201 bp, Bos taurus
aagttcagcgactccagaaagaattgagcagttgtatccgtaaaattgaagaagtagctaaaagaggtgagacaaattggactcttgactttgaaaaaaatgctccaagagggtagaggccaaatacgttcttcaggacccctgcccctcatcagttccctttctgtccttctgtcactagaatgagcattcatggcaaga

SEQ ID NO: 94605 - DNA, 201 bp, Bos taurus; identical to SEQ ID NO: 13000

SEQ ID NO: 94606 - DNA, 201 bp, Bos taurus; identical to SEQ ID NO: 13001

SEQ ID NO: 94607 - DNA, 201 bp, Bos taurus; identical to SEQ ID NO: 13002

SEQ ID NO: 94608 - DNA, 201 bp, Bos taurus; identical to SEQ ID NO: 13003

SEQ ID NO: 94609 - DNA, 201 bp, Bos taurus; identical to SEQ ID NO: 13004

SEQ ID NO: 94610 - DNA, 201 bp, Bos taurus
ctggagcatccttttgttttttaactttccaccttatgtcactgtttcttttgtctgctgcttacatatttccttacctgatggccagttccttgtcatgagaaatttgtttcaagttgtgcttttccctagtatttagctaatgatgtgaatagagaaggtcctcaataaattggtcagtaataagcaaatgcgagtggg

SEQ ID NO: 94611 - DNA, 201 bp, Bos taurus
cttcctatcaccctggtgacacttctctaactggccctccaggagattgtgcaaattgttgcgtatcttgctaaaatcaagagacactgatgcacaccacagaaagggccctgaagcagagatggaaacactaagttgcagtccacaccttgtccctgggctgtgcaagcctgggccgatcccatctcctctcttagtgtc

SEQ ID NO: 94612 - DNA, 201 bp, Bos taurus; identical to SEQ ID NO: 13005

SEQ ID NO: 94613 - DNA, 201 bp, Bos taurus
cagccatggccggaaatgccctcctcagcccacagctgagagaaagggaaatgctctgacttctcgcttcccccccagtctccaaccttctgccaaaaatagaaagcagtgccaaggggcctgagaaacagctgcaggagaaaagcaggtgtggatctgacagcaagagacaatgaccagcccagggaccaagggacagac

SEQ ID NO: 94614 - DNA, 201 bp, Bos taurus; identical to SEQ ID NO: 13006

SEQ ID NO: 94615 - DNA, 201 bp, Bos taurus
atactacattttgtttacccattcatcagctgagggatatttccatacaacacttctgtaatatacatatataagttgtgtggcccatgttttcatttcatttgtctatccaactgtgagctgatggctcatatggtcactctatctctagaattttgaggaactaccaaactgttttccaaaatggccacaccgtttaat

SEQ ID NO: 94616 - DNA, 201 bp, Bos taurus; identical to SEQ ID NO: 13007

SEQ ID NO: 94617 - DNA, 201 bp, Bos taurus; identical to SEQ ID NO: 13008

SEQ ID NO: 94618 - DNA, 201 bp, Bos taurus; identical to SEQ ID NO: 13009

SEQ ID NO: 94619 - DNA, 201 bp, Bos taurus; identical to SEQ ID NO: 13010

SEQ ID NO: 94620 - DNA, 201 bp, Bos taurus; identical to SEQ ID NO: 13011

SEQ ID NO: 94621 - DNA, 201 bp, Bos taurus
gagagccacccccatccctccccgactcagactcctgttccagcttcgccgtacccccctatcgctccattccctgtagcatggaggccaagagtacccattcctgccctgtcctcctagctgtaggacccctgagcatcactcacttcgggggagagtgaagtaggcctggggagagggatcccagcacttggccaccgt

SEQ ID NO: 94622 - DNA, 201 bp, Bos taurus; identical to SEQ ID NO: 13012

SEQ ID NO: 94623 - DNA, 201 bp, Bos taurus; identical to SEQ ID NO: 13014

SEQ ID NO: 94624 - DNA, 201 bp, Bos taurus; identical to SEQ ID NO: 13015

SEQ ID NO: 94625 - DNA, 201 bp, Bos taurus
gggcccagagcccacaatacaaagggtgatgggcattgaaactagagcttggggaccctaagggacacaaaatctccaggaaggggtcagggatcggagaggggttatctatggttttctatggggccacaatcagccaaagagggattgggattgaatacaaatgtagaagactgttggagtgaaatttggggcataaga

SEQ ID NO: 94626 - DNA, 201 bp, Bos taurus
gactgccaaatgccaactcctcttcccactggaccttctctgagccccacactggcactccacatggtctcctgggccctcccctgcctcgacccacatatccatctggggaccagctcaggtgatgctagcttctgagatgctccttagtcctgccggggcctctcagtgggtccttgtcctgaaacctgagcccccttg

SEQ ID NO: 94627 - DNA, 201 bp, Bos taurus; identical to SEQ ID NO: 13016

SEQ ID NO: 94628 - DNA, 201 bp, Bos taurus; identical to SEQ ID NO: 13018

SEQ ID NO: 94629 - DNA, 201 bp, Bos taurus; identical to SEQ ID NO: 13019

SEQ ID NO: 94630 - DNA, 201 bp, Bos taurus; identical to SEQ ID NO: 13020

SEQ ID NO: 94631 - DNA, 201 bp, Bos taurus; identical to SEQ ID NO: 13021

SEQ ID NO: 94632 - DNA, 201 bp, Bos taurus; identical to SEQ ID NO: 13022

SEQ ID NO: 94633 - DNA, 201 bp, Bos taurus; identical to SEQ ID NO: 13023

SEQ ID NO: 94634 - DNA, 201 bp, Bos taurus; identical to SEQ ID NO: 13024

SEQ ID NO: 94635 - DNA, 201 bp, Bos taurus; identical to SEQ ID NO: 13025

SEQ ID NO: 94636 - DNA, 201 bp, Bos taurus; identical to SEQ ID NO: 13026

SEQ ID NO: 94637 - DNA, 201 bp, Bos taurus; identical to SEQ ID NO: 13027

SEQ ID NO: 94638 - DNA, 201 bp, Bos taurus; identical to SEQ ID NO: 53971

SEQ ID NO: 94639 - DNA, 201 bp, Bos taurus; identical to SEQ ID NO: 13028

SEQ ID NO: 94640 - DNA, 201 bp, Bos taurus; identical to SEQ ID NO: 13029

SEQ ID NO: 94641 - DNA, 201 bp, Bos taurus; identical to SEQ ID NO: 13030

SEQ ID NO: 94642 - DNA, 201 bp, Bos taurus; identical to SEQ ID NO: 13031

SEQ ID NO: 94643 - DNA, 201 bp, Bos taurus; identical to SEQ ID NO: 13032

SEQ ID NO: 94644 - DNA, 201 bp, Bos taurus; identical to SEQ ID NO: 13033

SEQ ID NO: 94645 - DNA, 201 bp, Bos taurus; identical to SEQ ID NO: 13034

SEQ ID NO: 94646 - DNA, 201 bp, Bos taurus; identical to SEQ ID NO: 13035

SEQ ID NO: 94647 - DNA, 201 bp, Bos taurus; identical to SEQ ID NO: 13036

SEQ ID NO: 94648 - DNA, 201 bp, Bos taurus; identical to SEQ ID NO: 13037

SEQ ID NO: 94649 - DNA, 201 bp, Bos taurus; identical to SEQ ID NO: 13041

SEQ ID NO: 94650 - DNA, 201 bp, Bos taurus; identical to SEQ ID NO: 13043

SEQ ID NO: 94651 - DNA, 201 bp, Bos taurus; identical to SEQ ID NO: 13045

SEQ ID NO: 94652 - DNA, 201 bp, Bos taurus; identical to SEQ ID NO: 13046

SEQ ID NO: 94653 - DNA, 201 bp, Bos taurus; identical to SEQ ID NO: 13047

SEQ ID NO: 94654 - DNA, 201 bp, Bos taurus; identical to SEQ ID NO: 13049

SEQ ID NO: 94655 - DNA, 201 bp, Bos taurus; identical to SEQ ID NO: 13051

SEQ ID NO: 94656 - DNA, 201 bp, Bos taurus; identical to SEQ ID NO: 13052

SEQ ID NO: 94657 - DNA, 201 bp, Bos taurus; identical to SEQ ID NO: 13054

SEQ ID NO: 94658 - DNA, 201 bp, Bos taurus; identical to SEQ ID NO: 13055

SEQ ID NO: 94659 - DNA, 201 bp, Bos taurus; identical to SEQ ID NO: 13056

SEQ ID NO: 94660 - DNA, 201 bp, Bos taurus; identical to SEQ ID NO: 13059

SEQ ID NO: 94661 - DNA, 201 bp, Bos taurus; identical to SEQ ID NO: 13061

SEQ ID NO: 94662 - DNA, 201 bp, Bos taurus; identical to SEQ ID NO: 13062

SEQ ID NO: 94663 - DNA, 201 bp, Bos taurus; identical to SEQ ID NO: 13064

SEQ ID NO: 94664 - DNA, 201 bp, Bos taurus; identical to SEQ ID NO: 13066

SEQ ID NO: 94665 - DNA, 201 bp, Bos taurus; identical to SEQ ID NO: 13067

SEQ ID NO: 94666 - DNA, 201 bp, Bos taurus; identical to SEQ ID NO: 13069

SEQ ID NO: 94667 - DNA, 201 bp, Bos taurus; identical to SEQ ID NO: 13070

SEQ ID NO: 94668 - DNA, 201 bp, Bos taurus; identical to SEQ ID NO: 13071

SEQ ID NO: 94669 - DNA, 201 bp, Bos taurus; identical to SEQ ID NO: 13072

SEQ ID NO: 94670 - DNA, 201 bp, Bos taurus; identical to SEQ ID NO: 13073

SEQ ID NO: 94671 - DNA, 201 bp, Bos taurus; identical to SEQ ID NO: 13074

SEQ ID NO: 94672 - DNA, 201 bp, Bos taurus; identical to SEQ ID NO: 13076

SEQ ID NO: 94673 - DNA, 201 bp, Bos taurus; identical to SEQ ID NO: 13078

SEQ ID NO: 94674 - DNA, 201 bp, Bos taurus; identical to SEQ ID NO: 13079

SEQ ID NO: 94675 - DNA, 201 bp, Bos taurus; identical to SEQ ID NO: 13080

SEQ ID NO: 94676 - DNA, 201 bp, Bos taurus; identical to SEQ ID NO: 13082

SEQ ID NO: 94677 - DNA, 201 bp, Bos taurus; identical to SEQ ID NO: 13084

SEQ ID NO: 94678 - DNA, 201 bp, Bos taurus; identical to SEQ ID NO: 13085

SEQ ID NO: 94679 - DNA, 201 bp, Bos taurus; identical to SEQ ID NO: 13086

SEQ ID NO: 94680 - DNA, 201 bp, Bos taurus; identical to SEQ ID NO: 13087

SEQ ID NO: 94681 - DNA, 201 bp, Bos taurus; identical to SEQ ID NO: 13088

SEQ ID NO: 94682 - DNA, 201 bp, Bos taurus; identical to SEQ ID NO: 13089

SEQ ID NO: 94683 - DNA, 201 bp, Bos taurus; identical to SEQ ID NO: 13090

SEQ ID NO: 94684 - DNA, 201 bp, Bos taurus; identical to SEQ ID NO: 13092

SEQ ID NO: 94685 - DNA, 201 bp, Bos taurus; identical to SEQ ID NO: 13093

SEQ ID NO: 94686 - DNA, 201 bp, Bos taurus; identical to SEQ ID NO: 13094

SEQ ID NO: 94687 - DNA, 201 bp, Bos taurus; identical to SEQ ID NO: 13096

SEQ ID NO: 94688 - DNA, 201 bp, Bos taurus; identical to SEQ ID NO: 13097

SEQ ID NO: 94689 - DNA, 201 bp, Bos taurus; identical to SEQ ID NO: 13100

SEQ ID NO: 94690 - DNA, 201 bp, Bos taurus; identical to SEQ ID NO: 13101

SEQ ID NO: 94691 - DNA, 201 bp, Bos taurus; identical to SEQ ID NO: 13104

SEQ ID NO: 94692 - DNA, 201 bp, Bos taurus; identical to SEQ ID NO: 13105

SEQ ID NO: 94693 - DNA, 201 bp, Bos taurus; identical to SEQ ID NO: 13106

SEQ ID NO: 94694 - DNA, 201 bp, Bos taurus; identical to SEQ ID NO: 13108

SEQ ID NO: 94695 - DNA, 201 bp, Bos taurus; identical to SEQ ID NO: 13109

SEQ ID NO: 94696 - DNA, 201 bp, Bos taurus; identical to SEQ ID NO: 13112

SEQ ID NO: 94697 - DNA, 201 bp, Bos taurus; identical to SEQ ID NO: 13113

SEQ ID NO: 94698 - DNA, 201 bp, Bos taurus; identical to SEQ ID NO: 13114

SEQ ID NO: 94699 - DNA, 201 bp, Bos taurus; identical to SEQ ID NO: 13116

SEQ ID NO: 94700 - DNA, 201 bp, Bos taurus; identical to SEQ ID NO: 13118

SEQ ID NO: 94701 - DNA, 201 bp, Bos taurus; identical to SEQ ID NO: 13119

SEQ ID NO: 94702 - DNA, 201 bp, Bos taurus; identical to SEQ ID NO: 13120

SEQ ID NO: 94703 - DNA, 201 bp, Bos taurus; identical to SEQ ID NO: 13122

SEQ ID NO: 94704 - DNA, 201 bp, Bos taurus; identical to SEQ ID NO: 13123

SEQ ID NO: 94705 - DNA, 201 bp, Bos taurus; identical to SEQ ID NO: 13124

SEQ ID NO: 94706 - DNA, 201 bp, Bos taurus; identical to SEQ ID NO: 13125

SEQ ID NO: 94707 - DNA, 201 bp, Bos taurus; identical to SEQ ID NO: 13127

SEQ ID NO: 94708 - DNA, 201 bp, Bos taurus; identical to SEQ ID NO: 13128

SEQ ID NO: 94709 - DNA, 201 bp, Bos taurus; identical to SEQ ID NO: 13129

SEQ ID NO: 94710 - DNA, 201 bp, Bos taurus; identical to SEQ ID NO: 13130

SEQ ID NO: 94711 - DNA, 201 bp, Bos taurus; identical to SEQ ID NO: 13131

SEQ ID NO: 94712 - DNA, 201 bp, Bos taurus; identical to SEQ ID NO: 13132

SEQ ID NO: 94713 - DNA, 201 bp, Bos taurus; identical to SEQ ID NO: 13138

SEQ ID NO: 94714 - DNA, 201 bp, Bos taurus; identical to SEQ ID NO: 13139

SEQ ID NO: 94715 - DNA, 201 bp, Bos taurus; identical to SEQ ID NO: 13140

SEQ ID NO: 94716 - DNA, 201 bp, Bos taurus; identical to SEQ ID NO: 13141

SEQ ID NO: 94717 - DNA, 201 bp, Bos taurus; identical to SEQ ID NO: 13144

SEQ ID NO: 94718 - DNA, 201 bp, Bos taurus; identical to SEQ ID NO: 13145

SEQ ID NO: 94719 - DNA, 201 bp, Bos taurus; identical to SEQ ID NO: 13146

SEQ ID NO: 94720 - DNA, 201 bp, Bos taurus; identical to SEQ ID NO: 13147

SEQ ID NO: 94721 - DNA, 201 bp, Bos taurus; identical to SEQ ID NO: 13148

SEQ ID NO: 94722 - DNA, 201 bp, Bos taurus; identical to SEQ ID NO: 13149

SEQ ID NO: 94723 - DNA, 201 bp, Bos taurus; identical to SEQ ID NO: 13150

SEQ ID NO: 94724 - DNA, 201 bp, Bos taurus; identical to SEQ ID NO: 13151

SEQ ID NO: 94725 - DNA, 201 bp, Bos taurus; identical to SEQ ID NO: 13153

SEQ ID NO: 94726 - DNA, 201 bp, Bos taurus; identical to SEQ ID NO: 13155

SEQ ID NO: 94727 - DNA, 201 bp, Bos taurus; identical to SEQ ID NO: 13156

SEQ ID NO: 94728 - DNA, 201 bp, Bos taurus; identical to SEQ ID NO: 13158

SEQ ID NO: 94729 - DNA, 201 bp, Bos taurus; identical to SEQ ID NO: 13159

SEQ ID NO: 94730 - DNA, 201 bp, Bos taurus; identical to SEQ ID NO: 13162

SEQ ID NO: 94731 - DNA, 201 bp, Bos taurus; identical to SEQ ID NO: 13163

SEQ ID NO: 94732 - DNA, 201 bp, Bos taurus; identical to SEQ ID NO: 13164

SEQ ID NO: 94733 - DNA, 201 bp, Bos taurus; identical to SEQ ID NO: 13165

SEQ ID NO: 94734 - DNA, 201 bp, Bos taurus; identical to SEQ ID NO: 13166

SEQ ID NO: 94735 - DNA, 201 bp, Bos taurus; identical to SEQ ID NO: 13167

SEQ ID NO: 94736 - DNA, 201 bp, Bos taurus; identical to SEQ ID NO: 13168

SEQ ID NO: 94737 - DNA, 201 bp, Bos taurus; identical to SEQ ID NO: 13169

SEQ ID NO: 94738 - DNA, 201 bp, Bos taurus; identical to SEQ ID NO: 13170

SEQ ID NO: 94739 - DNA, 201 bp, Bos taurus; identical to SEQ ID NO: 13171

SEQ ID NO: 94740 - DNA, 201 bp, Bos taurus; identical to SEQ ID NO: 13172

SEQ ID NO: 94741 - DNA, 201 bp, Bos taurus; identical to SEQ ID NO: 13174

SEQ ID NO: 94742 - DNA, 201 bp, Bos taurus; identical to SEQ ID NO: 13175

SEQ ID NO: 94743 - DNA, 201 bp, Bos taurus; identical to SEQ ID NO: 13176

SEQ ID NO: 94744 - DNA, 201 bp, Bos taurus; identical to SEQ ID NO: 13177

SEQ ID NO: 94745 - DNA, 201 bp, Bos taurus; identical to SEQ ID NO: 13178

SEQ ID NO: 94746 - DNA, 201 bp, Bos taurus; identical to SEQ ID NO: 13180

SEQ ID NO: 94747 - DNA, 201 bp, Bos taurus; identical to SEQ ID NO: 13181

SEQ ID NO: 94748 - DNA, 201 bp, Bos taurus; identical to SEQ ID NO: 13182

SEQ ID NO: 94749 - DNA, 201 bp, Bos taurus; identical to SEQ ID NO: 13183

SEQ ID NO: 94750 - DNA, 201 bp, Bos taurus; identical to SEQ ID NO: 13184

SEQ ID NO: 94751 - DNA, 201 bp, Bos taurus; identical to SEQ ID NO: 13185

SEQ ID NO: 94752 - DNA, 201 bp, Bos taurus; identical to SEQ ID NO: 13187

SEQ ID NO: 94753 - DNA, 201 bp, Bos taurus; identical to SEQ ID NO: 13189

SEQ ID NO: 94754 - DNA, 201 bp, Bos taurus; identical to SEQ ID NO: 13191

SEQ ID NO: 94755 - DNA, 201 bp, Bos taurus; identical to SEQ ID NO: 13192

SEQ ID NO: 94756 - DNA, 201 bp, Bos taurus; identical to SEQ ID NO: 13193

SEQ ID NO: 94757 - DNA, 201 bp, Bos taurus; identical to SEQ ID NO: 13195

SEQ ID NO: 94758 - DNA, 201 bp, Bos taurus; identical to SEQ ID NO: 13196

SEQ ID NO: 94759 - DNA, 201 bp, Bos taurus; identical to SEQ ID NO: 13200

SEQ ID NO: 94760 - DNA, 201 bp, Bos taurus; identical to SEQ ID NO: 13201

SEQ ID NO: 94761 - DNA, 201 bp, Bos taurus; identical to SEQ ID NO: 13202

SEQ ID NO: 94762 - DNA, 201 bp, Bos taurus; identical to SEQ ID NO: 13203

SEQ ID NO: 94763 - DNA, 201 bp, Bos taurus; identical to SEQ ID NO: 13204

SEQ ID NO: 94764 - DNA, 201 bp, Bos taurus; identical to SEQ ID NO: 13205

SEQ ID NO: 94765 - DNA, 201 bp, Bos taurus
acacgactgagtgactatttcctttccttttaaagtaattctgttattttatttttggctttgccgggtcttcattcctgtgcggctctctctctagtgctggcaggcaggggccattctctagttgtggcgcgcaggcttattgtgatggcttcgcttgtggagcccggggtctagggtgcaggggcttcagtagttgtg

SEQ ID NO: 94766 - DNA, 201 bp, Bos taurus; identical to SEQ ID NO: 13206

SEQ ID NO: 94767 - DNA, 201 bp, Bos taurus; identical to SEQ ID NO: 13211

SEQ ID NO: 94768 - DNA, 201 bp, Bos taurus
ggtatttacagtataatttcatatttgtgactattttattggtattaatttgatggtatgatgcctttatatatgtgcctaggtagatgccactaactacacataatctatcagctatacatagcttcaagcaaaaatcctgataatcataaactctgtgagatacacatcatttttctagcctatcctttttcatgtgaa

SEQ ID NO: 94769 - DNA, 201 bp, Bos taurus; identical to SEQ ID NO: 13212

SEQ ID NO: 94770 - DNA, 201 bp, Bos taurus
agtgctttctatcagtgaaactgtaaaatgacattgagcaaatagcgatgggccaaatctgattgaggagtgaggtttgggggaaagctgagaagctcatacactgaaagcatgaaggtggctgagagcatggtgagttccagggaggggcgaggggacgtttctcagcctgcctccttagtaagctgcctttttcctctt

SEQ ID NO: 94771 - DNA, 201 bp, Bos taurus; identical to SEQ ID NO: 13213

SEQ ID NO: 94772 - DNA, 201 bp, Bos taurus; identical to SEQ ID NO: 13214

SEQ ID NO: 94773 - DNA, 201 bp, Bos taurus; identical to SEQ ID NO: 13215

SEQ ID NO: 94774 - DNA, 201 bp, Bos taurus
tgggtggacacctacagcagggttgaggagccacgttttctcctaggcttaaggggacatgacctccaagaggggctccttctcattcactcataaaatagggcccctggaataaacatctgcagagctgcacgcatgtcacagcaagcagatgtggaacaatgaccttgttctgcatatttttcttcttaaagaatcatt

SEQ ID NO: 94775 - DNA, 201 bp, Bos taurus; identical to SEQ ID NO: 13216

SEQ ID NO: 94776 - DNA, 201 bp, Bos taurus; identical to SEQ ID NO: 13218

SEQ ID NO: 94777 - DNA, 201 bp, Bos taurus
tgatgacgcctctgaaaaacaactgtgcttggaaactgagttctagctgagcagcttttggggaccttctccttaagactctcaaagattgcgtcaggccgatgggatgcctggcagaaattctcaggggacatggtgtgtttttgaagaggactgattgggtcacagggctgacaggccgtttcccgggtattccttggg

SEQ ID NO: 94778 - DNA, 201 bp, Bos taurus; identical to SEQ ID NO: 13219

SEQ ID NO: 94779 - DNA, 201 bp, Bos taurus; identical to SEQ ID NO: 13220

SEQ ID NO: 94780 - DNA, 201 bp, Bos taurus; identical to SEQ ID NO: 13221

SEQ ID NO: 94781 - DNA, 201 bp, Bos taurus
ctgtctgtaaaagcaaaaagggcctaaaattccaaagggctagcttttcaaggcaaataaactttaacaccaattgcaattatgcactattagtaaagggaaaaaaaaaggccacttcacatctttaattcacttggactctgcagcattcaagtttgtgacccctgccatacacaatctcccacggttaggtttctccta

SEQ ID NO: 94782 - DNA, 201 bp, Bos taurus
gataagggccctccacagtggagaaggagccagtcccgtggtggagctggcgacagagcaccggtggaggagcagcccgagcagagggtggaggcaggcacggcaaggctgcgcggagcaggcctgcaggcaaggctcacaatgtgagcacgggcagtcaggggtcaccatgcagggctttgtggactatggtaaggagtt

SEQ ID NO: 94783 - DNA, 201 bp, Bos taurus
cgtgcgatcattcattaacaccttctttgctgtctcctctcaaacctctcgctgcacaactgctgccctcacatccagacccagggagttctaaggaaggaccgcctgtcatgagccaagagccccaacacagagttctcaatagccttgtgaacttgagaacatgaacctgcagagacttttcaaaatatcaagcttcag

SEQ ID NO: 94784 - DNA, 201 bp, Bos taurus; identical to SEQ ID NO: 13222

SEQ ID NO: 94785 - DNA, 201 bp, Bos taurus
tttggaccctgatacatgaatactgatttttttaggtggtcagtgcattgtggttttaatgacatagagaaaataatatagcccttgtgcctggatctgcggtgaaaatgtttacacagaaataatcatataaatgttacttactggtgttcaagttttagaagcaacctaaagctactttaattgagacagaattcacag

SEQ ID NO: 94786 - DNA, 201 bp, Bos taurus
agagacctggggtccagctccccgccaagccccaacgccgaatggccgctgctcccggtcagagtggaggcgggacagcagggccttgggccgcaccgacctttcgtgaaaccaagctccaggcagccttccggcgtctgtggctactcgcgcgacgctcccagaccgcttggcctgagggcacaagagccccagacaact

SEQ ID NO: 94787 - DNA, 201 bp, Bos taurus; identical to SEQ ID NO: 13223

SEQ ID NO: 94788 - DNA, 201 bp, Bos taurus
acacacgacaaaagcacactggccctagggtggccaggggttcactcctcagttcacctggcacgcagctcactccctgctcatccatggttagtccagcggagttcaggccacttcatcaggaacaagtgaacacgttttcatgtatgagaaaatgagtcgttcctctctatttaaaacagatgaaaagcaggcaggcag

SEQ ID NO: 94789 - DNA, 201 bp, Bos taurus; identical to SEQ ID NO: 13224

SEQ ID NO: 94790 - DNA, 201 bp, Bos taurus; identical to SEQ ID NO: 13225

SEQ ID NO: 94791 - DNA, 201 bp, Bos taurus; identical to SEQ ID NO: 13226

SEQ ID NO: 94792 - DNA, 201 bp, Bos taurus; identical to SEQ ID NO: 13228

SEQ ID NO: 94793 - DNA, 201 bp, Bos taurus; identical to SEQ ID NO: 13229

SEQ ID NO: 94794 - DNA, 201 bp, Bos taurus
gtgccctggtactcatggccaggccttcctcactggtcttgatagaaccagctgtccttgcctcccaactagtctcagcccttaaactctagcaggcggcgggcagtggccacagacagaagtcaggcattgcagcccacaaatgggggacaagaaaaggggccacaagaggtggtgcctggggtatccagtgccagggta

SEQ ID NO: 94795 - DNA, 201 bp, Bos taurus
ttcatttgctaaaggtgccgctcccttaggaatgttcacttttcaccgaggagtgtgtaaaatgcttatgcttgtgtacaattgtttatttcagatatttggctgtcctttttaaggagactagttagaaacatctgagttcacactctgatgtaaaactgagtgaaagttgtctctgcagtggagtgtgtaactgcatca

SEQ ID NO: 94796 - DNA, 201 bp, Bos taurus
agaagttaacctatatttcacgggtttcacgtggcctcccaaagtttccccgagaaggctacaggaggctgtgctgcagaccagccctgtgctcgtccgctcacccacctgggccctgccctcaacaccccatgctctgacctcgggaccccgtgctctgcactcagtctgtcccaagtctcttgtgtgcattgctgtttt

SEQ ID NO: 94797 - DNA, 201 bp, Bos taurus
atgagggcagagtgggcatggtcacgctgctccaccttggccgggacattcccgtcccctggggacggggtctcccctgagcccagccacacctcctgtgcctaggggtcatcacgttaaggccacagaggagtgtgtttcctgggccacctgccacagcctgggtgggatctgagtggtgggtgtccccacgcctcggag

SEQ ID NO: 94798 - DNA, 201 bp, Bos taurus; identical to SEQ ID NO: 13231

SEQ ID NO: 94799 - DNA, 201 bp, Bos taurus; identical to SEQ ID NO: 13232

SEQ ID NO: 94800 - DNA, 201 bp, Bos taurus; identical to SEQ ID NO: 13233

SEQ ID NO: 94801 - DNA, 201 bp, Bos taurus; identical to SEQ ID NO: 13234

SEQ ID NO: 94802 - DNA, 201 bp, Bos taurus; identical to SEQ ID NO: 13235

SEQ ID NO: 94803 - DNA, 201 bp, Bos taurus; identical to SEQ ID NO: 13237

SEQ ID NO: 94804 - DNA, 201 bp, Bos taurus; identical to SEQ ID NO: 13238

SEQ ID NO: 94805 - DNA, 201 bp, Bos taurus; identical to SEQ ID NO: 13239

SEQ ID NO: 94806 - DNA, 201 bp, Bos taurus; identical to SEQ ID NO: 13240

SEQ ID NO: 94807 - DNA, 201 bp, Bos taurus
caaagtgctgcgctgggtgtggcctgaggagcccatgggctggctactctcagagcctttggtgtctcattcaatggaaagaagccagtggccagcagcccgagagtcaggggaaatgtggcttgtccacctgtccgtcggcatgatggagcacctttgacagaactgatgtggccacaaggacgtgtttactgagctaca

SEQ ID NO: 94808 - DNA, 201 bp, Bos taurus
cagcttgcctggcccaatgactgagacgctcagcgagctgtcacctccaggacagggtttctaaaccacagtaccaccaacacctggaactggagaatcttcccttgggggcctgtcctgtgtgctataggatgttcagcaacatccttggcctccaccccctggatgtcagtagtgtcccccagttgtgaccactagcag

SEQ ID NO: 94809 - DNA, 201 bp, Bos taurus; identical to SEQ ID NO: 13242

SEQ ID NO: 94810 - DNA, 201 bp, Bos taurus; identical to SEQ ID NO: 13243

SEQ ID NO: 94811 - DNA, 201 bp, Bos taurus; identical to SEQ ID NO: 13244

SEQ ID NO: 94812 - DNA, 201 bp, Bos taurus; identical to SEQ ID NO: 13245

SEQ ID NO: 94813 - DNA, 201 bp, Bos taurus
aggccctggtccccagtgccctggctaccaacagctccaggagcacttccctcttcccctgcccgtcaggggtcttcagcaggttccaagtcgtcatccgccccttctacctgaccaactccacggacatggactagactcgaggctggagttcaggatgggcaggagttcatagaggctgggcacctcccctccttcacc

SEQ ID NO: 94814 - DNA, 201 bp, Bos taurus
ggtcagatactgctttccctaggcaggctccttccaggcctgatggggcgaaatgcccaggggtctctctgtggtcccgcaaggcccctgttagttttgagtcacatcattgaagactgtctaacagtgcttggtggtccctcagcctctgtgaggcccacctcagggcagggacacttactcctaaaggtgtattgggaa

SEQ ID NO: 94815 - DNA, 201 bp, Bos taurus
tgccctcccgcatcggggctcgtcagcttcccggtatggtcaggtcagcctgagtgggggtatggcacagaggtgagcgggaccccagccctgtccttcgggggcccgcagtctggtggggcacacagaagggtcagacacagcaaacttgtcactgaatgcagattgggggatagtcagttttgcctagggtccagaaca

SEQ ID NO: 94816 - DNA, 201 bp, Bos taurus; identical to SEQ ID NO: 13250

SEQ ID NO: 94817 - DNA, 201 bp, Bos taurus; identical to SEQ ID NO: 13252

SEQ ID NO: 94818 - DNA, 201 bp, Bos taurus; identical to SEQ ID NO: 13253

SEQ ID NO: 94819 - DNA, 201 bp, Bos taurus; identical to SEQ ID NO: 13254

SEQ ID NO: 94820 - DNA, 201 bp, Bos taurus; identical to SEQ ID NO: 13255

SEQ ID NO: 94821 - DNA, 201 bp, Bos taurus; identical to SEQ ID NO: 13256

SEQ ID NO: 94822 - DNA, 201 bp, Bos taurus; identical to SEQ ID NO: 13257

SEQ ID NO: 94823 - DNA, 201 bp, Bos taurus; identical to SEQ ID NO: 13258

SEQ ID NO: 94824 - DNA, 201 bp, Bos taurus; identical to SEQ ID NO: 13259

SEQ ID NO: 94825 - DNA, 201 bp, Bos taurus; identical to SEQ ID NO: 13260

SEQ ID NO: 94826 - DNA, 201 bp, Bos taurus; identical to SEQ ID NO: 13261

SEQ ID NO: 94827 - DNA, 201 bp, Bos taurus; identical to SEQ ID NO: 13262

SEQ ID NO: 94828 - DNA, 201 bp, Bos taurus; identical to SEQ ID NO: 13263

SEQ ID NO: 94829 - DNA, 201 bp, Bos taurus; identical to SEQ ID NO: 13264

SEQ ID NO: 94830 - DNA, 201 bp, Bos taurus; identical to SEQ ID NO: 13265

SEQ ID NO: 94831 - DNA, 201 bp, Bos taurus; identical to SEQ ID NO: 13266

SEQ ID NO: 94832 - DNA, 201 bp, Bos taurus; identical to SEQ ID NO: 13267

SEQ ID NO: 94833 - DNA, 201 bp, Bos taurus; identical to SEQ ID NO: 13268

SEQ ID NO: 94834 - DNA, 201 bp, Bos taurus; identical to SEQ ID NO: 13270

SEQ ID NO: 94835 - DNA, 201 bp, Bos taurus; identical to SEQ ID NO: 13271

SEQ ID NO: 94836 - DNA, 201 bp, Bos taurus; identical to SEQ ID NO: 13272

SEQ ID NO: 94837 - DNA, 201 bp, Bos taurus; identical to SEQ ID NO: 13273

SEQ ID NO: 94838 - DNA, 201 bp, Bos taurus; identical to SEQ ID NO: 13274

SEQ ID NO: 94839 - DNA, 201 bp, Bos taurus; identical to SEQ ID NO: 13275

SEQ ID NO: 94840 - DNA, 201 bp, Bos taurus; identical to SEQ ID NO: 13277

SEQ ID NO: 94841 - DNA, 201 bp, Bos taurus; identical to SEQ ID NO: 13278

SEQ ID NO: 94842 - DNA, 201 bp, Bos taurus; identical to SEQ ID NO: 13279

SEQ ID NO: 94843 - DNA, 201 bp, Bos taurus; identical to SEQ ID NO: 13280

SEQ ID NO: 94844 - DNA, 201 bp, Bos taurus; identical to SEQ ID NO: 13281

SEQ ID NO: 94845 - DNA, 201 bp, Bos taurus; identical to SEQ ID NO: 13282

SEQ ID NO: 94846 - DNA, 201 bp, Bos taurus; identical to SEQ ID NO: 13283

SEQ ID NO: 94847 - DNA, 201 bp, Bos taurus; identical to SEQ ID NO: 13284

SEQ ID NO: 94848 - DNA, 201 bp, Bos taurus; identical to SEQ ID NO: 13285

SEQ ID NO: 94849 - DNA, 201 bp, Bos taurus; identical to SEQ ID NO: 13286

SEQ ID NO: 94850 - DNA, 201 bp, Bos taurus; identical to SEQ ID NO: 13287

SEQ ID NO: 94851 - DNA, 201 bp, Bos taurus; identical to SEQ ID NO: 13288

SEQ ID NO: 94852 - DNA, 201 bp, Bos taurus; identical to SEQ ID NO: 13289

SEQ ID NO: 94853 - DNA, 201 bp, Bos taurus; identical to SEQ ID NO: 13290

SEQ ID NO: 94854 - DNA, 201 bp, Bos taurus; identical to SEQ ID NO: 13291

SEQ ID NO: 94855 - DNA, 201 bp, Bos taurus; identical to SEQ ID NO: 13292

SEQ ID NO: 94856 - DNA, 201 bp, Bos taurus; identical to SEQ ID NO: 13293

SEQ ID NO: 94857 - DNA, 201 bp, Bos taurus; identical to SEQ ID NO: 13294

SEQ ID NO: 94858 - DNA, 201 bp, Bos taurus; identical to SEQ ID NO: 13295

SEQ ID NO: 94859 - DNA, 201 bp, Bos taurus; identical to SEQ ID NO: 13296

SEQ ID NO: 94860 - DNA, 201 bp, Bos taurus; identical to SEQ ID NO: 13297

SEQ ID NO: 94861 - DNA, 201 bp, Bos taurus; identical to SEQ ID NO: 13298

SEQ ID NO: 94862 - DNA, 201 bp, Bos taurus; identical to SEQ ID NO: 13299

SEQ ID NO: 94863 - DNA, 201 bp, Bos taurus; identical to SEQ ID NO: 13300

SEQ ID NO: 94864 - DNA, 201 bp, Bos taurus; identical to SEQ ID NO: 13301

SEQ ID NO: 94865 - DNA, 201 bp, Bos taurus; identical to SEQ ID NO: 13302

SEQ ID NO: 94866 - DNA, 201 bp, Bos taurus; identical to SEQ ID NO: 13303

SEQ ID NO: 94867 - DNA, 201 bp, Bos taurus; identical to SEQ ID NO: 13304

SEQ ID NO: 94868 - DNA, 201 bp, Bos taurus; identical to SEQ ID NO: 13305

SEQ ID NO: 94869 - DNA, 201 bp, Bos taurus; identical to SEQ ID NO: 54200

SEQ ID NO: 94870 - DNA, 201 bp, Bos taurus; identical to SEQ ID NO: 13306

SEQ ID NO: 94871 - DNA, 201 bp, Bos taurus; identical to SEQ ID NO: 13307

SEQ ID NO: 94872 - DNA, 201 bp, Bos taurus
agattggccaaagtacgagcttagagctttaccacagagccttgaaatgggggtgctttctccctgggtaactgtgtgcttggcgcctcatccgaggaccgctgacggcccgctagagcacactccagagccagacgcaccaggtgtgtgggcgcggggtcttcccaccagatcagaagtctggcggtttattcagaattt

SEQ ID NO: 94873 - DNA, 201 bp, Bos taurus; identical to SEQ ID NO: 13308

SEQ ID NO: 94874 - DNA, 201 bp, Bos taurus; identical to SEQ ID NO: 13310

SEQ ID NO: 94875 - DNA, 201 bp, Bos taurus; identical to SEQ ID NO: 13311

SEQ ID NO: 94876 - DNA, 201 bp, Bos taurus; identical to SEQ ID NO: 13312

SEQ ID NO: 94877 - DNA, 201 bp, Bos taurus; identical to SEQ ID NO: 13313

SEQ ID NO: 94878 - DNA, 201 bp, Bos taurus; identical to SEQ ID NO: 13314

SEQ ID NO: 94879 - DNA, 201 bp, Bos taurus; identical to SEQ ID NO: 13315

SEQ ID NO: 94880 - DNA, 201 bp, Bos taurus; identical to SEQ ID NO: 13316

SEQ ID NO: 94881 - DNA, 201 bp, Bos taurus; identical to SEQ ID NO: 13317

SEQ ID NO: 94882 - DNA, 201 bp, Bos taurus; identical to SEQ ID NO: 13318

SEQ ID NO: 94883 - DNA, 201 bp, Bos taurus; identical to SEQ ID NO: 13319

SEQ ID NO: 94884 - DNA, 201 bp, Bos taurus; identical to SEQ ID NO: 13320

SEQ ID NO: 94885 - DNA, 201 bp, Bos taurus; identical to SEQ ID NO: 13321

SEQ ID NO: 94886 - DNA, 201 bp, Bos taurus; identical to SEQ ID NO: 13322

SEQ ID NO: 94887 - DNA, 201 bp, Bos taurus; identical to SEQ ID NO: 13323

SEQ ID NO: 94888 - DNA, 201 bp, Bos taurus; identical to SEQ ID NO: 13324

SEQ ID NO: 94889 - DNA, 201 bp, Bos taurus; identical to SEQ ID NO: 13325

SEQ ID NO: 94890 - DNA, 201 bp, Bos taurus; identical to SEQ ID NO: 13326

SEQ ID NO: 94891 - DNA, 201 bp, Bos taurus; identical to SEQ ID NO: 13327

SEQ ID NO: 94892 - DNA, 201 bp, Bos taurus; identical to SEQ ID NO: 13329

SEQ ID NO: 94893 - DNA, 201 bp, Bos taurus; identical to SEQ ID NO: 13332

SEQ ID NO: 94894 - DNA, 201 bp, Bos taurus; identical to SEQ ID NO: 13333

SEQ ID NO: 94895 - DNA, 201 bp, Bos taurus; identical to SEQ ID NO: 13334

SEQ ID NO: 94896 - DNA, 201 bp, Bos taurus; identical to SEQ ID NO: 13335

SEQ ID NO: 94897 - DNA, 201 bp, Bos taurus; identical to SEQ ID NO: 13336

SEQ ID NO: 94898 - DNA, 201 bp, Bos taurus
aagcagggatccatgacttcccccatatgttgtcccctgagcccagtgcagggtataactcacaggctgcatctgcaagatggcctggaaatgcttccaaggagaagaacacggtggaagcaggagctctctaaatcacttaggaacagctcattcccaagtaatacaaaactaatgaattaagagagcatgtcggcccct

SEQ ID NO: 94899 - DNA, 201 bp, Bos taurus; identical to SEQ ID NO: 13337

SEQ ID NO: 94900 - DNA, 201 bp, Bos taurus; identical to SEQ ID NO: 13338

SEQ ID NO: 94901 - DNA, 201 bp, Bos taurus
tggtagccgggtgaagggtcactgcattttgactctctgaccacgctctggccattcaccctcccaggctgagggtcacaaagcaaaatggcagggccccagggtaacctcgctacacactccctgggtggagaaagcgtgagggcagagaaagaggggaaaaaagagatggaagatgtggaatgaaggttcagaagattg

SEQ ID NO: 94902 - DNA, 201 bp, Bos taurus; identical to SEQ ID NO: 13340

SEQ ID NO: 94903 - DNA, 201 bp, Bos taurus; identical to SEQ ID NO: 13342

SEQ ID NO: 94904 - DNA, 201 bp, Bos taurus; identical to SEQ ID NO: 13343

SEQ ID NO: 94905 - DNA, 201 bp, Bos taurus; identical to SEQ ID NO: 13344

SEQ ID NO: 94906 - DNA, 201 bp, Bos taurus
tcaagattgttggatattaagacatgatgttttgatagtacctggtgcaatgtctgacgtagagtagtcatttgataagatcatagctgttgatactgctcttggtatgttttcgttagagtccagacaacaggaagagctcgctgggtgtctgtgaaaccctttccccagatgcccagtaggtggcggcagagactcctt

SEQ ID NO: 94907 - DNA, 201 bp, Bos taurus
ccatgggacgctccactctgcctcctctctcctggcctcagagctcctggctggcaaagtagagagatgctggcttccattgccttcccaaaaaaggctggggtcacccctggccaccaaaaggcccagtcgactgaagaaaaccttcagaagtgggtgcccttgctgggggctgggaggacaagagagacttcattttcc

SEQ ID NO: 94908 - DNA, 201 bp, Bos taurus
gcactggccggtggattctctaccactgatccccaccatcatgttcaaattggtaatttcatgtaagaccccagatttctttctggttttctctgatctggctgcccttcttctggccacaggccgagctaggaggctttctcccctctttaggtgggctgtggatcctctggttgccacaggctccaccggtccacctct

SEQ ID NO: 94909 - DNA, 201 bp, Bos taurus
cctacagaatgttccgcaatcggctactttctttcctcttctttttttgaaaaatttattttattgaggtatttgagcttgatttactacgctgtgttaacctgatctacttactttccagttgcatagcctcagttcaggtccttaacctcaaggcactgttgcagaaattaaatctatagtttgtgcaaataaattata

SEQ ID NO: 94910 - DNA, 201 bp, Bos taurus; identical to SEQ ID NO: 13345

SEQ ID NO: 94911 - DNA, 201 bp, Bos taurus; identical to SEQ ID NO: 13347

SEQ ID NO: 94912 - DNA, 201 bp, Bos taurus; identical to SEQ ID NO: 13348

SEQ ID NO: 94913 - DNA, 201 bp, Bos taurus; identical to SEQ ID NO: 13349

SEQ ID NO: 94914 - DNA, 201 bp, Bos taurus
atatattttttcacacctgaaaacttgaagttccctttcaatctagagattcttgctcttcaagtttgggaaatattattttattttgttgatgaagcgcccctcctcttctttatttgtggtactcttgtttgcaagtcagacttcttggactggtctccaagttattttctcttttcttccctgttttctttctttttg

SEQ ID NO: 94915 - DNA, 201 bp, Bos taurus
cacaggggcagacaccccaaagcacaccccagttctgggccctgtgactttgtcaccgcgtgtaaagtccccttggtggggtggagtgctgagtctgtgttttccggggtgcccttcatcctcatctcttctagtctctaggggaatacaggtgggacaggaacagtctctctcactcccaagctccctgagtcccactct

SEQ ID NO: 94916 - DNA, 201 bp, Bos taurus; identical to SEQ ID NO: 13351

SEQ ID NO: 94917 - DNA, 201 bp, Bos taurus; identical to SEQ ID NO: 13352

SEQ ID NO: 94918 - DNA, 201 bp, Bos taurus; identical to SEQ ID NO: 13353

SEQ ID NO: 94919 - DNA, 201 bp, Bos taurus; identical to SEQ ID NO: 13354

SEQ ID NO: 94920 - DNA, 201 bp, Bos taurus; identical to SEQ ID NO: 13355

SEQ ID NO: 94921 - DNA, 201 bp, Bos taurus; identical to SEQ ID NO: 13356

SEQ ID NO: 94922 - DNA, 201 bp, Bos taurus; identical to SEQ ID NO: 13359

SEQ ID NO: 94923 - DNA, 201 bp, Bos taurus; identical to SEQ ID NO: 13360

SEQ ID NO: 94924 - DNA, 201 bp, Bos taurus; identical to SEQ ID NO: 13361

SEQ ID NO: 94925 - DNA, 201 bp, Bos taurus; identical to SEQ ID NO: 13362

SEQ ID NO: 94926 - DNA, 201 bp, Bos taurus; identical to SEQ ID NO: 13363

SEQ ID NO: 94927 - DNA, 201 bp, Bos taurus; identical to SEQ ID NO: 13364

SEQ ID NO: 94928 - DNA, 201 bp, Bos taurus; identical to SEQ ID NO: 13365

SEQ ID NO: 94929 - DNA, 201 bp, Bos taurus
gggccgggggagggctgggaggtgtagcatgtcacctccggctgggtgttcacttccagagagaatctgacactcggggaggaagagcacaaacctctgtaagggccccaggccacactgacttcacaagcctatctcacaaaccacacgaggaaggaaagccatgccatcctcctttcacacactccaaaagaggagtga

SEQ ID NO: 94930 - DNA, 201 bp, Bos taurus; identical to SEQ ID NO: 13366

SEQ ID NO: 94931 - DNA, 201 bp, Bos taurus
gttttgctgacattttgtagacacttcttggctgtaatccctcaattagctgggcatctatcaagtagttttgtgttctgaatatttttctaattaatctctgctgtacaagacgaaatcaaaaaaattttcttcgatcgagatatattacatcgctgacttctcttccatttactgggtctattactctgtcatagaaat

SEQ ID NO: 94932 - DNA, 201 bp, Bos taurus; identical to SEQ ID NO: 13368

SEQ ID NO: 94933 - DNA, 201 bp, Bos taurus; identical to SEQ ID NO: 13369

SEQ ID NO: 94934 - DNA, 201 bp, Bos taurus; identical to SEQ ID NO: 13370

SEQ ID NO: 94935 - DNA, 201 bp, Bos taurus
acctcttatgctaatgctgcggccagcctcatcatcttaccgccagcttgaacccaatgttccttggtggatgggtgatgctggtagtaaagcaaatccagatctgatggaaagtcctaggaggccacatttttacctaacatgggttcttgaacttatcttctgtaaagatgttggtgacaatggcacatcttccaggac

SEQ ID NO: 94936 - DNA, 201 bp, Bos taurus; identical to SEQ ID NO: 13371

SEQ ID NO: 94937 - DNA, 201 bp, Bos taurus
gcaattgtcctgcaataattgtgttttttctattaaaaaaaaaagaatcccacccatctaaatgactggtctaaactgaacccttacagactcctaaaccaacaccccaaaccgtctttgagagacagcaatcaaaattcagaacctacaagggagtactgaggcttctgaggacatgttagaaaacagagcattaaaatc

SEQ ID NO: 94938 - DNA, 201 bp, Bos taurus; identical to SEQ ID NO: 13376

SEQ ID NO: 94939 - DNA, 201 bp, Bos taurus; identical to SEQ ID NO: 13377

SEQ ID NO: 94940 - DNA, 201 bp, Bos taurus; identical to SEQ ID NO: 13378

SEQ ID NO: 94941 - DNA, 201 bp, Bos taurus; identical to SEQ ID NO: 13379

SEQ ID NO: 94942 - DNA, 201 bp, Bos taurus; identical to SEQ ID NO: 13380

SEQ ID NO: 94943 - DNA, 201 bp, Bos taurus; identical to SEQ ID NO: 13381

SEQ ID NO: 94944 - DNA, 201 bp, Bos taurus; identical to SEQ ID NO: 13382

SEQ ID NO: 94945 - DNA, 201 bp, Bos taurus; identical to SEQ ID NO: 13383

SEQ ID NO: 94946 - DNA, 201 bp, Bos taurus; identical to SEQ ID NO: 13384

SEQ ID NO: 94947 - DNA, 201 bp, Bos taurus; identical to SEQ ID NO: 13385

SEQ ID NO: 94948 - DNA, 201 bp, Bos taurus; identical to SEQ ID NO: 13386

SEQ ID NO: 94949 - DNA, 201 bp, Bos taurus; identical to SEQ ID NO: 13388

SEQ ID NO: 94950 - DNA, 201 bp, Bos taurus; identical to SEQ ID NO: 13389

SEQ ID NO: 94951 - DNA, 201 bp, Bos taurus; identical to SEQ ID NO: 13390

SEQ ID NO: 94952 - DNA, 201 bp, Bos taurus; identical to SEQ ID NO: 13391

SEQ ID NO: 94953 - DNA, 201 bp, Bos taurus; identical to SEQ ID NO: 13392

SEQ ID NO: 94954 - DNA, 201 bp, Bos taurus; identical to SEQ ID NO: 13393

SEQ ID NO: 94955 - DNA, 201 bp, Bos taurus; identical to SEQ ID NO: 13395

SEQ ID NO: 94956 - DNA, 201 bp, Bos taurus; identical to SEQ ID NO: 13396

SEQ ID NO: 94957 - DNA, 201 bp, Bos taurus; identical to SEQ ID NO: 13397

SEQ ID NO: 94958 - DNA, 201 bp, Bos taurus; identical to SEQ ID NO: 13398

SEQ ID NO: 94959 - DNA, 201 bp, Bos taurus; identical to SEQ ID NO: 13399

SEQ ID NO: 94960 - DNA, 201 bp, Bos taurus; identical to SEQ ID NO: 13400

SEQ ID NO: 94961 - DNA, 201 bp, Bos taurus; identical to SEQ ID NO: 13401

SEQ ID NO: 94962 - DNA, 201 bp, Bos taurus; identical to SEQ ID NO: 13402

SEQ ID NO: 94963 - DNA, 201 bp, Bos taurus; identical to SEQ ID NO: 13404

SEQ ID NO: 94964 - DNA, 201 bp, Bos taurus; identical to SEQ ID NO: 13405

SEQ ID NO: 94965 - DNA, 201 bp, Bos taurus; identical to SEQ ID NO: 13406

SEQ ID NO: 94966 - DNA, 201 bp, Bos taurus; identical to SEQ ID NO: 13407

SEQ ID NO: 94967 - DNA, 201 bp, Bos taurus; identical to SEQ ID NO: 13408

SEQ ID NO: 94968 - DNA, 201 bp, Bos taurus; identical to SEQ ID NO: 13410

SEQ ID NO: 94969 - DNA, 201 bp, Bos taurus; identical to SEQ ID NO: 13411

SEQ ID NO: 94970 - DNA, 201 bp, Bos taurus; identical to SEQ ID NO: 13413

SEQ ID NO: 94971 - DNA, 201 bp, Bos taurus; identical to SEQ ID NO: 13414

SEQ ID NO: 94972 - DNA, 201 bp, Bos taurus; identical to SEQ ID NO: 13415

SEQ ID NO: 94973 - DNA, 201 bp, Bos taurus; identical to SEQ ID NO: 13416

SEQ ID NO: 94974 - DNA, 201 bp, Bos taurus; identical to SEQ ID NO: 13417

SEQ ID NO: 94975 - DNA, 201 bp, Bos taurus; identical to SEQ ID NO: 13418

SEQ ID NO: 94976 - DNA, 201 bp, Bos taurus; identical to SEQ ID NO: 13419

SEQ ID NO: 94977 - DNA, 201 bp, Bos taurus; identical to SEQ ID NO: 13421

SEQ ID NO: 94978 - DNA, 201 bp, Bos taurus; identical to SEQ ID NO: 13422

SEQ ID NO: 94979 - DNA, 201 bp, Bos taurus; identical to SEQ ID NO: 13423

SEQ ID NO: 94980 - DNA, 201 bp, Bos taurus; identical to SEQ ID NO: 13424

SEQ ID NO: 94981 - DNA, 201 bp, Bos taurus; identical to SEQ ID NO: 13425

SEQ ID NO: 94982 - DNA, 201 bp, Bos taurus; identical to SEQ ID NO: 13426

SEQ ID NO: 94983 - DNA, 201 bp, Bos taurus; identical to SEQ ID NO: 13427

SEQ ID NO: 94984 - DNA, 201 bp, Bos taurus; identical to SEQ ID NO: 13428

SEQ ID NO: 94985 - DNA, 201 bp, Bos taurus; identical to SEQ ID NO: 13429

SEQ ID NO: 94986 - DNA, 201 bp, Bos taurus
cctatggtgatggttgaaaatttggacatctatctattgaacaaattatgaaatcttttcctttgtcttccaatatatgaacttctaatctccttgtcatcccttaaatcacttttattaggtttgcatacgcatcatttcagagaaggcaatggcaacccactccagtactcttgcctggaaaatcccatggacggagga

SEQ ID NO: 94987 - DNA, 201 bp, Bos taurus; identical to SEQ ID NO: 13430

SEQ ID NO: 94988 - DNA, 201 bp, Bos taurus; identical to SEQ ID NO: 13431

SEQ ID NO: 94989 - DNA, 201 bp, Bos taurus; identical to SEQ ID NO: 13432

SEQ ID NO: 94990 - DNA, 201 bp, Bos taurus; identical to SEQ ID NO: 13433

SEQ ID NO: 94991 - DNA, 201 bp, Bos taurus; identical to SEQ ID NO: 13434

SEQ ID NO: 94992 - DNA, 201 bp, Bos taurus; identical to SEQ ID NO: 13435

SEQ ID NO: 94993 - DNA, 201 bp, Bos taurus; identical to SEQ ID NO: 13436

SEQ ID NO: 94994 - DNA, 201 bp, Bos taurus; identical to SEQ ID NO: 13437

SEQ ID NO: 94995 - DNA, 201 bp, Bos taurus; identical to SEQ ID NO: 13438

SEQ ID NO: 94996 - DNA, 201 bp, Bos taurus; identical to SEQ ID NO: 13439

SEQ ID NO: 94997 - DNA, 201 bp, Bos taurus; identical to SEQ ID NO: 13440

SEQ ID NO: 94998 - DNA, 201 bp, Bos taurus; identical to SEQ ID NO: 13441

SEQ ID NO: 94999 - DNA, 201 bp, Bos taurus; identical to SEQ ID NO: 13442

SEQ ID NO: 95000 - DNA, 201 bp, Bos taurus; identical to SEQ ID NO: 13443

SEQ ID NO: 95001 - DNA, 201 bp, Bos taurus; identical to SEQ ID NO: 13444

SEQ ID NO: 95002 - DNA, 201 bp, Bos taurus; identical to SEQ ID NO: 13445

SEQ ID NO: 95003 - DNA, 201 bp, Bos taurus; identical to SEQ ID NO: 13446

SEQ ID NO: 95004 - DNA, 201 bp, Bos taurus; identical to SEQ ID NO: 13447

SEQ ID NO: 95005 - DNA, 201 bp, Bos taurus; identical to SEQ ID NO: 13448

SEQ ID NO: 95006 - DNA, 201 bp, Bos taurus; identical to SEQ ID NO: 13449

SEQ ID NO: 95007 - DNA, 201 bp, Bos taurus; identical to SEQ ID NO: 13450

SEQ ID NO: 95008 - DNA, 201 bp, Bos taurus; identical to SEQ ID NO: 13451

SEQ ID NO: 95009 - DNA, 201 bp, Bos taurus; identical to SEQ ID NO: 13452

SEQ ID NO: 95010 - DNA, 201 bp, Bos taurus; identical to SEQ ID NO: 13453

SEQ ID NO: 95011 - DNA, 201 bp, Bos taurus; identical to SEQ ID NO: 13454

SEQ ID NO: 95012 - DNA, 201 bp, Bos taurus; identical to SEQ ID NO: 13455

SEQ ID NO: 95013 - DNA, 201 bp, Bos taurus; identical to SEQ ID NO: 13457

SEQ ID NO: 95014 - DNA, 201 bp, Bos taurus; identical to SEQ ID NO: 13458

SEQ ID NO: 95015 - DNA, 201 bp, Bos taurus; identical to SEQ ID NO: 13459

SEQ ID NO: 95016 - DNA, 201 bp, Bos taurus; identical to SEQ ID NO: 13460

SEQ ID NO: 95017 - DNA, 201 bp, Bos taurus; identical to SEQ ID NO: 13461

SEQ ID NO: 95018 - DNA, 201 bp, Bos taurus; identical to SEQ ID NO: 13462

SEQ ID NO: 95019 - DNA, 201 bp, Bos taurus; identical to SEQ ID NO: 13463

SEQ ID NO: 95020 - DNA, 201 bp, Bos taurus; identical to SEQ ID NO: 13465

SEQ ID NO: 95021 - DNA, 201 bp, Bos taurus; identical to SEQ ID NO: 13466

SEQ ID NO: 95022 - DNA, 201 bp, Bos taurus; identical to SEQ ID NO: 13467

SEQ ID NO: 95023 - DNA, 201 bp, Bos taurus; identical to SEQ ID NO: 13468

SEQ ID NO: 95024 - DNA, 201 bp, Bos taurus; identical to SEQ ID NO: 13469

SEQ ID NO: 95025 - DNA, 201 bp, Bos taurus; identical to SEQ ID NO: 13470

SEQ ID NO: 95026 - DNA, 201 bp, Bos taurus; identical to SEQ ID NO: 13471

SEQ ID NO: 95027 - DNA, 201 bp, Bos taurus; identical to SEQ ID NO: 13472

SEQ ID NO: 95028 - DNA, 201 bp, Bos taurus; identical to SEQ ID NO: 13473

SEQ ID NO: 95029 - DNA, 201 bp, Bos taurus; identical to SEQ ID NO: 13474

SEQ ID NO: 95030 - DNA, 201 bp, Bos taurus; identical to SEQ ID NO: 13475

SEQ ID NO: 95031 - DNA, 201 bp, Bos taurus; identical to SEQ ID NO: 13476

SEQ ID NO: 95032 - DNA, 201 bp, Bos taurus; identical to SEQ ID NO: 13477

SEQ ID NO: 95033 - DNA, 201 bp, Bos taurus; identical to SEQ ID NO: 13478

SEQ ID NO: 95034 - DNA, 201 bp, Bos taurus; identical to SEQ ID NO: 13479

SEQ ID NO: 95035 - DNA, 201 bp, Bos taurus; identical to SEQ ID NO: 13480

SEQ ID NO: 95036 - DNA, 201 bp, Bos taurus; identical to SEQ ID NO: 13481

SEQ ID NO: 95037 - DNA, 201 bp, Bos taurus; identical to SEQ ID NO: 13482

SEQ ID NO: 95038 - DNA, 201 bp, Bos taurus; identical to SEQ ID NO: 13483

SEQ ID NO: 95039 - DNA, 201 bp, Bos taurus; identical to SEQ ID NO: 13484

SEQ ID NO: 95040 - DNA, 201 bp, Bos taurus; identical to SEQ ID NO: 13485

SEQ ID NO: 95041 - DNA, 201 bp, Bos taurus; identical to SEQ ID NO: 13486

SEQ ID NO: 95042 - DNA, 201 bp, Bos taurus; identical to SEQ ID NO: 13487

SEQ ID NO: 95043 - DNA, 201 bp, Bos taurus; identical to SEQ ID NO: 13488

SEQ ID NO: 95044 - DNA, 201 bp, Bos taurus; identical to SEQ ID NO: 13489

SEQ ID NO: 95045 - DNA, 201 bp, Bos taurus; identical to SEQ ID NO: 13490

SEQ ID NO: 95046 - DNA, 201 bp, Bos taurus; identical to SEQ ID NO: 13491

SEQ ID NO: 95047 - DNA, 201 bp, Bos taurus; identical to SEQ ID NO: 13492

SEQ ID NO: 95048 - DNA, 201 bp, Bos taurus; identical to SEQ ID NO: 13493

SEQ ID NO: 95049 - DNA, 201 bp, Bos taurus; identical to SEQ ID NO: 13494

SEQ ID NO: 95050 - DNA, 201 bp, Bos taurus; identical to SEQ ID NO: 13495

SEQ ID NO: 95051 - DNA, 201 bp, Bos taurus; identical to SEQ ID NO: 13496

SEQ ID NO: 95052 - DNA, 201 bp, Bos taurus; identical to SEQ ID NO: 13497

SEQ ID NO: 95053 - DNA, 201 bp, Bos taurus; identical to SEQ ID NO: 13498

SEQ ID NO: 95054 - DNA, 201 bp, Bos taurus; identical to SEQ ID NO: 13499

SEQ ID NO: 95055 - DNA, 201 bp, Bos taurus; identical to SEQ ID NO: 13500

SEQ ID NO: 95056 - DNA, 201 bp, Bos taurus; identical to SEQ ID NO: 13501

SEQ ID NO: 95057 - DNA, 201 bp, Bos taurus; identical to SEQ ID NO: 13502

SEQ ID NO: 95058 - DNA, 201 bp, Bos taurus; identical to SEQ ID NO: 13503

SEQ ID NO: 95059 - DNA, 201 bp, Bos taurus; identical to SEQ ID NO: 13504

SEQ ID NO: 95060 - DNA, 201 bp, Bos taurus; identical to SEQ ID NO: 13505

SEQ ID NO: 95061 - DNA, 201 bp, Bos taurus; identical to SEQ ID NO: 13506

SEQ ID NO: 95062 - DNA, 201 bp, Bos taurus; identical to SEQ ID NO: 13507

SEQ ID NO: 95063 - DNA, 201 bp, Bos taurus; identical to SEQ ID NO: 13508

SEQ ID NO: 95064 - DNA, 201 bp, Bos taurus; identical to SEQ ID NO: 13509

SEQ ID NO: 95065 - DNA, 201 bp, Bos taurus; identical to SEQ ID NO: 13510

SEQ ID NO: 95066 - DNA, 201 bp, Bos taurus; identical to SEQ ID NO: 13511

SEQ ID NO: 95067 - DNA, 201 bp, Bos taurus; identical to SEQ ID NO: 13512

SEQ ID NO: 95068 - DNA, 201 bp, Bos taurus; identical to SEQ ID NO: 13513

SEQ ID NO: 95069 - DNA, 201 bp, Bos taurus; identical to SEQ ID NO: 13514

SEQ ID NO: 95070 - DNA, 201 bp, Bos taurus; identical to SEQ ID NO: 13515

SEQ ID NO: 95071 - DNA, 201 bp, Bos taurus; identical to SEQ ID NO: 54395

SEQ ID NO: 95072 - DNA, 201 bp, Bos taurus; identical to SEQ ID NO: 13516

SEQ ID NO: 95073 - DNA, 201 bp, Bos taurus; identical to SEQ ID NO: 13517

SEQ ID NO: 95074 - DNA, 201 bp, Bos taurus; identical to SEQ ID NO: 13518

SEQ ID NO: 95075 - DNA, 201 bp, Bos taurus; identical to SEQ ID NO: 13519

SEQ ID NO: 95076 - DNA, 201 bp, Bos taurus; identical to SEQ ID NO: 13520

SEQ ID NO: 95077 - DNA, 201 bp, Bos taurus; identical to SEQ ID NO: 13521

SEQ ID NO: 95078 - DNA, 201 bp, Bos taurus; identical to SEQ ID NO: 13522

SEQ ID NO: 95079 - DNA, 201 bp, Bos taurus; identical to SEQ ID NO: 13523

SEQ ID NO: 95080 - DNA, 201 bp, Bos taurus; identical to SEQ ID NO: 13524

SEQ ID NO: 95081 - DNA, 201 bp, Bos taurus; identical to SEQ ID NO: 13525

SEQ ID NO: 95082 - DNA, 201 bp, Bos taurus; identical to SEQ ID NO: 13526

SEQ ID NO: 95083 - DNA, 201 bp, Bos taurus; identical to SEQ ID NO: 13527

SEQ ID NO: 95084 - DNA, 201 bp, Bos taurus; identical to SEQ ID NO: 13528

SEQ ID NO: 95085 - DNA, 201 bp, Bos taurus; identical to SEQ ID NO: 13529

SEQ ID NO: 95086 - DNA, 201 bp, Bos taurus; identical to SEQ ID NO: 13530

SEQ ID NO: 95087 - DNA, 201 bp, Bos taurus; identical to SEQ ID NO: 13531

SEQ ID NO: 95088 - DNA, 201 bp, Bos taurus; identical to SEQ ID NO: 13532

SEQ ID NO: 95089 - DNA, 201 bp, Bos taurus; identical to SEQ ID NO: 13533

SEQ ID NO: 95090 - DNA, 201 bp, Bos taurus; identical to SEQ ID NO: 13534

SEQ ID NO: 95091 - DNA, 201 bp, Bos taurus; identical to SEQ ID NO: 13535

SEQ ID NO: 95092 - DNA, 201 bp, Bos taurus; identical to SEQ ID NO: 13536

SEQ ID NO: 95093 - DNA, 201 bp, Bos taurus; identical to SEQ ID NO: 13537

SEQ ID NO: 95094 - DNA, 201 bp, Bos taurus; identical to SEQ ID NO: 13538

SEQ ID NO: 95095 - DNA, 201 bp, Bos taurus; identical to SEQ ID NO: 13539

SEQ ID NO: 95096 - DNA, 201 bp, Bos taurus; identical to SEQ ID NO: 13540

SEQ ID NO: 95097 - DNA, 201 bp, Bos taurus; identical to SEQ ID NO: 13541

SEQ ID NO: 95098 - DNA, 201 bp, Bos taurus; identical to SEQ ID NO: 13542

SEQ ID NO: 95099 - DNA, 201 bp, Bos taurus; identical to SEQ ID NO: 13543

SEQ ID NO: 95100 - DNA, 201 bp, Bos taurus; identical to SEQ ID NO: 13544

SEQ ID NO: 95101 - DNA, 201 bp, Bos taurus; identical to SEQ ID NO: 13545

SEQ ID NO: 95102 - DNA, 201 bp, Bos taurus; identical to SEQ ID NO: 13547

SEQ ID NO: 95103 - DNA, 201 bp, Bos taurus; identical to SEQ ID NO: 13548

SEQ ID NO: 95104 - DNA, 201 bp, Bos taurus; identical to SEQ ID NO: 13549

SEQ ID NO: 95105 - DNA, 201 bp, Bos taurus; identical to SEQ ID NO: 13550

SEQ ID NO: 95106 - DNA, 201 bp, Bos taurus; identical to SEQ ID NO: 13551

SEQ ID NO: 95107 - DNA, 201 bp, Bos taurus; identical to SEQ ID NO: 13552

SEQ ID NO: 95108 - DNA, 201 bp, Bos taurus; identical to SEQ ID NO: 13553

SEQ ID NO: 95109 - DNA, 201 bp, Bos taurus; identical to SEQ ID NO: 13554

SEQ ID NO: 95110 - DNA, 201 bp, Bos taurus; identical to SEQ ID NO: 13555

SEQ ID NO: 95111 - DNA, 201 bp, Bos taurus; identical to SEQ ID NO: 13556

SEQ ID NO: 95112 - DNA, 201 bp, Bos taurus; identical to SEQ ID NO: 13557

SEQ ID NO: 95113 - DNA, 201 bp, Bos taurus; identical to SEQ ID NO: 13558

SEQ ID NO: 95114 - DNA, 201 bp, Bos taurus; identical to SEQ ID NO: 13559

SEQ ID NO: 95115 - DNA, 201 bp, Bos taurus; identical to SEQ ID NO: 13560

SEQ ID NO: 95116 - DNA, 201 bp, Bos taurus; identical to SEQ ID NO: 13561

SEQ ID NO: 95117 - DNA, 201 bp, Bos taurus; identical to SEQ ID NO: 13562

SEQ ID NO: 95118 - DNA, 201 bp, Bos taurus; identical to SEQ ID NO: 13563

SEQ ID NO: 95119 - DNA, 201 bp, Bos taurus; identical to SEQ ID NO: 13564

SEQ ID NO: 95120 - DNA, 201 bp, Bos taurus; identical to SEQ ID NO: 13565

SEQ ID NO: 95121 - DNA, 201 bp, Bos taurus; identical to SEQ ID NO: 13566

SEQ ID NO: 95122 - DNA, 201 bp, Bos taurus; identical to SEQ ID NO: 13567

SEQ ID NO: 95123 - DNA, 201 bp, Bos taurus; identical to SEQ ID NO: 13568

SEQ ID NO: 95124 - DNA, 201 bp, Bos taurus; identical to SEQ ID NO: 13569

SEQ ID NO: 95125 - DNA, 201 bp, Bos taurus; identical to SEQ ID NO: 13570

SEQ ID NO: 95126 - DNA, 201 bp, Bos taurus; identical to SEQ ID NO: 13571

SEQ ID NO: 95127 - DNA, 201 bp, Bos taurus; identical to SEQ ID NO: 13572

SEQ ID NO: 95128 - DNA, 201 bp, Bos taurus; identical to SEQ ID NO: 13573

SEQ ID NO: 95129 - DNA, 201 bp, Bos taurus; identical to SEQ ID NO: 13574

SEQ ID NO: 95130 - DNA, 201 bp, Bos taurus; identical to SEQ ID NO: 13575

SEQ ID NO: 95131 - DNA, 201 bp, Bos taurus; identical to SEQ ID NO: 13576

SEQ ID NO: 95132 - DNA, 201 bp, Bos taurus; identical to SEQ ID NO: 13577

SEQ ID NO: 95133 - DNA, 201 bp, Bos taurus; identical to SEQ ID NO: 13578

SEQ ID NO: 95134 - DNA, 201 bp, Bos taurus; identical to SEQ ID NO: 13579

SEQ ID NO: 95135 - DNA, 201 bp, Bos taurus; identical to SEQ ID NO: 13580

SEQ ID NO: 95136 - DNA, 201 bp, Bos taurus; identical to SEQ ID NO: 13581

SEQ ID NO: 95137 - DNA, 201 bp, Bos taurus; identical to SEQ ID NO: 13582

SEQ ID NO: 95138 - DNA, 201 bp, Bos taurus; identical to SEQ ID NO: 13583

SEQ ID NO: 95139 - DNA, 201 bp, Bos taurus; identical to SEQ ID NO: 13584

SEQ ID NO: 95140 - DNA, 201 bp, Bos taurus; identical to SEQ ID NO: 13585

SEQ ID NO: 95141 - DNA, 201 bp, Bos taurus; identical to SEQ ID NO: 13586

SEQ ID NO: 95142 - DNA, 201 bp, Bos taurus; identical to SEQ ID NO: 13588

SEQ ID NO: 95143 - DNA, 201 bp, Bos taurus; identical to SEQ ID NO: 13589

SEQ ID NO: 95144 - DNA, 201 bp, Bos taurus; identical to SEQ ID NO: 13590

SEQ ID NO: 95145 - DNA, 201 bp, Bos taurus; identical to SEQ ID NO: 13591

SEQ ID NO: 95146 - DNA, 201 bp, Bos taurus; identical to SEQ ID NO: 13592

SEQ ID NO: 95147 - DNA, 201 bp, Bos taurus; identical to SEQ ID NO: 13593

SEQ ID NO: 95148 - DNA, 201 bp, Bos taurus; identical to SEQ ID NO: 13594

SEQ ID NO: 95149 - DNA, 201 bp, Bos taurus; identical to SEQ ID NO: 13595

SEQ ID NO: 95150 - DNA, 201 bp, Bos taurus; identical to SEQ ID NO: 13596

SEQ ID NO: 95151 - DNA, 201 bp, Bos taurus; identical to SEQ ID NO: 13597

SEQ ID NO: 95152 - DNA, 201 bp, Bos taurus; identical to SEQ ID NO: 13598

SEQ ID NO: 95153 - DNA, 201 bp, Bos taurus; identical to SEQ ID NO: 13600

SEQ ID NO: 95154 - DNA, 201 bp, Bos taurus; identical to SEQ ID NO: 13601

SEQ ID NO: 95155 - DNA, 201 bp, Bos taurus; identical to SEQ ID NO: 13602

SEQ ID NO: 95156 - DNA, 201 bp, Bos taurus; identical to SEQ ID NO: 13603

SEQ ID NO: 95157 - DNA, 201 bp, Bos taurus; identical to SEQ ID NO: 13604

SEQ ID NO: 95158 - DNA, 201 bp, Bos taurus; identical to SEQ ID NO: 13605

SEQ ID NO: 95159 - DNA, 201 bp, Bos taurus; identical to SEQ ID NO: 13606

SEQ ID NO: 95160 - DNA, 201 bp, Bos taurus; identical to SEQ ID NO: 13607

SEQ ID NO: 95161 - DNA, 201 bp, Bos taurus; identical to SEQ ID NO: 13608

SEQ ID NO: 95162 - DNA, 201 bp, Bos taurus; identical to SEQ ID NO: 13609

SEQ ID NO: 95163 - DNA, 201 bp, Bos taurus; identical to SEQ ID NO: 13610

SEQ ID NO: 95164 - DNA, 201 bp, Bos taurus; identical to SEQ ID NO: 13611

SEQ ID NO: 95165 - DNA, 201 bp, Bos taurus; identical to SEQ ID NO: 13612

SEQ ID NO: 95166 - DNA, 201 bp, Bos taurus; identical to SEQ ID NO: 13613

SEQ ID NO: 95167 - DNA, 201 bp, Bos taurus; identical to SEQ ID NO: 13614

SEQ ID NO: 95168 - DNA, 201 bp, Bos taurus; identical to SEQ ID NO: 13615

SEQ ID NO: 95169 - DNA, 201 bp, Bos taurus; identical to SEQ ID NO: 13616

SEQ ID NO: 95170 - DNA, 201 bp, Bos taurus; identical to SEQ ID NO: 13617

SEQ ID NO: 95171 - DNA, 201 bp, Bos taurus; identical to SEQ ID NO: 13618

SEQ ID NO: 95172 - DNA, 201 bp, Bos taurus; identical to SEQ ID NO: 13619

SEQ ID NO: 95173 - DNA, 201 bp, Bos taurus; identical to SEQ ID NO: 13620

SEQ ID NO: 95174 - DNA, 201 bp, Bos taurus; identical to SEQ ID NO: 13621

SEQ ID NO: 95175 - DNA, 201 bp, Bos taurus; identical to SEQ ID NO: 13622

SEQ ID NO: 95176 - DNA, 201 bp, Bos taurus; identical to SEQ ID NO: 13623

SEQ ID NO: 95177 - DNA, 201 bp, Bos taurus; identical to SEQ ID NO: 13624

SEQ ID NO: 95178 - DNA, 201 bp, Bos taurus; identical to SEQ ID NO: 13625

SEQ ID NO: 95179 - DNA, 201 bp, Bos taurus; identical to SEQ ID NO: 13626

SEQ ID NO: 95180 - DNA, 201 bp, Bos taurus; identical to SEQ ID NO: 13627

SEQ ID NO: 95181 - DNA, 201 bp, Bos taurus; identical to SEQ ID NO: 13628

SEQ ID NO: 95182 - DNA, 201 bp, Bos taurus; identical to SEQ ID NO: 13629

SEQ ID NO: 95183 - DNA, 201 bp, Bos taurus; identical to SEQ ID NO: 13630

SEQ ID NO: 95184 - DNA, 201 bp, Bos taurus; identical to SEQ ID NO: 13631

SEQ ID NO: 95185 - DNA, 201 bp, Bos taurus; identical to SEQ ID NO: 13632

SEQ ID NO: 95186 - DNA, 201 bp, Bos taurus; identical to SEQ ID NO: 13634

SEQ ID NO: 95187 - DNA, 201 bp, Bos taurus; identical to SEQ ID NO: 13635

SEQ ID NO: 95188 - DNA, 201 bp, Bos taurus; identical to SEQ ID NO: 13637

SEQ ID NO: 95189 - DNA, 201 bp, Bos taurus; identical to SEQ ID NO: 13638

SEQ ID NO: 95190 - DNA, 201 bp, Bos taurus; identical to SEQ ID NO: 13639

SEQ ID NO: 95191 - DNA, 201 bp, Bos taurus; identical to SEQ ID NO: 13640

SEQ ID NO: 95192 - DNA, 201 bp, Bos taurus; identical to SEQ ID NO: 13641

SEQ ID NO: 95193 - DNA, 201 bp, Bos taurus; identical to SEQ ID NO: 13643

SEQ ID NO: 95194 - DNA, 201 bp, Bos taurus; identical to SEQ ID NO: 54513

SEQ ID NO: 95195 - DNA, 201 bp, Bos taurus; identical to SEQ ID NO: 13644

SEQ ID NO: 95196 - DNA, 201 bp, Bos taurus; identical to SEQ ID NO: 13645

SEQ ID NO: 95197 - DNA, 201 bp, Bos taurus; identical to SEQ ID NO: 13646

SEQ ID NO: 95198 - DNA, 201 bp, Bos taurus; identical to SEQ ID NO: 13648

SEQ ID NO: 95199 - DNA, 201 bp, Bos taurus; identical to SEQ ID NO: 13649

SEQ ID NO: 95200 - DNA, 201 bp, Bos taurus; identical to SEQ ID NO: 13650

SEQ ID NO: 95201 - DNA, 201 bp, Bos taurus; identical to SEQ ID NO: 13655

SEQ ID NO: 95202 - DNA, 201 bp, Bos taurus; identical to SEQ ID NO: 13656

SEQ ID NO: 95203 - DNA, 201 bp, Bos taurus; identical to SEQ ID NO: 13657

SEQ ID NO: 95204 - DNA, 201 bp, Bos taurus; identical to SEQ ID NO: 13658

SEQ ID NO: 95205 - DNA, 201 bp, Bos taurus; identical to SEQ ID NO: 13659

SEQ ID NO: 95206 - DNA, 201 bp, Bos taurus; identical to SEQ ID NO: 13660

SEQ ID NO: 95207 - DNA, 201 bp, Bos taurus; identical to SEQ ID NO: 13661

SEQ ID NO: 95208 - DNA, 201 bp, Bos taurus; identical to SEQ ID NO: 13662

SEQ ID NO: 95209 - DNA, 201 bp, Bos taurus; identical to SEQ ID NO: 13663

SEQ ID NO: 95210 - DNA, 201 bp, Bos taurus; identical to SEQ ID NO: 13665

SEQ ID NO: 95211 - DNA, 201 bp, Bos taurus; identical to SEQ ID NO: 13667

SEQ ID NO: 95212 - DNA, 201 bp, Bos taurus; identical to SEQ ID NO: 13668

SEQ ID NO: 95213 - DNA, 201 bp, Bos taurus
accctgggtgcagcagacctgggtatggcataagccctcttggaggaggtcaccattaaccacaccgtagagctgctggaactacccaagactgtggaaatagactcctggtgggcataaacaaaaccttgtgcacaccaggacccaggtgaaaggaacagtgaccccacaagaaactgacccagacttgcccatgtgtgt

SEQ ID NO: 95214 - DNA, 201 bp, Bos taurus; identical to SEQ ID NO: 13669

SEQ ID NO: 95215 - DNA, 201 bp, Bos taurus; identical to SEQ ID NO: 13672

SEQ ID NO: 95216 - DNA, 201 bp, Bos taurus; identical to SEQ ID NO: 13676

SEQ ID NO: 95217 - DNA, 201 bp, Bos taurus; identical to SEQ ID NO: 13678

SEQ ID NO: 95218 - DNA, 201 bp, Bos taurus; identical to SEQ ID NO: 13679

SEQ ID NO: 95219 - DNA, 201 bp, Bos taurus; identical to SEQ ID NO: 13680

SEQ ID NO: 95220 - DNA, 201 bp, Bos taurus; identical to SEQ ID NO: 13681

SEQ ID NO: 95221 - DNA, 201 bp, Bos taurus; identical to SEQ ID NO: 13683

SEQ ID NO: 95222 - DNA, 201 bp, Bos taurus; identical to SEQ ID NO: 13684

SEQ ID NO: 95223 - DNA, 201 bp, Bos taurus; identical to SEQ ID NO: 13685

SEQ ID NO: 95224 - DNA, 201 bp, Bos taurus; identical to SEQ ID NO: 13686

SEQ ID NO: 95225 - DNA, 201 bp, Bos taurus; identical to SEQ ID NO: 13688

SEQ ID NO: 95226 - DNA, 201 bp, Bos taurus; identical to SEQ ID NO: 13689

SEQ ID NO: 95227 - DNA, 201 bp, Bos taurus; identical to SEQ ID NO: 13690

SEQ ID NO: 95228 - DNA, 201 bp, Bos taurus; identical to SEQ ID NO: 13691

SEQ ID NO: 95229 - DNA, 201 bp, Bos taurus; identical to SEQ ID NO: 13692

SEQ ID NO: 95230 - DNA, 201 bp, Bos taurus; identical to SEQ ID NO: 13693

SEQ ID NO: 95231 - DNA, 201 bp, Bos taurus
acctcttggttccatattgactcctgtttttttattcatttgatggtaatttattccttctatgagataagaaaacataggataacctcacttagaatagacagtttcaaaattttaaaaacaacaacaacaaaatctgttaagactttataaaacttgtcttatgatttataacctgctcctcggtaggtgatattttca

SEQ ID NO: 95232 - DNA, 201 bp, Bos taurus; identical to SEQ ID NO: 13694

SEQ ID NO: 95233 - DNA, 201 bp, Bos taurus; identical to SEQ ID NO: 13695

SEQ ID NO: 95234 - DNA, 201 bp, Bos taurus; identical to SEQ ID NO: 13696

SEQ ID NO: 95235 - DNA, 201 bp, Bos taurus; identical to SEQ ID NO: 13697

SEQ ID NO: 95236 - DNA, 201 bp, Bos taurus; identical to SEQ ID NO: 13699

SEQ ID NO: 95237 - DNA, 201 bp, Bos taurus
gttaatatggaagcaaggcagagatgcatatccgaagataaaggatgtgcacatccccattaatgttgaggagtataggaaagaggtggttaaatcattttatagggcagttcttccaggcctttgtttacctttggccaattatctggcttctttttccaatctgacctgtgctaggatcctctctgatatgtgtgcaca

SEQ ID NO: 95238 - DNA, 201 bp, Bos taurus; identical to SEQ ID NO: 13700

SEQ ID NO: 95239 - DNA, 201 bp, Bos taurus; identical to SEQ ID NO: 13702

SEQ ID NO: 95240 - DNA, 201 bp, Bos taurus
tgatttctctgctctatctaaatactcaactcagagcctgaccttcagatgtttatcagagtacacattctcctggaaaatccacagtttgcttttctgcatattaagttttcatctaataccaagccaggcttcccaggtagtcctagtggtaaagaatccgtctgccagtgcaggagacacaagagatgtgggttctat

SEQ ID NO: 95241 - DNA, 201 bp, Bos taurus
cttacaagatgaagaaggaatgctgcatttgaggagttgtcttgttgatgctgggagaatgttgcttttcatttaaagtgggtattcttgctgatggggaggtttggatgatgcataaagcagacacgcaatgcagggagaggggggagaggatgccaaagggcagagatttttatgtttaaatttttcttggctttctat

SEQ ID NO: 95242 - DNA, 201 bp, Bos taurus
gttccagttctaactgttgcttcctgacctgcatacaggtttctcagagacaggtctgataactctccttctcagtagcaatgatatcatcatatcctattgacatgaataaaattaataacatctgttcagatgaattgctttgtgtatagttctcttgaaaaaagtcatagattagtgttctgtgttagtcagctgaac

SEQ ID NO: 95243 - DNA, 201 bp, Bos taurus
tggtataggtttatttaagttgttataagcactcagataaaagagggccaattctttaaaggtggagaacagtagggaaatattttcatgcgagatttgtgttaagcatgcgtgaatacttcccatatactcaggaaagtaaacgtgagtcccaggctctatacccaattgaagtgcccttcatatatggagatcacagac

SEQ ID NO: 95244 - DNA, 201 bp, Bos taurus; identical to SEQ ID NO: 13706

SEQ ID NO: 95245 - DNA, 201 bp, Bos taurus; identical to SEQ ID NO: 13707

SEQ ID NO: 95246 - DNA, 201 bp, Bos taurus; identical to SEQ ID NO: 13709

SEQ ID NO: 95247 - DNA, 201 bp, Bos taurus
ggatctcctgcactgcaggcagattactatatgagccaccagagagtcaggggatctaggtaaaaggcaaaattcagaaatcgtgcaggtagcatctagtcttcggcaagcctctgttggctgcagctggatcttgccactagcagtgagctcaggacctggcctcccagtcacaaggaggactggcaagatctaggaagg

SEQ ID NO: 95248 - DNA, 201 bp, Bos taurus; identical to SEQ ID NO: 13710

SEQ ID NO: 95249 - DNA, 201 bp, Bos taurus; identical to SEQ ID NO: 13713

SEQ ID NO: 95250 - DNA, 201 bp, Bos taurus; identical to SEQ ID NO: 13714

SEQ ID NO: 95251 - DNA, 201 bp, Bos taurus; identical to SEQ ID NO: 13715

SEQ ID NO: 95252 - DNA, 201 bp, Bos taurus; identical to SEQ ID NO: 13716

SEQ ID NO: 95253 - DNA, 201 bp, Bos taurus
acacctcatttgccctgactctgaaggagtgaggttgatcagcttatgttccttcttgttctaaattataattcatggcctcttccaagatgtcattgaacggattcttcccttgaagagggcacatgttttaaagggaagagaactataggaaatcaggctctgccctgaactagctgagaaaatagggatctccctttc

SEQ ID NO: 95254 - DNA, 201 bp, Bos taurus
attacttactactgcctaaatatttttcatcttagtctctacaactgatactttcaatttaattctatttgttgattgagtatctgctatgaagtagatgttatgtaaagctctgggggctacagtgattgcaaaatcttccaggattttggaggaatctggcaggtaatgatgactataatataaaaaatggtgtggtaa

SEQ ID NO: 95255 - DNA, 201 bp, Bos taurus; identical to SEQ ID NO: 13718

SEQ ID NO: 95256 - DNA, 201 bp, Bos taurus; identical to SEQ ID NO: 13719

SEQ ID NO: 95257 - DNA, 201 bp, Bos taurus; identical to SEQ ID NO: 13721

SEQ ID NO: 95258 - DNA, 201 bp, Bos taurus
cataggaatttcttgcaacttcttgatggacttgctgggcaacttcaaacaactcttgttaacaacttaatcagtagttcgtaagtataaaacagaaatacagcacgcaggttaagaacaggaatttttgccaggggtccccaacctccaggatctaatacctgctgatctgaggtggagctcatgtaacaataatagaaa

SEQ ID NO: 95259 - DNA, 201 bp, Bos taurus
aaactagcatttgccatggtggattcaggagagcagtgtgccctcctcaatgcgggtgggccgtcatccaacccattgaggacctgaacagaacaaaagggcagaagaaagcaaaatttggcctttcctgcctcattttttgagctgggatgtagccagctgcaactcctggttctcaggtctttagacctggactgacct

SEQ ID NO: 95260 - DNA, 201 bp, Bos taurus
tggagactgaatgaagactatttcctataatcaagaaatgggggacaagaaaaccttttgtgccccaggagccccatgggggtcctgcttggtatcaatatgaatcctgatgatctagtattttatcttcctggtgaaaaagtttttatctcaagacattatctgaaaatgtgggtaagacgtctcatgaaaacaaattat

SEQ ID NO: 95261 - DNA, 201 bp, Bos taurus; identical to SEQ ID NO: 13723

SEQ ID NO: 95262 - DNA, 201 bp, Bos taurus; identical to SEQ ID NO: 13724

SEQ ID NO: 95263 - DNA, 201 bp, Bos taurus; identical to SEQ ID NO: 13725

SEQ ID NO: 95264 - DNA, 201 bp, Bos taurus; identical to SEQ ID NO: 13726

SEQ ID NO: 95265 - DNA, 201 bp, Bos taurus
ccatccaatcacaccagtccagtgatactctctcattcagatcaccctcttgccacagagcattgaacctaagtgtgatagggattcggcaaagaaagaggtaaaataggtgcaaaaaaccatcatgctggggagagacttgaactgaacccagtcatagggaggaacccaacccctaaggaggattgaccgccctagaaa

SEQ ID NO: 95266 - DNA, 201 bp, Bos taurus
gtctcccttgcctgagcacgaagtctaacgttctttgcaagttctgaggtgcacctcttccccttcaacccccactttccacacaaggccaaaagcattcgtgtttccctcagcaagccctgtcctgcctccacacccttacctgtgctgtggcattcacctggagccctaacacgtacctgtccagctctgctgaattca

SEQ ID NO: 95267 - DNA, 201 bp, Bos taurus
gaatcgaaggacgcagttggggagctgaatggcccaggagatgggctcctaccacctcagggcaggcagttaccatcctcaaggtgttctaatcacccagcgctctggccactgctcagtagccccttaccatgaagctccctaagactctgctgtcctgcagcggaaccacatgagaacggaggaggtggtgggaaggac

SEQ ID NO: 95268 - DNA, 201 bp, Bos taurus
gagagcgctcctaggagaaacaaatttgaccactaggccatcatcaaattccctcttcaccaccaagtcagtcgtgaagaaagcagacgacaacaacccacgtgttcgctgtggatatcagggccaacaagcacccagttcgacaggctgcgacactgaggtggctaaggtcaacacccagaccaggcctgatggacagaa

SEQ ID NO: 95269 - DNA, 201 bp, Bos taurus
acacaagaaacgctccgtcaacagtctggatgggagcctggggttaacactcagatgattaccccgggccaaaagtgccacgcgaccttggcctttctcgcgcagtgcctgtgctcctggctcctgaatgtcactcgagctgtgggggtggttttatgtgacagagagattacaatgtccggctggaccgggccgtagaca

SEQ ID NO: 95270 - DNA, 201 bp, Bos taurus
gatcagaggccacatgtggatcccgggccccagcacactgctgaatgcattttgtggggctctgacaccggttctttccggaaacacccggaaaaccaccggaggagggttattcgctgggcccagggctcgcaggggagacgccgcagaccctgacctcttccacggtctcgtcctgcggggtggccgcgctgtcgtccg

SEQ ID NO: 95271 - DNA, 201 bp, Bos taurus
tgtaaaatgactaatttctgcaaacccatgcttctgtgagtggttgattccttccctctcataaggtactagaacttgctgccttaaaagcaacagttcctaggataatgccgtattttttctacaggagctgtgcaggctcgattctgagttcctagaacaagtgaacaagttccaagcagaacaagtgaacccttccca

SEQ ID NO: 95272 - DNA, 201 bp, Bos taurus; identical to SEQ ID NO: 13730

SEQ ID NO: 95273 - DNA, 201 bp, Bos taurus; identical to SEQ ID NO: 13731

SEQ ID NO: 95274 - DNA, 201 bp, Bos taurus
atgtcaggaatcagcattagggactgaaaaatcaggattattagtagaatctaataataaaatatctgaactagagaactgagtgatattcaagtaggggagatggccagagagatgaggtgggttcctcaccgttttatgaaaaaactgataggatctgacaagagccagtgagcagtattttaggtctacagcctctgc

SEQ ID NO: 95275 - DNA, 201 bp, Bos taurus
acatctgatggttgtagtttatctttcttttgtcaattgctttacaatatacttaatgatgtcttctcttaaaaaatgttgttaggccaatctgggctgataaaatacaagatacgttcaatagctttctgtgtccacacaagacaagtcatgcataagacagaactctccaaggaaatttagggtgtttagaaaccagaa

SEQ ID NO: 95276 - DNA, 201 bp, Bos taurus; identical to SEQ ID NO: 13732

SEQ ID NO: 95277 - DNA, 201 bp, Bos taurus; identical to SEQ ID NO: 13733

SEQ ID NO: 95278 - DNA, 201 bp, Bos taurus; identical to SEQ ID NO: 13734

SEQ ID NO: 95279 - DNA, 201 bp, Bos taurus
tctaacaaaacctgttagatatgttcttcctctactacttttgtaatattgctttattatgaagatttgcatttaaaatagaatttttctactttacaatatgccagtcctttacatatcaaaatatataatagttaggctaaaagagaagcaaattatatcccctagcaccattacttaaaaagattccaatcttaattt

SEQ ID NO: 95280 - DNA, 201 bp, Bos taurus; identical to SEQ ID NO: 13735

SEQ ID NO: 95281 - DNA, 201 bp, Bos taurus; identical to SEQ ID NO: 13736

SEQ ID NO: 95282 - DNA, 201 bp, Bos taurus; identical to SEQ ID NO: 13738

SEQ ID NO: 95283 - DNA, 201 bp, Bos taurus; identical to SEQ ID NO: 13739

SEQ ID NO: 95284 - DNA, 201 bp, Bos taurus; identical to SEQ ID NO: 13740

SEQ ID NO: 95285 - DNA, 201 bp, Bos taurus; identical to SEQ ID NO: 13741

SEQ ID NO: 95286 - DNA, 201 bp, Bos taurus; identical to SEQ ID NO: 13742

SEQ ID NO: 95287 - DNA, 201 bp, Bos taurus; identical to SEQ ID NO: 13743

SEQ ID NO: 95288 - DNA, 201 bp, Bos taurus; identical to SEQ ID NO: 13744

SEQ ID NO: 95289 - DNA, 201 bp, Bos taurus; identical to SEQ ID NO: 13746

SEQ ID NO: 95290 - DNA, 201 bp, Bos taurus; identical to SEQ ID NO: 13747

SEQ ID NO: 95291 - DNA, 201 bp, Bos taurus
ctggctaggtgacatgacagcaggtgttagcacagctcttaaagaagacttccagtcttatataggtgatcaaaatctattttataatggacagtcaatcgatacttctttctctattaactcaatagaagtttgaggaaagtacccagataaaggcggtataccctggctttgagatagttctttttcctctgtattgat

SEQ ID NO: 95292 - DNA, 201 bp, Bos taurus
attcacagctgactcatgactggacgtggttggccacataattatgaagtctgggttcctaaatgataaattagatgcagtgccttcgttttgtgtaagtgctacttagagccacatggcctgaaatagagcccctttgaaatgaatcacactgtacaccagagactggaaaaatagattacattgaaaatgaatccaaaa

SEQ ID NO: 95293 - DNA, 201 bp, Bos taurus; identical to SEQ ID NO: 13751

SEQ ID NO: 95294 - DNA, 201 bp, Bos taurus
aatgtctccctctagccctgcgatggttctgagaggtctagggggtgagggtgggcatggagggcccaaacacccggcctccggcagccatgggctttcggttcatttcactgatgcccacacagtgcccaccgatgacacacatccagggcctcacgtggccctgcccaccaggcacctgggacattgctgtatctcttc

SEQ ID NO: 95295 - DNA, 201 bp, Bos taurus
tatctatgtataaattatactagataattattgttgtatctacaaaaattatactatcatatgagtctataaattatatttgtgatgtgtaaatggtttggcacttcaatgagctgacttagaaaaagaaaatatcagaggcgggggagggttgttcgtagcgaagctgccacctgcccaccccatccacaggacgctgtt

SEQ ID NO: 95296 - DNA, 201 bp, Bos taurus
ctacaagaagagacacagaaatgcccaacagaagtagagctggcagtaacagcagtcagtgctgctcaggaaagaaaatatctgtatacctagggccttcttatgccagatgactatctaaaactcctttcatatactccatataaattccattcaaatattccattcttatatttcatataaggttaaaacaaaacaaaa

SEQ ID NO: 95297 - DNA, 201 bp, Bos taurus; identical to SEQ ID NO: 13754

SEQ ID NO: 95298 - DNA, 201 bp, Bos taurus; identical to SEQ ID NO: 13755

SEQ ID NO: 95299 - DNA, 201 bp, Bos taurus; identical to SEQ ID NO: 13756

SEQ ID NO: 95300 - DNA, 201 bp, Bos taurus
agtattcttgcctggagaatcccatggacagaggagcctggagggctacagtccatagcatcccaaggagttaggcaggactgaagggacttagcactcacgcagcctgtgtactagataatactatcccctcttctttacagatgaggaaagggtcacagggagatgaatcaaccctccccctcaagccacatagcaggc

SEQ ID NO: 95301 - DNA, 201 bp, Bos taurus; identical to SEQ ID NO: 13762

SEQ ID NO: 95302 - DNA, 201 bp, Bos taurus; identical to SEQ ID NO: 13763

SEQ ID NO: 95303 - DNA, 201 bp, Bos taurus; identical to SEQ ID NO: 13764

SEQ ID NO: 95304 - DNA, 201 bp, Bos taurus; identical to SEQ ID NO: 13765

SEQ ID NO: 95305 - DNA, 201 bp, Bos taurus
gaaaagcaaatgtttggtaaacaagagtttgctgggcctgcagagactgatggacacagagtgggctctggtctctgggccctgctgagttttccccactacagtctgcccttattcagtgcagacatctctggaaatagctctattccaggaacaggccatctatctaaattttgtaagcgtttaggggaaggtcacagt

SEQ ID NO: 95306 - DNA, 201 bp, Bos taurus; identical to SEQ ID NO: 13768

SEQ ID NO: 95307 - DNA, 201 bp, Bos taurus; identical to SEQ ID NO: 13769

SEQ ID NO: 95308 - DNA, 201 bp, Bos taurus; identical to SEQ ID NO: 13770

SEQ ID NO: 95309 - DNA, 201 bp, Bos taurus
cccaggggatgagaggttcctttctcacaagggaggtgggggtaggatgggggtaccaaggtcacctccatttgagtcctccacagggttattttgggcaggacaggcctcctgtcctgataaaaataaatttatattaaatttataaaaaataaatttttatttatttttagtctgatcttaactatgaaaccattcatt

SEQ ID NO: 95310 - DNA, 201 bp, Bos taurus; identical to SEQ ID NO: 13771

SEQ ID NO: 95311 - DNA, 201 bp, Bos taurus; identical to SEQ ID NO: 13772

SEQ ID NO: 95312 - DNA, 201 bp, Bos taurus
tctaatgatttgtaaacttcccccagcctgctgtgtgctgtgctgtttctccttgaaactgtcaccgttttatttacttgtgctggtgaatatactccctcgcaaagaatgaagctatcaattcagggttctgggcaagagatgaacttaatttctcatgtaaatataaacttggcagaaagatggcagctgttcccctag

SEQ ID NO: 95313 - DNA, 201 bp, Bos taurus
tcttactatctctttatagaaattggagacatttatttctcatcatgttctctccagggttattgcaaattttgacagtatcattaaagctactctgatctttctatttttatgtaattacttatttcatagactttagtgttctcagaactaaattttttcactattttttcaaccttttattatccatataaaggattt

SEQ ID NO: 95314 - DNA, 201 bp, Bos taurus; identical to SEQ ID NO: 13773

SEQ ID NO: 95315 - DNA, 201 bp, Bos taurus; identical to SEQ ID NO: 13774

SEQ ID NO: 95316 - DNA, 201 bp, Bos taurus; identical to SEQ ID NO: 13775

SEQ ID NO: 95317 - DNA, 201 bp, Bos taurus; identical to SEQ ID NO: 13776

SEQ ID NO: 95318 - DNA, 201 bp, Bos taurus
tgcctggaaaataccatggacagaggagtctggcgggccacagtccatggggttgctaagaatcagacacaaataagcacgcatgctcgcactatgagctacagaagacaatgggccgtccaaggaagaatcaacagaaataacagaaaatagaataagtatcataagattcgcaaatcaatctgaaatagtttataaaat

SEQ ID NO: 95319 - DNA, 201 bp, Bos taurus
agtcagcgtgcttgttacacagtgtagggaggccgaaatgctttgagcagatgaaaatcaatatgccctttgacaagtcactgttcccttttacaaaaccatcaaggcctttcgttgcattcctatattgttgtctcattttataaaccctggctatattaaattctatttaaatttaaacacttttgaccaaaaaggggc

SEQ ID NO: 95320 - DNA, 201 bp, Bos taurus; identical to SEQ ID NO: 13779

SEQ ID NO: 95321 - DNA, 201 bp, Bos taurus
ttttctagcatttagtataaagcaaagaagagaatactgtgataattacagctgaaccagttcacattgacttgattttatcagaaaacaaacaaacaaataaagagcctatcaaattgactttgtttacagagaagattaaattcagtttttttctttttaaaatttttaattggaggataattgctttacagtgttgtg

SEQ ID NO: 95322 - DNA, 201 bp, Bos taurus
agtgcccttataagaagagacacaacagaggtgagctctctctctctatcaccctctgccatttgaaggcacaagaggagaaggccatctgcaacagggacgtggagctccacccaagaggatgtggggcgggcagcactgcagaagaaaaggctcctctcctttggggcaactctgaattcaaggcaagcccacactagg

SEQ ID NO: 95323 - DNA, 201 bp, Bos taurus; identical to SEQ ID NO: 13782

SEQ ID NO: 95324 - DNA, 201 bp, Bos taurus
gaggagccaggcaactggctggaagacttggaagaacagcagagccgatgtggtcaaatccgagctcacgttccacacattcagcacgtgaaagcatcaggagacaggccactccaaccccccagacgccaccacagagtggaaaggacagtcgtgcgagacacagccacacaccgccacccctcagcctcccgaggcctg

SEQ ID NO: 95325 - DNA, 201 bp, Bos taurus; identical to SEQ ID NO: 13783

SEQ ID NO: 95326 - DNA, 201 bp, Bos taurus; identical to SEQ ID NO: 13784

SEQ ID NO: 95327 - DNA, 201 bp, Bos taurus; identical to SEQ ID NO: 13785

SEQ ID NO: 95328 - DNA, 201 bp, Bos taurus
tctttaccatctaagccaccagggaatccccaaagcccattcaagtgtcttctaatttttccttcatcttaaggatgtggctgtgtgccaggccttgttatataaactcaatctgaagagcaaccctaagaagtaggtactacccagacccccattttgcaggtgagaaaactgaaacaaatgggaattaagtaactggcc

SEQ ID NO: 95329 - DNA, 201 bp, Bos taurus; identical to SEQ ID NO: 13786

SEQ ID NO: 95330 - DNA, 201 bp, Bos taurus; identical to SEQ ID NO: 13787

SEQ ID NO: 95331 - DNA, 201 bp, Bos taurus; identical to SEQ ID NO: 13789

SEQ ID NO: 95332 - DNA, 201 bp, Bos taurus; identical to SEQ ID NO: 13790

SEQ ID NO: 95333 - DNA, 201 bp, Bos taurus; identical to SEQ ID NO: 13791

SEQ ID NO: 95334 - DNA, 201 bp, Bos taurus
agaatgcgatctgtctccaagctcccttcctttcaagcagcctttttcctacttttaaaaaatatttatttatttggccccacctggttttacttgtggcgctctggttcttttttttattttactttttaaattttggcacgtgggatatttagctttggcacgtggaacctagttccccaaccagggactgaccccagg

SEQ ID NO: 95335 - DNA, 201 bp, Bos taurus; identical to SEQ ID NO: 13793

SEQ ID NO: 95336 - DNA, 201 bp, Bos taurus; identical to SEQ ID NO: 13794

SEQ ID NO: 95337 - DNA, 201 bp, Bos taurus
gtttctctgtaggctttattgggtcagatgcaagatttgatcagagggggaaaaattaatcctggagagaagcctcgctggattcaaggccctggggccctgcagggctctgccaggtgcatttggaaaggaagcccaaccttgaccatgaattagcaaagaagcagcatgaaggacaccaagcaagctcaaagacccagg

SEQ ID NO: 95338 - DNA, 201 bp, Bos taurus; identical to SEQ ID NO: 13795

SEQ ID NO: 95339 - DNA, 201 bp, Bos taurus; identical to SEQ ID NO: 13796

SEQ ID NO: 95340 - DNA, 201 bp, Bos taurus
ggctacaatccatagggtcacaaagagtcagacacgactgaagcaactgggcatgcacaccggcacagtgtcaggagactgggccaccacgtttgaagttcagttcagttcagtcactcagtcatgtccaactctttgcaaccccatggactgcagcacgccaggcctccctgtccctcaccaactcctggagttcactca

SEQ ID NO: 95341 - DNA, 201 bp, Bos taurus; identical to SEQ ID NO: 13798

SEQ ID NO: 95342 - DNA, 201 bp, Bos taurus; identical to SEQ ID NO: 13799

SEQ ID NO: 95343 - DNA, 201 bp, Bos taurus; identical to SEQ ID NO: 13800

SEQ ID NO: 95344 - DNA, 201 bp, Bos taurus; identical to SEQ ID NO: 13801

SEQ ID NO: 95345 - DNA, 201 bp, Bos taurus; identical to SEQ ID NO: 13802

SEQ ID NO: 95346 - DNA, 201 bp, Bos taurus; identical to SEQ ID NO: 13804

SEQ ID NO: 95347 - DNA, 201 bp, Bos taurus
acaaaaccactgcagctgcctgtgagtcatggctggcccaacagagcatccagagctggtctatctcatagcaagtggtcagctgtcctgcacggggctgtctgccttagtccccgggcccacggatgtatactgggatcccatccatcccgctgcaagccagttctttgtttcagtcaaattcaatgtattaggttgttc

SEQ ID NO: 95348 - DNA, 201 bp, Bos taurus; identical to SEQ ID NO: 13805

SEQ ID NO: 95349 - DNA, 201 bp, Bos taurus; identical to SEQ ID NO: 13806

SEQ ID NO: 95350 - DNA, 201 bp, Bos taurus
tgggcctttacagagcaagactgcctgcttctcattcggcagatcgggggtcatgacttaaaagatgtacaaaggtggacgaaagggcggggtcatccagcgaggcatgctaggggccgcgggtgacctgccaaccagcatcccagctcagtgtcctccagatgacggtcaccacctgggaaaggcagcctagctcagctg

SEQ ID NO: 95351 - DNA, 201 bp, Bos taurus; identical to SEQ ID NO: 13809

SEQ ID NO: 95352 - DNA, 201 bp, Bos taurus; identical to SEQ ID NO: 13811

SEQ ID NO: 95353 - DNA, 201 bp, Bos taurus; identical to SEQ ID NO: 13812

SEQ ID NO: 95354 - DNA, 201 bp, Bos taurus; identical to SEQ ID NO: 13813

SEQ ID NO: 95355 - DNA, 201 bp, Bos taurus
gggcagcccagcataaagcacagatggacaaatgaccgcaggctgctggccatgcacgcaggcgtccgggtggtttacactcacagtcgtccttccggccggcggcagagccaaaggcgccgcctttgccgtgggaacttggggtccagcgagctgcctggctagcggtccagttactgctcagatgctctgagcctgcca

SEQ ID NO: 95356 - DNA, 201 bp, Bos taurus; identical to SEQ ID NO: 13816

SEQ ID NO: 95357 - DNA, 201 bp, Bos taurus; identical to SEQ ID NO: 13817

SEQ ID NO: 95358 - DNA, 201 bp, Bos taurus; identical to SEQ ID NO: 13819

SEQ ID NO: 95359 - DNA, 201 bp, Bos taurus; identical to SEQ ID NO: 13820

SEQ ID NO: 95360 - DNA, 201 bp, Bos taurus
tgtgagtccagggtgtgtgatgcagggagcttggggggatcttgggcgtctgacacgggtcaggcagcacccgcaggacgccctccaggccccctcctccgacaggcagcaggctcacctgtctaaccttgtgatacatgcaagcaagctctccctcccgtccggtttcgggtgtctggggccgttgtggcggcctctgat

SEQ ID NO: 95361 - DNA, 201 bp, Bos taurus
ctatcaccatccgaagtgtggatgcagagtcagaaccctgagggcagccaggccatggagctcttgggccgtgtcggcctgacgggccgccggggccagcgtgtgggcagacgatgcgtctcagtgtctcccatgcagcagcaaaaaggcaaagtacattagagacttaagttccaggtggagccccagaggccctgggat

SEQ ID NO: 95362 - DNA, 201 bp, Bos taurus; identical to SEQ ID NO: 13821

SEQ ID NO: 95363 - DNA, 201 bp, Bos taurus
accccccatcccggccccgcttggacagtccttggcaccaaccgcctccgactctgctgagggacatggctctgtccccaaggcacctggggctcctctatctgccagcaggggcctgcgggtggcccagcccaccacccagcctgctcagacccaggcctggcctcctgccgaccccgggggcccccagcaggggaagat

SEQ ID NO: 95364 - DNA, 201 bp, Bos taurus; identical to SEQ ID NO: 13822

SEQ ID NO: 95365 - DNA, 201 bp, Bos taurus
cgcgggcacgtttccgaggaaagcctctgcggaggacgttacaaagtgtccctgtggtggtggcggtgccgtttctaagagagtttcttctggcctgtttcgtctgttctgaaatgttaagtgggtaggatgagaatatgaacaaggattacggtctcacacgcgaagacacaccggcaggcatcttctcatggtttcctt

SEQ ID NO: 95366 - DNA, 201 bp, Bos taurus
ggagaatcacagcacacacagctgggaccgcgttcacgacagccctgggggagcaccaaccacgggacgagaggcagtgtggctggaaggcccgagcggacacctcaaggcgccccacaccagaagacagctggaagtgcattttctaatggcagcggtgaccacactacggagacgtgcacgtgagggccgtgtccaccc

SEQ ID NO: 95367 - DNA, 201 bp, Bos taurus; identical to SEQ ID NO: 13823

SEQ ID NO: 95368 - DNA, 201 bp, Bos taurus; identical to SEQ ID NO: 13824

SEQ ID NO: 95369 - DNA, 201 bp, Bos taurus; identical to SEQ ID NO: 13826

SEQ ID NO: 95370 - DNA, 201 bp, Bos taurus; identical to SEQ ID NO: 13827

SEQ ID NO: 95371 - DNA, 201 bp, Bos taurus; identical to SEQ ID NO: 13828

SEQ ID NO: 95372 - DNA, 201 bp, Bos taurus
ctgtgtggcccagggcagcaagggcatttgttgacctgtggcaagcaaggcagtgtctccaaatggctgtctgtttgacctgggtgagaggcatgagctcatgttggcccactggggtgtgttgctgggttatctgtgtgacttcctacatgatcagggggttgttggggctggtgcagcctgctggttgacagctaagcc

SEQ ID NO: 95373 - DNA, 201 bp, Bos taurus; identical to SEQ ID NO: 13829

SEQ ID NO: 95374 - DNA, 201 bp, Bos taurus; identical to SEQ ID NO: 13830

SEQ ID NO: 95375 - DNA, 201 bp, Bos taurus; identical to SEQ ID NO: 13831

SEQ ID NO: 95376 - DNA, 201 bp, Bos taurus; identical to SEQ ID NO: 13832

SEQ ID NO: 95377 - DNA, 201 bp, Bos taurus
aactgaagaaaaagcagaagtggacggaattcccaggggcataaaccccacggaaagctgtgctctcagggctccaggagctgtcggcatactgggactcgtacacttctgtccacggatgttctcccacaactctggacatggggaaggctctctccatctgcagactgtcctagtattcaggaactgcctccttcctgg

SEQ ID NO: 95378 - DNA, 201 bp, Bos taurus
tcaattttctatgtagagctaagccctttgtgctatcacccaggcatttttgtgccacgggcatctgagaagccagagactgcattactgagtattaaggtacttgcctaaggctagatgttcccataaatctagaaacaacctgaaactcccaatcccattaggctctttgcagcacaacagctggattcctgggactca

SEQ ID NO: 95379 - DNA, 201 bp, Bos taurus
ctttctgagctttgggattcacagttcccagctggctcacatcttccaggggtcatgggggcctgcatacttctttgggccaggggacagactcacagcccgtggtgtgtggattgggaatggaatgaggggtgctggtgggacatgagcagccctcctccctgtgaacatggccggagtggggccagcctcacagagcag

SEQ ID NO: 95380 - DNA, 201 bp, Bos taurus; identical to SEQ ID NO: 13833

SEQ ID NO: 95381 - DNA, 201 bp, Bos taurus; identical to SEQ ID NO: 13835

SEQ ID NO: 95382 - DNA, 201 bp, Bos taurus; identical to SEQ ID NO: 13838

SEQ ID NO: 95383 - DNA, 201 bp, Bos taurus; identical to SEQ ID NO: 13840

SEQ ID NO: 95384 - DNA, 201 bp, Bos taurus; identical to SEQ ID NO: 13841

SEQ ID NO: 95385 - DNA, 201 bp, Bos taurus; identical to SEQ ID NO: 13850

SEQ ID NO: 95386 - DNA, 201 bp, Bos taurus; identical to SEQ ID NO: 13851

SEQ ID NO: 95387 - DNA, 201 bp, Bos taurus; identical to SEQ ID NO: 13853

SEQ ID NO: 95388 - DNA, 201 bp, Bos taurus; identical to SEQ ID NO: 13854

SEQ ID NO: 95389 - DNA, 201 bp, Bos taurus; identical to SEQ ID NO: 13855

SEQ ID NO: 95390 - DNA, 201 bp, Bos taurus; identical to SEQ ID NO: 13857

SEQ ID NO: 95391 - DNA, 201 bp, Bos taurus; identical to SEQ ID NO: 13858

SEQ ID NO: 95392 - DNA, 201 bp, Bos taurus; identical to SEQ ID NO: 13859

SEQ ID NO: 95393 - DNA, 201 bp, Bos taurus; identical to SEQ ID NO: 13860

SEQ ID NO: 95394 - DNA, 201 bp, Bos taurus; identical to SEQ ID NO: 13861

SEQ ID NO: 95395 - DNA, 201 bp, Bos taurus; identical to SEQ ID NO: 13862

SEQ ID NO: 95396 - DNA, 201 bp, Bos taurus; identical to SEQ ID NO: 13863

SEQ ID NO: 95397 - DNA, 201 bp, Bos taurus; identical to SEQ ID NO: 13866

SEQ ID NO: 95398 - DNA, 201 bp, Bos taurus; identical to SEQ ID NO: 13867

SEQ ID NO: 95399 - DNA, 201 bp, Bos taurus; identical to SEQ ID NO: 13868

SEQ ID NO: 95400 - DNA, 201 bp, Bos taurus; identical to SEQ ID NO: 13869

SEQ ID NO: 95401 - DNA, 201 bp, Bos taurus; identical to SEQ ID NO: 13870

SEQ ID NO: 95402 - DNA, 201 bp, Bos taurus; identical to SEQ ID NO: 13871

SEQ ID NO: 95403 - DNA, 201 bp, Bos taurus; identical to SEQ ID NO: 13872

SEQ ID NO: 95404 - DNA, 201 bp, Bos taurus; identical to SEQ ID NO: 13873

SEQ ID NO: 95405 - DNA, 201 bp, Bos taurus; identical to SEQ ID NO: 13874

SEQ ID NO: 95406 - DNA, 201 bp, Bos taurus; identical to SEQ ID NO: 13875

SEQ ID NO: 95407 - DNA, 201 bp, Bos taurus; identical to SEQ ID NO: 13876

SEQ ID NO: 95408 - DNA, 201 bp, Bos taurus; identical to SEQ ID NO: 13877

SEQ ID NO: 95409 - DNA, 201 bp, Bos taurus; identical to SEQ ID NO: 13878

SEQ ID NO: 95410 - DNA, 201 bp, Bos taurus
caatctggtttatgttttggcatgtggcaatcattggcttgatagccgagaaaccttcatttccagaactttatggcctgtgtttcaactgcagacccagccagagcccctcacctctcctgcgtgtttgatcttctaattgcctcaagacacagccacgggcttgctgtgcgatgctgcaggcctcagcctgagctgagg

SEQ ID NO: 95411 - DNA, 201 bp, Bos taurus; identical to SEQ ID NO: 13879

SEQ ID NO: 95412 - DNA, 201 bp, Bos taurus; identical to SEQ ID NO: 13880

SEQ ID NO: 95413 - DNA, 201 bp, Bos taurus; identical to SEQ ID NO: 13881

SEQ ID NO: 95414 - DNA, 201 bp, Bos taurus; identical to SEQ ID NO: 13882

SEQ ID NO: 95415 - DNA, 201 bp, Bos taurus; identical to SEQ ID NO: 13883

SEQ ID NO: 95416 - DNA, 201 bp, Bos taurus; identical to SEQ ID NO: 54757

SEQ ID NO: 95417 - DNA, 201 bp, Bos taurus; identical to SEQ ID NO: 13885

SEQ ID NO: 95418 - DNA, 201 bp, Bos taurus; identical to SEQ ID NO: 13886

SEQ ID NO: 95419 - DNA, 201 bp, Bos taurus; identical to SEQ ID NO: 13887

SEQ ID NO: 95420 - DNA, 201 bp, Bos taurus; identical to SEQ ID NO: 13888

SEQ ID NO: 95421 - DNA, 201 bp, Bos taurus
atcttcccagcccagggatcaaacccacatatcttatgtctcctttattggcagatgggctctttaccactagtgctatctgggaggccatagaaatgatgttattgtgtctcaaaacagtaacttttttttactgggctatgtcctagaattgatcattcttggccaatttcccgtatatgataaatcctttccgtatgt

SEQ ID NO: 95422 - DNA, 201 bp, Bos taurus; identical to SEQ ID NO: 13889

SEQ ID NO: 95423 - DNA, 201 bp, Bos taurus; identical to SEQ ID NO: 13890

SEQ ID NO: 95424 - DNA, 201 bp, Bos taurus; identical to SEQ ID NO: 13893

SEQ ID NO: 95425 - DNA, 201 bp, Bos taurus; identical to SEQ ID NO: 13894

SEQ ID NO: 95426 - DNA, 201 bp, Bos taurus; identical to SEQ ID NO: 13898

SEQ ID NO: 95427 - DNA, 201 bp, Bos taurus; identical to SEQ ID NO: 13899

SEQ ID NO: 95428 - DNA, 201 bp, Bos taurus; identical to SEQ ID NO: 13900

SEQ ID NO: 95429 - DNA, 201 bp, Bos taurus; identical to SEQ ID NO: 13901

SEQ ID NO: 95430 - DNA, 201 bp, Bos taurus; identical to SEQ ID NO: 13902

SEQ ID NO: 95431 - DNA, 201 bp, Bos taurus
ccccagcctctggcaagcagggctgtttctgggctcacttataatggaagctttcccaggacacagcctgcttcaggctcacgtccatatggctgggaaggggccacttcagcgacccggccgcagcactgcttatccacacagtgagcagaaggcttcaagcatcatcacagcctttcctgaactcacttcaccctagcc

SEQ ID NO: 95432 - DNA, 201 bp, Bos taurus; identical to SEQ ID NO: 13903

SEQ ID NO: 95433 - DNA, 201 bp, Bos taurus
agcccccacagatctctggttgactgaaaggccacgcacaagtggagaagagagcagagaggatccactttctctcctcactcctgcctgcgagcctgtgggcacaggtgaaggagaggccagagggcccagaggaaagtaaaggctgggaagatgaaaagctgccttaagtctgaataacagcgtagcgcttgaggcatc

SEQ ID NO: 95434 - DNA, 201 bp, Bos taurus; identical to SEQ ID NO: 13904

SEQ ID NO: 95435 - DNA, 201 bp, Bos taurus; identical to SEQ ID NO: 13905

SEQ ID NO: 95436 - DNA, 201 bp, Bos taurus; identical to SEQ ID NO: 13908

SEQ ID NO: 95437 - DNA, 201 bp, Bos taurus
aaggaaatgtactaaaaaatgtaaagtctacaaggagtcagagcccaagataatattagtaatgactgataatcattcaagatgatattgataaaaccccgacagcatatgaaagagagactgaatgagcagctcagaatttttcaggacattaaatcaagggaattttccagtctctgcttctgacaaagagatttagaa

SEQ ID NO: 95438 - DNA, 201 bp, Bos taurus; identical to SEQ ID NO: 13909

SEQ ID NO: 95439 - DNA, 201 bp, Bos taurus; identical to SEQ ID NO: 13910

SEQ ID NO: 95440 - DNA, 201 bp, Bos taurus; identical to SEQ ID NO: 13911

SEQ ID NO: 95441 - DNA, 201 bp, Bos taurus; identical to SEQ ID NO: 13912

SEQ ID NO: 95442 - DNA, 201 bp, Bos taurus; identical to SEQ ID NO: 13913

SEQ ID NO: 95443 - DNA, 201 bp, Bos taurus; identical to SEQ ID NO: 13914

SEQ ID NO: 95444 - DNA, 201 bp, Bos taurus; identical to SEQ ID NO: 13915

SEQ ID NO: 95445 - DNA, 201 bp, Bos taurus
atggcaacctactccagtattcttgcctggagaatcccatggacagaggagcctagtggctacagtccacagggtcacaaagagtcagacacgactgagcatgcttgcacacacacgtacctgtggtaggtaatcgggtaaccaggaaagatgcgtgatcctcctctagagtgcagagtctgagggggaaatggctgccca

SEQ ID NO: 95446 - DNA, 201 bp, Bos taurus; identical to SEQ ID NO: 13916

SEQ ID NO: 95447 - DNA, 201 bp, Bos taurus; identical to SEQ ID NO: 13918

SEQ ID NO: 95448 - DNA, 201 bp, Bos taurus; identical to SEQ ID NO: 13919

SEQ ID NO: 95449 - DNA, 201 bp, Bos taurus
cacccacacccaaagtcaggaagggaaagggggtcccagaggagcgggcagacacctcagggccttctccacgtgctctggccttttcacttgatgcacacgattgttatgcacacttgaagtgcagccattgagctctcatgattgatatagccaggcccagacggacacggtctctggttgtcagggctattattctga

SEQ ID NO: 95450 - DNA, 201 bp, Bos taurus
gcaaggaaaccagaggtcggaaaactgatagcgtttgcctgatgttgttcagtacaaggtaggtcagacgcccaggatggatgacggaatgaaaagccccagagtttccctctaatgtgtactgagtgcctaggtcacatcttcagcgggctttctcttattctgtctgtctccttctctctcctgtgacgggctgaagaa

SEQ ID NO: 95451 - DNA, 201 bp, Bos taurus; identical to SEQ ID NO: 13922

SEQ ID NO: 95452 - DNA, 201 bp, Bos taurus; identical to SEQ ID NO: 13923

SEQ ID NO: 95453 - DNA, 201 bp, Bos taurus
gtaggcatcgggagttggtgatggacagggaggcctggcatgccacagtccacggtgtcgcagagtcagacacgactgagctgaactgactgacatctatcgaagggccttgagtcatttcaaagtcattatcatttttttttataacttgtggactatctgacagtagcacttatatatcttttggatgtcacatctgac

SEQ ID NO: 95454 - DNA, 201 bp, Bos taurus; identical to SEQ ID NO: 13924

SEQ ID NO: 95455 - DNA, 201 bp, Bos taurus
tattttgcaactaaaagtaacaagtatacatttgaacccaggcaggatttttggtttctgttcaaattgtccataagacatttggtgcataccaaacggttcttgaaatttggccccatctaaaacactcatgagtatacttggtctatgccaagtggttttggatggaacgaaatatcaaggacctttctggtgtggacc

SEQ ID NO: 95456 - DNA, 201 bp, Bos taurus; identical to SEQ ID NO: 13925

SEQ ID NO: 95457 - DNA, 201 bp, Bos taurus; identical to SEQ ID NO: 13926

SEQ ID NO: 95458 - DNA, 201 bp, Bos taurus
tggcactcactctggggcagagttgtttgtttttctctccctaaatgtataacaggaaattaggcagttcacctttgtgtatcactttcatacgtgtacacgagccagatggcacctctttgtgttaagaaatttaaaaggaaagactagaaggagaagtttatctccacttcctctgccctcctaaacacatcctggaat

SEQ ID NO: 95459 - DNA, 201 bp, Bos taurus
tctcactatagtcaatgaattcaatgccttaggggccctgtttcctcttctaatgagaatgagactatcttgcttgtttagaggagcacagagaaaggtgtaattggccgaattgtttaacatagcaacatggtaaagggaaaaagcaaagtttaagtttcagctctcattctgccatcaaccacatgtgggtcacacgca

SEQ ID NO: 95460 - DNA, 201 bp, Bos taurus
tgtttagcctctgcccataaaataggaatttccatctccttgaaaacacaggaagtaaccgccagctcttccctcaacatgtgtacctggccccccaccctgtaagaagtgagagatgtacccaatgggtgaggtgggcagagtccgtcatctgccatcatattctcttccaggtggggccagtgcagacaagggagactc

SEQ ID NO: 95461 - DNA, 201 bp, Bos taurus; identical to SEQ ID NO: 13928

SEQ ID NO: 95462 - DNA, 201 bp, Bos taurus; identical to SEQ ID NO: 13929

SEQ ID NO: 95463 - DNA, 201 bp, Bos taurus; identical to SEQ ID NO: 13931

SEQ ID NO: 95464 - DNA, 201 bp, Bos taurus; identical to SEQ ID NO: 13932

SEQ ID NO: 95465 - DNA, 201 bp, Bos taurus; identical to SEQ ID NO: 13933

SEQ ID NO: 95466 - DNA, 201 bp, Bos taurus; identical to SEQ ID NO: 13934

SEQ ID NO: 95467 - DNA, 201 bp, Bos taurus; identical to SEQ ID NO: 13935

SEQ ID NO: 95468 - DNA, 201 bp, Bos taurus; identical to SEQ ID NO: 13936

SEQ ID NO: 95469 - DNA, 201 bp, Bos taurus; identical to SEQ ID NO: 13937

SEQ ID NO: 95470 - DNA, 201 bp, Bos taurus; identical to SEQ ID NO: 13938

SEQ ID NO: 95471 - DNA, 201 bp, Bos taurus
tgttttaagacttctgcccgctggaaataattaacctcttgagattttttttttttaattgaagggagggcacactgtacacccgccttccactcagatacttgaggcccaatgcctagttaccccggagaaggcaatggcaccccactccagtactcttgcttggaaaatcccatggacggaggagcctggtaggctgca

SEQ ID NO: 95472 - DNA, 201 bp, Bos taurus
ccgtcgctgccactgcattctcctgcatcgcgtcagtgctttatgccatagaaatggcgggcgtgtggaacttctacaagctcaaagagatcccctgctacgtgcacactgtgccaggcctgctgaacgtgctggagaccttcgttgctggtgtcatctttgccttcctcagcaacacctccctatacctgcaccagccgg

SEQ ID NO: 95473 - DNA, 201 bp, Bos taurus
cttcctgctcataaacttttagtatgccctgggtcctcttggccctctccccatctgactcaagactacccagggtggcctctctaggcattctactctgtctcctttcttttgctcatgttgggccatgtgtcagtcatgccaatcccttatttattgttcaacaatgaagcctcaacaacaaaacatgaccttcaataa

SEQ ID NO: 95474 - DNA, 201 bp, Bos taurus; identical to SEQ ID NO: 13939

SEQ ID NO: 95475 - DNA, 201 bp, Bos taurus; identical to SEQ ID NO: 13940

SEQ ID NO: 95476 - DNA, 201 bp, Bos taurus; identical to SEQ ID NO: 13941

SEQ ID NO: 95477 - DNA, 201 bp, Bos taurus
tgagtttgcccaaacttagaatggttcagaggaaccacagtcaccccaggaagccctttttcacagcattctgggtccagggcagttgaggagaggcctagggatgctaactacaggtcagatggcaggagatgttctcagaaggctgtgttctcagtttggtcccgaggaccaaagagctgctcagcaacggccttgcca

SEQ ID NO: 95478 - DNA, 201 bp, Bos taurus; identical to SEQ ID NO: 13942

SEQ ID NO: 95479 - DNA, 201 bp, Bos taurus; identical to SEQ ID NO: 13943

SEQ ID NO: 95480 - DNA, 201 bp, Bos taurus; identical to SEQ ID NO: 13944

SEQ ID NO: 95481 - DNA, 201 bp, Bos taurus; identical to SEQ ID NO: 13945

SEQ ID NO: 95482 - DNA, 201 bp, Bos taurus; identical to SEQ ID NO: 13946

SEQ ID NO: 95483 - DNA, 201 bp, Bos taurus; identical to SEQ ID NO: 13947

SEQ ID NO: 95484 - DNA, 201 bp, Bos taurus; identical to SEQ ID NO: 13948

SEQ ID NO: 95485 - DNA, 201 bp, Bos taurus; identical to SEQ ID NO: 13949

SEQ ID NO: 95486 - DNA, 201 bp, Bos taurus; identical to SEQ ID NO: 13950

SEQ ID NO: 95487 - DNA, 201 bp, Bos taurus; identical to SEQ ID NO: 13951

SEQ ID NO: 95488 - DNA, 201 bp, Bos taurus
ttagaccacgagtgggagagtatggaagggatcctggggggtgtagttggaaatcacccctgctctcttccttccctcccaagacccccacaaggacaccgtgtgccttccctcctctgtgtgcaacacagacctggtccccagtccttcctgcaggaaatcctgctcggaataaagcccagcgccctcagtgtggcctcc

SEQ ID NO: 95489 - DNA, 201 bp, Bos taurus
tcgtggagacctggaactttgcacgtcagtcctggggagttattcctgccgtagcgtccacgatgaggctccttcttcacctaccctattgatcactactgcgctacccgaagcactattatttattctccctctgcctgtaccctactactgtcagcacagtaaatggttcttggaagcttacaggtgtggatttggtct

SEQ ID NO: 95490 - DNA, 201 bp, Bos taurus
ggcccacagcagtgcctggggactgaagtaggaaccctcgcggcacaagaaagacatgcagattttgttcctggcacctgagagcaaagaaaacagttcctgcagaaacagcactgcggcctgggagtctatctgaaaccatcaccgaggctccactgtaagctccaatttccaggtcagaccccagcagcagaaaaggtg

SEQ ID NO: 95491 - DNA, 201 bp, Bos taurus; identical to SEQ ID NO: 13954

SEQ ID NO: 95492 - DNA, 201 bp, Bos taurus
aatttttaaagaggccatgatggttgtttttttttttaagtgagaaatgatatttagaggctacattctgggcaccagatgtgcttattttgctgaatatgtttctaggccttttcagtggccagagctaagaaatacaaagttttaaaataaggaaagagagatcttgagtttatactgctactgaaatgtaagattata

SEQ ID NO: 95493 - DNA, 201 bp, Bos taurus; identical to SEQ ID NO: 13957

SEQ ID NO: 95494 - DNA, 201 bp, Bos taurus; identical to SEQ ID NO: 13958

SEQ ID NO: 95495 - DNA, 201 bp, Bos taurus
agtgcaaggccgcactctgagccatcacaccggcctgcttccctagagaatggtgcaagtcagagaggggcttcttggccagccagggctctggggtgaaaacacatggaacagaacaacccccaagctgacttaacagttagtgagataaaaatatacatttttaaaaattgtgaatggcctgtataagaggaaaagttc

SEQ ID NO: 95496 - DNA, 201 bp, Bos taurus
gtctcctgcattgcaggcagatactttactgagtcaccagggaagtctcttccttaaacgtcagagtacatgatcacaggacatcctgaagaaaggccccgcaggatggtggggctcaagtaggacctgagcctacagagaggtgagtctcggtcgaaggtaagaggagggccacaaaagtgagtagtttgtctgactggg

SEQ ID NO: 95497 - DNA, 201 bp, Bos taurus
cgtcagtagctgtaagcatacataatggcctgcctcagggaaccctgccctccgcctgatattaaactgaagtgcctttgttcagctcacagggagacaccgtggccttgcccacctgtgagtgcctgcaggaggaagaaatgaacacatccccttccagtggttggctaaattaggcgatacttagcaagactcatggcc

SEQ ID NO: 95498 - DNA, 201 bp, Bos taurus
gtggaggctggggctgtggagctaaggaattcagccatgggttgggaggaggaaggtgcataagactgggtggtggccatcgccatgctggggtccttctccatgtctcacctgatgtgtggagcagctggaggtgcaggagctgacctagaactggccgagcagctccaggaaaggtccggcagggccgaggcggcctgg

SEQ ID NO: 95499 - DNA, 201 bp, Bos taurus
agttggccctttttaatctattgctcttatttgataattctagttatatattccattataattttttgcaaaaggctatggttaaatcgatcaacttcacattaaatcttttcctttttttgtctcattttgggagtattaattttactttttatttttaatcaattgttattggcatatagtttctttacaatgtttttt

SEQ ID NO: 95500 - DNA, 201 bp, Bos taurus
aatggctcagtgattcagccatatcaagaatattcaaaggtgtcagagagggtttggggaagaccttttccgccccctcccctgtggagacaccgtgaatactccttgacttctgatctgaagcttagtgatagaggaatctctgggcttcctgtgtctgggttggcggtaaggataatgtatggggaacgaattacagac

SEQ ID NO: 95501 - DNA, 201 bp, Bos taurus
tcatgttgctccttgccaggcctcagctaacctccagtccttgagggagtgaaaaacgggggtaaacactgcctgggaactttccagagctgaagatgataccagaaaattcccaagcagggcctctcctttttctcctcccaccccaaaggctgtctcttacctttgtacagaatcattcaaaccaaacatatcaggagc

SEQ ID NO: 95502 - DNA, 201 bp, Bos taurus
cagccagacccggggcccacagcagaggcacttatttgaaaataggaagaacttctcccccaacagactggtactggtacaatttaacggtttaaaatgatttggtcataattaagttaggaggccggaacaacacagagctgggtttaagtcacagcccgttcctaaactccccatcactagaaatggcttaacatgtta

SEQ ID NO: 95503 - DNA, 201 bp, Bos taurus
ctgtaaacattttgaggcctgaggggcaggcatctaatttaagacacacttgtaggagcctgctggaacactccagggacaaggcccggtgggtgacaccgtcatactctccctttgccgtgctccggaggtccagaatctcccaggagaaagcttatactcaagttggccctgactttgcgggtgtcatctagaggacac

SEQ ID NO: 95504 - DNA, 201 bp, Bos taurus; identical to SEQ ID NO: 13962

SEQ ID NO: 95505 - DNA, 201 bp, Bos taurus; identical to SEQ ID NO: 13963

SEQ ID NO: 95506 - DNA, 201 bp, Bos taurus; identical to SEQ ID NO: 13964

SEQ ID NO: 95507 - DNA, 201 bp, Bos taurus; identical to SEQ ID NO: 13965

SEQ ID NO: 95508 - DNA, 201 bp, Bos taurus; identical to SEQ ID NO: 13967

SEQ ID NO: 95509 - DNA, 201 bp, Bos taurus; identical to SEQ ID NO: 13968

SEQ ID NO: 95510 - DNA, 201 bp, Bos taurus; identical to SEQ ID NO: 13971

SEQ ID NO: 95511 - DNA, 201 bp, Bos taurus; identical to SEQ ID NO: 13972

SEQ ID NO: 95512 - DNA, 201 bp, Bos taurus; identical to SEQ ID NO: 13973

SEQ ID NO: 95513 - DNA, 201 bp, Bos taurus; identical to SEQ ID NO: 13976

SEQ ID NO: 95514 - DNA, 201 bp, Bos taurus; identical to SEQ ID NO: 13980

SEQ ID NO: 95515 - DNA, 201 bp, Bos taurus; identical to SEQ ID NO: 13984

SEQ ID NO: 95516 - DNA, 201 bp, Bos taurus
ccatcagtcccatcaaataaaatggcagtgagcttactgaatgatgaaacatccaaaggcagattccatgacctaccccctttctggccagattgctgcccctgaagcttccctgtgcagaagctgctcaaaatgctattgacaaggggcttcagaagctgctatttctctctggccattcccaagcccacatcgttgcag

SEQ ID NO: 95517 - DNA, 201 bp, Bos taurus; identical to SEQ ID NO: 13987

SEQ ID NO: 95518 - DNA, 201 bp, Bos taurus
tcctctgaggtctgtggctttgtaattagtgttggcttggttactgggtgctttcaattttgagattagagtgctggtaataaatgcggctagaagcatcgtgaaaaaattctaacaggctctgggaagaataaaatagtcatagaatcaaggtcctccaaaatggaccactgaggatctcaagctgtggtcctgataaac

SEQ ID NO: 95519 - DNA, 201 bp, Bos taurus; identical to SEQ ID NO: 13989

SEQ ID NO: 95520 - DNA, 201 bp, Bos taurus; identical to SEQ ID NO: 13990

SEQ ID NO: 95521 - DNA, 201 bp, Bos taurus; identical to SEQ ID NO: 13991

SEQ ID NO: 95522 - DNA, 201 bp, Bos taurus; identical to SEQ ID NO: 13992

SEQ ID NO: 95523 - DNA, 201 bp, Bos taurus
gggaggagacacacaactggaaagccctggggacacccgaggctggtgggaaccctgggggtggtgatggggattctggggggcggggaggggatggcctccagggcagaggagagctgggtggttctgtttctgtctctgccccattcatctgagacagagaccagcagctcaggcagcagcctcaaatcaggcagggtt

SEQ ID NO: 95524 - DNA, 201 bp, Bos taurus
gccaccttcctcccccctcccttgcctggctctcagctgcacgtggtatgctctttctgggtctaggatgtggagcatctgtcttcaaggagtggcacctcggggccggccggcctggagcacgtttgtgttcacacagtacacatacacttctacagcgtctgtgttcacaggtagcggtcagatgcctcccagcctgtg

SEQ ID NO: 95525 - DNA, 201 bp, Bos taurus; identical to SEQ ID NO: 13993

SEQ ID NO: 95526 - DNA, 201 bp, Bos taurus; identical to SEQ ID NO: 13994

SEQ ID NO: 95527 - DNA, 201 bp, Bos taurus
ctcccagggctacatgtggggaaagcactggcctctgcccttctgggctgcccagagcccctgcagttcctctaacacagaggtggggcagcctactttatgaatgtgaatgaggccatgaagtaaaagtgaattctccatttctaagctgtgtaacctgtgacaccctttctttccagggccatgaaaccaagggagcaa

SEQ ID NO: 95528 - DNA, 201 bp, Bos taurus; identical to SEQ ID NO: 13996

SEQ ID NO: 95529 - DNA, 201 bp, Bos taurus; identical to SEQ ID NO: 13997

SEQ ID NO: 95530 - DNA, 201 bp, Bos taurus; identical to SEQ ID NO: 13998

SEQ ID NO: 95531 - DNA, 201 bp, Bos taurus
ctcgaggccgccccctaactgttgtcagcccacgcaggggaccggcaccggcttcgctccctcccttctgcacatcacatcacttaccctacggctaccacggcgcacccggggcctccctacagtagggtactttctccgagccctcttcctcagaaaagcaacaaacaccgaaccaagactatgccatgcggcaacggc

SEQ ID NO: 95532 - DNA, 201 bp, Bos taurus; identical to SEQ ID NO: 14003

SEQ ID NO: 95533 - DNA, 201 bp, Bos taurus; identical to SEQ ID NO: 14005

SEQ ID NO: 95534 - DNA, 201 bp, Bos taurus; identical to SEQ ID NO: 14006

SEQ ID NO: 95535 - DNA, 201 bp, Bos taurus
tccctatgttccttagtggccctaaggtcgaggaaaggcccaccatcttcttctccccgccctcccccgcccccatttgtaagagatgaggatgggggccagtgtctcatcgcttgggtctcacgcagctagttgtttattccgctgtccagactcaagcccctccctctctctttgcctctagtagcagggtcgggggtg

SEQ ID NO: 95536 - DNA, 201 bp, Bos taurus; identical to SEQ ID NO: 14007

SEQ ID NO: 95537 - DNA, 201 bp, Bos taurus; identical to SEQ ID NO: 14009

SEQ ID NO: 95538 - DNA, 201 bp, Bos taurus; identical to SEQ ID NO: 14010

SEQ ID NO: 95539 - DNA, 201 bp, Bos taurus; identical to SEQ ID NO: 14012

SEQ ID NO: 95540 - DNA, 201 bp, Bos taurus; identical to SEQ ID NO: 14013

SEQ ID NO: 95541 - DNA, 201 bp, Bos taurus; identical to SEQ ID NO: 14018

SEQ ID NO: 95542 - DNA, 201 bp, Bos taurus; identical to SEQ ID NO: 14019

SEQ ID NO: 95543 - DNA, 201 bp, Bos taurus; identical to SEQ ID NO: 14021

SEQ ID NO: 95544 - DNA, 201 bp, Bos taurus; identical to SEQ ID NO: 14022

SEQ ID NO: 95545 - DNA, 201 bp, Bos taurus; identical to SEQ ID NO: 14023

SEQ ID NO: 95546 - DNA, 201 bp, Bos taurus; identical to SEQ ID NO: 14024

SEQ ID NO: 95547 - DNA, 201 bp, Bos taurus; identical to SEQ ID NO: 14027

SEQ ID NO: 95548 - DNA, 201 bp, Bos taurus; identical to SEQ ID NO: 14029

SEQ ID NO: 95549 - DNA, 201 bp, Bos taurus; identical to SEQ ID NO: 14030

SEQ ID NO: 95550 - DNA, 201 bp, Bos taurus; identical to SEQ ID NO: 14037

SEQ ID NO: 95551 - DNA, 201 bp, Bos taurus; identical to SEQ ID NO: 14039

SEQ ID NO: 95552 - DNA, 201 bp, Bos taurus; identical to SEQ ID NO: 14043

SEQ ID NO: 95553 - DNA, 201 bp, Bos taurus
gatcctcaagtcctggatgctttgacagctctgaaatccaaccttccagccccacgtggttgccaaagctttgccactcatttgttgcttggtaagaactctccccagattcttaaccgcacacctagcaccaagaatcagctgatttccagaagggatatgcaaagtagatgatactgccttcctggtttctgtaatcac

SEQ ID NO: 95554 - DNA, 201 bp, Bos taurus; identical to SEQ ID NO: 14044

SEQ ID NO: 95555 - DNA, 201 bp, Bos taurus; identical to SEQ ID NO: 14045

SEQ ID NO: 95556 - DNA, 201 bp, Bos taurus; identical to SEQ ID NO: 14047

SEQ ID NO: 95557 - DNA, 201 bp, Bos taurus; identical to SEQ ID NO: 14048

SEQ ID NO: 95558 - DNA, 201 bp, Bos taurus; identical to SEQ ID NO: 14049

SEQ ID NO: 95559 - DNA, 201 bp, Bos taurus; identical to SEQ ID NO: 14051

SEQ ID NO: 95560 - DNA, 201 bp, Bos taurus; identical to SEQ ID NO: 14052

SEQ ID NO: 95561 - DNA, 201 bp, Bos taurus; identical to SEQ ID NO: 14053

SEQ ID NO: 95562 - DNA, 201 bp, Bos taurus; identical to SEQ ID NO: 14054

SEQ ID NO: 95563 - DNA, 201 bp, Bos taurus; identical to SEQ ID NO: 14055

SEQ ID NO: 95564 - DNA, 201 bp, Bos taurus; identical to SEQ ID NO: 14056

SEQ ID NO: 95565 - DNA, 201 bp, Bos taurus; identical to SEQ ID NO: 14057

SEQ ID NO: 95566 - DNA, 201 bp, Bos taurus; identical to SEQ ID NO: 14058

SEQ ID NO: 95567 - DNA, 201 bp, Bos taurus; identical to SEQ ID NO: 14059

SEQ ID NO: 95568 - DNA, 201 bp, Bos taurus; identical to SEQ ID NO: 14060

SEQ ID NO: 95569 - DNA, 201 bp, Bos taurus; identical to SEQ ID NO: 14061

SEQ ID NO: 95570 - DNA, 201 bp, Bos taurus; identical to SEQ ID NO: 14062

SEQ ID NO: 95571 - DNA, 201 bp, Bos taurus; identical to SEQ ID NO: 14063

SEQ ID NO: 95572 - DNA, 201 bp, Bos taurus; identical to SEQ ID NO: 14064

SEQ ID NO: 95573 - DNA, 201 bp, Bos taurus; identical to SEQ ID NO: 14065

SEQ ID NO: 95574 - DNA, 201 bp, Bos taurus; identical to SEQ ID NO: 14066

SEQ ID NO: 95575 - DNA, 201 bp, Bos taurus; identical to SEQ ID NO: 14067

SEQ ID NO: 95576 - DNA, 201 bp, Bos taurus; identical to SEQ ID NO: 14068

SEQ ID NO: 95577 - DNA, 201 bp, Bos taurus; identical to SEQ ID NO: 14069

SEQ ID NO: 95578 - DNA, 201 bp, Bos taurus; identical to SEQ ID NO: 14070

SEQ ID NO: 95579 - DNA, 201 bp, Bos taurus; identical to SEQ ID NO: 14071

SEQ ID NO: 95580 - DNA, 201 bp, Bos taurus; identical to SEQ ID NO: 14072

SEQ ID NO: 95581 - DNA, 201 bp, Bos taurus; identical to SEQ ID NO: 14073

SEQ ID NO: 95582 - DNA, 201 bp, Bos taurus; identical to SEQ ID NO: 14074

SEQ ID NO: 95583 - DNA, 201 bp, Bos taurus; identical to SEQ ID NO: 14075

SEQ ID NO: 95584 - DNA, 201 bp, Bos taurus; identical to SEQ ID NO: 14076

SEQ ID NO: 95585 - DNA, 201 bp, Bos taurus; identical to SEQ ID NO: 14077

SEQ ID NO: 95586 - DNA, 201 bp, Bos taurus; identical to SEQ ID NO: 14078

SEQ ID NO: 95587 - DNA, 201 bp, Bos taurus; identical to SEQ ID NO: 14079

SEQ ID NO: 95588 - DNA, 201 bp, Bos taurus; identical to SEQ ID NO: 14080

SEQ ID NO: 95589 - DNA, 201 bp, Bos taurus; identical to SEQ ID NO: 14081

SEQ ID NO: 95590 - DNA, 201 bp, Bos taurus; identical to SEQ ID NO: 14083

SEQ ID NO: 95591 - DNA, 201 bp, Bos taurus; identical to SEQ ID NO: 14084

SEQ ID NO: 95592 - DNA, 201 bp, Bos taurus; identical to SEQ ID NO: 14085

SEQ ID NO: 95593 - DNA, 201 bp, Bos taurus; identical to SEQ ID NO: 14086

SEQ ID NO: 95594 - DNA, 201 bp, Bos taurus; identical to SEQ ID NO: 14087

SEQ ID NO: 95595 - DNA, 201 bp, Bos taurus; identical to SEQ ID NO: 14088

SEQ ID NO: 95596 - DNA, 201 bp, Bos taurus; identical to SEQ ID NO: 14089

SEQ ID NO: 95597 - DNA, 201 bp, Bos taurus; identical to SEQ ID NO: 14091

SEQ ID NO: 95598 - DNA, 201 bp, Bos taurus; identical to SEQ ID NO: 14093

SEQ ID NO: 95599 - DNA, 201 bp, Bos taurus; identical to SEQ ID NO: 14095

SEQ ID NO: 95600 - DNA, 201 bp, Bos taurus; identical to SEQ ID NO: 14096

SEQ ID NO: 95601 - DNA, 201 bp, Bos taurus; identical to SEQ ID NO: 14097

SEQ ID NO: 95602 - DNA, 201 bp, Bos taurus; identical to SEQ ID NO: 14098

SEQ ID NO: 95603 - DNA, 201 bp, Bos taurus; identical to SEQ ID NO: 14099

SEQ ID NO: 95604 - DNA, 201 bp, Bos taurus
ccacatttgtgggaaagtgctataggttaaatatataatcttgatgctgctctgtacctatagaacccaacaaaggaggctgggattgggatgggggtggaggtagcggggatggagtttcagctattgtaatagatgtggtacccaaagatcatatagtcttctgcatcaactggaaccatgtcaatataaaggccccac

SEQ ID NO: 95605 - DNA, 201 bp, Bos taurus; identical to SEQ ID NO: 14100

SEQ ID NO: 95606 - DNA, 201 bp, Bos taurus; identical to SEQ ID NO: 14101

SEQ ID NO: 95607 - DNA, 201 bp, Bos taurus; identical to SEQ ID NO: 14102

SEQ ID NO: 95608 - DNA, 201 bp, Bos taurus; identical to SEQ ID NO: 14103

SEQ ID NO: 95609 - DNA, 201 bp, Bos taurus; identical to SEQ ID NO: 14105

SEQ ID NO: 95610 - DNA, 201 bp, Bos taurus; identical to SEQ ID NO: 14106

SEQ ID NO: 95611 - DNA, 201 bp, Bos taurus
aaaaaaataataattgtggtcctagatgaaagcaatttttttttcttttttggaaaagatggttttctgaacagagctttcctttttgtgatgtaggccattagtgttgcccaaataggacagaaaaatgcagaagttaggaagtaaatgctgacagactcacaacctcaggggccaaatagcactacaatgatttctcac

SEQ ID NO: 95612 - DNA, 201 bp, Bos taurus; identical to SEQ ID NO: 14109

SEQ ID NO: 95613 - DNA, 201 bp, Bos taurus; identical to SEQ ID NO: 14111

SEQ ID NO: 95614 - DNA, 201 bp, Bos taurus; identical to SEQ ID NO: 14112

SEQ ID NO: 95615 - DNA, 201 bp, Bos taurus; identical to SEQ ID NO: 14113

SEQ ID NO: 95616 - DNA, 201 bp, Bos taurus
gtttatttatcaataacatactgtacctctctggacacactgacagacaactgatttttttttctacaatctcccctgggctctaaattttagaagacacgcatgaggaggaggaatcatgcctgaatctccttcccaaatatatctaaactacctgcccacggtgaaagctggagaagcagtacttgcacccttcaaagt

SEQ ID NO: 95617 - DNA, 201 bp, Bos taurus
ggctgaagcagctggaaacatggaaggtatagctcagtgcacagttctagattgtcttctcccagaaatgattcctctgggctacaactcaggcctaacattaggtctgccctgtcatgtgtcatgtgtcctgtcaagttaattaaagcctccctacagtatattctctatcatcctcctttcctctatcatcatcttttt

SEQ ID NO: 95618 - DNA, 201 bp, Bos taurus; identical to SEQ ID NO: 14116

SEQ ID NO: 95619 - DNA, 201 bp, Bos taurus; identical to SEQ ID NO: 14117

SEQ ID NO: 95620 - DNA, 201 bp, Bos taurus; identical to SEQ ID NO: 14118

SEQ ID NO: 95621 - DNA, 201 bp, Bos taurus
cccagatgcttgatgcagtgttataggacatactgaactcttccataaccttaatcttgttaattctatgaacaagatatcaaaatatggtaccacacccagaattcttggagaaatatcacagcaatagaaagcatgaatttaaggcatttaccttgaaaagtacccttgaagctaagaagtttaggagagctcaacaaa

SEQ ID NO: 95622 - DNA, 201 bp, Bos taurus
atctcagaatctgcttcccaagaccctggcctgtggcagcagggagttgatcagcaatccgctggcttccccataaaagggatgggactttcaagaggatgtgtattttgtttcctagtgttgatgggttcctccagtcactcacagtctcttagaagggtcctctgagagcaatgacttgaaggataaaattcaaaagta

SEQ ID NO: 95623 - DNA, 201 bp, Bos taurus; identical to SEQ ID NO: 14120

SEQ ID NO: 95624 - DNA, 201 bp, Bos taurus; identical to SEQ ID NO: 14121

SEQ ID NO: 95625 - DNA, 201 bp, Bos taurus; identical to SEQ ID NO: 14123

SEQ ID NO: 95626 - DNA, 201 bp, Bos taurus; identical to SEQ ID NO: 14124

SEQ ID NO: 95627 - DNA, 201 bp, Bos taurus; identical to SEQ ID NO: 14125

SEQ ID NO: 95628 - DNA, 201 bp, Bos taurus; identical to SEQ ID NO: 14126

SEQ ID NO: 95629 - DNA, 201 bp, Bos taurus; identical to SEQ ID NO: 14127

SEQ ID NO: 95630 - DNA, 201 bp, Bos taurus; identical to SEQ ID NO: 14128

SEQ ID NO: 95631 - DNA, 201 bp, Bos taurus; identical to SEQ ID NO: 14129

SEQ ID NO: 95632 - DNA, 201 bp, Bos taurus; identical to SEQ ID NO: 14131

SEQ ID NO: 95633 - DNA, 201 bp, Bos taurus
tttggatgtaaagcactatgaagaaaataaatgacagtgaagagatacagagaactaaagcacttggttttcctcttattgggacataatctcaccatgtgtctctgctcatagaatgattcatgtagaacaaaaaaataaagcaatagagagagtgttaaataccgtatcaacatccttgtgttgatgatagggaatgga

SEQ ID NO: 95634 - DNA, 201 bp, Bos taurus; identical to SEQ ID NO: 14132

SEQ ID NO: 95635 - DNA, 201 bp, Bos taurus; identical to SEQ ID NO: 14133

SEQ ID NO: 95636 - DNA, 201 bp, Bos taurus; identical to SEQ ID NO: 14134

SEQ ID NO: 95637 - DNA, 201 bp, Bos taurus; identical to SEQ ID NO: 14135

SEQ ID NO: 95638 - DNA, 201 bp, Bos taurus; identical to SEQ ID NO: 14136

SEQ ID NO: 95639 - DNA, 201 bp, Bos taurus; identical to SEQ ID NO: 14138

SEQ ID NO: 95640 - DNA, 201 bp, Bos taurus; identical to SEQ ID NO: 14139

SEQ ID NO: 95641 - DNA, 201 bp, Bos taurus; identical to SEQ ID NO: 14140

SEQ ID NO: 95642 - DNA, 201 bp, Bos taurus; identical to SEQ ID NO: 14141

SEQ ID NO: 95643 - DNA, 201 bp, Bos taurus; identical to SEQ ID NO: 14142

SEQ ID NO: 95644 - DNA, 201 bp, Bos taurus; identical to SEQ ID NO: 14143

SEQ ID NO: 95645 - DNA, 201 bp, Bos taurus; identical to SEQ ID NO: 14144

SEQ ID NO: 95646 - DNA, 201 bp, Bos taurus; identical to SEQ ID NO: 14145

SEQ ID NO: 95647 - DNA, 201 bp, Bos taurus; identical to SEQ ID NO: 14146

SEQ ID NO: 95648 - DNA, 201 bp, Bos taurus; identical to SEQ ID NO: 14147

SEQ ID NO: 95649 - DNA, 201 bp, Bos taurus; identical to SEQ ID NO: 14148

SEQ ID NO: 95650 - DNA, 201 bp, Bos taurus; identical to SEQ ID NO: 14149

SEQ ID NO: 95651 - DNA, 201 bp, Bos taurus; identical to SEQ ID NO: 14150

SEQ ID NO: 95652 - DNA, 201 bp, Bos taurus; identical to SEQ ID NO: 14151

SEQ ID NO: 95653 - DNA, 201 bp, Bos taurus; identical to SEQ ID NO: 14152

SEQ ID NO: 95654 - DNA, 201 bp, Bos taurus; identical to SEQ ID NO: 14153

SEQ ID NO: 95655 - DNA, 201 bp, Bos taurus; identical to SEQ ID NO: 14154

SEQ ID NO: 95656 - DNA, 201 bp, Bos taurus; identical to SEQ ID NO: 14155

SEQ ID NO: 95657 - DNA, 201 bp, Bos taurus; identical to SEQ ID NO: 14156

SEQ ID NO: 95658 - DNA, 201 bp, Bos taurus; identical to SEQ ID NO: 14157

SEQ ID NO: 95659 - DNA, 201 bp, Bos taurus; identical to SEQ ID NO: 14158

SEQ ID NO: 95660 - DNA, 201 bp, Bos taurus; identical to SEQ ID NO: 14159

SEQ ID NO: 95661 - DNA, 201 bp, Bos taurus; identical to SEQ ID NO: 14160

SEQ ID NO: 95662 - DNA, 201 bp, Bos taurus; identical to SEQ ID NO: 14161

SEQ ID NO: 95663 - DNA, 201 bp, Bos taurus; identical to SEQ ID NO: 14162

SEQ ID NO: 95664 - DNA, 201 bp, Bos taurus; identical to SEQ ID NO: 14163

SEQ ID NO: 95665 - DNA, 201 bp, Bos taurus; identical to SEQ ID NO: 14164

SEQ ID NO: 95666 - DNA, 201 bp, Bos taurus; identical to SEQ ID NO: 14165

SEQ ID NO: 95667 - DNA, 201 bp, Bos taurus; identical to SEQ ID NO: 14166

SEQ ID NO: 95668 - DNA, 201 bp, Bos taurus; identical to SEQ ID NO: 14167

SEQ ID NO: 95669 - DNA, 201 bp, Bos taurus; identical to SEQ ID NO: 14168

SEQ ID NO: 95670 - DNA, 201 bp, Bos taurus; identical to SEQ ID NO: 14169

SEQ ID NO: 95671 - DNA, 201 bp, Bos taurus; identical to SEQ ID NO: 14170

SEQ ID NO: 95672 - DNA, 201 bp, Bos taurus; identical to SEQ ID NO: 14171

SEQ ID NO: 95673 - DNA, 201 bp, Bos taurus; identical to SEQ ID NO: 14172

SEQ ID NO: 95674 - DNA, 201 bp, Bos taurus; identical to SEQ ID NO: 14173

SEQ ID NO: 95675 - DNA, 201 bp, Bos taurus; identical to SEQ ID NO: 14174

SEQ ID NO: 95676 - DNA, 201 bp, Bos taurus; identical to SEQ ID NO: 14175

SEQ ID NO: 95677 - DNA, 201 bp, Bos taurus; identical to SEQ ID NO: 14176

SEQ ID NO: 95678 - DNA, 201 bp, Bos taurus; identical to SEQ ID NO: 14177

SEQ ID NO: 95679 - DNA, 201 bp, Bos taurus; identical to SEQ ID NO: 14178

SEQ ID NO: 95680 - DNA, 201 bp, Bos taurus; identical to SEQ ID NO: 14179

SEQ ID NO: 95681 - DNA, 201 bp, Bos taurus; identical to SEQ ID NO: 14180

SEQ ID NO: 95682 - DNA, 201 bp, Bos taurus; identical to SEQ ID NO: 14181

SEQ ID NO: 95683 - DNA, 201 bp, Bos taurus; identical to SEQ ID NO: 14183

SEQ ID NO: 95684 - DNA, 201 bp, Bos taurus; identical to SEQ ID NO: 14184

SEQ ID NO: 95685 - DNA, 201 bp, Bos taurus; identical to SEQ ID NO: 14185

SEQ ID NO: 95686 - DNA, 201 bp, Bos taurus; identical to SEQ ID NO: 14186

SEQ ID NO: 95687 - DNA, 201 bp, Bos taurus; identical to SEQ ID NO: 14187

SEQ ID NO: 95688 - DNA, 201 bp, Bos taurus; identical to SEQ ID NO: 14188

SEQ ID NO: 95689 - DNA, 201 bp, Bos taurus; identical to SEQ ID NO: 14189

SEQ ID NO: 95690 - DNA, 201 bp, Bos taurus; identical to SEQ ID NO: 14190

SEQ ID NO: 95691 - DNA, 201 bp, Bos taurus; identical to SEQ ID NO: 14191

SEQ ID NO: 95692 - DNA, 201 bp, Bos taurus; identical to SEQ ID NO: 14192

SEQ ID NO: 95693 - DNA, 201 bp, Bos taurus; identical to SEQ ID NO: 14194

SEQ ID NO: 95694 - DNA, 201 bp, Bos taurus
tccagagtagatcagatgctaactgttttaaggtcacagcccctctctccaaaacaagacaaggaaaaaaatatattctctgctctgagtgtcttgggagcgtatggttagtagttacatgccctttgtttcagaggaaagaagtttatgaaaaaaaataattttacaccaatgggagagaatagagctagtatctagagg

SEQ ID NO: 95695 - DNA, 201 bp, Bos taurus; identical to SEQ ID NO: 14196

SEQ ID NO: 95696 - DNA, 201 bp, Bos taurus; identical to SEQ ID NO: 14197

SEQ ID NO: 95697 - DNA, 201 bp, Bos taurus; identical to SEQ ID NO: 14198

SEQ ID NO: 95698 - DNA, 201 bp, Bos taurus; identical to SEQ ID NO: 14199

SEQ ID NO: 95699 - DNA, 201 bp, Bos taurus; identical to SEQ ID NO: 14200

SEQ ID NO: 95700 - DNA, 201 bp, Bos taurus; identical to SEQ ID NO: 14201

SEQ ID NO: 95701 - DNA, 201 bp, Bos taurus; identical to SEQ ID NO: 14202

SEQ ID NO: 95702 - DNA, 201 bp, Bos taurus; identical to SEQ ID NO: 14203

SEQ ID NO: 95703 - DNA, 201 bp, Bos taurus; identical to SEQ ID NO: 14204

SEQ ID NO: 95704 - DNA, 201 bp, Bos taurus; identical to SEQ ID NO: 14205

SEQ ID NO: 95705 - DNA, 201 bp, Bos taurus; identical to SEQ ID NO: 14206

SEQ ID NO: 95706 - DNA, 201 bp, Bos taurus; identical to SEQ ID NO: 14207

SEQ ID NO: 95707 - DNA, 201 bp, Bos taurus; identical to SEQ ID NO: 14208

SEQ ID NO: 95708 - DNA, 201 bp, Bos taurus; identical to SEQ ID NO: 14210

SEQ ID NO: 95709 - DNA, 201 bp, Bos taurus; identical to SEQ ID NO: 14211

SEQ ID NO: 95710 - DNA, 201 bp, Bos taurus; identical to SEQ ID NO: 14212

SEQ ID NO: 95711 - DNA, 201 bp, Bos taurus; identical to SEQ ID NO: 14213

SEQ ID NO: 95712 - DNA, 201 bp, Bos taurus; identical to SEQ ID NO: 14214

SEQ ID NO: 95713 - DNA, 201 bp, Bos taurus; identical to SEQ ID NO: 14215

SEQ ID NO: 95714 - DNA, 201 bp, Bos taurus; identical to SEQ ID NO: 14216

SEQ ID NO: 95715 - DNA, 201 bp, Bos taurus; identical to SEQ ID NO: 14217

SEQ ID NO: 95716 - DNA, 201 bp, Bos taurus; identical to SEQ ID NO: 14219

SEQ ID NO: 95717 - DNA, 201 bp, Bos taurus; identical to SEQ ID NO: 14220

SEQ ID NO: 95718 - DNA, 201 bp, Bos taurus; identical to SEQ ID NO: 14221

SEQ ID NO: 95719 - DNA, 201 bp, Bos taurus; identical to SEQ ID NO: 14222

SEQ ID NO: 95720 - DNA, 201 bp, Bos taurus; identical to SEQ ID NO: 14223

SEQ ID NO: 95721 - DNA, 201 bp, Bos taurus; identical to SEQ ID NO: 14224

SEQ ID NO: 95722 - DNA, 201 bp, Bos taurus; identical to SEQ ID NO: 14225

SEQ ID NO: 95723 - DNA, 201 bp, Bos taurus
tcactgacagttgctatctaagggagttatctttgtttttggtctcatccaaacattttcccttttttcatccacgagcagctgatcctcttcactgttgtacctttttgttttactttttatagactgtacatcagtctgtacttctacagctattttttcttgcataagttccttattaccaagagcagaatgtcttca

SEQ ID NO: 95724 - DNA, 201 bp, Bos taurus
ttaactcatcttccttctcaggtctgtgtaaaaaggagagtaacatcaatctagacatgaaacgtgagctctgttcccaatgtcactggccgatcatgagcgtctcatgactagactgtcccaagtcagcctgtactttcctaagaatcctcgtagaagggccaggcgtattctaatctggatatctcttaactatctcaa

SEQ ID NO: 95725 - DNA, 201 bp, Bos taurus; identical to SEQ ID NO: 14226

SEQ ID NO: 95726 - DNA, 201 bp, Bos taurus; identical to SEQ ID NO: 14227

SEQ ID NO: 95727 - DNA, 201 bp, Bos taurus
aggactcttctagcccagcacccaacagtggccaagagcatgtcccaacaaaaatggtctcagtgctatcaatggcttattgatgtcatgttaatatcacatatggatgtgagagttgggccataatttgtaaagtaattagcctccaattaagatacattaatttaaaaaattcaaaaagaagagagagagctgagtgcc

SEQ ID NO: 95728 - DNA, 201 bp, Bos taurus
acagtgggacaaaggtcagggtctcagagacagggactttccgaatgcagaagaagaatctggagtcaatggctacggcaagagaaagagacccctggccgccttgggtcactggaaacctcaccccttcttccctccttcttgtttagtcactcagtcttgtcagactcttttgtggccccgtggactgtggcccctcca

SEQ ID NO: 95729 - DNA, 201 bp, Bos taurus; identical to SEQ ID NO: 14228

SEQ ID NO: 95730 - DNA, 201 bp, Bos taurus; identical to SEQ ID NO: 14229

SEQ ID NO: 95731 - DNA, 201 bp, Bos taurus; identical to SEQ ID NO: 14230

SEQ ID NO: 95732 - DNA, 201 bp, Bos taurus; identical to SEQ ID NO: 14231

SEQ ID NO: 95733 - DNA, 201 bp, Bos taurus; identical to SEQ ID NO: 14232

SEQ ID NO: 95734 - DNA, 201 bp, Bos taurus; identical to SEQ ID NO: 14233

SEQ ID NO: 95735 - DNA, 201 bp, Bos taurus; identical to SEQ ID NO: 14234

SEQ ID NO: 95736 - DNA, 201 bp, Bos taurus; identical to SEQ ID NO: 14235

SEQ ID NO: 95737 - DNA, 201 bp, Bos taurus; identical to SEQ ID NO: 14236

SEQ ID NO: 95738 - DNA, 201 bp, Bos taurus
tcacctagagaagacacttgcagagaaagcccgaggtctaaagcctccttctagtcatctgtaactggatatctgtgacgaggagccaagctttcgtctcgagcagtgagccgtgagcccaggccttgattgagagggaaggatgtagcccatccgtggcaccatgcctgctgtcatcctgagctgttctcaggccggggg

SEQ ID NO: 95739 - DNA, 201 bp, Bos taurus; identical to SEQ ID NO: 14237

SEQ ID NO: 95740 - DNA, 201 bp, Bos taurus; identical to SEQ ID NO: 14238

SEQ ID NO: 95741 - DNA, 201 bp, Bos taurus; identical to SEQ ID NO: 14239

SEQ ID NO: 95742 - DNA, 201 bp, Bos taurus; identical to SEQ ID NO: 14243

SEQ ID NO: 95743 - DNA, 201 bp, Bos taurus; identical to SEQ ID NO: 14244

SEQ ID NO: 95744 - DNA, 201 bp, Bos taurus; identical to SEQ ID NO: 14245

SEQ ID NO: 95745 - DNA, 201 bp, Bos taurus; identical to SEQ ID NO: 14247

SEQ ID NO: 95746 - DNA, 201 bp, Bos taurus; identical to SEQ ID NO: 14248

SEQ ID NO: 95747 - DNA, 201 bp, Bos taurus; identical to SEQ ID NO: 14249

SEQ ID NO: 95748 - DNA, 201 bp, Bos taurus; identical to SEQ ID NO: 14250

SEQ ID NO: 95749 - DNA, 201 bp, Bos taurus; identical to SEQ ID NO: 14251

SEQ ID NO: 95750 - DNA, 201 bp, Bos taurus; identical to SEQ ID NO: 14252

SEQ ID NO: 95751 - DNA, 201 bp, Bos taurus; identical to SEQ ID NO: 14254

SEQ ID NO: 95752 - DNA, 201 bp, Bos taurus; identical to SEQ ID NO: 14255

SEQ ID NO: 95753 - DNA, 201 bp, Bos taurus; identical to SEQ ID NO: 14256

SEQ ID NO: 95754 - DNA, 201 bp, Bos taurus; identical to SEQ ID NO: 14258

SEQ ID NO: 95755 - DNA, 201 bp, Bos taurus; identical to SEQ ID NO: 14261

SEQ ID NO: 95756 - DNA, 201 bp, Bos taurus; identical to SEQ ID NO: 14262

SEQ ID NO: 95757 - DNA, 201 bp, Bos taurus; identical to SEQ ID NO: 14264

SEQ ID NO: 95758 - DNA, 201 bp, Bos taurus; identical to SEQ ID NO: 14265

SEQ ID NO: 95759 - DNA, 201 bp, Bos taurus; identical to SEQ ID NO: 14266

SEQ ID NO: 95760 - DNA, 201 bp, Bos taurus; identical to SEQ ID NO: 14267

SEQ ID NO: 95761 - DNA, 201 bp, Bos taurus; identical to SEQ ID NO: 14268

SEQ ID NO: 95762 - DNA, 201 bp, Bos taurus; identical to SEQ ID NO: 14269

SEQ ID NO: 95763 - DNA, 201 bp, Bos taurus; identical to SEQ ID NO: 14270

SEQ ID NO: 95764 - DNA, 201 bp, Bos taurus; identical to SEQ ID NO: 14271

SEQ ID NO: 95765 - DNA, 201 bp, Bos taurus; identical to SEQ ID NO: 14273

SEQ ID NO: 95766 - DNA, 201 bp, Bos taurus; identical to SEQ ID NO: 14274

SEQ ID NO: 95767 - DNA, 201 bp, Bos taurus; identical to SEQ ID NO: 14275

SEQ ID NO: 95768 - DNA, 201 bp, Bos taurus; identical to SEQ ID NO: 14277

SEQ ID NO: 95769 - DNA, 201 bp, Bos taurus; identical to SEQ ID NO: 14278

SEQ ID NO: 95770 - DNA, 201 bp, Bos taurus; identical to SEQ ID NO: 14279

SEQ ID NO: 95771 - DNA, 201 bp, Bos taurus; identical to SEQ ID NO: 14280

SEQ ID NO: 95772 - DNA, 201 bp, Bos taurus; identical to SEQ ID NO: 14281

SEQ ID NO: 95773 - DNA, 201 bp, Bos taurus; identical to SEQ ID NO: 14282

SEQ ID NO: 95774 - DNA, 201 bp, Bos taurus; identical to SEQ ID NO: 14283

SEQ ID NO: 95775 - DNA, 201 bp, Bos taurus; identical to SEQ ID NO: 14284

SEQ ID NO: 95776 - DNA, 201 bp, Bos taurus; identical to SEQ ID NO: 14286

SEQ ID NO: 95777 - DNA, 201 bp, Bos taurus; identical to SEQ ID NO: 14287

SEQ ID NO: 95778 - DNA, 201 bp, Bos taurus; identical to SEQ ID NO: 14288

SEQ ID NO: 95779 - DNA, 201 bp, Bos taurus; identical to SEQ ID NO: 14289

SEQ ID NO: 95780 - DNA, 201 bp, Bos taurus; identical to SEQ ID NO: 14291

SEQ ID NO: 95781 - DNA, 201 bp, Bos taurus
ttactggagctctgttaatagtgaagaggccacactccatacagaggccttgagtggccttgagataaatcctgaagagacctaacataagaattcaggacttctgcaacccagcaaatgtgaaccttgagtgattgttgggttttagagagacctgagatgatagttatttgaggtagaatgacaatgtagaggaaagaa

SEQ ID NO: 95782 - DNA, 201 bp, Bos taurus; identical to SEQ ID NO: 14292

SEQ ID NO: 95783 - DNA, 201 bp, Bos taurus; identical to SEQ ID NO: 14293

SEQ ID NO: 95784 - DNA, 201 bp, Bos taurus
ttttgccaaatatcaaaatgaatcccctcggatagctgattattttactcacttcacccagactgcctttcctatagattctaccgcagaatggccagcctgtttcccaagagccatcccctcccctctgatgctcttcctccccaggagcccctcagccagcacacgcaccactcctccaggatgagcgtctcgaccagc

SEQ ID NO: 95785 - DNA, 201 bp, Bos taurus
ctaacctgtctgcttacagaattgtcacttgtctgcctagaactcttctgatctccccattacccttgagcaagagttcctgtttctttatatggcttacatgagaactttctccaatctcatctcctgccatagcttccttaagcggtctccacagggttctgcttcattacaactgcctggagcccatctttggagatg

SEQ ID NO: 95786 - DNA, 201 bp, Bos taurus
atattcaaccttcagaaggatgtgaatgccatgaaggctgaggccttctgcttggttggctgctgcatctcaggtgtccggaccacacccggcacacagcggctcccgcagacaacagtggccacgtgcgagaaaggactactgaaaatctcacgctcagatttccttccttcttgcccttcctccctccctttcatcttc

SEQ ID NO: 95787 - DNA, 201 bp, Bos taurus; identical to SEQ ID NO: 14297

SEQ ID NO: 95788 - DNA, 201 bp, Bos taurus; identical to SEQ ID NO: 14298

SEQ ID NO: 95789 - DNA, 201 bp, Bos taurus
caacttcacttcacttcatttcacttccaacctgtagtcttctgcacaatggcttgacttcctctggttgggcaggggtgtcaccagtgagtgaaagtaacttgtgtcacttacaggctagagcattaaactactgtgcaaggcctccagagctccagtccctctgctgtgagcccagcgattttgggaatgatgggtatc

SEQ ID NO: 95790 - DNA, 201 bp, Bos taurus; identical to SEQ ID NO: 14300

SEQ ID NO: 95791 - DNA, 201 bp, Bos taurus
ctctcctgggcagctgcaggccgctcatcttccatcctgtgtgagctgtcttctccagagggcgcttctggatgagaacgttgctctgttccctaggactcggcccttgggtggttgaggtctgaactctcccactctgcccctcaggttttcagggagtcacatccctgctctgcttacaaattaggttcctttctagca

SEQ ID NO: 95792 - DNA, 201 bp, Bos taurus; identical to SEQ ID NO: 14301

SEQ ID NO: 95793 - DNA, 201 bp, Bos taurus; identical to SEQ ID NO: 14302

SEQ ID NO: 95794 - DNA, 201 bp, Bos taurus; identical to SEQ ID NO: 14304

SEQ ID NO: 95795 - DNA, 201 bp, Bos taurus; identical to SEQ ID NO: 14306

SEQ ID NO: 95796 - DNA, 201 bp, Bos taurus; identical to SEQ ID NO: 14307

SEQ ID NO: 95797 - DNA, 201 bp, Bos taurus; identical to SEQ ID NO: 14308

SEQ ID NO: 95798 - DNA, 201 bp, Bos taurus; identical to SEQ ID NO: 14309

SEQ ID NO: 95799 - DNA, 201 bp, Bos taurus; identical to SEQ ID NO: 14310

SEQ ID NO: 95800 - DNA, 201 bp, Bos taurus; identical to SEQ ID NO: 55138

SEQ ID NO: 95801 - DNA, 201 bp, Bos taurus
acagaaggaagttttgctgtcgaggacagtcttttgatgccttttaaccatgttaacatacaagtgtgattctgtgcctgtgtctggagtctaagtgggaaagtttggaaggagatgggcatttcagaggttagtaaaggctaactgtagttagccagtggggagtctccatccctggctgctcagcatcaccatcctgct

SEQ ID NO: 95802 - DNA, 201 bp, Bos taurus; identical to SEQ ID NO: 14312

SEQ ID NO: 95803 - DNA, 201 bp, Bos taurus; identical to SEQ ID NO: 14313

SEQ ID NO: 95804 - DNA, 201 bp, Bos taurus; identical to SEQ ID NO: 14315

SEQ ID NO: 95805 - DNA, 201 bp, Bos taurus; identical to SEQ ID NO: 14316

SEQ ID NO: 95806 - DNA, 201 bp, Bos taurus; identical to SEQ ID NO: 14317

SEQ ID NO: 95807 - DNA, 201 bp, Bos taurus; identical to SEQ ID NO: 14318

SEQ ID NO: 95808 - DNA, 201 bp, Bos taurus; identical to SEQ ID NO: 14319

SEQ ID NO: 95809 - DNA, 201 bp, Bos taurus; identical to SEQ ID NO: 14320

SEQ ID NO: 95810 - DNA, 201 bp, Bos taurus; identical to SEQ ID NO: 14323

SEQ ID NO: 95811 - DNA, 201 bp, Bos taurus; identical to SEQ ID NO: 14324

SEQ ID NO: 95812 - DNA, 201 bp, Bos taurus; identical to SEQ ID NO: 14325

SEQ ID NO: 95813 - DNA, 201 bp, Bos taurus; identical to SEQ ID NO: 14326

SEQ ID NO: 95814 - DNA, 201 bp, Bos taurus; identical to SEQ ID NO: 14327

SEQ ID NO: 95815 - DNA, 201 bp, Bos taurus; identical to SEQ ID NO: 14328

SEQ ID NO: 95816 - DNA, 201 bp, Bos taurus; identical to SEQ ID NO: 14329

SEQ ID NO: 95817 - DNA, 201 bp, Bos taurus; identical to SEQ ID NO: 14330

SEQ ID NO: 95818 - DNA, 201 bp, Bos taurus; identical to SEQ ID NO: 14331

SEQ ID NO: 95819 - DNA, 201 bp, Bos taurus; identical to SEQ ID NO: 14332

SEQ ID NO: 95820 - DNA, 201 bp, Bos taurus; identical to SEQ ID NO: 14333

SEQ ID NO: 95821 - DNA, 201 bp, Bos taurus; identical to SEQ ID NO: 14334

SEQ ID NO: 95822 - DNA, 201 bp, Bos taurus; identical to SEQ ID NO: 14337

SEQ ID NO: 95823 - DNA, 201 bp, Bos taurus; identical to SEQ ID NO: 14338

SEQ ID NO: 95824 - DNA, 201 bp, Bos taurus; identical to SEQ ID NO: 14339

SEQ ID NO: 95825 - DNA, 201 bp, Bos taurus; identical to SEQ ID NO: 14340

SEQ ID NO: 95826 - DNA, 201 bp, Bos taurus; identical to SEQ ID NO: 14342

SEQ ID NO: 95827 - DNA, 201 bp, Bos taurus; identical to SEQ ID NO: 14343

SEQ ID NO: 95828 - DNA, 201 bp, Bos taurus; identical to SEQ ID NO: 14345

SEQ ID NO: 95829 - DNA, 201 bp, Bos taurus; identical to SEQ ID NO: 14347

SEQ ID NO: 95830 - DNA, 201 bp, Bos taurus; identical to SEQ ID NO: 14348

SEQ ID NO: 95831 - DNA, 201 bp, Bos taurus; identical to SEQ ID NO: 14349

SEQ ID NO: 95832 - DNA, 201 bp, Bos taurus; identical to SEQ ID NO: 14350

SEQ ID NO: 95833 - DNA, 201 bp, Bos taurus; identical to SEQ ID NO: 14351

SEQ ID NO: 95834 - DNA, 201 bp, Bos taurus; identical to SEQ ID NO: 14352

SEQ ID NO: 95835 - DNA, 201 bp, Bos taurus; identical to SEQ ID NO: 14353

SEQ ID NO: 95836 - DNA, 201 bp, Bos taurus; identical to SEQ ID NO: 14354

SEQ ID NO: 95837 - DNA, 201 bp, Bos taurus; identical to SEQ ID NO: 14355

SEQ ID NO: 95838 - DNA, 201 bp, Bos taurus; identical to SEQ ID NO: 14357

SEQ ID NO: 95839 - DNA, 201 bp, Bos taurus; identical to SEQ ID NO: 14358

SEQ ID NO: 95840 - DNA, 201 bp, Bos taurus; identical to SEQ ID NO: 14359

SEQ ID NO: 95841 - DNA, 201 bp, Bos taurus; identical to SEQ ID NO: 14360

SEQ ID NO: 95842 - DNA, 201 bp, Bos taurus; identical to SEQ ID NO: 55179

SEQ ID NO: 95843 - DNA, 201 bp, Bos taurus; identical to SEQ ID NO: 14363

SEQ ID NO: 95844 - DNA, 201 bp, Bos taurus
atctgctgcctcagcatcaccatcccaggtgctggcaactgctcttctccatttctataatttgtcatcttaagaatgttttataaagcaatggcaccccgctccagtactcttgcctggaaaaccctatggacggaagaacctggtaggctgcagtccatgggatcgcgaagagtcggacacgactgagcgacttcactt

SEQ ID NO: 95845 - DNA, 201 bp, Bos taurus
tacaaagggaaatgttgtgaggtaagggcatgatttttttttgctagtgtgaaaatttcctcctcatgttctctaattcatgttacggcctggtctttacgcctgtcgttggctgaactgttgattccctagctccgctggatcctggtggtgagtagtgtgtggcagtatctagttaaagaccttcaccggtgctgaggc

SEQ ID NO: 95846 - DNA, 201 bp, Bos taurus; identical to SEQ ID NO: 14365

SEQ ID NO: 95847 - DNA, 201 bp, Bos taurus
tcaggttcgaacctcacctccatcagtgccactactgtgaagccctggccaagtcacttaacctctctgagcctcatctgcaggctttcaggaaacagaaactgctacggtaggtcaagtcggccaaagcacttccaccctcaccctcctccccatatggcccaccccaaggccagacaggatatggagggtgcccttcca

SEQ ID NO: 95848 - DNA, 201 bp, Bos taurus
aaatgggtggatctatcctgaaatgaagaggcggtcgctgataaatgaggtatgccttgtcctgagttgtctgaagctaccccagggccccagagatgtgacttcaccctcactgaacagtggggggaaaactgagacccacgaaggtgaagcatttggccagggcagaaacaggattctttctgcccagccctaggctta

SEQ ID NO: 95849 - DNA, 201 bp, Bos taurus; identical to SEQ ID NO: 14369

SEQ ID NO: 95850 - DNA, 201 bp, Bos taurus; identical to SEQ ID NO: 14370

SEQ ID NO: 95851 - DNA, 201 bp, Bos taurus; identical to SEQ ID NO: 14371

SEQ ID NO: 95852 - DNA, 201 bp, Bos taurus; identical to SEQ ID NO: 14374

SEQ ID NO: 95853 - DNA, 201 bp, Bos taurus
cctcgaccaagtggtccggctttgtggagtggaggaaacaggcaggatagaggccagcccactccccaacgccccttggcccctgctcagttaccctgcacaaagcaaggatgtctgtgccaagtcccgtgccatcattctagccctacgtggaagctggtcttgggggaattccacccagtccctgaggcctgcgtggcc

SEQ ID NO: 95854 - DNA, 201 bp, Bos taurus; identical to SEQ ID NO: 14375

SEQ ID NO: 95855 - DNA, 201 bp, Bos taurus; identical to SEQ ID NO: 14376

SEQ ID NO: 95856 - DNA, 201 bp, Bos taurus; identical to SEQ ID NO: 14380

SEQ ID NO: 95857 - DNA, 201 bp, Bos taurus; identical to SEQ ID NO: 14381

SEQ ID NO: 95858 - DNA, 201 bp, Bos taurus; identical to SEQ ID NO: 14382

SEQ ID NO: 95859 - DNA, 201 bp, Bos taurus; identical to SEQ ID NO: 14383

SEQ ID NO: 95860 - DNA, 201 bp, Bos taurus; identical to SEQ ID NO: 14384

SEQ ID NO: 95861 - DNA, 201 bp, Bos taurus; identical to SEQ ID NO: 14385

SEQ ID NO: 95862 - DNA, 201 bp, Bos taurus; identical to SEQ ID NO: 14386

SEQ ID NO: 95863 - DNA, 201 bp, Bos taurus
tcttggtttaagtgggagagtctcccaggagactttgtgctcctggaagtcggggcctgccgacccccagtgcacagccagctcctggccctagagcaaatgctagcacatgttttccaagtccatcattttccttacagagaagctggagaaagaggtcgcttgtggccaagggacgtcctcgggtaatccgcagagacg

SEQ ID NO: 95864 - DNA, 201 bp, Bos taurus; identical to SEQ ID NO: 14387

SEQ ID NO: 95865 - DNA, 201 bp, Bos taurus; identical to SEQ ID NO: 14388

SEQ ID NO: 95866 - DNA, 201 bp, Bos taurus; identical to SEQ ID NO: 14389

SEQ ID NO: 95867 - DNA, 201 bp, Bos taurus
aggcagagagagacgcatgcacacacacgcatatggggtgtgagggaggcagctctgttatctgttggtcctttgatagctcatcacagtcacacctcccggtacactgtggactctggccacagcaagagcaggcgaggagctactctgaagctcaagttccaaagcaggagatacggggagaacaatcagctgtctgga

SEQ ID NO: 95868 - DNA, 201 bp, Bos taurus; identical to SEQ ID NO: 14391

SEQ ID NO: 95869 - DNA, 201 bp, Bos taurus; identical to SEQ ID NO: 14393

SEQ ID NO: 95870 - DNA, 201 bp, Bos taurus; identical to SEQ ID NO: 14395

SEQ ID NO: 95871 - DNA, 201 bp, Bos taurus; identical to SEQ ID NO: 14396

SEQ ID NO: 95872 - DNA, 201 bp, Bos taurus; identical to SEQ ID NO: 14397

SEQ ID NO: 95873 - DNA, 201 bp, Bos taurus; identical to SEQ ID NO: 14399

SEQ ID NO: 95874 - DNA, 201 bp, Bos taurus
ttagtttctcaatggtccaacttctgcaacaagactatttcttgagaaactcgcaaatgtgcccacgttgtgttcctataccaggctttgagtaggaaaaaactgttactgtaaatcactgacttttaatttttgctgctcaatataatctcctggcttggaaaagatcagtttgctttccaatccaaagaaaggcaatgc

SEQ ID NO: 95875 - DNA, 201 bp, Bos taurus; identical to SEQ ID NO: 14400

SEQ ID NO: 95876 - DNA, 201 bp, Bos taurus; identical to SEQ ID NO: 14401

SEQ ID NO: 95877 - DNA, 201 bp, Bos taurus; identical to SEQ ID NO: 14402

SEQ ID NO: 95878 - DNA, 201 bp, Bos taurus; identical to SEQ ID NO: 14403

SEQ ID NO: 95879 - DNA, 201 bp, Bos taurus
cagaggaactgtttggccagggaagctgttggtgaaacaacacaaatttgattcacggaaaatgaacttaattcttgttttgcagtctttgggggatgataattgatcaaaaacgttattcttttatatttactatgaagttcctagactaacagacaattttgggggcgggggggaagctttcatgagttcctgctctat

SEQ ID NO: 95880 - DNA, 201 bp, Bos taurus
gagaaatccttgagggatgccaaccacatgcttgtcttgatgcagagcactaggtaccagctcgccctctcccacaagcctgccaagatcgatgtggcccgagtaactttcgacctatacaaggtgaacccacaggacttcattggctgcctgaacgtgaaggcaactctctatggcacatactccgtctcctatgatctc

SEQ ID NO: 95881 - DNA, 201 bp, Bos taurus; identical to SEQ ID NO: 14407

SEQ ID NO: 95882 - DNA, 201 bp, Bos taurus
cacccctgctggtgacccggagcttatcacctcacctctgtgtctcagtcacatcttacagtgactgactacaacactttgtaggtgtgctgtaaactgtgagctctgtggagggagtactgctaattcttatcccctcacttcattctttcagttacttcatgaggtaggtacagcagcagttcttatacccattttaca

SEQ ID NO: 95883 - DNA, 201 bp, Bos taurus
tttaactttactgtttacggaactctttcatgtatgtgtatattttctaacttgacttttaccacaattcataggtaagtctcataaatcccagtttatatataaggttaataccttgagacagagctggaattaactcagaatctattttttttaagtccatgtttgagtaagaaatagtcttaccagaccacagcatgt

SEQ ID NO: 95884 - DNA, 201 bp, Bos taurus; identical to SEQ ID NO: 14409

SEQ ID NO: 95885 - DNA, 201 bp, Bos taurus
gaggaaagggtatcaaagaagaaaatagtcattgtgtcctttacactggaggaagtgttttgggctctcccatgtagacattttctaggccatcggtagcgtgtttgtaaggaaagcaacaactttaggcaagtaagtttataatcagataggaaaaaaatgagatttttgtttatttcattattacccgtgtgctaacta

SEQ ID NO: 95886 - DNA, 201 bp, Bos taurus; identical to SEQ ID NO: 14410

SEQ ID NO: 95887 - DNA, 201 bp, Bos taurus; identical to SEQ ID NO: 14411

SEQ ID NO: 95888 - DNA, 201 bp, Bos taurus
ctgggggcagtgaaccggccagagcaaggggctgagacacaacaggtgccggcagccagattagggagcatctgtacactgggggttgcaaactctggccttcaccctgctttatataaataaagttttattggagcacagctcatttgtttgtgtactgtctgtggctgcttttatacttcaagggcagagttaagcagt

SEQ ID NO: 95889 - DNA, 201 bp, Bos taurus
tttagtctggatattaaatagtctgatacagatggtagaaggattctggctttaaatttaaattttagatactttaataagcatggcccaggtatatagcgctgtgattaatggagcatctgaaattatgcattatgttcatgaaatttagattggcctgtttgcttggatctatgctcagttatacccaagggagagaat

SEQ ID NO: 95890 - DNA, 201 bp, Bos taurus
tgctgacagccctgctacagagcacatccagatctttagcttagattcccttacccaggaatatggaggtctggaggataagtagctgtgggactgggcctgagattgtgtacgtctgacaagtttccaggtgatgccattaacaccactcatgaatcactttcaggggccaaatgcaacattgtgctttacgttattttg

SEQ ID NO: 95891 - DNA, 201 bp, Bos taurus; identical to SEQ ID NO: 14414

SEQ ID NO: 95892 - DNA, 201 bp, Bos taurus; identical to SEQ ID NO: 14415

SEQ ID NO: 95893 - DNA, 201 bp, Bos taurus; identical to SEQ ID NO: 14416

SEQ ID NO: 95894 - DNA, 201 bp, Bos taurus; identical to SEQ ID NO: 14417

SEQ ID NO: 95895 - DNA, 201 bp, Bos taurus; identical to SEQ ID NO: 14418

SEQ ID NO: 95896 - DNA, 201 bp, Bos taurus; identical to SEQ ID NO: 14419

SEQ ID NO: 95897 - DNA, 201 bp, Bos taurus
tacatgatttatgacagaacatatcggttcagccagtgatttgggcaagaatggtgagtgctgaagatcaaacatggtatctcatccgtgtctcacatgcctgctttgtttcctggcacacagtagggggctgacaaaattcttagagtggatcaatgagcatctgtaaagagaagagactattgcaagctgtatgtagtt

SEQ ID NO: 95898 - DNA, 201 bp, Bos taurus; identical to SEQ ID NO: 14420

SEQ ID NO: 95899 - DNA, 201 bp, Bos taurus
ctcctcattactgctttcagatgcctccctccctttgacctaaaaacatccacagattgaagcttcatccatcaaatcacaccaccaatcaccagccttttctttatcattctacagtgttatctcctggagtttttccacttgccatactgtcattctctaaagttaccctctcacttctttgtgagttatgtatacttg

SEQ ID NO: 95900 - DNA, 201 bp, Bos taurus; identical to SEQ ID NO: 14422

SEQ ID NO: 95901 - DNA, 201 bp, Bos taurus; identical to SEQ ID NO: 14423

SEQ ID NO: 95902 - DNA, 201 bp, Bos taurus
acaaagtgtgatctgagcaatgggatacttggaagttaacttcaatcaaatattattaaaaggaaagataagaataaagcaaaacttaaaaattaatcgatttctatttcaacattgggcaaatgaaaactgaacctcggatttgctaatgcttgtacagttaaataatagtgaaagtatttaagaaaaataaaataagaa

SEQ ID NO: 95903 - DNA, 201 bp, Bos taurus; identical to SEQ ID NO: 14424

SEQ ID NO: 95904 - DNA, 201 bp, Bos taurus; identical to SEQ ID NO: 14425

SEQ ID NO: 95905 - DNA, 201 bp, Bos taurus; identical to SEQ ID NO: 14426

SEQ ID NO: 95906 - DNA, 201 bp, Bos taurus; identical to SEQ ID NO: 14428

SEQ ID NO: 95907 - DNA, 201 bp, Bos taurus; identical to SEQ ID NO: 14429

SEQ ID NO: 95908 - DNA, 201 bp, Bos taurus; identical to SEQ ID NO: 14430

SEQ ID NO: 95909 - DNA, 201 bp, Bos taurus; identical to SEQ ID NO: 14431

SEQ ID NO: 95910 - DNA, 201 bp, Bos taurus
ccgacagatcacctggatcaacacagatgcaaaggaagacatttcagaaggctctgtggttcacatggatacctaagttccaaagatcctggggctttcccttttgttaatagcatttgctgattgtatttctaactccaaaagtaatatgatcaggggaaatttgaattacaccaaaaagtataaagaataaactaaaaa

SEQ ID NO: 95911 - DNA, 201 bp, Bos taurus
tgatgacagaaagaaacttctaaacgaaagccatcactcagtcacagtattttattctgcatcatttattaaatatttttatatatgcatttacaaactttactcatttcagaactctgctttcaatacatttttaaactttttttggtagagtctctcgtaaaatgagatccatgtacaaaactaggcaacagatataaa

SEQ ID NO: 95912 - DNA, 201 bp, Bos taurus; identical to SEQ ID NO: 14432

SEQ ID NO: 95913 - DNA, 201 bp, Bos taurus
actgaacatcaaataaacaacccaaccttatacctaaagcaacaagaaaaagaacagcaacaaaagaaacaagactgtatgatggaccgaattctcagcacagcaaagagaatttatcatctccaacgccatgaatcagtcttcagtcccttttcacccactccatctcagaggagggaaaaaataaacaaacaaacagca

SEQ ID NO: 95914 - DNA, 201 bp, Bos taurus
aacagcaagacatagacaattaccagttgccaacagtaccaattcagaaattcaaagtatctaaacacttataatgatcaaagctgccagtattatttcaagccaagtttttcacttacacccccatccttcccactgtatccccatcacgcccacttcactttccggtccctccgtggtggatgcaggggatttggacag

SEQ ID NO: 95915 - DNA, 201 bp, Bos taurus
tgtgacaggtaagccataaaaccaattggtctcaatcaaaaattctatattttacatgacggattgcagcatttggcctcagttcttcacttatccctgagccatgccctctgccttgtaacctttcagtgcacatcttccatgggtggcctggcccctgggttgcctcttgactttggggtcagcccggagtgatgtgct

SEQ ID NO: 95916 - DNA, 201 bp, Bos taurus; identical to SEQ ID NO: 14433

SEQ ID NO: 95917 - DNA, 201 bp, Bos taurus; identical to SEQ ID NO: 14434

SEQ ID NO: 95918 - DNA, 201 bp, Bos taurus; identical to SEQ ID NO: 14435

SEQ ID NO: 95919 - DNA, 201 bp, Bos taurus; identical to SEQ ID NO: 14436

SEQ ID NO: 95920 - DNA, 201 bp, Bos taurus; identical to SEQ ID NO: 14437

SEQ ID NO: 95921 - DNA, 201 bp, Bos taurus
ttggacttctggcctctagacctgtgagagacaaatatttgttgtcgtaagccactcatcttgtaataatgagttgttttcatgacaaaaaaaattaatgcatggcctgtgtcatttttaaactatagactggctcatactatatctttaaaaacttaaaatgctcactacctcatcttattattatggtcattggtcatt

SEQ ID NO: 95922 - DNA, 201 bp, Bos taurus; identical to SEQ ID NO: 14438

SEQ ID NO: 95923 - DNA, 201 bp, Bos taurus
ttacctggaaggagagagtttaatacaaagaattattagctagatacccaactgtcgtctctgtaagtaaatatcaggccaaaagaaaccactaaggtcttctggagtagcagctgcaggaaatagttacccggacccgcctccagggactggagggaagaagggaaatgtaaactcagaagcccagagaaggggcctgcg

SEQ ID NO: 95924 - DNA, 201 bp, Bos taurus
taagtaaaaacatctttgtcaaatatagtcatctcttatgggattctctgcaaactttttcatcttttttgaaattagaatgtctttgtgggccaagatcggtttttaaatgtggttccttctaccctaagatcttgattctatgctgtttaagtgacttttgttttcttttcagagaaagtttcattgtgcaaatttgac

SEQ ID NO: 95925 - DNA, 201 bp, Bos taurus
ttgttacccgctgttgcagatacttccgagcttaaaattagaacacagactctgccaagttttctggggaaatatatgagtttaaaaaatagggtacagggtaaaataacttgatgaggaagtctgaattaataagaaagttacaaatgcagaaacaaaaagaggagatggctgccctggctctaactgaaggcattctgc

SEQ ID NO: 95926 - DNA, 201 bp, Bos taurus; identical to SEQ ID NO: 14439

SEQ ID NO: 95927 - DNA, 201 bp, Bos taurus; identical to SEQ ID NO: 14440

SEQ ID NO: 95928 - DNA, 201 bp, Bos taurus; identical to SEQ ID NO: 14441

SEQ ID NO: 95929 - DNA, 201 bp, Bos taurus
cttgatgacagctcttcgggggaaatataatattatttctttctttatactttacctttgcacatattgaatatgtacttctgaggtgacagaaaatatgttcagtgctactgatgatacaaagacaaaaagatgtggtccctatcattaaggttgctattattacagaaagacagtgaactggatagacactgcaggcaa

SEQ ID NO: 95930 - DNA, 201 bp, Bos taurus
agtgagaagtgggaagcataaagctagccacttgccatcttccctttctcatgatagactgatgtacatttttctccaaatgctatctggctaattaacacattcatgttctgcatgccctcctacctcaatttaggactggctttcatttcttcctgaatacatctagtctgatagtttctaggaacaagtcctggttct

SEQ ID NO: 95931 - DNA, 201 bp, Bos taurus
atattcatgcctattaaatatgattttcccaagtaacttctagatttcaattaggtttataaatatattttcatataatttttttgcctagtcaaatcatcctaatgattttgcatattaaccaaactacaactcacctttgttatagttttggctattttgcaatactaaccttcaagtcacacatacttatctatttct

SEQ ID NO: 95932 - DNA, 201 bp, Bos taurus; identical to SEQ ID NO: 14442

SEQ ID NO: 95933 - DNA, 201 bp, Bos taurus; identical to SEQ ID NO: 14443

SEQ ID NO: 95934 - DNA, 201 bp, Bos taurus
tctaaagctcatttattctagcagcaatgtcccgaagagactgttgaacagtagttataaataagacccatcccctcccccagttaccttctaggcctcacgctctggctgcctgatgtctttctcataaattccctttgtgctaatgtaagccagaatctatggcctgcaggtcacatacactgtagtggttgcgataga

SEQ ID NO: 95935 - DNA, 201 bp, Bos taurus; identical to SEQ ID NO: 14444

SEQ ID NO: 95936 - DNA, 201 bp, Bos taurus
agagggagagtttgaagatacatgaaaggagaacagaggaggaggaaatacctgtagttataaagcaatttccacacaaaggagttgtcagagggaaatgttgacgcatgtaaagactcgacctgcacacatatccactcttggaagcacactgaggaagtaagcgatagaaaatgagttaggccaagtgaaaagttcaat

SEQ ID NO: 95937 - DNA, 201 bp, Bos taurus
cttccttgtttgaagggaaagaacttcttgtgcaagaaatgtttagggggcaaatagtgaagtttcttcttaactcattaatttttgaccctagaagtaagcatattaagtggttaatagcttctccaacttgattgacaacaaagcttttatggaaatactattggatagtatgttagtgactttgtatgtaatgtggag

SEQ ID NO: 95938 - DNA, 201 bp, Bos taurus; identical to SEQ ID NO: 14445

SEQ ID NO: 95939 - DNA, 201 bp, Bos taurus
gaacagcagaaagaataagcaaaatattaaacagagctagttctaaagaactacttcctagcctctctactaggaggtgaacagaagctttgcccatacaattatgagcaaaccctatttataccacgagttcttcctcaaagcatcctttttttttttttttcctgttgaaatcacaccaaataacttagttttccttga

SEQ ID NO: 95940 - DNA, 201 bp, Bos taurus; identical to SEQ ID NO: 14446

SEQ ID NO: 95941 - DNA, 201 bp, Bos taurus; identical to SEQ ID NO: 14447

SEQ ID NO: 95942 - DNA, 201 bp, Bos taurus; identical to SEQ ID NO: 14448

SEQ ID NO: 95943 - DNA, 201 bp, Bos taurus; identical to SEQ ID NO: 14449

SEQ ID NO: 95944 - DNA, 201 bp, Bos taurus
acaaaagtaatagatgccttaacttgttgccttctacttttacatcctttgctgtctacttttgagctattgtgaataaaacatcaggaacatagactatgatgtcacgtgaacgcgtaggagtcttttatctggaacacatgtcaaatgttttgttattctgaggaattagtctaaagactagtgttgaatgtttttcct

SEQ ID NO: 95945 - DNA, 201 bp, Bos taurus
ttatgtgaatatttgtaaaatcttctatgtaagctagcagtcgctttattaatgtgagagaaagtactttattattgatttccagtttatagagacctcagttttatggttaagttttttatctatatatttgtccgtttagtagaaaaatgacatacctattagccaaagctggtgtaatattgtgctgctcctaaaaaa

SEQ ID NO: 95946 - DNA, 201 bp, Bos taurus
ccactactaaaaatctatttttacattgtcgagaaacgtaaatcttgataggttatgcgacctacccaaggttccaaggctaaaaatggtaaagttaaatcttgaggctctatttctgatgtcaaaagtctgtattcttgacaaccaaggcttattacttccattcagtcattgttttgattaagttaggctagtttaatt

SEQ ID NO: 95947 - DNA, 201 bp, Bos taurus
tgtgcttaattaagaaaaactggactgtggggaaagttttcttttttcctgctttactaaactaaacttgtcaaattaaagaaaaacaagcaaaacagatgggtatagttcaaaactatatctaatctaataagatggtatttaagaaaatatatattaagtcttaggttttaaaactgatatacttattcagaataggaa

SEQ ID NO: 95948 - DNA, 201 bp, Bos taurus; identical to SEQ ID NO: 14450

SEQ ID NO: 95949 - DNA, 201 bp, Bos taurus
tcttatatatttaaagataaacatatataattaaaccttgcctgtgtgtgtgcatgcttagtggcttcagtagtgtccacactttgtgaacccttggactatagcccattagactcctctgtccatggaatccttcaggtaagaatactgaagggggttgctatgccagcctccagggcatcatcctgatctaggaatcaa

SEQ ID NO: 95950 - DNA, 201 bp, Bos taurus; identical to SEQ ID NO: 14451

SEQ ID NO: 95951 - DNA, 201 bp, Bos taurus
ttaacaagttttagggattaggaattgagtttgattctaaaatttaggagcacggatgtcagctttgaatattttccaaacatcccatgaccatagatttatagaatggaagtgctattcctcatgcactattccccactgtcagtcagtcccagtcatgcttgtctttaagaaaaaaagcatcccagtcatttagaactc

SEQ ID NO: 95952 - DNA, 201 bp, Bos taurus
accaggagtgtggggttgggggtgagggaagatcaccagcattccttcccctcatgcagctgctcataagaaaggcatctctataaaagaggctcttaatttgatgtctaggcatctctagatggggtccgtggatgcccttcaaaggatctgaaaatcaacggaactgctagtaaaactttctatgtctgatttcgtaga

SEQ ID NO: 95953 - DNA, 201 bp, Bos taurus
gatgaaggatgcatgactggacccatagaaatgtacaagattttttttcaagtgtgctatctccctgtgggtggttttgaaggggccagaaataacagccgtcttccccacgagtttgaaaaacaccataaactaagacccagcactcagcagagggtagccgtgacacccctcttaatccttatgaggctgctattgcag

SEQ ID NO: 95954 - DNA, 201 bp, Bos taurus; identical to SEQ ID NO: 14452

SEQ ID NO: 95955 - DNA, 201 bp, Bos taurus; identical to SEQ ID NO: 14453

SEQ ID NO: 95956 - DNA, 201 bp, Bos taurus; identical to SEQ ID NO: 14454

SEQ ID NO: 95957 - DNA, 201 bp, Bos taurus; identical to SEQ ID NO: 14455

SEQ ID NO: 95958 - DNA, 201 bp, Bos taurus; identical to SEQ ID NO: 14456

SEQ ID NO: 95959 - DNA, 201 bp, Bos taurus
gaatctgcctgcaatgcaggagacctgggtttgatccctgggttgggaagatcccctggagaagggaaaagctactcactccagtattatggcctggagaattagatggactgtatagtaaaagaggtctgaaagagtcagacacaactgagcgactttcatttcacttcacaactgatataatccccagtgcccagaatg

SEQ ID NO: 95960 - DNA, 201 bp, Bos taurus; identical to SEQ ID NO: 14457

SEQ ID NO: 95961 - DNA, 201 bp, Bos taurus; identical to SEQ ID NO: 14458

SEQ ID NO: 95962 - DNA, 201 bp, Bos taurus; identical to SEQ ID NO: 14459

SEQ ID NO: 95963 - DNA, 201 bp, Bos taurus; identical to SEQ ID NO: 14460

SEQ ID NO: 95964 - DNA, 201 bp, Bos taurus; identical to SEQ ID NO: 14461

SEQ ID NO: 95965 - DNA, 201 bp, Bos taurus; identical to SEQ ID NO: 14462

SEQ ID NO: 95966 - DNA, 201 bp, Bos taurus; identical to SEQ ID NO: 14463

SEQ ID NO: 95967 - DNA, 201 bp, Bos taurus; identical to SEQ ID NO: 14464

SEQ ID NO: 95968 - DNA, 201 bp, Bos taurus; identical to SEQ ID NO: 14465

SEQ ID NO: 95969 - DNA, 201 bp, Bos taurus; identical to SEQ ID NO: 14466

SEQ ID NO: 95970 - DNA, 201 bp, Bos taurus; identical to SEQ ID NO: 14467

SEQ ID NO: 95971 - DNA, 201 bp, Bos taurus; identical to SEQ ID NO: 14468

SEQ ID NO: 95972 - DNA, 201 bp, Bos taurus; identical to SEQ ID NO: 14469

SEQ ID NO: 95973 - DNA, 201 bp, Bos taurus; identical to SEQ ID NO: 14470

SEQ ID NO: 95974 - DNA, 201 bp, Bos taurus; identical to SEQ ID NO: 14471

SEQ ID NO: 95975 - DNA, 201 bp, Bos taurus; identical to SEQ ID NO: 14472

SEQ ID NO: 95976 - DNA, 201 bp, Bos taurus; identical to SEQ ID NO: 14473

SEQ ID NO: 95977 - DNA, 201 bp, Bos taurus; identical to SEQ ID NO: 14474

SEQ ID NO: 95978 - DNA, 201 bp, Bos taurus; identical to SEQ ID NO: 14475

SEQ ID NO: 95979 - DNA, 201 bp, Bos taurus; identical to SEQ ID NO: 14476

SEQ ID NO: 95980 - DNA, 201 bp, Bos taurus; identical to SEQ ID NO: 14477

SEQ ID NO: 95981 - DNA, 201 bp, Bos taurus; identical to SEQ ID NO: 14478

SEQ ID NO: 95982 - DNA, 201 bp, Bos taurus; identical to SEQ ID NO: 14479

SEQ ID NO: 95983 - DNA, 201 bp, Bos taurus; identical to SEQ ID NO: 14481

SEQ ID NO: 95984 - DNA, 201 bp, Bos taurus; identical to SEQ ID NO: 14482

SEQ ID NO: 95985 - DNA, 201 bp, Bos taurus; identical to SEQ ID NO: 14483

SEQ ID NO: 95986 - DNA, 201 bp, Bos taurus; identical to SEQ ID NO: 14484

SEQ ID NO: 95987 - DNA, 201 bp, Bos taurus; identical to SEQ ID NO: 14485

SEQ ID NO: 95988 - DNA, 201 bp, Bos taurus; identical to SEQ ID NO: 14486

SEQ ID NO: 95989 - DNA, 201 bp, Bos taurus; identical to SEQ ID NO: 14487

SEQ ID NO: 95990 - DNA, 201 bp, Bos taurus; identical to SEQ ID NO: 14488

SEQ ID NO: 95991 - DNA, 201 bp, Bos taurus; identical to SEQ ID NO: 14489

SEQ ID NO: 95992 - DNA, 201 bp, Bos taurus; identical to SEQ ID NO: 14490

SEQ ID NO: 95993 - DNA, 201 bp, Bos taurus; identical to SEQ ID NO: 14491

SEQ ID NO: 95994 - DNA, 201 bp, Bos taurus; identical to SEQ ID NO: 14492

SEQ ID NO: 95995 - DNA, 201 bp, Bos taurus; identical to SEQ ID NO: 14493

SEQ ID NO: 95996 - DNA, 201 bp, Bos taurus; identical to SEQ ID NO: 14494

SEQ ID NO: 95997 - DNA, 201 bp, Bos taurus; identical to SEQ ID NO: 14495

SEQ ID NO: 95998 - DNA, 201 bp, Bos taurus; identical to SEQ ID NO: 14496

SEQ ID NO: 95999 - DNA, 201 bp, Bos taurus; identical to SEQ ID NO: 14497

SEQ ID NO: 96000 - DNA, 201 bp, Bos taurus; identical to SEQ ID NO: 14498

SEQ ID NO: 96001 - DNA, 201 bp, Bos taurus; identical to SEQ ID NO: 14499

SEQ ID NO: 96002 - DNA, 201 bp, Bos taurus; identical to SEQ ID NO: 14500

SEQ ID NO: 96003 - DNA, 201 bp, Bos taurus; identical to SEQ ID NO: 14503

SEQ ID NO: 96004 - DNA, 201 bp, Bos taurus; identical to SEQ ID NO: 14504

SEQ ID NO: 96005 - DNA, 201 bp, Bos taurus; identical to SEQ ID NO: 14505

SEQ ID NO: 96006 - DNA, 201 bp, Bos taurus; identical to SEQ ID NO: 14506

SEQ ID NO: 96007 - DNA, 201 bp, Bos taurus; identical to SEQ ID NO: 14507

SEQ ID NO: 96008 - DNA, 201 bp, Bos taurus; identical to SEQ ID NO: 14508

SEQ ID NO: 96009 - DNA, 201 bp, Bos taurus; identical to SEQ ID NO: 14509

SEQ ID NO: 96010 - DNA, 201 bp, Bos taurus; identical to SEQ ID NO: 14510

SEQ ID NO: 96011 - DNA, 201 bp, Bos taurus; identical to SEQ ID NO: 14512

SEQ ID NO: 96012 - DNA, 201 bp, Bos taurus; identical to SEQ ID NO: 14513

SEQ ID NO: 96013 - DNA, 201 bp, Bos taurus; identical to SEQ ID NO: 14514

SEQ ID NO: 96014 - DNA, 201 bp, Bos taurus; identical to SEQ ID NO: 14517

SEQ ID NO: 96015 - DNA, 201 bp, Bos taurus; identical to SEQ ID NO: 14518

SEQ ID NO: 96016 - DNA, 201 bp, Bos taurus; identical to SEQ ID NO: 14519

SEQ ID NO: 96017 - DNA, 201 bp, Bos taurus; identical to SEQ ID NO: 14520

SEQ ID NO: 96018 - DNA, 201 bp, Bos taurus; identical to SEQ ID NO: 14521

SEQ ID NO: 96019 - DNA, 201 bp, Bos taurus; identical to SEQ ID NO: 14522

SEQ ID NO: 96020 - DNA, 201 bp, Bos taurus
caggaattatttttaattcagccctatagctgccaaaagactcttgcattgatggcatttactggatagatcatctgttagtgttttataggcccatactcaagtagtactcatgaagcagtcaggtcagttcagtcgctcagtcatgtctgactctttgtgatccctgaattgcagcatgccaggcctccctgtccatcg

SEQ ID NO: 96021 - DNA, 201 bp, Bos taurus; identical to SEQ ID NO: 14523

SEQ ID NO: 96022 - DNA, 201 bp, Bos taurus; identical to SEQ ID NO: 14524

SEQ ID NO: 96023 - DNA, 201 bp, Bos taurus
ttccaaatcgacttcattccgtgttgccaaaaatagctcactcttgtaacttcagattattttcttattgcctttgaattcatcagttaataatgcagccgagcaatacgtactttttaattcctctacatatgccaacatggtgtgtctttttcaatatgatacccccctccccaaataatgttctctggaaaggaaaaa

SEQ ID NO: 96024 - DNA, 201 bp, Bos taurus
aatgctaatgaagctatgtctatacagtatgtactgaacccacaagaagagaatgattgttacaagcagtgcgactggaacacaggcgttttagggcatttgcaccaagccttctaccagaagaagttaagaatcacccagtagctacaaagcaggctctgagctcacttctgaaaatcatgaaaggacattggaggcccg

SEQ ID NO: 96025 - DNA, 201 bp, Bos taurus
ttaaatcagtgcggtgtcttgttttataagacccagatcaacacactgccagaccatttgttaagccacccctgcatcctatttgtaaatgtgtgtggctacacatatcaaagccagcaaaagctttgggtaaggaacaacgcgtctggtcattttttttttttaagagcttctgatctttcttcatcaaagacatggagt

SEQ ID NO: 96026 - DNA, 201 bp, Bos taurus; identical to SEQ ID NO: 14525

SEQ ID NO: 96027 - DNA, 201 bp, Bos taurus; identical to SEQ ID NO: 14526

SEQ ID NO: 96028 - DNA, 201 bp, Bos taurus; identical to SEQ ID NO: 14527

SEQ ID NO: 96029 - DNA, 201 bp, Bos taurus; identical to SEQ ID NO: 14528

SEQ ID NO: 96030 - DNA, 201 bp, Bos taurus; identical to SEQ ID NO: 14529

SEQ ID NO: 96031 - DNA, 201 bp, Bos taurus; identical to SEQ ID NO: 14530

SEQ ID NO: 96032 - DNA, 201 bp, Bos taurus
tttcatggaaaaaagagttaaagagaatgtttcaaacacatctgagatctgaatgcaaattcctgaattcattggtggcaagggccaagatttgagagaaacatggcatgtgcccaaaggaggtcagtaaggggaggctcaaggctgagcgaagccacaaagtctcaagagctgaggacggggttagggctcagcacccct

SEQ ID NO: 96033 - DNA, 201 bp, Bos taurus; identical to SEQ ID NO: 14531

SEQ ID NO: 96034 - DNA, 201 bp, Bos taurus; identical to SEQ ID NO: 14532

SEQ ID NO: 96035 - DNA, 201 bp, Bos taurus; identical to SEQ ID NO: 14533

SEQ ID NO: 96036 - DNA, 201 bp, Bos taurus; identical to SEQ ID NO: 14534

SEQ ID NO: 96037 - DNA, 201 bp, Bos taurus
tgaaatttaagatttactctcttaattttcctgtgttttgtacagcagtgttatctgtgttcctcatgttgtacgttgtatctctagtactaacttataactggaagtttgtacctttgaccatcatcctccaattcctcctctcccctaatccgtcacccctaatagtcacaagtccggtccctatttctatgagtttta

SEQ ID NO: 96038 - DNA, 201 bp, Bos taurus; identical to SEQ ID NO: 14535

SEQ ID NO: 96039 - DNA, 201 bp, Bos taurus; identical to SEQ ID NO: 14536

SEQ ID NO: 96040 - DNA, 201 bp, Bos taurus; identical to SEQ ID NO: 14537

SEQ ID NO: 96041 - DNA, 201 bp, Bos taurus; identical to SEQ ID NO: 14538

SEQ ID NO: 96042 - DNA, 201 bp, Bos taurus; identical to SEQ ID NO: 14539

SEQ ID NO: 96043 - DNA, 201 bp, Bos taurus; identical to SEQ ID NO: 14540

SEQ ID NO: 96044 - DNA, 201 bp, Bos taurus; identical to SEQ ID NO: 14541

SEQ ID NO: 96045 - DNA, 201 bp, Bos taurus; identical to SEQ ID NO: 14542

SEQ ID NO: 96046 - DNA, 201 bp, Bos taurus; identical to SEQ ID NO: 14544

SEQ ID NO: 96047 - DNA, 201 bp, Bos taurus
tgatgctctctgtctagacttcttgatggtgtatgtatgatgttccttagaatatgacccccaactttcacatccttgagcctggcatggcctgctcatgtaactcattttaagagacggattgttggttaatcaccttcatgaattaagccaatgtgggcagtaaccagggccagacagtgtcctaaaccaatgcaaaga

SEQ ID NO: 96048 - DNA, 201 bp, Bos taurus
tgactctatcgtgttctgtttaactccctcatcccctaggattgtaggggataatggtggctttttaaaacatattttgcacaagtattttgcttacagttctgattgatgatgaatatttgcttggtgatgtctgcagaacctttggttagagtctgtatatagagttaagtgattagggtcagacagttattgggacta

SEQ ID NO: 96049 - DNA, 201 bp, Bos taurus; identical to SEQ ID NO: 14545

SEQ ID NO: 96050 - DNA, 201 bp, Bos taurus
aagttatctgtttaaggcctttcaggccccaaatccaggattgaaacccaaatctgggcgaagctttgctatagtgtagatttttggatcacggtgaaggaatacctagcaccctcaccttccaaacaggttggaaagtcatgttttcttgacttcttttgccagatatggccaggctttagatttaaaaacaagaatcaa

SEQ ID NO: 96051 - DNA, 201 bp, Bos taurus; identical to SEQ ID NO: 14546

SEQ ID NO: 96052 - DNA, 201 bp, Bos taurus
agggtagtcacatatctatgtatttatatccacctctatcactatttatagtaagagtgagtcctgtttttgttaattggaatggcatcacactgaatacgctgtttgatcatctgtttctgtcatctaacagtagaacacggacttttttcaatgtcattaaatataagccaacattttcttttatgatataccataatt

SEQ ID NO: 96053 - DNA, 201 bp, Bos taurus
cgttgggctctgacctaactagacttgttgatcccgatacagggatggggacctggcaggagccagtttagtgtgaaattagactgaatccaggaccaagcggcccttcctccctgggcatttcacaatttcttggccgtccttgcaggcgcctgatgcatttaactggatgtttacatagcagagtttactcttgcagag

SEQ ID NO: 96054 - DNA, 201 bp, Bos taurus
caagaccctgagtctcagggagccaacagtgggtaagaccaagaaccaacaaagcttctatagagagccggagagtaaatatctgaggttgtacaggccatgtgaagactcgataacatatttccctttgccaaatttttgtccggtctttaaaactgtacaaatcattcttatctcaaggaactttcaaatttggccatg

SEQ ID NO: 96055 - DNA, 201 bp, Bos taurus
aagatgtcaaattcctgattaggagaactttttgttaaaatattacatatatatgcatgtatagtttatatactatttcttaaaacatgccttctctataatagtttttcaatctaccaaatacatttggaagatattcagatggcttgtggttcgaaccacaccaatggtttgcagttccatataattagtagataatta

SEQ ID NO: 96056 - DNA, 201 bp, Bos taurus
cagccttacagctagaaccgaggccctgggcacatgaccccagctgagtattccagatgagacttcaattatcaagatgcagagataagcctttctcactatacccaggccaaatttctgacccacaaaatcatgagcataataaaatggttgttgtcttctgccactaagttttggggtggtttcttagacaaaagtgaa

SEQ ID NO: 96057 - DNA, 201 bp, Bos taurus; identical to SEQ ID NO: 14547

SEQ ID NO: 96058 - DNA, 201 bp, Bos taurus; identical to SEQ ID NO: 14548

SEQ ID NO: 96059 - DNA, 201 bp, Bos taurus; identical to SEQ ID NO: 14549

SEQ ID NO: 96060 - DNA, 201 bp, Bos taurus; identical to SEQ ID NO: 14550

SEQ ID NO: 96061 - DNA, 201 bp, Bos taurus; identical to SEQ ID NO: 14551

SEQ ID NO: 96062 - DNA, 201 bp, Bos taurus; identical to SEQ ID NO: 14552

SEQ ID NO: 96063 - DNA, 201 bp, Bos taurus; identical to SEQ ID NO: 14553

SEQ ID NO: 96064 - DNA, 201 bp, Bos taurus
gaactgtaaaatgaacttaccagtaatagattcttatcagggctgaaggccacaggagaaaagaggctacgaatgccaggatcggaagggccagtgttccacccgcaatcacaaacatgttaaccacgtcaagatccatcctgctctttaggtctggcttatacctagaggggctgaaaagacagacagcactgaaactct

SEQ ID NO: 96065 - DNA, 201 bp, Bos taurus; identical to SEQ ID NO: 14554

SEQ ID NO: 96066 - DNA, 201 bp, Bos taurus
agtatttgcaaagcagggccacagaacacccatgtgttccatttgacaataacaaggaagggactttgcatcaaaacaaaagcactgggagcccagggcccctagcacaacccatggaagtcctgactggggcaatacagggcacgccaagatgaatggtgtcaagccacaaacaaagaggcctcagagatccacatccca

SEQ ID NO: 96067 - DNA, 201 bp, Bos taurus; identical to SEQ ID NO: 14555

SEQ ID NO: 96068 - DNA, 201 bp, Bos taurus; identical to SEQ ID NO: 14556

SEQ ID NO: 96069 - DNA, 201 bp, Bos taurus
attatagaagagatgctgaaaatgagaatgaatatgattaagccaaggaatagaagtttcatattctgagtgtcttttccagttcttattctcacacaatgagctaagccatatgggtaaacttaacatatttttggacttaacatagtatatattattgctgcattttacatatttataattaatgcttttttttttgct

SEQ ID NO: 96070 - DNA, 201 bp, Bos taurus; identical to SEQ ID NO: 14557

SEQ ID NO: 96071 - DNA, 201 bp, Bos taurus; identical to SEQ ID NO: 14558

SEQ ID NO: 96072 - DNA, 201 bp, Bos taurus
acttcagggcagtgtggtaagtgttctaccacatgcctttattcatttctttattcactcaacaaacctggccttggggccttgctaaagattttggctgtaattctccaggaagtggaggttttggaaaagggatgtgacctgattggaatggtcttttcagaaggtcaagaactgagagagcaggttagcgaagtcagg

SEQ ID NO: 96073 - DNA, 201 bp, Bos taurus; identical to SEQ ID NO: 14559

SEQ ID NO: 96074 - DNA, 201 bp, Bos taurus
gactaacactttcacttttccctattgactaaaactccaagacaagaatagcaggtctattaagggagaagattgggccctgcccagaccacatatttcacgttcccaaagttaagagacctccctgaccacacatgcatagaaaagaatccttggtggccaaaggggagtgatgccaagggatgttccctatccagatgt

SEQ ID NO: 96075 - DNA, 201 bp, Bos taurus; identical to SEQ ID NO: 14560

SEQ ID NO: 96076 - DNA, 201 bp, Bos taurus; identical to SEQ ID NO: 14561

SEQ ID NO: 96077 - DNA, 201 bp, Bos taurus; identical to SEQ ID NO: 14562

SEQ ID NO: 96078 - DNA, 201 bp, Bos taurus; identical to SEQ ID NO: 14563

SEQ ID NO: 96079 - DNA, 201 bp, Bos taurus; identical to SEQ ID NO: 14564

SEQ ID NO: 96080 - DNA, 201 bp, Bos taurus; identical to SEQ ID NO: 14565

SEQ ID NO: 96081 - DNA, 201 bp, Bos taurus; identical to SEQ ID NO: 14566

SEQ ID NO: 96082 - DNA, 201 bp, Bos taurus; identical to SEQ ID NO: 14567

SEQ ID NO: 96083 - DNA, 201 bp, Bos taurus
taataatttctgaatgaggcacaccacaattcattttgctccaggccccccaaattatgtagtctgggctggttagacccactgcgtattcctatatgctgcctctagctcctctccaggccccctccctattggctcattccccactcctgttttcttatggctggaatttaccttccgcctgccttatttttctggttt

SEQ ID NO: 96084 - DNA, 201 bp, Bos taurus; identical to SEQ ID NO: 14568

SEQ ID NO: 96085 - DNA, 201 bp, Bos taurus; identical to SEQ ID NO: 14569

SEQ ID NO: 96086 - DNA, 201 bp, Bos taurus; identical to SEQ ID NO: 14570

SEQ ID NO: 96087 - DNA, 201 bp, Bos taurus; identical to SEQ ID NO: 14571

SEQ ID NO: 96088 - DNA, 201 bp, Bos taurus; identical to SEQ ID NO: 14572

SEQ ID NO: 96089 - DNA, 201 bp, Bos taurus; identical to SEQ ID NO: 14573

SEQ ID NO: 96090 - DNA, 201 bp, Bos taurus; identical to SEQ ID NO: 14574

SEQ ID NO: 96091 - DNA, 201 bp, Bos taurus; identical to SEQ ID NO: 14575

SEQ ID NO: 96092 - DNA, 201 bp, Bos taurus; identical to SEQ ID NO: 14576

SEQ ID NO: 96093 - DNA, 201 bp, Bos taurus
gtgaaagggcagtacatttgatgagtttctaaaatctaggacagaactattgcaagtgatcactgtgagggaggtgggtgtgccaggcacctgcccagcagcaggccttacctctttgtttgtcctgtcagcttgcaccaatgtcccattcaggcaaggttccacgtagtgaagctcctcattatactgcgaagggaagaa

SEQ ID NO: 96094 - DNA, 201 bp, Bos taurus
gcatattttgtttggcccaagtagtgaggtatgcacaatgttttgaattttaattcatcaccaacatttctttttaatgggatgtttacggcaaaacaccaatttccagctctgacaacagtgggcctacctttccacatggcagtagcaactggataagagcagtggagacctaatgaggggctatgtgttgtacttctc

SEQ ID NO: 96095 - DNA, 201 bp, Bos taurus; identical to SEQ ID NO: 14577

SEQ ID NO: 96096 - DNA, 201 bp, Bos taurus; identical to SEQ ID NO: 14578

SEQ ID NO: 96097 - DNA, 201 bp, Bos taurus
atggttggaaaatatctctagaatgttgtatttataatcctatataatcttacaaggagcattagaagaaagagattcactttccctggaagaaaaatggcttactgccagtgccgtcattgtgaaagagaagatgagaaagcacaccagagggatcgctttgagcttcacattcaaaggtttctatagacagaaactctg

SEQ ID NO: 96098 - DNA, 201 bp, Bos taurus; identical to SEQ ID NO: 14579

SEQ ID NO: 96099 - DNA, 201 bp, Bos taurus; identical to SEQ ID NO: 14580

SEQ ID NO: 96100 - DNA, 201 bp, Bos taurus
gtgttcccttcagtggccccaggacctcctcaaagacagctgggagtcatcctcgttaatggaacgtctcagaggcccattttgggcccttggggaatacgcatacaccaaacttggaaagaagtattttgaggctcacagacttccacaatgacacagcccaaggggcccacctcaagggcagtccacaaacgtgcactt

SEQ ID NO: 96101 - DNA, 201 bp, Bos taurus
ggccagggcccccatcacagcccaagttgatggggtaacattattgactgcatgtctctgtcacccacttggacagagagggctcctcaagggcacagattagcttccaacccagccctgtctccccagggcctggcacccagtctttgaaagtcagatcctatataattaatgatgttaaagcctgtgcaagtggatttt

SEQ ID NO: 96102 - DNA, 201 bp, Bos taurus; identical to SEQ ID NO: 14581

SEQ ID NO: 96103 - DNA, 201 bp, Bos taurus; identical to SEQ ID NO: 14582

SEQ ID NO: 96104 - DNA, 201 bp, Bos taurus
aagcctggaggtaaacgggaatctaaaggagctcaaacactgcacgtggcccaacaagactgaaacccacagcggacaaatgtcgcagaataaacaagtcatatttgtgggactaacatacacaatcctaggtgcggccagcaggggtgctgtttctacggtttagtagctaagtcatgtccgagtcttgcgaccccatgg

SEQ ID NO: 96105 - DNA, 201 bp, Bos taurus
cagccacacagagtggggccaccagaaaagcccacacaggctgttacagctaagcaatgggttcttctggggttgatgagggttcagtactcagaaggatgcaaactgagtagggccatccccatcttccatgagggatggaggcggctcacaaacccagggagctggcgaagggtataaacggaccctgagcaagacacc

SEQ ID NO: 96106 - DNA, 201 bp, Bos taurus
aggccaactcggtcaggcacgggctccaccctgggtctcagcctctgctcacccattctccctgcacatgcctgggctccagccataggaatagcccttcatggcctccctgagctttcgtttgcccactttcatgtcctcctcacaccactgcctcaactcggaatgttctgcctgacacatctcaggtccatccatcct

SEQ ID NO: 96107 - DNA, 201 bp, Bos taurus
tgctgttccttctggctcgatatcgtttctctggatgtgcacaagcctttctccctcacttgattcaggtccctgctgacatatcgcctcagcaaagaagcctttcctggcccctcaaaacgtgtaacagcgtcaccctgccgtcttctcctcccttcactctgcccatatgccacacccttgccagaatgtctcagggac

SEQ ID NO: 96108 - DNA, 201 bp, Bos taurus; identical to SEQ ID NO: 14583

SEQ ID NO: 96109 - DNA, 201 bp, Bos taurus; identical to SEQ ID NO: 14584

SEQ ID NO: 96110 - DNA, 201 bp, Bos taurus; identical to SEQ ID NO: 14585

SEQ ID NO: 96111 - DNA, 201 bp, Bos taurus; identical to SEQ ID NO: 14586

SEQ ID NO: 96112 - DNA, 201 bp, Bos taurus; identical to SEQ ID NO: 14587

SEQ ID NO: 96113 - DNA, 201 bp, Bos taurus; identical to SEQ ID NO: 14588

SEQ ID NO: 96114 - DNA, 201 bp, Bos taurus
tcagggctgtgcatttctttatttttgttgtattactgaccattctaatgcccactaaaaccacagaattaagatattaatatctcatgtgatcatagccaaagtctttttgctttgggttttgttgtaggtcaagttaccttggaagcagagcctgagattgatatttgcatgtaggagtttcaggggagtgcttttggg

SEQ ID NO: 96115 - DNA, 201 bp, Bos taurus; identical to SEQ ID NO: 14589

SEQ ID NO: 96116 - DNA, 201 bp, Bos taurus; identical to SEQ ID NO: 14592

SEQ ID NO: 96117 - DNA, 201 bp, Bos taurus; identical to SEQ ID NO: 14594

SEQ ID NO: 96118 - DNA, 201 bp, Bos taurus; identical to SEQ ID NO: 14595

SEQ ID NO: 96119 - DNA, 201 bp, Bos taurus; identical to SEQ ID NO: 14596

SEQ ID NO: 96120 - DNA, 201 bp, Bos taurus; identical to SEQ ID NO: 14597

SEQ ID NO: 96121 - DNA, 201 bp, Bos taurus; identical to SEQ ID NO: 14598

SEQ ID NO: 96122 - DNA, 201 bp, Bos taurus; identical to SEQ ID NO: 14599

SEQ ID NO: 96123 - DNA, 201 bp, Bos taurus; identical to SEQ ID NO: 14600

SEQ ID NO: 96124 - DNA, 201 bp, Bos taurus; identical to SEQ ID NO: 14601

SEQ ID NO: 96125 - DNA, 201 bp, Bos taurus; identical to SEQ ID NO: 14604

SEQ ID NO: 96126 - DNA, 201 bp, Bos taurus; identical to SEQ ID NO: 14605

SEQ ID NO: 96127 - DNA, 201 bp, Bos taurus; identical to SEQ ID NO: 14608

SEQ ID NO: 96128 - DNA, 201 bp, Bos taurus; identical to SEQ ID NO: 14609

SEQ ID NO: 96129 - DNA, 201 bp, Bos taurus; identical to SEQ ID NO: 14610

SEQ ID NO: 96130 - DNA, 201 bp, Bos taurus; identical to SEQ ID NO: 14611

SEQ ID NO: 96131 - DNA, 201 bp, Bos taurus; identical to SEQ ID NO: 14612

SEQ ID NO: 96132 - DNA, 201 bp, Bos taurus; identical to SEQ ID NO: 14613

SEQ ID NO: 96133 - DNA, 201 bp, Bos taurus; identical to SEQ ID NO: 14614

SEQ ID NO: 96134 - DNA, 201 bp, Bos taurus; identical to SEQ ID NO: 14617

SEQ ID NO: 96135 - DNA, 201 bp, Bos taurus; identical to SEQ ID NO: 14618

SEQ ID NO: 96136 - DNA, 201 bp, Bos taurus; identical to SEQ ID NO: 14619

SEQ ID NO: 96137 - DNA, 201 bp, Bos taurus; identical to SEQ ID NO: 14620

SEQ ID NO: 96138 - DNA, 201 bp, Bos taurus; identical to SEQ ID NO: 14621

SEQ ID NO: 96139 - DNA, 201 bp, Bos taurus; identical to SEQ ID NO: 14622

SEQ ID NO: 96140 - DNA, 201 bp, Bos taurus; identical to SEQ ID NO: 14624

SEQ ID NO: 96141 - DNA, 201 bp, Bos taurus; identical to SEQ ID NO: 14627

SEQ ID NO: 96142 - DNA, 201 bp, Bos taurus; identical to SEQ ID NO: 14629

SEQ ID NO: 96143 - DNA, 201 bp, Bos taurus; identical to SEQ ID NO: 14630

SEQ ID NO: 96144 - DNA, 201 bp, Bos taurus; identical to SEQ ID NO: 14632

SEQ ID NO: 96145 - DNA, 201 bp, Bos taurus; identical to SEQ ID NO: 14633

SEQ ID NO: 96146 - DNA, 201 bp, Bos taurus
agcagcagtaaaggcaggcatgagggggtttttgccggcttttatgtttttcaggtcagggccgggattagaaagcctgggagactaggcctaacgtggagaagcctgtataatgttctcttggctttccttccagtgctaaattccaatgactccctaaactaaaagggttcactgggacacccactagccctccaggga

SEQ ID NO: 96147 - DNA, 201 bp, Bos taurus; identical to SEQ ID NO: 14634

SEQ ID NO: 96148 - DNA, 201 bp, Bos taurus
ggaagcagccaccgagaggagaagggaggttctttctcagatgaaagcaagggcttcgggactgcacagtgatgaggagaacacccccaccccatgctctcgggttacagaaagggagatggaagatggaatactcgggggaaatttcccacagaatatattctgtgtggatacggcagtccacgttcaaactatgaaaac

SEQ ID NO: 96149 - DNA, 201 bp, Bos taurus; identical to SEQ ID NO: 14635

SEQ ID NO: 96150 - DNA, 201 bp, Bos taurus
acactgaggccccgacagcccatgaagagacggagtgcctggccagccgcctgctgcttcagcctggctctccgggctctggccactgtctgatcacaactacatacgagacgcaagctgcaaccgcccagatgaacctttcccaagctcccaacccacagaaatcatggcaggttacacagtggttactgtcctaaggcc

SEQ ID NO: 96151 - DNA, 201 bp, Bos taurus
tgggatggtcggtgtgaggtctggacccaggcgtcccgttggcccaaccaacagggcaggtctctctgtcagtgaggattctatgaagctgcgggagggcgctggctgaccatcacggccagagggacccatggccaggagtcgattcggcacgggtgcagtaatagcactgaccgttccgaatgggcatttgttgtgatg

SEQ ID NO: 96152 - DNA, 201 bp, Bos taurus
ctgtggagcacacggtcaggtccgcgtcttcggccacgcccagtgttacatcccaccagggatcctcgcggtctggccctcatactgtcctccacccccatgcgtctctgttctctacccaaagctggagggcaggggtaaggtcagggcagggcactcagaatccgtcaggaggtagatccaggctcaggcccagggacc

SEQ ID NO: 96153 - DNA, 201 bp, Bos taurus
gggctgcccatccccactgcccactccatagagtcacagaggctggcttgtggaccccctgtcttggcctgcttgctcccctggtcccgggccagtcccttagcccaggatcagctctcagagcctgggagttggacaatcagtctgcaaggctgctgtgtgccagtggcgggggaaggcctttgcagaagtttctggcag

SEQ ID NO: 96154 - DNA, 201 bp, Bos taurus; identical to SEQ ID NO: 14636

SEQ ID NO: 96155 - DNA, 201 bp, Bos taurus; identical to SEQ ID NO: 14638

SEQ ID NO: 96156 - DNA, 201 bp, Bos taurus
gaggctgcatgctgcaattactgaagaccatgcaccatacagcctgtgctacaccacaggagaagcctcgcaatgcaaagccggtgtaccacaacagagcgtggcccccactcgctgccactagagaaagcccgtgtgcagtaacgaagacccagcacagccaaaaataaaataagtgcattttttaaaaagggaatatcc

SEQ ID NO: 96157 - DNA, 201 bp, Bos taurus
tccagctgagccagatgttgtgtgtgaggcgagcaggctctgatctgctgtgatgacagatggagattgaggctggccccccagtgtgtattgtggccccgcagctggtggcacaaggggttcatgagtggctttaattcaggctcaggcagagagtcacacagaagggcctgctcccaaattttagtgcattatctcaat

SEQ ID NO: 96158 - DNA, 201 bp, Bos taurus
accactggcccaccagggaagccctgtacaacgactcttaaacagcctgcctcctctgcatgatgctaatggtaaagaagatgcttaagtggcactttgatctgggccttgttccaaggcccttgctacattaaccactgagcattccctggtgactcagacggtaaagaatctgcctgcaatgtgggagacctgggtttg

SEQ ID NO: 96159 - DNA, 201 bp, Bos taurus
gttggcaggacctgatgctactcctgggatgtggaggaagcagagggaagtgacaaggctgactccagcctgagcaccaggggacaacctggaggggcctacacgtcccgggggaccagatctgtgcttgcatccacatcatcagctggttccataccttccccacccgactggcctctcccgttctcccgaacctcagag

SEQ ID NO: 96160 - DNA, 201 bp, Bos taurus
tgatggatgtgagtttgagtgagctccgggagttggtgatggacagggaggcctggcgtgctggagtccatggggtcgcaaagagtcggacacgactgggtgactgaactggctgactgacttggtaccccgctgtgtactttgcatgcattgtgtctctcttttgtggacaaggaagttggggctcagaaaagtgaagca

SEQ ID NO: 96161 - DNA, 201 bp, Bos taurus; identical to SEQ ID NO: 14639

SEQ ID NO: 96162 - DNA, 201 bp, Bos taurus
ccccatccacttaccaccattctgccaacagggccattcctctgggttgggggcatggtttgtcttcagctgccctcgtctctccaaaagtcatagcatcattagcccatcttatagggccccggacaccctgggttcaaatcctgacccctagcgtataccagctgtgcagcttcaggaaagagactgaacctctctgag

SEQ ID NO: 96163 - DNA, 201 bp, Bos taurus
ccctggcctcctgatgtgggccaggcagggttgaggcagttctctggaaccagaccacctgggttcaaatctcgctcttccactcattggctgtgtgtctttgggcaagttttaacttctctgggcctcagtttcctcctctgtgaagtgaaacgctgatagcatcagcttataaggctgctgtgaagatgaaatgagatc

SEQ ID NO: 96164 - DNA, 201 bp, Bos taurus
ctgcagaagtctctgtgtccacatctctaaaatgagggcatgaaggattactttcttgtgtggttctcagcactgcgaagattaaataaggaaaccaccctacccctagcccagtgtgtatgtagaaagtctttgaaatatgacttttctttttctccattgcatttctagaccagagaatacacagagcaggattgtttg

SEQ ID NO: 96165 - DNA, 201 bp, Bos taurus
ggggaataatgtaagcatttgaaacagaactaaataaacaaagaccgtccatccattgccggctcacccgagcccacggccccagggacacacacacacagggactgcagtcggggttgagtgtttggagactcacaaaatactctatttgtggttctcgtttttcactacgggcctttaaaaatgacttcaagtcatcca

SEQ ID NO: 96166 - DNA, 201 bp, Bos taurus; identical to SEQ ID NO: 14640

SEQ ID NO: 96167 - DNA, 201 bp, Bos taurus; identical to SEQ ID NO: 14641

SEQ ID NO: 96168 - DNA, 201 bp, Bos taurus
aggagatggggagggcccggtcacgggattgagtagggggctgggaggcagtgaggaatgagctatgtggatcccctggggaaaagcagtctaggcagagggaacaggccgtgcgaagtccccaaggcagagtgtgcctggaggctgggaaaaacagtgatgaggccgacacctgtgttcacagcaggattgtgcccagaa

SEQ ID NO: 96169 - DNA, 201 bp, Bos taurus; identical to SEQ ID NO: 14645

SEQ ID NO: 96170 - DNA, 201 bp, Bos taurus; identical to SEQ ID NO: 14646

SEQ ID NO: 96171 - DNA, 201 bp, Bos taurus; identical to SEQ ID NO: 14647

SEQ ID NO: 96172 - DNA, 201 bp, Bos taurus; identical to SEQ ID NO: 14648

SEQ ID NO: 96173 - DNA, 201 bp, Bos taurus; identical to SEQ ID NO: 14649

SEQ ID NO: 96174 - DNA, 201 bp, Bos taurus; identical to SEQ ID NO: 14650

SEQ ID NO: 96175 - DNA, 201 bp, Bos taurus; identical to SEQ ID NO: 14651

SEQ ID NO: 96176 - DNA, 201 bp, Bos taurus; identical to SEQ ID NO: 14652

SEQ ID NO: 96177 - DNA, 201 bp, Bos taurus; identical to SEQ ID NO: 14653

SEQ ID NO: 96178 - DNA, 201 bp, Bos taurus; identical to SEQ ID NO: 14654

SEQ ID NO: 96179 - DNA, 201 bp, Bos taurus; identical to SEQ ID NO: 14655

SEQ ID NO: 96180 - DNA, 201 bp, Bos taurus; identical to SEQ ID NO: 14656

SEQ ID NO: 96181 - DNA, 201 bp, Bos taurus; identical to SEQ ID NO: 14657

SEQ ID NO: 96182 - DNA, 201 bp, Bos taurus; identical to SEQ ID NO: 14658

SEQ ID NO: 96183 - DNA, 201 bp, Bos taurus; identical to SEQ ID NO: 14661

SEQ ID NO: 96184 - DNA, 201 bp, Bos taurus; identical to SEQ ID NO: 14662

SEQ ID NO: 96185 - DNA, 201 bp, Bos taurus; identical to SEQ ID NO: 14663

SEQ ID NO: 96186 - DNA, 201 bp, Bos taurus; identical to SEQ ID NO: 14664

SEQ ID NO: 96187 - DNA, 201 bp, Bos taurus; identical to SEQ ID NO: 14667

SEQ ID NO: 96188 - DNA, 201 bp, Bos taurus; identical to SEQ ID NO: 14668

SEQ ID NO: 96189 - DNA, 201 bp, Bos taurus; identical to SEQ ID NO: 14669

SEQ ID NO: 96190 - DNA, 201 bp, Bos taurus; identical to SEQ ID NO: 14670

SEQ ID NO: 96191 - DNA, 201 bp, Bos taurus; identical to SEQ ID NO: 14671

SEQ ID NO: 96192 - DNA, 201 bp, Bos taurus; identical to SEQ ID NO: 14672

SEQ ID NO: 96193 - DNA, 201 bp, Bos taurus; identical to SEQ ID NO: 14675

SEQ ID NO: 96194 - DNA, 201 bp, Bos taurus; identical to SEQ ID NO: 14676

SEQ ID NO: 96195 - DNA, 201 bp, Bos taurus; identical to SEQ ID NO: 14677

SEQ ID NO: 96196 - DNA, 201 bp, Bos taurus
aggacccggaggacagaggagactgcagggcggccgctccacgaaggcgagtttggacccaggcttagggagtccccctgaccgcctggcccgcatcgccagctcagcagctgggctgggagctttgggctatttatatccactccagcaaatcttctgatctcaaggatcctttccaaagcctgcgtcgtgctggcctct

SEQ ID NO: 96197 - DNA, 201 bp, Bos taurus
tgccctcagggccccccgaggacacgcccctccccccttcatccccagcctgctgtgttccaggtttgcgcccccgccccagactggccacgtgcgctgtgcttcaaggaaagcagagagcacaaacacgtctacatggagagcacgtgtcatgaagttacacggggcacaggacacactgccggcccttcaggtgggtgc

SEQ ID NO: 96198 - DNA, 201 bp, Bos taurus; identical to SEQ ID NO: 14678

SEQ ID NO: 96199 - DNA, 201 bp, Bos taurus; identical to SEQ ID NO: 14679

SEQ ID NO: 96200 - DNA, 201 bp, Bos taurus; identical to SEQ ID NO: 14682

SEQ ID NO: 96201 - DNA, 201 bp, Bos taurus; identical to SEQ ID NO: 14683

SEQ ID NO: 96202 - DNA, 201 bp, Bos taurus; identical to SEQ ID NO: 14684

SEQ ID NO: 96203 - DNA, 201 bp, Bos taurus; identical to SEQ ID NO: 14685

SEQ ID NO: 96204 - DNA, 201 bp, Bos taurus; identical to SEQ ID NO: 14687

SEQ ID NO: 96205 - DNA, 201 bp, Bos taurus
ggctcctgagtggcagagtgagaccccaggcctcgcggcgtctgacgcctgttcactgagctgcaggcgctgagcctggccgccaacctggttgggttggtgcagcccgagaatccagggaatgtggctggaaacagggatctattccagctgggagagccctgggtcccgggcctccgtgcggactcaggcttgaccccc

SEQ ID NO: 96206 - DNA, 201 bp, Bos taurus
tgaaacccttacggcttcagtcccccagcacagcgccctccttcaccccgggtcctgaacacaggcaccttgaaggaggtaaggcaaacctcctgcaggtgggggccgctggtgggaggcgggtgctgaaaatgcagccctagaagatgagtccccagaagacagagcagaataaacaaacacctgggccgacgccggcgg

SEQ ID NO: 96207 - DNA, 201 bp, Bos taurus; identical to SEQ ID NO: 14688

SEQ ID NO: 96208 - DNA, 201 bp, Bos taurus; identical to SEQ ID NO: 14689

SEQ ID NO: 96209 - DNA, 201 bp, Bos taurus; identical to SEQ ID NO: 14690

SEQ ID NO: 96210 - DNA, 201 bp, Bos taurus; identical to SEQ ID NO: 14691

SEQ ID NO: 96211 - DNA, 201 bp, Bos taurus; identical to SEQ ID NO: 14692

SEQ ID NO: 96212 - DNA, 201 bp, Bos taurus
ttgctctgcagaggtgtggccaggtaagggatggtgggggctgccctcaaggacccggagtggagaggtgcagggggtaaagcaaacccagcctaaccccatgcagggtgagtaagcaaggcggccaagagctggtcagttcaattcagttcagtcgctcagtcgtgtccgactctttgtgaccccatggactgcaacaca

SEQ ID NO: 96213 - DNA, 201 bp, Bos taurus; identical to SEQ ID NO: 14694

SEQ ID NO: 96214 - DNA, 201 bp, Bos taurus; identical to SEQ ID NO: 14696

SEQ ID NO: 96215 - DNA, 201 bp, Bos taurus; identical to SEQ ID NO: 14697

SEQ ID NO: 96216 - DNA, 201 bp, Bos taurus; identical to SEQ ID NO: 14698

SEQ ID NO: 96217 - DNA, 201 bp, Bos taurus; identical to SEQ ID NO: 14699

SEQ ID NO: 96218 - DNA, 201 bp, Bos taurus; identical to SEQ ID NO: 14700

SEQ ID NO: 96219 - DNA, 201 bp, Bos taurus; identical to SEQ ID NO: 14702

SEQ ID NO: 96220 - DNA, 201 bp, Bos taurus
tagaatcttaaaattactagtaaaaaaagaaatgctccacgattgcattgcaaatgtgatattataaaaaatatactacaacctgaattggagacaagatatttgagtagaaggacttgagctcatctcctctgaaaaataagataaaataaaataaaatttaaaaactccaccaaaatcacaactaaatattgaccaagc

SEQ ID NO: 96221 - DNA, 201 bp, Bos taurus
ttactggggtgaatggaaagctctgaggaagaacttaaaggaagtagagagagggaaggcagggggatatgtggtgggaatatgtctgtcctgcttatgggtatcagtaaggcctgtgtggcttgagtagcctttggtctttactctcagcacactagaagtcattgaagatttttaaacagagaagtgccaagatatgac

SEQ ID NO: 96222 - DNA, 201 bp, Bos taurus
aacttggaaacctcagaatacattaccctagctaaaatcaggtcacctgaatctcctttctacaactagaaaatacaaaaatgaataaaagagaaaactctctggaggttccatctttgtattgctgatcctgttcatagcgccaattgtttcactgtgtctcactgtgtgcactgttcactgaacacatggcatgcacgt

SEQ ID NO: 96223 - DNA, 201 bp, Bos taurus
gtcctttgtaattatgctaaatctattctgcctatgctctataaagggaaatacatagtctagatgacagcacatctgtttacaacatgatttactcaatgttttgagcctgtcgctgagacctacttgggggtgggggtggcaggtggtgggaagagctctttcaaaatggtaccgctcattgacagtgaacctgggaac

SEQ ID NO: 96224 - DNA, 201 bp, Bos taurus; identical to SEQ ID NO: 14703

SEQ ID NO: 96225 - DNA, 201 bp, Bos taurus; identical to SEQ ID NO: 14704

SEQ ID NO: 96226 - DNA, 201 bp, Bos taurus; identical to SEQ ID NO: 14705

SEQ ID NO: 96227 - DNA, 201 bp, Bos taurus; identical to SEQ ID NO: 14706

SEQ ID NO: 96228 - DNA, 201 bp, Bos taurus; identical to SEQ ID NO: 14707

SEQ ID NO: 96229 - DNA, 201 bp, Bos taurus; identical to SEQ ID NO: 14708

SEQ ID NO: 96230 - DNA, 201 bp, Bos taurus; identical to SEQ ID NO: 14709

SEQ ID NO: 96231 - DNA, 201 bp, Bos taurus; identical to SEQ ID NO: 14710

SEQ ID NO: 96232 - DNA, 201 bp, Bos taurus; identical to SEQ ID NO: 14711

SEQ ID NO: 96233 - DNA, 201 bp, Bos taurus; identical to SEQ ID NO: 14712

SEQ ID NO: 96234 - DNA, 201 bp, Bos taurus
aatgtgcaaaactgaaaccatggagagtaggactgaggggtggaaacggagctttcttgcgatttctggagcttacttggctaactggttaccaggcccaggcaaagtgagcttacaggtgcgctttcagagaggaccgatacagcagtctgtaacaggaggtcagcagactgggcctcgtgtgtgagactcgggctgtgc

SEQ ID NO: 96235 - DNA, 201 bp, Bos taurus; identical to SEQ ID NO: 14713

SEQ ID NO: 96236 - DNA, 201 bp, Bos taurus; identical to SEQ ID NO: 14714

SEQ ID NO: 96237 - DNA, 201 bp, Bos taurus; identical to SEQ ID NO: 14715

SEQ ID NO: 96238 - DNA, 201 bp, Bos taurus
acctcagtatcgacctgctaaatgtctaacacccaccttacattttcaatagtgcttttgagctactatcaaccacaacaaaatgtcagtgatcgaaaaagcctttatatggttgtattatgtgaataagtctcattatttgatttgatgtaattagctttcttgatctgtcacatggctaagaaattaaccaatacatga

SEQ ID NO: 96239 - DNA, 201 bp, Bos taurus
tcaccggccagctgagggaccggtgtgaccgcatcgaccaggccgttgggaaaagcacccagtatcaaagcctgctgagaagcctgtccgagaagctggctgacctggacgatcagctcagcagcagcgtggccggcagtgcacaccccgacgccatgagccagcagctggaaacggcccagaagctgaagcaggcggtgg

SEQ ID NO: 96240 - DNA, 201 bp, Bos taurus; identical to SEQ ID NO: 14716

SEQ ID NO: 96241 - DNA, 201 bp, Bos taurus; identical to SEQ ID NO: 14717

SEQ ID NO: 96242 - DNA, 201 bp, Bos taurus; identical to SEQ ID NO: 14718

SEQ ID NO: 96243 - DNA, 201 bp, Bos taurus; identical to SEQ ID NO: 14719

SEQ ID NO: 96244 - DNA, 201 bp, Bos taurus
cttaaaaaatataaattgacaaactgtttctgaaatgtatatggaagcagaaaagacctagcatggccaaaatgatcttgggaaaaggagaaacaaagacagaaagcttgtattattcaattcagagtttagtgtgaagttacaatgatcagggctatgtggtattggaagaagaactaagaaatagagtaaaggaacaac

SEQ ID NO: 96245 - DNA, 201 bp, Bos taurus
tatttgcaaaatttcagtatgaaattcatcctgtgtcttacctcatcaattctcttcccagcatctaggctgatggtgacctgttattatgccagccctaaagagtattccctgaattgtgttttggggagcaacaaattgggataaaattttcctccaaaattgaaaagacaaagtatctggcaatgaatcacactttta

SEQ ID NO: 96246 - DNA, 201 bp, Bos taurus
ttctcctgtgctcagtgttggcatgtaggtgcttactaaatgtagttagtgcatgaatgattgtatgcatgcatgaacaaagtgtcagagtttccttgcttgagttttctatgttttgtttgactgatgtgtttttatgataggaattttttaaaatttatttttaattgaaggataactgttttacaatattgtattggt

SEQ ID NO: 96247 - DNA, 201 bp, Bos taurus
tggccccactcctggctgctcgggaggtttgcgttcctgtggcctgctccctgcaggacccctctcaccacctcccagccccctggcctggttagcatcacggctgccttccagccagggagcctctcttctgtattaacatcagttctcaagaatgagggcccctgccacgatttctttgcttggaatatgatgttttta

SEQ ID NO: 96248 - DNA, 201 bp, Bos taurus; identical to SEQ ID NO: 14720

SEQ ID NO: 96249 - DNA, 201 bp, Bos taurus
gtagttgcggggagtaggcctagttgctcttaggcatgtggatcttagttccctgaccaggaatctcatccacgtcccctccattgcaaggccaattcttgactactggaccactgggcaagtcctggtccttgccatttagaggggggcggagagagaccaaggaaaggcccagggacttcttaccactttggagtgaag

SEQ ID NO: 96250 - DNA, 201 bp, Bos taurus; identical to SEQ ID NO: 14721

SEQ ID NO: 96251 - DNA, 201 bp, Bos taurus; identical to SEQ ID NO: 14722

SEQ ID NO: 96252 - DNA, 201 bp, Bos taurus
ataaatcacgcttattaatcatgttaataaatcatgtcatcctgttcgtgacgccagttgtctcgctgtatctcactgtgcacactgttcgttgaacgcggggtagacgaggtgccagctcagaggcttgaagatgagcggagccataggaatgcagacaggtttattctctgctggccggcacagcagccatagcaatat

SEQ ID NO: 96253 - DNA, 201 bp, Bos taurus
gggaaagggagggaaataaaataaaggatagagatacatttttggagagtcttcacagttatttggaatgatgagatgattcagaaagctttgtaagttactgagttttaaaatggaaaaaaaagtttaattgcagtatttcttcactgcacatacatttgtaagtcttcagggagaagttgacgaccaaagtatgataaa

SEQ ID NO: 96254 - DNA, 201 bp, Bos taurus; identical to SEQ ID NO: 14723

SEQ ID NO: 96255 - DNA, 201 bp, Bos taurus; identical to SEQ ID NO: 14724

SEQ ID NO: 96256 - DNA, 201 bp, Bos taurus
aaacttgcaacatatgagaaatacagcctgcctatatatttgtatgtatatttcctgaaagtaacaagcatagtctatatatgtagagattcttattaatatatgtatctattataccatgcgtccccaacccgtgggtcacgggctgctaccagtctgaggtctgttaggaactgggctgtacagcagggggtgagtgaa

SEQ ID NO: 96257 - DNA, 201 bp, Bos taurus
ctttgagtacctgctgtgccaagcaacaaagaaggccagccagacaagcccttgaacgccagccgccagaaactcaaagaggactctacgggcaccgtatctgctgtgcctgtggccgccggcttccctgcacacctggtgctgctgggttccccacgacccaagcggctacaccacctccatgcctggtcctcactgggg

SEQ ID NO: 96258 - DNA, 201 bp, Bos taurus
caactgtatctaactcgagcccagggccacctgcaatgacttagtcttcagactgttgatagtaaacagagaaacaagagccagtctcagcagtatcggtgatgtgaaggaagcagcagaaaggccctaagggaagagcttccatatatatatatacatatatatatgtatatatatatatttagaacttacttttcaagc

SEQ ID NO: 96259 - DNA, 201 bp, Bos taurus; identical to SEQ ID NO: 14726

SEQ ID NO: 96260 - DNA, 201 bp, Bos taurus; identical to SEQ ID NO: 14727

SEQ ID NO: 96261 - DNA, 201 bp, Bos taurus
tcattctatttgtatcctttagtgaagattaacttgtagagtactatacagacttctctagtatccacaagtaaggccctagataagtctctttttttccctcccaaagcttaacttttgaaggcatggttagaaatcatatgcatgtgatttgcacaattattttcctgcctgatccattttataggcctgaaggaacag

SEQ ID NO: 96262 - DNA, 201 bp, Bos taurus; identical to SEQ ID NO: 14730

SEQ ID NO: 96263 - DNA, 201 bp, Bos taurus; identical to SEQ ID NO: 14732

SEQ ID NO: 96264 - DNA, 201 bp, Bos taurus; identical to SEQ ID NO: 14733

SEQ ID NO: 96265 - DNA, 201 bp, Bos taurus; identical to SEQ ID NO: 14734

SEQ ID NO: 96266 - DNA, 201 bp, Bos taurus; identical to SEQ ID NO: 14735

SEQ ID NO: 96267 - DNA, 201 bp, Bos taurus
accatgaaggaaaccaaggcatggatgcaatcagtaactgcacacccactcagtgatggcagcgttggaagtaggatctaggccctgcctccttcccactccactaagatgagaacatccatttcctgacccacagtctcctaataccttgttgggctgtgcacacgaatgtgcccggccccccgaattcacgtaacgcct

SEQ ID NO: 96268 - DNA, 201 bp, Bos taurus
gcccctcacttcatcactctgccccaagtctgcctggggcccttctcctccaggaagatatcctggtccattccagcttatcaccaccctccagtctgttgactgcagagggcttttattatctgcatctcttattttatttagtgcttcattatactccattgatgtctcagctttgttttaatctctaagagttccttg

SEQ ID NO: 96269 - DNA, 201 bp, Bos taurus
cagcctctcttaccctacctccaaatgcttacctccctaggctgtcatctcttccacttcataccatctgtcaccccagccgctgtctctgtgaggactgcgtgtcctgggttgagcacattgctggtattcaggccacagaacacagagcctcgtggctgcatccgcagatgctgaggtacctccttagctgggtgtcac

SEQ ID NO: 96270 - DNA, 201 bp, Bos taurus; identical to SEQ ID NO: 14736

SEQ ID NO: 96271 - DNA, 201 bp, Bos taurus
gagggggcccgctgctagctggcgccgcgagcccgctccgctgaggtaggccccgggcctctcaccgcctcatcggggtaaactctctcagccgctcactcgctctcgcgctcccccccctcccacccccccggcgccgccgcctccgcctccgccgccgccgcctctagctgcgccgccgcctccgcctcctcccgcgcc

SEQ ID NO: 96272 - DNA, 201 bp, Bos taurus; identical to SEQ ID NO: 14738

SEQ ID NO: 96273 - DNA, 201 bp, Bos taurus
agatgtatgtcctgaacaaattcctaagaacctgttaaggtgcaaccactttaaaactccttgtgtgttttccacggggtattgactcagcccggccagcgctcagtacttgctaggagcacccatgggaaatacaagagaagcggaagaggtgtggtaggcttatgtcaaaggaccaggaacctccttggaccatattta

SEQ ID NO: 96274 - DNA, 201 bp, Bos taurus
ggcaaatgtatccccaaatattaacaggttttgtagttcttctcagagaatggggtaaagacacctcaaccatcttggctggacccaagctgagaggacatgagccctggggtggaggcctccacagatctcctcattgtctgttggaacatgaattttatacccccactaagaataaacaggattaggaatttaatgctg

SEQ ID NO: 96275 - DNA, 201 bp, Bos taurus; identical to SEQ ID NO: 14742

SEQ ID NO: 96276 - DNA, 201 bp, Bos taurus; identical to SEQ ID NO: 14745

SEQ ID NO: 96277 - DNA, 201 bp, Bos taurus
tggacgtgccagggcctcacaactgtgcctctggtgaactgaaccgcgtaccctcccggctcgtcctctagatccaagcagccttgatcagctctgaagtcctcttccctcctcgtggcctctcgggttgtcttcctgggcctgtgtcctacggaaacctccttaggatggaagtcagaggtccggtcggtccgtcctccc

SEQ ID NO: 96278 - DNA, 201 bp, Bos taurus; identical to SEQ ID NO: 14746

SEQ ID NO: 96279 - DNA, 201 bp, Bos taurus; identical to SEQ ID NO: 14747

SEQ ID NO: 96280 - DNA, 201 bp, Bos taurus
tttcctctttaaggcaaaaggcttgtaggttttgcctctttactttgtatttacctttaaagttccatttgttcacctaccagtgtttaccaagtccttacatttgggatgctttttctataataaaatgttaccatttgtgtccatgttgttttgttgttgctggttttagagtaggtttggagccagggcggcacacag

SEQ ID NO: 96281 - DNA, 201 bp, Bos taurus; identical to SEQ ID NO: 14748

SEQ ID NO: 96282 - DNA, 201 bp, Bos taurus
ttggacatttggtctttctcatttcttttacagtctgaaaccaaaatgtaagctccataatgtcaaggctttgtcttctttgttccctggtataactctaacgctcagaagtgtgcctggcccatagtcaggtgttcatgtagtatttttttggaatgaactaacgaataaatgtatttctcagaggagagtttccatagc

SEQ ID NO: 96283 - DNA, 201 bp, Bos taurus; identical to SEQ ID NO: 14749

SEQ ID NO: 96284 - DNA, 201 bp, Bos taurus; identical to SEQ ID NO: 14751

SEQ ID NO: 96285 - DNA, 201 bp, Bos taurus; identical to SEQ ID NO: 14752

SEQ ID NO: 96286 - DNA, 201 bp, Bos taurus; identical to SEQ ID NO: 14753

SEQ ID NO: 96287 - DNA, 201 bp, Bos taurus; identical to SEQ ID NO: 14755

SEQ ID NO: 96288 - DNA, 201 bp, Bos taurus; identical to SEQ ID NO: 14757

SEQ ID NO: 96289 - DNA, 201 bp, Bos taurus; identical to SEQ ID NO: 14759

SEQ ID NO: 96290 - DNA, 201 bp, Bos taurus; identical to SEQ ID NO: 14762

SEQ ID NO: 96291 - DNA, 201 bp, Bos taurus; identical to SEQ ID NO: 14763

SEQ ID NO: 96292 - DNA, 201 bp, Bos taurus; identical to SEQ ID NO: 14764

SEQ ID NO: 96293 - DNA, 201 bp, Bos taurus; identical to SEQ ID NO: 14765

SEQ ID NO: 96294 - DNA, 201 bp, Bos taurus; identical to SEQ ID NO: 14766

SEQ ID NO: 96295 - DNA, 201 bp, Bos taurus; identical to SEQ ID NO: 14768

SEQ ID NO: 96296 - DNA, 201 bp, Bos taurus; identical to SEQ ID NO: 14771

SEQ ID NO: 96297 - DNA, 201 bp, Bos taurus; identical to SEQ ID NO: 14772

SEQ ID NO: 96298 - DNA, 201 bp, Bos taurus
aggagccctggtttgttttagtggagggtggtgtttagaaactgtgatctgggggcttcctgggctgctgttactggggtgtcattacttctaggccttaggaaggagctaggacatgtttgtataaacagccacttttctttatttgcagtggttgtgttttataaagaaactacaaacaccaaatggacgatttagggg

SEQ ID NO: 96299 - DNA, 201 bp, Bos taurus; identical to SEQ ID NO: 14773

SEQ ID NO: 96300 - DNA, 201 bp, Bos taurus; identical to SEQ ID NO: 14776

SEQ ID NO: 96301 - DNA, 201 bp, Bos taurus; identical to SEQ ID NO: 14777

SEQ ID NO: 96302 - DNA, 201 bp, Bos taurus; identical to SEQ ID NO: 14778

SEQ ID NO: 96303 - DNA, 201 bp, Bos taurus; identical to SEQ ID NO: 14779

SEQ ID NO: 96304 - DNA, 201 bp, Bos taurus; identical to SEQ ID NO: 14780

SEQ ID NO: 96305 - DNA, 201 bp, Bos taurus
ttccaggagcagaagctctgcgaggctggggagagagcccagggaggcatgaaaacacagcggtctggactgcaggccaggctctgccagcagttcactttgaagattgccctggggcaaactgccaaaccctttctggatgccagcttcctcaaccataaaatggaaccgctggtgcttctggccctccctctttccagg

SEQ ID NO: 96306 - DNA, 201 bp, Bos taurus
gtgtgactagtgacagacccctcggatctctgaccacaggtcctgacacacctacctgactagtcctttttgtggtctaaatacttgtctgcatcttgatcggagaagaagtggtcacaggccaccatctgcttggaacttctctcctcttctctgccctctggtgctttcagtctgtatccccatttatagattccagga

SEQ ID NO: 96307 - DNA, 201 bp, Bos taurus
atcttcagcagtgagagaagggaggagcctggctttgctctctcttttctctacaaatgccctccaggtgatcccactgtgcggctggggctgagaaccctaggaaggcccactgcaattttaaagttccgattcttactctaaaatccctcggttttttagaagtactgtgtgttcttatcctctcccacagcccccaag

SEQ ID NO: 96308 - DNA, 201 bp, Bos taurus
cagaaccaacctcatctcctgcccatgtggccatgtccaccccattttgttcctgactagatctggggagcctggatccctctttgagacagactgggacttggggcccttcgctgcagtgcttgcacctggacaaatgtctcctcgagcaacggcatacaaagaagattcccttctccaggggatcttcctgacccaggg

SEQ ID NO: 96309 - DNA, 201 bp, Bos taurus; identical to SEQ ID NO: 14781

SEQ ID NO: 96310 - DNA, 201 bp, Bos taurus; identical to SEQ ID NO: 14782

SEQ ID NO: 96311 - DNA, 201 bp, Bos taurus; identical to SEQ ID NO: 14784

SEQ ID NO: 96312 - DNA, 201 bp, Bos taurus; identical to SEQ ID NO: 14785

SEQ ID NO: 96313 - DNA, 201 bp, Bos taurus; identical to SEQ ID NO: 14786

SEQ ID NO: 96314 - DNA, 201 bp, Bos taurus; identical to SEQ ID NO: 14787

SEQ ID NO: 96315 - DNA, 201 bp, Bos taurus
catcactcagaaaatttccaccacacgttcatccccacgctacaggtctttgggagcagccctgattccacattttcatccctttggccatcctggaatatgagcaataactcagcctttgtcacaggcggggacactgaggaccatccagagatgctaagtgatttggccaacatcatcacacagtgaatcgaggtctga

SEQ ID NO: 96316 - DNA, 201 bp, Bos taurus
ctggagaattcccgaggattctggggggctacaatccatggggtcacgaagagttggacatgactgagcgactaagcacagcacacacatcagtagctgcgaggtcatatgtaagtcatttaacgtcccagagcttcaatttcttcatctataaaagggaggtaattttgcctacctgaatggcagggtttttatggaata

SEQ ID NO: 96317 - DNA, 201 bp, Bos taurus; identical to SEQ ID NO: 14791

SEQ ID NO: 96318 - DNA, 201 bp, Bos taurus; identical to SEQ ID NO: 14792

SEQ ID NO: 96319 - DNA, 201 bp, Bos taurus; identical to SEQ ID NO: 14794

SEQ ID NO: 96320 - DNA, 201 bp, Bos taurus; identical to SEQ ID NO: 14796

SEQ ID NO: 96321 - DNA, 201 bp, Bos taurus; identical to SEQ ID NO: 14797

SEQ ID NO: 96322 - DNA, 201 bp, Bos taurus
ctgatcttatcctttaggacgctggcttagcgggagtaagggatgtatttcccgagacgctcaagaatgaggtagcatgtccaccaccttctcaagtgcttgtgtctagctggttccccaaccctaggacagatgcagtaggaacggggatcctattcccaaagctggaacagatcctggattctcatctcatttcagccc

SEQ ID NO: 96323 - DNA, 201 bp, Bos taurus; identical to SEQ ID NO: 14799

SEQ ID NO: 96324 - DNA, 201 bp, Bos taurus; identical to SEQ ID NO: 14801

SEQ ID NO: 96325 - DNA, 201 bp, Bos taurus
ccaagcgagcctttgtaaagcctgattgaaccataggctaagacaccgggtctgccctgtagagttacttccgtgaggccaaatatcccttctggaattcaccctgctatctccactgcagttgcatggtggctgctggcagtgactgttggcagtattgtccttgtgccatccctgccctcctgcctgtggccattcctc

SEQ ID NO: 96326 - DNA, 201 bp, Bos taurus; identical to SEQ ID NO: 14802

SEQ ID NO: 96327 - DNA, 201 bp, Bos taurus; identical to SEQ ID NO: 14804

SEQ ID NO: 96328 - DNA, 201 bp, Bos taurus; identical to SEQ ID NO: 14808

SEQ ID NO: 96329 - DNA, 201 bp, Bos taurus; identical to SEQ ID NO: 14810

SEQ ID NO: 96330 - DNA, 201 bp, Bos taurus; identical to SEQ ID NO: 14811

SEQ ID NO: 96331 - DNA, 201 bp, Bos taurus; identical to SEQ ID NO: 14812

SEQ ID NO: 96332 - DNA, 201 bp, Bos taurus; identical to SEQ ID NO: 14814

SEQ ID NO: 96333 - DNA, 201 bp, Bos taurus; identical to SEQ ID NO: 14815

SEQ ID NO: 96334 - DNA, 201 bp, Bos taurus; identical to SEQ ID NO: 14816

SEQ ID NO: 96335 - DNA, 201 bp, Bos taurus; identical to SEQ ID NO: 14821

SEQ ID NO: 96336 - DNA, 201 bp, Bos taurus
atagtgaggagaaatgtctgcttctctctgtacccctgaccccagctcagagtcgacgcctctaccgtctacttagagaggccctgacagcactgtgcagcttaccacctgtgcagagagaaaaactcaggtgtgtgcacagacggacagaaggcatcccagcaaaggcctagaaatgtcggtctacatgggaccttcagt

SEQ ID NO: 96337 - DNA, 201 bp, Bos taurus
cagtgaatacagttgaccgtctgggttttccattcatgactggttggattcatgcatgtaaaaacctgtgaatatggagggccagctgttaagtctttgacggtagaaaggaagtctaaaagggatgtggtgatgaaatgcatttcaacagctgttgcttttcttccgaagttactgtggcatccaagggcctagactttg

SEQ ID NO: 96338 - DNA, 201 bp, Bos taurus
gtgagttggggaggtcggtgaagtccgtgatggcttgaaaggcctcctccgtgaaacactgagtcacagcccagtctctgtctatgcagcagagcaagaagagtcctccatcttccgggatgtggccctgctgccccaggctcctcatcccaatgaagtaagaatctcccctcattcctgaggatacagaaacagacgtga

SEQ ID NO: 96339 - DNA, 201 bp, Bos taurus
agagagtagaatatgatccaggcaccagggaagcacaggccccataatccacacctctggcagggcttttggaggctctccaggccacggtgggagattacagaagctgggaacagcagtagctactctcaccctagggcatctgagaggtcaagttttggaagccaaggcagttcattattagttggccactgaacaaaa

SEQ ID NO: 96340 - DNA, 201 bp, Bos taurus; identical to SEQ ID NO: 14828

SEQ ID NO: 96341 - DNA, 201 bp, Bos taurus; identical to SEQ ID NO: 14829

SEQ ID NO: 96342 - DNA, 201 bp, Bos taurus; identical to SEQ ID NO: 14830

SEQ ID NO: 96343 - DNA, 201 bp, Bos taurus; identical to SEQ ID NO: 14832

SEQ ID NO: 96344 - DNA, 201 bp, Bos taurus; identical to SEQ ID NO: 14833

SEQ ID NO: 96345 - DNA, 201 bp, Bos taurus
aagttgggcctctctgctctttgacaataaggcttttctttgtttctgaatccgactccagctcctcctactgagtcaagcaacaccaggcaggagaaccgtttgctggggcctgactcagaagggtaagtattattttcactgccctaaaaatcctctctgctctacatatttattcatcccacctcccacaacccctgg

SEQ ID NO: 96346 - DNA, 201 bp, Bos taurus
tcaaacatggctgtaaattctttgctagtttttgcattaagaagttgagtctaattttcatttctttgtatctgggccggcttagagacatgcttgactaatagtatgtgacagaagtgatattcttgtactgctgaggtcaggctttaagaggttccagattccacccaggcctctgagtttactctttctgagagtcct

SEQ ID NO: 96347 - DNA, 201 bp, Bos taurus; identical to SEQ ID NO: 14836

SEQ ID NO: 96348 - DNA, 201 bp, Bos taurus; identical to SEQ ID NO: 14838

SEQ ID NO: 96349 - DNA, 201 bp, Bos taurus; identical to SEQ ID NO: 14839

SEQ ID NO: 96350 - DNA, 201 bp, Bos taurus
taaaaaaaaaaataggtcttgaaaaaagacacaaatgattgcacacaaaaacatgtgaggactttgttgctataacattttataaattcttttctctagatggtttagcctataaaagaaaactcctaagattcaatctattgatagctaggagtgttaagagtagctggaaagttggtttatttattaaaagtgtactat

SEQ ID NO: 96351 - DNA, 201 bp, Bos taurus
ctacatatgctacaggaagatcttccaagttttgaaatcttatgaaatactttcaaggtaaatgaacattttgatagtaataaataggcacttgaaaccctggatgaagaattaggggcaggtgtcatggtccaagactaaaattaaaaacctaaaacccaagtccctgagttaaaagctcaaaaccagcatgaaacatta

SEQ ID NO: 96352 - DNA, 201 bp, Bos taurus
tgttgtaagcactgtatagccggctaaaaaggtttcttccccttcagatattaacatcatatctcagatactgatcacccttaaaagttgacataaggagtggtcaggccttttccttataatttatagagtaaaggaccagaaggaagtacctcctagtcttaaagagagaactccacatttatcatgagacattggccc

SEQ ID NO: 96353 - DNA, 201 bp, Bos taurus; identical to SEQ ID NO: 14840

SEQ ID NO: 96354 - DNA, 201 bp, Bos taurus; identical to SEQ ID NO: 14841

SEQ ID NO: 96355 - DNA, 201 bp, Bos taurus
agggattagagacctttaagaaaaagaaaagctaacatctaactctatccaatgactagataatactgtaagtttattaaaattggaaaaccagcaagctggaggaagaacttgcaaaatattcatagtaaaaatcactgccttcaatttgcagtgaattttaataattgagactcattatgtttgacccataaaggataa

SEQ ID NO: 96356 - DNA, 201 bp, Bos taurus
ctttcagcaaccaggaagtggaaccaataggaatgaacacttacttggaaaaggaagctttaattaatatatatttctatctctaatatacacacagcagggctagatctttatcttcacaataaaatgtgtgcaaatgctctctgcagagatgagtccccacctcagtcggtatagaaaagcatgataaaggttggaaaa

SEQ ID NO: 96357 - DNA, 201 bp, Bos taurus; identical to SEQ ID NO: 14843

SEQ ID NO: 96358 - DNA, 201 bp, Bos taurus; identical to SEQ ID NO: 14844

SEQ ID NO: 96359 - DNA, 201 bp, Bos taurus; identical to SEQ ID NO: 14845

SEQ ID NO: 96360 - DNA, 201 bp, Bos taurus; identical to SEQ ID NO: 14846

SEQ ID NO: 96361 - DNA, 201 bp, Bos taurus; identical to SEQ ID NO: 14847

SEQ ID NO: 96362 - DNA, 201 bp, Bos taurus; identical to SEQ ID NO: 14848

SEQ ID NO: 96363 - DNA, 201 bp, Bos taurus
tgattttatccttgtttaaaaaacatattcaggtacttggagaattaccaactcctccataaatttggcttactataaataccaaaactggtacctggtttgcaaaggaggaaagtggaacttgtttttatctttgatctttagcatactggtcctctctgccattattggaggcacgattccagtgttctctgcattggg

SEQ ID NO: 96364 - DNA, 201 bp, Bos taurus; identical to SEQ ID NO: 14849

SEQ ID NO: 96365 - DNA, 201 bp, Bos taurus
ggccattttccaactgtctcaaagaaatttatataatcctcctttctactataagctatgcttataaggaaaaaaaaaagttctattttatacatggaactatacagaaggcacagctaagttcagaattctcaagggccatatgtataagtgttagttttcctgacggagaagcctggtccctgtatatattaggattct

SEQ ID NO: 96366 - DNA, 201 bp, Bos taurus; identical to SEQ ID NO: 14850

SEQ ID NO: 96367 - DNA, 201 bp, Bos taurus; identical to SEQ ID NO: 14851

SEQ ID NO: 96368 - DNA, 201 bp, Bos taurus
actcctccaggagtcaccccagaatcatttcagctcgtcttatgcgtctcagattctgcctctggcaatctaagaccaccaaggctcctcacattgctgaatggccagttcttctgtacgacccctggacgagcaagtattttaattaatgagtgggtttccctatgggaccactgcacagtatgaagacaaggcctccac

SEQ ID NO: 96369 - DNA, 201 bp, Bos taurus; identical to SEQ ID NO: 14852

SEQ ID NO: 96370 - DNA, 201 bp, Bos taurus; identical to SEQ ID NO: 14853

SEQ ID NO: 96371 - DNA, 201 bp, Bos taurus
cgagtggccggatcccgagcgagtgaccaggtgtggccgccgcctgagatgctacagcgccggcactgcaggtggtacagccaagtaacaatctccgctgcaccgggagggcaccggccggataccagccgggtaagacaccggccggataggaccccggccggataggaccgagcttcggaggaagggatgctgagcatg

SEQ ID NO: 96372 - DNA, 201 bp, Bos taurus
agtgtgcttatagaagaagagaaaatacacagacacacacatatgggtgatgtgaagatggaggcagagaatgaagtgatgtggccatgagtcatggaaaagaaggatgcaaaaagccaccagaagccagaagaggcagggaagacttctcccaagagtgtccagaggcaatgcagcaccttaactttggacttcaggcct

SEQ ID NO: 96373 - DNA, 201 bp, Bos taurus; identical to SEQ ID NO: 14854

SEQ ID NO: 96374 - DNA, 201 bp, Bos taurus
actccctcacttctcaggctgccttgatctcagctgcaagacaaaccactgcccccctacccccggaccacccacttcccatggccatcaggcatcacagccatctttcagaacagaaagactgaatccattctttatccttcttcttcctctagagtcaagaagaaataggtctcccttcaggccaatctcctaaggcca

SEQ ID NO: 96375 - DNA, 201 bp, Bos taurus; identical to SEQ ID NO: 14855

SEQ ID NO: 96376 - DNA, 201 bp, Bos taurus
aaacacaagtctgatctctatgtctccctcacccgctcctgaagagtctctgcatctcactcatgccgtgagcttggaggtacccaactggccaccaagacagtcatctttcaaccaagccccgatgtccaggtccagtttacctttgacctctactggtagggctggttgacaaaagaaagcaatgactgataaaacatt

SEQ ID NO: 96377 - DNA, 201 bp, Bos taurus; identical to SEQ ID NO: 14857

SEQ ID NO: 96378 - DNA, 201 bp, Bos taurus; identical to SEQ ID NO: 14858

SEQ ID NO: 96379 - DNA, 201 bp, Bos taurus; identical to SEQ ID NO: 14859

SEQ ID NO: 96380 - DNA, 201 bp, Bos taurus; identical to SEQ ID NO: 14860

SEQ ID NO: 96381 - DNA, 201 bp, Bos taurus; identical to SEQ ID NO: 14861

SEQ ID NO: 96382 - DNA, 201 bp, Bos taurus
tttaacattttttgtttgacattggccatggagctaacaatttgtccagtaaaaagagagttattagcaatcactagacaggctcaaagagacgaggtagacacaggtgctgcacaggcgcaggccataccatccttcaagtccatgaaattctccaaagcgggggagaggttttgaaaggtgtttgcatttctggtgtcc

SEQ ID NO: 96383 - DNA, 201 bp, Bos taurus
aatggttggtgtaaggaaccaatataagcatacaaagttggtgttttaatctgtagggtttattattatttatgtgtgataaggccaatagataagtagatgactacagtgaaaacatggtttgtaactcacaggtccccagaggacaggacataccatattaggcaaggtcacatggggaatcatgagggtctgggagaa

SEQ ID NO: 96384 - DNA, 201 bp, Bos taurus; identical to SEQ ID NO: 14863

SEQ ID NO: 96385 - DNA, 201 bp, Bos taurus; identical to SEQ ID NO: 14864

SEQ ID NO: 96386 - DNA, 201 bp, Bos taurus; identical to SEQ ID NO: 14867

SEQ ID NO: 96387 - DNA, 201 bp, Bos taurus
caggacactggagagccttccatagcacccctcagtcgggtcccgcctagttccaggtattccccagatcaaatctctccatctgctctaacttctcatgctcactttggcctccttgattgtcctactgtttgttctccactctagggatatggagacacctctaattcccttggggaactaataaataccagatcctat

SEQ ID NO: 96388 - DNA, 201 bp, Bos taurus; identical to SEQ ID NO: 14871

SEQ ID NO: 96389 - DNA, 201 bp, Bos taurus
agtcctcatccttggggcttatgtactcctaagcctccgcttcaggcttctgaatcttttcttcattcagggcaattttattttggcccagagcctccacatgtgcatatccacagccctctgtctgctggtccaccctaaaagaagtactagaggcctggaaatacagtgtaagtcgttcatttgtttttttctatttca

SEQ ID NO: 96390 - DNA, 201 bp, Bos taurus
aggccaattcaaaccctttgcaaaggcctttgccaggtctccccatctcctcagttgctggaaggtagatagccccaggatggagcctagtcacccttgggggccagaccaggcatggataaagcttaaaagagacagcatggaagagaaggtgtctgaccagccaaagccagtggaacctgtacagaagctgctccctca

SEQ ID NO: 96391 - DNA, 201 bp, Bos taurus
aggtggcccccttttgaagaggtcccctgaaatattttcacctcctaaatgacctgagccctgcagcccaagtgtcctcatttgtaccaccccatggtcatcttgctcctcctccctcacccaaatctttggttttcagagttctgaattttggtgttacagggttgtgttgttttctttgaaattgtactctgcttcact

SEQ ID NO: 96392 - DNA, 201 bp, Bos taurus
tctttaacgctctggtacattctgtcatgactgcacgcctgaacttttgccactctcaagagctcaatcacttcttctgtgatgtcaagcccctcttggagctggcctgcagtaacacgctgctcaaccagtggctgctttttgttgtcacaggcagcgtatctatgggagctttcttcctgacgcttctctcctacttct

SEQ ID NO: 96393 - DNA, 201 bp, Bos taurus
aaaaaaggccctgggttttgtctgacttgatcttactcaagcctgttctgcctcttggaatgtctggttctaaacggctgtttaaggagatggagctgacaaggatttctaagtgacacttggccccaggacagactggagttaggaggagtttctgcaaaggtgttggaggaggtaatggaaatggtgagctagcagttg

SEQ ID NO: 96394 - DNA, 201 bp, Bos taurus
aagaagtaatacatgggggaatggaggcgatggtccaaggtagttatggtgataatgaggaggttgcctgtcaaggccagcaggtatgtcatcaaaaacaacagtgcgtgtaaaatctgaagcttacggtcagcagaaaaccccacgaggaggaatccactcactgaggtcaggttggccatgtcactctgaagatagcaa

SEQ ID NO: 96395 - DNA, 201 bp, Bos taurus; identical to SEQ ID NO: 14873

SEQ ID NO: 96396 - DNA, 201 bp, Bos taurus; identical to SEQ ID NO: 14874

SEQ ID NO: 96397 - DNA, 201 bp, Bos taurus
agtatgagtggtcctgtatcttaacagttagaacgttttttcctcctcctaacactctgattttttaaatacatattcattggcagttcagtaattgtccatgtctgcaaaaatggagtttgtatatcttgatatgccaccctctcttacatgtatttttggctttgtgtgtaatgtgctcagtcgtgtctgattctttgc

SEQ ID NO: 96398 - DNA, 201 bp, Bos taurus; identical to SEQ ID NO: 14875

SEQ ID NO: 96399 - DNA, 201 bp, Bos taurus; identical to SEQ ID NO: 14876

SEQ ID NO: 96400 - DNA, 201 bp, Bos taurus; identical to SEQ ID NO: 14877

SEQ ID NO: 96401 - DNA, 201 bp, Bos taurus; identical to SEQ ID NO: 14878

SEQ ID NO: 96402 - DNA, 201 bp, Bos taurus; identical to SEQ ID NO: 14879

SEQ ID NO: 96403 - DNA, 201 bp, Bos taurus
tgggcaattagcagctcaaggttggaaaaaagttactttcaggcagaacccatcctccttatagcaacacagaactaaaggcccctgctaagtagttgaagtgggagcaaaggaatgcaggggaaaaaagtttggcggcttgccagtttgtctcctcctggggcttggggaccacaggcctccctaggcagacttgcctag

SEQ ID NO: 96404 - DNA, 201 bp, Bos taurus; identical to SEQ ID NO: 14880

SEQ ID NO: 96405 - DNA, 201 bp, Bos taurus; identical to SEQ ID NO: 14881

SEQ ID NO: 96406 - DNA, 201 bp, Bos taurus; identical to SEQ ID NO: 14882

SEQ ID NO: 96407 - DNA, 201 bp, Bos taurus
catcaaaaatggtgcctgaaagcaggcataacatactttcttactgagatcatggggaatgaacactcttttgggtaattagctgggccaccaaagggaatagagtatattcttaggggaaatcttgcagtaacatcaaatgattgagaatcaaaactcttaggttcttttcttgctttctgactggggccacaattgtcc

SEQ ID NO: 96408 - DNA, 201 bp, Bos taurus; identical to SEQ ID NO: 14883

SEQ ID NO: 96409 - DNA, 201 bp, Bos taurus; identical to SEQ ID NO: 14884

SEQ ID NO: 96410 - DNA, 201 bp, Bos taurus
atcgaggtcaaccttggcccgtacggggatcgaacccgcgaccttggcgttattagcaccacgctctaaccaactgagctaaccggccaggacgacacctttgcccttcacattacaaacgacacttaaacagcatggttttgcagtttactgtgggaagcataagttgcttccattctttttctcgtctttcttcattgg

SEQ ID NO: 96411 - DNA, 201 bp, Bos taurus
agtttttcttcctgtatagcttttaaatcatttcacagcaatcttcctcctaggaatgtacctcagtgaaattccagctcaactccatggttggccttgtttaagtgcaggattttgcagtaccagattattacaggcaagctagatatccaccaggtatacgtcagtggccacccatgaatttcatactatgtagcagct

SEQ ID NO: 96412 - DNA, 201 bp, Bos taurus; identical to SEQ ID NO: 14885

SEQ ID NO: 96413 - DNA, 201 bp, Bos taurus; identical to SEQ ID NO: 14886

SEQ ID NO: 96414 - DNA, 201 bp, Bos taurus; identical to SEQ ID NO: 14887

SEQ ID NO: 96415 - DNA, 201 bp, Bos taurus; identical to SEQ ID NO: 14888

SEQ ID NO: 96416 - DNA, 201 bp, Bos taurus; identical to SEQ ID NO: 14889

SEQ ID NO: 96417 - DNA, 201 bp, Bos taurus
tcccatacagcatctagtagggtcaagatctcttccttgtttttgatgtctttactgttagctgttaagagccctttctccttgtatagggccccatgtatattgcaaagtagcaaaagcatacctggagtcagtgtaaacgttggtcttcttaccttttgacaactggagggcccgaatgagagcccataattcagtccg

SEQ ID NO: 96418 - DNA, 201 bp, Bos taurus; identical to SEQ ID NO: 14890

SEQ ID NO: 96419 - DNA, 201 bp, Bos taurus; identical to SEQ ID NO: 14891

SEQ ID NO: 96420 - DNA, 201 bp, Bos taurus; identical to SEQ ID NO: 14892

SEQ ID NO: 96421 - DNA, 201 bp, Bos taurus; identical to SEQ ID NO: 14893

SEQ ID NO: 96422 - DNA, 201 bp, Bos taurus; identical to SEQ ID NO: 14894

SEQ ID NO: 96423 - DNA, 201 bp, Bos taurus; identical to SEQ ID NO: 14897

SEQ ID NO: 96424 - DNA, 201 bp, Bos taurus
ggtgtgacagaaaacaacaaaattctgtaaagtaattatccttcaataaaaaaaaaaaaaaagaatcttggacgtaagtcaggatttcctttaatgtcaacagataacatcttcaccagaaagtcacttcagaaaaattccttattacactgcatatgtttgatatcttcaaaatcaagatttacatttttcctactcctg

SEQ ID NO: 96425 - DNA, 201 bp, Bos taurus; identical to SEQ ID NO: 14899

SEQ ID NO: 96426 - DNA, 201 bp, Bos taurus; identical to SEQ ID NO: 14900

SEQ ID NO: 96427 - DNA, 201 bp, Bos taurus; identical to SEQ ID NO: 14901

SEQ ID NO: 96428 - DNA, 201 bp, Bos taurus; identical to SEQ ID NO: 14902

SEQ ID NO: 96429 - DNA, 201 bp, Bos taurus; identical to SEQ ID NO: 14903

SEQ ID NO: 96430 - DNA, 201 bp, Bos taurus; identical to SEQ ID NO: 14904

SEQ ID NO: 96431 - DNA, 201 bp, Bos taurus; identical to SEQ ID NO: 14905

SEQ ID NO: 96432 - DNA, 201 bp, Bos taurus
acaatatttttttcagttttctttcaattttctgataaaagctgagtaactttgcttttcacgtttagttttagtgccacctaaattacaatttttgtacagttgaggtaggaatcaatttttaattgctccatctataggaccaattgtcttggcaacatgtatctttttcctattattttcaaatttcacctccactat

SEQ ID NO: 96433 - DNA, 201 bp, Bos taurus; identical to SEQ ID NO: 14907

SEQ ID NO: 96434 - DNA, 201 bp, Bos taurus
tgaggcgcaaggcccttgagggaagaattttcacacctaagttgttactggcaatgaatgcctaatacttcatcaccaccatcttttctattgctctctatacctctggccagatacagtgacaacaaacttgacccaagtctctgctagcttatacagtcataagaggcccctttcctcaaataaaacagttttaagtta

SEQ ID NO: 96435 - DNA, 201 bp, Bos taurus
tctaaattccatatatatgcgttagtatactgtatttatgtttttccttctggcttacttcactctgtataataggctcatactttaatttggccctactgtatatgttttgcctccaatgtccacaactgctaaatctagagcatttccttaatggaacattcatggcccttttatatattccatgggctaagagtcctc

SEQ ID NO: 96436 - DNA, 201 bp, Bos taurus
gggactttcaaggtaagcattctatttttagttctatttgagattagctgaatatcttaacaccattctttgaaccacgttaaagggccaaaatctattaaaaataatttttggtttctctttcttcaagataagggatttggccttttccttacctctctttctttctctgtgttagttaatttattctgggtttgtaaa

SEQ ID NO: 96437 - DNA, 201 bp, Bos taurus; identical to SEQ ID NO: 14908

SEQ ID NO: 96438 - DNA, 201 bp, Bos taurus; identical to SEQ ID NO: 14909

SEQ ID NO: 96439 - DNA, 201 bp, Bos taurus
agtctcgaactttgttcttctttcccaagatcactttcactctttggtattttgtgatttaatacagcagaatatgttggagatatgtctctgggacttggaaacggcgaacctgaaagaacaacacttggagagtcactgcaaggactgacaagtttatttctgcagtcaagcctttttataggagcaaggaacaaagag

SEQ ID NO: 96440 - DNA, 201 bp, Bos taurus; identical to SEQ ID NO: 14910

SEQ ID NO: 96441 - DNA, 201 bp, Bos taurus; identical to SEQ ID NO: 14911

SEQ ID NO: 96442 - DNA, 201 bp, Bos taurus; identical to SEQ ID NO: 14912

SEQ ID NO: 96443 - DNA, 201 bp, Bos taurus
tacagatacaagagcattatctttattcaccacgtgccaaatacttagcacaatgcacagcacacaacagaaactcaataaatacgaactgaattcaagaattcaatttgaggaatttaggcacaccgcacggagaaggcaatggcaccccactccagtactcttacctggaaaatcccatggatgggggagcctggtagg

SEQ ID NO: 96444 - DNA, 201 bp, Bos taurus; identical to SEQ ID NO: 14913

SEQ ID NO: 96445 - DNA, 201 bp, Bos taurus; identical to SEQ ID NO: 14914

SEQ ID NO: 96446 - DNA, 201 bp, Bos taurus; identical to SEQ ID NO: 14915

SEQ ID NO: 96447 - DNA, 201 bp, Bos taurus; identical to SEQ ID NO: 14916

SEQ ID NO: 96448 - DNA, 201 bp, Bos taurus; identical to SEQ ID NO: 14917

SEQ ID NO: 96449 - DNA, 201 bp, Bos taurus
ctcctaaactatgagttatttggcctcccagtttcctcccaactcacagaatctgtttagctctgcttctagtagataatttctcacggctatctaaaaaagacagatgttcgatggcaggcctggaaggtacattggagatattattaagtggaataaatgctcctatttttgtttgtttggaatataaaagaatattga

SEQ ID NO: 96450 - DNA, 201 bp, Bos taurus; identical to SEQ ID NO: 14918

SEQ ID NO: 96451 - DNA, 201 bp, Bos taurus; identical to SEQ ID NO: 14919

SEQ ID NO: 96452 - DNA, 201 bp, Bos taurus; identical to SEQ ID NO: 14922

SEQ ID NO: 96453 - DNA, 201 bp, Bos taurus; identical to SEQ ID NO: 14923

SEQ ID NO: 96454 - DNA, 201 bp, Bos taurus; identical to SEQ ID NO: 14924

SEQ ID NO: 96455 - DNA, 201 bp, Bos taurus
gtacggaagatgttaatacctggcctgcggagaccatgagcaagtataggaggctgttgtgactgtcagatgggagatgatgcactgaactatgacagtcgacagtggtaatgagaggccaaatcaaaagacattttgatgataaaatgatcaggattgagtctggttaaatttcttcgaggccgtgtaggcagcataaag

SEQ ID NO: 96456 - DNA, 201 bp, Bos taurus
gcaggaatggacgtggggagggagtccagaacacactgagactagtacccagcagagacatagtgaccacagaggcagaacggggagtgttttctcgtccataccccagatacagagagaagtccctccccaggcccttggttgagcatgtgtgcaagtgaccagctagaccagcagggagggcgcagccaggagggaagt

SEQ ID NO: 96457 - DNA, 201 bp, Bos taurus; identical to SEQ ID NO: 14925

SEQ ID NO: 96458 - DNA, 201 bp, Bos taurus; identical to SEQ ID NO: 14926

SEQ ID NO: 96459 - DNA, 201 bp, Bos taurus
ccagaggtgcagccttgctaaggtagcaatgggcagttttggaattttaagatgccgttggtttgctgattttgtcttgccctctgttcaaccatttagctgttcatgcagtgatcttatgctaattaccaggagaattgttaaggtgtacgggcatggactttgaggagcttatatagtatgttttggcaactcaaggat

SEQ ID NO: 96460 - DNA, 201 bp, Bos taurus; identical to SEQ ID NO: 14928

SEQ ID NO: 96461 - DNA, 201 bp, Bos taurus; identical to SEQ ID NO: 14931

SEQ ID NO: 96462 - DNA, 201 bp, Bos taurus; identical to SEQ ID NO: 14932

SEQ ID NO: 96463 - DNA, 201 bp, Bos taurus; identical to SEQ ID NO: 14934

SEQ ID NO: 96464 - DNA, 201 bp, Bos taurus; identical to SEQ ID NO: 14935

SEQ ID NO: 96465 - DNA, 201 bp, Bos taurus
cctgccagcaagggcgggatgctccctgctcacaacagatcagccccacgcttcttaggtttagccaagataagcataagaatatgcagacctatgatttcgtggccaacccatccatttctgggacagtgatgctctcaaaatcaatgtttgtttgcctcccagaataaaacgctttccgtgaagacaacataaagcagc

SEQ ID NO: 96466 - DNA, 201 bp, Bos taurus
tggctacccaccctcctggctcacgtctccccactcctctctgtgtctgtgtcttggacagccttgagaaggagccctccggtggtcccttcccttgctccgaaagttcaggcctctcctctggtccctgctgcctcttgtttgtgtctctctgcacgcatcccatcgcactgtaacagaacacggctctcgtcctctcta

SEQ ID NO: 96467 - DNA, 201 bp, Bos taurus; identical to SEQ ID NO: 14936

SEQ ID NO: 96468 - DNA, 201 bp, Bos taurus
aactgagtctgtgaggtcaagcattaccataatccccattttacaggtgatgaaactgaggccaaaagggatcgacagggaggaaactaggatttgaatgcagggctgactctaactgacatcaggagtggagaattcaggagggctgagttgggtgaaagagcctgggagctggggatttgaggaaggagccggcagatg

SEQ ID NO: 96469 - DNA, 201 bp, Bos taurus; identical to SEQ ID NO: 14937

SEQ ID NO: 96470 - DNA, 201 bp, Bos taurus; identical to SEQ ID NO: 14939

SEQ ID NO: 96471 - DNA, 201 bp, Bos taurus; identical to SEQ ID NO: 14940

SEQ ID NO: 96472 - DNA, 201 bp, Bos taurus; identical to SEQ ID NO: 14941

SEQ ID NO: 96473 - DNA, 201 bp, Bos taurus; identical to SEQ ID NO: 14942

SEQ ID NO: 96474 - DNA, 201 bp, Bos taurus; identical to SEQ ID NO: 14943

SEQ ID NO: 96475 - DNA, 201 bp, Bos taurus
ataagtccagaaactgaaggagaaatggcacgtggtggccttgacaccgagactttgggaactgaaggagagggcgagcctcggggctcccgccatcccttcccgagctgaaccgagagggccggtgagcaaccgactagcactaagtgtgtgtaaaatcagggggaaataaccgtcccggcttcctgcaccaagagcttt

SEQ ID NO: 96476 - DNA, 201 bp, Bos taurus
ctccaaaccacaccacgtgaggtcgcagcaggcccccacatcctgcctcttcacacctgtaagagtgtcatccttaacccactcccaagacctactcttgagaaggcctgcctaggtggatcaggggaaatcataaagtctctattgtgtccagatgcactggggtgatttgttggcgaatgtgtctcagccaaccttgag

SEQ ID NO: 96477 - DNA, 201 bp, Bos taurus; identical to SEQ ID NO: 14944

SEQ ID NO: 96478 - DNA, 201 bp, Bos taurus; identical to SEQ ID NO: 14945

SEQ ID NO: 96479 - DNA, 201 bp, Bos taurus; identical to SEQ ID NO: 14946

SEQ ID NO: 96480 - DNA, 201 bp, Bos taurus; identical to SEQ ID NO: 14947

SEQ ID NO: 96481 - DNA, 201 bp, Bos taurus; identical to SEQ ID NO: 14948

SEQ ID NO: 96482 - DNA, 201 bp, Bos taurus
tattgtcaaattgggacacttctgggagcaaaagggggtgccatgactagttactctggaacagaagacatggctgaggctctagcaggcctagtggggcgcagtcaccctactttcaggggtctatttaggtgatgtgctgttttacatttgctgacaggctgcttttggaatctttctcaagttgcttcttgcgggccg

SEQ ID NO: 96483 - DNA, 201 bp, Bos taurus; identical to SEQ ID NO: 14949

SEQ ID NO: 96484 - DNA, 201 bp, Bos taurus; identical to SEQ ID NO: 14950

SEQ ID NO: 96485 - DNA, 201 bp, Bos taurus; identical to SEQ ID NO: 14951

SEQ ID NO: 96486 - DNA, 201 bp, Bos taurus; identical to SEQ ID NO: 14952

SEQ ID NO: 96487 - DNA, 201 bp, Bos taurus; identical to SEQ ID NO: 14953

SEQ ID NO: 96488 - DNA, 201 bp, Bos taurus; identical to SEQ ID NO: 14954

SEQ ID NO: 96489 - DNA, 201 bp, Bos taurus; identical to SEQ ID NO: 14955

SEQ ID NO: 96490 - DNA, 201 bp, Bos taurus; identical to SEQ ID NO: 14956

SEQ ID NO: 96491 - DNA, 201 bp, Bos taurus; identical to SEQ ID NO: 14957

SEQ ID NO: 96492 - DNA, 201 bp, Bos taurus
atatctgttctggagatgctgataatgatacccagcctgtaaatctcttaatgggtcagtccctccatgccccgtgatcagttgttggtgcatttggcctaaagaactgtgatgctctgaggttatttatgggtgactccagtcttcaggaatttcggttgatccagtaactggcctaagaattcgtttttgatgatttag

SEQ ID NO: 96493 - DNA, 201 bp, Bos taurus; identical to SEQ ID NO: 14958

SEQ ID NO: 96494 - DNA, 201 bp, Bos taurus; identical to SEQ ID NO: 14959

SEQ ID NO: 96495 - DNA, 201 bp, Bos taurus; identical to SEQ ID NO: 14960

SEQ ID NO: 96496 - DNA, 201 bp, Bos taurus
ccaagttgtatcagctgtgttctggctgggaggcaaaggttggtagcatgtgtacatatacgcattcatggatttagatataacttcataccttggggatagcatacattgatgcaggaagataagatagatgggcatgtgcaaataggaagatctttcccttctttcaaatatgctttattagatgttacaacttgtgtg

SEQ ID NO: 96497 - DNA, 201 bp, Bos taurus; identical to SEQ ID NO: 14961

SEQ ID NO: 96498 - DNA, 201 bp, Bos taurus
gatattttacttctcaatatattaagcacaaccttcattctcattctttctcttagatcccacccatttctataattcaaaataaaatccaccatttccaatatacaaactgaaataatccacgctcatctcaacagactccacttgaagagaaatggaaacatcctctgagaggcctgcttctcagacaatagtctcctt

SEQ ID NO: 96499 - DNA, 201 bp, Bos taurus
gggatccagccagttcagactcaccaataccaacccctggggcagcactacggaatcctaatcttaaaaccatgaatatcaatcaggccttgaagagatggaacatgtaaaagatctgtgcccaatgaacctttaagaaaatccacctcacttaactcaaagtcatactgacagtaagacctgcatttggtttatttatat

SEQ ID NO: 96500 - DNA, 201 bp, Bos taurus
gaacacagtagacgttctggggcatgtagacggccctgaagagtctttcaaaagtattaaagtccttatggatgaccatgacatatgccagagggaactcggcttcttctttcgacaaaggccttgtgatatagtgattctggatcaggtagtccttgcacgggacacttcccatgggggacatcaatgtcttttcccaca

SEQ ID NO: 96501 - DNA, 201 bp, Bos taurus; identical to SEQ ID NO: 14963

SEQ ID NO: 96502 - DNA, 201 bp, Bos taurus; identical to SEQ ID NO: 14964

SEQ ID NO: 96503 - DNA, 201 bp, Bos taurus; identical to SEQ ID NO: 14965

SEQ ID NO: 96504 - DNA, 201 bp, Bos taurus; identical to SEQ ID NO: 14966

SEQ ID NO: 96505 - DNA, 201 bp, Bos taurus; identical to SEQ ID NO: 14967

SEQ ID NO: 96506 - DNA, 201 bp, Bos taurus; identical to SEQ ID NO: 14968

SEQ ID NO: 96507 - DNA, 201 bp, Bos taurus; identical to SEQ ID NO: 14969

SEQ ID NO: 96508 - DNA, 201 bp, Bos taurus; identical to SEQ ID NO: 14970

SEQ ID NO: 96509 - DNA, 201 bp, Bos taurus
caaagtaaagtatgaacatttttcataaatgggtattctaagaacatacatctcttttgtatgtagacagatatatctattgtaacctcttagaagcatggtaattcttttttgagtatgtcaaggtatgaccaaagcaatgacagctaaaataatctcaagtgcttttcagtatttacactgtttttgctgctgtttatt

SEQ ID NO: 96510 - DNA, 201 bp, Bos taurus; identical to SEQ ID NO: 14971

SEQ ID NO: 96511 - DNA, 201 bp, Bos taurus; identical to SEQ ID NO: 14973

SEQ ID NO: 96512 - DNA, 201 bp, Bos taurus
ctggatgtcacttaagatatggtccttggataaacatcacatgctcctggctttcttacaaaatgggtaagcactgagtctctttttggccgctgaagccacttttattttcctgaagccttctagttagcaggtggcttgaagagaccgtggaaagggacagacagcacgcatgtgaattactgtcttcctggccttcac

SEQ ID NO: 96513 - DNA, 201 bp, Bos taurus; identical to SEQ ID NO: 14974

SEQ ID NO: 96514 - DNA, 201 bp, Bos taurus; identical to SEQ ID NO: 14975

SEQ ID NO: 96515 - DNA, 201 bp, Bos taurus; identical to SEQ ID NO: 14976

SEQ ID NO: 96516 - DNA, 201 bp, Bos taurus; identical to SEQ ID NO: 14978

SEQ ID NO: 96517 - DNA, 201 bp, Bos taurus
cgaaactcctgaatctgtgtcccagaaaaaaaagtttcaaatcacagaaaaatctcagatcgttcaatgattcatattaactacaggtaaaaagaataaatctgcaggaaaacaaaaatgctatcatctgaagggctatttccagcccctgtaaacttctaactccactcatgccacaaagctgaaggtcttgtaatacct

SEQ ID NO: 96518 - DNA, 201 bp, Bos taurus
gaggcagcaaaccatctcacttggattcatagtgagtggactctgcagggaaagggacccgaagttgtcaacgcaacaccaagcacagccagagactcacgagcctccaggaaccctggccaagaccctgtgtcacctttcgaagtctgacttgacccagcagagccaaatcttcccccttctatgtccccacaccctgta

SEQ ID NO: 96519 - DNA, 201 bp, Bos taurus; identical to SEQ ID NO: 14979

SEQ ID NO: 96520 - DNA, 201 bp, Bos taurus
caaacctgtcctccacggcctttctcctgcgcttctcatcctcgatctcgtacgtcagccgggtgatcttctcgttgagttctttgatctgcccgtagcacttgtctaggttttgcttggccgacttgccgtccagctcggcctgtctcttcagctcctccaggctcacgagcttagctttgaactgggagcactccgcct

SEQ ID NO: 96521 - DNA, 201 bp, Bos taurus
gacttaatcatgtgtgggactataaaaactggcacagggagttcctaggcaggtgcagatgggaactctgggtaagggaagggcttggccaagatgttcgctgggggttgtccgtatcgtaaaaaattaaaacaataaacactaaaaaagtaaaaggaagcagagaggccaaacttgcgaatgaaagtctctaagtatata

SEQ ID NO: 96522 - DNA, 201 bp, Bos taurus; identical to SEQ ID NO: 14980

SEQ ID NO: 96523 - DNA, 201 bp, Bos taurus; identical to SEQ ID NO: 14981

SEQ ID NO: 96524 - DNA, 201 bp, Bos taurus; identical to SEQ ID NO: 14982

SEQ ID NO: 96525 - DNA, 201 bp, Bos taurus; identical to SEQ ID NO: 14983

SEQ ID NO: 96526 - DNA, 201 bp, Bos taurus; identical to SEQ ID NO: 14984

SEQ ID NO: 96527 - DNA, 201 bp, Bos taurus; identical to SEQ ID NO: 14987

SEQ ID NO: 96528 - DNA, 201 bp, Bos taurus; identical to SEQ ID NO: 14988

SEQ ID NO: 96529 - DNA, 201 bp, Bos taurus; identical to SEQ ID NO: 14989

SEQ ID NO: 96530 - DNA, 201 bp, Bos taurus; identical to SEQ ID NO: 14990

SEQ ID NO: 96531 - DNA, 201 bp, Bos taurus
gatccagatccatcctgttgattttctctcctaaagtctcaagaatggatccatttctttccatcttgtctcacctgccaccttgagagctgcctgcaccaactccccactcctcctggcccctttcactctatgatgcacagaccaggtcctgtccagaccaggtcaccacctcaccctcctgggacactcccctccttt

SEQ ID NO: 96532 - DNA, 201 bp, Bos taurus
cattgggtgctctgggcccctctgccttgattgccaccaccaccaccatcacccaactggtggggaaggtccagctaaactttctgtcctcctccctctaacaagggcagagtcaggcctaattgttcctggaaaccgctgactatctcgctaatctaataggcacacctcctggagccgagggtgtggatcctgctgtcc

SEQ ID NO: 96533 - DNA, 201 bp, Bos taurus; identical to SEQ ID NO: 14993

SEQ ID NO: 96534 - DNA, 201 bp, Bos taurus; identical to SEQ ID NO: 14994

SEQ ID NO: 96535 - DNA, 201 bp, Bos taurus; identical to SEQ ID NO: 14995

SEQ ID NO: 96536 - DNA, 201 bp, Bos taurus
cgcccttcccaccaaggccggaggttcctctaagcgtgccagctacgccctgggtccggccaccactgcctcagtccaggtgccccacgaggcccaaaggcgtcaacaagcacagatcagaagcctctgtccacagcgtcccccactgtcctcttctttgctggacgtcagtgacagacaacaaaagggccgatgggtggc

SEQ ID NO: 96537 - DNA, 201 bp, Bos taurus; identical to SEQ ID NO: 14996

SEQ ID NO: 96538 - DNA, 201 bp, Bos taurus; identical to SEQ ID NO: 14997

SEQ ID NO: 96539 - DNA, 201 bp, Bos taurus; identical to SEQ ID NO: 14998

SEQ ID NO: 96540 - DNA, 201 bp, Bos taurus; identical to SEQ ID NO: 14999

SEQ ID NO: 96541 - DNA, 201 bp, Bos taurus
caaggactaattataccttgtttattttctctacagaatcagacccattttccaaacaccagatggcgtaaattaattgttaaaatagtagtaaggttgacccttataaaatataagcaagtcctttttgtttttgcaggatttttacagcggctccacagagtacaatgaagccttaatagaagcaggaacacaggttgt

SEQ ID NO: 96542 - DNA, 201 bp, Bos taurus
acgtccaagagccacggttcttggaagtgtcctgggcttccgtgaggcggctgacccaccgctgtgcgtcggggttcccgggaggggcctgctgcgtgtctgggaaggaagggcgcagtccacgtgtgcctcgtcccgactactgcacacgcggtcgctggagccggccacttggtctctagcgtctgcagggcccatggc

SEQ ID NO: 96543 - DNA, 201 bp, Bos taurus
ggcgcctgccttactgataacgttcacatttcctgtctaagaacaatgtggctaagtgtggtgtcattaaaaactagtttaaaaaaccactataggccacccctgagagtctcactgctggatgctagggctctcccaggagtcagatcacagtggggggcgggggggggggcagtcagctctgccctcagaagacgctcg

SEQ ID NO: 96544 - DNA, 201 bp, Bos taurus; identical to SEQ ID NO: 15000

SEQ ID NO: 96545 - DNA, 201 bp, Bos taurus
ttctgaccccgagtctgaccttcatcctggcctggatggaccgtgtcagtcctcaggaagaacgcggggctcgggggaggacggggtagcccagggacctatcctggaatcactggcctggcgatgtttccactggggccgcaagaagtctttggaaaatgtgcctttaaccagaaaaggggtcttaacacttcaatagtt

SEQ ID NO: 96546 - DNA, 201 bp, Bos taurus; identical to SEQ ID NO: 15001

SEQ ID NO: 96547 - DNA, 201 bp, Bos taurus
agcctgcctggccctgggatccctgatccgtccaagggagaaaatgaaaccgccgatctcgtgggctgttgggaggactacagagttgatgggtgttcacggcgggtgctggcgaggcctggcgatggtgcagagttggaagcttgggggcagggaaacattatgctaatgagatgtttctcctcagtgtcaacaaagaga

SEQ ID NO: 96548 - DNA, 201 bp, Bos taurus; identical to SEQ ID NO: 15002

SEQ ID NO: 96549 - DNA, 201 bp, Bos taurus; identical to SEQ ID NO: 15003

SEQ ID NO: 96550 - DNA, 201 bp, Bos taurus; identical to SEQ ID NO: 15004

SEQ ID NO: 96551 - DNA, 201 bp, Bos taurus; identical to SEQ ID NO: 15005

SEQ ID NO: 96552 - DNA, 201 bp, Bos taurus; identical to SEQ ID NO: 15006

SEQ ID NO: 96553 - DNA, 201 bp, Bos taurus; identical to SEQ ID NO: 15007

SEQ ID NO: 96554 - DNA, 201 bp, Bos taurus
ccaggttggcctcctgaagcttcttctgctcctcaatgatgtcactgctcagagactgcttcttgtaggccttgtgggcctccacgccatagttgaagaagccagggttggagagggtgcctgggaagcaggacaaaggctcccactcagcgggacatccacggcccgccagccccacagtgacactgctgcctggacgcc

SEQ ID NO: 96555 - DNA, 201 bp, Bos taurus; identical to SEQ ID NO: 15008

SEQ ID NO: 96556 - DNA, 201 bp, Bos taurus; identical to SEQ ID NO: 15009

SEQ ID NO: 96557 - DNA, 201 bp, Bos taurus; identical to SEQ ID NO: 15010

SEQ ID NO: 96558 - DNA, 201 bp, Bos taurus; identical to SEQ ID NO: 15011

SEQ ID NO: 96559 - DNA, 201 bp, Bos taurus; identical to SEQ ID NO: 15012

SEQ ID NO: 96560 - DNA, 201 bp, Bos taurus; identical to SEQ ID NO: 15013

SEQ ID NO: 96561 - DNA, 201 bp, Bos taurus; identical to SEQ ID NO: 15014

SEQ ID NO: 96562 - DNA, 201 bp, Bos taurus; identical to SEQ ID NO: 15015

SEQ ID NO: 96563 - DNA, 201 bp, Bos taurus; identical to SEQ ID NO: 15017

SEQ ID NO: 96564 - DNA, 201 bp, Bos taurus; identical to SEQ ID NO: 15018

SEQ ID NO: 96565 - DNA, 201 bp, Bos taurus
gccctcggcgactgacctcgtcagggctggaggcctggtaggtgcggttgtcatcactgaaatcctggtccgcctcggcgacctcggtctcgccagctgcaccgcgggcctcgtacacgggcgtcacattgtgacacagggcgacagccttcacggcctcatggacccggctgctcacgctcctcctcaccttgggcgctg

SEQ ID NO: 96566 - DNA, 201 bp, Bos taurus; identical to SEQ ID NO: 15019

SEQ ID NO: 96567 - DNA, 201 bp, Bos taurus; identical to SEQ ID NO: 15020

SEQ ID NO: 96568 - DNA, 201 bp, Bos taurus; identical to SEQ ID NO: 15021

SEQ ID NO: 96569 - DNA, 201 bp, Bos taurus; identical to SEQ ID NO: 15022

SEQ ID NO: 96570 - DNA, 201 bp, Bos taurus; identical to SEQ ID NO: 15023

SEQ ID NO: 96571 - DNA, 201 bp, Bos taurus
tctgacgagtgctagaacaaagcacaaggaggccagggtgccagtctgtgggtgtgtcctgcagccccaggctgcccctgggccatcccaggcagtctgctgtccttggggagaagctgggcactgaccatgctcttgcagactccaggaggtctgtcgtgcagagccctggggcaggactggtctgcgggctcgtctgac

SEQ ID NO: 96572 - DNA, 201 bp, Bos taurus; identical to SEQ ID NO: 15024

SEQ ID NO: 96573 - DNA, 201 bp, Bos taurus; identical to SEQ ID NO: 15025

SEQ ID NO: 96574 - DNA, 201 bp, Bos taurus; identical to SEQ ID NO: 15026

SEQ ID NO: 96575 - DNA, 201 bp, Bos taurus; identical to SEQ ID NO: 15027

SEQ ID NO: 96576 - DNA, 201 bp, Bos taurus; identical to SEQ ID NO: 15028

SEQ ID NO: 96577 - DNA, 201 bp, Bos taurus
gcatggatcgccagttggcaccatcacaaggggccacctggaccctgtgggagcctcagagggttcccctggcatgagctaatagagggcaaagccacctgcaacactcgggcccatctcgggggccgcatcttctgtccaacaccagcaatactggagtaagttgtttaaaagagcagccacaagatgatcagactaaga

SEQ ID NO: 96578 - DNA, 201 bp, Bos taurus; identical to SEQ ID NO: 15029

SEQ ID NO: 96579 - DNA, 201 bp, Bos taurus; identical to SEQ ID NO: 15030

SEQ ID NO: 96580 - DNA, 201 bp, Bos taurus; identical to SEQ ID NO: 15031

SEQ ID NO: 96581 - DNA, 201 bp, Bos taurus
tcctccacgggcagaaatccatcctccatggctccagagtccaaaagatgcttcaaggtgtccaggggctggttcccttcagagactctgagggccatccatcccacgtctcttcacctccacatgtcctcggcatgtggacgaacctgcagatcctgccccgcgtgccctggcctgcgtcctgctccctgcgtgtcctct

SEQ ID NO: 96582 - DNA, 201 bp, Bos taurus
agaaagagaactatggggagcaactccttctatcaaataaaccatggctgtggcagcaagctttctcaaaatgtgtggcgggacactgggaaaacacatgggaatttattgttgaaaagtctcttatagaaactgagacgtttacaacaagatctcactttgagagggagtaaatccaccctcctgtagtgccacccacaa

SEQ ID NO: 96583 - DNA, 201 bp, Bos taurus
tcttgagtccacagaaacaccataagtaacttctccatcatcagtaaattgcaggtatagtcaatatatgtgtgaattttaggatatcctctgatacattgtaagttcacagtcttggaaaagtaaattaaggccacccagtttgtgactgtggttcgatttttctggaagcacactaaaacctaaaagtgactgtttcag

SEQ ID NO: 96584 - DNA, 201 bp, Bos taurus; identical to SEQ ID NO: 15032

SEQ ID NO: 96585 - DNA, 201 bp, Bos taurus; identical to SEQ ID NO: 15033

SEQ ID NO: 96586 - DNA, 201 bp, Bos taurus; identical to SEQ ID NO: 15034

SEQ ID NO: 96587 - DNA, 201 bp, Bos taurus
ggaggagggggaggccgtgggtccccttgcaggtgagtctgtggacagcagagcttgcccgcttcccttgttctggtgccagtcgctgtcactagccttacgagcagcggcccaaatacagagcaaaactgagcagttggagcttcagttttgtcactcttgggttttcttcccaggtatttgctgtaagtcagcatgagc

SEQ ID NO: 96588 - DNA, 201 bp, Bos taurus
caggggccttaacctcgtgcagggacccgcgtggacacagggacccgcgtggacgcacagccgtggagcagtgcttccaaagacgtgtgactgtgctgggtggccgtgtggttttccccagattctgtaaatagtagcatgtcactttttgcagctacgtgttttaggtttggtgtgtatgtttcctggaaaccctgaagt

SEQ ID NO: 96589 - DNA, 201 bp, Bos taurus; identical to SEQ ID NO: 15037

SEQ ID NO: 96590 - DNA, 201 bp, Bos taurus
agccagggagagagcagtgagccaaagagataaaggtctctggcctcatgggaagaaaaactgtaagttaaacctaatacaatggagccttgaatgacataggtctaaactgcattgggccactgacacgtgggtttttcagtagtagatataacagtcatacaaatgcgagtttggatgagtctgcagatactggactgt

SEQ ID NO: 96591 - DNA, 201 bp, Bos taurus; identical to SEQ ID NO: 15038

SEQ ID NO: 96592 - DNA, 201 bp, Bos taurus; identical to SEQ ID NO: 15039

SEQ ID NO: 96593 - DNA, 201 bp, Bos taurus; identical to SEQ ID NO: 15040

SEQ ID NO: 96594 - DNA, 201 bp, Bos taurus; identical to SEQ ID NO: 15041

SEQ ID NO: 96595 - DNA, 201 bp, Bos taurus; identical to SEQ ID NO: 15042

SEQ ID NO: 96596 - DNA, 201 bp, Bos taurus; identical to SEQ ID NO: 15043

SEQ ID NO: 96597 - DNA, 201 bp, Bos taurus; identical to SEQ ID NO: 15044

SEQ ID NO: 96598 - DNA, 201 bp, Bos taurus; identical to SEQ ID NO: 15045

SEQ ID NO: 96599 - DNA, 201 bp, Bos taurus; identical to SEQ ID NO: 15046

SEQ ID NO: 96600 - DNA, 201 bp, Bos taurus; identical to SEQ ID NO: 15047

SEQ ID NO: 96601 - DNA, 201 bp, Bos taurus
actttgcacgtctgggcccccacggaggtgcttccctgagctctccctcctcgtgtgctaagcagactgcagctcacctttcaacactgggctcaggtgcatcccccagaaagatgcatccccggcctcctgccttctaatgaccagggccagaaagggcaggggggagcctttcacgcgaactgccagggcctctgcacc

SEQ ID NO: 96602 - DNA, 201 bp, Bos taurus
gcaaacacctttttatttccatcaggtctcagtttctgaaatgttggttgacagtggatgggagcccagaacgaaaccctgtgactgtcatggatagtttcggcctcaggtgatttcgtcagggtctgctgttccttctcagttgaaaacctcttccctgcttggcagtgcccttccctgccttcccagtgcacatgactc

SEQ ID NO: 96603 - DNA, 201 bp, Bos taurus
gctgtcatcactgtgcagagtaagtgtgtgtgcctgtgtgtgtctggggatgtgcacacctgtgcagagcaagcttcacggtatagtactacatggcacacagcctttgcggcccgcagagcactcacattccaaggtttctcagtgatgctctcaacactcctctgccctgagctgggataatggccattgctttacacg

SEQ ID NO: 96604 - DNA, 201 bp, Bos taurus; identical to SEQ ID NO: 15048

SEQ ID NO: 96605 - DNA, 201 bp, Bos taurus; identical to SEQ ID NO: 15049

SEQ ID NO: 96606 - DNA, 201 bp, Bos taurus; identical to SEQ ID NO: 15050

SEQ ID NO: 96607 - DNA, 201 bp, Bos taurus; identical to SEQ ID NO: 15051

SEQ ID NO: 96608 - DNA, 201 bp, Bos taurus; identical to SEQ ID NO: 15052

SEQ ID NO: 96609 - DNA, 201 bp, Bos taurus; identical to SEQ ID NO: 15053

SEQ ID NO: 96610 - DNA, 201 bp, Bos taurus
ttaaaaccttccaaaagagagtattttgctgaggccactaaataagctaaagcaaagttgtatgaaataaaaaatacagctccaccatatagactggctataataatttctttctagaaatacaaaaagtggccacattaaaatatgttcagtatgtattctttcttatatgtaaacagaaaaatgtcctagagttttcaa

SEQ ID NO: 96611 - DNA, 201 bp, Bos taurus; identical to SEQ ID NO: 15054

SEQ ID NO: 96612 - DNA, 201 bp, Bos taurus
ttttctaaatgccattttattggcatgcaactaagcttccaaaatcttgtaagacattttgtattattttcctcattaagcagctaccaaaaaaatatgatttgacccaggtcagacactaattgagactggtgtctttatttgaatagatctgcctttggatagcctcagctagaataaaatgtaggacatttttaaacc

SEQ ID NO: 96613 - DNA, 201 bp, Bos taurus
aataggcaactggaaaaacatttaaacataatacaggagctcaaatacttatgatatgccaagtgaattaattggatattacgaacacagtctcaatttgtatatcaaaattagaaacagtaataatcatacaaaatatatgactatttccattttgggggtcacaattttggttgtttctatctttgtcacatttgctct

SEQ ID NO: 96614 - DNA, 201 bp, Bos taurus; identical to SEQ ID NO: 15055

SEQ ID NO: 96615 - DNA, 201 bp, Bos taurus
ctaatgtgccattctaacttatgtcatcatcatctgcttcatagactattggacttgacttttagctacactttctatctctgctcttgattcctgtggtggtggtttagtcatgtcctactcttcacaaacccctcgactgtaaaacccaccaggctcctctgttcatgggattcttcagacaaggatactgaagtcggt

SEQ ID NO: 96616 - DNA, 201 bp, Bos taurus
aatcttgaattttttacaaagacaattttatttgtgaatgtcctggttcaagcagcccaagttactagttttattaaatcctgaaactttgaatatgattgtgaatttttggtatggcaaaatatgaagtgtagagcagttgtgctgaattctgaagagcgacatttttagagggaaagcacaaggagactaagtttaaaa

SEQ ID NO: 96617 - DNA, 201 bp, Bos taurus
ctaaaccggtggacaaaggcccaattccagtattataaagctgtaaagctccatagcaaggaaaaaccaccatattttattttcaccatttacaatattgacctggccagaaaagaaagaaatctctatttatcgccaccatttcttttggtggagaagattttattgcatttttgacacttattcagatcaagactttat

SEQ ID NO: 96618 - DNA, 201 bp, Bos taurus; identical to SEQ ID NO: 15056

SEQ ID NO: 96619 - DNA, 201 bp, Bos taurus; identical to SEQ ID NO: 15057

SEQ ID NO: 96620 - DNA, 201 bp, Bos taurus; identical to SEQ ID NO: 15058

SEQ ID NO: 96621 - DNA, 201 bp, Bos taurus; identical to SEQ ID NO: 15059

SEQ ID NO: 96622 - DNA, 201 bp, Bos taurus; identical to SEQ ID NO: 15060

SEQ ID NO: 96623 - DNA, 201 bp, Bos taurus
caatggacatgagtttgaggaagctccaggagatggtgatggacagggaggtctggcttgctccagtccatggaattgcaaatagtcagacatgactgagtgactaaaaacccacaacaggcagtcaaatccttctttttctttgaacttttgacacccattctgtgcctagccaaagggagatctctgcttttaaagggc

SEQ ID NO: 96624 - DNA, 201 bp, Bos taurus; identical to SEQ ID NO: 15061

SEQ ID NO: 96625 - DNA, 201 bp, Bos taurus
gtacatcaactctaagagccctattcatcacacgcaaggcttccgcagtcaggcggccttaattctctggttttgtattgcgagtcaggccacaagatacatattatttcacaaggaaatactggagatggttggaggcgcttgcagacacacacacgggatggaataatgacgtctggcccgtttactccatgcacagga

SEQ ID NO: 96626 - DNA, 201 bp, Bos taurus
gccgcccaaagaccttgacgtcaggagatggcagggacctcgcctccctccccagatctgccagatgccttcctggcagctactgcggcctgcctggcccgctgagtaacgcggaacatctcggtgtcactgtagccatctacactctcgctggcataaggagtgatcgcccctggtaactgactgaccatccacgtgacg

SEQ ID NO: 96627 - DNA, 201 bp, Bos taurus
ttatttcttcttatcttctttatttcttctctgtttctcatctgagcaatttaatttaattcaacaattccttactgactgcctgatatacccaagacactatctttggttcagggggatacaaagttttttaagatgcagtctcaacaccccatgaatcaaaatgttatcaaacaaacagtagcttagtggaaataaaaa

SEQ ID NO: 96628 - DNA, 201 bp, Bos taurus; identical to SEQ ID NO: 15062

SEQ ID NO: 96629 - DNA, 201 bp, Bos taurus
ccttctgctcgcccacctccaaatgcagatgccaaaaaagcgtgatccttccttttccagccacttttgtggttcagggagggaggccatgagaccccctttgcccagagagatgtaggcagagcgacctccgggaaagatatttctccgtggatacaggagatgggtgtgtgggaagggtggccttttccaccctgacag

SEQ ID NO: 96630 - DNA, 201 bp, Bos taurus; identical to SEQ ID NO: 15063

SEQ ID NO: 96631 - DNA, 201 bp, Bos taurus; identical to SEQ ID NO: 15064

SEQ ID NO: 96632 - DNA, 201 bp, Bos taurus
ctgtcatccaatgtccagcatgtcagactggacaggggccgggcagtgcccagggtgttcactgctgcaatttgattcttcagcaacacaaagtaggagcaatgggattaccaagggcctcctaatgtattcaggaggttgttttatgttttaaaaattatcactggatggaggatatgaattaggatgtttgatctgtct

SEQ ID NO: 96633 - DNA, 201 bp, Bos taurus
agaggcactgagtatcattatgatgttcccattcagactggatattaacaggactgccgtgttgttgttttcaggctgtaacaccaaaagatttgcatgacatactcatgaggccaactcccatcttccagcaccaaagagattttagattcttctctgtgattctctgaggagtttcggtagaaaataaatgtctcaaga

SEQ ID NO: 96634 - DNA, 201 bp, Bos taurus; identical to SEQ ID NO: 15066

SEQ ID NO: 96635 - DNA, 201 bp, Bos taurus; identical to SEQ ID NO: 15067

SEQ ID NO: 96636 - DNA, 201 bp, Bos taurus; identical to SEQ ID NO: 15068

SEQ ID NO: 96637 - DNA, 201 bp, Bos taurus; identical to SEQ ID NO: 15070

SEQ ID NO: 96638 - DNA, 201 bp, Bos taurus; identical to SEQ ID NO: 15071

SEQ ID NO: 96639 - DNA, 201 bp, Bos taurus; identical to SEQ ID NO: 15072

SEQ ID NO: 96640 - DNA, 201 bp, Bos taurus; identical to SEQ ID NO: 15073

SEQ ID NO: 96641 - DNA, 201 bp, Bos taurus; identical to SEQ ID NO: 15074

SEQ ID NO: 96642 - DNA, 201 bp, Bos taurus; identical to SEQ ID NO: 15075

SEQ ID NO: 96643 - DNA, 201 bp, Bos taurus
aatatttggtcatcaccacagacacatgactaatgtacctattctttctgtggaattctcctattttaaatctttacgttctcatcttttcctccatccacgtattttcctatgtgttgtatttcatagtaaaggaaagtgaaaacatttgatttcatcagaaaaataactatttaagtttagacagacttctccattagc

SEQ ID NO: 96644 - DNA, 201 bp, Bos taurus
tataggtcacttcacgttcacaaatgccctgggccccttcaggaaagaaattggcaatcaccaaggaaattgattcggattacttcaggaaatacagatacaagatggccagaaaaccacatgacccagtccagtagggaagaaaatctaaggtgggtatccggcttcccgtcattgcagggcacttcccaggaggccccc

SEQ ID NO: 96645 - DNA, 201 bp, Bos taurus; identical to SEQ ID NO: 15076

SEQ ID NO: 96646 - DNA, 201 bp, Bos taurus
aaaacccagagtcactgcttgatgctttccagcaggttatgtctttttgctaattggagaaactggacatttgtgctatttcactggttcacagttacatcgagcatattctagagggtcatacacccatgtacatgtacatgcctgtatgtatgcatatgcttccctggttgctcaggtggtaaaacgtctgcctgcaat

SEQ ID NO: 96647 - DNA, 201 bp, Bos taurus
atggcagaggatgaaatggttggatggcatcaccaactcaatggacatgaatttgggtagactctgggagttggtgatggacagggaggcctggcatgctctggttcaaggagttgcaaagcatcagactgagtaactgaactgaactgaacgtgaaaagagctgaaacacacagaccctttcctagaaccaaggcccacc

SEQ ID NO: 96648 - DNA, 201 bp, Bos taurus; identical to SEQ ID NO: 15077

SEQ ID NO: 96649 - DNA, 201 bp, Bos taurus; identical to SEQ ID NO: 15078

SEQ ID NO: 96650 - DNA, 201 bp, Bos taurus; identical to SEQ ID NO: 15079

SEQ ID NO: 96651 - DNA, 201 bp, Bos taurus; identical to SEQ ID NO: 15080

SEQ ID NO: 96652 - DNA, 201 bp, Bos taurus
aagctatagtccatgggtcatggagaatcagacacaactgagtgactgatcatgcaagcatgcagagtacaataataaatattggagagtgaagcagacatagtttagtctataaaagtgggaaatggttaaactacttaacatatccaaagcatatgctctttccattatactaggcagtgtgtgtgtgagtgcatgcat

SEQ ID NO: 96653 - DNA, 201 bp, Bos taurus; identical to SEQ ID NO: 15081

SEQ ID NO: 96654 - DNA, 201 bp, Bos taurus; identical to SEQ ID NO: 15082

SEQ ID NO: 96655 - DNA, 201 bp, Bos taurus; identical to SEQ ID NO: 15083

SEQ ID NO: 96656 - DNA, 201 bp, Bos taurus
agcccgctataggagcagagcaggcgtaagtcttatgttggtgaaccttggcagaagcagttcaagccagctcagctctgtggtctgatgccagcacttttctcagcgactgcagcttgcttgatcctcgtcatggtgtagactgcactgcatagcttatctaattattctgcattgggtgtatctctcagcatacatttt

SEQ ID NO: 96657 - DNA, 201 bp, Bos taurus; identical to SEQ ID NO: 15084

SEQ ID NO: 96658 - DNA, 201 bp, Bos taurus; identical to SEQ ID NO: 15085

SEQ ID NO: 96659 - DNA, 201 bp, Bos taurus; identical to SEQ ID NO: 15086

SEQ ID NO: 96660 - DNA, 201 bp, Bos taurus; identical to SEQ ID NO: 15087

SEQ ID NO: 96661 - DNA, 201 bp, Bos taurus
ctgacactgctgagaatcttgaatcactaaatttctctcatccttcttaccaacagaaccagctccaatttcactgacaaaaatgtggccatcagttaaactgatagtactaaattatgtcacctgacagtttgtgcatgcctgggctttttaagcctttcctgcaacccctaactgtctccaggccaatagcagtagcta

SEQ ID NO: 96662 - DNA, 201 bp, Bos taurus
tatccagctcatctaactactaatatttccctgctgtttttagaaagcacttttgataagaaacatcatttttaagatggcttaaatatatgaacaggcacgacaagatctggccaaaatcaggcagcggataaaggtcacgattttccccacaagactctattggatttatatacagaactcacagattttacctctttg

SEQ ID NO: 96663 - DNA, 201 bp, Bos taurus
gtgccctgcccaaagtcacttctcatttgaacccaggaggtctgctcctacagcctataagtagttcatcccacagtatgactcacaaagaaggggcctccccattctccaaaacaacagcatgtggagaaagagctgggcttcattggaaatggtatcggatgcttcaatatcattatccttcattaaactgcagtgtta

SEQ ID NO: 96664 - DNA, 201 bp, Bos taurus; identical to SEQ ID NO: 15088

SEQ ID NO: 96665 - DNA, 201 bp, Bos taurus
ggaaattatcaatctctgttaatccttctatacaatgaccttacatttgaaatgcctactgttgcgtgatgagttcttcatgcaattttgggcaaaaattctcaaaagggaatctggcagaacagcatcttggctcattcattcactggggactctgaacacagagaaaggttgctgtgttctaggcactgtttcaggtgt

SEQ ID NO: 96666 - DNA, 201 bp, Bos taurus; identical to SEQ ID NO: 15089

SEQ ID NO: 96667 - DNA, 201 bp, Bos taurus; identical to SEQ ID NO: 15090

SEQ ID NO: 96668 - DNA, 201 bp, Bos taurus
gagctgatgatagacaggaaggcctggcgtgttgcagtccatggggtcgcaaagagtcagacaggactgagctactgaactaaattgaatctgtccacccgtcctggcctctcttctcagtcccttccagagcacagagctgataatcagttatagttcccctcaggtctttcaattactttgttatttttattttactgt

SEQ ID NO: 96669 - DNA, 201 bp, Bos taurus; identical to SEQ ID NO: 15091

SEQ ID NO: 96670 - DNA, 201 bp, Bos taurus; identical to SEQ ID NO: 15092

SEQ ID NO: 96671 - DNA, 201 bp, Bos taurus; identical to SEQ ID NO: 15093

SEQ ID NO: 96672 - DNA, 201 bp, Bos taurus; identical to SEQ ID NO: 15094

SEQ ID NO: 96673 - DNA, 201 bp, Bos taurus; identical to SEQ ID NO: 15095

SEQ ID NO: 96674 - DNA, 201 bp, Bos taurus; identical to SEQ ID NO: 15096

SEQ ID NO: 96675 - DNA, 201 bp, Bos taurus; identical to SEQ ID NO: 15097

SEQ ID NO: 96676 - DNA, 201 bp, Bos taurus; identical to SEQ ID NO: 15098

SEQ ID NO: 96677 - DNA, 201 bp, Bos taurus; identical to SEQ ID NO: 15099

SEQ ID NO: 96678 - DNA, 201 bp, Bos taurus; identical to SEQ ID NO: 15100

SEQ ID NO: 96679 - DNA, 201 bp, Bos taurus
caagggatgaagaaatgtatcccaagcaaatataaatcaaaagaaagctgaggtagcaaaataaactttaaaactttaatcagacaaaataaactttaaagcaaagactgtgacaagagacaagaatatcatataaagggatcaatccaatgagaatatgtaacagttgtaaatataatgcaaccaacataagagaaccta

SEQ ID NO: 96680 - DNA, 201 bp, Bos taurus; identical to SEQ ID NO: 15101

SEQ ID NO: 96681 - DNA, 201 bp, Bos taurus; identical to SEQ ID NO: 15102

SEQ ID NO: 96682 - DNA, 201 bp, Bos taurus; identical to SEQ ID NO: 15103

SEQ ID NO: 96683 - DNA, 201 bp, Bos taurus; identical to SEQ ID NO: 15104

SEQ ID NO: 96684 - DNA, 201 bp, Bos taurus
aataaggagaaagactttccatggcaaaaagagtgaaaaaaaaaaaaaatccagagagtgtatcttctccatcagttgtggccccacctgggagaaagccatggggtttgagatgcagttgtctgccaaatcaaaattgggatctgggtgaatgagttttcttcctctcagccctgctgagcctcattttcagagctcgaa

SEQ ID NO: 96685 - DNA, 201 bp, Bos taurus; identical to SEQ ID NO: 15105

SEQ ID NO: 96686 - DNA, 201 bp, Bos taurus; identical to SEQ ID NO: 15106

SEQ ID NO: 96687 - DNA, 201 bp, Bos taurus; identical to SEQ ID NO: 15107

SEQ ID NO: 96688 - DNA, 201 bp, Bos taurus; identical to SEQ ID NO: 15108

SEQ ID NO: 96689 - DNA, 201 bp, Bos taurus; identical to SEQ ID NO: 15110

SEQ ID NO: 96690 - DNA, 201 bp, Bos taurus
tttctcatagttttggagactacaaggccaaaatcaaggtatcagcaggattggatccttttgtggcctgtgagggatgaatccattccaggcctttcttcctaggttacagatagctgttttatcctccggtgtccccgcattgtcttcccccatatctacctttgtcctcatttcctcttcatataaagacagcaatca

SEQ ID NO: 96691 - DNA, 201 bp, Bos taurus; identical to SEQ ID NO: 15111

SEQ ID NO: 96692 - DNA, 201 bp, Bos taurus; identical to SEQ ID NO: 15112

SEQ ID NO: 96693 - DNA, 201 bp, Bos taurus; identical to SEQ ID NO: 15113

SEQ ID NO: 96694 - DNA, 201 bp, Bos taurus; identical to SEQ ID NO: 15114

SEQ ID NO: 96695 - DNA, 201 bp, Bos taurus; identical to SEQ ID NO: 15115

SEQ ID NO: 96696 - DNA, 201 bp, Bos taurus; identical to SEQ ID NO: 15116

SEQ ID NO: 96697 - DNA, 201 bp, Bos taurus; identical to SEQ ID NO: 15117

SEQ ID NO: 96698 - DNA, 201 bp, Bos taurus
tgtatacacttgtatctgtttcttccaaggctaagggccatatcttacacaaggctgttagttacatatatgttgtctaataatacataatgtgtgatccgtgacttctcttggccactcagagttgatatctctgtggcagcagcacaacagctccacacccctctatctgcaagtccatacaaataggtttccacacca

SEQ ID NO: 96699 - DNA, 201 bp, Bos taurus; identical to SEQ ID NO: 15118

SEQ ID NO: 96700 - DNA, 201 bp, Bos taurus; identical to SEQ ID NO: 15119

SEQ ID NO: 96701 - DNA, 201 bp, Bos taurus; identical to SEQ ID NO: 15120

SEQ ID NO: 96702 - DNA, 201 bp, Bos taurus
tgtgcacagactcatataggaaaggaaatgtcataactttagacatttgatatgaatgatatccatcttctttttgtacagacaaaactgtttctttcccctcttagcaaaattattttccattcctttggttcctttaagtttttggtattaaaatgtattaatggtaattataaaaatatattgcatgtactttcagat

SEQ ID NO: 96703 - DNA, 201 bp, Bos taurus; identical to SEQ ID NO: 15121

SEQ ID NO: 96704 - DNA, 201 bp, Bos taurus
gcacccagggttggctggccacatttggagttagatgggactctcccaggctcacctccagaagaggaccatctgagggtgctcacagcaacattgccttacttcccaggctcatcaacaggcctgagatagcttcttttcacttctattaatcttgttaacaatttaatgccttgcatgtattcttttctgaccagatct

SEQ ID NO: 96705 - DNA, 201 bp, Bos taurus; identical to SEQ ID NO: 15122

SEQ ID NO: 96706 - DNA, 201 bp, Bos taurus
caaggcagaatctgggtttacctaatcatatgacatgactttgagtggatggagctaagggaaattgcttcactgcatctggattactcacatttttgaacgtccatagttttatgagaattgtttgaacacagaatcaatatatagaaacttgcagaaaaagataatagttaaaaagagaataaaaagaatagccaagaa

SEQ ID NO: 96707 - DNA, 201 bp, Bos taurus
tatccctcgcaggtcaagtcagttccagggtcctggatttggttttgcagctcgaaggcggtgtcctcgcacccgtgaaaaatggccacataatagcccatggtgcccagggcatagcagtcagaggacaccagcaagtagatgagcagtgtcacaggacctcccagcaagaggagggcagtgccaggcccagggctgccg

SEQ ID NO: 96708 - DNA, 201 bp, Bos taurus
atacatccaacaaagtaaaaagaaaaataagcatcctttccttgtttatgtgttgttttaagtgatttccttcgatgcttcgagcaccgtatttgtttccgtggggcagatacgtgccctcccctttgtcttgatttgagatagagacagaaggatcactgcactctccttcttactcacatagcagacgatccacgtgtc

SEQ ID NO: 96709 - DNA, 201 bp, Bos taurus
gaagagtaaaggaaatatggaattctgtgagtcatgtagaatttaggaaatggttataaataagtgtgcagtcttctccacttcttctcaccttctactttaatggcttgtctctccaaaagaaaatcaggatgttagagcttctgatcctcctggactgctgttttttatggtctatgtgactattcctccaatatgaaa

SEQ ID NO: 96710 - DNA, 201 bp, Bos taurus; identical to SEQ ID NO: 15123

SEQ ID NO: 96711 - DNA, 201 bp, Bos taurus; identical to SEQ ID NO: 15125

SEQ ID NO: 96712 - DNA, 201 bp, Bos taurus
ttttatctatcaacaggactgtaccatgggagcccaaacatttggccaaagatttttctgggtgtgtctatgaggatgtttctggatgagattaacattttaataggtagactgactgaagcagattgccctctttaatttgggtgggtctcatccagtcaaaggaagactggaatagaacaaaaagactgaattagaggg

SEQ ID NO: 96713 - DNA, 201 bp, Bos taurus
acgtagatcaactcctaggaaatcagctatgttaaccattatgccaccaatgctgcatcataaatgcgttagaaaaaagcaaaaggcatcagaattgcagacattctgtcaagtcaagaatttaagtcccaaagaagtgtctatccaagttcaccagctagtccctggcatgatcaggataaacctacttctaaacctgtt

SEQ ID NO: 96714 - DNA, 201 bp, Bos taurus; identical to SEQ ID NO: 15126

SEQ ID NO: 96715 - DNA, 201 bp, Bos taurus; identical to SEQ ID NO: 15127

SEQ ID NO: 96716 - DNA, 201 bp, Bos taurus; identical to SEQ ID NO: 15128

SEQ ID NO: 96717 - DNA, 201 bp, Bos taurus; identical to SEQ ID NO: 15129

SEQ ID NO: 96718 - DNA, 201 bp, Bos taurus
acaccctgcaagcttgagtgcttatcaagccagcactgataagatggttaagaagggtgtgtacagagggtatggaatcagagacagaattcccctgggtctcaacttttatataagtcaccatccttgtcaaccagagccaccactttttgggtgttcaccccaaatgaagcaaggcactgcaggaagtcttacttcacc

SEQ ID NO: 96719 - DNA, 201 bp, Bos taurus
ctacagatgtacctggccaacatggaataataagatgatcaactgcagactcactttcaaaatgtgatacgggctctgaactaatgaccaatatgtagtattattccttccatggccataaagcatgagtttggaaataaagaggagaagggggggactaatctcgctgttatacctaataaatcacacaaaaatttttgc

SEQ ID NO: 96720 - DNA, 201 bp, Bos taurus
ccttggagtactaggaaatgttgtaggtgaataatgtcaagcttaaaaacgagcccctgaactcagaaggctttagacctggcctcaagctgcttgcatcaccacccttctccacaaggggtacagatttcatgggaagacatgaagaggcagagcaaagcaatgatgccaacaatcaagtattttattaaagcaccaact

SEQ ID NO: 96721 - DNA, 201 bp, Bos taurus; identical to SEQ ID NO: 15130

SEQ ID NO: 96722 - DNA, 201 bp, Bos taurus; identical to SEQ ID NO: 15131

SEQ ID NO: 96723 - DNA, 201 bp, Bos taurus; identical to SEQ ID NO: 15132

SEQ ID NO: 96724 - DNA, 201 bp, Bos taurus; identical to SEQ ID NO: 15133

SEQ ID NO: 96725 - DNA, 201 bp, Bos taurus; identical to SEQ ID NO: 15134

SEQ ID NO: 96726 - DNA, 201 bp, Bos taurus
taagatggcccagctcacaccaaaaggtgcttttctgagatcttccctaataaatgcacagcccactctcttccatgatgctacacccaataggagccaggacaaggccttcccagttgcttgctgagcctccagacacagcgcccacacaaaatggttcaattttaaaggaaagaatggcctgatggcagaagggaaatt

SEQ ID NO: 96727 - DNA, 201 bp, Bos taurus
tggcagcaccagagagcacacgccccttgttcagactgcaccgccggccaagcctttagaatcttgctttgtgtccagactgttttcgctagtctgacttcatctggggaccactcctttggccacctggagctttccctgagcagtgaaagttcttcttgaaaatactttttctagacacaggctcagtctcagggtaaa

SEQ ID NO: 96728 - DNA, 201 bp, Bos taurus; identical to SEQ ID NO: 15135

SEQ ID NO: 96729 - DNA, 201 bp, Bos taurus; identical to SEQ ID NO: 15136

SEQ ID NO: 96730 - DNA, 201 bp, Bos taurus; identical to SEQ ID NO: 15137

SEQ ID NO: 96731 - DNA, 201 bp, Bos taurus
taggtgagccgccattgctcagatgctgcgactgtggtcacgagagcagggcctggaggtgagtgcccaaaaggaccggctggagtgacctcagccctccagccccaccctgagaaagacaatggccaagtcaagaaaggctggtcctgtgagaagatgtgtcacaagacaggatgaagatgtgctgagcaaaggggatgt

SEQ ID NO: 96732 - DNA, 201 bp, Bos taurus; identical to SEQ ID NO: 15139

SEQ ID NO: 96733 - DNA, 201 bp, Bos taurus; identical to SEQ ID NO: 15140

SEQ ID NO: 96734 - DNA, 201 bp, Bos taurus
tgtcacctacttaaacgcttccaggtgttgatcaaccagtcacctcccaaggcctttcctatgaccagtctgtctgtagaccccaggcctgtggccctccgatgggataccatcagaaccagattttcccaatgttgggggtgggggggaaatcacatcaactcagttaggagtgaggaacaagcccatttagtacaattt

SEQ ID NO: 96735 - DNA, 201 bp, Bos taurus; identical to SEQ ID NO: 15141

SEQ ID NO: 96736 - DNA, 201 bp, Bos taurus
cacccagaaaagcaagtgggtggaagaggctgttttggccacagttgccctccattctactttctcatcacaacttcatcttttctcaccctgagacctttggaatcccacagaggcttggccagtgcccagccgggtgaaggagctggctgctggaacaggatgagagctatattcccagtacaatggggcacttgcttc

SEQ ID NO: 96737 - DNA, 201 bp, Bos taurus; identical to SEQ ID NO: 15142

SEQ ID NO: 96738 - DNA, 201 bp, Bos taurus; identical to SEQ ID NO: 15143

SEQ ID NO: 96739 - DNA, 201 bp, Bos taurus
aggcatggagcagcatcgctggtgcatatggcagcaacagcaggtactgcatcgggaaaaggggaggggggtggggggaggcctggggaagcctggtctcggtctgtgccaggcacaagttctttaccatcgcacctcatgcctgtcgtgaccttccagtgaatgcggccctatcatcctgactttaaagatggagaaact

SEQ ID NO: 96740 - DNA, 201 bp, Bos taurus
ctccacaatggagtgctgctgagaaggccgagtggagcacccaggctggtaacaaggcacccttccacaccatgtcccctgagaatcctggacctctaaccccacctggccataacagaacactctctctacttcttaggtcaagggacgtcaaggggggagcctgtacttctactatacctagcagtagcaaggctgcac

SEQ ID NO: 96741 - DNA, 201 bp, Bos taurus
tcctgaaaatccccacccctttcccaaaggaactggaatactcctcccactcattagcctgtgaaattacccactcctacaaaaactgacaaccccataccaaagggcctctcttacctcttttgccttccaagacggccctccctctgtctgtggagtgtgtttcttccctgaataaaccttctttcactttgctgtggc

SEQ ID NO: 96742 - DNA, 201 bp, Bos taurus
cagtgaggggctgtttccctgtgtgggggcctggccagaaggcccacagggtcacacctgtgttgagccctggttacaaggctgtggaaagtgcttcagcactgggggaagtgggggccagcgttcactgcccagctccctgcaacaagggaggcgataaagccacttgctgcctgccctctgaggagggggccttggctt

SEQ ID NO: 96743 - DNA, 201 bp, Bos taurus
ccattctgggctgaaacagcttagcgtgaagctcactaaaactgggtcctgtacttcagagtttctttgggtaatctcttctttcctgaaggatataaaatcactgttaacttacagcgatgaaaaaaaacctctaagaacttgtaataataaagatcagtcactggaataacatatggagtggggtcagggtggagaccg

SEQ ID NO: 96744 - DNA, 201 bp, Bos taurus; identical to SEQ ID NO: 15144

SEQ ID NO: 96745 - DNA, 201 bp, Bos taurus
aacaccagtgacttcctttagggtaatgcactcatcaaattttatcaaaacaagctgtctgacataagcagcttcgtgccataagctctggcctctacatgggaatcaggaatgcaggaatgggagaggccctgggagcgcaggcaggatggtggcaggacaaaatgtcactggctcccagatactgaaactggcagcgcg

SEQ ID NO: 96746 - DNA, 201 bp, Bos taurus; identical to SEQ ID NO: 15145

SEQ ID NO: 96747 - DNA, 201 bp, Bos taurus; identical to SEQ ID NO: 15146

SEQ ID NO: 96748 - DNA, 201 bp, Bos taurus
atctaaaatttaaaaaaaaataagaagcttgcctgtggtcaagtgagtcatgtgtatgcaaagaaccagggtgtgtgtccagcacattaatacagaggcccgtgctcagaagggcagcacacttggggtttaatgctctcccattgctgtcttgattttcttaacaactcttttaacttacattttatgaatgacatctga

SEQ ID NO: 96749 - DNA, 201 bp, Bos taurus
tgaatttaaaatttgcatttatgatatatatatatatatatattatatatttaaacagaaaaattgcaagtattttttaaaatgtaattcaggccttgaaagaattttgaaaatttccaagacactataactaaaccaagaactccagacgaaagattttgaactcacaaatttattgggccatgttcacttgcttcccta

SEQ ID NO: 96750 - DNA, 201 bp, Bos taurus; identical to SEQ ID NO: 15147

SEQ ID NO: 96751 - DNA, 201 bp, Bos taurus; identical to SEQ ID NO: 15149

SEQ ID NO: 96752 - DNA, 201 bp, Bos taurus; identical to SEQ ID NO: 15150

SEQ ID NO: 96753 - DNA, 201 bp, Bos taurus; identical to SEQ ID NO: 15152

SEQ ID NO: 96754 - DNA, 201 bp, Bos taurus; identical to SEQ ID NO: 15153

SEQ ID NO: 96755 - DNA, 201 bp, Bos taurus; identical to SEQ ID NO: 15154

SEQ ID NO: 96756 - DNA, 201 bp, Bos taurus; identical to SEQ ID NO: 15155

SEQ ID NO: 96757 - DNA, 201 bp, Bos taurus; identical to SEQ ID NO: 15156

SEQ ID NO: 96758 - DNA, 201 bp, Bos taurus; identical to SEQ ID NO: 15158

SEQ ID NO: 96759 - DNA, 201 bp, Bos taurus; identical to SEQ ID NO: 15159

SEQ ID NO: 96760 - DNA, 201 bp, Bos taurus; identical to SEQ ID NO: 15160

SEQ ID NO: 96761 - DNA, 201 bp, Bos taurus; identical to SEQ ID NO: 15161

SEQ ID NO: 96762 - DNA, 201 bp, Bos taurus; identical to SEQ ID NO: 15162

SEQ ID NO: 96763 - DNA, 201 bp, Bos taurus; identical to SEQ ID NO: 15163

SEQ ID NO: 96764 - DNA, 201 bp, Bos taurus; identical to SEQ ID NO: 15164

SEQ ID NO: 96765 - DNA, 201 bp, Bos taurus; identical to SEQ ID NO: 15165

SEQ ID NO: 96766 - DNA, 201 bp, Bos taurus; identical to SEQ ID NO: 15166

SEQ ID NO: 96767 - DNA, 201 bp, Bos taurus; identical to SEQ ID NO: 15167

SEQ ID NO: 96768 - DNA, 201 bp, Bos taurus; identical to SEQ ID NO: 15168

SEQ ID NO: 96769 - DNA, 201 bp, Bos taurus; identical to SEQ ID NO: 15169

SEQ ID NO: 96770 - DNA, 201 bp, Bos taurus; identical to SEQ ID NO: 15170

SEQ ID NO: 96771 - DNA, 201 bp, Bos taurus; identical to SEQ ID NO: 15171

SEQ ID NO: 96772 - DNA, 201 bp, Bos taurus; identical to SEQ ID NO: 15172

SEQ ID NO: 96773 - DNA, 201 bp, Bos taurus; identical to SEQ ID NO: 15173

SEQ ID NO: 96774 - DNA, 201 bp, Bos taurus; identical to SEQ ID NO: 15174

SEQ ID NO: 96775 - DNA, 201 bp, Bos taurus; identical to SEQ ID NO: 15175

SEQ ID NO: 96776 - DNA, 201 bp, Bos taurus; identical to SEQ ID NO: 15176

SEQ ID NO: 96777 - DNA, 201 bp, Bos taurus; identical to SEQ ID NO: 15177

SEQ ID NO: 96778 - DNA, 201 bp, Bos taurus; identical to SEQ ID NO: 15179

SEQ ID NO: 96779 - DNA, 201 bp, Bos taurus; identical to SEQ ID NO: 15180

SEQ ID NO: 96780 - DNA, 201 bp, Bos taurus; identical to SEQ ID NO: 15182

SEQ ID NO: 96781 - DNA, 201 bp, Bos taurus; identical to SEQ ID NO: 15184

SEQ ID NO: 96782 - DNA, 201 bp, Bos taurus; identical to SEQ ID NO: 15185

SEQ ID NO: 96783 - DNA, 201 bp, Bos taurus; identical to SEQ ID NO: 15186

SEQ ID NO: 96784 - DNA, 201 bp, Bos taurus; identical to SEQ ID NO: 15188

SEQ ID NO: 96785 - DNA, 201 bp, Bos taurus; identical to SEQ ID NO: 15189

SEQ ID NO: 96786 - DNA, 201 bp, Bos taurus; identical to SEQ ID NO: 15190

SEQ ID NO: 96787 - DNA, 201 bp, Bos taurus; identical to SEQ ID NO: 15199

SEQ ID NO: 96788 - DNA, 201 bp, Bos taurus; identical to SEQ ID NO: 15200

SEQ ID NO: 96789 - DNA, 201 bp, Bos taurus; identical to SEQ ID NO: 15201

SEQ ID NO: 96790 - DNA, 201 bp, Bos taurus; identical to SEQ ID NO: 15207

SEQ ID NO: 96791 - DNA, 201 bp, Bos taurus; identical to SEQ ID NO: 15208

SEQ ID NO: 96792 - DNA, 201 bp, Bos taurus; identical to SEQ ID NO: 15209

SEQ ID NO: 96793 - DNA, 201 bp, Bos taurus; identical to SEQ ID NO: 15210

SEQ ID NO: 96794 - DNA, 201 bp, Bos taurus; identical to SEQ ID NO: 15212

SEQ ID NO: 96795 - DNA, 201 bp, Bos taurus; identical to SEQ ID NO: 15213

SEQ ID NO: 96796 - DNA, 201 bp, Bos taurus; identical to SEQ ID NO: 15214

SEQ ID NO: 96797 - DNA, 201 bp, Bos taurus; identical to SEQ ID NO: 15215

SEQ ID NO: 96798 - DNA, 201 bp, Bos taurus; identical to SEQ ID NO: 15216

SEQ ID NO: 96799 - DNA, 201 bp, Bos taurus; identical to SEQ ID NO: 15217

SEQ ID NO: 96800 - DNA, 201 bp, Bos taurus; identical to SEQ ID NO: 15218

SEQ ID NO: 96801 - DNA, 201 bp, Bos taurus; identical to SEQ ID NO: 15219

SEQ ID NO: 96802 - DNA, 201 bp, Bos taurus; identical to SEQ ID NO: 15220

SEQ ID NO: 96803 - DNA, 201 bp, Bos taurus; identical to SEQ ID NO: 15222

SEQ ID NO: 96804 - DNA, 201 bp, Bos taurus
gggaggcctaccaaaacacagaacccgtttctgggcttttttttaagggagagaagagcttattttcgtctgtgctgccacgtggggggcactcgggctgcggcccataaaaaggtagagaggatgtgaacccggtcaaaagaaagagtgttggctctgcggggaggagctgggacaagtttacagagaaggcaggagccg

SEQ ID NO: 96805 - DNA, 201 bp, Bos taurus; identical to SEQ ID NO: 15223

SEQ ID NO: 96806 - DNA, 201 bp, Bos taurus; identical to SEQ ID NO: 15224

SEQ ID NO: 96807 - DNA, 201 bp, Bos taurus
tgagtccctgggatgaccttgagcctcagggcttggggatcacaaccgaaccaaaagcactgattcaatagcatccttatgttgccaggcctgcggtctcgctccctcacttgtgaataaggagaaaatgaaacctctgctgctctattgctgcttctggagaacatgcaggttcaagagactggtgagaggcccccaggg

SEQ ID NO: 96808 - DNA, 201 bp, Bos taurus; identical to SEQ ID NO: 15226

SEQ ID NO: 96809 - DNA, 201 bp, Bos taurus; identical to SEQ ID NO: 15227

SEQ ID NO: 96810 - DNA, 201 bp, Bos taurus
tgcccaaacatgtttgtgcctgttgcctttattaactgcaattatcgaattcattgtttactgtgtaaacagatgaaacaagactccaaaaagtgttatatatgaaaaataattatgagctttgaaaagactgataaaggcatatgactctgaaagctcctttaggattagattaaaagctcctcagagtgctctgccaat

SEQ ID NO: 96811 - DNA, 201 bp, Bos taurus; identical to SEQ ID NO: 15228

SEQ ID NO: 96812 - DNA, 201 bp, Bos taurus
gatgacctagaatgacaatgaataacaggaaatcacccgaagtgacttcgagaaaaggtttatctcactgcatttctgtagacaaatctcatgggtaaatctactttatcttatgactgttgccaagccctgactgcagctcataagcctacaggggtgcctaaggctcatgaacagggccgggccctccctctgctcagg

SEQ ID NO: 96813 - DNA, 201 bp, Bos taurus
aggcattcaaatccacagtggtctgacctcagaacccttgttcttcatattttctgtacaagaggtttccaccctctggaggcccaggttcctcaggaaacctacaagggggcagggaggaggggtctgcaggaaagaatgacaggaactgaaactaagggctgttctaggctcttagcgtctgggaacccaccaagggag

SEQ ID NO: 96814 - DNA, 201 bp, Bos taurus; identical to SEQ ID NO: 15229

SEQ ID NO: 96815 - DNA, 201 bp, Bos taurus; identical to SEQ ID NO: 15230

SEQ ID NO: 96816 - DNA, 201 bp, Bos taurus; identical to SEQ ID NO: 15231

SEQ ID NO: 96817 - DNA, 201 bp, Bos taurus; identical to SEQ ID NO: 15232

SEQ ID NO: 96818 - DNA, 201 bp, Bos taurus; identical to SEQ ID NO: 15235

SEQ ID NO: 96819 - DNA, 201 bp, Bos taurus; identical to SEQ ID NO: 15236

SEQ ID NO: 96820 - DNA, 201 bp, Bos taurus; identical to SEQ ID NO: 15238

SEQ ID NO: 96821 - DNA, 201 bp, Bos taurus; identical to SEQ ID NO: 15239

SEQ ID NO: 96822 - DNA, 201 bp, Bos taurus; identical to SEQ ID NO: 15240

SEQ ID NO: 96823 - DNA, 201 bp, Bos taurus; identical to SEQ ID NO: 15241

SEQ ID NO: 96824 - DNA, 201 bp, Bos taurus
gtttggaaggtgatctgctgatcactttttctgtctgtcttactgggcctcctccctggtctcctgtgtctggactccagccctccactccgagccttctcttgtcccctgagtgccaacaaggccttgctgatggtattccttgtttgcagaagataatgactctctcatctcttcctttctcatcctacctcttggcct

SEQ ID NO: 96825 - DNA, 201 bp, Bos taurus; identical to SEQ ID NO: 15243

SEQ ID NO: 96826 - DNA, 201 bp, Bos taurus; identical to SEQ ID NO: 15244

SEQ ID NO: 96827 - DNA, 201 bp, Bos taurus; identical to SEQ ID NO: 15245

SEQ ID NO: 96828 - DNA, 201 bp, Bos taurus; identical to SEQ ID NO: 15246

SEQ ID NO: 96829 - DNA, 201 bp, Bos taurus; identical to SEQ ID NO: 15247

SEQ ID NO: 96830 - DNA, 201 bp, Bos taurus; identical to SEQ ID NO: 15248

SEQ ID NO: 96831 - DNA, 201 bp, Bos taurus; identical to SEQ ID NO: 15249

SEQ ID NO: 96832 - DNA, 201 bp, Bos taurus; identical to SEQ ID NO: 15250

SEQ ID NO: 96833 - DNA, 201 bp, Bos taurus; identical to SEQ ID NO: 15251

SEQ ID NO: 96834 - DNA, 201 bp, Bos taurus; identical to SEQ ID NO: 15252

SEQ ID NO: 96835 - DNA, 201 bp, Bos taurus; identical to SEQ ID NO: 15253

SEQ ID NO: 96836 - DNA, 201 bp, Bos taurus; identical to SEQ ID NO: 15255

SEQ ID NO: 96837 - DNA, 201 bp, Bos taurus
gaggcacccaggaagcacagatgctaaggagcaaagcagcaccaggctcacagacaggctccaacagtctgacctggctgacctctatcaatcatctctgctgccatgaacacaagtccctgcaccagtgagaactctctggttgaatatctgttccttcttctcccttcctgtccccctttccctgggacttccagcgaa

SEQ ID NO: 96838 - DNA, 201 bp, Bos taurus; identical to SEQ ID NO: 15259

SEQ ID NO: 96839 - DNA, 201 bp, Bos taurus; identical to SEQ ID NO: 15260

SEQ ID NO: 96840 - DNA, 201 bp, Bos taurus
cccggcccagccctcctctgcggggatcaccctcctccgcggatacgggcagcatagtctccctcagggtggggaggattttccttctacgagatgcctcgggcaggcggtcctgaggccagagagctgagcactacaggcccgatttcctgtcctcttcacggggcgcacctcggcaccagtaagagtagggggcgaggt

SEQ ID NO: 96841 - DNA, 201 bp, Bos taurus; identical to SEQ ID NO: 15261

SEQ ID NO: 96842 - DNA, 201 bp, Bos taurus
aaattcgctgaaataagagcaacataaaaggaatatgtgtgcaggtcctataggggatatggaaaacagcagccacaaatttcttgtaaataataaaaatgcactgggaaaatatgttgccacaaggaagattaaaagcataaccccaaatcaagacagtaattcttgaagcaattacagctgtaaaggaagaccacagag

SEQ ID NO: 96843 - DNA, 201 bp, Bos taurus
tcaactacagatctttgagttgccccaggcagggagcactgtggaaagacagtttctccgcgtagatctactaactgttacttttctttagtgactttgcctagtcactaaaaacaaaactgcatttactgagaaaatgtactgacaaagtacaggtactttcagtgtggtttcttcattcatcgtgattacggaccatac

SEQ ID NO: 96844 - DNA, 201 bp, Bos taurus; identical to SEQ ID NO: 15262

SEQ ID NO: 96845 - DNA, 201 bp, Bos taurus; identical to SEQ ID NO: 15266

SEQ ID NO: 96846 - DNA, 201 bp, Bos taurus; identical to SEQ ID NO: 15268

SEQ ID NO: 96847 - DNA, 201 bp, Bos taurus; identical to SEQ ID NO: 15269

SEQ ID NO: 96848 - DNA, 201 bp, Bos taurus; identical to SEQ ID NO: 15272

SEQ ID NO: 96849 - DNA, 201 bp, Bos taurus; identical to SEQ ID NO: 15273

SEQ ID NO: 96850 - DNA, 201 bp, Bos taurus; identical to SEQ ID NO: 15275

SEQ ID NO: 96851 - DNA, 201 bp, Bos taurus
atcacccagcagatcatcacacagagacccgaactcagatatcatatttcactcagccccttcggcagcagtgggaaggccagatgacaaccttgtctgggtgtttgacagattgagaattttccttgccacggacatttaagcatgtgctggttggtctccctcttagctggttgtgcaggaagtggcctccctccactt

SEQ ID NO: 96852 - DNA, 201 bp, Bos taurus; identical to SEQ ID NO: 15277

SEQ ID NO: 96853 - DNA, 201 bp, Bos taurus; identical to SEQ ID NO: 15278

SEQ ID NO: 96854 - DNA, 201 bp, Bos taurus
taaaatagtctccatctgcaaataatatgatcatttatatacaaaagcctaaggtaccttcagctaatagaactaataagatgatttagcaaggtcatggtgtacaagattattatataaaaatcaggttgggaaaaatataattgtaaagcatatatttaacaaaggactaatattcaggctatatcaagaactcattaa

SEQ ID NO: 96855 - DNA, 201 bp, Bos taurus; identical to SEQ ID NO: 56084

SEQ ID NO: 96856 - DNA, 201 bp, Bos taurus
ctttacacatcctgaaggatttgttacaatcagttgagtcatcatttggtatcacacttttcccttttcactgagatgtcttccttcattagaagaggggcgagttgtcactcactaggactcacgtttgtatgagctttgtattgggtcgtgaaagcatctacactgttgtgtgttcttggcacattgtcccaagactgt

SEQ ID NO: 96857 - DNA, 201 bp, Bos taurus; identical to SEQ ID NO: 15282

SEQ ID NO: 96858 - DNA, 201 bp, Bos taurus; identical to SEQ ID NO: 15283

SEQ ID NO: 96859 - DNA, 201 bp, Bos taurus; identical to SEQ ID NO: 15285

SEQ ID NO: 96860 - DNA, 201 bp, Bos taurus; identical to SEQ ID NO: 15286

SEQ ID NO: 96861 - DNA, 201 bp, Bos taurus; identical to SEQ ID NO: 15287

SEQ ID NO: 96862 - DNA, 201 bp, Bos taurus; identical to SEQ ID NO: 15288

SEQ ID NO: 96863 - DNA, 201 bp, Bos taurus; identical to SEQ ID NO: 15289

SEQ ID NO: 96864 - DNA, 201 bp, Bos taurus; identical to SEQ ID NO: 15290

SEQ ID NO: 96865 - DNA, 201 bp, Bos taurus; identical to SEQ ID NO: 15291

SEQ ID NO: 96866 - DNA, 201 bp, Bos taurus; identical to SEQ ID NO: 15292

SEQ ID NO: 96867 - DNA, 201 bp, Bos taurus; identical to SEQ ID NO: 15293

SEQ ID NO: 96868 - DNA, 201 bp, Bos taurus; identical to SEQ ID NO: 15294

SEQ ID NO: 96869 - DNA, 201 bp, Bos taurus
agcacctgctggcccagtgctggacgagcctttagaaacggccctgcattatccgggatgggaaccaggtataaggagggcaaaagtgtggtctggaaaaggtctcccttacagccggcctctgcgatgggcccttcgttcctaacctggagctgagcctctgactcctgctcaagtcatggggcggcagccatgtgggtg

SEQ ID NO: 96870 - DNA, 201 bp, Bos taurus
acgtcccaatgtcaccaagactaggatctggctaaaggtgatgagtggacggattctctggccagcccactgaccgcagctgtgaggtgtggggccagacccctgtgatgacctcccctgcttaatgtgctcacagtatccctccatgtttccggagctgtgaggtgaggggttgggcccctgtgatgcccccctcttgcg

SEQ ID NO: 96871 - DNA, 201 bp, Bos taurus
cctgagttgcaggcaggttctttaccttctgagcctccacatgtgtatattcctaattttccctatgagaagtttcaggccaaacttcccagactaaagcgcatgatcctttatgagatacaacagaatcagtgcagctgggaaccatggtgacgagaggtgacagagtgaacatgctggccaagatcctaggactgtgag

SEQ ID NO: 96872 - DNA, 201 bp, Bos taurus
tctggtggcctctggagcccaggcactgatgcttggtcaccatcccatagcaggggagctgcacagggacagggatgccccaggcaccctccctgagtctcgtcggggccccacttcagcaccaatgcagactggttcaccttctctttcctccgggacccctcatttccccagcagtgtcaacgattgtgcacagtctag

SEQ ID NO: 96873 - DNA, 201 bp, Bos taurus; identical to SEQ ID NO: 15295

SEQ ID NO: 96874 - DNA, 201 bp, Bos taurus
tgtattaattgtccacctgatattttatagccaaacagacaacacagcacaaccagctcatgcaggatttcagcctttttagagcagagaggcccacaccatccacacccactaaccagtactgacctgtctacagggactgtctccacagcaagaggtcatcaggaagtatccctgggcctgaatggaggtaagagaaag

SEQ ID NO: 96875 - DNA, 201 bp, Bos taurus
ccgcatctgtccgtggaggggcttggggccacaggtgggtctgcgcctggctcccctcgattggctaggacttagggccgagggtgtacaaatccaccctactcggaggtgacaatgccgcctctcaggggctggaagtcacgtgctaacccaccccacacaaagcctcagccctggactccagtgctcactgacaacctg

SEQ ID NO: 96876 - DNA, 201 bp, Bos taurus
gtcgaggagcgtgggcccctggacagagagtcatggggtcaggtttacttacatgtctccccataacctcacttctgccatctgcacttgaaggactcaattggcccctctaagcagctccacactccatggaggccaaaaacagcaccgtccaaaccacacacctgacacagtgaccccaccgggaggtcagaccttggg

SEQ ID NO: 96877 - DNA, 201 bp, Bos taurus
cttcttgaaattctctcccacttgtgggccagataaaatgattagaaaacaagccagagctgtgtccctgtgtccatcctgacccataggacccacacctgttcctggaaacttggccggcacacagaggcccattttctgaaaccacgagcctggatgggcaatgattggcttacctggccagcccgccctttacacatg

SEQ ID NO: 96878 - DNA, 201 bp, Bos taurus; identical to SEQ ID NO: 15301

SEQ ID NO: 96879 - DNA, 201 bp, Bos taurus; identical to SEQ ID NO: 15302

SEQ ID NO: 96880 - DNA, 201 bp, Bos taurus; identical to SEQ ID NO: 15303

SEQ ID NO: 96881 - DNA, 201 bp, Bos taurus; identical to SEQ ID NO: 15304

SEQ ID NO: 96882 - DNA, 201 bp, Bos taurus
gggcagcagaggtagctttatggagaagcagaagagatgccccctctaggctgaaacttgagggagattaagcaggcctcccctgcccctggcctccctcctactccactctaaaaatcagacaagtcagaagatctgggcttctttccctgtgactgaaggcgtgaggcccaggagaagggacctgctcagggtcagggt

SEQ ID NO: 96883 - DNA, 201 bp, Bos taurus
tgacattccaatttctgcttctgtcttcacatggccttcttctctctttgcttgtctctgtgtttcatctcctctccttgtaagaataccagtcaatggatgtagggccccgcatggtaaagaagctgcctgcaatgcaggagacccaggttcaatccctgggttgggaagatcccctgaagaaggaatggctactcactc

SEQ ID NO: 96884 - DNA, 201 bp, Bos taurus; identical to SEQ ID NO: 15305

SEQ ID NO: 96885 - DNA, 201 bp, Bos taurus
gggggtatttatacaccagatcccaagagtcgttgatttgagggctatttctagagggggataattctttgaaactctggcctgccatatatttatagagaaaactttcctccactgaggctgaaggaaggagagccttcaggcaaagaagtgcaaaaataagcagttgtaagctagctgctgctgcggccgctgctgcgc

SEQ ID NO: 96886 - DNA, 201 bp, Bos taurus
catgtgagagagattaaagttgaaagcaataccatcacacaaataccatcctaccctcaagggagaaggctggtcaaaggccgagctccctgtggtcaacacaacagaccaaagtcacgctctgtctctgccctttgctcatgccctctcctaacatctgcaggctggggcgagagtgcatacgaaggcccatgtatgcca

SEQ ID NO: 96887 - DNA, 201 bp, Bos taurus
agaaaagccctgtcttgatcacactctcatgctttaaagcgtcctactctgaccttcctctggccatgcccttccccatgggaataatagcccaggcccacgggacacttccacctggagcctggttcctccttcgagacatgcttcaagcacctcaggtcacagaatgtccttccaagtgtcctgcggctgcttcctggg

SEQ ID NO: 96888 - DNA, 201 bp, Bos taurus
tccagatgccctgtggccatctcatgtgcatatgagcacattaaggattgtttcttcctcttcttaaagaaatatgtttttccctctgactccatctagagccaaggcccaggcagtcatgtaactgtccttgctcatccaggagtatattttacttgtaggcaggcatgtctaacgtgacccccactctgctttttcccc

SEQ ID NO: 96889 - DNA, 201 bp, Bos taurus
ccctggcacctcccctccagtgtccactccttctgttcctaacttatcctgtcttgacttttgttcccataattccctctctggtgagtgcccacaaggataggaggcccttccttactgattcatggaaccaaaaagatccttcaaggacatccaatccatgatcatggttttgtagaggggaaaagggagtcacagaga

SEQ ID NO: 96890 - DNA, 201 bp, Bos taurus
gggagagtaccaagtggccagtgaggatggagagaggcaggtgaagggctgggacatcggccagagaggacaaggcttatgggtccaggagagccatgatgggatctggggagggccatcaccgagaggggatgagaaggctccagacagagacagtgaggagcaggagacattggttctgggaatgttgctctccttgga

SEQ ID NO: 96891 - DNA, 201 bp, Bos taurus; identical to SEQ ID NO: 15309

SEQ ID NO: 96892 - DNA, 201 bp, Bos taurus
aatatacagccactttatatagtgttcgaaatgtaagggagcagctttactaggctgttggcagttgtgtctgttttgtctattttatctggaaagataaaatgaaaattactctattagaaataatgctgattctatgtaattttttttaaacttctcttttatttttaatttatttttggctgcgccatgcagaatgtg

SEQ ID NO: 96893 - DNA, 201 bp, Bos taurus; identical to SEQ ID NO: 15310

SEQ ID NO: 96894 - DNA, 201 bp, Bos taurus; identical to SEQ ID NO: 15311

SEQ ID NO: 96895 - DNA, 201 bp, Bos taurus; identical to SEQ ID NO: 15313

SEQ ID NO: 96896 - DNA, 201 bp, Bos taurus
gatcgactgccaaccacctcctcacacctgctgtgctcaggcttgtggccttggctgaccctctgccagttaaaactgccaccctctcaccccaccaggtacagctcccaatgctgggggccccgagaggaacgaataccaaagaggaccctccccacagactctgggcagggtatgcggccaggggtaagccccaggcct

SEQ ID NO: 96897 - DNA, 201 bp, Bos taurus
agagtatgtttagttttgtaagaaaccaacaaactgtcttctgaagcggccgtaccattctgcattcccaccatcagtgagtgagagttcccatggcttcacatcttcatcagtatgtggtgctggtagtgttttggattttcaccattctgataggtgtgcagtgatatcttgttttaatgtgctactccttgatgacgt

SEQ ID NO: 96898 - DNA, 201 bp, Bos taurus; identical to SEQ ID NO: 15314

SEQ ID NO: 96899 - DNA, 201 bp, Bos taurus; identical to SEQ ID NO: 15317

SEQ ID NO: 96900 - DNA, 201 bp, Bos taurus
taaggaggtgaaggaagcaggcacatggcttgtccttaaaacatgacagttccctttgggagaagagagaagtgtgacaagttagctaaccaagtgggcctagacatggcaagaggtacagagggtacactctgggccaggggtccaggatggattgagattccttggggaagcaggtgtatcagtcaggataggctgagt

SEQ ID NO: 96901 - DNA, 201 bp, Bos taurus
ggagaggaaggagcagctgcaggacatttgatgtcttgggattaagatccagctcctctctggcaagatgcatgacccggaaagggtggtcggccccatcgactcatagcttcccctgtcagtgaatgagctgaactaacttcaaggtctctacaaggtttgatgatccctgagtctatgacaaataaaacagcaatgaac

SEQ ID NO: 96902 - DNA, 201 bp, Bos taurus; identical to SEQ ID NO: 15320

SEQ ID NO: 96903 - DNA, 201 bp, Bos taurus; identical to SEQ ID NO: 15321

SEQ ID NO: 96904 - DNA, 201 bp, Bos taurus
aaaagtgaggcaggagcggcaagtaagaggggcaacctgaatgagagctggcaggctttggctccttctcctttgcccccttctcctttgcccagaggcccttacagttgacaaaaggaccccttctctggcactcactcaccttcatgtggtacaaggtcagtgtgcgagggcaaacggcctggtcaagaaagtcagtaa

SEQ ID NO: 96905 - DNA, 201 bp, Bos taurus; identical to SEQ ID NO: 15322

SEQ ID NO: 96906 - DNA, 201 bp, Bos taurus; identical to SEQ ID NO: 15323

SEQ ID NO: 96907 - DNA, 201 bp, Bos taurus; identical to SEQ ID NO: 15324

SEQ ID NO: 96908 - DNA, 201 bp, Bos taurus; identical to SEQ ID NO: 15325

SEQ ID NO: 96909 - DNA, 201 bp, Bos taurus; identical to SEQ ID NO: 15326

SEQ ID NO: 96910 - DNA, 201 bp, Bos taurus
gggaaaggagattcagacaacttattaagtcctcaaggcccactcctcctaataggcacacccggggctgccctaggcatggctccccttagatcctccaatttctctgctccagggctccttggccggatatgagagagtgagaacaattgccagtttgggctctcttcttgggccgagagcacagtccgagggtcaaca

SEQ ID NO: 96911 - DNA, 201 bp, Bos taurus; identical to SEQ ID NO: 15329

SEQ ID NO: 96912 - DNA, 201 bp, Bos taurus; identical to SEQ ID NO: 15330

SEQ ID NO: 96913 - DNA, 201 bp, Bos taurus; identical to SEQ ID NO: 15331

SEQ ID NO: 96914 - DNA, 201 bp, Bos taurus; identical to SEQ ID NO: 15332

SEQ ID NO: 96915 - DNA, 201 bp, Bos taurus; identical to SEQ ID NO: 15333

SEQ ID NO: 96916 - DNA, 201 bp, Bos taurus; identical to SEQ ID NO: 15334

SEQ ID NO: 96917 - DNA, 201 bp, Bos taurus; identical to SEQ ID NO: 15335

SEQ ID NO: 96918 - DNA, 201 bp, Bos taurus
agccaaggtaggtacacgtgtattgctgactttatagaaaacggcagagatactccttgtctacttcggctgtcaaccgatgtatgactggcatttcgatattcatccagattttaaaaatatcagtcctccacagacaagctaaataagagtaacatacataatatttaaaatgatcaagacagttttactacagaaacc

SEQ ID NO: 96919 - DNA, 201 bp, Bos taurus
attttcagtttatctcagatgctttctcaaataggtctcagaaccagtgttcttgctcagcctgaaactggtggctctgggctggggccagaagctgcaccctctagtttgcgctctgccactgaaacttgatgtatatgaccttgggcaagtcatttcccttccttgggcctcagttgcctcatctgtaaaatgagggag

SEQ ID NO: 96920 - DNA, 201 bp, Bos taurus; identical to SEQ ID NO: 15339

SEQ ID NO: 96921 - DNA, 201 bp, Bos taurus; identical to SEQ ID NO: 15340

SEQ ID NO: 96922 - DNA, 201 bp, Bos taurus
ttcagtctttttcatgagcctcgaacggaagcctgtgaagaaaagcctgaggatgacaatgcatgttgtgtatgtagctccccagcatcagggtttctacaccctcatattgttccaaattcagcatctagcaattcattaaaaaaaatttagccaaattccttgtatccactgtgtagtggccccatcgtcctcttatgc

SEQ ID NO: 96923 - DNA, 201 bp, Bos taurus; identical to SEQ ID NO: 15342

SEQ ID NO: 96924 - DNA, 201 bp, Bos taurus; identical to SEQ ID NO: 15343

SEQ ID NO: 96925 - DNA, 201 bp, Bos taurus; identical to SEQ ID NO: 15344

SEQ ID NO: 96926 - DNA, 201 bp, Bos taurus; identical to SEQ ID NO: 15346

SEQ ID NO: 96927 - DNA, 201 bp, Bos taurus; identical to SEQ ID NO: 15348

SEQ ID NO: 96928 - DNA, 201 bp, Bos taurus; identical to SEQ ID NO: 15349

SEQ ID NO: 96929 - DNA, 201 bp, Bos taurus; identical to SEQ ID NO: 15350

SEQ ID NO: 96930 - DNA, 201 bp, Bos taurus; identical to SEQ ID NO: 15352

SEQ ID NO: 96931 - DNA, 201 bp, Bos taurus; identical to SEQ ID NO: 15353

SEQ ID NO: 96932 - DNA, 201 bp, Bos taurus; identical to SEQ ID NO: 15354

SEQ ID NO: 96933 - DNA, 201 bp, Bos taurus; identical to SEQ ID NO: 15355

SEQ ID NO: 96934 - DNA, 201 bp, Bos taurus
ccacccatctttcaaatttgtaaaattttgagtgtattttgaattttttttttttactatgttgaagtccacttgtttttaattcattttctacaggagcggagtaaaaatgcatgtgttcagttcatcttgttaaaccacaaaatattctagtttactttcaccagaaaataaacctcagtctcttggaggctgagttga

SEQ ID NO: 96935 - DNA, 201 bp, Bos taurus
tgcatattggaaccatttgaggagcatcaaaaaatactaacacttttgtctcaccatcaggattcagatttatgtggtttgggctctggcccaggcaaaagggaattttaaaagcagccaagtttgagaaccactaagttggaaaaacctattttccgatcttgctgatagatctcagggaaagcattggcctctttgggt

SEQ ID NO: 96936 - DNA, 201 bp, Bos taurus; identical to SEQ ID NO: 15359

SEQ ID NO: 96937 - DNA, 201 bp, Bos taurus; identical to SEQ ID NO: 15360

SEQ ID NO: 96938 - DNA, 201 bp, Bos taurus; identical to SEQ ID NO: 15361

SEQ ID NO: 96939 - DNA, 201 bp, Bos taurus
aggttacattcacaataaccaccagtgggtatgtctctaagattcacatggcttaaatttcccatctgaaaagtggagatacaataactgctttctaatggggatgtagataaagataaaacttaggcgaattatgggaaatcacaaataccatacagttatatgaatattgtcatttctgtcccaccccaccctcttttc

SEQ ID NO: 96940 - DNA, 201 bp, Bos taurus; identical to SEQ ID NO: 15362

SEQ ID NO: 96941 - DNA, 201 bp, Bos taurus; identical to SEQ ID NO: 15363

SEQ ID NO: 96942 - DNA, 201 bp, Bos taurus; identical to SEQ ID NO: 15364

SEQ ID NO: 96943 - DNA, 201 bp, Bos taurus
acccagaataaatcttcatatcacagtcctggagttttgccatggtctactctgtacttggggcttgtagtgcatttctattcgcttggccaaaaaactcattcagatttttctgtgccatcttatggtaaaacccaaacaaactttttggccgatcctactttgggaagctactctttcccccctgcagaatgtttactt

SEQ ID NO: 96944 - DNA, 201 bp, Bos taurus; identical to SEQ ID NO: 15365

SEQ ID NO: 96945 - DNA, 201 bp, Bos taurus
cccttcacggttccactgctttcttccttctcctgaaagctaaggagctgaatcgcacagctgagaccagagagtgagcccagggcttctgcccaccccatggccttacagaagcagagcaagttggcaggagccggtgtgacctcattggatgcaagctgcaaggctccggccccgtgatggcagccctgtggttacctc

SEQ ID NO: 96946 - DNA, 201 bp, Bos taurus
agaaaaaaatttttaagacaataaaattttaaataacagctaagatagagacagcgtgatcaaggcagaactacactaccccacttcctctgtgacaacattgcaggaaaatacagggaaacacaacaggtttacactgggagtgagggctagacataaaaggaatgtctcatttaggtgggtagaaagtatgaaggcagc

SEQ ID NO: 96947 - DNA, 201 bp, Bos taurus
gctgtggtctgaacctctgtcccctggagtggaagtgtgagggcctgacgatggcttgccaggagtccccggcgttctttcttgatctcagcacgttgtgctagttgctctgagcttatttagttgagagaaatcttcggtgatacatcttaaaaatgaatgttgtcaccatggagaagtgaactccttccagattccctt

SEQ ID NO: 96948 - DNA, 201 bp, Bos taurus; identical to SEQ ID NO: 15369

SEQ ID NO: 96949 - DNA, 201 bp, Bos taurus
caccgtgatggccactctccagaaactctctagaactgagagacacgtaaatgaggtaagcagacacccatcctgtgctcactgggggctgatttggcgctcgtgagggggcctcagcccagaagaatgaatggaggagatagaatcagaaggattatgctgagcagcgatccaaacggaaagaaaggtgcaggaaaggtg

SEQ ID NO: 96950 - DNA, 201 bp, Bos taurus; identical to SEQ ID NO: 15370

SEQ ID NO: 96951 - DNA, 201 bp, Bos taurus; identical to SEQ ID NO: 15371

SEQ ID NO: 96952 - DNA, 201 bp, Bos taurus; identical to SEQ ID NO: 15372

SEQ ID NO: 96953 - DNA, 201 bp, Bos taurus
taatttacatccccactaacagtgcaggaaggttcccttttcttcacatcgtcttgtcaactctcgcttgttgttttttcatactggccgtactaaagacgtgaggggatatctcatcgtgattttggtttgcatttccctgatgattagtgatgttgagcgtcttttcatgtgcctgttggccatcttatgtcttctttg

SEQ ID NO: 96954 - DNA, 201 bp, Bos taurus
tcagggattcctgttgcgagtgttgcttagatgggaggacagttccgtgaagcagagatggttgtaggtaggttccctcacaggctgtgagctctcggcagcgtgggttttgctgcagatagtgactgttattaaattccatgctgtctagcctggtgctttttcacgtaggaattttttaagaagtattcattccacagt

SEQ ID NO: 96955 - DNA, 201 bp, Bos taurus
gggagacttcccatggggacatggggtgtgagtctgtgatcagagttggcctttaaaccacccatttttgaggttggagcagtttggatgttgacaaggtctaggagagaagaggaaaaggccattagaaatgaggaagtcaagtgcctgagaagccaggcagttggagggacatcactgcatctgtttagtgtgtcccag

SEQ ID NO: 96956 - DNA, 201 bp, Bos taurus
atgggtagaggaaccctggtgggctacagtccttggggactcagagtcgaacaggacggagcaaataaacaatgaaagcggccttggttcagccttcactgtgctggaagagggtgagggcagacaggcagggacacaggagcttgtccagtcatcaaggtgagagatgctggtggcctgaacaaggctgcagcatctaaa

SEQ ID NO: 96957 - DNA, 201 bp, Bos taurus
cagaagtcgtgtcccggagcagggcttgctgcatctgttttccccggtttctgaggtcattgtttttgtcctctggttcatcgtgtgcttccttgacagacggaggccttgaaacacggtcacagcctcggtgcagggagaagatgtgagcccgggagagcattcttaagtcgctgctgaggaaattgatgctcctttgtc

SEQ ID NO: 96958 - DNA, 201 bp, Bos taurus; identical to SEQ ID NO: 15374

SEQ ID NO: 96959 - DNA, 201 bp, Bos taurus
gccctggtcacttgggagcctcaggcagagggaaatccttggggctcagaccaacggccagacttgccctctgagctggccccaaacctctgacccaaggatccttcttccccagcaaagcatggaagggaatttatagccactggagtctatggtccgagatacaaagagagcaggagccacgaaggactaggcctgtgg

SEQ ID NO: 96960 - DNA, 201 bp, Bos taurus
gagagaggtcgaggaaggcttttccaggtgagtgacataaatttagatctaaagatgcttggaagcgagttacacaaaggggactgggggtggtggtgagcggtggtcctcagcctttgttggcgccaaggacgggttccatggaagatgatttttccatagaccggggtggcggggatggtttggggatgatccaagtgc

SEQ ID NO: 96961 - DNA, 201 bp, Bos taurus; identical to SEQ ID NO: 15379

SEQ ID NO: 96962 - DNA, 201 bp, Bos taurus; identical to SEQ ID NO: 15380

SEQ ID NO: 96963 - DNA, 201 bp, Bos taurus; identical to SEQ ID NO: 15381

SEQ ID NO: 96964 - DNA, 201 bp, Bos taurus; identical to SEQ ID NO: 15383

SEQ ID NO: 96965 - DNA, 201 bp, Bos taurus; identical to SEQ ID NO: 15384

SEQ ID NO: 96966 - DNA, 201 bp, Bos taurus; identical to SEQ ID NO: 15386

SEQ ID NO: 96967 - DNA, 201 bp, Bos taurus; identical to SEQ ID NO: 15387

SEQ ID NO: 96968 - DNA, 201 bp, Bos taurus; identical to SEQ ID NO: 15388

SEQ ID NO: 96969 - DNA, 201 bp, Bos taurus; identical to SEQ ID NO: 15389

SEQ ID NO: 96970 - DNA, 201 bp, Bos taurus; identical to SEQ ID NO: 15390

SEQ ID NO: 96971 - DNA, 201 bp, Bos taurus; identical to SEQ ID NO: 15391

SEQ ID NO: 96972 - DNA, 201 bp, Bos taurus; identical to SEQ ID NO: 15394

SEQ ID NO: 96973 - DNA, 201 bp, Bos taurus; identical to SEQ ID NO: 15395

SEQ ID NO: 96974 - DNA, 201 bp, Bos taurus
aaacaacatcatttaaaatgatgtcaaagtcagaatgaagaaaatagattttgatgatagatgtttcccaacttataaatgttaaacctaatttatccttggattcactctgtaattttgaactggtttccttgtttttggtttcctctatttttttctaaaacaaaaaatgctatttattaactagcactttattaactt

SEQ ID NO: 96975 - DNA, 201 bp, Bos taurus; identical to SEQ ID NO: 15396

SEQ ID NO: 96976 - DNA, 201 bp, Bos taurus; identical to SEQ ID NO: 15397

SEQ ID NO: 96977 - DNA, 201 bp, Bos taurus; identical to SEQ ID NO: 15398

SEQ ID NO: 96978 - DNA, 201 bp, Bos taurus; identical to SEQ ID NO: 15399

SEQ ID NO: 96979 - DNA, 201 bp, Bos taurus
ggccctgggccttctggtactcagagattggctgttcccagaaatcagggataaagaatggcaaaaatctgttgtctatatgtaacctaatcacatctccgctggcaggccatattcttgtttcttcttccctcttctgaaaagaagaaacattaagtgatgttctcttctgattcctcccatgcatagcctggctgtgaa

SEQ ID NO: 96980 - DNA, 201 bp, Bos taurus; identical to SEQ ID NO: 15400

SEQ ID NO: 96981 - DNA, 201 bp, Bos taurus
tttgaactgtggtgttggagaagactcttgagagtcccctggactgcaaggacatccaaccagtccatcttaaaggagatcagtcctgggtgttcattggaaggaatgtgcaagctgtgcattaaatcacaagtgcttgctgcgctcctaatagtttgttaccgaagtggagtgaagtgaagtgaagtcgctcagtcgtgt

SEQ ID NO: 96982 - DNA, 201 bp, Bos taurus; identical to SEQ ID NO: 15403

SEQ ID NO: 96983 - DNA, 201 bp, Bos taurus; identical to SEQ ID NO: 15404

SEQ ID NO: 96984 - DNA, 201 bp, Bos taurus; identical to SEQ ID NO: 15405

SEQ ID NO: 96985 - DNA, 201 bp, Bos taurus
tgctcgccaggtcttggcagccttctttggaccttggggctctttgagtacttacagtctttgttcaaataagcagcctcctgatggctggcccccatgcgaggcccacatctggaaaccatccctggtcttggcccaggcgttcaggcctagggggtgtgtgtgcgtcaggtagagcccgcccggggatccacacgccag

SEQ ID NO: 96986 - DNA, 201 bp, Bos taurus; identical to SEQ ID NO: 15408

SEQ ID NO: 96987 - DNA, 201 bp, Bos taurus; identical to SEQ ID NO: 15409

SEQ ID NO: 96988 - DNA, 201 bp, Bos taurus
aacactaacataatcacaacatcatgatcacatccaagacaataacaattccaaagtatctggtatctggtttgtagtcagatttctgcaattacctccaatgtctaataaagctgttttcccctcaaaccaggattcaaatcaatgttcttaccatgcattaggttctgggttgtcctcagtttcttttaacctggggct

SEQ ID NO: 96989 - DNA, 201 bp, Bos taurus; identical to SEQ ID NO: 15410

SEQ ID NO: 96990 - DNA, 201 bp, Bos taurus; identical to SEQ ID NO: 56212

SEQ ID NO: 96991 - DNA, 201 bp, Bos taurus; identical to SEQ ID NO: 15411

SEQ ID NO: 96992 - DNA, 201 bp, Bos taurus; identical to SEQ ID NO: 15412

SEQ ID NO: 96993 - DNA, 201 bp, Bos taurus; identical to SEQ ID NO: 15413

SEQ ID NO: 96994 - DNA, 201 bp, Bos taurus; identical to SEQ ID NO: 15415

SEQ ID NO: 96995 - DNA, 201 bp, Bos taurus; identical to SEQ ID NO: 15419

SEQ ID NO: 96996 - DNA, 201 bp, Bos taurus; identical to SEQ ID NO: 15420

SEQ ID NO: 96997 - DNA, 201 bp, Bos taurus
ttcctgcctcccactggccagcttcctgttcctggtttgccctgggcaccaaccagacctggggcattgttcctatccgtccatgcccactgactctgcgtaggcttggtgtggctcccataggccctggacggcccagccccaccccgatcttgtgtgctcctcacctgtgccctgcaccctgcgtggctgccccttgcc

SEQ ID NO: 96998 - DNA, 201 bp, Bos taurus
ggctcttgaggccgggttggtaggcctgagcacgttctctgacgctctggctgtgtgtgggcacccctgtccctgaacccgagctggtgcagagctcgtcttctgctctggccatgcccacaggacctgctttgtccaaacctgatcatcgagcgtctggtggttggacaggagcaggtggggtttctcccaaggcatgtg

SEQ ID NO: 96999 - DNA, 201 bp, Bos taurus; identical to SEQ ID NO: 15422

SEQ ID NO: 97000 - DNA, 201 bp, Bos taurus; identical to SEQ ID NO: 15424

SEQ ID NO: 97001 - DNA, 201 bp, Bos taurus; identical to SEQ ID NO: 15425

SEQ ID NO: 97002 - DNA, 201 bp, Bos taurus
ggccctgggcagtgaaagcgaggagtcctaaccactggaccaccagggaatttcctgcaaagacttgtttctaaataaggtcacattcccagggtcagaagcagacagtgcagggctgaggcaggcctttaatttaaccatcagtaactgggaccacccatcctcaccaggctgttctctgtgcccaacagcacctcctgc

SEQ ID NO: 97003 - DNA, 201 bp, Bos taurus; identical to SEQ ID NO: 15426

SEQ ID NO: 97004 - DNA, 201 bp, Bos taurus; identical to SEQ ID NO: 15432

SEQ ID NO: 97005 - DNA, 201 bp, Bos taurus; identical to SEQ ID NO: 15433

SEQ ID NO: 97006 - DNA, 201 bp, Bos taurus
agcagacaaagccgagggcatcagtcagcctttgtactgttgtggctctgaatgacaatgacttgaggatattatgtcttccacttgcttctaggacttactacaccttcaagaggacaggtatttatcaatggatatgaactttctaaagacatgcttcaaatccggaagagcatgggctggtgcccccagcatgatatc

SEQ ID NO: 97007 - DNA, 201 bp, Bos taurus; identical to SEQ ID NO: 15435

SEQ ID NO: 97008 - DNA, 201 bp, Bos taurus; identical to SEQ ID NO: 15436

SEQ ID NO: 97009 - DNA, 201 bp, Bos taurus; identical to SEQ ID NO: 15437

SEQ ID NO: 97010 - DNA, 201 bp, Bos taurus; identical to SEQ ID NO: 15438

SEQ ID NO: 97011 - DNA, 201 bp, Bos taurus; identical to SEQ ID NO: 15439

SEQ ID NO: 97012 - DNA, 201 bp, Bos taurus; identical to SEQ ID NO: 15440

SEQ ID NO: 97013 - DNA, 201 bp, Bos taurus; identical to SEQ ID NO: 15443

SEQ ID NO: 97014 - DNA, 201 bp, Bos taurus; identical to SEQ ID NO: 15444

SEQ ID NO: 97015 - DNA, 201 bp, Bos taurus; identical to SEQ ID NO: 15445

SEQ ID NO: 97016 - DNA, 201 bp, Bos taurus; identical to SEQ ID NO: 15446

SEQ ID NO: 97017 - DNA, 201 bp, Bos taurus; identical to SEQ ID NO: 15447

SEQ ID NO: 97018 - DNA, 201 bp, Bos taurus; identical to SEQ ID NO: 15448

SEQ ID NO: 97019 - DNA, 201 bp, Bos taurus
tgaccattcaggtactctgtgatgttgttgactccagtttggtttactttttcatattgacttcgtttatttaccataaaatgtctcctattatattacatattgtaaagccagtgaaatttagcagtattgttgatggtctggtctaacaatgttatatatgtttacagaatatgcattacatttattcataaatccttt

SEQ ID NO: 97020 - DNA, 201 bp, Bos taurus; identical to SEQ ID NO: 15452

SEQ ID NO: 97021 - DNA, 201 bp, Bos taurus
ctcacaaactggaactcgatttgggattctcaggggaaattcagactgcaggccagggtcctcctaatttaaaaaatttaatcaagatggccatcgttccgttgtgtcctctggaacatgacttggagctcagggaataggagggagaccagtttgggcactgggacaggagtctctgctttactggtggcctggacaatg

SEQ ID NO: 97022 - DNA, 201 bp, Bos taurus
gcactgtaatcgactacaaccctctaaccaccaataaaatccaataaatacttgtttaatgcacctgtgcctgaatgcttttggctgcggcccaggcatcagggacctggctggggagggaccatgcatggctgtcctgtgggtctgggtgtaattgcacgtggccagctccgcaccgtccatggctgacttgctttgtcc

SEQ ID NO: 97023 - DNA, 201 bp, Bos taurus
acaggggccctgtgcttggtttagtgttctgcgctgacatcttgagattcacaataattctgaacagaggcttttgcacgttattttgcattcagtcctgaaaattatgcagctggccttgcttgagccaggaggtgaatggtggccccgtttatgaagatagagggggccggaagagggacatctgggggaggatatgga

SEQ ID NO: 97024 - DNA, 201 bp, Bos taurus; identical to SEQ ID NO: 15453

SEQ ID NO: 97025 - DNA, 201 bp, Bos taurus; identical to SEQ ID NO: 15454

SEQ ID NO: 97026 - DNA, 201 bp, Bos taurus
gggaaaaccatagcttgggtcttgtaagatgaaccagtttcagtgataatattgatggccacatttacaggaatgtgccatgctctgttctcagactttacgcatagtaactcatttagccttgcagtggccctctggggaaggtgctattgttatcctccttttatcagaggcagaaaccaaggcacagagaggctaggt

SEQ ID NO: 97027 - DNA, 201 bp, Bos taurus
attgtcttgttgtacctcagctgggaatgtgtcaggcaactcagatttttcttgctatgtgcagtcttgcacaaacatcacccaaagcgcttcatgtattaattctgaagttacaaagaaattttagcaagtaagctaattcacaaatacccacaagtagtgaggattgactctctgtgtgtgttaatgttagaggatgca

SEQ ID NO: 97028 - DNA, 201 bp, Bos taurus; identical to SEQ ID NO: 15455

SEQ ID NO: 97029 - DNA, 201 bp, Bos taurus; identical to SEQ ID NO: 15456

SEQ ID NO: 97030 - DNA, 201 bp, Bos taurus; identical to SEQ ID NO: 15457

SEQ ID NO: 97031 - DNA, 201 bp, Bos taurus; identical to SEQ ID NO: 15459

SEQ ID NO: 97032 - DNA, 201 bp, Bos taurus; identical to SEQ ID NO: 15461

SEQ ID NO: 97033 - DNA, 201 bp, Bos taurus
catgtcaagagagtaagggcttccctgatggcccagtgattgagactgtgctcccatggtggcaggtgtgggttcagtccttggtcaaggaactatcctacatgccgtgtggtgtggccaataaataaataaactttaggacttcgctggtggctcagtggtaaagaatccacctgccaatgcagggcacacaggttcgct

SEQ ID NO: 97034 - DNA, 201 bp, Bos taurus
ataagcagttggttactggtcttgaatggtgattggtttgcagatggagtgattaaaatcttttcctcatggcacagtcaaaaaatgattctgtcacagtagtcaaatagtaggcagttgccatattctacaaggtaaaaacttgaatcttcatggagagaggttgtgtcctcaagaaaagaaggagtgtatatgtggaac

SEQ ID NO: 97035 - DNA, 201 bp, Bos taurus; identical to SEQ ID NO: 15464

SEQ ID NO: 97036 - DNA, 201 bp, Bos taurus
ctggcaggctatagtccatagggttgcaaaaagtggacatgactaaagtgacttagcacacacacataatttgtgattatagaccacagtggttaaaaacctgagctcttttaggacagtgaaaattctctgtaagatactatagtgatgggtacatgtatttatacatgtgtccaaacccatccaatatgtaacacctag

SEQ ID NO: 97037 - DNA, 201 bp, Bos taurus; identical to SEQ ID NO: 15467

SEQ ID NO: 97038 - DNA, 201 bp, Bos taurus
tgaagttatctttggtaggctggggagaggaaaagctgtaaatattttcatactaataatattcccttgctatgtctacataagatatcatccagcatctcagagatgtatgtggttcacaaagatgacccagacaaacacctattagaatatttagatgatttagaatagaattaattggagtagaaatcactgtagaat

SEQ ID NO: 97039 - DNA, 201 bp, Bos taurus
ttctcttccatgagctcccacctggagttaagaattgaacgtcttaaacagattcctattttgttttagtggtcagttcctggccagctctaactgtgagcatctggttccttaaggccaatctgtagatattctcagtgacccctacatctcctgacatcactgtattcatagatggcttctctaggaaaaccattatta

SEQ ID NO: 97040 - DNA, 201 bp, Bos taurus; identical to SEQ ID NO: 15468

SEQ ID NO: 97041 - DNA, 201 bp, Bos taurus; identical to SEQ ID NO: 15469

SEQ ID NO: 97042 - DNA, 201 bp, Bos taurus; identical to SEQ ID NO: 15470

SEQ ID NO: 97043 - DNA, 201 bp, Bos taurus; identical to SEQ ID NO: 15471

SEQ ID NO: 97044 - DNA, 201 bp, Bos taurus; identical to SEQ ID NO: 15472

SEQ ID NO: 97045 - DNA, 201 bp, Bos taurus; identical to SEQ ID NO: 15473

SEQ ID NO: 97046 - DNA, 201 bp, Bos taurus
agagtttctgaagaatcatttcgtcactaagatatattgaatatgacagcagtgcttgcaaatcagtcattttggggaaaagactatagtcacatcctaaagaggagatggacccctttgttcggaatccatgtttgcagagtaggaaaaagtgttttaggactatctgtggcatggttagtagagctttggagcactcaa

SEQ ID NO: 97047 - DNA, 201 bp, Bos taurus; identical to SEQ ID NO: 15474

SEQ ID NO: 97048 - DNA, 201 bp, Bos taurus; identical to SEQ ID NO: 15476

SEQ ID NO: 97049 - DNA, 201 bp, Bos taurus; identical to SEQ ID NO: 15477

SEQ ID NO: 97050 - DNA, 201 bp, Bos taurus; identical to SEQ ID NO: 15478

SEQ ID NO: 97051 - DNA, 201 bp, Bos taurus; identical to SEQ ID NO: 15479

SEQ ID NO: 97052 - DNA, 201 bp, Bos taurus
aataaaaaatagagattaaagacaattttaaagtagacagtaaccaacatgtgaatatgttctattgaccttgggtgtaaacaattgtatgcattcaggagtggatagagctctagggtacccactcgggggtctggaggtcaatagaaatggggagattggttctcagaaaatgaaaggagagactccttgagccatgtt

SEQ ID NO: 97053 - DNA, 201 bp, Bos taurus; identical to SEQ ID NO: 15482

SEQ ID NO: 97054 - DNA, 201 bp, Bos taurus; identical to SEQ ID NO: 15483

SEQ ID NO: 97055 - DNA, 201 bp, Bos taurus; identical to SEQ ID NO: 15484

SEQ ID NO: 97056 - DNA, 201 bp, Bos taurus; identical to SEQ ID NO: 15486

SEQ ID NO: 97057 - DNA, 201 bp, Bos taurus
gcaaggccgagtggcagagaggcggggacaccgagcgcttgtgcaacaacagaaacgcgctcctcacgctggaagtcaggattctcagaaaactagcaaggaaggcaggccaagcaccatcgccaccagccaccaaaagcggagtccagtgactgagcagctctccctgtgcccgggagagacaggagagtgccgaggacg

SEQ ID NO: 97058 - DNA, 201 bp, Bos taurus; identical to SEQ ID NO: 15487

SEQ ID NO: 97059 - DNA, 201 bp, Bos taurus; identical to SEQ ID NO: 15488

SEQ ID NO: 97060 - DNA, 201 bp, Bos taurus; identical to SEQ ID NO: 15489

SEQ ID NO: 97061 - DNA, 201 bp, Bos taurus; identical to SEQ ID NO: 15490

SEQ ID NO: 97062 - DNA, 201 bp, Bos taurus
tatcgacaggcaggaggtgatgggggagtctggccacacgcctgggacccagcatctgatgggcgtgccaaatggtcctttgtttcaaggccccgctgcatgttctttctgattcccacctggacagcaaaggctgacccctctgcacatccctcctcccaccatcactcagcatgcccctttcgggccccacagatcagt

SEQ ID NO: 97063 - DNA, 201 bp, Bos taurus; identical to SEQ ID NO: 15491

SEQ ID NO: 97064 - DNA, 201 bp, Bos taurus; identical to SEQ ID NO: 15492

SEQ ID NO: 97065 - DNA, 201 bp, Bos taurus
gatttgtggactccaggcaactcccacgtgtgcaaccacaggaagacagtctccttctggtccaggcatctacagcacccttcagtcaggtgaggtgggcatgaccatccccgctgcttttgatctgttcacggtgacaaaatgagatcagaggctataattattcacggtgacgactttaaatgagagatgtgtgcatgc

SEQ ID NO: 97066 - DNA, 201 bp, Bos taurus; identical to SEQ ID NO: 15493

SEQ ID NO: 97067 - DNA, 201 bp, Bos taurus; identical to SEQ ID NO: 15494

SEQ ID NO: 97068 - DNA, 201 bp, Bos taurus; identical to SEQ ID NO: 15495

SEQ ID NO: 97069 - DNA, 201 bp, Bos taurus
ggtgacccacctgacttcatggcgccccagaaggttcccagactgaagagccatactagttattactattcgaggcctgggatgcatttagcttgggagaataagaactcctcattcgtatcccgagccccagaggtcaaagatgttttattagttgtgtgacctcgggcaagtcatttggcctctctgagcctcccttgc

SEQ ID NO: 97070 - DNA, 201 bp, Bos taurus; identical to SEQ ID NO: 15497

SEQ ID NO: 97071 - DNA, 201 bp, Bos taurus; identical to SEQ ID NO: 15498

SEQ ID NO: 97072 - DNA, 201 bp, Bos taurus
gcacggccacgttggcatggacaggcacgaactttcagggagccatgtgaaggaattgtctgactaacggatgctgagaacgacggttcagagcattccctctctctcttttccatttgcagcacgttttatgaagactgggcttttgtcatggatgaagaaaggtctagcatgcttcccaccatggcagctggtaagctt

SEQ ID NO: 97073 - DNA, 201 bp, Bos taurus
aggtgctgagaatgccgagtggtcgtggctgggccgccgagtccttcagccccgtctttggggcggaggcagggtggctcactggctggtgtggggccctcgctctttctgtcccccgctcccttgcccttctaacaagcccgaattatgctgggagccctgaggagcaagatcggcccagtcctagggcagaaaccttgg

SEQ ID NO: 97074 - DNA, 201 bp, Bos taurus
ggtaaactctgcctcctttggcctgggggcaggcctgtgagctgagccatggcagttggggctttagctcctgaattgaccaagaatggcaagaatgcttgagaggccatttattcaacagccaggtcctgatgactttctgtttgctcctatgggtactggccagagctattctggcttcatttccttctctgggtcaag

SEQ ID NO: 97075 - DNA, 201 bp, Bos taurus
tgctgtataataggctctaggtttgtccacctcattagaaccgagtcaaatgtgagcttttatcgagttgtagcgaatgagggccgcttcactgcagtgcgcggacttcacgctgtggtcgcttcccttgtggagcacagggtctgggacactcgggcttcagcggttgcagctcctgggctctggagtagttgcagctcg

SEQ ID NO: 97076 - DNA, 201 bp, Bos taurus; identical to SEQ ID NO: 15500

SEQ ID NO: 97077 - DNA, 201 bp, Bos taurus
ggagccgctgccatgtggggagggtgctgctaggccagggcccaggctggtctctgggcttcaggtctgcctcgcttgtggagcagcctctaggatcggatgagaaaggggcctttgactccaagagggcctcactagaccccagagctttatatcgagacacagcttctgtcaaggttaatttcctgaaaggtaaagccg

SEQ ID NO: 97078 - DNA, 201 bp, Bos taurus
aaggaacacttgcctgcctggaccattgagccatgtattaatatggaacacttgccttcccggaccattaaggcgtgtattaatatgcagacacacatctccaggggggctgagttacatgcacctggttgctctaagccttagacccgttaaatgattcactgtagaatctacagtcctggacagtattcaaggacgtat

SEQ ID NO: 97079 - DNA, 201 bp, Bos taurus; identical to SEQ ID NO: 15501

SEQ ID NO: 97080 - DNA, 201 bp, Bos taurus; identical to SEQ ID NO: 15502

SEQ ID NO: 97081 - DNA, 201 bp, Bos taurus; identical to SEQ ID NO: 15504

SEQ ID NO: 97082 - DNA, 201 bp, Bos taurus; identical to SEQ ID NO: 15507

SEQ ID NO: 97083 - DNA, 201 bp, Bos taurus; identical to SEQ ID NO: 15508

SEQ ID NO: 97084 - DNA, 201 bp, Bos taurus; identical to SEQ ID NO: 15509

SEQ ID NO: 97085 - DNA, 201 bp, Bos taurus
aatttgcagttcctgccaacctaatacttgaaatattgagatcaagcatgatctccacctctccatctttcctataaattaattcattcaccctttgctacttgagtgcttgttgatatctatagtaggtctgggacaagtaacaaaaatgatgaataagatgtgatccaagtctacttggaatggcacaccactatcttt

SEQ ID NO: 97086 - DNA, 201 bp, Bos taurus; identical to SEQ ID NO: 15510

SEQ ID NO: 97087 - DNA, 201 bp, Bos taurus; identical to SEQ ID NO: 15511

SEQ ID NO: 97088 - DNA, 201 bp, Bos taurus; identical to SEQ ID NO: 15515

SEQ ID NO: 97089 - DNA, 201 bp, Bos taurus
cataaagacagtaaacaaaggatcagaggagtggcccaagcaccacaaggaaatgttctgtttctgcaggatgacttgctcaagaaggatgtgttcgatttactgggagcagatatggatcaaactcttgctgagaagtgagagggatctgagcgctgtgcttctgtgccctgctcttgactcttaaaataggctcactcg

SEQ ID NO: 97090 - DNA, 201 bp, Bos taurus; identical to SEQ ID NO: 15516

SEQ ID NO: 97091 - DNA, 201 bp, Bos taurus
tgccaaacagggcacacgggttcgatccctggttcggaaagattgcacatgccgaggagtaattaagccacagcttagtccaccacagttactgagccctcgggccaaaactcgagagtaatccccacttgctgcaactagagaatgcctgcacacagcaacaaagactaagcacagccaaaactaaacaaataaatattt

SEQ ID NO: 97092 - DNA, 201 bp, Bos taurus
catctacagtggagtcacctctccctaaactcagtgggaactgtgcttccaaacagaaaagtacccaagatctcttttgccaaaagtcctcggaatgtctacaatcctgctacttggtgaggttccattagaatagtggtccctaacccttctggagccagggaccagtttcatggaagacaatttttccatggaaatggg

SEQ ID NO: 97093 - DNA, 201 bp, Bos taurus; identical to SEQ ID NO: 15517

SEQ ID NO: 97094 - DNA, 201 bp, Bos taurus; identical to SEQ ID NO: 15518

SEQ ID NO: 97095 - DNA, 201 bp, Bos taurus; identical to SEQ ID NO: 15519

SEQ ID NO: 97096 - DNA, 201 bp, Bos taurus
gcaaacagcgagacatgaaattctcatagtgtcacaactgggaatgaaataattggatgctgaatagccaagatgtgaaactgtgggattcttgctttccctttctataactagaggtaatagaaatgaataattttatgtaaaattgttttgtcattgactttataattaacatatttaggttcttcaatatttgaaata

SEQ ID NO: 97097 - DNA, 201 bp, Bos taurus; identical to SEQ ID NO: 15520

SEQ ID NO: 97098 - DNA, 201 bp, Bos taurus; identical to SEQ ID NO: 15521

SEQ ID NO: 97099 - DNA, 201 bp, Bos taurus; identical to SEQ ID NO: 15522

SEQ ID NO: 97100 - DNA, 201 bp, Bos taurus
acaaggaaaagaaaaagtccttaacaaaaggtctggcctggccccaggatgtcggaaaagtggcttgaggtcgtcaaaggaaccctgaggtcaggtctgccgtttagaagccaggtggccttgggaacatcccacagctctccccatctgggtctcctcacctggagaagagagtcctgctccccagcctcccttacagtg

SEQ ID NO: 97101 - DNA, 201 bp, Bos taurus; identical to SEQ ID NO: 15523

SEQ ID NO: 97102 - DNA, 201 bp, Bos taurus
aaaggaagaaaaatattaggattaaagcaaacttaaaatacctttccccaatcacctactacagttatttgttaaatcttaagaagtcagccccaacttgaaaggccaaacttggaaattcatttgaccttttggaaaggcactttggcaatatttcagtttagttcagtcgctcagtcatgtccgactcttggcaacccc

SEQ ID NO: 97103 - DNA, 201 bp, Bos taurus
ccctggttgtcccctggttaggaccccacgctttcactgccaagggcatggattcagtccctgatcagggagctaggaacctgcaagcctgtgccgcagttaaaaaagaaaatccctcaaaataatcactgtaacattttgaatggagtcttcctgtcttttatcgaagcatctgtactttgcaaaattgggtcctaacgt

SEQ ID NO: 97104 - DNA, 201 bp, Bos taurus; identical to SEQ ID NO: 15525

SEQ ID NO: 97105 - DNA, 201 bp, Bos taurus; identical to SEQ ID NO: 15526

SEQ ID NO: 97106 - DNA, 201 bp, Bos taurus
aacagtacttggttggctttgattggcccttgggtttgcaaccacagtcctagatgtcccatagtggctcttctcagacagagggcttctgctgggagacacactctggccaaattgatgtctcagtttttcaaataaaacacactctatctgaccccagtgccttggcatatgctgtaaactcttcccctcttttcttca

SEQ ID NO: 97107 - DNA, 201 bp, Bos taurus; identical to SEQ ID NO: 15527

SEQ ID NO: 97108 - DNA, 201 bp, Bos taurus; identical to SEQ ID NO: 15528

SEQ ID NO: 97109 - DNA, 201 bp, Bos taurus
gttttgccccctgggggacatttggcaatatctggggacatttttggttgtcagaactgggagtggtactactggcatctattgggtagatgctaggaactccgctaaacagcctacaatgcaccggacagcccctaatcaaaaattacctggcgccagctgtcagtagcgccaaggttgagaaactgggctatgagttac

SEQ ID NO: 97110 - DNA, 201 bp, Bos taurus; identical to SEQ ID NO: 15531

SEQ ID NO: 97111 - DNA, 201 bp, Bos taurus
aggagctggccggagagacgggagccacaggcctccatccaggggattggagcagctcacgtggtgcaccccggggagtggggaagatttcctgcgaaaggaggtggactgttggccggcacttatagagtggatagagtttagagaagctggtggggggtcattccaggcgggggaccagtgagaacactggtccagtgg

SEQ ID NO: 97112 - DNA, 201 bp, Bos taurus; identical to SEQ ID NO: 15532

SEQ ID NO: 97113 - DNA, 201 bp, Bos taurus; identical to SEQ ID NO: 15533

SEQ ID NO: 97114 - DNA, 201 bp, Bos taurus; identical to SEQ ID NO: 15535

SEQ ID NO: 97115 - DNA, 201 bp, Bos taurus; identical to SEQ ID NO: 15536

SEQ ID NO: 97116 - DNA, 201 bp, Bos taurus; identical to SEQ ID NO: 15538

SEQ ID NO: 97117 - DNA, 201 bp, Bos taurus; identical to SEQ ID NO: 15539

SEQ ID NO: 97118 - DNA, 201 bp, Bos taurus; identical to SEQ ID NO: 15540

SEQ ID NO: 97119 - DNA, 201 bp, Bos taurus; identical to SEQ ID NO: 15541

SEQ ID NO: 97120 - DNA, 201 bp, Bos taurus
ataagcctcattaaggcccaaaacaatagttgttacatagtggtaggaagctggtctggaaaagttaggaaatacttcctggaagaggtggcatgataaacagccttcaaagatggccaccaccaattctttccctgcttgtttttacacgctgctctaagcaccaagacggaacccatttctactcccagtgaaatctag

SEQ ID NO: 97121 - DNA, 201 bp, Bos taurus; identical to SEQ ID NO: 15542

SEQ ID NO: 97122 - DNA, 201 bp, Bos taurus
tgccatctgcatgctgagagccaagagatcattatcctccattggatctttgtgccaggaaagactgggcaaggatgatggatggctttccacaaatccacctgcaattggaggcataactcaaagctgtgtctggatttcttcttaggtacaaatttattcattcatccatcgtctcgcctattcactcactcacttatt

SEQ ID NO: 97123 - DNA, 201 bp, Bos taurus
ggagttaaaaaattttgtccacacaaaaacctacacacagatatttacagaagctttattcataattgccaaaacctgaaagcaaccaaaatgtccttccatatatgaatggacaaagaaactggggtccatccagatactggaatattgttgttgttttagtcacaagtcatgtctgactcttttgcgaccctatggact

SEQ ID NO: 97124 - DNA, 201 bp, Bos taurus
ctgccatggcccacttcggagggcttcaaagactgggagagagagggaaatattgagacccgttttccatttcagagatttacgagggagcaaatgaaatccgcttctgctctcagacctggccccctgggaaaggaaacactgtccgaatcaagtaaataaggtcctttgtgtcagcaaaggctgtggtggatgaaatta

SEQ ID NO: 97125 - DNA, 201 bp, Bos taurus
atactaaattaatgacaataattatatagaaaaatggacaaaagacttaagtcttttggttcttcaccccaagaaaaaaaaaatatctaaatggccaatgatagatggaaagatcagagaaggcaatggcaccccactccagtactcttgcctggaaaatcccatggatggaggggcctggtaggctccagtccatggggt

SEQ ID NO: 97126 - DNA, 201 bp, Bos taurus
taaaccagtcatgaaagaccacgtattgtattatttcaatttgatgtaatgtccagactaggcgaatctatagaaacagaaagtagataaagtggttgcctagggctgggaggttgatgagaaatgaggagtgactgctaatgggtatgaggattctttttagacatgaaactgttctaaaattgattgttgtgatggttg

SEQ ID NO: 97127 - DNA, 201 bp, Bos taurus
tacacctgagaagtaggctaagcaaattaatgagatacactgaaaactgcaacacctgtagctggcactggtcagcagaaagggccaaattcttctccataacaacacccaaccacacatcccacgagcaaggcttcaaaagttgaacaaattgtgctacaaagtttggcctcatctgccatatccacctggcctcctgcc

SEQ ID NO: 97128 - DNA, 201 bp, Bos taurus; identical to SEQ ID NO: 15543

SEQ ID NO: 97129 - DNA, 201 bp, Bos taurus; identical to SEQ ID NO: 15544

SEQ ID NO: 97130 - DNA, 201 bp, Bos taurus
caaccggcacattacactttctggaatttctctctacagaatcatcaacatatgtgcctctgtggtgccagtcaccacggccatgcagctgaggaagtcctaactggcaaaaccaaagcaggatgagaggctcaaggctttgaaggagtgtggagagtaccacttctctactaagcacctactctgtatatagcccaggac

SEQ ID NO: 97131 - DNA, 201 bp, Bos taurus; identical to SEQ ID NO: 15546

SEQ ID NO: 97132 - DNA, 201 bp, Bos taurus; identical to SEQ ID NO: 15547

SEQ ID NO: 97133 - DNA, 201 bp, Bos taurus; identical to SEQ ID NO: 15548

SEQ ID NO: 97134 - DNA, 201 bp, Bos taurus; identical to SEQ ID NO: 15549

SEQ ID NO: 97135 - DNA, 201 bp, Bos taurus; identical to SEQ ID NO: 15550

SEQ ID NO: 97136 - DNA, 201 bp, Bos taurus; identical to SEQ ID NO: 15551

SEQ ID NO: 97137 - DNA, 201 bp, Bos taurus; identical to SEQ ID NO: 15552

SEQ ID NO: 97138 - DNA, 201 bp, Bos taurus; identical to SEQ ID NO: 15553

SEQ ID NO: 97139 - DNA, 201 bp, Bos taurus; identical to SEQ ID NO: 15554

SEQ ID NO: 97140 - DNA, 201 bp, Bos taurus; identical to SEQ ID NO: 15555

SEQ ID NO: 97141 - DNA, 201 bp, Bos taurus; identical to SEQ ID NO: 15556

SEQ ID NO: 97142 - DNA, 201 bp, Bos taurus; identical to SEQ ID NO: 15557

SEQ ID NO: 97143 - DNA, 201 bp, Bos taurus; identical to SEQ ID NO: 15558

SEQ ID NO: 97144 - DNA, 201 bp, Bos taurus; identical to SEQ ID NO: 15559

SEQ ID NO: 97145 - DNA, 201 bp, Bos taurus; identical to SEQ ID NO: 15560

SEQ ID NO: 97146 - DNA, 201 bp, Bos taurus; identical to SEQ ID NO: 15561

SEQ ID NO: 97147 - DNA, 201 bp, Bos taurus; identical to SEQ ID NO: 15562

SEQ ID NO: 97148 - DNA, 201 bp, Bos taurus; identical to SEQ ID NO: 15563

SEQ ID NO: 97149 - DNA, 201 bp, Bos taurus; identical to SEQ ID NO: 15564

SEQ ID NO: 97150 - DNA, 201 bp, Bos taurus; identical to SEQ ID NO: 15565

SEQ ID NO: 97151 - DNA, 201 bp, Bos taurus; identical to SEQ ID NO: 15566

SEQ ID NO: 97152 - DNA, 201 bp, Bos taurus; identical to SEQ ID NO: 15567

SEQ ID NO: 97153 - DNA, 201 bp, Bos taurus; identical to SEQ ID NO: 15568

SEQ ID NO: 97154 - DNA, 201 bp, Bos taurus; identical to SEQ ID NO: 15569

SEQ ID NO: 97155 - DNA, 201 bp, Bos taurus; identical to SEQ ID NO: 15570

SEQ ID NO: 97156 - DNA, 201 bp, Bos taurus; identical to SEQ ID NO: 15571

SEQ ID NO: 97157 - DNA, 201 bp, Bos taurus; identical to SEQ ID NO: 15572

SEQ ID NO: 97158 - DNA, 201 bp, Bos taurus; identical to SEQ ID NO: 15573

SEQ ID NO: 97159 - DNA, 201 bp, Bos taurus; identical to SEQ ID NO: 15574

SEQ ID NO: 97160 - DNA, 201 bp, Bos taurus; identical to SEQ ID NO: 15575

SEQ ID NO: 97161 - DNA, 201 bp, Bos taurus; identical to SEQ ID NO: 15576

SEQ ID NO: 97162 - DNA, 201 bp, Bos taurus; identical to SEQ ID NO: 15577

SEQ ID NO: 97163 - DNA, 201 bp, Bos taurus; identical to SEQ ID NO: 15579

SEQ ID NO: 97164 - DNA, 201 bp, Bos taurus; identical to SEQ ID NO: 15580

SEQ ID NO: 97165 - DNA, 201 bp, Bos taurus; identical to SEQ ID NO: 15581

SEQ ID NO: 97166 - DNA, 201 bp, Bos taurus; identical to SEQ ID NO: 15582

SEQ ID NO: 97167 - DNA, 201 bp, Bos taurus; identical to SEQ ID NO: 15583

SEQ ID NO: 97168 - DNA, 201 bp, Bos taurus; identical to SEQ ID NO: 15584

SEQ ID NO: 97169 - DNA, 201 bp, Bos taurus
aggatgaactgtattttgtacactgccctaaaaattctctctgctccacctattcatcccttcttcccactcaatctctggccactactgatctttttgttttcacggtttgcctttttcagaatgtcatattgttggaattatgcaatatatagtcttttcaatatgacttctttcacttattaacatgtatttaagctt

SEQ ID NO: 97170 - DNA, 201 bp, Bos taurus
gtaaatgtgtcaggaagatgcctaccaggctgtaggtgcttataaagcttcagctgagcctggatgtgggtgcctagaaaccctctgatccaaaagtgataatgatagaagatcaatggcccccagatcagggaggacatgggaagcatgctcagtcatcgaagaaaaccatagaaattctattacagttaaaatcctttc

SEQ ID NO: 97171 - DNA, 201 bp, Bos taurus; identical to SEQ ID NO: 15585

SEQ ID NO: 97172 - DNA, 201 bp, Bos taurus; identical to SEQ ID NO: 15586

SEQ ID NO: 97173 - DNA, 201 bp, Bos taurus; identical to SEQ ID NO: 15587

SEQ ID NO: 97174 - DNA, 201 bp, Bos taurus; identical to SEQ ID NO: 15590

SEQ ID NO: 97175 - DNA, 201 bp, Bos taurus
gaggcgagaagtgaaagccggccaagcagcccagtgaacggctgagcctgcctttacctttcttggtcttgcaaggtccacgttcagggtggatctcttttaagggaagaggcaccaccttggccagccccgcgttcagcatgtactggtacaggcgcttgaatgtcctctcgcacagtccctgcaacatgtaaatgcggc

SEQ ID NO: 97176 - DNA, 201 bp, Bos taurus; identical to SEQ ID NO: 15591

SEQ ID NO: 97177 - DNA, 201 bp, Bos taurus
tttaattaaatgttttattttaagatcatcataaattcacatgcaattgtaagaaataatcagagagagccttgtgcactctaccgtgtttcccccaatgacaaaactgaaaaagtgaaagtgttagttgctcagtcatgtccaactctttgtggctccatggcctgtagcctccaggctcctctgaccacgggattctcc

SEQ ID NO: 97178 - DNA, 201 bp, Bos taurus
caaatgagattccctggagtcctgcagtgcacagcctgtatggctgtacacagcagccatggatatttttagagtaacaaatacccccaaacataggacaaaagagaattaatctgctattcagctagactgaaattggcaaagttcctcactccaaattatggcactctttgatcttcccaccatgtacccgccccccca

SEQ ID NO: 97179 - DNA, 201 bp, Bos taurus
gacaccacaatggagacgggatcagggaaatccagtgtagactggtgactttcaatcacagtgaagactgagtcccagccattttatgacagtggtcacgcgattcttaccccatcatctgcctctaggctgggccatggcaacagggccggtgaggggtgggtaggagacataatgaagcagggggagaggactggtcgg

SEQ ID NO: 97180 - DNA, 201 bp, Bos taurus; identical to SEQ ID NO: 15596

SEQ ID NO: 97181 - DNA, 201 bp, Bos taurus; identical to SEQ ID NO: 15597

SEQ ID NO: 97182 - DNA, 201 bp, Bos taurus; identical to SEQ ID NO: 15598

SEQ ID NO: 97183 - DNA, 201 bp, Bos taurus; identical to SEQ ID NO: 15600

SEQ ID NO: 97184 - DNA, 201 bp, Bos taurus; identical to SEQ ID NO: 15601

SEQ ID NO: 97185 - DNA, 201 bp, Bos taurus; identical to SEQ ID NO: 15602

SEQ ID NO: 97186 - DNA, 201 bp, Bos taurus; identical to SEQ ID NO: 15603

SEQ ID NO: 97187 - DNA, 201 bp, Bos taurus; identical to SEQ ID NO: 15604

SEQ ID NO: 97188 - DNA, 201 bp, Bos taurus; identical to SEQ ID NO: 15605

SEQ ID NO: 97189 - DNA, 201 bp, Bos taurus; identical to SEQ ID NO: 15606

SEQ ID NO: 97190 - DNA, 201 bp, Bos taurus; identical to SEQ ID NO: 15607

SEQ ID NO: 97191 - DNA, 201 bp, Bos taurus; identical to SEQ ID NO: 15608

SEQ ID NO: 97192 - DNA, 201 bp, Bos taurus; identical to SEQ ID NO: 15609

SEQ ID NO: 97193 - DNA, 201 bp, Bos taurus; identical to SEQ ID NO: 15610

SEQ ID NO: 97194 - DNA, 201 bp, Bos taurus; identical to SEQ ID NO: 15611

SEQ ID NO: 97195 - DNA, 201 bp, Bos taurus; identical to SEQ ID NO: 15612

SEQ ID NO: 97196 - DNA, 201 bp, Bos taurus; identical to SEQ ID NO: 15615

SEQ ID NO: 97197 - DNA, 201 bp, Bos taurus; identical to SEQ ID NO: 15616

SEQ ID NO: 97198 - DNA, 201 bp, Bos taurus; identical to SEQ ID NO: 15619

SEQ ID NO: 97199 - DNA, 201 bp, Bos taurus; identical to SEQ ID NO: 15621

SEQ ID NO: 97200 - DNA, 201 bp, Bos taurus; identical to SEQ ID NO: 15622

SEQ ID NO: 97201 - DNA, 201 bp, Bos taurus; identical to SEQ ID NO: 15624

SEQ ID NO: 97202 - DNA, 201 bp, Bos taurus; identical to SEQ ID NO: 15626

SEQ ID NO: 97203 - DNA, 201 bp, Bos taurus; identical to SEQ ID NO: 15627

SEQ ID NO: 97204 - DNA, 201 bp, Bos taurus; identical to SEQ ID NO: 15628

SEQ ID NO: 97205 - DNA, 201 bp, Bos taurus; identical to SEQ ID NO: 15629

SEQ ID NO: 97206 - DNA, 201 bp, Bos taurus; identical to SEQ ID NO: 15631

SEQ ID NO: 97207 - DNA, 201 bp, Bos taurus; identical to SEQ ID NO: 15633

SEQ ID NO: 97208 - DNA, 201 bp, Bos taurus; identical to SEQ ID NO: 15635

SEQ ID NO: 97209 - DNA, 201 bp, Bos taurus; identical to SEQ ID NO: 15637

SEQ ID NO: 97210 - DNA, 201 bp, Bos taurus; identical to SEQ ID NO: 15639

SEQ ID NO: 97211 - DNA, 201 bp, Bos taurus; identical to SEQ ID NO: 15640

SEQ ID NO: 97212 - DNA, 201 bp, Bos taurus; identical to SEQ ID NO: 15641

SEQ ID NO: 97213 - DNA, 201 bp, Bos taurus; identical to SEQ ID NO: 15642

SEQ ID NO: 97214 - DNA, 201 bp, Bos taurus; identical to SEQ ID NO: 15645

SEQ ID NO: 97215 - DNA, 201 bp, Bos taurus; identical to SEQ ID NO: 15652

SEQ ID NO: 97216 - DNA, 201 bp, Bos taurus; identical to SEQ ID NO: 15653

SEQ ID NO: 97217 - DNA, 201 bp, Bos taurus; identical to SEQ ID NO: 15655

SEQ ID NO: 97218 - DNA, 201 bp, Bos taurus; identical to SEQ ID NO: 15656

SEQ ID NO: 97219 - DNA, 201 bp, Bos taurus; identical to SEQ ID NO: 15657

SEQ ID NO: 97220 - DNA, 201 bp, Bos taurus; identical to SEQ ID NO: 15658

SEQ ID NO: 97221 - DNA, 201 bp, Bos taurus; identical to SEQ ID NO: 15659

SEQ ID NO: 97222 - DNA, 201 bp, Bos taurus; identical to SEQ ID NO: 15660

SEQ ID NO: 97223 - DNA, 201 bp, Bos taurus; identical to SEQ ID NO: 15663

SEQ ID NO: 97224 - DNA, 201 bp, Bos taurus; identical to SEQ ID NO: 15665

SEQ ID NO: 97225 - DNA, 201 bp, Bos taurus; identical to SEQ ID NO: 15666

SEQ ID NO: 97226 - DNA, 201 bp, Bos taurus; identical to SEQ ID NO: 15667

SEQ ID NO: 97227 - DNA, 201 bp, Bos taurus; identical to SEQ ID NO: 15668

SEQ ID NO: 97228 - DNA, 201 bp, Bos taurus; identical to SEQ ID NO: 15670

SEQ ID NO: 97229 - DNA, 201 bp, Bos taurus; identical to SEQ ID NO: 15674

SEQ ID NO: 97230 - DNA, 201 bp, Bos taurus; identical to SEQ ID NO: 15678

SEQ ID NO: 97231 - DNA, 201 bp, Bos taurus; identical to SEQ ID NO: 15679

SEQ ID NO: 97232 - DNA, 201 bp, Bos taurus; identical to SEQ ID NO: 15680

SEQ ID NO: 97233 - DNA, 201 bp, Bos taurus; identical to SEQ ID NO: 15682

SEQ ID NO: 97234 - DNA, 201 bp, Bos taurus; identical to SEQ ID NO: 15684

SEQ ID NO: 97235 - DNA, 201 bp, Bos taurus; identical to SEQ ID NO: 15685

SEQ ID NO: 97236 - DNA, 201 bp, Bos taurus; identical to SEQ ID NO: 15689

SEQ ID NO: 97237 - DNA, 201 bp, Bos taurus; identical to SEQ ID NO: 15690

SEQ ID NO: 97238 - DNA, 201 bp, Bos taurus; identical to SEQ ID NO: 15693

SEQ ID NO: 97239 - DNA, 201 bp, Bos taurus; identical to SEQ ID NO: 15694

SEQ ID NO: 97240 - DNA, 201 bp, Bos taurus; identical to SEQ ID NO: 15695

SEQ ID NO: 97241 - DNA, 201 bp, Bos taurus; identical to SEQ ID NO: 15696

SEQ ID NO: 97242 - DNA, 201 bp, Bos taurus; identical to SEQ ID NO: 15697

SEQ ID NO: 97243 - DNA, 201 bp, Bos taurus; identical to SEQ ID NO: 15698

SEQ ID NO: 97244 - DNA, 201 bp, Bos taurus; identical to SEQ ID NO: 15699

SEQ ID NO: 97245 - DNA, 201 bp, Bos taurus; identical to SEQ ID NO: 15700

SEQ ID NO: 97246 - DNA, 201 bp, Bos taurus; identical to SEQ ID NO: 15701

SEQ ID NO: 97247 - DNA, 201 bp, Bos taurus; identical to SEQ ID NO: 15702

SEQ ID NO: 97248 - DNA, 201 bp, Bos taurus; identical to SEQ ID NO: 15705

SEQ ID NO: 97249 - DNA, 201 bp, Bos taurus; identical to SEQ ID NO: 15706

SEQ ID NO: 97250 - DNA, 201 bp, Bos taurus; identical to SEQ ID NO: 15707

SEQ ID NO: 97251 - DNA, 201 bp, Bos taurus; identical to SEQ ID NO: 15708

SEQ ID NO: 97252 - DNA, 201 bp, Bos taurus; identical to SEQ ID NO: 15709

SEQ ID NO: 97253 - DNA, 201 bp, Bos taurus; identical to SEQ ID NO: 15710

SEQ ID NO: 97254 - DNA, 201 bp, Bos taurus; identical to SEQ ID NO: 15711

SEQ ID NO: 97255 - DNA, 201 bp, Bos taurus; identical to SEQ ID NO: 15713

SEQ ID NO: 97256 - DNA, 201 bp, Bos taurus; identical to SEQ ID NO: 15714

SEQ ID NO: 97257 - DNA, 201 bp, Bos taurus; identical to SEQ ID NO: 15716

SEQ ID NO: 97258 - DNA, 201 bp, Bos taurus; identical to SEQ ID NO: 15718

SEQ ID NO: 97259 - DNA, 201 bp, Bos taurus; identical to SEQ ID NO: 15719

SEQ ID NO: 97260 - DNA, 201 bp, Bos taurus; identical to SEQ ID NO: 15720

SEQ ID NO: 97261 - DNA, 201 bp, Bos taurus; identical to SEQ ID NO: 15721

SEQ ID NO: 97262 - DNA, 201 bp, Bos taurus; identical to SEQ ID NO: 15722

SEQ ID NO: 97263 - DNA, 201 bp, Bos taurus; identical to SEQ ID NO: 15727

SEQ ID NO: 97264 - DNA, 201 bp, Bos taurus; identical to SEQ ID NO: 15729

SEQ ID NO: 97265 - DNA, 201 bp, Bos taurus; identical to SEQ ID NO: 15730

SEQ ID NO: 97266 - DNA, 201 bp, Bos taurus; identical to SEQ ID NO: 15731

SEQ ID NO: 97267 - DNA, 201 bp, Bos taurus; identical to SEQ ID NO: 15732

SEQ ID NO: 97268 - DNA, 201 bp, Bos taurus; identical to SEQ ID NO: 15734

SEQ ID NO: 97269 - DNA, 201 bp, Bos taurus; identical to SEQ ID NO: 15735

SEQ ID NO: 97270 - DNA, 201 bp, Bos taurus; identical to SEQ ID NO: 15736

SEQ ID NO: 97271 - DNA, 201 bp, Bos taurus
ctacctcccacaccgccgggccaggccctgtcgtcacagtgacccacgctgggatgcacaggactgagcgcagagctcacctgccctgtgacaggctgaatggtgtggccgtgtgtcacctcacctgcaagtaagcgtcaccatccactgtggtggccttgagaacactgtgggtccagagggggctgtgcaagagcggag

SEQ ID NO: 97272 - DNA, 201 bp, Bos taurus
actgtgctgctctgcgtctggccaatgctcaaagcaaacaggagcttccagccaacagcgaacacttcccaagtgattttggccatgaaggcaggaacggcggagtgggtgtagctgtttttcaaggttacctaaagtatattccttaccactcactgttcttaagttatcttctctccacaataggccactccccaaatt

SEQ ID NO: 97273 - DNA, 201 bp, Bos taurus; identical to SEQ ID NO: 15738

SEQ ID NO: 97274 - DNA, 201 bp, Bos taurus; identical to SEQ ID NO: 15739

SEQ ID NO: 97275 - DNA, 201 bp, Bos taurus; identical to SEQ ID NO: 15742

SEQ ID NO: 97276 - DNA, 201 bp, Bos taurus; identical to SEQ ID NO: 15743

SEQ ID NO: 97277 - DNA, 201 bp, Bos taurus; identical to SEQ ID NO: 15746

SEQ ID NO: 97278 - DNA, 201 bp, Bos taurus; identical to SEQ ID NO: 15747

SEQ ID NO: 97279 - DNA, 201 bp, Bos taurus
tcgggttcctcgcagcgtcgtcgcctgtgtgttctgcccgcgacagtgtggcttcgcttgttttgagttgtgcgggtggatttaggtctcgtccgtcatgctgctcccggccatggcctgtccccccgcgaacgagtctgggagccacgctgctgcgagcatcctggtccccacatgtgcggcccctctgcggtgcgcgcc

SEQ ID NO: 97280 - DNA, 201 bp, Bos taurus; identical to SEQ ID NO: 15749

SEQ ID NO: 97281 - DNA, 201 bp, Bos taurus; identical to SEQ ID NO: 15751

SEQ ID NO: 97282 - DNA, 201 bp, Bos taurus; identical to SEQ ID NO: 15752

SEQ ID NO: 97283 - DNA, 201 bp, Bos taurus; identical to SEQ ID NO: 15754

SEQ ID NO: 97284 - DNA, 201 bp, Bos taurus
caccattctggtaagagctgcctgccactgactattacatacagtgcacgggactccatccaacccaacttattccctaaaagtgggggatgggggtcagggcaggttaagactcccagtgtttcctcactagctgactttggagaagggcaaatggggtttgggttttgtttgttttttagagttttttttctcaatagt

SEQ ID NO: 97285 - DNA, 201 bp, Bos taurus
cctctcaccaggccgggcacaaacgccctggccccgcactcgggatccctgctgtttccctctggtttgttctccagactccactagcagtgtgctctgcaagtctctccccggccactctgcagcccctcacccgtgacccgtctggcccaggcagctgaggctgtgaggaggcactgtctcaccttcccagtgacagcg

SEQ ID NO: 97286 - DNA, 201 bp, Bos taurus
gctgccccctccccgagctggcagctcccaagaaggctggacccaacccccgggtgatcccagcgtcctgttggtaagggagggagaaattcagagatcctgtccagcggccccgctcccttggaggaggctcccctcatccctccaacattacttccaagtcctctcccttcacaggagaatgcctttgcccccagggtg

SEQ ID NO: 97287 - DNA, 201 bp, Bos taurus; identical to SEQ ID NO: 15755

SEQ ID NO: 97288 - DNA, 201 bp, Bos taurus
gcgctgtcgccccagctcccaaaacggccctgccctcgggtcaggcctaaactctcctggtggtggaaggccatcccgggcctcgggcgtgcgtcgctgtgtgccttgcttttaagatgtcctcctccaacccccaaatggttttcaaggctctgtggggccaggagggcccccgggtgccccggcccagccataaccagc

SEQ ID NO: 97289 - DNA, 201 bp, Bos taurus
accactatgccagtgccattgagtgcgggccagggcaccaggctgtggacacttccttcctgcctggggatccggattccacaggcccagtgactggggttcctggtcacccagagcatgtctgagttcctctttggtgatgaatgcagagccctagggtgagtagggggagcggctttgctcgcaagacggcccaggcgt

SEQ ID NO: 97290 - DNA, 201 bp, Bos taurus; identical to SEQ ID NO: 15757

SEQ ID NO: 97291 - DNA, 201 bp, Bos taurus
ggtccccccacagcgccccacgacaccccccacgccacaccccggcccttctcccaaagtgctgtgggaacgccgtgctctgggaaacatttctggaagatattagaacccaaacatttttcaaccaaaattttagaaacccagaccacttccaaagacgaccgactttgaaacctgacacttcaaatccacttttcgaat

SEQ ID NO: 97292 - DNA, 201 bp, Bos taurus; identical to SEQ ID NO: 15761

SEQ ID NO: 97293 - DNA, 201 bp, Bos taurus
aaccaccaccaaaaaaaaagcaactaaagaaaagttctgctaaggttatggtgaaaccagcacaatttttttggaaagtcatttggcaacacagataaaaagcttccaaagtgtgcatagctgacagcagaagagaggcttaatgacgaagctgaaacttcccgtctgagaccagggacagcacgcggatgctgccaccac

SEQ ID NO: 97294 - DNA, 201 bp, Bos taurus; identical to SEQ ID NO: 15762

SEQ ID NO: 97295 - DNA, 201 bp, Bos taurus; identical to SEQ ID NO: 15763

SEQ ID NO: 97296 - DNA, 201 bp, Bos taurus; identical to SEQ ID NO: 15764

SEQ ID NO: 97297 - DNA, 201 bp, Bos taurus; identical to SEQ ID NO: 15765

SEQ ID NO: 97298 - DNA, 201 bp, Bos taurus; identical to SEQ ID NO: 15766

SEQ ID NO: 97299 - DNA, 201 bp, Bos taurus
cctgctcggatgagaccagggcacccagccccaccggccgctcacctgtccgcagatttaagtacaacactgtttatacctaaaaccatgacactctcccaacactggccacttggtgccacccaccaaggacacactccagacagagctggaaaaacactggtcccagcgcccgcgggcctcacggggcatccaggccgc

SEQ ID NO: 97300 - DNA, 201 bp, Bos taurus; identical to SEQ ID NO: 15767

SEQ ID NO: 97301 - DNA, 201 bp, Bos taurus; identical to SEQ ID NO: 15768

SEQ ID NO: 97302 - DNA, 201 bp, Bos taurus; identical to SEQ ID NO: 15769

SEQ ID NO: 97303 - DNA, 201 bp, Bos taurus; identical to SEQ ID NO: 15770

SEQ ID NO: 97304 - DNA, 201 bp, Bos taurus; identical to SEQ ID NO: 15771

SEQ ID NO: 97305 - DNA, 201 bp, Bos taurus; identical to SEQ ID NO: 15772

SEQ ID NO: 97306 - DNA, 201 bp, Bos taurus; identical to SEQ ID NO: 15773

SEQ ID NO: 97307 - DNA, 201 bp, Bos taurus; identical to SEQ ID NO: 15774

SEQ ID NO: 97308 - DNA, 201 bp, Bos taurus; identical to SEQ ID NO: 15775

SEQ ID NO: 97309 - DNA, 201 bp, Bos taurus; identical to SEQ ID NO: 15776

SEQ ID NO: 97310 - DNA, 201 bp, Bos taurus; identical to SEQ ID NO: 15777

SEQ ID NO: 97311 - DNA, 201 bp, Bos taurus; identical to SEQ ID NO: 15778

SEQ ID NO: 97312 - DNA, 201 bp, Bos taurus; identical to SEQ ID NO: 15779

SEQ ID NO: 97313 - DNA, 201 bp, Bos taurus; identical to SEQ ID NO: 15780

SEQ ID NO: 97314 - DNA, 201 bp, Bos taurus; identical to SEQ ID NO: 15781

SEQ ID NO: 97315 - DNA, 201 bp, Bos taurus; identical to SEQ ID NO: 15782

SEQ ID NO: 97316 - DNA, 201 bp, Bos taurus
cactaccatctccagccacaaagagggaactccaaggctttcttgaaatggctgaattctgttgtatcaggattccaaatcatggccttatagctaagccctatatgaggctctaaagagaggagaaagggagccccttcaatggaataaggacaactagcaggcctttgagactctaaagactgagtagagagccagcaa

SEQ ID NO: 97317 - DNA, 201 bp, Bos taurus; identical to SEQ ID NO: 15783

SEQ ID NO: 97318 - DNA, 201 bp, Bos taurus; identical to SEQ ID NO: 15784

SEQ ID NO: 97319 - DNA, 201 bp, Bos taurus
aattacttctgctgtactttccataaaaaggttttgtggggaaaattggaaattagtgacttaatggtcaacctatgctatttgttggtttgaataacgagctatccctaagatatatgaaatacatttaaatttatacagccttaaataaatcacaaaaggagagaccatgtcactatatatttttttaaatatccagtt

SEQ ID NO: 97320 - DNA, 201 bp, Bos taurus; identical to SEQ ID NO: 15785

SEQ ID NO: 97321 - DNA, 201 bp, Bos taurus; identical to SEQ ID NO: 15787

SEQ ID NO: 97322 - DNA, 201 bp, Bos taurus; identical to SEQ ID NO: 15788

SEQ ID NO: 97323 - DNA, 201 bp, Bos taurus; identical to SEQ ID NO: 15791

SEQ ID NO: 97324 - DNA, 201 bp, Bos taurus; identical to SEQ ID NO: 15792

SEQ ID NO: 97325 - DNA, 201 bp, Bos taurus
ttacatttggccttttgaaagaaatgtgtctgacatgacttgtgtagtatggttgttgttgttcaaccagtaagccatgtctcacttttttccaccccaggaacttcagcatgccaggcttccctgtccttctgtatctccctgagtttgatcaaactcatgttcattgagtcactgatgccttacaaccatcacattctc

SEQ ID NO: 97326 - DNA, 201 bp, Bos taurus; identical to SEQ ID NO: 15793

SEQ ID NO: 97327 - DNA, 201 bp, Bos taurus
tgacagtaaaatttccaagaacagggatttgcatctctgattctttgtgtcttccacacaacttacctgaggtttagatattggaaagattttgactggcggtatttaattcgaattgttagcaactttcacatctatatgccaagctgcaagtactctgtaaaaattaaaataaaaagtatcaattttatagtagattta

SEQ ID NO: 97328 - DNA, 201 bp, Bos taurus; identical to SEQ ID NO: 15794

SEQ ID NO: 97329 - DNA, 201 bp, Bos taurus
aaagtgaaaacaaaagtttattaaaaaatgaacataatttcatgtcacaatggaaattttacttatagaaattagtgattaaattaaaaacaactttattaggaatagggatctttgcaatttgttggaaatattcacagaacaaacatttgtaagcaaacacaaatgtgtttactgaagtatgggattattcatttcctg

SEQ ID NO: 97330 - DNA, 201 bp, Bos taurus; identical to SEQ ID NO: 15797

SEQ ID NO: 97331 - DNA, 201 bp, Bos taurus; identical to SEQ ID NO: 15798

SEQ ID NO: 97332 - DNA, 201 bp, Bos taurus; identical to SEQ ID NO: 15799

SEQ ID NO: 97333 - DNA, 201 bp, Bos taurus; identical to SEQ ID NO: 15800

SEQ ID NO: 97334 - DNA, 201 bp, Bos taurus; identical to SEQ ID NO: 15801

SEQ ID NO: 97335 - DNA, 201 bp, Bos taurus; identical to SEQ ID NO: 15802

SEQ ID NO: 97336 - DNA, 201 bp, Bos taurus; identical to SEQ ID NO: 15803

SEQ ID NO: 97337 - DNA, 201 bp, Bos taurus; identical to SEQ ID NO: 15805

SEQ ID NO: 97338 - DNA, 201 bp, Bos taurus; identical to SEQ ID NO: 15807

SEQ ID NO: 97339 - DNA, 201 bp, Bos taurus; identical to SEQ ID NO: 15808

SEQ ID NO: 97340 - DNA, 201 bp, Bos taurus; identical to SEQ ID NO: 15809

SEQ ID NO: 97341 - DNA, 201 bp, Bos taurus; identical to SEQ ID NO: 15810

SEQ ID NO: 97342 - DNA, 201 bp, Bos taurus
gcccgatgcctaaaagtacatctgctttaagaatataatacagttataccctgtcaattggtcatctagtatttctccctgctagctcacacaacccctcatcaggccacttgctttggcgtcctgtgaaaacacatggccttctgtgctgtaaacttttcctggaatggcctttcccccaaacagccttttctcatctat

SEQ ID NO: 97343 - DNA, 201 bp, Bos taurus
taatgttaagtgacattggtattgcttttgttcttccaaatttgcttcactctatctgatacataatttaatctaatttctcattgtgcttgtttattcaacttgaacacttctgtgcattgggtagtatattcatacgtctaacttcatattttggctgtttacttcatttgtatgtcttcagagcaaatgtgtgggcac

SEQ ID NO: 97344 - DNA, 201 bp, Bos taurus; identical to SEQ ID NO: 15812

SEQ ID NO: 97345 - DNA, 201 bp, Bos taurus; identical to SEQ ID NO: 15813

SEQ ID NO: 97346 - DNA, 201 bp, Bos taurus; identical to SEQ ID NO: 15814

SEQ ID NO: 97347 - DNA, 201 bp, Bos taurus; identical to SEQ ID NO: 15815

SEQ ID NO: 97348 - DNA, 201 bp, Bos taurus; identical to SEQ ID NO: 15816

SEQ ID NO: 97349 - DNA, 201 bp, Bos taurus; identical to SEQ ID NO: 15817

SEQ ID NO: 97350 - DNA, 201 bp, Bos taurus
aaagagcttcttatccataaagtaaccattaaggattttacagctgaaaatcaatgagtcccctcacttgaaagcctgtcattgacactgagctgactgatggctacagaggtttggccataaggtttctgagaatgtgtgcagtcctttgggttgctgtcccatgtttataggtcagggttaccactgaggagagagttt

SEQ ID NO: 97351 - DNA, 201 bp, Bos taurus; identical to SEQ ID NO: 15818

SEQ ID NO: 97352 - DNA, 201 bp, Bos taurus; identical to SEQ ID NO: 15820

SEQ ID NO: 97353 - DNA, 201 bp, Bos taurus
ggaatgatctaagagtcttcactttccttgtggtaatccttgtgcctctgctgcgattatcatctaacacagtgtcagagtcaaacagtgtcctgggccaaagagcctctgactaagtcacctcattgatatttggaccaagtctcctcatctatggagagcatatggaatcggtcctgtctggcagcaccataagaaaac

SEQ ID NO: 97354 - DNA, 201 bp, Bos taurus; identical to SEQ ID NO: 15821

SEQ ID NO: 97355 - DNA, 201 bp, Bos taurus; identical to SEQ ID NO: 15822

SEQ ID NO: 97356 - DNA, 201 bp, Bos taurus
aaaaatatttttcttcattctgaccaaaaaaaagaaaagcaacacatacggactcaaatcacagccagcacaccaaattcaggtgatgacagctgtgcccagtcatcagctgtccttcttggagggaccatgagaatgttagaacagtaagcatacctttaaatgtttgtcttaacagttgtttttctgactgtgtggaag

SEQ ID NO: 97357 - DNA, 201 bp, Bos taurus; identical to SEQ ID NO: 15824

SEQ ID NO: 97358 - DNA, 201 bp, Bos taurus; identical to SEQ ID NO: 15825

SEQ ID NO: 97359 - DNA, 201 bp, Bos taurus; identical to SEQ ID NO: 15826

SEQ ID NO: 97360 - DNA, 201 bp, Bos taurus; identical to SEQ ID NO: 15828

SEQ ID NO: 97361 - DNA, 201 bp, Bos taurus; identical to SEQ ID NO: 15829

SEQ ID NO: 97362 - DNA, 201 bp, Bos taurus; identical to SEQ ID NO: 15831

SEQ ID NO: 97363 - DNA, 201 bp, Bos taurus
ttatttattttgtactcacagattaagtgagtcagaaatctggacaaggcatgatggaaatgacttgtttctgctccagaatatttggggccttagttggaaaaactcagtgacaggagatgagttttggcagattgagggctgaatcatctatttgtattttcactcatgtgtctggtataggctgtttgttatctgggt

SEQ ID NO: 97364 - DNA, 201 bp, Bos taurus; identical to SEQ ID NO: 15832

SEQ ID NO: 97365 - DNA, 201 bp, Bos taurus
gatggggaagtctgaggagagagcattttaggtgaaggaaatagtaagtgcaaagtcccaaaggcgggagagtgcctggagtgttcagtaaaaagcaaaggggctagtgtggtaggagatggggttggggagcgagccagaggctcaaagggctctgccctcacagttagaccttaggcttttcccctgagtaacatgaaa

SEQ ID NO: 97366 - DNA, 201 bp, Bos taurus; identical to SEQ ID NO: 15834

SEQ ID NO: 97367 - DNA, 201 bp, Bos taurus; identical to SEQ ID NO: 15835

SEQ ID NO: 97368 - DNA, 201 bp, Bos taurus; identical to SEQ ID NO: 15837

SEQ ID NO: 97369 - DNA, 201 bp, Bos taurus
gcagagttggatgtgactgagcaattgagcacacacacaacccttgctttgaaagctattccttcaagcctagtaagtactaatagcattcgcattcaccagttgctcaagctaaaaacctgaaagtcatctttgtctttgctttctccttatgcttaatttatctgcaatgtggattcaatttccaaaatgcatcttgaa

SEQ ID NO: 97370 - DNA, 201 bp, Bos taurus; identical to SEQ ID NO: 15838

SEQ ID NO: 97371 - DNA, 201 bp, Bos taurus
acttcgggtatcactgttctaagtctgttaagcagacaaattttgttgctctgttgttgatttgctttcctttgtctacggtttatagtcagaaacttgctaagtacttacacccattgttctaaatacttgtacccattgttatctttatatattgactctggtaagtaacatacctctttttagagacaattcttatat

SEQ ID NO: 97372 - DNA, 201 bp, Bos taurus; identical to SEQ ID NO: 15839

SEQ ID NO: 97373 - DNA, 201 bp, Bos taurus
atccccgtaccacgggtgtccccagagtgaatggtctgcagacccatagtccaagactgagacacaatccaggccttttactacttcttcatatgagatctcaaagactatgatgctttccttagcattaattcaatctgggaaaattttaatctctgtgcaatatccagggaagtctcaccatcctgagaagaaaaagaa

SEQ ID NO: 97374 - DNA, 201 bp, Bos taurus
acatggaaaagcactaaatttttaacttgagatatctagcttttttttgttaacagtaatcttttgttcctactcctgcccttgcttgcaaagctcctatgtatcctggcttccccttcacctccttggagcagttttctcagggttacttgagatgttgccttctgggcttaagatcctcagagtgtctgctgaataaaa

SEQ ID NO: 97375 - DNA, 201 bp, Bos taurus
gtaaggtatgaaaaatacagcggctgaaattttgccccaagaactggcactttattactccctggctgtgggtgtgaccttcacctcagttttctcatttacaaaatgaccatgaaacctactcaatcacggcacaagattcctgagctaaattttatagaaagacttaaattgctagagtactttgaaaactttaaatag

SEQ ID NO: 97376 - DNA, 201 bp, Bos taurus; identical to SEQ ID NO: 15840

SEQ ID NO: 97377 - DNA, 201 bp, Bos taurus; identical to SEQ ID NO: 15841

SEQ ID NO: 97378 - DNA, 201 bp, Bos taurus; identical to SEQ ID NO: 15842

SEQ ID NO: 97379 - DNA, 201 bp, Bos taurus
gatctctaaccccagaaagcttgtgattttgtagaggtgacatttaaaaataaacacacaaatgaatatggaattataattaaaatatgttctctggtgggaaagagcagggtgctatgagaacgtgtcgtgtgggtggtgatagtgtgataggcaatttgtgtgcctgtgtgctcagtcgtgtccaacacttttgggacc

SEQ ID NO: 97380 - DNA, 201 bp, Bos taurus; identical to SEQ ID NO: 15843

SEQ ID NO: 97381 - DNA, 201 bp, Bos taurus; identical to SEQ ID NO: 15844

SEQ ID NO: 97382 - DNA, 201 bp, Bos taurus
tttatgattaaaacagccattatcagcaggaattagtttgacaagattttaaaagataacaatctatttcaacctattcagtcttcatttgaaatcttttgggatatgtaaaaaagcaatagataagatgtagcctccatgttacatgggtaagaacttctatagttgtatatttatgcctttgatgatcttctctcaaga

SEQ ID NO: 97383 - DNA, 201 bp, Bos taurus; identical to SEQ ID NO: 15846

SEQ ID NO: 97384 - DNA, 201 bp, Bos taurus; identical to SEQ ID NO: 15849

SEQ ID NO: 97385 - DNA, 201 bp, Bos taurus; identical to SEQ ID NO: 15850

SEQ ID NO: 97386 - DNA, 201 bp, Bos taurus; identical to SEQ ID NO: 15851

SEQ ID NO: 97387 - DNA, 201 bp, Bos taurus; identical to SEQ ID NO: 15853

SEQ ID NO: 97388 - DNA, 201 bp, Bos taurus; identical to SEQ ID NO: 15854

SEQ ID NO: 97389 - DNA, 201 bp, Bos taurus; identical to SEQ ID NO: 15855

SEQ ID NO: 97390 - DNA, 201 bp, Bos taurus; identical to SEQ ID NO: 15857

SEQ ID NO: 97391 - DNA, 201 bp, Bos taurus
atacttgttagcatctcatataaactctatattgtcacaccccatggtcatgtccctgttctcatcttattcatttttgacatagcaggtatttctcaaagtaaccttttttccctacttccttatctatttctctccaatctcacttggtgttttttacctcttcaaggctgcctggggctgctggtctctcatcccttc

SEQ ID NO: 97392 - DNA, 201 bp, Bos taurus; identical to SEQ ID NO: 15859

SEQ ID NO: 97393 - DNA, 201 bp, Bos taurus; identical to SEQ ID NO: 15860

SEQ ID NO: 97394 - DNA, 201 bp, Bos taurus; identical to SEQ ID NO: 15861

SEQ ID NO: 97395 - DNA, 201 bp, Bos taurus
aatttaccctttctcctgctgtaggacatttgtttctaaattttcattattttccaaacttttgtttccttaaagctatatttctaaagaaatccggactcgatgaaaggcataacattaaagcatctgacatgtattagcaaaatttttaagcttcagcagtttgtatttcctaaagaattaaccttctaatatgaaaac

SEQ ID NO: 97396 - DNA, 201 bp, Bos taurus
atccaaaaacaatttatcctgatgtcttcatctattctttcctttgtgcttttaaatttaatcatcttactctcttatagtcatactttaccagaaagagaaatgactgggttttttctttctctcaggtgaaaattgaatgagaccatatgtgaaatcatttgtgtaatacttttgttctccaagttcaagaggttaaga

SEQ ID NO: 97397 - DNA, 201 bp, Bos taurus
agctgcacagtggccaaggcgggaaaaggtgaagatactaaacttaagagaatttaaatttcttgtccaaagtcgttaacctagtaagctgcaaagctgcatttgaatcttggcctaattccaaagtccatatgcattccactcccctgcactgccctagaaggccctttcactagaccctgtcagcactcagtctctttg

SEQ ID NO: 97398 - DNA, 201 bp, Bos taurus
tgcatggtacctctcagatctcaattagccaccaaagtcgagtagctagaaaaggagtgtgattggagggcatgccatagtttcccttgagaggctcaaggcttcctggggagacctttgtttttctccttcagtggacatgtgtagaggggcagcttctaagaagggatatggccccttttcaagtggctttggagtggc

SEQ ID NO: 97399 - DNA, 201 bp, Bos taurus; identical to SEQ ID NO: 15863

SEQ ID NO: 97400 - DNA, 201 bp, Bos taurus
gatctagaggtcaggattgcagtacttctgtccaggtgttggggaggggagtttggaaaccccaggtttagacaggccagtgtatttctttcttttttttttttttgttgccattattattattatttttttaattggaggataactgctttccagtgttgtgttggtttctactgtacaataaggtgagtcaattataaa

SEQ ID NO: 97401 - DNA, 201 bp, Bos taurus
ctgtcttagcatttcctcttctttgcggcctcgtttccccacccccaatctgtgactattaaccgcactgccagtcaggacttactccagggctgtccatgcagaaagctggcctttccaagctcagatgccctgaataggcttcaggtcacaccatgcttctacttagctttttcagggcttggaatcttgaaagtgttg

SEQ ID NO: 97402 - DNA, 201 bp, Bos taurus
gactcagaggctttcagtcctcttagggaagaagcggtggagtgcttctggagtcgtactgccctgggtgagcctgtgctgccgctccatgcagacccgtgaaatagaaaggccccctcacttgaaagggcagcctgccatcatcctctgtccactaccctgtgttgttattcttctcagtacaacttgtctgcatgtgta

SEQ ID NO: 97403 - DNA, 201 bp, Bos taurus; identical to SEQ ID NO: 15866

SEQ ID NO: 97404 - DNA, 201 bp, Bos taurus; identical to SEQ ID NO: 15867

SEQ ID NO: 97405 - DNA, 201 bp, Bos taurus
gggagctacaaggaggccaacggtggttcactcgatgtaagggtgatctttctatgaattagtagtgtcacacagtgggacagattgcattaggagcagaagaaatattaaggccaagtgttgtattttatctttcaggatatagtcaaaactcttcctctgtggatgagaggttgaccagatcaactctatggccctttc

SEQ ID NO: 97406 - DNA, 201 bp, Bos taurus
tcacttgtctcgcttggacttagcttttcgttttccactttctacttgggtttctctgttttggccaataggtgtgacatggatagggggattacaggccggaggcacgtgaaagctcctgctatttactcagaacggtgtggctgtcacgtcctacattttgcatgtatccgaaggccactcggtgccctgtccacttgg

SEQ ID NO: 97407 - DNA, 201 bp, Bos taurus; identical to SEQ ID NO: 15869

SEQ ID NO: 97408 - DNA, 201 bp, Bos taurus; identical to SEQ ID NO: 15870

SEQ ID NO: 97409 - DNA, 201 bp, Bos taurus; identical to SEQ ID NO: 15871

SEQ ID NO: 97410 - DNA, 201 bp, Bos taurus; identical to SEQ ID NO: 15873

SEQ ID NO: 97411 - DNA, 201 bp, Bos taurus; identical to SEQ ID NO: 15874

SEQ ID NO: 97412 - DNA, 201 bp, Bos taurus; identical to SEQ ID NO: 15875

SEQ ID NO: 97413 - DNA, 201 bp, Bos taurus; identical to SEQ ID NO: 15876

SEQ ID NO: 97414 - DNA, 201 bp, Bos taurus; identical to SEQ ID NO: 15877

SEQ ID NO: 97415 - DNA, 201 bp, Bos taurus; identical to SEQ ID NO: 15878

SEQ ID NO: 97416 - DNA, 201 bp, Bos taurus; identical to SEQ ID NO: 15879

SEQ ID NO: 97417 - DNA, 201 bp, Bos taurus; identical to SEQ ID NO: 15880

SEQ ID NO: 97418 - DNA, 201 bp, Bos taurus; identical to SEQ ID NO: 15881

SEQ ID NO: 97419 - DNA, 201 bp, Bos taurus; identical to SEQ ID NO: 15882

SEQ ID NO: 97420 - DNA, 201 bp, Bos taurus; identical to SEQ ID NO: 15883

SEQ ID NO: 97421 - DNA, 201 bp, Bos taurus; identical to SEQ ID NO: 15884

SEQ ID NO: 97422 - DNA, 201 bp, Bos taurus; identical to SEQ ID NO: 15885

SEQ ID NO: 97423 - DNA, 201 bp, Bos taurus; identical to SEQ ID NO: 15887

SEQ ID NO: 97424 - DNA, 201 bp, Bos taurus
cataagcagtaagtactaatgcactaatgcacacaggatttgaattcctgtgtgacgccactataacttaagggcatagcaaaatcttgtgaaccatctacagcagagttgggcaagcttaggcctgaaagctaaggatatttttacttttttaaaatggttgaaaactttgtgtttcctggcttagctggaaaagtgtca

SEQ ID NO: 97425 - DNA, 201 bp, Bos taurus
aaggaagtatgccagtgtggaggccatagtaatccaaggacattttaagaaacactgacccaaggataaccagtgatcactataaacacattctatgtatatattcttgactactaagagtgtttagggctccatgtgtctgtttattcatctgttctctaccatctattaacagttgaacaaagtaaatcctgatatggc

SEQ ID NO: 97426 - DNA, 201 bp, Bos taurus; identical to SEQ ID NO: 15888

SEQ ID NO: 97427 - DNA, 201 bp, Bos taurus
tgtaaatgtagtgaagccattagccagcatttcctgcctctgcccctccccctcagtgcacagtgtggctgagactcggcaaaggtgaggtcgggaggtgaaagggctctgagaggtcaggaatactagtaagtccagagatcagagattcgaggacaataaatgttgattggtttgataggaaggtaagagaagatgaac

SEQ ID NO: 97428 - DNA, 201 bp, Bos taurus
atacagcagcacttaccaacatgcccttaaagggaccgactgcagccatgctgcctcctgattctagaccagcagttcgtttcaaactatcatttaccaatggcctaccaggtatataacccatattataactgtcaaggactgtcccttggccattcccaggctaactgcccttaaattctgtctcaacaaccttaattc

SEQ ID NO: 97429 - DNA, 201 bp, Bos taurus; identical to SEQ ID NO: 15890

SEQ ID NO: 97430 - DNA, 201 bp, Bos taurus; identical to SEQ ID NO: 56682

SEQ ID NO: 97431 - DNA, 201 bp, Bos taurus; identical to SEQ ID NO: 15892

SEQ ID NO: 97432 - DNA, 201 bp, Bos taurus; identical to SEQ ID NO: 15893

SEQ ID NO: 97433 - DNA, 201 bp, Bos taurus; identical to SEQ ID NO: 15897

SEQ ID NO: 97434 - DNA, 201 bp, Bos taurus; identical to SEQ ID NO: 15898

SEQ ID NO: 97435 - DNA, 201 bp, Bos taurus; identical to SEQ ID NO: 15899

SEQ ID NO: 97436 - DNA, 201 bp, Bos taurus; identical to SEQ ID NO: 15900

SEQ ID NO: 97437 - DNA, 201 bp, Bos taurus; identical to SEQ ID NO: 15901

SEQ ID NO: 97438 - DNA, 201 bp, Bos taurus; identical to SEQ ID NO: 15902

SEQ ID NO: 97439 - DNA, 201 bp, Bos taurus; identical to SEQ ID NO: 15903

SEQ ID NO: 97440 - DNA, 201 bp, Bos taurus; identical to SEQ ID NO: 15905

SEQ ID NO: 97441 - DNA, 201 bp, Bos taurus
tattttagatttttcttcaaacagcatttagttgaacttcatttcttcttatctgaaaatttttgtcttttaattgaagcatttgtcctattgacaataatattacaaataattttgtgtttaaattcatcattttacagtttgctttctattagttccaccagttctttgttgtctttttcttctttcttgattttagat

SEQ ID NO: 97442 - DNA, 201 bp, Bos taurus; identical to SEQ ID NO: 15906

SEQ ID NO: 97443 - DNA, 201 bp, Bos taurus
acagcatactgaagatcctaacaagttaaaaaaaaaatagacaaaacccacaaagaaaatcaaaagtacatcgctattagaaagaaagaaaccaattgattataatttgtaagcaatacaatgatctatagaaaagctcaatggctcagtgggtaaagaatctgcctgcagtgcaggagacacatgggttcaatccttggg

SEQ ID NO: 97444 - DNA, 201 bp, Bos taurus; identical to SEQ ID NO: 15907

SEQ ID NO: 97445 - DNA, 201 bp, Bos taurus; identical to SEQ ID NO: 15908

SEQ ID NO: 97446 - DNA, 201 bp, Bos taurus
ccgacgggatcagcaccagtccatggcctggaagctgggacccctcttctagaagcatttctaacagaggaagttacagattgtttacaacaaaaacagtatttatgtaaatatatggagtaaggaggtagctgcccaaggtagtgggacaacacttaaattgaatagctgtggtaatatttctaagtcagtcacattatt

SEQ ID NO: 97447 - DNA, 201 bp, Bos taurus
tgaacatacagagaaatgcatttttaagtcttgacagtacacttaaagatactgtccagcaaattttcactgatttggccattttcatgttctcagttcacaaaactgtctataataataatagcaggagtccaaccataagttataagaatgcatttggtattatgaatttaaataaattcctagtaaaaggccaccata

SEQ ID NO: 97448 - DNA, 201 bp, Bos taurus; identical to SEQ ID NO: 15911

SEQ ID NO: 97449 - DNA, 201 bp, Bos taurus
gttaaccttttttagcgaatttaataaatgataccttccttaaaccagaagtgtggtaagtagggaaatagtctgcaacttaaaatacttgaaaaattactaacactcacatgaaaagatgcttcgatttaaaaagcaaaggtcatggaaaagaatttgaaaaagaataggtgtatatatatacggctgagtcccttcgct

SEQ ID NO: 97450 - DNA, 201 bp, Bos taurus; identical to SEQ ID NO: 15915

SEQ ID NO: 97451 - DNA, 201 bp, Bos taurus; identical to SEQ ID NO: 15917

SEQ ID NO: 97452 - DNA, 201 bp, Bos taurus; identical to SEQ ID NO: 15918

SEQ ID NO: 97453 - DNA, 201 bp, Bos taurus; identical to SEQ ID NO: 15919

SEQ ID NO: 97454 - DNA, 201 bp, Bos taurus; identical to SEQ ID NO: 15920

SEQ ID NO: 97455 - DNA, 201 bp, Bos taurus; identical to SEQ ID NO: 15921

SEQ ID NO: 97456 - DNA, 201 bp, Bos taurus; identical to SEQ ID NO: 15922

SEQ ID NO: 97457 - DNA, 201 bp, Bos taurus; identical to SEQ ID NO: 15923

SEQ ID NO: 97458 - DNA, 201 bp, Bos taurus; identical to SEQ ID NO: 15924

SEQ ID NO: 97459 - DNA, 201 bp, Bos taurus; identical to SEQ ID NO: 15925

SEQ ID NO: 97460 - DNA, 201 bp, Bos taurus; identical to SEQ ID NO: 15927

SEQ ID NO: 97461 - DNA, 201 bp, Bos taurus; identical to SEQ ID NO: 15928

SEQ ID NO: 97462 - DNA, 201 bp, Bos taurus; identical to SEQ ID NO: 15929

SEQ ID NO: 97463 - DNA, 201 bp, Bos taurus; identical to SEQ ID NO: 15930

SEQ ID NO: 97464 - DNA, 201 bp, Bos taurus; identical to SEQ ID NO: 15931

SEQ ID NO: 97465 - DNA, 201 bp, Bos taurus; identical to SEQ ID NO: 15936

SEQ ID NO: 97466 - DNA, 201 bp, Bos taurus; identical to SEQ ID NO: 15939

SEQ ID NO: 97467 - DNA, 201 bp, Bos taurus; identical to SEQ ID NO: 15940

SEQ ID NO: 97468 - DNA, 201 bp, Bos taurus; identical to SEQ ID NO: 15941

SEQ ID NO: 97469 - DNA, 201 bp, Bos taurus; identical to SEQ ID NO: 15942

SEQ ID NO: 97470 - DNA, 201 bp, Bos taurus; identical to SEQ ID NO: 15943

SEQ ID NO: 97471 - DNA, 201 bp, Bos taurus; identical to SEQ ID NO: 15944

SEQ ID NO: 97472 - DNA, 201 bp, Bos taurus; identical to SEQ ID NO: 15945

SEQ ID NO: 97473 - DNA, 201 bp, Bos taurus; identical to SEQ ID NO: 15946

SEQ ID NO: 97474 - DNA, 201 bp, Bos taurus; identical to SEQ ID NO: 15947

SEQ ID NO: 97475 - DNA, 201 bp, Bos taurus; identical to SEQ ID NO: 15948

SEQ ID NO: 97476 - DNA, 201 bp, Bos taurus; identical to SEQ ID NO: 15949

SEQ ID NO: 97477 - DNA, 201 bp, Bos taurus; identical to SEQ ID NO: 15950

SEQ ID NO: 97478 - DNA, 201 bp, Bos taurus; identical to SEQ ID NO: 15951

SEQ ID NO: 97479 - DNA, 201 bp, Bos taurus; identical to SEQ ID NO: 15952

SEQ ID NO: 97480 - DNA, 201 bp, Bos taurus; identical to SEQ ID NO: 15953

SEQ ID NO: 97481 - DNA, 201 bp, Bos taurus; identical to SEQ ID NO: 15954

SEQ ID NO: 97482 - DNA, 201 bp, Bos taurus; identical to SEQ ID NO: 15955

SEQ ID NO: 97483 - DNA, 201 bp, Bos taurus; identical to SEQ ID NO: 15956

SEQ ID NO: 97484 - DNA, 201 bp, Bos taurus; identical to SEQ ID NO: 15957

SEQ ID NO: 97485 - DNA, 201 bp, Bos taurus; identical to SEQ ID NO: 15958

SEQ ID NO: 97486 - DNA, 201 bp, Bos taurus; identical to SEQ ID NO: 15959

SEQ ID NO: 97487 - DNA, 201 bp, Bos taurus; identical to SEQ ID NO: 15960

SEQ ID NO: 97488 - DNA, 201 bp, Bos taurus
atgaactggacctcgatagatagagtcagggtgagaaaggggaagcatacaattgtggtgggagcagggacaagaaggggcctatgaatggtgctcagggcaggttctgatgtgattctaccagctgttcagggagagatgactcctgccccaggccatctcttggggcagtgagtaagtgactcacatctaacccttgct

SEQ ID NO: 97489 - DNA, 201 bp, Bos taurus; identical to SEQ ID NO: 15963

SEQ ID NO: 97490 - DNA, 201 bp, Bos taurus; identical to SEQ ID NO: 15964

SEQ ID NO: 97491 - DNA, 201 bp, Bos taurus; identical to SEQ ID NO: 15965

SEQ ID NO: 97492 - DNA, 201 bp, Bos taurus; identical to SEQ ID NO: 15966

SEQ ID NO: 97493 - DNA, 201 bp, Bos taurus; identical to SEQ ID NO: 15970

SEQ ID NO: 97494 - DNA, 201 bp, Bos taurus; identical to SEQ ID NO: 15971

SEQ ID NO: 97495 - DNA, 201 bp, Bos taurus; identical to SEQ ID NO: 15973

SEQ ID NO: 97496 - DNA, 201 bp, Bos taurus; identical to SEQ ID NO: 15974

SEQ ID NO: 97497 - DNA, 201 bp, Bos taurus; identical to SEQ ID NO: 15975

SEQ ID NO: 97498 - DNA, 201 bp, Bos taurus; identical to SEQ ID NO: 15976

SEQ ID NO: 97499 - DNA, 201 bp, Bos taurus; identical to SEQ ID NO: 15979

SEQ ID NO: 97500 - DNA, 201 bp, Bos taurus; identical to SEQ ID NO: 15981

SEQ ID NO: 97501 - DNA, 201 bp, Bos taurus; identical to SEQ ID NO: 15982

SEQ ID NO: 97502 - DNA, 201 bp, Bos taurus; identical to SEQ ID NO: 15983

SEQ ID NO: 97503 - DNA, 201 bp, Bos taurus; identical to SEQ ID NO: 15985

SEQ ID NO: 97504 - DNA, 201 bp, Bos taurus; identical to SEQ ID NO: 15988

SEQ ID NO: 97505 - DNA, 201 bp, Bos taurus; identical to SEQ ID NO: 15991

SEQ ID NO: 97506 - DNA, 201 bp, Bos taurus; identical to SEQ ID NO: 15995

SEQ ID NO: 97507 - DNA, 201 bp, Bos taurus; identical to SEQ ID NO: 15997

SEQ ID NO: 97508 - DNA, 201 bp, Bos taurus; identical to SEQ ID NO: 15998

SEQ ID NO: 97509 - DNA, 201 bp, Bos taurus; identical to SEQ ID NO: 15999

SEQ ID NO: 97510 - DNA, 201 bp, Bos taurus; identical to SEQ ID NO: 16001

SEQ ID NO: 97511 - DNA, 201 bp, Bos taurus; identical to SEQ ID NO: 16002

SEQ ID NO: 97512 - DNA, 201 bp, Bos taurus; identical to SEQ ID NO: 16003

SEQ ID NO: 97513 - DNA, 201 bp, Bos taurus; identical to SEQ ID NO: 16005

SEQ ID NO: 97514 - DNA, 201 bp, Bos taurus; identical to SEQ ID NO: 16006

SEQ ID NO: 97515 - DNA, 201 bp, Bos taurus; identical to SEQ ID NO: 16008

SEQ ID NO: 97516 - DNA, 201 bp, Bos taurus; identical to SEQ ID NO: 16010

SEQ ID NO: 97517 - DNA, 201 bp, Bos taurus; identical to SEQ ID NO: 16011

SEQ ID NO: 97518 - DNA, 201 bp, Bos taurus; identical to SEQ ID NO: 16013

SEQ ID NO: 97519 - DNA, 201 bp, Bos taurus; identical to SEQ ID NO: 16014

SEQ ID NO: 97520 - DNA, 201 bp, Bos taurus; identical to SEQ ID NO: 16015

SEQ ID NO: 97521 - DNA, 201 bp, Bos taurus; identical to SEQ ID NO: 16016

SEQ ID NO: 97522 - DNA, 201 bp, Bos taurus; identical to SEQ ID NO: 16017

SEQ ID NO: 97523 - DNA, 201 bp, Bos taurus; identical to SEQ ID NO: 16018

SEQ ID NO: 97524 - DNA, 201 bp, Bos taurus; identical to SEQ ID NO: 16019

SEQ ID NO: 97525 - DNA, 201 bp, Bos taurus; identical to SEQ ID NO: 16023

SEQ ID NO: 97526 - DNA, 201 bp, Bos taurus; identical to SEQ ID NO: 16024

SEQ ID NO: 97527 - DNA, 201 bp, Bos taurus; identical to SEQ ID NO: 16027

SEQ ID NO: 97528 - DNA, 201 bp, Bos taurus; identical to SEQ ID NO: 16028

SEQ ID NO: 97529 - DNA, 201 bp, Bos taurus; identical to SEQ ID NO: 16029

SEQ ID NO: 97530 - DNA, 201 bp, Bos taurus; identical to SEQ ID NO: 16030

SEQ ID NO: 97531 - DNA, 201 bp, Bos taurus; identical to SEQ ID NO: 16031

SEQ ID NO: 97532 - DNA, 201 bp, Bos taurus
aaattcaagctacagaacaggcacttaaagcatgttacataagagaggagcagcttcatctggggcgtggacattagccaaaatgctggccttcagtgtctctagaccaggcaggtatcaagagcccatgtaaatccagcccagagtagggagacacactgtggtcaggctcactggcagcccttccaacctccagatacc

SEQ ID NO: 97533 - DNA, 201 bp, Bos taurus
gtggggtgagaagcacctctctgctagacgcacaaggccctgggcacacagggtgcctttcaccgcctgatgtcagacttgcttctctgtgccctcagcattcaacccctcatgcttcccaggcctgtaggattttctggtcatgtctgggcagatctttctctctgcgtctgctgaaacctggaagagtgagattcgcca

SEQ ID NO: 97534 - DNA, 201 bp, Bos taurus; identical to SEQ ID NO: 16034

SEQ ID NO: 97535 - DNA, 201 bp, Bos taurus; identical to SEQ ID NO: 16037

SEQ ID NO: 97536 - DNA, 201 bp, Bos taurus
aacagatgagatctactttcctcatttaggcatatgaggaaggttgtgggtcccttgctttctattcaccccatgtcagtgtgggtaacatgtcagaagcgggaccccacatagctactaagaaaggataattgctcttcaaacactgtaaagagacagcaggcaaagcacaagggttgggacagtgcaacaggacacctg

SEQ ID NO: 97537 - DNA, 201 bp, Bos taurus
acacgactgagcgacttcactttcactttcctacagctttacagggaacacactatttctccgtccctaaacattgggctgagtcattgatttggccaattcggacacaacacgaataagatataaatgtgcttgcacatttggcttgccacatgccatgaaaagaacctgccctatcaagtcactggtccaaggaggata

SEQ ID NO: 97538 - DNA, 201 bp, Bos taurus; identical to SEQ ID NO: 16039

SEQ ID NO: 97539 - DNA, 201 bp, Bos taurus
gccaggggccagtgaccttcctactagatgccaaattctatggtaagtgctttacctgtgttatcttatttgatttctagaataatcttttgcggaagatattgcaggtcctcaggcccttagccaaaaattctcggggtctgttgtgttcaaaattaagccttttcctctcagattttagaaaaagaataatacggtata

SEQ ID NO: 97540 - DNA, 201 bp, Bos taurus; identical to SEQ ID NO: 16040

SEQ ID NO: 97541 - DNA, 201 bp, Bos taurus; identical to SEQ ID NO: 16041

SEQ ID NO: 97542 - DNA, 201 bp, Bos taurus
aaattttaatacttaataatgttcaacttttaatttttggcatttagatggtcttctgattgttggtgttcactcggccaagtttccaaatgaaaaagtcctggataacattaggagtgctgttcttcgatacaacatcacccaccctgtggttaatgatgcagatgccagcctttggcaagaactagaagtttcctgctg

SEQ ID NO: 97543 - DNA, 201 bp, Bos taurus; identical to SEQ ID NO: 16043

SEQ ID NO: 97544 - DNA, 201 bp, Bos taurus; identical to SEQ ID NO: 16044

SEQ ID NO: 97545 - DNA, 201 bp, Bos taurus; identical to SEQ ID NO: 16048

SEQ ID NO: 97546 - DNA, 201 bp, Bos taurus; identical to SEQ ID NO: 16049

SEQ ID NO: 97547 - DNA, 201 bp, Bos taurus; identical to SEQ ID NO: 16050

SEQ ID NO: 97548 - DNA, 201 bp, Bos taurus; identical to SEQ ID NO: 16051

SEQ ID NO: 97549 - DNA, 201 bp, Bos taurus
catccttgctcaaaatccacgtgctttcagcagtagtgttactgtttcagaatgtcagctgctgagcaatagttttgtcatgctttgccttcaacattgtattatttttagtatgaattatatgcagtggatttatgttatctttttgtgctatatgtttctagttattcaccaaacctttgacagtagtaagtcttcaca

SEQ ID NO: 97550 - DNA, 201 bp, Bos taurus; identical to SEQ ID NO: 16052

SEQ ID NO: 97551 - DNA, 201 bp, Bos taurus; identical to SEQ ID NO: 16054

SEQ ID NO: 97552 - DNA, 201 bp, Bos taurus; identical to SEQ ID NO: 16055

SEQ ID NO: 97553 - DNA, 201 bp, Bos taurus; identical to SEQ ID NO: 16057

SEQ ID NO: 97554 - DNA, 201 bp, Bos taurus
aggcccctgcagaaagctgccgtggccaggaggacattttttttttttcctatgctccaccaaggggtaattcttttaaagttctcacatttgttttgtattgatcagcacttgaggccagagcactcttctggatctcttactctgtactgtgtactatgttccccacccaacacatactcccaactctttcctctctca

SEQ ID NO: 97555 - DNA, 201 bp, Bos taurus
cttgagggctgtgctctcctcaacccactgcagtctggtttcttccccagtcctgctagcaaaaccactaagaccaccaacggcttcttagtgggactcttccaggcctttcccatctttgctttccttggcccctctgcagaatttgactcgctagcctcctcactggtgggacaccctcccttggttcctgtggtttcc

SEQ ID NO: 97556 - DNA, 201 bp, Bos taurus; identical to SEQ ID NO: 16059

SEQ ID NO: 97557 - DNA, 201 bp, Bos taurus; identical to SEQ ID NO: 16060

SEQ ID NO: 97558 - DNA, 201 bp, Bos taurus; identical to SEQ ID NO: 16061

SEQ ID NO: 97559 - DNA, 201 bp, Bos taurus; identical to SEQ ID NO: 16062

SEQ ID NO: 97560 - DNA, 201 bp, Bos taurus; identical to SEQ ID NO: 16063

SEQ ID NO: 97561 - DNA, 201 bp, Bos taurus; identical to SEQ ID NO: 16064

SEQ ID NO: 97562 - DNA, 201 bp, Bos taurus; identical to SEQ ID NO: 16065

SEQ ID NO: 97563 - DNA, 201 bp, Bos taurus; identical to SEQ ID NO: 16066

SEQ ID NO: 97564 - DNA, 201 bp, Bos taurus
cggtaagtccatctgtccttcctctatcttgcctccaaatgggtccaacaaactgctgggcagaaacaagcaaaatttagttaaggctcacagagaactttaatttcaggaaggccatgctcactaattcccaggaagatgccttgtttaggggaggagttgggggtgggtggatggctggagcgggtcaccctgtggacc

SEQ ID NO: 97565 - DNA, 201 bp, Bos taurus; identical to SEQ ID NO: 16069

SEQ ID NO: 97566 - DNA, 201 bp, Bos taurus; identical to SEQ ID NO: 16070

SEQ ID NO: 97567 - DNA, 201 bp, Bos taurus; identical to SEQ ID NO: 16071

SEQ ID NO: 97568 - DNA, 201 bp, Bos taurus; identical to SEQ ID NO: 16072

SEQ ID NO: 97569 - DNA, 201 bp, Bos taurus; identical to SEQ ID NO: 16073

SEQ ID NO: 97570 - DNA, 201 bp, Bos taurus; identical to SEQ ID NO: 16074

SEQ ID NO: 97571 - DNA, 201 bp, Bos taurus; identical to SEQ ID NO: 16075

SEQ ID NO: 97572 - DNA, 201 bp, Bos taurus; identical to SEQ ID NO: 16076

SEQ ID NO: 97573 - DNA, 201 bp, Bos taurus; identical to SEQ ID NO: 16077

SEQ ID NO: 97574 - DNA, 201 bp, Bos taurus; identical to SEQ ID NO: 16078

SEQ ID NO: 97575 - DNA, 201 bp, Bos taurus; identical to SEQ ID NO: 16079

SEQ ID NO: 97576 - DNA, 201 bp, Bos taurus; identical to SEQ ID NO: 16080

SEQ ID NO: 97577 - DNA, 201 bp, Bos taurus; identical to SEQ ID NO: 16081

SEQ ID NO: 97578 - DNA, 201 bp, Bos taurus; identical to SEQ ID NO: 16082

SEQ ID NO: 97579 - DNA, 201 bp, Bos taurus; identical to SEQ ID NO: 16083

SEQ ID NO: 97580 - DNA, 201 bp, Bos taurus; identical to SEQ ID NO: 16084

SEQ ID NO: 97581 - DNA, 201 bp, Bos taurus; identical to SEQ ID NO: 16085

SEQ ID NO: 97582 - DNA, 201 bp, Bos taurus; identical to SEQ ID NO: 16086

SEQ ID NO: 97583 - DNA, 201 bp, Bos taurus; identical to SEQ ID NO: 16087

SEQ ID NO: 97584 - DNA, 201 bp, Bos taurus; identical to SEQ ID NO: 16088

SEQ ID NO: 97585 - DNA, 201 bp, Bos taurus; identical to SEQ ID NO: 16089

SEQ ID NO: 97586 - DNA, 201 bp, Bos taurus; identical to SEQ ID NO: 16090

SEQ ID NO: 97587 - DNA, 201 bp, Bos taurus; identical to SEQ ID NO: 16091

SEQ ID NO: 97588 - DNA, 201 bp, Bos taurus; identical to SEQ ID NO: 16092

SEQ ID NO: 97589 - DNA, 201 bp, Bos taurus; identical to SEQ ID NO: 16093

SEQ ID NO: 97590 - DNA, 201 bp, Bos taurus; identical to SEQ ID NO: 16094

SEQ ID NO: 97591 - DNA, 201 bp, Bos taurus; identical to SEQ ID NO: 16095

SEQ ID NO: 97592 - DNA, 201 bp, Bos taurus; identical to SEQ ID NO: 16096

SEQ ID NO: 97593 - DNA, 201 bp, Bos taurus; identical to SEQ ID NO: 16097

SEQ ID NO: 97594 - DNA, 201 bp, Bos taurus; identical to SEQ ID NO: 16098

SEQ ID NO: 97595 - DNA, 201 bp, Bos taurus; identical to SEQ ID NO: 16099

SEQ ID NO: 97596 - DNA, 201 bp, Bos taurus; identical to SEQ ID NO: 16100

SEQ ID NO: 97597 - DNA, 201 bp, Bos taurus; identical to SEQ ID NO: 16101

SEQ ID NO: 97598 - DNA, 201 bp, Bos taurus; identical to SEQ ID NO: 16103

SEQ ID NO: 97599 - DNA, 201 bp, Bos taurus; identical to SEQ ID NO: 16104

SEQ ID NO: 97600 - DNA, 201 bp, Bos taurus; identical to SEQ ID NO: 16105

SEQ ID NO: 97601 - DNA, 201 bp, Bos taurus; identical to SEQ ID NO: 16106

SEQ ID NO: 97602 - DNA, 201 bp, Bos taurus; identical to SEQ ID NO: 16107

SEQ ID NO: 97603 - DNA, 201 bp, Bos taurus; identical to SEQ ID NO: 16108

SEQ ID NO: 97604 - DNA, 201 bp, Bos taurus; identical to SEQ ID NO: 16109

SEQ ID NO: 97605 - DNA, 201 bp, Bos taurus; identical to SEQ ID NO: 16110

SEQ ID NO: 97606 - DNA, 201 bp, Bos taurus; identical to SEQ ID NO: 16111

SEQ ID NO: 97607 - DNA, 201 bp, Bos taurus
ggttttgacctcctagcctcctcctcaccccgattcacctgccgtccaggggaagggatcttgtcgaggtggccagagcatgatccaggcccttgaccctcttctcctggaaacaacactgctgaggtttcctttgtcctcggggctccacccgctttgttctctctgtgacttcctcctcccgtgcctgttcctctgggc

SEQ ID NO: 97608 - DNA, 201 bp, Bos taurus
ccacatcttgccttgggtggctcatcagggggtcatgctggactgggcgtcatgtttgactctcgtttagctcctggcctcctctctgtttatcatcatgcttagtcatgtctgactctttgtgacccctgtggactgcagcatgccaggcctccgtgtccatcaccaactcctggagcttgctgatttccattgagttgg

SEQ ID NO: 97609 - DNA, 201 bp, Bos taurus; identical to SEQ ID NO: 16112

SEQ ID NO: 97610 - DNA, 201 bp, Bos taurus
tgcgagttgtaagttcacgattgatgggaagccagttgtctagttgtttgtgccatgccatttcaacatggaaaaaagagaaaagcaaaaagccacatctgtacgaaccactctcgtatcgcttgaaaaaagaagagatacattggtgagtctggcacaaacccaatgaaattgatatgccatgatataaaattgagaggt

SEQ ID NO: 97611 - DNA, 201 bp, Bos taurus; identical to SEQ ID NO: 16113

SEQ ID NO: 97612 - DNA, 201 bp, Bos taurus; identical to SEQ ID NO: 16114

SEQ ID NO: 97613 - DNA, 201 bp, Bos taurus
gacattcaccccggagacctggacacacaggctcaaacagacagtgcgacttctacccttaaaaatgattaaagtggcaaattttaaataaaggccagaggaaaagcaaccagccagccagtcaggagagcgaccattccatcagaggctaccttctcacgcctcgattcaaccgcaaggcctccttatcaattgacaccc

SEQ ID NO: 97614 - DNA, 201 bp, Bos taurus; identical to SEQ ID NO: 16115

SEQ ID NO: 97615 - DNA, 201 bp, Bos taurus; identical to SEQ ID NO: 16116

SEQ ID NO: 97616 - DNA, 201 bp, Bos taurus; identical to SEQ ID NO: 16117

SEQ ID NO: 97617 - DNA, 201 bp, Bos taurus; identical to SEQ ID NO: 16118

SEQ ID NO: 97618 - DNA, 201 bp, Bos taurus; identical to SEQ ID NO: 16119

SEQ ID NO: 97619 - DNA, 201 bp, Bos taurus; identical to SEQ ID NO: 16120

SEQ ID NO: 97620 - DNA, 201 bp, Bos taurus; identical to SEQ ID NO: 16122

SEQ ID NO: 97621 - DNA, 201 bp, Bos taurus; identical to SEQ ID NO: 16123

SEQ ID NO: 97622 - DNA, 201 bp, Bos taurus; identical to SEQ ID NO: 16124

SEQ ID NO: 97623 - DNA, 201 bp, Bos taurus; identical to SEQ ID NO: 16125

SEQ ID NO: 97624 - DNA, 201 bp, Bos taurus; identical to SEQ ID NO: 16126

SEQ ID NO: 97625 - DNA, 201 bp, Bos taurus; identical to SEQ ID NO: 16129

SEQ ID NO: 97626 - DNA, 201 bp, Bos taurus; identical to SEQ ID NO: 16131

SEQ ID NO: 97627 - DNA, 201 bp, Bos taurus; identical to SEQ ID NO: 16132

SEQ ID NO: 97628 - DNA, 201 bp, Bos taurus; identical to SEQ ID NO: 16134

SEQ ID NO: 97629 - DNA, 201 bp, Bos taurus; identical to SEQ ID NO: 16135

SEQ ID NO: 97630 - DNA, 201 bp, Bos taurus; identical to SEQ ID NO: 16136

SEQ ID NO: 97631 - DNA, 201 bp, Bos taurus; identical to SEQ ID NO: 16137

SEQ ID NO: 97632 - DNA, 201 bp, Bos taurus; identical to SEQ ID NO: 16142

SEQ ID NO: 97633 - DNA, 201 bp, Bos taurus; identical to SEQ ID NO: 16143

SEQ ID NO: 97634 - DNA, 201 bp, Bos taurus; identical to SEQ ID NO: 16145

SEQ ID NO: 97635 - DNA, 201 bp, Bos taurus; identical to SEQ ID NO: 16146

SEQ ID NO: 97636 - DNA, 201 bp, Bos taurus
acgggagacacacggggaccctcaggaggtggcagagcttcacaagtgggagacgagaagcccgacgtccaacgccactgggccacacgcagaaacgacttagagcaaacacagcccagcacccttgagactcacaccccggatccaagcagggctctgggcaccagggatgcaggcggagccagggcctggctgaccacc

SEQ ID NO: 97637 - DNA, 201 bp, Bos taurus; identical to SEQ ID NO: 16148

SEQ ID NO: 97638 - DNA, 201 bp, Bos taurus; identical to SEQ ID NO: 16149

SEQ ID NO: 97639 - DNA, 201 bp, Bos taurus; identical to SEQ ID NO: 16150

SEQ ID NO: 97640 - DNA, 201 bp, Bos taurus; identical to SEQ ID NO: 16151

SEQ ID NO: 97641 - DNA, 201 bp, Bos taurus; identical to SEQ ID NO: 16152

SEQ ID NO: 97642 - DNA, 201 bp, Bos taurus; identical to SEQ ID NO: 16153

SEQ ID NO: 97643 - DNA, 201 bp, Bos taurus; identical to SEQ ID NO: 16154

SEQ ID NO: 97644 - DNA, 201 bp, Bos taurus; identical to SEQ ID NO: 16155

SEQ ID NO: 97645 - DNA, 201 bp, Bos taurus; identical to SEQ ID NO: 16156

SEQ ID NO: 97646 - DNA, 201 bp, Bos taurus; identical to SEQ ID NO: 16157

SEQ ID NO: 97647 - DNA, 201 bp, Bos taurus; identical to SEQ ID NO: 16159

SEQ ID NO: 97648 - DNA, 201 bp, Bos taurus; identical to SEQ ID NO: 16160

SEQ ID NO: 97649 - DNA, 201 bp, Bos taurus; identical to SEQ ID NO: 16161

SEQ ID NO: 97650 - DNA, 201 bp, Bos taurus; identical to SEQ ID NO: 16162

SEQ ID NO: 97651 - DNA, 201 bp, Bos taurus
agatgaagtgcatgaagaatggatccagttttgacaggagcaggagatactaatcacaaaattattctagaataaacacaatgacagtctaagtgagtaaaaagaagagactaggaatgtgttatttcttgaagaagctcttaggcaccttgtatgggtgctctcagctaaaagaactgcaacggagaaaaggccagacac

SEQ ID NO: 97652 - DNA, 201 bp, Bos taurus
ttcttacttgctacaggttataaatccttccttctcctactctttgccttggttgtgtctttgggattgacactaaccaagagagagaaccagttttgggtaacatgcaaaaatagcaaagataatccaacataacaatttggtttttacatgtaaactattgaaatgtctttctaatgtgaaattaattgtcaagaacaa

SEQ ID NO: 97653 - DNA, 201 bp, Bos taurus
tctccttccctgcatctctctgagccctgagatcccagccttgaaggctagaatcagggagcatccttgctctctgactgctgcactgaaaaaaggagggggtcaaggtcagggtcacattcctacagataagtgcccatttagtgcaaacacagctccctcctgtgagcaggcctctcctgtgggcacatttctacctcc

SEQ ID NO: 97654 - DNA, 201 bp, Bos taurus; identical to SEQ ID NO: 16164

SEQ ID NO: 97655 - DNA, 201 bp, Bos taurus
acctcaaactttaaaaatctctcaatactgatcagtttctacacctgatagaagatattctcacttttaagcaaaaagttttctgatcaccacacattctgatttgtgagggattatcttactaagacaaaaaaggcaaagtacaaatgtgtcccagggatggacctttccctcctaatcagacagaaagcatgaggataa

SEQ ID NO: 97656 - DNA, 201 bp, Bos taurus
ctcacattcacaactcttttcaggggtctctcaggacccttcccaccaccgcctccccagccaaacctgcagaagggagtgaagggcaagttacaggtcctggccttgtgtggtcaccttcacagcaaggaacacactggcagggtgaacttttattctcccaaagcagccatcttattgatgctgtggtttagttgctaa

SEQ ID NO: 97657 - DNA, 201 bp, Bos taurus; identical to SEQ ID NO: 16165

SEQ ID NO: 97658 - DNA, 201 bp, Bos taurus; identical to SEQ ID NO: 16168

SEQ ID NO: 97659 - DNA, 201 bp, Bos taurus
ttaataatccaaaaactgtggaaacagtaaattatcaagaaaacaagaaatgacgtgtttattgaaatttgcagcactcacccttggactagagatgtcatttcattcacccctactctgccaagcctagattactacatttgattttcaaatctctcaattactgctaataaatgtctacatggcagcactgactcagtc

SEQ ID NO: 97660 - DNA, 201 bp, Bos taurus
gaaccagacagcaacggccaggttagctaagggtcaggtggcttgctgtgctgcccatcagatgtcttcttccagaaagtacgcacagccatgaacacaccgaagctgtcagtgaaggccacctgctgggcttactggaacatgcaaatgttgacacattaaagacttagcttccctgcattttgttcctgtgacagtgca

SEQ ID NO: 97661 - DNA, 201 bp, Bos taurus; identical to SEQ ID NO: 16171

SEQ ID NO: 97662 - DNA, 201 bp, Bos taurus; identical to SEQ ID NO: 16172

SEQ ID NO: 97663 - DNA, 201 bp, Bos taurus; identical to SEQ ID NO: 16174

SEQ ID NO: 97664 - DNA, 201 bp, Bos taurus; identical to SEQ ID NO: 16175

SEQ ID NO: 97665 - DNA, 201 bp, Bos taurus; identical to SEQ ID NO: 16176

SEQ ID NO: 97666 - DNA, 201 bp, Bos taurus; identical to SEQ ID NO: 16177

SEQ ID NO: 97667 - DNA, 201 bp, Bos taurus; identical to SEQ ID NO: 16178

SEQ ID NO: 97668 - DNA, 201 bp, Bos taurus
cgggggtgacagggtctgcgcaggatcgactgagatacgggccggggatgccccactctgctccgaagttctgagtcatcaccagtttcacaagcaatcgcgggggtaggcactccagggccggtgcaagaagctttctgttaagaataaatgtgccctaaattactcttaaatagccaacaccattttgagttgttggag

SEQ ID NO: 97669 - DNA, 201 bp, Bos taurus; identical to SEQ ID NO: 16182

SEQ ID NO: 97670 - DNA, 201 bp, Bos taurus
atatgaatgaggacagatgactgtaaatattgggatgcgtttatcatacacccacttcaaggcaattaactaatttattcttaaaaaaaaaaggtgtcgtcgtgttctataccataaaataaaaaagtgagcacacagagattcagtatcttggaactaggatttggacccaggcaacgctccaaagcctgtgcttttaat

SEQ ID NO: 97671 - DNA, 201 bp, Bos taurus
gttatgatgaaaccattttatttttcagaaagtctttgccttctccccatcctagtcccatcagcagatgtggaagcaggactcatcagagagcaaatttaggagtggtacagggggctctctgggtttgggtcacaccggattttcctcaatggtcccaaacaggaatgtcaggacggtcacctcaaacaggagatgaca

SEQ ID NO: 97672 - DNA, 201 bp, Bos taurus; identical to SEQ ID NO: 16183

SEQ ID NO: 97673 - DNA, 201 bp, Bos taurus
ccacatccatcaccctggatggaaggtggaaatcaccctgcttgctggccagcagcattcagcatccccatggcttgtgctggcccaggcttctggggacaaacagagagcatgggaacacccaagcttcttgtccgtctctggcaggtcactgggctggggccatagggatgccagggccattggggccactcacctgga

SEQ ID NO: 97674 - DNA, 201 bp, Bos taurus; identical to SEQ ID NO: 16184

SEQ ID NO: 97675 - DNA, 201 bp, Bos taurus; identical to SEQ ID NO: 16186

SEQ ID NO: 97676 - DNA, 201 bp, Bos taurus; identical to SEQ ID NO: 16187

SEQ ID NO: 97677 - DNA, 201 bp, Bos taurus
attttacattcccatcaaccaggaatttaccttcacactaatatttgtaattgtgtaggtctattgctgttcttgttcagttgctaagtcttatccccagatctatgaccccatgggccacagcatgccaggattccctattctttactatctactgtagttttctcaaattcatgtcctttgaatcggtgatgctatctg

SEQ ID NO: 97678 - DNA, 201 bp, Bos taurus
aaatgtaaagagaaataaacaaaatagacatcagaaataataaaaagaaaataattcataaatacaaagacaatggaaatttttaattcattaaaactcattaaagcagataatgtgcaagaggctaaagattttgtaaaaatagtcagctgcattcttacatttagagcagatggttttacctgaagtttcttttatgtt

SEQ ID NO: 97679 - DNA, 201 bp, Bos taurus
gattttcgaggtgagaatactgttgccatttcctcctccagggatcttcccaacccaggggtcgaaccagcgtctcctgcactgataggaggattctaaaccactgagacactataaccaaaacaaggctattcaggggccattctaatactttagtagaaagttatgggagatgacatctgtcttcctgctaaagatgct

SEQ ID NO: 97680 - DNA, 201 bp, Bos taurus; identical to SEQ ID NO: 16189

SEQ ID NO: 97681 - DNA, 201 bp, Bos taurus; identical to SEQ ID NO: 16190

SEQ ID NO: 97682 - DNA, 201 bp, Bos taurus; identical to SEQ ID NO: 16191

SEQ ID NO: 97683 - DNA, 201 bp, Bos taurus; identical to SEQ ID NO: 16193

SEQ ID NO: 97684 - DNA, 201 bp, Bos taurus
attatctcctttaaaattcacactaatgtgaggaagataattgttattatgtttacagttagaaaaagcattttatcacaggtctctacataattgtgttcgtatagaaacatttaagacacggataaaatggtaaagatcaaaacaggattaatattttaagaaaaaattatccagaggagttacatgagaagtaacata

SEQ ID NO: 97685 - DNA, 201 bp, Bos taurus
agtcaaaaattagtcaataaatgaataagagtatttaaaatactagtccctcaactctggaaaaaaaaaaaaaggttgttctatgtcccttttgaagttcgtatattggaataaactttaaagaccagaatattttgatcagggaaaatttatttaagccacaaggtagcctatatcaattccagcatctatcaattagtt

SEQ ID NO: 97686 - DNA, 201 bp, Bos taurus; identical to SEQ ID NO: 16194

SEQ ID NO: 97687 - DNA, 201 bp, Bos taurus; identical to SEQ ID NO: 16195

SEQ ID NO: 97688 - DNA, 201 bp, Bos taurus; identical to SEQ ID NO: 16196

SEQ ID NO: 97689 - DNA, 201 bp, Bos taurus; identical to SEQ ID NO: 16197

SEQ ID NO: 97690 - DNA, 201 bp, Bos taurus
gttagaagactatcaaagcatagccacaggaaaatgccctgcattacaaatgtatatatggaattccatgaatgttcattattttattcacaccaaattccctattcagtgaaatgcttgacttttttattttcataactgttttctataaaaatgtattaaagcactatagatatttactctgaccccaaattttaatac

SEQ ID NO: 97691 - DNA, 201 bp, Bos taurus
tctttaaaatgattctccacacacagtaagccctcaatgatcgttaggttatgattattactgtagtaattcagtgggttgtctctggccatgaagcattcaggcagttcttctcatttaactggaaacactgccaaagctcactctctctcctggttaattacaatagccatccctccacagacacaaggccagggtgat

SEQ ID NO: 97692 - DNA, 201 bp, Bos taurus
ttgagatgctccctggggggtctgttttataagggcactaatcccagagtattccacctaatcatttcacaaaggccacagttgctaattccatcacgaggggcagtcaggatttcaacatattaattttggtgtaatattcattccatagtacgccagaagcctttttgagcacaagggccattgctttgctcccatcta

SEQ ID NO: 97693 - DNA, 201 bp, Bos taurus; identical to SEQ ID NO: 16200

SEQ ID NO: 97694 - DNA, 201 bp, Bos taurus
gaaattcctcaataccctcctccctcattattgaagaggccagggttgtggttccagagagtatctaccatttataggccaattttcaatgaggtaattcaagtcataaatcttagtgggaaatgctactgttgaacactcttggtgttccattaattgagagggatggtgggcctgtgatgatgctgtactaacccaagg

SEQ ID NO: 97695 - DNA, 201 bp, Bos taurus; identical to SEQ ID NO: 16201

SEQ ID NO: 97696 - DNA, 201 bp, Bos taurus; identical to SEQ ID NO: 16202

SEQ ID NO: 97697 - DNA, 201 bp, Bos taurus; identical to SEQ ID NO: 16206

SEQ ID NO: 97698 - DNA, 201 bp, Bos taurus
aatcaaattttatggttaagcaataacttgccttcatggacaattttttaaggaattaaaatacaataaaatacaatttatgaaaaaaatagtctaaccacgacttaagagttgatcattcaaagcatttggggaacttacaaagtgttagggatataatgatgaatcttgattatcattttactgaaactgtgcaggcta

SEQ ID NO: 97699 - DNA, 201 bp, Bos taurus; identical to SEQ ID NO: 16208

SEQ ID NO: 97700 - DNA, 201 bp, Bos taurus; identical to SEQ ID NO: 16209

SEQ ID NO: 97701 - DNA, 201 bp, Bos taurus
aaatggaaagtatggttaatctaagttaaaaatgggttctttaaatagctctaattacattctgtttatatttgtatgtataagacacttaagatttaatcggtagcagttctaacaaaccataatgtttattagctggttttaaattattgttatcgatggcaatggaacgaaaaaataaatgacttgtctactataaaa

SEQ ID NO: 97702 - DNA, 201 bp, Bos taurus; identical to SEQ ID NO: 16211

SEQ ID NO: 97703 - DNA, 201 bp, Bos taurus
cttaaagcaactgaaacttgactttactatcattcctaattagccttcttccaaaagctcatattggccctgacatctgacttatgtcctagacccatgatttatgtcatattggccctgacatctgacttatgtcctagacttattaagcctgataccaatatcagtagactccttttttttaatataaactttgtcact

SEQ ID NO: 97704 - DNA, 201 bp, Bos taurus
ccctggagaagggaaaggctacccactccagtattctggcctggagaattccatggactgtacagtccatggggtcacaaagagtcagatacgactgagtgactttcacttcacatggttgtttttgtgctacagtggcagaactgaatagtagcgaaagcaaagcatcgctcagtcgtgtccaactcttcgcaaccccat

SEQ ID NO: 97705 - DNA, 201 bp, Bos taurus
gtggagagaaatttattaatctcttgcatttatttttatgtacccagttggggaatgattgatgtcacataagcacttaacaaatgtacagtgatttacctgtgtagatattagagagagtgctttttgaaagaaaattcaacatatttgcttgcattaatattatttatagaacaaaattggaaactgtagctatatata

SEQ ID NO: 97706 - DNA, 201 bp, Bos taurus
aagctacattaagggaaatccaatttctattaaaagctattggaaggattggtaaagagaaaaatggagtaatgaatcagcaggggtcagtgaaaaacattcgtctttttaaatcagaaggggtcagtgaaaaaattcatctttttaaaataggattcatcaaaaagaagacaaaggtagggatttcaagatacatttcaa

SEQ ID NO: 97707 - DNA, 201 bp, Bos taurus; identical to SEQ ID NO: 16212

SEQ ID NO: 97708 - DNA, 201 bp, Bos taurus
aaaactcttccagaaaaagaatcttggtaaagacagtgtataacaatagttgagtcacaaaaactcagtatcacgtaaagaaaagaagggatggtttgaagccgttttaggcttcagtcatatgatgcttttcctgttcaaaattaaacagaggtttaggtggctgtttgttggtatgttttgtcctcatcagaacatgac

SEQ ID NO: 97709 - DNA, 201 bp, Bos taurus; identical to SEQ ID NO: 16213

SEQ ID NO: 97710 - DNA, 201 bp, Bos taurus; identical to SEQ ID NO: 16214

SEQ ID NO: 97711 - DNA, 201 bp, Bos taurus; identical to SEQ ID NO: 16215

SEQ ID NO: 97712 - DNA, 201 bp, Bos taurus; identical to SEQ ID NO: 16216

SEQ ID NO: 97713 - DNA, 201 bp, Bos taurus
tccgcctctcggcgctccccgggctcttccttgctcctccgtgtgttgtatgttggagtgcagcgctgagagccacagctggggtcgggggatggcggggaagaggtggctcagacccagacagcagtgttctgtgaaattctgacaagtgagctgtgaggtcagtgcagttgacgctctaagccagctgggaaggtggag

SEQ ID NO: 97714 - DNA, 201 bp, Bos taurus; identical to SEQ ID NO: 16217

SEQ ID NO: 97715 - DNA, 201 bp, Bos taurus; identical to SEQ ID NO: 16218

SEQ ID NO: 97716 - DNA, 201 bp, Bos taurus; identical to SEQ ID NO: 16219

SEQ ID NO: 97717 - DNA, 201 bp, Bos taurus
tctggtagaaggccatctaaatctggcttgacttgccatctcttttcatcagttggtcattgagattcgccacaaggccacgggcatcagctgaggtcaccagtgtggctggtccgagcatgctggggtacgactgactggcttctgggcctaatctgtgccttcaggaacagttaggcatcaacctgtgtatatcatctc

SEQ ID NO: 97718 - DNA, 201 bp, Bos taurus; identical to SEQ ID NO: 16220

SEQ ID NO: 97719 - DNA, 201 bp, Bos taurus; identical to SEQ ID NO: 16221

SEQ ID NO: 97720 - DNA, 201 bp, Bos taurus; identical to SEQ ID NO: 16222

SEQ ID NO: 97721 - DNA, 201 bp, Bos taurus; identical to SEQ ID NO: 16224

SEQ ID NO: 97722 - DNA, 201 bp, Bos taurus
tgccccggccccccaggcccgggacaccttccttcagacggcagcacagcagctgtatccccattgagagcagcgtcctgccccgctgaggaggcagaaagcagggcacagtggccgaagcccctgcaacaggctgtcggaagaggacacgagaggtctggctggggtccctgacgcctactccatgctcccagggaggct

SEQ ID NO: 97723 - DNA, 201 bp, Bos taurus; identical to SEQ ID NO: 16225

SEQ ID NO: 97724 - DNA, 201 bp, Bos taurus
gcaacagttgttagccctgctttgctgagtaggctgccgtagtgtggtgcttcttagtccaaggttgtagtttggtgttgtgccagacctgtcagctcacatggaccaaaggcctcagattcactagctgtggttacctgactctagcacatgatctaaccaaagcaacagcaagaaaaacatgggaataatgaatcaata

SEQ ID NO: 97725 - DNA, 201 bp, Bos taurus; identical to SEQ ID NO: 16226

SEQ ID NO: 97726 - DNA, 201 bp, Bos taurus; identical to SEQ ID NO: 16227

SEQ ID NO: 97727 - DNA, 201 bp, Bos taurus
ttaccattttgattttagattccctggctgagctttaattcctgccatagtttatcttccatctctctaaactagctgtgagacttctgtcagtgtggcccgatcaactctgctctattttgattctaagcattgtatcctaatccttagctgtattcccaacacaccctaatattttgcacctaagaaagtagtggtagt

SEQ ID NO: 97728 - DNA, 201 bp, Bos taurus; identical to SEQ ID NO: 16228

SEQ ID NO: 97729 - DNA, 201 bp, Bos taurus; identical to SEQ ID NO: 16229

SEQ ID NO: 97730 - DNA, 201 bp, Bos taurus; identical to SEQ ID NO: 16230

SEQ ID NO: 97731 - DNA, 201 bp, Bos taurus
aatgtgattgtatcaatataaaaatgagcagtggttatagaaatcaaggaagattatgatctcacttttacactcacgttggcacctcatggcctcaattaaaaaaaaaaaaatgttgttcttttggttttgtccatgagccagcctgctgcagatgtgagtatctccccagattttagagggtagccctgaatgctgaag

SEQ ID NO: 97732 - DNA, 201 bp, Bos taurus; identical to SEQ ID NO: 16231

SEQ ID NO: 97733 - DNA, 201 bp, Bos taurus; identical to SEQ ID NO: 16232

SEQ ID NO: 97734 - DNA, 201 bp, Bos taurus
ccaaaatagatacgtcttcaagtattctctttctagtctgaaattccatgatcctgggactgggttgtttttattaacaaccttgatctttttacaacaaccttgatctaatctttgccaaagttgcaacatccagctataagcaaagaaacacaagaaacacaaagattagaaaaccggactacagtgtccctttttctc

SEQ ID NO: 97735 - DNA, 201 bp, Bos taurus
atgtatatacacacatacatacacacacaaacaattaatggaaacaatctatattctatgcaatattctgccttctagacctactaatgaaaagtcttgctgggtagaaaatgtttaattgatgattttaaactttgagagatatacatccttacccttttgtgattcacccaaagagattttctttaaggattgtataac

SEQ ID NO: 97736 - DNA, 201 bp, Bos taurus; identical to SEQ ID NO: 16233

SEQ ID NO: 97737 - DNA, 201 bp, Bos taurus; identical to SEQ ID NO: 16234

SEQ ID NO: 97738 - DNA, 201 bp, Bos taurus; identical to SEQ ID NO: 16235

SEQ ID NO: 97739 - DNA, 201 bp, Bos taurus; identical to SEQ ID NO: 16236

SEQ ID NO: 97740 - DNA, 201 bp, Bos taurus
caagagagaggccaagttaaatgattgcaaaatgagcttccatctactctgacactagcttaacatcacaagaattgctccactgtaatatttttatatgccaggatctaggccatcagcatctttgacaaagaaaatttctgcaacaccagcaaaatgggtttttaacattctaactaaataccatcccagacattcaac

SEQ ID NO: 97741 - DNA, 201 bp, Bos taurus; identical to SEQ ID NO: 16237

SEQ ID NO: 97742 - DNA, 201 bp, Bos taurus; identical to SEQ ID NO: 16238

SEQ ID NO: 97743 - DNA, 201 bp, Bos taurus; identical to SEQ ID NO: 16239

SEQ ID NO: 97744 - DNA, 201 bp, Bos taurus; identical to SEQ ID NO: 16240

SEQ ID NO: 97745 - DNA, 201 bp, Bos taurus; identical to SEQ ID NO: 16241

SEQ ID NO: 97746 - DNA, 201 bp, Bos taurus; identical to SEQ ID NO: 16242

SEQ ID NO: 97747 - DNA, 201 bp, Bos taurus; identical to SEQ ID NO: 16243

SEQ ID NO: 97748 - DNA, 201 bp, Bos taurus
ttctggacagattggggccacagtccagacgtgctggtcattcccatatgatgctgctattttggtgttgcttcagaaccaataacctgtctgtcacgaaaagggccaggttcgatatactgaaattttatttcagtttccatttggcaagaattgtgaaggtcttaactgaaacagtactattaaacaaggctccaactc

SEQ ID NO: 97749 - DNA, 201 bp, Bos taurus; identical to SEQ ID NO: 16244

SEQ ID NO: 97750 - DNA, 201 bp, Bos taurus; identical to SEQ ID NO: 16245

SEQ ID NO: 97751 - DNA, 201 bp, Bos taurus; identical to SEQ ID NO: 16246

SEQ ID NO: 97752 - DNA, 201 bp, Bos taurus
acagatggaagagcgggagaaggactcttgtttttggttttaacactcctattagctgaagcactgactctgctctaaaagcagctgctcaccttccctcatcttggctggaaaacagcctactgtaaggcttaggggaccgcatgacctccctgaggtggtcaagtcaagagcagagttagacaggcaacaaatttcatg

SEQ ID NO: 97753 - DNA, 201 bp, Bos taurus; identical to SEQ ID NO: 16247

SEQ ID NO: 97754 - DNA, 201 bp, Bos taurus; identical to SEQ ID NO: 16248

SEQ ID NO: 97755 - DNA, 201 bp, Bos taurus; identical to SEQ ID NO: 16249

SEQ ID NO: 97756 - DNA, 201 bp, Bos taurus; identical to SEQ ID NO: 16250

SEQ ID NO: 97757 - DNA, 201 bp, Bos taurus; identical to SEQ ID NO: 16251

SEQ ID NO: 97758 - DNA, 201 bp, Bos taurus; identical to SEQ ID NO: 16252

SEQ ID NO: 97759 - DNA, 201 bp, Bos taurus
tgtaataaatctgaaactgttgaaattaaagtggttatgtctatggaaaacttatttttgaagaaatatttctagttgattcttatgtgccccagtaagcgtcctattaacattttgtccaaagtcatctttggaggaagggattaaatgcatctgctgaagtgcaatggtgatgccaagtgtgggggaccagtgaggcta

SEQ ID NO: 97760 - DNA, 201 bp, Bos taurus; identical to SEQ ID NO: 16253

SEQ ID NO: 97761 - DNA, 201 bp, Bos taurus
tttaaggaatggggaggatcctaatacctgagtaaaaatgcccataaagattcaaggagaatgtgcagtttgaatcacactggtccagttttaagaaatggatgatcagtagtgtcaaatgcatgtcaaagtctagaataatgtctgtgagatatatgatagatttggcgattgaaagaacattgatgacttcatgagagc

SEQ ID NO: 97762 - DNA, 201 bp, Bos taurus; identical to SEQ ID NO: 16254

SEQ ID NO: 97763 - DNA, 201 bp, Bos taurus
cctaagttattgccacatcttatctgaatagaaagaaatatttttattccaagatatggcaaggcctcctgccaatcatgatttataattttaagtattcaatatttattgtttaggaactgagaagatcgcttttatatttaacttccttttgttgttaaactatttgacttaaaatttggcttttgactaaagattgca

SEQ ID NO: 97764 - DNA, 201 bp, Bos taurus; identical to SEQ ID NO: 16255

SEQ ID NO: 97765 - DNA, 201 bp, Bos taurus; identical to SEQ ID NO: 16256

SEQ ID NO: 97766 - DNA, 201 bp, Bos taurus; identical to SEQ ID NO: 16257

SEQ ID NO: 97767 - DNA, 201 bp, Bos taurus; identical to SEQ ID NO: 16258

SEQ ID NO: 97768 - DNA, 201 bp, Bos taurus; identical to SEQ ID NO: 16259

SEQ ID NO: 97769 - DNA, 201 bp, Bos taurus
ttatcataaagaaatataaggttaatccttctgacatacagacatctgaatgatttaccaaagcactctaaattgcactcaacaaatatctacttctataaaaagaatatttattttaaatcattgcaaatcctgtgctttcaatacgttttgatagtcattaatatttttatcacatttcctcaaaggtgagctaattac

SEQ ID NO: 97770 - DNA, 201 bp, Bos taurus; identical to SEQ ID NO: 16260

SEQ ID NO: 97771 - DNA, 201 bp, Bos taurus
aagttattataataactagaaagggcctataattgtagatctccttacagttgtaatctcctctaaattaattttcccctctctgtctgttcagtcctctcggcctctgggccttcccatctcaggtacttagcatttagtgttcccccagcttggaatgcttttctttcaggtattacacacatgtctgtctctcatatc

SEQ ID NO: 97772 - DNA, 201 bp, Bos taurus; identical to SEQ ID NO: 16261

SEQ ID NO: 97773 - DNA, 201 bp, Bos taurus; identical to SEQ ID NO: 16262

SEQ ID NO: 97774 - DNA, 201 bp, Bos taurus; identical to SEQ ID NO: 16263

SEQ ID NO: 97775 - DNA, 201 bp, Bos taurus
gatagttttggattaaaaccaagatctttacctcaaatcatttcttttcactgctacttatccttgaagtgaaagacagtttaaacttttgctgcctttacaagcagggagagaaacatctggaggagctatagtctttcttgtcactggctgtgcacttggagtgcaggtgtgtgcggaagagggcagcaaggatagata

SEQ ID NO: 97776 - DNA, 201 bp, Bos taurus
ccttaaggtcattgcacttgcagcattctctgtttgtaacaggaaatgttaaaaacaaaaccacctgaacagaagcacccaggtgctctcaggggggcctggagggttgtgtagtgttggcgcttgtgaccctggcaggaggcgcgtccgtagagccactgcccagcgtccccagcgacagccatgttgccacggccccgc

SEQ ID NO: 97777 - DNA, 201 bp, Bos taurus; identical to SEQ ID NO: 16264

SEQ ID NO: 97778 - DNA, 201 bp, Bos taurus; identical to SEQ ID NO: 16265

SEQ ID NO: 97779 - DNA, 201 bp, Bos taurus; identical to SEQ ID NO: 16266

SEQ ID NO: 97780 - DNA, 201 bp, Bos taurus; identical to SEQ ID NO: 16267

SEQ ID NO: 97781 - DNA, 201 bp, Bos taurus; identical to SEQ ID NO: 16268

SEQ ID NO: 97782 - DNA, 201 bp, Bos taurus; identical to SEQ ID NO: 16269

SEQ ID NO: 97783 - DNA, 201 bp, Bos taurus; identical to SEQ ID NO: 16270

SEQ ID NO: 97784 - DNA, 201 bp, Bos taurus
aagacacagcactaaatagacttaaaagcacactcatttacagtataagagttcaaacaggaaggcaataagacctttggtttgatctcaactggaagcgtgtacgtgggtgactcagatttttcctactctgtgtatgcttgcaaatgaccacaaaagttacgctgagtattgactttgaggtttaaaataaatgttagc

SEQ ID NO: 97785 - DNA, 201 bp, Bos taurus; identical to SEQ ID NO: 16271

SEQ ID NO: 97786 - DNA, 201 bp, Bos taurus
ctacagataaatgtgtgcatattgagtgaaatactatatgtaaagcttctggcccagtgcttagcaggtattaggtttgcaataaatatctgttttaaaagtgataattctttaggtctttcagggactaaaaatatttcaaagaaaatgcacatataaacaacacattttcttacctaagtctataagttataatagttt

SEQ ID NO: 97787 - DNA, 201 bp, Bos taurus
aaatgttcctttgatgttctctgaagtcattgttaaggaatggcaaaattcaaatgattttctgcaagtcacgcttatgagcgtaataagagtttgaaggcatgtatagcagtctccagttttccagcctcagttttcattctgagaccatttctaatgtgcttacaaatttaatccctcataatgttttattataatatt

SEQ ID NO: 97788 - DNA, 201 bp, Bos taurus
tgggtatcaatagtaacctcatgttgtcataaggattaagtgacgcatgatgtagataataaagcacttagttgcctggtccacagtaaacacccaaataaaagttcatcaatagacaaattattgtttcactttttttctagtacagtgtcatttcaaaaaggcttgtgtgtggagaagctatttcaaggtcaggattaa

SEQ ID NO: 97789 - DNA, 201 bp, Bos taurus; identical to SEQ ID NO: 16272

SEQ ID NO: 97790 - DNA, 201 bp, Bos taurus
gagagcagaggttctgatcatacagatcataaagagagtttctgatcataaagagccttgacagtcacatgaaaattttgacttttattctaaaaggtacggaagtttttgaaagggtttgaactccagtgaattgatactgaatttttacagtattcttcatactgagaaatcattagaaagttattgcagtcatttaga

SEQ ID NO: 97791 - DNA, 201 bp, Bos taurus; identical to SEQ ID NO: 16274

SEQ ID NO: 97792 - DNA, 201 bp, Bos taurus; identical to SEQ ID NO: 16275

SEQ ID NO: 97793 - DNA, 201 bp, Bos taurus; identical to SEQ ID NO: 16276

SEQ ID NO: 97794 - DNA, 201 bp, Bos taurus
ctttccctgcttcagccggtgtccaagaaggttgacagctagggactgtcttgccacctggattccagttggattggccagtggtaaacataggccggtcggaggagaggatgagagagacattgggatacgttttcctggtcatgatttcatctggttgtactcctggcaggggccatcacctcttctttttttgcaata

SEQ ID NO: 97795 - DNA, 201 bp, Bos taurus; identical to SEQ ID NO: 16277

SEQ ID NO: 97796 - DNA, 201 bp, Bos taurus; identical to SEQ ID NO: 16278

SEQ ID NO: 97797 - DNA, 201 bp, Bos taurus; identical to SEQ ID NO: 16279

SEQ ID NO: 97798 - DNA, 201 bp, Bos taurus; identical to SEQ ID NO: 16280

SEQ ID NO: 97799 - DNA, 201 bp, Bos taurus; identical to SEQ ID NO: 16281

SEQ ID NO: 97800 - DNA, 201 bp, Bos taurus; identical to SEQ ID NO: 16283

SEQ ID NO: 97801 - DNA, 201 bp, Bos taurus; identical to SEQ ID NO: 16284

SEQ ID NO: 97802 - DNA, 201 bp, Bos taurus; identical to SEQ ID NO: 16286

SEQ ID NO: 97803 - DNA, 201 bp, Bos taurus; identical to SEQ ID NO: 16287

SEQ ID NO: 97804 - DNA, 201 bp, Bos taurus; identical to SEQ ID NO: 16288

SEQ ID NO: 97805 - DNA, 201 bp, Bos taurus; identical to SEQ ID NO: 16289

SEQ ID NO: 97806 - DNA, 201 bp, Bos taurus
ttcaggcctgaataatattacacacacacacaaccacacacacacatgcacaccacatcttctttatccattcatccatcagtaggcacttaggctgttaccgtaccttggccattgtggataatgttgctgtgcagctgggagtgcagatacctctttgatatcctctttccttttctttagacatatatacccagacat

SEQ ID NO: 97807 - DNA, 201 bp, Bos taurus
cagataggaaacagaaataaaaatataattttaaattggttgtgtattagaatgtgtttgcaccatacccatggtatgtggccaagtttctccataaggatttgaaatgaccttacaatgaaatttggatttaatgagtttttagaaatgaggggccaagttgccagccctactttgggctatggtaaaatcagaaattaa

SEQ ID NO: 97808 - DNA, 201 bp, Bos taurus; identical to SEQ ID NO: 16291

SEQ ID NO: 97809 - DNA, 201 bp, Bos taurus; identical to SEQ ID NO: 16292

SEQ ID NO: 97810 - DNA, 201 bp, Bos taurus
ggacatgacagtctaatgtgatacttgaacctggattggatcttgcactaagaaatatggaaattattgggatgattgtcagaattaaagtatggactctctatattatatcaatgctgcagttcctgaatttgatcattgtactgtggttatgtagaagaatatacttatataaatatgtgtatatctatatataggtag

SEQ ID NO: 97811 - DNA, 201 bp, Bos taurus
ccacagtgacattcgtagagcaatatcaggtaatttttcattgttttactattacagttggtcttatagtatgtaaacttttgaaaacctctggttggaacgggaaatgtttcttgccccatgtattcctagacgagagggtaaactgcactgatttcagtgtctcaagcaaaatcaaatccaaaagctgctcagagcacc

SEQ ID NO: 97812 - DNA, 201 bp, Bos taurus; identical to SEQ ID NO: 16293

SEQ ID NO: 97813 - DNA, 201 bp, Bos taurus
cacctaagaacaatgagtctctaactcctggcctgttaaggaagaaacgctacatgttcaagagcttgatcatctgttcacacaggggcagatgggaagaggtgaaaagaaggccatgaatgaccaatggaaagtaaagactgaacaactacaattcacagacggggccctcccaccagctgccctgcccacaggtcagca

SEQ ID NO: 97814 - DNA, 201 bp, Bos taurus
cctcttagtgccctgtcagtctcctggaataccgctattccgccacttgctgagccaaatggggattgtacatgtccttagagcagtcaataatgctgtggtctctatgcattcccctttgtggccaattattgtaatactcgatgggagatgctaaatggtttactgtgttcgacctcaagggtgccttcttttctatct

SEQ ID NO: 97815 - DNA, 201 bp, Bos taurus
tctgggctgtagggagacaaggggtgggagatggaagtttgggtcaagtcacagacagccttggatgctatgatcaggaatttagcctccattctagagcccatgagtagccgctaacaggtttctaggtagatagtccaataaccaggtttatatttcacaaagatatgtctggcagcatttggagggaaaatgggaaag

SEQ ID NO: 97816 - DNA, 201 bp, Bos taurus
cagaaattctgagctgaggctggggaatctgcctctgcagatgtttggaggccctcctggtgattctgatgctcagctccaccaggcatcagacccactggacagcactgcttcccacagcagcactcacacttgtaatgggccttgtggctgggggagttccatcaccaaacctgccttgacccattaaaaatcccttta

SEQ ID NO: 97817 - DNA, 201 bp, Bos taurus; identical to SEQ ID NO: 16294

SEQ ID NO: 97818 - DNA, 201 bp, Bos taurus; identical to SEQ ID NO: 16295

SEQ ID NO: 97819 - DNA, 201 bp, Bos taurus
atcccacctgtctgtctatcccaggaacgcacggttaggacactgacattactaactagctgtaggcggcctcacagaaccgcgtgaacttcaccttgaccccttcacagcggtgggcaggaaggcgagcccgctttctcttccgcacactcagcacacacgctcacctgctgtgcacagtcacctcattaatacactaga

SEQ ID NO: 97820 - DNA, 201 bp, Bos taurus
atttcttgaacattccaggcactttgtcagctctgggccttttcatttgttgtttgcactgcctgcaattctcttccctcagagagcctcaaagttggctccttccctccttcaggcctttgcccaagtagcacatcatcaaagagacctcccataaccattctatttacaattgcaagaccctttcccacagaatcatcc

SEQ ID NO: 97821 - DNA, 201 bp, Bos taurus
ggctgcttactcccctaatgagtttgaggctacagaggccactctggccaatcagttctactctgctggctcctgtggccgtagaaccatcctgaatccatccagccagaccctgcctcaagaggagagactggaaatggaccccaccagttctaagactgggaaggccaccccaaacagggtaaattgagtctggaatgt

SEQ ID NO: 97822 - DNA, 201 bp, Bos taurus
atgtatcatgcctaatgaaagaaggacaaaaacaaacaactgatttttttcagtggttctcaccaagaggttatattttctgcccccaaagtggccttgacctctgctgaaataagcaccagaaaatgaatgtattcccatgattggtaatgacagttacctcattatgagttcacatttcctgtcacttgggcaattagt

SEQ ID NO: 97823 - DNA, 201 bp, Bos taurus; identical to SEQ ID NO: 16298

SEQ ID NO: 97824 - DNA, 201 bp, Bos taurus; identical to SEQ ID NO: 16299

SEQ ID NO: 97825 - DNA, 201 bp, Bos taurus; identical to SEQ ID NO: 16300

SEQ ID NO: 97826 - DNA, 201 bp, Bos taurus; identical to SEQ ID NO: 16301

SEQ ID NO: 97827 - DNA, 201 bp, Bos taurus; identical to SEQ ID NO: 16302

SEQ ID NO: 97828 - DNA, 201 bp, Bos taurus; identical to SEQ ID NO: 16303

SEQ ID NO: 97829 - DNA, 201 bp, Bos taurus; identical to SEQ ID NO: 16304

SEQ ID NO: 97830 - DNA, 201 bp, Bos taurus; identical to SEQ ID NO: 16305

SEQ ID NO: 97831 - DNA, 201 bp, Bos taurus; identical to SEQ ID NO: 16307

SEQ ID NO: 97832 - DNA, 201 bp, Bos taurus; identical to SEQ ID NO: 16308

SEQ ID NO: 97833 - DNA, 201 bp, Bos taurus
cccagcacatcctataaacatttatgtgcaggcctttcctcacctgttaaagacataattcttcataaactttcccacaatgttttccagttcctaaacacagggaagcaaggttatgggtgaagacaatccatgcattccctgacagaggtttattgccctcagtcccagggcaaacagagctggctcctagcagtacaa

SEQ ID NO: 97834 - DNA, 201 bp, Bos taurus
actctgggctagactggagggaaacattgctcctgcggtgcctgggacctgcaggctctgtgacagcctcagttttgagggcctccacttctgccacttactgtgtggagaccagcccaggaataactgctcagtggtggtttgaacagctggatcatacgccaccgattcatcctcagagaccctcacacaggcctgggc

SEQ ID NO: 97835 - DNA, 201 bp, Bos taurus; identical to SEQ ID NO: 16311

SEQ ID NO: 97836 - DNA, 201 bp, Bos taurus; identical to SEQ ID NO: 16312

SEQ ID NO: 97837 - DNA, 201 bp, Bos taurus; identical to SEQ ID NO: 16313

SEQ ID NO: 97838 - DNA, 201 bp, Bos taurus; identical to SEQ ID NO: 16315

SEQ ID NO: 97839 - DNA, 201 bp, Bos taurus; identical to SEQ ID NO: 16316

SEQ ID NO: 97840 - DNA, 201 bp, Bos taurus; identical to SEQ ID NO: 16317

SEQ ID NO: 97841 - DNA, 201 bp, Bos taurus; identical to SEQ ID NO: 16318

SEQ ID NO: 97842 - DNA, 201 bp, Bos taurus; identical to SEQ ID NO: 16320

SEQ ID NO: 97843 - DNA, 201 bp, Bos taurus; identical to SEQ ID NO: 16321

SEQ ID NO: 97844 - DNA, 201 bp, Bos taurus; identical to SEQ ID NO: 16322

SEQ ID NO: 97845 - DNA, 201 bp, Bos taurus
atattcaaaatttctttgagaagaatgctctcagtgaagttctatctcctcattctttttactacttgctaaagaaaattcactgacactagttctggatctttatcatcattcagagctgtgtagttaaagaactgagtgaattactaccttcaggagctgaaactcaagggggcagtttgactattgactagcgaaatt

SEQ ID NO: 97846 - DNA, 201 bp, Bos taurus
gctcatttccaccccaccccccatcatgaggtgatgattgacagccagctctaactacacaaaagagggcagtaagaccgcattaacttggataccagtgtctctcaaagtgatttgaaaatcaatagcaagttctgaaattcactgtgtaagaaatagtaatgttgagggtcatttagaagaaagattagtctaatgaat

SEQ ID NO: 97847 - DNA, 201 bp, Bos taurus; identical to SEQ ID NO: 16323

SEQ ID NO: 97848 - DNA, 201 bp, Bos taurus; identical to SEQ ID NO: 16324

SEQ ID NO: 97849 - DNA, 201 bp, Bos taurus; identical to SEQ ID NO: 16325

SEQ ID NO: 97850 - DNA, 201 bp, Bos taurus; identical to SEQ ID NO: 16326

SEQ ID NO: 97851 - DNA, 201 bp, Bos taurus; identical to SEQ ID NO: 16327

SEQ ID NO: 97852 - DNA, 201 bp, Bos taurus; identical to SEQ ID NO: 16328

SEQ ID NO: 97853 - DNA, 201 bp, Bos taurus; identical to SEQ ID NO: 16329

SEQ ID NO: 97854 - DNA, 201 bp, Bos taurus
cttaatgattaagacagtctccacgtgatgtttgaagcgccggctcataattaaaagtcaggtgaataaaatcattggtgttccagaggattcattcctacgattctttttttatgttttctttatattggtttgaaattctttgcaaattaagtatttagtgttggaaccacagagaaaaacagggggctgatagataca

SEQ ID NO: 97855 - DNA, 201 bp, Bos taurus; identical to SEQ ID NO: 16330

SEQ ID NO: 97856 - DNA, 201 bp, Bos taurus; identical to SEQ ID NO: 16331

SEQ ID NO: 97857 - DNA, 201 bp, Bos taurus
tggtttgtatggagaaaatataaataatatggcccatttgaggaagagttcccattaaaaaatccaaactgggttaggcattttttgtttactatgaatccgttcttagagagtcattggccttcttgggaaaaatgatgatacatttccatttattgaagattgtttgagcttctggctaagacattatgggagatactt

SEQ ID NO: 97858 - DNA, 201 bp, Bos taurus; identical to SEQ ID NO: 16332

SEQ ID NO: 97859 - DNA, 201 bp, Bos taurus; identical to SEQ ID NO: 16333

SEQ ID NO: 97860 - DNA, 201 bp, Bos taurus; identical to SEQ ID NO: 16337

SEQ ID NO: 97861 - DNA, 201 bp, Bos taurus; identical to SEQ ID NO: 16339

SEQ ID NO: 97862 - DNA, 201 bp, Bos taurus; identical to SEQ ID NO: 16340

SEQ ID NO: 97863 - DNA, 201 bp, Bos taurus
ggaacatgacactctctattccttaggcaggggtggggccttctttttaaaggttacagtatggtcaggggaaagagaaaaaattctacagtggtgaaatctgacaaacactacctcagtcaggccaccggggtcaacttctgtgctatgaattcttaaattgcagtacagttgacttacagtactatattagtttcaggt

SEQ ID NO: 97864 - DNA, 201 bp, Bos taurus
ccatccagttaatccttaatacatgcagagtctatattgtaaagtgcatattgtatataaagctgttgtagaatactgagtttaagaacatagtgtcttccttgaacattattctgcttttgtcttaaaggctatttaatcagatcctatgaaaaatctattttctttggtgtgtttttgtttgagatatcactttatatc

SEQ ID NO: 97865 - DNA, 201 bp, Bos taurus; identical to SEQ ID NO: 16345

SEQ ID NO: 97866 - DNA, 201 bp, Bos taurus; identical to SEQ ID NO: 16346

SEQ ID NO: 97867 - DNA, 201 bp, Bos taurus
aatttggtgaattcacagagaggtcagggccctttcatttgaaaggtgttgtgtgtttgctgtgaagatgtaactggattttcattttgaattaaagaaagtcactcgggctgccacgtgggccagctgttgttactgttgttcagttgctaagtcgtgtctgactctttgtgaccccatggactatagacctctaggctc

SEQ ID NO: 97868 - DNA, 201 bp, Bos taurus; identical to SEQ ID NO: 16348

SEQ ID NO: 97869 - DNA, 201 bp, Bos taurus; identical to SEQ ID NO: 16349

SEQ ID NO: 97870 - DNA, 201 bp, Bos taurus
cccagcagccagcccccagcctcacctctcctgcagggtcctgttcccaggcctgccctcccctcatggcctgggctttcccctccctgccacaccccctttcctcactccagccccccaaagacgtgcaggttagtgtttgtaaagtgctctgagggggaaaagagccaagtgctttccctccactgaaaggaaacaatt

SEQ ID NO: 97871 - DNA, 201 bp, Bos taurus; identical to SEQ ID NO: 16350

SEQ ID NO: 97872 - DNA, 201 bp, Bos taurus
caggcttcatcttttatcattttcccctccagacttttaggggggaacagttctaaacagttctaaggaaaagattacaactcccagtggttggccagagcaaagagccagctcctcaaacacaggtgagagcattgtatttcccttccctaaacccgaggggaaaggagccatctgtacaaacttccctgttctcccgcg

SEQ ID NO: 97873 - DNA, 201 bp, Bos taurus; identical to SEQ ID NO: 16351

SEQ ID NO: 97874 - DNA, 201 bp, Bos taurus; identical to SEQ ID NO: 16352

SEQ ID NO: 97875 - DNA, 201 bp, Bos taurus; identical to SEQ ID NO: 16354

SEQ ID NO: 97876 - DNA, 201 bp, Bos taurus; identical to SEQ ID NO: 16355

SEQ ID NO: 97877 - DNA, 201 bp, Bos taurus
tatatttttctgccgctcccatggtgtcaggtaggggaccacctgcaggtgagaagtgtgccaccctagatatgatagataccttctttctggcccactacttaagaactgtttgattttggacaagtcatgcatttgaaagaaatcaagacctgtttacatgttttccctcagttggctggggccccctcacaaggttgt

SEQ ID NO: 97878 - DNA, 201 bp, Bos taurus; identical to SEQ ID NO: 16356

SEQ ID NO: 97879 - DNA, 201 bp, Bos taurus; identical to SEQ ID NO: 16358

SEQ ID NO: 97880 - DNA, 201 bp, Bos taurus; identical to SEQ ID NO: 16360

SEQ ID NO: 97881 - DNA, 201 bp, Bos taurus; identical to SEQ ID NO: 16361

SEQ ID NO: 97882 - DNA, 201 bp, Bos taurus; identical to SEQ ID NO: 57153

SEQ ID NO: 97883 - DNA, 201 bp, Bos taurus; identical to SEQ ID NO: 16364

SEQ ID NO: 97884 - DNA, 201 bp, Bos taurus
attcaagctgatcctagattttgcttttctttgaaaattttcatattgtccaagcatcagccaatttcattctcagtgtctttgagttgttaagggtatgatcagacctgtcaatgtcctaaaatgaaggacctgacttagcacctaagattggggtgattggaaacctgaccttcagttagcagcctttaaagtatgcaa

SEQ ID NO: 97885 - DNA, 201 bp, Bos taurus; identical to SEQ ID NO: 16365

SEQ ID NO: 97886 - DNA, 201 bp, Bos taurus; identical to SEQ ID NO: 16366

SEQ ID NO: 97887 - DNA, 201 bp, Bos taurus
aagatgcccttgtgattcagtcatccttcccttcctgatgcagagaaggagacacccttacaaatggaggttttatcaatttaaaattctttgcaaaagggtagcttctactgtggtttgcagagcttctcctgggtctgctgtttcttgaaatagtcaactcaaaataatccttctattagaaaaggatattttggtgca

SEQ ID NO: 97888 - DNA, 201 bp, Bos taurus; identical to SEQ ID NO: 16367

SEQ ID NO: 97889 - DNA, 201 bp, Bos taurus
atggccagtacatggagggacttttcaatacggatctagaacctcaaatgtatccccatcctctcctcggactccacctcctggactggactccttgtagagagatagttccagaaggccatctgggagcacggtgcatgggaagggctgggttcaggctggtggtgagaaagtataaacccgatgatttacacggtttgt

SEQ ID NO: 97890 - DNA, 201 bp, Bos taurus
cagcaagctcctgcaggccagtccttgtcagcctggataaactggggatgatgacagggaaaccacttcctacacaggcgccagataagtgagcgcgatccgtggccccccagaggaaggcaaaccagtgtcctcaggcctctgatacctgccagatgttttcctaggttcatggattgtcacttaattctaataacagcc

SEQ ID NO: 97891 - DNA, 201 bp, Bos taurus; identical to SEQ ID NO: 16368

SEQ ID NO: 97892 - DNA, 201 bp, Bos taurus; identical to SEQ ID NO: 16369

SEQ ID NO: 97893 - DNA, 201 bp, Bos taurus; identical to SEQ ID NO: 16370

SEQ ID NO: 97894 - DNA, 201 bp, Bos taurus
cctacctgccaggcgaagagtaaggactccgccaggtgccaaggccagaaaagcccagatggtaggggggggtgggcccctggaactcagcctactccaacgccctcactgtacacatgaaactgcccaaagccacattgctgatgctcgggcactggcccagcttccatggttccaattcccactttccagctctatccc

SEQ ID NO: 97895 - DNA, 201 bp, Bos taurus; identical to SEQ ID NO: 16372

SEQ ID NO: 97896 - DNA, 201 bp, Bos taurus; identical to SEQ ID NO: 16374

SEQ ID NO: 97897 - DNA, 201 bp, Bos taurus
tgtacttccagagactggagtccgtgttgaggggccttaaggcaccagcacctctgggtgtaatggcagctccgggatccagcaacatgtttgggggcccgtttgatacccacagctttcttacctcatccatacttctaagaatccacaggaggattgttcggtgttggccacagaacttgtttggctagttgctgttct

SEQ ID NO: 97898 - DNA, 201 bp, Bos taurus; identical to SEQ ID NO: 16375

SEQ ID NO: 97899 - DNA, 201 bp, Bos taurus
tctttttgggtaagacatagacctggaactcctaaaggatgaactgccttgagaacaagcgagtgcttctgctgagcagccctggggccaccgggcagggtggtagagaagcaatgaggcatcttctcctgtgcatctcagaacccctgtgcccagcatggaagcagctctcagcacgtgtctcaaccaaatgggagcttt

SEQ ID NO: 97900 - DNA, 201 bp, Bos taurus; identical to SEQ ID NO: 16377

SEQ ID NO: 97901 - DNA, 201 bp, Bos taurus
tatttttggaggggtgaaggatatttcccaggtaagtttctgtggccaagggcattggtatgtactgagatagggcctctcttgacctcggaactcctgacttgggggctggagaattctttgctggtggggggcgggcggtcctgtgcattgtgggatactcagcagcacccttggcctcaactcactggatgccagcac

SEQ ID NO: 97902 - DNA, 201 bp, Bos taurus; identical to SEQ ID NO: 16378

SEQ ID NO: 97903 - DNA, 201 bp, Bos taurus
catggtctcaataactaaataagatttctgccacagcaacccactgctattcgacttctcaaaagcagggggaggtttgtggccggaggcctttagattgcactgtgtcaaggagtgacacaggctgcctaagctccatgttgagatacccacaacaaccactagatggcagcattgagacaaatacgcagcagaggttct

SEQ ID NO: 97904 - DNA, 201 bp, Bos taurus; identical to SEQ ID NO: 16379

SEQ ID NO: 97905 - DNA, 201 bp, Bos taurus
gtggttcctggggttagaggctgtcactgtgggcatctcttcagctgggcgcttgtaagggcaggggatggaaatgctgggggcccgaggagacgcagaagactgccggggagatgctgcctcatgcgtttcattaacttgctgacgagggtagttgtatttacggcctgaggccgacgggaaggttgctgcaggtcagtg

SEQ ID NO: 97906 - DNA, 201 bp, Bos taurus; identical to SEQ ID NO: 16380

SEQ ID NO: 97907 - DNA, 201 bp, Bos taurus; identical to SEQ ID NO: 16382

SEQ ID NO: 97908 - DNA, 201 bp, Bos taurus; identical to SEQ ID NO: 16383

SEQ ID NO: 97909 - DNA, 201 bp, Bos taurus; identical to SEQ ID NO: 16384

SEQ ID NO: 97910 - DNA, 201 bp, Bos taurus; identical to SEQ ID NO: 16385

SEQ ID NO: 97911 - DNA, 201 bp, Bos taurus; identical to SEQ ID NO: 16386

SEQ ID NO: 97912 - DNA, 201 bp, Bos taurus; identical to SEQ ID NO: 16387

SEQ ID NO: 97913 - DNA, 201 bp, Bos taurus; identical to SEQ ID NO: 16388

SEQ ID NO: 97914 - DNA, 201 bp, Bos taurus; identical to SEQ ID NO: 16389

SEQ ID NO: 97915 - DNA, 201 bp, Bos taurus; identical to SEQ ID NO: 16390

SEQ ID NO: 97916 - DNA, 201 bp, Bos taurus
cgcagaggagaacgggcctgggtcacactgtccatgggaaccgggccgggccaccctcaccacagcctccattcccgccaccccaccatggccagatccttcttttcacagcctcatctcttactccactttttccaatcttctgtgggttcccagtctctgcctcagttatcctgagagcatctctgggaccaagacagc

SEQ ID NO: 97917 - DNA, 201 bp, Bos taurus; identical to SEQ ID NO: 16391

SEQ ID NO: 97918 - DNA, 201 bp, Bos taurus; identical to SEQ ID NO: 16392

SEQ ID NO: 97919 - DNA, 201 bp, Bos taurus; identical to SEQ ID NO: 16393

SEQ ID NO: 97920 - DNA, 201 bp, Bos taurus; identical to SEQ ID NO: 16394

SEQ ID NO: 97921 - DNA, 201 bp, Bos taurus; identical to SEQ ID NO: 16395

SEQ ID NO: 97922 - DNA, 201 bp, Bos taurus; identical to SEQ ID NO: 16396

SEQ ID NO: 97923 - DNA, 201 bp, Bos taurus; identical to SEQ ID NO: 16397

SEQ ID NO: 97924 - DNA, 201 bp, Bos taurus; identical to SEQ ID NO: 16398

SEQ ID NO: 97925 - DNA, 201 bp, Bos taurus; identical to SEQ ID NO: 16399

SEQ ID NO: 97926 - DNA, 201 bp, Bos taurus; identical to SEQ ID NO: 16400

SEQ ID NO: 97927 - DNA, 201 bp, Bos taurus; identical to SEQ ID NO: 16401

SEQ ID NO: 97928 - DNA, 201 bp, Bos taurus; identical to SEQ ID NO: 16402

SEQ ID NO: 97929 - DNA, 201 bp, Bos taurus; identical to SEQ ID NO: 16405

SEQ ID NO: 97930 - DNA, 201 bp, Bos taurus; identical to SEQ ID NO: 16406

SEQ ID NO: 97931 - DNA, 201 bp, Bos taurus
caccctaccgtgtattcacataacctcctttttgttctcactccagcagagacaatgaactctctgatgtctcttctcattagggcactaatcccatcacgaggccccatcctcacaaactcctctaaacctaattacccctcaaacattccatctccagataccatcagatttggggtgagggcttcacaagatggattt

SEQ ID NO: 97932 - DNA, 201 bp, Bos taurus; identical to SEQ ID NO: 16407

SEQ ID NO: 97933 - DNA, 201 bp, Bos taurus; identical to SEQ ID NO: 16408

SEQ ID NO: 97934 - DNA, 201 bp, Bos taurus; identical to SEQ ID NO: 16409

SEQ ID NO: 97935 - DNA, 201 bp, Bos taurus; identical to SEQ ID NO: 16410

SEQ ID NO: 97936 - DNA, 201 bp, Bos taurus; identical to SEQ ID NO: 16411

SEQ ID NO: 97937 - DNA, 201 bp, Bos taurus; identical to SEQ ID NO: 16412

SEQ ID NO: 97938 - DNA, 201 bp, Bos taurus; identical to SEQ ID NO: 16413

SEQ ID NO: 97939 - DNA, 201 bp, Bos taurus; identical to SEQ ID NO: 16414

SEQ ID NO: 97940 - DNA, 201 bp, Bos taurus; identical to SEQ ID NO: 16415

SEQ ID NO: 97941 - DNA, 201 bp, Bos taurus; identical to SEQ ID NO: 16416

SEQ ID NO: 97942 - DNA, 201 bp, Bos taurus; identical to SEQ ID NO: 16417

SEQ ID NO: 97943 - DNA, 201 bp, Bos taurus; identical to SEQ ID NO: 16418

SEQ ID NO: 97944 - DNA, 201 bp, Bos taurus; identical to SEQ ID NO: 16419

SEQ ID NO: 97945 - DNA, 201 bp, Bos taurus; identical to SEQ ID NO: 16420

SEQ ID NO: 97946 - DNA, 201 bp, Bos taurus; identical to SEQ ID NO: 16427

SEQ ID NO: 97947 - DNA, 201 bp, Bos taurus; identical to SEQ ID NO: 16428

SEQ ID NO: 97948 - DNA, 201 bp, Bos taurus; identical to SEQ ID NO: 16429

SEQ ID NO: 97949 - DNA, 201 bp, Bos taurus; identical to SEQ ID NO: 16430

SEQ ID NO: 97950 - DNA, 201 bp, Bos taurus; identical to SEQ ID NO: 16431

SEQ ID NO: 97951 - DNA, 201 bp, Bos taurus
gaattgtgaaccaagaaaagattctaactgcatcttcatttaaacttttttaaggttaatcttattaaaagctttattttgtgttggaatacagtccgtgggattgcaagagtcagacacaactcagccactaatcaacaacagcgaaatagttgtttcaaggcgctgcgttgctttcaggcatgcagcaaagtggttaag

SEQ ID NO: 97952 - DNA, 201 bp, Bos taurus
attgtccgttcagcgttggccacaatccgatgaagtaaatctcacaaactctattttgcaaggaagacactgaactttaaagtggccgtgcgaatttcccaggttcatacgatatccaagcgacagacgtggacctgaagatggtacccgtggaagctcagcccaaactctgaggcattgttctgttcactttcctgtaga

SEQ ID NO: 97953 - DNA, 201 bp, Bos taurus; identical to SEQ ID NO: 16432

SEQ ID NO: 97954 - DNA, 201 bp, Bos taurus; identical to SEQ ID NO: 16433

SEQ ID NO: 97955 - DNA, 201 bp, Bos taurus; identical to SEQ ID NO: 16434

SEQ ID NO: 97956 - DNA, 201 bp, Bos taurus; identical to SEQ ID NO: 16435

SEQ ID NO: 97957 - DNA, 201 bp, Bos taurus; identical to SEQ ID NO: 16436

SEQ ID NO: 97958 - DNA, 201 bp, Bos taurus; identical to SEQ ID NO: 16438

SEQ ID NO: 97959 - DNA, 201 bp, Bos taurus; identical to SEQ ID NO: 16439

SEQ ID NO: 97960 - DNA, 201 bp, Bos taurus; identical to SEQ ID NO: 16441

SEQ ID NO: 97961 - DNA, 201 bp, Bos taurus; identical to SEQ ID NO: 16443

SEQ ID NO: 97962 - DNA, 201 bp, Bos taurus; identical to SEQ ID NO: 16444

SEQ ID NO: 97963 - DNA, 201 bp, Bos taurus; identical to SEQ ID NO: 16446

SEQ ID NO: 97964 - DNA, 201 bp, Bos taurus
cccatcatcacagcattaatatcaagcacccacctagtcctctactctgcccagttaatgaagttctgttctcaaagctttggaaagaagttttaataaggatggtcaggtctggccagcaggctcttgtcaagggatccaggcagaattttttccagtggaaggtctgcaacaatttattccggtcagactgctactaag

SEQ ID NO: 97965 - DNA, 201 bp, Bos taurus; identical to SEQ ID NO: 16447

SEQ ID NO: 97966 - DNA, 201 bp, Bos taurus; identical to SEQ ID NO: 16448

SEQ ID NO: 97967 - DNA, 201 bp, Bos taurus
gtgactaaatgtagggatggggatgggccaggaaaagggatggtgagcatggaaacaacaactgggaaacgggacccacagtgcttacttgagcaaaggcgataagaagttaacctccttgatggccctgtctccccagtgagtgatactgcaactttctatttctgacaaaaataaagattattatagatatggcagagg

SEQ ID NO: 97968 - DNA, 201 bp, Bos taurus; identical to SEQ ID NO: 16450

SEQ ID NO: 97969 - DNA, 201 bp, Bos taurus; identical to SEQ ID NO: 16451

SEQ ID NO: 97970 - DNA, 201 bp, Bos taurus; identical to SEQ ID NO: 16452

SEQ ID NO: 97971 - DNA, 201 bp, Bos taurus; identical to SEQ ID NO: 16454

SEQ ID NO: 97972 - DNA, 201 bp, Bos taurus; identical to SEQ ID NO: 16455

SEQ ID NO: 97973 - DNA, 201 bp, Bos taurus; identical to SEQ ID NO: 16456

SEQ ID NO: 97974 - DNA, 201 bp, Bos taurus
tccccacaatggcaaacccaacacaggaaaggatttgaattctgccaagaatcagccaggtccccaagcatcgcagccattcctgagcccaggacagaagatactcttggtggccactgctctgcaagtctccaggtggctcctatcagccttgtgtgtgtgtctctctctcttttttttttttttaattatggtaaaata

SEQ ID NO: 97975 - DNA, 201 bp, Bos taurus; identical to SEQ ID NO: 16459

SEQ ID NO: 97976 - DNA, 201 bp, Bos taurus
ggcaggaaatctagcaatatgtgcttttcacaagtgcccaatcacttaattagcataataaccccaatgcagcatctacaagaacttcagagattgaagggaggctttccaagaggcagaaattttcaaagggcaaaaataaacagacaggaaataacaggaaaagtacaaaggggtcatgaagcaataagaaaaatgtca

SEQ ID NO: 97977 - DNA, 201 bp, Bos taurus; identical to SEQ ID NO: 16461

SEQ ID NO: 97978 - DNA, 201 bp, Bos taurus
aatgatatgtataaagggcctggcctcatgagctgggaagagttttacaagtagaaaacacttaaatataaaccaggtcataagacacagagggcctgaagagctgcaggcagcttcttatcaaatggatcatttctgagctctgaacaggtgttatagacgttactggataagaagttactggatgaggtctatatttat

SEQ ID NO: 97979 - DNA, 201 bp, Bos taurus
caatttttccgtaaccatttggcaatcattaaagcttcgcagttgctggttttcctactggtgttttacaacctaaggtaaaaacagagagatggctcatgaaatcatacaacacttgggcactggcgaaagaaaaacacacgacatctgtgcagagttttacagactgaaaaacaatcagtggagacagcagcaccgtta

SEQ ID NO: 97980 - DNA, 201 bp, Bos taurus; identical to SEQ ID NO: 16464

SEQ ID NO: 97981 - DNA, 201 bp, Bos taurus
gaaggaaattgcaacccactccagtattcttgtctgggaatcttcaggactgagaagtttggtgggctacagaccataggatcgcaaaacagtcagacacgatttcctgacaaaacaacaacagattgactaatggtatctagcttcttttcatcagttaatttttgacttgtataacttctttggagaaaagtttactga

SEQ ID NO: 97982 - DNA, 201 bp, Bos taurus; identical to SEQ ID NO: 16465

SEQ ID NO: 97983 - DNA, 201 bp, Bos taurus; identical to SEQ ID NO: 16466

SEQ ID NO: 97984 - DNA, 201 bp, Bos taurus
atgattttgagctaactgattttgagcattttctacatgtagaacttaagtgtttcatatacattccttctttcaattctcagatctaactacggtctaccgaactcgatcaagaagaaaatttgcattatttggtgttggcccatgatagtgaaggacaggggagcctggagtgctgcagtccgtggggtcacaaagagc

SEQ ID NO: 97985 - DNA, 201 bp, Bos taurus; identical to SEQ ID NO: 16467

SEQ ID NO: 97986 - DNA, 201 bp, Bos taurus; identical to SEQ ID NO: 16469

SEQ ID NO: 97987 - DNA, 201 bp, Bos taurus; identical to SEQ ID NO: 16470

SEQ ID NO: 97988 - DNA, 201 bp, Bos taurus; identical to SEQ ID NO: 16471

SEQ ID NO: 97989 - DNA, 201 bp, Bos taurus
ggaggactgggagcccaggagaggtgtggacacctggctcctactgcaggcttagcacaggtgaacttggccctgggtggcaccaaaggaagtgggcctgtgcaagcttcacaacctttgaggctgctacctgtggacggggctttcctctttgctcgtcaagaactgtgcccctcacttttggctttggggatgaaggaa

SEQ ID NO: 97990 - DNA, 201 bp, Bos taurus
tctcactgtggcttcagcctgggctctggcaggactgggtgtctgggttcccacacccagaagttgggctccagcccagacacatgggagaggtttgctgccaggcccagaccaaaggtgggcatatattaatagttctgacccccagcctctcctggatgactcctgctggtacagagacccatctcctgccctatgcgt

SEQ ID NO: 97991 - DNA, 201 bp, Bos taurus
tgcacatcacaggtgatgaggactgactacccgagcaggcagcgaaagggtggggataagaagagccgatcaggcggccttgcccctctatgggggtggggggtggtggcagtgaacaccattgctataactcagatacacaggagatcctcagacaggcccccagaatggtctgccctctgcagatcctgcttgttaccc

SEQ ID NO: 97992 - DNA, 201 bp, Bos taurus; identical to SEQ ID NO: 16475

SEQ ID NO: 97993 - DNA, 201 bp, Bos taurus; identical to SEQ ID NO: 16476

SEQ ID NO: 97994 - DNA, 201 bp, Bos taurus
tctgttttggtgttatgaatagaaattcattaataactccaaatgtatgaagttattttcaccagtgcatatgtctatttggaaatatttatagaatacacattgcattggccaaaaatttcattcgagtttttgcatgttaaggaaccaaggctggagatttaggtgccttatctcttcatgcacacaaaggctattttt

SEQ ID NO: 97995 - DNA, 201 bp, Bos taurus; identical to SEQ ID NO: 16479

SEQ ID NO: 97996 - DNA, 201 bp, Bos taurus; identical to SEQ ID NO: 16480

SEQ ID NO: 97997 - DNA, 201 bp, Bos taurus; identical to SEQ ID NO: 16481

SEQ ID NO: 97998 - DNA, 201 bp, Bos taurus
gcagggaggctccaaaatatacggttggccaaaaagttcattcagatttttctgtaagatgtaatgaaaaaaaacaaacaaacttttggccaatccactatagcacttgacaagccaaagcagcttggattttataatgtgacctcagcagaagtcgttcaatgcagagaaaggaagaggttcattcaggcctccaaaagt

SEQ ID NO: 97999 - DNA, 201 bp, Bos taurus; identical to SEQ ID NO: 16482

SEQ ID NO: 98000 - DNA, 201 bp, Bos taurus; identical to SEQ ID NO: 16483

SEQ ID NO: 98001 - DNA, 201 bp, Bos taurus; identical to SEQ ID NO: 16484

SEQ ID NO: 98002 - DNA, 201 bp, Bos taurus; identical to SEQ ID NO: 16485

SEQ ID NO: 98003 - DNA, 201 bp, Bos taurus; identical to SEQ ID NO: 16487

SEQ ID NO: 98004 - DNA, 201 bp, Bos taurus; identical to SEQ ID NO: 57271

SEQ ID NO: 98005 - DNA, 201 bp, Bos taurus; identical to SEQ ID NO: 16491

SEQ ID NO: 98006 - DNA, 201 bp, Bos taurus; identical to SEQ ID NO: 16492

SEQ ID NO: 98007 - DNA, 201 bp, Bos taurus; identical to SEQ ID NO: 16493

SEQ ID NO: 98008 - DNA, 201 bp, Bos taurus; identical to SEQ ID NO: 16494

SEQ ID NO: 98009 - DNA, 201 bp, Bos taurus; identical to SEQ ID NO: 16496

SEQ ID NO: 98010 - DNA, 201 bp, Bos taurus
tgtgtgtgtttctcacgacatggccaggagggagccggtctcatcacccacaggcaggttatctcactcgtccaaggtcaccagagtgtgtcgcagcctgagtttaaacccaggtcaggtggccctaatccattctctcagcaacggcaccattctataatttctctcttacacactttttacttcacagatttttttcct

SEQ ID NO: 98011 - DNA, 201 bp, Bos taurus; identical to SEQ ID NO: 16497

SEQ ID NO: 98012 - DNA, 201 bp, Bos taurus; identical to SEQ ID NO: 16498

SEQ ID NO: 98013 - DNA, 201 bp, Bos taurus
gccctggggcctgtgctctgcaacaagagaagccaccaccgtgagaagcctgtgccccgcaactagagtagaccccgctgaccacagctagagagagcccgtgtacaacaatgaagagcctgtgcagccgaaaaaatttaaaaataaacttaaaaagataaaacaaaaataaaagcatagtattgaaaaaataaaattcta

SEQ ID NO: 98014 - DNA, 201 bp, Bos taurus; identical to SEQ ID NO: 16499

SEQ ID NO: 98015 - DNA, 201 bp, Bos taurus
agattgccttgggtagtatagtcattttaactgaattgattcttcaatccaagaacatggtatatttttctgtgtcatcttcaatgttttctttttctcccaccgcccccagccccaccaccttcagttcctttcatcatcatcatatagtttttagagtacaggttttttgcctcctttactagttttattcctaagtat

SEQ ID NO: 98016 - DNA, 201 bp, Bos taurus; identical to SEQ ID NO: 16501

SEQ ID NO: 98017 - DNA, 201 bp, Bos taurus; identical to SEQ ID NO: 16502

SEQ ID NO: 98018 - DNA, 201 bp, Bos taurus; identical to SEQ ID NO: 16503

SEQ ID NO: 98019 - DNA, 201 bp, Bos taurus; identical to SEQ ID NO: 16504

SEQ ID NO: 98020 - DNA, 201 bp, Bos taurus; identical to SEQ ID NO: 16505

SEQ ID NO: 98021 - DNA, 201 bp, Bos taurus
gaacaagaaggcagaggaagagggaattctttctttctccttgagctgggacaccaccttctccccttggacatcaggctttcagacttggactcagacgcacacctggttcccaggccttcagatttggactgaaccacaccaccagcctccagcttgcagatggcagactgtgggacttctcaacatctatcaaggagc

SEQ ID NO: 98022 - DNA, 201 bp, Bos taurus; identical to SEQ ID NO: 16506

SEQ ID NO: 98023 - DNA, 201 bp, Bos taurus
gaattctttacctctgtgctacctgagaagggccttgggaattaaactgacaaaagacttgtaggaattaagatgtgtttgagtttcacaaggaaaatatactcgagattgtggccaagtgttgttgctgctgctgctaagtcgcttcagccatggccaagtgattgaggcttaaatactgttttagactaaagttaggaa

SEQ ID NO: 98024 - DNA, 201 bp, Bos taurus; identical to SEQ ID NO: 16507

SEQ ID NO: 98025 - DNA, 201 bp, Bos taurus; identical to SEQ ID NO: 16508

SEQ ID NO: 98026 - DNA, 201 bp, Bos taurus
agacaccttaagtagactgtcattttaatttgttgaataattctccctccaagacttctgacataatcaggagtggttgctcaggagactgatggcatagctgtcgctgtgatatgtccctccccatcatcctgacagttcttttcacctctctcatagctgtttagatttcagtttcctcatacttggtttaatctctta

SEQ ID NO: 98027 - DNA, 201 bp, Bos taurus
aaaaaaaaaaaaaatccgaacattatgcttcagaacaagatgtgtagctttataaggagcaaagatcaagttccagcttccaggcccctccctggagctacgtgttggcagcctgctctctcctaagcctctaccaactaagattaacttaacctggaagccggagtaggagccagggagggatggaggcaggggctggcc

SEQ ID NO: 98028 - DNA, 201 bp, Bos taurus; identical to SEQ ID NO: 16509

SEQ ID NO: 98029 - DNA, 201 bp, Bos taurus; identical to SEQ ID NO: 16510

SEQ ID NO: 98030 - DNA, 201 bp, Bos taurus; identical to SEQ ID NO: 16511

SEQ ID NO: 98031 - DNA, 201 bp, Bos taurus; identical to SEQ ID NO: 16513

SEQ ID NO: 98032 - DNA, 201 bp, Bos taurus; identical to SEQ ID NO: 16514

SEQ ID NO: 98033 - DNA, 201 bp, Bos taurus; identical to SEQ ID NO: 16515

SEQ ID NO: 98034 - DNA, 201 bp, Bos taurus; identical to SEQ ID NO: 16516

SEQ ID NO: 98035 - DNA, 201 bp, Bos taurus; identical to SEQ ID NO: 16517

SEQ ID NO: 98036 - DNA, 201 bp, Bos taurus; identical to SEQ ID NO: 16518

SEQ ID NO: 98037 - DNA, 201 bp, Bos taurus; identical to SEQ ID NO: 16519

SEQ ID NO: 98038 - DNA, 201 bp, Bos taurus; identical to SEQ ID NO: 16520

SEQ ID NO: 98039 - DNA, 201 bp, Bos taurus; identical to SEQ ID NO: 16521

SEQ ID NO: 98040 - DNA, 201 bp, Bos taurus; identical to SEQ ID NO: 16522

SEQ ID NO: 98041 - DNA, 201 bp, Bos taurus; identical to SEQ ID NO: 16523

SEQ ID NO: 98042 - DNA, 201 bp, Bos taurus; identical to SEQ ID NO: 16524

SEQ ID NO: 98043 - DNA, 201 bp, Bos taurus; identical to SEQ ID NO: 16525

SEQ ID NO: 98044 - DNA, 201 bp, Bos taurus; identical to SEQ ID NO: 16526

SEQ ID NO: 98045 - DNA, 201 bp, Bos taurus; identical to SEQ ID NO: 16527

SEQ ID NO: 98046 - DNA, 201 bp, Bos taurus
aatattttaataaattctttcttacttctttatgcaaagattacctggataaatacattttctataaccatgaagtaaaattaatgatatattctaaatgaatggaaaaacatgatatttcattataatgtgtatggataaggcaattatggccaattaaatataaagatataagcaattcaaaactttttaaacatatca

SEQ ID NO: 98047 - DNA, 201 bp, Bos taurus
aaaaaaaaacttaaaaaaataatgaggttatttttaaaaagaagaaggaagtaaatgaaaatcaaagacttgccctaccagatgtccagacttattctgagattgtcatcatgaagaatttggtactgtcacagagacatacaaattgacaagtggaatacagaacagagaaacagatttgcacatgtgtaaaactgtagt

SEQ ID NO: 98048 - DNA, 201 bp, Bos taurus; identical to SEQ ID NO: 16528

SEQ ID NO: 98049 - DNA, 201 bp, Bos taurus; identical to SEQ ID NO: 16529

SEQ ID NO: 98050 - DNA, 201 bp, Bos taurus; identical to SEQ ID NO: 16530

SEQ ID NO: 98051 - DNA, 201 bp, Bos taurus; identical to SEQ ID NO: 16531

SEQ ID NO: 98052 - DNA, 201 bp, Bos taurus
gtaatctcaatgtttctgtattttcaaaattataaataaccatgcagcaagttctttcttatcttcactaagatttcatgttctgtgtcttgcctgagaatataattcctgaggtttgattgttcaggtttccacttcctggaaccaagaaagaaaatatatttcaaattagaaagacattttaacagagttaataggact

SEQ ID NO: 98053 - DNA, 201 bp, Bos taurus; identical to SEQ ID NO: 16532

SEQ ID NO: 98054 - DNA, 201 bp, Bos taurus
tgggatccagctccctgaccagggattgaaccaggctccctgctggaagtgtgtaatcttaaccactgcaccaccaactaagtccccatttcccagtatttaaaaaaaaaaagtgaaattgacgaacagttttcctttacttgtctgtatgtaaatctgcattctgactgcacagagaactcggctgtaatccgtaacttt

SEQ ID NO: 98055 - DNA, 201 bp, Bos taurus
gataacatgattgtctatgtagaaaattccagagaatcagcaacaaaaaattctcctgacactagaaaacagtcacagaaaggttaccgaatatgatgctgaggcaggtcatacaaagaaaggagctatcaagtaacagaggtacagaagaaccttagatgcatatggctaaatgagacaagtcaatcggaaaaggtttta

SEQ ID NO: 98056 - DNA, 201 bp, Bos taurus; identical to SEQ ID NO: 16534

SEQ ID NO: 98057 - DNA, 201 bp, Bos taurus
aagaggagggaaccagaggagatgacatcagagcccgggcagcggcggcagggggtcggagggagctaacagtccccctttccacccggggccccccaccgtgttggaagtcaggctcgcttctcacttactgatgccctgcctgcccttggtgctaagattcggccttttccactctgtgaagttaggtaccgctcatcc

SEQ ID NO: 98058 - DNA, 201 bp, Bos taurus
cctctgttctgagcaaaagttaagattcccatgtggcctgtgaagctttcgaggctgctgctgccccaggctagaggaggcctcagtccacaccggctctaggctgtccacctgcagagctcttgcacactgaggagcagggtgtgtttaaggctggcctagagagctggccgaagtaggggtcgtatcaggaaccatggg

SEQ ID NO: 98059 - DNA, 201 bp, Bos taurus; identical to SEQ ID NO: 16535

SEQ ID NO: 98060 - DNA, 201 bp, Bos taurus
ccagaagtcttgcctagtacacaattctacctcctaagtgtaagtggaaggacttcagaattagtcacaccaaaaaaagaatatgtgaaatatagtagagaaaatttatgctttgcacatgcatctctaatgtcagggatgatgacaacccgaggcacagacatgatattcaagtgcatgtcttatgtgttggaggaaggt

SEQ ID NO: 98061 - DNA, 201 bp, Bos taurus; identical to SEQ ID NO: 16536

SEQ ID NO: 98062 - DNA, 201 bp, Bos taurus; identical to SEQ ID NO: 16539

SEQ ID NO: 98063 - DNA, 201 bp, Bos taurus; identical to SEQ ID NO: 16541

SEQ ID NO: 98064 - DNA, 201 bp, Bos taurus
actatagagatcccactggctcctgtcaacctctccctagtaacaatgcatttgcctcaagcaaagcagtccacaattactctggtccagggccttccccgcagaggcaccttaatgcccatcactaaggaagaaagagagggtcatgcatcattctgttcacagcctgatctgaaggtcaaaagctctgcctcttgccat

SEQ ID NO: 98065 - DNA, 201 bp, Bos taurus
ttgccctcacccgccatagataaccaggtagtctcaagtccgtcaaggaaaacatcagaccactctgaagccggccaagaaaaagagatactctgtctaacaaactttttctcaaggacctccccacaggcatgattgagactgcttccaccaaatactttcatgtcaattggtctaataagttagaagaatagcattttc

SEQ ID NO: 98066 - DNA, 201 bp, Bos taurus
actaacattgttaagaggaaactgaaatcacagatggatcaggtggttgtagatgaggacctaggtgttctaaatgagtttcaagcagacaaagaacagttcagggatcccagagaactgctgttggtaacctctgaggaatcagagaagaaaaagtataattatcatcccctttctcacaaaataaaggagtggattcta

SEQ ID NO: 98067 - DNA, 201 bp, Bos taurus
tgacagtggcctaaaggatctccattttccttcatttctcctgtcttgctcagggttcaggtgctttacttaagtgctctctgcttcttttagcaaggctttcaccaggatgtgatgctcaaattattggacccgtaagttttcttttcctatgttatattggacatctaatgccctagctttttttatatatgtatcttt

SEQ ID NO: 98068 - DNA, 201 bp, Bos taurus
agggttggtttggcatattacacacatttgcttttttcaagtcagtaaaacctacatgattcgcaccaatcaaccgtagacccgcctagcacgctgggagcgggccaatgtaacaggaggcagaaattcagccctacacaaaggagtctacagtacttgggggtaaaattgtatggatacactcaaactcagctctgccaa

SEQ ID NO: 98069 - DNA, 201 bp, Bos taurus; identical to SEQ ID NO: 16543

SEQ ID NO: 98070 - DNA, 201 bp, Bos taurus; identical to SEQ ID NO: 16544

SEQ ID NO: 98071 - DNA, 201 bp, Bos taurus; identical to SEQ ID NO: 16545

SEQ ID NO: 98072 - DNA, 201 bp, Bos taurus; identical to SEQ ID NO: 16546

SEQ ID NO: 98073 - DNA, 201 bp, Bos taurus; identical to SEQ ID NO: 16547

SEQ ID NO: 98074 - DNA, 201 bp, Bos taurus; identical to SEQ ID NO: 16548

SEQ ID NO: 98075 - DNA, 201 bp, Bos taurus; identical to SEQ ID NO: 16549

SEQ ID NO: 98076 - DNA, 201 bp, Bos taurus; identical to SEQ ID NO: 16550

SEQ ID NO: 98077 - DNA, 201 bp, Bos taurus; identical to SEQ ID NO: 16551

SEQ ID NO: 98078 - DNA, 201 bp, Bos taurus; identical to SEQ ID NO: 16552

SEQ ID NO: 98079 - DNA, 201 bp, Bos taurus; identical to SEQ ID NO: 16553

SEQ ID NO: 98080 - DNA, 201 bp, Bos taurus; identical to SEQ ID NO: 16554

SEQ ID NO: 98081 - DNA, 201 bp, Bos taurus; identical to SEQ ID NO: 16555

SEQ ID NO: 98082 - DNA, 201 bp, Bos taurus; identical to SEQ ID NO: 16556

SEQ ID NO: 98083 - DNA, 201 bp, Bos taurus; identical to SEQ ID NO: 16557

SEQ ID NO: 98084 - DNA, 201 bp, Bos taurus; identical to SEQ ID NO: 16558

SEQ ID NO: 98085 - DNA, 201 bp, Bos taurus
tgtggcccagtgctttgttcttctttggaacaccagagagtaagagacctactcacttggcaatgcggtttagcccccatcctactgtacctgggccatgtccaagctcagaaccacattctgcctcaactagggctaacactttagggataggtttgaattgtttgcttcaggccaaagccagtaaatgcattaggaagc

SEQ ID NO: 98086 - DNA, 201 bp, Bos taurus; identical to SEQ ID NO: 16559

SEQ ID NO: 98087 - DNA, 201 bp, Bos taurus; identical to SEQ ID NO: 16560

SEQ ID NO: 98088 - DNA, 201 bp, Bos taurus
aagggaaagctatgctgagagagtttaagtctttcctttgaaaacatggcaatctgcagtgtttatgcttacagtatggaacctgagatgaagtcagaacttgggaggtgggccttaggtggaaataaaaactctcagttctttctgagccttgattttggaggccttgggttgtgatggagatattcaggagtgcagtgg

SEQ ID NO: 98089 - DNA, 201 bp, Bos taurus; identical to SEQ ID NO: 16562

SEQ ID NO: 98090 - DNA, 201 bp, Bos taurus; identical to SEQ ID NO: 16563

SEQ ID NO: 98091 - DNA, 201 bp, Bos taurus; identical to SEQ ID NO: 16565

SEQ ID NO: 98092 - DNA, 201 bp, Bos taurus
cacaggaaggtgaagtgatttacccagagtcacacagcagtttagtaacaaggcagggaataaacagaactaaatttctgacattaacgctcctctggcagtgttataggttatatgttaatggcctattcagtagctgtttgcacttcacctcatgttctctcatcctgaaagaactaaaaaaattcataacaaaaaaac

SEQ ID NO: 98093 - DNA, 201 bp, Bos taurus
ctacatgtcttctctttgatgtttctgccaaagaagggaagagtatactgagatctgtcccggaacccgaaccatttatgcttaggtcaaagaaaaggctgaagctcttggctacaactgtgttgggtgatactggcagatttcattcattcttgctagttataggctgtgctcacacaattaagacagaaatgacaaggt

SEQ ID NO: 98094 - DNA, 201 bp, Bos taurus; identical to SEQ ID NO: 16566

SEQ ID NO: 98095 - DNA, 201 bp, Bos taurus; identical to SEQ ID NO: 16567

SEQ ID NO: 98096 - DNA, 201 bp, Bos taurus; identical to SEQ ID NO: 16568

SEQ ID NO: 98097 - DNA, 201 bp, Bos taurus
tttatggtcactctgtattttaagccagtaatacatataactcttcaacactgtgtggaaaattaatcaaattatttgtgtggccataatgccatggaccggagaaggcaatggcaccccactccagtactcttgcctggaaaatcccatggacggaggagcctggtaggctgcagtccatggggtcgctgagggtcggac

SEQ ID NO: 98098 - DNA, 201 bp, Bos taurus
ccttcctaccttctttctctgctacttctaagctattttgtagagagttttcaaagtagtcttcaggaaaatcaattgtatcacttcacttccctcctcacgaactaacagtggtttcccattggccacagactagaggccctcaactataagttggaagatttccataacatgattctttacatcataggcaagtagctg

SEQ ID NO: 98099 - DNA, 201 bp, Bos taurus; identical to SEQ ID NO: 16571

SEQ ID NO: 98100 - DNA, 201 bp, Bos taurus
ttgcagctctggatctttgaggcctgatggaggcctgtagtttacctgactagggatggggaagaagccatcagtcctgtgagttcggggcagtccatcccgtgggagaaggaggaggcccctgctgtagttaggctgcctaaagtaaccttccagagttatttctagacaattttgcttgtcacacatactaaccttaac

SEQ ID NO: 98101 - DNA, 201 bp, Bos taurus; identical to SEQ ID NO: 16572

SEQ ID NO: 98102 - DNA, 201 bp, Bos taurus; identical to SEQ ID NO: 16573

SEQ ID NO: 98103 - DNA, 201 bp, Bos taurus; identical to SEQ ID NO: 16574

SEQ ID NO: 98104 - DNA, 201 bp, Bos taurus; identical to SEQ ID NO: 16575

SEQ ID NO: 98105 - DNA, 201 bp, Bos taurus; identical to SEQ ID NO: 16576

SEQ ID NO: 98106 - DNA, 201 bp, Bos taurus; identical to SEQ ID NO: 16578

SEQ ID NO: 98107 - DNA, 201 bp, Bos taurus; identical to SEQ ID NO: 16579

SEQ ID NO: 98108 - DNA, 201 bp, Bos taurus; identical to SEQ ID NO: 16581

SEQ ID NO: 98109 - DNA, 201 bp, Bos taurus; identical to SEQ ID NO: 16582

SEQ ID NO: 98110 - DNA, 201 bp, Bos taurus; identical to SEQ ID NO: 16584

SEQ ID NO: 98111 - DNA, 201 bp, Bos taurus; identical to SEQ ID NO: 16585

SEQ ID NO: 98112 - DNA, 201 bp, Bos taurus; identical to SEQ ID NO: 16586

SEQ ID NO: 98113 - DNA, 201 bp, Bos taurus; identical to SEQ ID NO: 16588

SEQ ID NO: 98114 - DNA, 201 bp, Bos taurus; identical to SEQ ID NO: 16589

SEQ ID NO: 98115 - DNA, 201 bp, Bos taurus; identical to SEQ ID NO: 16591

SEQ ID NO: 98116 - DNA, 201 bp, Bos taurus; identical to SEQ ID NO: 16592

SEQ ID NO: 98117 - DNA, 201 bp, Bos taurus; identical to SEQ ID NO: 16593

SEQ ID NO: 98118 - DNA, 201 bp, Bos taurus; identical to SEQ ID NO: 16594

SEQ ID NO: 98119 - DNA, 201 bp, Bos taurus; identical to SEQ ID NO: 16595

SEQ ID NO: 98120 - DNA, 201 bp, Bos taurus; identical to SEQ ID NO: 16596

SEQ ID NO: 98121 - DNA, 201 bp, Bos taurus; identical to SEQ ID NO: 16597

SEQ ID NO: 98122 - DNA, 201 bp, Bos taurus; identical to SEQ ID NO: 16598

SEQ ID NO: 98123 - DNA, 201 bp, Bos taurus; identical to SEQ ID NO: 16601

SEQ ID NO: 98124 - DNA, 201 bp, Bos taurus; identical to SEQ ID NO: 16602

SEQ ID NO: 98125 - DNA, 201 bp, Bos taurus; identical to SEQ ID NO: 16603

SEQ ID NO: 98126 - DNA, 201 bp, Bos taurus; identical to SEQ ID NO: 16606

SEQ ID NO: 98127 - DNA, 201 bp, Bos taurus; identical to SEQ ID NO: 16608

SEQ ID NO: 98128 - DNA, 201 bp, Bos taurus; identical to SEQ ID NO: 16609

SEQ ID NO: 98129 - DNA, 201 bp, Bos taurus; identical to SEQ ID NO: 16610

SEQ ID NO: 98130 - DNA, 201 bp, Bos taurus; identical to SEQ ID NO: 16611

SEQ ID NO: 98131 - DNA, 201 bp, Bos taurus; identical to SEQ ID NO: 16612

SEQ ID NO: 98132 - DNA, 201 bp, Bos taurus; identical to SEQ ID NO: 16617

SEQ ID NO: 98133 - DNA, 201 bp, Bos taurus; identical to SEQ ID NO: 16618

SEQ ID NO: 98134 - DNA, 201 bp, Bos taurus; identical to SEQ ID NO: 16619

SEQ ID NO: 98135 - DNA, 201 bp, Bos taurus; identical to SEQ ID NO: 16620

SEQ ID NO: 98136 - DNA, 201 bp, Bos taurus; identical to SEQ ID NO: 16621

SEQ ID NO: 98137 - DNA, 201 bp, Bos taurus; identical to SEQ ID NO: 16622

SEQ ID NO: 98138 - DNA, 201 bp, Bos taurus; identical to SEQ ID NO: 16625

SEQ ID NO: 98139 - DNA, 201 bp, Bos taurus; identical to SEQ ID NO: 16626

SEQ ID NO: 98140 - DNA, 201 bp, Bos taurus; identical to SEQ ID NO: 16629

SEQ ID NO: 98141 - DNA, 201 bp, Bos taurus; identical to SEQ ID NO: 16633

SEQ ID NO: 98142 - DNA, 201 bp, Bos taurus; identical to SEQ ID NO: 16634

SEQ ID NO: 98143 - DNA, 201 bp, Bos taurus; identical to SEQ ID NO: 16635

SEQ ID NO: 98144 - DNA, 201 bp, Bos taurus; identical to SEQ ID NO: 16638

SEQ ID NO: 98145 - DNA, 201 bp, Bos taurus; identical to SEQ ID NO: 16639

SEQ ID NO: 98146 - DNA, 201 bp, Bos taurus; identical to SEQ ID NO: 16640

SEQ ID NO: 98147 - DNA, 201 bp, Bos taurus; identical to SEQ ID NO: 16641

SEQ ID NO: 98148 - DNA, 201 bp, Bos taurus; identical to SEQ ID NO: 16642

SEQ ID NO: 98149 - DNA, 201 bp, Bos taurus; identical to SEQ ID NO: 16645

SEQ ID NO: 98150 - DNA, 201 bp, Bos taurus; identical to SEQ ID NO: 16648

SEQ ID NO: 98151 - DNA, 201 bp, Bos taurus; identical to SEQ ID NO: 16649

SEQ ID NO: 98152 - DNA, 201 bp, Bos taurus; identical to SEQ ID NO: 16651

SEQ ID NO: 98153 - DNA, 201 bp, Bos taurus; identical to SEQ ID NO: 16652

SEQ ID NO: 98154 - DNA, 201 bp, Bos taurus; identical to SEQ ID NO: 16655

SEQ ID NO: 98155 - DNA, 201 bp, Bos taurus; identical to SEQ ID NO: 16656

SEQ ID NO: 98156 - DNA, 201 bp, Bos taurus; identical to SEQ ID NO: 16658

SEQ ID NO: 98157 - DNA, 201 bp, Bos taurus; identical to SEQ ID NO: 16659

SEQ ID NO: 98158 - DNA, 201 bp, Bos taurus; identical to SEQ ID NO: 16661

SEQ ID NO: 98159 - DNA, 201 bp, Bos taurus; identical to SEQ ID NO: 16662

SEQ ID NO: 98160 - DNA, 201 bp, Bos taurus; identical to SEQ ID NO: 16663

SEQ ID NO: 98161 - DNA, 201 bp, Bos taurus; identical to SEQ ID NO: 16664

SEQ ID NO: 98162 - DNA, 201 bp, Bos taurus; identical to SEQ ID NO: 16665

SEQ ID NO: 98163 - DNA, 201 bp, Bos taurus; identical to SEQ ID NO: 16666

SEQ ID NO: 98164 - DNA, 201 bp, Bos taurus; identical to SEQ ID NO: 16667

SEQ ID NO: 98165 - DNA, 201 bp, Bos taurus; identical to SEQ ID NO: 16668

SEQ ID NO: 98166 - DNA, 201 bp, Bos taurus; identical to SEQ ID NO: 16669

SEQ ID NO: 98167 - DNA, 201 bp, Bos taurus; identical to SEQ ID NO: 16670

SEQ ID NO: 98168 - DNA, 201 bp, Bos taurus; identical to SEQ ID NO: 16671

SEQ ID NO: 98169 - DNA, 201 bp, Bos taurus; identical to SEQ ID NO: 16672

SEQ ID NO: 98170 - DNA, 201 bp, Bos taurus; identical to SEQ ID NO: 16673

SEQ ID NO: 98171 - DNA, 201 bp, Bos taurus; identical to SEQ ID NO: 16674

SEQ ID NO: 98172 - DNA, 201 bp, Bos taurus; identical to SEQ ID NO: 16675

SEQ ID NO: 98173 - DNA, 201 bp, Bos taurus; identical to SEQ ID NO: 16676

SEQ ID NO: 98174 - DNA, 201 bp, Bos taurus; identical to SEQ ID NO: 16677

SEQ ID NO: 98175 - DNA, 201 bp, Bos taurus; identical to SEQ ID NO: 16678

SEQ ID NO: 98176 - DNA, 201 bp, Bos taurus; identical to SEQ ID NO: 16679

SEQ ID NO: 98177 - DNA, 201 bp, Bos taurus; identical to SEQ ID NO: 16680

SEQ ID NO: 98178 - DNA, 201 bp, Bos taurus; identical to SEQ ID NO: 16682

SEQ ID NO: 98179 - DNA, 201 bp, Bos taurus; identical to SEQ ID NO: 16684

SEQ ID NO: 98180 - DNA, 201 bp, Bos taurus; identical to SEQ ID NO: 16687

SEQ ID NO: 98181 - DNA, 201 bp, Bos taurus; identical to SEQ ID NO: 16688

SEQ ID NO: 98182 - DNA, 201 bp, Bos taurus; identical to SEQ ID NO: 16690

SEQ ID NO: 98183 - DNA, 201 bp, Bos taurus; identical to SEQ ID NO: 16691

SEQ ID NO: 98184 - DNA, 201 bp, Bos taurus; identical to SEQ ID NO: 16692

SEQ ID NO: 98185 - DNA, 201 bp, Bos taurus; identical to SEQ ID NO: 16693

SEQ ID NO: 98186 - DNA, 201 bp, Bos taurus; identical to SEQ ID NO: 16694

SEQ ID NO: 98187 - DNA, 201 bp, Bos taurus; identical to SEQ ID NO: 16696

SEQ ID NO: 98188 - DNA, 201 bp, Bos taurus; identical to SEQ ID NO: 16698

SEQ ID NO: 98189 - DNA, 201 bp, Bos taurus; identical to SEQ ID NO: 16699

SEQ ID NO: 98190 - DNA, 201 bp, Bos taurus; identical to SEQ ID NO: 16700

SEQ ID NO: 98191 - DNA, 201 bp, Bos taurus; identical to SEQ ID NO: 16701

SEQ ID NO: 98192 - DNA, 201 bp, Bos taurus; identical to SEQ ID NO: 16702

SEQ ID NO: 98193 - DNA, 201 bp, Bos taurus; identical to SEQ ID NO: 16703

SEQ ID NO: 98194 - DNA, 201 bp, Bos taurus; identical to SEQ ID NO: 16704

SEQ ID NO: 98195 - DNA, 201 bp, Bos taurus; identical to SEQ ID NO: 16705

SEQ ID NO: 98196 - DNA, 201 bp, Bos taurus; identical to SEQ ID NO: 16706

SEQ ID NO: 98197 - DNA, 201 bp, Bos taurus; identical to SEQ ID NO: 16707

SEQ ID NO: 98198 - DNA, 201 bp, Bos taurus; identical to SEQ ID NO: 16709

SEQ ID NO: 98199 - DNA, 201 bp, Bos taurus; identical to SEQ ID NO: 57429

SEQ ID NO: 98200 - DNA, 201 bp, Bos taurus; identical to SEQ ID NO: 16710

SEQ ID NO: 98201 - DNA, 201 bp, Bos taurus; identical to SEQ ID NO: 16716

SEQ ID NO: 98202 - DNA, 201 bp, Bos taurus; identical to SEQ ID NO: 16718

SEQ ID NO: 98203 - DNA, 201 bp, Bos taurus; identical to SEQ ID NO: 16720

SEQ ID NO: 98204 - DNA, 201 bp, Bos taurus; identical to SEQ ID NO: 16721

SEQ ID NO: 98205 - DNA, 201 bp, Bos taurus; identical to SEQ ID NO: 16722

SEQ ID NO: 98206 - DNA, 201 bp, Bos taurus; identical to SEQ ID NO: 16723

SEQ ID NO: 98207 - DNA, 201 bp, Bos taurus; identical to SEQ ID NO: 16724

SEQ ID NO: 98208 - DNA, 201 bp, Bos taurus; identical to SEQ ID NO: 16725

SEQ ID NO: 98209 - DNA, 201 bp, Bos taurus; identical to SEQ ID NO: 16726

SEQ ID NO: 98210 - DNA, 201 bp, Bos taurus; identical to SEQ ID NO: 16727

SEQ ID NO: 98211 - DNA, 201 bp, Bos taurus; identical to SEQ ID NO: 16728

SEQ ID NO: 98212 - DNA, 201 bp, Bos taurus; identical to SEQ ID NO: 16729

SEQ ID NO: 98213 - DNA, 201 bp, Bos taurus; identical to SEQ ID NO: 16730

SEQ ID NO: 98214 - DNA, 201 bp, Bos taurus; identical to SEQ ID NO: 16731

SEQ ID NO: 98215 - DNA, 201 bp, Bos taurus; identical to SEQ ID NO: 16732

SEQ ID NO: 98216 - DNA, 201 bp, Bos taurus; identical to SEQ ID NO: 16733

SEQ ID NO: 98217 - DNA, 201 bp, Bos taurus; identical to SEQ ID NO: 16734

SEQ ID NO: 98218 - DNA, 201 bp, Bos taurus; identical to SEQ ID NO: 57448

SEQ ID NO: 98219 - DNA, 201 bp, Bos taurus; identical to SEQ ID NO: 16735

SEQ ID NO: 98220 - DNA, 201 bp, Bos taurus; identical to SEQ ID NO: 16736

SEQ ID NO: 98221 - DNA, 201 bp, Bos taurus; identical to SEQ ID NO: 16737

SEQ ID NO: 98222 - DNA, 201 bp, Bos taurus; identical to SEQ ID NO: 16738

SEQ ID NO: 98223 - DNA, 201 bp, Bos taurus; identical to SEQ ID NO: 16739

SEQ ID NO: 98224 - DNA, 201 bp, Bos taurus; identical to SEQ ID NO: 16740

SEQ ID NO: 98225 - DNA, 201 bp, Bos taurus; identical to SEQ ID NO: 16742

SEQ ID NO: 98226 - DNA, 201 bp, Bos taurus
cagtatgtaatcaactataaataagaaaaatggccgaactaataaataaaccaaacaccaaatctctgagcaaaccaataaaccagaaatgcagaagtcgaaagcacaaattcataaaataataaatgatggaggaaaaatcatgatatttggaggaaattaaaagattgacaagaggctatgctgttcaactatgcaaaa

SEQ ID NO: 98227 - DNA, 201 bp, Bos taurus
ccaagttggagactcagacaggaggcgatttgtagcaggagcatgtgctaggggatggagagaagtggcagcaaggtccagtttctgaatgtggccagcctgccgaggaagaataaaggctgaagaaagttggctggcaccaaggtgagcccagatggctcacggccacatgaagaccctgagaaaatgaaatattatggt

SEQ ID NO: 98228 - DNA, 201 bp, Bos taurus; identical to SEQ ID NO: 16746

SEQ ID NO: 98229 - DNA, 201 bp, Bos taurus
gaggccctgctggaacatcttggttggactgagggagggggaggggaaggcctgagctccaggaagggggactctggagacaggaaagcctgagtgcccttaagttgcacctaagcccctaggccggagttcctgtgacaaaggatggtgaagactccctttcagtaagcagagcgggtgctcctgggccgggcctgggcc

SEQ ID NO: 98230 - DNA, 201 bp, Bos taurus; identical to SEQ ID NO: 16749

SEQ ID NO: 98231 - DNA, 201 bp, Bos taurus
aatcgctaatgtacaaagcctgtagaaatcattttgcagctattaaagaagcaaaatgaaaatttatggtaatagaacttgaagctggccagtgcatggtcctgctggcacaattattcattgctggtggagtttgaagtggaaagaactcttttgaatggcattgcagacatatttagtaagggccataaaagtattcat

SEQ ID NO: 98232 - DNA, 201 bp, Bos taurus; identical to SEQ ID NO: 16750

SEQ ID NO: 98233 - DNA, 201 bp, Bos taurus; identical to SEQ ID NO: 16751

SEQ ID NO: 98234 - DNA, 201 bp, Bos taurus; identical to SEQ ID NO: 16753

SEQ ID NO: 98235 - DNA, 201 bp, Bos taurus; identical to SEQ ID NO: 16754

SEQ ID NO: 98236 - DNA, 201 bp, Bos taurus; identical to SEQ ID NO: 16756

SEQ ID NO: 98237 - DNA, 201 bp, Bos taurus; identical to SEQ ID NO: 16757

SEQ ID NO: 98238 - DNA, 201 bp, Bos taurus; identical to SEQ ID NO: 16758

SEQ ID NO: 98239 - DNA, 201 bp, Bos taurus; identical to SEQ ID NO: 16759

SEQ ID NO: 98240 - DNA, 201 bp, Bos taurus; identical to SEQ ID NO: 16760

SEQ ID NO: 98241 - DNA, 201 bp, Bos taurus; identical to SEQ ID NO: 16762

SEQ ID NO: 98242 - DNA, 201 bp, Bos taurus; identical to SEQ ID NO: 16763

SEQ ID NO: 98243 - DNA, 201 bp, Bos taurus; identical to SEQ ID NO: 16764

SEQ ID NO: 98244 - DNA, 201 bp, Bos taurus; identical to SEQ ID NO: 16765

SEQ ID NO: 98245 - DNA, 201 bp, Bos taurus; identical to SEQ ID NO: 16766

SEQ ID NO: 98246 - DNA, 201 bp, Bos taurus; identical to SEQ ID NO: 16768

SEQ ID NO: 98247 - DNA, 201 bp, Bos taurus; identical to SEQ ID NO: 16769

SEQ ID NO: 98248 - DNA, 201 bp, Bos taurus; identical to SEQ ID NO: 16770

SEQ ID NO: 98249 - DNA, 201 bp, Bos taurus; identical to SEQ ID NO: 16771

SEQ ID NO: 98250 - DNA, 201 bp, Bos taurus; identical to SEQ ID NO: 16772

SEQ ID NO: 98251 - DNA, 201 bp, Bos taurus
cacaatgtcccttcatagtgctgtccctactgttactcttattacttgacaccaggatagctgcagtgggctttaacctcttcttttggagccccttcactgccacggacgcctttcaccaaaccctgccagattcacttccctgaagcatgtgtctgatcactccagagtgctgctcaagattcttctgaatgttcctgt

SEQ ID NO: 98252 - DNA, 201 bp, Bos taurus; identical to SEQ ID NO: 16773

SEQ ID NO: 98253 - DNA, 201 bp, Bos taurus
aaagccaattgattccaggatggatcatagctgttcctgaaacaggctaccccacatgctgatttagtaccaaaggccctagatcaggccatgttgggtgttgggtaacggcattgtctggatgacattttgtgagtctcacatcctctctggggtccctcccttccctctgtcaccatattctttctgcttgttctctct

SEQ ID NO: 98254 - DNA, 201 bp, Bos taurus; identical to SEQ ID NO: 16775

SEQ ID NO: 98255 - DNA, 201 bp, Bos taurus; identical to SEQ ID NO: 16776

SEQ ID NO: 98256 - DNA, 201 bp, Bos taurus; identical to SEQ ID NO: 16780

SEQ ID NO: 98257 - DNA, 201 bp, Bos taurus; identical to SEQ ID NO: 16782

SEQ ID NO: 98258 - DNA, 201 bp, Bos taurus; identical to SEQ ID NO: 16783

SEQ ID NO: 98259 - DNA, 201 bp, Bos taurus; identical to SEQ ID NO: 57494

SEQ ID NO: 98260 - DNA, 201 bp, Bos taurus; identical to SEQ ID NO: 16784

SEQ ID NO: 98261 - DNA, 201 bp, Bos taurus; identical to SEQ ID NO: 16786

SEQ ID NO: 98262 - DNA, 201 bp, Bos taurus; identical to SEQ ID NO: 16788

SEQ ID NO: 98263 - DNA, 201 bp, Bos taurus; identical to SEQ ID NO: 16791

SEQ ID NO: 98264 - DNA, 201 bp, Bos taurus; identical to SEQ ID NO: 16794

SEQ ID NO: 98265 - DNA, 201 bp, Bos taurus
gattcaaatcaaagaacaaactaagaaggccaggccatttctgtttaaaaaaagaatgctcttaagcagagagagagatgtcaggaactgtcagtgacaacgccggtggggccccaggcaaaggccagccgtcctctcactcctctgggcgactccacattttcgtgctctcagccacaaccagcaacacctcaaaaacca

SEQ ID NO: 98266 - DNA, 201 bp, Bos taurus; identical to SEQ ID NO: 16795

SEQ ID NO: 98267 - DNA, 201 bp, Bos taurus
agtggaacaagtttggagttttgtgttgaggcctagatttaaatctgccacttagaactgttttgagtgtaggcaacttgttttaccttagttatttccttctttgtcattcatgtaggggcctcagtaccaaccttgcaggattgttaagagagagaatatgcaaagatcttcattaattatctggcacttgaaacttgg

SEQ ID NO: 98268 - DNA, 201 bp, Bos taurus; identical to SEQ ID NO: 16796

SEQ ID NO: 98269 - DNA, 201 bp, Bos taurus; identical to SEQ ID NO: 16797

SEQ ID NO: 98270 - DNA, 201 bp, Bos taurus; identical to SEQ ID NO: 16798

SEQ ID NO: 98271 - DNA, 201 bp, Bos taurus
actttcctgccttcctgggccctagggaggtgggggtcaaatgcataccttgatccttgatctccaaagagaaagacttcaggaagaagcacccccatcactgtccctggggcaggcccaccatcatacttattaaaagtgcccagaatcctttcccaccaaggccgcccccggcaggggcgtggccatggggagggtggg

SEQ ID NO: 98272 - DNA, 201 bp, Bos taurus; identical to SEQ ID NO: 16800

SEQ ID NO: 98273 - DNA, 201 bp, Bos taurus
caggcaagttgtctttgagttaaaccaaaattgggccagaggactgagaaattgttcaaggtctcacaggcatgatgcagtgctggcacgattgagacacaagttcctccaactcctaaacctgtgcttgtgaataacacgcaatgttgaggatgtttagggaccagccatgagcgtgaggacctgcacacaggaacaccg

SEQ ID NO: 98274 - DNA, 201 bp, Bos taurus; identical to SEQ ID NO: 16801

SEQ ID NO: 98275 - DNA, 201 bp, Bos taurus; identical to SEQ ID NO: 16802

SEQ ID NO: 98276 - DNA, 201 bp, Bos taurus; identical to SEQ ID NO: 16803

SEQ ID NO: 98277 - DNA, 201 bp, Bos taurus; identical to SEQ ID NO: 16806

SEQ ID NO: 98278 - DNA, 201 bp, Bos taurus; identical to SEQ ID NO: 16807

SEQ ID NO: 98279 - DNA, 201 bp, Bos taurus; identical to SEQ ID NO: 16808

SEQ ID NO: 98280 - DNA, 201 bp, Bos taurus; identical to SEQ ID NO: 16809

SEQ ID NO: 98281 - DNA, 201 bp, Bos taurus; identical to SEQ ID NO: 16810

SEQ ID NO: 98282 - DNA, 201 bp, Bos taurus; identical to SEQ ID NO: 16811

SEQ ID NO: 98283 - DNA, 201 bp, Bos taurus; identical to SEQ ID NO: 16812

SEQ ID NO: 98284 - DNA, 201 bp, Bos taurus; identical to SEQ ID NO: 16813

SEQ ID NO: 98285 - DNA, 201 bp, Bos taurus; identical to SEQ ID NO: 16814

SEQ ID NO: 98286 - DNA, 201 bp, Bos taurus
caggactcttcccttcactgatactcttttgcctaattaagtttttaaaaaaatattcctgctccatctccaaatctatctttctctatttttgcctaccttgaccaatggcatcaagagaatgggtttgttttttttaagtattctttaaaaattcggtattaagaatatgttcttgcttgtgtgacctcacttcattgc

SEQ ID NO: 98287 - DNA, 201 bp, Bos taurus; identical to SEQ ID NO: 16815

SEQ ID NO: 98288 - DNA, 201 bp, Bos taurus
gtcaggatatgttctttccatggaaacagtagagatacaagatctaagccttgcttccattatatatccaaaatccgcaagtactatggccaaacccaaaagtcaaagatggaagaggacttatattcagcctttttagttgcagaagctgaagacttgcaaagaaaagggtgtggataatgggaggaacagggccaacaa

SEQ ID NO: 98289 - DNA, 201 bp, Bos taurus; identical to SEQ ID NO: 16816

SEQ ID NO: 98290 - DNA, 201 bp, Bos taurus; identical to SEQ ID NO: 16817

SEQ ID NO: 98291 - DNA, 201 bp, Bos taurus
ccaaggcgtcttcaggccttggctggaccgccactagagtctcctaactggtcttcttacatcacaatctgaccatctccctcctcctcttctccgcacagctgccagggtatcttgccaagaggcctgtctgatcagatatgaacttaagacgaggaccagacaaaccacagagccctgatggccccgcttggtctgatc

SEQ ID NO: 98292 - DNA, 201 bp, Bos taurus
ttagttctgcagcacccccagactcttcttcaacttttgttttattggaagaatgggatttttataaagcctaagaagagtccacgatcggaacactgtccgcaagcctggtctttggcaggggcgtatggactggggcgggggcgggggcgtgcagccagctcacggggcagccccagcgcagcttccgggccaggtacc

SEQ ID NO: 98293 - DNA, 201 bp, Bos taurus
tctgtccctgagaagctggttccatcaatcaggaaagacaaacaaggaataacactgcggtgtgcagagtgttacaatagagccgatacaggctcccagacaccacagactggggctctgtaacctggtccgggtgcctgggaaggcatgcctgcaaaagccacactgaagcagaggcctgaagggttctgacctacatta

SEQ ID NO: 98294 - DNA, 201 bp, Bos taurus; identical to SEQ ID NO: 16818

SEQ ID NO: 98295 - DNA, 201 bp, Bos taurus; identical to SEQ ID NO: 16819

SEQ ID NO: 98296 - DNA, 201 bp, Bos taurus; identical to SEQ ID NO: 16820

SEQ ID NO: 98297 - DNA, 201 bp, Bos taurus; identical to SEQ ID NO: 16821

SEQ ID NO: 98298 - DNA, 201 bp, Bos taurus; identical to SEQ ID NO: 16822

SEQ ID NO: 98299 - DNA, 201 bp, Bos taurus
gtagtggcactgaaggacagcaaagctcatttcaaatttctacgctccccttgtgatctgtgaagacccagcagagccagaaggcatgcagcatggcccggtgcatgatgacggcacagggcatagaggagtctgggttatgtctctcctcggaagaggcaagagcttcatagggtcaaaagtgggcgaacaccgctgagg

SEQ ID NO: 98300 - DNA, 201 bp, Bos taurus; identical to SEQ ID NO: 16823

SEQ ID NO: 98301 - DNA, 201 bp, Bos taurus
taccatcagtcaaagcagcagcttccaaataaggcagagagtgtaggcagcgagcttaggtggcatgtcccctcaaacgtgagacgctgttgcagaggccatgaggacagctgcatatacttcccagcccacggcgtccatgcgctctaacacccgtgtttcttcaaagacagaagaatgacctcaggcccagaatagaaa

SEQ ID NO: 98302 - DNA, 201 bp, Bos taurus
gatgtaggcctctgtctctcaggaattctgcagaaggcagttggaaggggacttattcacgatcctggaggcactagggtaatgcatttcacaggacacgactggtcctgttagagctccaggccccgagcgcagactgcgggccaggcaccctgtctgaggctgtgcacactgatctcattgccttctttatgaacagct

SEQ ID NO: 98303 - DNA, 201 bp, Bos taurus; identical to SEQ ID NO: 16824

SEQ ID NO: 98304 - DNA, 201 bp, Bos taurus; identical to SEQ ID NO: 16825

SEQ ID NO: 98305 - DNA, 201 bp, Bos taurus
gaagcagaagagaatagctgccaagtccatgccaagtccttcaatcatgcagtcaagaaatacattattttaatttcaacattcatggagccctgtgatatttctccccagatagtattttattttgatttatatatgatctctaggataataattctactttttccttcagttttctgtccactaccttacagttgcttt

SEQ ID NO: 98306 - DNA, 201 bp, Bos taurus; identical to SEQ ID NO: 16826

SEQ ID NO: 98307 - DNA, 201 bp, Bos taurus; identical to SEQ ID NO: 16827

SEQ ID NO: 98308 - DNA, 201 bp, Bos taurus; identical to SEQ ID NO: 16828

SEQ ID NO: 98309 - DNA, 201 bp, Bos taurus
agagtcggaaagggtgcttctgctgcaggaggagaaaggaagctgaggaggttagaagggggagatcgcactcttctaaggcaggaggccattctgcctcaggagatgaaggaacgggagcaccagcaaggacgtcagaggcagtggacaagggttgggaaggccgtgagagcacttggtacaagggtatttaggaaaaag

SEQ ID NO: 98310 - DNA, 201 bp, Bos taurus; identical to SEQ ID NO: 16829

SEQ ID NO: 98311 - DNA, 201 bp, Bos taurus
tcaaggttatcctactttttaaaaacactgtaacaaggtgatgtatttcaactggtcaatttgtgttcttttctttggccaaagcacaaatacagtcagcttgttatcaggggcagtttgactaaacagctattaccgtcaccaaatcttaggcctagcttgactaagaatgtcgtttaaataactgagttaagtgtaata

SEQ ID NO: 98312 - DNA, 201 bp, Bos taurus; identical to SEQ ID NO: 16830

SEQ ID NO: 98313 - DNA, 201 bp, Bos taurus; identical to SEQ ID NO: 16831

SEQ ID NO: 98314 - DNA, 201 bp, Bos taurus; identical to SEQ ID NO: 16832

SEQ ID NO: 98315 - DNA, 201 bp, Bos taurus; identical to SEQ ID NO: 16833

SEQ ID NO: 98316 - DNA, 201 bp, Bos taurus
gagccacttgagaattctgaaagtcacatagaaatttacttggctctcattatccaagaaaagcatattcccgttcctcagaaaaaaacaaatgggtatatcaagaataagagtggaaggggaagggaaaagcaaattgtatctccctctgtttagattgtggaatcaagttatttacttgcctagcatgaatgtagactc

SEQ ID NO: 98317 - DNA, 201 bp, Bos taurus; identical to SEQ ID NO: 16834

SEQ ID NO: 98318 - DNA, 201 bp, Bos taurus; identical to SEQ ID NO: 16835

SEQ ID NO: 98319 - DNA, 201 bp, Bos taurus; identical to SEQ ID NO: 16836

SEQ ID NO: 98320 - DNA, 201 bp, Bos taurus; identical to SEQ ID NO: 16837

SEQ ID NO: 98321 - DNA, 201 bp, Bos taurus; identical to SEQ ID NO: 16838

SEQ ID NO: 98322 - DNA, 201 bp, Bos taurus; identical to SEQ ID NO: 16839

SEQ ID NO: 98323 - DNA, 201 bp, Bos taurus; identical to SEQ ID NO: 16840

SEQ ID NO: 98324 - DNA, 201 bp, Bos taurus; identical to SEQ ID NO: 16841

SEQ ID NO: 98325 - DNA, 201 bp, Bos taurus
acagatgcaaccccagtgtcagagacaattcactcaataaatgcatttaaagagtaaatgaatgcatgacaatgcgcacaacttccacttcattattccacgccactggactggtaatccaaacctgagcactatctctgagaaagtccattcaggccaatatctgcttggtatctttccatctctcattcatagtctgga

SEQ ID NO: 98326 - DNA, 201 bp, Bos taurus; identical to SEQ ID NO: 16842

SEQ ID NO: 98327 - DNA, 201 bp, Bos taurus
gaaagagaagcttgattctgtgcttgagttcagcatcccaggctctctgctgatccagagactcacaggaaggcccccagaatggccattcatacacaagaagttcaatcccctaaaggcgtccatgaaagatggtatcacagaggaacccttgatctgccaatcagatgataataaaaaggccttgaaaatccaccctga

SEQ ID NO: 98328 - DNA, 201 bp, Bos taurus
aaaggtggggaaaggcaggggtctctagcctccaaatgtaaccttttgctcattatagccccattacaacgatattagccttacagatatgaagtaccactgatgccaagactagggatgtaaatccctccactcctcggggaggagaagctgggatgacaatcagggaggaagattcccaagcccctctctccccggtga

SEQ ID NO: 98329 - DNA, 201 bp, Bos taurus
aagcactgtgctaagtactttgtatggatttcacatgtacaactttgtgctgaatacctatgtgcttgataaagggccaagctcctccatctccctaattccctcacctaaggggctgtatatctcattgctggggtctttctgtgaacaggctaagtattgagtcacataattagaaatggccactagaaaccacattgg

SEQ ID NO: 98330 - DNA, 201 bp, Bos taurus
gtagtttaaaagatatcctattgctttatcttacattttcatgaatcatcatctagactctaaatatgacccattcagaccttgcaaggtattgaaaatgaaaataaactggaaaaataaagcatacatgacagaataactggaggatatattgatcttaaaatggataaaattagatctatatgttatagagaaggaatg

SEQ ID NO: 98331 - DNA, 201 bp, Bos taurus; identical to SEQ ID NO: 16843

SEQ ID NO: 98332 - DNA, 201 bp, Bos taurus; identical to SEQ ID NO: 16844

SEQ ID NO: 98333 - DNA, 201 bp, Bos taurus; identical to SEQ ID NO: 16845

SEQ ID NO: 98334 - DNA, 201 bp, Bos taurus; identical to SEQ ID NO: 16846

SEQ ID NO: 98335 - DNA, 201 bp, Bos taurus; identical to SEQ ID NO: 16847

SEQ ID NO: 98336 - DNA, 201 bp, Bos taurus; identical to SEQ ID NO: 16848

SEQ ID NO: 98337 - DNA, 201 bp, Bos taurus; identical to SEQ ID NO: 16849

SEQ ID NO: 98338 - DNA, 201 bp, Bos taurus; identical to SEQ ID NO: 16851

SEQ ID NO: 98339 - DNA, 201 bp, Bos taurus; identical to SEQ ID NO: 16852

SEQ ID NO: 98340 - DNA, 201 bp, Bos taurus; identical to SEQ ID NO: 16853

SEQ ID NO: 98341 - DNA, 201 bp, Bos taurus
ctgacaccgggcagggcagggcccctttgtttggcttgtaaaaactgcgaaacagaggcgccctcagtgacagccggcgagcagccccaagctggagtggcggcctgtgggctactgtgaggagcatcgatggtggaggtgacctcctgcccggcctcgcaccggctgccccgcaggtgtgaaaggagcctgttctgacat

SEQ ID NO: 98342 - DNA, 201 bp, Bos taurus; identical to SEQ ID NO: 16854

SEQ ID NO: 98343 - DNA, 201 bp, Bos taurus; identical to SEQ ID NO: 16855

SEQ ID NO: 98344 - DNA, 201 bp, Bos taurus; identical to SEQ ID NO: 16856

SEQ ID NO: 98345 - DNA, 201 bp, Bos taurus; identical to SEQ ID NO: 16857

SEQ ID NO: 98346 - DNA, 201 bp, Bos taurus
agcccagttttgcctttgacccactcactagctcatccattaaacaagctcaggttttttctcttctgttattgggccaggagagactctccatgcagccgtaggtattagcttcaggagaattactgatttattattatggtgggtgacatggagtctggactagctacacatctggcacacaagtgcttgctggccttg

SEQ ID NO: 98347 - DNA, 201 bp, Bos taurus
ttattgtgatcatttcacagtgtatacaaatatcgaatcattatgttgtacacctaatataatgtcaattatatctcaatttaaaaaggataaagccccagtgagcactaacaggtaaggtataggcgtaagcagagaggcttactcagaggatgaagaaggcagggggcagtgaggagcgggtcatgaagagtatattag

SEQ ID NO: 98348 - DNA, 201 bp, Bos taurus; identical to SEQ ID NO: 16858

SEQ ID NO: 98349 - DNA, 201 bp, Bos taurus
cgtacctgctgataaggccctctttcttatccactctcactccgtcccccagtcacttcgcagactcacaggcatgcatcatatttactctgcaaacatcaggggtggttctgtggccatcaagtccaaccagtcccagggaggggctaagggaagctcaagccaccacagaaaaccaggaacgtcagcctgcatctcact

SEQ ID NO: 98350 - DNA, 201 bp, Bos taurus; identical to SEQ ID NO: 16859

SEQ ID NO: 98351 - DNA, 201 bp, Bos taurus
taaaggtggcaaagtagcacaaggcaaattatttttctgcaccaaatttgagctttgttttgaatgatcggactatcataaaacagaattaaaggagaaactggtcgactaataaaacactttatgatgcaatgaagatatcagatagcgtaaaaacttggagaaaatgaagtcaaatgaccagagtggaaggagaggttt

SEQ ID NO: 98352 - DNA, 201 bp, Bos taurus
cttgaaattggccatagtggatatatttataccacagaaatcagaaaaaagctagctgctggcttgctttactgtttctttctctctctttctctttttttctttctggccatataacagggcttgtggcatcttagttcccagaccaggggttgaaccttggtcctcggcagtaagagtgcagagtcctaagccctggat

SEQ ID NO: 98353 - DNA, 201 bp, Bos taurus; identical to SEQ ID NO: 16860

SEQ ID NO: 98354 - DNA, 201 bp, Bos taurus
aaacgtttctcaaaatgacaagtgcatattctgtgtgactcagaaattacctctaagaattcatcttacagatttaactgcacatatgtgaaatgagagaggcacagtgtggccttgttcggaaacagctccccacccatcaccattaataaagaactgctaaacctaagttggtgacatacatgtgtagctatttaaaag

SEQ ID NO: 98355 - DNA, 201 bp, Bos taurus
atttgtctatttagaatgagggccttggcctgctcttgccagagcattcccaagattgagaatcctatcttttgggcccatatcaatggctgatggagcctcctgaccttctactccatttacctggtgccttcttgatactttttgcctgaatctctgaaggtacttcctttggattcatgctatggccagatccaatta

SEQ ID NO: 98356 - DNA, 201 bp, Bos taurus; identical to SEQ ID NO: 16861

SEQ ID NO: 98357 - DNA, 201 bp, Bos taurus
ccaggggaagcagatgaagctgtgtaaatgcagcctgcttgttagagttgtagcccatcagtggaatcagccctggcattgatggatgactgctttgttatagactggctggtcaggcccctgaagaagcccaccctttgttcattgccttgtaataaagccccactcttcaatggcaccagccgaggctgtcacctgcca

SEQ ID NO: 98358 - DNA, 201 bp, Bos taurus; identical to SEQ ID NO: 16862

SEQ ID NO: 98359 - DNA, 201 bp, Bos taurus
tggacaccgcagcaacagatcccgcatgacacagccaagacggccggatcaataaacagtaaaccgcagggagagtccaagggttcccagggcttggggactgctgattcaaaggccacgctccccgcgggcacacctctctgccttgccgcggggctgcctcacccccactgcgagaagggcttgccatagcaagtggat

SEQ ID NO: 98360 - DNA, 201 bp, Bos taurus; identical to SEQ ID NO: 16863

SEQ ID NO: 98361 - DNA, 201 bp, Bos taurus; identical to SEQ ID NO: 16864

SEQ ID NO: 98362 - DNA, 201 bp, Bos taurus; identical to SEQ ID NO: 16865

SEQ ID NO: 98363 - DNA, 201 bp, Bos taurus
aaagttttgtttattagctggtgtgtaatttggcctcttcctgcaggtgtctgaaagcccctgggaagcacgcttacccagaagggagaaataaagagctaggtttgcagggcagaggcacagccttgtcttctttttgctgatgcaattttcccccgtgggatttctgctgggtcagccaaccctctgaggtccagggtc

SEQ ID NO: 98364 - DNA, 201 bp, Bos taurus; identical to SEQ ID NO: 16866

SEQ ID NO: 98365 - DNA, 201 bp, Bos taurus
attatatgtatgtatacatataaagagagaagtttattttgaggaattttgtctcatatgatcatggaggctgatgagtccaaactctgcatggtaggcccgcagactgagacccggtaagaatccgtgtcttggtccaagtctgaaggctgtcttctgctgcactccttgttcaggaggggtctgtgttattctactaag

SEQ ID NO: 98366 - DNA, 201 bp, Bos taurus
atctcagagtttgtaaattagaggccatgagaatctgaaccagattatgggcagtggtacggagatcagccaatgggtactttggactgagaaagcagagatcttggtaattgatataaaggccagttgggaaacggggagccaggagtttttcattggttttgttcattcgtttgttttgtgttttggtcttgccttgca

SEQ ID NO: 98367 - DNA, 201 bp, Bos taurus
gggtgagacctccagagcagatgctgcttctcggccgggtttcctgcaggcacgccccctgtggtcgggctcggcaggggagcccagcacctccgctgggagacaagaccgcctctctcctccttttcgtcggaaaccccctgggcatcacccactgtggtcttcgttcttctccacagccgtttcctggtattagattcc

SEQ ID NO: 98368 - DNA, 201 bp, Bos taurus
gcaaacatggcacagagacaaggaacagaggctgctgcggctggcgggagtccctgatcacacccggaagttcatccacccagacatctggtgccctggagagggccagggtggaacccgagaagccctcctcggcctccttccatcactcactgattttggcttacaatttgagcagcaaaagtcatttgcagagggttt

SEQ ID NO: 98369 - DNA, 201 bp, Bos taurus
gggcctggggcttccaagaaagagcaatgcccagggggcttcctgtgactctgcagcacctgggctgacctgaaggaaccgcctctcccactgtcactcaaacctcctgtgctgggccaaggcagttctgtgccttgagctcctctctattcccccactgctgtctccatggggcagctggtcgtcacagggaatcgacgc

SEQ ID NO: 98370 - DNA, 201 bp, Bos taurus; identical to SEQ ID NO: 16867

SEQ ID NO: 98371 - DNA, 201 bp, Bos taurus; identical to SEQ ID NO: 16868

SEQ ID NO: 98372 - DNA, 201 bp, Bos taurus
tccaagctctggggacctttaggaggcccactgagagggtcagccggagcacggagcagggtaaggggacctcgggagggcgggcccgcagagagtaagggagaagcgtgttgctaggacgcgacaaaggctcgctccgttgctagggagtcagaatagggccgtggcccagccccctaggtgtgtctggtcccaggtggc

SEQ ID NO: 98373 - DNA, 201 bp, Bos taurus; identical to SEQ ID NO: 16869

SEQ ID NO: 98374 - DNA, 201 bp, Bos taurus; identical to SEQ ID NO: 16870

SEQ ID NO: 98375 - DNA, 201 bp, Bos taurus; identical to SEQ ID NO: 16871

SEQ ID NO: 98376 - DNA, 201 bp, Bos taurus; identical to SEQ ID NO: 16872

SEQ ID NO: 98377 - DNA, 201 bp, Bos taurus; identical to SEQ ID NO: 16873

SEQ ID NO: 98378 - DNA, 201 bp, Bos taurus; identical to SEQ ID NO: 16874

SEQ ID NO: 98379 - DNA, 201 bp, Bos taurus; identical to SEQ ID NO: 16875

SEQ ID NO: 98380 - DNA, 201 bp, Bos taurus
atacccacataaaccctcctcccacagaacaagcctccaggaccagctgggtttagaactgccatccacccacactgctcttcgaggccagatttctcccatttgtcctaccctatgacctctgtgtctctgggtctctggtgttctttgaaggcactctgctcagcctcagggacagacaggtggcctccagtaaggtct

SEQ ID NO: 98381 - DNA, 201 bp, Bos taurus; identical to SEQ ID NO: 16878

SEQ ID NO: 98382 - DNA, 201 bp, Bos taurus; identical to SEQ ID NO: 16879

SEQ ID NO: 98383 - DNA, 201 bp, Bos taurus; identical to SEQ ID NO: 16880

SEQ ID NO: 98384 - DNA, 201 bp, Bos taurus; identical to SEQ ID NO: 16881

SEQ ID NO: 98385 - DNA, 201 bp, Bos taurus; identical to SEQ ID NO: 16882

SEQ ID NO: 98386 - DNA, 201 bp, Bos taurus
tgtgtgtgtgcgtggtaatgcatattattactgttgagatgtgtgcatcttacagacaggtgtgatgtaccttttctttttgaatgtggagtgcatgtgtggagtgctactttagcttaattgaattgtttatctttagacagctagatcataagagctactatgtcttcatgacaactaatatttggtattattgtttct

SEQ ID NO: 98387 - DNA, 201 bp, Bos taurus
ataccagcactctgtgaaataggaatagcgtgtcattgcacagttactgtgtcccaggcagatccacctataacatttgtagctcttgaagcaaaaatacgtagggaggccatgtgctaaatatttagaagttctaaatcaggctagtgaagcattgctcaatacagttagtcatcttaattcaatagatattctttcaca

SEQ ID NO: 98388 - DNA, 201 bp, Bos taurus; identical to SEQ ID NO: 16883

SEQ ID NO: 98389 - DNA, 201 bp, Bos taurus
ccttaagaaaaaaagaaatatatatatatatgtatatataaatgtcagtgggatgtgggaggtacaggtggccgtggcctggtccagtttggaccagattcttggtccagtttggtttcggataaagattgttaacagtttgtactctacggtttcccagtggccggtttaggctcagatgaatggtgctgggacaataaa

SEQ ID NO: 98390 - DNA, 201 bp, Bos taurus; identical to SEQ ID NO: 16884

SEQ ID NO: 98391 - DNA, 201 bp, Bos taurus
tcatttttgtggacctctgtttgtcaggctaaagagaaactcccatgatcttagaacaaaagtcaggccttttggaatgagactctgtgggccactgatatcaccagttggttctaaggcagctgggagtgagctggctaagggaagacagcttcatctgggccataactatagcttcgtagcaacatggtacagttgaaa

SEQ ID NO: 98392 - DNA, 201 bp, Bos taurus
aattatcttaagtaattattttctctggaagctgtaatgaataagataaatatcattactttacactatacagtgtcatgttaaaatgatacagttggttacaaagtaatgttttcaataaatattatgaggttttaccaacttcaagttcctcttgctggtttaagagacacttaactaatagtaaagaaagtaaatgaa

SEQ ID NO: 98393 - DNA, 201 bp, Bos taurus
agcgagagacctagatggctcagaggaccaccgctcagctctgcacaggcagaaggcacaatagcaagaaaagggggagaggcccaggaggcctggaagacgggctccaccgaggtgaacccacagcatggagcctgaggaggcagcaaaacttctaggtgctgtccctagacaggacataagccctacatggcttaatgc

SEQ ID NO: 98394 - DNA, 201 bp, Bos taurus
actttgaggacatattagtatttttataacagtatttgatggccaaataatcctctttggttagaacctactgccagtgaggccagggtcaaggccataccttctgtctttgatcttacacctgtttcatgttccaaagtcactcaagggcagcttgtcatgaggggcttggggacaaaggcaggtggttgagaacagctg

SEQ ID NO: 98395 - DNA, 201 bp, Bos taurus
tgtttcttgagtatgcctgggtttttttttttttttattaaagtcctaagataaatgtctgtactgttgaacccgctgagtcagacttttcttaaggcccatctgtcactttaactcatcaggcagtctagccctaaatctagaacacatggcaaagataaattgcttagttggagttgaggacgacttggccacaaaggt

SEQ ID NO: 98396 - DNA, 201 bp, Bos taurus; identical to SEQ ID NO: 16885

SEQ ID NO: 98397 - DNA, 201 bp, Bos taurus; identical to SEQ ID NO: 16886

SEQ ID NO: 98398 - DNA, 201 bp, Bos taurus
tgagaatatttgcttattaatattaaatgttaatgattatacaaatataagccttttgatttattttacataatcagaatgcttaagagactgcatatgataatacaaattctaatatatattcttcataatataagcagtattctcagtcccctaaacttatttgctggatataatttttatacattttaggcttttatt

SEQ ID NO: 98399 - DNA, 201 bp, Bos taurus; identical to SEQ ID NO: 16887

SEQ ID NO: 98400 - DNA, 201 bp, Bos taurus; identical to SEQ ID NO: 16888

SEQ ID NO: 98401 - DNA, 201 bp, Bos taurus
ttcatagaaggatattagtggatgttttactgtggcttatgtagcatataacacgaactagcagacagaaatcttcaaatgtgaactgcatttttatgtcatttgaaaggagattctctctgatatttttaatttagttatttggttgcaagaggacattgtcagtatttcaagaagtctttgtcaagtctgtcgagggtt

SEQ ID NO: 98402 - DNA, 201 bp, Bos taurus
tgccctgatattagcatatttttgatatgcaaatttatcataattggagaagccattttcataggtactaagtaagagcgatgtaaatcttgactgggccaccctatggacgtgattctccgcttgtttctgcagggagccccgcaaggtggtcctgcataaaggctccactggcctgggcttcaacatcgtgggcggaga

SEQ ID NO: 98403 - DNA, 201 bp, Bos taurus; identical to SEQ ID NO: 16889

SEQ ID NO: 98404 - DNA, 201 bp, Bos taurus; identical to SEQ ID NO: 16890

SEQ ID NO: 98405 - DNA, 201 bp, Bos taurus
ggtcagtttgcttctgggtctccttgttcacacttgacaaactgcagaggaagcaggtatatggcagagcttcctctcatgtgtggcaaggggcgttcacgcccttgcccttgctccatccaagtgtccatcagtagctcaaagccttgcgatgataccgatggacaagatcactgatgttcctgaaaaaggcagcagcct

SEQ ID NO: 98406 - DNA, 201 bp, Bos taurus; identical to SEQ ID NO: 16891

SEQ ID NO: 98407 - DNA, 201 bp, Bos taurus; identical to SEQ ID NO: 16892

SEQ ID NO: 98408 - DNA, 201 bp, Bos taurus
tccaaggttctatgatgccatgaccctaaacctaactcactaaagaatgctctgaactgaaactcagttccaagaattctgggatgacaagaaatccaaccagttccctgtaggtggtcttgcaaaacctagtgttccaagaagagactggctagtcctttggattttgttctggcataaaattaaataaggataaggaaa

SEQ ID NO: 98409 - DNA, 201 bp, Bos taurus; identical to SEQ ID NO: 16893

SEQ ID NO: 98410 - DNA, 201 bp, Bos taurus; identical to SEQ ID NO: 16894

SEQ ID NO: 98411 - DNA, 201 bp, Bos taurus
cttctgattactttgatggatgatccttactgttaagaaactcatactctggtagggtcagacatagataagcaaatgttgcaacaaagtaatagagatccatacctgttgagagtggtattataggagggtgtgataagcaagtcatcaagagggcaggcagaggagagtatcttgagctggggtacagtgtctgtagat

SEQ ID NO: 98412 - DNA, 201 bp, Bos taurus
gcttttgatacccttaggcttcaccttctcagcttcacaaaagcacaggaaaagcctggaggagcccaaagcactgggagaaaccaagtgtctcctgagtgctgagggcaggacatacagcacacacatgctttctccaccagcctgtggagaagtggcggctgcagtaaccagcgggaatggcatcttggagaagggccc

SEQ ID NO: 98413 - DNA, 201 bp, Bos taurus; identical to SEQ ID NO: 16895

SEQ ID NO: 98414 - DNA, 201 bp, Bos taurus; identical to SEQ ID NO: 16896

SEQ ID NO: 98415 - DNA, 201 bp, Bos taurus; identical to SEQ ID NO: 16897

SEQ ID NO: 98416 - DNA, 201 bp, Bos taurus; identical to SEQ ID NO: 16898

SEQ ID NO: 98417 - DNA, 201 bp, Bos taurus
ctttcctctggcctatcctccccacccctactcccagctcagttcctagtttctcctgggcgcccctctttcaccactgacttgcacataattctcatctcgggaggagggaacttcatctgggccaacttagggaatgtgattcactcacaaggaagctcattttcctcatctggaaaaggaaggttgtatcaactacca

SEQ ID NO: 98418 - DNA, 201 bp, Bos taurus
cgtgaatggtttgaaagcattttgtagacatgaaaatcactatacttatgtaaggaattagtattgattaaaaggggccaagcgggaggattgataaaaaggctcttaaaattctatagttcagatcagttcagtcgctcatcatgcctgactctttgcgaccccatgaatcacagcatgctaggcctccctgtccatcac

SEQ ID NO: 98419 - DNA, 201 bp, Bos taurus; identical to SEQ ID NO: 16899

SEQ ID NO: 98420 - DNA, 201 bp, Bos taurus; identical to SEQ ID NO: 16900

SEQ ID NO: 98421 - DNA, 201 bp, Bos taurus; identical to SEQ ID NO: 16901

SEQ ID NO: 98422 - DNA, 201 bp, Bos taurus; identical to SEQ ID NO: 16902

SEQ ID NO: 98423 - DNA, 201 bp, Bos taurus; identical to SEQ ID NO: 16903

SEQ ID NO: 98424 - DNA, 201 bp, Bos taurus
tattcttacaacttgatgaatcattgacagttcctcacatgtaagtcagccagtcaggaatgaaaacactccagtaaaaagtcttttatgtgccaaccaaccaaaaatttctccattaaagtatttaaatattcataatatgattcactgaaaatccaaccgaccaatttggtctaatacaggtgcctgaaaatccaccaa

SEQ ID NO: 98425 - DNA, 201 bp, Bos taurus; identical to SEQ ID NO: 16904

SEQ ID NO: 98426 - DNA, 201 bp, Bos taurus; identical to SEQ ID NO: 16905

SEQ ID NO: 98427 - DNA, 201 bp, Bos taurus; identical to SEQ ID NO: 16906

SEQ ID NO: 98428 - DNA, 201 bp, Bos taurus
atctcttattttttctcatttagtatttggcctccttgatctatcggtcctaggaaacttgctatcattcagcatttttttaagcatacacgaaaatcaacaattgtcttccttcttttaaaaataggaatatatctacctaaagaaactaaagacctatatatagaaaactataaaacactggtgaaagaaatcaaagag

SEQ ID NO: 98429 - DNA, 201 bp, Bos taurus; identical to SEQ ID NO: 16907

SEQ ID NO: 98430 - DNA, 201 bp, Bos taurus; identical to SEQ ID NO: 16909

SEQ ID NO: 98431 - DNA, 201 bp, Bos taurus; identical to SEQ ID NO: 16910

SEQ ID NO: 98432 - DNA, 201 bp, Bos taurus
ttaggccctactgcacaatcatataatcatcaaattgtagtaataatgagagattattagctctgggagtacagcaaaacaacattttaagttgcaaacacgctgggccactctgagcagtgatcggaaaggcagttgattcctggtgtggagacggacgcatagcaatgtggcccctgaacttcatgtacttccttggca

SEQ ID NO: 98433 - DNA, 201 bp, Bos taurus; identical to SEQ ID NO: 16911

SEQ ID NO: 98434 - DNA, 201 bp, Bos taurus; identical to SEQ ID NO: 16912

SEQ ID NO: 98435 - DNA, 201 bp, Bos taurus; identical to SEQ ID NO: 16913

SEQ ID NO: 98436 - DNA, 201 bp, Bos taurus; identical to SEQ ID NO: 16914

SEQ ID NO: 98437 - DNA, 201 bp, Bos taurus
tccctctgtccctgcccccagcactcactgctctgcagggaatggaagaggggcgaggagtacacggaggtgtctgggcctcgccaagtccagaacagagctcttgaacccagggatcatctactcccaggcaccccaccctgcctcccccagccggccccttcctccattcagctctgtctataaacagctccaccacgg

SEQ ID NO: 98438 - DNA, 201 bp, Bos taurus; identical to SEQ ID NO: 16915

SEQ ID NO: 98439 - DNA, 201 bp, Bos taurus; identical to SEQ ID NO: 16916

SEQ ID NO: 98440 - DNA, 201 bp, Bos taurus; identical to SEQ ID NO: 16917

SEQ ID NO: 98441 - DNA, 201 bp, Bos taurus; identical to SEQ ID NO: 16918

SEQ ID NO: 98442 - DNA, 201 bp, Bos taurus; identical to SEQ ID NO: 16921

SEQ ID NO: 98443 - DNA, 201 bp, Bos taurus; identical to SEQ ID NO: 16922

SEQ ID NO: 98444 - DNA, 201 bp, Bos taurus; identical to SEQ ID NO: 16923

SEQ ID NO: 98445 - DNA, 201 bp, Bos taurus; identical to SEQ ID NO: 16924

SEQ ID NO: 98446 - DNA, 201 bp, Bos taurus; identical to SEQ ID NO: 16925

SEQ ID NO: 98447 - DNA, 201 bp, Bos taurus; identical to SEQ ID NO: 16926

SEQ ID NO: 98448 - DNA, 201 bp, Bos taurus; identical to SEQ ID NO: 16927

SEQ ID NO: 98449 - DNA, 201 bp, Bos taurus; identical to SEQ ID NO: 16928

SEQ ID NO: 98450 - DNA, 201 bp, Bos taurus
tttcaccatcgacagttcccgaatggccctagacttcattatcttgctgagagtctccttccttaactcaggcaatggctggccaagaactgaatggacaactgaagaatgaatcattttcattctttaggataatttttgatcttgcctgccattatccttaggaccaaaatatgagagatgggccatattttagaaaag

SEQ ID NO: 98451 - DNA, 201 bp, Bos taurus; identical to SEQ ID NO: 16931

SEQ ID NO: 98452 - DNA, 201 bp, Bos taurus
ttctgcaaaagggtctaacatgcagcctggcctgcagctgaacaaagaattgagcaaatatagaaggagagctagctggctacttacaggcccctcctccaccagaggcagagaggcaggcatgccacagccagagccagaaggcaaggggctgccacaatcttgggccctgagacagcatcttccaccaaactgtgagga

SEQ ID NO: 98453 - DNA, 201 bp, Bos taurus; identical to SEQ ID NO: 16932

SEQ ID NO: 98454 - DNA, 201 bp, Bos taurus; identical to SEQ ID NO: 16933

SEQ ID NO: 98455 - DNA, 201 bp, Bos taurus; identical to SEQ ID NO: 16934

SEQ ID NO: 98456 - DNA, 201 bp, Bos taurus
tttcccagtttaaaatggcccgctgcgcaggtgcttgtctttgattagagcattctctttcttgctatctgccattgcttcccaggtggagctgtatatgtcccattcatatgaggtggcccatgctgtactgtgagatgcctgtttttaaaagtcatcacttcatagctggaataatttcttactcatggataattttta

SEQ ID NO: 98457 - DNA, 201 bp, Bos taurus
tttcccttcacttgaacacttagagtattgttattattattaattggcctaatttcaattttgttctgtctcaggaaatagggaggcccaaggagaggaagagagaagtggagacagtcagtcagtggagcagtcacataacacacacatttagcagttaagttcaatatctttataggcaaggttcaatactttggccac

SEQ ID NO: 98458 - DNA, 201 bp, Bos taurus
aaacatgtatccactgatttcaacattaatgagtttttattccaagaagattacagttttcaccaggtaattcagtcccttgggcagacaatattattaattatgttttacaaagcatccttgtccctagactagaaactatgaaaaataaatatatgatcattaaaaaggattagtaatttcatcagtactaatgttagt

SEQ ID NO: 98459 - DNA, 201 bp, Bos taurus
acaataattctcaagttaagtatcattgaatcagaccagtgcataactttggatctggaatatattaaatgtcaagtcagagttcgagtaatctgcatacattttgtcaaagattaaaagcaattttggaataactgggaacaaaagtataacaaggacttgacctagaaatgtgaaatcgtcttcacctcctagggcgtg

SEQ ID NO: 98460 - DNA, 201 bp, Bos taurus
ggaggcctggcgtgctgcagtccatgtggtcataaagagttagacatgactgagtgactgaatgaactgaattcagaaaaacgtgtaatgatgaactggtagaatggccttctaaaatttctgttaaataccaactggaagaaaatgctacacaagataggagcatagtccaagagggcatggtatgcaccttatatgtgc

SEQ ID NO: 98461 - DNA, 201 bp, Bos taurus
cttcactaaagtaaacaaagagattatcttctttatagtcccacattctctctgcagaggtgtctagggtgttttgactctgtcctcaattatctataagcggccacagtcctgccttcctagttggcttttgtgaagcttgggcttgtttcctaaaatgtaaaattttactattaaagtcaaatatctcaaagacatttg

SEQ ID NO: 98462 - DNA, 201 bp, Bos taurus; identical to SEQ ID NO: 16936

SEQ ID NO: 98463 - DNA, 201 bp, Bos taurus; identical to SEQ ID NO: 16937

SEQ ID NO: 98464 - DNA, 201 bp, Bos taurus
ttttctgagataacagataggattagatgcgccagagacttttggagaaactatatttgagaacaaatggaaaagggacaaggaaacagaaagaggcctcagatctggggatggaggagaggggggtggagagagactaggaggaaggctccaagctgctgcacaggataagaaatcttctgccaagacaatgcaggccag

SEQ ID NO: 98465 - DNA, 201 bp, Bos taurus
gagggggattgttattagtttagttcttagtaagctacatgttcaagcacatctgaatttattcttatttatttcatttgccatttagaagtgacaccgccatgtactcaaagatctgttgaaatgtgtcactggcaaagaacaaggaaataaaaataagttacaaggtcattaacagttctttcttcaccgtggatccta

SEQ ID NO: 98466 - DNA, 201 bp, Bos taurus
tttggtttctactgagcaaggtgagtgataaaatctttaaacagtaagaagctctgttgtctgatagacagggactatgaagaagattatttatctttttacaaggccttttgtttaaatgaataatactctgagaccttaacagataattttatagttagattggatcctcgtatcaagaaacttttccaggtctgaagt

SEQ ID NO: 98467 - DNA, 201 bp, Bos taurus
tgcaaagagtcggacacaactgagctactgatctgaactgaactgaatgcatggtacaagactatgctattgtgtgacactggcaagttttgaattttatgtatacttctctttggctctgtcatcttagtgaagtttgaagttttcccaatcttagtttccttgtatgtaaaataggagaataaatgcacatgccttcta

SEQ ID NO: 98468 - DNA, 201 bp, Bos taurus; identical to SEQ ID NO: 16939

SEQ ID NO: 98469 - DNA, 201 bp, Bos taurus; identical to SEQ ID NO: 16940

SEQ ID NO: 98470 - DNA, 201 bp, Bos taurus; identical to SEQ ID NO: 16942

SEQ ID NO: 98471 - DNA, 201 bp, Bos taurus; identical to SEQ ID NO: 16943

SEQ ID NO: 98472 - DNA, 201 bp, Bos taurus; identical to SEQ ID NO: 16944

SEQ ID NO: 98473 - DNA, 201 bp, Bos taurus
taatcttctttaatcctggggaaatgtggactaaactgtactgcccctgcagcaactgctaatatttcatcacaagatcgaatgtttgcattaacactaacatggcctttaagcttcctatcccattgagtctcaaggaaatagaatcagggaaatgaccaagaaagtaagaatcaaaaagagaagttggtgctgcctagc

SEQ ID NO: 98474 - DNA, 201 bp, Bos taurus; identical to SEQ ID NO: 16946

SEQ ID NO: 98475 - DNA, 201 bp, Bos taurus; identical to SEQ ID NO: 16947

SEQ ID NO: 98476 - DNA, 201 bp, Bos taurus; identical to SEQ ID NO: 16948

SEQ ID NO: 98477 - DNA, 201 bp, Bos taurus; identical to SEQ ID NO: 16949

SEQ ID NO: 98478 - DNA, 201 bp, Bos taurus; identical to SEQ ID NO: 16950

SEQ ID NO: 98479 - DNA, 201 bp, Bos taurus; identical to SEQ ID NO: 16951

SEQ ID NO: 98480 - DNA, 201 bp, Bos taurus
ctcacaagagtagagtcaaatttagtaacatattatcagagggtcattgattatttgcaaattcaataggatttagatgacagagcagttgagggcaataccttcaaatattttggctatagctcagctggtaaagaacctgcctgccaatgcaagagatacatgagatgtgggtttgatccctgggttgggaagattccc

SEQ ID NO: 98481 - DNA, 201 bp, Bos taurus; identical to SEQ ID NO: 16953

SEQ ID NO: 98482 - DNA, 201 bp, Bos taurus
acatcccattcccaaggtcgtcacagagcaccaaactgagctcgagctccctgcgtcgcatggcagctccccactagctagttattttatatgtcatagcatgtatatgtcaatgcttctctctcaatgtatcccaccttcttcttgccctgctgtatccacaagtccattctttacatctgtgactctattcctacctta

SEQ ID NO: 98483 - DNA, 201 bp, Bos taurus; identical to SEQ ID NO: 16954

SEQ ID NO: 98484 - DNA, 201 bp, Bos taurus; identical to SEQ ID NO: 16955

SEQ ID NO: 98485 - DNA, 201 bp, Bos taurus
aaaaaaagttatagtgaccttgctgggatatgctgaacaggtcttataagtcatatttcacagatgaaattggactttggagcatctatacatatatagatagtaagttgtatgtcaaagactcgaaccccaatatcctcgttctttctccttcattctttccaaaccccagagtattatgaagctattcaaatatctaca

SEQ ID NO: 98486 - DNA, 201 bp, Bos taurus
ccttgctctttgggtaacacacaaattttctagcaggacaagaggtgtctggggaaactgctaaaaccattaggaataactgggatcttgttgttaggtcttgggaccttagcctattctgggtgttgatcacagagcagatggtctcgtgggaaaactggacccaggatgtggctcaggtaggagggatatggatactct

SEQ ID NO: 98487 - DNA, 201 bp, Bos taurus
ccactgactccccagtgatgtcctgtatatactcctgactcaggatctaccctggtagaagaatcactctgtctcctcaacttccagaaacttaactttcgtaaatttacattatattgtcattattctgtattatctactccctttctgcaatggcttttttttcccaaacagagaagttatcttaggaacatttccatg

SEQ ID NO: 98488 - DNA, 201 bp, Bos taurus; identical to SEQ ID NO: 16956

SEQ ID NO: 98489 - DNA, 201 bp, Bos taurus; identical to SEQ ID NO: 16957

SEQ ID NO: 98490 - DNA, 201 bp, Bos taurus; identical to SEQ ID NO: 16958

SEQ ID NO: 98491 - DNA, 201 bp, Bos taurus
gccccaggctggctggtggccttgtcagtaaccttggtcaccaatcagaaatcaacaaggagcacagcctcatgccctccccaaggccaggagagggatgtcggaattgaaaggtcatctttcaataacaaaggggcacacaagggttcacaggctttccccccagataatcaaaatgtctaagtctccaaacccatcatt

SEQ ID NO: 98492 - DNA, 201 bp, Bos taurus; identical to SEQ ID NO: 16959

SEQ ID NO: 98493 - DNA, 201 bp, Bos taurus; identical to SEQ ID NO: 16960

SEQ ID NO: 98494 - DNA, 201 bp, Bos taurus; identical to SEQ ID NO: 16961

SEQ ID NO: 98495 - DNA, 201 bp, Bos taurus
agggccccacccggctcaggtgatcctgaccaagctgccagaatccaccatccaggcccatgtggaaccagattacatggagggcaccagaggcctcacactcttgtccacgtgtctgggagaagacagaccgctccgtgtcgctgatgggtgtcacgtgggggcttggtgggggctgggaagcatgcccagcgggtgaaa

SEQ ID NO: 98496 - DNA, 201 bp, Bos taurus; identical to SEQ ID NO: 16962

SEQ ID NO: 98497 - DNA, 201 bp, Bos taurus
taactacataatactaaatttggacctgtttttcaaggtcccagaccaatttctgcatctttcattatgcccttcctgactccttcaaccctcactcaagtctcctgcttccaaaatcctaatacaatattcagtactgaattatacactgtttgcagtcctttagagtttctcctttcatcctccataatacctttccag

SEQ ID NO: 98498 - DNA, 201 bp, Bos taurus
ggctgcccctaattgccgcctggaatggcaggaactgggagaggccttgccgtccacacattctgattccccacgcactaaagggaggccgtgtggttcctgggctaggggtagtcaggaaacactgagctagttcattacatagatgggaaaactatggccttgagaataggtggccctcatccgagggagacaccagga

SEQ ID NO: 98499 - DNA, 201 bp, Bos taurus; identical to SEQ ID NO: 16963

SEQ ID NO: 98500 - DNA, 201 bp, Bos taurus
ttagaactttacggcccttctaaaatattatcacttggttgtggacttgcaagcctaagtccaactgtggaagcccagacagggaagggacaggagagaacgcagaggaccggggccatctgcggaaggctcagcaggggcatcataactagatgccctgaccctgaaacagccttctgcttgctcaagagaacctgtctg

SEQ ID NO: 98501 - DNA, 201 bp, Bos taurus; identical to SEQ ID NO: 16964

SEQ ID NO: 98502 - DNA, 201 bp, Bos taurus
gtaatgcctgaaatgccagctgctaatatcaactcttcccaatttaataaaccttggcatcacaaagttggcaattagatttcctgtaaaaggctaaatgcggcggccttctgcttcctggattctatatttcagtaagaaaggcattagtgtgtggcagctgggataatcatttaattgatcttttccatctatggaagt

SEQ ID NO: 98503 - DNA, 201 bp, Bos taurus
catcatggagggagaaagagcaaaggctaggagtggccaaggccaagcctgagttgaacttctcacccctgctcggtgaggcctctcaaaggtatcccccactcccggttctgctgttcagattccaggtgaccctggaaaagccatggatccctttcaggcctccgttttctcagctgcaaaataagggcctctcattct

SEQ ID NO: 98504 - DNA, 201 bp, Bos taurus; identical to SEQ ID NO: 16965

SEQ ID NO: 98505 - DNA, 201 bp, Bos taurus; identical to SEQ ID NO: 16966

SEQ ID NO: 98506 - DNA, 201 bp, Bos taurus; identical to SEQ ID NO: 16967

SEQ ID NO: 98507 - DNA, 201 bp, Bos taurus; identical to SEQ ID NO: 16968

SEQ ID NO: 98508 - DNA, 201 bp, Bos taurus; identical to SEQ ID NO: 16969

SEQ ID NO: 98509 - DNA, 201 bp, Bos taurus; identical to SEQ ID NO: 16970

SEQ ID NO: 98510 - DNA, 201 bp, Bos taurus; identical to SEQ ID NO: 16971

SEQ ID NO: 98511 - DNA, 201 bp, Bos taurus; identical to SEQ ID NO: 16972

SEQ ID NO: 98512 - DNA, 201 bp, Bos taurus; identical to SEQ ID NO: 16973

SEQ ID NO: 98513 - DNA, 201 bp, Bos taurus
acttctgtcctgggccagaagtttcctccccggtgcatgaagtcaagaggacgtagagtgactgcaggccaccctcatgactgagagaggcccatccactagggagaaagaagactgtgctttagggacatgagacgcatgtgatctcttgctaggagaggtgcgagggtggccaggccaggtgggtcagcagtggctcag

SEQ ID NO: 98514 - DNA, 201 bp, Bos taurus; identical to SEQ ID NO: 16976

SEQ ID NO: 98515 - DNA, 201 bp, Bos taurus
ttggctgaatcacctgcccggctctgtagccagggtacaggatgcaatgggatagagactgaaaattctcaaaagtataggggagataaaagcctgttgttaggagagaagtggtaggaaacatgctgataagtcaaaagaacttttagctataacttgaagtgtgtgtcttttagtacttgatatctgttcaaatgtcta

SEQ ID NO: 98516 - DNA, 201 bp, Bos taurus
ccaagtactttacattctttgtcatgtgttaggctttattgtcttgaatttacagagaaggctgagattcctgttaaagaactgttacattttgagtgttgacagtgctgagtttcaaactaagactgttgaaatcagagccttaggtatttttttctttttccattgaagtggaactgtttctctggttacagtttttct

SEQ ID NO: 98517 - DNA, 201 bp, Bos taurus; identical to SEQ ID NO: 16977

SEQ ID NO: 98518 - DNA, 201 bp, Bos taurus; identical to SEQ ID NO: 16978

SEQ ID NO: 98519 - DNA, 201 bp, Bos taurus; identical to SEQ ID NO: 16979

SEQ ID NO: 98520 - DNA, 201 bp, Bos taurus; identical to SEQ ID NO: 16980

SEQ ID NO: 98521 - DNA, 201 bp, Bos taurus; identical to SEQ ID NO: 16981

SEQ ID NO: 98522 - DNA, 201 bp, Bos taurus; identical to SEQ ID NO: 16982

SEQ ID NO: 98523 - DNA, 201 bp, Bos taurus; identical to SEQ ID NO: 16983

SEQ ID NO: 98524 - DNA, 201 bp, Bos taurus; identical to SEQ ID NO: 16984

SEQ ID NO: 98525 - DNA, 201 bp, Bos taurus
ggacatctttgttcctcaaactgtagatgaaaggattcaccattggccccacaatggtgtaaaaaactgtggacactttctcttcatccagagactcagcgggaaaaggcttgagatacatgaatgcagatgatccaaagaaaagagaaaccacgattatgtgggagctgcaggtactgaaggctttggacctgccctctg

SEQ ID NO: 98526 - DNA, 201 bp, Bos taurus
agagaaggagtcatatccttgaggaggccagactgaatggcatctacaaccaaattgtggggtcaagtgtcttggggtgttttttctcccactccaggcctggctcttccttttctgtggtctcactagtcactgattgaactgggaaactattgtgtgtgcaagtgaaacatggtgagaaacaacactaaggaaccacca

SEQ ID NO: 98527 - DNA, 201 bp, Bos taurus; identical to SEQ ID NO: 16985

SEQ ID NO: 98528 - DNA, 201 bp, Bos taurus; identical to SEQ ID NO: 16986

SEQ ID NO: 98529 - DNA, 201 bp, Bos taurus; identical to SEQ ID NO: 16987

SEQ ID NO: 98530 - DNA, 201 bp, Bos taurus; identical to SEQ ID NO: 16988

SEQ ID NO: 98531 - DNA, 201 bp, Bos taurus; identical to SEQ ID NO: 16989

SEQ ID NO: 98532 - DNA, 201 bp, Bos taurus
aatctgaatgcatattttggccaactcaatattagcatttaatcctttttcttttgaattagcatttctctgtcataggaggatctgtaaaacagtgcccgtggccttttgtcttaagctggggaggcatatttatagagccagttctacttatccttccttgggggctgcccgagtgcatcactagagagtaagaacatt

SEQ ID NO: 98533 - DNA, 201 bp, Bos taurus; identical to SEQ ID NO: 16990

SEQ ID NO: 98534 - DNA, 201 bp, Bos taurus; identical to SEQ ID NO: 16991

SEQ ID NO: 98535 - DNA, 201 bp, Bos taurus; identical to SEQ ID NO: 16992

SEQ ID NO: 98536 - DNA, 201 bp, Bos taurus; identical to SEQ ID NO: 16993

SEQ ID NO: 98537 - DNA, 201 bp, Bos taurus; identical to SEQ ID NO: 16994

SEQ ID NO: 98538 - DNA, 201 bp, Bos taurus
ctatttctctttcctccccctacccttcagcgctggcctttctgcttcgctcatgaatattcagaagctcaagatgcgaacttgcagtaactcccagtgtgggtttctcactgggagggccgggcactgtagcttcaccatgaaagcgtaggcgggtggccgaatggatgggcggggtgcgcaggcggatgcccgcagtca

SEQ ID NO: 98539 - DNA, 201 bp, Bos taurus
gtaaacggtgccgattcagtcatgacttctgtttctcagccttctgctttctcttctgtgctcattccctgctttccttcatacactcctgccttttcttatatgctgtgtttctccatttaattattcttttctctgttttcagtctttcctgtttgctttgcctctcttcctccaaccctctttttttctatgtgtttc

SEQ ID NO: 98540 - DNA, 201 bp, Bos taurus; identical to SEQ ID NO: 16995

SEQ ID NO: 98541 - DNA, 201 bp, Bos taurus
atgtcatacttgagacattttgaaggacataccgttcctacagctaaagaacatgtcattaaatgagttcacgatagcagattcctattatctctagccaaagtaccatatgttcactgatgggtcagtgaactgtcagagactgacagtgcctgaaccagtcatagttttcagtggtttacccatggtgaacctcacctg

SEQ ID NO: 98542 - DNA, 201 bp, Bos taurus; identical to SEQ ID NO: 16996

SEQ ID NO: 98543 - DNA, 201 bp, Bos taurus
cgaagggccggcgtcccaggcctgggggcaggggcttgggagaccatggctggtgacatcgagccggagagcaggggccggcggctggggggcttggacccgggggtcctctacgccttccgcgtcctggctctgaatcatcgtacggctggccatccctctgaggtgaagacaccaggtgcctgggcttgcgtcgtggag

SEQ ID NO: 98544 - DNA, 201 bp, Bos taurus; identical to SEQ ID NO: 16997

SEQ ID NO: 98545 - DNA, 201 bp, Bos taurus; identical to SEQ ID NO: 16998

SEQ ID NO: 98546 - DNA, 201 bp, Bos taurus; identical to SEQ ID NO: 16999

SEQ ID NO: 98547 - DNA, 201 bp, Bos taurus; identical to SEQ ID NO: 17000

SEQ ID NO: 98548 - DNA, 201 bp, Bos taurus
gtccatacggacgcagagtcagacacgatgcagtgactgaacagcaacaacctattaggttataggccaggagtctgcagagggcccacattcaccccagcggtaactccttggtctttcctggctttaaaaagacagctcaaccttccagatattaatcaggatggaagaacatgttgagagacatctctagctcactgg

SEQ ID NO: 98549 - DNA, 201 bp, Bos taurus; identical to SEQ ID NO: 17001

SEQ ID NO: 98550 - DNA, 201 bp, Bos taurus; identical to SEQ ID NO: 17002

SEQ ID NO: 98551 - DNA, 201 bp, Bos taurus
cctggagggtgggcacccgtgatctaagggacaccactgcaatgtgtggccctattctatactttcccagccctctgtgaattcagagtttttgattttacatcaacctgtcaatcaatctggcctcaaccaatcaactgatacattcttctgcacacctccagctatgaccctgaaccttttttctctctgcccttcaga

SEQ ID NO: 98552 - DNA, 201 bp, Bos taurus; identical to SEQ ID NO: 17003

SEQ ID NO: 98553 - DNA, 201 bp, Bos taurus; identical to SEQ ID NO: 17004

SEQ ID NO: 98554 - DNA, 201 bp, Bos taurus
ggtgggtgggcacccttcctgagatggatacaggccagccgggagatctagacaacctgttcctccctgagcagttacactcacaacatcacatgctgtacgttggccagttagtctgcaagatagcagaggccctggacttcaattgcccaggaggcctgtttgtggactgtgtggggagaaattttaaacatggtttca

SEQ ID NO: 98555 - DNA, 201 bp, Bos taurus; identical to SEQ ID NO: 17005

SEQ ID NO: 98556 - DNA, 201 bp, Bos taurus
gcagacaagatcactgcttctctgtgcctttatatctgcaagacaaaggtattttgcatgcctctcaagttatctagcctacactaggtattaaaataaacaaacttcctcaagcaattctacatgactcttctttgcacatttgaaaagcttcctgcatgtgtagcaccagaggagagtctcgctgaaaatccccagaga

SEQ ID NO: 98557 - DNA, 201 bp, Bos taurus
aagtggggatatgaagctcttgactgtcttttgactggtttcactggtgtcattgggtattgtctttttctctggagtcattaagtaaaccttggctctctgaacacactattcacaggtaatgtgactggtgaggtcaaactaatctaaccccacggaaactgctttgtagctccccgctgtttcagaatgaactttggt

SEQ ID NO: 98558 - DNA, 201 bp, Bos taurus; identical to SEQ ID NO: 17006

SEQ ID NO: 98559 - DNA, 201 bp, Bos taurus; identical to SEQ ID NO: 17007

SEQ ID NO: 98560 - DNA, 201 bp, Bos taurus; identical to SEQ ID NO: 17008

SEQ ID NO: 98561 - DNA, 201 bp, Bos taurus; identical to SEQ ID NO: 17009

SEQ ID NO: 98562 - DNA, 201 bp, Bos taurus; identical to SEQ ID NO: 17010

SEQ ID NO: 98563 - DNA, 201 bp, Bos taurus; identical to SEQ ID NO: 17011

SEQ ID NO: 98564 - DNA, 201 bp, Bos taurus; identical to SEQ ID NO: 17012

SEQ ID NO: 98565 - DNA, 201 bp, Bos taurus; identical to SEQ ID NO: 17015

SEQ ID NO: 98566 - DNA, 201 bp, Bos taurus; identical to SEQ ID NO: 17016

SEQ ID NO: 98567 - DNA, 201 bp, Bos taurus
ctgcagctcccgacaggcagtgggccagtctggggactagtgacagggtgagtaatgctcgaggtcagagggcagctgctcctgggatcgagtctccttatatgaggaggccgcctcgctgtgatcacccagtggaataagttcccagagctgatggcaagataaagcacattaacaaaacgtgccctctttgattttatg

SEQ ID NO: 98568 - DNA, 201 bp, Bos taurus; identical to SEQ ID NO: 17017

SEQ ID NO: 98569 - DNA, 201 bp, Bos taurus; identical to SEQ ID NO: 17018

SEQ ID NO: 98570 - DNA, 201 bp, Bos taurus
ctgtaaccatgtcccttatgacatttggtgtgtcaggatgagaaaaatctcttaccaagaaaattctaaaactaaaatttgctttatttctctctaacttggtgtttaaggaagttatgaggacctttgaaggactgtagaatttggaatgaaaagaaacaataatcctaaaaaaatctttgaacacatttatatgcctcc

SEQ ID NO: 98571 - DNA, 201 bp, Bos taurus; identical to SEQ ID NO: 17019

SEQ ID NO: 98572 - DNA, 201 bp, Bos taurus; identical to SEQ ID NO: 17020

SEQ ID NO: 98573 - DNA, 201 bp, Bos taurus; identical to SEQ ID NO: 17021

SEQ ID NO: 98574 - DNA, 201 bp, Bos taurus; identical to SEQ ID NO: 17022

SEQ ID NO: 98575 - DNA, 201 bp, Bos taurus; identical to SEQ ID NO: 17023

SEQ ID NO: 98576 - DNA, 201 bp, Bos taurus; identical to SEQ ID NO: 17025

SEQ ID NO: 98577 - DNA, 201 bp, Bos taurus; identical to SEQ ID NO: 17026

SEQ ID NO: 98578 - DNA, 201 bp, Bos taurus; identical to SEQ ID NO: 17027

SEQ ID NO: 98579 - DNA, 201 bp, Bos taurus; identical to SEQ ID NO: 17028

SEQ ID NO: 98580 - DNA, 201 bp, Bos taurus
ctctaccataatgggccagtgcagaatgatcaacagaacaatctaccaggaaatgataaagattgttattttatccaaatcatgattctgactcaaaatatattttaagctgacagaattacctcaagaaatgaacattttatgggaaggaggtgggagggggtttcaggatggggaacagatgtacacccatggctgatt

SEQ ID NO: 98581 - DNA, 201 bp, Bos taurus; identical to SEQ ID NO: 17029

SEQ ID NO: 98582 - DNA, 201 bp, Bos taurus; identical to SEQ ID NO: 17030

SEQ ID NO: 98583 - DNA, 201 bp, Bos taurus; identical to SEQ ID NO: 17032

SEQ ID NO: 98584 - DNA, 201 bp, Bos taurus
tttagaggcgagggctgggttctcaaggaactgtccaggagaagccccaaaggatgggtggaattcagccttggaaaaggacctggaggttggccaggacccacagcgaaaggagcaacgtgtttgagcgggtggaggaatcgagttcacgtgattgaaagtccagggtgcttgggtgggggtggggggttggaggaggca

SEQ ID NO: 98585 - DNA, 201 bp, Bos taurus; identical to SEQ ID NO: 17033

SEQ ID NO: 98586 - DNA, 201 bp, Bos taurus
aacatgtgtttagggctggccaaaatggcgttgcctgttaagttaggaactgttaacctttcttgattttttattttccaatccactcaagatggcccaggctattttgggttcattagtttgtgtaccatttcccctgcaggaagatgctttttgggttgaggaggaaggtggctgggaatgggccctggggagagaggc

SEQ ID NO: 98587 - DNA, 201 bp, Bos taurus; identical to SEQ ID NO: 17034

SEQ ID NO: 98588 - DNA, 201 bp, Bos taurus; identical to SEQ ID NO: 17036

SEQ ID NO: 98589 - DNA, 201 bp, Bos taurus; identical to SEQ ID NO: 17037

SEQ ID NO: 98590 - DNA, 201 bp, Bos taurus; identical to SEQ ID NO: 17038

SEQ ID NO: 98591 - DNA, 201 bp, Bos taurus; identical to SEQ ID NO: 17039

SEQ ID NO: 98592 - DNA, 201 bp, Bos taurus
aagatgcgagagtctgggctcactgaaattattcctttaatatccacctcagttatctgggagcagcatcctgtgttttctcatcctgagtttcttcaggattcaccattctggcagctgtaattggcttgatggctccagcctcctttgttaactgacatggtagcaatactttagttctcaagtccaaaggtgagtgct

SEQ ID NO: 98593 - DNA, 201 bp, Bos taurus; identical to SEQ ID NO: 17041

SEQ ID NO: 98594 - DNA, 201 bp, Bos taurus; identical to SEQ ID NO: 17042

SEQ ID NO: 98595 - DNA, 201 bp, Bos taurus
tagtgaaggatagggaagcctggcgtgctgcagtccatggggccgcaaatagtcagacgtgatttagtgactggcaaccacagtagcattttctgatatctactagggcaaatcagtctccctactctttttttcacgtattttctaggcaggttaccagcatttattcttctaaaattacgagatcgttttaaaaatgta

SEQ ID NO: 98596 - DNA, 201 bp, Bos taurus; identical to SEQ ID NO: 17044

SEQ ID NO: 98597 - DNA, 201 bp, Bos taurus
aaactaagacagaaactaaaatcactcaaggccaaaaccctactcattccatcacatggggttgctgctgtcagtgacatggggacggcaggactctgatgggaaagaggccattgagtcactggtgcaggaagggtcccatccttgatggacatcagagctggatggacagagtcagtataaagagagaatgaaaatgat

SEQ ID NO: 98598 - DNA, 201 bp, Bos taurus; identical to SEQ ID NO: 17045

SEQ ID NO: 98599 - DNA, 201 bp, Bos taurus; identical to SEQ ID NO: 17049

SEQ ID NO: 98600 - DNA, 201 bp, Bos taurus; identical to SEQ ID NO: 17051

SEQ ID NO: 98601 - DNA, 201 bp, Bos taurus; identical to SEQ ID NO: 17052

SEQ ID NO: 98602 - DNA, 201 bp, Bos taurus; identical to SEQ ID NO: 17053

SEQ ID NO: 98603 - DNA, 201 bp, Bos taurus; identical to SEQ ID NO: 17055

SEQ ID NO: 98604 - DNA, 201 bp, Bos taurus; identical to SEQ ID NO: 17057

SEQ ID NO: 98605 - DNA, 201 bp, Bos taurus; identical to SEQ ID NO: 17059

SEQ ID NO: 98606 - DNA, 201 bp, Bos taurus; identical to SEQ ID NO: 17060

SEQ ID NO: 98607 - DNA, 201 bp, Bos taurus; identical to SEQ ID NO: 17063

SEQ ID NO: 98608 - DNA, 201 bp, Bos taurus; identical to SEQ ID NO: 17064

SEQ ID NO: 98609 - DNA, 201 bp, Bos taurus; identical to SEQ ID NO: 17066

SEQ ID NO: 98610 - DNA, 201 bp, Bos taurus; identical to SEQ ID NO: 17067

SEQ ID NO: 98611 - DNA, 201 bp, Bos taurus; identical to SEQ ID NO: 17070

SEQ ID NO: 98612 - DNA, 201 bp, Bos taurus; identical to SEQ ID NO: 17080

SEQ ID NO: 98613 - DNA, 201 bp, Bos taurus; identical to SEQ ID NO: 17081

SEQ ID NO: 98614 - DNA, 201 bp, Bos taurus; identical to SEQ ID NO: 17083

SEQ ID NO: 98615 - DNA, 201 bp, Bos taurus; identical to SEQ ID NO: 17084

SEQ ID NO: 98616 - DNA, 201 bp, Bos taurus; identical to SEQ ID NO: 17085

SEQ ID NO: 98617 - DNA, 201 bp, Bos taurus; identical to SEQ ID NO: 17088

SEQ ID NO: 98618 - DNA, 201 bp, Bos taurus; identical to SEQ ID NO: 17090

SEQ ID NO: 98619 - DNA, 201 bp, Bos taurus; identical to SEQ ID NO: 17093

SEQ ID NO: 98620 - DNA, 201 bp, Bos taurus; identical to SEQ ID NO: 17094

SEQ ID NO: 98621 - DNA, 201 bp, Bos taurus; identical to SEQ ID NO: 17095

SEQ ID NO: 98622 - DNA, 201 bp, Bos taurus; identical to SEQ ID NO: 17096

SEQ ID NO: 98623 - DNA, 201 bp, Bos taurus; identical to SEQ ID NO: 17097

SEQ ID NO: 98624 - DNA, 201 bp, Bos taurus; identical to SEQ ID NO: 17099

SEQ ID NO: 98625 - DNA, 201 bp, Bos taurus; identical to SEQ ID NO: 17100

SEQ ID NO: 98626 - DNA, 201 bp, Bos taurus; identical to SEQ ID NO: 17101

SEQ ID NO: 98627 - DNA, 201 bp, Bos taurus; identical to SEQ ID NO: 17102

SEQ ID NO: 98628 - DNA, 201 bp, Bos taurus; identical to SEQ ID NO: 17104

SEQ ID NO: 98629 - DNA, 201 bp, Bos taurus; identical to SEQ ID NO: 17105

SEQ ID NO: 98630 - DNA, 201 bp, Bos taurus; identical to SEQ ID NO: 17106

SEQ ID NO: 98631 - DNA, 201 bp, Bos taurus; identical to SEQ ID NO: 17107

SEQ ID NO: 98632 - DNA, 201 bp, Bos taurus; identical to SEQ ID NO: 17108

SEQ ID NO: 98633 - DNA, 201 bp, Bos taurus; identical to SEQ ID NO: 17110

SEQ ID NO: 98634 - DNA, 201 bp, Bos taurus; identical to SEQ ID NO: 17111

SEQ ID NO: 98635 - DNA, 201 bp, Bos taurus; identical to SEQ ID NO: 17113

SEQ ID NO: 98636 - DNA, 201 bp, Bos taurus; identical to SEQ ID NO: 17114

SEQ ID NO: 98637 - DNA, 201 bp, Bos taurus; identical to SEQ ID NO: 17116

SEQ ID NO: 98638 - DNA, 201 bp, Bos taurus; identical to SEQ ID NO: 17118

SEQ ID NO: 98639 - DNA, 201 bp, Bos taurus; identical to SEQ ID NO: 17121

SEQ ID NO: 98640 - DNA, 201 bp, Bos taurus; identical to SEQ ID NO: 17122

SEQ ID NO: 98641 - DNA, 201 bp, Bos taurus; identical to SEQ ID NO: 17123

SEQ ID NO: 98642 - DNA, 201 bp, Bos taurus; identical to SEQ ID NO: 17124

SEQ ID NO: 98643 - DNA, 201 bp, Bos taurus; identical to SEQ ID NO: 17125

SEQ ID NO: 98644 - DNA, 201 bp, Bos taurus; identical to SEQ ID NO: 17128

SEQ ID NO: 98645 - DNA, 201 bp, Bos taurus; identical to SEQ ID NO: 17132

SEQ ID NO: 98646 - DNA, 201 bp, Bos taurus; identical to SEQ ID NO: 17133

SEQ ID NO: 98647 - DNA, 201 bp, Bos taurus; identical to SEQ ID NO: 17134

SEQ ID NO: 98648 - DNA, 201 bp, Bos taurus; identical to SEQ ID NO: 17137

SEQ ID NO: 98649 - DNA, 201 bp, Bos taurus; identical to SEQ ID NO: 17139

SEQ ID NO: 98650 - DNA, 201 bp, Bos taurus; identical to SEQ ID NO: 17140

SEQ ID NO: 98651 - DNA, 201 bp, Bos taurus; identical to SEQ ID NO: 17141

SEQ ID NO: 98652 - DNA, 201 bp, Bos taurus; identical to SEQ ID NO: 17143

SEQ ID NO: 98653 - DNA, 201 bp, Bos taurus; identical to SEQ ID NO: 17144

SEQ ID NO: 98654 - DNA, 201 bp, Bos taurus; identical to SEQ ID NO: 17146

SEQ ID NO: 98655 - DNA, 201 bp, Bos taurus; identical to SEQ ID NO: 17147

SEQ ID NO: 98656 - DNA, 201 bp, Bos taurus; identical to SEQ ID NO: 17148

SEQ ID NO: 98657 - DNA, 201 bp, Bos taurus; identical to SEQ ID NO: 17149

SEQ ID NO: 98658 - DNA, 201 bp, Bos taurus; identical to SEQ ID NO: 17150

SEQ ID NO: 98659 - DNA, 201 bp, Bos taurus; identical to SEQ ID NO: 17151

SEQ ID NO: 98660 - DNA, 201 bp, Bos taurus; identical to SEQ ID NO: 17154

SEQ ID NO: 98661 - DNA, 201 bp, Bos taurus; identical to SEQ ID NO: 17155

SEQ ID NO: 98662 - DNA, 201 bp, Bos taurus; identical to SEQ ID NO: 17158

SEQ ID NO: 98663 - DNA, 201 bp, Bos taurus; identical to SEQ ID NO: 17159

SEQ ID NO: 98664 - DNA, 201 bp, Bos taurus; identical to SEQ ID NO: 17160

SEQ ID NO: 98665 - DNA, 201 bp, Bos taurus; identical to SEQ ID NO: 17161

SEQ ID NO: 98666 - DNA, 201 bp, Bos taurus; identical to SEQ ID NO: 17162

SEQ ID NO: 98667 - DNA, 201 bp, Bos taurus; identical to SEQ ID NO: 17163

SEQ ID NO: 98668 - DNA, 201 bp, Bos taurus; identical to SEQ ID NO: 17165

SEQ ID NO: 98669 - DNA, 201 bp, Bos taurus; identical to SEQ ID NO: 17166

SEQ ID NO: 98670 - DNA, 201 bp, Bos taurus; identical to SEQ ID NO: 17167

SEQ ID NO: 98671 - DNA, 201 bp, Bos taurus; identical to SEQ ID NO: 17170

SEQ ID NO: 98672 - DNA, 201 bp, Bos taurus; identical to SEQ ID NO: 17171

SEQ ID NO: 98673 - DNA, 201 bp, Bos taurus; identical to SEQ ID NO: 17172

SEQ ID NO: 98674 - DNA, 201 bp, Bos taurus; identical to SEQ ID NO: 17173

SEQ ID NO: 98675 - DNA, 201 bp, Bos taurus; identical to SEQ ID NO: 17174

SEQ ID NO: 98676 - DNA, 201 bp, Bos taurus; identical to SEQ ID NO: 17175

SEQ ID NO: 98677 - DNA, 201 bp, Bos taurus; identical to SEQ ID NO: 17177

SEQ ID NO: 98678 - DNA, 201 bp, Bos taurus; identical to SEQ ID NO: 17179

SEQ ID NO: 98679 - DNA, 201 bp, Bos taurus; identical to SEQ ID NO: 17180

SEQ ID NO: 98680 - DNA, 201 bp, Bos taurus; identical to SEQ ID NO: 17181

SEQ ID NO: 98681 - DNA, 201 bp, Bos taurus; identical to SEQ ID NO: 17182

SEQ ID NO: 98682 - DNA, 201 bp, Bos taurus; identical to SEQ ID NO: 17183

SEQ ID NO: 98683 - DNA, 201 bp, Bos taurus; identical to SEQ ID NO: 17184

SEQ ID NO: 98684 - DNA, 201 bp, Bos taurus; identical to SEQ ID NO: 17185

SEQ ID NO: 98685 - DNA, 201 bp, Bos taurus; identical to SEQ ID NO: 17186

SEQ ID NO: 98686 - DNA, 201 bp, Bos taurus; identical to SEQ ID NO: 17187

SEQ ID NO: 98687 - DNA, 201 bp, Bos taurus
aagtgaactatgtgacttccccacgagacccttaaatggcatcctactgcctggctcaagaaacaaccaagaggtatcttagatcatgcaaagggagccaggcaataagacagaaggatcatgggttcccagatactgagggctgctaggctgcttatactggggagattttgcgagaaagaacattcgatcaagttgaaa

SEQ ID NO: 98688 - DNA, 201 bp, Bos taurus
gaccaggcctgagagcctctggaccataaggtgctgccacctggcaaagcttttctccatcatcatgacctccagccatgctccagctgagcaaaggacagggagctggcctctgcaatgtgcatgattcactgcacttaccttttcatcagagccatttttccaatattgcacatggtaagtccatgagttataaatgtt

SEQ ID NO: 98689 - DNA, 201 bp, Bos taurus; identical to SEQ ID NO: 17192

SEQ ID NO: 98690 - DNA, 201 bp, Bos taurus; identical to SEQ ID NO: 17194

SEQ ID NO: 98691 - DNA, 201 bp, Bos taurus; identical to SEQ ID NO: 17195

SEQ ID NO: 98692 - DNA, 201 bp, Bos taurus; identical to SEQ ID NO: 17196

SEQ ID NO: 98693 - DNA, 201 bp, Bos taurus
gtttctttctagcattctaagatacaataactgttgctagtagttaatattaagaatctatggaaattactgcttgttattctatctatatgatttatgagtgactactgattaaaagaaggttggattaaaatttttgagtacaaaagaagtacatgcttttagggggaagaaatgcagataatacagaaagttctgaag

SEQ ID NO: 98694 - DNA, 201 bp, Bos taurus
tattctcctgagagtgaaatcagaggatctacaatatccacgatggcaacaccgtttttgtcagctgtcacattgcccaggtctccaacatgcctaacattgaaaaagcagagggattaggactgatttctgtctatctaactttagttcataagctaaattaaaaatggatgagtcagatatataagggtgacttgagag

SEQ ID NO: 98695 - DNA, 201 bp, Bos taurus; identical to SEQ ID NO: 17197

SEQ ID NO: 98696 - DNA, 201 bp, Bos taurus
gaattcagatgctttccagaaatagagacgcagatgcagagaataaatgtgagaataccaaggcaggaaggggagtggggtgagttgggagattgatactgtataaaatatgtaactgatgagaacccactgcagagcacagggagctctgctcagtgctgtggtgaccctgagaaagaagggcacgtgtattcgtatggc

SEQ ID NO: 98697 - DNA, 201 bp, Bos taurus; identical to SEQ ID NO: 17199

SEQ ID NO: 98698 - DNA, 201 bp, Bos taurus; identical to SEQ ID NO: 17200

SEQ ID NO: 98699 - DNA, 201 bp, Bos taurus; identical to SEQ ID NO: 17202

SEQ ID NO: 98700 - DNA, 201 bp, Bos taurus
ttctgctgtctggctttcacactctaggccactatccacctcttcaaaccaccctaggaccacataccagataaccagggatagtcccaaggccccagagtctgctgaaattattcacactagccagtcctaagcctgtttaccctgcatctctgttccttcctgtggaaactataagaaagtctcttatccacattttta

SEQ ID NO: 98701 - DNA, 201 bp, Bos taurus; identical to SEQ ID NO: 17204

SEQ ID NO: 98702 - DNA, 201 bp, Bos taurus; identical to SEQ ID NO: 17205

SEQ ID NO: 98703 - DNA, 201 bp, Bos taurus
cctcactccttctgccacgtgagggcatgagaagacaacggtccatgaacgatgaaatggatctttaccagacactagatcttctggaaacttgatcttggatttctagtctctagaactgtgagaaatatctgttgtttataagtcatccagtatatggtattctacgataggcagccttaatggataaacacttgaatt

SEQ ID NO: 98704 - DNA, 201 bp, Bos taurus
accatctggaaagttctcatcatattttcatgaacagctatgcttttatagctaaatttatggggattatttctctctgttagattaactaccccttattttgttttcttttatttttgttgttacagttttattatattgtatataatctcctgcttctcaatttataacttagttttactttgaggcaaatgaagaatg

SEQ ID NO: 98705 - DNA, 201 bp, Bos taurus; identical to SEQ ID NO: 17207

SEQ ID NO: 98706 - DNA, 201 bp, Bos taurus; identical to SEQ ID NO: 17208

SEQ ID NO: 98707 - DNA, 201 bp, Bos taurus; identical to SEQ ID NO: 17209

SEQ ID NO: 98708 - DNA, 201 bp, Bos taurus
tcttgcttggagaatcccatggacagaggagcctggcaggctacaatccatggggtcacaaagagtcgggcatgactgagggactaagcacacagcacagtgcaaaacattagaggtttttttcaaagagtaatcttaataccgaaagccacaagtactgtctggtacctgtgaacagacagtatccttgacatgtttgtg

SEQ ID NO: 98709 - DNA, 201 bp, Bos taurus; identical to SEQ ID NO: 17212

SEQ ID NO: 98710 - DNA, 201 bp, Bos taurus
taaagatggtgaaaacatggcattaaaaggagctaggaaacatgagctatcggtatctatgtgctacagccaaagcaagacaagataggccgctaggggccggtccctgtgaagagccagtttaaagcataaaaaatgcagtgaagcggtctgtgaaagcagtagctgctgagtcacaggtgaggagaagggaggggacca

SEQ ID NO: 98711 - DNA, 201 bp, Bos taurus; identical to SEQ ID NO: 17213

SEQ ID NO: 98712 - DNA, 201 bp, Bos taurus; identical to SEQ ID NO: 17214

SEQ ID NO: 98713 - DNA, 201 bp, Bos taurus; identical to SEQ ID NO: 17215

SEQ ID NO: 98714 - DNA, 201 bp, Bos taurus; identical to SEQ ID NO: 17216

SEQ ID NO: 98715 - DNA, 201 bp, Bos taurus; identical to SEQ ID NO: 17219

SEQ ID NO: 98716 - DNA, 201 bp, Bos taurus; identical to SEQ ID NO: 17220

SEQ ID NO: 98717 - DNA, 201 bp, Bos taurus; identical to SEQ ID NO: 17223

SEQ ID NO: 98718 - DNA, 201 bp, Bos taurus; identical to SEQ ID NO: 17224

SEQ ID NO: 98719 - DNA, 201 bp, Bos taurus; identical to SEQ ID NO: 17226

SEQ ID NO: 98720 - DNA, 201 bp, Bos taurus
gacaagggaggggctgtcaaaagaaacactagtccagccttgggccaacgttctggttccccctccagggatacatataactatctttgagcagttttgcggatactgtaatccccaccagatgggagaaattaacagcctggtgcccacaagtccataggccccagacccaggaacaagaaggctgaagatgctgaatct

SEQ ID NO: 98721 - DNA, 201 bp, Bos taurus
aaatttttggccccacattcatttggaagagagtctgagtgttgtgttggtgaagtatgaaattgaagtgccctgttggctactcttagactcctctgctacgttcctgctataaacttgaatggccagctaagcaaaacaaagaactccagacctatttttctaaggtcctttactgaggtctgttcttgcctaatcatg

SEQ ID NO: 98722 - DNA, 201 bp, Bos taurus
tttgtaagtgatgctcagtgacattaccttaattcgaaaggggaaacatctaataggattgaagtggttctggagaataatagatatgaagcttgatgaaaatagcacatgatattcccatcttagaaaagtgttagtttctgcagttaaccagcagtgacattgctggcaaagctcatcaagaagagacctcaggccaag

SEQ ID NO: 98723 - DNA, 201 bp, Bos taurus; identical to SEQ ID NO: 17230

SEQ ID NO: 98724 - DNA, 201 bp, Bos taurus
ggtgcattgctggagatgaacttcaggatgggttttgaaaggtttggagcacatccatttgcaaagaggagaatagttctatatggatgagagaatgaccggggccagtcttcctttcttacactgttgtaaaacttgagttccgccaggagagggccatagatgggaaagaattctcagaaagtgagggagactctaact

SEQ ID NO: 98725 - DNA, 201 bp, Bos taurus
gagatggtgagggacagggaagcctggtgtgctgcagtccttggggccgcaatcgggcatgacttggcaactgaacaacaacaacaaagctagggccaagcaaaactacagaggctcaaaagtattcgctcttttccaatatcagatgcgataagtgaaagacttgaaaaaaggttctgtagtcaaggcctatgtaaattc

SEQ ID NO: 98726 - DNA, 201 bp, Bos taurus; identical to SEQ ID NO: 17231

SEQ ID NO: 98727 - DNA, 201 bp, Bos taurus; identical to SEQ ID NO: 17232

SEQ ID NO: 98728 - DNA, 201 bp, Bos taurus; identical to SEQ ID NO: 17233

SEQ ID NO: 98729 - DNA, 201 bp, Bos taurus; identical to SEQ ID NO: 17235

SEQ ID NO: 98730 - DNA, 201 bp, Bos taurus; identical to SEQ ID NO: 17236

SEQ ID NO: 98731 - DNA, 201 bp, Bos taurus; identical to SEQ ID NO: 17237

SEQ ID NO: 98732 - DNA, 201 bp, Bos taurus; identical to SEQ ID NO: 17238

SEQ ID NO: 98733 - DNA, 201 bp, Bos taurus; identical to SEQ ID NO: 17239

SEQ ID NO: 98734 - DNA, 201 bp, Bos taurus; identical to SEQ ID NO: 17241

SEQ ID NO: 98735 - DNA, 201 bp, Bos taurus; identical to SEQ ID NO: 17245

SEQ ID NO: 98736 - DNA, 201 bp, Bos taurus
caagacataagtcattataaagtcatgcgtgctagaaattaactcatttattcattcatgagtctatttagttatctacaattttaggttgagattttaattgagattgttaaagacccacatgaagattataaagagtaatacagagacatcccatgtacaccctacctaatattctccaatgataccatttaaaaaaaa

SEQ ID NO: 98737 - DNA, 201 bp, Bos taurus
gactttaggaagggatttttcccacagtgttttactaaaatttatttcaacttttattactatagttaatataaagagcaatttggtgatgtcttccaccccaggaaaattatctccttgatttacatgatgaatgcaggggttgaagtatcattaaccataaggagaataatttttgaaatcctggtttgtaagtagtta

SEQ ID NO: 98738 - DNA, 201 bp, Bos taurus; identical to SEQ ID NO: 17247

SEQ ID NO: 98739 - DNA, 201 bp, Bos taurus; identical to SEQ ID NO: 17248

SEQ ID NO: 98740 - DNA, 201 bp, Bos taurus; identical to SEQ ID NO: 17249

SEQ ID NO: 98741 - DNA, 201 bp, Bos taurus; identical to SEQ ID NO: 17250

SEQ ID NO: 98742 - DNA, 201 bp, Bos taurus
cacagggatcgaactcgtgtctcttaagtctcctgcattagcagtagggttctttaccagtagcgctgcctgggaagccccaaccaatatgtagcacttatacatagcatttataaagtggttaaacttggacagttatacaacacttaaggtgaatggtgtcttttttttttttttttctgtattctcggagataatttt

SEQ ID NO: 98743 - DNA, 201 bp, Bos taurus
catgaatatgcttgtatctgtcttgtataaagttatctaagtttgtgtaataatgggaaaactcaaagtacagtattgacctcatgtttattttagtctattactatacaagagtgagatatttagtaaagagaagcctagtaatatgtttgcagtctcatctaaattctaactttaaacaatttttaacatttacatcat

SEQ ID NO: 98744 - DNA, 201 bp, Bos taurus
aaaaagccctccctgtgttactctggttctagtgtccagtctcaccattctgccacttgaaataagagaaggtttcatccttttccaggccaaggctgatatcagttcagttcagctcagtcactcagacatgtccaactctttgtgatcccatgaactgcagcacgccaggcctccctatccatcaacgattcccagaat

SEQ ID NO: 98745 - DNA, 201 bp, Bos taurus
tattaataaaatatacatttccttatatttcaattgaatatgtctactctaaagaatttgtccattagacaacatgaatgcctgtgatcaaatacttaccgtgtatgttctagaaacattgaattgctctgattgtgcttatcatctcacatggatcttgggtcatgtttcgtgttttttgatttggtcttttctaaaatt

SEQ ID NO: 98746 - DNA, 201 bp, Bos taurus
actccatccctaggtagctgcacaaagcaatgaaagtttataggacaaacttgatcaaagtgatttaaatcttcctggaaagcatttccaaggactatcctatggaagtcaggcctgaggtcatgattcccaacaactcagataaaagaagaggatattcttataatttcaagtttacattgatctttgtacagtctgaat

SEQ ID NO: 98747 - DNA, 201 bp, Bos taurus; identical to SEQ ID NO: 17258

SEQ ID NO: 98748 - DNA, 201 bp, Bos taurus
tgtttagagtcaatgaaaatggctttaagcataactagatgtatgtgtatttaatacatatatgcatgaacatttttctttttggccataccatggggcatgggggattttagttccccaaccagggactgaacctaagccccctgcatgggaagcacggaggcttaccacggggccagcagggaagccactgtacacaca

SEQ ID NO: 98749 - DNA, 201 bp, Bos taurus; identical to SEQ ID NO: 17259

SEQ ID NO: 98750 - DNA, 201 bp, Bos taurus; identical to SEQ ID NO: 17267

SEQ ID NO: 98751 - DNA, 201 bp, Bos taurus; identical to SEQ ID NO: 17268

SEQ ID NO: 98752 - DNA, 201 bp, Bos taurus
caattcaagtttcacagcaaaattgagcagaaagtacaaagatatccccttcctatacccctagccctagccccacacatgcactttttaatcacttctactgcacaaagggaagtgaatgcagaactagaagccaaatgttctacttctaaattctgtgttctttctactttatagcaaatagtcctctctaaacacagt

SEQ ID NO: 98753 - DNA, 201 bp, Bos taurus
ttcagtccatgaatttctggctaaacaggtcactgctaatccatggttcttcctatccaaaaagtttcttcagacatgcaacctctcatatttttttttcgggtatgtaggattattatactgttcctcatcacacacatcacaaagacttacagcataagaagctgcctaggacctcttgttacttccttgcttctccta

SEQ ID NO: 98754 - DNA, 201 bp, Bos taurus; identical to SEQ ID NO: 17271

SEQ ID NO: 98755 - DNA, 201 bp, Bos taurus; identical to SEQ ID NO: 17273

SEQ ID NO: 98756 - DNA, 201 bp, Bos taurus; identical to SEQ ID NO: 17274

SEQ ID NO: 98757 - DNA, 201 bp, Bos taurus; identical to SEQ ID NO: 17275

SEQ ID NO: 98758 - DNA, 201 bp, Bos taurus; identical to SEQ ID NO: 17276

SEQ ID NO: 98759 - DNA, 201 bp, Bos taurus; identical to SEQ ID NO: 17277

SEQ ID NO: 98760 - DNA, 201 bp, Bos taurus; identical to SEQ ID NO: 17278

SEQ ID NO: 98761 - DNA, 201 bp, Bos taurus; identical to SEQ ID NO: 17279

SEQ ID NO: 98762 - DNA, 201 bp, Bos taurus; identical to SEQ ID NO: 17280

SEQ ID NO: 98763 - DNA, 201 bp, Bos taurus; identical to SEQ ID NO: 17281

SEQ ID NO: 98764 - DNA, 201 bp, Bos taurus
gcaagggcagaggccttcacttcaacaatctatagaaaacaatgctgtcaacaatcgctgagagagcttggaggaggattctcttcccagctaagccttcggatgagacctcagacttttgggccaatagcttgaatgcaaacctgaatcagaggatccccataagccatgctcatattcctgacacaaagaacttgtgaa

SEQ ID NO: 98765 - DNA, 201 bp, Bos taurus; identical to SEQ ID NO: 17282

SEQ ID NO: 98766 - DNA, 201 bp, Bos taurus; identical to SEQ ID NO: 17283

SEQ ID NO: 98767 - DNA, 201 bp, Bos taurus; identical to SEQ ID NO: 17284

SEQ ID NO: 98768 - DNA, 201 bp, Bos taurus; identical to SEQ ID NO: 17285

SEQ ID NO: 98769 - DNA, 201 bp, Bos taurus
attgacagttttggtcagagtaccttggacaaacactttccggaaatattttagatggccctgatctccttcctgtattgaaactgatattgagtacttcgtatatactaatctctttaaattacttatgtggattaattttggaatgctcctaaatccccatgaaataagtaaacattttcatcacctttttgctgacgg

SEQ ID NO: 98770 - DNA, 201 bp, Bos taurus; identical to SEQ ID NO: 17286

SEQ ID NO: 98771 - DNA, 201 bp, Bos taurus; identical to SEQ ID NO: 17287

SEQ ID NO: 98772 - DNA, 201 bp, Bos taurus; identical to SEQ ID NO: 17288

SEQ ID NO: 98773 - DNA, 201 bp, Bos taurus
gtggaatgtcagttccccaacaagggattgaacccatgctcctgcagtgggagcatggggtcttaatggctggacggccagggaagtcccattccaccttcttcatgccagtattgtcagttctttcctgtctttgcctgcccagtaggcacctggagcaaaactccaactctgcacttatccctgttcaacggcttcagg

SEQ ID NO: 98774 - DNA, 201 bp, Bos taurus; identical to SEQ ID NO: 17292

SEQ ID NO: 98775 - DNA, 201 bp, Bos taurus; identical to SEQ ID NO: 17293

SEQ ID NO: 98776 - DNA, 201 bp, Bos taurus; identical to SEQ ID NO: 17294

SEQ ID NO: 98777 - DNA, 201 bp, Bos taurus; identical to SEQ ID NO: 17295

SEQ ID NO: 98778 - DNA, 201 bp, Bos taurus
gcatctctccagtctccacctctcatcagaaccatgtccagcttgcagatacgtgaacacatgtttcccttcctccccagtactttctggatgtgttccattccctctggattccaagtctgccttcactttagacactcttctgagttctgagtctcatagttttgagtctgctgtgtccaccctaaaggatttagttcc

SEQ ID NO: 98779 - DNA, 201 bp, Bos taurus; identical to SEQ ID NO: 17296

SEQ ID NO: 98780 - DNA, 201 bp, Bos taurus
agagacagaaaattaaaagataggcttgggagatgtctaaatttaggactccctgttactgcttcagatccttactctatgtactttttaaccttcattcaggacctatctagatgttgcccatagacagtaatataaaatagggtcctggcaagaaggaagaaaagatacaagcaattcactcaatcttgcttttctctt

SEQ ID NO: 98781 - DNA, 201 bp, Bos taurus; identical to SEQ ID NO: 17299

SEQ ID NO: 98782 - DNA, 201 bp, Bos taurus; identical to SEQ ID NO: 17300

SEQ ID NO: 98783 - DNA, 201 bp, Bos taurus; identical to SEQ ID NO: 17303

SEQ ID NO: 98784 - DNA, 201 bp, Bos taurus; identical to SEQ ID NO: 17304

SEQ ID NO: 98785 - DNA, 201 bp, Bos taurus
ccttcctcatgttctgtacacttagatataatgggatattgctgttacctacccaagtctttcagagaaggcaaatgaatcttccatttggaactgggtctcatctagcagtttgattatatttgaaagagaggactaatcttaaaatgttagttcatttgtaagtcaagctgtgtgtgtgtgtgtgctcagtcatgtccg

SEQ ID NO: 98786 - DNA, 201 bp, Bos taurus; identical to SEQ ID NO: 17305

SEQ ID NO: 98787 - DNA, 201 bp, Bos taurus
tcttagtagacacacacacacatttattgggccagacctctctgttgcctccctactatgggattctgtgagcctataatttcttcatttgattaccacaggaagggcctgcccttaaacatctttcttcataatgtttttgctacacttgttgccagaaagtctttctgaatacatatagcatgatcatgaaccaacgct

SEQ ID NO: 98788 - DNA, 201 bp, Bos taurus; identical to SEQ ID NO: 17306

SEQ ID NO: 98789 - DNA, 201 bp, Bos taurus; identical to SEQ ID NO: 17309

SEQ ID NO: 98790 - DNA, 201 bp, Bos taurus
atatttaagttttgtggatctgtgacttttacatcaattagaccactcaggttaaccacataataaatttagctaaaaaatgccattcttgataaattatggtttctttccatccattaaaatcaaagtattttatgatataccacaaaagtgaatcaaattttgtttcaataattaaacttctccagaattgacatggac

SEQ ID NO: 98791 - DNA, 201 bp, Bos taurus; identical to SEQ ID NO: 17311

SEQ ID NO: 98792 - DNA, 201 bp, Bos taurus; identical to SEQ ID NO: 17314

SEQ ID NO: 98793 - DNA, 201 bp, Bos taurus; identical to SEQ ID NO: 17315

SEQ ID NO: 98794 - DNA, 201 bp, Bos taurus
gcctgcgtatacttacctgagtagaaaaagatctttcacctattttatttaggctttcatttctcaaattttaactaggagctaagtgtaatttgaaactgggatgcactagttttgctccaaagaagtataattattcaaattatctgcattaaaagtgtaaaccttttaaagcaaagcgttacttaatttaaaagagag

SEQ ID NO: 98795 - DNA, 201 bp, Bos taurus
tatttttggaaccaagtagttaacgcctcactatcatttgcttcaaaaaaaaatgataatagattgatttatgccacacattaatatcaggagtgccacacaaatttgcacaaagttctcatttataaaactggagttctttgtactgctttacattaaaaactattcttaggagtcctccaaactatatgaaaagaaaaa

SEQ ID NO: 98796 - DNA, 201 bp, Bos taurus
gataataacacttaatgtctccaaaatatttcttcgagtagatattttaaatcttattccccacttctctttggttgaccatttatattgtttgtaacaacactgtaatgaaagcttcaggtctagggatgttttggaatacaaataatgaaagaaaggtcacaaataacaaatctaaacaaatccaaataacaaatctac

SEQ ID NO: 98797 - DNA, 201 bp, Bos taurus; identical to SEQ ID NO: 17316

SEQ ID NO: 98798 - DNA, 201 bp, Bos taurus
ttctaattcaaaaccatttgtggactgttgtatttatttctggtcctgagtaacttctaggattttcaaaatcagcaacttattccactagatgttactagttgtactagtattgtatagtaacaagtaagagacattgttaagtttggccaaatattaaaaaaatgaagaaaaattatatattcctcttagctattacac

SEQ ID NO: 98799 - DNA, 201 bp, Bos taurus; identical to SEQ ID NO: 17317

SEQ ID NO: 98800 - DNA, 201 bp, Bos taurus; identical to SEQ ID NO: 17318

SEQ ID NO: 98801 - DNA, 201 bp, Bos taurus; identical to SEQ ID NO: 17319

SEQ ID NO: 98802 - DNA, 201 bp, Bos taurus; identical to SEQ ID NO: 17320

SEQ ID NO: 98803 - DNA, 201 bp, Bos taurus
acttggaagaaattgattttatttatgttttataaatgaacatttttactgtaacaaataggccttttctggggaggcttgttatggtcgaagtaatactgtatgatggtagtttagccaatactgcagaaagacttagggaagaataattccatctgggttccaattgtgaggataattactacattaaaaaaagaataa

SEQ ID NO: 98804 - DNA, 201 bp, Bos taurus
cacaagtgtgggcatttttgcctaataaggggtcaggaagctggctggtaagtatcagggggcctcttggcaatggctccaaaggggcttagcttcagagatgaccttggttctgggctttgtatcagtgggcttggtgcaaggcctcccacctgtggccttgggatacgaatccacctagacttaggaagctgtccagat

SEQ ID NO: 98805 - DNA, 201 bp, Bos taurus
atctatttgtataacttccctagctattctgtaagttcctggcatagtcaaagatgtttcaaccaaatgtattgagagtgagaaaaaaaatacgtagagcaggaggcataacttaaattgctttcacaactctcctaatcattttcctaaaaatctatagaggtatcagcttggtatattgaaccacagagaagaactttt

SEQ ID NO: 98806 - DNA, 201 bp, Bos taurus
agccactaaaccaccaccaccacccgccctcactccacatctacccagatcccattagcgggtgtttacctctcctttggtagttgtgaatgctggccaccagcaactcacaggtactctcttctcgagacagtcattttcatgcagaggtgggctacctttccagggagcctccattctgaggcccccatggcccctgtg

SEQ ID NO: 98807 - DNA, 201 bp, Bos taurus; identical to SEQ ID NO: 17321

SEQ ID NO: 98808 - DNA, 201 bp, Bos taurus; identical to SEQ ID NO: 17322

SEQ ID NO: 98809 - DNA, 201 bp, Bos taurus; identical to SEQ ID NO: 17323

SEQ ID NO: 98810 - DNA, 201 bp, Bos taurus; identical to SEQ ID NO: 17325

SEQ ID NO: 98811 - DNA, 201 bp, Bos taurus; identical to SEQ ID NO: 17326

SEQ ID NO: 98812 - DNA, 201 bp, Bos taurus; identical to SEQ ID NO: 17327

SEQ ID NO: 98813 - DNA, 201 bp, Bos taurus
taaataaatgagaggtatttataatctttcagtaaacctcacaactaaaaacaatattcagtaaattaattagatatgcatgatattcaaaaggacagaacagaaagaaaaaataagcctgtgtttgggaatcacagaaaagaatgtttaagttgaactttgacaagtaaatgacttgaacatgttcaagttattagagct

SEQ ID NO: 98814 - DNA, 201 bp, Bos taurus
atagtttatctgctgaagttcagcactggacagtagatatgaatttttagcaaaaagaagtgcagttgatcttactgtgtaaggtgcttaaaaaatatggtgaaataggaaatactcatctatcaaattatatatatatgaattaaaagaagtaattttcataaatagatttctaattataaagaataatgttaaatataa

SEQ ID NO: 98815 - DNA, 201 bp, Bos taurus
aagactccttggagaagggaaaggctgcccactccagtattctggcctggagaattccatggactgtatagtccatggggttacaaagagttggacatgattgagcaactatcactttagaaatgaaaattacaactttaagtttttttttcccattaaaaatatattataacttaaaaaaaattaagaccaatagtgagc

SEQ ID NO: 98816 - DNA, 201 bp, Bos taurus; identical to SEQ ID NO: 17328

SEQ ID NO: 98817 - DNA, 201 bp, Bos taurus
gtgtcatagcaatcagagctatttctaactacttacatgctaaattcaaagtcatataaacatttaaacaattaaatagttttatcctttggatcataagcatttaggataaaagaaaatgtactgttcataaagtagatcatgcctttgaaacaattaaaagtgattaaatatttcactcagttatgaataccataaaac

SEQ ID NO: 98818 - DNA, 201 bp, Bos taurus; identical to SEQ ID NO: 17329

SEQ ID NO: 98819 - DNA, 201 bp, Bos taurus; identical to SEQ ID NO: 17330

SEQ ID NO: 98820 - DNA, 201 bp, Bos taurus; identical to SEQ ID NO: 17332

SEQ ID NO: 98821 - DNA, 201 bp, Bos taurus; identical to SEQ ID NO: 17335

SEQ ID NO: 98822 - DNA, 201 bp, Bos taurus; identical to SEQ ID NO: 17336

SEQ ID NO: 98823 - DNA, 201 bp, Bos taurus; identical to SEQ ID NO: 17337

SEQ ID NO: 98824 - DNA, 201 bp, Bos taurus; identical to SEQ ID NO: 17338

SEQ ID NO: 98825 - DNA, 201 bp, Bos taurus
ctgacaatacttccatctcagaagttaaaatactgttagacagagaagaccttatgccctccaaagtaaagatttcagcatgtatccttcagataatagaaaacacacacaaaaaaatcacatacaagtatgtatacaatagagaaaggttatggaacagggtcccatacattttaaaagtggtcttaaattgctactgct

SEQ ID NO: 98826 - DNA, 201 bp, Bos taurus; identical to SEQ ID NO: 17339

SEQ ID NO: 98827 - DNA, 201 bp, Bos taurus
ttcatgttagactggaggctatttaaaacatattaactctaaaataggttagaaatgacaaatatgatcatgcatacagtcattctcaactttatgccagcggaaacaggatcaacatctgcagcacagtaatttctgagtctagacctggcttcagagtactactctgtacatcaaacagaggttagtccaaacaagtat

SEQ ID NO: 98828 - DNA, 201 bp, Bos taurus
acataattattgttcacaagtgataagaacataaattggatgactctggtgagcctgggcagtactgaaatgctttgctggccttatcttaacgtgtattgtcttacgttagggcatcagcataacagcctgatgaacagtcactactctctttactcagtttatgaataaaatcactgaagattatagtgattgaatcac

SEQ ID NO: 98829 - DNA, 201 bp, Bos taurus; identical to SEQ ID NO: 17341

SEQ ID NO: 98830 - DNA, 201 bp, Bos taurus; identical to SEQ ID NO: 17342

SEQ ID NO: 98831 - DNA, 201 bp, Bos taurus; identical to SEQ ID NO: 17344

SEQ ID NO: 98832 - DNA, 201 bp, Bos taurus; identical to SEQ ID NO: 17345

SEQ ID NO: 98833 - DNA, 201 bp, Bos taurus; identical to SEQ ID NO: 17346

SEQ ID NO: 98834 - DNA, 201 bp, Bos taurus; identical to SEQ ID NO: 17347

SEQ ID NO: 98835 - DNA, 201 bp, Bos taurus
caggggtatcttattgtgaaaatcctgtgattgatagctgttgggaaacaggacaaggagattttttacatctgtttactgccttgaagtttctccattctatcccacactgactgttgtctttcatagaagagctagaatttctacccttccgatgcagatgccacagagccacaaagttgtagggcaaaatgaaatgat

SEQ ID NO: 98836 - DNA, 201 bp, Bos taurus; identical to SEQ ID NO: 17348

SEQ ID NO: 98837 - DNA, 201 bp, Bos taurus; identical to SEQ ID NO: 17350

SEQ ID NO: 98838 - DNA, 201 bp, Bos taurus; identical to SEQ ID NO: 17351

SEQ ID NO: 98839 - DNA, 201 bp, Bos taurus; identical to SEQ ID NO: 17352

SEQ ID NO: 98840 - DNA, 201 bp, Bos taurus; identical to SEQ ID NO: 17355

SEQ ID NO: 98841 - DNA, 201 bp, Bos taurus; identical to SEQ ID NO: 17357

SEQ ID NO: 98842 - DNA, 201 bp, Bos taurus; identical to SEQ ID NO: 17358

SEQ ID NO: 98843 - DNA, 201 bp, Bos taurus; identical to SEQ ID NO: 17359

SEQ ID NO: 98844 - DNA, 201 bp, Bos taurus; identical to SEQ ID NO: 17360

SEQ ID NO: 98845 - DNA, 201 bp, Bos taurus; identical to SEQ ID NO: 17361

SEQ ID NO: 98846 - DNA, 201 bp, Bos taurus; identical to SEQ ID NO: 17362

SEQ ID NO: 98847 - DNA, 201 bp, Bos taurus; identical to SEQ ID NO: 17363

SEQ ID NO: 98848 - DNA, 201 bp, Bos taurus; identical to SEQ ID NO: 17364

SEQ ID NO: 98849 - DNA, 201 bp, Bos taurus; identical to SEQ ID NO: 17366

SEQ ID NO: 98850 - DNA, 201 bp, Bos taurus; identical to SEQ ID NO: 17367

SEQ ID NO: 98851 - DNA, 201 bp, Bos taurus; identical to SEQ ID NO: 17368

SEQ ID NO: 98852 - DNA, 201 bp, Bos taurus; identical to SEQ ID NO: 17369

SEQ ID NO: 98853 - DNA, 201 bp, Bos taurus; identical to SEQ ID NO: 17370

SEQ ID NO: 98854 - DNA, 201 bp, Bos taurus; identical to SEQ ID NO: 17371

SEQ ID NO: 98855 - DNA, 201 bp, Bos taurus; identical to SEQ ID NO: 17372

SEQ ID NO: 98856 - DNA, 201 bp, Bos taurus; identical to SEQ ID NO: 17373

SEQ ID NO: 98857 - DNA, 201 bp, Bos taurus; identical to SEQ ID NO: 17374

SEQ ID NO: 98858 - DNA, 201 bp, Bos taurus; identical to SEQ ID NO: 17375

SEQ ID NO: 98859 - DNA, 201 bp, Bos taurus; identical to SEQ ID NO: 17376

SEQ ID NO: 98860 - DNA, 201 bp, Bos taurus; identical to SEQ ID NO: 17377

SEQ ID NO: 98861 - DNA, 201 bp, Bos taurus; identical to SEQ ID NO: 17378

SEQ ID NO: 98862 - DNA, 201 bp, Bos taurus; identical to SEQ ID NO: 17379

SEQ ID NO: 98863 - DNA, 201 bp, Bos taurus; identical to SEQ ID NO: 17380

SEQ ID NO: 98864 - DNA, 201 bp, Bos taurus; identical to SEQ ID NO: 17381

SEQ ID NO: 98865 - DNA, 201 bp, Bos taurus; identical to SEQ ID NO: 17382

SEQ ID NO: 98866 - DNA, 201 bp, Bos taurus; identical to SEQ ID NO: 17383

SEQ ID NO: 98867 - DNA, 201 bp, Bos taurus; identical to SEQ ID NO: 17385

SEQ ID NO: 98868 - DNA, 201 bp, Bos taurus; identical to SEQ ID NO: 17386

SEQ ID NO: 98869 - DNA, 201 bp, Bos taurus; identical to SEQ ID NO: 17387

SEQ ID NO: 98870 - DNA, 201 bp, Bos taurus; identical to SEQ ID NO: 17388

SEQ ID NO: 98871 - DNA, 201 bp, Bos taurus; identical to SEQ ID NO: 17389

SEQ ID NO: 98872 - DNA, 201 bp, Bos taurus; identical to SEQ ID NO: 17390

SEQ ID NO: 98873 - DNA, 201 bp, Bos taurus; identical to SEQ ID NO: 17391

SEQ ID NO: 98874 - DNA, 201 bp, Bos taurus; identical to SEQ ID NO: 17392

SEQ ID NO: 98875 - DNA, 201 bp, Bos taurus; identical to SEQ ID NO: 17393

SEQ ID NO: 98876 - DNA, 201 bp, Bos taurus; identical to SEQ ID NO: 17394

SEQ ID NO: 98877 - DNA, 201 bp, Bos taurus
tattaaactaaaaacgtttgctgtcacttgtgggcagtgatgattttttagctcagtacctaccaaccttccccatttctttttttttttttttttggccaaatgtcttgtggaagcaacagtgagagcacagagccctaatcactgaaccatcaaggaattccctccaccggactacacagtccacgggattctccaggc

SEQ ID NO: 98878 - DNA, 201 bp, Bos taurus; identical to SEQ ID NO: 17396

SEQ ID NO: 98879 - DNA, 201 bp, Bos taurus
taaatacgtattttacatttgttaggatgaaagaaaagagagcgtttgcatcttctttgtccacccctcccctgccacgcttaaacattttactggttacgttattctctgttgatgcaacttttctctgttggtggacatcaaactctgcacatactcttgattaagtgtatttttttctaaaatgggaatttattttta

SEQ ID NO: 98880 - DNA, 201 bp, Bos taurus; identical to SEQ ID NO: 17397

SEQ ID NO: 98881 - DNA, 201 bp, Bos taurus; identical to SEQ ID NO: 17398

SEQ ID NO: 98882 - DNA, 201 bp, Bos taurus; identical to SEQ ID NO: 17399

SEQ ID NO: 98883 - DNA, 201 bp, Bos taurus
attaatgaagaaaacctggtcttctcactggggccatgtccccagaccttgattcaagcaggtaccaccagcatggatgataggctgattcctcctttagctgatgggaaaacaacccagaggccactgtcccctagtacatcatggaaacttctccaccacatcctcctttcatcctgtgaaaacagtgacatccatgcc

SEQ ID NO: 98884 - DNA, 201 bp, Bos taurus; identical to SEQ ID NO: 17400

SEQ ID NO: 98885 - DNA, 201 bp, Bos taurus; identical to SEQ ID NO: 17401

SEQ ID NO: 98886 - DNA, 201 bp, Bos taurus; identical to SEQ ID NO: 17402

SEQ ID NO: 98887 - DNA, 201 bp, Bos taurus; identical to SEQ ID NO: 17403

SEQ ID NO: 98888 - DNA, 201 bp, Bos taurus; identical to SEQ ID NO: 17404

SEQ ID NO: 98889 - DNA, 201 bp, Bos taurus; identical to SEQ ID NO: 17405

SEQ ID NO: 98890 - DNA, 201 bp, Bos taurus; identical to SEQ ID NO: 17406

SEQ ID NO: 98891 - DNA, 201 bp, Bos taurus; identical to SEQ ID NO: 17407

SEQ ID NO: 98892 - DNA, 201 bp, Bos taurus; identical to SEQ ID NO: 17409

SEQ ID NO: 98893 - DNA, 201 bp, Bos taurus; identical to SEQ ID NO: 17410

SEQ ID NO: 98894 - DNA, 201 bp, Bos taurus; identical to SEQ ID NO: 17411

SEQ ID NO: 98895 - DNA, 201 bp, Bos taurus; identical to SEQ ID NO: 17412

SEQ ID NO: 98896 - DNA, 201 bp, Bos taurus; identical to SEQ ID NO: 17413

SEQ ID NO: 98897 - DNA, 201 bp, Bos taurus; identical to SEQ ID NO: 17414

SEQ ID NO: 98898 - DNA, 201 bp, Bos taurus; identical to SEQ ID NO: 17418

SEQ ID NO: 98899 - DNA, 201 bp, Bos taurus; identical to SEQ ID NO: 17419

SEQ ID NO: 98900 - DNA, 201 bp, Bos taurus; identical to SEQ ID NO: 17420

SEQ ID NO: 98901 - DNA, 201 bp, Bos taurus; identical to SEQ ID NO: 17421

SEQ ID NO: 98902 - DNA, 201 bp, Bos taurus; identical to SEQ ID NO: 17422

SEQ ID NO: 98903 - DNA, 201 bp, Bos taurus; identical to SEQ ID NO: 17423

SEQ ID NO: 98904 - DNA, 201 bp, Bos taurus; identical to SEQ ID NO: 17424

SEQ ID NO: 98905 - DNA, 201 bp, Bos taurus; identical to SEQ ID NO: 17425

SEQ ID NO: 98906 - DNA, 201 bp, Bos taurus; identical to SEQ ID NO: 17426

SEQ ID NO: 98907 - DNA, 201 bp, Bos taurus; identical to SEQ ID NO: 17427

SEQ ID NO: 98908 - DNA, 201 bp, Bos taurus; identical to SEQ ID NO: 17428

SEQ ID NO: 98909 - DNA, 201 bp, Bos taurus; identical to SEQ ID NO: 17429

SEQ ID NO: 98910 - DNA, 201 bp, Bos taurus; identical to SEQ ID NO: 17430

SEQ ID NO: 98911 - DNA, 201 bp, Bos taurus; identical to SEQ ID NO: 17432

SEQ ID NO: 98912 - DNA, 201 bp, Bos taurus; identical to SEQ ID NO: 17433

SEQ ID NO: 98913 - DNA, 201 bp, Bos taurus; identical to SEQ ID NO: 17434

SEQ ID NO: 98914 - DNA, 201 bp, Bos taurus; identical to SEQ ID NO: 17435

SEQ ID NO: 98915 - DNA, 201 bp, Bos taurus; identical to SEQ ID NO: 17437

SEQ ID NO: 98916 - DNA, 201 bp, Bos taurus; identical to SEQ ID NO: 17439

SEQ ID NO: 98917 - DNA, 201 bp, Bos taurus; identical to SEQ ID NO: 17441

SEQ ID NO: 98918 - DNA, 201 bp, Bos taurus; identical to SEQ ID NO: 17442

SEQ ID NO: 98919 - DNA, 201 bp, Bos taurus; identical to SEQ ID NO: 17443

SEQ ID NO: 98920 - DNA, 201 bp, Bos taurus; identical to SEQ ID NO: 17445

SEQ ID NO: 98921 - DNA, 201 bp, Bos taurus; identical to SEQ ID NO: 17446

SEQ ID NO: 98922 - DNA, 201 bp, Bos taurus; identical to SEQ ID NO: 17447

SEQ ID NO: 98923 - DNA, 201 bp, Bos taurus; identical to SEQ ID NO: 17448

SEQ ID NO: 98924 - DNA, 201 bp, Bos taurus; identical to SEQ ID NO: 17449

SEQ ID NO: 98925 - DNA, 201 bp, Bos taurus; identical to SEQ ID NO: 17454

SEQ ID NO: 98926 - DNA, 201 bp, Bos taurus; identical to SEQ ID NO: 17455

SEQ ID NO: 98927 - DNA, 201 bp, Bos taurus; identical to SEQ ID NO: 17456

SEQ ID NO: 98928 - DNA, 201 bp, Bos taurus; identical to SEQ ID NO: 17457

SEQ ID NO: 98929 - DNA, 201 bp, Bos taurus; identical to SEQ ID NO: 17458

SEQ ID NO: 98930 - DNA, 201 bp, Bos taurus; identical to SEQ ID NO: 17459

SEQ ID NO: 98931 - DNA, 201 bp, Bos taurus; identical to SEQ ID NO: 17463

SEQ ID NO: 98932 - DNA, 201 bp, Bos taurus; identical to SEQ ID NO: 17466

SEQ ID NO: 98933 - DNA, 201 bp, Bos taurus; identical to SEQ ID NO: 17467

SEQ ID NO: 98934 - DNA, 201 bp, Bos taurus; identical to SEQ ID NO: 17470

SEQ ID NO: 98935 - DNA, 201 bp, Bos taurus; identical to SEQ ID NO: 17472

SEQ ID NO: 98936 - DNA, 201 bp, Bos taurus; identical to SEQ ID NO: 17473

SEQ ID NO: 98937 - DNA, 201 bp, Bos taurus; identical to SEQ ID NO: 17474

SEQ ID NO: 98938 - DNA, 201 bp, Bos taurus; identical to SEQ ID NO: 17475

SEQ ID NO: 98939 - DNA, 201 bp, Bos taurus; identical to SEQ ID NO: 17476

SEQ ID NO: 98940 - DNA, 201 bp, Bos taurus; identical to SEQ ID NO: 17477

SEQ ID NO: 98941 - DNA, 201 bp, Bos taurus; identical to SEQ ID NO: 17478

SEQ ID NO: 98942 - DNA, 201 bp, Bos taurus; identical to SEQ ID NO: 17480

SEQ ID NO: 98943 - DNA, 201 bp, Bos taurus; identical to SEQ ID NO: 17481

SEQ ID NO: 98944 - DNA, 201 bp, Bos taurus; identical to SEQ ID NO: 17482

SEQ ID NO: 98945 - DNA, 201 bp, Bos taurus; identical to SEQ ID NO: 17485

SEQ ID NO: 98946 - DNA, 201 bp, Bos taurus; identical to SEQ ID NO: 17486

SEQ ID NO: 98947 - DNA, 201 bp, Bos taurus; identical to SEQ ID NO: 17487

SEQ ID NO: 98948 - DNA, 201 bp, Bos taurus; identical to SEQ ID NO: 17488

SEQ ID NO: 98949 - DNA, 201 bp, Bos taurus; identical to SEQ ID NO: 17491

SEQ ID NO: 98950 - DNA, 201 bp, Bos taurus; identical to SEQ ID NO: 17492

SEQ ID NO: 98951 - DNA, 201 bp, Bos taurus; identical to SEQ ID NO: 17495

SEQ ID NO: 98952 - DNA, 201 bp, Bos taurus; identical to SEQ ID NO: 17496

SEQ ID NO: 98953 - DNA, 201 bp, Bos taurus; identical to SEQ ID NO: 17498

SEQ ID NO: 98954 - DNA, 201 bp, Bos taurus; identical to SEQ ID NO: 17499

SEQ ID NO: 98955 - DNA, 201 bp, Bos taurus; identical to SEQ ID NO: 17503

SEQ ID NO: 98956 - DNA, 201 bp, Bos taurus; identical to SEQ ID NO: 17504

SEQ ID NO: 98957 - DNA, 201 bp, Bos taurus; identical to SEQ ID NO: 17505

SEQ ID NO: 98958 - DNA, 201 bp, Bos taurus; identical to SEQ ID NO: 17507

SEQ ID NO: 98959 - DNA, 201 bp, Bos taurus; identical to SEQ ID NO: 17511

SEQ ID NO: 98960 - DNA, 201 bp, Bos taurus; identical to SEQ ID NO: 17512

SEQ ID NO: 98961 - DNA, 201 bp, Bos taurus; identical to SEQ ID NO: 17517

SEQ ID NO: 98962 - DNA, 201 bp, Bos taurus; identical to SEQ ID NO: 17519

SEQ ID NO: 98963 - DNA, 201 bp, Bos taurus; identical to SEQ ID NO: 17520

SEQ ID NO: 98964 - DNA, 201 bp, Bos taurus; identical to SEQ ID NO: 17522

SEQ ID NO: 98965 - DNA, 201 bp, Bos taurus; identical to SEQ ID NO: 17523

SEQ ID NO: 98966 - DNA, 201 bp, Bos taurus; identical to SEQ ID NO: 17529

SEQ ID NO: 98967 - DNA, 201 bp, Bos taurus; identical to SEQ ID NO: 17531

SEQ ID NO: 98968 - DNA, 201 bp, Bos taurus; identical to SEQ ID NO: 17534

SEQ ID NO: 98969 - DNA, 201 bp, Bos taurus; identical to SEQ ID NO: 17535

SEQ ID NO: 98970 - DNA, 201 bp, Bos taurus; identical to SEQ ID NO: 17536

SEQ ID NO: 98971 - DNA, 201 bp, Bos taurus; identical to SEQ ID NO: 17538

SEQ ID NO: 98972 - DNA, 201 bp, Bos taurus; identical to SEQ ID NO: 17539

SEQ ID NO: 98973 - DNA, 201 bp, Bos taurus; identical to SEQ ID NO: 17541

SEQ ID NO: 98974 - DNA, 201 bp, Bos taurus; identical to SEQ ID NO: 17543

SEQ ID NO: 98975 - DNA, 201 bp, Bos taurus; identical to SEQ ID NO: 17544

SEQ ID NO: 98976 - DNA, 201 bp, Bos taurus; identical to SEQ ID NO: 17545

SEQ ID NO: 98977 - DNA, 201 bp, Bos taurus; identical to SEQ ID NO: 17546

SEQ ID NO: 98978 - DNA, 201 bp, Bos taurus; identical to SEQ ID NO: 17547

SEQ ID NO: 98979 - DNA, 201 bp, Bos taurus; identical to SEQ ID NO: 17548

SEQ ID NO: 98980 - DNA, 201 bp, Bos taurus; identical to SEQ ID NO: 17549

SEQ ID NO: 98981 - DNA, 201 bp, Bos taurus; identical to SEQ ID NO: 17552

SEQ ID NO: 98982 - DNA, 201 bp, Bos taurus; identical to SEQ ID NO: 17553

SEQ ID NO: 98983 - DNA, 201 bp, Bos taurus; identical to SEQ ID NO: 17556

SEQ ID NO: 98984 - DNA, 201 bp, Bos taurus; identical to SEQ ID NO: 17558

SEQ ID NO: 98985 - DNA, 201 bp, Bos taurus
aatgaggatggagtgctactgggcccccactggtacgactccaaagccataccattatttctaacattcagccagtagtaccccaatttcaaccctaagacaaaggccacagagtctacactggatttcacaacaaggaggtcactagtgacctggaagagagccgcaccagcaggaggagtggtgggagagatgggaaga

SEQ ID NO: 98986 - DNA, 201 bp, Bos taurus
ctcctgcactatcaggatctgggacatagaaacacatttggaaagacagaggcttgactttatcacagaaatgaatcccccatgtggaattttaggttaccgtttcactgtcaaaactatgaacaggcaactccaacccatactaagaataggccgcccttaagtcctcacttacacagaaactgcaattgaggaaaagtc

SEQ ID NO: 98987 - DNA, 201 bp, Bos taurus; identical to SEQ ID NO: 17559

SEQ ID NO: 98988 - DNA, 201 bp, Bos taurus
tgtaattgtgtagactttgatgagacagcttccataaatgttgcccatggagtaacactctcgggcagtgagttcccatttcccctaaggccatatttttctaaagtagcagcaggggtatgactttcacatagaccccccataggaagtgctgtcatttcctgtgctgatttatccaacccctggcccacacctccagtt

SEQ ID NO: 98989 - DNA, 201 bp, Bos taurus
tggtggcagagctggaagagaccagggctcctacctcctcgctgaacctctgtaccacactctgcctgctgggcttccgagaagctccagggcctttctccagtctttccttcctgaggctacttaggagtcagtggttgcttgtttcctcttgatatctttgtggcaggactgctggtggggctgtgtgacaaagcagag

SEQ ID NO: 98990 - DNA, 201 bp, Bos taurus; identical to SEQ ID NO: 17564

SEQ ID NO: 98991 - DNA, 201 bp, Bos taurus; identical to SEQ ID NO: 17565

SEQ ID NO: 98992 - DNA, 201 bp, Bos taurus; identical to SEQ ID NO: 17566

SEQ ID NO: 98993 - DNA, 201 bp, Bos taurus; identical to SEQ ID NO: 17567

SEQ ID NO: 98994 - DNA, 201 bp, Bos taurus
actccaggttttactcgatgtgcttttacctgctgatgcaggccatggtggaaggctttggtgggaaggaggcggtgttgaggacactgaaggacaccccagtgatgatccatacaggcccctgctgctgctgttgcccctgctgcccccgaatcaagatcaccaggtgaggcgggagggagaggctgcctggagagcaga

SEQ ID NO: 98995 - DNA, 201 bp, Bos taurus; identical to SEQ ID NO: 17569

SEQ ID NO: 98996 - DNA, 201 bp, Bos taurus
gatttttaaagttgtatttctttctgcttcatttctggcacattattttttatctgactgcacttaaatttcatttacaaatcttctgttttgctatacaacttttaacatatgtatatgatgttcctaagaaaaatgttttacattgcctcttagttaccaatctttagtaaaacaagtctgaaagtattactctcattc

SEQ ID NO: 98997 - DNA, 201 bp, Bos taurus
ttacttgaaaaaaaatatttagcttctaaacttgtgacatttacacattcattttgttctgctctttctggcagcatcccttcctgaaactggccaagccattatccagcttgacaccactgattatggcagctaaagaagcaatgaagagtaaccgttaacatcattgccgcggcctcatattcttttttccattttcta

SEQ ID NO: 98998 - DNA, 201 bp, Bos taurus
gggacacccccagggaagccgtgatcggacaggacacagccaaggaagaaactccccgaagcctgacagaaaaagataggctcggccctgattcaccgcgggcagagagccatggacctgagtacaaccggagagaggtttaacctcagcaaatgggactaaaactaatgatcgatgctgctgccgctgcattgatgtagc

SEQ ID NO: 98999 - DNA, 201 bp, Bos taurus
tccaactgttagcactgtatacctcatgcgtacattcagctcaaacagtggattagaaaatcaaattagaacagtctggcctgggcactgctgctcactcgaccccagtgcctccctctttttgctctgctcaccatgtgctcatccagtgcttggtgcctcgcacagcaagactcttgtgtctgctttctgggcccaaga

SEQ ID NO: 99000 - DNA, 201 bp, Bos taurus
tcaaagccttaactggtgtgtatgtgtgcttggggaaggttggagagggtgcactatacaagacattgtgacaataattagggaaagttaaatacagactattttccagaatatattagagaaaaacttttttgtacaagacatacatgtgtgcaagagtatgtatatacttacgtagcagaacatatatttccatataca

SEQ ID NO: 99001 - DNA, 201 bp, Bos taurus; identical to SEQ ID NO: 17570

SEQ ID NO: 99002 - DNA, 201 bp, Bos taurus; identical to SEQ ID NO: 17571

SEQ ID NO: 99003 - DNA, 201 bp, Bos taurus; identical to SEQ ID NO: 17572

SEQ ID NO: 99004 - DNA, 201 bp, Bos taurus; identical to SEQ ID NO: 17573

SEQ ID NO: 99005 - DNA, 201 bp, Bos taurus; identical to SEQ ID NO: 17576

SEQ ID NO: 99006 - DNA, 201 bp, Bos taurus; identical to SEQ ID NO: 17577

SEQ ID NO: 99007 - DNA, 201 bp, Bos taurus; identical to SEQ ID NO: 17578

SEQ ID NO: 99008 - DNA, 201 bp, Bos taurus; identical to SEQ ID NO: 17579

SEQ ID NO: 99009 - DNA, 201 bp, Bos taurus; identical to SEQ ID NO: 17583

SEQ ID NO: 99010 - DNA, 201 bp, Bos taurus; identical to SEQ ID NO: 17584

SEQ ID NO: 99011 - DNA, 201 bp, Bos taurus
tagactagatggcatattaataatagatatcaaagttctagggactgggaagttcaagatcaagatgccaaatgattcagtgtctagtgagagtattctttctggctcatagacactgtcttctagctctacctttacatggaggaaaaggcaaaagagctctgtaggtctcttttacttagggcattaatcctatcgatg

SEQ ID NO: 99012 - DNA, 201 bp, Bos taurus; identical to SEQ ID NO: 17586

SEQ ID NO: 99013 - DNA, 201 bp, Bos taurus
tttggggttaaaaaatatgaattttggagggtttttgtttgtttgtttagaattccatgatttgctatgacatacatagtgcacaatcatttatacaagttgaatgagaaatttacattaacaattttcatgaaagtgaaggtttctcagttatgtctgactctttgtgaccccatgtactatacagtccttggaattctc

SEQ ID NO: 99014 - DNA, 201 bp, Bos taurus
aactttgtttacccctttctcaagcacctttgatatcttgtgcttggtttataacacaatcctgtaccatactgtccagaagaaaacatatatttttccaatattattatattctatataaaaatgttctgtatccaattcccagactagctttcaaggcccaactttattttttaatctaaaaagttagtataatttaaa

SEQ ID NO: 99015 - DNA, 201 bp, Bos taurus; identical to SEQ ID NO: 17589

SEQ ID NO: 99016 - DNA, 201 bp, Bos taurus; identical to SEQ ID NO: 17590

SEQ ID NO: 99017 - DNA, 201 bp, Bos taurus; identical to SEQ ID NO: 17597

SEQ ID NO: 99018 - DNA, 201 bp, Bos taurus; identical to SEQ ID NO: 17599

SEQ ID NO: 99019 - DNA, 201 bp, Bos taurus; identical to SEQ ID NO: 17602

SEQ ID NO: 99020 - DNA, 201 bp, Bos taurus; identical to SEQ ID NO: 17606

SEQ ID NO: 99021 - DNA, 201 bp, Bos taurus; identical to SEQ ID NO: 17607

SEQ ID NO: 99022 - DNA, 201 bp, Bos taurus
ccttccagtcctgattctcctttcacaagcctcgctgggtcagtctacaccctgctgtataattgagagataagtccctctcatggccctgctccaagactgactcctctgacccccagctcctaatttctgtgcagtgctctgtgtttactctgaacatgccctcgaccttcaactactgatacagctctgctcattctc

SEQ ID NO: 99023 - DNA, 201 bp, Bos taurus
cccagctttcctcttccctccccatgccaacttcctctggtgaccagattcctgctggcactgaagtgtccacatccctagaagtccagcctcaacctcacgggctcccctctgtacccccttacacacacccatgggcacctcccctagactccagaccacatttaagaacaaaatttaaaccagacacctgtacagaaa

SEQ ID NO: 99024 - DNA, 201 bp, Bos taurus
gagggctttctccgtgtttaactgcaggcctctctacgccccttccacctatgtgagaatacagacatcaagcatttggctgttccacacagctgagggcatatgtgcatcctataaaagcagccagcaatattaatcatctccagcaccggtgaacaagtctggcacacttagcagagaaaaatggagcctcaggaacgg

SEQ ID NO: 99025 - DNA, 201 bp, Bos taurus; identical to SEQ ID NO: 17609

SEQ ID NO: 99026 - DNA, 201 bp, Bos taurus; identical to SEQ ID NO: 17611

SEQ ID NO: 99027 - DNA, 201 bp, Bos taurus; identical to SEQ ID NO: 17612

SEQ ID NO: 99028 - DNA, 201 bp, Bos taurus
agaagggagtcacaggtcatggcgaggtcggcggcggggaggaggaacggaggaagctgactggaagtcaggaagtcactgctgcaggtgggggtggattaggggaatattgaagaatgatggactgactcattcttgtacaggagaggctgggctggcaaaccatgaggtcctccaggttgctaggggctggaatctggc

SEQ ID NO: 99029 - DNA, 201 bp, Bos taurus
gagaaaagaatagcttctttctaccttagaatgggcttagaaatagaaagtagcttacctgttcatagttaaaggtatccaacattcccagaataaggccctggatttctccaagttttccttttccataaactgggtcctaattagaaaaaagttgctaaagattataatttcattcttgttattttaaatgtattttaa

SEQ ID NO: 99030 - DNA, 201 bp, Bos taurus; identical to SEQ ID NO: 17613

SEQ ID NO: 99031 - DNA, 201 bp, Bos taurus; identical to SEQ ID NO: 17614

SEQ ID NO: 99032 - DNA, 201 bp, Bos taurus; identical to SEQ ID NO: 17615

SEQ ID NO: 99033 - DNA, 201 bp, Bos taurus; identical to SEQ ID NO: 17616

SEQ ID NO: 99034 - DNA, 201 bp, Bos taurus; identical to SEQ ID NO: 17617

SEQ ID NO: 99035 - DNA, 201 bp, Bos taurus; identical to SEQ ID NO: 17619

SEQ ID NO: 99036 - DNA, 201 bp, Bos taurus; identical to SEQ ID NO: 17620

SEQ ID NO: 99037 - DNA, 201 bp, Bos taurus; identical to SEQ ID NO: 17621

SEQ ID NO: 99038 - DNA, 201 bp, Bos taurus; identical to SEQ ID NO: 17623

SEQ ID NO: 99039 - DNA, 201 bp, Bos taurus; identical to SEQ ID NO: 17624

SEQ ID NO: 99040 - DNA, 201 bp, Bos taurus
acagatttatttttaaaaaccctctaattattttgccatataagagcaaaattcaaataatataaataacattttggtataaaattaataatatggaaaacagatgtaagccaaccaagaggtaaaaagtttttagcaataatactgtatataaccatcaattgaccatccaggctgaaagtttattttccctttattgat

SEQ ID NO: 99041 - DNA, 201 bp, Bos taurus
acaattggcactagccttcccacagttatctaaactgaggaaaagctatttgggtcctgtggtgagatggtacagaggaaaagaagaaaatcacagtccatggagatgttcagaaaataggtattgactatgatatgggggctgcgtgcttgactcagatgcaatcatttgtgatagaaattttgcacttaaatttggttg

SEQ ID NO: 99042 - DNA, 201 bp, Bos taurus
cggaatttgaagctgggaacgtgcacactgatttcatcgctcaacaccgcaaagaactgttgcccgaccggaagaccacagccaaggagtttttatgtcatgcagctctggccctcatcctcaaggagaaagctgtgtctgatgtcttcaaaattcagacacaaggtatggaatatttttctatttcttctgctttgcaaa

SEQ ID NO: 99043 - DNA, 201 bp, Bos taurus
gtgtgggcttcagaattcaagagctcagtggttgtgcacgggcttacttgctctgcggtctgtgagatcttcccataccagggactgaacccaaagcccccgcatgccagattcttaaccactagactgccacagaagtctcatatccactctcttttagatgattttcccaaataagtcattacagagaaatgagtagag

SEQ ID NO: 99044 - DNA, 201 bp, Bos taurus
gttagctttaccaaaagaaaagtttatctcaggactatagtttgtatttccagcctccaaaatagggcaggagaaagcagataactcagtgaaatcaccagcatgaccataaattcaattcatataatggcagatcaataataccatttcttttttgaagtcagatcatcattgtaaagggaaattactgttagatgtatc

SEQ ID NO: 99045 - DNA, 201 bp, Bos taurus; identical to SEQ ID NO: 17625

SEQ ID NO: 99046 - DNA, 201 bp, Bos taurus
ctgataggagacactcccactaagagcagtgtctcactattgggtgtgagtttgagtctggaggagggggttaagaacagtccaaaaacttggctctcactcattttccactgtgattctgaccacagagtaacatgatcaaccttgaagatactggggctttaaagatgggtggatgttcagaacttccagggacttcat

SEQ ID NO: 99047 - DNA, 201 bp, Bos taurus; identical to SEQ ID NO: 17626

SEQ ID NO: 99048 - DNA, 201 bp, Bos taurus
catccaatgactttcatcatatatagggtaatacagacaaaaatactgatgaagatgcctttgtaatgtaagctctatgttccattcacaaagttacatgttcctcttaagaaaaatacgacactgaagatcaaactaatggattcttttagttaaaaaatattaagtgggcccacatttcccttccaaaaatatgcataa

SEQ ID NO: 99049 - DNA, 201 bp, Bos taurus
aggaggacagaaatccctatggacactgtagtgccattgggcagttttatcatgggtagatgtaggccaggaatgacttttactcagaataggcataaatgtgtagtttcctccagagtgaagttctttgggaatcaagattaatgtcaatcatatttaacacatttataaatgttcaaaaagaccgaatttattcagtgt

SEQ ID NO: 99050 - DNA, 201 bp, Bos taurus; identical to SEQ ID NO: 17630

SEQ ID NO: 99051 - DNA, 201 bp, Bos taurus
gaaacaagaatggtggatttggggaagaggaaataggaaaacaagtgggatgttggatggagcctagggagggcaagtccaaatgagaagctcacggtgattgaggacatcctggggaaaccaggggtcctggagggtaggccttaagaagaaaccctcaaagtcaaaatggcttagtcataatttagtccgatactgctc

SEQ ID NO: 99052 - DNA, 201 bp, Bos taurus; identical to SEQ ID NO: 17631

SEQ ID NO: 99053 - DNA, 201 bp, Bos taurus; identical to SEQ ID NO: 17632

SEQ ID NO: 99054 - DNA, 201 bp, Bos taurus
ttgttactcaaaatgtttacagtgaaatgagactgaattgagagttgaaattctgaatcaaaatattggaatttttagatcaatcaatttagaaaagaaaatcattgcattaataagaaactacaaccccttcaacaaaataatgccctcatacatttctaaatgctgtgtgttttcatacataatatgtcatttgtcaca

SEQ ID NO: 99055 - DNA, 201 bp, Bos taurus
ttacctatgcagcacttcagggttcacaaaggactgatatattttttccttaccacctgctggtgatcagcttaaggaatcagaacttcaggcatcaataattaatttgggtattttgccctgtggaagtaaactactgattctcagtaggcactctgctcaagtttgctcactgagctcaggagggtggagtccagaagg

SEQ ID NO: 99056 - DNA, 201 bp, Bos taurus; identical to SEQ ID NO: 17633

SEQ ID NO: 99057 - DNA, 201 bp, Bos taurus; identical to SEQ ID NO: 17634

SEQ ID NO: 99058 - DNA, 201 bp, Bos taurus
atatatacttaatttcagcttcctcggtgatacagtgaatatatgaattagaaaatataagaaaatggaattaaattttagataatcagaatttttaagtagaaaagttggagaaggacagcctgttctagaaacaatttaagcagccaagaactgaggaaaagtagagtagagaagaagcaaactggtacctagagagtg

SEQ ID NO: 99059 - DNA, 201 bp, Bos taurus
agcacttaatttcactctcagacgaccttacaaggtggatgcttttattatctccattttataggcaactgaatctcagaggtattaaataatttgcctgtgatcgcaaaatccgtagtggcaaagccaggatttgaactcaagtaatctgattctaggatctaggcctgtaaccactatattatgcaatcaattttgatt

SEQ ID NO: 99060 - DNA, 201 bp, Bos taurus
ttgataaagcaatcatcatagaaagaatcagaccagagattagatatctaggtatgtagaaagcccagaaacacattttcattgctgaaattttatctcagccttaaagaacaggtcattataaagctgtttctaatccagatcataggagaatgagtatatcatttgatttgattttataaggttaatataatttaatac

SEQ ID NO: 99061 - DNA, 201 bp, Bos taurus; identical to SEQ ID NO: 17635

SEQ ID NO: 99062 - DNA, 201 bp, Bos taurus; identical to SEQ ID NO: 17636

SEQ ID NO: 99063 - DNA, 201 bp, Bos taurus; identical to SEQ ID NO: 17638

SEQ ID NO: 99064 - DNA, 201 bp, Bos taurus; identical to SEQ ID NO: 17639

SEQ ID NO: 99065 - DNA, 201 bp, Bos taurus; identical to SEQ ID NO: 17640

SEQ ID NO: 99066 - DNA, 201 bp, Bos taurus; identical to SEQ ID NO: 17641

SEQ ID NO: 99067 - DNA, 201 bp, Bos taurus; identical to SEQ ID NO: 17643

SEQ ID NO: 99068 - DNA, 201 bp, Bos taurus; identical to SEQ ID NO: 17644

SEQ ID NO: 99069 - DNA, 201 bp, Bos taurus; identical to SEQ ID NO: 17646

SEQ ID NO: 99070 - DNA, 201 bp, Bos taurus; identical to SEQ ID NO: 17647

SEQ ID NO: 99071 - DNA, 201 bp, Bos taurus; identical to SEQ ID NO: 17648

SEQ ID NO: 99072 - DNA, 201 bp, Bos taurus; identical to SEQ ID NO: 17650

SEQ ID NO: 99073 - DNA, 201 bp, Bos taurus; identical to SEQ ID NO: 17651

SEQ ID NO: 99074 - DNA, 201 bp, Bos taurus; identical to SEQ ID NO: 17654

SEQ ID NO: 99075 - DNA, 201 bp, Bos taurus; identical to SEQ ID NO: 17656

SEQ ID NO: 99076 - DNA, 201 bp, Bos taurus; identical to SEQ ID NO: 17657

SEQ ID NO: 99077 - DNA, 201 bp, Bos taurus; identical to SEQ ID NO: 17658

SEQ ID NO: 99078 - DNA, 201 bp, Bos taurus; identical to SEQ ID NO: 17659

SEQ ID NO: 99079 - DNA, 201 bp, Bos taurus
ccattttctttggttcatcctttttccaggtcacttaaagaacaggacatttgagggcattttgataacacaactgaatggaactgccttaccaaaatattccagagttaataaatattgaattttacaggattttctttagacttagtacactctgactatatacatttgggaatatagttgaaattctgtgtgaatgta

SEQ ID NO: 99080 - DNA, 201 bp, Bos taurus; identical to SEQ ID NO: 17660

SEQ ID NO: 99081 - DNA, 201 bp, Bos taurus; identical to SEQ ID NO: 17662

SEQ ID NO: 99082 - DNA, 201 bp, Bos taurus
ccatgaaattcaagatggataaaagtcaatgtttcaggctcatctacttccagctttctttctataatgaggtaaaaacaagctttaagtgtgtttaaaggctcttctagtttaaaaaagaaagaaaaagaaaaatagctttatcagtttctgtatcaagttctaaaagatagtttctattccaatatgctaaagattatt

SEQ ID NO: 99083 - DNA, 201 bp, Bos taurus
atcacacggaaaaacagaaacttggtatttctttggcaagctagactcagaccactatgacaagaaggagaaggaggattaagatggccaggagagaggagactcagaggacagtgaggacatgggtgagatgaatgattacaatgagtagcctgatgatggagaatcattgagacggacacgaaagcaacagaaagaatt

SEQ ID NO: 99084 - DNA, 201 bp, Bos taurus; identical to SEQ ID NO: 17665

SEQ ID NO: 99085 - DNA, 201 bp, Bos taurus
ttaaactggcaatactgtggagcagaaatccccaaagtaatgggcttataccccaccacaagaggaccagatgagagaagggaagtaaatagttgaacttctatgtattataattttttataaagcataaagagaacaaaactaagcttgataatatgtatacatggtttcataccagtgacctcacacagttgtatgttg

SEQ ID NO: 99086 - DNA, 201 bp, Bos taurus; identical to SEQ ID NO: 17666

SEQ ID NO: 99087 - DNA, 201 bp, Bos taurus; identical to SEQ ID NO: 17667

SEQ ID NO: 99088 - DNA, 201 bp, Bos taurus; identical to SEQ ID NO: 17670

SEQ ID NO: 99089 - DNA, 201 bp, Bos taurus
tatattcccaaatattctaattggtttttcatttatattttaggatcatttttgtggctttccatgatgtctcaaagcatgggtgatgataactttagtattttagatgctaatgaagcagaaatcgaaccagaaaacatgagagaaaagttcttcagaagcttagcagtgttactggaaaacaagagtaataacaccaag

SEQ ID NO: 99090 - DNA, 201 bp, Bos taurus; identical to SEQ ID NO: 17673

SEQ ID NO: 99091 - DNA, 201 bp, Bos taurus; identical to SEQ ID NO: 17676

SEQ ID NO: 99092 - DNA, 201 bp, Bos taurus
gtgcttgtatggtggttaatggtcataattttccctgtcttgtgcctggcaagcatgcttagtctgagtggaggcaatagtggtggcctcgctgggaaatgagcctgcttgctgggtctatagcaggatgccattgtcgtcctcctctggactttcatgaaaacttgagcctgtaaccagctggctcgaatgttggcccac

SEQ ID NO: 99093 - DNA, 201 bp, Bos taurus; identical to SEQ ID NO: 17678

SEQ ID NO: 99094 - DNA, 201 bp, Bos taurus; identical to SEQ ID NO: 17679

SEQ ID NO: 99095 - DNA, 201 bp, Bos taurus; identical to SEQ ID NO: 17680

SEQ ID NO: 99096 - DNA, 201 bp, Bos taurus; identical to SEQ ID NO: 17681

SEQ ID NO: 99097 - DNA, 201 bp, Bos taurus; identical to SEQ ID NO: 17685

SEQ ID NO: 99098 - DNA, 201 bp, Bos taurus; identical to SEQ ID NO: 17686

SEQ ID NO: 99099 - DNA, 201 bp, Bos taurus; identical to SEQ ID NO: 17687

SEQ ID NO: 99100 - DNA, 201 bp, Bos taurus; identical to SEQ ID NO: 17688

SEQ ID NO: 99101 - DNA, 201 bp, Bos taurus; identical to SEQ ID NO: 17689

SEQ ID NO: 99102 - DNA, 201 bp, Bos taurus; identical to SEQ ID NO: 17690

SEQ ID NO: 99103 - DNA, 201 bp, Bos taurus; identical to SEQ ID NO: 17691

SEQ ID NO: 99104 - DNA, 201 bp, Bos taurus; identical to SEQ ID NO: 17692

SEQ ID NO: 99105 - DNA, 201 bp, Bos taurus; identical to SEQ ID NO: 17693

SEQ ID NO: 99106 - DNA, 201 bp, Bos taurus; identical to SEQ ID NO: 17694

SEQ ID NO: 99107 - DNA, 201 bp, Bos taurus; identical to SEQ ID NO: 17695

SEQ ID NO: 99108 - DNA, 201 bp, Bos taurus; identical to SEQ ID NO: 17696

SEQ ID NO: 99109 - DNA, 201 bp, Bos taurus; identical to SEQ ID NO: 17697

SEQ ID NO: 99110 - DNA, 201 bp, Bos taurus; identical to SEQ ID NO: 17698

SEQ ID NO: 99111 - DNA, 201 bp, Bos taurus; identical to SEQ ID NO: 17699

SEQ ID NO: 99112 - DNA, 201 bp, Bos taurus; identical to SEQ ID NO: 17700

SEQ ID NO: 99113 - DNA, 201 bp, Bos taurus; identical to SEQ ID NO: 17701

SEQ ID NO: 99114 - DNA, 201 bp, Bos taurus; identical to SEQ ID NO: 17702

SEQ ID NO: 99115 - DNA, 201 bp, Bos taurus
tcaataaggctaaaataaaactggaaatgcccccataaaatactccctacacaccatattagcaagcactaagtaccaattgacagtgatctaccctggggagggggcaagagtttggaaacagattctttcttaagttttggctaataggaaaagactaaaattgagaaaaagcctccagcagtccaacccttacttagg

SEQ ID NO: 99116 - DNA, 201 bp, Bos taurus
gacatttctgtgtttcctatttttactctggacttccataaagtacttcaacacagagcatctgagtcttgcaactttcaactatatcctactattattatatacaaccctgttgatagaatggtaaggtgggggaaaataattaatctctaatattatgattaaatctgtcttttatgtaattatcttttgataatattg

SEQ ID NO: 99117 - DNA, 201 bp, Bos taurus; identical to SEQ ID NO: 17703

SEQ ID NO: 99118 - DNA, 201 bp, Bos taurus; identical to SEQ ID NO: 17704

SEQ ID NO: 99119 - DNA, 201 bp, Bos taurus; identical to SEQ ID NO: 17705

SEQ ID NO: 99120 - DNA, 201 bp, Bos taurus; identical to SEQ ID NO: 17706

SEQ ID NO: 99121 - DNA, 201 bp, Bos taurus; identical to SEQ ID NO: 17707

SEQ ID NO: 99122 - DNA, 201 bp, Bos taurus; identical to SEQ ID NO: 17708

SEQ ID NO: 99123 - DNA, 201 bp, Bos taurus; identical to SEQ ID NO: 17709

SEQ ID NO: 99124 - DNA, 201 bp, Bos taurus; identical to SEQ ID NO: 17710

SEQ ID NO: 99125 - DNA, 201 bp, Bos taurus
agttttgttaatagaggaggtccccctccaaagcctctccagtactctaccctgtgaatttcctacatatacagaggcctgaagcccagctttagatgcagcttaagcttgaggagccacacactctctcttgtcaactcaaacactcgtacttttactgaatgccacatcactactgttgggcccatcattatgacagat

SEQ ID NO: 99126 - DNA, 201 bp, Bos taurus; identical to SEQ ID NO: 17713

SEQ ID NO: 99127 - DNA, 201 bp, Bos taurus; identical to SEQ ID NO: 17715

SEQ ID NO: 99128 - DNA, 201 bp, Bos taurus
gtaattgttagtaaacgtaagtgggcatattagcagtagaatgatagaaccgaggtaaagaaaaggggctggtgatccagaaagtatataagcatctttataaagaacagagatatagaaacaaaccctcttgtcttgttggaggaccactgagaccaacagaatgccagtaagactcttggattccactcataaagagca

SEQ ID NO: 99129 - DNA, 201 bp, Bos taurus
tgaatgggttaataaacacgtgaaaagtattacatttcaggtagtgcaaaaattgaccaccaggagattccatttcagaaaatatataaatccaaattgtaaagtttcaatcatactgaaggttgagaatatagcaaaacagggacactctcgtgtgtcctggacagtttccagtgtggtacatctccagtgtggtacaaa

SEQ ID NO: 99130 - DNA, 201 bp, Bos taurus
gatctagactactttattaccaaagctttaacttcttgaaaaaattaggttgcatatatgtcccaatttagaaatgtccagccatccaaatcattagaaaggtgtcttatttattttgttattcaatgctctattctcattttaataatacacaaatatatagaagatactataataaactgaaacagtctgtggcccccc

SEQ ID NO: 99131 - DNA, 201 bp, Bos taurus; identical to SEQ ID NO: 17722

SEQ ID NO: 99132 - DNA, 201 bp, Bos taurus
aaaagtaagtaaactgttattaagaaagaaagaaaatgcaattaaataactcagatttttactctccctcagggaagattaaatgcatttaattataataactgtggtatcaatttatgctttccaaaaatgggtgggagaaattaaataatatcattatcataatgatatttttgccaaagccatagagaatagcaagca

SEQ ID NO: 99133 - DNA, 201 bp, Bos taurus; identical to SEQ ID NO: 17723

SEQ ID NO: 99134 - DNA, 201 bp, Bos taurus; identical to SEQ ID NO: 17724

SEQ ID NO: 99135 - DNA, 201 bp, Bos taurus
cactgtgcctccatctctcactccacatctagtcttctggaaaatctgttgtcttttaagataaatgcatcatatggccacatttcactatgtccactatgtcccaatccaactatgcagtgatcttttcgtctgcatgtgtgagtgtgaagtcccttcagttgtgtccgactctttgagactctatggacagtagctggc

SEQ ID NO: 99136 - DNA, 201 bp, Bos taurus; identical to SEQ ID NO: 17725

SEQ ID NO: 99137 - DNA, 201 bp, Bos taurus; identical to SEQ ID NO: 17727

SEQ ID NO: 99138 - DNA, 201 bp, Bos taurus
actggctaagtcacaagggcaagcattcctttctgcttttcttgaagaatactttcctagagatcatagaggaactatacaccatctattctgaagaaagggaaggagaagaatttatctgtaggtttctgtaccctattattcaaagtttacctgataaggcttcaagtctcccaagattctgaattgtaccagtttccc

SEQ ID NO: 99139 - DNA, 201 bp, Bos taurus; identical to SEQ ID NO: 17728

SEQ ID NO: 99140 - DNA, 201 bp, Bos taurus
attgcctgtgaggtgaaatacatctttgaaggctccataaaggcaggaatggaaatattataaagaacttcaccagggaattaaaaaggcattccacattcatttttaggtttaagagtaaatgcctaagactctattcagatagtaagtttcaacaaaacattacatgcagtggctttatatataatctgacaaggcata

SEQ ID NO: 99141 - DNA, 201 bp, Bos taurus; identical to SEQ ID NO: 17731

SEQ ID NO: 99142 - DNA, 201 bp, Bos taurus; identical to SEQ ID NO: 17732

SEQ ID NO: 99143 - DNA, 201 bp, Bos taurus; identical to SEQ ID NO: 17733

SEQ ID NO: 99144 - DNA, 201 bp, Bos taurus; identical to SEQ ID NO: 17734

SEQ ID NO: 99145 - DNA, 201 bp, Bos taurus; identical to SEQ ID NO: 17735

SEQ ID NO: 99146 - DNA, 201 bp, Bos taurus; identical to SEQ ID NO: 17736

SEQ ID NO: 99147 - DNA, 201 bp, Bos taurus
tcctgagagtgtacatgcaaaggggcaactggctcagttgggtcctctggggcctcaagcttgcacatgcttgaagtgtccagctcagtcatttgcctctagttgtaaagttctcaaacatggtggcttttgtcccagtcccagcctctgccagggattaaggaaaatctcgatgctctgagtcaaccagacgtgcttttt

SEQ ID NO: 99148 - DNA, 201 bp, Bos taurus
gatccgaggcctatttttagaagggccctcagtcttcctaagttaccttgttccccaccctctgctctgagaaggcagaaccctgcttgtttgccatcgtgtcttggccagacagtctcctctgcttgaatgcccctagtgggcaactgccctggcaggacaaggcatcactgaggtcttcaagcaaatgatctaacaatt

SEQ ID NO: 99149 - DNA, 201 bp, Bos taurus
tctcctgtgtgtcaggaccaagacttcaagctgatggctggtgaagtgcctgccctgagcctctttgggttgtgatctgggcctgtgggcacttggtaccgaaacccctccagcagctccatgatcccagggctacaaggcagagatgtgctcttgcctggctagagggcaccccttggattggtttaacagattgggaca

SEQ ID NO: 99150 - DNA, 201 bp, Bos taurus; identical to SEQ ID NO: 17737

SEQ ID NO: 99151 - DNA, 201 bp, Bos taurus; identical to SEQ ID NO: 17738

SEQ ID NO: 99152 - DNA, 201 bp, Bos taurus
ttcctttcgtcccgtgttccacatttcaaggtgaagccctgccttcccaaggccaatcccgtaatgtaagtggatagtgaggagggtttctacaaacaccgtcaacctccacggctgaagggggccaatgtaactgaccctttccgatcacaatagcatgcatctccctcacatccttcttctgtccatcccacctccaca

SEQ ID NO: 99153 - DNA, 201 bp, Bos taurus; identical to SEQ ID NO: 17739

SEQ ID NO: 99154 - DNA, 201 bp, Bos taurus; identical to SEQ ID NO: 17740

SEQ ID NO: 99155 - DNA, 201 bp, Bos taurus; identical to SEQ ID NO: 17741

SEQ ID NO: 99156 - DNA, 201 bp, Bos taurus; identical to SEQ ID NO: 17744

SEQ ID NO: 99157 - DNA, 201 bp, Bos taurus; identical to SEQ ID NO: 17745

SEQ ID NO: 99158 - DNA, 201 bp, Bos taurus; identical to SEQ ID NO: 17746

SEQ ID NO: 99159 - DNA, 201 bp, Bos taurus; identical to SEQ ID NO: 17748

SEQ ID NO: 99160 - DNA, 201 bp, Bos taurus
ttccccttgttccacctttccttttcctcacgcataagctggttctgtgtttgctcagcagccttcacctacagaggtccatctggagctctgacatatcgtttctttcctgaaagagtaccacagaataagggggaagagttttgcatatattttcagaaacatactcatcaactgttccagaaagtgcagaagagagag

SEQ ID NO: 99161 - DNA, 201 bp, Bos taurus
agccactaagatcaaatggcttcttaagcagtgatagataaatgacaaagatgcttgtttcttggttatgagataataataaaacctaatgtttattggtgccggcaacagatgacaaacttacagtactttctcatttaacccttaaaatgagcccttgaagtaggtattacttatgaatcccattttgttgatgaacaa

SEQ ID NO: 99162 - DNA, 201 bp, Bos taurus
accaaagatatgcttaaaaattctttgtccaaatgcttacaagtactatgtaagccctaacagaaaatctttaaggaagagtgaattcttccaaggggccagatggaggacatatttccactaatacacacttagaagcagactttcaaacttgaggggtgggagctcccacctctgtccatctccaggtcacatggcctg

SEQ ID NO: 99163 - DNA, 201 bp, Bos taurus
aatatttcacttacagttagattggcggcctttatttcaataggaaaagaaaagtttaggatgttattatgcaacataaaagattgagaatacgcagagatggccacaaagaaagaaattagatctcaaactcagcattaaaaaagaggcaaaatggttaattatttgcttgcaatacgtgcatgctatttttcaaaacat

SEQ ID NO: 99164 - DNA, 201 bp, Bos taurus; identical to SEQ ID NO: 17749

SEQ ID NO: 99165 - DNA, 201 bp, Bos taurus
gtcacagcttaggaatccttagtacataaggattctcatgtactatgggttcgttcagtgtaaacaagcatatggatcctctaggtcagcctacgtctccaggccttgtacttaggacagtgaggtggtctcaagcactgccttcccttggagcaatggctctcagaccttcatggatgtcagatcacctggaggacctgt

SEQ ID NO: 99166 - DNA, 201 bp, Bos taurus
agcaccctgcactctatactttgggggagaccctgaggtgagatgtcctaccctttctcaccaacaggtcggtggctgggagccaggcccacccctttccctgctctccctttttgctctggcaagcctgtactgtggagaagatgactttctccccattatgctcctttccagggttcctatgaccatgggcctgtatta

SEQ ID NO: 99167 - DNA, 201 bp, Bos taurus; identical to SEQ ID NO: 17751

SEQ ID NO: 99168 - DNA, 201 bp, Bos taurus; identical to SEQ ID NO: 17752

SEQ ID NO: 99169 - DNA, 201 bp, Bos taurus; identical to SEQ ID NO: 17755

SEQ ID NO: 99170 - DNA, 201 bp, Bos taurus; identical to SEQ ID NO: 17758

SEQ ID NO: 99171 - DNA, 201 bp, Bos taurus; identical to SEQ ID NO: 17759

SEQ ID NO: 99172 - DNA, 201 bp, Bos taurus; identical to SEQ ID NO: 17760

SEQ ID NO: 99173 - DNA, 201 bp, Bos taurus
gatgacccatagaatcatgatcttacaaaatggtggctcttttatgccactaagtttttggaaggtttgttgtgcagcagtacatctttagaacagttttcaatatctgtggatattttcttagttctacttatactgcattagctaatatgatctcacattacttttctatcacctaaacactgagggttcagacctcta

SEQ ID NO: 99174 - DNA, 201 bp, Bos taurus; identical to SEQ ID NO: 17764

SEQ ID NO: 99175 - DNA, 201 bp, Bos taurus; identical to SEQ ID NO: 17766

SEQ ID NO: 99176 - DNA, 201 bp, Bos taurus; identical to SEQ ID NO: 17767

SEQ ID NO: 99177 - DNA, 201 bp, Bos taurus
tcccttcagcagaatataggtgttctaagagtcaaatttatcttttcatgttaccaggggtatatataaattgtatgacatttgaattgtatgtgcaaatactcagttcactgtttgcagtagtgaatatctattttgaatcataagaagtaagactgaatatagaaagcattgttctgatgtcctatagctttctgataa

SEQ ID NO: 99178 - DNA, 201 bp, Bos taurus
tcctcatcacctcatgaaacccatgtgtctctaaacccacatatgtcatagtccagctgattagaatacttggcccataagctctatctaccttgcaccagagttaacagagttaaccgttaggatttccatctgtaatacttctgaactcagtttttgtatatagacttcatcaacacttgattttatctcatctgtctt

SEQ ID NO: 99179 - DNA, 201 bp, Bos taurus
cttccccatgtgattttcaggcaaattgtatgaaccaagtttgcaaatcctaatgataaggtcagaagaaggaaggtgtacaggtataagaaactggaagaaaaaatggaaatgtgggacagtcaggaatgtgaagggcaatgtcagaaatctgtgaagggtagctgaagcagttacataacacatctcctcctagctgtg

SEQ ID NO: 99180 - DNA, 201 bp, Bos taurus
attttaagtgaataaataatatgtccctcaaccttaatcctgagacctaaacctcgacatcattgaactgtaatcttgttgaatttaatctcatggcctgcatccttcctttcttctgaatcccttgtccaatcatttttcaaccttttaaagccatgaaagaaattggtactgagtgcatcccaaggcagacttgggatg

SEQ ID NO: 99181 - DNA, 201 bp, Bos taurus
cccaactgctgaagcgaccctggtggagcagccccacccgcggcctgtctggggagagcctgggctctgtagctccagctggtgcctcttcattctttgaaataaaaataaagatttcctttgttttggaggcaacttacccttgtcctattggcttgaacaacactgggcaggaggactcctgttggagcccaacttggg

SEQ ID NO: 99182 - DNA, 201 bp, Bos taurus; identical to SEQ ID NO: 17770

SEQ ID NO: 99183 - DNA, 201 bp, Bos taurus; identical to SEQ ID NO: 17771

SEQ ID NO: 99184 - DNA, 201 bp, Bos taurus
aatatacactcatccctatgttcatagcagcactgttcacaagaaacaagacatggaagcaacctaacgtccaatgacagaggaatggataaagaagatacggtacgtatatacaaagaactatcactcacccataaaaaagaatgaaataatgccatctgcagcaacatggatgaacctagagattatcatactaagtga

SEQ ID NO: 99185 - DNA, 201 bp, Bos taurus; identical to SEQ ID NO: 17775

SEQ ID NO: 99186 - DNA, 201 bp, Bos taurus; identical to SEQ ID NO: 17776

SEQ ID NO: 99187 - DNA, 201 bp, Bos taurus
tcttctcaagatagaatctgacttgctttcttagtctgatttttccatgcaagcatatctgaaaaatactcagggtttggcccagttgttcatatctttataaaacccaagtgtatctgagctctcaacagggctctggttgcagggtgctccggtggggactttctctgaaatttctccacctgatactgcatggcccag

SEQ ID NO: 99188 - DNA, 201 bp, Bos taurus; identical to SEQ ID NO: 17777

SEQ ID NO: 99189 - DNA, 201 bp, Bos taurus; identical to SEQ ID NO: 17778

SEQ ID NO: 99190 - DNA, 201 bp, Bos taurus; identical to SEQ ID NO: 17780

SEQ ID NO: 99191 - DNA, 201 bp, Bos taurus; identical to SEQ ID NO: 17781

SEQ ID NO: 99192 - DNA, 201 bp, Bos taurus; identical to SEQ ID NO: 17782

SEQ ID NO: 99193 - DNA, 201 bp, Bos taurus; identical to SEQ ID NO: 17783

SEQ ID NO: 99194 - DNA, 201 bp, Bos taurus; identical to SEQ ID NO: 17784

SEQ ID NO: 99195 - DNA, 201 bp, Bos taurus; identical to SEQ ID NO: 17785

SEQ ID NO: 99196 - DNA, 201 bp, Bos taurus; identical to SEQ ID NO: 17790

SEQ ID NO: 99197 - DNA, 201 bp, Bos taurus; identical to SEQ ID NO: 17793

SEQ ID NO: 99198 - DNA, 201 bp, Bos taurus; identical to SEQ ID NO: 17794

SEQ ID NO: 99199 - DNA, 201 bp, Bos taurus; identical to SEQ ID NO: 58446

SEQ ID NO: 99200 - DNA, 201 bp, Bos taurus; identical to SEQ ID NO: 17797

SEQ ID NO: 99201 - DNA, 201 bp, Bos taurus; identical to SEQ ID NO: 17798

SEQ ID NO: 99202 - DNA, 201 bp, Bos taurus; identical to SEQ ID NO: 17799

SEQ ID NO: 99203 - DNA, 201 bp, Bos taurus; identical to SEQ ID NO: 17800

SEQ ID NO: 99204 - DNA, 201 bp, Bos taurus; identical to SEQ ID NO: 17801

SEQ ID NO: 99205 - DNA, 201 bp, Bos taurus; identical to SEQ ID NO: 17808

SEQ ID NO: 99206 - DNA, 201 bp, Bos taurus; identical to SEQ ID NO: 17810

SEQ ID NO: 99207 - DNA, 201 bp, Bos taurus; identical to SEQ ID NO: 17811

SEQ ID NO: 99208 - DNA, 201 bp, Bos taurus; identical to SEQ ID NO: 17812

SEQ ID NO: 99209 - DNA, 201 bp, Bos taurus; identical to SEQ ID NO: 17814

SEQ ID NO: 99210 - DNA, 201 bp, Bos taurus; identical to SEQ ID NO: 17817

SEQ ID NO: 99211 - DNA, 201 bp, Bos taurus; identical to SEQ ID NO: 17818

SEQ ID NO: 99212 - DNA, 201 bp, Bos taurus; identical to SEQ ID NO: 17820

SEQ ID NO: 99213 - DNA, 201 bp, Bos taurus; identical to SEQ ID NO: 17821

SEQ ID NO: 99214 - DNA, 201 bp, Bos taurus; identical to SEQ ID NO: 17822

SEQ ID NO: 99215 - DNA, 201 bp, Bos taurus; identical to SEQ ID NO: 17823

SEQ ID NO: 99216 - DNA, 201 bp, Bos taurus; identical to SEQ ID NO: 17828

SEQ ID NO: 99217 - DNA, 201 bp, Bos taurus; identical to SEQ ID NO: 17831

SEQ ID NO: 99218 - DNA, 201 bp, Bos taurus; identical to SEQ ID NO: 17834

SEQ ID NO: 99219 - DNA, 201 bp, Bos taurus; identical to SEQ ID NO: 17838

SEQ ID NO: 99220 - DNA, 201 bp, Bos taurus; identical to SEQ ID NO: 17842

SEQ ID NO: 99221 - DNA, 201 bp, Bos taurus; identical to SEQ ID NO: 17844

SEQ ID NO: 99222 - DNA, 201 bp, Bos taurus; identical to SEQ ID NO: 17845

SEQ ID NO: 99223 - DNA, 201 bp, Bos taurus
aagcaatttatcttgctcggctccaagtaaatggctgtgtctcttggggttcagtcaagggtaattaaagtaagcacttgcaattaaattattttgtagcagaattaagcaatgttcatttaaaattcagttctcccaaaagaaggcagaaccagaggattcttcaatatatttacaacctaaataaatatgataaatatg

SEQ ID NO: 99224 - DNA, 201 bp, Bos taurus
acatgctacaacacagatgaaccttgaagacatcatgctacatgaaataagccagtcacagaaaaacaaatattatatgattctacttatatacgttacccagtgtaaccaaactcatacaaacagaaagtagaatggcggtagtcccagaggacaggggttggggaaaggtggactgttgaggagttagtttttaacagt

SEQ ID NO: 99225 - DNA, 201 bp, Bos taurus
ccaattgttaaagcaggacttgtggcctctttctctgtacttctttattacgctcctctgaagaaggaaaaacgatttctcttattcatgagaaggtaagtgtcttgggtcccctgaacctcctagctccactgcaatgattctcaaactttaattgcaagagaataaggagggctaagtaaaacacagactcttgggccc

SEQ ID NO: 99226 - DNA, 201 bp, Bos taurus
actaggaatctttcacaggttatgttcccttgagacctaaccttttctactgatccagcttcaggagcaatgaaagtagggcgaaggctgtatctatagcggaatgggccactggaatgactagcaatgatcactttggaatatgatttgcaggttacaaagtgcttccacctagagtgtcacaaacaagagagtattttc

SEQ ID NO: 99227 - DNA, 201 bp, Bos taurus
gctatctggcatgcccccctcccccaaaaaagaggaattgaatgaagaatttaaaaagagaaatggacaaaaaagcaaggtatgaaacaagaggtgactgaactgaagaaagaaattgaagaaatgaaggttaaattataaggagcatacaggaggaatatatatgactaaaactttaggaaggagcattgaagaaaggca

SEQ ID NO: 99228 - DNA, 201 bp, Bos taurus
atatgaaaactgtataaacattctgtaatttctaaagatgctaccatactaaaagtgcaccagaatgcagaatcctgtagtttgggggaaaagcagtacgtaacatttcatgaggttttaaaacctaaacaattttaataataaatttgggggtatgttttattacagaagatttaaaataattcatagtaattacaaagc

SEQ ID NO: 99229 - DNA, 201 bp, Bos taurus; identical to SEQ ID NO: 17846

SEQ ID NO: 99230 - DNA, 201 bp, Bos taurus; identical to SEQ ID NO: 17849

SEQ ID NO: 99231 - DNA, 201 bp, Bos taurus; identical to SEQ ID NO: 17850

SEQ ID NO: 99232 - DNA, 201 bp, Bos taurus; identical to SEQ ID NO: 17851

SEQ ID NO: 99233 - DNA, 201 bp, Bos taurus; identical to SEQ ID NO: 17855

SEQ ID NO: 99234 - DNA, 201 bp, Bos taurus; identical to SEQ ID NO: 17856

SEQ ID NO: 99235 - DNA, 201 bp, Bos taurus; identical to SEQ ID NO: 17860

SEQ ID NO: 99236 - DNA, 201 bp, Bos taurus; identical to SEQ ID NO: 17861

SEQ ID NO: 99237 - DNA, 201 bp, Bos taurus
tgcacccagccagccagctcagaagactgaggctaggtgaacaggaagtgtctaaagtggctggaggaggtaggagtggccagatctcggttcttgggaaggaacagcagaggacctactggaaggggaggagaggggcagacctctgcctggagcatgaggggaccactctgggcatgcaaagagccagcagtgacttgg

SEQ ID NO: 99238 - DNA, 201 bp, Bos taurus
agtgagggaatgggagctaagggataggaagaaccactgggaagggagaaactcactcatgaccctcaacatcaagctagcccaggctgggccctgccccttgggaggagcactgtgttaggagtcagatgagctgagttggaatgccagtaccaccactcacagggccaccatacctctctggacctcacttctgtagtc

SEQ ID NO: 99239 - DNA, 201 bp, Bos taurus
agaggtgcacaggtgtgagttctcatttcttggcttcaccagccaggccacaaatgctgctgcacagccgagagactccagctgtctgaagcctgggacctgtgacctgttgtacatgaggggtgagcactgggtatttgctggacagtgttctgtatgggtccaggggttctgtgggagcccaaccagacaaaaatgagg

SEQ ID NO: 99240 - DNA, 201 bp, Bos taurus; identical to SEQ ID NO: 17864

SEQ ID NO: 99241 - DNA, 201 bp, Bos taurus
tgtaattttggggttttgatggccccaccctagccctttcaatcctgagagcacagaggctctgttccaccacagagtgagcacatgtttcttgggtgcttgggccaggctatgcatgctagccttagccctgcccactgctccagatggtactctgggtacattatgaagagcacagaaagcagagcccatggtgcacaa

SEQ ID NO: 99242 - DNA, 201 bp, Bos taurus; identical to SEQ ID NO: 17865

SEQ ID NO: 99243 - DNA, 201 bp, Bos taurus
cgaggctggcacgctggggaaaaggcctgtgctggaagaggtgggagaaagaggagacggggaggtcaacggatgggccctcggattctaaactaagatggcagaacttggtggtactggggagctattgaagattctgagggaagagatatagtcagaggagagtgagtgaaggaagcgctggtgaagaggtggaggagg

SEQ ID NO: 99244 - DNA, 201 bp, Bos taurus; identical to SEQ ID NO: 17866

SEQ ID NO: 99245 - DNA, 201 bp, Bos taurus; identical to SEQ ID NO: 17868

SEQ ID NO: 99246 - DNA, 201 bp, Bos taurus; identical to SEQ ID NO: 17870

SEQ ID NO: 99247 - DNA, 201 bp, Bos taurus; identical to SEQ ID NO: 17871

SEQ ID NO: 99248 - DNA, 201 bp, Bos taurus; identical to SEQ ID NO: 17872

SEQ ID NO: 99249 - DNA, 201 bp, Bos taurus; identical to SEQ ID NO: 17873

SEQ ID NO: 99250 - DNA, 201 bp, Bos taurus; identical to SEQ ID NO: 17874

SEQ ID NO: 99251 - DNA, 201 bp, Bos taurus; identical to SEQ ID NO: 17879

SEQ ID NO: 99252 - DNA, 201 bp, Bos taurus; identical to SEQ ID NO: 17880

SEQ ID NO: 99253 - DNA, 201 bp, Bos taurus; identical to SEQ ID NO: 17881

SEQ ID NO: 99254 - DNA, 201 bp, Bos taurus; identical to SEQ ID NO: 17882

SEQ ID NO: 99255 - DNA, 201 bp, Bos taurus; identical to SEQ ID NO: 17885

SEQ ID NO: 99256 - DNA, 201 bp, Bos taurus; identical to SEQ ID NO: 17886

SEQ ID NO: 99257 - DNA, 201 bp, Bos taurus; identical to SEQ ID NO: 17887

SEQ ID NO: 99258 - DNA, 201 bp, Bos taurus; identical to SEQ ID NO: 17888

SEQ ID NO: 99259 - DNA, 201 bp, Bos taurus; identical to SEQ ID NO: 17889

SEQ ID NO: 99260 - DNA, 201 bp, Bos taurus; identical to SEQ ID NO: 17890

SEQ ID NO: 99261 - DNA, 201 bp, Bos taurus; identical to SEQ ID NO: 17891

SEQ ID NO: 99262 - DNA, 201 bp, Bos taurus; identical to SEQ ID NO: 17892

SEQ ID NO: 99263 - DNA, 201 bp, Bos taurus; identical to SEQ ID NO: 17893

SEQ ID NO: 99264 - DNA, 201 bp, Bos taurus; identical to SEQ ID NO: 17894

SEQ ID NO: 99265 - DNA, 201 bp, Bos taurus; identical to SEQ ID NO: 17895

SEQ ID NO: 99266 - DNA, 201 bp, Bos taurus; identical to SEQ ID NO: 17896

SEQ ID NO: 99267 - DNA, 201 bp, Bos taurus; identical to SEQ ID NO: 17897

SEQ ID NO: 99268 - DNA, 201 bp, Bos taurus; identical to SEQ ID NO: 17898

SEQ ID NO: 99269 - DNA, 201 bp, Bos taurus; identical to SEQ ID NO: 17899

SEQ ID NO: 99270 - DNA, 201 bp, Bos taurus; identical to SEQ ID NO: 17900

SEQ ID NO: 99271 - DNA, 201 bp, Bos taurus; identical to SEQ ID NO: 17901

SEQ ID NO: 99272 - DNA, 201 bp, Bos taurus; identical to SEQ ID NO: 17902

SEQ ID NO: 99273 - DNA, 201 bp, Bos taurus; identical to SEQ ID NO: 17903

SEQ ID NO: 99274 - DNA, 201 bp, Bos taurus; identical to SEQ ID NO: 17904

SEQ ID NO: 99275 - DNA, 201 bp, Bos taurus; identical to SEQ ID NO: 17905

SEQ ID NO: 99276 - DNA, 201 bp, Bos taurus
cgtgtatcgatattattatgaaaataactccaacatcacgaacctcctgaaagacttttgagtaccccagacccctgtgggccatattttgagaactgttgttctagagaattccagtcctgttcagtgggaccagcttttaaaagcctgttaagaagggcctgatgtcttcagtttcagctaacctttcatgagctagct

SEQ ID NO: 99277 - DNA, 201 bp, Bos taurus
tgataaaactagcttattccctaagagtaaaaggtgagagagaataagaggaagcaacctgccctggagtcactgccgctgaaggtcactgcctttctaatggcctccccttggtgctttgagaaagacttctgtctttgtgagcgcctgtcactcacgcgccaacctggatccacaccttggaaagaggcaaagccggaa

SEQ ID NO: 99278 - DNA, 201 bp, Bos taurus; identical to SEQ ID NO: 17907

SEQ ID NO: 99279 - DNA, 201 bp, Bos taurus; identical to SEQ ID NO: 17908

SEQ ID NO: 99280 - DNA, 201 bp, Bos taurus
tcaaagattagttaataagcaaagtttggagctataaacatgttattagcatatgcaaatcattaacaatttctatattgtaatacatttgacctgtatcagttcataaacttggctataggagaaaattaagtaatttgggtggaacaaaagctgaatattgaagaaggatagtttgtttgtcttaacatattaaccttg

SEQ ID NO: 99281 - DNA, 201 bp, Bos taurus; identical to SEQ ID NO: 17909

SEQ ID NO: 99282 - DNA, 201 bp, Bos taurus; identical to SEQ ID NO: 17910

SEQ ID NO: 99283 - DNA, 201 bp, Bos taurus; identical to SEQ ID NO: 17911

SEQ ID NO: 99284 - DNA, 201 bp, Bos taurus; identical to SEQ ID NO: 17912

SEQ ID NO: 99285 - DNA, 201 bp, Bos taurus; identical to SEQ ID NO: 17913

SEQ ID NO: 99286 - DNA, 201 bp, Bos taurus; identical to SEQ ID NO: 17914

SEQ ID NO: 99287 - DNA, 201 bp, Bos taurus; identical to SEQ ID NO: 17915

SEQ ID NO: 99288 - DNA, 201 bp, Bos taurus; identical to SEQ ID NO: 17916

SEQ ID NO: 99289 - DNA, 201 bp, Bos taurus; identical to SEQ ID NO: 17917

SEQ ID NO: 99290 - DNA, 201 bp, Bos taurus; identical to SEQ ID NO: 17918

SEQ ID NO: 99291 - DNA, 201 bp, Bos taurus
gcagctgatggagaggcaatgacttgaagatgtgtttatactccccacccaggagacagagccaatgctcacatgcatgcatacacacacacacacacacaccctaagtgggcccatagagagggagggaggaccagagagagaccatgaagaggtgccacgtggaaaggaccacgggaatgacaagaccagaagagggtt

SEQ ID NO: 99292 - DNA, 201 bp, Bos taurus
tccgtgcatataaacaatccatggtgaagggacggaccgcgctgaccctttaccgggtggtgctgtgttccatgcacatcaccttactaattaccacaattacctccaagaggagactcacacccagctggggacctactggcggaggtgagaaacggggcccccagtcctggccaaatgggtcccgggcagcccctccca

SEQ ID NO: 99293 - DNA, 201 bp, Bos taurus
cttgtcatgatcaggcccagaggctttctggaggcagaggagtaatcttcatcagtggttgcatcttgtcttcagttcagatgaaaaacaaggtctaggtaggcctcaccaacttctccacgcaggaagctttgtcctgttcaccccattgctccacggtgaccctgctcgctgcacatcttctccagctcccgtcccagt

SEQ ID NO: 99294 - DNA, 201 bp, Bos taurus
ctccggcagggccacacatggggctgggggtgaccagggggcccagaagaggggaggggagggggcagcgggagaaggaggagggggcatgctcctgatgggttttccctaaagctggccctgggtgagaaaggacgggaagctttggggggatttacagggctgggggcagtgggtatttacagggctcacttaacagcc

SEQ ID NO: 99295 - DNA, 201 bp, Bos taurus
tgccctgcatttaaggctacactttcctgcctcacattccagtgtcagcagcttggctatgcttaatgatggaagagtggacctgatttggttttggtcatagtgatgggatgcaggcttgttactgggagggcaatgtggtgacagcctcccatagtggaaagccagcagacagaaagcaaagccatggacagagcttgg

SEQ ID NO: 99296 - DNA, 201 bp, Bos taurus
gtaaaatctgagacttcagaaataaaaaagagtgaagacactgtacagttggtggacgtcaacttagctgaacgtttcttgggtatgagggaggaacaggaaaacacatggggccttcctgaggtcacgaggctgtaagtctcgagtgagagggcgagtccagccctgtgtccccgtcttgggctgtgaggacccactacc

SEQ ID NO: 99297 - DNA, 201 bp, Bos taurus
ttctaactgaaagaaaggttgggaaagtgagtctttccattgttctttatagggtgaggtcagggaagaaagagggaaataatggatagtagtcacggggcaatgggcctgctgtgtcctgggagaaagcccttctctcaggagctgggggatgtagggagcacaaggagctggggcggaccagctgggcctcaagaaggg

SEQ ID NO: 99298 - DNA, 201 bp, Bos taurus
tcaggagaggcgcaatgtgcaggatacatggccgtttgttaatcactccttgtgcatgtacgactttgacctcccgtgtaggtggtacggctggcagagcccgtgtcactctcaggccctctcagacttgcagcaatgactccaagactcctagaagacaaggctaaataagatcgcagaatcataggatgatttatggtt

SEQ ID NO: 99299 - DNA, 201 bp, Bos taurus
caatccaggaggcctctccaggagaagagaggaggaaatcagctccagcagtttcctcggctcctggcagaagccctcctatttagaagagggaggcaacggacagtttctgtggccaactacagcattcatgctgttgaccacttttctaatactgtttgcaagctttgtataatatcactaggttttctgcaattctca

SEQ ID NO: 99300 - DNA, 201 bp, Bos taurus
gcaagtactgtggaagagataattaaattgaaaataagcacctgaaatcaattatgatacacccatacaatagaatacttgaagtttttaaaaatgatcatgaggaggtatttatgcactgatgtaaaaaaacacaaggtaaattgcagaacaatgtgtataggatagtactaactgtggggaacagatgaattaaaacat

SEQ ID NO: 99301 - DNA, 201 bp, Bos taurus
atgtttctaaatactgttaaaccctgctgcctgggcccttcccatccagacgagagcctcgggtggggacagagtgagtcagctagggttgagtcaagaggttggcagcttgcagcaccccaaggcctggccttctttttctttatttatctttgtctttgctgggtcttcgttactgctcagactttctctagctgcgga

SEQ ID NO: 99302 - DNA, 201 bp, Bos taurus
gaaaagaccagaaacctaccctcgagaaccacagtcagcagtttgttctagcaagtgaattttctgtcctaacttcgtgactatagagagtaatcaggaataactttgacctgcagttaactttaaagttacgacccaggtcaaggagggtgagaaggaagaacagtcaggacctttcagagtcaggtgagaaaaggagag

SEQ ID NO: 99303 - DNA, 201 bp, Bos taurus
gtctgtcccacatgcccaaaatatagcagcaaaaggaggaaggctaaccaggataaatgcttccatttgacaaggggaggaaagggatgcacagagcaattgctggtccgcagcagttctgaaatcaccagggaaatgaccacagggcacacagggacaggaagtgttccctgagtcagcaagttccacttactgggagtg

SEQ ID NO: 99304 - DNA, 201 bp, Bos taurus; identical to SEQ ID NO: 17919

SEQ ID NO: 99305 - DNA, 201 bp, Bos taurus
caataaagctttttgggagaatcttttgggtgggaaaataaaatccaataataaaaaaaggtttacagctcaatgctatttggtgtgggtcaggtcagactgcatcctgggccccgagatgcaggggaaacgataggggttggggaagtcccaggacggactgcaccgctctgcttcctgcacgtggacctcgtgggcctg

SEQ ID NO: 99306 - DNA, 201 bp, Bos taurus
ggaggccagacagagtggatgctgtgcctgtcatttctgaatctcgctggtgccccaggaggcacagcagtgggcacctctggaggagagggtcctggcaaggcagaggggccacaggacactgactggttctggttccgacccaggtatatgacccaggtgcagctcatggacacgcatcagaaggtgtgcctgtgacag

SEQ ID NO: 99307 - DNA, 201 bp, Bos taurus
aggcccactgactgctctctggactggccttcggcccatggtcacacccaccacagccctggggggacgccttctggtggggacgggcctcagtgtgtccaactctgcacctctggtgaactctgtgcccatttcaagccatcgctgcacaaatgagtcagggaggccctgctgtggcttcgggcagccctgcctggacgt

SEQ ID NO: 99308 - DNA, 201 bp, Bos taurus
ctttatttgttaataggcagaccccttacctaggtcaggacaaaatccatgaccaacaaggatggagagccgcatgctggctgacactcagggcctggagtgaaccaggagccagcccacgctgctgacagtaaattcaggggcagaaggagaccccagacttggctctaggccacagaaatttcatatgaaagccagcgt

SEQ ID NO: 99309 - DNA, 201 bp, Bos taurus
attgaaattgtgacagattgttctccagcttctccacaccaccttcacccacgcctgtctcaggattaaatcctgatccaagacctgcctctcaggacaactgaccatgggctctgggggacgtggtttagcactcaaagttcagtccttggatctggtcactctaatgcactagggagccccagtatcacgggaacagtc

SEQ ID NO: 99310 - DNA, 201 bp, Bos taurus
gcagcctggtggccacagtaccagagggtggggtgggggccacacccacatggacagaggtcccctgacctgaagcaagctgcagctcccagactgccaaatgatcagacggccttgccgcgtgagcccagcagggggtgttgtgcccacactgactcccaggaacccgcctgtgggcctcattcagcgccaggactcccc

SEQ ID NO: 99311 - DNA, 201 bp, Bos taurus
gcttggcctctaaacatgtcccccttttaacaactgccttctagcttcactgactccaagctccagttcagggactccccagtcctgcagcgacattgcactcagcacaagggctcccggccagctgggagctgaggaggtgggcagggtgccagggaacatagctggcaggagtgcctgccccgcccacccagtgccatg

SEQ ID NO: 99312 - DNA, 201 bp, Bos taurus
cctgtctgtggccggccttgaccgtcatgccaggtctccagacccagaaggtcgtgtggcttaaatgcctcttgcccgaacctgccagactttcccattgcgttggccaaaccctcccagagcgccagcggccgcgtgcaaggtttcaactccatttcacagctggacctccccctaagtggctgttttataagagtctgg

SEQ ID NO: 99313 - DNA, 201 bp, Bos taurus
cctccacatcctcacagctcagggccactgcacagccttcccgcaccacccctcatcacagagctctgatggctcttcctccgcctcactcaggtctccattgcccacagagaagaaccacttggccccgggagccctctcaccacccagtctttactagaagatttccaccactctgctggtcatcaggtctcccgaact

SEQ ID NO: 99314 - DNA, 201 bp, Bos taurus
atagagactgatctgaattacaaaaaaaaagggaagttaactattttgcacacttgaatgaaatacgtttctactaaaaacattaaaaattatgatgaacagatgggggcaaaattttaggttcaattggaggtaagggagaagaggagaaagagtaaagaaattttttattccaaagaaaatgaaaaacattacatatac

SEQ ID NO: 99315 - DNA, 201 bp, Bos taurus
tgaacaacagtgactatggataagaaaaattcactaatttcacagtttaaaccaatctctgacagccagcttttgcttaggacacagtaaactgaaaagaccgacacctccattctttaaaaagaggcaggtagataattgaaaaatcacaacttatcctgaacacatcagagttgaggttgcagaatcaaccgactgaca

SEQ ID NO: 99316 - DNA, 201 bp, Bos taurus
gctgccagacctggggctgggctcggcctttctgctccccggcgctgccccctcccggcacacgcctccacgcttgcttttgttctaacttagcacagtcgtgtagaacaaaacacagctggccgtctctgctcgctaacaaagaggaactggaatgtaaggagaggtggaaacttttccatctccagtctcactgggatg

SEQ ID NO: 99317 - DNA, 201 bp, Bos taurus
cctcaaggtcactgagggtcaacgggcccctccccagaggccactgcttcttcaggactcaccctccacagtttcctctgggttcctgcagatgtacctcgctgtccctggtgttatcacccagagtgccctgcgtcctgtattgggttccttacacactccccacatccctgtaaataatctcttcttagaattatctac

SEQ ID NO: 99318 - DNA, 201 bp, Bos taurus; identical to SEQ ID NO: 17920

SEQ ID NO: 99319 - DNA, 201 bp, Bos taurus
ttttaagagcacagctcagccgtgtgaaacatgttcacccagctgtggaccacctccagagccttttcatctcctgaactgaagctctgcccccgaaacatggactccctggcccctccccagccccggcccccaggcccaccatctaccttcggtctctatggatctgactcccccagggacctcgggtaagggaattgt

SEQ ID NO: 99320 - DNA, 201 bp, Bos taurus
ctgcactccattttacagagaagccccgcttcagctgacatattgtgtgtagtcaccagccatataacacataggacacagccctctggctgaagtgggggaggccccgggcccctaaattcctgccccaggttggagaggcccagtgtgccctgtggaggtggcctggaagaccctggggcccggtggtgctccggaggg

SEQ ID NO: 99321 - DNA, 201 bp, Bos taurus
ctgcttgtggaaagtcttcagcgcctgcatcactgctgaggtgcactccacgtacgtgtagtcaatcatgatgtcccctggaaaacggaaggaaagactcgggcaatccaggccaaaccatgagacaggagagtgccgtaacacacggtgcctgactgtcctccagaggaaaggaggagatgtcaccggcgaccagcctgg

SEQ ID NO: 99322 - DNA, 201 bp, Bos taurus
gtttgaggtcagaagtggtcagacattgggaattcacatgaatcagtgatagttccttcccttgaggaaatcgcagggccactgtattagagaccattcaaaacacacggtgagggtgtgagacgctgatggggagggcagggtggcaggcggaggacagaggggcctctgcaagcttcccatgcaggtcagacttctgac

SEQ ID NO: 99323 - DNA, 201 bp, Bos taurus
gtcctgggcctggatgtggtgggtgtagcgcctggccccagagcgtgtcatccacctgagaacgcctcttactccctgggttgtctcccctgagcttcctgtctgctgtcgtcttcattcttattgaccacatgttggacctcctggacttaaaactttctctttttccacatctttgttttcttgttctcatattcaaga

SEQ ID NO: 99324 - DNA, 201 bp, Bos taurus
ccaccaccatgagactaatgggttgattgaggtgaaggggtacagcgtctgggcctggcgccaggcatcttccacactgggtgcctgacggccttccgctcagctctcgtgtccactctgtctcatgcagggtccatatcctcctgtgatgcgttcctcaacgtcttccaggccagagggctgaggccagaggtcatctgc

SEQ ID NO: 99325 - DNA, 201 bp, Bos taurus; identical to SEQ ID NO: 17922

SEQ ID NO: 99326 - DNA, 201 bp, Bos taurus
cttcctgtgcctggggggctgctctccaaggacaggaaggggcttagctgcagggcctggggaccggcatctttcaggtggccgcccaggtgctgggcacttggtgttccttctctcacttgctcgcagtgttcctgggtctgcagccccatttgcacccactgatgctgcctggtgcccgggcctaggtctgccctgtaa

SEQ ID NO: 99327 - DNA, 201 bp, Bos taurus
ttctaaagtcttcgggaacgtggcaaagacgcactagcaagctcattgaaagtcctcaggaagagggctttccttttgtcacatggacttggccacagtacgccaacacaacagcttctggacatcagagcaacacggactgatacaaactcagtccatggtctgtatagaatggagctgtgtacctcatggggccgtgtt

SEQ ID NO: 99328 - DNA, 201 bp, Bos taurus
actcagacaattgattctcaatgatatcagagtattgactcactcaatctgaccacaacgtaaaaacattagtctcagaacggtgccggtgcccatactctcgggactggtggtttcctcctgttagtgttgtgatagtcgtgccattatgggaatgtttcaatatgcaggaaggcctgcattttcctggcacacagatat

SEQ ID NO: 99329 - DNA, 201 bp, Bos taurus
tatctgcattgttcatttttgagatatttctttataaattaatctgtaacctcctgcagatgcaggccaatctgggataagaaggccaggctaaataaatgaaacagctcaattccagatcagttttccagtgtctcgcattaacttctaggagagctctgcagggaaggcctgctcttgaggctaaggtcagcaggaggg

SEQ ID NO: 99330 - DNA, 201 bp, Bos taurus
tccaagggcacatccagccctggcctcactgccaacaacctccagagacacagccgcgggggttccctcccgcctctgctattcctgaaggcacagaggacccatgtggtcaccgaaccaggggccaccgtcctggatagtaccagagagtgctctgagactacttagccagcttaggtgaaaatgtactctgtaccctct

SEQ ID NO: 99331 - DNA, 201 bp, Bos taurus; identical to SEQ ID NO: 17923

SEQ ID NO: 99332 - DNA, 201 bp, Bos taurus
aggctacagctctgcaaagagagggtatgagaacacatctggccaggatcatctggtgactgatgagcagacacagatggcagtctgaaatgagtttgagtggtgacatcccagctgtctccaggccctgctaatcatcttgaaagtgactggtgagccctacaggactctaacgtgtgggtatcacatgtctcctgagct

SEQ ID NO: 99333 - DNA, 201 bp, Bos taurus
gaagaaaacaagatattttccccgctcgcttggagctgcagttggggagggcacacacgctataaattacaggcgacaagaaatgaccacagtgcggggcgctgctcatggccaggctcggggaacagggtaccagctgcgaggagaatacggactttaatagagagtagggcaattcttctagcgtcgcgctctaaggca

SEQ ID NO: 99334 - DNA, 201 bp, Bos taurus
gcagggttttcttcctctcctagccccgtggcccactgccccacaccctatccctgttgattgatcgagccttccttccagcgctcagctctgtctcattcccaggcacacaggccctgtaagcacagcggactgaggatccccaggacccagctgcacaaaagacccgggcctgtgagaaggctcagagcaacatctgcc

SEQ ID NO: 99335 - DNA, 201 bp, Bos taurus; identical to SEQ ID NO: 17924

SEQ ID NO: 99336 - DNA, 201 bp, Bos taurus; identical to SEQ ID NO: 17925

SEQ ID NO: 99337 - DNA, 201 bp, Bos taurus; identical to SEQ ID NO: 17926

SEQ ID NO: 99338 - DNA, 201 bp, Bos taurus; identical to SEQ ID NO: 17927

SEQ ID NO: 99339 - DNA, 201 bp, Bos taurus
gaagtattcaccttagggattagctggtccctttttggtttctgtgagccttattctgaccctaatcaacacaccctgggctacctttacgatctaaacacgttgactcatttctacttgccaacttttgggtgggctgctcttctgaccacacagaagcctttgacactaattcttgtatctttagcttgtgtcttacct

SEQ ID NO: 99340 - DNA, 201 bp, Bos taurus; identical to SEQ ID NO: 17930

SEQ ID NO: 99341 - DNA, 201 bp, Bos taurus; identical to SEQ ID NO: 17931

SEQ ID NO: 99342 - DNA, 201 bp, Bos taurus
tggacttgttggatctcctttctgtccaagggactctcaagagtcttctccaacaccacaattcgaaagcatccattcttcagcacacagccttctttacgattaagtaatagtgccaggcttcaaacctagaccatctggccccaacccacttctaaaaaatgggccaaaaaatatataaacgttaaaggggaaaggaac

SEQ ID NO: 99343 - DNA, 201 bp, Bos taurus
aaggcccaggtggtatggcctgcaggaggctctagaacccaggatgagctagaacgagacctcggtggagaagtagacctggagagatttggggacttgccgtcttgcagtgggactggcaaggcagctagtggcaaagaagctgatggctctgcctctgtctaaaaatgccccaagcttcctgttctccaggaaaaactc

SEQ ID NO: 99344 - DNA, 201 bp, Bos taurus; identical to SEQ ID NO: 17932

SEQ ID NO: 99345 - DNA, 201 bp, Bos taurus
gcatatctccccaccccctaggagaaccggactagaatcttccttggcttccacacagatttcttgtctcctcaagggcttacccaaggtggcccaggaaagtaggaaaggctgacacatgacccaggacacctccacaggaggggctgccggtgggagggtcttgtatagggccaccccagtgagcctgcagagagtggc

SEQ ID NO: 99346 - DNA, 201 bp, Bos taurus
agtgtgtctttgagggtatggtcacatattaagcatgggagtcagaggggaagggcagaggcaggaatacacaagaatgggaggaggaggaaagcgtaagcccagagcaggtagagttagcttcaggtgagacagcaacgctaaggagcaggcgttctcacagtggccaagagtgggaaatagtcttagacgtctcatcag

SEQ ID NO: 99347 - DNA, 201 bp, Bos taurus
gaatgctctcaggtaaaaaatgctcattttttaaactgagttttctatttctactaagcttgtttgttcattcagtctttaaggttttcttcttcctttcttcttaccattttaacattaatcttcatttttaaagtctcccaaagatttgcaccaatgaaataattcattgaattcacatgagtctgcctaagtcaggtt

SEQ ID NO: 99348 - DNA, 201 bp, Bos taurus; identical to SEQ ID NO: 17939

SEQ ID NO: 99349 - DNA, 201 bp, Bos taurus; identical to SEQ ID NO: 17940

SEQ ID NO: 99350 - DNA, 201 bp, Bos taurus; identical to SEQ ID NO: 17941

SEQ ID NO: 99351 - DNA, 201 bp, Bos taurus
cagccagtaaccattacttgccctccacccagatataaatgaaacagttcttttatttgttttatatattgggcttcccaagaacattgtcttaggccaagcttcctggaagcagaacctgagacagttttagatgcgtacaggttattgaggggttccctggaaagaagcctgtgagggagtaaggggagcaggccgtga

SEQ ID NO: 99352 - DNA, 201 bp, Bos taurus; identical to SEQ ID NO: 17942

SEQ ID NO: 99353 - DNA, 201 bp, Bos taurus; identical to SEQ ID NO: 17943

SEQ ID NO: 99354 - DNA, 201 bp, Bos taurus; identical to SEQ ID NO: 17947

SEQ ID NO: 99355 - DNA, 201 bp, Bos taurus; identical to SEQ ID NO: 17948

SEQ ID NO: 99356 - DNA, 201 bp, Bos taurus; identical to SEQ ID NO: 17949

SEQ ID NO: 99357 - DNA, 201 bp, Bos taurus; identical to SEQ ID NO: 17950

SEQ ID NO: 99358 - DNA, 201 bp, Bos taurus; identical to SEQ ID NO: 17951

SEQ ID NO: 99359 - DNA, 201 bp, Bos taurus; identical to SEQ ID NO: 17953

SEQ ID NO: 99360 - DNA, 201 bp, Bos taurus; identical to SEQ ID NO: 17954

SEQ ID NO: 99361 - DNA, 201 bp, Bos taurus; identical to SEQ ID NO: 17955

SEQ ID NO: 99362 - DNA, 201 bp, Bos taurus; identical to SEQ ID NO: 17956

SEQ ID NO: 99363 - DNA, 201 bp, Bos taurus; identical to SEQ ID NO: 17957

SEQ ID NO: 99364 - DNA, 201 bp, Bos taurus; identical to SEQ ID NO: 17958

SEQ ID NO: 99365 - DNA, 201 bp, Bos taurus; identical to SEQ ID NO: 17959

SEQ ID NO: 99366 - DNA, 201 bp, Bos taurus
accttaggggttaagtaggagtttgctagatatacatgtgggtgggtatctttggcagtattcacagcataaccaaaggcaggggggagcttttgtgctccggaagtgctgttgtactcacggaacttagctcccctgctgtgatcatggtattgaaatatgtgtgtgttagggtcagggtgtgttggtgtcagctcacac

SEQ ID NO: 99367 - DNA, 201 bp, Bos taurus; identical to SEQ ID NO: 17960

SEQ ID NO: 99368 - DNA, 201 bp, Bos taurus
ggaaaagagagtgaaagttacaggccaggctttacaaataagagtgaaaggaaaagaaagccaggggcttttatttcagggcgaaaatgagaacagcacgggatatgggccttctggttcagcaaagcctccaagatgccttccagttgaaccttttcctgagcattgtaaggatacttcataaatggctgttcttaagct

SEQ ID NO: 99369 - DNA, 201 bp, Bos taurus; identical to SEQ ID NO: 17961

SEQ ID NO: 99370 - DNA, 201 bp, Bos taurus; identical to SEQ ID NO: 17962

SEQ ID NO: 99371 - DNA, 201 bp, Bos taurus; identical to SEQ ID NO: 17963

SEQ ID NO: 99372 - DNA, 201 bp, Bos taurus; identical to SEQ ID NO: 17965

SEQ ID NO: 99373 - DNA, 201 bp, Bos taurus; identical to SEQ ID NO: 17966

SEQ ID NO: 99374 - DNA, 201 bp, Bos taurus; identical to SEQ ID NO: 17967

SEQ ID NO: 99375 - DNA, 201 bp, Bos taurus; identical to SEQ ID NO: 17968

SEQ ID NO: 99376 - DNA, 201 bp, Bos taurus; identical to SEQ ID NO: 17969

SEQ ID NO: 99377 - DNA, 201 bp, Bos taurus; identical to SEQ ID NO: 17977

SEQ ID NO: 99378 - DNA, 201 bp, Bos taurus; identical to SEQ ID NO: 17981

SEQ ID NO: 99379 - DNA, 201 bp, Bos taurus; identical to SEQ ID NO: 17982

SEQ ID NO: 99380 - DNA, 201 bp, Bos taurus; identical to SEQ ID NO: 17991

SEQ ID NO: 99381 - DNA, 201 bp, Bos taurus; identical to SEQ ID NO: 17992

SEQ ID NO: 99382 - DNA, 201 bp, Bos taurus; identical to SEQ ID NO: 17995

SEQ ID NO: 99383 - DNA, 201 bp, Bos taurus; identical to SEQ ID NO: 17996

SEQ ID NO: 99384 - DNA, 201 bp, Bos taurus; identical to SEQ ID NO: 17997

SEQ ID NO: 99385 - DNA, 201 bp, Bos taurus; identical to SEQ ID NO: 17998

SEQ ID NO: 99386 - DNA, 201 bp, Bos taurus; identical to SEQ ID NO: 17999

SEQ ID NO: 99387 - DNA, 201 bp, Bos taurus
gagcaggaggatcaccaggcaggccatgccaattcctcggaaggttgcagcagcccctgtgaaaacaagtgacactctagagagtagttcctggaaaggcaggtagccctcacccaggcctgtagatgttctaaagctgacaaaggcagcagagcagagaatggcaagtggccgttagcttcataccgaaggaaaaacaag

SEQ ID NO: 99388 - DNA, 201 bp, Bos taurus
atgtccccggtctctccaacctgtgactaagatcacaattccccctttgtatataggctttcacgacacaaactttcaacctatgtgactggcccgagtctgatattcctctgatttctttctgcaaataccaccaggagagtcccaaagcacaacaacacatatgccgcagagtaagaatttagattctcccacttcagc

SEQ ID NO: 99389 - DNA, 201 bp, Bos taurus; identical to SEQ ID NO: 18005

SEQ ID NO: 99390 - DNA, 201 bp, Bos taurus
cacttcctcgcccccacagccattggcggtcgatgtctgttgctgggcaaattatcctcatttccagtttgcagaagcagagagtgagacatgttcccagaagcaaatcagtgtcaggccctgtcatagctgagacagcagtactcaaagaggggttctgaaggatgctggttaactcgttgagaccctgtgtcttggttg

SEQ ID NO: 99391 - DNA, 201 bp, Bos taurus
taaacaaatatttgctgagcactctgtgctaagctctactaaactttggccttaaccaattgaataagatgaattggaccttgccctaatttttattttagtaggcgacagagagcatagaaagacagttatgacaatagcgtgttttaagtgcagtggtaatggaggcacagtgtatgtataaatctagaggatgcagat

SEQ ID NO: 99392 - DNA, 201 bp, Bos taurus; identical to SEQ ID NO: 18007

SEQ ID NO: 99393 - DNA, 201 bp, Bos taurus; identical to SEQ ID NO: 18008

SEQ ID NO: 99394 - DNA, 201 bp, Bos taurus; identical to SEQ ID NO: 18009

SEQ ID NO: 99395 - DNA, 201 bp, Bos taurus
tactggagtgggtagcctatcccttctccagtggatcttcctgacccatgccaacatcaaaatcaagaattattgaatttcacatttttacatgtaatttcttgggtttagttgtacgaacaatcacatatacggattcatatagctgccatcacaaattgagtactgaagggttccataatctcaaagaaattcttttgt

SEQ ID NO: 99396 - DNA, 201 bp, Bos taurus; identical to SEQ ID NO: 18010

SEQ ID NO: 99397 - DNA, 201 bp, Bos taurus; identical to SEQ ID NO: 18013

SEQ ID NO: 99398 - DNA, 201 bp, Bos taurus
tcaaaggtggcatatattgtgggcaaatcctttgaaataacaagggacttttatccttgtaggacttaaccttataaactcactaacaggaaatacaagtgttgttagatggcatttctgtgcacaagtctatgaaaaagagaattctcaattccaccaaagaacaagacctcaaaatacttgtcactgaatttaacaatt

SEQ ID NO: 99399 - DNA, 201 bp, Bos taurus; identical to SEQ ID NO: 18017

SEQ ID NO: 99400 - DNA, 201 bp, Bos taurus; identical to SEQ ID NO: 18018

SEQ ID NO: 99401 - DNA, 201 bp, Bos taurus; identical to SEQ ID NO: 18019

SEQ ID NO: 99402 - DNA, 201 bp, Bos taurus
taaacactatgttcaatgaattctgcaaattttaaattgtattctcatttaaatttagttcagaaattttgtaaaagtttctcatgagacttcttcattggcatatattttgcttagaagtgtgttgtttaatatccaaattattggagaattttccatcttttattggttgttattggtttctaattcattttcattgtc

SEQ ID NO: 99403 - DNA, 201 bp, Bos taurus
agtccaaaatctctaacaatatgctattagttatttgttctgctattgaagtactgtcacatgccagattaccaccacaggtcacttttgatttatattgttgtaaaacaccataataaactgagtcaacaatcctactaacggtttctttatggattggtggaaaacatagcctttcttcagaattccgtaaaacagtga

SEQ ID NO: 99404 - DNA, 201 bp, Bos taurus; identical to SEQ ID NO: 18022

SEQ ID NO: 99405 - DNA, 201 bp, Bos taurus
agtaaacctttaatccaattttctgttgatgggtggaggtgtgttccctgcctgctgtttacctggtgccaaactatggtggaggttatgaagataatggtgacctcctttgaaatatcccatgaatgcactgctatactcactgccccaaccctgcagcaggccaccactgacccccgcctccactggaatctcctagac

SEQ ID NO: 99406 - DNA, 201 bp, Bos taurus
gctgtttgctgatcacttacatgtcatttttatagtttgtatagtttagcaatagttccgatactacacttaagaattattctatatattagtgtaaaccgatatccaatgcttccaggggaaataaattagtggagaataaacagatgaacaggtaaaaaaaatacaagatagggtaaagtaaatgcatttttcaggtgg

SEQ ID NO: 99407 - DNA, 201 bp, Bos taurus
aaacttttggagtagttgatggacagggaggcctggcatgctgtagcccatggggtcacaaagagtcagacatgactgagcaactaatctgaaccaaataacaactaaaccaaataaacaagtggccctttgaagcccatatattttgtcactgcaaataattgtttactgctgtagatagtctctcttcatgaatcattt

SEQ ID NO: 99408 - DNA, 201 bp, Bos taurus; identical to SEQ ID NO: 18026

SEQ ID NO: 99409 - DNA, 201 bp, Bos taurus; identical to SEQ ID NO: 18027

SEQ ID NO: 99410 - DNA, 201 bp, Bos taurus
aagtaattttggaaaaaaataatttagaagtaataagagtgagctgagaatgggagacagagctactcttgatatgagatactgagactctactgattagcgtagagattgcagggatggggagaaagaaacctatacaaagttcagtaatgttcatattgatcgatccaacaggtactattattttctcatcaacttttc

SEQ ID NO: 99411 - DNA, 201 bp, Bos taurus; identical to SEQ ID NO: 18030

SEQ ID NO: 99412 - DNA, 201 bp, Bos taurus; identical to SEQ ID NO: 18031

SEQ ID NO: 99413 - DNA, 201 bp, Bos taurus; identical to SEQ ID NO: 18032

SEQ ID NO: 99414 - DNA, 201 bp, Bos taurus
ttaccaactcaggccactgagagccagaaggccttcacagcagtgtttaaagtgactctcatctcttagggccaaaggccggactgagactggaactgaactgtgacggtagacaagatgcaaaagaggtggagagaatagccaagacaggtctaagttggagtcagggccctgagagtgaggacttgagaaataggatga

SEQ ID NO: 99415 - DNA, 201 bp, Bos taurus; identical to SEQ ID NO: 18038

SEQ ID NO: 99416 - DNA, 201 bp, Bos taurus; identical to SEQ ID NO: 18039

SEQ ID NO: 99417 - DNA, 201 bp, Bos taurus; identical to SEQ ID NO: 18040

SEQ ID NO: 99418 - DNA, 201 bp, Bos taurus
ttaaatagattatttaactgtcgtatgttgcaaatatttcttcccagttggattttgtttatgacttctatttatgggtctttaggaccttattggcattgaataacctttatgttatgcatctcagtctatgtctgcctttattgccgtactatggctttactagtttatggttatataaagttctttgtaatctagaaa

SEQ ID NO: 99419 - DNA, 201 bp, Bos taurus; identical to SEQ ID NO: 18041

SEQ ID NO: 99420 - DNA, 201 bp, Bos taurus; identical to SEQ ID NO: 18042

SEQ ID NO: 99421 - DNA, 201 bp, Bos taurus; identical to SEQ ID NO: 18043

SEQ ID NO: 99422 - DNA, 201 bp, Bos taurus; identical to SEQ ID NO: 18044

SEQ ID NO: 99423 - DNA, 201 bp, Bos taurus; identical to SEQ ID NO: 18050

SEQ ID NO: 99424 - DNA, 201 bp, Bos taurus
cccaccatatccaacgtctttacctcctcttcattacctcttttatctccctttggaagaaaagttccttgaaaccaactgaaatactactatttcattcaaatttatattcacttgctaaattcacattatatccatacccaactatgtgcagttctattgcttgatcagtgccacattcattgatgatcttaaattatt

SEQ ID NO: 99425 - DNA, 201 bp, Bos taurus; identical to SEQ ID NO: 18051

SEQ ID NO: 99426 - DNA, 201 bp, Bos taurus; identical to SEQ ID NO: 18052

SEQ ID NO: 99427 - DNA, 201 bp, Bos taurus
gttctacttttattttataaaatttgactcattatgacacttaaaaaaaaattctagagtactgttaaagccaatttcaaattatttaaaatagaattaaactaataagtttctgctatatgtcccttttccccttacctaggaccttgatatttaaatgaaagagttttaagaattacctttttaaaataaatattttac

SEQ ID NO: 99428 - DNA, 201 bp, Bos taurus; identical to SEQ ID NO: 18053

SEQ ID NO: 99429 - DNA, 201 bp, Bos taurus
cacatgtctcaactaagagtgcatatgttacaagtaaaaagatcccacgtgctgcagctaaggaccccacttgccattatgaacattgaagatttcatgtactgtggctaagacccagcacagccaaataagtaaataaaaaacatacctaagggtagctgcaagtagcattttaaaaaagaaagaaacagcggtaaagga

SEQ ID NO: 99430 - DNA, 201 bp, Bos taurus; identical to SEQ ID NO: 18054

SEQ ID NO: 99431 - DNA, 201 bp, Bos taurus; identical to SEQ ID NO: 18055

SEQ ID NO: 99432 - DNA, 201 bp, Bos taurus
acagctgtttgacaggtcttccgtctcttcacgttttgtctgtaccaagtaaacccaccgtgtatgctagcataggttggcaaaccctcaaattgagatccccgctcaaaaatacccccatattgggaaatattaacctgtatggtttactttggcttgatgaaccttattttcttagttgtgagaaactttttttttttt

SEQ ID NO: 99433 - DNA, 201 bp, Bos taurus; identical to SEQ ID NO: 18056

SEQ ID NO: 99434 - DNA, 201 bp, Bos taurus
atgaactcccagccagcgataaatacagaatggctttcatcgattcggtggccgtcttacagatgaattatcttggtactgaggacactggggatttcatctgtgaggctcagaatcctgctggcagcacgagctgtagcaccaaggtcattgtaaaaggtagaaccctctttcttctcttcctcattacccgaagcccac

SEQ ID NO: 99435 - DNA, 201 bp, Bos taurus; identical to SEQ ID NO: 18057

SEQ ID NO: 99436 - DNA, 201 bp, Bos taurus
tcattaggcagtgtgcctttagggtacctggactcatagaaggaaatgagtacagattccgtataaaggcagctaacattgtgggagagggagagccacgtgaactagcagaatctgtaattgcaaaggacatccttcatcctccagaagtagaacttgatgtaacctgccgtgatgtcatcaccgtcagagtgggccaga

SEQ ID NO: 99437 - DNA, 201 bp, Bos taurus; identical to SEQ ID NO: 18058

SEQ ID NO: 99438 - DNA, 201 bp, Bos taurus
aagactgtctggagtggggcgagactgaaaggggaggctaattacgaggccataataaataattctaagaaaagagtatctgggtttcccgataaccccacataaagatgccaccaaggctgctattttggggaaatgggggaaggattccataatagatggaaagaatttctgctccattctgggcatcgtgtggtatga

SEQ ID NO: 99439 - DNA, 201 bp, Bos taurus
aaaatccttagatagggagatgtaggtaacaaaaccactcttccccagttaaaacgaacatgaaaatcaaagctccaaagcacataaatctaccattaaacaacactgccacaaaatcaataatcagaaaaataatctgaaataataccataacttaaagaaaacaatgtttcatattctcagaggtgaagcaatacatac

SEQ ID NO: 99440 - DNA, 201 bp, Bos taurus; identical to SEQ ID NO: 18059

SEQ ID NO: 99441 - DNA, 201 bp, Bos taurus; identical to SEQ ID NO: 18060

SEQ ID NO: 99442 - DNA, 201 bp, Bos taurus
agatgacagattttgctgaatatctaggccttacagctgttttccagggaaaacaaagaaaggatacaggcagacccaacactcccacatatatttcatcgatcagaggaatgtcacacggccacccaacatgataacccctagtggcagggagcctgccaattgggtttttgattttcaaactctatcagtaagttatga

SEQ ID NO: 99443 - DNA, 201 bp, Bos taurus
gctttcaacaaatttgtgttggattgatttgaactgaaatacacatatagcataagaagatgggaccaaaatgtcttcacttttacactcaaggacttgtgtttttttttgcggatgggtggcaggggagaagggtgtccacaactgcttaaggaccaagaaaaataatctggaaaaactggacatctcactgtaacatac

SEQ ID NO: 99444 - DNA, 201 bp, Bos taurus; identical to SEQ ID NO: 18061

SEQ ID NO: 99445 - DNA, 201 bp, Bos taurus
tacttagcagttactaaagggatattctgaaagaggttttcttgtaaccacctgtatctggtttaatacacaaactgatagacgctcatccttcattgtatttttggtttccaaaaatacatcaacacagctatgtataccagaaggcttccagcttcataattagcttttaggtaagagtactatttaggaagaaaactc

SEQ ID NO: 99446 - DNA, 201 bp, Bos taurus; identical to SEQ ID NO: 18062

SEQ ID NO: 99447 - DNA, 201 bp, Bos taurus
ctgcatcagccagagggaataaaacatgtctgcagttcctacaactcctcgtattttctttcagcttcccagctcatgcgttgcctaccctgggttcagcaatcagtgagacactggtttattttaaaaacatggcatgatacaagctaaacaataatcactttctatctttttaattggattgtaagtttttttcctcca

SEQ ID NO: 99448 - DNA, 201 bp, Bos taurus
taattgtacaatttttcctttagaacattggctttacaaagggtctataagcagccactggctttccacaagttcagtgttactacatcagaaatggatcctacttttcattggcttatttgctcctaagacctactcagagatgtggagtccagttattattgactcacttcctttcctatgcttagggagataaacctg

SEQ ID NO: 99449 - DNA, 201 bp, Bos taurus; identical to SEQ ID NO: 18063

SEQ ID NO: 99450 - DNA, 201 bp, Bos taurus; identical to SEQ ID NO: 18064

SEQ ID NO: 99451 - DNA, 201 bp, Bos taurus
gggcactgtgaaagggggggcacaaacttttggtgggtggttagacatcacagccattatgagaaaagaaagggccaaggaagaggtgggagccggactctgggctgtcatgtagagaagggtgggaattcaaaggaagcagtggggagagggcagcaaacgccgactttgccggccgtggcggggtttgtgggctttttc

SEQ ID NO: 99452 - DNA, 201 bp, Bos taurus; identical to SEQ ID NO: 18065

SEQ ID NO: 99453 - DNA, 201 bp, Bos taurus; identical to SEQ ID NO: 18066

SEQ ID NO: 99454 - DNA, 201 bp, Bos taurus
ttgttttaataattggaaaatttcaactcaggaggaaaactggccaagggaaaaagcctacatctaaactcagtttgggaagctctggattttccttgatttggagaccgcagggcagctttctgtcggcctctaaccttcctttgactggctctggaattttgtttaaaatatttcaagattcgaaagacagcaacaact

SEQ ID NO: 99455 - DNA, 201 bp, Bos taurus
accatatttacaggagaacactgtttagaaaaaattcttattggtagagacagtcctctcaatcttagaacataatcaccatcagtttgataggtcctctctgaaaatgaagacaatatgtcctctcaagcttgatttggagggtcactcactatttctgattacttgcaaaattctttactatcatctgattacttcata

SEQ ID NO: 99456 - DNA, 201 bp, Bos taurus; identical to SEQ ID NO: 18067

SEQ ID NO: 99457 - DNA, 201 bp, Bos taurus; identical to SEQ ID NO: 18068

SEQ ID NO: 99458 - DNA, 201 bp, Bos taurus
tgtttctcctagtcctgtggaagttctgtaatcagatcccactggccttcaaagtcaagttccctgtggattcccagtccctttgccagaccctcaggttggaaagtctgatgtggggcctagaactatctatactattggcttcataatcagtagaaagggttcagtgaccctacaaacacataggtgtcatcaactgaa

SEQ ID NO: 99459 - DNA, 201 bp, Bos taurus; identical to SEQ ID NO: 18069

SEQ ID NO: 99460 - DNA, 201 bp, Bos taurus; identical to SEQ ID NO: 18070

SEQ ID NO: 99461 - DNA, 201 bp, Bos taurus; identical to SEQ ID NO: 18071

SEQ ID NO: 99462 - DNA, 201 bp, Bos taurus
ggttgggaagatcccctggagaaggaaatggcaacccattcagtatgcttgcctaagaaaacccatggcgggctacagtccatggggtcacaaaagagtcagacacttcttagcgacagactattttgcaatctctaggagttagctaaccctaggaggggcggtctatccaggaagaaggcctcagatgcctgaacatca

SEQ ID NO: 99463 - DNA, 201 bp, Bos taurus; identical to SEQ ID NO: 18073

SEQ ID NO: 99464 - DNA, 201 bp, Bos taurus; identical to SEQ ID NO: 18074

SEQ ID NO: 99465 - DNA, 201 bp, Bos taurus; identical to SEQ ID NO: 18075

SEQ ID NO: 99466 - DNA, 201 bp, Bos taurus
gttcttttcggaaactgaaagtaaaaggtaactttatatttgcaggaaaaaaatttggtttctttttcactgcatggttactctgatgtaactgatataatagagtggacattagtatataagatgatcaaatgagtcatgcgatggaacatctgcctcagaaagccctttcagacatcatatgctatgccgttgaagtgt

SEQ ID NO: 99467 - DNA, 201 bp, Bos taurus; identical to SEQ ID NO: 18076

SEQ ID NO: 99468 - DNA, 201 bp, Bos taurus
ccctgaagaaggaagctgagatgaaactttgtgtattttcacttgttcatctttgttaaaaattgatttcacaaagagtttcttattttaatcttatagaaccagtacttggcctcgttgatcgtctctctattttgtgtttgttttcatttcattcacttctgggcacttatatttttaacaacttcttgtttttttttt

SEQ ID NO: 99469 - DNA, 201 bp, Bos taurus
tttttgagttgctcgatagccgcctggccacatgcttttggtcctctgagatatattcttctccttctggggaaggtcaagaaccctgccctagacttccgtaactctctgccttccaggcagagaagacaaagttagcacattaacaaggaagcagtgatcagggtgggagctaggctccttacagcaattctcaaggag

SEQ ID NO: 99470 - DNA, 201 bp, Bos taurus; identical to SEQ ID NO: 18077

SEQ ID NO: 99471 - DNA, 201 bp, Bos taurus
gggtaaactcttgataaatagtcattaagacttccgtttccactgtccacacatacccattcattttccaagctctgtatattctggctctcccccgccatgaaagatgtcctaacttccacctcctaactctccctgcttactgctgctgcgttcattaaagttcagttctggtggaatcacattctttctcttaaaaaa

SEQ ID NO: 99472 - DNA, 201 bp, Bos taurus
tggtactctgtctccccacaactagtcctggagaaccagaatcttgttcttggtgtccacaagagtgtctaagcactgctgtcacacctggcacctaggagctcagtgattgaataaatggtttgtgattttcaatctttcaaaaggcttctagctattattattataacataatcaaattgttttctaactcccaacttt

SEQ ID NO: 99473 - DNA, 201 bp, Bos taurus; identical to SEQ ID NO: 18078

SEQ ID NO: 99474 - DNA, 201 bp, Bos taurus
ttgtaacatgcatcttaagtgcacagcttaaattttacacgagggcccacagggtcaccaccacccagaggaaggtttgcactgctccctgacaccccacgtgcctctcctgctttccatgcgattgctatcctgactgccaccttctctttaggaaggtaacaaaaatgaacaggggcagggtgtttgggagagaatgga

SEQ ID NO: 99475 - DNA, 201 bp, Bos taurus; identical to SEQ ID NO: 18079

SEQ ID NO: 99476 - DNA, 201 bp, Bos taurus
gccgtttctgaagaagaaaaaaataatcacttgttgggacttaggaaagtagatctttaagagaaatatccacaagcatagtaataaggtcaaatcaccataacaaaataagatacgatgtaatatcctgattttgttctttcacaactgtcagactgcataggaaccatacttattttcaatcaattattcataataggc

SEQ ID NO: 99477 - DNA, 201 bp, Bos taurus; identical to SEQ ID NO: 18080

SEQ ID NO: 99478 - DNA, 201 bp, Bos taurus; identical to SEQ ID NO: 18081

SEQ ID NO: 99479 - DNA, 201 bp, Bos taurus; identical to SEQ ID NO: 18082

SEQ ID NO: 99480 - DNA, 201 bp, Bos taurus
gtttatccccataacaatctatccagatgtttagaacattaatgtgatttttagattttatttaactcctacaaaaaacaagtggagagagaaaaaactacattcccttcagacagtaatcagaagaataaagaacatctcaccagggcccttgtctcaatatgatgtcagaaatgcaccctaacgagtaacatttcaaat

SEQ ID NO: 99481 - DNA, 201 bp, Bos taurus
tttctgtgttcctcctatggcaggaggcatttctgtccactgcttttctataatatcctaatcatgtaaacgttcagagtcagatacaggcattgggccactttctaccagcaagtgttgctcttatgccctaaaatacctgaaccaatgcgctttggcaccttctgcttcttttctcaatttggcagcaaacctgggtgg

SEQ ID NO: 99482 - DNA, 201 bp, Bos taurus; identical to SEQ ID NO: 18083

SEQ ID NO: 99483 - DNA, 201 bp, Bos taurus
gcccaaaagagatacttacagatgactcttcaacttgtgatttaaagtattttaaagcagtattttatttcttccctttgtaccagattgtagtctgacagattttgctaataatggcccttcaaaactggaccccagctcttaacagctgagaaataaaaacaccatgctcatacacatgcagttcttgatccttgtccc

SEQ ID NO: 99484 - DNA, 201 bp, Bos taurus
acctttactaagcattctcaacttattactactactaataataacatcttccattcatcagtattatccaacagttctcagagtgtggtccagaaacctaagggggtccctagacactttcagaggctccatgaggtcaaaattgttttcacaataaagcaaaagctttatttgcctttttcactgtcagtctctcaaaaa

SEQ ID NO: 99485 - DNA, 201 bp, Bos taurus; identical to SEQ ID NO: 18091

SEQ ID NO: 99486 - DNA, 201 bp, Bos taurus
aggttttgtgaaagattactctctgagcataatgaaaactaaaaggaatttgaaggctttacagtactttgtttgcattggcaatataaattttctttctcctgatacgcaggaagagcacaaataataatagttgtgcctttttggctcctctaaacactacagatgaaagctgcaaccctgcccaaaagggtctctcaa

SEQ ID NO: 99487 - DNA, 201 bp, Bos taurus
agtgccccttcattccagacatcctacaaactaatcgtcttttttctgactcaagggctcagtcaaggcctgcaggcaggttcacttttctgatctgcagctgcaccttgggtaaatgccatgagtttctgatctgaattcctaaataaaagagaagtgactcttcaaccacattcagaagcatactctgagccaagagga

SEQ ID NO: 99488 - DNA, 201 bp, Bos taurus; identical to SEQ ID NO: 18093

SEQ ID NO: 99489 - DNA, 201 bp, Bos taurus
ctgttgaaattattctctgtataactctctgaggctgcagagctatgggtacacaaacttctttaaatatatttatttggctgcggtgggcctcagttgcggcacacaagacctttgatcttctttcagcatgcacatcttttaattgcagcgtgtgagctccaagctgcagcatatgggaactacttccctgactagggt

SEQ ID NO: 99490 - DNA, 201 bp, Bos taurus; identical to SEQ ID NO: 18094

SEQ ID NO: 99491 - DNA, 201 bp, Bos taurus; identical to SEQ ID NO: 18095

SEQ ID NO: 99492 - DNA, 201 bp, Bos taurus; identical to SEQ ID NO: 58729

SEQ ID NO: 99493 - DNA, 201 bp, Bos taurus; identical to SEQ ID NO: 18105

SEQ ID NO: 99494 - DNA, 201 bp, Bos taurus; identical to SEQ ID NO: 18108

SEQ ID NO: 99495 - DNA, 201 bp, Bos taurus; identical to SEQ ID NO: 18109

SEQ ID NO: 99496 - DNA, 201 bp, Bos taurus; identical to SEQ ID NO: 18110

SEQ ID NO: 99497 - DNA, 201 bp, Bos taurus; identical to SEQ ID NO: 18112

SEQ ID NO: 99498 - DNA, 201 bp, Bos taurus; identical to SEQ ID NO: 18113

SEQ ID NO: 99499 - DNA, 201 bp, Bos taurus; identical to SEQ ID NO: 18114

SEQ ID NO: 99500 - DNA, 201 bp, Bos taurus; identical to SEQ ID NO: 18115

SEQ ID NO: 99501 - DNA, 201 bp, Bos taurus; identical to SEQ ID NO: 18116

SEQ ID NO: 99502 - DNA, 201 bp, Bos taurus; identical to SEQ ID NO: 18117

SEQ ID NO: 99503 - DNA, 201 bp, Bos taurus; identical to SEQ ID NO: 18118

SEQ ID NO: 99504 - DNA, 201 bp, Bos taurus; identical to SEQ ID NO: 18119

SEQ ID NO: 99505 - DNA, 201 bp, Bos taurus; identical to SEQ ID NO: 18123

SEQ ID NO: 99506 - DNA, 201 bp, Bos taurus; identical to SEQ ID NO: 18126

SEQ ID NO: 99507 - DNA, 201 bp, Bos taurus
cgggaagtatcccaagttcttaaatgcaggtgcatctagctatgtcagtgcaacagaggaagattgtgaataataaacactttacttatagcagggctctgtgtgctgttactttgcctgctattgacaaatgagtatctctgagcagaaatcattgagatcaaattaatattagtgtcagtccatgtatgccttacgtcc

SEQ ID NO: 99508 - DNA, 201 bp, Bos taurus
tcattggaagaaggggaattgataaaagcaaagatttttttaacatataaatactaatttactaatgtacatgtcatgtattatgctatttttattcttaatgtattttaagattatactgaatacttttgttttaggctgccacccagctggaaaacttaggaaatgcgttggatgccgtggaaccacagaatgctcaac

SEQ ID NO: 99509 - DNA, 201 bp, Bos taurus
attaaaaaatagcagttatcttaattgcatgtaccaaataccctatcttgtctctgaataacttcgataaacggaaatgcttacacacttaatgaaaattgaaattcttactgtgttgttgtattgttctatgtctaagaagagtctccagttattctacagttctttaacctttctttaggccactttttaatcataaat

SEQ ID NO: 99510 - DNA, 201 bp, Bos taurus; identical to SEQ ID NO: 18128

SEQ ID NO: 99511 - DNA, 201 bp, Bos taurus; identical to SEQ ID NO: 18129

SEQ ID NO: 99512 - DNA, 201 bp, Bos taurus; identical to SEQ ID NO: 18130

SEQ ID NO: 99513 - DNA, 201 bp, Bos taurus; identical to SEQ ID NO: 18131

SEQ ID NO: 99514 - DNA, 201 bp, Bos taurus; identical to SEQ ID NO: 18134

SEQ ID NO: 99515 - DNA, 201 bp, Bos taurus; identical to SEQ ID NO: 18136

SEQ ID NO: 99516 - DNA, 201 bp, Bos taurus; identical to SEQ ID NO: 18138

SEQ ID NO: 99517 - DNA, 201 bp, Bos taurus; identical to SEQ ID NO: 18139

SEQ ID NO: 99518 - DNA, 201 bp, Bos taurus; identical to SEQ ID NO: 18142

SEQ ID NO: 99519 - DNA, 201 bp, Bos taurus
ttaagccaacaaaagaggtgatttaagatttaacatccattgataagttgagtgactttttattttcctgtgaaaggacataaaatgtctgtctctggaatgaagtggttttatatttgaaaaatattaacttttgtcacgtggagcttaattagtctatacccacttgaaaagattctcaccaattactcaaaagaagga

SEQ ID NO: 99520 - DNA, 201 bp, Bos taurus; identical to SEQ ID NO: 18143

SEQ ID NO: 99521 - DNA, 201 bp, Bos taurus
attcatcctggaatttggcttagaagtttctggttttattgtcatctaatcaagcacctacctagaaattcccatgggttattacatcaaataagacagactacatttgacattttctcaaagcattttgaaatttcccttcctgcctccacccatgtattttattttcacctagtgaaagggggtccatcagtttaagat

SEQ ID NO: 99522 - DNA, 201 bp, Bos taurus
tccaaggaggggcaaacaggactttcacgctttcccaccactctgagcatccactgtctctcctgttgttttggcacttgattatatttagcctattggtgtatactgactctcaaatacttttcttaaatcacaagcatgtgaggaaaggggcactgcatatgaaaatctctctcgttgagggaacgggacatcagatca

SEQ ID NO: 99523 - DNA, 201 bp, Bos taurus; identical to SEQ ID NO: 18146

SEQ ID NO: 99524 - DNA, 201 bp, Bos taurus
gccctgtggctgagggacttagatttttcataccttgaaaaacacttgaagatcctcttccctccagacccacttaagaagaatcagtgccccaaaacaattttgggggaaaaaaaaaagaaagagaagaaaaaataccccaagagggattttaataacttgttgagcaggttttgaatttggaaggcacgtgtcagaact

SEQ ID NO: 99525 - DNA, 201 bp, Bos taurus
gcataagagactcttttccaagatatataaagaactctcaaaactcaacaatatcatcaatgaaactatgaaaaaaatgatcaaaggccttaaaagacatcttaccaaagaagatatacagatggcaaataagggagatgtaaattaaaatgttatagcactatataccttttagaatggccaaaatctggaacacagaca

SEQ ID NO: 99526 - DNA, 201 bp, Bos taurus; identical to SEQ ID NO: 18148

SEQ ID NO: 99527 - DNA, 201 bp, Bos taurus; identical to SEQ ID NO: 18149

SEQ ID NO: 99528 - DNA, 201 bp, Bos taurus; identical to SEQ ID NO: 18150

SEQ ID NO: 99529 - DNA, 201 bp, Bos taurus; identical to SEQ ID NO: 18151

SEQ ID NO: 99530 - DNA, 201 bp, Bos taurus; identical to SEQ ID NO: 18155

SEQ ID NO: 99531 - DNA, 201 bp, Bos taurus; identical to SEQ ID NO: 18156

SEQ ID NO: 99532 - DNA, 201 bp, Bos taurus; identical to SEQ ID NO: 18157

SEQ ID NO: 99533 - DNA, 201 bp, Bos taurus; identical to SEQ ID NO: 18159

SEQ ID NO: 99534 - DNA, 201 bp, Bos taurus; identical to SEQ ID NO: 18161

SEQ ID NO: 99535 - DNA, 201 bp, Bos taurus; identical to SEQ ID NO: 18162

SEQ ID NO: 99536 - DNA, 201 bp, Bos taurus; identical to SEQ ID NO: 18163

SEQ ID NO: 99537 - DNA, 201 bp, Bos taurus
cttcaaaaagcatgagtcacaagattatagaggaaggccccaggaccacattgcaggtaggacagttcacactctctagctcttgtctttagaatatacctaacagtggccttaagtggaaactgacatttaaagactctaactttaaagatgaggcaattttgattttgacttggatagtttggtaatttttttccagac

SEQ ID NO: 99538 - DNA, 201 bp, Bos taurus; identical to SEQ ID NO: 18165

SEQ ID NO: 99539 - DNA, 201 bp, Bos taurus; identical to SEQ ID NO: 18166

SEQ ID NO: 99540 - DNA, 201 bp, Bos taurus; identical to SEQ ID NO: 18167

SEQ ID NO: 99541 - DNA, 201 bp, Bos taurus; identical to SEQ ID NO: 18168

SEQ ID NO: 99542 - DNA, 201 bp, Bos taurus; identical to SEQ ID NO: 18169

SEQ ID NO: 99543 - DNA, 201 bp, Bos taurus
atagggcctttaagaaaataattaagattaaataaaatcataaggatgtgacccttaggaataggaatagtgtccttgtaagaaaaggaagagactccagagatatgtgtacacagtaaaaaggccatgtgaagacacagggaaaaactgctaccaaaaaaaaaggagagaagcattaaaagataccaaatgtgctgccac

SEQ ID NO: 99544 - DNA, 201 bp, Bos taurus; identical to SEQ ID NO: 18170

SEQ ID NO: 99545 - DNA, 201 bp, Bos taurus; identical to SEQ ID NO: 18174

SEQ ID NO: 99546 - DNA, 201 bp, Bos taurus; identical to SEQ ID NO: 18175

SEQ ID NO: 99547 - DNA, 201 bp, Bos taurus; identical to SEQ ID NO: 18176

SEQ ID NO: 99548 - DNA, 201 bp, Bos taurus
aattgactacctcaagaagcctgagaatgagcttttctgtgtgtttaataggagaactttgggctctgagcatccctctttagctccagattgctgcatgtgtatgcaggatgaggaaagtatacttagatctatacagatgttaatccttcttccctcctctagttctggagcccttgtcagggggaaaagttcagcctg

SEQ ID NO: 99549 - DNA, 201 bp, Bos taurus
cgcaaatttagacaaactatttaaaacacattgctggtgttcattcagtagcttaaattcataccttatacctagtagtagcttgaacatagtgtgtgtcacaccagatgtgtttgtgtgctttacagaatcagttcagttcagtcagttcagtcgctcagtcatgtccgactctttgcagtcccatgaatcgtagcacgc

SEQ ID NO: 99550 - DNA, 201 bp, Bos taurus; identical to SEQ ID NO: 18182

SEQ ID NO: 99551 - DNA, 201 bp, Bos taurus; identical to SEQ ID NO: 18183

SEQ ID NO: 99552 - DNA, 201 bp, Bos taurus; identical to SEQ ID NO: 18185

SEQ ID NO: 99553 - DNA, 201 bp, Bos taurus; identical to SEQ ID NO: 18186

SEQ ID NO: 99554 - DNA, 201 bp, Bos taurus; identical to SEQ ID NO: 18188

SEQ ID NO: 99555 - DNA, 201 bp, Bos taurus; identical to SEQ ID NO: 18189

SEQ ID NO: 99556 - DNA, 201 bp, Bos taurus; identical to SEQ ID NO: 18190

SEQ ID NO: 99557 - DNA, 201 bp, Bos taurus; identical to SEQ ID NO: 18191

SEQ ID NO: 99558 - DNA, 201 bp, Bos taurus; identical to SEQ ID NO: 18192

SEQ ID NO: 99559 - DNA, 201 bp, Bos taurus; identical to SEQ ID NO: 18193

SEQ ID NO: 99560 - DNA, 201 bp, Bos taurus; identical to SEQ ID NO: 18194

SEQ ID NO: 99561 - DNA, 201 bp, Bos taurus
ctcccaacctgctgtgtcccacagcagtgccagctgcgtggagatacgtccacacagcacaggagggctcctgctgggggttctgtgggccaaattaaggaatctgggcgccccaccactgcattgtgtcctggttgcttcagacacagctgtcttgcaaacatgtcaatacgtttggcctttcttaggagctccttacct

SEQ ID NO: 99562 - DNA, 201 bp, Bos taurus; identical to SEQ ID NO: 18195

SEQ ID NO: 99563 - DNA, 201 bp, Bos taurus
tttagactctccactattctccaagttctcaaactgcctaatagtttttgttatgatttacggttgcaccatcccttaatttgtttctacacatacctaaataattcaccagtgtattagtacaattaatctatccaattattaaactagacttacctctattttctggacttgcacataaaacctgagacaacattaaac

SEQ ID NO: 99564 - DNA, 201 bp, Bos taurus; identical to SEQ ID NO: 18196

SEQ ID NO: 99565 - DNA, 201 bp, Bos taurus
tgacaattcatctctggggtcctgttgcagagaaccggaagtattgatgcagagtctgtatgctcactactttctaactgtggccaatggcatcattattcctaatgtcctctgggggaacccttgaaagtgaaagttgctcagtcgtgtccgactctttgtgaccccatgaactattcagttcatggaattctccaggcc

SEQ ID NO: 99566 - DNA, 201 bp, Bos taurus
tcatctacatttatctcatactttgtctccataggccctctgctctggttccatgtttctcacatctatagactcattaaacaaagtgttacctgtatgcgattttgtttggcctgcatgctgtttaaaacaattaaatttcaagtatctttaaatccatattttcttgacttgcctgatgtgattttgtcattctctcct

SEQ ID NO: 99567 - DNA, 201 bp, Bos taurus; identical to SEQ ID NO: 18197

SEQ ID NO: 99568 - DNA, 201 bp, Bos taurus; identical to SEQ ID NO: 18198

SEQ ID NO: 99569 - DNA, 201 bp, Bos taurus; identical to SEQ ID NO: 18199

SEQ ID NO: 99570 - DNA, 201 bp, Bos taurus; identical to SEQ ID NO: 18200

SEQ ID NO: 99571 - DNA, 201 bp, Bos taurus; identical to SEQ ID NO: 18201

SEQ ID NO: 99572 - DNA, 201 bp, Bos taurus; identical to SEQ ID NO: 18202

SEQ ID NO: 99573 - DNA, 201 bp, Bos taurus; identical to SEQ ID NO: 18203

SEQ ID NO: 99574 - DNA, 201 bp, Bos taurus; identical to SEQ ID NO: 18204

SEQ ID NO: 99575 - DNA, 201 bp, Bos taurus
tcagtggtcagaatcctgcagtaattattactttgagttaagcattaatagtgtgtgattaagtgaaaaccattatctttaagagataacatgccaaattttgtgtgattattattaaagactttgctttaatgataatatttttgggcttatcacaaatgataattttaaaaataattttattttgtatttattcgtggc

SEQ ID NO: 99576 - DNA, 201 bp, Bos taurus; identical to SEQ ID NO: 18211

SEQ ID NO: 99577 - DNA, 201 bp, Bos taurus; identical to SEQ ID NO: 18214

SEQ ID NO: 99578 - DNA, 201 bp, Bos taurus; identical to SEQ ID NO: 18215

SEQ ID NO: 99579 - DNA, 201 bp, Bos taurus
tagcatgtgaaattagtgcaattgtgttttgtaatgtagaagttactataaatgggtgcattttgatgatttttaatcaagatcatttgtttctgtgggttcatgttagaaagtatttaggtctttgaaaagttttgttatgagagattagatatctcaatactttgtgtgtgtatgagtgtctttgtgtgtgtgtgtgtc

SEQ ID NO: 99580 - DNA, 201 bp, Bos taurus; identical to SEQ ID NO: 18217

SEQ ID NO: 99581 - DNA, 201 bp, Bos taurus; identical to SEQ ID NO: 18218

SEQ ID NO: 99582 - DNA, 201 bp, Bos taurus; identical to SEQ ID NO: 18219

SEQ ID NO: 99583 - DNA, 201 bp, Bos taurus; identical to SEQ ID NO: 18220

SEQ ID NO: 99584 - DNA, 201 bp, Bos taurus
atggcaaggctccaacaaagaatgcccagaatactttttatgaggtagcaaaatgattcctgttttgatcttgacacttgtgttattttcctagttatttattgtgccttgcctcttcttttcatgatggtacctgctcatcacacatatctcttgtttctagaaccatcatccaaattcccctaaagaatcaccagtcac

SEQ ID NO: 99585 - DNA, 201 bp, Bos taurus; identical to SEQ ID NO: 18221

SEQ ID NO: 99586 - DNA, 201 bp, Bos taurus
gatgaatgcatagactcttcccaagagaaggaaaatcagcattaaacacttgccatcttcatataacattgggtcttgttggtacagtagcagtcaagtaagaactatactgttacgcctgacccctcctcccctccctgtctttgatctgggtgggctcagaaaacttgaaagacggcagaagagaaacttgtgagaaga

SEQ ID NO: 99587 - DNA, 201 bp, Bos taurus; identical to SEQ ID NO: 18222

SEQ ID NO: 99588 - DNA, 201 bp, Bos taurus; identical to SEQ ID NO: 18223

SEQ ID NO: 99589 - DNA, 201 bp, Bos taurus; identical to SEQ ID NO: 18224

SEQ ID NO: 99590 - DNA, 201 bp, Bos taurus; identical to SEQ ID NO: 18226

SEQ ID NO: 99591 - DNA, 201 bp, Bos taurus; identical to SEQ ID NO: 18227

SEQ ID NO: 99592 - DNA, 201 bp, Bos taurus
gggcagtggctgatggaggacaaaaataatattctcaagatgggtaatttcagcaatttaggtgatttcatcctttgactttaaacagtaagcgacatgtggtttccctttgtgagtaggtttccagacccaaacttttagattacttatcaaggaatcctatctctattcttatattttctccagttccattcttgcatt

SEQ ID NO: 99593 - DNA, 201 bp, Bos taurus; identical to SEQ ID NO: 18229

SEQ ID NO: 99594 - DNA, 201 bp, Bos taurus
ttaaagcagcacttgcttcctaacagctgggctctaggtcatttaacactgtttctatcactgtaaagtgacaaattcccattcccagggccagataggacacaattccagcctctagaagactgaggatgaacaatgacactaggactcaagcttgcagcattttgactcatcaaattcttcccttatgaactcttggta

SEQ ID NO: 99595 - DNA, 201 bp, Bos taurus; identical to SEQ ID NO: 18230

SEQ ID NO: 99596 - DNA, 201 bp, Bos taurus; identical to SEQ ID NO: 18231

SEQ ID NO: 99597 - DNA, 201 bp, Bos taurus; identical to SEQ ID NO: 18235

SEQ ID NO: 99598 - DNA, 201 bp, Bos taurus; identical to SEQ ID NO: 18237

SEQ ID NO: 99599 - DNA, 201 bp, Bos taurus; identical to SEQ ID NO: 18238

SEQ ID NO: 99600 - DNA, 201 bp, Bos taurus; identical to SEQ ID NO: 18241

SEQ ID NO: 99601 - DNA, 201 bp, Bos taurus; identical to SEQ ID NO: 18242

SEQ ID NO: 99602 - DNA, 201 bp, Bos taurus; identical to SEQ ID NO: 18243

SEQ ID NO: 99603 - DNA, 201 bp, Bos taurus
aacaaaaacaggaagattaacagatgaatggacgatcagtattcttcagtccttccacagtgagtttcaaattatcttatatgccatcctttaaggattttatttacagatcagttgacaggattcgcagatttctcagaatagctactggcttctagaggactacctatgcaaatatgaatgcacttaaataagtgtatc

SEQ ID NO: 99604 - DNA, 201 bp, Bos taurus
gggtgattgagcactgtacacaatgcagtgcaatgaaaacctccttagtcttataaatttgtattaattatttcaaaagttttaccaatgcattttcttacctatttcaatgaaattcaagtggatatctatatagcactagctgtatttctttttatctatctataagctgccggaatccagctctagcagccagggaat

SEQ ID NO: 99605 - DNA, 201 bp, Bos taurus
ctgtcaccaactttttctgtgtttcagcactttgtctataagagagcataattcgtctttgttatgtacttaaaactgagataaaatgacaggtttataactctggtgaatacttgctaagcaatgtaatttatatatttttcttcctgctttatgatttcacctttgatgtcatatggcacaaagctacactaaaatttc

SEQ ID NO: 99606 - DNA, 201 bp, Bos taurus
tagaaaaattcagtttctccattagatgaataccagcagaagcagccaaatatggtctcattttcacattccaaactcaagttagtatatcttgtactaactcaacttggatttaggtacttaaataaaaattagagccatggctatattagtgtctgaggagtgtaatttttagttttcaattgtttataatagaagaaa

SEQ ID NO: 99607 - DNA, 201 bp, Bos taurus; identical to SEQ ID NO: 18244

SEQ ID NO: 99608 - DNA, 201 bp, Bos taurus
attatagtttgtccatattatgaattcatcaaaagctatttattttgaaggcaatgttgtgtatgtttgaggaggagagctataaaaataaattagcaagggcctatcttcaagaagtatatgtgaaagtagtagtatgttcacatataattatcatgttacatagaaaaggattgaccagatatagtcttattgagttag

SEQ ID NO: 99609 - DNA, 201 bp, Bos taurus; identical to SEQ ID NO: 18246

SEQ ID NO: 99610 - DNA, 201 bp, Bos taurus; identical to SEQ ID NO: 18247

SEQ ID NO: 99611 - DNA, 201 bp, Bos taurus
tctataattcaattaagtaattttaacaactggagatcactccaattgaaatcagaggaagtaaaaataaacctttgtgtgcagctttattttcaacattcgatacctgacaatagtcaagtgatctacattggtatgatacattgtgtaagcatttataatacttatgaagaattcatagcaagaaaaattgctcaggct

SEQ ID NO: 99612 - DNA, 201 bp, Bos taurus; identical to SEQ ID NO: 18248

SEQ ID NO: 99613 - DNA, 201 bp, Bos taurus; identical to SEQ ID NO: 18249

SEQ ID NO: 99614 - DNA, 201 bp, Bos taurus; identical to SEQ ID NO: 18250

SEQ ID NO: 99615 - DNA, 201 bp, Bos taurus
cattttgagaacttatgagcaaatatagcattaatttagaaaccaagaactaagttagaagcaaactgcaaatgtttcagtttatgctttagaaggtaccggttggaacaaacatttaaaacctgaaacattatttcagatgctggagtgtattaaatagcaaaacataaaaaatcaaaaccaaaaatagtgtgttgaaaa

SEQ ID NO: 99616 - DNA, 201 bp, Bos taurus; identical to SEQ ID NO: 18251

SEQ ID NO: 99617 - DNA, 201 bp, Bos taurus
agttgcaggtttagtgggattatgtgactcacccttaagacagcccatcactgtatgttttgtttgggcatgaaaaataagaaccatgcaaacctttgcatgcagacagataaagggttcccatcaatgagcattaagtctgagtaatggggttttaaagagacaacttgtagtgttactctttaggaacctcaacatcga

SEQ ID NO: 99618 - DNA, 201 bp, Bos taurus; identical to SEQ ID NO: 18252

SEQ ID NO: 99619 - DNA, 201 bp, Bos taurus; identical to SEQ ID NO: 18253

SEQ ID NO: 99620 - DNA, 201 bp, Bos taurus; identical to SEQ ID NO: 18255

SEQ ID NO: 99621 - DNA, 201 bp, Bos taurus; identical to SEQ ID NO: 18257

SEQ ID NO: 99622 - DNA, 201 bp, Bos taurus
gtgccatattccagagagaatccatcaatactacgatggtctcacggccatggcagaggaaagatcataatctggggcccagtataccatgtggggtccgaagcagcctttgtgattatattaaagagtttcagttggaccttcagtgttccttaagagtgatccatccagatgttgtcagagcacagccctgataaacca

SEQ ID NO: 99623 - DNA, 201 bp, Bos taurus; identical to SEQ ID NO: 18258

SEQ ID NO: 99624 - DNA, 201 bp, Bos taurus; identical to SEQ ID NO: 18259

SEQ ID NO: 99625 - DNA, 201 bp, Bos taurus
tgtgttaaaatggtactgatctaaatcaaaattgtaaaatgggaaagccctgattaatgatttgcctcgtatacctgtgatattatatgaaagccaaatacaaaaatgttatttcaaatgaggacaataaagataatactctcccacttaaactatttagcaattctaatgttggtgattatttgtgagtttaagggtcct

SEQ ID NO: 99626 - DNA, 201 bp, Bos taurus; identical to SEQ ID NO: 18261

SEQ ID NO: 99627 - DNA, 201 bp, Bos taurus
gtgttccccaagaaacacaatataatcaatccttagagtaaggggataacctgttgctaccagaaactgtctattgtacttgttcatgaacattttttatgtctaatttttagtagagaaactcttgtgataaaataaatccaatgaaaatgagtagacattttttcaatatattttctaaaattgtgttttctttatcta

SEQ ID NO: 99628 - DNA, 201 bp, Bos taurus
gacctgcaacatgagaaaaatcatttcaaatccagaattgctgtactcagtcaaactgtcatttcactttgaggagaaaataaaatcattttagaacacataagatatcagaaaatttaccatatcagggctcccaaaaaactaagccaagaaaaattaaatatgaattcaagagaaaagaagcagaactaaatctaagtt

SEQ ID NO: 99629 - DNA, 201 bp, Bos taurus
attccactgcctgattctccaaggcaacggttactaatacccagccccttttctaggcactggtagaaagtactggagaagaggccatatcatcccatatttcgttgaccttataacctgaacaaatgaactagatttacatataaaaactaagcactcttaaacaacaggtatgtaattaggcaatcatgggcctagtac

SEQ ID NO: 99630 - DNA, 201 bp, Bos taurus
aaaatcactgagcatgtgtcaaaggcagccaatcaatagctcaagaagaaagagcccatgtggggaaatttgtacaagagacccagcagatggtaagtaacaaaagtttacttcatgccttgtctctactggcccaaaatactcaattctgggaatcaacatgagcaagataacctggtaaatcactatagcagaaataaa

SEQ ID NO: 99631 - DNA, 201 bp, Bos taurus
caaagcttcaccttctaccctctaacccactaaaccagttctgccagtctccttctctttccctggattctacacctcaggcccccttgctttctcccctactctgtatctcaggagaaacaatccctcctttctggggctaacagcctaataaccacactatgcctatcccggcctcctctgtactcccttcccatcttc

SEQ ID NO: 99632 - DNA, 201 bp, Bos taurus; identical to SEQ ID NO: 18266

SEQ ID NO: 99633 - DNA, 201 bp, Bos taurus; identical to SEQ ID NO: 18267

SEQ ID NO: 99634 - DNA, 201 bp, Bos taurus; identical to SEQ ID NO: 18268

SEQ ID NO: 99635 - DNA, 201 bp, Bos taurus; identical to SEQ ID NO: 18269

SEQ ID NO: 99636 - DNA, 201 bp, Bos taurus; identical to SEQ ID NO: 18272

SEQ ID NO: 99637 - DNA, 201 bp, Bos taurus; identical to SEQ ID NO: 18273

SEQ ID NO: 99638 - DNA, 201 bp, Bos taurus
cctatctaatgaactcattaaagaacatgctttaaaaaaaaatttaaaagaaagatctctttaccccactccacgctcctcccaggcctactctccttttttaaaaatgcaaaaaggaaatgcacatggtaaaagatgtctccacatgtgagcgtttctactacctggctccatcctctccatcaaatacctgagctgatg

SEQ ID NO: 99639 - DNA, 201 bp, Bos taurus; identical to SEQ ID NO: 18274

SEQ ID NO: 99640 - DNA, 201 bp, Bos taurus; identical to SEQ ID NO: 18277

SEQ ID NO: 99641 - DNA, 201 bp, Bos taurus; identical to SEQ ID NO: 18278

SEQ ID NO: 99642 - DNA, 201 bp, Bos taurus; identical to SEQ ID NO: 18279

SEQ ID NO: 99643 - DNA, 201 bp, Bos taurus; identical to SEQ ID NO: 18280

SEQ ID NO: 99644 - DNA, 201 bp, Bos taurus; identical to SEQ ID NO: 18281

SEQ ID NO: 99645 - DNA, 201 bp, Bos taurus; identical to SEQ ID NO: 18282

SEQ ID NO: 99646 - DNA, 201 bp, Bos taurus; identical to SEQ ID NO: 18284

SEQ ID NO: 99647 - DNA, 201 bp, Bos taurus; identical to SEQ ID NO: 18285

SEQ ID NO: 99648 - DNA, 201 bp, Bos taurus
caactgtgcctccaagggagtgactcacaatgctgtgcaccttgggctttttgtatctcactggagaaaccacaggccccgggggcctctcagtgtgctgttgtgcttccggggaaggggtgacgggatcagtatatagccattactcttacccttctaatgagggccttatcaatctctgtggtctagaggggagcttcc

SEQ ID NO: 99649 - DNA, 201 bp, Bos taurus; identical to SEQ ID NO: 18287

SEQ ID NO: 99650 - DNA, 201 bp, Bos taurus; identical to SEQ ID NO: 18290

SEQ ID NO: 99651 - DNA, 201 bp, Bos taurus; identical to SEQ ID NO: 18291

SEQ ID NO: 99652 - DNA, 201 bp, Bos taurus; identical to SEQ ID NO: 18293

SEQ ID NO: 99653 - DNA, 201 bp, Bos taurus; identical to SEQ ID NO: 18294

SEQ ID NO: 99654 - DNA, 201 bp, Bos taurus; identical to SEQ ID NO: 18295

SEQ ID NO: 99655 - DNA, 201 bp, Bos taurus; identical to SEQ ID NO: 18296

SEQ ID NO: 99656 - DNA, 201 bp, Bos taurus; identical to SEQ ID NO: 18297

SEQ ID NO: 99657 - DNA, 201 bp, Bos taurus; identical to SEQ ID NO: 18298

SEQ ID NO: 99658 - DNA, 201 bp, Bos taurus; identical to SEQ ID NO: 18299

SEQ ID NO: 99659 - DNA, 201 bp, Bos taurus; identical to SEQ ID NO: 18300

SEQ ID NO: 99660 - DNA, 201 bp, Bos taurus; identical to SEQ ID NO: 18301

SEQ ID NO: 99661 - DNA, 201 bp, Bos taurus; identical to SEQ ID NO: 18302

SEQ ID NO: 99662 - DNA, 201 bp, Bos taurus; identical to SEQ ID NO: 18303

SEQ ID NO: 99663 - DNA, 201 bp, Bos taurus
cccgtctgggcttgaggtccaggggatggccttgacggggctctggaaaggaacagcctccaccaagcccaagtccgatggcaaatctggggcccttcacagaggaaattcctcagcctcaccgggtggtaacagaagacctgaaaacagtccacagggtctgccgtgaggacttgactgacatggagaatcagccagaag

SEQ ID NO: 99664 - DNA, 201 bp, Bos taurus; identical to SEQ ID NO: 18315

SEQ ID NO: 99665 - DNA, 201 bp, Bos taurus; identical to SEQ ID NO: 18316

SEQ ID NO: 99666 - DNA, 201 bp, Bos taurus; identical to SEQ ID NO: 18317

SEQ ID NO: 99667 - DNA, 201 bp, Bos taurus; identical to SEQ ID NO: 18318

SEQ ID NO: 99668 - DNA, 201 bp, Bos taurus; identical to SEQ ID NO: 18319

SEQ ID NO: 99669 - DNA, 201 bp, Bos taurus; identical to SEQ ID NO: 18320

SEQ ID NO: 99670 - DNA, 201 bp, Bos taurus
tgaatacttttcatgggatcttgaaagtaaacatggattataaaaattattcatatggtatataggactcaaaccaagtttggactctggttagcttcacagtttgcagttgttgtatattattctaacctcagcagatgagctgtcccagtaaagcatatagtagatttaaggaacagtggtatcttagtgaattatctc

SEQ ID NO: 99671 - DNA, 201 bp, Bos taurus; identical to SEQ ID NO: 18321

SEQ ID NO: 99672 - DNA, 201 bp, Bos taurus; identical to SEQ ID NO: 18322

SEQ ID NO: 99673 - DNA, 201 bp, Bos taurus; identical to SEQ ID NO: 18323

SEQ ID NO: 99674 - DNA, 201 bp, Bos taurus; identical to SEQ ID NO: 18324

SEQ ID NO: 99675 - DNA, 201 bp, Bos taurus
ataagaaaatattatttgatgtcacttcagagttagaactaccaagataacagaaagctggaagtcaatgaattgaccattccttccaatttcttaagtctttggtaatgttatttaactcataaaatacttgtgtactttaacaaataattaataggagggaagatcaataaggtggttgtgtttcagggctggatcaag

SEQ ID NO: 99676 - DNA, 201 bp, Bos taurus
tcattgtctgcttaaatcctttaacctaggttcaccatcaataccactgaaataatattgattgagaacttttgcataagagcctttagagatcagacagcttatatataccctctgatttaatctgtaaaatgaggataatgagacctaatagagattatttggaggatatatacatttatatgtaaatgtagatttaca

SEQ ID NO: 99677 - DNA, 201 bp, Bos taurus; identical to SEQ ID NO: 18325

SEQ ID NO: 99678 - DNA, 201 bp, Bos taurus
gcataaatatggcctgattttaacttaattccttctttaaatgccttatctccaaatacagtcctatttgaagtatgggatttaggggtccaatagaagagttctatagaaatgggcctccctgatggctcagacagtaaagagtccacctgcaatgcaggaaggagatatgggtttgatttctgggtcaggaagatcccc

SEQ ID NO: 99679 - DNA, 201 bp, Bos taurus; identical to SEQ ID NO: 18326

SEQ ID NO: 99680 - DNA, 201 bp, Bos taurus; identical to SEQ ID NO: 18327

SEQ ID NO: 99681 - DNA, 201 bp, Bos taurus; identical to SEQ ID NO: 18328

SEQ ID NO: 99682 - DNA, 201 bp, Bos taurus
ttctagactgtgagtcattgtcaactgggagcatccatttcgtttttaataatgtagaagataaagcaaaatgtttgttgaatgagtgaataagtgataagcctttcttatattcatagacttttccccccttcaggttaggcattcagcattgtgagttttatcttgtgaacactactatgaatatgaagctgcagaata

SEQ ID NO: 99683 - DNA, 201 bp, Bos taurus
tcacacaattatgttagttttaggtgtaaaacatagtggttcaatattctgatagattgcacttcataaattattacaaatattggctatattacttattattacaacatatctgttttgtatatattatttattttatacatagttgtttgtatctcttaatcccataacactatctcaccccctctcagcttcaaatgt

SEQ ID NO: 99684 - DNA, 201 bp, Bos taurus
attgagataaatactgttgaaataaagtgtaaacctatgaaactgatgccaggggttagaagcaccacccagaggatgtgacaaaccaaccaagttgcccaggggctgggtcaaagctagggggcatgggtgacaatacccatgtgacaatggacacatgtgacaatggacacattccaggcagattgtattggagagaga

SEQ ID NO: 99685 - DNA, 201 bp, Bos taurus
tgacaactcaaaatgtcagccatatgattccaaacccaaatgtgaacagctgaggccgtactggaggcttgttcaaagccaaaccaaagaagacaggtccatttagacatgatccctattacttggcaagaatattgattataggacaaaccgaaagaacattgtctatatttctttttgtggaatcctccgaatcctagt

SEQ ID NO: 99686 - DNA, 201 bp, Bos taurus; identical to SEQ ID NO: 18330

SEQ ID NO: 99687 - DNA, 201 bp, Bos taurus; identical to SEQ ID NO: 18331

SEQ ID NO: 99688 - DNA, 201 bp, Bos taurus; identical to SEQ ID NO: 18332

SEQ ID NO: 99689 - DNA, 201 bp, Bos taurus; identical to SEQ ID NO: 18333

SEQ ID NO: 99690 - DNA, 201 bp, Bos taurus
ctttgaaatagtcacaaatggggagaaagattgacacttaaatttactaaaagtattaatctattaaagccattgacagtttatgcccaccagataacttgaggaaattttttaggctttttttttagctaataaatagatgtctgtaaaattttacaaataatataggatagaacatgaagatatattatcttataattt

SEQ ID NO: 99691 - DNA, 201 bp, Bos taurus; identical to SEQ ID NO: 18334

SEQ ID NO: 99692 - DNA, 201 bp, Bos taurus
tgcataaatatgttaatatcctttggagaataaggcttatgcatatggattgagatccattattcaaaagacaggtataataatgaagtgatgtagaaagacttagtattagaaaggtcttgaatagagtttctgtgtcctgtctcttatatgttacaaggccctttattcactgtaacaaaatttatgattctttgttgc

SEQ ID NO: 99693 - DNA, 201 bp, Bos taurus; identical to SEQ ID NO: 18335

SEQ ID NO: 99694 - DNA, 201 bp, Bos taurus; identical to SEQ ID NO: 18336

SEQ ID NO: 99695 - DNA, 201 bp, Bos taurus; identical to SEQ ID NO: 58944

SEQ ID NO: 99696 - DNA, 201 bp, Bos taurus; identical to SEQ ID NO: 18337

SEQ ID NO: 99697 - DNA, 201 bp, Bos taurus; identical to SEQ ID NO: 18338

SEQ ID NO: 99698 - DNA, 201 bp, Bos taurus
actgggtttacttagtgatgcattttccaaaatgttatccatggagcaatccttctttagaatgttatgtatttcatggggaaaaaattagttccatattaaaagtgattttaatgctacatttttaataactttatttgtttatgtttggctgtgctgggtcttcagtgcttcaggggcttttttgctggtcgtggtgag

SEQ ID NO: 99699 - DNA, 201 bp, Bos taurus; identical to SEQ ID NO: 18339

SEQ ID NO: 99700 - DNA, 201 bp, Bos taurus; identical to SEQ ID NO: 18340

SEQ ID NO: 99701 - DNA, 201 bp, Bos taurus
aagtccctgcagagggcccattgtcaggcttgggggttgcagaaatttgcatatcatcaattattatctaaattatacagtattcaaagtaaccatttttggtgacaacttctggcctatgttgaacagctatgtattaatgtgttagaagtatgtttgtgtgtgtgtgtgtgtgtgtattgggatgaatattaaaaaaaa

SEQ ID NO: 99702 - DNA, 201 bp, Bos taurus; identical to SEQ ID NO: 18341

SEQ ID NO: 99703 - DNA, 201 bp, Bos taurus
tctgaccagcgccagctctggaggataaatggagctcctgaggggttgtagaatccatgaatgtttagtgggcatagaatctggatcatattgagaaaaatcttactagtactgagatctgaaaggaaagccagtggacctaatcaaagagttcaagtatatattaaaaaataaattttattatttttaggctgagagcta

SEQ ID NO: 99704 - DNA, 201 bp, Bos taurus
aaatgcctctacatgtggtttctgtttgaaaagagaaaactgacatttgaacaggacttttaatttgttcacatctcttatcattgcttttaaaacagtaggaaagagtaattcttattttagaaaaagtaacagaagcagtccagcaaagttatatattcctttttctgataagcatcatatatgatcctagatatgcta

SEQ ID NO: 99705 - DNA, 201 bp, Bos taurus
tttgaaaggcagaagagaggccatggctgtcactttctgagggtctttttggagtcccgtgtagtgaaggatgggcaaagcttatcctcactctgctctgcatccagacaactggccatgctgaccagcagccccgagccccttgccagataccaggctacagacccacagcagaaacaaaggccagagctccctgaaaac

SEQ ID NO: 99706 - DNA, 201 bp, Bos taurus
gtgtacttcctcatgtggtatcacatgaaatacatagaaccacctgtgaagtatccacgtcaaaaatgttagctctgtatttaatcaagtctttataactaaattctagttacagaaagatagatgatagaaaacaaattggaaaaaaaatcagcaagttatgaactgttatggaacaactgacccaggtcactgcttgag

SEQ ID NO: 99707 - DNA, 201 bp, Bos taurus; identical to SEQ ID NO: 18342

SEQ ID NO: 99708 - DNA, 201 bp, Bos taurus; identical to SEQ ID NO: 18343

SEQ ID NO: 99709 - DNA, 201 bp, Bos taurus; identical to SEQ ID NO: 18344

SEQ ID NO: 99710 - DNA, 201 bp, Bos taurus
atagtggtgtgtatatatcaatctcaatctcctagtcattctctccccccagtcttctccttctatacatcaggaattgtgaatgatctgagatttttactccgcttgctaactgacaagctggtctggtacaagttcaaagattttgatggaaatatggggatcctatgtagagccaagggaatccattactcgaagaac

SEQ ID NO: 99711 - DNA, 201 bp, Bos taurus
aagcctagagaatcaaggtaccagacatgtgaaggaacatgccatcttggaattggatcctagccatcccaccaccccagccatctcatttgtgtcagagctgaaccactgtgacaagcacatctcaaaaactatactcaaaactgtaagcaaaataaaatggttgttttagacaacttagttttgtgatactttgaaaag

SEQ ID NO: 99712 - DNA, 201 bp, Bos taurus; identical to SEQ ID NO: 18347

SEQ ID NO: 99713 - DNA, 201 bp, Bos taurus
acactctggcagatgatgaaggacagggaaacctggcatgctgcagtccatgggtttgcagagctggacacagcgactgatcaacaacaacagattagtatcaacgtattttttttccactgtcagtcaagaaaacttaaaagcaaccacatctcagttgcaacaagaatacctgcatccatatcttggtttctaattcca

SEQ ID NO: 99714 - DNA, 201 bp, Bos taurus
aaaaacagaggattgtgctttgtcttacaatgtcctcctattgaagagaagaatatacctgctggttctactagctgtcattctgccagcacagcagagacgcacagtatatacaacataaatttctgtctgtatgtctatatttatactccacatcattccatgaaagattccagtatggtttacaggaaaatatgcttt

SEQ ID NO: 99715 - DNA, 201 bp, Bos taurus
tcactaaactctaatctctatttttcaatagattttgccttacaaaaacagctgaggttttagcaagagaatctaaatctattacaaaggtatgaaattatctcactgaaggaagggggtaaatgtcaccgaccaaagtaatttaggaaatgagtgaagtctgctaagagaaaagtaaaaggaactatatataagcactga

SEQ ID NO: 99716 - DNA, 201 bp, Bos taurus; identical to SEQ ID NO: 18348

SEQ ID NO: 99717 - DNA, 201 bp, Bos taurus; identical to SEQ ID NO: 18349

SEQ ID NO: 99718 - DNA, 201 bp, Bos taurus; identical to SEQ ID NO: 18350

SEQ ID NO: 99719 - DNA, 201 bp, Bos taurus; identical to SEQ ID NO: 18351

SEQ ID NO: 99720 - DNA, 201 bp, Bos taurus; identical to SEQ ID NO: 18352

SEQ ID NO: 99721 - DNA, 201 bp, Bos taurus; identical to SEQ ID NO: 18353

SEQ ID NO: 99722 - DNA, 201 bp, Bos taurus; identical to SEQ ID NO: 18354

SEQ ID NO: 99723 - DNA, 201 bp, Bos taurus; identical to SEQ ID NO: 18355

SEQ ID NO: 99724 - DNA, 201 bp, Bos taurus; identical to SEQ ID NO: 18356

SEQ ID NO: 99725 - DNA, 201 bp, Bos taurus; identical to SEQ ID NO: 18357

SEQ ID NO: 99726 - DNA, 201 bp, Bos taurus; identical to SEQ ID NO: 18358

SEQ ID NO: 99727 - DNA, 201 bp, Bos taurus; identical to SEQ ID NO: 18359

SEQ ID NO: 99728 - DNA, 201 bp, Bos taurus; identical to SEQ ID NO: 18360

SEQ ID NO: 99729 - DNA, 201 bp, Bos taurus
gataatagtttggcaatttctttaaaagttaaatacagacttaaatgattcaggtatttaggagtttacccaaatgaacagaaagcatctgtccacacaaggacctatacatgaatgcctgtaacagctttctttattttattgagtacagttgatttacaatgttctgttagtttctgctgtacagcaaagtgattcagt

SEQ ID NO: 99730 - DNA, 201 bp, Bos taurus; identical to SEQ ID NO: 18361

SEQ ID NO: 99731 - DNA, 201 bp, Bos taurus; identical to SEQ ID NO: 18362

SEQ ID NO: 99732 - DNA, 201 bp, Bos taurus
gcttcctcaagaacaagaccatggatcagaagttggtggaccctgagtaactggacatctgaaggctatcagtgaaccacacattttgtagctggaaagtaagtcctttattgaagaagaatctgagtgtggcatctctgtttgacatctaacttacacactgagaagaaaaaggcattcaatccaatagaaaattaggca

SEQ ID NO: 99733 - DNA, 201 bp, Bos taurus; identical to SEQ ID NO: 18363

SEQ ID NO: 99734 - DNA, 201 bp, Bos taurus; identical to SEQ ID NO: 18364

SEQ ID NO: 99735 - DNA, 201 bp, Bos taurus; identical to SEQ ID NO: 18365

SEQ ID NO: 99736 - DNA, 201 bp, Bos taurus; identical to SEQ ID NO: 18366

SEQ ID NO: 99737 - DNA, 201 bp, Bos taurus
tacatcaacatgaatcagccatgggtatacatatatcccctctctcttgaaacttcttcccacatcccaccccatcccatccctctaggttgtcatagagcactggatttgcgttccctacctcttaacagcacattcccattgggtatctatttaacatatggtaatgtatatgttaaaagatgcttactccttggaagg

SEQ ID NO: 99738 - DNA, 201 bp, Bos taurus; identical to SEQ ID NO: 18367

SEQ ID NO: 99739 - DNA, 201 bp, Bos taurus; identical to SEQ ID NO: 18368

SEQ ID NO: 99740 - DNA, 201 bp, Bos taurus; identical to SEQ ID NO: 18369

SEQ ID NO: 99741 - DNA, 201 bp, Bos taurus; identical to SEQ ID NO: 18370

SEQ ID NO: 99742 - DNA, 201 bp, Bos taurus; identical to SEQ ID NO: 18371

SEQ ID NO: 99743 - DNA, 201 bp, Bos taurus; identical to SEQ ID NO: 18372

SEQ ID NO: 99744 - DNA, 201 bp, Bos taurus; identical to SEQ ID NO: 18373

SEQ ID NO: 99745 - DNA, 201 bp, Bos taurus; identical to SEQ ID NO: 18374

SEQ ID NO: 99746 - DNA, 201 bp, Bos taurus; identical to SEQ ID NO: 18375

SEQ ID NO: 99747 - DNA, 201 bp, Bos taurus
gtattcactcctaagaacaacaaagcagcattattgtccattgcccatataccatccatggtatcaatttatggaacataggaaataagggtggggcagacattattttagacaaagaagagaatttagcctcgccacatggtgccttacaaaatattttttttaattatgatcagcactgtcatatcaagtgcttattta

SEQ ID NO: 99748 - DNA, 201 bp, Bos taurus
tctatcttttgccaggcctttcttctcctttcttttatggcctgcacttttaatgacaacatttcgtgatttcttgatttccgagggttctgctgtgctaaccctccgctctggccaaccttccttccctagtgcccgcgcgggaaagactaggcccgactgcccgagcgcagggtgccggtgccgggcgtgggattctag

SEQ ID NO: 99749 - DNA, 201 bp, Bos taurus; identical to SEQ ID NO: 18376

SEQ ID NO: 99750 - DNA, 201 bp, Bos taurus; identical to SEQ ID NO: 18377

SEQ ID NO: 99751 - DNA, 201 bp, Bos taurus; identical to SEQ ID NO: 18378

SEQ ID NO: 99752 - DNA, 201 bp, Bos taurus; identical to SEQ ID NO: 18379

SEQ ID NO: 99753 - DNA, 201 bp, Bos taurus; identical to SEQ ID NO: 18380

SEQ ID NO: 99754 - DNA, 201 bp, Bos taurus; identical to SEQ ID NO: 18381

SEQ ID NO: 99755 - DNA, 201 bp, Bos taurus; identical to SEQ ID NO: 18382

SEQ ID NO: 99756 - DNA, 201 bp, Bos taurus; identical to SEQ ID NO: 18383

SEQ ID NO: 99757 - DNA, 201 bp, Bos taurus
cataaacctcccttgttatggtgggggccataacaagagaggtttacagggacttggagggatccatccatagtcaagtttgggcaaaggtcctggggaggtggccttaacccccaaacagagcatattgtacgtttgttgttcatcttggagcctggggttggaagactatagtcacagatgtatcagtgtcccccacca

SEQ ID NO: 99758 - DNA, 201 bp, Bos taurus; identical to SEQ ID NO: 18384

SEQ ID NO: 99759 - DNA, 201 bp, Bos taurus
cacagggtagtcacctcctgactatcttctctttctgtggtaagactggaattttgtctcactcatgttagaagatataggccagagaattaactgaatcattttataccctagtctaaagttattgaggggtgagtttgtgaggagttattaaaaaaactaagatcatggcatctggccccatctcttcagcaaatagat

SEQ ID NO: 99760 - DNA, 201 bp, Bos taurus; identical to SEQ ID NO: 18385

SEQ ID NO: 99761 - DNA, 201 bp, Bos taurus; identical to SEQ ID NO: 18386

SEQ ID NO: 99762 - DNA, 201 bp, Bos taurus; identical to SEQ ID NO: 18387

SEQ ID NO: 99763 - DNA, 201 bp, Bos taurus; identical to SEQ ID NO: 18388

SEQ ID NO: 99764 - DNA, 201 bp, Bos taurus; identical to SEQ ID NO: 18390

SEQ ID NO: 99765 - DNA, 201 bp, Bos taurus
agtttttatagctgttctacttaagatctctctataaactccagtgtcttcttgagcctttctcttcacattaacttcattgttgtgtgatgtgaacatagtattacagaatctaagtgtggagatcttttgatgattatagggaaagggttgttgtgtgaggaatcaaccagagagaatggaaacaaattgatagttgct

SEQ ID NO: 99766 - DNA, 201 bp, Bos taurus
gagtaaagatatccttaatctagaataagaatttgtatacatcttatacttccaaagcagcaatccacaaaatcacctctgtgatccttatatgtagttatgagatacataaggaatttaactatataattagatgccatgtagttaaactttaaacctgattttattatataaaattttatagaaatggtcaagcaaata

SEQ ID NO: 99767 - DNA, 201 bp, Bos taurus
catttccaaccagctcccaggtgaagctgatgatgctgatgggaacttcacatttgcagaaccactgatccagaaaacagaagattgttttacttagcaaatttctttgctatgctacaggaaacaggaattggagacttgagatttaggttctgactgttagattttagttctggtacctaaaaacagtttgtattattt

SEQ ID NO: 99768 - DNA, 201 bp, Bos taurus; identical to SEQ ID NO: 18391

SEQ ID NO: 99769 - DNA, 201 bp, Bos taurus; identical to SEQ ID NO: 18392

SEQ ID NO: 99770 - DNA, 201 bp, Bos taurus; identical to SEQ ID NO: 18393

SEQ ID NO: 99771 - DNA, 201 bp, Bos taurus; identical to SEQ ID NO: 18394

SEQ ID NO: 99772 - DNA, 201 bp, Bos taurus; identical to SEQ ID NO: 18395

SEQ ID NO: 99773 - DNA, 201 bp, Bos taurus; identical to SEQ ID NO: 18396

SEQ ID NO: 99774 - DNA, 201 bp, Bos taurus; identical to SEQ ID NO: 18397

SEQ ID NO: 99775 - DNA, 201 bp, Bos taurus; identical to SEQ ID NO: 18398

SEQ ID NO: 99776 - DNA, 201 bp, Bos taurus; identical to SEQ ID NO: 18399

SEQ ID NO: 99777 - DNA, 201 bp, Bos taurus; identical to SEQ ID NO: 18400

SEQ ID NO: 99778 - DNA, 201 bp, Bos taurus; identical to SEQ ID NO: 18401

SEQ ID NO: 99779 - DNA, 201 bp, Bos taurus; identical to SEQ ID NO: 18402

SEQ ID NO: 99780 - DNA, 201 bp, Bos taurus; identical to SEQ ID NO: 18403

SEQ ID NO: 99781 - DNA, 201 bp, Bos taurus; identical to SEQ ID NO: 18405

SEQ ID NO: 99782 - DNA, 201 bp, Bos taurus; identical to SEQ ID NO: 18406

SEQ ID NO: 99783 - DNA, 201 bp, Bos taurus; identical to SEQ ID NO: 18407

SEQ ID NO: 99784 - DNA, 201 bp, Bos taurus; identical to SEQ ID NO: 18408

SEQ ID NO: 99785 - DNA, 201 bp, Bos taurus; identical to SEQ ID NO: 18409

SEQ ID NO: 99786 - DNA, 201 bp, Bos taurus; identical to SEQ ID NO: 18410

SEQ ID NO: 99787 - DNA, 201 bp, Bos taurus; identical to SEQ ID NO: 18413

SEQ ID NO: 99788 - DNA, 201 bp, Bos taurus; identical to SEQ ID NO: 18414

SEQ ID NO: 99789 - DNA, 201 bp, Bos taurus; identical to SEQ ID NO: 18415

SEQ ID NO: 99790 - DNA, 201 bp, Bos taurus; identical to SEQ ID NO: 18416

SEQ ID NO: 99791 - DNA, 201 bp, Bos taurus; identical to SEQ ID NO: 18417

SEQ ID NO: 99792 - DNA, 201 bp, Bos taurus; identical to SEQ ID NO: 18418

SEQ ID NO: 99793 - DNA, 201 bp, Bos taurus; identical to SEQ ID NO: 18419

SEQ ID NO: 99794 - DNA, 201 bp, Bos taurus; identical to SEQ ID NO: 18420

SEQ ID NO: 99795 - DNA, 201 bp, Bos taurus; identical to SEQ ID NO: 18421

SEQ ID NO: 99796 - DNA, 201 bp, Bos taurus; identical to SEQ ID NO: 18422

SEQ ID NO: 99797 - DNA, 201 bp, Bos taurus; identical to SEQ ID NO: 18423

SEQ ID NO: 99798 - DNA, 201 bp, Bos taurus; identical to SEQ ID NO: 18424

SEQ ID NO: 99799 - DNA, 201 bp, Bos taurus; identical to SEQ ID NO: 18425

SEQ ID NO: 99800 - DNA, 201 bp, Bos taurus; identical to SEQ ID NO: 18426

SEQ ID NO: 99801 - DNA, 201 bp, Bos taurus; identical to SEQ ID NO: 18427

SEQ ID NO: 99802 - DNA, 201 bp, Bos taurus; identical to SEQ ID NO: 18428

SEQ ID NO: 99803 - DNA, 201 bp, Bos taurus; identical to SEQ ID NO: 18429

SEQ ID NO: 99804 - DNA, 201 bp, Bos taurus; identical to SEQ ID NO: 18430

SEQ ID NO: 99805 - DNA, 201 bp, Bos taurus; identical to SEQ ID NO: 18431

SEQ ID NO: 99806 - DNA, 201 bp, Bos taurus; identical to SEQ ID NO: 18432

SEQ ID NO: 99807 - DNA, 201 bp, Bos taurus; identical to SEQ ID NO: 18433

SEQ ID NO: 99808 - DNA, 201 bp, Bos taurus; identical to SEQ ID NO: 18434

SEQ ID NO: 99809 - DNA, 201 bp, Bos taurus; identical to SEQ ID NO: 18435

SEQ ID NO: 99810 - DNA, 201 bp, Bos taurus; identical to SEQ ID NO: 18436

SEQ ID NO: 99811 - DNA, 201 bp, Bos taurus; identical to SEQ ID NO: 18437

SEQ ID NO: 99812 - DNA, 201 bp, Bos taurus; identical to SEQ ID NO: 18438

SEQ ID NO: 99813 - DNA, 201 bp, Bos taurus; identical to SEQ ID NO: 18439

SEQ ID NO: 99814 - DNA, 201 bp, Bos taurus; identical to SEQ ID NO: 18440

SEQ ID NO: 99815 - DNA, 201 bp, Bos taurus; identical to SEQ ID NO: 18441

SEQ ID NO: 99816 - DNA, 201 bp, Bos taurus; identical to SEQ ID NO: 18442

SEQ ID NO: 99817 - DNA, 201 bp, Bos taurus; identical to SEQ ID NO: 18443

SEQ ID NO: 99818 - DNA, 201 bp, Bos taurus; identical to SEQ ID NO: 18444

SEQ ID NO: 99819 - DNA, 201 bp, Bos taurus; identical to SEQ ID NO: 18445

SEQ ID NO: 99820 - DNA, 201 bp, Bos taurus; identical to SEQ ID NO: 18446

SEQ ID NO: 99821 - DNA, 201 bp, Bos taurus; identical to SEQ ID NO: 18447

SEQ ID NO: 99822 - DNA, 201 bp, Bos taurus; identical to SEQ ID NO: 18448

SEQ ID NO: 99823 - DNA, 201 bp, Bos taurus; identical to SEQ ID NO: 18449

SEQ ID NO: 99824 - DNA, 201 bp, Bos taurus; identical to SEQ ID NO: 18450

SEQ ID NO: 99825 - DNA, 201 bp, Bos taurus; identical to SEQ ID NO: 18451

SEQ ID NO: 99826 - DNA, 201 bp, Bos taurus; identical to SEQ ID NO: 18452

SEQ ID NO: 99827 - DNA, 201 bp, Bos taurus; identical to SEQ ID NO: 18453

SEQ ID NO: 99828 - DNA, 201 bp, Bos taurus; identical to SEQ ID NO: 18454

SEQ ID NO: 99829 - DNA, 201 bp, Bos taurus; identical to SEQ ID NO: 18455

SEQ ID NO: 99830 - DNA, 201 bp, Bos taurus; identical to SEQ ID NO: 18456

SEQ ID NO: 99831 - DNA, 201 bp, Bos taurus; identical to SEQ ID NO: 18457

SEQ ID NO: 99832 - DNA, 201 bp, Bos taurus; identical to SEQ ID NO: 18458

SEQ ID NO: 99833 - DNA, 201 bp, Bos taurus; identical to SEQ ID NO: 18459

SEQ ID NO: 99834 - DNA, 201 bp, Bos taurus; identical to SEQ ID NO: 18460

SEQ ID NO: 99835 - DNA, 201 bp, Bos taurus; identical to SEQ ID NO: 18463

SEQ ID NO: 99836 - DNA, 201 bp, Bos taurus; identical to SEQ ID NO: 18465

SEQ ID NO: 99837 - DNA, 201 bp, Bos taurus
atacttcccagttctaatatctatacttatggaatcctggccctataccctcatcctgaaagagagtgttaggtagctagttggatattagcagatcccaacccaagctggatggggtcatctttctctgttccctcacaatcccccaacaccagtgataagaacatacccagaaattctcctttttagtcaaggaccacc

SEQ ID NO: 99838 - DNA, 201 bp, Bos taurus
tggtagattcattgcagtttatcaacacacatatatacagagacaatccaacagtttaagtaacatgctccttacgcgtttatgctggatccaaactctttgttcttcatgtttctggggtttatatttgttcagtctcaggctttattgattcccttccctaattctgttgatggtttaatgatggattaatctgcttta

SEQ ID NO: 99839 - DNA, 201 bp, Bos taurus; identical to SEQ ID NO: 18467

SEQ ID NO: 99840 - DNA, 201 bp, Bos taurus; identical to SEQ ID NO: 18468

SEQ ID NO: 99841 - DNA, 201 bp, Bos taurus
taagagaactgcattgctcaaagtgtggtccctggaccagttgcatatctatcatctaggagctagttaaacatagggttttgttatgacttcactgagccgtaagtacttttgtcttcatggacctcttcctccataaagaaaactgaaaactatatttctatgactctgctaatataaagacagacatattaatattat

SEQ ID NO: 99842 - DNA, 201 bp, Bos taurus
tactgctggctgccattaaggaagttttagcaaaaacatccacatttttgttgcttggtcaggaaaaccttgtttcatttatacagcatttctctctcctggggacacattctgtattcatttccctgagatggtccacttaaggaaaagtaaactgaaggaaagtcatctagaaaacaaatcggccggcagtcagcctat

SEQ ID NO: 99843 - DNA, 201 bp, Bos taurus
ctctgtgataaggaagcaatgacatccagacgaccagaagactagtaggaccttctccttatgcaaataagaaaagccctaaaaggccaaaggaatttccccaaatctcaaaacgactcagtgacaggcaggaattactccctgcttggtagcctgccacctcctgaatacgtaactttggccaaaaaactcaacttctcc

SEQ ID NO: 99844 - DNA, 201 bp, Bos taurus
tgacatagctaaatttctcaggagtatgtgtcttctctaatgcagaaaacaaaccccttagcaaaccagcgccctcagatattgcagtaatcatgtacacaagtggatccacaggaattccaaagggggtcatgatctctcatagtaacattattgctggtataactgggatggcggaaaggattccagaactcgggtatg

SEQ ID NO: 99845 - DNA, 201 bp, Bos taurus; identical to SEQ ID NO: 18471

SEQ ID NO: 99846 - DNA, 201 bp, Bos taurus; identical to SEQ ID NO: 18472

SEQ ID NO: 99847 - DNA, 201 bp, Bos taurus; identical to SEQ ID NO: 18473

SEQ ID NO: 99848 - DNA, 201 bp, Bos taurus
agcttatttggagaaaggatcattgcaaatttaattaaattaaggattttgagataagatcatcccaggttatctgtgtgggccctaaatccaaagacacatgcttttataagagacactcagagaaaatgctcagaagaggaggcagtgtgaccacacagtcagtgatgtgaagtgatgtggccacaagccaagaacacc

SEQ ID NO: 99849 - DNA, 201 bp, Bos taurus
tctttctgagctccagatcaggtgcccttggattttcaccaaatctaatgaatccatagggtcaacaccctgacttcagtagtttcttgagggaagaacactggccatagccttcctggaagttaatgcagaactaaaatcattgccttgattttgagatttaagaaacttaattttctttctttttttttggtgagtcaa

SEQ ID NO: 99850 - DNA, 201 bp, Bos taurus
tcagacaccactgaagtgactggacacgcacgcatttatttagcaagtgcaagaaccagataactgagctacatactttttattcaaacctttgaaagatgaataggaagtagtgaggccaggatttgcagttagatctgtctcactctacagctcaacattgcacagagacatatctcctccaaattgccactggagata

SEQ ID NO: 99851 - DNA, 201 bp, Bos taurus
attatgctggaacatcatgcatcaataaaacaccaagatatggcacatgattgaaaacaataacattttggaataaggtatttttatgtttgttaagattcagtgatttcccaaagaacatattgccggctttcctttggttcaagatagtagtagtctgtctggtcagatttttttcccattccccacttagatgaaaat

SEQ ID NO: 99852 - DNA, 201 bp, Bos taurus
ccaaccaaatctcctttgcttttcacaatattcaagacacatttcagtgtttcagcctgttttctccttcctagtaattgtctttctctatcatatcacacgaactccttcatgagtttcaagtctgtccaaatatcatgtttactcctgaggcccacgctgaatattccacgtaaaatcacagccctccttaacacacat

SEQ ID NO: 99853 - DNA, 201 bp, Bos taurus
tgtagaattgttgaaacttggtaacccttcccatccagagtaaatctgacactttactattacattaggctgttatacagttagagtagaagctgtgactgtctcctctgctcatctcttaggtcactggcttgttgcctttctaagtatgggaccttgctcaaagtgagtatggagaggaacaaaactgggagaaaccag

SEQ ID NO: 99854 - DNA, 201 bp, Bos taurus
agcgtaagctcccacctcagggccttacttggcatttgctgagatgactttccttaagacatatatgatttactcactccctgagttttttcaggtttttggtcaaaggaatcaactctaaaaggcctcccatatcctccccccacctaacagtacactcactgactgtgctgaattgtgtatagtttctgtctgttatca

SEQ ID NO: 99855 - DNA, 201 bp, Bos taurus
ttcatctatgtattctttatgactgcttttgattctgcaatggtagagttgagaagctgccacagagactgtctggcccacaaagtctaatatttatgtccggtcctttgtaggagaagtctgtggacccaccccacactgtggtgagcagcccagttctggagttggatgcacatggactggaattccaacctctggcct

SEQ ID NO: 99856 - DNA, 201 bp, Bos taurus
tctaccttttcaatccaaaggtcagtattaatttttagagtgtgagtcccaggaaataaaacaagtatctaagaaacaactgggcctaggggcccaaaggcgtgaaaacataacttcaaaagtaacacaaaagtattagcctctttccgtctctgttttgtttgtcttattgaaggacatcatagagcaaggaaagaagat

SEQ ID NO: 99857 - DNA, 201 bp, Bos taurus; identical to SEQ ID NO: 18474

SEQ ID NO: 99858 - DNA, 201 bp, Bos taurus; identical to SEQ ID NO: 18475

SEQ ID NO: 99859 - DNA, 201 bp, Bos taurus; identical to SEQ ID NO: 18476

SEQ ID NO: 99860 - DNA, 201 bp, Bos taurus
gcctaaaaggattgagttataaaacatttaagggacttctttatcatgtaaattccacctttgtaatgcaaatcccattgtacggcccctgccaggagaatgagagcaatattaatttacttactgtttaattattctcctctctccaacagcccctgggatgatgtaaggattccagggccaagaagagaatcttccact

SEQ ID NO: 99861 - DNA, 201 bp, Bos taurus; identical to SEQ ID NO: 18477

SEQ ID NO: 99862 - DNA, 201 bp, Bos taurus
aagctaagaggcaggccaataaataatatttaagaaaaaggaggcggtccagcctgtctacagtcagaggctgagtgggagaggaaagggagaaacaattcaaaacagaagtcggggccaattcatggaaggctttgaaagccaagaaaatgaaagtttccattgtatcatgaaagttatggaaaaccactgaaggatttt

SEQ ID NO: 99863 - DNA, 201 bp, Bos taurus; identical to SEQ ID NO: 18478

SEQ ID NO: 99864 - DNA, 201 bp, Bos taurus; identical to SEQ ID NO: 59075

SEQ ID NO: 99865 - DNA, 201 bp, Bos taurus; identical to SEQ ID NO: 18479

SEQ ID NO: 99866 - DNA, 201 bp, Bos taurus
taatcttgaatttattttttgttactatgtttgaagggagtattggtacctcacgccttaccttggtaatacatttcctggagcctcaaagttcatctgctgtagtgaaagttgctcagttgtgtctgactctttgtgaccccatgaactatacagtccatggaattctccaggccagaagactgagtgggtaacctttac

SEQ ID NO: 99867 - DNA, 201 bp, Bos taurus
tgaacctgggaagctgtcccactctgttgccacctgaggttggccttttcagctttgctggcaaaatacaagctcacggccacggctggttagtgacggattcagctctatagaagaaatatagagtaagaaagaattttggtaggaaaaaaagaaacaagggagacgaagaaagcaggccacgcggaggaattggcatct

SEQ ID NO: 99868 - DNA, 201 bp, Bos taurus; identical to SEQ ID NO: 18480

SEQ ID NO: 99869 - DNA, 201 bp, Bos taurus
tttcaagctgctgtatttgtgataatctgttattgtagcgatagaaaaagaatccattttactaaattattgggcagaaaaagtggggtaaaattcattgtcaaagcacatagcttacagcctggagaagagcagatcctcagcaaccttgctgtccttttcagtgtgtgcgtgctcagtctcttcagtcatgtctgactc

SEQ ID NO: 99870 - DNA, 201 bp, Bos taurus; identical to SEQ ID NO: 18481

SEQ ID NO: 99871 - DNA, 201 bp, Bos taurus; identical to SEQ ID NO: 18482

SEQ ID NO: 99872 - DNA, 201 bp, Bos taurus; identical to SEQ ID NO: 18483

SEQ ID NO: 99873 - DNA, 201 bp, Bos taurus; identical to SEQ ID NO: 18484

SEQ ID NO: 99874 - DNA, 201 bp, Bos taurus
catgaatgagatttttcagacgattgtccaggtgttaaaccctatagtacaaaagacaatttgaaagggaaagaacatgtgagaaggaatagtgaatcacgctgataaaataagcctctttattaaaatcaagtttgatcaggaaagtaatagactactcttctagaaatcatggaggtatctacgttaccatgttaccat

SEQ ID NO: 99875 - DNA, 201 bp, Bos taurus
cctactgtttttcaagtatgttggaagcccagcacactcagtaccccaacatgcagcagtaatattatatttgcaaagctaacttgcgggagggtgatatgtctactttgaaatgttccctctggtgattttaacatgtcatccttctttggtcaaggtttttactccttaggggtgactttatgattagcatttattgaa

SEQ ID NO: 99876 - DNA, 201 bp, Bos taurus
tcaatccccacatttatagatggtcaagtggccatggtatttataataaaaaagtgtccactgcaagctacatgtgactttgattccacatagaaaccccgactgtaagaagaatataattatatatcatcattgttgccaatatcttctcttagcttccacttgcccgcttaaaaatctacaatggtattttaaccaatt

SEQ ID NO: 99877 - DNA, 201 bp, Bos taurus; identical to SEQ ID NO: 18485

SEQ ID NO: 99878 - DNA, 201 bp, Bos taurus
ttgatggtggtaccttctttagtcgcttgattatatgactcttcactggcccaatgcaggcataatgcagttggtgatttttaacgtatgcaaatgttcacggctggtctgcttggctttgcaggcgtgctggaggccaggacagagatgcacagctcattctgtgtgaccacttaactttttttttttaagtaatttggt

SEQ ID NO: 99879 - DNA, 201 bp, Bos taurus; identical to SEQ ID NO: 18486

SEQ ID NO: 99880 - DNA, 201 bp, Bos taurus; identical to SEQ ID NO: 18487

SEQ ID NO: 99881 - DNA, 201 bp, Bos taurus
tattttaacaagcttctccaggtgatttctgattgagaagaactgttctaggcaaacatccaagaaactattctacagacagttaccagttaaggccaactaatattactccatccatagctctctttaaagtcgaaaatcacaagtgacctcaaggtcatctaattttactagtaagttaaagccttatattggtgctaa

SEQ ID NO: 99882 - DNA, 201 bp, Bos taurus
ctggcaaatgcatgccttcagtcaccaggacaaccagacaatagagtgtccatctaaatcagttgctatcattgagccttagatgaagctgaacaatgggcgagtcgtgttcatgctggaggtagccctctggtgctggtgctgtctgtccctaaaccattgataatccgagaacagttcttacttcgtaggacaagtgaa

SEQ ID NO: 99883 - DNA, 201 bp, Bos taurus
agtttatagaatcctataacctaatagttgaaaatggaccatggaagttacctagcacccaccactgaaagattttactttttaggtgtggaatcaagcatagagatgagagttaaagccttgacttcacactgccagttcatgacagaggtggtacttgaacattataattctgacttatttgttgactaggtttcacaa

SEQ ID NO: 99884 - DNA, 201 bp, Bos taurus
gtttcattttcagcagtagagcactggtgggcagaagaatacagaagaaatggcatgtcatgtacaggcacaaagagaacaagggcgggccctgaagttacgtcaaagaatttcaggaaagcaaaagcatttgtgaccatgattcggttttcaagttttttcaatatgtggattgtctgcagtggctggggtgtcttgttg

SEQ ID NO: 99885 - DNA, 201 bp, Bos taurus
caggctacagtccattggactgcaaagagtcggccatgactgagcgactaacactttttcactggtccataatggttgcagaagtagaggcttggggttcgctggccgattctggacctctgtctgtggtctgctttgtcttaacagtcacgttcctgtctcggaaactctgaaacagacctgcccctaagtgatttacag

SEQ ID NO: 99886 - DNA, 201 bp, Bos taurus; identical to SEQ ID NO: 18488

SEQ ID NO: 99887 - DNA, 201 bp, Bos taurus; identical to SEQ ID NO: 18489

SEQ ID NO: 99888 - DNA, 201 bp, Bos taurus
tgtgagtgtctccttgaagcctggccctggaagtccaggaggagtgaagagataccttggtaatcctctaatccataggtgacatcttttcttaaaaaatgttttttattttatttttggccatggtgagtcttcattgttgtacatgggtattttctagttgtggtgagcaggggctactctctagttgcagtgtgaggg

SEQ ID NO: 99889 - DNA, 201 bp, Bos taurus
tagtctccatctcttggcaggcaggaagattttgttttaaaacagagatttccttcagcatccctaaggcatctttatggagaatggggccatctaaccactaaatctgttaaagtgcctccgtcagcatcctcactagtgttttcttattctctctccctcctgaaacttcttacgtgaagattgtgatgcgtcagccaa

SEQ ID NO: 99890 - DNA, 201 bp, Bos taurus
agttcttaattgtggcaggtgggatgtttagttacagcctgagaactctcagctgtggcatatgggatctagttgtcagaccagggactgaacccaggcctcctgccttaggtgtgaagagtcttagccactggatcaccatggaactccccagtgctttgcattttgaaagatttttataccagtgtaagcattactatt

SEQ ID NO: 99891 - DNA, 201 bp, Bos taurus
gcatcactgattcaatggtcgtgattttgagcaaactccaggagataatgaaggacggggaagtctggcattctgctgtccgtccagagtcttaaagagttagacatgtcttagtgactgaacagcaacatttctacaacatgctgaatgacttcctcaaaagaaagcaatttaagagaaaattgcatatgagccatccat

SEQ ID NO: 99892 - DNA, 201 bp, Bos taurus; identical to SEQ ID NO: 18490

SEQ ID NO: 99893 - DNA, 201 bp, Bos taurus; identical to SEQ ID NO: 18491

SEQ ID NO: 99894 - DNA, 201 bp, Bos taurus; identical to SEQ ID NO: 18492

SEQ ID NO: 99895 - DNA, 201 bp, Bos taurus
ttgttgatttatacccatggttaattttacatttttatgttaacacagaaaagtttcttatcctttcaattgttgttgagagagctttctattgcttctcaaacagtaagatatatatatatacatatatatatatatatatgttaaataaatatatatgtgtgtgtgtgtgtgtatcagcacatatatatagttgtgttt

SEQ ID NO: 99896 - DNA, 201 bp, Bos taurus; identical to SEQ ID NO: 18493

SEQ ID NO: 99897 - DNA, 201 bp, Bos taurus; identical to SEQ ID NO: 18494

SEQ ID NO: 99898 - DNA, 201 bp, Bos taurus; identical to SEQ ID NO: 18495

SEQ ID NO: 99899 - DNA, 201 bp, Bos taurus; identical to SEQ ID NO: 18496

SEQ ID NO: 99900 - DNA, 201 bp, Bos taurus; identical to SEQ ID NO: 18497

SEQ ID NO: 99901 - DNA, 201 bp, Bos taurus; identical to SEQ ID NO: 18499

SEQ ID NO: 99902 - DNA, 201 bp, Bos taurus; identical to SEQ ID NO: 18500

SEQ ID NO: 99903 - DNA, 201 bp, Bos taurus; identical to SEQ ID NO: 18501

SEQ ID NO: 99904 - DNA, 201 bp, Bos taurus; identical to SEQ ID NO: 18505

SEQ ID NO: 99905 - DNA, 201 bp, Bos taurus; identical to SEQ ID NO: 18508

SEQ ID NO: 99906 - DNA, 201 bp, Bos taurus; identical to SEQ ID NO: 18509

SEQ ID NO: 99907 - DNA, 201 bp, Bos taurus
gtgctacagggtaaccacccttcatcttcatcccagtggaaatcaccatatccctgactggaataactgtagtatatagtgcttgacaatctccttccctggacgggaaggaagaacagttaggattaaagaactgtttttctgctcatcctgacccacagcaggttagagacactgagatcaaagcctggcacaccatgg

SEQ ID NO: 99908 - DNA, 201 bp, Bos taurus; identical to SEQ ID NO: 18511

SEQ ID NO: 99909 - DNA, 201 bp, Bos taurus; identical to SEQ ID NO: 18513

SEQ ID NO: 99910 - DNA, 201 bp, Bos taurus; identical to SEQ ID NO: 18514

SEQ ID NO: 99911 - DNA, 201 bp, Bos taurus
ctcctggaagacaaggtctgtgtctcgctcacctctgaatccttgacctagcgcagtgctcagttctgagcttgtgaccactaagcgtgggctgaatgcatgaatgagcagaaactagtgaacatcttgatgcataaagttttcccatgctgaagatggtctcctttgaacgggttcccagaagctgcagtgattggatta

SEQ ID NO: 99912 - DNA, 201 bp, Bos taurus
cacgtgatggtgatgagtttcatcaccctttgaccttccccacctggacgccgtcctactcttgctttcgacacacatgctcgctttgcacgtgctgctctattttccctagtcaaccaccaactcttcctcgcatggggacccacccaagaagtcttccctcacccttcaatccccacacaagtctggttagggttctcc

SEQ ID NO: 99913 - DNA, 201 bp, Bos taurus
ggtgtggtctgggcagggtgaccagtgtgggaggacgaggttggagggaggcaggcagagccaacggggagaacaagaaggccgatgtggatttatattcgacgctgcaggttgtgggagatggtttgatggaatcgcaagagggaaaaggacatggtcagatgtgcatcttgaaggcaaggcctaagtgcttgtcactcc

SEQ ID NO: 99914 - DNA, 201 bp, Bos taurus
ctccttgaggccaattccaaggagcttttctcagtcttcattttgattccttcaggaagcagattatattattgttcatgaatgttcactgctcctcctaacggggccctcccagtgagagaaatatatcccagtctccttggctgctgtatggccgggagacttgcttttgcaaataaaatgtgagtgcatgtgacctgt

SEQ ID NO: 99915 - DNA, 201 bp, Bos taurus
cctcagatagaaagatggtggcatagaggtcaagagtcaatccatgtatctgtcacttcatcccacaggcagtcatgctggaggccccatatgggcagaatacaaaacatggaaaacagcaggtgccaaagggtgtgagatgaatccagtgaaaatataatagcctgacaccacgttaaaatcctagagcatatggcctga

SEQ ID NO: 99916 - DNA, 201 bp, Bos taurus; identical to SEQ ID NO: 18515

SEQ ID NO: 99917 - DNA, 201 bp, Bos taurus
tgtcaatcccactgtgcagaggaacaaacagatgtgaagttaactgacttgcccaaggctatataaccaggcagtggtagaaccagagtccaggtgtcttaactcccacagttcagtgctctttctactacaacaaatgacaactggaggaaagttatttcaggcctaaaagggtaaaagtacaaactaacacataatgtg

SEQ ID NO: 99918 - DNA, 201 bp, Bos taurus; identical to SEQ ID NO: 18522

SEQ ID NO: 99919 - DNA, 201 bp, Bos taurus; identical to SEQ ID NO: 18523

SEQ ID NO: 99920 - DNA, 201 bp, Bos taurus; identical to SEQ ID NO: 18524

SEQ ID NO: 99921 - DNA, 201 bp, Bos taurus; identical to SEQ ID NO: 18525

SEQ ID NO: 99922 - DNA, 201 bp, Bos taurus; identical to SEQ ID NO: 18526

SEQ ID NO: 99923 - DNA, 201 bp, Bos taurus
cagctcagacttttccatgccaaccccttggctgggctgcttcttttaagctaacttgatgtctgtcctgatcacggggccccatcctggccctctgtcccagcccccctctcatgccacaattcaacacactgacaacctctttgacttccagttcatcccaccctccactctgccctgctgctgctaagtcgtgtcagt

SEQ ID NO: 99924 - DNA, 201 bp, Bos taurus
ggccctgacgtatcaggggtcagggaagtcttctctgaagaagcgccacttgggctgagaccaagaatgagtcaagaggaatgtatagtggccttctaccacctctctactcctcatgcgttgctctcgttctggtaagaccaccccagtttccctttgaaaacagctccctggctgttctcagcccgtccaggtgggctg

SEQ ID NO: 99925 - DNA, 201 bp, Bos taurus; identical to SEQ ID NO: 18529

SEQ ID NO: 99926 - DNA, 201 bp, Bos taurus; identical to SEQ ID NO: 18530

SEQ ID NO: 99927 - DNA, 201 bp, Bos taurus; identical to SEQ ID NO: 18531

SEQ ID NO: 99928 - DNA, 201 bp, Bos taurus
atctgcacctgaagcctcgcagaggcctccaaaatgatgtcttcgctgccagagtccctctccctgtttcatcagcacccaggtacctttcccaaacgcatggccctgttgaaacaagaaaaggcactgaggtcctgtggtccacatgttgaaatgaaaactctgtccccagcattccagacccctcctactctgaatcct

SEQ ID NO: 99929 - DNA, 201 bp, Bos taurus; identical to SEQ ID NO: 18532

SEQ ID NO: 99930 - DNA, 201 bp, Bos taurus; identical to SEQ ID NO: 18533

SEQ ID NO: 99931 - DNA, 201 bp, Bos taurus; identical to SEQ ID NO: 18534

SEQ ID NO: 99932 - DNA, 201 bp, Bos taurus; identical to SEQ ID NO: 18536

SEQ ID NO: 99933 - DNA, 201 bp, Bos taurus
gtttcccaaggtcactgaaagtgatacagggtctcagttgtagttacacagtatgagggagggaattccagctgtgacagacgtcgctgccgtattcactgccatattcatctatactctggctcctcccctcctgagagacagaaggcccatgcctagaactgtttctctcggaaatgtagggttggaaggaaatgcctg

SEQ ID NO: 99934 - DNA, 201 bp, Bos taurus
cccctggtttcggcatttttcgccatggtgccatgatgccacatgttttgtcctttaatgtcttcagtaggtaaactgaaattacacaggggcctcagtgggaacccgcatggctaaccccacttcaactcctgggctatttttcagaagagatgatctgggtctgtgtggggcccattcccgtataaaatctcagaatga

SEQ ID NO: 99935 - DNA, 201 bp, Bos taurus
aggagatctcacagacagttttcattacggagtgcaatgtttttactatatacaccaaagaaaaataactgcactcaacaatagggccttgaacttaaaatgttatctgagcaagcaaacctaaaattggttgaagacatggagactcacaactggatggccacagtgggcttaatccccatttcttggtaaataaatggc

SEQ ID NO: 99936 - DNA, 201 bp, Bos taurus
tgtggtataataaaaagtatatttggtctttttcctcaggtcctggcaaagagttcctaaaagccttagaatttcctgagtgataggagtgtcttttgttattcataaagggctcctttggagcatacagagtttacctattgaggtgacctaagccctgatggccttagggtgggcagggtttgtcaccggaaagaccaa

SEQ ID NO: 99937 - DNA, 201 bp, Bos taurus
ggcgggggcagcgggaagacagcctgagccatacccccagcggtgggagaggaagggtgtgggcaagccgagcagcagtgctgtgctgtgagatggccgtcctctcacatgtcacaggattgtgacaggttgtcctgtcacacatggcgggggaagcttgacatatctcacttgcaaaccaccagcacccactgaggcctc

SEQ ID NO: 99938 - DNA, 201 bp, Bos taurus; identical to SEQ ID NO: 18539

SEQ ID NO: 99939 - DNA, 201 bp, Bos taurus
acacacaggggctagttgaatctggccttggaaaagtccatctctggatgctgatccatgaacctgcagagacaaagcgggaaggtgggacaggccatccgtcccccaactttgcccctttctctcagcctccaacatgaggtctcatctgtttacaactctcagcaacctggagccatgccaggcaggagtggggccccc

SEQ ID NO: 99940 - DNA, 201 bp, Bos taurus; identical to SEQ ID NO: 18541

SEQ ID NO: 99941 - DNA, 201 bp, Bos taurus
cagcagccgcttgctgaccgggcaactgtcgggagaggcagcgtcccccatggttaggagcccaggcaaacactgattccccctttctggcttgtccagtgtgggtgtacatgctgggtctcatgatgaaaattcacgtgcattatttcattgtattctcacatcagtcataggaggacaatacttttgcccccctcctct

SEQ ID NO: 99942 - DNA, 201 bp, Bos taurus
gtcctcctctagtcactgcctgccaatgcatctctcatcagcttcaggaaccctgtctgctaaaatggaaaaggcagggccttagtcaagtctctggagcaggctgcttggtttgcgagccagctggagaaggacccgagcacctgcagacacaggtagctgtgttctgacacgcaggcctgcagaggaatggctgcctct

SEQ ID NO: 99943 - DNA, 201 bp, Bos taurus; identical to SEQ ID NO: 18542

SEQ ID NO: 99944 - DNA, 201 bp, Bos taurus; identical to SEQ ID NO: 18543

SEQ ID NO: 99945 - DNA, 201 bp, Bos taurus
gctctgtgcacctggaggcggccatctgtgacctacctgcttggtctttgggctccctgacccccctgctgggttcagccagagggaggcgctgctggaggggctccttgctcacctggcctgccatggtttgggcagtgtctgcattccttctgtgaggcacctcccttcccagagctattggcttcccgaaccatctcc

SEQ ID NO: 99946 - DNA, 201 bp, Bos taurus; identical to SEQ ID NO: 18544

SEQ ID NO: 99947 - DNA, 201 bp, Bos taurus; identical to SEQ ID NO: 18545

SEQ ID NO: 99948 - DNA, 201 bp, Bos taurus
gtctgtaagcggagttagtgaatttacacagaaaagaaatagcctagaaaatttgaaaaggtttttaaagatgacatattttatgtggcccttgtaaggaatatgcctatgggacagttctttcttcaggggaccatggtggtaataggctctacctactcatcacagttgatggcctccctagtcatcgatttggcagcg

SEQ ID NO: 99949 - DNA, 201 bp, Bos taurus
caggtagagaatgacaatgactggatataccgggggcccaggaagccatggctgtcgctgccatcattgttattagttttagagtcacagacaagagccagcctagaggatgctgagggcccggcccagctctgaaaatctaaatcctgtggttgcagctgggggagtgactccaggaggcacctggtaagaggtggctcc

SEQ ID NO: 99950 - DNA, 201 bp, Bos taurus; identical to SEQ ID NO: 18546

SEQ ID NO: 99951 - DNA, 201 bp, Bos taurus; identical to SEQ ID NO: 18551

SEQ ID NO: 99952 - DNA, 201 bp, Bos taurus; identical to SEQ ID NO: 18552

SEQ ID NO: 99953 - DNA, 201 bp, Bos taurus; identical to SEQ ID NO: 18553

SEQ ID NO: 99954 - DNA, 201 bp, Bos taurus
ccaaaccatggatcagcgtggacgccaccatggatgccggagtccagacccggggcaggggcaggcagccgggaggcaggcgagaggcccccctcccttcgtgggaggttccagggcaccacggctctgcggtggggctccaggcttgggtgggatgagttcacagctggccgcagctcctcctgagccgctgggaacaga

SEQ ID NO: 99955 - DNA, 201 bp, Bos taurus; identical to SEQ ID NO: 18555

SEQ ID NO: 99956 - DNA, 201 bp, Bos taurus; identical to SEQ ID NO: 18556

SEQ ID NO: 99957 - DNA, 201 bp, Bos taurus; identical to SEQ ID NO: 18557

SEQ ID NO: 99958 - DNA, 201 bp, Bos taurus; identical to SEQ ID NO: 18558

SEQ ID NO: 99959 - DNA, 201 bp, Bos taurus; identical to SEQ ID NO: 18559

SEQ ID NO: 99960 - DNA, 201 bp, Bos taurus; identical to SEQ ID NO: 18560

SEQ ID NO: 99961 - DNA, 201 bp, Bos taurus
ggccgagaagggcccttccccctgatcctgctgccccagtttgggggctactggattgaaggcaccaatcacgaaatcaccagcatcccagagacagagctgctgcagtcgcccacgaccaaggtgaagctggagtgcaaccacactgcccgcctctaccggaagcactttctcggcaaggtggggtggccctctgggctg

SEQ ID NO: 99962 - DNA, 201 bp, Bos taurus; identical to SEQ ID NO: 18562

SEQ ID NO: 99963 - DNA, 201 bp, Bos taurus; identical to SEQ ID NO: 18563

SEQ ID NO: 99964 - DNA, 201 bp, Bos taurus; identical to SEQ ID NO: 18564

SEQ ID NO: 99965 - DNA, 201 bp, Bos taurus; identical to SEQ ID NO: 18565

SEQ ID NO: 99966 - DNA, 201 bp, Bos taurus; identical to SEQ ID NO: 18566

SEQ ID NO: 99967 - DNA, 201 bp, Bos taurus; identical to SEQ ID NO: 18567

SEQ ID NO: 99968 - DNA, 201 bp, Bos taurus; identical to SEQ ID NO: 18568

SEQ ID NO: 99969 - DNA, 201 bp, Bos taurus; identical to SEQ ID NO: 18569

SEQ ID NO: 99970 - DNA, 201 bp, Bos taurus; identical to SEQ ID NO: 18570

SEQ ID NO: 99971 - DNA, 201 bp, Bos taurus; identical to SEQ ID NO: 18571

SEQ ID NO: 99972 - DNA, 201 bp, Bos taurus; identical to SEQ ID NO: 18572

SEQ ID NO: 99973 - DNA, 201 bp, Bos taurus; identical to SEQ ID NO: 18573

SEQ ID NO: 99974 - DNA, 201 bp, Bos taurus; identical to SEQ ID NO: 18574

SEQ ID NO: 99975 - DNA, 201 bp, Bos taurus; identical to SEQ ID NO: 18575

SEQ ID NO: 99976 - DNA, 201 bp, Bos taurus; identical to SEQ ID NO: 18576

SEQ ID NO: 99977 - DNA, 201 bp, Bos taurus; identical to SEQ ID NO: 18577

SEQ ID NO: 99978 - DNA, 201 bp, Bos taurus; identical to SEQ ID NO: 18583

SEQ ID NO: 99979 - DNA, 201 bp, Bos taurus
aatatgcaactgatatctctagtcaaagtgggaacaaaagggaacttctttatcctgataaacagtatataccaaaactaaaaaagagagagaaaaacgatagcaaacagaacactcactggtgaaagattagaaactagagttcacagccaacacactaggacaaacaggttttaaacgttttaaataaaagatacagac

SEQ ID NO: 99980 - DNA, 201 bp, Bos taurus; identical to SEQ ID NO: 18587

SEQ ID NO: 99981 - DNA, 201 bp, Bos taurus; identical to SEQ ID NO: 18589

SEQ ID NO: 99982 - DNA, 201 bp, Bos taurus; identical to SEQ ID NO: 18590

SEQ ID NO: 99983 - DNA, 201 bp, Bos taurus
gctcagtgggcatgattacaaatattttcacaattagacattttctcagctcacaccttaagtaaagatcctctggcagggtagaaggggtgcttaatacttgtggcccctcactcatgtagtaggaacaggatacttatagtttagataaagactcaaaaagaattaaatgatagagtcagggttaggtatgaggctcac

SEQ ID NO: 99984 - DNA, 201 bp, Bos taurus; identical to SEQ ID NO: 18592

SEQ ID NO: 99985 - DNA, 201 bp, Bos taurus; identical to SEQ ID NO: 18594

SEQ ID NO: 99986 - DNA, 201 bp, Bos taurus; identical to SEQ ID NO: 18596

SEQ ID NO: 99987 - DNA, 201 bp, Bos taurus
ctgcgattagacaccgcacagaaatattctaggaagggcatccctgggagttgatgatgaagtttacctctagcaaggccatgaggccatgccaggtcttcccaggttctgggtaccccatgggagcaccaccctaggctccaggagaagagaaagaactccaaggggccctctagctgcagccccccagtaaacagccca

SEQ ID NO: 99988 - DNA, 201 bp, Bos taurus
tgaagaccagtataatccaggctgccttcatgattccatttccattaggatttcttctgattctaaaagaaattaccatgccagctttctcgtgggcccccccaaaagcaggcactatgtcaaatgtcccagtgggcgagcggtcgcggaggagcccagcactttgctgaacgccctggactggagacaaaggggcgggcc

SEQ ID NO: 99989 - DNA, 201 bp, Bos taurus; identical to SEQ ID NO: 18597

SEQ ID NO: 99990 - DNA, 201 bp, Bos taurus; identical to SEQ ID NO: 18599

SEQ ID NO: 99991 - DNA, 201 bp, Bos taurus
tgagagcttggaggtaacaaggggggtgatttggataataattaataacccgagttccaggcgccactgaagcagcatgcaaattcaatgaccccgcagttgtacctcttgaagaagaaggtgctttattgcctctgtcaggcgttcccttctcagctgtgattccttccagcctcggtggtttgcatactgcggctaaac

SEQ ID NO: 99992 - DNA, 201 bp, Bos taurus
atcccttaaaaatcttccatctgaaatcattcttgctaacatcaataactgccaagtgtaacagtcatggtgcagttcttatcatagttaatttcttcttggcaaccaatgcttttgagcacttgtttttcctcaaactatccgacttacttgtatgttattacattctccttagtttcatattatggttcctttttcaac

SEQ ID NO: 99993 - DNA, 201 bp, Bos taurus
aaggttctaggcaccacatcaggcttcccagtctggggactcaacagagggactgggaatctccagggaatctgacttagaagtccagaggatttgattgcagaactttcacaggcctgggggaaacagagactccactcttggaaggtacaaacaaaactgtttgtttgtgcatgccagggcccaggagaaaggagcagc

SEQ ID NO: 99994 - DNA, 201 bp, Bos taurus; identical to SEQ ID NO: 18605

SEQ ID NO: 99995 - DNA, 201 bp, Bos taurus; identical to SEQ ID NO: 18606

SEQ ID NO: 99996 - DNA, 201 bp, Bos taurus; identical to SEQ ID NO: 18607

SEQ ID NO: 99997 - DNA, 201 bp, Bos taurus; identical to SEQ ID NO: 18608

SEQ ID NO: 99998 - DNA, 201 bp, Bos taurus; identical to SEQ ID NO: 18610

SEQ ID NO: 99999 - DNA, 201 bp, Bos taurus; identical to SEQ ID NO: 18611

SEQ ID NO: 100000 - DNA, 201 bp, Bos taurus; identical to SEQ ID NO: 18612

SEQ ID NO: 100001 - DNA, 201 bp, Bos taurus
actatcaagtggagacaatacctagcagagggtttcatggaaaaattaaataacatgtaaagcacacagactgcacctcactaagtggaagctctcctacaaaaagctaaaaatgctcaagataccatagctcttgatccctccttggaccaccgcccagctgccccatcagaggcagcccagtggtgctgggtatgaaaa

SEQ ID NO: 100002 - DNA, 201 bp, Bos taurus; identical to SEQ ID NO: 18613

SEQ ID NO: 100003 - DNA, 201 bp, Bos taurus
ttattaaactgtcttctaggccagtgctacaaacttagtgcacgtaagaatcgtcctgggagtggggaagagagtgtattaaagtgcaaagtccctgggtcctaactagaaaagaggcctgggagagaagcagaagtctgcatttttaatgagcagaaccaggtaattctcatatagatgctagaggcatagcggaaaata

SEQ ID NO: 100004 - DNA, 201 bp, Bos taurus
gcctcgcttggcagagcattttcttacccacgcccccgccttctgtcatccgaactccctgctccgccgcttggcgccgccctaggactagatccacaggatgttgcattcagtaagggcgatttgaagcgaaagggccgagggagagcagccaacaagggagtccactctggtgtggctaggtctccggagaaaaggagc

SEQ ID NO: 100005 - DNA, 201 bp, Bos taurus
atttgtgtggcctctgaggctatctagacgtgaggggttagaggtaggcaggttagcaaagccccaagaatcctttacatagtacacctttaccagcagtgacttgtatctttaaggacctcctcctccttcatttttctttccctcctgaaccttcccatttccctgcctgtggccccttgaacctcttccatgtctgcc

SEQ ID NO: 100006 - DNA, 201 bp, Bos taurus
cacagacacagcagtgatggtgctcagggcacgggccagaggtgtggcctcagcagggagcagcttgctgagcactggaggagagagcagcctgcctcagtaggcgttcccagtgcagttttggccaccctccttaggataagatccccacagggatgagcagttcaagggcatggtatggtcctgttggcccaggaagaa

SEQ ID NO: 100007 - DNA, 201 bp, Bos taurus
ttgaattgaggcaaggatttcagagcttcatagaaaagaactagtcctgggaagaggtagagaagctgtcaggtgttgttcccaactgtgctactctgccgttcttttcaacttttcaaaacttgggtgtagactcagctctcactgcaatctcttctgtgtgtcttcttttccccacagacatcagactgcgggttcggg

SEQ ID NO: 100008 - DNA, 201 bp, Bos taurus; identical to SEQ ID NO: 18614

SEQ ID NO: 100009 - DNA, 201 bp, Bos taurus
agggggtctctgggctcattccctctgcagatggcctgtatcacctccgcactgagaatggtgtcgtctaccagaccttctgtgacatgacctcttggggcggtggctggaccctggtggccagtgtccatgaaaacaacatgcttgggaaatgcacgttgggcgatcgctggtccagtcagcagggcaacagggctgact

SEQ ID NO: 100010 - DNA, 201 bp, Bos taurus
gtttaatttgaggggacactaatgcaaatggggtatattgtagctgtggttgctggggctttctccttaaggacagatggggttggcgggcctgtcatgatggttacccttcttggaaagtgggttgacagcgtcttgtgttccctcttcagggacttattgagaaggagccaagtggccaaatcacccttagtgtgttat

SEQ ID NO: 100011 - DNA, 201 bp, Bos taurus
ttacttgaagtaaggccagctttgttgttgttgtccagtggctaagtcatgtgcaactcttttgccaccccatggagttgctggcttccctgtgcttcatgatgaaaaggccagcatgctgctgctgctgctgctaagtcgcttcagtcatgtccgactctgtgcgaccccatagatggcagcccatgaggcttccctgcc

SEQ ID NO: 100012 - DNA, 201 bp, Bos taurus; identical to SEQ ID NO: 18615

SEQ ID NO: 100013 - DNA, 201 bp, Bos taurus
cactttagacatgttgagctgagatcatgagtgtatatttaggtgaaatgtccagtaaggagttgcaggtgtttggccagagcagggtgtaggtatgtgcatgtcatcaaaatggaacaggcaccagggactgggaggagaagagctcactcgggtgcattaggagatgaacagagcactgaggcctgatgaccagtgaag

SEQ ID NO: 100014 - DNA, 201 bp, Bos taurus; identical to SEQ ID NO: 18616

SEQ ID NO: 100015 - DNA, 201 bp, Bos taurus
aggggagcctgcttggaactgacaagagggccacctgaacctggcaatgtaccatctgttccagggaaggcagaccctgattataaaacatgacacagacgaaggggaagtgtggcctccaataggaccgtaggtatttcccgcctttctctgatcttgctgaggaattgttatggactaatgctctcaaaccggagaagg

SEQ ID NO: 100016 - DNA, 201 bp, Bos taurus; identical to SEQ ID NO: 18617

SEQ ID NO: 100017 - DNA, 201 bp, Bos taurus
tactgtaaagataggtgttgttgaaataaccagcagagggctgataactgcctctggaggtgagggaggccccagtgaaggagatggggaagtatgggacgtgggagtaaatcacattgcattcttacctggagtcaattcagtgaacaatccccagtgtttgctttgggaggggagaagttgcagagggcgccatggtgc

SEQ ID NO: 100018 - DNA, 201 bp, Bos taurus
tttggaaaatcccacacaccaaggcactctttgacttcagggtcattctcagctgggttctccttcttccttacaggaggccccaaggactcagcctcttgaaagcttctctgaaccacagagccctacactccttcagaaggatacttttgtccctaaaagtgacatgattttctttaataatgataataatcatggcca

SEQ ID NO: 100019 - DNA, 201 bp, Bos taurus; identical to SEQ ID NO: 18618

SEQ ID NO: 100020 - DNA, 201 bp, Bos taurus; identical to SEQ ID NO: 18619

SEQ ID NO: 100021 - DNA, 201 bp, Bos taurus; identical to SEQ ID NO: 18620

SEQ ID NO: 100022 - DNA, 201 bp, Bos taurus; identical to SEQ ID NO: 18621

SEQ ID NO: 100023 - DNA, 201 bp, Bos taurus; identical to SEQ ID NO: 59200

SEQ ID NO: 100024 - DNA, 201 bp, Bos taurus; identical to SEQ ID NO: 18623

SEQ ID NO: 100025 - DNA, 201 bp, Bos taurus
aaaggaaggtctgactacaagagtcttgtagtcccattgaatcacacttgtgtaacaattcagtattaattttaacccctctctaggccacagtctccttgtctctacctcatggggctgcagtcagaatagagaagtgggagtaggggtagcacttggcctagagttaaacagtaagttgtctgtcttctgctacttaat

SEQ ID NO: 100026 - DNA, 201 bp, Bos taurus; identical to SEQ ID NO: 18624

SEQ ID NO: 100027 - DNA, 201 bp, Bos taurus; identical to SEQ ID NO: 18625

SEQ ID NO: 100028 - DNA, 201 bp, Bos taurus; identical to SEQ ID NO: 18626

SEQ ID NO: 100029 - DNA, 201 bp, Bos taurus; identical to SEQ ID NO: 18631

SEQ ID NO: 100030 - DNA, 201 bp, Bos taurus; identical to SEQ ID NO: 18633

SEQ ID NO: 100031 - DNA, 201 bp, Bos taurus
aggcctggtgggctgccgtctatggggttgcacagagtcgggcatgactgaagcgacttagcagcagcagggaacccaagcctgaattttgcccgtcccctctgctgctattctaatggctttgtccttgggcccttgatgaggaaccacatttgagacaacacaatgttttacctgcaagtccattcattattatcctat

SEQ ID NO: 100032 - DNA, 201 bp, Bos taurus
gtcgccggccctaccggtctcactccctacctcatggaggttcagagtcccgctcctttccctcatgggtataacccccgtgccggtccatttcctcaccaagtcacaaaccagctcccccggcccggcaaacggcagacactgtcaagcgctgtctccacgccgcgcgtcccgcagcggagaagtaagctcgggtcgtaa

SEQ ID NO: 100033 - DNA, 201 bp, Bos taurus; identical to SEQ ID NO: 18634

SEQ ID NO: 100034 - DNA, 201 bp, Bos taurus; identical to SEQ ID NO: 18635

SEQ ID NO: 100035 - DNA, 201 bp, Bos taurus
acataacaacagagattaactttgcctgctgaattttatataaatagaatcataatcttttgtattttttttcaatagtgagaatcaagggcattgttgaatgcagttgtagctcatcatcttcattgctgtagagtgttccattgcataaatgcaccactgtttatccatttcaccacggatagatatttgggttgtttt

SEQ ID NO: 100036 - DNA, 201 bp, Bos taurus; identical to SEQ ID NO: 18639

SEQ ID NO: 100037 - DNA, 201 bp, Bos taurus; identical to SEQ ID NO: 18640

SEQ ID NO: 100038 - DNA, 201 bp, Bos taurus
aataaacatttgcggcatgattaatgaactaaaagcattgttggtcgacttgattgtattcccactggaagttgaacttagaaagggctaagacctgtgcaccattcatttctgtgtcttccgtgtctagctgagttcctgaatgtcatagttgcttattagcttgtgtgagtgagtgggaaaatgagagctgaatgtcac

SEQ ID NO: 100039 - DNA, 201 bp, Bos taurus; identical to SEQ ID NO: 18641

SEQ ID NO: 100040 - DNA, 201 bp, Bos taurus; identical to SEQ ID NO: 18642

SEQ ID NO: 100041 - DNA, 201 bp, Bos taurus; identical to SEQ ID NO: 18643

SEQ ID NO: 100042 - DNA, 201 bp, Bos taurus; identical to SEQ ID NO: 18644

SEQ ID NO: 100043 - DNA, 201 bp, Bos taurus
agacccatacctaggaaggccccctgtgcaaggcttcaggccatctgaccagtgagaaccatggtcaggggacacagcagctattgaggcacctgcactgtgtctgctgtggctgtgggtggccctcagcaaacctccttgacacctgccacaccccttgccacatacctgagctctgttgttacaaggccctataagggg

SEQ ID NO: 100044 - DNA, 201 bp, Bos taurus
tgtcagacatagcatagcaggcaaggttagaatgggacctagggtctcaggaggcatttagagacctcagtggcagggggcatgaccatatcgccataaggttgtcacaggaagagctatgcttacattggaccatggactctgggtcaaaaaatgttgtctccatagaggcagggtggggtagaatggaggagcacggac

SEQ ID NO: 100045 - DNA, 201 bp, Bos taurus; identical to SEQ ID NO: 18645

SEQ ID NO: 100046 - DNA, 201 bp, Bos taurus; identical to SEQ ID NO: 18646

SEQ ID NO: 100047 - DNA, 201 bp, Bos taurus
gggaaaaaagagacctatttccgcctggtttcgaaccggagacttttcacatgtgaggcaaacgtgataaccactacaccacggaaaggcgacagtcgctaccactgagccctgtatccaggaaaacccaaggttcagccgccactatccaagccaccaacttttaacattcatgcagaaaccttggagccccacgctctc

SEQ ID NO: 100048 - DNA, 201 bp, Bos taurus; identical to SEQ ID NO: 18647

SEQ ID NO: 100049 - DNA, 201 bp, Bos taurus; identical to SEQ ID NO: 18648

SEQ ID NO: 100050 - DNA, 201 bp, Bos taurus
agcctggagtgggggttaagcttcccacacaaccccgattcacctgacatcggtctctcaagtaccctgctgcccgggcgtctcggcccaggctccgcaactctcgctcggatgttccacctgcccctcactttctctcccctcttgaccagctcctcccatccccctccccccgcggtccatttttaatttttttggcct

SEQ ID NO: 100051 - DNA, 201 bp, Bos taurus
ccttataaattaaaccagtacatttaataaagtgtgaattctcatacttatcattaatgttttttccactttattttcaaaaggctggcttttctccatttttctactatcaaagccaagagctgcctaatggttctgtcaaggaggttccagctcctactcctgctcctctggaggtctcaagcccagaaactacagagg

SEQ ID NO: 100052 - DNA, 201 bp, Bos taurus
tattgatccctgtatagtattgtcttcatggaaatgtgctttggtgagatgctatcattctgtgtcaagggaacaataagaaacaatcccacaaaactcactgctgtgactactgaaaagatgttcattatattactctatcctctttatgaggacccttgggaggaatttgtctgttcacttgagaaatggtgtgcttct

SEQ ID NO: 100053 - DNA, 201 bp, Bos taurus
agtaactcaagagtgcctgttcttttttttaattctgctgtatatgcagggtctgaattcagaatttcccagagagggccacattaaggaaatcctaagatagccgtatgtctcctttttattttgcacctcttctcttctagtaattcatcaatatatcagcatgctaccagaaaaggccagagtgatgtgcctaaaact

SEQ ID NO: 100054 - DNA, 201 bp, Bos taurus; identical to SEQ ID NO: 18649

SEQ ID NO: 100055 - DNA, 201 bp, Bos taurus; identical to SEQ ID NO: 18650

SEQ ID NO: 100056 - DNA, 201 bp, Bos taurus
gatcaaagggtctggggttaagatggaggtacaagataaatcattattatgctgagttgtttattttacctaattctcttaaggccccctgatggaacctgtggtatcctcattttcagaaagcaaaggttaagctatctgctcaaagcaacacagccagtaagagacaaggcttggatctgaatccaagtaaaagggatc

SEQ ID NO: 100057 - DNA, 201 bp, Bos taurus
tgtttttctattgcaggatcccactttctaagtgggatcacatgccctttattattagtctgctttagactgtgacagtctcttacactttccttgttttcgatgacttgacagttttgaggagtactagttaagtattttgtagactatcccttaatttgtgattgtctgatattttcccctcatgattaggctagggtt

SEQ ID NO: 100058 - DNA, 201 bp, Bos taurus; identical to SEQ ID NO: 18651

SEQ ID NO: 100059 - DNA, 201 bp, Bos taurus
ttcacagaccagctccctcccctccattcctactgccacggccttcatctaggcccacatcatctcttggttggtctctctgttctcctgacttcctgccatatcatccttgaatccatcttcctctcccaccagaaggatctagcatgtttcctgcttaagtatggagtcctgccccaaggccacaggtgcgaggccttg

SEQ ID NO: 100060 - DNA, 201 bp, Bos taurus; identical to SEQ ID NO: 18652

SEQ ID NO: 100061 - DNA, 201 bp, Bos taurus
ggggagttctaggcagcagggaaagcagaacaagtcaaggaactggcccaccagtatttcaataacacttactgtgtgccaggcatgcgataaccatgctgaacaagtcatgtgaggccactgccctcagggaactcacagccagtgagtgagcacatgtgctgtgtgtttcatctgtactggacagtgaggaaagcctct

SEQ ID NO: 100062 - DNA, 201 bp, Bos taurus
aggagtattttggcttcaggcataatcaacaatagcataaggatttgcttgtgatagtattccgccccccccacacatcttttctcagttctgcttcttctgttagcttatcccttgcacagcaacagaatctatcctgttggtacatgttgatcttgtatccaccatgatctgccactctctaaaccacaatgactaagg

SEQ ID NO: 100063 - DNA, 201 bp, Bos taurus; identical to SEQ ID NO: 18653

SEQ ID NO: 100064 - DNA, 201 bp, Bos taurus; identical to SEQ ID NO: 18654

SEQ ID NO: 100065 - DNA, 201 bp, Bos taurus; identical to SEQ ID NO: 18655

SEQ ID NO: 100066 - DNA, 201 bp, Bos taurus
tttgaactggccctctacagtgagggcatgtctgggctgcctggctccctgaagaaggagaacatccagcaagttccagaggtgtgagcctcagggaagacgggctcccagaagatgagcccaagcagagtaagttttggttgagaaaggtcattcaggagcaaactgagaggtcaaattacatctttggcgatgaccacc

SEQ ID NO: 100067 - DNA, 201 bp, Bos taurus; identical to SEQ ID NO: 18656

SEQ ID NO: 100068 - DNA, 201 bp, Bos taurus; identical to SEQ ID NO: 18657

SEQ ID NO: 100069 - DNA, 201 bp, Bos taurus
gaggaagtcagcgaggacagagggagagcttcagagcctcagaggagaatacagcaactggtttgcagcagctagaacagagagaggcctgcagacagtccgtgccacccctctacactcccagcccgagacgtgtgtccactggtgcatgtgagggctagatgtggaagctcgggcctcagggtgggctgtgcaaaaaca

SEQ ID NO: 100070 - DNA, 201 bp, Bos taurus
gccaagtcaaatggggactggttatgtcaatcctcagtaatcctgaattcttatgtcaggacaagtctcgccatcttcagcatgatagtgctggcctcagaaaacatctccaagagcattcccaatttagttcttactcctccacaccaatttctttataagtctgacagcagctcagaattagtagattcttctctgctg

SEQ ID NO: 100071 - DNA, 201 bp, Bos taurus; identical to SEQ ID NO: 18658

SEQ ID NO: 100072 - DNA, 201 bp, Bos taurus
ctttgtccttgccctgcctaaaccctctctggctacagtcttcagaaaggtgactctaaaatttgaggcagtgaggcctctgaatcaatcttagggccaattgtttgctaggaaggttaagggaatggaatcttgactctgaagggggttccttgctttgggtcttgagaggcctgggaccctactacctgttgtcagaaa

SEQ ID NO: 100073 - DNA, 201 bp, Bos taurus; identical to SEQ ID NO: 18659

SEQ ID NO: 100074 - DNA, 201 bp, Bos taurus; identical to SEQ ID NO: 18660

SEQ ID NO: 100075 - DNA, 201 bp, Bos taurus; identical to SEQ ID NO: 18661

SEQ ID NO: 100076 - DNA, 201 bp, Bos taurus
aacaggtttcatttcgtgtctggtctcttgggccaaaagcccatttggcttcctgaaactctgctccaaggaacagggggcaaggagtaggagcttcagccactccagaaggcccacccgtggaaatggggtgatctgagccccagccttccctgcaacagccctgaagccaggttagaggcacagctatctacagaaagg

SEQ ID NO: 100077 - DNA, 201 bp, Bos taurus; identical to SEQ ID NO: 18662

SEQ ID NO: 100078 - DNA, 201 bp, Bos taurus; identical to SEQ ID NO: 18663

SEQ ID NO: 100079 - DNA, 201 bp, Bos taurus
gcagcttaacactgcttggctgtccccagggctgttatgctgtccacttatttcagaagtgaccgtcatactgtgaccaggtcacagaggggccagagttaagccaagtgagagtggtgccctcaaagaagaaggggagaaggtccaagaggagcttgaaagcccactctcaggagcaatgtggagtgagaaggaaacagt

SEQ ID NO: 100080 - DNA, 201 bp, Bos taurus; identical to SEQ ID NO: 18664

SEQ ID NO: 100081 - DNA, 201 bp, Bos taurus
gtgctggagagaggcataggcagcgcctgcgggctccagtgggttaaataaggctcacattggggctccattgggccatggttactctttcctttccatcgcctcaattctcaggctccgctttttgcctggggccagctgtgaccacactgacagctacctaaattaattatgagagaatgcaccttttccatcctcaaa

SEQ ID NO: 100082 - DNA, 201 bp, Bos taurus
ttctctgtatagtactgtacgataaggtacacaaaagcataaccactggtagaggatgcacgcaagtgacaatgtaagccagatacatgaaccaacttacgtgactggacatgcaaacacatgcgtacatctttgaaagtccacagcttgaaggttcatactataatggggtataaaatagatactggttaaattagtgag

SEQ ID NO: 100083 - DNA, 201 bp, Bos taurus; identical to SEQ ID NO: 18665

SEQ ID NO: 100084 - DNA, 201 bp, Bos taurus; identical to SEQ ID NO: 18666

SEQ ID NO: 100085 - DNA, 201 bp, Bos taurus; identical to SEQ ID NO: 18667

SEQ ID NO: 100086 - DNA, 201 bp, Bos taurus
atatctggtgactaaaagcccttggtgcctgaccaaggtgaaacacagcagagctggtcggaatcttccatctgagtagggccagtgatggacaggctgccgtcagaatggaaacaaaccctggcttatgtggaaaagtgacttactgaacagacactgggtagctcacgggaccaaccagaggccgagagccaggcttgt

SEQ ID NO: 100087 - DNA, 201 bp, Bos taurus
atgaggcccacctgcattgtggaaggtagcctgctttactcaaagtccacttatttaaatgttgatctcatccaaaaacacccccatagaaataatctttaactaaatgtctgggcactaaggccagtcaagttgacacataacactaactatcacaaccactttcaactctattaggcgtttaatctggtactcacgtcc

SEQ ID NO: 100088 - DNA, 201 bp, Bos taurus; identical to SEQ ID NO: 18668

SEQ ID NO: 100089 - DNA, 201 bp, Bos taurus; identical to SEQ ID NO: 18669

SEQ ID NO: 100090 - DNA, 201 bp, Bos taurus
aagtcagataatcgatactctgtttagaaccacctaatgacttcttgctactcttagaatataattcagacttctaaacagggcctagcaagccctacatgttccagctctgaccatctcggacccaaactcacccacccttccccctctcaaactatgttctgcccacaagtccatctttctcatctctaataggccaaa

SEQ ID NO: 100091 - DNA, 201 bp, Bos taurus; identical to SEQ ID NO: 18670

SEQ ID NO: 100092 - DNA, 201 bp, Bos taurus
tataaatattcttataaattatataaaatttctaaaattggatatgttctggtataatgctaccagtcataattctaattatgatcttaaaatgttgtacattatagcaataactaagtttttttgtcaattgcattgtaatcagatctctgctgctgctgctaagtcacttcagtcgtgtctgactctgtgggaccccat

SEQ ID NO: 100093 - DNA, 201 bp, Bos taurus
gtagattctttaccatcagagccactagggaagcccaagaatgctggagtgggtatcctaagccttctccaagggatcttcctgacccaggaatgaaaccggggtctgcttttgtgttaggccttatttatatatacttttcagcatgggaactttagaggctttttggtaacaaccttttaaattcccagcgctatcttg

SEQ ID NO: 100094 - DNA, 201 bp, Bos taurus; identical to SEQ ID NO: 18671

SEQ ID NO: 100095 - DNA, 201 bp, Bos taurus; identical to SEQ ID NO: 18672

SEQ ID NO: 100096 - DNA, 201 bp, Bos taurus
tttccttttctgttttacagtacttagattaaggctctactatcatttctttatgtctttatgtttgctggcattaatctaccttcgttgttgttcttgaccagaataattttgtatggtctattacaattttcataggaattgtatagaatctatttgaaaaagcttcccatattatttttcttattcagacaaactttt

SEQ ID NO: 100097 - DNA, 201 bp, Bos taurus
tcaaaagacgcaagggacggagtcactgcgggggccgtatacatacaaccaaaggaatgttacagagaaaagcgtgttcagattctgaggccaatgtctctgaggcttacacatttattaccgcgagttagtttagccggtagtatgtggaaaaagaggtgtaggaggataggtggccaagatattagagacctctccctg

SEQ ID NO: 100098 - DNA, 201 bp, Bos taurus
gatagtatataatacataaaaaatatcctggctactgaaggaaacttaggtgtaatcttctctgtgaatcattatgttttaaaatgttaaatttatagttgaccttgattcagcactgaattagtcattccttacttatgcagggtattacatcaggaattcctcggtctgtgtccaaccctgtgagcagccaactgaagt

SEQ ID NO: 100099 - DNA, 201 bp, Bos taurus
tggctgataagatcaaagcattccctctgccaaatcattaccttattttcgaggcaattatagaacttattgtatcaattagtctggtctccagctgcagccgtttatctctgtctctcctggtgcgcttgccgaagaaaggggtctgcccagccccgcgcagccagccaggccggcgaggggagggcggccagtagggcc

SEQ ID NO: 100100 - DNA, 201 bp, Bos taurus
aacgaagataatgcacacgacaaaattatgaaacacactgtaagacacacacactgtcctaaaaattcttctgtcagatgtctgagatcatgacctacaccagctctgtttccctctactttggaaacgtagctatgtagtcaaacatttgaaaccaaaccaacccatagctaaaataagatactaattcttcacctatgt

SEQ ID NO: 100101 - DNA, 201 bp, Bos taurus; identical to SEQ ID NO: 18673

SEQ ID NO: 100102 - DNA, 201 bp, Bos taurus
tagttaatgtgggcaggttcctggggggagccaggcctgttgacttgtggtccctatttcattcggggatgatcagacctgagtgtgtgcctatctaagatataagccttaaagataaggccattacctctgtctctgtttcttacagaggagacactgaataagcattgattgaatactttacatcactatctcattgaa

SEQ ID NO: 100103 - DNA, 201 bp, Bos taurus; identical to SEQ ID NO: 18675

SEQ ID NO: 100104 - DNA, 201 bp, Bos taurus; identical to SEQ ID NO: 18676

SEQ ID NO: 100105 - DNA, 201 bp, Bos taurus; identical to SEQ ID NO: 18677

SEQ ID NO: 100106 - DNA, 201 bp, Bos taurus; identical to SEQ ID NO: 18678

SEQ ID NO: 100107 - DNA, 201 bp, Bos taurus; identical to SEQ ID NO: 18679

SEQ ID NO: 100108 - DNA, 201 bp, Bos taurus
aacttcatggcaaactttattccctgatcctttattcctaaacacatggtcctcagggtatctgatccaaatggcttactctgatgactggcaggccaagatagtaaacacaggagacctagaacctcttcagattatctagttatctaattgaccctgataggagcatctccatcatggccagcttggggtctctgtcag

SEQ ID NO: 100109 - DNA, 201 bp, Bos taurus
cactttcagatcctgtgcagcccttttccctgttcacctatcctgagtgtggaccacaaggctggtgtgaacacccttgccagaggatctgtgtatgcgcatgcgtgtgtgtgtgcacgcgcactggggtggagtgaagacaaactttggatgcaaaagccgagatgtctgtgttgcaggaagggggagcccttccagggc

SEQ ID NO: 100110 - DNA, 201 bp, Bos taurus
tgaaataatcactagacaggtcacctccaagagatgcattgaaagaatatcatcctttgcccacaaatctgatggccaaggaaaccactggcccacccaaaatgtgtgcagccaatacccaaatctctgaaattgggaatttctgcaaactcttccaaagggatttggccattcctgggccttgtcacatcaccttggggc

SEQ ID NO: 100111 - DNA, 201 bp, Bos taurus; identical to SEQ ID NO: 18680

SEQ ID NO: 100112 - DNA, 201 bp, Bos taurus
tgggctcatttcaccatctctggagcccattgctccaaacaaaaattacctgagagcagacttgattaagcaggataaggaactcagaacaatcagaaagagggttgctgaccagggaaccccaggtaacagtatagaaatgtggactataacgaaagcattaagacatggtcctgggttctggcccatggggaactgcag

SEQ ID NO: 100113 - DNA, 201 bp, Bos taurus; identical to SEQ ID NO: 18681

SEQ ID NO: 100114 - DNA, 201 bp, Bos taurus
tctagccctatcctatacctgtgttcctcccctcattctattgtattccaacaaccctgatcttccagttatagaataagctctcgttttaccttaagcagtagggatctttgcaaatgttcccactgctagccccttccttccctcctcaccccattcacttctatctttacttcaatacttcctccaagttatctctca

SEQ ID NO: 100115 - DNA, 201 bp, Bos taurus; identical to SEQ ID NO: 18682

SEQ ID NO: 100116 - DNA, 201 bp, Bos taurus; identical to SEQ ID NO: 18683

SEQ ID NO: 100117 - DNA, 201 bp, Bos taurus; identical to SEQ ID NO: 18684

SEQ ID NO: 100118 - DNA, 201 bp, Bos taurus; identical to SEQ ID NO: 18685

SEQ ID NO: 100119 - DNA, 201 bp, Bos taurus; identical to SEQ ID NO: 18686

SEQ ID NO: 100120 - DNA, 201 bp, Bos taurus
actctatccctaggaagcagcagggccagttggacaattcagatggtcaggaggaaaaaagataagacatagcaggtgtggttaaagcttaattggtgatcggcaatgctgggcagggcccacgctgggagagcaaggcctgcacactaggcctattctggtcttcagggcagtgctgggggctcaggcttgagctctcca

SEQ ID NO: 100121 - DNA, 201 bp, Bos taurus; identical to SEQ ID NO: 18687

SEQ ID NO: 100122 - DNA, 201 bp, Bos taurus; identical to SEQ ID NO: 18688

SEQ ID NO: 100123 - DNA, 201 bp, Bos taurus
ggcagcaccacccactgccctgatgttgtggggttctgggggccagagatggaaaagcctgggtagctctccaccctgagccccagacagagccccactgggctgacatctcctttgggcctagacttccagctactcatcacccacttggctcatggcattaaatccagtgcctgccacacccccgggccacacactcac

SEQ ID NO: 100124 - DNA, 201 bp, Bos taurus
tggtgtctgtgggatgcaggagagggaggcggatacctgagacgatattcacgatgtggtaagggatccccagagactggtagaactcctccgcggtggcaatcatctcctcaaacatctcccaggacttgttgtcgtgtggcgaggagtagacaaactgctctatctgcaaggacagatccgaggagacagggatgatgg

SEQ ID NO: 100125 - DNA, 201 bp, Bos taurus
cagggaatagatgtcagcatggtgagcactttgctgttcatccctattaggggatgactgagctgtttcctcagggccaggtgaggtgctggctgcgtttgctcaaagtgttcactcggagggtgatttgtgagctattgctgagcacataatggttaggatagctgcaaaagcagccatggccccacacaggttcacctg

SEQ ID NO: 100126 - DNA, 201 bp, Bos taurus; identical to SEQ ID NO: 18689

SEQ ID NO: 100127 - DNA, 201 bp, Bos taurus; identical to SEQ ID NO: 18690

SEQ ID NO: 100128 - DNA, 201 bp, Bos taurus
ctcttagctcatccgtgtgcacaaggaaagcaacccaactccagatgatagttcaattgtgattagtctaagctgaccatggccatccattcctactgcctatgactagtttgggagggggcatatgatccagctgtcgccaatcagaggtacagggaaatcctctggcggccatctaggaagttttctcacttaaaaaag

SEQ ID NO: 100129 - DNA, 201 bp, Bos taurus
ccagttcctatgctcagttattccttctctttgtcatttttttatagtatgctatgttgatattaactgaaataatagcctgacagatgacagcaccctcaatgtgatttttgtagataagttctttaggacaatgtcattaccagcttctgtgctggtaactttccctacttggaaactccacatttcttgactgttgag

SEQ ID NO: 100130 - DNA, 201 bp, Bos taurus
gcctgtgatgagagagaggcatttttggcttcttgttttttcccatctaggattcattttctctagcttgccaactccatcagagtcccagtagaatagagaggcaaggaaagggccagcaggccagttcttacctaagaccacggtgagcagcacttgagttttctgccctgacatcttgtgaagctctttctttctctt

SEQ ID NO: 100131 - DNA, 201 bp, Bos taurus
ctgataaatatctcaatgtttttataatacatacaataagtgtgaaagtctgtcttcagggtgtttgtacttttgagtaacgcataaatgacaatattaaggtactagattaactcttttttcactcataaaattatgggatgagtaaaatttcaggctactgaaaaaattcattgttcattatgaatttaaattgttttc

SEQ ID NO: 100132 - DNA, 201 bp, Bos taurus; identical to SEQ ID NO: 18691

SEQ ID NO: 100133 - DNA, 201 bp, Bos taurus
tttcattataacttctttcaaacaatgagttgccattgagctataaaaatgttctctgttcagtctttgcattgaagggatccattttcacagccttttcgttgttgttgttttttcctctttttcttgccttgaaagttctataaaattatcttcaagtgaaatgaatataaagtaggaagttggtcatttagggtctgt

SEQ ID NO: 100134 - DNA, 201 bp, Bos taurus
ctcgtgggctaggacttctcaaataggatagattcaggacctttacctcagaattatgtaaactgtgattgtgttttagaaaagttacttgctaaaaccaattaagtttttgtatatgtgtaaatgatcatgaaattgagttttataagatgttctgtatagtgaagttacacactcaaggtgtctcttggagtggattct

SEQ ID NO: 100135 - DNA, 201 bp, Bos taurus
gtaaaacactgcatgctttttgccttttttcccctgttgtttaacttcaaaaggccatcaggctatttttctgtgactgtttcatgaggactgttaacatgtgaattaactgaatttgtaggtctttataaagaggaagctgtagacactgctcatttctgcccatgtcacaaatgatacctattttttagttttaagcca

SEQ ID NO: 100136 - DNA, 201 bp, Bos taurus; identical to SEQ ID NO: 18692

SEQ ID NO: 100137 - DNA, 201 bp, Bos taurus; identical to SEQ ID NO: 18693

SEQ ID NO: 100138 - DNA, 201 bp, Bos taurus
aggcctgacgtgctgcaattcatggagtcgcaaagagtaggacacgactgagcgactgaactgaactgagggcaggggatgcagctcagaatgaaggccttgcattttaattgcagattcatctcttccaagatctctgatcttaagctggtttattttggcttctgtagaaaatggagataatgttaatacttacctgag

SEQ ID NO: 100139 - DNA, 201 bp, Bos taurus
aatgaagactacaaaacggtttattaaatatgtttcatttgcttcagttttcttttcaaaaagtaaaacccagttgtctgctttgtattgattaaggaaaataaatttcctgtcaaatgttaaatatgtttatataaattaactcttcctataagataatattcagaaaagtttacaaggaaccaaacttctatattcaga

SEQ ID NO: 100140 - DNA, 201 bp, Bos taurus
tcctctcatatcccttttctcctccttccccttaaggaaattatcctaaaaatgtttggtaactgtttcctcctcacaactcagtcaccctggtttagtccttggagaagaggacatgttattgaacatatgattacaaaatcttaacacagaagctgaaagaattcaatctgattcacagtttccaaattaaatattgca

SEQ ID NO: 100141 - DNA, 201 bp, Bos taurus; identical to SEQ ID NO: 18694

SEQ ID NO: 100142 - DNA, 201 bp, Bos taurus; identical to SEQ ID NO: 18695

SEQ ID NO: 100143 - DNA, 201 bp, Bos taurus; identical to SEQ ID NO: 18696

SEQ ID NO: 100144 - DNA, 201 bp, Bos taurus; identical to SEQ ID NO: 18697

SEQ ID NO: 100145 - DNA, 201 bp, Bos taurus; identical to SEQ ID NO: 18698

SEQ ID NO: 100146 - DNA, 201 bp, Bos taurus; identical to SEQ ID NO: 18699

SEQ ID NO: 100147 - DNA, 201 bp, Bos taurus; identical to SEQ ID NO: 18700

SEQ ID NO: 100148 - DNA, 201 bp, Bos taurus; identical to SEQ ID NO: 18702

SEQ ID NO: 100149 - DNA, 201 bp, Bos taurus; identical to SEQ ID NO: 18703

SEQ ID NO: 100150 - DNA, 201 bp, Bos taurus; identical to SEQ ID NO: 18704

SEQ ID NO: 100151 - DNA, 201 bp, Bos taurus; identical to SEQ ID NO: 18706

SEQ ID NO: 100152 - DNA, 201 bp, Bos taurus; identical to SEQ ID NO: 18709

SEQ ID NO: 100153 - DNA, 201 bp, Bos taurus; identical to SEQ ID NO: 18713

SEQ ID NO: 100154 - DNA, 201 bp, Bos taurus; identical to SEQ ID NO: 18714

SEQ ID NO: 100155 - DNA, 201 bp, Bos taurus; identical to SEQ ID NO: 18715

SEQ ID NO: 100156 - DNA, 201 bp, Bos taurus; identical to SEQ ID NO: 18716

SEQ ID NO: 100157 - DNA, 201 bp, Bos taurus; identical to SEQ ID NO: 18717

SEQ ID NO: 100158 - DNA, 201 bp, Bos taurus; identical to SEQ ID NO: 18723

SEQ ID NO: 100159 - DNA, 201 bp, Bos taurus; identical to SEQ ID NO: 18724

SEQ ID NO: 100160 - DNA, 201 bp, Bos taurus; identical to SEQ ID NO: 18725

SEQ ID NO: 100161 - DNA, 201 bp, Bos taurus; identical to SEQ ID NO: 18733

SEQ ID NO: 100162 - DNA, 201 bp, Bos taurus; identical to SEQ ID NO: 18735

SEQ ID NO: 100163 - DNA, 201 bp, Bos taurus; identical to SEQ ID NO: 18736

SEQ ID NO: 100164 - DNA, 201 bp, Bos taurus; identical to SEQ ID NO: 18737

SEQ ID NO: 100165 - DNA, 201 bp, Bos taurus; identical to SEQ ID NO: 18738

SEQ ID NO: 100166 - DNA, 201 bp, Bos taurus; identical to SEQ ID NO: 18743

SEQ ID NO: 100167 - DNA, 201 bp, Bos taurus; identical to SEQ ID NO: 18746

SEQ ID NO: 100168 - DNA, 201 bp, Bos taurus; identical to SEQ ID NO: 18748

SEQ ID NO: 100169 - DNA, 201 bp, Bos taurus; identical to SEQ ID NO: 18749

SEQ ID NO: 100170 - DNA, 201 bp, Bos taurus; identical to SEQ ID NO: 18750

SEQ ID NO: 100171 - DNA, 201 bp, Bos taurus; identical to SEQ ID NO: 18751

SEQ ID NO: 100172 - DNA, 201 bp, Bos taurus; identical to SEQ ID NO: 18757

SEQ ID NO: 100173 - DNA, 201 bp, Bos taurus; identical to SEQ ID NO: 18759

SEQ ID NO: 100174 - DNA, 201 bp, Bos taurus; identical to SEQ ID NO: 18761

SEQ ID NO: 100175 - DNA, 201 bp, Bos taurus; identical to SEQ ID NO: 18764

SEQ ID NO: 100176 - DNA, 201 bp, Bos taurus; identical to SEQ ID NO: 18767

SEQ ID NO: 100177 - DNA, 201 bp, Bos taurus; identical to SEQ ID NO: 18770

SEQ ID NO: 100178 - DNA, 201 bp, Bos taurus; identical to SEQ ID NO: 18773

SEQ ID NO: 100179 - DNA, 201 bp, Bos taurus; identical to SEQ ID NO: 18774

SEQ ID NO: 100180 - DNA, 201 bp, Bos taurus; identical to SEQ ID NO: 18775

SEQ ID NO: 100181 - DNA, 201 bp, Bos taurus; identical to SEQ ID NO: 18776

SEQ ID NO: 100182 - DNA, 201 bp, Bos taurus; identical to SEQ ID NO: 18780

SEQ ID NO: 100183 - DNA, 201 bp, Bos taurus; identical to SEQ ID NO: 18781

SEQ ID NO: 100184 - DNA, 201 bp, Bos taurus; identical to SEQ ID NO: 18786

SEQ ID NO: 100185 - DNA, 201 bp, Bos taurus; identical to SEQ ID NO: 18787

SEQ ID NO: 100186 - DNA, 201 bp, Bos taurus; identical to SEQ ID NO: 18792

SEQ ID NO: 100187 - DNA, 201 bp, Bos taurus; identical to SEQ ID NO: 18793

SEQ ID NO: 100188 - DNA, 201 bp, Bos taurus; identical to SEQ ID NO: 18794

SEQ ID NO: 100189 - DNA, 201 bp, Bos taurus; identical to SEQ ID NO: 18795

SEQ ID NO: 100190 - DNA, 201 bp, Bos taurus; identical to SEQ ID NO: 18796

SEQ ID NO: 100191 - DNA, 201 bp, Bos taurus; identical to SEQ ID NO: 18797

SEQ ID NO: 100192 - DNA, 201 bp, Bos taurus; identical to SEQ ID NO: 18798

SEQ ID NO: 100193 - DNA, 201 bp, Bos taurus; identical to SEQ ID NO: 18799

SEQ ID NO: 100194 - DNA, 201 bp, Bos taurus; identical to SEQ ID NO: 18801

SEQ ID NO: 100195 - DNA, 201 bp, Bos taurus; identical to SEQ ID NO: 18802

SEQ ID NO: 100196 - DNA, 201 bp, Bos taurus; identical to SEQ ID NO: 18803

SEQ ID NO: 100197 - DNA, 201 bp, Bos taurus; identical to SEQ ID NO: 18804

SEQ ID NO: 100198 - DNA, 201 bp, Bos taurus; identical to SEQ ID NO: 18809

SEQ ID NO: 100199 - DNA, 201 bp, Bos taurus; identical to SEQ ID NO: 18812

SEQ ID NO: 100200 - DNA, 201 bp, Bos taurus; identical to SEQ ID NO: 18813

SEQ ID NO: 100201 - DNA, 201 bp, Bos taurus; identical to SEQ ID NO: 18814

SEQ ID NO: 100202 - DNA, 201 bp, Bos taurus; identical to SEQ ID NO: 18815

SEQ ID NO: 100203 - DNA, 201 bp, Bos taurus; identical to SEQ ID NO: 18816

SEQ ID NO: 100204 - DNA, 201 bp, Bos taurus; identical to SEQ ID NO: 18817

SEQ ID NO: 100205 - DNA, 201 bp, Bos taurus; identical to SEQ ID NO: 18818

SEQ ID NO: 100206 - DNA, 201 bp, Bos taurus; identical to SEQ ID NO: 18819

SEQ ID NO: 100207 - DNA, 201 bp, Bos taurus; identical to SEQ ID NO: 18820

SEQ ID NO: 100208 - DNA, 201 bp, Bos taurus; identical to SEQ ID NO: 18821

SEQ ID NO: 100209 - DNA, 201 bp, Bos taurus; identical to SEQ ID NO: 18822

SEQ ID NO: 100210 - DNA, 201 bp, Bos taurus; identical to SEQ ID NO: 18824

SEQ ID NO: 100211 - DNA, 201 bp, Bos taurus; identical to SEQ ID NO: 18829

SEQ ID NO: 100212 - DNA, 201 bp, Bos taurus; identical to SEQ ID NO: 18832

SEQ ID NO: 100213 - DNA, 201 bp, Bos taurus; identical to SEQ ID NO: 18833

SEQ ID NO: 100214 - DNA, 201 bp, Bos taurus; identical to SEQ ID NO: 18836

SEQ ID NO: 100215 - DNA, 201 bp, Bos taurus; identical to SEQ ID NO: 18837

SEQ ID NO: 100216 - DNA, 201 bp, Bos taurus; identical to SEQ ID NO: 18838

SEQ ID NO: 100217 - DNA, 201 bp, Bos taurus; identical to SEQ ID NO: 18839

SEQ ID NO: 100218 - DNA, 201 bp, Bos taurus; identical to SEQ ID NO: 18841

SEQ ID NO: 100219 - DNA, 201 bp, Bos taurus; identical to SEQ ID NO: 18844

SEQ ID NO: 100220 - DNA, 201 bp, Bos taurus; identical to SEQ ID NO: 18845

SEQ ID NO: 100221 - DNA, 201 bp, Bos taurus; identical to SEQ ID NO: 18846

SEQ ID NO: 100222 - DNA, 201 bp, Bos taurus; identical to SEQ ID NO: 18848

SEQ ID NO: 100223 - DNA, 201 bp, Bos taurus; identical to SEQ ID NO: 18852

SEQ ID NO: 100224 - DNA, 201 bp, Bos taurus; identical to SEQ ID NO: 18853

SEQ ID NO: 100225 - DNA, 201 bp, Bos taurus; identical to SEQ ID NO: 18854

SEQ ID NO: 100226 - DNA, 201 bp, Bos taurus; identical to SEQ ID NO: 18855

SEQ ID NO: 100227 - DNA, 201 bp, Bos taurus; identical to SEQ ID NO: 18856

SEQ ID NO: 100228 - DNA, 201 bp, Bos taurus; identical to SEQ ID NO: 18857

SEQ ID NO: 100229 - DNA, 201 bp, Bos taurus; identical to SEQ ID NO: 18858

SEQ ID NO: 100230 - DNA, 201 bp, Bos taurus; identical to SEQ ID NO: 18859

SEQ ID NO: 100231 - DNA, 201 bp, Bos taurus; identical to SEQ ID NO: 18863

SEQ ID NO: 100232 - DNA, 201 bp, Bos taurus; identical to SEQ ID NO: 18864

SEQ ID NO: 100233 - DNA, 201 bp, Bos taurus; identical to SEQ ID NO: 18865

SEQ ID NO: 100234 - DNA, 201 bp, Bos taurus; identical to SEQ ID NO: 18867

SEQ ID NO: 100235 - DNA, 201 bp, Bos taurus; identical to SEQ ID NO: 18869

SEQ ID NO: 100236 - DNA, 201 bp, Bos taurus; identical to SEQ ID NO: 18873

SEQ ID NO: 100237 - DNA, 201 bp, Bos taurus; identical to SEQ ID NO: 18879

SEQ ID NO: 100238 - DNA, 201 bp, Bos taurus; identical to SEQ ID NO: 18881

SEQ ID NO: 100239 - DNA, 201 bp, Bos taurus; identical to SEQ ID NO: 18882

SEQ ID NO: 100240 - DNA, 201 bp, Bos taurus; identical to SEQ ID NO: 18884

SEQ ID NO: 100241 - DNA, 201 bp, Bos taurus; identical to SEQ ID NO: 18885

SEQ ID NO: 100242 - DNA, 201 bp, Bos taurus; identical to SEQ ID NO: 18886

SEQ ID NO: 100243 - DNA, 201 bp, Bos taurus; identical to SEQ ID NO: 18891

SEQ ID NO: 100244 - DNA, 201 bp, Bos taurus; identical to SEQ ID NO: 18892

SEQ ID NO: 100245 - DNA, 201 bp, Bos taurus; identical to SEQ ID NO: 18894

SEQ ID NO: 100246 - DNA, 201 bp, Bos taurus; identical to SEQ ID NO: 18895

SEQ ID NO: 100247 - DNA, 201 bp, Bos taurus; identical to SEQ ID NO: 18896

SEQ ID NO: 100248 - DNA, 201 bp, Bos taurus; identical to SEQ ID NO: 18897

SEQ ID NO: 100249 - DNA, 201 bp, Bos taurus; identical to SEQ ID NO: 18900

SEQ ID NO: 100250 - DNA, 201 bp, Bos taurus; identical to SEQ ID NO: 18901

SEQ ID NO: 100251 - DNA, 201 bp, Bos taurus; identical to SEQ ID NO: 18902

SEQ ID NO: 100252 - DNA, 201 bp, Bos taurus; identical to SEQ ID NO: 18903

SEQ ID NO: 100253 - DNA, 201 bp, Bos taurus; identical to SEQ ID NO: 18904

SEQ ID NO: 100254 - DNA, 201 bp, Bos taurus; identical to SEQ ID NO: 18905

SEQ ID NO: 100255 - DNA, 201 bp, Bos taurus; identical to SEQ ID NO: 18907

SEQ ID NO: 100256 - DNA, 201 bp, Bos taurus; identical to SEQ ID NO: 18908

SEQ ID NO: 100257 - DNA, 201 bp, Bos taurus; identical to SEQ ID NO: 18909

SEQ ID NO: 100258 - DNA, 201 bp, Bos taurus; identical to SEQ ID NO: 18916

SEQ ID NO: 100259 - DNA, 201 bp, Bos taurus; identical to SEQ ID NO: 18918

SEQ ID NO: 100260 - DNA, 201 bp, Bos taurus; identical to SEQ ID NO: 18919

SEQ ID NO: 100261 - DNA, 201 bp, Bos taurus; identical to SEQ ID NO: 18920

SEQ ID NO: 100262 - DNA, 201 bp, Bos taurus; identical to SEQ ID NO: 18926

SEQ ID NO: 100263 - DNA, 201 bp, Bos taurus; identical to SEQ ID NO: 18927

SEQ ID NO: 100264 - DNA, 201 bp, Bos taurus; identical to SEQ ID NO: 18929

SEQ ID NO: 100265 - DNA, 201 bp, Bos taurus; identical to SEQ ID NO: 18930

SEQ ID NO: 100266 - DNA, 201 bp, Bos taurus; identical to SEQ ID NO: 18931

SEQ ID NO: 100267 - DNA, 201 bp, Bos taurus; identical to SEQ ID NO: 18932

SEQ ID NO: 100268 - DNA, 201 bp, Bos taurus; identical to SEQ ID NO: 18933

SEQ ID NO: 100269 - DNA, 201 bp, Bos taurus; identical to SEQ ID NO: 18934

SEQ ID NO: 100270 - DNA, 201 bp, Bos taurus; identical to SEQ ID NO: 18935

SEQ ID NO: 100271 - DNA, 201 bp, Bos taurus; identical to SEQ ID NO: 18936

SEQ ID NO: 100272 - DNA, 201 bp, Bos taurus; identical to SEQ ID NO: 18937

SEQ ID NO: 100273 - DNA, 201 bp, Bos taurus; identical to SEQ ID NO: 18938

SEQ ID NO: 100274 - DNA, 201 bp, Bos taurus; identical to SEQ ID NO: 18939

SEQ ID NO: 100275 - DNA, 201 bp, Bos taurus; identical to SEQ ID NO: 18940

SEQ ID NO: 100276 - DNA, 201 bp, Bos taurus; identical to SEQ ID NO: 18941

SEQ ID NO: 100277 - DNA, 201 bp, Bos taurus; identical to SEQ ID NO: 18942

SEQ ID NO: 100278 - DNA, 201 bp, Bos taurus; identical to SEQ ID NO: 18943

SEQ ID NO: 100279 - DNA, 201 bp, Bos taurus; identical to SEQ ID NO: 18945

SEQ ID NO: 100280 - DNA, 201 bp, Bos taurus; identical to SEQ ID NO: 18947

SEQ ID NO: 100281 - DNA, 201 bp, Bos taurus; identical to SEQ ID NO: 18948

SEQ ID NO: 100282 - DNA, 201 bp, Bos taurus; identical to SEQ ID NO: 18949

SEQ ID NO: 100283 - DNA, 201 bp, Bos taurus; identical to SEQ ID NO: 18950

SEQ ID NO: 100284 - DNA, 201 bp, Bos taurus; identical to SEQ ID NO: 18951

SEQ ID NO: 100285 - DNA, 201 bp, Bos taurus; identical to SEQ ID NO: 18952

SEQ ID NO: 100286 - DNA, 201 bp, Bos taurus; identical to SEQ ID NO: 18953

SEQ ID NO: 100287 - DNA, 201 bp, Bos taurus; identical to SEQ ID NO: 18954

SEQ ID NO: 100288 - DNA, 201 bp, Bos taurus; identical to SEQ ID NO: 18955

SEQ ID NO: 100289 - DNA, 201 bp, Bos taurus; identical to SEQ ID NO: 18956

SEQ ID NO: 100290 - DNA, 201 bp, Bos taurus; identical to SEQ ID NO: 18957

SEQ ID NO: 100291 - DNA, 201 bp, Bos taurus; identical to SEQ ID NO: 18958

SEQ ID NO: 100292 - DNA, 201 bp, Bos taurus; identical to SEQ ID NO: 18959

SEQ ID NO: 100293 - DNA, 201 bp, Bos taurus; identical to SEQ ID NO: 18960

SEQ ID NO: 100294 - DNA, 201 bp, Bos taurus; identical to SEQ ID NO: 18961

SEQ ID NO: 100295 - DNA, 201 bp, Bos taurus; identical to SEQ ID NO: 18963

SEQ ID NO: 100296 - DNA, 201 bp, Bos taurus; identical to SEQ ID NO: 18964

SEQ ID NO: 100297 - DNA, 201 bp, Bos taurus; identical to SEQ ID NO: 18965

SEQ ID NO: 100298 - DNA, 201 bp, Bos taurus; identical to SEQ ID NO: 18966

SEQ ID NO: 100299 - DNA, 201 bp, Bos taurus; identical to SEQ ID NO: 18967

SEQ ID NO: 100300 - DNA, 201 bp, Bos taurus; identical to SEQ ID NO: 18968

SEQ ID NO: 100301 - DNA, 201 bp, Bos taurus; identical to SEQ ID NO: 18969

SEQ ID NO: 100302 - DNA, 201 bp, Bos taurus; identical to SEQ ID NO: 18970

SEQ ID NO: 100303 - DNA, 201 bp, Bos taurus; identical to SEQ ID NO: 18971

SEQ ID NO: 100304 - DNA, 201 bp, Bos taurus; identical to SEQ ID NO: 18972

SEQ ID NO: 100305 - DNA, 201 bp, Bos taurus; identical to SEQ ID NO: 18973

SEQ ID NO: 100306 - DNA, 201 bp, Bos taurus; identical to SEQ ID NO: 18974

SEQ ID NO: 100307 - DNA, 201 bp, Bos taurus; identical to SEQ ID NO: 18975

SEQ ID NO: 100308 - DNA, 201 bp, Bos taurus; identical to SEQ ID NO: 18976

SEQ ID NO: 100309 - DNA, 201 bp, Bos taurus; identical to SEQ ID NO: 18977

SEQ ID NO: 100310 - DNA, 201 bp, Bos taurus; identical to SEQ ID NO: 18978

SEQ ID NO: 100311 - DNA, 201 bp, Bos taurus; identical to SEQ ID NO: 18979

SEQ ID NO: 100312 - DNA, 201 bp, Bos taurus; identical to SEQ ID NO: 18980

SEQ ID NO: 100313 - DNA, 201 bp, Bos taurus; identical to SEQ ID NO: 18981

SEQ ID NO: 100314 - DNA, 201 bp, Bos taurus; identical to SEQ ID NO: 18982

SEQ ID NO: 100315 - DNA, 201 bp, Bos taurus; identical to SEQ ID NO: 18983

SEQ ID NO: 100316 - DNA, 201 bp, Bos taurus; identical to SEQ ID NO: 18984

SEQ ID NO: 100317 - DNA, 201 bp, Bos taurus; identical to SEQ ID NO: 18985

SEQ ID NO: 100318 - DNA, 201 bp, Bos taurus; identical to SEQ ID NO: 18986

SEQ ID NO: 100319 - DNA, 201 bp, Bos taurus; identical to SEQ ID NO: 18987

SEQ ID NO: 100320 - DNA, 201 bp, Bos taurus; identical to SEQ ID NO: 59591

SEQ ID NO: 100321 - DNA, 201 bp, Bos taurus; identical to SEQ ID NO: 18988

SEQ ID NO: 100322 - DNA, 201 bp, Bos taurus; identical to SEQ ID NO: 18989

SEQ ID NO: 100323 - DNA, 201 bp, Bos taurus; identical to SEQ ID NO: 18990

SEQ ID NO: 100324 - DNA, 201 bp, Bos taurus; identical to SEQ ID NO: 18991

SEQ ID NO: 100325 - DNA, 201 bp, Bos taurus; identical to SEQ ID NO: 18992

SEQ ID NO: 100326 - DNA, 201 bp, Bos taurus; identical to SEQ ID NO: 18993

SEQ ID NO: 100327 - DNA, 201 bp, Bos taurus; identical to SEQ ID NO: 18994

SEQ ID NO: 100328 - DNA, 201 bp, Bos taurus; identical to SEQ ID NO: 18995

SEQ ID NO: 100329 - DNA, 201 bp, Bos taurus; identical to SEQ ID NO: 18996

SEQ ID NO: 100330 - DNA, 201 bp, Bos taurus; identical to SEQ ID NO: 18997

SEQ ID NO: 100331 - DNA, 201 bp, Bos taurus; identical to SEQ ID NO: 18998

SEQ ID NO: 100332 - DNA, 201 bp, Bos taurus; identical to SEQ ID NO: 18999

SEQ ID NO: 100333 - DNA, 201 bp, Bos taurus; identical to SEQ ID NO: 19000

SEQ ID NO: 100334 - DNA, 201 bp, Bos taurus; identical to SEQ ID NO: 19001

SEQ ID NO: 100335 - DNA, 201 bp, Bos taurus; identical to SEQ ID NO: 19002

SEQ ID NO: 100336 - DNA, 201 bp, Bos taurus; identical to SEQ ID NO: 19003

SEQ ID NO: 100337 - DNA, 201 bp, Bos taurus; identical to SEQ ID NO: 19004

SEQ ID NO: 100338 - DNA, 201 bp, Bos taurus; identical to SEQ ID NO: 19005

SEQ ID NO: 100339 - DNA, 201 bp, Bos taurus; identical to SEQ ID NO: 19006

SEQ ID NO: 100340 - DNA, 201 bp, Bos taurus; identical to SEQ ID NO: 19007

SEQ ID NO: 100341 - DNA, 201 bp, Bos taurus; identical to SEQ ID NO: 19008

SEQ ID NO: 100342 - DNA, 201 bp, Bos taurus; identical to SEQ ID NO: 19009

SEQ ID NO: 100343 - DNA, 201 bp, Bos taurus
aaagaagataatatagcttctaaccgcttagagtttataaactacctgcaaataaacatctcattcacccttttcaataaactcatcaagtgagaatttttgagttttgtgtttgagacaacagaactagaatgtccttgtccaaggacccttaaacctgttggggtgaggctgtgactagtacatgggaccctggacctc

SEQ ID NO: 100344 - DNA, 201 bp, Bos taurus
agacgatggacatgggaatgatgctgtgatggatagccgtgagtgctggagtcaggctggacttaggaaaggtagcttgatgcttgatggcagacgggaagtgtgtaactgtctcaggtcgcttttagcccttgcttcctaagctctgcaagacttgtccctgctgtcttagttgagtatccaatggcttttggtcaggct

SEQ ID NO: 100345 - DNA, 201 bp, Bos taurus; identical to SEQ ID NO: 19010

SEQ ID NO: 100346 - DNA, 201 bp, Bos taurus; identical to SEQ ID NO: 19011

SEQ ID NO: 100347 - DNA, 201 bp, Bos taurus
aagtttgacaacaaagaataacaaagtagacttttcctcaaagactatacaagccaaagataatggagtgatatattcaaagtaatgtggaagggaaagacggaacttttcatgtagaatttcatatttgtcaaagatatccttcaaaaaaggcaagataaagagctcttctgactaataaaaacgggtcattctctcacc

SEQ ID NO: 100348 - DNA, 201 bp, Bos taurus; identical to SEQ ID NO: 19016

SEQ ID NO: 100349 - DNA, 201 bp, Bos taurus; identical to SEQ ID NO: 19017

SEQ ID NO: 100350 - DNA, 201 bp, Bos taurus; identical to SEQ ID NO: 19019

SEQ ID NO: 100351 - DNA, 201 bp, Bos taurus; identical to SEQ ID NO: 19021

SEQ ID NO: 100352 - DNA, 201 bp, Bos taurus
gtgatgtaaaaattaaaatcaaagttttgctttttgaatgcatggtctgtaacccacagaaaatgagcaaattgtttggtcaggatcttgtttaagaagcaaaaaatttaagaatcaaaatatgtacaccattaaaaatactaattctgagtattatatatctaaaaattaaatcaccctgtccagcaagtttcaaaaaat

SEQ ID NO: 100353 - DNA, 201 bp, Bos taurus; identical to SEQ ID NO: 19022

SEQ ID NO: 100354 - DNA, 201 bp, Bos taurus
ccctttcagttggcaggcataggcaaacctagaaataagagggtagcagcactccatggaagcaatagacaaatgcttccttttttttcatcacttgggtggacaattctgaagttcttagagggtcccaatggaaaagccccaatcacccaccatggtgatcagctcaataacacaacctgacattgaccttcctttcat

SEQ ID NO: 100355 - DNA, 201 bp, Bos taurus; identical to SEQ ID NO: 19026

SEQ ID NO: 100356 - DNA, 201 bp, Bos taurus; identical to SEQ ID NO: 19029

SEQ ID NO: 100357 - DNA, 201 bp, Bos taurus
tataaagcatttggaatcatgtgggcaggctgtgaacgctgcaaaaatctctttgaaggggtaggcccaacgcctgtgggaggttttgcgggtctttaatgagaaacccctcagggatggagttgcccctgtggaggctgtcctgcttctcgtcactgcacctaaacagctgcaagtaacaacagacattttgataaagcc

SEQ ID NO: 100358 - DNA, 201 bp, Bos taurus
tggcctttgtgtttgaagacagttctgcagcaaggttcctgatgacaaggcaggctccttgggggtgtggtgctacacgtggtgtgaatccccaggaaagggtgcagactgtctccagggcctgatctgctggggagcatagttgggaatgctggaggtacttataacccccagaagtttgggaggacaggcttgactgaa

SEQ ID NO: 100359 - DNA, 201 bp, Bos taurus
gggcacacgatggtggagggtggacgtggacactgggctccttgctctcaggctcggtgctgcctcagaagcccactagggttgggatgcggccatgctgcggaaaaaagggagggtgatcacgttcagaattggcatggctacttacagactccatgatctgcagtgacccctgttagcctgagggacagacctgggctc

SEQ ID NO: 100360 - DNA, 201 bp, Bos taurus
ttcaaagaatcgaatgttcctggtaatcaagtgggaaggcttgatgaataggacctgatgcatgctgggctgctgggcaccttctggggccctgccttctgtctctccacatatcttcctgtgggaaggaggagcagataacccggagcgggtaggttacccaacgggcctgttggggaaagaacctcagaaccacatcct

SEQ ID NO: 100361 - DNA, 201 bp, Bos taurus
gctcccctgttctcttatccccatccctggccgacagctctattctcaaggctcccagatgctacctctgtgactactacagtgcctgctcagacccacacggccagcatcccactggacgagtgcccgaatgccacaggcagctaaaccacacttttccaaagctggaagccggtgtctgcacacaccctctctttctcc

SEQ ID NO: 100362 - DNA, 201 bp, Bos taurus
tgaaggggaggttcagggctcctgcgccggcccaccccgcgccccctgcaggctgtttcgagtccgcattagcgtgttaattacaccagctgcccgggcgaggctggggaggcggcggcctggggatggtgtcactcttgggttcaaagaaccacggaagaaccgtggggcagggagaacaggctggggtcacggctgaaa

SEQ ID NO: 100363 - DNA, 201 bp, Bos taurus; identical to SEQ ID NO: 19032

SEQ ID NO: 100364 - DNA, 201 bp, Bos taurus; identical to SEQ ID NO: 19033

SEQ ID NO: 100365 - DNA, 201 bp, Bos taurus
ggactgacaaatgacgatggactcctgatggattcaagtactgagaatactgtactcaaaactgataagcctcaatttatagtccatggttgaagatttatgttatttttcctactttagtgtcttgttttggaacatccaaggtatttccaatatgatgtcatttgtataaatacaactaaattcaacaaaggctatttc

SEQ ID NO: 100366 - DNA, 201 bp, Bos taurus
gtacagggctctatgggacagtcaggagaatcagaacttctcctagaagatctgaattgatcttttaaaaaatgcaaacaagggggtggtcctaagatggcggaggaataggacagggagaccactttctcccccacaaattcatcaaaagaacatttaaacgcccagtaaattccacaacttctgaatgctggtagagga

SEQ ID NO: 100367 - DNA, 201 bp, Bos taurus
acctggccgctttctgatgtcgcactgttctgctcagagtgttgtggcagcaaggcaggggcaagctatagcaaccccgctcagccatcagttggcacaatgtgggcccctctcctgaagcgagcaactgtcaacatgcaaccattagtgatcctgctcagccactggtcagtgccaagtgagcccctctcccctcctgta

SEQ ID NO: 100368 - DNA, 201 bp, Bos taurus; identical to SEQ ID NO: 19034

SEQ ID NO: 100369 - DNA, 201 bp, Bos taurus
aagaaccaaaattaagtaataccaagagggagccatatatacaaacagaaaatagaattgagattcaaaattacttattcgaagatccctccttaaaagtgtaattcggtactctggtactcaataaaacctaaccaattctaaaatctctgtagttacaccagtttcttccccaaagattttaacagaagagagctatta

SEQ ID NO: 100370 - DNA, 201 bp, Bos taurus; identical to SEQ ID NO: 19037

SEQ ID NO: 100371 - DNA, 201 bp, Bos taurus; identical to SEQ ID NO: 19038

SEQ ID NO: 100372 - DNA, 201 bp, Bos taurus
tggtggtggattatgctgaggccggagttaatatttatttgtcttctcccagcttctacttccttcctgtctctgtctttttagcaagaacatcaggaaggaaaagctacatcctgtcaggccagtttgttatcctgatcttgggccagtaaacaggatagatgattacaatagtggttattaagaattgtgctatgcctg

SEQ ID NO: 100373 - DNA, 201 bp, Bos taurus; identical to SEQ ID NO: 19039

SEQ ID NO: 100374 - DNA, 201 bp, Bos taurus
ctctaaaatgctctttttagagaggcaagtttattcctaagagattctgtttgaaatgacagacataaaaaagtattttaaatgtattttgtaatcttatctttgtgatgctatatcttggaatctttctgggctacagatcataaccattgtgggttgtgagatcagttttagagggtcaaagctaggactttttagaaa

SEQ ID NO: 100375 - DNA, 201 bp, Bos taurus; identical to SEQ ID NO: 19041

SEQ ID NO: 100376 - DNA, 201 bp, Bos taurus; identical to SEQ ID NO: 19042

SEQ ID NO: 100377 - DNA, 201 bp, Bos taurus; identical to SEQ ID NO: 19043

SEQ ID NO: 100378 - DNA, 201 bp, Bos taurus; identical to SEQ ID NO: 19044

SEQ ID NO: 100379 - DNA, 201 bp, Bos taurus; identical to SEQ ID NO: 19045

SEQ ID NO: 100380 - DNA, 201 bp, Bos taurus; identical to SEQ ID NO: 19046

SEQ ID NO: 100381 - DNA, 201 bp, Bos taurus; identical to SEQ ID NO: 19048

SEQ ID NO: 100382 - DNA, 201 bp, Bos taurus; identical to SEQ ID NO: 19052

SEQ ID NO: 100383 - DNA, 201 bp, Bos taurus; identical to SEQ ID NO: 19056

SEQ ID NO: 100384 - DNA, 201 bp, Bos taurus; identical to SEQ ID NO: 19057

SEQ ID NO: 100385 - DNA, 201 bp, Bos taurus; identical to SEQ ID NO: 19058

SEQ ID NO: 100386 - DNA, 201 bp, Bos taurus; identical to SEQ ID NO: 19059

SEQ ID NO: 100387 - DNA, 201 bp, Bos taurus; identical to SEQ ID NO: 19060

SEQ ID NO: 100388 - DNA, 201 bp, Bos taurus; identical to SEQ ID NO: 19061

SEQ ID NO: 100389 - DNA, 201 bp, Bos taurus; identical to SEQ ID NO: 19062

SEQ ID NO: 100390 - DNA, 201 bp, Bos taurus; identical to SEQ ID NO: 19063

SEQ ID NO: 100391 - DNA, 201 bp, Bos taurus; identical to SEQ ID NO: 19065

SEQ ID NO: 100392 - DNA, 201 bp, Bos taurus; identical to SEQ ID NO: 19066

SEQ ID NO: 100393 - DNA, 201 bp, Bos taurus; identical to SEQ ID NO: 19067

SEQ ID NO: 100394 - DNA, 201 bp, Bos taurus; identical to SEQ ID NO: 19068

SEQ ID NO: 100395 - DNA, 201 bp, Bos taurus; identical to SEQ ID NO: 19069

SEQ ID NO: 100396 - DNA, 201 bp, Bos taurus; identical to SEQ ID NO: 19070

SEQ ID NO: 100397 - DNA, 201 bp, Bos taurus; identical to SEQ ID NO: 19071

SEQ ID NO: 100398 - DNA, 201 bp, Bos taurus; identical to SEQ ID NO: 19080

SEQ ID NO: 100399 - DNA, 201 bp, Bos taurus; identical to SEQ ID NO: 19081

SEQ ID NO: 100400 - DNA, 201 bp, Bos taurus; identical to SEQ ID NO: 19082

SEQ ID NO: 100401 - DNA, 201 bp, Bos taurus; identical to SEQ ID NO: 19083

SEQ ID NO: 100402 - DNA, 201 bp, Bos taurus; identical to SEQ ID NO: 19084

SEQ ID NO: 100403 - DNA, 201 bp, Bos taurus; identical to SEQ ID NO: 19086

SEQ ID NO: 100404 - DNA, 201 bp, Bos taurus; identical to SEQ ID NO: 19087

SEQ ID NO: 100405 - DNA, 201 bp, Bos taurus; identical to SEQ ID NO: 19090

SEQ ID NO: 100406 - DNA, 201 bp, Bos taurus
tatttttgtaagaaggaggaaccagagggagacagagctggatggtaatgcggtggtacaccggataaacacggtgggtggggtggggtgtgtcggagcttgcggccgtggaagacagaaatgcgctctccctcagcttgagagtcagtgccaccagtctctctcttcacttactccgagggacaaagttgtttccctgat

SEQ ID NO: 100407 - DNA, 201 bp, Bos taurus; identical to SEQ ID NO: 19092

SEQ ID NO: 100408 - DNA, 201 bp, Bos taurus
ggcagccctggagatggccagcacctggtcactttctgggtgtggacctctgctcagggccttcctggctgagaatgaaggtgtacaggcctaggcctccatggctgtctctgtaacagcctgagtcactctactgagaaactgaagactggaggaaggggctctcctggcccagaagttagaactcacccctcccagcga

SEQ ID NO: 100409 - DNA, 201 bp, Bos taurus
cggaacatcagaagacttggactatttttaagattattatattaataagattaggattataaggtgctctccaataggaactcctcttataagtgttctcggatacctagtatggcgctaggcacatgggctttcagtaagtacataacaactgatatccaaagacatgtcaaaatagttatttttcgttggtaactctct

SEQ ID NO: 100410 - DNA, 201 bp, Bos taurus
gggctaggccccctgctggatagggtatctccagcatgtatcactttgccaacatcttttgatttagaaagagctgggtttcccaacatttaacactgaagttggccttgggccccaattgtatgggaagtagagaaatgcccaatttctcaacccaggttctttctagcttttgattctccctgtttgacttctccagga

SEQ ID NO: 100411 - DNA, 201 bp, Bos taurus
caccagggtcttgtggcctttttcctcacactgaagaggtcagcaataatctgtcactgtggacccaggctccccacttctccaccccacaatgaagtagaagcttcttggccaaaggtcagggtgggtgaggggcctgggaatacagcctgtggaggctgctcactcctttatgtctttattaaaagtgacagaggaaag

SEQ ID NO: 100412 - DNA, 201 bp, Bos taurus
tgtgagaccaactgacacagcaggactgttagaggaaatgcctatcatatgctcagtgtgaagtgtggcatgtactagtcattcagtacatgacagctgcgattaactgctgaagacactatatgctagccctgtaaagaaggcaagaatgaaaaagattccttatatgatcttgttaaaaattcaattaaaaaaatggta

SEQ ID NO: 100413 - DNA, 201 bp, Bos taurus
ctctgcactttgacggccgtctcatggtatgccaccctggtgacccaggagttcttcaaccccagcacacctgtcaacgccaggtgagtgccaggacatgacttgagccatggctgggcctctcgctccaccttctctgaggccactggccttcgtccagcagggtgcccggaggggaaacaagggacaggccccaggagc

SEQ ID NO: 100414 - DNA, 201 bp, Bos taurus
tattttttatacatatttctggttaaaagtgtaatcccctcctacccattagactagctatcaccaaaaagacaagagataacaaatgctggagaaaatacgggaaaaagggaacgcttctggactgttggtgggaatgtaaattggtacagccactgtggaagacagtatggaggttcctaaaaaaattaaaaagagaac

SEQ ID NO: 100415 - DNA, 201 bp, Bos taurus
agtcaaataaggatgggggcgactgaggagggagcagcccagggctgccctgcgtgggactcatcactgccatctggcccggggagagacttatcacctcatcactttgtagaggaggaaggctggggcttggacaggtgatgctgctcataaggccacagtggtcaggggcagagcagagacttaaaaccaggcccacac

SEQ ID NO: 100416 - DNA, 201 bp, Bos taurus
ttgacatacatgaagagccccaagaaagcccaggccctacgggagctctgaaggttttagccatcccgaacctctgtccctgagggttcctcagggctgcacagggccggggtgcagcctagcccctcaagggtccacatctctgtgaggaggcggaaacataggcaaaaagacaggatggccggctaggcaggacccagg

SEQ ID NO: 100417 - DNA, 201 bp, Bos taurus; identical to SEQ ID NO: 19095

SEQ ID NO: 100418 - DNA, 201 bp, Bos taurus; identical to SEQ ID NO: 19096

SEQ ID NO: 100419 - DNA, 201 bp, Bos taurus; identical to SEQ ID NO: 19097

SEQ ID NO: 100420 - DNA, 201 bp, Bos taurus
gcctttccagagagaccgtcggtctatacctgtcaggccatctgatgacaactgcccaggcctcctgaaaaggcctgggagtccccagcacaggcccagatacccacacagtggctggagacaggtccaagagaggatgagacagagaatggaagaggaggaggagaagcaagaggaggtggcagccccggggggccccta

SEQ ID NO: 100421 - DNA, 201 bp, Bos taurus; identical to SEQ ID NO: 19100

SEQ ID NO: 100422 - DNA, 201 bp, Bos taurus; identical to SEQ ID NO: 19101

SEQ ID NO: 100423 - DNA, 201 bp, Bos taurus; identical to SEQ ID NO: 19102

SEQ ID NO: 100424 - DNA, 201 bp, Bos taurus
aagcaactgttagtggtcccagtaagccattggttggcactgcagtagtcccctccccctcctctgcataaaaggggcccaaattgggactgggacaagatggtttttttgagacgctagtctgccatcttctcggcctgctagctttcttattaaagtcattcttccttgcccctaaaagttgtctccggattggttgat

SEQ ID NO: 100425 - DNA, 201 bp, Bos taurus; identical to SEQ ID NO: 19103

SEQ ID NO: 100426 - DNA, 201 bp, Bos taurus; identical to SEQ ID NO: 19105

SEQ ID NO: 100427 - DNA, 201 bp, Bos taurus; identical to SEQ ID NO: 19110

SEQ ID NO: 100428 - DNA, 201 bp, Bos taurus; identical to SEQ ID NO: 19111

SEQ ID NO: 100429 - DNA, 201 bp, Bos taurus
caaggccagcatttgatgccaaacccagcctctgtaccctgacaccgaattaagtcttgaagacaagagttttgagtgaagtagaaataaatgaatggctttcttgctttgccaggcaaagcgggccacagggggctaatgccctcaaatctgtgtgtcccgacctggtgggagtagtgaggcatttgatagtaatggttc

SEQ ID NO: 100430 - DNA, 201 bp, Bos taurus; identical to SEQ ID NO: 19112

SEQ ID NO: 100431 - DNA, 201 bp, Bos taurus; identical to SEQ ID NO: 19113

SEQ ID NO: 100432 - DNA, 201 bp, Bos taurus; identical to SEQ ID NO: 19114

SEQ ID NO: 100433 - DNA, 201 bp, Bos taurus; identical to SEQ ID NO: 19115

SEQ ID NO: 100434 - DNA, 201 bp, Bos taurus; identical to SEQ ID NO: 19117

SEQ ID NO: 100435 - DNA, 201 bp, Bos taurus; identical to SEQ ID NO: 19121

SEQ ID NO: 100436 - DNA, 201 bp, Bos taurus; identical to SEQ ID NO: 19123

SEQ ID NO: 100437 - DNA, 201 bp, Bos taurus; identical to SEQ ID NO: 19124

SEQ ID NO: 100438 - DNA, 201 bp, Bos taurus; identical to SEQ ID NO: 19126

SEQ ID NO: 100439 - DNA, 201 bp, Bos taurus; identical to SEQ ID NO: 19128

SEQ ID NO: 100440 - DNA, 201 bp, Bos taurus; identical to SEQ ID NO: 19129

SEQ ID NO: 100441 - DNA, 201 bp, Bos taurus; identical to SEQ ID NO: 19131

SEQ ID NO: 100442 - DNA, 201 bp, Bos taurus; identical to SEQ ID NO: 19132

SEQ ID NO: 100443 - DNA, 201 bp, Bos taurus; identical to SEQ ID NO: 19133

SEQ ID NO: 100444 - DNA, 201 bp, Bos taurus; identical to SEQ ID NO: 19134

SEQ ID NO: 100445 - DNA, 201 bp, Bos taurus; identical to SEQ ID NO: 19140

SEQ ID NO: 100446 - DNA, 201 bp, Bos taurus; identical to SEQ ID NO: 19141

SEQ ID NO: 100447 - DNA, 201 bp, Bos taurus; identical to SEQ ID NO: 19143

SEQ ID NO: 100448 - DNA, 201 bp, Bos taurus; identical to SEQ ID NO: 19145

SEQ ID NO: 100449 - DNA, 201 bp, Bos taurus
tggctcagagccctgtgttttggaaggtgccagttaaagtacaaattgattacttgatgtgtaccacacttagagaatgtgaagcttcactcagtccttcagggggtgtctatgaagcatgtgtgctggcctcagcttttgaatgcattgggggctacagacaagtttcaaagataagggaacataagagggacaactatc

SEQ ID NO: 100450 - DNA, 201 bp, Bos taurus; identical to SEQ ID NO: 19148

SEQ ID NO: 100451 - DNA, 201 bp, Bos taurus; identical to SEQ ID NO: 19149

SEQ ID NO: 100452 - DNA, 201 bp, Bos taurus; identical to SEQ ID NO: 19150

SEQ ID NO: 100453 - DNA, 201 bp, Bos taurus
taagaaatattttaggttttatgggacacttgcagatatctgttgcatagtctttgctttaaaaaaaaaaaaaaacttctttataaatgcaaaaaccattattggcccttaggccatacaaaaacagactctagaccagatttggcccaggggctgtagttggctgacccctggcctggaacattctgactcccatgaggc

SEQ ID NO: 100454 - DNA, 201 bp, Bos taurus; identical to SEQ ID NO: 19152

SEQ ID NO: 100455 - DNA, 201 bp, Bos taurus; identical to SEQ ID NO: 19153

SEQ ID NO: 100456 - DNA, 201 bp, Bos taurus
ttgtgaatgaaccttagttttaaattctcatgtgtgaactttgcttcctgagaatcccatccaggtggaattacctgacaaagactgtgcggagttgaaccgcctgattaatatctgtaaggtatgcagagcagcgcaaggcacctcggaagtgcatttttagcattaactatttattagaaacattcttgtcgtacttgt

SEQ ID NO: 100457 - DNA, 201 bp, Bos taurus; identical to SEQ ID NO: 19163

SEQ ID NO: 100458 - DNA, 201 bp, Bos taurus; identical to SEQ ID NO: 19164

SEQ ID NO: 100459 - DNA, 201 bp, Bos taurus
accccttggagccatacttagctgctgggggaccacagtggtggttacccatagatggcagggacacagcagactctgctcctaagggcccatgagagagttggagatgcttgggtccctgcctgcatctgggaagtagcaccttgttcctcctctgcaaggttgatgctctcttgttctcagaggtaggccactgggctc

SEQ ID NO: 100460 - DNA, 201 bp, Bos taurus
atttgcctgctctcagaatctcattattccttgtgatgtattcggtcttactgccaccttttaatacatccattctgcctgggcttttaagaccttcattacttcaatacatttagtttcaaatgttccgcctggaagggctccagccttcttgttctcacaaatatgaattcaattctggtaattgctaaatggatacac

SEQ ID NO: 100461 - DNA, 201 bp, Bos taurus; identical to SEQ ID NO: 19167

SEQ ID NO: 100462 - DNA, 201 bp, Bos taurus; identical to SEQ ID NO: 19168

SEQ ID NO: 100463 - DNA, 201 bp, Bos taurus; identical to SEQ ID NO: 19169

SEQ ID NO: 100464 - DNA, 201 bp, Bos taurus; identical to SEQ ID NO: 19170

SEQ ID NO: 100465 - DNA, 201 bp, Bos taurus; identical to SEQ ID NO: 19171

SEQ ID NO: 100466 - DNA, 201 bp, Bos taurus
acttcctgcttccagagaagagaatcgtgtggtcagcttgcatcatgttgaataaatgcctttcgggtcactgaccagtgtgccactgaaggccatttcgtactaaattccttacaagggtcttgaccgtgaagcttgggagtgctcagaaggtgaccaaggatccaaagagggtccccaaagtccctgcgggaaactccc

SEQ ID NO: 100467 - DNA, 201 bp, Bos taurus; identical to SEQ ID NO: 19175

SEQ ID NO: 100468 - DNA, 201 bp, Bos taurus; identical to SEQ ID NO: 19176

SEQ ID NO: 100469 - DNA, 201 bp, Bos taurus; identical to SEQ ID NO: 19177

SEQ ID NO: 100470 - DNA, 201 bp, Bos taurus
ctcctttccccggggtgccctcttcaccaccagagattaggagagtcccagcccagccctcaaagggacttgcctgcccagctaccccaagagacagggatattaaagggccctcccgtgggacccaccttccacgctgatcttcctgaagtcatggacgagacagccatcccgccttgcttgtccggtccacttcaaatc

SEQ ID NO: 100471 - DNA, 201 bp, Bos taurus; identical to SEQ ID NO: 19178

SEQ ID NO: 100472 - DNA, 201 bp, Bos taurus; identical to SEQ ID NO: 19179

SEQ ID NO: 100473 - DNA, 201 bp, Bos taurus; identical to SEQ ID NO: 19180

SEQ ID NO: 100474 - DNA, 201 bp, Bos taurus
ggtggaccgaggttacaggactggccaaggcgggcaccacgttcttggcagagcgcagctccccgcacgggcagtgtcggtcccagacctgatcgttcctcctcggtgcctctccctgcagaaaaaaatcagacggtgacgctgacaataataattagcttttcactgacttcagtgctaatcctccttcaagtcgctttg

SEQ ID NO: 100475 - DNA, 201 bp, Bos taurus; identical to SEQ ID NO: 19184

SEQ ID NO: 100476 - DNA, 201 bp, Bos taurus
tgcgaggctggcgggctgccagggaagagtggccagtccagaacccccagttctcagtgtctgcactgctctggctctctgcatttgccctgagacacataaacacctgtcctgcaggcccatcaggtaggtgtctttcggtcagagttagtgaccacggggggcaggggaccgggctctgcaggggcggctgtcaccatg

SEQ ID NO: 100477 - DNA, 201 bp, Bos taurus
cacccatgtcattggctgaggtgcatcgctggctttctctggttggtcgtgatttgcagggcaagcgtgagggaggctgtcagttactaatcccatcccaatcatttggggccagttgttacaggcgtggatgtttcactttctgaactgtctctagagacagaggtctgccttcctaaaacaatagcgggcagcaaccgg

SEQ ID NO: 100478 - DNA, 201 bp, Bos taurus; identical to SEQ ID NO: 19185

SEQ ID NO: 100479 - DNA, 201 bp, Bos taurus; identical to SEQ ID NO: 19186

SEQ ID NO: 100480 - DNA, 201 bp, Bos taurus; identical to SEQ ID NO: 19188

SEQ ID NO: 100481 - DNA, 201 bp, Bos taurus; identical to SEQ ID NO: 19189

SEQ ID NO: 100482 - DNA, 201 bp, Bos taurus
acgacgggcctggccaccatgcacctcaccggtaggaccaatttcaaatcgcagggcttccaagaccgactgcctcagcaccactaaggcggtgaatggatgtgtgtggagatccctctctggggtcacagagtcactgagcaggagaaagaggacaaggggcccaaacccgttaggtgtgagaggtaaactcaaagggtg

SEQ ID NO: 100483 - DNA, 201 bp, Bos taurus; identical to SEQ ID NO: 19190

SEQ ID NO: 100484 - DNA, 201 bp, Bos taurus; identical to SEQ ID NO: 19191

SEQ ID NO: 100485 - DNA, 201 bp, Bos taurus; identical to SEQ ID NO: 19192

SEQ ID NO: 100486 - DNA, 201 bp, Bos taurus; identical to SEQ ID NO: 19193

SEQ ID NO: 100487 - DNA, 201 bp, Bos taurus; identical to SEQ ID NO: 19194

SEQ ID NO: 100488 - DNA, 201 bp, Bos taurus; identical to SEQ ID NO: 19195

SEQ ID NO: 100489 - DNA, 201 bp, Bos taurus; identical to SEQ ID NO: 19196

SEQ ID NO: 100490 - DNA, 201 bp, Bos taurus; identical to SEQ ID NO: 19197

SEQ ID NO: 100491 - DNA, 201 bp, Bos taurus; identical to SEQ ID NO: 19198

SEQ ID NO: 100492 - DNA, 201 bp, Bos taurus; identical to SEQ ID NO: 19199

SEQ ID NO: 100493 - DNA, 201 bp, Bos taurus; identical to SEQ ID NO: 19200

SEQ ID NO: 100494 - DNA, 201 bp, Bos taurus; identical to SEQ ID NO: 19201

SEQ ID NO: 100495 - DNA, 201 bp, Bos taurus; identical to SEQ ID NO: 19204

SEQ ID NO: 100496 - DNA, 201 bp, Bos taurus; identical to SEQ ID NO: 19205

SEQ ID NO: 100497 - DNA, 201 bp, Bos taurus
gctattcctgagttgcgtcctttatattaaactggtcatctagttggtgaatgtgtctgggttctgtgagatgctctaacaaattaactgaacctgaggaggtggttgtgggacacttcagcccagtccatcagtcagaattataggaaaaagattggatttacaactggtatgtgaagtgctgggggtgcagtcttgaac

SEQ ID NO: 100498 - DNA, 201 bp, Bos taurus; identical to SEQ ID NO: 19207

SEQ ID NO: 100499 - DNA, 201 bp, Bos taurus; identical to SEQ ID NO: 19208

SEQ ID NO: 100500 - DNA, 201 bp, Bos taurus
cctcctggtgtggcctcagagctgggtcgcccctttcctctgcccgtttgcgctccggttgtgccattgtcatcttgagctgaacccatcgaaagtctgtttctggccatctccaatggcgagtcctctgctggcccatgtagagctccatgctggagtctggttgccgagcagtgcccccaccccagagcccgctgcctc

SEQ ID NO: 100501 - DNA, 201 bp, Bos taurus; identical to SEQ ID NO: 19209

SEQ ID NO: 100502 - DNA, 201 bp, Bos taurus
gagtagcaaatgacctccacccatggccgcttcttactatggctccccatggggaaagaggtagcaatggagccacttgataaatgctggtctggaggtttgtgcaagtgggaatcaggcccggaggcgtagctgccatgtccgtgtaggagtgttgcctgctcttcctagagactgaggtccttctcccatcttgagaaa

SEQ ID NO: 100503 - DNA, 201 bp, Bos taurus; identical to SEQ ID NO: 19210

SEQ ID NO: 100504 - DNA, 201 bp, Bos taurus
cttagggtataataggcagcaactagacgtggtggcaataaggatatccttcttcccttagagccatcatgaccgctgctcttctggttgaggccacagagaaatcactgtgggaccccctttactgatccttgtacctcattccgtagaaactcttctgaattgtcatcacactcaacaattctgtcatcggcctcaatc

SEQ ID NO: 100505 - DNA, 201 bp, Bos taurus
ccacatccgagtttagtgttctaagggccatggacagctcccagtccttcctaccacatgctctggtagggagcacttgcttggacacctcatgcaagtcgcttactctcggccttcgtcatcctttgtttcagggctgtgtttgcatttgtgtgtgtatggttatatgtgtggaatgtgtggaatgtatatgaagtgatt

SEQ ID NO: 100506 - DNA, 201 bp, Bos taurus
agacattatttaaaaaggaataataattgtaaaacaaagagatgagcctggtggttctcaatatcagaaatactctggcagcttaaaacagggcccctcctctgctgtgaagtcgtgctttctctggtcaggggtgcagcccagtcctggagtttcaggagctccctgaaggggtttgcggcacagcccagtggtggggcc

SEQ ID NO: 100507 - DNA, 201 bp, Bos taurus
gagaccttgggcgacactcctacccggaggcccagggaggagacaagccttcaccctacttttcccacttcttcctgttctccacccaaaagcactggcagcggaggccaggatgggggaggacccggcagaaagtaggaggcaacctgggtctggggacgggcagggctgaggttggaggccgggatacacatgcagggg

SEQ ID NO: 100508 - DNA, 201 bp, Bos taurus; identical to SEQ ID NO: 19212

SEQ ID NO: 100509 - DNA, 201 bp, Bos taurus; identical to SEQ ID NO: 19216

SEQ ID NO: 100510 - DNA, 201 bp, Bos taurus; identical to SEQ ID NO: 19217

SEQ ID NO: 100511 - DNA, 201 bp, Bos taurus; identical to SEQ ID NO: 19218

SEQ ID NO: 100512 - DNA, 201 bp, Bos taurus; identical to SEQ ID NO: 19223

SEQ ID NO: 100513 - DNA, 201 bp, Bos taurus; identical to SEQ ID NO: 19225

SEQ ID NO: 100514 - DNA, 201 bp, Bos taurus; identical to SEQ ID NO: 19231

SEQ ID NO: 100515 - DNA, 201 bp, Bos taurus
tctaaaagcgttgcccagaagaacagcagcagttgtagagtgaatgagagggagatgcaggaagatgaagtggagcataatgtagtgcaggccagaagagctgctagccacgagccaagatagagactggggggcggaagagtgactgggtttggtctatagttaccaggcacctagtctaaagatattccttttattttt

SEQ ID NO: 100516 - DNA, 201 bp, Bos taurus
gcttcacgttttttacattctccagctctctgattggttcagccttatgcaaaatagggcttgtacccaccaccaattagggaagggaatgcaaacggtcgcactcttaaggctaatcagtgaagagggttgtctcggggcggagggggggcctgttttcctgccagaaggtctcactcccgccctccgcttcctttttgt

SEQ ID NO: 100517 - DNA, 201 bp, Bos taurus; identical to SEQ ID NO: 19232

SEQ ID NO: 100518 - DNA, 201 bp, Bos taurus; identical to SEQ ID NO: 19233

SEQ ID NO: 100519 - DNA, 201 bp, Bos taurus; identical to SEQ ID NO: 19234

SEQ ID NO: 100520 - DNA, 201 bp, Bos taurus
accaggctcctccatccatgggattttccaggcaagagtacaggagtggagtgccattgctttctctgaaggctctactaaaatgatgtaattaagaaaagaaagtgtgttggaatcactaggaactgtgtgtgggacaccagtggcagggagtaagcaatgatgaaggaacagagaggaaagggaatgaggtgaagtagt

SEQ ID NO: 100521 - DNA, 201 bp, Bos taurus; identical to SEQ ID NO: 19238

SEQ ID NO: 100522 - DNA, 201 bp, Bos taurus; identical to SEQ ID NO: 19239

SEQ ID NO: 100523 - DNA, 201 bp, Bos taurus; identical to SEQ ID NO: 19240

SEQ ID NO: 100524 - DNA, 201 bp, Bos taurus; identical to SEQ ID NO: 19241

SEQ ID NO: 100525 - DNA, 201 bp, Bos taurus; identical to SEQ ID NO: 19242

SEQ ID NO: 100526 - DNA, 201 bp, Bos taurus; identical to SEQ ID NO: 19243

SEQ ID NO: 100527 - DNA, 201 bp, Bos taurus; identical to SEQ ID NO: 19244

SEQ ID NO: 100528 - DNA, 201 bp, Bos taurus
cctaccttgttgagtttctttttacagtgaattgacattgaattttatcaaatgccttttgtgcatcttttaaaatgatcacgtgctttgtcatttattttgctaatgtgatcaattacaatgattgattgccttatgttacaactgttgcacaccgccagtaggatatacgtcagttactcatgatgtgttgtatattac

SEQ ID NO: 100529 - DNA, 201 bp, Bos taurus
aataaaatggcctggctctgaatgttagaccagcttgtaatgacattgtggtctacctgtaaaatcagtccctgatatcaagggcttccttctttgttttacttctctgctggcctagccagggactctcctccccactggggacaggaccccatcactctgttccttggccctgctttgcttagggtggttccctttcca

SEQ ID NO: 100530 - DNA, 201 bp, Bos taurus
gactacaagcatgaaactgcctatctcaaagataatgattttttaaaagcactgctttaaaatattactcattttgattactgagtttaggcatccacttcgattttgcactggaagagtctactccgttctggagattatcctgttagagactaagagctttagcagcccaagaacaacccactgcagcccatgattcta

SEQ ID NO: 100531 - DNA, 201 bp, Bos taurus; identical to SEQ ID NO: 19245

SEQ ID NO: 100532 - DNA, 201 bp, Bos taurus; identical to SEQ ID NO: 19248

SEQ ID NO: 100533 - DNA, 201 bp, Bos taurus; identical to SEQ ID NO: 19249

SEQ ID NO: 100534 - DNA, 201 bp, Bos taurus
cacccatcatcttcatctctcctgggtgactaaggaagttgtagagaaaacctggtttggattcatgaaaagccccacagaaggcccctctacaggggaaggagagcctgccggggtcttctgcccacaggaagccaggctgcttcccctgctctagggctcggaacagccacaccttgctcacccgcctgagatctgcag

SEQ ID NO: 100535 - DNA, 201 bp, Bos taurus
aaaggcaaatgctcccctggtggcctgctctgcagtgaggctctgcaagtcactcctaagaactcaacctgaagttcctttcttcacctttccaacaaatgccatatgccatttaacaccctgtaataaatttccctctgcttaaaccagctagagtggattctgttctctgcaagtggaccttgactgatacaatcagta

SEQ ID NO: 100536 - DNA, 201 bp, Bos taurus; identical to SEQ ID NO: 19250

SEQ ID NO: 100537 - DNA, 201 bp, Bos taurus; identical to SEQ ID NO: 19251

SEQ ID NO: 100538 - DNA, 201 bp, Bos taurus; identical to SEQ ID NO: 19253

SEQ ID NO: 100539 - DNA, 201 bp, Bos taurus; identical to SEQ ID NO: 19254

SEQ ID NO: 100540 - DNA, 201 bp, Bos taurus
gggggcataagagaagtccttgtgattgaaacagcaaaacagaaatggggagaaaagatgtaagccactggttctggaaatagagaaaggggccataaaacaaggaatacaaagaaggtggctccagattctggaaaagccaaagtaatagaatcccctccccaccacacctcacctcccggcctctggactccctgtcag

SEQ ID NO: 100541 - DNA, 201 bp, Bos taurus; identical to SEQ ID NO: 19255

SEQ ID NO: 100542 - DNA, 201 bp, Bos taurus
aattattttgttaactagcattttcacttatttatacttactattaaataaagcaaccccatcagcattgtagtgatataaatctcgctattccccaatgtgtgcagaaagttcactgcttgcaatagcatgactctccaagtccaattatccaggctgtttgatgcaacattcatctgactagtattaaagacaatgatt

SEQ ID NO: 100543 - DNA, 201 bp, Bos taurus
tctaattcatcattgtttaaaagacacctgtgagttctaactggaaaagacaagacagagaaacgcagatggtcacattttgcattatatctatcacatttttttgtactctaattagaggaggaactcattctccacaggaaaaagatactgcttaattgaatatttgaataaaagccagtagatacagtattcaaaaca

SEQ ID NO: 100544 - DNA, 201 bp, Bos taurus; identical to SEQ ID NO: 19257

SEQ ID NO: 100545 - DNA, 201 bp, Bos taurus; identical to SEQ ID NO: 19258

SEQ ID NO: 100546 - DNA, 201 bp, Bos taurus
cccctgccccttgccgaccaactgctcatctgggttttgagatcatagataagtttacacctttgaaaggaaggattcatacaaagttgacagtgttgagaacttcattaatattgacctccagcaaattagcccaaaggttaacaagttgaagaagccttcagaatcaaagagcaaagaggagttgatgaagaatccata

SEQ ID NO: 100547 - DNA, 201 bp, Bos taurus; identical to SEQ ID NO: 19259

SEQ ID NO: 100548 - DNA, 201 bp, Bos taurus
ctaatatgatctattattttagaaaaatgcagcatcttaagttcagtaaaacttttgtcagtttatatatagttcattgttcatgttcatatttcgtcacgtttgactctttgtgatccattggactgtagccctctacagtcaggctcctctgtccgtgggattttccaggcaagaatactggagtgggttgccatttcc

SEQ ID NO: 100549 - DNA, 201 bp, Bos taurus
aaaactgaacgtaaagtgcttcttttctacttttctaaactactttttctagggacttttatttctgagagcattaagcaagtcttcaatttactggactaatttaaaattctaaccccccccctttttctctcctcacacacatccgtatttttctctctgttccccgctttgctctctgagcttcgtacttgtgtaaga

SEQ ID NO: 100550 - DNA, 201 bp, Bos taurus; identical to SEQ ID NO: 19260

SEQ ID NO: 100551 - DNA, 201 bp, Bos taurus
ttttttacaagccacccagggtctgttacagcatcccaagtagactaaggtggcttgtgaagcatgcgcatactccaggcctttggggcctttccaaacctatggaatcagaaagttctgcagaagacgctcagaatctgtatttttaacacccaactgagttgattcttatggccagagaaatttggaaactctgttata

SEQ ID NO: 100552 - DNA, 201 bp, Bos taurus
gattcatgggcctaacattccaggttcctatgcaatattgttctttacagcaatggattttactttcactaccagtgaaattttacatccacagctgagcatcatttccactttgcctcggccactttcttctttctggagctattagcaaatgccctctgctcttccccattagcatactggacactttctgacctggag

SEQ ID NO: 100553 - DNA, 201 bp, Bos taurus; identical to SEQ ID NO: 19261

SEQ ID NO: 100554 - DNA, 201 bp, Bos taurus; identical to SEQ ID NO: 19262

SEQ ID NO: 100555 - DNA, 201 bp, Bos taurus; identical to SEQ ID NO: 19263

SEQ ID NO: 100556 - DNA, 201 bp, Bos taurus
atataagtacaaaatactggcaaactgaatgcaatagcacattaaaaagatgacatagtatgaccaagtgggatttatcccagaattaaagtgattcaacataagaaaatcacatcaatgtaatatatcacattactagtatgaagaaaaaaaaaacacattatctcaattgatgaaaaagaaaaaaggcacttaagatag

SEQ ID NO: 100557 - DNA, 201 bp, Bos taurus; identical to SEQ ID NO: 19264

SEQ ID NO: 100558 - DNA, 201 bp, Bos taurus; identical to SEQ ID NO: 19265

SEQ ID NO: 100559 - DNA, 201 bp, Bos taurus
atccaaggagctttttcttgaatccaacaaaatagttttttttcatttacgatctaatgtgtctggagtgagcattgactttgtgtcctttctaacagatgaccatgaagtctgacacaggttgcttagcaactccttatgcccagaagtagaaataactctttgatatactcactatgtgtatttctactgatttatttc

SEQ ID NO: 100560 - DNA, 201 bp, Bos taurus
tctagaaatttcaagtactagattcaagaaattaagaaatcttgcttagatttattgtttttatcctttggtcttcatcttctgggagtttcagacttgagtacaagactccttaaaaagtaaactaaaactgtgtgttaaatagttaatcatatagtgtttgcaaaggcatcacagttgagggctgaattatataactca

SEQ ID NO: 100561 - DNA, 201 bp, Bos taurus; identical to SEQ ID NO: 19266

SEQ ID NO: 100562 - DNA, 201 bp, Bos taurus; identical to SEQ ID NO: 19267

SEQ ID NO: 100563 - DNA, 201 bp, Bos taurus; identical to SEQ ID NO: 19268

SEQ ID NO: 100564 - DNA, 201 bp, Bos taurus; identical to SEQ ID NO: 19269

SEQ ID NO: 100565 - DNA, 201 bp, Bos taurus
tgttaatgatatagctggatttctactattcattcagtgagcatatgaagttaagggttcagggaagaaacatctgttattttcctatgtacaaggccatgacagagattatagatactacttcacaacactgtgttcaattatctgatgcaccaagaaacacaaattccacttctcccaaggccaagatacttgtgctat

SEQ ID NO: 100566 - DNA, 201 bp, Bos taurus; identical to SEQ ID NO: 19270

SEQ ID NO: 100567 - DNA, 201 bp, Bos taurus
agcacagcatttagatgcttttaaaagttgactaaaaagtgacctataaaacagtattggattgatagttgttgggcattatattctaagtgatttcatctaattctacataccaaatagcatctatggttcatgacaattttatcagttatctactactgcataataagttaccacaaacctagtagcttagcagtttct

SEQ ID NO: 100568 - DNA, 201 bp, Bos taurus; identical to SEQ ID NO: 19271

SEQ ID NO: 100569 - DNA, 201 bp, Bos taurus; identical to SEQ ID NO: 19272

SEQ ID NO: 100570 - DNA, 201 bp, Bos taurus
tcagatgattcttaatattacatgtcaaatatgtaagaattgatacggaagttttgaagaaaatagtgaggacctaccatagcagaaattaaaggaaaatataattattgtgataaaagaagcatgccacaatgaatacataaatcagtagatggaatagaaagcttagaaataagaatttcatatatgatatatattatc

SEQ ID NO: 100571 - DNA, 201 bp, Bos taurus; identical to SEQ ID NO: 19273

SEQ ID NO: 100572 - DNA, 201 bp, Bos taurus
gccagtgacaatggtgtcattggtatgtgtcatttggtatagcctgttgtgttttgaaatatacacagtaagtgtttaaataatatagtatggctataatgagactccatttttagacaaagatatgaaaaagatcacagagtgagacagatttcaagaagatgacaaagcaacaattgtttttgtttttgtttttgtttt

SEQ ID NO: 100573 - DNA, 201 bp, Bos taurus
tgtggaggaaaaaagaaagaattggaaataagaacagaagagggtgccttgggtttgaagatacacagggggagtcatgctggttaatactctctgttgaatccaaaaagagtctgtagagactgtagcctcctttttatgtttcctcatcttggtttgctctgcttcagggtgtttctagtggtctcaaaaatatcacaa

SEQ ID NO: 100574 - DNA, 201 bp, Bos taurus
tcaacccactaaaccttgcatttgcagagcaaagaaatgcagttacagcacatttgttaacacaggataggattagcagtcctactgcgtgacaagtaatacaaaataatcccaacagaaaatactagtttctagccggcccttcagaaatgtttgttttacaagacagcataatacttgttaaaacaagatgatgtcagc

SEQ ID NO: 100575 - DNA, 201 bp, Bos taurus
gaagcttaaaacccatccactgggactcactgacctacttcccacacagttgtctgatcaaagctctctggcttgttcctctgtggctgaatgtctgtctcgataaactttcaaactccacattccttctgggtcaggtttttaccttgcttatccagctccccttctagtctttgcttttgagtagagttctgactggca

SEQ ID NO: 100576 - DNA, 201 bp, Bos taurus
attaggggcctgccaatgaaactgtaattttgagaagttacttaatacaagtgtctgactgtcttttttttttttttttaattatatatttattttcattggaggataattggccttctctcatagctcagtcagtaaatcacctgcctgcaattcaggagacccaggtttgattcctgggttgggaagatcctctggaga

SEQ ID NO: 100577 - DNA, 201 bp, Bos taurus
cttgagaaaagcccagtggtctggtactatattcattttaagagtttgaggtcagcttttatttttctgagctctgtggaatttgtctgcgacaagctagatatgacaaccggatctgactttcccagactcctttttcctggttatccttgtgcttcaaatattctctaagttggcaaagattagaatatacaggttcat

SEQ ID NO: 100578 - DNA, 201 bp, Bos taurus
tttaggtcatacctgaatggtctagttgttttccctatcttcttcaatttaagtctgaatttggctctaagacctactgagtcagaaaatctgggcctggctcccctcccagctacccgtgttgagcaagtcctcctggtgactctggagcagactaatggttgagaaatgtggcttttccctttcttttctattttgtgt

SEQ ID NO: 100579 - DNA, 201 bp, Bos taurus; identical to SEQ ID NO: 19274

SEQ ID NO: 100580 - DNA, 201 bp, Bos taurus
catgttcctttgtgaaagctatagtatccagtcagataaatcctatcaataaaactgataaacagcaagagatagcaagacacagcaatctttgttttctggcaaatgacataaataacacacaaatgttttcatgacatgatgtcaaaatttagtcacgagaagtctcaaagatgcagatcaaactgaccatctgcacag

SEQ ID NO: 100581 - DNA, 201 bp, Bos taurus; identical to SEQ ID NO: 19275

SEQ ID NO: 100582 - DNA, 201 bp, Bos taurus
gaaattttcctggagctaaacatccattctcccccagtccttatagtctgaggaaatctgaatgcttgaactggaaagttgggtgagtcaggccactgatccaacttttttcttctacattccacctctattctatgggtttctccggtggctcagtggtaaagaataggcctgcaatgcaggagatgtaggtttgatccc

SEQ ID NO: 100583 - DNA, 201 bp, Bos taurus; identical to SEQ ID NO: 19276

SEQ ID NO: 100584 - DNA, 201 bp, Bos taurus; identical to SEQ ID NO: 19277

SEQ ID NO: 100585 - DNA, 201 bp, Bos taurus; identical to SEQ ID NO: 19278

SEQ ID NO: 100586 - DNA, 201 bp, Bos taurus
tgggtgggtggcaatttcaatgtgtgcaactcaccatagtgaaggttccagaataggaaaaggagtcaggttaaatatatgctaagtttaagttttcatctggctgcaatcttcctttgacttgggaaattcttgtttagaaatagaatccagtatgtctttcacattgtaaaatattggcaaggtatcttaatttccccc

SEQ ID NO: 100587 - DNA, 201 bp, Bos taurus
aaaaatactgcctatcccttatataagaagatgggaaacagacaaaagttgtatactactgatcaagaccacacttaaaggccctatctggctgactcccggaaagatggctctgtatggaaaatggaaataaattttgatggtgaccttgatttctttagaaggaaaacaagcttaagggtgcatagaactggcccactt

SEQ ID NO: 100588 - DNA, 201 bp, Bos taurus
agcacagcaaaatatccaagaacagatccactgaagggggttagaacacttttcctttactggcatggccactcccccagcgtggcccagctcagttgcaaaaaaggctccattcagtcccagatttccctcagcatcgggatggagtgtttagcttcctgtgcctcgcaggatgctgccgcagaggccacttctttctca

SEQ ID NO: 100589 - DNA, 201 bp, Bos taurus
ctttcccaactttctttcatgcctcaacacgtgctctgatatctatttggagtttctctgttttttgaaaaactctattcaatactttcaattaaaattcttctcccttttcaacacctatccatgtgaagaagagttaaaagctctcagagtcttgctagattttggttcaagatggtgacacaggaagctcctgaactc

SEQ ID NO: 100590 - DNA, 201 bp, Bos taurus
tttttcttactatattatttctgaagctttctggaaatgtcccaagaagaactgtgtgaaagatgctttgacccacttaaagagttatttaccctgtgatacttttgggatggataaaataaatagtatagcctagtactggagatattttcttatattacaaattgaaatataaaatagaatatgttaaaagtagggatt

SEQ ID NO: 100591 - DNA, 201 bp, Bos taurus; identical to SEQ ID NO: 19279

SEQ ID NO: 100592 - DNA, 201 bp, Bos taurus; identical to SEQ ID NO: 19280

SEQ ID NO: 100593 - DNA, 201 bp, Bos taurus
tgtgggcactttatctctaggtacagaactgtttcaggcccaagatctattctttttgtggctgcagaatggggagggcagggataaagactgcccatgcaaatgctacctttccccaaaaatatccaaaaacctttttcattagtcatatccctaggcaaagggtatctcaatttagtaaacatatttttttgctgtaag

SEQ ID NO: 100594 - DNA, 201 bp, Bos taurus
aattcatattgatgtatggcaaaacccgttacaatagtgtaaagtaattatcctccaattaaaattaattaataaaaaataaaacaggaaaaaattctttgtctttaagaaatctaggcccacctttcttttcttatttctgtgctcttagccatttccccctttcctcattccacctttttatatatcctatattctcac

SEQ ID NO: 100595 - DNA, 201 bp, Bos taurus
ttatctagccaatgctaaaagagattcaaaatttcctctgtcattaaatttttcaccaaaatatcatcctcagggtaacctgggagaatctggatctattaaaggatgccttgacccttttcttccagacataagggtgtagtgatcaattgtgttaataatagcaattgtcagagtgctttttagaatttccacagtata

SEQ ID NO: 100596 - DNA, 201 bp, Bos taurus; identical to SEQ ID NO: 19281

SEQ ID NO: 100597 - DNA, 201 bp, Bos taurus; identical to SEQ ID NO: 19283

SEQ ID NO: 100598 - DNA, 201 bp, Bos taurus; identical to SEQ ID NO: 19284

SEQ ID NO: 100599 - DNA, 201 bp, Bos taurus
gcagtcctgtaaatcagcagttctacttctggaaacttgccttaaagaaacactcagatgttatcagtgttaatgtagtgtgctcataataataaagagatagaaacaaacagaacaagcacccatccagagttggttgaagaaattagcagttcatccatgtaatgaaacagtagttacaaataatgatatgacttcatt

SEQ ID NO: 100600 - DNA, 201 bp, Bos taurus; identical to SEQ ID NO: 19285

SEQ ID NO: 100601 - DNA, 201 bp, Bos taurus; identical to SEQ ID NO: 19286

SEQ ID NO: 100602 - DNA, 201 bp, Bos taurus; identical to SEQ ID NO: 19287

SEQ ID NO: 100603 - DNA, 201 bp, Bos taurus
aatgctggaaatgagatgaacaaaatagtccctgactgcctggatttcagagtatagaagaaaatccaaaattataatcacaatgtgtctgtgtattcatccactcagtcatgtctgattctttgcgacgccatggactgtagcctggcaggctccactgcctatggtattttctaggcaagaatactgcagtgggttgcc

SEQ ID NO: 100604 - DNA, 201 bp, Bos taurus
agacccttaacttagtgacatcttttgccatacgatataatattcattcttttgcttcatatggtagtattcagttggggtcattttttttttggcctaccatctgctgccttactctttctttgcaatctttggcttattctatctatctggatttttttgttgtttgttgattattctatattctggcccaccttgtaa

SEQ ID NO: 100605 - DNA, 201 bp, Bos taurus
aacacataccacttccctctgtcataaaggctggtagtccggaaatagaagaccatagaagccccccgaacgtacaagtctcttggtggaagtttagacgttggtccaaagagttaaatgcttcgagatgaacatgaaaggggctaagagtgggcagaaaaagtctacgctgtacattcagaaaggtagaagttcaccagt

SEQ ID NO: 100606 - DNA, 201 bp, Bos taurus; identical to SEQ ID NO: 19288

SEQ ID NO: 100607 - DNA, 201 bp, Bos taurus
gtcttaacatattttatcactgtgtctttttaagaaagcaaattaatcagaccactaataactttaccatccttgggtgacttaaaagtgccaccatctgactttcttttacttaaataggacagctgaaaggcatagacatgttttgcatgtattatataaaaacaatgaaatcccaaactgaaatgtagtattaaaata

SEQ ID NO: 100608 - DNA, 201 bp, Bos taurus; identical to SEQ ID NO: 19289

SEQ ID NO: 100609 - DNA, 201 bp, Bos taurus; identical to SEQ ID NO: 19290

SEQ ID NO: 100610 - DNA, 201 bp, Bos taurus; identical to SEQ ID NO: 19291

SEQ ID NO: 100611 - DNA, 201 bp, Bos taurus; identical to SEQ ID NO: 19292

SEQ ID NO: 100612 - DNA, 201 bp, Bos taurus; identical to SEQ ID NO: 19293

SEQ ID NO: 100613 - DNA, 201 bp, Bos taurus; identical to SEQ ID NO: 19294

SEQ ID NO: 100614 - DNA, 201 bp, Bos taurus; identical to SEQ ID NO: 19295

SEQ ID NO: 100615 - DNA, 201 bp, Bos taurus; identical to SEQ ID NO: 19296

SEQ ID NO: 100616 - DNA, 201 bp, Bos taurus; identical to SEQ ID NO: 19297

SEQ ID NO: 100617 - DNA, 201 bp, Bos taurus; identical to SEQ ID NO: 19298

SEQ ID NO: 100618 - DNA, 201 bp, Bos taurus
ttctaaggatgaattgtgaaattcaaagattttataatttgtaaatgtataaaattaatacttaaaaaactctagaaatgttttctccttttcttttacagctcattattatgcttcttttgattcagatgataagttaaactgttttctacctttaagataactggactatttgtgaaaacacataggataaatacaaat

SEQ ID NO: 100619 - DNA, 201 bp, Bos taurus
ttccttatagtttgtaggataaaatccagatatctttgcaggggcccacaaggctcttgccccctcattgaccctatctcccaactcccttcctgtacccactgagctcccaccacattggcctcctgtctggtgtgtgggcagtcagtctccttccatctcatgaaacgaactgctagtcacagttctggtggaatgttc

SEQ ID NO: 100620 - DNA, 201 bp, Bos taurus; identical to SEQ ID NO: 19299

SEQ ID NO: 100621 - DNA, 201 bp, Bos taurus
tagctggtttctctttctgattgttaagcccaaagtgaaagtccaagacagcagtaccataacaaacacactagtgctgacagactaagagaatgaatccgtttgttgctaataatttggagaggcctgtagcaatgccaccgtagatagccaagaactgtggtagatagctgtgttcagggactccatttaacccacagt

SEQ ID NO: 100622 - DNA, 201 bp, Bos taurus; identical to SEQ ID NO: 19300

SEQ ID NO: 100623 - DNA, 201 bp, Bos taurus; identical to SEQ ID NO: 19301

SEQ ID NO: 100624 - DNA, 201 bp, Bos taurus; identical to SEQ ID NO: 19302

SEQ ID NO: 100625 - DNA, 201 bp, Bos taurus
tttatttattgatgataaaaacaatgtaattaaataagctactaaaggtcacatggttcatgaattgcagacccagaatatagacccagagtctttctggccccagagcgtgtgtgttttcccatagcatcatgttagtaagcaaaatgacatttatataaaaaattcagagtaagacatgtctatttatgatgtacacct

SEQ ID NO: 100626 - DNA, 201 bp, Bos taurus; identical to SEQ ID NO: 19303

SEQ ID NO: 100627 - DNA, 201 bp, Bos taurus
ttatctcatcaattaacaccccagccacagatgcagaagcagaagggtggaatatcaccctgaaatactaacaaaaggggagatggaattgagacagagaagaggaaagtgctttatgtctactaggtggccacagttagcctcccaacccacgtactggatgagtccttaggacacgtgctcacatctctacaaagagtt

SEQ ID NO: 100628 - DNA, 201 bp, Bos taurus; identical to SEQ ID NO: 19304

SEQ ID NO: 100629 - DNA, 201 bp, Bos taurus
cttttaaaggtgtaaaatgtagtacaaactttttctctcatcattgttctccccatacttaggtctctctgttatcatacaatggggaagaaagggggaagaggaggtagtttgaagcaaagttgttgtattttcaaattactgaagaaatgtaacccattcacatccagatgagggtagttacaagtctagatatttccc

SEQ ID NO: 100630 - DNA, 201 bp, Bos taurus
cacccaccagcaggccagctgccataggaacccctaagcacccagccacctgatcaagctccacctgtcagagggcttaggactaagccccacctaccagtgagtaggcctagccccaggacttctggggatccatcagctagctagctatcagacatgtcctgcccactattggaatggtactagtcctggtacctggct

SEQ ID NO: 100631 - DNA, 201 bp, Bos taurus; identical to SEQ ID NO: 19305

SEQ ID NO: 100632 - DNA, 201 bp, Bos taurus; identical to SEQ ID NO: 19306

SEQ ID NO: 100633 - DNA, 201 bp, Bos taurus; identical to SEQ ID NO: 19307

SEQ ID NO: 100634 - DNA, 201 bp, Bos taurus
agatgggctaacttctttagattccattatgctctcaaactggttataaccaaagtatttcattttatctatagacaaatcttcctgaagtttctctattgaaaatttttaaattatataagtctgaatggccttctgtggttctggggacactggcttctgttctaaatggaactgttcatccaatattttccatcatct

SEQ ID NO: 100635 - DNA, 201 bp, Bos taurus
cctgttgtgtgacaactaccttggtatcttgtaagaaagatcactggctcagaactcagcaagtgttcaccatgggcctactgggttgccgttactaaattatgctttaaataatcttttgaacaggtattatgtttacagaattgtgacataggccttagatggaaaatataggtaagggcatacagaaatggtagagat

SEQ ID NO: 100636 - DNA, 201 bp, Bos taurus
cttatatctgcttgtgaatccatcttcataatttttgcttcctgccattgtactaaaacccagatgctcactcacaagctgaactccacatctgctaattactttgttggttctgagagggaaatttacttatttttgcactgtcttgattctcatagtttgtgccagccagtgagagagtgggcatattttctttctgtg

SEQ ID NO: 100637 - DNA, 201 bp, Bos taurus
tcccactgacatggcaaaccctcggccaattgtccttattatagcccctgtgtatttctccccagcgcacttgcacagggggaagacgtgagcgtggagcgtacttaactgccaagctgaatggctctgtaatgtagcttcagtatggcataaattaagctgtcatttttttggcagcaagtgcagagaggcgattttcct

SEQ ID NO: 100638 - DNA, 201 bp, Bos taurus
atctggcctgcctacctttccgctttgagtccctgtcttaccactgaactatttgttcccagccacaccggcttcttgactgtgcccaacatgacctaacttgtccctgcatctgggcctttgcactttgctttgctgtgcctggagagctcttccccctgtggcctccctcatcttcttccaatctctgcttaaccttcc

SEQ ID NO: 100639 - DNA, 201 bp, Bos taurus; identical to SEQ ID NO: 19308

SEQ ID NO: 100640 - DNA, 201 bp, Bos taurus
cggcattagtcagtcacatatatgatggcattttcccaagtatattctgtgtattcacactttcctttctaccagtcactttgaatttggggcccactctgcttgtatcagtgtgcttaagacaccctaacaaactgccatagaatgagtggcttaaacgtcagagatgcatttttctcaggctaagatttggttttccct

SEQ ID NO: 100641 - DNA, 201 bp, Bos taurus
gaggaacaagagagtgaccgtcagccttttaagaaggacctcaagcctaactgaagagttagggcatccaacaaaaaggagatgttaaagatctaatgtcgcattaccataaacttcactgacgggagaatgagagcgccttcgtaataatgggttcacgtgactgagtggtcagcatcgttatgccccccagtcatgttc

SEQ ID NO: 100642 - DNA, 201 bp, Bos taurus; identical to SEQ ID NO: 19309

SEQ ID NO: 100643 - DNA, 201 bp, Bos taurus; identical to SEQ ID NO: 19310

SEQ ID NO: 100644 - DNA, 201 bp, Bos taurus
gcgggaactgattcagacagacaggcgccctgctggaccgggcagtacattaggactgtcttccccccaccacctcatccctcctcctgggcctggagccgtctcagcactgcctccagattgctctgcaccatcctgtgctctgggggaatcccaccctccaggggcagggatttctgagttctgggcctagcgctctca

SEQ ID NO: 100645 - DNA, 201 bp, Bos taurus; identical to SEQ ID NO: 19313

SEQ ID NO: 100646 - DNA, 201 bp, Bos taurus
gtctgctccaggccggccccactagctcccagctactagcatgaacttgttgggagctgacctctcacgtgggtcttccatctggcccagccaggggataaggtctagctaggggtatattacctgccactggctgatctcacttcaaatgcatatcactaattgtccttggggccttcgggtgtcctaccctcgtactgt

SEQ ID NO: 100647 - DNA, 201 bp, Bos taurus; identical to SEQ ID NO: 19314

SEQ ID NO: 100648 - DNA, 201 bp, Bos taurus
caactccaaagattctgcttggccatgaaaatttttcactcagaagacctgagtgatggtctttgatggatttcaggcaagtacctgtgcgaattataagcatttgaaggtggtcaggccgagtcatattgggtgcacatccagttagtgtttatagcagagaaagtttattcatgaggcaaccaagcaaggagatgggag

SEQ ID NO: 100649 - DNA, 201 bp, Bos taurus
ggggagcagtttgatctttttcctacaatgaacacaaaatttattattataattttaactgcagcgggtcctcgtcgcaagcgtctgggcccctctggctgtggtgggcagtctctagaacacgcagctcagtggttgcagtgtgtaggaccttagttcccacaccagggactgaacctgggccccctgcaccacgagcac

SEQ ID NO: 100650 - DNA, 201 bp, Bos taurus
ttgattgattgaatcaggattgcctgtgtcttcgtatcactgaacagctgagattcacattgtagaaacttgctgccataagagatgtgaccttagtcactgtaatctgagacctgtaaaatgtagacattccctttctttgcttagtctgtgactagttgacctcattttccacagggcctatccatagcctgtcagtga

SEQ ID NO: 100651 - DNA, 201 bp, Bos taurus; identical to SEQ ID NO: 19315

SEQ ID NO: 100652 - DNA, 201 bp, Bos taurus
gtgtgttactctgaaagcatcccatttcatttggagaattggcatctgcccttctccccagtactgactcacacatttgaccttctcaaatccatggctcagtggggttgtgattcatcaaggggtttccagcaggtctgggtgtttgggaagaagcctcacccagagtcaagtacctagttcctttgagaagattctgaa

SEQ ID NO: 100653 - DNA, 201 bp, Bos taurus; identical to SEQ ID NO: 19316

SEQ ID NO: 100654 - DNA, 201 bp, Bos taurus
tactttctttcacttaatacctagagcttccacaagagggcaccacaactctagccagacacattttctaggcaagaataaaggaggggcatgggggcaggggaaggacacgaccaaggagaccagcagtgaccacctggctcgaggacagccagtctcttgaccactgactcacctcaagtcctgagacggaagtcctgc

SEQ ID NO: 100655 - DNA, 201 bp, Bos taurus; identical to SEQ ID NO: 19317

SEQ ID NO: 100656 - DNA, 201 bp, Bos taurus; identical to SEQ ID NO: 19318

SEQ ID NO: 100657 - DNA, 201 bp, Bos taurus; identical to SEQ ID NO: 19319

SEQ ID NO: 100658 - DNA, 201 bp, Bos taurus
taaattttttcaggaatattagtatcaggagagcacagccttaaaatatgttctgtgactcacagaatgaagataatgtttgacttctcttcaattatttggttactcagtaggttcagtcaataaaagccatgcagccataggctgatgcagttatggcagattgttgtgtaattgcatttagaaaatgcaaattaatta

SEQ ID NO: 100659 - DNA, 201 bp, Bos taurus
ttatttgtaattcacacatcaaaacatcagcctaagtcactatgacctctaataccttaaaaaattcttttgattataattttgattataattacaatagttctattaatcctttgatgatagcatatcactttacctgtggagcaggcagcttttcatagtcagtgaaagtaaatgaactaagtctgtattaaaattctg

SEQ ID NO: 100660 - DNA, 201 bp, Bos taurus; identical to SEQ ID NO: 19320

SEQ ID NO: 100661 - DNA, 201 bp, Bos taurus
gaataccatgagtagtcattccctattattaaaaatatactttttcatttgtcagttctgtactttgagataactctgtagatgtttgtttactgcctgaacatctacagaggtaaaaacagtggtctgagaaaccagggtcatttcagctgggagtttgaaagcttcaagttatacgtatcattaccaagtttggcttta

SEQ ID NO: 100662 - DNA, 201 bp, Bos taurus
tgtgtagtgtccacactcgacctaaactgtttggaagtttcagggccactttgagaatagctgagcaaacaataaggtgagccacggtaaacttttgaatagatgcaaagattgcaaacttatataaatgcatttgatttagtaggttaattacttagcagccttgcatagtggttaaaaggatatgccccgaacatagat

SEQ ID NO: 100663 - DNA, 201 bp, Bos taurus; identical to SEQ ID NO: 19321

SEQ ID NO: 100664 - DNA, 201 bp, Bos taurus; identical to SEQ ID NO: 19322

SEQ ID NO: 100665 - DNA, 201 bp, Bos taurus
gagtcaaggccttcttactcctgtcactatgagaacgctgaagaaacgggcatgtcatgaggttgtcaattggtttgtcatgaattgcagaacacaatgatggcatttgagaggccgaacattaatataaaagtgactatatcattactccaggcttttatatttgtagagactgtggagtcacataaagctatattttat

SEQ ID NO: 100666 - DNA, 201 bp, Bos taurus; identical to SEQ ID NO: 19323

SEQ ID NO: 100667 - DNA, 201 bp, Bos taurus; identical to SEQ ID NO: 19324

SEQ ID NO: 100668 - DNA, 201 bp, Bos taurus; identical to SEQ ID NO: 19325

SEQ ID NO: 100669 - DNA, 201 bp, Bos taurus; identical to SEQ ID NO: 19326

SEQ ID NO: 100670 - DNA, 201 bp, Bos taurus; identical to SEQ ID NO: 19327

SEQ ID NO: 100671 - DNA, 201 bp, Bos taurus
atatttaagcaagaaaaattacttgccagtaatgggagacaagatacaaaaggaagaagtagtgaaatctctgaacaagtaagtaggcaatggccaagagctaagttaaatctttatttactcactcattcaacaagttctgctgacctaattccatgtgctaagaactatggctaacatcaggccagttagaaaggtaag

SEQ ID NO: 100672 - DNA, 201 bp, Bos taurus
tgtgtcaacagtgaagacttacactaatcttaactggacaactgtatacagatgtgtcatccaaaatggttagcccaggggggtaaaaatgtatcttggtctcactattcatccagcaacagctgacaatttggcagcaatctatgttatgctaagatttcctaatactcctgcttgtattgtttcataggaggctgcttg

SEQ ID NO: 100673 - DNA, 201 bp, Bos taurus
gacaaaaagtaaattaaaaaaataaaagtactgcttttattattaaaattggaagcaaacaaatatatttgagggggagtttattgataatttcctaatgacatagtagataacacatctaaaccttgatgatttgaaattacctgttgacaaaattgggataatattgatgaaaaattttatgagccagttgtgggggac

SEQ ID NO: 100674 - DNA, 201 bp, Bos taurus
cagacatgctacttttcactaatgcgacagatgatttagaaaaatttaatgcatgctgtgagaaatgttgacacttatacccaggcaaagtgatggctgctagtaacataatgatgaccatttctgaaataatacattatttttctcatctgataatcaaaaactctgctctggttatgatcatcgatgctacacagctgc

SEQ ID NO: 100675 - DNA, 201 bp, Bos taurus; identical to SEQ ID NO: 19328

SEQ ID NO: 100676 - DNA, 201 bp, Bos taurus; identical to SEQ ID NO: 19329

SEQ ID NO: 100677 - DNA, 201 bp, Bos taurus; identical to SEQ ID NO: 19330

SEQ ID NO: 100678 - DNA, 201 bp, Bos taurus
tcttttccaatgagttggctgttcgcatcaggtggccaaagttttggaacttcagcctcagaatcagtccctccaataaatgttccggattgatttccttaaggtggtggttggccatctctacgcacttccccagcttcatacatcctgaatcccaagacagcaatcaactacaactcaactcatgatccttccttttct

SEQ ID NO: 100679 - DNA, 201 bp, Bos taurus
actgtacctaatttataaattaaagcttatcatatgcatgtataggaaaatacataggatatataagtttcactactatccactccttcaagcatcccctaggggtcttggagtatatcccctgaaaataaaggggaactactgcatttcattttttataagaatagaggatgtttttaaaacaaacacttcataataaat

SEQ ID NO: 100680 - DNA, 201 bp, Bos taurus; identical to SEQ ID NO: 19331

SEQ ID NO: 100681 - DNA, 201 bp, Bos taurus
ggtctacagatagaatatatggaaaaatataaatagctctatcatacttattaggtgacatttggataatgaaatggaaggaatgtctaaacttctatacataataagatatgactataatcccctcttataaagtagctgttctttacctggaggatccatgactcattggtaagggtatccatgtattggtttaagatg

SEQ ID NO: 100682 - DNA, 201 bp, Bos taurus; identical to SEQ ID NO: 19333

SEQ ID NO: 100683 - DNA, 201 bp, Bos taurus; identical to SEQ ID NO: 19334

SEQ ID NO: 100684 - DNA, 201 bp, Bos taurus
tcatgcttgcttcctctctatccaaatccttattaaacttacctaaaaaggggaataacttttggatttatctttactggtaacccctattgccttgcacatttgtacactatgaactaattagtatgttctcatttttcacatgttctgagcactcagaaatgtttggaatgattaagatataggcctttgcccttttga

SEQ ID NO: 100685 - DNA, 201 bp, Bos taurus
cagagtgtatgatcacactgaggaatgaggattttgaaagcccactagcaaaaaaccccaaaaacatgaaacagagtttatcccccaaatattttgtgcacagaaataattggcttaagcaatatccattttgtaagattgttcaagatgttaagtaagtttgttgtttaattaatgaaccagtcctaacaggaaacatga

SEQ ID NO: 100686 - DNA, 201 bp, Bos taurus; identical to SEQ ID NO: 19335

SEQ ID NO: 100687 - DNA, 201 bp, Bos taurus; identical to SEQ ID NO: 19336

SEQ ID NO: 100688 - DNA, 201 bp, Bos taurus; identical to SEQ ID NO: 19337

SEQ ID NO: 100689 - DNA, 201 bp, Bos taurus; identical to SEQ ID NO: 19338

SEQ ID NO: 100690 - DNA, 201 bp, Bos taurus
tataggagtgaaattgctggattatatggtaactctatttgtttaacattttgaggaactactaaattgttttccaaagtagcttcagtattttatcctcccacctgcagtggttgaagactgatttctctacaacttcatcaacactgatttcctgtatttttgtttatagtcattctactagatgtgaagtggtctctc

SEQ ID NO: 100691 - DNA, 201 bp, Bos taurus; identical to SEQ ID NO: 19339

SEQ ID NO: 100692 - DNA, 201 bp, Bos taurus
ttgaagggacggggaaataaagctgcattagggattaaggactagagtctcctcataggaactaaacccactgcaggtatgtctgacaggaaggagccagatccatgtggaggaagtagttactgactgcaagcctgcagagaaagagctaagaagtactgtggcttctaccatcctgtggactccatcctctcttccaaa

SEQ ID NO: 100693 - DNA, 201 bp, Bos taurus; identical to SEQ ID NO: 19341

SEQ ID NO: 100694 - DNA, 201 bp, Bos taurus; identical to SEQ ID NO: 19342

SEQ ID NO: 100695 - DNA, 201 bp, Bos taurus; identical to SEQ ID NO: 19343

SEQ ID NO: 100696 - DNA, 201 bp, Bos taurus
agtcagacataaggggtggagccatcaccatagcctccctctccccacatgcctgcatcagcagctgaacaatacagaggctggcccatcaaacgcacaacagccgactacagagcaggaccccaatccagggtgcccctggatgggcgaagctacgagaaggactggccaaagaggccttctgatcgccagctacaagag

SEQ ID NO: 100697 - DNA, 201 bp, Bos taurus
tttccccagctgactcagcctcccctccaagttagtctggattcctcctgatcttcatcctaccatcttgtagcagaggccactgtaactacactgcctgatgttcacccagcctttcacacaaggtctctggtacctccagcaggtgcctacataggccagggaaagtaagacggtaatccccatgtggcagaacctaat

SEQ ID NO: 100698 - DNA, 201 bp, Bos taurus; identical to SEQ ID NO: 19344

SEQ ID NO: 100699 - DNA, 201 bp, Bos taurus; identical to SEQ ID NO: 19345

SEQ ID NO: 100700 - DNA, 201 bp, Bos taurus
tcaagattgtgatgcaataaacataatcaataaatgtgagaaaatggagagaatttaatttttctttcattaaaaaataatgttaaaccaaacaggtcaataatgtagttgcttacaggttcaacatctaagtacgtgctatgttcttcttcatttggacttacgccttcaataggttctgcaatttctggacttgcatat

SEQ ID NO: 100701 - DNA, 201 bp, Bos taurus; identical to SEQ ID NO: 19346

SEQ ID NO: 100702 - DNA, 201 bp, Bos taurus; identical to SEQ ID NO: 19347

SEQ ID NO: 100703 - DNA, 201 bp, Bos taurus
acttgattttccatacatggtatggcaagagtccaatttctttcttttttttttcttttttgcatgtggcttttctaggtgccatttgttgaacaggccatcctctctctcacggaatgatcttggcactcttgttgagtgtcagctgaccataaacatatggattgacttctggactgtcggttatattctgttgatttc

SEQ ID NO: 100704 - DNA, 201 bp, Bos taurus
caaaaggctatgttattttaaatctgcacttagaagctttaggggcaagagatcagaggtggagtctcagggagaagaaagggtgccctatactgcttccgtgctttctttcctctctaccttcagccagaagaactctttaatcattagacattaggatgagtttctttctgaagaaacagatacatagttaaaactagt

SEQ ID NO: 100705 - DNA, 201 bp, Bos taurus
tggaaggatcatgataacagacaacctacctggtgctgaaatgacaacttcgggaaatctaggctggcagtgatgagtatggtctggaagtaaatgtttacagtgcatcgacccaagaacgtgactgaatttgacacagattgcctgaagcaccaaacaactggtgtaatatttacctttgccatttcccatcatttacag

SEQ ID NO: 100706 - DNA, 201 bp, Bos taurus; identical to SEQ ID NO: 19348

SEQ ID NO: 100707 - DNA, 201 bp, Bos taurus; identical to SEQ ID NO: 19349

SEQ ID NO: 100708 - DNA, 201 bp, Bos taurus; identical to SEQ ID NO: 19350

SEQ ID NO: 100709 - DNA, 201 bp, Bos taurus
atctcagtttaatacctattcccctattttacttgtgagtttgatttcttaagaaacaatcatggtaaaatatggcaatatctcagagagctgtccaaactctcaccacatgggttatcactgatctactatgtatttgatattaaagtcacctttattattcagaaatttggagctttaacttttttaaactggaaacta

SEQ ID NO: 100710 - DNA, 201 bp, Bos taurus
tcagggcactggatctcgcatgccacaactaagtcacatttcaaaagatcccacatgccacaaccaggacctggcacaccagataaatacgtatttaaaaaagaaaatgtgctcaacagagaagtttgcctaaaagataacttatttgcctgacccaacccatacgtgtagataaatccctcctctgagagtttatattcg

SEQ ID NO: 100711 - DNA, 201 bp, Bos taurus; identical to SEQ ID NO: 19351

SEQ ID NO: 100712 - DNA, 201 bp, Bos taurus
ggaaccagtggaactgagtaaaggctgttaggtaactaaatagcaatagctattatgcaaataaataaacaaatcatagtcatcacttggtcactccaaggatgctttctgctttgttgttgtttgagaaagttataatttaaggatttatggttttaaaaatggctataatatttaatgcatttatgtgtatctctttga

SEQ ID NO: 100713 - DNA, 201 bp, Bos taurus
tgcagagaaaatgtctcttattacttcattctgttctaacatttttcccttgaataccgcaatagtctaacacagaggaaagaacatgcttccaaaggagcagggtgaaagttattaacatatgtacatatatataaacataactgagtaaatatatacacacagagaaagagaggtacaactctttatgagcctaatgca

SEQ ID NO: 100714 - DNA, 201 bp, Bos taurus; identical to SEQ ID NO: 19352

SEQ ID NO: 100715 - DNA, 201 bp, Bos taurus; identical to SEQ ID NO: 19353

SEQ ID NO: 100716 - DNA, 201 bp, Bos taurus; identical to SEQ ID NO: 19354

SEQ ID NO: 100717 - DNA, 201 bp, Bos taurus; identical to SEQ ID NO: 19355

SEQ ID NO: 100718 - DNA, 201 bp, Bos taurus; identical to SEQ ID NO: 19356

SEQ ID NO: 100719 - DNA, 201 bp, Bos taurus
cacagtatatgggatgttttaaatagtctctaatgcatgagtgggaagtggggaggtgtagaaagtgagagaagagcatgaacaaaggtgggagagggtgcaaatgacactcctatgcagagaagtaaatacagatcagtgaggctagtgaaaggggtagctgagtaaacttgttattaaccgaggatttttccagaaatt

SEQ ID NO: 100720 - DNA, 201 bp, Bos taurus
tcctgtgatacaaaaatcccacttgactatttcatataggagcaaccaaacattttgttgttgtattcagtctccaaatcatgtctgactctttgccacctcatctattccagcacaccaatccttcaccaatccctgtccttcaccatctcctggagtttgcccaagtttatgtccatttaatcaatgatgctatcccat

SEQ ID NO: 100721 - DNA, 201 bp, Bos taurus
tcaaatgtattatcagagaggagtcatcaatggagaggatctggtgcagtatggataaaagtaaaaatgtaaacagaacatacagattctatgttctccttctttgttaatataacactggtttaggcaataatataattgctgagtaacaggtaatgtcaaatgttagttttttaaacattaagtccagatctttcttcc

SEQ ID NO: 100722 - DNA, 201 bp, Bos taurus; identical to SEQ ID NO: 19357

SEQ ID NO: 100723 - DNA, 201 bp, Bos taurus
tcaaagccaggaagacattaagtggaataagaagttggggtaagagtctaggtggttcatgaatattgagaggaactagtgagtacaaggtaacccagctggaaggcaaaagtgcagagaccaaggtatctaagaaaatattaggaagtcaatagagttgctcagtcatgtcggactctttgcgaccccgtggactgtagg

SEQ ID NO: 100724 - DNA, 201 bp, Bos taurus; identical to SEQ ID NO: 19358

SEQ ID NO: 100725 - DNA, 201 bp, Bos taurus
ccgggagctggtgatggacagggaggcctggcatgctgcgattcatggggtcgcaaagagtctgacacgactgagcgactgaactgaagtgaatatacgattgactacctagggcctatttatctattgggtttttttttttcccccacatttttcttctcatttagaaatgctctttgtatattatctttagtctgtcac

SEQ ID NO: 100726 - DNA, 201 bp, Bos taurus; identical to SEQ ID NO: 19359

SEQ ID NO: 100727 - DNA, 201 bp, Bos taurus
taggcatttaaaattccaatacttttaatgatcatcaaaagaagccttgagggttcctgtgaagtcacatttttctgtgataaaaataaaaccaataaaaaataaaaccaacttatgtttccaatacggttctatataaatattaaatgaaacaaaagtaggcagcaaacagtgggactcaaacccacatctgattttttt

SEQ ID NO: 100728 - DNA, 201 bp, Bos taurus; identical to SEQ ID NO: 19360

SEQ ID NO: 100729 - DNA, 201 bp, Bos taurus; identical to SEQ ID NO: 19361

SEQ ID NO: 100730 - DNA, 201 bp, Bos taurus
agtagggctgactagcaaccttccaaaaggacttatgccgacacgcacctccgtggactgctgccaccagtgaccctatccctggcggaggctacttccacctgaggccacttctgagccacgcctctgcaggagaccctcagacactcacaggcaggtctgacacagtctcttgtggggtcaccacttctttctggcgtg

SEQ ID NO: 100731 - DNA, 201 bp, Bos taurus; identical to SEQ ID NO: 19362

SEQ ID NO: 100732 - DNA, 201 bp, Bos taurus; identical to SEQ ID NO: 19364

SEQ ID NO: 100733 - DNA, 201 bp, Bos taurus; identical to SEQ ID NO: 19365

SEQ ID NO: 100734 - DNA, 201 bp, Bos taurus; identical to SEQ ID NO: 19366

SEQ ID NO: 100735 - DNA, 201 bp, Bos taurus
ctaaatgaagttccctgaatgcattatattgtatactattcctcagtcttccatatataatttcttctttaaaaaaatgtttctttctcctctctcttctatcctttatatttgtcattcaaaactcagttcaagtatcaccttatgctccagcccttgcagttaaggcaacatgtttgtgaatgaaaaagtcaacttgga

SEQ ID NO: 100736 - DNA, 201 bp, Bos taurus
ttccaaaagaggaaagaatagcttaaggcttaaggcttataacatctggaaatcagaattctagcacagggattaagacacatatgttaaaatggcctcaccctaagaggctcaaaaccacaggttatttgtccatactatataaaacacagcacaatctgccagtctcaatagtctctgctcagtaacaaggcccagaat

SEQ ID NO: 100737 - DNA, 201 bp, Bos taurus
aaacattaatttccaaaagtctataaaaaaaggagacatgtgtaagcatcatttcatttttaaacagttcttctacctgtagaaaatttcacaagaaaaacttactgaaggcctatagctacagccagtttcaaaatctaaatatttgacaaaacaggtaacaggaatttaaaatcctacaaaaaccattcacaaagttta

SEQ ID NO: 100738 - DNA, 201 bp, Bos taurus; identical to SEQ ID NO: 19367

SEQ ID NO: 100739 - DNA, 201 bp, Bos taurus
ttaaaaaatcttaatcagaacaataattccatttgaatttttctttcaaaataaatccagccaagttctaatatatagcaaattatttgcatattaataaaccatatttagaaaacctaatcaaggagttcatctttatatgcaaattttcctacgtaattacttaaaatttccataaaactttcaggttaattgacaatt

SEQ ID NO: 100740 - DNA, 201 bp, Bos taurus
tccaggatgcttcagtcacgtctggatccttcactatttatcaatgtctttcttaaaatgtgccactaaaaaatactccataagttaagaaatcactagtttaatggtcttgacacttctttttttaagatagaatgatgttctatgagatgttttcatgaaaaacaacctgtctccaaaccacactttttttgatgaaaa

SEQ ID NO: 100741 - DNA, 201 bp, Bos taurus
atggtgaggaagctactttctcacatatactttaacttttaggatttcgtccttttctggccagggagcctgtgaaaggaaattcaagggttgtaggttccgaatatatgatgtctatgtgggcccaacaggagtagtaaatttggtacttgaatctgagtattagcatagttcttgattcatcattggcttcaatgtttc

SEQ ID NO: 100742 - DNA, 201 bp, Bos taurus
cctgaaataataataaactgccgacatttctcccacaaaacagagtttatttgggatcagcagagaagtgcagtcaggctctgcaattatgatgagccacatgcaagtctcccaagggcaagggaaggagcctctcttttagaggggaaaagaaagttgggagggctcagtaaacaaagagcccatggtttttcattggtg

SEQ ID NO: 100743 - DNA, 201 bp, Bos taurus; identical to SEQ ID NO: 19368

SEQ ID NO: 100744 - DNA, 201 bp, Bos taurus
tttcctagcgggcgagttaagcttctgctgattaacacactcaggatcccgattaactttgtggcatgaagctaacataattacataattggccttaaaaggaaactcttactttcagagatgctccaaaggtaagtgttttacttttttctggagcctgagaccttcacaaagacaacctggcccacctgttgtgtgaaa

SEQ ID NO: 100745 - DNA, 201 bp, Bos taurus; identical to SEQ ID NO: 19369

SEQ ID NO: 100746 - DNA, 201 bp, Bos taurus; identical to SEQ ID NO: 19370

SEQ ID NO: 100747 - DNA, 201 bp, Bos taurus
actatcctctgcaattatcctctaactctcctgtgttcaaatcagtatgtcagatggaaatgaaattagaaagagacagaaagaaaaagagcaagaaaggtagagaatataaaggctaaaaagtaggagaagggaaaaaaagacgagggaaaatgaactgggcctgtctcagaaattttgcatttcctagatacctctgta

SEQ ID NO: 100748 - DNA, 201 bp, Bos taurus
aaatagtggcaatggtcatgaagaggaggtgaacctccccttcatcaaggggaggtgaaccaaaagataacggacatacttatggacataacagacaccagctgttgaaatgagatggttcctgggttttgacaaggtgtagatcatactgtttgcatcatatttttaaagataaaatacaagcattttgccttgtcacta

SEQ ID NO: 100749 - DNA, 201 bp, Bos taurus
aaagaaccctgggttttaccactaagagcaatccagagctttattacagcttggtgtcacgaatttaatacactgctatgtatttaaactttaacagaagtggggtgggtgacgactgcctcactttcaccagtttctctacggagaacaagactggacctctcagtcatgacctccagggacgaatgggatgggaatgaa

SEQ ID NO: 100750 - DNA, 201 bp, Bos taurus
ttttgccatctgtattcggaaaaatgtcatttcaaattccctgtccatttttcaattgggttgtctttgttgttgagttgtgagagttctttatatgttccggataacagacccttatcagatgtatgatttacaaacattttatgggttgtcgtttcactatctttatagtgccctttaacacaaaaaagttttaaatct

SEQ ID NO: 100751 - DNA, 201 bp, Bos taurus
tcgaatgcaatgttctgaccttgtctgtatcatgatttaaacgagtcctctgtatgcaaaaggcatttctgaaacaatgaggggaaaactgaacatgcaccgggtatgagatattaagaaattattattgattttgtcaggaggtgataatggtttagggctttagtccttttctatcagatatatgctgaagtagttaca

SEQ ID NO: 100752 - DNA, 201 bp, Bos taurus
cttggttccctgcagggcagtttcaattgtgtctgcttagagtatgtctcccgtggaaactgagaggacctgctggcctgtttgtatattccttagtgatcggacctcagaatctcaacaggcttcctgggttctgagagtctgccagatgggagcttctcagaagaccaccacttccagaggccaggccattttgatcag

SEQ ID NO: 100753 - DNA, 201 bp, Bos taurus
ctgaccacagattccaacccactttatgcataactctcctgggaagatggggaggggaagcgagggtgggtgatgccagggggcctaattcctctaagagtaagtcagtaagcaacacgcaaaacctatacatcaggaaatccggcatcagcatctaatttatggaggtcaagagaattcccttatgatctagtggttagg

SEQ ID NO: 100754 - DNA, 201 bp, Bos taurus; identical to SEQ ID NO: 19371

SEQ ID NO: 100755 - DNA, 201 bp, Bos taurus; identical to SEQ ID NO: 19372

SEQ ID NO: 100756 - DNA, 201 bp, Bos taurus; identical to SEQ ID NO: 19374

SEQ ID NO: 100757 - DNA, 201 bp, Bos taurus; identical to SEQ ID NO: 19375

SEQ ID NO: 100758 - DNA, 201 bp, Bos taurus
taaaatctgcagtttgagggtcaggcttctaatttaacacaaatctgggggctgactacatctctcctgagattggaaagcaccaccttcatgccaccccccaacaagtcaccagtatttccctaaaaaatcttgtgtaagtatctggtgccatggcctctgcagctgttacccagggtacaatagcccttgactgcctgg

SEQ ID NO: 100759 - DNA, 201 bp, Bos taurus
ataacaatggctggattttttttagtaggctttgaagatgcaaggcaatcaaaattctcattgctggtaggaatgcaagatggtacctttgaaaaagagattggcaatttcttaagcatacactcatcatatacctcagtaatccttctctgaaagtgtttacctaagagaagtaaaaacattatgtcctgtaaacaaatg

SEQ ID NO: 100760 - DNA, 201 bp, Bos taurus
gttcctataaataaagtgcatgatcttttggtttgatattttgatagtctggtgaattaaaagagtaaggaactaagagtctttgtcctctgtcatcatctatttctgtggccctggggcagaggggggttctcctatagtgtaagtgttagctgttcagttgtgtctgactctttgtgaccccgtgattgtagtccacca

SEQ ID NO: 100761 - DNA, 201 bp, Bos taurus; identical to SEQ ID NO: 19381

SEQ ID NO: 100762 - DNA, 201 bp, Bos taurus; identical to SEQ ID NO: 19382

SEQ ID NO: 100763 - DNA, 201 bp, Bos taurus
atagccaggcgctggctcagtgcagctgcgacctgtgacgtgggggcgacagtcacactgcccgttcttgggtgagcacctgtggggaaacaaacccacctcgtgaaataaaagtggaggtggggggcaagtgtaagataagggcttaggggtgctggggtaagtgccctctggatttgagtccattctttgagtccatca

SEQ ID NO: 100764 - DNA, 201 bp, Bos taurus; identical to SEQ ID NO: 19385

SEQ ID NO: 100765 - DNA, 201 bp, Bos taurus; identical to SEQ ID NO: 19386

SEQ ID NO: 100766 - DNA, 201 bp, Bos taurus
cttgctttaccagggaacttcaggaacgcaaacatgaactattttgactgataaggttccaaaataaaatctaagggtaccttggccattgcatgagtcaatattccagataaacacatttagcattttaggctctgaactttatttttggtggtgattttgctaaaatgtgtcacacttcatggccttcagggtcatcac

SEQ ID NO: 100767 - DNA, 201 bp, Bos taurus; identical to SEQ ID NO: 19387

SEQ ID NO: 100768 - DNA, 201 bp, Bos taurus; identical to SEQ ID NO: 19388

SEQ ID NO: 100769 - DNA, 201 bp, Bos taurus; identical to SEQ ID NO: 19389

SEQ ID NO: 100770 - DNA, 201 bp, Bos taurus; identical to SEQ ID NO: 19391

SEQ ID NO: 100771 - DNA, 201 bp, Bos taurus
taaaacacacagagtactaactattcagtgctccgcctgcctaatcagaatggatcacttgttcccctctagtctcatagcatttttgtttccaatcactatcaacatgttctaattctatatggaccttttttaactagtctgagattctttaaagtggagctatttcacctttatcttctcctttttgctcttcaatta

SEQ ID NO: 100772 - DNA, 201 bp, Bos taurus; identical to SEQ ID NO: 19392

SEQ ID NO: 100773 - DNA, 201 bp, Bos taurus
aatctacagaatttgtaaagtgttcataaacagtagctttcttttagtctgtgtcttccctttccattactatgtagtaaggacttatttagtttttttagttatatatcattatgtagaaattattaagttgagaatattttagagaatgcagagtatagataaaatgtgaaaatttttaatcatttattaaaaacagga

SEQ ID NO: 100774 - DNA, 201 bp, Bos taurus
taacgtaaaatataatttgttagatataagacctataggccatggggttgctgaaaaatcgcacttggtgggaaccgcaagagagtgacagttactgactagtcaccatggccaaaaaaccaattcttaacaggctctctcactgggtttttctcagataactggagagaaaacagaacccttgaattacgacatctaacc

SEQ ID NO: 100775 - DNA, 201 bp, Bos taurus
gctgataacagtggctgagtcttgataaactgtttacaaaaacaggcagcaggccatagttttccagtccctggactaggaggatttgaagaccaaatgttgcctatgctatctaagtagactcttttgttataatagtttccaaatagagatcccaagggcctgatattagtcagcactaatgaagagttaacatccttt

SEQ ID NO: 100776 - DNA, 201 bp, Bos taurus; identical to SEQ ID NO: 19393

SEQ ID NO: 100777 - DNA, 201 bp, Bos taurus; identical to SEQ ID NO: 19394

SEQ ID NO: 100778 - DNA, 201 bp, Bos taurus
taaatacttttgcttgatacccaaactgcttgtggaatagcaaagaaagctgtttaaataccttgtgacctgtgagaaaatgtcaagccaattcttatagaggcatcttgctgattggggcattgcttaggataattaaatgtgaaatagaatagcatgagtaagtgttttctctctgcttttaagttcgagtaaatgaat

SEQ ID NO: 100779 - DNA, 201 bp, Bos taurus; identical to SEQ ID NO: 19396

SEQ ID NO: 100780 - DNA, 201 bp, Bos taurus; identical to SEQ ID NO: 19397

SEQ ID NO: 100781 - DNA, 201 bp, Bos taurus
taagcatactattaaaaagtagagtaggacagagtggaagatcaagttcaaagtttagaaagttttacttagaatgttttataatggaatacattattaaatgataaaaccacatgctatactgactcatgattttctaaaaatctattacatttgtctaaaaattaggaaaatgtcatttgcaaggtgactctcagctca

SEQ ID NO: 100782 - DNA, 201 bp, Bos taurus; identical to SEQ ID NO: 19401

SEQ ID NO: 100783 - DNA, 201 bp, Bos taurus
aaggatttttacatatatgttcatgagaaatatttctctgcattttttgctttccctgcaatgtcttagtctggttttcatattaggtagtggtggcccaatagaataatttgggaagtattccttatgctcttatcttgtgaataaattatagagaattggtataatttctttcttaaatttctgatggaattcactaat

SEQ ID NO: 100784 - DNA, 201 bp, Bos taurus; identical to SEQ ID NO: 19403

SEQ ID NO: 100785 - DNA, 201 bp, Bos taurus; identical to SEQ ID NO: 19404

SEQ ID NO: 100786 - DNA, 201 bp, Bos taurus; identical to SEQ ID NO: 19405

SEQ ID NO: 100787 - DNA, 201 bp, Bos taurus
agttattggaagttcccatacagagctggcatcatatataatatattgaaaagtcaatctatcccctaagaaatacgtgataaagatttggaagcgagtatcctgtagtgaaaagatggtgggagttaaccatcagggagctgaatcttgactgagatatttctgcaagtccataagcaactacataaaatctgagactat

SEQ ID NO: 100788 - DNA, 201 bp, Bos taurus; identical to SEQ ID NO: 19407

SEQ ID NO: 100789 - DNA, 201 bp, Bos taurus; identical to SEQ ID NO: 19410

SEQ ID NO: 100790 - DNA, 201 bp, Bos taurus; identical to SEQ ID NO: 19411

SEQ ID NO: 100791 - DNA, 201 bp, Bos taurus; identical to SEQ ID NO: 19412

SEQ ID NO: 100792 - DNA, 201 bp, Bos taurus; identical to SEQ ID NO: 19414

SEQ ID NO: 100793 - DNA, 201 bp, Bos taurus; identical to SEQ ID NO: 19415

SEQ ID NO: 100794 - DNA, 201 bp, Bos taurus
ttgcatttgtgtttatttcttatatttaatctttgaattatctggaatttatctttttatgatgagtaaaatgaatatccgccttttttttctccctccacaccctgattatttaacatcattggttaatttaagctcctctctatcagtgtgaaagtctttatcatatacccaatttctttgtgtctttgtatttatttc

SEQ ID NO: 100795 - DNA, 201 bp, Bos taurus
tacatataaaaatgcttagtgattggtatcatattatttaacaacaaataatcatcaagcagtaactgttgctttcttttggtgaacaaccaggcttatatttgtttagtatgatgcaatactaataaaagacactgtttaaagtatctttttagtttcatgagcaaaaatgctttctggacacatgtccttacattagaa

SEQ ID NO: 100796 - DNA, 201 bp, Bos taurus; identical to SEQ ID NO: 19417

SEQ ID NO: 100797 - DNA, 201 bp, Bos taurus; identical to SEQ ID NO: 19418

SEQ ID NO: 100798 - DNA, 201 bp, Bos taurus; identical to SEQ ID NO: 19419

SEQ ID NO: 100799 - DNA, 201 bp, Bos taurus
attacttgtcagttctatgggtgtgtgtgtctgtgtgaagagcagcggtgtggtaaaaatgacttttggagaaatacattatagcccccaaagaagaatatgtatttttcaagcaccatttgacattgggtatttcctacccttatgtgagtgtgcatgttaagtcacttcaatcgtatccaactctttgcgaccctatgg

SEQ ID NO: 100800 - DNA, 201 bp, Bos taurus; identical to SEQ ID NO: 19421

SEQ ID NO: 100801 - DNA, 201 bp, Bos taurus; identical to SEQ ID NO: 19422

SEQ ID NO: 100802 - DNA, 201 bp, Bos taurus
gccatattttcctgaagagtaggcatgtatgcatttattcaataaattatgcattgaagataccatatatgctggaaatacagtggttcaaagcccatacatggactttatgttgggagtggtagacaatgtttaattcaatgaataaatcaataggtaagtgtaattaacatttactgagaaattaatatgtctcagtaa

SEQ ID NO: 100803 - DNA, 201 bp, Bos taurus; identical to SEQ ID NO: 19423

SEQ ID NO: 100804 - DNA, 201 bp, Bos taurus; identical to SEQ ID NO: 19424

SEQ ID NO: 100805 - DNA, 201 bp, Bos taurus
cacattccacatatttcttgagactacagcataatgttctgaatcagttttgttttagcttgagtgaccacataatttgtcatccaaaccagcgtattttgggggttaggaggtattcataatcatgacaaggcaactgatatagctggctgttttagattaggctcctcagaaacagttcctaatttatattaaagtgat

SEQ ID NO: 100806 - DNA, 201 bp, Bos taurus
cagaaacatgtacacaatgctcatgataaagtgaaatggcatgctttaactgagattattatacaactccatcagctgaaaataaaggatattaaatgacgaacaggattgcttttcttacaaaactgcccagtcatcttggtaacaggtacattacctgttattattgttgcttagcatccatgcttataattctcttat

SEQ ID NO: 100807 - DNA, 201 bp, Bos taurus; identical to SEQ ID NO: 19425

SEQ ID NO: 100808 - DNA, 201 bp, Bos taurus
accgaatctgcacctctgaggatttcctgagtgcccgaacctgagcagcttagaactgggaggtgcatgcagcccaggtctggcctcagatggttctgagtagagcaacatagagcctgagcagtgtgggcagggagggcacacacgccgtgagtgagggcaggcccagtgtggctgagacactgcgagcacatgccagtg

SEQ ID NO: 100809 - DNA, 201 bp, Bos taurus
gccaagttaaaggggatacaaagggcttctgcccttgaaagctatttcccagctaaggaggatatgaggaagaattttatagcaataatttaagggcaaggttgcagataagattagggtgtgagtagggccagccctcctataatctggcttcagttaatcttattaatgagcttctgtggttccattagtctggcctca

SEQ ID NO: 100810 - DNA, 201 bp, Bos taurus; identical to SEQ ID NO: 19426

SEQ ID NO: 100811 - DNA, 201 bp, Bos taurus; identical to SEQ ID NO: 19427

SEQ ID NO: 100812 - DNA, 201 bp, Bos taurus
tgcatccagagggagcatgtggattttaacctgggaactaaataaataaactgtcagagctgaaagaaatgttccataggtcagatcctaaaaatagagtcgatgggtagagtatgaaagcagatgtaattatgagattgagcagtctcaatctcgtcttttcatttaggagttggacaggggagaactggagccacagaa

SEQ ID NO: 100813 - DNA, 201 bp, Bos taurus; identical to SEQ ID NO: 19428

SEQ ID NO: 100814 - DNA, 201 bp, Bos taurus
agccctgattaaatggcggggcagccaagggaaggcccccgccgccgccagagccaccgtcaccgcgccgactaggcagggactggcagtggcgggggctctaactttaatgtctgcgtcccggccgcagggactgcggcggttggagctgagggtactgtcttgggcctcgggtcctgggttggagccgcgtgtgcggga

SEQ ID NO: 100815 - DNA, 201 bp, Bos taurus; identical to SEQ ID NO: 19429

SEQ ID NO: 100816 - DNA, 201 bp, Bos taurus; identical to SEQ ID NO: 19430

SEQ ID NO: 100817 - DNA, 201 bp, Bos taurus; identical to SEQ ID NO: 19432

SEQ ID NO: 100818 - DNA, 201 bp, Bos taurus; identical to SEQ ID NO: 19436

SEQ ID NO: 100819 - DNA, 201 bp, Bos taurus; identical to SEQ ID NO: 19437

SEQ ID NO: 100820 - DNA, 201 bp, Bos taurus; identical to SEQ ID NO: 19439

SEQ ID NO: 100821 - DNA, 201 bp, Bos taurus; identical to SEQ ID NO: 19440

SEQ ID NO: 100822 - DNA, 201 bp, Bos taurus; identical to SEQ ID NO: 19441

SEQ ID NO: 100823 - DNA, 201 bp, Bos taurus; identical to SEQ ID NO: 19443

SEQ ID NO: 100824 - DNA, 201 bp, Bos taurus; identical to SEQ ID NO: 19445

SEQ ID NO: 100825 - DNA, 201 bp, Bos taurus; identical to SEQ ID NO: 19446

SEQ ID NO: 100826 - DNA, 201 bp, Bos taurus; identical to SEQ ID NO: 19447

SEQ ID NO: 100827 - DNA, 201 bp, Bos taurus; identical to SEQ ID NO: 19448

SEQ ID NO: 100828 - DNA, 201 bp, Bos taurus; identical to SEQ ID NO: 19449

SEQ ID NO: 100829 - DNA, 201 bp, Bos taurus; identical to SEQ ID NO: 19450

SEQ ID NO: 100830 - DNA, 201 bp, Bos taurus; identical to SEQ ID NO: 19451

SEQ ID NO: 100831 - DNA, 201 bp, Bos taurus; identical to SEQ ID NO: 19452

SEQ ID NO: 100832 - DNA, 201 bp, Bos taurus; identical to SEQ ID NO: 19453

SEQ ID NO: 100833 - DNA, 201 bp, Bos taurus; identical to SEQ ID NO: 19456

SEQ ID NO: 100834 - DNA, 201 bp, Bos taurus; identical to SEQ ID NO: 19457

SEQ ID NO: 100835 - DNA, 201 bp, Bos taurus; identical to SEQ ID NO: 19459

SEQ ID NO: 100836 - DNA, 201 bp, Bos taurus; identical to SEQ ID NO: 19460

SEQ ID NO: 100837 - DNA, 201 bp, Bos taurus; identical to SEQ ID NO: 19461

SEQ ID NO: 100838 - DNA, 201 bp, Bos taurus; identical to SEQ ID NO: 19462

SEQ ID NO: 100839 - DNA, 201 bp, Bos taurus; identical to SEQ ID NO: 19464

SEQ ID NO: 100840 - DNA, 201 bp, Bos taurus; identical to SEQ ID NO: 19469

SEQ ID NO: 100841 - DNA, 201 bp, Bos taurus; identical to SEQ ID NO: 19470

SEQ ID NO: 100842 - DNA, 201 bp, Bos taurus; identical to SEQ ID NO: 19476

SEQ ID NO: 100843 - DNA, 201 bp, Bos taurus; identical to SEQ ID NO: 19482

SEQ ID NO: 100844 - DNA, 201 bp, Bos taurus; identical to SEQ ID NO: 19484

SEQ ID NO: 100845 - DNA, 201 bp, Bos taurus; identical to SEQ ID NO: 19485

SEQ ID NO: 100846 - DNA, 201 bp, Bos taurus; identical to SEQ ID NO: 19486

SEQ ID NO: 100847 - DNA, 201 bp, Bos taurus; identical to SEQ ID NO: 19487

SEQ ID NO: 100848 - DNA, 201 bp, Bos taurus; identical to SEQ ID NO: 19488

SEQ ID NO: 100849 - DNA, 201 bp, Bos taurus; identical to SEQ ID NO: 19490

SEQ ID NO: 100850 - DNA, 201 bp, Bos taurus; identical to SEQ ID NO: 19491

SEQ ID NO: 100851 - DNA, 201 bp, Bos taurus; identical to SEQ ID NO: 19493

SEQ ID NO: 100852 - DNA, 201 bp, Bos taurus; identical to SEQ ID NO: 19494

SEQ ID NO: 100853 - DNA, 201 bp, Bos taurus; identical to SEQ ID NO: 19495

SEQ ID NO: 100854 - DNA, 201 bp, Bos taurus; identical to SEQ ID NO: 19497

SEQ ID NO: 100855 - DNA, 201 bp, Bos taurus; identical to SEQ ID NO: 19498

SEQ ID NO: 100856 - DNA, 201 bp, Bos taurus; identical to SEQ ID NO: 19499

SEQ ID NO: 100857 - DNA, 201 bp, Bos taurus; identical to SEQ ID NO: 19503

SEQ ID NO: 100858 - DNA, 201 bp, Bos taurus; identical to SEQ ID NO: 19505

SEQ ID NO: 100859 - DNA, 201 bp, Bos taurus; identical to SEQ ID NO: 19508

SEQ ID NO: 100860 - DNA, 201 bp, Bos taurus; identical to SEQ ID NO: 19509

SEQ ID NO: 100861 - DNA, 201 bp, Bos taurus; identical to SEQ ID NO: 19514

SEQ ID NO: 100862 - DNA, 201 bp, Bos taurus; identical to SEQ ID NO: 19515

SEQ ID NO: 100863 - DNA, 201 bp, Bos taurus; identical to SEQ ID NO: 19517

SEQ ID NO: 100864 - DNA, 201 bp, Bos taurus; identical to SEQ ID NO: 19518

SEQ ID NO: 100865 - DNA, 201 bp, Bos taurus; identical to SEQ ID NO: 19519

SEQ ID NO: 100866 - DNA, 201 bp, Bos taurus; identical to SEQ ID NO: 19520

SEQ ID NO: 100867 - DNA, 201 bp, Bos taurus; identical to SEQ ID NO: 19521

SEQ ID NO: 100868 - DNA, 201 bp, Bos taurus; identical to SEQ ID NO: 19522

SEQ ID NO: 100869 - DNA, 201 bp, Bos taurus; identical to SEQ ID NO: 19523

SEQ ID NO: 100870 - DNA, 201 bp, Bos taurus; identical to SEQ ID NO: 19524

SEQ ID NO: 100871 - DNA, 201 bp, Bos taurus; identical to SEQ ID NO: 19525

SEQ ID NO: 100872 - DNA, 201 bp, Bos taurus; identical to SEQ ID NO: 19526

SEQ ID NO: 100873 - DNA, 201 bp, Bos taurus
gcagctgtctccctgcagcgcggaagcaggagatcatcaagatcacggagcagctcatcgaggctgtcaacaatggcgacttcgaggcctacgcgtgagttggggcgcctggcctgttctggggtgtggggggtggacctggagggcttccccacagggagggggctggatggaagcacccggttctgaggggcccctcct

SEQ ID NO: 100874 - DNA, 201 bp, Bos taurus
aagctatagtgccaccttctggaagacaaaaagaggtttcctgcagccggcgcggtgagctatgagaacaagaggagacactcagaaggaagaattccacaccaggagagaacgagagtggagcaagtctaccccttataaacctaggatccctggagaagcaacaccgaagaacagtacctcatcaaagataaccagtaa

SEQ ID NO: 100875 - DNA, 201 bp, Bos taurus; identical to SEQ ID NO: 19528

SEQ ID NO: 100876 - DNA, 201 bp, Bos taurus; identical to SEQ ID NO: 19529

SEQ ID NO: 100877 - DNA, 201 bp, Bos taurus; identical to SEQ ID NO: 19533

SEQ ID NO: 100878 - DNA, 201 bp, Bos taurus
gccaggatactggagtgggtagccattcccttctccaggggatcttcccagcccagggatcgaacccaggtctcccatattgcaggtggtttctttaccagctccaggggacatcagtcaggccctacccattgacttgtgcaccatggcaaccttcagaaaagaaggcctatagtctttcactattgtgatctgttgggc

SEQ ID NO: 100879 - DNA, 201 bp, Bos taurus
ggagaaaagatctacgtatgtatatattttcccagagtattttttttttaaaggaagaaattttcacgaatgcaattacagtgtttggtgctttttttttgaagtcatcagcaaattcctcaagagcacttcattctcttaagaggactggattcctaaactatgctggtgcagaaaacaatctggcactgcccacttgtc

SEQ ID NO: 100880 - DNA, 201 bp, Bos taurus
ttgagaatctgggccacatgctcatttaattacttgtgctttctcctcatccctgtttgttctggtcttggacataccacatctaaatagttgttgagcccgcttgaccttatggcctgatgagtctaacacagctaatgatgcgcagttctggctctgtggtaggtcacttactgtcctatagtcctgcccgctcagaaa

SEQ ID NO: 100881 - DNA, 201 bp, Bos taurus; identical to SEQ ID NO: 19535

SEQ ID NO: 100882 - DNA, 201 bp, Bos taurus; identical to SEQ ID NO: 19537

SEQ ID NO: 100883 - DNA, 201 bp, Bos taurus; identical to SEQ ID NO: 19538

SEQ ID NO: 100884 - DNA, 201 bp, Bos taurus
aaaaacatcaggcttgaagaaactccccccggaatgattttttccaacatttgtgtttgcttctaattattttcaacacttctgaaaacgctaggaagggagaagaaacaccttgctgacaatgtgctctttgccaaaataatcaatcctccagcttctctcgccttctaaaattctaatattcaatacaagctttttggg

SEQ ID NO: 100885 - DNA, 201 bp, Bos taurus
tatagaataaactcttaagcaactcagcgttgggctgctacccacccatagtgggaactccacatataacaacattataatcggccctccatacttggggctccacatccacaggttcaaccagctatggattgtgtagtaccacagtacatatttattaaaaaaaactttacacacgttgacttgtgtagttcaaacctg

SEQ ID NO: 100886 - DNA, 201 bp, Bos taurus; identical to SEQ ID NO: 19539

SEQ ID NO: 100887 - DNA, 201 bp, Bos taurus; identical to SEQ ID NO: 19540

SEQ ID NO: 100888 - DNA, 201 bp, Bos taurus; identical to SEQ ID NO: 19541

SEQ ID NO: 100889 - DNA, 201 bp, Bos taurus; identical to SEQ ID NO: 19542

SEQ ID NO: 100890 - DNA, 201 bp, Bos taurus; identical to SEQ ID NO: 19543

SEQ ID NO: 100891 - DNA, 201 bp, Bos taurus; identical to SEQ ID NO: 19544

SEQ ID NO: 100892 - DNA, 201 bp, Bos taurus; identical to SEQ ID NO: 19545

SEQ ID NO: 100893 - DNA, 201 bp, Bos taurus; identical to SEQ ID NO: 19546

SEQ ID NO: 100894 - DNA, 201 bp, Bos taurus; identical to SEQ ID NO: 19547

SEQ ID NO: 100895 - DNA, 201 bp, Bos taurus; identical to SEQ ID NO: 19548

SEQ ID NO: 100896 - DNA, 201 bp, Bos taurus; identical to SEQ ID NO: 19549

SEQ ID NO: 100897 - DNA, 201 bp, Bos taurus; identical to SEQ ID NO: 19550

SEQ ID NO: 100898 - DNA, 201 bp, Bos taurus; identical to SEQ ID NO: 19551

SEQ ID NO: 100899 - DNA, 201 bp, Bos taurus; identical to SEQ ID NO: 19552

SEQ ID NO: 100900 - DNA, 201 bp, Bos taurus; identical to SEQ ID NO: 19553

SEQ ID NO: 100901 - DNA, 201 bp, Bos taurus; identical to SEQ ID NO: 19555

SEQ ID NO: 100902 - DNA, 201 bp, Bos taurus; identical to SEQ ID NO: 19556

SEQ ID NO: 100903 - DNA, 201 bp, Bos taurus
aaggtcttctttaggaaacaaatacctgaatacatatagaatggcttgagtgaaaagtcaggatgctacaaaagaaaggaatgaatgtgtagtattttctcccagtcggcacctctcctgagattagatttatgtcattccatttgccacttaagaggtattttagtcataagaatggacgaatattgtgtctttttcagt

SEQ ID NO: 100904 - DNA, 201 bp, Bos taurus
taagaaatacaccacctctaattatacactatttctcttttataatgtagtatataaagtttaggaacatatacatccaaattgtatgcaaatccaaaaatgtagctttacaggcgttattatgtatttgtatgtctagtagaaatgattcctggaatgtagttaatcttgtttatatgaccatgattttgtatttgtttt

SEQ ID NO: 100905 - DNA, 201 bp, Bos taurus
tttgttttacctttatttcaaaatcattgacctaatatcatgatatgttgacctgttctgctagcactattaaaattttacctcattagcattttatgataattaatagtattgaggcaggatatagaagagccccaagttaagcagccagaattagtcccctgtggacaggtatccccaaaataacaggagcgagagagg

SEQ ID NO: 100906 - DNA, 201 bp, Bos taurus
aaggcatcctggcaggagcaaagccacgtcacactccctggtctcaccctcctccttctctctaacttccttctttgcttgcccatgatcaacatccaatctgatacagaaggtaagaaagcttatagatacaatctataaagttcaacttgccaagacagagagatgaggaagagcctgatatgtgtacctggaggtcag

SEQ ID NO: 100907 - DNA, 201 bp, Bos taurus; identical to SEQ ID NO: 19557

SEQ ID NO: 100908 - DNA, 201 bp, Bos taurus; identical to SEQ ID NO: 19558

SEQ ID NO: 100909 - DNA, 201 bp, Bos taurus; identical to SEQ ID NO: 19561

SEQ ID NO: 100910 - DNA, 201 bp, Bos taurus; identical to SEQ ID NO: 19562

SEQ ID NO: 100911 - DNA, 201 bp, Bos taurus; identical to SEQ ID NO: 19563

SEQ ID NO: 100912 - DNA, 201 bp, Bos taurus; identical to SEQ ID NO: 19564

SEQ ID NO: 100913 - DNA, 201 bp, Bos taurus; identical to SEQ ID NO: 19565

SEQ ID NO: 100914 - DNA, 201 bp, Bos taurus
tttataattctagataatcctgacatacatgccccaagaaatcggctgaaatttcaaaggattcaacagttctcttattaatactctttttttggacattcaatctctagttgcatgttttaaaagtaactaacaactactaagtacttgcatgtgtatgtgctgagtggcttcagccgtgtctgattctctgtgacccta

SEQ ID NO: 100915 - DNA, 201 bp, Bos taurus
ctaacacttgacacaacctaatactgaaggcttagacaagtttagttaaatgaacttaatttctcattagttagttaaggatcatggtgtgttacctcccagtatgaaccctcatttccagctatcatttagttgtgctttgcgttattttccatgctaccatctgtcactgggctacgatctcatcaagtttccaagtcc

SEQ ID NO: 100916 - DNA, 201 bp, Bos taurus
ctttcaccctctaccctttgctctttcattcctggcccatgtcttctttatccttccaaccccccactactcctttgttcctttacaacagatcacacaccacaatggctgttacattttaggccctaaggaatgttttggaagaggtcatttggtaggcatttttcttagtaagtagaaataaaaactagaggaagcttg

SEQ ID NO: 100917 - DNA, 201 bp, Bos taurus; identical to SEQ ID NO: 19566

SEQ ID NO: 100918 - DNA, 201 bp, Bos taurus
aagcagagagagcaaagacagaaaaaaacaaaacaaaacaaaacaaaacacaacagaacagaatatctaagaactgtgagagagctaaggtgtaacatacacattacaggaaatcatgggagactgttaggggattttgcccctctaatcatgatatgtgactatgacatctctatattcaagaaagtttcaaagtgagtg

SEQ ID NO: 100919 - DNA, 201 bp, Bos taurus
cagaacgagaaaaaaatactgtatattaacacacatatgtggattctagaaaaattgttcagatgaacctattttcaggccagaaatagagacgtagatgaagggaacaagagaccaaacatatggacacaaggaagggtgggataaattggggtattaggattgacatataaaatagatagctagtgggaagctgctctg

SEQ ID NO: 100920 - DNA, 201 bp, Bos taurus
tcttcttgagcttgtgtacctctatagttaatttttcactatgaatgcttagaggcagtataagtgcctctaacagatggaaagaaaaaagtcctaagaatgagactaagaataaggagcctcctggttttgctcccacctcatcctgggtatttcaaaacatcacatttgtaaggtgagcaagttgaattaccaacatat

SEQ ID NO: 100921 - DNA, 201 bp, Bos taurus; identical to SEQ ID NO: 19568

SEQ ID NO: 100922 - DNA, 201 bp, Bos taurus; identical to SEQ ID NO: 19569

SEQ ID NO: 100923 - DNA, 201 bp, Bos taurus; identical to SEQ ID NO: 19570

SEQ ID NO: 100924 - DNA, 201 bp, Bos taurus; identical to SEQ ID NO: 19572

SEQ ID NO: 100925 - DNA, 201 bp, Bos taurus; identical to SEQ ID NO: 19573

SEQ ID NO: 100926 - DNA, 201 bp, Bos taurus
ttccccacaatagaaatttccagctgcactctcatggtatggttcactgttttcctgtgtcatctgtacgacccacaaattggcaggtggatcagaaagcctgaacatactcagattcaataccgtaaatttggacttggagccctcagaacagtgagaccaaaaaaagaaaaaagtatgttgtcttaagttacccaattt

SEQ ID NO: 100927 - DNA, 201 bp, Bos taurus; identical to SEQ ID NO: 19574

SEQ ID NO: 100928 - DNA, 201 bp, Bos taurus; identical to SEQ ID NO: 19575

SEQ ID NO: 100929 - DNA, 201 bp, Bos taurus; identical to SEQ ID NO: 19576

SEQ ID NO: 100930 - DNA, 201 bp, Bos taurus; identical to SEQ ID NO: 19580

SEQ ID NO: 100931 - DNA, 201 bp, Bos taurus; identical to SEQ ID NO: 19581

SEQ ID NO: 100932 - DNA, 201 bp, Bos taurus; identical to SEQ ID NO: 19582

SEQ ID NO: 100933 - DNA, 201 bp, Bos taurus; identical to SEQ ID NO: 19583

SEQ ID NO: 100934 - DNA, 201 bp, Bos taurus; identical to SEQ ID NO: 19584

SEQ ID NO: 100935 - DNA, 201 bp, Bos taurus; identical to SEQ ID NO: 19585

SEQ ID NO: 100936 - DNA, 201 bp, Bos taurus; identical to SEQ ID NO: 19586

SEQ ID NO: 100937 - DNA, 201 bp, Bos taurus; identical to SEQ ID NO: 19587

SEQ ID NO: 100938 - DNA, 201 bp, Bos taurus; identical to SEQ ID NO: 19589

SEQ ID NO: 100939 - DNA, 201 bp, Bos taurus; identical to SEQ ID NO: 19590

SEQ ID NO: 100940 - DNA, 201 bp, Bos taurus
ttcccctgggttttgtgtgttcaggttattcttaactggcttactcttgggaggaaactgaggcaagccgggagctgctggtgcagagtcattgttgagaacctgggcttctattcattctctgggtgacagcgagctgcccacttaactcttgatcatttgttgccatcagatgctggagggatgtttgatttcaagtcc

SEQ ID NO: 100941 - DNA, 201 bp, Bos taurus
actgaaaatctcaggccatggccaggcccctccctggtagtgacactgaagtgaaccaaaaaagacttgatgtctgtgtccaggtgaataaattaattagcgttaagtttggccacgtttagcagagatccaaaataacagtggcttcaccaagacagagccgacgtctctcacacactcagcacaagtccagggataggt

SEQ ID NO: 100942 - DNA, 201 bp, Bos taurus
tctttgcctgattgtcctccacaagcactgtgggcttgacttcagaggaggatattcataaaaaatgaaaagtaacctcttcaatattaagaataaattattgacacagtggaaaagtaaaacctaatttctaatctagttcctagatttcctactgagaaataatcaaaacattgttgaaaacatcctctatcactgagt

SEQ ID NO: 100943 - DNA, 201 bp, Bos taurus
tgggtctcagcccctcggttctgacttcctgctgtacccattagggcaacatggcagtgacagtgacctatggtggcgaccctgtccccaagagccccttcgtggtgaacgtggcaccgcctctggacctcagcaaggtcaaggttcaaggcctcaacagcagtaagtggggaggagctgcccatgcagtgaggagggttg

SEQ ID NO: 100944 - DNA, 201 bp, Bos taurus
atgtcatagtctctgtgccgctggcaccacgctgactcctccaccgatggggaggactcaggctggccggagaggcgaacacactgcaaggcagggccccgggaggcagcccccctcccagcccagctgttccctcagactgggctgagcaagaggtaaggtcccacctggctgtccccaaacccttagcaccccaactta

SEQ ID NO: 100945 - DNA, 201 bp, Bos taurus
attgccagtgactggctgcatgtgtatgtgggtggacattgctaagggacaagcttgccaaaggtgagagagagacaaacctccagacagactcacaagtaggaactctggaggtttccctagcacagcccaggtttctcaggttctggctcactggtgtgtactgtatgtgtcccaaacacctgggtccttgtaggcctc

SEQ ID NO: 100946 - DNA, 201 bp, Bos taurus; identical to SEQ ID NO: 19592

SEQ ID NO: 100947 - DNA, 201 bp, Bos taurus
agacttcctgctgctgccctttctggtggccctttttgcccaatgcttttgaaaagttctgtgtcattgtcagacctctgtatagcaaattgcctgttgcgaatggatgctgaacaggccacaggggcttcatctttgtggaaagaaggaagtggctggagggtagacttaagaggctacccttccaggcactgcagccta

SEQ ID NO: 100948 - DNA, 201 bp, Bos taurus
attttctcaggttctagaggctggaagtctgagaacagagtgccagcatggtcaggctctggtgacctctcttgctggcttgtggatggccaacttctcattgcatcctctcatgttggagagagagatagaaaggaaggggcaagctctctggttttctggtttctctttttaagggtactaatcccattatgagggccc

SEQ ID NO: 100949 - DNA, 201 bp, Bos taurus; identical to SEQ ID NO: 19596

SEQ ID NO: 100950 - DNA, 201 bp, Bos taurus; identical to SEQ ID NO: 19598

SEQ ID NO: 100951 - DNA, 201 bp, Bos taurus; identical to SEQ ID NO: 19599

SEQ ID NO: 100952 - DNA, 201 bp, Bos taurus; identical to SEQ ID NO: 19600

SEQ ID NO: 100953 - DNA, 201 bp, Bos taurus; identical to SEQ ID NO: 19601

SEQ ID NO: 100954 - DNA, 201 bp, Bos taurus; identical to SEQ ID NO: 19602

SEQ ID NO: 100955 - DNA, 201 bp, Bos taurus; identical to SEQ ID NO: 19603

SEQ ID NO: 100956 - DNA, 201 bp, Bos taurus
tagtgtggctgattgcacttcatggtgttgttggtaatttttaaaaaaaatataagctgtgaaatactctttcctctaaatctcagatcggccctccagccttatgttccttctgaaggaagagagctgaagattacttgaatgtgtcatggcaagacacctccgcgtctccctgagaagagagtgccaaagccaccctgg

SEQ ID NO: 100957 - DNA, 201 bp, Bos taurus
cccagacccaaggggccagcgatgcccattcctccagcaaagtggaccgtgccacacgtcacaggctcacctccctgccttgaatcccagggcttcgaatgcgagcagggcccctgcttctgcattcaccctgcttaagccgccccagaatagcacagtgagggtgctttgttttgatttcctgattctagccaggagaaa

SEQ ID NO: 100958 - DNA, 201 bp, Bos taurus
ggcctgagcatcggcatcacacaggcataaaggaaccctccgtgagcacgtgtgacatgaatgaatgaatccatccaccacagatttttcctttggcttcgatgtggctttgaggagaccagctcgtcttgctctgcctcttactatccctcttccccataacatcagaaaaatcattcctgccgttaaggaatttatgag

SEQ ID NO: 100959 - DNA, 201 bp, Bos taurus; identical to SEQ ID NO: 19605

SEQ ID NO: 100960 - DNA, 201 bp, Bos taurus; identical to SEQ ID NO: 19607

SEQ ID NO: 100961 - DNA, 201 bp, Bos taurus; identical to SEQ ID NO: 19609

SEQ ID NO: 100962 - DNA, 201 bp, Bos taurus; identical to SEQ ID NO: 19610

SEQ ID NO: 100963 - DNA, 201 bp, Bos taurus; identical to SEQ ID NO: 19612

SEQ ID NO: 100964 - DNA, 201 bp, Bos taurus; identical to SEQ ID NO: 19613

SEQ ID NO: 100965 - DNA, 201 bp, Bos taurus; identical to SEQ ID NO: 19614

SEQ ID NO: 100966 - DNA, 201 bp, Bos taurus; identical to SEQ ID NO: 19617

SEQ ID NO: 100967 - DNA, 201 bp, Bos taurus; identical to SEQ ID NO: 19621

SEQ ID NO: 100968 - DNA, 201 bp, Bos taurus; identical to SEQ ID NO: 19622

SEQ ID NO: 100969 - DNA, 201 bp, Bos taurus
gtagaaataccagcatcaacttacaaaaacagtttggcatccattcttggtattactgctagttcccatatctaccgtgcaattgcgatatatgaatacttaagtctatttgtagaacaatcacatttggcttttttttttttccttgaaattaaccagtggatttttttaaggggtttaagataacattcatttcatcta

SEQ ID NO: 100970 - DNA, 201 bp, Bos taurus; identical to SEQ ID NO: 19623

SEQ ID NO: 100971 - DNA, 201 bp, Bos taurus
ggctacgtctgttttcaattagtttcaaactggtttttacttttgtgtttaggccctagaatcatatgaatcatcatggccgttcaaacaggcagagtaaactgaagccagaagtagagtttagtcagcttaccagagacagagttagatcttggccagtatcaagttattctaaataccaacctatatgccatgtgtcaa

SEQ ID NO: 100972 - DNA, 201 bp, Bos taurus
aagtgtcttctagaaaacttaaaattaaagactgcagcttacataatagttctcctgaacaccaatggtctctactaatacagtgctacagctgtgaagacccttagggatccaaatgtgtctgttttcagacttagaacatctcagaaggggttaaggaacttgccaaaaccacagcaacggtggcacaagcatctcttc

SEQ ID NO: 100973 - DNA, 201 bp, Bos taurus; identical to SEQ ID NO: 19625

SEQ ID NO: 100974 - DNA, 201 bp, Bos taurus; identical to SEQ ID NO: 19626

SEQ ID NO: 100975 - DNA, 201 bp, Bos taurus
gggcaagccagctctctaaggttctttttaaaggggcattaatcccatgcaggagaaccccaatctcatgaactaatcacctcccaaaggccccatctcccaataccatcatccagggcattaggtttttgtggggttttgttgcctttttttcttttttgctgcactgggccttcgttgtagcacacaggctttttattg

SEQ ID NO: 100976 - DNA, 201 bp, Bos taurus; identical to SEQ ID NO: 19627

SEQ ID NO: 100977 - DNA, 201 bp, Bos taurus
aacagttatggctttatatgaggctcagtccacattcatgttccaaccaagctatatacactccactaaaaaaaaccctttgacttcctggtaaccgtaaaacttgctcttactatctgttgagctttaattgtgtactgggcaacatgaagagtactttgtatcagagaattgtgtgtcatattaagaaacattgtaaga

SEQ ID NO: 100978 - DNA, 201 bp, Bos taurus
ctttgccacaagaaagtggcagagctggaatgtgaacccaggtgaagtggtttacaatgcggactgagaggtgtttatggacggaaaaagaaggattcacccagcgtacttgccatgggcgccaccatgcagctcaagggcatcaaccttacaacacgcagcccctggggacggcagagctgacccagatggggttcagcc

SEQ ID NO: 100979 - DNA, 201 bp, Bos taurus
cagtatctatttccaagtctctggtgcacctggccccattgtggttggtgagcaacattgctcatagaaagcatgcatcctctacagaacagtttggggacggaaagacatcacggccaaccaacccatctttgcttgtgaagaccaccgcgtcccagctcgacaatggatgagagacacgtttactctccacgtcactgg

SEQ ID NO: 100980 - DNA, 201 bp, Bos taurus; identical to SEQ ID NO: 19632

SEQ ID NO: 100981 - DNA, 201 bp, Bos taurus; identical to SEQ ID NO: 19633

SEQ ID NO: 100982 - DNA, 201 bp, Bos taurus; identical to SEQ ID NO: 19634

SEQ ID NO: 100983 - DNA, 201 bp, Bos taurus; identical to SEQ ID NO: 19635

SEQ ID NO: 100984 - DNA, 201 bp, Bos taurus; identical to SEQ ID NO: 19638

SEQ ID NO: 100985 - DNA, 201 bp, Bos taurus
accatgtaggaagtaaaacatttgagtgaataggttatagatagatatatattcccataccacgtaagtatcccttaggccagttaaacacacattcacttatttttgtacctgattttgccttgaggacagtgtttatataccaatcaccatctaccctaaagcactggccttacagtatgaatgaatgtgttatgtatt

SEQ ID NO: 100986 - DNA, 201 bp, Bos taurus; identical to SEQ ID NO: 19640

SEQ ID NO: 100987 - DNA, 201 bp, Bos taurus
tagatagcaatagtttattatgattgttctagtgttaggggtgctgaagggatgagaaggaagggatagtacaagttttatgctcaactgtagaatctttctaaaatgtccttccaagaagtgagcttattatcagttggcttccacatgataaacaaaatcttcccaattattctgagctaaagtaatctttgccttcat

SEQ ID NO: 100988 - DNA, 201 bp, Bos taurus; identical to SEQ ID NO: 19642

SEQ ID NO: 100989 - DNA, 201 bp, Bos taurus; identical to SEQ ID NO: 19643

SEQ ID NO: 100990 - DNA, 201 bp, Bos taurus; identical to SEQ ID NO: 19645

SEQ ID NO: 100991 - DNA, 201 bp, Bos taurus; identical to SEQ ID NO: 19646

SEQ ID NO: 100992 - DNA, 201 bp, Bos taurus
gtgaggatcagtgagtacactgagtgtgtgtagtctgaagaagcagcagcagctaaggggaaacgtgatctcgaataacacaaaaaatatgcaaccttccatttacaatcaaatgctaggtgtcatcctcatgactgatggagtgaggaggtaaggcgtgaacaaagaaatctgtaccacggtgctgaatatggtgttata

SEQ ID NO: 100993 - DNA, 201 bp, Bos taurus
attccatgaggacttggtgccattaatgcctcctgctgctgcttgggtgctctctccaacctctgatccattcctcagttctccattgcccaggcctggccgtcagtatccaccagatcaggtagtgtactcaatctatatgagaaagctcttcccttagactacagcatccaggcttagtatgaggtagactaaagtttc

SEQ ID NO: 100994 - DNA, 201 bp, Bos taurus
aggggtataatcacaggcataatgaagttattacaattgagtgaagggaatgaaaagcatagtatattatgaggcaccctgcagaatggcgggtaattgaagatcagaggatgtattgtactgactgtcagaaagtgctatgtaagctgagttctgcaggattggtagtacagcctgatcaagatgacggcaagagcattc

SEQ ID NO: 100995 - DNA, 201 bp, Bos taurus; identical to SEQ ID NO: 19647

SEQ ID NO: 100996 - DNA, 201 bp, Bos taurus; identical to SEQ ID NO: 19648

SEQ ID NO: 100997 - DNA, 201 bp, Bos taurus
gacaaagcctccattggttcacattctaccttatatacattaatatattcagtcacaatattccactctaattgataggagaggactcactgagaaaagactaaggatgtcctaactgtggagaaggcaatggcaatgcagtccagtactcttgcctggaaaaccccatggacagaggagcctggtaggctgccgtctatg

SEQ ID NO: 100998 - DNA, 201 bp, Bos taurus
ttaatgctagtggagggaggtcattgatcagaccttatgctgtcctaagactacgttcctctcttttgctctcaaagacagagctctttcaaccccaatttacaaaattgaatccacaaaattgaatctgctagtttttgtttttgctttttcccctattccagtgtccagaggtaacttttcctagcccggcctctttgt

SEQ ID NO: 100999 - DNA, 201 bp, Bos taurus; identical to SEQ ID NO: 19649

SEQ ID NO: 101000 - DNA, 201 bp, Bos taurus; identical to SEQ ID NO: 19650

SEQ ID NO: 101001 - DNA, 201 bp, Bos taurus; identical to SEQ ID NO: 19651

SEQ ID NO: 101002 - DNA, 201 bp, Bos taurus
acaggcttcttaactcctggagcttgaatgtaaaatctttcagagggagaggtacttaccctggtgggaaagcttgagcttaccattccctctgaagtttcttattgcatttccctattattgaaaggccctgacttctaagagggctgagtggtgttcagggtatcagagagccgcggctcctggcttggggggatgtga

SEQ ID NO: 101003 - DNA, 201 bp, Bos taurus; identical to SEQ ID NO: 60236

SEQ ID NO: 101004 - DNA, 201 bp, Bos taurus
cctctctaacaatctttaatgagctcccattttactggccccaaagtttgactcttggttccttcccatcatttgctttggtttagttcatgagcttatgacaggcacacggtggcccagcaaaggatgttggccaagctccttgctccaggagctactgggactactgaatcccaatcccttagcgaccctccccttgac

SEQ ID NO: 101005 - DNA, 201 bp, Bos taurus
cgtgtgctgattggctgaagcatggctgtaccccttacatcagcagaggaaaggcctagagattcagggacccttagctgagcaggccagtgctgccgggatatcctggaccttccttctctgggcgagctgagcccagaagctcagttaagtgctggtttgctgacctaggggttagcaagagtgactccatcttgggcc

SEQ ID NO: 101006 - DNA, 201 bp, Bos taurus
tatctgtgggcatccttctgggtcaagacaagtattctcttgacctggggaggatgaaggtggtgctgattgagaggaatcagaaaagcttcacctgcacgtaggcaggctcattcccagatggggtcttccagccgaggcctgcggccaggtggtgcctctgatctgggtttcacctcccagagcatcagctcctgtgac

SEQ ID NO: 101007 - DNA, 201 bp, Bos taurus
aagcctattgagatttgctggatgtcaaaatcacttagaatcacttttctaagtgaaaaagaagtaagtggccctactctcaggcctgtgtgtgtgccacttggaaagttccccatcagttcttcaggaagcatggacataacctccggtactttcgtttgagtgtccttctttcctgtgctactgtggagcctggcctga

SEQ ID NO: 101008 - DNA, 201 bp, Bos taurus
agtggaaccgacaactgacagtcctgctcaggttgttctaaactttttaatattcctcccaaggagatatagtgctcgtctgggccgtgtacaaaggaaagcagcaggcattgaggtggctgtgattcttgtgggcaacaatggcaaaatgggtttaaatgaaacagaggtctcatttgggaaaacaggcagtgttgaagg

SEQ ID NO: 101009 - DNA, 201 bp, Bos taurus; identical to SEQ ID NO: 19652

SEQ ID NO: 101010 - DNA, 201 bp, Bos taurus
aagtagtctggttgttcccgtcacgtttctgagggctgtatctagtgggacttagagctacatccgttcgcaggaaatctcctgtcattttggcaggcctcggcaccagggacgcgccccgtgcaccctggtctcggacgcgagcagtgaccactactgtgtcccgtctcctgggccagtatgtgcggtatatggtaacat

SEQ ID NO: 101011 - DNA, 201 bp, Bos taurus
caagtgtgagccacacaagaagatggaccgcgttcctataattgcaccttgtttttgccaagatcatccgtcccagcttgttctcatcacattcaccatccttgactctgacagacttggggctgttttcaaaagcaaatctgccttccaaagagagagtcactgccccaaggaacactgaaaacgaagatgctgtggttt

SEQ ID NO: 101012 - DNA, 201 bp, Bos taurus
caggcttccctgtccttcaccatctcccggagcttgctcaaactcatgtccattgagtctgtgatgccgtccacctgtctcatcctctgtcgtcccctcgtccttagactgttagtaacgggtggtcttggtcaatcagtgaggctggaggaaccagaagtggctctgtgtctgtctatctgggaagcattccatgttcaa

SEQ ID NO: 101013 - DNA, 201 bp, Bos taurus; identical to SEQ ID NO: 19653

SEQ ID NO: 101014 - DNA, 201 bp, Bos taurus
gatggaggaggtttgcatcttggagccgggcactgctgagttaggctcctacctcccattggaggggacactggctgctgttcctctgatgtttgcgctttgaagagatggctcccagatcctcaagaaacacagtcctggatgtaaatctggcaagaggcttagtgagtttttcaaaatatttacatacacctcaaaggc

SEQ ID NO: 101015 - DNA, 201 bp, Bos taurus; identical to SEQ ID NO: 19655

SEQ ID NO: 101016 - DNA, 201 bp, Bos taurus
cggcagggaatcaggccccagcctcgtgcaaggtccacgtggcgattagcccagaggagacctccatgggcacaatggaaactcaggaggagcccagagccgacctgggggctcttgacccccaggccccagctgagtcatgaggcacatgcttttgcttgatgaggacacggaaagagcttaaatcttgtcactccactc

SEQ ID NO: 101017 - DNA, 201 bp, Bos taurus
agagacaagccgaccggaaaggccaccctggggcttaaccaaagcctccgggacaaccctgcaaagtgccaagcatgaaagtcatggatcgagtggagagtcagacccgggggtgtcagcagggccgtgggactctgtcccaagggcgcactggcacccagcacccaccaccagcccccccagggctcaacagtctcctcc

SEQ ID NO: 101018 - DNA, 201 bp, Bos taurus; identical to SEQ ID NO: 19658

SEQ ID NO: 101019 - DNA, 201 bp, Bos taurus; identical to SEQ ID NO: 19659

SEQ ID NO: 101020 - DNA, 201 bp, Bos taurus
gaatggaaggaccaacagtctcatccgagcgagaagtttctggggtctgccgtgggctctatcttgtcttcccattcttcggtccggtcttaccaaacacagatctaagcatctctggaagctatgctatgacctgtgctcaaccagcgggctctgcgctccattcgttctagacacccctgtcttatgtcctcacctaga

SEQ ID NO: 101021 - DNA, 201 bp, Bos taurus
ttgatattatgacccaattctagggccatcaagtgtgtgtaacaaacacatgaactggtatttggggatccccaaaaccagtcttcattgccagacatagtaaacgtggaaggccaggctcaggaacacggaatgagagcagatcttaaggcagaaacgtgttcctttcattcccctgaccacctgaccctcaaactagct

SEQ ID NO: 101022 - DNA, 201 bp, Bos taurus; identical to SEQ ID NO: 19663

SEQ ID NO: 101023 - DNA, 201 bp, Bos taurus; identical to SEQ ID NO: 19664

SEQ ID NO: 101024 - DNA, 201 bp, Bos taurus; identical to SEQ ID NO: 19665

SEQ ID NO: 101025 - DNA, 201 bp, Bos taurus; identical to SEQ ID NO: 19666

SEQ ID NO: 101026 - DNA, 201 bp, Bos taurus; identical to SEQ ID NO: 19671

SEQ ID NO: 101027 - DNA, 201 bp, Bos taurus
tatgtagtcgctccaggaattcaaggcaactctctgcctggaagagccaaagtgtgatttttatatggagacagcacacgctttctgatccttgaatccatttttcattaactgttcacattaagcggccctacctccttggaaaacaaagcaggagtatgttagagaaagggctattttgtaatctagataaatacttgc

SEQ ID NO: 101028 - DNA, 201 bp, Bos taurus
gcatcacccacctggccaagggaccctggggagcccgatgccaacctcagcccacggaagagctgctttttaattggcctcgagtcacttcatctgtttgccttctggggctgtctgccttacagcacggatatttgcatttcaccccatcagctggccctaaaatcacaggctttccgaaggctgcagacctgcagttgt

SEQ ID NO: 101029 - DNA, 201 bp, Bos taurus
tccaggcctggctgcctaacttccaaaagtggggggctgacccggcaggagggcttgtaaaagcaagcccaccgagacaaaatgtccttgactgacagtatatcgaaggctggttccgggccgcagaacacatggactcgccccaagtttgaggagcacgtggttctcaccctccagctcttggtcctcactctggagaga

SEQ ID NO: 101030 - DNA, 201 bp, Bos taurus; identical to SEQ ID NO: 19674

SEQ ID NO: 101031 - DNA, 201 bp, Bos taurus; identical to SEQ ID NO: 19675

SEQ ID NO: 101032 - DNA, 201 bp, Bos taurus; identical to SEQ ID NO: 19676

SEQ ID NO: 101033 - DNA, 201 bp, Bos taurus; identical to SEQ ID NO: 19677

SEQ ID NO: 101034 - DNA, 201 bp, Bos taurus; identical to SEQ ID NO: 19678

SEQ ID NO: 101035 - DNA, 201 bp, Bos taurus; identical to SEQ ID NO: 19679

SEQ ID NO: 101036 - DNA, 201 bp, Bos taurus; identical to SEQ ID NO: 19680

SEQ ID NO: 101037 - DNA, 201 bp, Bos taurus; identical to SEQ ID NO: 19681

SEQ ID NO: 101038 - DNA, 201 bp, Bos taurus; identical to SEQ ID NO: 19682

SEQ ID NO: 101039 - DNA, 201 bp, Bos taurus
gcaaagcagaaaagctaagtgtgccccaaaccaggcacaccagatgtccccatctccagcttccctgtgcccacggcctcccgcagggcacactgagcctgtcccctttcactcctgcccgtcttcgaggctctgctgaacaggagtgctggtggccaaggcccccttgatagaaaacccttaatcaatagcacgtcttcc

SEQ ID NO: 101040 - DNA, 201 bp, Bos taurus
tggttggacagcatcactgactcgatggacgtgagtctgagcaggctccaggacatggtgaagcacgagagaagcctggtgtgctgcagcccgtggggccgcaaagagggagacacggtcgagcgactggacagcagcagcaaacgccattgtgagacggctgagcaaggctggctcccatacacccctccctgcctcccg

SEQ ID NO: 101041 - DNA, 201 bp, Bos taurus; identical to SEQ ID NO: 19685

SEQ ID NO: 101042 - DNA, 201 bp, Bos taurus
caacccaggccgaccttgcatttcacctaaagccgccaggcctcaaaaacccggcaccaagcgttttcagagccaggagaactgcccggcgaaggaagctgggagccactctgggcttggcctttggcttcaggggctcagaagcccagaatgctatgaaaacccactcagccatgccgtagtcccgtggcgctttctgac

SEQ ID NO: 101043 - DNA, 201 bp, Bos taurus; identical to SEQ ID NO: 19686

SEQ ID NO: 101044 - DNA, 201 bp, Bos taurus
ctggaggaaaaccgttcggtccctcggacctcccacagccctcccctcgggtccctccttgtccatcctaagagcggtgactgatgggtgctgaggagcttaagttcttcagttaaatcaagccccactgcttggaaaagaaagtacactgccccagtgaagacttcatagtagaatatactttcagaaagtgggaaatag

SEQ ID NO: 101045 - DNA, 201 bp, Bos taurus
aggaggttggacgtctcacatgtccagtggtccagcttccaggaagggagtgaacaggaggcagaagctggacctgggtggctgaactgtgcagacggtcggcatgggccccagcccgccaagcagcccctctgctctggagggctctggagtgttgtgccctcagccccgggccctgactccagaggctctggccctgca

SEQ ID NO: 101046 - DNA, 201 bp, Bos taurus
aaacacaaagcccgaacttcctggactcctgcagctgacagctccctgggtcctgaatgtcagagacgcctcatagctcacattcgactcggcctctgagagcaaaggcagtctggagtggctccactgtgtgcaggggcgtttcaggttcatatttaatattcagacaataaaaaacggccacgtcaagtggaaacaaac

SEQ ID NO: 101047 - DNA, 201 bp, Bos taurus
cactgcaagcagattctttatcatcagagcccccgggaagcccctcactcactattcatctcaaattagccatgagaggctggcattccaggcccagcccccatcccgacagcccctgacactgtctgggactcagagggtcctgagatgcatggttccgcccatgatcaggccgggcgggtggcaggggccggccacacc

SEQ ID NO: 101048 - DNA, 201 bp, Bos taurus; identical to SEQ ID NO: 19687

SEQ ID NO: 101049 - DNA, 201 bp, Bos taurus; identical to SEQ ID NO: 19688

SEQ ID NO: 101050 - DNA, 201 bp, Bos taurus
agatgagagcacactacagctagacttcaggttctccagacacgaaccctccaagttgtgtcttcggggtcctccaggggctgggagcttgttatgggttataagtcctgcttggccttgtacacacttgctgctgtggcctcaggacgccagccctccccgggcaccggtctccgggagtctccactctgcgggggaggg

SEQ ID NO: 101051 - DNA, 201 bp, Bos taurus; identical to SEQ ID NO: 19689

SEQ ID NO: 101052 - DNA, 201 bp, Bos taurus
ttgacccatgcctccactggagacttgtggatacttacaggcaagtctgactcagtcccttgtggggacactgctcctttctcctggatcctggcacatatgaggttttgtttgtgctcacctagtctgtttccccagacctgtgaaagttctgcagtcaatcccactggccccctaagtcaaattttctgggagttctca

SEQ ID NO: 101053 - DNA, 201 bp, Bos taurus
ttaatctgtgccagcgcccactccacattgaactggacccaccaagtatgagcctgagtatccccagcctgggacagaccgtagcatgttcaaattaaatctttttagtcttggtcttgtggtttgccattttgtgggatttttgcttcatgtactaaatccttggtaatagtacattgatgtcaagagatcagatattga

SEQ ID NO: 101054 - DNA, 201 bp, Bos taurus
atttaagagatatttcagcaacagcacctccaacatgcggttgtcattctaattaggttaggattgagaggaaaggaataggcccatgaggaaaaccacattgattgtaagcattattcagacttagaactgggggaggggaaaagtgaatgaccttcctgagcacattctccaaaagtaactctcatgcaagggcaggta

SEQ ID NO: 101055 - DNA, 201 bp, Bos taurus; identical to SEQ ID NO: 19690

SEQ ID NO: 101056 - DNA, 201 bp, Bos taurus; identical to SEQ ID NO: 19691

SEQ ID NO: 101057 - DNA, 201 bp, Bos taurus; identical to SEQ ID NO: 19692

SEQ ID NO: 101058 - DNA, 201 bp, Bos taurus; identical to SEQ ID NO: 19693

SEQ ID NO: 101059 - DNA, 201 bp, Bos taurus; identical to SEQ ID NO: 19695

SEQ ID NO: 101060 - DNA, 201 bp, Bos taurus; identical to SEQ ID NO: 19697

SEQ ID NO: 101061 - DNA, 201 bp, Bos taurus; identical to SEQ ID NO: 19700

SEQ ID NO: 101062 - DNA, 201 bp, Bos taurus; identical to SEQ ID NO: 19701

SEQ ID NO: 101063 - DNA, 201 bp, Bos taurus; identical to SEQ ID NO: 19702

SEQ ID NO: 101064 - DNA, 201 bp, Bos taurus; identical to SEQ ID NO: 19703

SEQ ID NO: 101065 - DNA, 201 bp, Bos taurus
aatttctagtgagactgaggcaacccctcctcgaagggtgtcctgatcctcagtgtgttcatttggaagccccatacaggggaaagtacaagagggagctgtagttttcacacccaaatctgcacccttaggacataagtctggcatgtgtctcagacagataaagagcaacacatatgaaacatcaacccatttcccttg

SEQ ID NO: 101066 - DNA, 201 bp, Bos taurus; identical to SEQ ID NO: 19705

SEQ ID NO: 101067 - DNA, 201 bp, Bos taurus; identical to SEQ ID NO: 60294

SEQ ID NO: 101068 - DNA, 201 bp, Bos taurus
ctaatataattatatttaaggccaattacacacagcaataatacctggagagaatgcacagagcagctactttaagaccctgaaaagaaaataacaaggagctttggaaaaaaggccagaatttgaaagccagtttaccaccaaactggtagtgagtttaacatatcttttttcctcacatcttcataccacttaaccctg

SEQ ID NO: 101069 - DNA, 201 bp, Bos taurus; identical to SEQ ID NO: 19706

SEQ ID NO: 101070 - DNA, 201 bp, Bos taurus; identical to SEQ ID NO: 19707

SEQ ID NO: 101071 - DNA, 201 bp, Bos taurus
ctacatgagaagggccatgtgaaagaatgttcagtgccgaaccacttatcttcacaaaaacctctggttaaacttaatgtttgcatccccatactaaaggcagcattggcctctggaggtatagcaggatttttccaaggcctgagaactaaagcagaatcataagacttttcatccataacattcagcttagcattagta

SEQ ID NO: 101072 - DNA, 201 bp, Bos taurus; identical to SEQ ID NO: 19709

SEQ ID NO: 101073 - DNA, 201 bp, Bos taurus; identical to SEQ ID NO: 19710

SEQ ID NO: 101074 - DNA, 201 bp, Bos taurus; identical to SEQ ID NO: 19712

SEQ ID NO: 101075 - DNA, 201 bp, Bos taurus
ttaatagggttgtgaaaattaattaagatgctccatattaattattgaggaaaagaaattgatttttttggaatcaaaatacccgccacctagagagtagaactcaacatattaaaatttcccaatttgaagattgcattcataagacacactaaacaccccaggatgatattttgatcagtcctttttcaccagtcatgt

SEQ ID NO: 101076 - DNA, 201 bp, Bos taurus; identical to SEQ ID NO: 19714

SEQ ID NO: 101077 - DNA, 201 bp, Bos taurus; identical to SEQ ID NO: 19715

SEQ ID NO: 101078 - DNA, 201 bp, Bos taurus; identical to SEQ ID NO: 19718

SEQ ID NO: 101079 - DNA, 201 bp, Bos taurus; identical to SEQ ID NO: 19719

SEQ ID NO: 101080 - DNA, 201 bp, Bos taurus; identical to SEQ ID NO: 19720

SEQ ID NO: 101081 - DNA, 201 bp, Bos taurus; identical to SEQ ID NO: 19721

SEQ ID NO: 101082 - DNA, 201 bp, Bos taurus
ttccctggcagtccagtagttaagattctgtgcttctactgcagcagcacgggtccaatccctggtcatggaaataagatcccacatgccgcatgatgtgaccaaaaggggctacggagatttttttaaaaagaaaatgctaatggtcacattagtttggcttttcaacaaagtccaaaatagcaacgacctataaaaaga

SEQ ID NO: 101083 - DNA, 201 bp, Bos taurus; identical to SEQ ID NO: 19722

SEQ ID NO: 101084 - DNA, 201 bp, Bos taurus
ggacatgactgagcaactaacactttcgctttcaaacaggtaagagactgctcatgccttcctttgtcaaatgctctagatggctttcagtgcttgttttctttgtgttttttcctttgctctgagtagttggttgtcagtgtgttagctttgaatccctttcatgccagaagccctggacaagaggagactctacttctt

SEQ ID NO: 101085 - DNA, 201 bp, Bos taurus
ctaacctagaaaactgtgatttgtaatgccagcgactgtgatggccataaattggatgatgcctctccatccttttcaacgcctgcactatctccaggacatgaacatgatgaatacatttgggcctgacaaagtgatatatatgtatatcacttctccatatatatatatgtgtgtgtgtgtgcgtgtgtgtgtgtgtga

SEQ ID NO: 101086 - DNA, 201 bp, Bos taurus; identical to SEQ ID NO: 19723

SEQ ID NO: 101087 - DNA, 201 bp, Bos taurus; identical to SEQ ID NO: 19724

SEQ ID NO: 101088 - DNA, 201 bp, Bos taurus
ttttaaatatgaaatgaatatatgtagttatgatgttttatattatctgtacttagttttaatgctattataatttgattcttccagtatctcaactgttatctcagtgaatattcagaatcagtgatataaaaaatcaacggcacaagtagaataatgtgttaaaaggcatcagtctcaccatgacatgcccttgctttc

SEQ ID NO: 101089 - DNA, 201 bp, Bos taurus
ttttttgtaccttgataaaatcaagacccagtgaattgaaatggcctatcttaaagccatatcatcttaaaaagtgaatatacaaatctttgacctgagtgccccagttgttgttaacgtttatttaggttgccctaagaatcctgcttgagaaaaatgaatatgactctaacatcaaatccaagactcattgtttcatag

SEQ ID NO: 101090 - DNA, 201 bp, Bos taurus
gtatatgcaaactacttaattttgcaaaaaactctcatgatcacttaactgcggaccccagggcctttgatgtttggcttatccttccttctgtgtggcctacattgccccatcaatgggatggcagctcagtaccagtttacccctaaggcaatatgagagagagattaggaagttcaagcttatcaagttcattaacat

SEQ ID NO: 101091 - DNA, 201 bp, Bos taurus
gcttaacaaaattaccaccttcaaagagaagaatagttcttgatagcattcatagtaatgcttccatttctctgtggaaacataagcgggaagcatgaagtagacaggggagagagtctcaggaaaagcaactggcttgctttcattcctgtgttcactctgccttatttctcatgtattctatcttaaaatagcaacaca

SEQ ID NO: 101092 - DNA, 201 bp, Bos taurus
cagcagcagcagtaaagatgttgaacgtcttttcatgtgaggctccatctttcttgattatttcatttcaaaggaatgagtctttatagatacccgagggaaaaaaaaatctggtttgtagaagatttacatctccaagtgccagagaaagtataaagtaaatgccctaagaaaggcaatataataagccaatagttaaga

SEQ ID NO: 101093 - DNA, 201 bp, Bos taurus; identical to SEQ ID NO: 19725

SEQ ID NO: 101094 - DNA, 201 bp, Bos taurus
aatataaaacagcaaagaaaacttgaggctgagacttcaccttcaaatgacaaaagacatgtgggttacttcttagcaggagtgaaacatacacatttcagtgagaaaacgggaagccagaggtcacatttgctgtggaacatgtttcaaggtggaatcaatatcaaaatgatcattaaaggtaccatggagggtgcagag

SEQ ID NO: 101095 - DNA, 201 bp, Bos taurus; identical to SEQ ID NO: 19726

SEQ ID NO: 101096 - DNA, 201 bp, Bos taurus; identical to SEQ ID NO: 19727

SEQ ID NO: 101097 - DNA, 201 bp, Bos taurus
gcataaccaagtaggaacatttgagctaggctgctgagattctctggccaaattgaattggaaaggactgaatcataccctgaagttgaaagaatttctatgagtattttacaaaaagtccctatctccgtatctactcatccgcttccatctgtgcccataaaccctgcctccctacgtttaccacaggtgtactaactg

SEQ ID NO: 101098 - DNA, 201 bp, Bos taurus
actgtcagctttcagaagttgttttgtggaatttgctcagcattcaaatgatctttcaataaatttgtgggggagaaagtggtctcccccttctattccttggccatcttaggaccactcctctctttaaaaagacaaccagtatcttgttaataagttagcaaataacctcacatgacattttttcaataaatttcattg

SEQ ID NO: 101099 - DNA, 201 bp, Bos taurus; identical to SEQ ID NO: 19728

SEQ ID NO: 101100 - DNA, 201 bp, Bos taurus
ggaaaatctgttgaccatgaaagggtcattccagaggcaaaagggaagaattagaagggaacagtgagaaaaatggagtagggagagaaagcacagaaaatatgggaataagtttacaagaaaagacaggtgtcaagaatagaggaatttaaggtggtatctgaggatggggtatgaaggaaggcttgatctctaagatcc

SEQ ID NO: 101101 - DNA, 201 bp, Bos taurus
atggtcactcagtcaggtctgtgtcaaaggcctgcaccatgaatcagagcctccagttatttgatgtgctcacttccctttattatatgtgaaatcttacgtacaaaaagaggggccacaactgtccaggaatggacagttaaatataaacatagaaaaatggttatcaatttgaacatacacctaattcttccaggaatt

SEQ ID NO: 101102 - DNA, 201 bp, Bos taurus; identical to SEQ ID NO: 19729

SEQ ID NO: 101103 - DNA, 201 bp, Bos taurus; identical to SEQ ID NO: 19730

SEQ ID NO: 101104 - DNA, 201 bp, Bos taurus; identical to SEQ ID NO: 19731

SEQ ID NO: 101105 - DNA, 201 bp, Bos taurus
tagccatctaggcctagcatctatgacctagcatagccatctaggtcatctttttagaccaaaatttcattaaattttatttttgtgatgccctattaacaattcagtaacagcacaaatagtcctaaatcctgggtgatagcatgttcttcttctagttttagaaatccaactgaagcaacacaggtataaaaataccta

SEQ ID NO: 101106 - DNA, 201 bp, Bos taurus
agtgtataacatctagtcgtctttcataagctagaataatatgtagagtaagtcttttccactatgaagctaagtgcaaaaggagccaagtgagtgaattctctcagttttgaagagaagttaatttttaagtgcttttacattatcagagtactcctgacttgtgttcaacaatcattaatactaatgatgtttatgtaa

SEQ ID NO: 101107 - DNA, 201 bp, Bos taurus; identical to SEQ ID NO: 19732

SEQ ID NO: 101108 - DNA, 201 bp, Bos taurus; identical to SEQ ID NO: 19733

SEQ ID NO: 101109 - DNA, 201 bp, Bos taurus; identical to SEQ ID NO: 19734

SEQ ID NO: 101110 - DNA, 201 bp, Bos taurus; identical to SEQ ID NO: 19735

SEQ ID NO: 101111 - DNA, 201 bp, Bos taurus; identical to SEQ ID NO: 19736

SEQ ID NO: 101112 - DNA, 201 bp, Bos taurus; identical to SEQ ID NO: 19737

SEQ ID NO: 101113 - DNA, 201 bp, Bos taurus; identical to SEQ ID NO: 19738

SEQ ID NO: 101114 - DNA, 201 bp, Bos taurus; identical to SEQ ID NO: 19739

SEQ ID NO: 101115 - DNA, 201 bp, Bos taurus; identical to SEQ ID NO: 19740

SEQ ID NO: 101116 - DNA, 201 bp, Bos taurus; identical to SEQ ID NO: 19741

SEQ ID NO: 101117 - DNA, 201 bp, Bos taurus; identical to SEQ ID NO: 19742

SEQ ID NO: 101118 - DNA, 201 bp, Bos taurus; identical to SEQ ID NO: 19743

SEQ ID NO: 101119 - DNA, 201 bp, Bos taurus
aaaatgtaataaggaaatgaagtggaactctgttgtgttttaccagctaaggattattataactttttaaaaagtgagagagaattagaatatttacttttctttaaataataacaatattaattcatgactcctatagccttagttaggaattatgaggttggtcattaaactaatgttacaataggtactatgatttat

SEQ ID NO: 101120 - DNA, 201 bp, Bos taurus
tataagaaaagaaagataaatattgctatagtgcaataatcctggtgggtatgattatctgaattgaggtttttggataaaagataaggcatgaatatgtggcctacaagtcacctgaatgttggttcccagaataagactcaagtttttttaactgacccattaatagtttgccattgctgtatatgaagacagagaggc

SEQ ID NO: 101121 - DNA, 201 bp, Bos taurus
ttagggacaactgcagctctttcttatcagttgtatggctttggttccagggttactaatcatgatcttttcaaaagaagctagaattgtagatttttaaataaaatctctcgggatgttaacgtttgcagcttttaatttttaaaccagccccctctccttccaaataaaaaaagaaaaaagaaaacaaacagtctgctc

SEQ ID NO: 101122 - DNA, 201 bp, Bos taurus
agggtgtgatagttatgttttagaagaatttcactatagtctaaactttcttttcccaaactacagcatttttgttgttgctacctagctttgagccatagggctctgaaaataaatatccagggcaagtaaaatagtgtgaatttcaatatctttgttattgaatctagattttctcttcaaagatgaacaagaaacaaa

SEQ ID NO: 101123 - DNA, 201 bp, Bos taurus; identical to SEQ ID NO: 19746

SEQ ID NO: 101124 - DNA, 201 bp, Bos taurus
agttccaaagagagctaaatgaaaaatcaaattgatttggtcttataaaatactattgactttgatttttgtgtccaatttatgcttctgtgcattttcagggacatcatttctaacaagattgcatgatttggacatgtgcaagctgaagtacttaattaccccctggaatgaaccaattagatttttgactagacttct

SEQ ID NO: 101125 - DNA, 201 bp, Bos taurus
tatcagcaatgttcctgcagtagcttcttagtgaatattctgtgcttcatgttgacatgaatatggtcatactaaagtacagatttgtacatcctaaagtagaggccctgatgctgggaaagatttaaggcaggagaagaaggagacaacagaggacaagatggttggatggcatcaccaactcgatggatgagtttgagc

SEQ ID NO: 101126 - DNA, 201 bp, Bos taurus
tttttgaataaaagtatctttgtagaaattaaattcacctcagtaaccgcttattgaatcctactgtattcagacagagtgctgtggatacttagcagaaagaaatataacctgatctcaaagtattcaaaatcaagcatagaaaacacatagaagtgatcaacagtttcttcttctgcaccctctcatcctcttcatttt

SEQ ID NO: 101127 - DNA, 201 bp, Bos taurus; identical to SEQ ID NO: 19750

SEQ ID NO: 101128 - DNA, 201 bp, Bos taurus; identical to SEQ ID NO: 19751

SEQ ID NO: 101129 - DNA, 201 bp, Bos taurus; identical to SEQ ID NO: 19753

SEQ ID NO: 101130 - DNA, 201 bp, Bos taurus; identical to SEQ ID NO: 19755

SEQ ID NO: 101131 - DNA, 201 bp, Bos taurus; identical to SEQ ID NO: 19756

SEQ ID NO: 101132 - DNA, 201 bp, Bos taurus; identical to SEQ ID NO: 19757

SEQ ID NO: 101133 - DNA, 201 bp, Bos taurus; identical to SEQ ID NO: 19758

SEQ ID NO: 101134 - DNA, 201 bp, Bos taurus; identical to SEQ ID NO: 19760

SEQ ID NO: 101135 - DNA, 201 bp, Bos taurus; identical to SEQ ID NO: 19761

SEQ ID NO: 101136 - DNA, 201 bp, Bos taurus; identical to SEQ ID NO: 19762

SEQ ID NO: 101137 - DNA, 201 bp, Bos taurus; identical to SEQ ID NO: 19763

SEQ ID NO: 101138 - DNA, 201 bp, Bos taurus; identical to SEQ ID NO: 19764

SEQ ID NO: 101139 - DNA, 201 bp, Bos taurus; identical to SEQ ID NO: 19766

SEQ ID NO: 101140 - DNA, 201 bp, Bos taurus; identical to SEQ ID NO: 19768

SEQ ID NO: 101141 - DNA, 201 bp, Bos taurus
taatacagggcaaaatgtgttagctgttgaatagaactgacatccttgattccaccaccaatcacctatctgatctcaagcaatttattaaacagtcaacttcattttcttcatcagaaaaacaaagttaatgtaaacataccttgaagttttttatggagagctaaaaaagatatgtaacattttcaacaaaatggcttt

SEQ ID NO: 101142 - DNA, 201 bp, Bos taurus; identical to SEQ ID NO: 19770

SEQ ID NO: 101143 - DNA, 201 bp, Bos taurus; identical to SEQ ID NO: 19771

SEQ ID NO: 101144 - DNA, 201 bp, Bos taurus
ccgcacccccaccttgttctgctgcgggcacaccggcctactggctattacttggacactccagacctgctcctaccttcggccccttgcactagctgtaccttctgcctagaaaaaccgtcacccaggcagctccaagattctctgtgatcaacttccagtctgtcccgccctctggcctgtgttctagattccccttgt

SEQ ID NO: 101145 - DNA, 201 bp, Bos taurus; identical to SEQ ID NO: 19772

SEQ ID NO: 101146 - DNA, 201 bp, Bos taurus
gtcatttccttcactgtcccttcctccaaagcatgtgagagtaatccataaattacgttcagaaaagggaatattcagaaacaataagaaccacaaagcagtcttcagttggtcaaaagtgttgtacttctccaggcaagtagaaaattctaatttgccttctacctcctttccaagcctctactctgtgcctttgaagat

SEQ ID NO: 101147 - DNA, 201 bp, Bos taurus; identical to SEQ ID NO: 19773

SEQ ID NO: 101148 - DNA, 201 bp, Bos taurus
ataggactactttcagttctaaggggttggccgttgctgaacagcagtgcatagaaataatccttggcaatcccatgggtgacatttctccttccttatcccccatgctgcatgcggccagaacttgataagacacccagaaagaagataatggctgctatcaagctgtctaggtagaaataataataataatctgtttat

SEQ ID NO: 101149 - DNA, 201 bp, Bos taurus; identical to SEQ ID NO: 19775

SEQ ID NO: 101150 - DNA, 201 bp, Bos taurus; identical to SEQ ID NO: 19776

SEQ ID NO: 101151 - DNA, 201 bp, Bos taurus
actgaactgaactgaataaacatattcaagtatctctggtttttaaggaagaaacatttcctagatgaagttccactccagtttctgcccagtctttatgtaattcacatttgaatttcattccttctctttacaaattcctctttatcagtgtcaccaatggcctcatgttgccaaatccaaaggattcccagtcttcat

SEQ ID NO: 101152 - DNA, 201 bp, Bos taurus
cgaaattgcaaggaagataattttaattcaacttctaattggatgccgttactccaattaatctttcaaaaagtggcagttaataaatttttgaaagtaacttgtctagcaaaaaaaaatcttctgaaacatttaacagattgaacagtttaggatattaacaaaagaaaattaggaagcatctatcaaaattttaaaggg

SEQ ID NO: 101153 - DNA, 201 bp, Bos taurus
catcttctcttatgatttgatagaaactcattgatagaagattccacagaccacctaattcagtgtgttgcttaagtccatagatggcttagaatagtctaaaaatctaaagtagagtattacagtcagggctcaaataaatggtcctttgtaaaatactaatctgaaaatgtcttgccaccacaggtagcatgaatgaga

SEQ ID NO: 101154 - DNA, 201 bp, Bos taurus; identical to SEQ ID NO: 19780

SEQ ID NO: 101155 - DNA, 201 bp, Bos taurus
ttttacttttgtttccctctattttttgtcaggcctgcaaagcattttcctccttatggttagtgatttctgctaaagcacagacattacccaacacaggtaagccaggagcatgcaggccaacagctgcccttgctgagggaccagctcctcccttcctgcagtttcccaggactcagccttgatgccctgaaggacaca

SEQ ID NO: 101156 - DNA, 201 bp, Bos taurus; identical to SEQ ID NO: 19781

SEQ ID NO: 101157 - DNA, 201 bp, Bos taurus; identical to SEQ ID NO: 19782

SEQ ID NO: 101158 - DNA, 201 bp, Bos taurus; identical to SEQ ID NO: 19783

SEQ ID NO: 101159 - DNA, 201 bp, Bos taurus; identical to SEQ ID NO: 19785

SEQ ID NO: 101160 - DNA, 201 bp, Bos taurus; identical to SEQ ID NO: 19787

SEQ ID NO: 101161 - DNA, 201 bp, Bos taurus; identical to SEQ ID NO: 19789

SEQ ID NO: 101162 - DNA, 201 bp, Bos taurus; identical to SEQ ID NO: 19791

SEQ ID NO: 101163 - DNA, 201 bp, Bos taurus; identical to SEQ ID NO: 19793

SEQ ID NO: 101164 - DNA, 201 bp, Bos taurus; identical to SEQ ID NO: 19794

SEQ ID NO: 101165 - DNA, 201 bp, Bos taurus; identical to SEQ ID NO: 19796

SEQ ID NO: 101166 - DNA, 201 bp, Bos taurus; identical to SEQ ID NO: 19797

SEQ ID NO: 101167 - DNA, 201 bp, Bos taurus; identical to SEQ ID NO: 19799

SEQ ID NO: 101168 - DNA, 201 bp, Bos taurus; identical to SEQ ID NO: 19803

SEQ ID NO: 101169 - DNA, 201 bp, Bos taurus; identical to SEQ ID NO: 19804

SEQ ID NO: 101170 - DNA, 201 bp, Bos taurus; identical to SEQ ID NO: 19809

SEQ ID NO: 101171 - DNA, 201 bp, Bos taurus; identical to SEQ ID NO: 19812

SEQ ID NO: 101172 - DNA, 201 bp, Bos taurus; identical to SEQ ID NO: 19813

SEQ ID NO: 101173 - DNA, 201 bp, Bos taurus; identical to SEQ ID NO: 19814

SEQ ID NO: 101174 - DNA, 201 bp, Bos taurus; identical to SEQ ID NO: 19816

SEQ ID NO: 101175 - DNA, 201 bp, Bos taurus; identical to SEQ ID NO: 19819

SEQ ID NO: 101176 - DNA, 201 bp, Bos taurus; identical to SEQ ID NO: 19820

SEQ ID NO: 101177 - DNA, 201 bp, Bos taurus; identical to SEQ ID NO: 19821

SEQ ID NO: 101178 - DNA, 201 bp, Bos taurus; identical to SEQ ID NO: 19822

SEQ ID NO: 101179 - DNA, 201 bp, Bos taurus; identical to SEQ ID NO: 19824

SEQ ID NO: 101180 - DNA, 201 bp, Bos taurus; identical to SEQ ID NO: 19825

SEQ ID NO: 101181 - DNA, 201 bp, Bos taurus; identical to SEQ ID NO: 19827

SEQ ID NO: 101182 - DNA, 201 bp, Bos taurus; identical to SEQ ID NO: 19831

SEQ ID NO: 101183 - DNA, 201 bp, Bos taurus; identical to SEQ ID NO: 19832

SEQ ID NO: 101184 - DNA, 201 bp, Bos taurus; identical to SEQ ID NO: 19833

SEQ ID NO: 101185 - DNA, 201 bp, Bos taurus; identical to SEQ ID NO: 19836

SEQ ID NO: 101186 - DNA, 201 bp, Bos taurus; identical to SEQ ID NO: 19837

SEQ ID NO: 101187 - DNA, 201 bp, Bos taurus; identical to SEQ ID NO: 19841

SEQ ID NO: 101188 - DNA, 201 bp, Bos taurus; identical to SEQ ID NO: 19842

SEQ ID NO: 101189 - DNA, 201 bp, Bos taurus; identical to SEQ ID NO: 19843

SEQ ID NO: 101190 - DNA, 201 bp, Bos taurus; identical to SEQ ID NO: 19844

SEQ ID NO: 101191 - DNA, 201 bp, Bos taurus; identical to SEQ ID NO: 19846

SEQ ID NO: 101192 - DNA, 201 bp, Bos taurus
tccctagaaacttcagttattgaggacagacatacatcaacagatactcattaagctataaattggttgcactggttgagtagattttgaatgctactggaccaagggagaaagatccttatcacatgagggagagaatggagacacaggagactgagaagtgatacctaagataaggcataataataaatcattaagctg

SEQ ID NO: 101193 - DNA, 201 bp, Bos taurus; identical to SEQ ID NO: 19847

SEQ ID NO: 101194 - DNA, 201 bp, Bos taurus; identical to SEQ ID NO: 19848

SEQ ID NO: 101195 - DNA, 201 bp, Bos taurus; identical to SEQ ID NO: 19849

SEQ ID NO: 101196 - DNA, 201 bp, Bos taurus
gactactgtgagatgatacctccttgaagttttaatttacattcctttggtaattaaagactgagcatcttcttctatggtttttggccatctaattaattttgacactgaaaatccctgtttgctgtagcatcatgagtcccacattacactgtataccttaggcacattggaaatagaaggagacatttgaggtgctat

SEQ ID NO: 101197 - DNA, 201 bp, Bos taurus
tattgtgacactcaatgtgttgacgctagcaagagggtccacaaataatttgcagtcaaataaattgcttcaaaatggcccagactgtgaggttatttaacctgtttcttgatgtgtgcctcaagtacataaggtggctcaagctcttcctagttaccatgtcagttctcccttggcctcagaatacaggtgagcaacaca

SEQ ID NO: 101198 - DNA, 201 bp, Bos taurus; identical to SEQ ID NO: 19850

SEQ ID NO: 101199 - DNA, 201 bp, Bos taurus
tacttctctagaggatattttttttagtgaacatagtaaaggtctagaatttaagctagggacaacttaggtattttctaggccagaatatataaaattagtatttttgagaattgatccattcaatatgtatgtagagtgtgtttggccttgaagtacaaaatgaagcagggaaaaggttaacagagctttgccaagaga

SEQ ID NO: 101200 - DNA, 201 bp, Bos taurus; identical to SEQ ID NO: 19851

SEQ ID NO: 101201 - DNA, 201 bp, Bos taurus; identical to SEQ ID NO: 19852

SEQ ID NO: 101202 - DNA, 201 bp, Bos taurus
agattgtaaaggaagaagtaaaactatctctatttctctatttgcaaatgacataatcttatatgtagaaaatctttagaaattcactaaaaaactagaattaataaatgagcttatcaaggttgcaagatacaagataaatatacaaatgtgaattaaacttcatgaaaatgaaatttaaacaattacatttataataaa

SEQ ID NO: 101203 - DNA, 201 bp, Bos taurus
acttgacagcagaagccgggccttttagagcggttattggagcggcaaggaaagtggggcgggcactagagagaaagccgcgtgtctgattgggcaaacgggatgtcactcatcccaggaccagggcttgctgcggaacagggtagctgctgctagacccaaccgcaagggtctctgcagtccctggaaccaaaccctgca

SEQ ID NO: 101204 - DNA, 201 bp, Bos taurus
tgtctaggggtggctgtcagctcagtatgactttaggcagcctatctgctgatgggtgtgtctgtgtttccactctgcttgttgtttggcctgagacatcccagaatcagagcctgaggtctgttgggttggaccaggtctcagtgccacaatggtggacctcctggtaagctcactcagcaaatattccctggggccagt

SEQ ID NO: 101205 - DNA, 201 bp, Bos taurus
tttggcaacaaggagttcttagatagattgccgttttccactttacttcattcttcttctgaggttttatcttgttctttcctttggaatatgttccccagtcacctcattttgccaagcttaattgtttttatttctacctatctggtaggagatgttctacacatccaaggagcacattaccctctgaacactagagct

SEQ ID NO: 101206 - DNA, 201 bp, Bos taurus
tttcactgaggaattcttgcgacctaaaagaatgtttggaatcaagctgtaaagttagttcttacattttcagtttcagacacaatgttttttgatggacgtgctgctctagtacagacgtcctcttgaaagcctataaacatgatcttacatttatagaatgagaactttccttttacccaaaacaacacagtgacattt

SEQ ID NO: 101207 - DNA, 201 bp, Bos taurus
gttgcagaattctaataaggtctgtgtgttaagaagagaattttggctatttaaactgaaaccaaaggaaatattgctgaagtctgctattagatgaaatataaatttattacctgtactccatcttcacaaacttcatagcttttactaacagccttcgaacaatcatcaggaattttactatcggcaatgtgctcattg

SEQ ID NO: 101208 - DNA, 201 bp, Bos taurus; identical to SEQ ID NO: 19853

SEQ ID NO: 101209 - DNA, 201 bp, Bos taurus; identical to SEQ ID NO: 19861

SEQ ID NO: 101210 - DNA, 201 bp, Bos taurus; identical to SEQ ID NO: 19863

SEQ ID NO: 101211 - DNA, 201 bp, Bos taurus; identical to SEQ ID NO: 19865

SEQ ID NO: 101212 - DNA, 201 bp, Bos taurus; identical to SEQ ID NO: 19866

SEQ ID NO: 101213 - DNA, 201 bp, Bos taurus; identical to SEQ ID NO: 19867

SEQ ID NO: 101214 - DNA, 201 bp, Bos taurus; identical to SEQ ID NO: 19871

SEQ ID NO: 101215 - DNA, 201 bp, Bos taurus; identical to SEQ ID NO: 19872

SEQ ID NO: 101216 - DNA, 201 bp, Bos taurus; identical to SEQ ID NO: 19873

SEQ ID NO: 101217 - DNA, 201 bp, Bos taurus; identical to SEQ ID NO: 19874

SEQ ID NO: 101218 - DNA, 201 bp, Bos taurus; identical to SEQ ID NO: 19875

SEQ ID NO: 101219 - DNA, 201 bp, Bos taurus; identical to SEQ ID NO: 19876

SEQ ID NO: 101220 - DNA, 201 bp, Bos taurus; identical to SEQ ID NO: 19877

SEQ ID NO: 101221 - DNA, 201 bp, Bos taurus; identical to SEQ ID NO: 19878

SEQ ID NO: 101222 - DNA, 201 bp, Bos taurus; identical to SEQ ID NO: 19879

SEQ ID NO: 101223 - DNA, 201 bp, Bos taurus; identical to SEQ ID NO: 19881

SEQ ID NO: 101224 - DNA, 201 bp, Bos taurus; identical to SEQ ID NO: 19882

SEQ ID NO: 101225 - DNA, 201 bp, Bos taurus; identical to SEQ ID NO: 19884

SEQ ID NO: 101226 - DNA, 201 bp, Bos taurus; identical to SEQ ID NO: 19885

SEQ ID NO: 101227 - DNA, 201 bp, Bos taurus; identical to SEQ ID NO: 19886

SEQ ID NO: 101228 - DNA, 201 bp, Bos taurus; identical to SEQ ID NO: 19888

SEQ ID NO: 101229 - DNA, 201 bp, Bos taurus; identical to SEQ ID NO: 19889

SEQ ID NO: 101230 - DNA, 201 bp, Bos taurus; identical to SEQ ID NO: 19890

SEQ ID NO: 101231 - DNA, 201 bp, Bos taurus; identical to SEQ ID NO: 19891

SEQ ID NO: 101232 - DNA, 201 bp, Bos taurus; identical to SEQ ID NO: 19892

SEQ ID NO: 101233 - DNA, 201 bp, Bos taurus; identical to SEQ ID NO: 19894

SEQ ID NO: 101234 - DNA, 201 bp, Bos taurus; identical to SEQ ID NO: 19896

SEQ ID NO: 101235 - DNA, 201 bp, Bos taurus; identical to SEQ ID NO: 19897

SEQ ID NO: 101236 - DNA, 201 bp, Bos taurus
agaaatggggccatgctgggtgagctaacaaagcaagtttctagaccttcaagacagaggggctgaaggagaaccagggttaagttgccaaggagttgaatgctacctcagagggcctcgtgggagacaggagacttactgcccctgtgcaatacttcatgtcattttccatgttgactttctccaggaaagacgacctac

SEQ ID NO: 101237 - DNA, 201 bp, Bos taurus; identical to SEQ ID NO: 19898

SEQ ID NO: 101238 - DNA, 201 bp, Bos taurus
gtgggttgccattttcctcctccaggggatcttcctgtcccagggcttcgaaccctgtgcctcctgcattgcaggtggattctttacccattgaaccatctgggaagccatttttaaagctggtgatctaaaagtggaaagagaaacaaacttgcagttggcagatttctcctcaaaccctggctgtgccacatgacagtt

SEQ ID NO: 101239 - DNA, 201 bp, Bos taurus; identical to SEQ ID NO: 19901

SEQ ID NO: 101240 - DNA, 201 bp, Bos taurus; identical to SEQ ID NO: 19902

SEQ ID NO: 101241 - DNA, 201 bp, Bos taurus; identical to SEQ ID NO: 19903

SEQ ID NO: 101242 - DNA, 201 bp, Bos taurus; identical to SEQ ID NO: 19904

SEQ ID NO: 101243 - DNA, 201 bp, Bos taurus; identical to SEQ ID NO: 19905

SEQ ID NO: 101244 - DNA, 201 bp, Bos taurus; identical to SEQ ID NO: 19906

SEQ ID NO: 101245 - DNA, 201 bp, Bos taurus; identical to SEQ ID NO: 19907

SEQ ID NO: 101246 - DNA, 201 bp, Bos taurus; identical to SEQ ID NO: 19908

SEQ ID NO: 101247 - DNA, 201 bp, Bos taurus; identical to SEQ ID NO: 19909

SEQ ID NO: 101248 - DNA, 201 bp, Bos taurus; identical to SEQ ID NO: 19911

SEQ ID NO: 101249 - DNA, 201 bp, Bos taurus; identical to SEQ ID NO: 19912

SEQ ID NO: 101250 - DNA, 201 bp, Bos taurus
aacaatggacatatttcaaaatatttgtttgctgatggtttcctccaaatatttctaattcattgtctttctcttgtctttcattctgactactatatttgctatttgtcttaagtcatttgcttcagaatatattgagcatgtcattcagggctcctgccaggtccaatttatagtagatataattacccacacacagcc

SEQ ID NO: 101251 - DNA, 201 bp, Bos taurus; identical to SEQ ID NO: 19913

SEQ ID NO: 101252 - DNA, 201 bp, Bos taurus
aaaaggttacttacatttttgtgttgcttgtaagttagtcaatgatcaactcaactgaaaattatgaatgtatggaacccaaagtccaaatttaagtaaacttacacaaattcactagaggaatccatttcagttgtatttaagaagcaggaaactacatatcttaacattagcatgttttagaactcaggacaaaacagt

SEQ ID NO: 101253 - DNA, 201 bp, Bos taurus; identical to SEQ ID NO: 19914

SEQ ID NO: 101254 - DNA, 201 bp, Bos taurus; identical to SEQ ID NO: 19915

SEQ ID NO: 101255 - DNA, 201 bp, Bos taurus; identical to SEQ ID NO: 19916

SEQ ID NO: 101256 - DNA, 201 bp, Bos taurus; identical to SEQ ID NO: 19917

SEQ ID NO: 101257 - DNA, 201 bp, Bos taurus
ttaaaaattctttgtgaaacatacagtcataaaagacataaagtgctcctttcagcaactcctgtgtgaaaaaggaggccaaacctcacattcctcacaacgtactaaaaagaaccctcttaaaacgacacaaattagaaaatgttttgctgatacttgatctcacccaaacttggaggccctcctttaactcttcttcag

SEQ ID NO: 101258 - DNA, 201 bp, Bos taurus
actcaaaagtgaagagatggctgaatggtaattgaacttacggttcagtgattaagacgtgttttaaagggacatgccacattgacaacagcagtgaagccgatgtggaagctgccacagacccgttcctttgtccctttttgggaccctcaggccctgtgtatttgaaggggagcgtgtatggctcagatccttttgaag

SEQ ID NO: 101259 - DNA, 201 bp, Bos taurus; identical to SEQ ID NO: 19919

SEQ ID NO: 101260 - DNA, 201 bp, Bos taurus
cactcttgtctgaaatggattggtattcatttttcagatacgaaagtaggcaagagaaataactgaaaatctcttccagtttgtattttattagagcaggaaggcacagaaggcaacagccagagcagtcctgaaccggtgtgagtttcaaaagtcaaccttggtgtattggagcaggttacataaaataactcttttgtc

SEQ ID NO: 101261 - DNA, 201 bp, Bos taurus; identical to SEQ ID NO: 19921

SEQ ID NO: 101262 - DNA, 201 bp, Bos taurus
ctaatggatgccacctgcttctggcttgaggatgagaagcataaaaatcagctcatcagcagagtagtgctctctgtcctcggctgagtgaaggaacaacgctccgggccagcgggggaggactcagtgttaggaggagctcaggaatgaggctgcgactgagaaccctgcctttgtttttgttaggatcagagaaaatac

SEQ ID NO: 101263 - DNA, 201 bp, Bos taurus; identical to SEQ ID NO: 19922

SEQ ID NO: 101264 - DNA, 201 bp, Bos taurus; identical to SEQ ID NO: 19923

SEQ ID NO: 101265 - DNA, 201 bp, Bos taurus; identical to SEQ ID NO: 19925

SEQ ID NO: 101266 - DNA, 201 bp, Bos taurus; identical to SEQ ID NO: 19926

SEQ ID NO: 101267 - DNA, 201 bp, Bos taurus
agttggtgcagcgaataggctgcacatggccgcggccctttttggcacgaccgttgttccttcttttcttggtctgcgtcaggatgaagattccattaaggaggagcaacttacccggccttagcccccatccggccacattccttgccgaccacccccaagaaagcgcgactcacatctccagtccctccgcagatccct

SEQ ID NO: 101268 - DNA, 201 bp, Bos taurus; identical to SEQ ID NO: 19933

SEQ ID NO: 101269 - DNA, 201 bp, Bos taurus; identical to SEQ ID NO: 19934

SEQ ID NO: 101270 - DNA, 201 bp, Bos taurus; identical to SEQ ID NO: 19935

SEQ ID NO: 101271 - DNA, 201 bp, Bos taurus; identical to SEQ ID NO: 19936

SEQ ID NO: 101272 - DNA, 201 bp, Bos taurus; identical to SEQ ID NO: 19937

SEQ ID NO: 101273 - DNA, 201 bp, Bos taurus
gtctctcattaaaatggaagggatgttcttcctctttccctttaggtctttgggccatatctctgcaaattgccccttcatcccgatccaacttcctccccgaatttcttcctcttgttagagacagatttgttgaaggaattgcctttgttcactgttccatattcttcccctcctacttatacttggcagtctgctgtc

SEQ ID NO: 101274 - DNA, 201 bp, Bos taurus; identical to SEQ ID NO: 19938

SEQ ID NO: 101275 - DNA, 201 bp, Bos taurus
gaactggcatctcctgcactgcaggccggttctttacactagcaccacctgcgaagcccttgttatgaacactctgtatatttctccctcttcatctaacgtctttcttttaggacatacagtggccaagcaagtatattataccagtaaaaagaaggattcttcaaagtggttacctgcccttcatttttttgaaatagc

SEQ ID NO: 101276 - DNA, 201 bp, Bos taurus
tctggcctttatgccttatgcacttcattgttggttgtataactcctgcttcctgttctgattagagtctgatgttttgaaggggatttgccctgtttgataccctttattagttctttatttggtgaaaaagactttgctggagtgagagaccagccgttctttctgcacaataggggtcaggtttcaaaagctcttttc

SEQ ID NO: 101277 - DNA, 201 bp, Bos taurus; identical to SEQ ID NO: 19939

SEQ ID NO: 101278 - DNA, 201 bp, Bos taurus; identical to SEQ ID NO: 19940

SEQ ID NO: 101279 - DNA, 201 bp, Bos taurus
gtccacattccttggcatttgactggccacatgcctccaatctctgcctccctctctctgtgcgtcagttcccatctgtgtatctcttacaaggacactcgccattggatttagggcccccttggataatccaacatgatcttcttgcaagacttcaacttaattatatccacaaggatctttttttccaaataaggtcac

SEQ ID NO: 101280 - DNA, 201 bp, Bos taurus; identical to SEQ ID NO: 19942

SEQ ID NO: 101281 - DNA, 201 bp, Bos taurus; identical to SEQ ID NO: 19943

SEQ ID NO: 101282 - DNA, 201 bp, Bos taurus
actaagtagagcggccacaagttcctcccatgcagggacctacctgcctgcatctgtgtccataaaagtagccttgcccctggtgctaaaggtgttctaatcgtgctcccagctaaggccaaccttttgctttgggctggaaaaggaaatggcaacccactccagtattcttgcttggataatcccatggacagagaagcc

SEQ ID NO: 101283 - DNA, 201 bp, Bos taurus; identical to SEQ ID NO: 19947

SEQ ID NO: 101284 - DNA, 201 bp, Bos taurus; identical to SEQ ID NO: 19949

SEQ ID NO: 101285 - DNA, 201 bp, Bos taurus; identical to SEQ ID NO: 19950

SEQ ID NO: 101286 - DNA, 201 bp, Bos taurus; identical to SEQ ID NO: 19951

SEQ ID NO: 101287 - DNA, 201 bp, Bos taurus; identical to SEQ ID NO: 19952

SEQ ID NO: 101288 - DNA, 201 bp, Bos taurus; identical to SEQ ID NO: 19953

SEQ ID NO: 101289 - DNA, 201 bp, Bos taurus; identical to SEQ ID NO: 19954

SEQ ID NO: 101290 - DNA, 201 bp, Bos taurus; identical to SEQ ID NO: 19956

SEQ ID NO: 101291 - DNA, 201 bp, Bos taurus; identical to SEQ ID NO: 19959

SEQ ID NO: 101292 - DNA, 201 bp, Bos taurus
aattgcgatgtttcatagaatagcattggggcttggagtgggccacccaaaatatgcactatggcacgttgattattttgaattaaagttacttaataaatgaccagtgggacactctggccctcctttctgttgcctgaaagcaggaagtacgtcacatgaaaggtgcactccctacatctaaggaagtagaaagacacc

SEQ ID NO: 101293 - DNA, 201 bp, Bos taurus; identical to SEQ ID NO: 19963

SEQ ID NO: 101294 - DNA, 201 bp, Bos taurus
actggggagctggatggttaggccctcaatatatgaatttggggaggacacgattccgtatattacattcagtaaagaatcaaaccttgcttttgcatttcgaaggcctaaccttgtcattgagcagctacactggaataatcttttcctgggaagagaagttggaggtgccccagtgttccagaaaatggggtgaatttc

SEQ ID NO: 101295 - DNA, 201 bp, Bos taurus; identical to SEQ ID NO: 19964

SEQ ID NO: 101296 - DNA, 201 bp, Bos taurus; identical to SEQ ID NO: 19965

SEQ ID NO: 101297 - DNA, 201 bp, Bos taurus
agttattataattttagctcttatatttaaatctatatttatttagaggtaattttgtacatgatacgagataagggccatagttaagatcatacgtatatcccatttttcgagctgttttttgaaggaactatattcctctcaccttggtgcctttgtcaaaaaccaagtggccatatatgtatgggtaactttctggcc

SEQ ID NO: 101298 - DNA, 201 bp, Bos taurus; identical to SEQ ID NO: 19966

SEQ ID NO: 101299 - DNA, 201 bp, Bos taurus; identical to SEQ ID NO: 19968

SEQ ID NO: 101300 - DNA, 201 bp, Bos taurus; identical to SEQ ID NO: 19969

SEQ ID NO: 101301 - DNA, 201 bp, Bos taurus; identical to SEQ ID NO: 19970

SEQ ID NO: 101302 - DNA, 201 bp, Bos taurus; identical to SEQ ID NO: 19971

SEQ ID NO: 101303 - DNA, 201 bp, Bos taurus; identical to SEQ ID NO: 19972

SEQ ID NO: 101304 - DNA, 201 bp, Bos taurus; identical to SEQ ID NO: 19974

SEQ ID NO: 101305 - DNA, 201 bp, Bos taurus; identical to SEQ ID NO: 19978

SEQ ID NO: 101306 - DNA, 201 bp, Bos taurus; identical to SEQ ID NO: 19979

SEQ ID NO: 101307 - DNA, 201 bp, Bos taurus; identical to SEQ ID NO: 19981

SEQ ID NO: 101308 - DNA, 201 bp, Bos taurus; identical to SEQ ID NO: 19983

SEQ ID NO: 101309 - DNA, 201 bp, Bos taurus; identical to SEQ ID NO: 19984

SEQ ID NO: 101310 - DNA, 201 bp, Bos taurus; identical to SEQ ID NO: 19986

SEQ ID NO: 101311 - DNA, 201 bp, Bos taurus; identical to SEQ ID NO: 19987

SEQ ID NO: 101312 - DNA, 201 bp, Bos taurus; identical to SEQ ID NO: 19989

SEQ ID NO: 101313 - DNA, 201 bp, Bos taurus; identical to SEQ ID NO: 19991

SEQ ID NO: 101314 - DNA, 201 bp, Bos taurus; identical to SEQ ID NO: 19992

SEQ ID NO: 101315 - DNA, 201 bp, Bos taurus; identical to SEQ ID NO: 19993

SEQ ID NO: 101316 - DNA, 201 bp, Bos taurus; identical to SEQ ID NO: 19994

SEQ ID NO: 101317 - DNA, 201 bp, Bos taurus; identical to SEQ ID NO: 19995

SEQ ID NO: 101318 - DNA, 201 bp, Bos taurus; identical to SEQ ID NO: 19996

SEQ ID NO: 101319 - DNA, 201 bp, Bos taurus; identical to SEQ ID NO: 19997

SEQ ID NO: 101320 - DNA, 201 bp, Bos taurus; identical to SEQ ID NO: 19998

SEQ ID NO: 101321 - DNA, 201 bp, Bos taurus; identical to SEQ ID NO: 20000

SEQ ID NO: 101322 - DNA, 201 bp, Bos taurus; identical to SEQ ID NO: 20003

SEQ ID NO: 101323 - DNA, 201 bp, Bos taurus
tgacggcggcccacctctttccaaattcctcttccctcccttttaaaaactaccaaagcccaggtcttggctactcagctctccagggaggaggccattcggtctgcttctcctgcgaggacagtggaagcagagaaagtgaacactgaccctaactcccagaccgcagtcgggccccctagactacctaaaatcaaacac

SEQ ID NO: 101324 - DNA, 201 bp, Bos taurus; identical to SEQ ID NO: 20006

SEQ ID NO: 101325 - DNA, 201 bp, Bos taurus; identical to SEQ ID NO: 20007

SEQ ID NO: 101326 - DNA, 201 bp, Bos taurus
gagaaatgaggaacagaggactataagaaaccaatagaaagagaggggaaacgggggtcggtcggaggtggaaagacagggagagacagagagagaagacagcgagtgggtggaaagccagaatgagggggagtgatgagaaatgcgtgacaggagaagagaaaagaggagaaaagagcagagaaggggccagagggaggg

SEQ ID NO: 101327 - DNA, 201 bp, Bos taurus
tgagctataattaataatttatgcacatttccacaatgtaagcatgttatgattaaacatgaacttaagtgttattaacccttactgtctatattggaacgtcctgcctacctcctgggatacatgaatgtgaaatttaaaacataactttagaaaatatttgaagcagtattaacttcccctactgaaagaaaaagaaac

SEQ ID NO: 101328 - DNA, 201 bp, Bos taurus; identical to SEQ ID NO: 20010

SEQ ID NO: 101329 - DNA, 201 bp, Bos taurus; identical to SEQ ID NO: 20011

SEQ ID NO: 101330 - DNA, 201 bp, Bos taurus; identical to SEQ ID NO: 20012

SEQ ID NO: 101331 - DNA, 201 bp, Bos taurus
ttcatatctaccatatgaatgtgaagtcattcacattgtgaagtcaggtgaaggcccacttcctggttcagagttggccatcttcttgctgcgtcctcacgtagtagaagggataagggagcttctctgcagtatttatagagtctaattcatgagggctccactctcatgacctaatcatccccaaaggccctacctcca

SEQ ID NO: 101332 - DNA, 201 bp, Bos taurus
tggagattagactctgagtccactttggcatcactatcaaacagcagttgtcttactgaggctgaggatggtgactcccaagggtgttctgaagattgtgcttccatatctgcagcttactgacaactgatggaaagtttatccacagtttattaaaacacacaaagacataacaaaaccaaaaaaaaaaaaaaaccaccc

SEQ ID NO: 101333 - DNA, 201 bp, Bos taurus
gacccagaagaaaggagcagtgacccaaatagagactgaaccaaacttgcctgtgagtgtccaggagtctctgggggagacatggattgacagtggccagccatggggtaaggagcactaaatacaacagtcctggcataagccctcttgaaggtcaccatccccataccatagtttggcctaagaccaaactacagggag

SEQ ID NO: 101334 - DNA, 201 bp, Bos taurus
cagctgaaccatgctgttctgttgagtataagcagccccacgggaccatccactacaagcaaggtcactgtgcaacccacgaaatacgaagcaccctcttccttcaagctgcctggtatatattttttagaagtgctctgctaagcaggttttcacctaacacttaataatgaatcagatgagggaatttttaaatacatg

SEQ ID NO: 101335 - DNA, 201 bp, Bos taurus; identical to SEQ ID NO: 20013

SEQ ID NO: 101336 - DNA, 201 bp, Bos taurus
ttctaacgaatacacccaacttctcagattcttttaattcaataattccctcctcaacccacattctgattcatgagttgtttcaagtcattactcaggacagaagcttaatgggtatgaattttaaattctttcgggaaggtttctgagcctacagagctgggaaaagagtttcccgataggggagaccactgacagttc

SEQ ID NO: 101337 - DNA, 201 bp, Bos taurus
tataactctaaccaaaattttgttttcaaacttaaattattttcaaagccaagaagtccataattgttttaattcatgaccaaaaagcttttaaactggtcgagtgttcatcaagaaatgttttcagcttcccaactggtggtacagatccctatttttaattctgttaggagaaaatatcttaaatatctgatggtctct

SEQ ID NO: 101338 - DNA, 201 bp, Bos taurus
caagagccactgactgctgtcacttgagacactataagtttcagcctacattagctttatggttgtagaaaggctgaatatcttaatgaaatcaagcctccttaagtgacctataaattcaatatgattttaatcaaaactttataaatttggaatatttaatgtctaagaatagctaagaacccataaaaaaagaaacat

SEQ ID NO: 101339 - DNA, 201 bp, Bos taurus; identical to SEQ ID NO: 20015

SEQ ID NO: 101340 - DNA, 201 bp, Bos taurus; identical to SEQ ID NO: 20017

SEQ ID NO: 101341 - DNA, 201 bp, Bos taurus; identical to SEQ ID NO: 20018

SEQ ID NO: 101342 - DNA, 201 bp, Bos taurus
tagtaactgacagaggattttcaaaagtaataaagtttatatgaccagatataaaatatgggagtaaaagaataaacacttaaaaaacaaaagcaaaagaaaagagaaatggaccgagacagtgccagatcatgaaagccaaatttaaggaagctttgaaaaaaagtcataagcaagttttaggaaaaaagtgaaagtgaa

SEQ ID NO: 101343 - DNA, 201 bp, Bos taurus; identical to SEQ ID NO: 20020

SEQ ID NO: 101344 - DNA, 201 bp, Bos taurus; identical to SEQ ID NO: 20021

SEQ ID NO: 101345 - DNA, 201 bp, Bos taurus; identical to SEQ ID NO: 20022

SEQ ID NO: 101346 - DNA, 201 bp, Bos taurus; identical to SEQ ID NO: 20023

SEQ ID NO: 101347 - DNA, 201 bp, Bos taurus
caacttttatttgggttgcactttccagttacactttcaccttaattgtgtcatttgatatttcaaaaattctgtaagatgggccaggcaggaatcattagcttcattctatagataaaaaaactgaggcaaaaagaggtcacttcccaatattacactgctgagaggtttcagctttgacccacccatggtcttctgatt

SEQ ID NO: 101348 - DNA, 201 bp, Bos taurus; identical to SEQ ID NO: 20024

SEQ ID NO: 101349 - DNA, 201 bp, Bos taurus
tgcctcctattagactgggggaggaaaaaaaggcagactgcctggggtgaactcactcagctcttatctcttccaatcacatttctttcctcaatttcccgcaacctttctttcattctctcaagaagcattcttacagatttcaaagctaacccgcattctccacctaatttcagtctatccctttcctttccccttctt

SEQ ID NO: 101350 - DNA, 201 bp, Bos taurus; identical to SEQ ID NO: 20025

SEQ ID NO: 101351 - DNA, 201 bp, Bos taurus; identical to SEQ ID NO: 20027

SEQ ID NO: 101352 - DNA, 201 bp, Bos taurus
gatgatgccatccaaccatctcatcctctttcattctcttctcctcctgcctttgatctttcccagcatcagggtcttttccaatgagtgctgggtcgactgcatcttttttttttgtttgttggtggatatgcttcatggaaaaacacatcatcaaaatgaaagcattcagaagtaagcatctgtggtactaaagggatc

SEQ ID NO: 101353 - DNA, 201 bp, Bos taurus; identical to SEQ ID NO: 20028

SEQ ID NO: 101354 - DNA, 201 bp, Bos taurus
tatgtgggcatgccattgcattatgtgtttttttttttttagaagataaatttaacagtaaaagctaagagggaaacattgatgttggtaacaatccaaacgtaaggcaataagagattagccgacagtgagggaaggtgggaaactggagatgccagtttgttaaaagggacttacaggaatgagttttcctaccaccat

SEQ ID NO: 101355 - DNA, 201 bp, Bos taurus
tggaaactaacacaacattgtaaagcaactgtatactccaataaaaataataataactactttcaagctttcctcagaaatcagacaagtaacaggagtacggactaagatattttaaagtgttgagagaaaaaacccaccaaactaaattctgtatcctgctaaattacccttcaaaagtggaaagagaaagaaaggttt

SEQ ID NO: 101356 - DNA, 201 bp, Bos taurus; identical to SEQ ID NO: 20031

SEQ ID NO: 101357 - DNA, 201 bp, Bos taurus
ttaggcaagttacacaataaaaattccatgataaaggtgttacaatctgaggatatgaaaatctaactgattaaaagggtaggcaacggaaagaggccaccccccgaaaagcagaataagtacagtctgcccttttagcttacctgtgtctttcagtcacagccaaagcaccatcctctatttcttcatatctgggccttt

SEQ ID NO: 101358 - DNA, 201 bp, Bos taurus; identical to SEQ ID NO: 20032

SEQ ID NO: 101359 - DNA, 201 bp, Bos taurus; identical to SEQ ID NO: 20035

SEQ ID NO: 101360 - DNA, 201 bp, Bos taurus; identical to SEQ ID NO: 20038

SEQ ID NO: 101361 - DNA, 201 bp, Bos taurus
aactcagataacatgctcagtgccttgctcttcccttctcctccacatcctactgtacacatttggcaataaacatcatgcataggtgcaagttgatcctatatcaataaatcgtcaagtaaccagaatgcccagagactgggcctaacagacttttttatccctaagcattatatggatattccactcttcctacaagct

SEQ ID NO: 101362 - DNA, 201 bp, Bos taurus; identical to SEQ ID NO: 20039

SEQ ID NO: 101363 - DNA, 201 bp, Bos taurus; identical to SEQ ID NO: 20042

SEQ ID NO: 101364 - DNA, 201 bp, Bos taurus; identical to SEQ ID NO: 20043

SEQ ID NO: 101365 - DNA, 201 bp, Bos taurus; identical to SEQ ID NO: 20044

SEQ ID NO: 101366 - DNA, 201 bp, Bos taurus; identical to SEQ ID NO: 20045

SEQ ID NO: 101367 - DNA, 201 bp, Bos taurus; identical to SEQ ID NO: 20047

SEQ ID NO: 101368 - DNA, 201 bp, Bos taurus; identical to SEQ ID NO: 20048

SEQ ID NO: 101369 - DNA, 201 bp, Bos taurus; identical to SEQ ID NO: 20049

SEQ ID NO: 101370 - DNA, 201 bp, Bos taurus
caagaaattttgaaaatgaatcttatgaaggaagacgtgaatttttagaaattaaaatgtatttttacattttatagatataattcttatatagagtgactctaggcagaaataggcatgttaatgagattagaaagtccccagacacccataatttaataagttttaaaggtacagaatcaggacttaaaaaaaaacttt

SEQ ID NO: 101371 - DNA, 201 bp, Bos taurus
cagtacagattttattcaactaatccttctgctctgtctgccaaaactaccatcagtaatgaagcccaaggttacaactgctgttagaaaagccttataagattgggcctgaagtcaacccaaatctttaagccttttgcttcatttgtttataagcaaatattcaggcactttccatactggaattttattaaaatttat

SEQ ID NO: 101372 - DNA, 201 bp, Bos taurus; identical to SEQ ID NO: 20050

SEQ ID NO: 101373 - DNA, 201 bp, Bos taurus; identical to SEQ ID NO: 20051

SEQ ID NO: 101374 - DNA, 201 bp, Bos taurus; identical to SEQ ID NO: 20052

SEQ ID NO: 101375 - DNA, 201 bp, Bos taurus
aatgcaatcaaaggggaaatttagcactggaaaagcacagtttagtgtctgctcagactacccagatgtgtaaatagccactgtttgatgtatacttttcgggcattaatcataaacatcatgacccagaaaagtacatattagttgctggaaaaacaaaacaaaacaaaaaaaaaccttctgcaaatgaaaaaagatatc

SEQ ID NO: 101376 - DNA, 201 bp, Bos taurus; identical to SEQ ID NO: 20053

SEQ ID NO: 101377 - DNA, 201 bp, Bos taurus; identical to SEQ ID NO: 20055

SEQ ID NO: 101378 - DNA, 201 bp, Bos taurus; identical to SEQ ID NO: 20056

SEQ ID NO: 101379 - DNA, 201 bp, Bos taurus; identical to SEQ ID NO: 20058

SEQ ID NO: 101380 - DNA, 201 bp, Bos taurus; identical to SEQ ID NO: 20059

SEQ ID NO: 101381 - DNA, 201 bp, Bos taurus; identical to SEQ ID NO: 20060

SEQ ID NO: 101382 - DNA, 201 bp, Bos taurus; identical to SEQ ID NO: 20061

SEQ ID NO: 101383 - DNA, 201 bp, Bos taurus
gattttgctgcggtcatccttagtccacccatggtagtgacacaggtttcaacattagcgctggcaagtgtatgtggaactgtgacaaacttgaaacattcgtctggaaccaacccaaatatacgataaaacattctaaagaaatatttaaatgcacaaaggaaattactgtgcactatatgagtatataatataatacct

SEQ ID NO: 101384 - DNA, 201 bp, Bos taurus
tctctcatttctgcactcactcatcttttccaagccaattttgtgatcccttccatcagggcatgtttggaaaaggatggacagtgtcttccttctcttttgaaaatgcttaaactttggaaagtgatcctgctaagagcagtggacagggagagaagagagtgacttgccttcacaagtcacaagtggctagaggaagga

SEQ ID NO: 101385 - DNA, 201 bp, Bos taurus; identical to SEQ ID NO: 20062

SEQ ID NO: 101386 - DNA, 201 bp, Bos taurus; identical to SEQ ID NO: 20063

SEQ ID NO: 101387 - DNA, 201 bp, Bos taurus; identical to SEQ ID NO: 20064

SEQ ID NO: 101388 - DNA, 201 bp, Bos taurus; identical to SEQ ID NO: 20066

SEQ ID NO: 101389 - DNA, 201 bp, Bos taurus; identical to SEQ ID NO: 20068

SEQ ID NO: 101390 - DNA, 201 bp, Bos taurus
ttttcctgcgtcccttggaagactattggtgtgggtgaggaaacgggataaaaggtgtggtgattcacggctttcttccgttctctgattggtgctccccatcacattctgacaagtgagtgtcactgggtttgaggtgggtgtcttggttacaggagataaggagtgacagcgctgtagagtacatttccataaattcac

SEQ ID NO: 101391 - DNA, 201 bp, Bos taurus; identical to SEQ ID NO: 20069

SEQ ID NO: 101392 - DNA, 201 bp, Bos taurus
aatctggaaaacagacctagccagctatcgcgtcggtttcttcatctgtaaaatgataatgaaagagtgcctgtgtcatggggtttttgggaagattttacgaaacaacacatgggctttgtataaggcctgacaagcaagtactcaatatatatatactgacttattatttttattattaaattctttctacactgagtt

SEQ ID NO: 101393 - DNA, 201 bp, Bos taurus
tgccatttactgatcataatttttttcttcctttatggctcagtttgactgttcttattagtctgggttcgtttgcagtgcattcaggcatgttctacccggaatactcttagatccatgtaaaagagaaagtgttagctgcttattccaactctttgcaaccccacggactatagcccaccaggctccttggtccatgga

SEQ ID NO: 101394 - DNA, 201 bp, Bos taurus; identical to SEQ ID NO: 20070

SEQ ID NO: 101395 - DNA, 201 bp, Bos taurus; identical to SEQ ID NO: 20071

SEQ ID NO: 101396 - DNA, 201 bp, Bos taurus; identical to SEQ ID NO: 20072

SEQ ID NO: 101397 - DNA, 201 bp, Bos taurus
cagaatcaggggtcagagatcataaaatgtgtccagggtcacacagctcatcctagcagtaaagtcagaattcaaacttatgctttttaagcctaatctctccctatcttttcttcagagcccattaattcaaatgattcacttcaatgaaatatataccatgttgggccacgtgttcaggaccttcttgatacccttgac

SEQ ID NO: 101398 - DNA, 201 bp, Bos taurus
ttttttacaagcttatacactgcaattataaatgtcttaaacagactctttgtatgttttaaatcttgtttttccttctgtagatgttaactggtaaccaatgtacaaaagggttggatctcaccttcaggatatctgaaatttacagtttattgtccgtttttagctcatactctgtatacttctgtaggtacatgtatt

SEQ ID NO: 101399 - DNA, 201 bp, Bos taurus; identical to SEQ ID NO: 20077

SEQ ID NO: 101400 - DNA, 201 bp, Bos taurus; identical to SEQ ID NO: 20078

SEQ ID NO: 101401 - DNA, 201 bp, Bos taurus; identical to SEQ ID NO: 20079

SEQ ID NO: 101402 - DNA, 201 bp, Bos taurus
acatgaacagctcttggtcctttcctgaaagcagcttacttcaatgggagaaaacagaagtgtaaataggtaattacacatattttttgcaactctgtgtagtcatttatcccaacactttcaccatctaataccttgattctcttattcttttctctcccttatctctgtctatgctcttgtcaactgttaaaaaacaaa

SEQ ID NO: 101403 - DNA, 201 bp, Bos taurus
taatagtctctacttcttagaatttttttcagctacactgcataaacaagttttttcctttcttgatcagaattatgccaccttgttgcttcttccagttcgagagctctctgggcaaattaatattcaccatggcctgtaaaaacttgatttatgggcaataaagtagatgcctttatcagggacaaatatattcttatt

SEQ ID NO: 101404 - DNA, 201 bp, Bos taurus
gataagattaccatactattaaccaatatatttcagataagcaatctaattttacaaatattatgtgaaatgcctcaggattatgtagcaatgcatatttaacttacatattctatactaccacttttctgctgaaaaaaatatgtatatttatgaattttatagaactgacaacttatctcaggaaattgtttacatcct

SEQ ID NO: 101405 - DNA, 201 bp, Bos taurus
taggtaggcctgggacaaaagtcatcgacaagtcttcgtggaacctgccttgcttcatggaattcttccttttgcctatatactgtgtcctgagtatcactgcagttctcccgaggcctggatagacctctaatctagtatgtatgtatgtgtgtgtgcactcagttgtgtccaactctgcgaccccatggactgtagact

SEQ ID NO: 101406 - DNA, 201 bp, Bos taurus; identical to SEQ ID NO: 20081

SEQ ID NO: 101407 - DNA, 201 bp, Bos taurus; identical to SEQ ID NO: 20086

SEQ ID NO: 101408 - DNA, 201 bp, Bos taurus; identical to SEQ ID NO: 20088

SEQ ID NO: 101409 - DNA, 201 bp, Bos taurus; identical to SEQ ID NO: 20090

SEQ ID NO: 101410 - DNA, 201 bp, Bos taurus
agtgtactgagctggggacaggagaccaaatgaggtggctcaggagaggggtatggaccaaacactttttgtttgaatacaagagtgctcactaagacagtaggcaccgggcctccagcttcctcaaaggtgatgcggggacctcagggaccagggagacatgagcgctcccactccttaatcaagcctctgtctgtcctg

SEQ ID NO: 101411 - DNA, 201 bp, Bos taurus
ataagatatctgataatctattatcagatagataatagagatgataatctctccaggccttctgttgtgacctgtagctctaacaaaaattagatgcccttatgcagttctaggtgaattgttctcctcaagcagagagtttttaaggtaggggctgaagggtgttgacattttccctgcagttactgaagacaagggcaa

SEQ ID NO: 101412 - DNA, 201 bp, Bos taurus; identical to SEQ ID NO: 20093

SEQ ID NO: 101413 - DNA, 201 bp, Bos taurus; identical to SEQ ID NO: 20095

SEQ ID NO: 101414 - DNA, 201 bp, Bos taurus
cggtgtgggtagtagctctgtagggtcagaggagctggctgagggcccatggaagcacacatgtgctgtcccttttttgcgggtgggaggtggggggagcaggaagggagctgtccccgggcctgaccctgcaggcgtctgcccacctgctcactctgtagaggtcagcccactttggggggacagcctgtctctctagcc

SEQ ID NO: 101415 - DNA, 201 bp, Bos taurus; identical to SEQ ID NO: 20096

SEQ ID NO: 101416 - DNA, 201 bp, Bos taurus; identical to SEQ ID NO: 20097

SEQ ID NO: 101417 - DNA, 201 bp, Bos taurus; identical to SEQ ID NO: 20098

SEQ ID NO: 101418 - DNA, 201 bp, Bos taurus; identical to SEQ ID NO: 20101

SEQ ID NO: 101419 - DNA, 201 bp, Bos taurus; identical to SEQ ID NO: 20102

SEQ ID NO: 101420 - DNA, 201 bp, Bos taurus
tttatttatacctctttccctgacctctcttctctcacttcctctgaatcctccccgccccacctctctctgctgatggagtcggctgtgatgaagttcacgaggccgcatgtatgactctcctgctattgaacccggagcctgcccctccacatcttgcttccaggaggggcctttaagctcccctctggatatttgttt

SEQ ID NO: 101421 - DNA, 201 bp, Bos taurus
catgtaaataaggcaaatttactggggcttgttgcaaggatggcttaatgtttccatgagcaaaggcaatcctaaagtgcagcagctgacccaactgaccagaagccaaggccataaatgcgatccacacagccattgggtgccattaggggccacccattggattccagggttgcactttcagtctgagccaggccagcg

SEQ ID NO: 101422 - DNA, 201 bp, Bos taurus; identical to SEQ ID NO: 20103

SEQ ID NO: 101423 - DNA, 201 bp, Bos taurus
gttgatgaccacgcgctcgcagcattcgtggtcgtcgtgctcggccggccgcgggtagctgctgtcctgagggtggcctggggcagccgaagcctcgtccacattctctccagacatcaccgtcatggtggaggtggtgggaggcagagatggtggccggaggcgggaggcgggggaccgggccggggcggggaggggcga

SEQ ID NO: 101424 - DNA, 201 bp, Bos taurus
acgcgcccacagaatgtcatctcaggttttaatagaggctctcattcactatatacaggattctccgccaaaggtggcctggttggtagcaacccaaacaacaccaaaagccgcgggcagctcaggggccactagtgggaattgtcttggccggctgcacgtcctcgatctcagaagacagccagcggtaggtgcggtgac

SEQ ID NO: 101425 - DNA, 201 bp, Bos taurus
ggccagggaccccactttgagaagcaagattctaaatccttctcaaagacgtttgtgctccttcagcaagaatttgaggggcgtgacccgtgtgctcagcatgtcccaggcactctggagggcccaatttggtggccctggatttcatgggcaggtgccagaggctgtgtcaggtggcgggggtgtgttgaggacatggaa

SEQ ID NO: 101426 - DNA, 201 bp, Bos taurus; identical to SEQ ID NO: 20106

SEQ ID NO: 101427 - DNA, 201 bp, Bos taurus
atttctccaaggtctgcagcgtcagctctgcacgttcttaactctaagcaccgggacacattaagcccgagagccgatcagatatcatgaagccggcaacgggagcaggacgccggcggcccggcacccgggaaagcatcagggcagctgcagtggcctgctccgtcctgcccccagtccccaccgagccctgtcctgtct

SEQ ID NO: 101428 - DNA, 201 bp, Bos taurus
aatgagcaaaaagtcaagctaagggacgggcagggcctgctgaattgcgacacctagtggggagagttcacagtgctggaggctaggttaaaggtccacctcaggactggccattggttatttcaagtcagctggtaaagcaaagaacaacagctaacatttaccaagcactatattttccagtagttatgtatggatgtg

SEQ ID NO: 101429 - DNA, 201 bp, Bos taurus
cggcttatgccccagttgggaaggcagcaggcaggaaggcctcaactcagaaccaggaggggagttgggatccctcccactgatgtgctcgggcttcccccctcccaggaagcgcctgaaggccaagaacctgatgtacatcaagcagctcctgtatcttctggagaagttcgtggctgtcctgggcggtgagcggcctcc

SEQ ID NO: 101430 - DNA, 201 bp, Bos taurus; identical to SEQ ID NO: 20107

SEQ ID NO: 101431 - DNA, 201 bp, Bos taurus
gggccagggaaggtggttgtaagcagtggtatctcctttgtctgagagccctgggcagaggcaagtgccagggtcaggaccgaggggagagtcactcaccgtaggcccacgccacgcagaaggactcaaagatagccacgaacagcaggcacatgccgctggctgcatagtagtcaaagagctggaacacgtacatgccgc

SEQ ID NO: 101432 - DNA, 201 bp, Bos taurus; identical to SEQ ID NO: 20108

SEQ ID NO: 101433 - DNA, 201 bp, Bos taurus; identical to SEQ ID NO: 20109

SEQ ID NO: 101434 - DNA, 201 bp, Bos taurus; identical to SEQ ID NO: 20110

SEQ ID NO: 101435 - DNA, 201 bp, Bos taurus; identical to SEQ ID NO: 20111

SEQ ID NO: 101436 - DNA, 201 bp, Bos taurus; identical to SEQ ID NO: 20112

SEQ ID NO: 101437 - DNA, 201 bp, Bos taurus; identical to SEQ ID NO: 20113

SEQ ID NO: 101438 - DNA, 201 bp, Bos taurus; identical to SEQ ID NO: 20114

SEQ ID NO: 101439 - DNA, 201 bp, Bos taurus; identical to SEQ ID NO: 20115

SEQ ID NO: 101440 - DNA, 201 bp, Bos taurus; identical to SEQ ID NO: 20116

SEQ ID NO: 101441 - DNA, 201 bp, Bos taurus; identical to SEQ ID NO: 20117

SEQ ID NO: 101442 - DNA, 201 bp, Bos taurus; identical to SEQ ID NO: 20118

SEQ ID NO: 101443 - DNA, 201 bp, Bos taurus; identical to SEQ ID NO: 20120

SEQ ID NO: 101444 - DNA, 201 bp, Bos taurus; identical to SEQ ID NO: 20122

SEQ ID NO: 101445 - DNA, 201 bp, Bos taurus
cctctcccggggcggagcagggtgtgcgggtacgtgcaaaacctgcccctcggggtgtcctgttgtgttggaggtgagagaagaggcccctggaacagccacaggattagacacggggacgtgagggctgctgtgctgggattttcatgggtgttgtcaggccagatctgacctggagacggttagaagtaaagccagagg

SEQ ID NO: 101446 - DNA, 201 bp, Bos taurus; identical to SEQ ID NO: 20123

SEQ ID NO: 101447 - DNA, 201 bp, Bos taurus; identical to SEQ ID NO: 20124

SEQ ID NO: 101448 - DNA, 201 bp, Bos taurus; identical to SEQ ID NO: 20127

SEQ ID NO: 101449 - DNA, 201 bp, Bos taurus; identical to SEQ ID NO: 20128

SEQ ID NO: 101450 - DNA, 201 bp, Bos taurus; identical to SEQ ID NO: 20131

SEQ ID NO: 101451 - DNA, 201 bp, Bos taurus; identical to SEQ ID NO: 20132

SEQ ID NO: 101452 - DNA, 201 bp, Bos taurus
tcttaacccctaagtcatccaaacagagattcaaggtctcccggcttccctatttaggaagcaaaagtgaaaaggtttggagtcaggcccctgcgggcacgcaggaggcgcccgggaagcctgtgtgtccagcgaggacctctttccttccaggaggcctgcaccaccaggcgccactctccccgaatggcccgaggccct

SEQ ID NO: 101453 - DNA, 201 bp, Bos taurus
tcgtatgtgccaggcctgcccctgtcccccagcctgcctcctttgcatcatttggtcccaacctatagtgagtgagtgatatctagactcagctggggagatcaggtgggcccccacatagtcatggccctgggagtccctcagagatccttgacaggagagagaagctcaccatcagcccttatgctgtccatcggtgtg

SEQ ID NO: 101454 - DNA, 201 bp, Bos taurus; identical to SEQ ID NO: 20137

SEQ ID NO: 101455 - DNA, 201 bp, Bos taurus
ggggggtggggcttgtgagcctgagtctctcaaagtggcaatctccctcgcagggatgctggggggtggggggtggcagtcagaggcacagaagggccagtggctactgcaactgtcagccttgagattaacccacttggtgcccagctggtgatgtcataggacatcagtcatggtgcatcacccagcctcccttgaggg

SEQ ID NO: 101456 - DNA, 201 bp, Bos taurus; identical to SEQ ID NO: 20139

SEQ ID NO: 101457 - DNA, 201 bp, Bos taurus; identical to SEQ ID NO: 20140

SEQ ID NO: 101458 - DNA, 201 bp, Bos taurus; identical to SEQ ID NO: 20141

SEQ ID NO: 101459 - DNA, 201 bp, Bos taurus; identical to SEQ ID NO: 20142

SEQ ID NO: 101460 - DNA, 201 bp, Bos taurus; identical to SEQ ID NO: 20143

SEQ ID NO: 101461 - DNA, 201 bp, Bos taurus; identical to SEQ ID NO: 20145

SEQ ID NO: 101462 - DNA, 201 bp, Bos taurus; identical to SEQ ID NO: 20148

SEQ ID NO: 101463 - DNA, 201 bp, Bos taurus
ccctcggagccggccgtgaggttcgcctgcatcaccgcctggaactctgtctcgttgcagcagtatttgaaaactgtgttgttatggtgacagcagaggacgaaggttttgttgtccgagagccgggggcagtggaagccgaagtggtagcggcctttgtggtctgtgtacggctcacagacccggaaatgcgcagacaag

SEQ ID NO: 101464 - DNA, 201 bp, Bos taurus
gggaggcctggcatgctgcgattcatggggttgcaaagagtaggacacgactgagtgactgaactgaactgaactggactcaccagaaaacattcaacaataggaagcctacaggcccaaacacactgtgctcctaacggtaaggaatcgtgaaaggaagtgttgtcgatcctcagcctggcagaggggctgctgtcagac

SEQ ID NO: 101465 - DNA, 201 bp, Bos taurus; identical to SEQ ID NO: 20152

SEQ ID NO: 101466 - DNA, 201 bp, Bos taurus; identical to SEQ ID NO: 20153

SEQ ID NO: 101467 - DNA, 201 bp, Bos taurus; identical to SEQ ID NO: 20154

SEQ ID NO: 101468 - DNA, 201 bp, Bos taurus
agtccagctgcgcgcgggcgccgtggggcccattcctcacccatcactgggtgtaagaggcaggatccatcaatccgttgggtgtcatgggcagggggccctccgtacattctaagtgagatacttctgactcacagatctcctacccgctcctgcccccacattgtcacagctcccagggtcccctccagggggtgatga

SEQ ID NO: 101469 - DNA, 201 bp, Bos taurus; identical to SEQ ID NO: 20155

SEQ ID NO: 101470 - DNA, 201 bp, Bos taurus; identical to SEQ ID NO: 20156

SEQ ID NO: 101471 - DNA, 201 bp, Bos taurus
tttgtgactggcttctctcacctttcataatgttttcaagattcatcacgcggtagtccgtgtcagtacgccattctattttataagcaaataatattccacggtatgaatagcccacattttgtttattcatcagctgatggacatttgggatgtttccactctttcactggcaatgagttgtggtgccgtgagcattca

SEQ ID NO: 101472 - DNA, 201 bp, Bos taurus
tgttctgagatgatccgcccttgggaacaagtcctctgcaggaagcagctcctctcgtctccctgggtcccccagacggcccccgcgtgtcagcaggggtcgacgctgtccccattcgtcagagatgtgtctgcagcctgccacgtgcactgagcatttgcggaggcgtgcagtaaccccaggccaggcgcccgtgcgctg

SEQ ID NO: 101473 - DNA, 201 bp, Bos taurus
cagacccaggcacaggcacacacatgtctgtgtgtgcctgtgtgtgtgtgtcatggacgcatgtgtaagcacacacgtgtgcagctgtagggcctgcagatgcctgacctctccgtgccgtatgaggcatgtccagatggggtttcggctcttggtcctgctgtgggagctcggtggacgccagcccactgctgggtgccc

SEQ ID NO: 101474 - DNA, 201 bp, Bos taurus
tagcaggttaagctgggtaacctgtccgtaactgttcttccagccagacccgaaagaatctctgtgacagcctcagaagaagagttgctgggcctttcagacagaaagtgtcggaactgggagggtttggctctcaccagcagcccctgggagaggcgaccccggcccccttcgctcactgtcctcctgaaggacgactct

SEQ ID NO: 101475 - DNA, 201 bp, Bos taurus
gccaggatctgatagaaagattacagttgtaatggagagctttaattctcacttatcagtgtgccagttaccaaacagaaaaaaataatggccaaggatctgaacggtataatttttaccgttgagttaatctttacttaccaggaacccagagaagggagaatagctggactctgtttagaggaagtcacacggccgtgt

SEQ ID NO: 101476 - DNA, 201 bp, Bos taurus; identical to SEQ ID NO: 20158

SEQ ID NO: 101477 - DNA, 201 bp, Bos taurus
gcgcaggagaaggggacagggatgcagaaaaaagggggtgcggcagtgagtggtttgcactcatcaaagtgagcagggcgagtgggtggccagggctctgggaggctcttggtggcccttccggctgcctggtcagcagggttgaagggcaggctgcctggcccccagggttattatttcttgacccctcagcctggtttg

SEQ ID NO: 101478 - DNA, 201 bp, Bos taurus; identical to SEQ ID NO: 20160

SEQ ID NO: 101479 - DNA, 201 bp, Bos taurus; identical to SEQ ID NO: 20161

SEQ ID NO: 101480 - DNA, 201 bp, Bos taurus
tggcccacatgctcctgccaaaccggaaaccagctcttgagtaacactgggtgctgagtgtggagctgagtgactgagcagaaatcggcatccggcctccagtgacctcggatcctggtgtagccccgccctaggcaggctgcctggtattcttcgaggtctccctcgggcccccttactgattcaggatgccaatgagga

SEQ ID NO: 101481 - DNA, 201 bp, Bos taurus; identical to SEQ ID NO: 20162

SEQ ID NO: 101482 - DNA, 201 bp, Bos taurus; identical to SEQ ID NO: 20163

SEQ ID NO: 101483 - DNA, 201 bp, Bos taurus
tctcactctgtgccaaactcccaggcagaggagcacgtgggctttggctgaaactaggcttcttctgggctgtgccctgaaccccagatgctgagtgctgggccctgggactcccgctggcgcaatcgtgtagctcctgcctccgtgtgctctgggcctactgtctcctctgcggccaccgagtgtcccgaggcctgggac

SEQ ID NO: 101484 - DNA, 201 bp, Bos taurus; identical to SEQ ID NO: 20164

SEQ ID NO: 101485 - DNA, 201 bp, Bos taurus; identical to SEQ ID NO: 20165

SEQ ID NO: 101486 - DNA, 201 bp, Bos taurus; identical to SEQ ID NO: 20166

SEQ ID NO: 101487 - DNA, 201 bp, Bos taurus; identical to SEQ ID NO: 20167

SEQ ID NO: 101488 - DNA, 201 bp, Bos taurus
actggggcccaccagccccatcaggccctcttgcactccctgtggtctctgcattcctcctgctcagtttttccctcacgtccgggccactggactctggcgtctccaggggtcattccaggctccaggctcacaggtctcccagggatggaaggcaagacgcgggcgcctgcagtcagtgacagacaaggggaagttctg

SEQ ID NO: 101489 - DNA, 201 bp, Bos taurus
gctggtggaggccagggggctgcaggaagttggccccctcccctcccagcggcactgagaccgaggcaaacctcagccacggtgacactactcctggtggtgccggggccagagggccacgtgtgccccacggacacagccaggtgcctctctggagcgactctcgagaatgggtgcaccccgagcagtcccggaggatgc

SEQ ID NO: 101490 - DNA, 201 bp, Bos taurus; identical to SEQ ID NO: 20169

SEQ ID NO: 101491 - DNA, 201 bp, Bos taurus
tgaattctgcttttattggactcagatttgcaaacaagcactatgttaagttttgactttaaattttaaaatatatcttatggtctagaacaaaagcaacattcttaagtaactctgaaaattcaaatgtaaatgatctatgcaacttcagttggggatcaaaatcgtcaaacttcctccagggagaagagttgaattgac

SEQ ID NO: 101492 - DNA, 201 bp, Bos taurus
gagggagtcagaataatggatggagggaaggacaagtgcaaaatctgttggaaataagatcagagcaatagtaacagaggtgtgggtggaatgggcatggattaagagcagtttaggagacttatgggaaacaatgacaagacattgcctccaagtgattgatggaaggaataaggctttaagggaggcagtttacatgaa

SEQ ID NO: 101493 - DNA, 201 bp, Bos taurus
ttattactgaaaaatgaataaggagttggagagctgtgagcttgaccaaagtacactgagctgtggtgggcagtgagacaaaggggcctgagtcaggcctccaaaggctcagggtggtacctaactgccagccaacaggaaacccgacttgaggacttccactccaagaaacgtcattcagccaacagcccgagggaactt

SEQ ID NO: 101494 - DNA, 201 bp, Bos taurus
taagaaactcattgtacagtcaacaggatttaactgaagaaaaaatagtggcagtatattgtatgtctgtggcatgtgtaaagtaaaatgcatgacaaaatagctcaaagaatgggcagggatgattgggaattgttgtacggcaacaattatactactttagcttcccaagtagaatccagaaggtggaggatcttaatg

SEQ ID NO: 101495 - DNA, 201 bp, Bos taurus
aagttctagaatcactcttcacaaggtattcttaatgtattactggataagagaagccatttgtaaatggttatgcataatcattctttagcacatccataaattatctgtcaggctcttctagtgaagtagacctaaacctgtcaaggcagcaggaggcaactgtttcagcgtcttttgaaacaataattaattttcaaa

SEQ ID NO: 101496 - DNA, 201 bp, Bos taurus
gaaagcttcctatgttcattcagggcaggacgagaaggagagttaatctctggatataaataatattataatggtttgtttctctgaaaattgtatggatcgttcaaaaaaacgctcatttacttattcactcaggcatttattgattacagtgcatcaggcttttattgcaggcatttgacatctgagagcttactgtct

SEQ ID NO: 101497 - DNA, 201 bp, Bos taurus
acagtggaagatgattggctcacatgaggcctggtttatttaggggcacactgaacactagaatgaaaaataaagataagcattactgtattaatggtaaaagaggacacggcgttttaaaaccacatgtacattctcaaaattaacttgaataggctttgactttcttgaaatgacaaaatatagagctctctaacagga

SEQ ID NO: 101498 - DNA, 201 bp, Bos taurus; identical to SEQ ID NO: 20175

SEQ ID NO: 101499 - DNA, 201 bp, Bos taurus
tgtgcccctttctgctgaattttagtatttgatactcaggggacctgtacggactgttgttgcagcagccagagccatccaagagctcatgaatataaacgtcctatttcatttgtcactattttaacacagcaggcattttgaaaatgcccataggcttgtgtggtgggtgaaaggaaagatgaaagtgtcaagaagcta

SEQ ID NO: 101500 - DNA, 201 bp, Bos taurus
taaaatctatgatgtgttcattttatatttatattttaccttttaaactgtattcttcaatataatttaataataatttgatcattgtgcattatatatatacttatttgtagaagccaggattcaaagatttctgtgtattccaattttgatttaagataaatttttagtcattttaataattagagttcttcatcaaca

SEQ ID NO: 101501 - DNA, 201 bp, Bos taurus
aagaatcttgcactgttataaagtggaggtccactatcactggagaacaggacacttgctccaatccaggagctcctccccaaaatagtccagggacccgaaacagcattcagggccacgggggaagggtcaggagtgctaagccctgttctccttatgagagcccgtgtggcctgagcccacagctggagcaagagaact

SEQ ID NO: 101502 - DNA, 201 bp, Bos taurus
ttatgaactttttggctacccccaatatataatctggaattttctgataattgaaccatggaaaaggaatgtttttctggtatttcagatacactcagtattgttggaataatgatgttaggaaatgaggagagttttaaaaaatagatatttgtaagttgcacagcgtgaaaaataagataaacaagaaattgcttagtt

SEQ ID NO: 101503 - DNA, 201 bp, Bos taurus; identical to SEQ ID NO: 20177

SEQ ID NO: 101504 - DNA, 201 bp, Bos taurus; identical to SEQ ID NO: 20178

SEQ ID NO: 101505 - DNA, 201 bp, Bos taurus; identical to SEQ ID NO: 20179

SEQ ID NO: 101506 - DNA, 201 bp, Bos taurus; identical to SEQ ID NO: 20180

SEQ ID NO: 101507 - DNA, 201 bp, Bos taurus; identical to SEQ ID NO: 20181

SEQ ID NO: 101508 - DNA, 201 bp, Bos taurus; identical to SEQ ID NO: 20182

SEQ ID NO: 101509 - DNA, 201 bp, Bos taurus; identical to SEQ ID NO: 20183

SEQ ID NO: 101510 - DNA, 201 bp, Bos taurus
actgttcaccatgtaacaagagaaggctttgaaagaggccaaaagctcgaaataccaaaaagtatttggccctcatatattctatacgacataacgtttgcaatcctatagctgggcccattctgatcctaggataagctagatatctttggaactgatttattactccaaataaggagaaatgttttatttccaacacat

SEQ ID NO: 101511 - DNA, 201 bp, Bos taurus; identical to SEQ ID NO: 20185

SEQ ID NO: 101512 - DNA, 201 bp, Bos taurus; identical to SEQ ID NO: 20187

SEQ ID NO: 101513 - DNA, 201 bp, Bos taurus
gtctcagaacagaggaagaagcccccaaagagacatgatcagcactgtatccacccttgggcttctaattcctcccccttctcccagatgagctcacacatcccctggctttcattaccaatgatgctcccccaaattgcaagtgtttatttggaattcaaacctctttcctctgagctccagcatttcaaattgaactac

SEQ ID NO: 101514 - DNA, 201 bp, Bos taurus
tttgtgcagtcagaggagtggaaactggcaatgtaatattgctttgggtcaggttgtcctgtgtgtatggctttgtgaaaatatctgcactgtcaccatacagtcataggtcaacttgtagcctattattcattttttttccaattccacagagctggtattacatgcaattaattcaggctagattactgtacttttaaa

SEQ ID NO: 101515 - DNA, 201 bp, Bos taurus
acccattcccttggctgccagcctcctccatgccccatggggtcaagtgtggagcgtgctctgaatgactcacagaaagggctcctgtaccagtcaatcctgctcaatctctgttgcttgcctcttgaagtatcatttccctctccttccctctcctgggccttggcttcctctgtaacaccttacctgcaaatttatttc

SEQ ID NO: 101516 - DNA, 201 bp, Bos taurus
tatagtaatcaatttcccatttgtctttactattttattttctactggttcaggacttagacaaaaagaggtggtatctgaaaagctcacccataacaagcgaatcaatttcctaaaattaaaggaaggggatgagagactcaaattctcgctctcccactcaccatttggtcaaaccagtttgcccaaatgggccctacg

SEQ ID NO: 101517 - DNA, 201 bp, Bos taurus; identical to SEQ ID NO: 20189

SEQ ID NO: 101518 - DNA, 201 bp, Bos taurus
ttgagttcctggtgcccatgctctaaataacagtggcgtgcctcttgtacacacacacacacacacacacacacacacttcccagattttccagacaactattgtaggaaacatgtctcacccttgaattttaaagatctttccaaacttctcattttttagaggaaggcaatgcagttaccattgattaagggatgcttg

SEQ ID NO: 101519 - DNA, 201 bp, Bos taurus; identical to SEQ ID NO: 20191

SEQ ID NO: 101520 - DNA, 201 bp, Bos taurus; identical to SEQ ID NO: 20192

SEQ ID NO: 101521 - DNA, 201 bp, Bos taurus
gtgcacaaatttcatggtctacaggtattgaagtcttacagagtctgttctcttattcttatggagttagttccactgttctacttagtctgtactttgatcagtaccacactgtcttgattactgtatgtttataatcttcaagcgagatagtgctacctccaaccatcttccttcacttatttattgtgatggttattc

SEQ ID NO: 101522 - DNA, 201 bp, Bos taurus
tgaaagttgtgcttaaaaccctttacctaagattgggactcaaacccacgtgtcagggactctgtgctgtgcttagtcacagtcaagagtgtgggccatcacagaggacaagtgcagcagccatgaaatgtagtgtggtttagtttttatgggctgggtagtttcacatgctaatgagtaggaggatcattccaacaattg

SEQ ID NO: 101523 - DNA, 201 bp, Bos taurus; identical to SEQ ID NO: 20200

SEQ ID NO: 101524 - DNA, 201 bp, Bos taurus; identical to SEQ ID NO: 20201

SEQ ID NO: 101525 - DNA, 201 bp, Bos taurus; identical to SEQ ID NO: 20202

SEQ ID NO: 101526 - DNA, 201 bp, Bos taurus; identical to SEQ ID NO: 20203

SEQ ID NO: 101527 - DNA, 201 bp, Bos taurus; identical to SEQ ID NO: 20205

SEQ ID NO: 101528 - DNA, 201 bp, Bos taurus; identical to SEQ ID NO: 20212

SEQ ID NO: 101529 - DNA, 201 bp, Bos taurus; identical to SEQ ID NO: 20214

SEQ ID NO: 101530 - DNA, 201 bp, Bos taurus; identical to SEQ ID NO: 20217

SEQ ID NO: 101531 - DNA, 201 bp, Bos taurus; identical to SEQ ID NO: 20218

SEQ ID NO: 101532 - DNA, 201 bp, Bos taurus; identical to SEQ ID NO: 20224

SEQ ID NO: 101533 - DNA, 201 bp, Bos taurus; identical to SEQ ID NO: 20226

SEQ ID NO: 101534 - DNA, 201 bp, Bos taurus; identical to SEQ ID NO: 20227

SEQ ID NO: 101535 - DNA, 201 bp, Bos taurus; identical to SEQ ID NO: 20228

SEQ ID NO: 101536 - DNA, 201 bp, Bos taurus; identical to SEQ ID NO: 20229

SEQ ID NO: 101537 - DNA, 201 bp, Bos taurus; identical to SEQ ID NO: 20230

SEQ ID NO: 101538 - DNA, 201 bp, Bos taurus; identical to SEQ ID NO: 20231

SEQ ID NO: 101539 - DNA, 201 bp, Bos taurus; identical to SEQ ID NO: 20234

SEQ ID NO: 101540 - DNA, 201 bp, Bos taurus; identical to SEQ ID NO: 20236

SEQ ID NO: 101541 - DNA, 201 bp, Bos taurus; identical to SEQ ID NO: 20237

SEQ ID NO: 101542 - DNA, 201 bp, Bos taurus; identical to SEQ ID NO: 20239

SEQ ID NO: 101543 - DNA, 201 bp, Bos taurus; identical to SEQ ID NO: 20241

SEQ ID NO: 101544 - DNA, 201 bp, Bos taurus; identical to SEQ ID NO: 20243

SEQ ID NO: 101545 - DNA, 201 bp, Bos taurus; identical to SEQ ID NO: 20245

SEQ ID NO: 101546 - DNA, 201 bp, Bos taurus; identical to SEQ ID NO: 20247

SEQ ID NO: 101547 - DNA, 201 bp, Bos taurus; identical to SEQ ID NO: 20249

SEQ ID NO: 101548 - DNA, 201 bp, Bos taurus; identical to SEQ ID NO: 20250

SEQ ID NO: 101549 - DNA, 201 bp, Bos taurus; identical to SEQ ID NO: 20251

SEQ ID NO: 101550 - DNA, 201 bp, Bos taurus; identical to SEQ ID NO: 20255

SEQ ID NO: 101551 - DNA, 201 bp, Bos taurus; identical to SEQ ID NO: 20258

SEQ ID NO: 101552 - DNA, 201 bp, Bos taurus; identical to SEQ ID NO: 20259

SEQ ID NO: 101553 - DNA, 201 bp, Bos taurus; identical to SEQ ID NO: 20263

SEQ ID NO: 101554 - DNA, 201 bp, Bos taurus; identical to SEQ ID NO: 20264

SEQ ID NO: 101555 - DNA, 201 bp, Bos taurus; identical to SEQ ID NO: 20265

SEQ ID NO: 101556 - DNA, 201 bp, Bos taurus; identical to SEQ ID NO: 20266

SEQ ID NO: 101557 - DNA, 201 bp, Bos taurus; identical to SEQ ID NO: 20267

SEQ ID NO: 101558 - DNA, 201 bp, Bos taurus; identical to SEQ ID NO: 20268

SEQ ID NO: 101559 - DNA, 201 bp, Bos taurus; identical to SEQ ID NO: 20269

SEQ ID NO: 101560 - DNA, 201 bp, Bos taurus; identical to SEQ ID NO: 20271

SEQ ID NO: 101561 - DNA, 201 bp, Bos taurus; identical to SEQ ID NO: 20272

SEQ ID NO: 101562 - DNA, 201 bp, Bos taurus; identical to SEQ ID NO: 20274

SEQ ID NO: 101563 - DNA, 201 bp, Bos taurus; identical to SEQ ID NO: 20275

SEQ ID NO: 101564 - DNA, 201 bp, Bos taurus; identical to SEQ ID NO: 20276

SEQ ID NO: 101565 - DNA, 201 bp, Bos taurus; identical to SEQ ID NO: 20277

SEQ ID NO: 101566 - DNA, 201 bp, Bos taurus; identical to SEQ ID NO: 20278

SEQ ID NO: 101567 - DNA, 201 bp, Bos taurus; identical to SEQ ID NO: 20279

SEQ ID NO: 101568 - DNA, 201 bp, Bos taurus; identical to SEQ ID NO: 20280

SEQ ID NO: 101569 - DNA, 201 bp, Bos taurus; identical to SEQ ID NO: 20282

SEQ ID NO: 101570 - DNA, 201 bp, Bos taurus; identical to SEQ ID NO: 20283

SEQ ID NO: 101571 - DNA, 201 bp, Bos taurus; identical to SEQ ID NO: 20284

SEQ ID NO: 101572 - DNA, 201 bp, Bos taurus; identical to SEQ ID NO: 20285

SEQ ID NO: 101573 - DNA, 201 bp, Bos taurus; identical to SEQ ID NO: 20286

SEQ ID NO: 101574 - DNA, 201 bp, Bos taurus; identical to SEQ ID NO: 20287

SEQ ID NO: 101575 - DNA, 201 bp, Bos taurus; identical to SEQ ID NO: 20288

SEQ ID NO: 101576 - DNA, 201 bp, Bos taurus; identical to SEQ ID NO: 20289

SEQ ID NO: 101577 - DNA, 201 bp, Bos taurus; identical to SEQ ID NO: 20290

SEQ ID NO: 101578 - DNA, 201 bp, Bos taurus; identical to SEQ ID NO: 20291

SEQ ID NO: 101579 - DNA, 201 bp, Bos taurus; identical to SEQ ID NO: 20292

SEQ ID NO: 101580 - DNA, 201 bp, Bos taurus; identical to SEQ ID NO: 20293

SEQ ID NO: 101581 - DNA, 201 bp, Bos taurus; identical to SEQ ID NO: 20294

SEQ ID NO: 101582 - DNA, 201 bp, Bos taurus; identical to SEQ ID NO: 20295

SEQ ID NO: 101583 - DNA, 201 bp, Bos taurus; identical to SEQ ID NO: 20296

SEQ ID NO: 101584 - DNA, 201 bp, Bos taurus; identical to SEQ ID NO: 20297

SEQ ID NO: 101585 - DNA, 201 bp, Bos taurus; identical to SEQ ID NO: 20298

SEQ ID NO: 101586 - DNA, 201 bp, Bos taurus; identical to SEQ ID NO: 20299

SEQ ID NO: 101587 - DNA, 201 bp, Bos taurus; identical to SEQ ID NO: 20300

SEQ ID NO: 101588 - DNA, 201 bp, Bos taurus; identical to SEQ ID NO: 20301

SEQ ID NO: 101589 - DNA, 201 bp, Bos taurus; identical to SEQ ID NO: 20302

SEQ ID NO: 101590 - DNA, 201 bp, Bos taurus; identical to SEQ ID NO: 20303

SEQ ID NO: 101591 - DNA, 201 bp, Bos taurus
gaagaccccactgacaaggctttctttatttgatctgacctggagctcacctattatatacagccttttccccactggaggtatttgttggcaatagtgagaggcagttgttgaacactgtagctgtctgaggtcttggtagacaaaactagctagactgaccaagaaaaagagagaagacccaaattactaaattagaaa

SEQ ID NO: 101592 - DNA, 201 bp, Bos taurus; identical to SEQ ID NO: 20305

SEQ ID NO: 101593 - DNA, 201 bp, Bos taurus; identical to SEQ ID NO: 20306

SEQ ID NO: 101594 - DNA, 201 bp, Bos taurus; identical to SEQ ID NO: 20307

SEQ ID NO: 101595 - DNA, 201 bp, Bos taurus
gggaacagattagaagcccctcaggcccatagtcagccatagtcttcatagggtcgaggaacgttaggcttggaggagatctcagacagcatcctgtgcaacggttctccaaggtgttctgaggcctaaatgtctgcaagagtcccctgcagaccttgttaaaaattcaaactctttggtcttactccgtgagctgaccca

SEQ ID NO: 101596 - DNA, 201 bp, Bos taurus
caggtaatacttgagagcagcttttaagaatagtgtaggaataaagggttaaaatcacttttttatttaataagatacaatatgtagaatgcatgagaatatctggtacaccacacacacttaatacatatcaatcctgtttccttacttgagctcctgctaaccaagttagttccagattaatccaggactctcgctgtt

SEQ ID NO: 101597 - DNA, 201 bp, Bos taurus
aaatacctggctaatatatgtattctagttaacttaaatattctcatagaggatacagatttttttgttgttgttcattttaggtatttttaaagtaaaggagacaaaattttggaaagcatctcttcatattgcagttgcatacttaatgtgcaaagaaaaatatgagttcagtgattcttgataaaaccaaagtttcct

SEQ ID NO: 101598 - DNA, 201 bp, Bos taurus
ccaaaactactggctactgaccaatagaaacataatttctaagctttctgaaggatgactatttgtgtatcttattatcaaaatagctaaatactggacttagatggggaaactaagtttgtaccccatttacataactgcagtttcaccaaaactgtgctacatatacagctgccattcgactgaaattagaatgacatt

SEQ ID NO: 101599 - DNA, 201 bp, Bos taurus
gcctctgggaagaaaggccatgacttttctgtaatagataagacaaatttcattatagcagccaagagagaagctgagattaatcagtgtcagaaaaactatcaaagagaggccagtgagtatatcccttgccccacgtcacaaaaatacataaaccatccaagaaattagccctggataattagagcaggagatgtggaa

SEQ ID NO: 101600 - DNA, 201 bp, Bos taurus; identical to SEQ ID NO: 20308

SEQ ID NO: 101601 - DNA, 201 bp, Bos taurus
ctcttggcgtagtcttaatcaaagctttacccttgtagtcaggagaaaaaaatctgttaccaaaaggagaattgggatagggagaagtagacatgttagtatgtactaactccacacttccagcagatgtaaaccagacatgaaccattcactgcaatcttcagcattatttaagacctgggtaaagacccataagggcaa

SEQ ID NO: 101602 - DNA, 201 bp, Bos taurus
tactttggttcaaggcctctgaggggtgtgtgtgacgaggaaggtttctaagccatgagtgccacgttgcttgcattttaagcagatcgtgtgcgcagtcattatggacaacaaaatggagcataaaaccttcatgcagatgaaccactgcaatcagatcatcgtaaaagtgaaacctagatgttataagaatccaagcaa

SEQ ID NO: 101603 - DNA, 201 bp, Bos taurus
aaggataaaatagtacttgacgaatggttatagatcttaaggcagaaatgaaagaggacatgaaaaggccgtactttaaagatggaaagctttaaaatcacttgaggtagaagtaactcatttttattgtctcagaggagtagtggtaaaagaggaggtcaaattgctggttaataagcatatggtggataaccttaaatg

SEQ ID NO: 101604 - DNA, 201 bp, Bos taurus; identical to SEQ ID NO: 20309

SEQ ID NO: 101605 - DNA, 201 bp, Bos taurus
ttttaagtgattattattaaatttttattatattgtctttaagtaaatgaaggacattacttttgaaacttttcagaatatatttctatatgaataatctgtgtagttttgtgtaacagatgggaactgcttcctaccattttgggagcaagtgatatcacgtgctttagttgactaaaattaaatacggcctgaatcctc

SEQ ID NO: 101606 - DNA, 201 bp, Bos taurus
gttctttgctgtgcatcctcctttcatcatgcgtgtcccctctggctgcagaattctgccccttttcttttctttctcctttgaggccaattccactgctcagctagacccatctcccctcctgttcaggctcctaacatcatgtacctctctttcttagccttcatgactgttcaaagtttccatatagttgtgtgattc

SEQ ID NO: 101607 - DNA, 201 bp, Bos taurus; identical to SEQ ID NO: 20310

SEQ ID NO: 101608 - DNA, 201 bp, Bos taurus
ggagacatagttactgaagttggcagagttttaactcccatttattcactgatgattctcaaactcacacctccagcctatatctcctaagcttcaaatgtggctccttaagtcatttccatggatgctccgtgggctgtcaaattcaacatttctgcatgctgaattattatcttctttccctaatccacttctccagta

SEQ ID NO: 101609 - DNA, 201 bp, Bos taurus; identical to SEQ ID NO: 20311

SEQ ID NO: 101610 - DNA, 201 bp, Bos taurus
acagaacaataaagggttgtttactgttctttctctttctggattatatccatagttttcttggtttcttttgaaatcatttatacaaattaattttatacggccccaaaccaatgctatacaattttgaatgcttccagaggcagtcatttttttcccttaaaaaaggctttgctgcagtaatataacaatgctgccatt

SEQ ID NO: 101611 - DNA, 201 bp, Bos taurus; identical to SEQ ID NO: 20312

SEQ ID NO: 101612 - DNA, 201 bp, Bos taurus; identical to SEQ ID NO: 20313

SEQ ID NO: 101613 - DNA, 201 bp, Bos taurus; identical to SEQ ID NO: 20314

SEQ ID NO: 101614 - DNA, 201 bp, Bos taurus; identical to SEQ ID NO: 20315

SEQ ID NO: 101615 - DNA, 201 bp, Bos taurus
tatatttaccaacaaatagtttatcaagtgccagcattttatatgaattatctcatttcattttcataacctatgaggaatatccaattaatagaataccaatttcatagatgaggaataaggataataaaactaactttccccaaggcattcagtcagtaaaaaatggctgtaatttgcagtgtgttagactccagggtc

SEQ ID NO: 101616 - DNA, 201 bp, Bos taurus; identical to SEQ ID NO: 20316

SEQ ID NO: 101617 - DNA, 201 bp, Bos taurus; identical to SEQ ID NO: 20317

SEQ ID NO: 101618 - DNA, 201 bp, Bos taurus; identical to SEQ ID NO: 20318

SEQ ID NO: 101619 - DNA, 201 bp, Bos taurus; identical to SEQ ID NO: 20319

SEQ ID NO: 101620 - DNA, 201 bp, Bos taurus; identical to SEQ ID NO: 20320

SEQ ID NO: 101621 - DNA, 201 bp, Bos taurus; identical to SEQ ID NO: 20321

SEQ ID NO: 101622 - DNA, 201 bp, Bos taurus; identical to SEQ ID NO: 20322

SEQ ID NO: 101623 - DNA, 201 bp, Bos taurus; identical to SEQ ID NO: 20323

SEQ ID NO: 101624 - DNA, 201 bp, Bos taurus; identical to SEQ ID NO: 20324

SEQ ID NO: 101625 - DNA, 201 bp, Bos taurus; identical to SEQ ID NO: 20325

SEQ ID NO: 101626 - DNA, 201 bp, Bos taurus; identical to SEQ ID NO: 20326

SEQ ID NO: 101627 - DNA, 201 bp, Bos taurus; identical to SEQ ID NO: 20327

SEQ ID NO: 101628 - DNA, 201 bp, Bos taurus; identical to SEQ ID NO: 20328

SEQ ID NO: 101629 - DNA, 201 bp, Bos taurus; identical to SEQ ID NO: 20332

SEQ ID NO: 101630 - DNA, 201 bp, Bos taurus; identical to SEQ ID NO: 20334

SEQ ID NO: 101631 - DNA, 201 bp, Bos taurus; identical to SEQ ID NO: 20337

SEQ ID NO: 101632 - DNA, 201 bp, Bos taurus; identical to SEQ ID NO: 20339

SEQ ID NO: 101633 - DNA, 201 bp, Bos taurus; identical to SEQ ID NO: 20340

SEQ ID NO: 101634 - DNA, 201 bp, Bos taurus; identical to SEQ ID NO: 20341

SEQ ID NO: 101635 - DNA, 201 bp, Bos taurus; identical to SEQ ID NO: 20342

SEQ ID NO: 101636 - DNA, 201 bp, Bos taurus; identical to SEQ ID NO: 20343

SEQ ID NO: 101637 - DNA, 201 bp, Bos taurus
aaagaatccccctgccaactgctttccaaacaggatctttgtctgtgtaaaatatctctccttaaagagcgaaggtatccaaattaaacctaagcaagggagctctgttaattctgcactgaagctttattctaggcaagaaggtgaatgacatttggaaaagaattgtaagatgatccctgaacatcctttgcacttttt

SEQ ID NO: 101638 - DNA, 201 bp, Bos taurus; identical to SEQ ID NO: 20345

SEQ ID NO: 101639 - DNA, 201 bp, Bos taurus; identical to SEQ ID NO: 20346

SEQ ID NO: 101640 - DNA, 201 bp, Bos taurus; identical to SEQ ID NO: 20347

SEQ ID NO: 101641 - DNA, 201 bp, Bos taurus
atactcaagttccctggtatctgctgggtctgtggcctaagttggataactactcatactacttccgggaaaagtgaaagtaatgctacattcagttagagggcaagactgtttcctggccattctaaagatcttatgccacacaaccaaccaacaaacaaaaaatctcctagttggattaagtgttttcagttgtcaaga

SEQ ID NO: 101642 - DNA, 201 bp, Bos taurus; identical to SEQ ID NO: 20348

SEQ ID NO: 101643 - DNA, 201 bp, Bos taurus
cttcatgttccttgttactttatataattaagttgggtaccttggttcaaatattatgcatcttctaagacaccttagaaatcttcagttcaataccctaaaaggccaaggaaatcataattggccagtcacatgataaaaatcaagagaattttcctgcagagatacagatatttcaactctctgcaagtgtaagagagt

SEQ ID NO: 101644 - DNA, 201 bp, Bos taurus; identical to SEQ ID NO: 20349

SEQ ID NO: 101645 - DNA, 201 bp, Bos taurus; identical to SEQ ID NO: 20350

SEQ ID NO: 101646 - DNA, 201 bp, Bos taurus; identical to SEQ ID NO: 20351

SEQ ID NO: 101647 - DNA, 201 bp, Bos taurus; identical to SEQ ID NO: 20352

SEQ ID NO: 101648 - DNA, 201 bp, Bos taurus; identical to SEQ ID NO: 20353

SEQ ID NO: 101649 - DNA, 201 bp, Bos taurus; identical to SEQ ID NO: 20354

SEQ ID NO: 101650 - DNA, 201 bp, Bos taurus
aatgagaacatctgaggctgtgagtcagcactccatggccagccagggacagttcggctgggtttccacctagaccccattgtcatggtccagacaagacgtacggaggacccaaagtgggccgtagccctaaggtctaagttctctacacctctgccccaacctctatttatacctaatagaagtgttggccacttgtgt

SEQ ID NO: 101651 - DNA, 201 bp, Bos taurus; identical to SEQ ID NO: 20355

SEQ ID NO: 101652 - DNA, 201 bp, Bos taurus; identical to SEQ ID NO: 20356

SEQ ID NO: 101653 - DNA, 201 bp, Bos taurus; identical to SEQ ID NO: 20357

SEQ ID NO: 101654 - DNA, 201 bp, Bos taurus; identical to SEQ ID NO: 20358

SEQ ID NO: 101655 - DNA, 201 bp, Bos taurus; identical to SEQ ID NO: 20359

SEQ ID NO: 101656 - DNA, 201 bp, Bos taurus; identical to SEQ ID NO: 20360

SEQ ID NO: 101657 - DNA, 201 bp, Bos taurus; identical to SEQ ID NO: 20363

SEQ ID NO: 101658 - DNA, 201 bp, Bos taurus; identical to SEQ ID NO: 20366

SEQ ID NO: 101659 - DNA, 201 bp, Bos taurus; identical to SEQ ID NO: 20367

SEQ ID NO: 101660 - DNA, 201 bp, Bos taurus; identical to SEQ ID NO: 20368

SEQ ID NO: 101661 - DNA, 201 bp, Bos taurus
attcatttaggttgattgtttttaagaaacaggcctcaggaaggtgttcttgctccctgcccttaactgcctaaaatattttaggtaaagggcctgttcccggaacaggagtatcaccagaaataactcgcaaagaatactggactggtgtggtgggggaaattgacagggcctagagatcagagtccattatgtgtccca

SEQ ID NO: 101662 - DNA, 201 bp, Bos taurus
tacttagtctcttatttttggcccctctttttattatgtgtagtgatctgattacatataatgctgtattttcaattcttcaattgcttttcattttcccaaaatcatcaattctaaaagggcctttaagaagccccatattttgccacttaaatgttaacaaatgagttgaaagcctggcttacatttaaataaagtaaa

SEQ ID NO: 101663 - DNA, 201 bp, Bos taurus
tcagtcaccatggatatttaacaaatcaggtggtgtgttagaagcagactttagactacagtggactcagaagcaagctgaagatgagggagaaataaggagttaccaactacacacttggaaattaaagcttcttccaagaatgaagaatagtagctaataggatcgagatatgctgtgcaagtacattacatggaaaac

SEQ ID NO: 101664 - DNA, 201 bp, Bos taurus
tcccaaattaaaatataacatgattgaaaatttaaaggtgacacactaatcacaaaattgtattcttacactgagtcctattttgaattgctgctcatctagctagaaatttgtaatgaaatgagaaattatatgttatttcatgagtaaataatgaagtagacaacactgtattcattttatatttttatcatatgcata

SEQ ID NO: 101665 - DNA, 201 bp, Bos taurus; identical to SEQ ID NO: 20372

SEQ ID NO: 101666 - DNA, 201 bp, Bos taurus; identical to SEQ ID NO: 20373

SEQ ID NO: 101667 - DNA, 201 bp, Bos taurus; identical to SEQ ID NO: 20374

SEQ ID NO: 101668 - DNA, 201 bp, Bos taurus
catgattaatgtctataaacatttgacattaagtaaagccgattacctctaataatgtgggtgggtctcactgaatcagctgaaggcctaaaagcaaaaatcgacatttcctggagaaggaattttgcctcaaactgtaacatagaaatcctgcctgagtttccagcctgctggcctgccctacagatttcagatttgcca

SEQ ID NO: 101669 - DNA, 201 bp, Bos taurus
tgtacaattaaaatttaaatgtgtttgtgtgtggcctgcatctattccatatagaataaaaacaacttaaaaccatgcactaggaaatattaagaagtttcttcaggggccacttgataaagcatgctggagaactggtgatcagtggacatctctgtgtgggtatgtgatttgctataaagtctttgaaagcacaaagcc

SEQ ID NO: 101670 - DNA, 201 bp, Bos taurus
gagaatgttaggtaattagaataggaagaaaggagtccagaatggtggtggctaaaaaacaaagaagggaaaagtctgcaaaaatagaacaaaccaaggttcaaggacaagagtgaaaatctcaggcaaaaccaacagccctcctggctagataaatttacatagggcaggctggggatgggtggttggcggagggacata

SEQ ID NO: 101671 - DNA, 201 bp, Bos taurus; identical to SEQ ID NO: 20375

SEQ ID NO: 101672 - DNA, 201 bp, Bos taurus
ttggcctaagggcattttcaaacaattacggatcgtgaagattttctaatctgaattctacactttgcctatcaagaaactgaggctctgagaactttactggctccttctaaggcctgttactggttttagtggaatccctgagcagctgatgactggagaataagagatgtccacttctgagcagttttcccatggtcc

SEQ ID NO: 101673 - DNA, 201 bp, Bos taurus
cccatctttcagctctgtaccttccttccgtgggtgacaactccttcaagtcttccaggccaggcttcacgttcagtagcttcttatagagagccagcgggaagtgcaggtccaccacagtggagttgtaaatggcgagtccgcaggttatgccaatcaagtgaaaccagttgtgctctacgaaacactttaagcacatgc

SEQ ID NO: 101674 - DNA, 201 bp, Bos taurus; identical to SEQ ID NO: 20376

SEQ ID NO: 101675 - DNA, 201 bp, Bos taurus; identical to SEQ ID NO: 20377

SEQ ID NO: 101676 - DNA, 201 bp, Bos taurus; identical to SEQ ID NO: 20379

SEQ ID NO: 101677 - DNA, 201 bp, Bos taurus; identical to SEQ ID NO: 20381

SEQ ID NO: 101678 - DNA, 201 bp, Bos taurus
gtgggaaagacaacaatcgctgctaccctacttctttctagccgccatttcccaggctaatatctcatttctgcaggctgatcaggcttggtctctagactgggatgtcctagggctcagggagccagggaggtgtccccagaacacaagccccctttgtacctgttctgcccagtccaatctgcctgggaccacagtgtc

SEQ ID NO: 101679 - DNA, 201 bp, Bos taurus; identical to SEQ ID NO: 20383

SEQ ID NO: 101680 - DNA, 201 bp, Bos taurus; identical to SEQ ID NO: 20386

SEQ ID NO: 101681 - DNA, 201 bp, Bos taurus; identical to SEQ ID NO: 20389

SEQ ID NO: 101682 - DNA, 201 bp, Bos taurus; identical to SEQ ID NO: 20391

SEQ ID NO: 101683 - DNA, 201 bp, Bos taurus; identical to SEQ ID NO: 20392

SEQ ID NO: 101684 - DNA, 201 bp, Bos taurus; identical to SEQ ID NO: 20393

SEQ ID NO: 101685 - DNA, 201 bp, Bos taurus
atagaattgtaatgaacaaagcaacatacctagggttgactactaaccggagggcttgctcactttaaaagccattccatttaggcaatgccttattttctgtactctctagctgaccctgcccaaatccacacaggtgacctctcaggaacccgacaggatacttatagggaggcttccattctagtcccctcactctgg

SEQ ID NO: 101686 - DNA, 201 bp, Bos taurus
tttcaacttgcagattccttgaagaactgatgaaatctctggaaatttgtctgaataaaatgcccacaaataattttgcacataatttcagagacatagagatctcctaaagatcagagatagactttttagttgtctcttaaccctaaatttagatattctataatatgcaaaactattaaagtttgcagttttaaaaat

SEQ ID NO: 101687 - DNA, 201 bp, Bos taurus; identical to SEQ ID NO: 20394

SEQ ID NO: 101688 - DNA, 201 bp, Bos taurus
agtgttggaggtttgttttttttttcctagtgattattcccacatgtgggaatacaaagcagtgagcctggcatactgttttcttcatacttgtctatctgtctgttggtctttattcactcttttttttttaattaatctgtgattatcaacaggaaacccctgagaccactattattaacttgaacacaaatggaagat

SEQ ID NO: 101689 - DNA, 201 bp, Bos taurus; identical to SEQ ID NO: 20395

SEQ ID NO: 101690 - DNA, 201 bp, Bos taurus; identical to SEQ ID NO: 20396

SEQ ID NO: 101691 - DNA, 201 bp, Bos taurus
tgcagtccattcagtacttccaatcctgttcccaaccacatgtgctgtcaatgatgatgtggtgcggggggtactcttcctccctccagctctctggaccgcagttcccaagccacacagatgctcttttcctttctaaacctcatcccaaactttccactctgttcacatgatgatggtggctcaactctgcccacttgg

SEQ ID NO: 101692 - DNA, 201 bp, Bos taurus
aacaattcatgctctggatttgttgtcagtggtatgctcccaggtggatattatcttttaaaaattgagtacatgccatttgtctgtaaggtaaagggtgatatttttaacagtaactgaaaaactgttttggaaagaagctctaacacaggtgttttggaagtggacagggaaatgtttgcatcattgtgtgtgtgtgta

SEQ ID NO: 101693 - DNA, 201 bp, Bos taurus
agcaggaaaaaatcagaagctctttaccacaagtgattttttccctgcagtaatgttaaaaaaagaaatgcagcctgtagacagggatttggagaggaaaggagaacacagccaagggcagggtgtgttttgtgctcccaactcttccaaccaagcaaaggtcccgcctccacatttcttcctgcagggatcagaatttgg

SEQ ID NO: 101694 - DNA, 201 bp, Bos taurus
aggtcgtcaagaacatgttcttcaactaaaacataatctctctataactcacactaactaggcttcaccccaaatacagtgggactaaaattttaatcctgaaaatccttaacatcactcatttcaatgtcataaatgtctgttgatgctttagtttgatccttgatgccttctcttcccagggatcttagagttttattg

SEQ ID NO: 101695 - DNA, 201 bp, Bos taurus; identical to SEQ ID NO: 20399

SEQ ID NO: 101696 - DNA, 201 bp, Bos taurus
agtaaaagcaggccagtctgcttacaagacttgtcaacacttctaatacatccaagtatgttctgagtctccaaactgaccgacagcagtgtttccaaaattccatggtcattgaggccttttcttacctgacctttgactctactgaaaacacttccttggcagctcagacagtaacaaatctgcctgcgatggaggaga

SEQ ID NO: 101697 - DNA, 201 bp, Bos taurus; identical to SEQ ID NO: 20400

SEQ ID NO: 101698 - DNA, 201 bp, Bos taurus; identical to SEQ ID NO: 20401

SEQ ID NO: 101699 - DNA, 201 bp, Bos taurus; identical to SEQ ID NO: 20402

SEQ ID NO: 101700 - DNA, 201 bp, Bos taurus; identical to SEQ ID NO: 20405

SEQ ID NO: 101701 - DNA, 201 bp, Bos taurus; identical to SEQ ID NO: 20406

SEQ ID NO: 101702 - DNA, 201 bp, Bos taurus; identical to SEQ ID NO: 20408

SEQ ID NO: 101703 - DNA, 201 bp, Bos taurus
tataatctttaaaacttggaaaccatttctagctttccagcatttagaacatcaaacaaacaaatgagagctgactggaacaggcctgtggatcaaatatttgccagggtttgcagactccattactggtgtaaaggagacaaatcaagttaataaaaacttgatcttgtatcttgatgacaaaatgtaagagaatttaag

SEQ ID NO: 101704 - DNA, 201 bp, Bos taurus; identical to SEQ ID NO: 20410

SEQ ID NO: 101705 - DNA, 201 bp, Bos taurus; identical to SEQ ID NO: 20411

SEQ ID NO: 101706 - DNA, 201 bp, Bos taurus; identical to SEQ ID NO: 20412

SEQ ID NO: 101707 - DNA, 201 bp, Bos taurus; identical to SEQ ID NO: 20414

SEQ ID NO: 101708 - DNA, 201 bp, Bos taurus; identical to SEQ ID NO: 20415

SEQ ID NO: 101709 - DNA, 201 bp, Bos taurus
cctgagagtattttaaaaattacatatcattacataaataaaggcataggcttaaccttgtgactttgtaatttcaaatgaaataaataagatatagagacctacattctaattctggttttacaactgcatctggttagtcaactactgaaatttgtttttataaaattgcattcactcatattttattgtaactctaag

SEQ ID NO: 101710 - DNA, 201 bp, Bos taurus; identical to SEQ ID NO: 20417

SEQ ID NO: 101711 - DNA, 201 bp, Bos taurus
gtacatgggaagtctgagttgcagtgctttagtaaacatgtggacgggtatcataaggtcttatggtttgtgtgtaacacaaacagactctaagttaccagccctctccagaaaatcagaaccagaggtgaagaaccataagaaaagtgcaatggaaatgctgcacttatgaagtcattgtaccaattatctcagggaaag

SEQ ID NO: 101712 - DNA, 201 bp, Bos taurus; identical to SEQ ID NO: 20418

SEQ ID NO: 101713 - DNA, 201 bp, Bos taurus; identical to SEQ ID NO: 20419

SEQ ID NO: 101714 - DNA, 201 bp, Bos taurus; identical to SEQ ID NO: 20420

SEQ ID NO: 101715 - DNA, 201 bp, Bos taurus
gcagatgttttgatatccatctcctcattcctggctctctcatttgattgagaattggagagagtggagagcagtgtagttaattagttccctcggcccaagcagaagggaccggaccagtacctccaggaagatgtcgtggcaacaacctgcttggacatgttggaagaaagcctagcctggcagggaaaggaggtagct

SEQ ID NO: 101716 - DNA, 201 bp, Bos taurus
ctttattttgtacttctaggccaaatttgcctgttactccaggtatctcttgacttcctacttttgcattccagtcccctatgatgaaaaggacatcttttggggaattagtactagaaggtcttttagatcttcatagaaccattcaatttcagtttcttcagcattactggttggagcatagacttggattactgtgat

SEQ ID NO: 101717 - DNA, 201 bp, Bos taurus
ttctctagggaacccaatgtgctttgcaaacgtattaaataattaactctctcaaatctgagtgaagtggaaaggcagtgaaaatattccaggaagagccgagcaggttggtgagtgatgaccagatgtgttgctttgaaaaggcaaatccacatggcacctggcagagaccacaggacacgaggcttcttctgggggctg

SEQ ID NO: 101718 - DNA, 201 bp, Bos taurus
tttggctgtcccacaaatgagacagttggtggctgaagagggtgacacatgcaagacaagttggacagccaaagccaaggtcagcaggcaaggcctcaaaccaagccagtgccatgaaagtgatgggcaagggaagcaggagtgagtgggtcttgaacctgaagctggccatcaggcacatgaggctgggtctagacaccc

SEQ ID NO: 101719 - DNA, 201 bp, Bos taurus
gacctcaccaccccattccctgcctctcagcctgatgcctcacttgaagacagctcttgtaggttcaggagccctgcttgcaaagctctgtgtgaggcaccaggggccccagatgtcaggcacccctgggtgttctttggagccagagatgctacctctcatctgcggtcatagttcaaggagctggggtacagggatctc

SEQ ID NO: 101720 - DNA, 201 bp, Bos taurus; identical to SEQ ID NO: 20424

SEQ ID NO: 101721 - DNA, 201 bp, Bos taurus; identical to SEQ ID NO: 20425

SEQ ID NO: 101722 - DNA, 201 bp, Bos taurus; identical to SEQ ID NO: 20426

SEQ ID NO: 101723 - DNA, 201 bp, Bos taurus; identical to SEQ ID NO: 20428

SEQ ID NO: 101724 - DNA, 201 bp, Bos taurus
atacatgaacaagtgacttataatggaaaataagtgtaatggagatggtccacatctgggtcatgttaatgccaaggaggttatgcaagaaataggaaaggaataggctgacatcattcccattgaatgaacaggaattctgttgactggaagacatatggctccttgaataaaaggagtactgaataaatgagttactta

SEQ ID NO: 101725 - DNA, 201 bp, Bos taurus; identical to SEQ ID NO: 20430

SEQ ID NO: 101726 - DNA, 201 bp, Bos taurus; identical to SEQ ID NO: 20432

SEQ ID NO: 101727 - DNA, 201 bp, Bos taurus; identical to SEQ ID NO: 20433

SEQ ID NO: 101728 - DNA, 201 bp, Bos taurus; identical to SEQ ID NO: 20435

SEQ ID NO: 101729 - DNA, 201 bp, Bos taurus; identical to SEQ ID NO: 20436

SEQ ID NO: 101730 - DNA, 201 bp, Bos taurus; identical to SEQ ID NO: 20438

SEQ ID NO: 101731 - DNA, 201 bp, Bos taurus; identical to SEQ ID NO: 20441

SEQ ID NO: 101732 - DNA, 201 bp, Bos taurus; identical to SEQ ID NO: 20442

SEQ ID NO: 101733 - DNA, 201 bp, Bos taurus; identical to SEQ ID NO: 20443

SEQ ID NO: 101734 - DNA, 201 bp, Bos taurus; identical to SEQ ID NO: 20444

SEQ ID NO: 101735 - DNA, 201 bp, Bos taurus; identical to SEQ ID NO: 20445

SEQ ID NO: 101736 - DNA, 201 bp, Bos taurus
acctgatatcatgtcatgcctccaagcatgacattcacttttactgtcctgtcaatggagtgctctactaacccctacactattccttggtaggcaaaacgcaatcatttcccaatctagattaaatgatcttccctcagatatagacttctatagtacaagactttgtgcatttacagtttctcagtatttgtgttatct

SEQ ID NO: 101737 - DNA, 201 bp, Bos taurus; identical to SEQ ID NO: 20446

SEQ ID NO: 101738 - DNA, 201 bp, Bos taurus; identical to SEQ ID NO: 20447

SEQ ID NO: 101739 - DNA, 201 bp, Bos taurus; identical to SEQ ID NO: 20448

SEQ ID NO: 101740 - DNA, 201 bp, Bos taurus
gacaccttttcccaaagctatattattgtttctctagactgtccctcacttgtctctgtatcctctccctttcctaattggtaactgtttgaacctcctctttggaactgagggaaggtcataaatgaagcctatttcctatagtcaagaaattggggacatagaaatacagggtcctgcactctatcagtcaaattcaga

SEQ ID NO: 101741 - DNA, 201 bp, Bos taurus; identical to SEQ ID NO: 20449

SEQ ID NO: 101742 - DNA, 201 bp, Bos taurus; identical to SEQ ID NO: 60944

SEQ ID NO: 101743 - DNA, 201 bp, Bos taurus; identical to SEQ ID NO: 20453

SEQ ID NO: 101744 - DNA, 201 bp, Bos taurus; identical to SEQ ID NO: 20454

SEQ ID NO: 101745 - DNA, 201 bp, Bos taurus; identical to SEQ ID NO: 20455

SEQ ID NO: 101746 - DNA, 201 bp, Bos taurus; identical to SEQ ID NO: 20458

SEQ ID NO: 101747 - DNA, 201 bp, Bos taurus
ctaaactattttttagtgacttgaacctcaagtgattttagtaaatcaagactgcttccgtcaggctagtctgtcataagagcaaaataggcataaaccattgcatttttttaagggcttttgttttcctgagtgagatactgctaaatttcaaggttgcttttcagttaaatgtgacatatagaatataaccttgcatcc

SEQ ID NO: 101748 - DNA, 201 bp, Bos taurus
tccaggatcataaataagcatagggaaaagtgaacttaggattgagatagcatgagtaaatatcttgtccaatcatgtccacaaaataatattacattaacaaatgtattgatggaaacacacagatacacacgaagcagaatgatggtcaagctcttctcaggggaataatgattagaataataatgttttggttcctgg

SEQ ID NO: 101749 - DNA, 201 bp, Bos taurus; identical to SEQ ID NO: 20459

SEQ ID NO: 101750 - DNA, 201 bp, Bos taurus; identical to SEQ ID NO: 20460

SEQ ID NO: 101751 - DNA, 201 bp, Bos taurus; identical to SEQ ID NO: 20461

SEQ ID NO: 101752 - DNA, 201 bp, Bos taurus; identical to SEQ ID NO: 20462

SEQ ID NO: 101753 - DNA, 201 bp, Bos taurus; identical to SEQ ID NO: 20463

SEQ ID NO: 101754 - DNA, 201 bp, Bos taurus; identical to SEQ ID NO: 20464

SEQ ID NO: 101755 - DNA, 201 bp, Bos taurus; identical to SEQ ID NO: 20465

SEQ ID NO: 101756 - DNA, 201 bp, Bos taurus; identical to SEQ ID NO: 60957

SEQ ID NO: 101757 - DNA, 201 bp, Bos taurus; identical to SEQ ID NO: 20466

SEQ ID NO: 101758 - DNA, 201 bp, Bos taurus
ttccctgcaaacgcaactttgagaaatggcccagagagccaacgttttgcgttcttggaatacccaaagagaatgtgcagggacattcaggcctatggtagattgcttctctcagcataggctgcaaagccattgaaaacctggctttcttgggcatgccactgtctcggattaccaaataaagcaggtaaggaggaagat

SEQ ID NO: 101759 - DNA, 201 bp, Bos taurus
tggatataatattccctgagttttggctgtttttataacctgataaatctgtttttataaccatgataattgaaggacagtttggttggaagtaaaatccgtggcttacatatttctatccttaagcagtttttaatgatattgtatggttgtctttattttttctgttattgtcaaaaaatcagaggtcaagtgattttt

SEQ ID NO: 101760 - DNA, 201 bp, Bos taurus; identical to SEQ ID NO: 20467

SEQ ID NO: 101761 - DNA, 201 bp, Bos taurus
tgctggccattacaggtactgtaactgaaccatttcaaaacttgctacacagtgtgagcaagaatattatctaagaaaccagactactggacttctatcagttaaccctattagtcaacgctctgatgatgaagatcttaatctcacattgcatcactttttagtctccaggggctaaagaataaaaagatacagattcag

SEQ ID NO: 101762 - DNA, 201 bp, Bos taurus
ctgtatctttgtggtatttgttactacatgacatctgtagacttctaccagaggatagaaatcttgtctatggttcactgctgaaggtcttaactttgaacaccatcaggcacataaaaggtgctcaataaatgtgtgctgaaagactccctctcaactttgagatgatttaaggtaacaagtggaaagtacaaagtttta

SEQ ID NO: 101763 - DNA, 201 bp, Bos taurus; identical to SEQ ID NO: 20468

SEQ ID NO: 101764 - DNA, 201 bp, Bos taurus
cctgcctcttgggtccctggaaactagaatgggaaggaaagagacatggtaatcggatcttccagaaagcaggtggaaaatggccccaagctttggaaataatactcttacaagagaggaaataccatgtacacatatgtgtcctaggtaaacaggaaattctctctcaggtggcagagggtggggccagctttggtctct

SEQ ID NO: 101765 - DNA, 201 bp, Bos taurus; identical to SEQ ID NO: 20469

SEQ ID NO: 101766 - DNA, 201 bp, Bos taurus; identical to SEQ ID NO: 20471

SEQ ID NO: 101767 - DNA, 201 bp, Bos taurus; identical to SEQ ID NO: 20472

SEQ ID NO: 101768 - DNA, 201 bp, Bos taurus; identical to SEQ ID NO: 20473

SEQ ID NO: 101769 - DNA, 201 bp, Bos taurus; identical to SEQ ID NO: 20475

SEQ ID NO: 101770 - DNA, 201 bp, Bos taurus
gggaatcccacaatgtttttctaggtcttaaatcaaaagagcagtggctgtaatcattccaaggtaatgggggaggtatctgcgtgttccgtctggctacctataataccctatgggttgagactttcctggtggtacaatgaataagaatcggtctgccaaagcaggggacaggggtttgatctccagtctgggaagatt

SEQ ID NO: 101771 - DNA, 201 bp, Bos taurus; identical to SEQ ID NO: 20479

SEQ ID NO: 101772 - DNA, 201 bp, Bos taurus
ggcatatcatttttctaagaaatgatttagaagaaagggaaagtggattgagtgtaaaatagctctgttcaaaaggcctctgttatgtttgtttgtttttctttaaaatgtattcatttatttttgactgtggtgggtctttgttgctcacgtgggccgtctgtagtcgtgacgagcaggggctactcggtgtttcttctc

SEQ ID NO: 101773 - DNA, 201 bp, Bos taurus; identical to SEQ ID NO: 20480

SEQ ID NO: 101774 - DNA, 201 bp, Bos taurus; identical to SEQ ID NO: 20481

SEQ ID NO: 101775 - DNA, 201 bp, Bos taurus; identical to SEQ ID NO: 20484

SEQ ID NO: 101776 - DNA, 201 bp, Bos taurus
gaaatgggggtgacaaactcttctgaggttgaagggccacatgctctaggactcagttagtcccacaatcttacctgtgcctccctgctccttgcccccagcacgggggcaacactggccccttttaagtccttcagcatgcccagcttcctccagccttaggaactgcataaatgctataccttcagcaccacatcacat

SEQ ID NO: 101777 - DNA, 201 bp, Bos taurus; identical to SEQ ID NO: 20486

SEQ ID NO: 101778 - DNA, 201 bp, Bos taurus
aattatccctattaagacaactattattattaacatcttccattacagataaaacaggctcaaaaagaatgaatgaatttatttacaagaggtgaagccaaactgggacctaactcatttctccaaaatttctgctctcatcacaaataaataaaatgtaataaaatatggacttcccatgtaagtggtaaagaatccgcc

SEQ ID NO: 101779 - DNA, 201 bp, Bos taurus; identical to SEQ ID NO: 20488

SEQ ID NO: 101780 - DNA, 201 bp, Bos taurus; identical to SEQ ID NO: 20489

SEQ ID NO: 101781 - DNA, 201 bp, Bos taurus; identical to SEQ ID NO: 20490

SEQ ID NO: 101782 - DNA, 201 bp, Bos taurus; identical to SEQ ID NO: 20493

SEQ ID NO: 101783 - DNA, 201 bp, Bos taurus; identical to SEQ ID NO: 20495

SEQ ID NO: 101784 - DNA, 201 bp, Bos taurus
aaccattctgatagggagaagatgctgagggcccagcacattaattcctttatcgccacaaacaaattcattcctacatgaatcaaggccttcattttttcagcagggatagtgacattgtccgtgttttcttcactgtccaccaaggagagagagaattatcacagcaggccctgttgatttagaaaataccttggctga

SEQ ID NO: 101785 - DNA, 201 bp, Bos taurus; identical to SEQ ID NO: 20496

SEQ ID NO: 101786 - DNA, 201 bp, Bos taurus; identical to SEQ ID NO: 20497

SEQ ID NO: 101787 - DNA, 201 bp, Bos taurus; identical to SEQ ID NO: 20498

SEQ ID NO: 101788 - DNA, 201 bp, Bos taurus; identical to SEQ ID NO: 20499

SEQ ID NO: 101789 - DNA, 201 bp, Bos taurus; identical to SEQ ID NO: 20500

SEQ ID NO: 101790 - DNA, 201 bp, Bos taurus; identical to SEQ ID NO: 20501

SEQ ID NO: 101791 - DNA, 201 bp, Bos taurus; identical to SEQ ID NO: 20502

SEQ ID NO: 101792 - DNA, 201 bp, Bos taurus; identical to SEQ ID NO: 20503

SEQ ID NO: 101793 - DNA, 201 bp, Bos taurus; identical to SEQ ID NO: 20505

SEQ ID NO: 101794 - DNA, 201 bp, Bos taurus; identical to SEQ ID NO: 20509

SEQ ID NO: 101795 - DNA, 201 bp, Bos taurus
cttcttctgcaaccacagtgaaagtctaaaagcattttgttcatgaacacttaagtttccaaactttctttggctttccattgtccctaggaaaaatctagtgttttatgtggcttaaaaggctcaggtatctgctgacttctgcagcttcatctctctacattctgctttctgcatttttcttcttattcttctaaggct

SEQ ID NO: 101796 - DNA, 201 bp, Bos taurus
catttataatccacctccttccaaaaaaaatgtcttgagttaatcaatgccttagtcaagagcaccaatgtctgtgcacatcattgtccaaattccctacataaaagtggttaatgcccctgagcaatttcagacagattttagtagaataactactctaatttttattgttattagaaactgctgacctaagattcagac

SEQ ID NO: 101797 - DNA, 201 bp, Bos taurus
aggacagagatgatagatagacacatacatagattcctttccccttttatagcacaactgtatttggatttactagttctatataatttttctgggcttcaaaatcactgcagatggtgactgcagccatgaaattaaaagacgcttactccttggaaggaaagttatgaccaacctagatagcatattcaaaagcagaaa

SEQ ID NO: 101798 - DNA, 201 bp, Bos taurus
tcagctcaatgttattcatgtctttggagtataagcatcaggagattgggagctctaaagaaaaactgattgtaatatagattcaggtcatgaaaaaaataccctctatacatgggatggcacaagcatgcttatatccccagactgatatttttattatagattgcctgttggggtactaggcataggtgaggatatatt

SEQ ID NO: 101799 - DNA, 201 bp, Bos taurus; identical to SEQ ID NO: 20511

SEQ ID NO: 101800 - DNA, 201 bp, Bos taurus; identical to SEQ ID NO: 20515

SEQ ID NO: 101801 - DNA, 201 bp, Bos taurus
atgcttgtgacaagcatatacagtgtctggaagaatagagttttttcccctctttaaaaaaatccatgaggataggaaattctggcataagtaatataagacttatatgacaattcatcagcagtataatgatctctactttttctgtacatcaactttggcacttagaattcttctgtctgaatccaagagaaagaaaga

SEQ ID NO: 101802 - DNA, 201 bp, Bos taurus
catctcttcctaagtaaaataaattgaacttttcagggattctcagctaagcagtcaaagagatctcaagaatggccttgagtatcattgaaatagacacgttgacctttcaatgactctaggcaagatctttggtcctggcccattgccataaataatttggtgaaggaaaggaaatgcttggttttaaactattcacaa

SEQ ID NO: 101803 - DNA, 201 bp, Bos taurus; identical to SEQ ID NO: 20516

SEQ ID NO: 101804 - DNA, 201 bp, Bos taurus; identical to SEQ ID NO: 20517

SEQ ID NO: 101805 - DNA, 201 bp, Bos taurus; identical to SEQ ID NO: 20518

SEQ ID NO: 101806 - DNA, 201 bp, Bos taurus; identical to SEQ ID NO: 20519

SEQ ID NO: 101807 - DNA, 201 bp, Bos taurus; identical to SEQ ID NO: 20520

SEQ ID NO: 101808 - DNA, 201 bp, Bos taurus; identical to SEQ ID NO: 20522

SEQ ID NO: 101809 - DNA, 201 bp, Bos taurus; identical to SEQ ID NO: 20523

SEQ ID NO: 101810 - DNA, 201 bp, Bos taurus
tatggttggcaggaaaatactggtaacaagaataacagtatttctctcccatcaataagcttctgaagcatatcatctccagaaaaaccttttctgcagagcctggaaaaatgtcattccccattctcaatggaaaaatcccacttgctactgaaactatagagaaatgcattatttaagaatgctaaatatttgcacaat

SEQ ID NO: 101811 - DNA, 201 bp, Bos taurus
gtaggccagttcctaaccactgaaccaccacggaagtccataccttgttttttaaccaaatccacagaatgtcactataaaaataaatgacatagtcttttggaatgtgtttttaataagatatgcaggttaaaatccagaatcagtttacatctttgaatgtatatttgctgccatatcatccagttgttttgttttttt

SEQ ID NO: 101812 - DNA, 201 bp, Bos taurus
gcttgcatcattcattaggggatacgcatgtggacaggaagatgcaaaatgttaagataaatcaagggaggcaaatgagagagctagacagaacactttcgtatataaactgaactaaattgaaatgtcgagagaaggcaaaagaaggggaggcagagagaaatttgggaccagggtgagtttagagggtatagttaactc

SEQ ID NO: 101813 - DNA, 201 bp, Bos taurus; identical to SEQ ID NO: 20525

SEQ ID NO: 101814 - DNA, 201 bp, Bos taurus; identical to SEQ ID NO: 20526

SEQ ID NO: 101815 - DNA, 201 bp, Bos taurus
gaacccacttttgttgttgcttctgtggtgcgacaccatcatggccaccaatctgggtcaaggtcccaacccagtcactttggggtcctaggggttcccagacagtcctcaagcacatgctttgggccaacaggccaattgttcagcacccacacctcccaaccatcatgcgtttgaatgtgcacacactaccacctagca

SEQ ID NO: 101816 - DNA, 201 bp, Bos taurus
aaaatatatataaattttcaattttcagatgactgtaactgacttttacacttattcatcatgcagacaatatcactggataagcccaagatatgaaggcgtgcaagactctgcagaaacttaacatagtaccttggaagttattttataaaatcattcaaagcagttgttttcatgcattagccttttactcataaaaga

SEQ ID NO: 101817 - DNA, 201 bp, Bos taurus; identical to SEQ ID NO: 20527

SEQ ID NO: 101818 - DNA, 201 bp, Bos taurus
ggaaatgggctgaatgatgtggctgcttttcgaagtctcgggccaagcctgttgcttcacatctttgtgaagcaaagcttcactgaaaggagctgtctgcagatgaccttgttgagtggccactagatggcaacgtacagttcagacagggtgactcagcgaggcgtggatccctggtgggggttagtccacgggctctat

SEQ ID NO: 101819 - DNA, 201 bp, Bos taurus; identical to SEQ ID NO: 20528

SEQ ID NO: 101820 - DNA, 201 bp, Bos taurus; identical to SEQ ID NO: 20529

SEQ ID NO: 101821 - DNA, 201 bp, Bos taurus; identical to SEQ ID NO: 20530

SEQ ID NO: 101822 - DNA, 201 bp, Bos taurus
ctttcttccctttctttctttcatcagtatttattaacttttctacttctgaaataacttagaaagtcatttaaaataggttgatttgtgttcatccttatgtaaaatagaaaatttgctaattaatatgaaacataaggggaagattttagagcattttatttcaggcagttaagtttatattttttaaagacactatgg

SEQ ID NO: 101823 - DNA, 201 bp, Bos taurus
aggttctggcctaatgggatcacctgaggaacaacttcccaagactcaatcactttgatagcaagttataaaaaattctaaagggaaataactcctggacgctgatttctgaacactggccggctaacaaactccagctcactcaccatgaaagggaaggaagagtcccagcataaacactgccctggcaagagcttcagt

SEQ ID NO: 101824 - DNA, 201 bp, Bos taurus; identical to SEQ ID NO: 20531

SEQ ID NO: 101825 - DNA, 201 bp, Bos taurus; identical to SEQ ID NO: 20532

SEQ ID NO: 101826 - DNA, 201 bp, Bos taurus
cttagttttctgaatgttaagctttaagcttatcattattaaaagtaactttggaggaggcataattttaatatttaagaaaaagaaaaaagagtatttcctatatgtgtcagtactgttaagcactttcatttctttaacaaattaaaaaagctcaaataaagctatcttaaataataaaggaaatgaattcatataatt

SEQ ID NO: 101827 - DNA, 201 bp, Bos taurus
gatgtgaaggcctaacataaaccaatggctgtgagacagccatcagcacagaggattcaaaggctgacgcttccttggaaatttccaaatgtgagacaactgaggcccactttcagtaatgaaaggggagaactgttctctcaagccaattatagaacacatgataatggtaaaaatgttccttttcaccttgttaaactg

SEQ ID NO: 101828 - DNA, 201 bp, Bos taurus; identical to SEQ ID NO: 20534

SEQ ID NO: 101829 - DNA, 201 bp, Bos taurus; identical to SEQ ID NO: 20535

SEQ ID NO: 101830 - DNA, 201 bp, Bos taurus; identical to SEQ ID NO: 20536

SEQ ID NO: 101831 - DNA, 201 bp, Bos taurus; identical to SEQ ID NO: 20537

SEQ ID NO: 101832 - DNA, 201 bp, Bos taurus; identical to SEQ ID NO: 20538

SEQ ID NO: 101833 - DNA, 201 bp, Bos taurus; identical to SEQ ID NO: 20539

SEQ ID NO: 101834 - DNA, 201 bp, Bos taurus
atagagtatgccaactcacaactcagtgaagttagtaggtttttttttagattttagttgaagtggtgaagagatattgtattgatttatgcttgctacatctttacacattcaaagataatcatttatgcttcctctaaatcttctttttgcctgggcaatgacttctttaatagactttttatattttttattatgtaa

SEQ ID NO: 101835 - DNA, 201 bp, Bos taurus
ctgatagtattttgaaatacccaaagggaagtcattgtatacagcaatccctactgaagaattcctagtaaaactaatggcagtgatggaatttactctttctctacttcgaatgttcactaactggaaaagtttaaaatgtggacgagtactataaaggtcaaacaatgttacttatgacaaaacaaaagattccttctg

SEQ ID NO: 101836 - DNA, 201 bp, Bos taurus
aggccttgttactttgaaatgtgtaccttaagaggcgtgactcaatccaacagtgttggaggtgactcatcacacagaccgagctccaaaaaaaacacattggccaccaatctccacacatcatcccacgatgcctgttcctttattttattttattttttattttaattcaggagctaatcccaaacagcttcctctctt

SEQ ID NO: 101837 - DNA, 201 bp, Bos taurus
agcaaaatactccgtaggtctgtagattatctgtaaaccaactgacaggtatccaatgcagaccacgcggagacgtttcttcgcccctatcgctgccctcggatgatgctgtgaaaagtaaaagttcatcaggtgctgaccgggttcatgatagacctgcactgtgaattcctgaaagaccaattgcaatttatcattcct

SEQ ID NO: 101838 - DNA, 201 bp, Bos taurus; identical to SEQ ID NO: 20540

SEQ ID NO: 101839 - DNA, 201 bp, Bos taurus; identical to SEQ ID NO: 20541

SEQ ID NO: 101840 - DNA, 201 bp, Bos taurus; identical to SEQ ID NO: 20542

SEQ ID NO: 101841 - DNA, 201 bp, Bos taurus; identical to SEQ ID NO: 20543

SEQ ID NO: 101842 - DNA, 201 bp, Bos taurus; identical to SEQ ID NO: 20544

SEQ ID NO: 101843 - DNA, 201 bp, Bos taurus; identical to SEQ ID NO: 20545

SEQ ID NO: 101844 - DNA, 201 bp, Bos taurus; identical to SEQ ID NO: 20546

SEQ ID NO: 101845 - DNA, 201 bp, Bos taurus; identical to SEQ ID NO: 20547

SEQ ID NO: 101846 - DNA, 201 bp, Bos taurus
gactggctctttcccaagcaactttaactcaaaatgatcagggtacccacatggcatattttagggtggcatattctgcttgccttcagtcttatgttccggtctctccccttctctgacctccacttctgtcatcacacctcttcctatgaccctttaaaggtacttgtgtttgcattgggcccacctggaaaatccgtc

SEQ ID NO: 101847 - DNA, 201 bp, Bos taurus; identical to SEQ ID NO: 20548

SEQ ID NO: 101848 - DNA, 201 bp, Bos taurus; identical to SEQ ID NO: 20549

SEQ ID NO: 101849 - DNA, 201 bp, Bos taurus; identical to SEQ ID NO: 20550

SEQ ID NO: 101850 - DNA, 201 bp, Bos taurus; identical to SEQ ID NO: 20551

SEQ ID NO: 101851 - DNA, 201 bp, Bos taurus
aatctaattccaatcttcatttccaaatgctttcctcaggactcctctgtaagaatcctatgatttagccaggagggtttccttgtcatttcttaaacatactatttccttcctccaagcctttggtggtgcgttctctttcgtgtccaactctttgtgaccccacagactgtaaccctccagactcctctgtccatggaa

SEQ ID NO: 101852 - DNA, 201 bp, Bos taurus; identical to SEQ ID NO: 20552

SEQ ID NO: 101853 - DNA, 201 bp, Bos taurus; identical to SEQ ID NO: 20553

SEQ ID NO: 101854 - DNA, 201 bp, Bos taurus; identical to SEQ ID NO: 20554

SEQ ID NO: 101855 - DNA, 201 bp, Bos taurus
tcccttcccaaggagataccaatctaaatatctctggaggcttgttgtctttctttttagcttagaagagagctggctctgtagccctgagtcactcatcagaagaacagggctgtgctctggagtctccctatcatttctggaagcaagaactccctgcagttagctattccctctgtgtaagtaagggcttccttgata

SEQ ID NO: 101856 - DNA, 201 bp, Bos taurus; identical to SEQ ID NO: 20555

SEQ ID NO: 101857 - DNA, 201 bp, Bos taurus; identical to SEQ ID NO: 20557

SEQ ID NO: 101858 - DNA, 201 bp, Bos taurus; identical to SEQ ID NO: 20560

SEQ ID NO: 101859 - DNA, 201 bp, Bos taurus; identical to SEQ ID NO: 20562

SEQ ID NO: 101860 - DNA, 201 bp, Bos taurus; identical to SEQ ID NO: 20564

SEQ ID NO: 101861 - DNA, 201 bp, Bos taurus
ctgagcatcagctctgttctgtgagtttacccagggactcagggtccttctatgcttcaccatcccctagggtgttttgttcatccatagcataacaggtctgtagggtcatatccacatacagcccattagaataggtgaagagcagggaaaacaaatacccaactattttaaagacaaaagtcagaagttgtatatgct

SEQ ID NO: 101862 - DNA, 201 bp, Bos taurus; identical to SEQ ID NO: 20569

SEQ ID NO: 101863 - DNA, 201 bp, Bos taurus; identical to SEQ ID NO: 20570

SEQ ID NO: 101864 - DNA, 201 bp, Bos taurus; identical to SEQ ID NO: 20571

SEQ ID NO: 101865 - DNA, 201 bp, Bos taurus; identical to SEQ ID NO: 20572

SEQ ID NO: 101866 - DNA, 201 bp, Bos taurus; identical to SEQ ID NO: 20574

SEQ ID NO: 101867 - DNA, 201 bp, Bos taurus; identical to SEQ ID NO: 20575

SEQ ID NO: 101868 - DNA, 201 bp, Bos taurus; identical to SEQ ID NO: 20576

SEQ ID NO: 101869 - DNA, 201 bp, Bos taurus; identical to SEQ ID NO: 20577

SEQ ID NO: 101870 - DNA, 201 bp, Bos taurus; identical to SEQ ID NO: 20578

SEQ ID NO: 101871 - DNA, 201 bp, Bos taurus; identical to SEQ ID NO: 20579

SEQ ID NO: 101872 - DNA, 201 bp, Bos taurus; identical to SEQ ID NO: 20580

SEQ ID NO: 101873 - DNA, 201 bp, Bos taurus
gattttaagaagatgcaaatgttcagactatggcagccattaaaagttaacacctgaactttctaatatgaatattttaagagagtcagaatttctaagccaaatctgtgaaatctgaaagatatttaacagattttcatcaaaggataactccatatgggatattgttataaggaaataatttagaacataaatttaact

SEQ ID NO: 101874 - DNA, 201 bp, Bos taurus; identical to SEQ ID NO: 20581

SEQ ID NO: 101875 - DNA, 201 bp, Bos taurus; identical to SEQ ID NO: 20582

SEQ ID NO: 101876 - DNA, 201 bp, Bos taurus; identical to SEQ ID NO: 20583

SEQ ID NO: 101877 - DNA, 201 bp, Bos taurus; identical to SEQ ID NO: 20585

SEQ ID NO: 101878 - DNA, 201 bp, Bos taurus
tggccaaaacgtttggatttttccctaaggtgttatggaaaaatccaaacaaacttttgccaacccaataataacatcctcagggtcttcctcatgctttgcccagtagacaccaccatttctgccctcatcactaacacaagataatgagattctgagagcttcaccctcagtggagatggagaggggcaaacataacat

SEQ ID NO: 101879 - DNA, 201 bp, Bos taurus; identical to SEQ ID NO: 20586

SEQ ID NO: 101880 - DNA, 201 bp, Bos taurus; identical to SEQ ID NO: 20587

SEQ ID NO: 101881 - DNA, 201 bp, Bos taurus; identical to SEQ ID NO: 20588

SEQ ID NO: 101882 - DNA, 201 bp, Bos taurus; identical to SEQ ID NO: 20589

SEQ ID NO: 101883 - DNA, 201 bp, Bos taurus; identical to SEQ ID NO: 20590

SEQ ID NO: 101884 - DNA, 201 bp, Bos taurus; identical to SEQ ID NO: 20591

SEQ ID NO: 101885 - DNA, 201 bp, Bos taurus; identical to SEQ ID NO: 20592

SEQ ID NO: 101886 - DNA, 201 bp, Bos taurus; identical to SEQ ID NO: 20593

SEQ ID NO: 101887 - DNA, 201 bp, Bos taurus
gagatattaaactaaggtgttttctgtaaagtcaaattttcttacttgtattttttccagatggcattctgaaggccatcatttttcagctgtttgtgaagcaaatgctaggccatctttttgggaattacttctccagaatcattaaacccatgttgagggtagcaatgtgagaattccacaagaagtttaagccctaag

SEQ ID NO: 101888 - DNA, 201 bp, Bos taurus
tattacactaatactgggaggagaaaacttgcctgtatacttggaaagagggagaagtggcttggtaacaatatacatagatgcaaggtagtggaacagaaacctggaagggcaatctggaaagttagaggcaagtacatctaaagaagtctaatgtagatttaggagtatatgaggatgagcaccggagaaggcaatgga

SEQ ID NO: 101889 - DNA, 201 bp, Bos taurus; identical to SEQ ID NO: 20594

SEQ ID NO: 101890 - DNA, 201 bp, Bos taurus; identical to SEQ ID NO: 20595

SEQ ID NO: 101891 - DNA, 201 bp, Bos taurus
ttatgagattagtattttagccagatattcgttttcctacgtgtactgaatgtgtcattagcacatcatctaatgaaatcatctgctgacagagaccactggagctgtttgccatttctgctgactctgtgttcccagttgatttggctaaagagcagttctagggtggcagcaggacatttctgaggcagtttacagcat

SEQ ID NO: 101892 - DNA, 201 bp, Bos taurus; identical to SEQ ID NO: 20596

SEQ ID NO: 101893 - DNA, 201 bp, Bos taurus
aatgacagaatttaataaattgtatcagaaagagaaacagaattatggcacttaaatcatgcctcacatttgaagaaacacagtctttcactttaacatcctaggaattgatacactacttaaatgcattttgtgcagacagactttttggtttacatatctttgttttcaggtgtagaaactaaagatagttattaaaaa

SEQ ID NO: 101894 - DNA, 201 bp, Bos taurus
aaaatactttcttacagagacaccaggattagggccccactattatgacctaatttgcctcatttatctttttaaaggccctttctctaaacacagtttcgttcaattgctcagtcatgtcagactctttgtgaccccatgaatcgcagcacgccaggcctccctgtccatcaccaactcccggaatttactcaaactcat

SEQ ID NO: 101895 - DNA, 201 bp, Bos taurus; identical to SEQ ID NO: 20598

SEQ ID NO: 101896 - DNA, 201 bp, Bos taurus; identical to SEQ ID NO: 20599

SEQ ID NO: 101897 - DNA, 201 bp, Bos taurus; identical to SEQ ID NO: 20601

SEQ ID NO: 101898 - DNA, 201 bp, Bos taurus
aagaatatactatggggcaaagatagcctcttgaatacatggtgctgggaaaactggacagctacatgcaaacgaatgaaaaattagaaaactacctgacgccatacacaaagataaactcaaaatggcttaaagacctaaatttaagaccagaaactgtaaaactcttagaggaaaacataggtaaaacactcgatgaca

SEQ ID NO: 101899 - DNA, 201 bp, Bos taurus; identical to SEQ ID NO: 20602

SEQ ID NO: 101900 - DNA, 201 bp, Bos taurus
accgtccaatcttctgaatgatttttcctggaggcacaatttaattaaaatacactcaatttgtgggtcaaaatggtattctcagtggttatcttataaccttaagctatgtttcccaaacagtactataaagcacttaaattattatcttaaaaatgtctttgatgtggggatgtcataaatgctgcagacatataaaaa

SEQ ID NO: 101901 - DNA, 201 bp, Bos taurus; identical to SEQ ID NO: 20603

SEQ ID NO: 101902 - DNA, 201 bp, Bos taurus; identical to SEQ ID NO: 20604

SEQ ID NO: 101903 - DNA, 201 bp, Bos taurus; identical to SEQ ID NO: 20605

SEQ ID NO: 101904 - DNA, 201 bp, Bos taurus; identical to SEQ ID NO: 20606

SEQ ID NO: 101905 - DNA, 201 bp, Bos taurus
cttcagttttcctcctccagtggtttgtggtgaggcataattctacgttattaaaactcacactatgtacttattattaccttcatttttgaaatatttacatttctaagagtttttaagaatagataagagaaaagcaaaggggaaaggaaagatatacccatttgaatgcagacttccaaagaatagcaaggagagata

SEQ ID NO: 101906 - DNA, 201 bp, Bos taurus
ggtttgagttcgggttccatccctgtcaccgaactaaaaccccataattcatgtaccacagtccaaagaaaaaaatggctaggaaatcgtttgtttataaagtgtttgatgtggtctttttgatgctttgcagttataatttgttgtgctcttgatctatgagttgcagatttcctaacatttggacattatttgttcact

SEQ ID NO: 101907 - DNA, 201 bp, Bos taurus; identical to SEQ ID NO: 20607

SEQ ID NO: 101908 - DNA, 201 bp, Bos taurus; identical to SEQ ID NO: 20608

SEQ ID NO: 101909 - DNA, 201 bp, Bos taurus; identical to SEQ ID NO: 20609

SEQ ID NO: 101910 - DNA, 201 bp, Bos taurus; identical to SEQ ID NO: 20610

SEQ ID NO: 101911 - DNA, 201 bp, Bos taurus
ggaaggatttaacttctaggttgttttattttttcctgcacttttgtccaatctgaaaaattaagtctttgtattttggagaaggaaattatgaatgcctgaaagtgtatttaaatcaaaaatttgctttagtttttcttaaaacaccacctttagcagagcaaagaattttgatagctaagtatataaggataaaagaag

SEQ ID NO: 101912 - DNA, 201 bp, Bos taurus; identical to SEQ ID NO: 20611

SEQ ID NO: 101913 - DNA, 201 bp, Bos taurus; identical to SEQ ID NO: 20612

SEQ ID NO: 101914 - DNA, 201 bp, Bos taurus; identical to SEQ ID NO: 20613

SEQ ID NO: 101915 - DNA, 201 bp, Bos taurus
tgtctactgtgaccactcacactaatattgatccctgcaagtctttgagaattaatgaatacttccactgcccacacctcactgggttcagacccaccttgccttacagcttctgagccccttcctgagtttgacccacttctacatcttctcctcatcctggcccctagccttgtctcagctatccttgtgatcttctgg

SEQ ID NO: 101916 - DNA, 201 bp, Bos taurus
agttattagaccttgcagattttgtattagctgaagagaatgctagcctttgaggtgagatagatataagctcagtttagaataaagctatagtcacacattacttaatggcctttatctgaataccaaaaagttggggggaagacttccacatttctagttcatttttaaaaatctatttttaattagaggataattacc

SEQ ID NO: 101917 - DNA, 201 bp, Bos taurus; identical to SEQ ID NO: 20614

SEQ ID NO: 101918 - DNA, 201 bp, Bos taurus; identical to SEQ ID NO: 20615

SEQ ID NO: 101919 - DNA, 201 bp, Bos taurus; identical to SEQ ID NO: 20616

SEQ ID NO: 101920 - DNA, 201 bp, Bos taurus; identical to SEQ ID NO: 20617

SEQ ID NO: 101921 - DNA, 201 bp, Bos taurus; identical to SEQ ID NO: 20618

SEQ ID NO: 101922 - DNA, 201 bp, Bos taurus; identical to SEQ ID NO: 20619

SEQ ID NO: 101923 - DNA, 201 bp, Bos taurus
agagtagagaggatgaggacaaaacacaaataacaacgaatgacaagcccaaacccaatctactacctttctaaaggacaactactctactccacgggacccaacaaacagttccaggtcacttacaatagtaccaaaggcatggaagataatcaggatgtaaaactatccaggcaaccttgcaatctcatctctctggtt

SEQ ID NO: 101924 - DNA, 201 bp, Bos taurus; identical to SEQ ID NO: 20620

SEQ ID NO: 101925 - DNA, 201 bp, Bos taurus
ggacacagctgagtgacttccacacatacaatgaagcatcaaacaaatctcctttgaggatgtcttctatccaagatcactcaggaaaataaaactccttgcttctgaaatgttagtgacttgacatccaaatctgagaaagaaggagaaaatgaatgttttcttcttattcctctctatttttttctctttatcttcttt

SEQ ID NO: 101926 - DNA, 201 bp, Bos taurus
gttctttctgctaaatacctgaataattaaagatcagatgacatttaaaatcaaaggaggtggaaagctttgagggctgtgccatccaggccatgatgagatttctcagagaccatctccttgtgaccaacctcagttgagttcagtctctcagtcgtgtccaactctttgcgacccattgaactgcaggcctccctgtcc

SEQ ID NO: 101927 - DNA, 201 bp, Bos taurus; identical to SEQ ID NO: 20623

SEQ ID NO: 101928 - DNA, 201 bp, Bos taurus; identical to SEQ ID NO: 20624

SEQ ID NO: 101929 - DNA, 201 bp, Bos taurus
tcagatgtatagcaaccaaaatttgctatgtatgtaattccattgggtgaatgtgaaggccatgatagataattcagaaatcaaacaatcttgggccctcagaggtaggatttttatgatagatttgaatggattcttttgttattctagtgtatttgcttttttatttttttattttttatttttttgcaaattcttaaa

SEQ ID NO: 101930 - DNA, 201 bp, Bos taurus; identical to SEQ ID NO: 20625

SEQ ID NO: 101931 - DNA, 201 bp, Bos taurus; identical to SEQ ID NO: 20626

SEQ ID NO: 101932 - DNA, 201 bp, Bos taurus; identical to SEQ ID NO: 20629

SEQ ID NO: 101933 - DNA, 201 bp, Bos taurus
tgtcaagatgcatgtaacatatcctttattagccaagtaaatatttgctttactaagtccttcctctgttcattctcagtgctcatgaaactgtaatttacagcccttagggtatctgctataccatcaaatatatttcattatatttaatagcaccctcccagcgatggcaaatactgcttcaaagcagtgagaatcaga

SEQ ID NO: 101934 - DNA, 201 bp, Bos taurus; identical to SEQ ID NO: 20633

SEQ ID NO: 101935 - DNA, 201 bp, Bos taurus; identical to SEQ ID NO: 20634

SEQ ID NO: 101936 - DNA, 201 bp, Bos taurus
tcaccagcagaattgaaacttaggaggctaactggacctgtctttaaaaggcagaccctgagccctgtttagggcttgtgaaattagaaattaagaatatgacagcacaaaaaattaaaggctagagaggtgagcatggttagccatctgtccaacaggatgttgctcactgaggagcaattctcatttgttaaatcacta

SEQ ID NO: 101937 - DNA, 201 bp, Bos taurus
ggagagacgtcgtgtttgaaagtgttgatgagggataagatttcatctttgtaaccccagagcagttcatccacagtgtgggtcacaaagagcttctgcctgtaggccttcagcagggcctcgatgatatcccgaagtaagggcagctgggtccattccatggcggtctgaggagcacaggcaaattcagagagctgtgtc

SEQ ID NO: 101938 - DNA, 201 bp, Bos taurus; identical to SEQ ID NO: 20639

SEQ ID NO: 101939 - DNA, 201 bp, Bos taurus; identical to SEQ ID NO: 20640

SEQ ID NO: 101940 - DNA, 201 bp, Bos taurus; identical to SEQ ID NO: 20641

SEQ ID NO: 101941 - DNA, 201 bp, Bos taurus; identical to SEQ ID NO: 20643

SEQ ID NO: 101942 - DNA, 201 bp, Bos taurus; identical to SEQ ID NO: 20644

SEQ ID NO: 101943 - DNA, 201 bp, Bos taurus
cctcacctctcaagatgtaattattgaagacatttaagggccatttgattgattttcagcaaccaatgttagtatctgaactgatttctgttatcattaccatgtagttttattaatctggccctggattttacatgattaaaattttttttttacccgcagttcatagagcactctatatggaaaaagagaagacccttt

SEQ ID NO: 101944 - DNA, 201 bp, Bos taurus; identical to SEQ ID NO: 20645

SEQ ID NO: 101945 - DNA, 201 bp, Bos taurus; identical to SEQ ID NO: 20646

SEQ ID NO: 101946 - DNA, 201 bp, Bos taurus; identical to SEQ ID NO: 20650

SEQ ID NO: 101947 - DNA, 201 bp, Bos taurus; identical to SEQ ID NO: 20651

SEQ ID NO: 101948 - DNA, 201 bp, Bos taurus; identical to SEQ ID NO: 20653

SEQ ID NO: 101949 - DNA, 201 bp, Bos taurus; identical to SEQ ID NO: 20655

SEQ ID NO: 101950 - DNA, 201 bp, Bos taurus; identical to SEQ ID NO: 20658

SEQ ID NO: 101951 - DNA, 201 bp, Bos taurus; identical to SEQ ID NO: 20660

SEQ ID NO: 101952 - DNA, 201 bp, Bos taurus; identical to SEQ ID NO: 20661

SEQ ID NO: 101953 - DNA, 201 bp, Bos taurus; identical to SEQ ID NO: 20662

SEQ ID NO: 101954 - DNA, 201 bp, Bos taurus
caccaaccacaaactttaaaaagaacatgtctttaaaataatgtgttgggcccataactctctcatctgtgacaagatgtcacagaatgtcccagtgcagcgttcttcctgattagctgtcttgtcataagagaagtctgtcaggactgatcttggccaaagcagaggaagggccaacaggtctgcgtaacctgactccct

SEQ ID NO: 101955 - DNA, 201 bp, Bos taurus; identical to SEQ ID NO: 20664

SEQ ID NO: 101956 - DNA, 201 bp, Bos taurus; identical to SEQ ID NO: 20666

SEQ ID NO: 101957 - DNA, 201 bp, Bos taurus; identical to SEQ ID NO: 20669

SEQ ID NO: 101958 - DNA, 201 bp, Bos taurus; identical to SEQ ID NO: 20670

SEQ ID NO: 101959 - DNA, 201 bp, Bos taurus; identical to SEQ ID NO: 20671

SEQ ID NO: 101960 - DNA, 201 bp, Bos taurus; identical to SEQ ID NO: 20673

SEQ ID NO: 101961 - DNA, 201 bp, Bos taurus
cattttccctcgatttcctcagaaacttagttctcagtggagatgtgggattctgtaatacgccctgttcaacagctcagttcagatatataacaaacacgtgataaacagaatagattgtgccagtactggggctacaagatgaatacgattggtcttttgcctccagaggtatgtccaacacaggggggatgtcaataa

SEQ ID NO: 101962 - DNA, 201 bp, Bos taurus; identical to SEQ ID NO: 20674

SEQ ID NO: 101963 - DNA, 201 bp, Bos taurus; identical to SEQ ID NO: 20675

SEQ ID NO: 101964 - DNA, 201 bp, Bos taurus; identical to SEQ ID NO: 20676

SEQ ID NO: 101965 - DNA, 201 bp, Bos taurus; identical to SEQ ID NO: 20677

SEQ ID NO: 101966 - DNA, 201 bp, Bos taurus; identical to SEQ ID NO: 20683

SEQ ID NO: 101967 - DNA, 201 bp, Bos taurus; identical to SEQ ID NO: 20684

SEQ ID NO: 101968 - DNA, 201 bp, Bos taurus; identical to SEQ ID NO: 20685

SEQ ID NO: 101969 - DNA, 201 bp, Bos taurus; identical to SEQ ID NO: 20690

SEQ ID NO: 101970 - DNA, 201 bp, Bos taurus; identical to SEQ ID NO: 20692

SEQ ID NO: 101971 - DNA, 201 bp, Bos taurus; identical to SEQ ID NO: 20694

SEQ ID NO: 101972 - DNA, 201 bp, Bos taurus; identical to SEQ ID NO: 20702

SEQ ID NO: 101973 - DNA, 201 bp, Bos taurus; identical to SEQ ID NO: 20705

SEQ ID NO: 101974 - DNA, 201 bp, Bos taurus; identical to SEQ ID NO: 20706

SEQ ID NO: 101975 - DNA, 201 bp, Bos taurus; identical to SEQ ID NO: 20709

SEQ ID NO: 101976 - DNA, 201 bp, Bos taurus; identical to SEQ ID NO: 20710

SEQ ID NO: 101977 - DNA, 201 bp, Bos taurus; identical to SEQ ID NO: 20716

SEQ ID NO: 101978 - DNA, 201 bp, Bos taurus; identical to SEQ ID NO: 20718

SEQ ID NO: 101979 - DNA, 201 bp, Bos taurus; identical to SEQ ID NO: 20719

SEQ ID NO: 101980 - DNA, 201 bp, Bos taurus; identical to SEQ ID NO: 20720

SEQ ID NO: 101981 - DNA, 201 bp, Bos taurus; identical to SEQ ID NO: 20721

SEQ ID NO: 101982 - DNA, 201 bp, Bos taurus; identical to SEQ ID NO: 20722

SEQ ID NO: 101983 - DNA, 201 bp, Bos taurus
cccaggctgctgccccaggggagacagcaggtcagggtgtgggtcccagctccgggctttgttcacacgcagttctcctgggatctcctgcaaggtcagttcatctgtccaggctgaccgtctcctcaggccgttctgtttgtgaggcgttgtcggaagaggtagacgttctccacaaaccggggggctgtggactgctgt

SEQ ID NO: 101984 - DNA, 201 bp, Bos taurus
aagggcggggtggaggctggcagtcctgggcggccctggaggagggaggggcagccttcagggacagagcagcccccaagctgagttgccattcccacccagagtcccggcctcctctgacgtgaggaggatcgacctctggttgtttcctgccgatggagctagggtgctcagcttgtgccttgcacgtcattttaggag

SEQ ID NO: 101985 - DNA, 201 bp, Bos taurus
ccacagcctcagcctgggccgtggggacaggaaggcttcgctggggtcctctctggacacacaggtttcccaactgcccggcatccttggtagctgcagagtccagggcccgctcaggggctccatctagctctgcacacagctccagagagagatgggccgccctgagttcttggaggctggctgtgcctccaccctgcc

SEQ ID NO: 101986 - DNA, 201 bp, Bos taurus
agggtggtggcgcggggcgggggggcggggagatgcccaccccaaggtccgagactcgaggcgaaccgccgtctccacctgcgcacggccgcccgcagcgtctctcctccttgggggtttaatactgcctcctccgagaagccttcggggacccgggagggctcaggcacctccctccttcccggccccagccccgggccg

SEQ ID NO: 101987 - DNA, 201 bp, Bos taurus; identical to SEQ ID NO: 20727

SEQ ID NO: 101988 - DNA, 201 bp, Bos taurus
gaactttacaccttcacccacagtccgcttcccaggtcacactctctcccgtgctgggtacactgagaattgcatactcagcctggggccacgtgccctttggaggggacccaggctccgacagggtctgaggctccctcgtctctttggaccaggtttggccgccccacctggcaggcaggcccaccaagcgctgagact

SEQ ID NO: 101989 - DNA, 201 bp, Bos taurus
cgctctgcatggtgctgaagaaagtcctcgccactgccatggtctcccattccacccaggaactcagtctcctctgaaagccgtgtggctacgggcttatgtccatggatttccctgggccaacacacacaccacgtcacctggacatggctggcctgatagaagagcagacacactcccggagctatgagggcgctgccc

SEQ ID NO: 101990 - DNA, 201 bp, Bos taurus; identical to SEQ ID NO: 20728

SEQ ID NO: 101991 - DNA, 201 bp, Bos taurus
agagagaggccttgtttaccccggaggcagggagccaccccacagggagagaaggggcagcacagagtgacaggagggcagagggcagcccgatgcccccagagctgtgggccctccgtgagccccagtcccctgctcccagaccccggatccggtccccaggccggcaggctgtgtaggtgctgaggacggcggagacag

SEQ ID NO: 101992 - DNA, 201 bp, Bos taurus
tgcacagcccagtggggccatgggacccccctcactccgcaaggagccagtcaaggaactcactgcccagggcgaccccttggtgggctctactatgactcgggggccacaggagcagggctgggggggttcctggatgcagggcccacaagcctgcctctggcagagcaaagctagtgagacagggtcctgcacgtctgg

SEQ ID NO: 101993 - DNA, 201 bp, Bos taurus; identical to SEQ ID NO: 20729

SEQ ID NO: 101994 - DNA, 201 bp, Bos taurus; identical to SEQ ID NO: 20730

SEQ ID NO: 101995 - DNA, 201 bp, Bos taurus
acgcagacgccaccggggaaggtctgcctgtcagcaaaccagcacaacttagcagagcagcatccgacttgtaagcgagcttctcctaacagtgtggctaacactaactggctctcagggatcactgacactctgtgaattcacagatcagagctctggaaccagagaggggaggaccagacccccagccacatgacaccc

SEQ ID NO: 101996 - DNA, 201 bp, Bos taurus; identical to SEQ ID NO: 20732

SEQ ID NO: 101997 - DNA, 201 bp, Bos taurus; identical to SEQ ID NO: 20733

SEQ ID NO: 101998 - DNA, 201 bp, Bos taurus
gtggacgacagtaactgccgtcagggaggcgaagcgggagtgccaggtggaggaagcactgcgcaagcgtggcagtgtgcatacaacagggccagattcgcgttgtcaaaggttcactttgcagcaatgcaaagaacagacacaggggaagttgcctcagtttctctggcacagatccctattgcagcccagaggcacagt

SEQ ID NO: 101999 - DNA, 201 bp, Bos taurus
ttttatggtatgaatctttcttttttacacaactgtgtgtcataaagtacaaacccatagcacgggaagaacaataatcaggtcaggtatttaaatacatgttttgcacattctatttcgtcctcatagcagtcctgtatgatgatcagggatgacgttgctgtccccattttacagatagagtaaccgagacttcagaag

SEQ ID NO: 102000 - DNA, 201 bp, Bos taurus
cagggtgtctcctggttcgcctccctcccctgcacctgtccacgcagggctcccggtccggtgatctggatccttctccaccactctcctacagggccccgtctggcggggctggctctttgggacacaaagaccaggtccccctgtggctggtggctcaggggagctcggcctgactccaaccctggccccagtgtacgt

SEQ ID NO: 102001 - DNA, 201 bp, Bos taurus; identical to SEQ ID NO: 20734

SEQ ID NO: 102002 - DNA, 201 bp, Bos taurus
gccagggcgtgcgcgggggccggagggcttgtctcggtggagagcaccatgaccaggggctggaaacgacagaaatctctcctctcaaaggttggagacccgagatctgaacctggcggggccacgctccctccggaggctctgggcaggggtccttcctgcattttccagcctccggtgactctaggagtcccctggcct

SEQ ID NO: 102003 - DNA, 201 bp, Bos taurus; identical to SEQ ID NO: 20735

SEQ ID NO: 102004 - DNA, 201 bp, Bos taurus; identical to SEQ ID NO: 20740

SEQ ID NO: 102005 - DNA, 201 bp, Bos taurus; identical to SEQ ID NO: 20741

SEQ ID NO: 102006 - DNA, 201 bp, Bos taurus; identical to SEQ ID NO: 20742

SEQ ID NO: 102007 - DNA, 201 bp, Bos taurus; identical to SEQ ID NO: 20743

SEQ ID NO: 102008 - DNA, 201 bp, Bos taurus; identical to SEQ ID NO: 20744

SEQ ID NO: 102009 - DNA, 201 bp, Bos taurus; identical to SEQ ID NO: 20745

SEQ ID NO: 102010 - DNA, 201 bp, Bos taurus; identical to SEQ ID NO: 20746

SEQ ID NO: 102011 - DNA, 201 bp, Bos taurus; identical to SEQ ID NO: 20751

SEQ ID NO: 102012 - DNA, 201 bp, Bos taurus; identical to SEQ ID NO: 20752

SEQ ID NO: 102013 - DNA, 201 bp, Bos taurus; identical to SEQ ID NO: 20753

SEQ ID NO: 102014 - DNA, 201 bp, Bos taurus; identical to SEQ ID NO: 20754

SEQ ID NO: 102015 - DNA, 201 bp, Bos taurus; identical to SEQ ID NO: 20756

SEQ ID NO: 102016 - DNA, 201 bp, Bos taurus; identical to SEQ ID NO: 20757

SEQ ID NO: 102017 - DNA, 201 bp, Bos taurus; identical to SEQ ID NO: 20758

SEQ ID NO: 102018 - DNA, 201 bp, Bos taurus; identical to SEQ ID NO: 20759

SEQ ID NO: 102019 - DNA, 201 bp, Bos taurus; identical to SEQ ID NO: 20760

SEQ ID NO: 102020 - DNA, 201 bp, Bos taurus; identical to SEQ ID NO: 20761

SEQ ID NO: 102021 - DNA, 201 bp, Bos taurus; identical to SEQ ID NO: 20762

SEQ ID NO: 102022 - DNA, 201 bp, Bos taurus; identical to SEQ ID NO: 20763

SEQ ID NO: 102023 - DNA, 201 bp, Bos taurus; identical to SEQ ID NO: 20764

SEQ ID NO: 102024 - DNA, 201 bp, Bos taurus; identical to SEQ ID NO: 20765

SEQ ID NO: 102025 - DNA, 201 bp, Bos taurus; identical to SEQ ID NO: 20766

SEQ ID NO: 102026 - DNA, 201 bp, Bos taurus; identical to SEQ ID NO: 20767

SEQ ID NO: 102027 - DNA, 201 bp, Bos taurus; identical to SEQ ID NO: 20768

SEQ ID NO: 102028 - DNA, 201 bp, Bos taurus; identical to SEQ ID NO: 20769

SEQ ID NO: 102029 - DNA, 201 bp, Bos taurus; identical to SEQ ID NO: 20770

SEQ ID NO: 102030 - DNA, 201 bp, Bos taurus; identical to SEQ ID NO: 20771

SEQ ID NO: 102031 - DNA, 201 bp, Bos taurus; identical to SEQ ID NO: 20772

SEQ ID NO: 102032 - DNA, 201 bp, Bos taurus; identical to SEQ ID NO: 20773

SEQ ID NO: 102033 - DNA, 201 bp, Bos taurus; identical to SEQ ID NO: 20774

SEQ ID NO: 102034 - DNA, 201 bp, Bos taurus; identical to SEQ ID NO: 20775

SEQ ID NO: 102035 - DNA, 201 bp, Bos taurus; identical to SEQ ID NO: 20776

SEQ ID NO: 102036 - DNA, 201 bp, Bos taurus; identical to SEQ ID NO: 20777

SEQ ID NO: 102037 - DNA, 201 bp, Bos taurus; identical to SEQ ID NO: 20778

SEQ ID NO: 102038 - DNA, 201 bp, Bos taurus; identical to SEQ ID NO: 20779

SEQ ID NO: 102039 - DNA, 201 bp, Bos taurus; identical to SEQ ID NO: 20780

SEQ ID NO: 102040 - DNA, 201 bp, Bos taurus; identical to SEQ ID NO: 20781

SEQ ID NO: 102041 - DNA, 201 bp, Bos taurus; identical to SEQ ID NO: 20782

SEQ ID NO: 102042 - DNA, 201 bp, Bos taurus; identical to SEQ ID NO: 20783

SEQ ID NO: 102043 - DNA, 201 bp, Bos taurus; identical to SEQ ID NO: 20784

SEQ ID NO: 102044 - DNA, 201 bp, Bos taurus; identical to SEQ ID NO: 20785

SEQ ID NO: 102045 - DNA, 201 bp, Bos taurus; identical to SEQ ID NO: 20786

SEQ ID NO: 102046 - DNA, 201 bp, Bos taurus; identical to SEQ ID NO: 20787

SEQ ID NO: 102047 - DNA, 201 bp, Bos taurus; identical to SEQ ID NO: 20788

SEQ ID NO: 102048 - DNA, 201 bp, Bos taurus; identical to SEQ ID NO: 20789

SEQ ID NO: 102049 - DNA, 201 bp, Bos taurus; identical to SEQ ID NO: 20790

SEQ ID NO: 102050 - DNA, 201 bp, Bos taurus; identical to SEQ ID NO: 20791

SEQ ID NO: 102051 - DNA, 201 bp, Bos taurus; identical to SEQ ID NO: 20792

SEQ ID NO: 102052 - DNA, 201 bp, Bos taurus; identical to SEQ ID NO: 20793

SEQ ID NO: 102053 - DNA, 201 bp, Bos taurus; identical to SEQ ID NO: 20794

SEQ ID NO: 102054 - DNA, 201 bp, Bos taurus; identical to SEQ ID NO: 20795

SEQ ID NO: 102055 - DNA, 201 bp, Bos taurus; identical to SEQ ID NO: 20796

SEQ ID NO: 102056 - DNA, 201 bp, Bos taurus; identical to SEQ ID NO: 20797

SEQ ID NO: 102057 - DNA, 201 bp, Bos taurus; identical to SEQ ID NO: 20798

SEQ ID NO: 102058 - DNA, 201 bp, Bos taurus; identical to SEQ ID NO: 20799

SEQ ID NO: 102059 - DNA, 201 bp, Bos taurus; identical to SEQ ID NO: 20801

SEQ ID NO: 102060 - DNA, 201 bp, Bos taurus; identical to SEQ ID NO: 20802

SEQ ID NO: 102061 - DNA, 201 bp, Bos taurus; identical to SEQ ID NO: 20803

SEQ ID NO: 102062 - DNA, 201 bp, Bos taurus; identical to SEQ ID NO: 20804

SEQ ID NO: 102063 - DNA, 201 bp, Bos taurus; identical to SEQ ID NO: 20805

SEQ ID NO: 102064 - DNA, 201 bp, Bos taurus; identical to SEQ ID NO: 20806

SEQ ID NO: 102065 - DNA, 201 bp, Bos taurus; identical to SEQ ID NO: 20807

SEQ ID NO: 102066 - DNA, 201 bp, Bos taurus; identical to SEQ ID NO: 20808

SEQ ID NO: 102067 - DNA, 201 bp, Bos taurus; identical to SEQ ID NO: 20809

SEQ ID NO: 102068 - DNA, 201 bp, Bos taurus; identical to SEQ ID NO: 20810

SEQ ID NO: 102069 - DNA, 201 bp, Bos taurus; identical to SEQ ID NO: 20811

SEQ ID NO: 102070 - DNA, 201 bp, Bos taurus; identical to SEQ ID NO: 20812

SEQ ID NO: 102071 - DNA, 201 bp, Bos taurus; identical to SEQ ID NO: 20813

SEQ ID NO: 102072 - DNA, 201 bp, Bos taurus; identical to SEQ ID NO: 20814

SEQ ID NO: 102073 - DNA, 201 bp, Bos taurus; identical to SEQ ID NO: 20816

SEQ ID NO: 102074 - DNA, 201 bp, Bos taurus; identical to SEQ ID NO: 20817

SEQ ID NO: 102075 - DNA, 201 bp, Bos taurus; identical to SEQ ID NO: 20818

SEQ ID NO: 102076 - DNA, 201 bp, Bos taurus; identical to SEQ ID NO: 20819

SEQ ID NO: 102077 - DNA, 201 bp, Bos taurus; identical to SEQ ID NO: 20820

SEQ ID NO: 102078 - DNA, 201 bp, Bos taurus; identical to SEQ ID NO: 20821

SEQ ID NO: 102079 - DNA, 201 bp, Bos taurus; identical to SEQ ID NO: 20822

SEQ ID NO: 102080 - DNA, 201 bp, Bos taurus; identical to SEQ ID NO: 20823

SEQ ID NO: 102081 - DNA, 201 bp, Bos taurus; identical to SEQ ID NO: 20824

SEQ ID NO: 102082 - DNA, 201 bp, Bos taurus
cctgcacacttggagcccctaggtccctgtgatccaagcagctgtgccagctccatgcttgatccacactgtggcagagctaccagaggctaggaaaaaaaccctaacagcctcatatctcctaagcctgtgctgccagccccactgtgtacttggcactcttagggtccctgagatccaagcagggactataaaagtctt

SEQ ID NO: 102083 - DNA, 201 bp, Bos taurus; identical to SEQ ID NO: 20826

SEQ ID NO: 102084 - DNA, 201 bp, Bos taurus; identical to SEQ ID NO: 20827

SEQ ID NO: 102085 - DNA, 201 bp, Bos taurus
cactcttgcggcagggtggagtggacagaagctggcgggaatgcacggggcccactgaggtggctgcaactgcagccaccagggaaacaactgtggcctagaccacatacactgtggtggaaaacacgggaatggaagcaagcaaaatcaagagggctgctgatggtctggagcggcctaagggaaaaggtggtttgagga

SEQ ID NO: 102086 - DNA, 201 bp, Bos taurus; identical to SEQ ID NO: 20828

SEQ ID NO: 102087 - DNA, 201 bp, Bos taurus; identical to SEQ ID NO: 20831

SEQ ID NO: 102088 - DNA, 201 bp, Bos taurus
ccagctctgttgctgcagcctgcctgagaggggccagggaagtgataagtgaaaatccatcacaacttctggaaataactcaaaggacacactcgactgcagaaataccagcaggactcggccaagctcagcaatgttgtcaggagaatgattccatttcagcaggtactgtccttgtggaaagaggtctttggaggatag

SEQ ID NO: 102089 - DNA, 201 bp, Bos taurus; identical to SEQ ID NO: 20832

SEQ ID NO: 102090 - DNA, 201 bp, Bos taurus
atgtggaatctgagaaataacacctccaacccccacaataaccctgttcccaaagaggaagtgccgaaaccaagagagcctgccatggagactggcctggcgctgatgctcagatctggagctgggatggtcgtgtgtgtgtgtgtgtgtgtgtgtgtgtgtgtgtgtgtgctcgtgtctgtgggctgcctgtcagggccc

SEQ ID NO: 102091 - DNA, 201 bp, Bos taurus
caaacagtattacaagttgccatatggagcaaactaatctctctaccagttgagtcccaacaagacataaaaaggccatcagcaccgtgtttggtgtacatcacacaacttttttttttatctttcacaccaggacttcccaagtactaaatatagggttgaaagaaaattattttcatcctgcattccttctgacaacat

SEQ ID NO: 102092 - DNA, 201 bp, Bos taurus
actggcctttgccctggaagccccctcctggacaaccctgctgtctccgcggtggcctcaggcctgagcattccactcaacaggccaggagccttgaagcgaccctaccctgccagagatctcagtcgagggtgagactgcgtgtgtccttgataaccatgctgcctcctgcaggtggtcggagtgttggcctggctgggg

SEQ ID NO: 102093 - DNA, 201 bp, Bos taurus
caataactatatcacaatccccagatcctactcagactttaccaactgttccacttttggccttttctgattattttgctaagttttaaattatagaaagaattctgttgttcatctcttggacaacattggatggacaatggattgcactcgattttagcaattatgaacaatgctgttaagaatattcttgtcctgaac

SEQ ID NO: 102094 - DNA, 201 bp, Bos taurus; identical to SEQ ID NO: 20837

SEQ ID NO: 102095 - DNA, 201 bp, Bos taurus
caaccacttgattctgtattcatggaaatgatgacatctttttcattcaatctcttaatgtcaagctttctgtctattaccatggccaaagttaaacccaaaatgcaaccctggactaggatcgctgatctctaccctcagattcaatactgaatccattttgatgacatttaatttatgatttgggccagaatagtcaca

SEQ ID NO: 102096 - DNA, 201 bp, Bos taurus
ggccaggcaacatttcacagtaccagaggctgaggaggaaaagtcttggcacggcagtacatggtgggcagttcctatgggcattagttgaggggtccatcggccttgctcattcccagacaggatgaatgagtcagatgtgatgagggccaagccaagtagcccaccggagacttcacaatggccagtggcaggtaggtc

SEQ ID NO: 102097 - DNA, 201 bp, Bos taurus; identical to SEQ ID NO: 20838

SEQ ID NO: 102098 - DNA, 201 bp, Bos taurus
aatgccttgtctgaggtctccctgcgggccaggtagggcccagaggccagctggagcctgggtctcttccacacctcatacaccatccagcttcaactcattgcacacccactattggccatctaaagtcactttgcaaactgattcaacagccactctttgtgcactcattctgccctgtccagaatttatcattacact

SEQ ID NO: 102099 - DNA, 201 bp, Bos taurus; identical to SEQ ID NO: 20840

SEQ ID NO: 102100 - DNA, 201 bp, Bos taurus
tgatcggtagtttcagccttctggttgggtctgtcccaaagactgccctttgggcaagtgtgtgacttctttcggaatccgggccccttctgtgatcggcaggacctgaggagtagttcactgtggctgcgcagggagcagatctcctagagctgggggttatttttcaggttgcttggagtatcctttcttggccccaca

SEQ ID NO: 102101 - DNA, 201 bp, Bos taurus
gaagcacccccagcctcctactcagacagccctctggcccagaagccgctcattaaagctgctcattaaagccactcagcagagaataacgtgggatatgagagatggggcaatcgtgctgagggccagggggagcttgtgtgtcccatgagctggggttccccctcacgaggaccccaggggcaaagacacgaccctggg

SEQ ID NO: 102102 - DNA, 201 bp, Bos taurus
gaagaacgtgggagtgagatgggccggcgcgcacaaaggctaggagcgtgaggacaggtggggcctgcacacggcgcagccgctgtcctcagggacatgcggagagaaggggctgagcttgtgcagcgactgccacggagctgagtgacaacagggtccagatgccagccgcactgggcagcggccaagctccacaccctc

SEQ ID NO: 102103 - DNA, 201 bp, Bos taurus; identical to SEQ ID NO: 20841

SEQ ID NO: 102104 - DNA, 201 bp, Bos taurus; identical to SEQ ID NO: 20842

SEQ ID NO: 102105 - DNA, 201 bp, Bos taurus; identical to SEQ ID NO: 20844

SEQ ID NO: 102106 - DNA, 201 bp, Bos taurus; identical to SEQ ID NO: 20847

SEQ ID NO: 102107 - DNA, 201 bp, Bos taurus; identical to SEQ ID NO: 20848

SEQ ID NO: 102108 - DNA, 201 bp, Bos taurus
gcagcagtgtggataagcccacctcacaggaggtagcttcccagctccagggctatgttcagcgtctccaggaacgccgtgctctggtgaagattccctccgagcctggctccacctgggtgcccatatctaccgtgccccatgcagaagccatggtgcaggccattctggggacccagcctggcccagccctaccccggt

SEQ ID NO: 102109 - DNA, 201 bp, Bos taurus
gcccacatccccccaaacagatgatgcacaaggttggcctctctgtgtgcagaaatgcggccaccagatgccgctgcgtctgggtgtttctgattcaagcagttgccgggttccttattcaggtcaaccctgacctgggttcagggtgtcgggtttctggcgccattttaaacaacgccgctgcctacaggctccagctgg

SEQ ID NO: 102110 - DNA, 201 bp, Bos taurus
tctgacatacaagatgcgcacgagagggcctgagttgcctaagctgactggtttcctcgcaaagatgtggcaaggacacagagaagtgggaccaggaagcgcggagggcagaaggggccagcggagtcacaggctcagaggggctgcgtgggagggacagaaaagcgagctccttgaggatgggcgtggatggggtgggag

SEQ ID NO: 102111 - DNA, 201 bp, Bos taurus
catcagctcactgaggcgctcagctgacttctctggcttttacgcatgccttccgcacagagtccaaacacagcctaaaacctggaagccagtcacactgcagcttaaggtcttgttccaagtgcctgtgaaacctgcaccccaggaagccccagactgtgtctggaatgaaaggaagcaggtctggggctgaggaactgg

SEQ ID NO: 102112 - DNA, 201 bp, Bos taurus
tcctgactgcagtgggttagctcacatgatcagaggccaccaggaggtagagaagagaagttagtctagctccagcctctgagactgcaggaagagattctacatggcaggcccggcacacacagccctcagccttccccaagagacggacagacacatatcatctcttgctgccttgtgaggaagacatggtctctgctc

SEQ ID NO: 102113 - DNA, 201 bp, Bos taurus
ttccaagatgtggttgaatgagggaggtggaatattggcccctgggcatccctcagccatccctctccgggaacctggagcctcctgtgtgcatgcctccggagaacttggcctggagtgggtctgtaagcagtctctaaaccccaaaccacaaaggcaattgtaaattccagtgcagaaaggcacaataaaggccttaaa

SEQ ID NO: 102114 - DNA, 201 bp, Bos taurus; identical to SEQ ID NO: 20851

SEQ ID NO: 102115 - DNA, 201 bp, Bos taurus; identical to SEQ ID NO: 20855

SEQ ID NO: 102116 - DNA, 201 bp, Bos taurus
tatagcatttaaaaaaacatacatttcttgatacaaaaaggccagttagagttccttctgagctatgatactactaaatgatttctcaactttggccctactgacatttgagactgtgtcattctctgctgtgggggctgtcacatgcattatacgatgttgagtaacatatctggcctaattatcagtagaaatagcaat

SEQ ID NO: 102117 - DNA, 201 bp, Bos taurus
agggggcagctgggctctgtttcacacggtcatgcagggacccagggtccatgcttcctgtggctctgccaccctcaagtcctccactgggccaattacaatttgatgctggacagaagaagagaatgagcgtggaggatcttgcaggaagttttaggaacctggccctggagtggcttatgtcgtttcctctcccatccc

SEQ ID NO: 102118 - DNA, 201 bp, Bos taurus
gacggagtttgacctaaggacgctgagggcagttcgagtgctgcggccgctcaagctggtgtctggaatcccaagtgcgtgagtttctaaccctggcaaggggtctgctcaggggtcctgggagccctccatttcccttctgcaagaaggtctcataggtgccctcagatgcttccctagcctgggtcagggcagccttat

SEQ ID NO: 102119 - DNA, 201 bp, Bos taurus; identical to SEQ ID NO: 20857

SEQ ID NO: 102120 - DNA, 201 bp, Bos taurus; identical to SEQ ID NO: 20861

SEQ ID NO: 102121 - DNA, 201 bp, Bos taurus; identical to SEQ ID NO: 20862

SEQ ID NO: 102122 - DNA, 201 bp, Bos taurus; identical to SEQ ID NO: 20863

SEQ ID NO: 102123 - DNA, 201 bp, Bos taurus; identical to SEQ ID NO: 20864

SEQ ID NO: 102124 - DNA, 201 bp, Bos taurus; identical to SEQ ID NO: 20865

SEQ ID NO: 102125 - DNA, 201 bp, Bos taurus; identical to SEQ ID NO: 20867

SEQ ID NO: 102126 - DNA, 201 bp, Bos taurus; identical to SEQ ID NO: 20868

SEQ ID NO: 102127 - DNA, 201 bp, Bos taurus; identical to SEQ ID NO: 20870

SEQ ID NO: 102128 - DNA, 201 bp, Bos taurus; identical to SEQ ID NO: 20871

SEQ ID NO: 102129 - DNA, 201 bp, Bos taurus; identical to SEQ ID NO: 20874

SEQ ID NO: 102130 - DNA, 201 bp, Bos taurus; identical to SEQ ID NO: 20875

SEQ ID NO: 102131 - DNA, 201 bp, Bos taurus; identical to SEQ ID NO: 20876

SEQ ID NO: 102132 - DNA, 201 bp, Bos taurus
ccaagagccctttcaactaggtctccaggtctgcctcctgcctagtcccccagaacccctggcctcagtcccatgggcccattggaattgcttttcctagccccccagtccccaggaactctgagctgacccctcctcaagctcccttcagttccccaccctctgatcctagctgtagacctgggggctccgaggggccgg

SEQ ID NO: 102133 - DNA, 201 bp, Bos taurus; identical to SEQ ID NO: 20877

SEQ ID NO: 102134 - DNA, 201 bp, Bos taurus; identical to SEQ ID NO: 61339

SEQ ID NO: 102135 - DNA, 201 bp, Bos taurus; identical to SEQ ID NO: 20878

SEQ ID NO: 102136 - DNA, 201 bp, Bos taurus
aattcccagctcgtgggccatgaatataagtcatttggcttgcggatcggattctgctgcgggtccagactgtaccaggacaccggcaataaggcgtctgagtccccaaaactcggccttccgggagctgcgccaccagcaccgagcccgcgcgcgcctccggccttccaaccctccttcgcagcgcgcgcctcccgccaa

SEQ ID NO: 102137 - DNA, 201 bp, Bos taurus
ctttcacttagccacgtgcatttaagcccctccgcgtctcatcatggccgggtagctcatttctttttagcactgaatcacattccattgtttgaatgttccacacttttgtttctttttacctgctgaaggatgtctgagttgcttccaagctttggcaattatgaacaaagcttccataagcattcacgtgcaggtttt

SEQ ID NO: 102138 - DNA, 201 bp, Bos taurus
tcctcaccaacatcagcgcttgattttactacccccattcctacctcctccgcaacgggctcatctgtacctcaccccacatcaggccaagtcctacacacttactgcagggactatgtgctcacagagagcccgcccaactaaaggaagggacttgcaacgtgtggtcactggcccctgtgttctctctgttcaagggac

SEQ ID NO: 102139 - DNA, 201 bp, Bos taurus; identical to SEQ ID NO: 20881

SEQ ID NO: 102140 - DNA, 201 bp, Bos taurus; identical to SEQ ID NO: 20882

SEQ ID NO: 102141 - DNA, 201 bp, Bos taurus; identical to SEQ ID NO: 20884

SEQ ID NO: 102142 - DNA, 201 bp, Bos taurus; identical to SEQ ID NO: 20886

SEQ ID NO: 102143 - DNA, 201 bp, Bos taurus; identical to SEQ ID NO: 20887

SEQ ID NO: 102144 - DNA, 201 bp, Bos taurus; identical to SEQ ID NO: 20888

SEQ ID NO: 102145 - DNA, 201 bp, Bos taurus
gcggtggatctcattacctacccccacccctgctccgcatggatgctgcctccattgcgtgggcagagaatgactcatatctggcctctgacacactctttcccatttgaacaccacccagaaggaagtggggagacaatcccattctacttcccttgacagggctccatgaaggtgagcacttggccaggtgcttctctg

SEQ ID NO: 102146 - DNA, 201 bp, Bos taurus
cagcctgattcttccactcctgtctgaacaccaatctctcccaggtctaatccagggtcacctccagcactgcttacactggagccacatcactcaaggggacattcctagacaccatggggtggccctggccccatctacctgaggccagcagtaacaccccctcccctcacccctcgggtgctaacagctggtccactg

SEQ ID NO: 102147 - DNA, 201 bp, Bos taurus
tttggttcatttctgtaactcgcccaccttcccttctttggctacatctaggttttgcatcgtgttagacactctggccagttccgctggtcacaacagtagtgaactcttggtctgatctttagtttctctttgaaagagtagctggtcggcctgcatttcggaccccagggcatggcaaagcaaatatgtgaaaggagt

SEQ ID NO: 102148 - DNA, 201 bp, Bos taurus
ttgaggccagaagaggccagggtccattggtgtctcccagctgcctggctctgcctcttctcactcccagcagaaacaccttacacaacccacatagctacgtcttatgtccaggccagccttttggctcttccttccacatgttatttctgaggccactaagaagggatggttcttggggttacggacagtaagggatgg

SEQ ID NO: 102149 - DNA, 201 bp, Bos taurus
agatagtttctaaggtcatatgtcgaaaagtggcaaatgtgtagattcacgttgaggtctttctactctgggacctttgttcttttgctgtaactatactgccttctccaatttaatgtccgcattaagtaattaacaaacataaatttcttaggattagctaaaatgttcgattttacatttatctcattggctctagaa

SEQ ID NO: 102150 - DNA, 201 bp, Bos taurus
agttataatactttacaagagaacaaaaccatcctgaataaatacattacaggactccaatgggagattcaatattaaaaacattttccctcaagtaatccgtaaattaaatgcaatccaaacaaaactcccaacaagattaaataattttttaaataaaacccacaagatgactctaaaattcatatatgagagataatg

SEQ ID NO: 102151 - DNA, 201 bp, Bos taurus
ggggcaaagtaaacctgaatggaagtgatgagtgctcatctgcagcaactcagctgtgagttgcctgcatgctggcccaaggcagaaacaggcccctgacatccacacaggggtattctcctgcccagggcagttctttctccttcagctcattaacactcttttgctggcagaaacctcttccccttcgtctcaaggcct

SEQ ID NO: 102152 - DNA, 201 bp, Bos taurus; identical to SEQ ID NO: 20890

SEQ ID NO: 102153 - DNA, 201 bp, Bos taurus; identical to SEQ ID NO: 20891

SEQ ID NO: 102154 - DNA, 201 bp, Bos taurus; identical to SEQ ID NO: 20892

SEQ ID NO: 102155 - DNA, 201 bp, Bos taurus; identical to SEQ ID NO: 20894

SEQ ID NO: 102156 - DNA, 201 bp, Bos taurus; identical to SEQ ID NO: 20895

SEQ ID NO: 102157 - DNA, 201 bp, Bos taurus; identical to SEQ ID NO: 20897

SEQ ID NO: 102158 - DNA, 201 bp, Bos taurus; identical to SEQ ID NO: 20898

SEQ ID NO: 102159 - DNA, 201 bp, Bos taurus; identical to SEQ ID NO: 20899

SEQ ID NO: 102160 - DNA, 201 bp, Bos taurus; identical to SEQ ID NO: 20900

SEQ ID NO: 102161 - DNA, 201 bp, Bos taurus
tttacctcctaaaataacagtctcccttgaatggctttctattctagaaaaccatcacccactactttcccaggttagtactgctatgttgaggcctcacgtgtccatgtaaagtggaatttgctgggtaggtattgagagagatgcatattaaccctctatagtgtcatactggggccttgtaactccaggaaacctcta

SEQ ID NO: 102162 - DNA, 201 bp, Bos taurus; identical to SEQ ID NO: 20901

SEQ ID NO: 102163 - DNA, 201 bp, Bos taurus; identical to SEQ ID NO: 20902

SEQ ID NO: 102164 - DNA, 201 bp, Bos taurus; identical to SEQ ID NO: 20903

SEQ ID NO: 102165 - DNA, 201 bp, Bos taurus; identical to SEQ ID NO: 20904

SEQ ID NO: 102166 - DNA, 201 bp, Bos taurus; identical to SEQ ID NO: 20905

SEQ ID NO: 102167 - DNA, 201 bp, Bos taurus
gacacacagtataaagaacgtattttactgtattcaccaaaacgcaagatttcctggcttctgtctctccagtcacccatcaaaagctgaaaaggcccttgcttcacctacattcatttttgatgttgcctaaaatataaaccatgatagctagttgcctcataatggctcgtgaacagaattcaccaagctagaaagaga

SEQ ID NO: 102168 - DNA, 201 bp, Bos taurus; identical to SEQ ID NO: 20907

SEQ ID NO: 102169 - DNA, 201 bp, Bos taurus; identical to SEQ ID NO: 20908

SEQ ID NO: 102170 - DNA, 201 bp, Bos taurus
gctagaatccccaatataatgttgaaatgaagtggtgactgtgaacatctctgtatattcccaatcttagaaggaaagcattcagtatttcaccattaagaatgaagtaggttttttataaacatgttttttctgcttaaggaagttctcttcggtttgttgaaaggttttattatgaatgatgatttgctttgtcaaatg

SEQ ID NO: 102171 - DNA, 201 bp, Bos taurus
gctgaaggcacagaacttccaggcttcaagttatcagcaagtacatatgatcagtttagaccacacagaatatctgctctccgcatgaggagcgagactgagacataaaacactcatttagcgatggtgtgactataaactggtactgtaactctaaaagtagtcaaatgctcacacgtgttctgggtaataagttatttc

SEQ ID NO: 102172 - DNA, 201 bp, Bos taurus
tgtggagaaccacattatgccactaataaaatatatacatggctccaaagttagaactataaaacaaggcatactggaaagatctaggttccaccattatgtaatccttcgtatcctcttccttctctaagataactaattttattagatttggtgtttacttctagtttataaaaaatgcacacatacatacatgcacat

SEQ ID NO: 102173 - DNA, 201 bp, Bos taurus; identical to SEQ ID NO: 20910

SEQ ID NO: 102174 - DNA, 201 bp, Bos taurus; identical to SEQ ID NO: 20912

SEQ ID NO: 102175 - DNA, 201 bp, Bos taurus; identical to SEQ ID NO: 20913

SEQ ID NO: 102176 - DNA, 201 bp, Bos taurus; identical to SEQ ID NO: 20914

SEQ ID NO: 102177 - DNA, 201 bp, Bos taurus
ttcctcaccttgtgtgggtagacaaaacttaatgccctgaaacagacacgcaaatagctttgatccaatctcctgccagagctggcctgatgcctaggtatagtaggtggctgccttcctggaaagatatgagggtactttaaagcctgacctgttgcttcccatggaatctctgttttgggcctgccagagcatagcttc

SEQ ID NO: 102178 - DNA, 201 bp, Bos taurus; identical to SEQ ID NO: 20915

SEQ ID NO: 102179 - DNA, 201 bp, Bos taurus
gggggacatagaatattgaaaattcatggcccagtgatgtcactcaatacatgtctttttcctttctcctttctcatctctgtaatattggagtccacttatctgagtatctgtcctccctttctcaacttttttcacattatgagctcctggagggtagaaaatttgatgaattcagctttatctccaggctttagctct

SEQ ID NO: 102180 - DNA, 201 bp, Bos taurus; identical to SEQ ID NO: 20916

SEQ ID NO: 102181 - DNA, 201 bp, Bos taurus
tggaaaacctgagatacctatccaaaagacaggcaccatcaaaaggtagtttgtgcccctggatcaatgcaacaggacaggcacaagttaatattaaggagataaacgcctgcacagagtggcttcacaattttggcagaggcaatattgcctccactggtgcaccaagacggacttccctggtggctcaggtggtaaagc

SEQ ID NO: 102182 - DNA, 201 bp, Bos taurus; identical to SEQ ID NO: 20918

SEQ ID NO: 102183 - DNA, 201 bp, Bos taurus; identical to SEQ ID NO: 20919

SEQ ID NO: 102184 - DNA, 201 bp, Bos taurus; identical to SEQ ID NO: 20920

SEQ ID NO: 102185 - DNA, 201 bp, Bos taurus
gcagtccctgctgggcctccactctgccaagaggaactcaaaggagacaattgtttgatgtttgtgtgtttggttggttggttgatttgttgtttggggtttggaagtttctgcactggggccatacactgagccactcccaaacccttcctcaagcctgtgggtcgaagaacatccagagccatgtaatcacatcgccct

SEQ ID NO: 102186 - DNA, 201 bp, Bos taurus
ctagagagcaagctcctaactcctgactctggaggctgaatacataacaggatgtttatttggagcaggactggggctaattaaggccaatgaacagattcataaatctagagacatggtgataaagtcttataaggataagagtaggaattttgattaatgatcagacttgaacagcttgagaatataaactgaaggctt

SEQ ID NO: 102187 - DNA, 201 bp, Bos taurus; identical to SEQ ID NO: 20921

SEQ ID NO: 102188 - DNA, 201 bp, Bos taurus; identical to SEQ ID NO: 20922

SEQ ID NO: 102189 - DNA, 201 bp, Bos taurus; identical to SEQ ID NO: 20924

SEQ ID NO: 102190 - DNA, 201 bp, Bos taurus; identical to SEQ ID NO: 20925

SEQ ID NO: 102191 - DNA, 201 bp, Bos taurus; identical to SEQ ID NO: 20926

SEQ ID NO: 102192 - DNA, 201 bp, Bos taurus; identical to SEQ ID NO: 20927

SEQ ID NO: 102193 - DNA, 201 bp, Bos taurus; identical to SEQ ID NO: 20928

SEQ ID NO: 102194 - DNA, 201 bp, Bos taurus; identical to SEQ ID NO: 20929

SEQ ID NO: 102195 - DNA, 201 bp, Bos taurus
ggtacaggcagtggccttggatatcaaagaccaatcttattaagatattttttttctatacatgtacatttgcatatcaagattaggcacctcagggacttagcacacaattcaggccatgatgaacttgaagcaatgtaagataacacacgagttttctagcccaaaagaatgtaaactttcagccctctgtgaagggga

SEQ ID NO: 102196 - DNA, 201 bp, Bos taurus
gcccgtggacatggggtgccattcccaaaggccaggaagacaatcattcaattcccaccctgtcactgggctgaacacagcctcatgaaacttctcaattcagccaagattcaggccaatactgccaacttttaaacaggacataagctgagaaagatattaaatgaagcctctatagccatttttctcaacttttaattt

SEQ ID NO: 102197 - DNA, 201 bp, Bos taurus; identical to SEQ ID NO: 20931

SEQ ID NO: 102198 - DNA, 201 bp, Bos taurus; identical to SEQ ID NO: 20932

SEQ ID NO: 102199 - DNA, 201 bp, Bos taurus
tcattctagtgatgggccggtagaggaacaggctctaacctgaagcccctgggttgttttcttagtgagaatgcagctttctatagtcgacagatcagagctctggcatttaggccaccatggattctaaatcagggttaacttcttaattaggtacgtggttctgagcttcaatttcctgtcttacaaaatggcgatagt

SEQ ID NO: 102200 - DNA, 201 bp, Bos taurus
aattgtgtctcagcctcactagcctgtaggtacagatgtggtcacatttacagtaataattcaaatttctctgctttgtactttcaccaatttctggaagtcccccgagagagactcacaggctcataaataattctgactctactggtacttctgctgttgcatcaggtgtcaaggcaccaaatggtcacagcttctgtc

SEQ ID NO: 102201 - DNA, 201 bp, Bos taurus
aatcaatccataaattaagttgagggcccggggtgtggagggcggactattataggatttctttttaagctaaaaataataataataaattttaaggactaggccaaaaagtaaacacgcaaatatagctgaccaacctctgatcttaatataaaagctatggtaatttaaaaagatgaataggttagcttattgacagaa

SEQ ID NO: 102202 - DNA, 201 bp, Bos taurus; identical to SEQ ID NO: 20934

SEQ ID NO: 102203 - DNA, 201 bp, Bos taurus; identical to SEQ ID NO: 20938

SEQ ID NO: 102204 - DNA, 201 bp, Bos taurus; identical to SEQ ID NO: 20939

SEQ ID NO: 102205 - DNA, 201 bp, Bos taurus; identical to SEQ ID NO: 20940

SEQ ID NO: 102206 - DNA, 201 bp, Bos taurus; identical to SEQ ID NO: 20941

SEQ ID NO: 102207 - DNA, 201 bp, Bos taurus; identical to SEQ ID NO: 20942

SEQ ID NO: 102208 - DNA, 201 bp, Bos taurus
tactgtctgctccttcctgcttctgagactgcactgcttgtttgcagttttaagtcatcatattcttatgtgtcagtcaggactcactccctttaccccagatttgtagtcagtatctcttcaagagtcactactgcagcccaggctcttctctcctctgggactgccctgcccttcttctggagaaatgcctgttttcca

SEQ ID NO: 102209 - DNA, 201 bp, Bos taurus; identical to SEQ ID NO: 20943

SEQ ID NO: 102210 - DNA, 201 bp, Bos taurus; identical to SEQ ID NO: 20947

SEQ ID NO: 102211 - DNA, 201 bp, Bos taurus
actgatgtccaacagtcccaaagtgctataggaaactgagactccttcaaggggtgaatgtggtctcactcatgccaagaccaagaaaatcacagcaatatgaaacgtgccaagactatgtaggaaaggaggtcatttgcaaacctaaaagcattggctagagaggaaagcactagtgaggatgcttatccatgctcctca

SEQ ID NO: 102212 - DNA, 201 bp, Bos taurus; identical to SEQ ID NO: 20953

SEQ ID NO: 102213 - DNA, 201 bp, Bos taurus
tgacttctctatatacagaaagaatgtaaatagatggaaaagcaggaaagtctccactaagtgcctcagcaaacacctgggaacctatctgcttctacagttatagctggtcatgacaaaattatctttcaccactggttaggttgccacctcttaagctactcacacaagtgaatcagagtccaggcaactaagaaaaat

SEQ ID NO: 102214 - DNA, 201 bp, Bos taurus; identical to SEQ ID NO: 20957

SEQ ID NO: 102215 - DNA, 201 bp, Bos taurus; identical to SEQ ID NO: 20958

SEQ ID NO: 102216 - DNA, 201 bp, Bos taurus
ttctttcaggccttcctgaatctttaccttcctaagtaaatagctaccatgtggtatcacctgcttccctttcgtgaatcctttaatgaagacttgcccacgctcctcactggcaatttgtttgtcagtgacaaggtgatagttttggttagtttaacaaacaccaatttccaaccactgaaaaaccatctgggaatcctg

SEQ ID NO: 102217 - DNA, 201 bp, Bos taurus; identical to SEQ ID NO: 20959

SEQ ID NO: 102218 - DNA, 201 bp, Bos taurus
cagcagccagggttttaatgtaaatctgaaaacgatgcttcacttaaattctctgctaaccatcatacttccttgttcctgaaatcctcatcatttgcttccgttttcattgtctgtcttatttgactagaatctacgcactctgagagcagaagttgtatatattattcactgtgtcgtccctctaggcccacgagggta

SEQ ID NO: 102219 - DNA, 201 bp, Bos taurus
caaaggattcaagatgctccccagccgtgcccccatcagcctagcactgttctacttctgggtccctgttcacccactttccttggcctctggggtccattccaccatcatcagctacaaactactgccagtctcccaaggctcagtcacacaaggccattgtgatggctatgttgctgttgtttagttgctaagtcgggt

SEQ ID NO: 102220 - DNA, 201 bp, Bos taurus
taatagcatctgttgaagaaaacatatagtggggagaagcaataggagaattgggtttctcactgacattcacctgctgaagcagagcacagaaatatttttaacagtgctgagtgaaggccctggcccttgggatgtagaattttaaaaattaattattggaggatgtatcagcccatcccctgccatgatcaggagctg

SEQ ID NO: 102221 - DNA, 201 bp, Bos taurus
tcatggatttcccactattatagaacaaaaggcagagagcaggttgtttctgtggccactgcaagtagggtaaaccactgttaaaattagtgggccatggagatttgtttcatcatcttggttcttaaaagtgacagttgtgttgcaccaagtggattcagcataatcttctggtagcatcatacttggccaacagtcatc

SEQ ID NO: 102222 - DNA, 201 bp, Bos taurus
tgctgagctaggagtgagtgatgagaggacaccagatgctgctctctaaagcggggcccccactgtgagggcctcagcaggccagagaggagctcctcaccgcttcttctgagtaaggcacaatctcgtgtccagattggggctggcagttgcaggctcgccaggaatggagagagagagccaactccctcacaggctgat

SEQ ID NO: 102223 - DNA, 201 bp, Bos taurus; identical to SEQ ID NO: 20960

SEQ ID NO: 102224 - DNA, 201 bp, Bos taurus; identical to SEQ ID NO: 20962

SEQ ID NO: 102225 - DNA, 201 bp, Bos taurus; identical to SEQ ID NO: 20966

SEQ ID NO: 102226 - DNA, 201 bp, Bos taurus; identical to SEQ ID NO: 20967

SEQ ID NO: 102227 - DNA, 201 bp, Bos taurus; identical to SEQ ID NO: 20968

SEQ ID NO: 102228 - DNA, 201 bp, Bos taurus; identical to SEQ ID NO: 20969

SEQ ID NO: 102229 - DNA, 201 bp, Bos taurus; identical to SEQ ID NO: 20970

SEQ ID NO: 102230 - DNA, 201 bp, Bos taurus; identical to SEQ ID NO: 20971

SEQ ID NO: 102231 - DNA, 201 bp, Bos taurus; identical to SEQ ID NO: 20972

SEQ ID NO: 102232 - DNA, 201 bp, Bos taurus; identical to SEQ ID NO: 20973

SEQ ID NO: 102233 - DNA, 201 bp, Bos taurus; identical to SEQ ID NO: 20974

SEQ ID NO: 102234 - DNA, 201 bp, Bos taurus; identical to SEQ ID NO: 20975

SEQ ID NO: 102235 - DNA, 201 bp, Bos taurus; identical to SEQ ID NO: 20976

SEQ ID NO: 102236 - DNA, 201 bp, Bos taurus; identical to SEQ ID NO: 20977

SEQ ID NO: 102237 - DNA, 201 bp, Bos taurus; identical to SEQ ID NO: 20978

SEQ ID NO: 102238 - DNA, 201 bp, Bos taurus; identical to SEQ ID NO: 20979

SEQ ID NO: 102239 - DNA, 201 bp, Bos taurus; identical to SEQ ID NO: 20980

SEQ ID NO: 102240 - DNA, 201 bp, Bos taurus; identical to SEQ ID NO: 20981

SEQ ID NO: 102241 - DNA, 201 bp, Bos taurus; identical to SEQ ID NO: 20982

SEQ ID NO: 102242 - DNA, 201 bp, Bos taurus; identical to SEQ ID NO: 20983

SEQ ID NO: 102243 - DNA, 201 bp, Bos taurus; identical to SEQ ID NO: 20984

SEQ ID NO: 102244 - DNA, 201 bp, Bos taurus; identical to SEQ ID NO: 20985

SEQ ID NO: 102245 - DNA, 201 bp, Bos taurus; identical to SEQ ID NO: 20986

SEQ ID NO: 102246 - DNA, 201 bp, Bos taurus; identical to SEQ ID NO: 20987

SEQ ID NO: 102247 - DNA, 201 bp, Bos taurus; identical to SEQ ID NO: 20988

SEQ ID NO: 102248 - DNA, 201 bp, Bos taurus; identical to SEQ ID NO: 20989

SEQ ID NO: 102249 - DNA, 201 bp, Bos taurus; identical to SEQ ID NO: 20990

SEQ ID NO: 102250 - DNA, 201 bp, Bos taurus; identical to SEQ ID NO: 20991

SEQ ID NO: 102251 - DNA, 201 bp, Bos taurus; identical to SEQ ID NO: 20992

SEQ ID NO: 102252 - DNA, 201 bp, Bos taurus; identical to SEQ ID NO: 20993

SEQ ID NO: 102253 - DNA, 201 bp, Bos taurus; identical to SEQ ID NO: 20994

SEQ ID NO: 102254 - DNA, 201 bp, Bos taurus; identical to SEQ ID NO: 20995

SEQ ID NO: 102255 - DNA, 201 bp, Bos taurus; identical to SEQ ID NO: 20996

SEQ ID NO: 102256 - DNA, 201 bp, Bos taurus; identical to SEQ ID NO: 20997

SEQ ID NO: 102257 - DNA, 201 bp, Bos taurus; identical to SEQ ID NO: 20998

SEQ ID NO: 102258 - DNA, 201 bp, Bos taurus; identical to SEQ ID NO: 20999

SEQ ID NO: 102259 - DNA, 201 bp, Bos taurus; identical to SEQ ID NO: 21000

SEQ ID NO: 102260 - DNA, 201 bp, Bos taurus; identical to SEQ ID NO: 21001

SEQ ID NO: 102261 - DNA, 201 bp, Bos taurus; identical to SEQ ID NO: 21002

SEQ ID NO: 102262 - DNA, 201 bp, Bos taurus; identical to SEQ ID NO: 21003

SEQ ID NO: 102263 - DNA, 201 bp, Bos taurus; identical to SEQ ID NO: 21004

SEQ ID NO: 102264 - DNA, 201 bp, Bos taurus; identical to SEQ ID NO: 21005

SEQ ID NO: 102265 - DNA, 201 bp, Bos taurus; identical to SEQ ID NO: 21006

SEQ ID NO: 102266 - DNA, 201 bp, Bos taurus; identical to SEQ ID NO: 21007

SEQ ID NO: 102267 - DNA, 201 bp, Bos taurus; identical to SEQ ID NO: 61504

SEQ ID NO: 102268 - DNA, 201 bp, Bos taurus; identical to SEQ ID NO: 21008

SEQ ID NO: 102269 - DNA, 201 bp, Bos taurus; identical to SEQ ID NO: 21009

SEQ ID NO: 102270 - DNA, 201 bp, Bos taurus; identical to SEQ ID NO: 21010

SEQ ID NO: 102271 - DNA, 201 bp, Bos taurus; identical to SEQ ID NO: 21011

SEQ ID NO: 102272 - DNA, 201 bp, Bos taurus; identical to SEQ ID NO: 21012

SEQ ID NO: 102273 - DNA, 201 bp, Bos taurus; identical to SEQ ID NO: 21013

SEQ ID NO: 102274 - DNA, 201 bp, Bos taurus; identical to SEQ ID NO: 21014

SEQ ID NO: 102275 - DNA, 201 bp, Bos taurus; identical to SEQ ID NO: 21015

SEQ ID NO: 102276 - DNA, 201 bp, Bos taurus; identical to SEQ ID NO: 21016

SEQ ID NO: 102277 - DNA, 201 bp, Bos taurus; identical to SEQ ID NO: 21017

SEQ ID NO: 102278 - DNA, 201 bp, Bos taurus; identical to SEQ ID NO: 21018

SEQ ID NO: 102279 - DNA, 201 bp, Bos taurus; identical to SEQ ID NO: 21019

SEQ ID NO: 102280 - DNA, 201 bp, Bos taurus; identical to SEQ ID NO: 21020

SEQ ID NO: 102281 - DNA, 201 bp, Bos taurus; identical to SEQ ID NO: 21021

SEQ ID NO: 102282 - DNA, 201 bp, Bos taurus; identical to SEQ ID NO: 21022

SEQ ID NO: 102283 - DNA, 201 bp, Bos taurus; identical to SEQ ID NO: 21023

SEQ ID NO: 102284 - DNA, 201 bp, Bos taurus; identical to SEQ ID NO: 21024

SEQ ID NO: 102285 - DNA, 201 bp, Bos taurus; identical to SEQ ID NO: 21025

SEQ ID NO: 102286 - DNA, 201 bp, Bos taurus; identical to SEQ ID NO: 21026

SEQ ID NO: 102287 - DNA, 201 bp, Bos taurus; identical to SEQ ID NO: 21027

SEQ ID NO: 102288 - DNA, 201 bp, Bos taurus; identical to SEQ ID NO: 21028

SEQ ID NO: 102289 - DNA, 201 bp, Bos taurus; identical to SEQ ID NO: 21029

SEQ ID NO: 102290 - DNA, 201 bp, Bos taurus; identical to SEQ ID NO: 21030

SEQ ID NO: 102291 - DNA, 201 bp, Bos taurus; identical to SEQ ID NO: 21031

SEQ ID NO: 102292 - DNA, 201 bp, Bos taurus; identical to SEQ ID NO: 21032

SEQ ID NO: 102293 - DNA, 201 bp, Bos taurus; identical to SEQ ID NO: 21033

SEQ ID NO: 102294 - DNA, 201 bp, Bos taurus; identical to SEQ ID NO: 21034

SEQ ID NO: 102295 - DNA, 201 bp, Bos taurus; identical to SEQ ID NO: 21035

SEQ ID NO: 102296 - DNA, 201 bp, Bos taurus; identical to SEQ ID NO: 21036

SEQ ID NO: 102297 - DNA, 201 bp, Bos taurus; identical to SEQ ID NO: 21037

SEQ ID NO: 102298 - DNA, 201 bp, Bos taurus; identical to SEQ ID NO: 21038

SEQ ID NO: 102299 - DNA, 201 bp, Bos taurus; identical to SEQ ID NO: 21039

SEQ ID NO: 102300 - DNA, 201 bp, Bos taurus; identical to SEQ ID NO: 21040

SEQ ID NO: 102301 - DNA, 201 bp, Bos taurus; identical to SEQ ID NO: 21041

SEQ ID NO: 102302 - DNA, 201 bp, Bos taurus; identical to SEQ ID NO: 21042

SEQ ID NO: 102303 - DNA, 201 bp, Bos taurus; identical to SEQ ID NO: 21043

SEQ ID NO: 102304 - DNA, 201 bp, Bos taurus; identical to SEQ ID NO: 21044

SEQ ID NO: 102305 - DNA, 201 bp, Bos taurus; identical to SEQ ID NO: 21046

SEQ ID NO: 102306 - DNA, 201 bp, Bos taurus; identical to SEQ ID NO: 21047

SEQ ID NO: 102307 - DNA, 201 bp, Bos taurus; identical to SEQ ID NO: 21048

SEQ ID NO: 102308 - DNA, 201 bp, Bos taurus; identical to SEQ ID NO: 21050

SEQ ID NO: 102309 - DNA, 201 bp, Bos taurus; identical to SEQ ID NO: 21051

SEQ ID NO: 102310 - DNA, 201 bp, Bos taurus; identical to SEQ ID NO: 21052

SEQ ID NO: 102311 - DNA, 201 bp, Bos taurus; identical to SEQ ID NO: 21053

SEQ ID NO: 102312 - DNA, 201 bp, Bos taurus; identical to SEQ ID NO: 21054

SEQ ID NO: 102313 - DNA, 201 bp, Bos taurus; identical to SEQ ID NO: 21055

SEQ ID NO: 102314 - DNA, 201 bp, Bos taurus; identical to SEQ ID NO: 21056

SEQ ID NO: 102315 - DNA, 201 bp, Bos taurus; identical to SEQ ID NO: 21057

SEQ ID NO: 102316 - DNA, 201 bp, Bos taurus; identical to SEQ ID NO: 21058

SEQ ID NO: 102317 - DNA, 201 bp, Bos taurus; identical to SEQ ID NO: 21059

SEQ ID NO: 102318 - DNA, 201 bp, Bos taurus; identical to SEQ ID NO: 21060

SEQ ID NO: 102319 - DNA, 201 bp, Bos taurus; identical to SEQ ID NO: 21061

SEQ ID NO: 102320 - DNA, 201 bp, Bos taurus; identical to SEQ ID NO: 21062

SEQ ID NO: 102321 - DNA, 201 bp, Bos taurus; identical to SEQ ID NO: 21063

SEQ ID NO: 102322 - DNA, 201 bp, Bos taurus; identical to SEQ ID NO: 21064

SEQ ID NO: 102323 - DNA, 201 bp, Bos taurus; identical to SEQ ID NO: 21065

SEQ ID NO: 102324 - DNA, 201 bp, Bos taurus; identical to SEQ ID NO: 21066

SEQ ID NO: 102325 - DNA, 201 bp, Bos taurus; identical to SEQ ID NO: 21067

SEQ ID NO: 102326 - DNA, 201 bp, Bos taurus; identical to SEQ ID NO: 21068

SEQ ID NO: 102327 - DNA, 201 bp, Bos taurus; identical to SEQ ID NO: 21069

SEQ ID NO: 102328 - DNA, 201 bp, Bos taurus; identical to SEQ ID NO: 21070

SEQ ID NO: 102329 - DNA, 201 bp, Bos taurus; identical to SEQ ID NO: 21071

SEQ ID NO: 102330 - DNA, 201 bp, Bos taurus; identical to SEQ ID NO: 21072

SEQ ID NO: 102331 - DNA, 201 bp, Bos taurus; identical to SEQ ID NO: 21073

SEQ ID NO: 102332 - DNA, 201 bp, Bos taurus; identical to SEQ ID NO: 21074

SEQ ID NO: 102333 - DNA, 201 bp, Bos taurus; identical to SEQ ID NO: 21075

SEQ ID NO: 102334 - DNA, 201 bp, Bos taurus; identical to SEQ ID NO: 21076

SEQ ID NO: 102335 - DNA, 201 bp, Bos taurus; identical to SEQ ID NO: 21077

SEQ ID NO: 102336 - DNA, 201 bp, Bos taurus; identical to SEQ ID NO: 21078

SEQ ID NO: 102337 - DNA, 201 bp, Bos taurus; identical to SEQ ID NO: 21079

SEQ ID NO: 102338 - DNA, 201 bp, Bos taurus; identical to SEQ ID NO: 21080

SEQ ID NO: 102339 - DNA, 201 bp, Bos taurus; identical to SEQ ID NO: 21081

SEQ ID NO: 102340 - DNA, 201 bp, Bos taurus; identical to SEQ ID NO: 21082

SEQ ID NO: 102341 - DNA, 201 bp, Bos taurus; identical to SEQ ID NO: 21083

SEQ ID NO: 102342 - DNA, 201 bp, Bos taurus; identical to SEQ ID NO: 21084

SEQ ID NO: 102343 - DNA, 201 bp, Bos taurus; identical to SEQ ID NO: 21085

SEQ ID NO: 102344 - DNA, 201 bp, Bos taurus; identical to SEQ ID NO: 21086

SEQ ID NO: 102345 - DNA, 201 bp, Bos taurus; identical to SEQ ID NO: 21087

SEQ ID NO: 102346 - DNA, 201 bp, Bos taurus; identical to SEQ ID NO: 21088

SEQ ID NO: 102347 - DNA, 201 bp, Bos taurus; identical to SEQ ID NO: 21089

SEQ ID NO: 102348 - DNA, 201 bp, Bos taurus; identical to SEQ ID NO: 21090

SEQ ID NO: 102349 - DNA, 201 bp, Bos taurus; identical to SEQ ID NO: 21091

SEQ ID NO: 102350 - DNA, 201 bp, Bos taurus; identical to SEQ ID NO: 21092

SEQ ID NO: 102351 - DNA, 201 bp, Bos taurus; identical to SEQ ID NO: 21093

SEQ ID NO: 102352 - DNA, 201 bp, Bos taurus; identical to SEQ ID NO: 21094

SEQ ID NO: 102353 - DNA, 201 bp, Bos taurus; identical to SEQ ID NO: 21095

SEQ ID NO: 102354 - DNA, 201 bp, Bos taurus; identical to SEQ ID NO: 21096

SEQ ID NO: 102355 - DNA, 201 bp, Bos taurus; identical to SEQ ID NO: 21097

SEQ ID NO: 102356 - DNA, 201 bp, Bos taurus; identical to SEQ ID NO: 21098

SEQ ID NO: 102357 - DNA, 201 bp, Bos taurus; identical to SEQ ID NO: 21102

SEQ ID NO: 102358 - DNA, 201 bp, Bos taurus; identical to SEQ ID NO: 21103

SEQ ID NO: 102359 - DNA, 201 bp, Bos taurus; identical to SEQ ID NO: 21104

SEQ ID NO: 102360 - DNA, 201 bp, Bos taurus; identical to SEQ ID NO: 21105

SEQ ID NO: 102361 - DNA, 201 bp, Bos taurus; identical to SEQ ID NO: 21106

SEQ ID NO: 102362 - DNA, 201 bp, Bos taurus; identical to SEQ ID NO: 21108

SEQ ID NO: 102363 - DNA, 201 bp, Bos taurus; identical to SEQ ID NO: 21117

SEQ ID NO: 102364 - DNA, 201 bp, Bos taurus; identical to SEQ ID NO: 21119

SEQ ID NO: 102365 - DNA, 201 bp, Bos taurus; identical to SEQ ID NO: 21120

SEQ ID NO: 102366 - DNA, 201 bp, Bos taurus; identical to SEQ ID NO: 21125

SEQ ID NO: 102367 - DNA, 201 bp, Bos taurus; identical to SEQ ID NO: 21128

SEQ ID NO: 102368 - DNA, 201 bp, Bos taurus; identical to SEQ ID NO: 21131

SEQ ID NO: 102369 - DNA, 201 bp, Bos taurus; identical to SEQ ID NO: 21132

SEQ ID NO: 102370 - DNA, 201 bp, Bos taurus; identical to SEQ ID NO: 21133

SEQ ID NO: 102371 - DNA, 201 bp, Bos taurus; identical to SEQ ID NO: 21134

SEQ ID NO: 102372 - DNA, 201 bp, Bos taurus; identical to SEQ ID NO: 21135

SEQ ID NO: 102373 - DNA, 201 bp, Bos taurus; identical to SEQ ID NO: 21138

SEQ ID NO: 102374 - DNA, 201 bp, Bos taurus; identical to SEQ ID NO: 21139

SEQ ID NO: 102375 - DNA, 201 bp, Bos taurus; identical to SEQ ID NO: 21140

SEQ ID NO: 102376 - DNA, 201 bp, Bos taurus; identical to SEQ ID NO: 21141

SEQ ID NO: 102377 - DNA, 201 bp, Bos taurus; identical to SEQ ID NO: 21142

SEQ ID NO: 102378 - DNA, 201 bp, Bos taurus; identical to SEQ ID NO: 21143

SEQ ID NO: 102379 - DNA, 201 bp, Bos taurus; identical to SEQ ID NO: 21144

SEQ ID NO: 102380 - DNA, 201 bp, Bos taurus; identical to SEQ ID NO: 21145

SEQ ID NO: 102381 - DNA, 201 bp, Bos taurus; identical to SEQ ID NO: 21147

SEQ ID NO: 102382 - DNA, 201 bp, Bos taurus; identical to SEQ ID NO: 21148

SEQ ID NO: 102383 - DNA, 201 bp, Bos taurus; identical to SEQ ID NO: 21151

SEQ ID NO: 102384 - DNA, 201 bp, Bos taurus; identical to SEQ ID NO: 21152

SEQ ID NO: 102385 - DNA, 201 bp, Bos taurus; identical to SEQ ID NO: 21153

SEQ ID NO: 102386 - DNA, 201 bp, Bos taurus; identical to SEQ ID NO: 21154

SEQ ID NO: 102387 - DNA, 201 bp, Bos taurus; identical to SEQ ID NO: 21155

SEQ ID NO: 102388 - DNA, 201 bp, Bos taurus; identical to SEQ ID NO: 21156

SEQ ID NO: 102389 - DNA, 201 bp, Bos taurus; identical to SEQ ID NO: 21157

SEQ ID NO: 102390 - DNA, 201 bp, Bos taurus; identical to SEQ ID NO: 21161

SEQ ID NO: 102391 - DNA, 201 bp, Bos taurus; identical to SEQ ID NO: 21162

SEQ ID NO: 102392 - DNA, 201 bp, Bos taurus; identical to SEQ ID NO: 21163

SEQ ID NO: 102393 - DNA, 201 bp, Bos taurus; identical to SEQ ID NO: 21164

SEQ ID NO: 102394 - DNA, 201 bp, Bos taurus; identical to SEQ ID NO: 21166

SEQ ID NO: 102395 - DNA, 201 bp, Bos taurus; identical to SEQ ID NO: 21171

SEQ ID NO: 102396 - DNA, 201 bp, Bos taurus; identical to SEQ ID NO: 21172

SEQ ID NO: 102397 - DNA, 201 bp, Bos taurus; identical to SEQ ID NO: 21175

SEQ ID NO: 102398 - DNA, 201 bp, Bos taurus; identical to SEQ ID NO: 21178

SEQ ID NO: 102399 - DNA, 201 bp, Bos taurus; identical to SEQ ID NO: 21179

SEQ ID NO: 102400 - DNA, 201 bp, Bos taurus
ttaaatagggaggggagcaccgtggggcaggctgggacccagcagccacagtgcttcccagcaagtccctgcgatactgaatgactgggcgcagtttccacgtgtaggcagcggaggctcacccttcaggaacaccgagagaagagaggccaggcatccccttctgcttactctctctttgcacactcgaggttctaataa

SEQ ID NO: 102401 - DNA, 201 bp, Bos taurus
gtggggttggaggtgtttggaggaatcaatgaaactcacatagtctttcctaaggtggagagagtaccatgctattatacaccctttgtacacacccaacccttttttcctcctcttagaacatatctgcactaggtattttcctttttggaagccaaggactcctctaattatttccttatacatctcagaatatatata

SEQ ID NO: 102402 - DNA, 201 bp, Bos taurus
ttcaagatgacttccagatagggttcaatagtgactgcctcttcagatagagcttgttcctcaccagttacccatggtccccactgctctctgtggtattgcaccaggcctatattatttgcctacaattccattaaggcttgtgtacacatttgagtttccaagacataagatatactgtaagatatgatacaccataag

SEQ ID NO: 102403 - DNA, 201 bp, Bos taurus; identical to SEQ ID NO: 21180

SEQ ID NO: 102404 - DNA, 201 bp, Bos taurus
ccatgtaaggcactgaagatacactggtaaacaaaactgatataagttctgttctcatggaaattacaaatgctaaattcttcttgttgctagatctttacacataaccatgatgatttcttttggatatattttagacatacatctgctggttgaaaaggtgtgatatatgctaacattttaataactgccaattttttt

SEQ ID NO: 102405 - DNA, 201 bp, Bos taurus; identical to SEQ ID NO: 21181

SEQ ID NO: 102406 - DNA, 201 bp, Bos taurus; identical to SEQ ID NO: 21182

SEQ ID NO: 102407 - DNA, 201 bp, Bos taurus; identical to SEQ ID NO: 21183

SEQ ID NO: 102408 - DNA, 201 bp, Bos taurus; identical to SEQ ID NO: 21184

SEQ ID NO: 102409 - DNA, 201 bp, Bos taurus
atgctgattctggttcctctaaaagtgaagcatgtgagtgaataatttgtattattatctattactgttatttgttgaaactgaatccactatttagaaattgaaaaaaaaatccctggaaaatgacaagatggggctcttttgacattataaaactgtttgtttgtttttgcatatgcctttagctttctagaaggaact

SEQ ID NO: 102410 - DNA, 201 bp, Bos taurus; identical to SEQ ID NO: 21186

SEQ ID NO: 102411 - DNA, 201 bp, Bos taurus; identical to SEQ ID NO: 21187

SEQ ID NO: 102412 - DNA, 201 bp, Bos taurus
taatggcctcctcacttaattacttcagcaaaaccaagcctgcgctctgaagcatcactggaaatgaagctagtgagtcccagaaatatcaggtttacccctcatgcactgaggtccactgggccactgttctgggaccagcttcaaagtagaagagagaggacgcatgactatgcatcccactcccctacatgtcactgt

SEQ ID NO: 102413 - DNA, 201 bp, Bos taurus; identical to SEQ ID NO: 21189

SEQ ID NO: 102414 - DNA, 201 bp, Bos taurus; identical to SEQ ID NO: 21190

SEQ ID NO: 102415 - DNA, 201 bp, Bos taurus
aaataaaaatttcttaggtgtggagatggaggtgggcattggcagtactaggattctccaaacgattttttcaacagctttggacgttttaagtaggcaagtgcaacacacaaattatcaggtggtttcttccatttattggtccctcttaaactcagttcttcatcatcctgtgaaattgtaaaattaaaagcaaatgaa

SEQ ID NO: 102416 - DNA, 201 bp, Bos taurus
gcagtttttggcacgaatacttgctgttatgtgctcttgttgcatcgtcagcgggtactttaggttggcttattatcagtgatgccagcctcgaacctttaaagtggtgaccaacatattttacctttgttaaggctcacttagttttaaattaaccaataatctgtaggatgattctttggcaaggtgtgaatattttac

SEQ ID NO: 102417 - DNA, 201 bp, Bos taurus
ttacactatcaaattccattatatccaacacacccgaaacctctattctctcacctttgattacccaagtgaacgttccatcaccatagacttaaaggcctgttagggtttgacatcttggcttttaaaaacaactttaaaaaaatacccttgaagattaaggaaaacctaaaacttggggatggaggcctgaataccctc

SEQ ID NO: 102418 - DNA, 201 bp, Bos taurus; identical to SEQ ID NO: 21192

SEQ ID NO: 102419 - DNA, 201 bp, Bos taurus
aggagagagctccagagtgggcctcccaggctgacttcccaacaatcctgtggagctggtcttctcagcgtgtttctcctgctacactaaggataccagggacacgtaaaactgctggcccatgttagctatgacccggaactaggtaactgtttccacatttgttgaattcagagtcacgccttgccagccactcttcac

SEQ ID NO: 102420 - DNA, 201 bp, Bos taurus
ccttcagagaggacaggttcactaaccaaaacaaataaaacatttttcctatatcaagaaaaattagactagataaagagaaatcaaaataagccagactattattacaaatattttcttaagtaaacaatatatataaaactatatatatatatatatataaatgaggaaatatttccattttgatccctttttccaaat

SEQ ID NO: 102421 - DNA, 201 bp, Bos taurus; identical to SEQ ID NO: 21194

SEQ ID NO: 102422 - DNA, 201 bp, Bos taurus; identical to SEQ ID NO: 21195

SEQ ID NO: 102423 - DNA, 201 bp, Bos taurus; identical to SEQ ID NO: 21196

SEQ ID NO: 102424 - DNA, 201 bp, Bos taurus; identical to SEQ ID NO: 21197

SEQ ID NO: 102425 - DNA, 201 bp, Bos taurus
gcaagagtcaaacatgacttagcagtctaaacaaccaccaccacaagcctctccttcctggctcacagggccattctcactatgtttttccatagtagaaaggtcagtggcgtcctctgggtctctgttgttgtttaggctgctaagtcatgtctgactcttttgtgaccccatggactgtagccttcaaagttcctcatt

SEQ ID NO: 102426 - DNA, 201 bp, Bos taurus; identical to SEQ ID NO: 21201

SEQ ID NO: 102427 - DNA, 201 bp, Bos taurus; identical to SEQ ID NO: 21203

SEQ ID NO: 102428 - DNA, 201 bp, Bos taurus
tattctcatcttgtctttcaaatggccaaagttgagagtttataccaattccatgaattgagatgtgagaaagtagtactatagtagctccttggtagctttcacagactgttattgcctctccaattgccattttgccctccatttttgctcacagatccctactcttttttagtgcagaaatacgtccagcagaatgga

SEQ ID NO: 102429 - DNA, 201 bp, Bos taurus
gaggggtggttaaattatttctacttttaatgtgagagttccaaataattggtccggttgacttatttttcatagtttgaaggtgctccgtgctattccaacctttgaaagaagcaaatttcaaaagtaactcagacaacataaaggagggcctatcttgcccattttctgctttcttctcaatctaaaatggaatctaat

SEQ ID NO: 102430 - DNA, 201 bp, Bos taurus; identical to SEQ ID NO: 21208

SEQ ID NO: 102431 - DNA, 201 bp, Bos taurus
ttgctgctttacaggagggccgggtgagtggagagttgagtatttgtttatcttctcctgttcgtccttctccatccctcaactcccccacccgccccccgcgatgatgccctaggccttctcttaaggagaaatggagaatttgacctgtctggaaaactggaaaactcaccctccatcttttggaaacaaaccactcaa

SEQ ID NO: 102432 - DNA, 201 bp, Bos taurus; identical to SEQ ID NO: 21209

SEQ ID NO: 102433 - DNA, 201 bp, Bos taurus; identical to SEQ ID NO: 21210

SEQ ID NO: 102434 - DNA, 201 bp, Bos taurus; identical to SEQ ID NO: 21211

SEQ ID NO: 102435 - DNA, 201 bp, Bos taurus
tggagtgggttgccattgccttctccgaaagagtagccttagctcactgcaattagagaagacctgtgcaacaataaaggcccagagcagccaaagataataaataaaaattaaaatacagactcctggacccctctctcaccatatctggatggcccagagacctacttttatccacattcccacgtcagtcttatgcac

SEQ ID NO: 102436 - DNA, 201 bp, Bos taurus
gatccaagatgagtggaggccaggatctggcttcccactctggaacctgaagcgaagcaggtgatccctctttggaccccttagacctgtgtgtggacatttggccaaggctcagccaatcagaggctctttggtgagactttgggtcttcagggagtgatgataaggctagagacagccataggtcattcatagtggctg

SEQ ID NO: 102437 - DNA, 201 bp, Bos taurus; identical to SEQ ID NO: 21212

SEQ ID NO: 102438 - DNA, 201 bp, Bos taurus; identical to SEQ ID NO: 21217

SEQ ID NO: 102439 - DNA, 201 bp, Bos taurus; identical to SEQ ID NO: 21218

SEQ ID NO: 102440 - DNA, 201 bp, Bos taurus; identical to SEQ ID NO: 21219

SEQ ID NO: 102441 - DNA, 201 bp, Bos taurus
aggttctcttaaacatgtgttactgtatttcccaattgggattttaatggttgctgttttaaatttaaaatattggagtgaaattacgtatctgcaacatcgtctttccttttagaaacagaatagatgctcactttaaagattgattctgctggatatattttgcaactagttacctaaatgaactgtcttactacatct

SEQ ID NO: 102442 - DNA, 201 bp, Bos taurus
tgtctgtcttctgcaaggaggggttcagttacaatctattttgctccttcactaagcttgtcctccagtctggcctttcatagtaataaaggtggtatttgaccctatacttgtctaacatcttgtttttgtggtttagtcactaagtggtgtctgactcttgtgaccccgtggacttggggacatagccagccaagctcc

SEQ ID NO: 102443 - DNA, 201 bp, Bos taurus; identical to SEQ ID NO: 21222

SEQ ID NO: 102444 - DNA, 201 bp, Bos taurus
tggtaaacattagcaaagagaagccttgcaaggagtttattttttctgagacagatcagtttaagaaacaacagtgaaggcttctttaccttgggcccacattgacttcaacctgtaggaacctgagagaaattcaggtttactcacattttatctggtcaaaaggcagtcttttcttagaactcatcttgagtgcaatca

SEQ ID NO: 102445 - DNA, 201 bp, Bos taurus; identical to SEQ ID NO: 21225

SEQ ID NO: 102446 - DNA, 201 bp, Bos taurus; identical to SEQ ID NO: 21227

SEQ ID NO: 102447 - DNA, 201 bp, Bos taurus
aaggaaagttgtactatttacaaaaataaagtcagagaagcagatttagaagggataaacagctttgtttcgaaaatgttttgaattgctgggaggccatccaagtgggtcttaagagggtgtgatgctcttgtaatgtgtcagcttggttgatacattgcaagcttggccatcctacattttttagaattcttagtttct

SEQ ID NO: 102448 - DNA, 201 bp, Bos taurus
ctcaaactggggatcaaattatatgcattttaagtacaaatcaataacttaaataattctttgacggattaattcattctttcattcagcagtacttatcgtgagaatgtaaagtgatacagccacagtggaaaacaatacagaggttccttaagaaactaaacacagggttataatatgatcctgtgatcctattcctgg

SEQ ID NO: 102449 - DNA, 201 bp, Bos taurus
tttaaacagtttttcaagttagagtatcagagatgttgctaagtgccagagatagtcactagaatctctttgatagataattgtgcctagaaaaagataagtaaactgttttctaactaaagtaggagtgcatgtgtgatagagagagaggaatgttgtacaatgatcttttttggtcttgaattactcaaaacacatttc

SEQ ID NO: 102450 - DNA, 201 bp, Bos taurus; identical to SEQ ID NO: 21235

SEQ ID NO: 102451 - DNA, 201 bp, Bos taurus; identical to SEQ ID NO: 21236

SEQ ID NO: 102452 - DNA, 201 bp, Bos taurus; identical to SEQ ID NO: 21238

SEQ ID NO: 102453 - DNA, 201 bp, Bos taurus; identical to SEQ ID NO: 21240

SEQ ID NO: 102454 - DNA, 201 bp, Bos taurus
tgccatcaaatttggaaaactcagcaatggccacaggactgggaaaggtcagttttcattccatatcaaagaaggcaataccaaagaacaggaaaactgccatacaattgaacttatttcacatgctagcaagttttaatgttcaaaaaccttcaaatatgtgaaccaagaatttccaaatgtacaagttaggtgtagaaa

SEQ ID NO: 102455 - DNA, 201 bp, Bos taurus; identical to SEQ ID NO: 21242

SEQ ID NO: 102456 - DNA, 201 bp, Bos taurus
gcattagaagacagagaaaagtggagagtttgggtcatcccccaaaagagcatccactgaatgctgtgtatagatttttttttaaattgaaaatatcaccgtgaggaatattgctgcagtatcgtgaaactttatgcaagataaccactgaatgttctactcctattggttgacctgaggaattattgcacatacacatat

SEQ ID NO: 102457 - DNA, 201 bp, Bos taurus; identical to SEQ ID NO: 21244

SEQ ID NO: 102458 - DNA, 201 bp, Bos taurus; identical to SEQ ID NO: 21247

SEQ ID NO: 102459 - DNA, 201 bp, Bos taurus; identical to SEQ ID NO: 21248

SEQ ID NO: 102460 - DNA, 201 bp, Bos taurus
cctacatctctccctgggaacaatacgaagacaagggccaacttctggatgtttgacctgtgcttgacttaacgctctgatgttgcctcttgatattcttaatagttttttaacaagaggccccacatttttatttcgtcctgggtcccacaaattttgtaagtggtcctagtaaggagattggctatggatggaggaaca

SEQ ID NO: 102461 - DNA, 201 bp, Bos taurus
cccagttatggttttgaatataaagaataagagaaaatgctaattttctattcagtccatacaaatcattaagtatgtttcctagtatggataaatatttattttccggtcctagatttggcagaaatgctgccactctgaaaccatctctgttttagtaacattcttctttcataaagttctcttagttctaacactatc

SEQ ID NO: 102462 - DNA, 201 bp, Bos taurus; identical to SEQ ID NO: 21250

SEQ ID NO: 102463 - DNA, 201 bp, Bos taurus; identical to SEQ ID NO: 21252

SEQ ID NO: 102464 - DNA, 201 bp, Bos taurus; identical to SEQ ID NO: 21253

SEQ ID NO: 102465 - DNA, 201 bp, Bos taurus
agaatgcagaacacaaatgaaagaaggacgaatgaaagagaagtgacacttcagaccagtagaaaattcctgatttgaagaaagactcatagattgagcaggctcagcttaatgaaaagacatcactataaagagaggctgctatttaaatagacttcaacattaggtagagaattccaagcaaaaggaaagatcatagag

SEQ ID NO: 102466 - DNA, 201 bp, Bos taurus
gccagttttagaaaggtatgctggcaataatttgactccacttcacacaaatcagaattctactacagattgaaaggagccatggcagctagaaattattctttaataggattttaaaaaatcacgttgctaatggttgaaaatgtaactggtaattaaagaatggttttaacaattttttttttaccatattttacaaga

SEQ ID NO: 102467 - DNA, 201 bp, Bos taurus
ggcgccaggcctgggctcgggcaccaggccactgaggctgagaggccactgaggctgagaggcgcgctccggcgggccgggcggccggcttcatgacgctcttccacttccggaactgctttgccctggtctactccccctactccaccacctacaagtacagtggcctgtctgagtccagtgccttctggaagtgtgtcc

SEQ ID NO: 102468 - DNA, 201 bp, Bos taurus; identical to SEQ ID NO: 21257

SEQ ID NO: 102469 - DNA, 201 bp, Bos taurus; identical to SEQ ID NO: 21258

SEQ ID NO: 102470 - DNA, 201 bp, Bos taurus; identical to SEQ ID NO: 21259

SEQ ID NO: 102471 - DNA, 201 bp, Bos taurus
tttgtcaaagcattcaccactttgtaatggattcactgctataactattgctgaaatcttcctttggacatccaagcgaaagagtttgcagcgtatatgtattctgttggacttacattagccaagtttatagaaacctctctctctctaatatatacatgctaaagtgtgtactaccagatggaatttcaggtgcctaca

SEQ ID NO: 102472 - DNA, 201 bp, Bos taurus
aagcctggcatgacaatcaataccaaaattacagctccatggtaagaaatgctgtcaacatggtaatgacttgtttaaacatttattaaatcacttcacagcaaatagtaacacatgaagtgttatcctcacatttcacagcgacatcactcctaagcagaaaaaacgctagccaaactgttttaaaatcttcatcaagat

SEQ ID NO: 102473 - DNA, 201 bp, Bos taurus; identical to SEQ ID NO: 21262

SEQ ID NO: 102474 - DNA, 201 bp, Bos taurus
aatagattattcgtgttcttgaagaactgtaatgttctagtgagctacaacttagaaaaaaattacattataagtcttggtttataatttaagtatgttcaattcaagattagtttttccacacaagtagttataacgagacattaagatcccaaaccagctactgaaaccctttaactcttcatccgactattatggatt

SEQ ID NO: 102475 - DNA, 201 bp, Bos taurus; identical to SEQ ID NO: 21265

SEQ ID NO: 102476 - DNA, 201 bp, Bos taurus; identical to SEQ ID NO: 21266

SEQ ID NO: 102477 - DNA, 201 bp, Bos taurus
gtgtatagagagtgttgggctagggtctggtctacacaggaaatggtcaagctcttttaggagagcttcctgtacagaggacacttgcactagtggtagcagtgacagagggtggcaggtcttcctggaatgctctcagtctgatatcacctcagatgtcatcagtataggaagtagctcaaccactcactctgcagtcta

SEQ ID NO: 102478 - DNA, 201 bp, Bos taurus
cctccctgtagtttggcctaaggacaaactaaggtaggggtaatgggggtgatggcaacctccttcaaaaggactcatgccaggactattatatttggtgcccctcatctcatggagggccactgtcaacccacacctctgccagagacttctgaacactcctggacacttacaggcaagtctagctcagtctcttgtggg

SEQ ID NO: 102479 - DNA, 201 bp, Bos taurus
actttatgctcacagaagcagctagctaatatgagtcagacaccagtttaagtatcctcagaactcgaggagatacacagaaagttctctatgtagatcaattaaacccaggtttgattcctaggtcgagaagatcccctggagaagggcctggaaacctactctagcattcttgcctggagaattccatggacagaggag

SEQ ID NO: 102480 - DNA, 201 bp, Bos taurus
tcatgtaactgaataaacagaatgacgctgagtcgatgctgccatgtctaccagcacactgtgcaaaagagacgaatgcaaacttggtaggcagacgagtgtgggatagagttgagttatctaggtttacttggataaccaggaccaaattcctggctttgtgtttttgcataatacttgcatttatttttaagatctatg

SEQ ID NO: 102481 - DNA, 201 bp, Bos taurus
acaggaactatagtctactgtgacctggagaggttgtagaaacttcatgaaagaattggaacttgggcagcatatttaagaatggacaggattaagcttttaggtaagggtagcgaggaagaaaggcataggaagtgattttgagcatgagagcgagttgtgatgttcaagatagatgactctcccaatatgataaaggac

SEQ ID NO: 102482 - DNA, 201 bp, Bos taurus
ctagaatttctaaaaaaaaaaaaaagtaaagctattttacccctaatcatagacaagcattaaagatcttaaaacatgactgtgatcaggcaattttttttctggcatacttttaagtgaatactagtgtctgcacaatttagaatgaagacctgatgttctaatacatcccatatagtctcattttgaaagccatcagct

SEQ ID NO: 102483 - DNA, 201 bp, Bos taurus; identical to SEQ ID NO: 21267

SEQ ID NO: 102484 - DNA, 201 bp, Bos taurus; identical to SEQ ID NO: 21268

SEQ ID NO: 102485 - DNA, 201 bp, Bos taurus; identical to SEQ ID NO: 21269

SEQ ID NO: 102486 - DNA, 201 bp, Bos taurus
cttttcaattgcgtaaagcatgcatttcagtagatgtagtagcttactcacatgtgtgcactgatcagtactcagccaaaaactcaagattaatgcactatagatctccagagcatttttctttttgcttctgtgcagctctctccttccaacatactgctgcacaaatgtgaggaaatcctagccaggaaagcctcccta

SEQ ID NO: 102487 - DNA, 201 bp, Bos taurus; identical to SEQ ID NO: 21271

SEQ ID NO: 102488 - DNA, 201 bp, Bos taurus
atccagagttgccacaatatatgatctaaagtatctacttttcaacaagatattataagatatgcaaggagggaaaaagtggccaatagaaactgggtatatctagatattgaatttaaacacagtctttaaagcagaattataaataaattcaatgaaccaaaggtgaccacacttaaaaaacaaaacgaaagtaaggca

SEQ ID NO: 102489 - DNA, 201 bp, Bos taurus
cacctccagggtgtggcctgtgctgtctccagggcccacctgcaagactgagccagctgccctctgcgatttcatttggtatcacatccttgctgggcttacttcctttctggccctgcactcccaaccttctatttgctttcctgagcaaatttcctaataagtcacattcataagaatgagtcctctcaaggtcagctt

SEQ ID NO: 102490 - DNA, 201 bp, Bos taurus; identical to SEQ ID NO: 21272

SEQ ID NO: 102491 - DNA, 201 bp, Bos taurus; identical to SEQ ID NO: 21273

SEQ ID NO: 102492 - DNA, 201 bp, Bos taurus; identical to SEQ ID NO: 21274

SEQ ID NO: 102493 - DNA, 201 bp, Bos taurus
cacaattcagtgatatgtccaggaaaagcaactgtcgttgccaagctcctgggttttctgccttcagcctggctctctgctcgcttgcctggcccagtggtcagtcaccagttctgagagcttggtgcactctgtgtcctggtggtgaccggagctggactcactacacacgtgcttctctaggactgccttctgaaggta

SEQ ID NO: 102494 - DNA, 201 bp, Bos taurus
tgagcatctggatttgctcttccctaatcagatatctttccagctcctccaagtaggtcggcctcactcagcctgtcttgcttagctgccgtggccatcataactgagataccagagactaaaccgcaactccacaggtggtcccagggctcctggagtgatgctgggctctctagcaactgcacatcttttccagctatg

SEQ ID NO: 102495 - DNA, 201 bp, Bos taurus; identical to SEQ ID NO: 21275

SEQ ID NO: 102496 - DNA, 201 bp, Bos taurus
atgcagccccaagggggcttgggagtggctgagagcaccgatgaactctaagaagcttgaacccatgttaggatctcaggcagtagcagaagtcgtgggcgtaacatccaatttctaaagggtaggaaagacaatttaaatagctgatgccagcagagaatagagaatgcctattgaccagacacatgcacaccctgtcaa

SEQ ID NO: 102497 - DNA, 201 bp, Bos taurus; identical to SEQ ID NO: 21276

SEQ ID NO: 102498 - DNA, 201 bp, Bos taurus
gaggtgctcccctttctgctctgggccatgggaggatacaagtgtgacttgactatctgcatcccagaagagggctctcaccagaacctgagcatgttggcaccctggtcttggacttctggcctgtagtagtcctgtgggaaatgaatgtctggtgtttcagttcactcagttgtgtccaactctttgtgaccccatgga

SEQ ID NO: 102499 - DNA, 201 bp, Bos taurus
gtgaagtatggcccatatagcaaatataaaaacacaatgtaaaaagtgctaaaaagcattgctgtcaaggtgctgtgaagcagtgcaagtttgagggaagtgggatgaggttaagatgggcctgtttttctgggaataaacattagtaaaatgagtcccttaaaggagatctgtaaccagtcagttcaaggccggactctc

SEQ ID NO: 102500 - DNA, 201 bp, Bos taurus; identical to SEQ ID NO: 21277

SEQ ID NO: 102501 - DNA, 201 bp, Bos taurus; identical to SEQ ID NO: 21278

SEQ ID NO: 102502 - DNA, 201 bp, Bos taurus; identical to SEQ ID NO: 21279

SEQ ID NO: 102503 - DNA, 201 bp, Bos taurus
cggtgcagccatggctccttggacatggggtagttcctcccggccaccgcccctgacctcgggtgtggggtagcttctctcgccacgcttctgcatggtctgtcgcagccaggctgggccaaaaagaaaaaaagattaatataaagtagtcttatgggttaaacattcttttcagaattttgaccctagaatataatacct

SEQ ID NO: 102504 - DNA, 201 bp, Bos taurus; identical to SEQ ID NO: 21280

SEQ ID NO: 102505 - DNA, 201 bp, Bos taurus
acacacaggccttggggactgctcactcttgctctagacatcccccagaacttggcatgtctctgctgtccgtggcatcgtgcctcaagcatctgcattcggtgcacaaggccaagtccatcaggagctcgaggaagctaatggcttgtcattagccgctggcatcccgtgtgaaagggctggtctgtggctttgtgtgct

SEQ ID NO: 102506 - DNA, 201 bp, Bos taurus
gctgtcaagcctgtcattcaggtggtggggggcatttgctggtatgactccgagtccaagtctcagcaagcgacttgcagagtttgtgtgtacggcctgcaagctctggtcagtgtcaccaacacctcggtttcatcctgacagcaagccatcagcacaaagaatgccacacaaaccaggccctgatgctaattgtccccc

SEQ ID NO: 102507 - DNA, 201 bp, Bos taurus; identical to SEQ ID NO: 21281

SEQ ID NO: 102508 - DNA, 201 bp, Bos taurus; identical to SEQ ID NO: 21282

SEQ ID NO: 102509 - DNA, 201 bp, Bos taurus
aaaccttcacattgctttgctctaatgagatgagggaaataaagagtgtttccttcactctataaagtcacaagtctgctaaatggtagaggtggatgtcattctggaaacccaagcctagagctgcttcgtcttctgtaacatatttcttggtgttagtccaaactgtggtgcatacagatttagcactggtttccttag

SEQ ID NO: 102510 - DNA, 201 bp, Bos taurus
aacagcttacacagcactatggtggggacactctttattgtattttggagggttctcaagttctcaccaatattcaggccggtgcggttcgcctctgagcccctattttagttactgttgccttccttttgccccatatgtcattatttggggccttagttaaatcttctggacaaatattaccatatttacaacctcata

SEQ ID NO: 102511 - DNA, 201 bp, Bos taurus
tttatttgattcaaggaaaaaaaaaaaaaaaaggattgggacaagaacatcaggtaaggttttaaagaggagttgagagggcatttagaaataaagcactattgtagtcagagctcagagaagagagtatcatccttcactttccaggaaagaaggtaaggaggtaatatggtccatgggcaaaattagtgggagtttaag

SEQ ID NO: 102512 - DNA, 201 bp, Bos taurus
ggaaatggcaacctgcttccagtattcttgcctgagaaatcccatagacagaggaacctggtggtctatagtccatggggtcacaaaagagtcagcaggacttagggactaaacaacagtgtctgaccaggaaagaacataattccaggccaatggaatttggagtttttcttgaaggagtttaagtgtggtggggataag

SEQ ID NO: 102513 - DNA, 201 bp, Bos taurus; identical to SEQ ID NO: 21285

SEQ ID NO: 102514 - DNA, 201 bp, Bos taurus; identical to SEQ ID NO: 21286

SEQ ID NO: 102515 - DNA, 201 bp, Bos taurus
catctctaagctccaaatccaccaggccgtggtgtaaacaaaacaaacaaaaagcactctcccccaaatcaagaatgatcctttaatcaacaagttccaagggcctgcttcccacaggtcacttttaaagaaattccagtcttttgctctaatttcacccttcagtagtcataaaacctgcagaaaaatttatgagttcac

SEQ ID NO: 102516 - DNA, 201 bp, Bos taurus; identical to SEQ ID NO: 21289

SEQ ID NO: 102517 - DNA, 201 bp, Bos taurus; identical to SEQ ID NO: 21290

SEQ ID NO: 102518 - DNA, 201 bp, Bos taurus; identical to SEQ ID NO: 21291

SEQ ID NO: 102519 - DNA, 201 bp, Bos taurus
agtctaaagggtttctttgcagagataaatgtctccagagagactgatgagtcaaggagtctgttaataggataagtaaatgtaacctttcacctagttactgctattacctaagtcataactacgtagttttagcaaattgtttgaactcgttccagttacttaataaaacagagcatattggtcccattcttttctagt

SEQ ID NO: 102520 - DNA, 201 bp, Bos taurus; identical to SEQ ID NO: 21294

SEQ ID NO: 102521 - DNA, 201 bp, Bos taurus; identical to SEQ ID NO: 21295

SEQ ID NO: 102522 - DNA, 201 bp, Bos taurus; identical to SEQ ID NO: 21296

SEQ ID NO: 102523 - DNA, 201 bp, Bos taurus; identical to SEQ ID NO: 21297

SEQ ID NO: 102524 - DNA, 201 bp, Bos taurus
acagggcagagacacaggaggatctcacatcaacaattaattgccagtgctttccaaaacagctcatccagaattaggttgggaggcctacttgaatacaatatgccagaaagagcaatcagttcagttcagtctctcagtcgtgtccaactctttgtgcccccaagaaccacagcacaccaggcctctctgtccatcacc

SEQ ID NO: 102525 - DNA, 201 bp, Bos taurus
gggggttaactagcagtatctgccatgcctaacagtatagattagtaacagtgacattggtaaaaattgggatggtttaaaagaaccaggaacaactgagcggaaatagaccttcccaagccatccggactctctgtctcttgtctcctcttgtgcacatttttcatgttttcttctcaggctttctactccatattgcac

SEQ ID NO: 102526 - DNA, 201 bp, Bos taurus
ccatgacattttccaggcaaggatactggagtgggttgccatttccttatccagcaaataggatagatttatttaaattactacttaaagagaatatttcaattaaagaaagcaaatgtaccataaatacatataaaatattcatatttataataaaacataattttttgcagtaaatgtatatataatactcaaaattgt

SEQ ID NO: 102527 - DNA, 201 bp, Bos taurus
ttttttttttttccagaaaacataatttggagccatgtaccctacctttcataaatctttgacttcataggtttcctctcttgatctaagacctccatttttatggtagtactttcattagtataaccaactagtttgaagttgtaatggggttttgtcaagttacttgacatcctcagacagtactttcttctgtgtgta

SEQ ID NO: 102528 - DNA, 201 bp, Bos taurus
tgttaaagttgtggggcataaaaatagagcttgaatagggactgattcactagattattttaacccaaaggctttcctccaatttacaaaggaatcagcatggtgctgaagcccactgtttaaataaaatatactgactgccaaaggaagaaaagactcttaagtcacagacacactttcaaagcctcaaaagactctgtc

SEQ ID NO: 102529 - DNA, 201 bp, Bos taurus; identical to SEQ ID NO: 21298

SEQ ID NO: 102530 - DNA, 201 bp, Bos taurus
tagctcagttttgtctttgtaaattacttttgtaagtcttcttagaaaagtttctaatttctagttcatttttgcaataacctgcatttccatcaatagcttttcttcattttttctgtattttaatttcctccttttgaacttagtgtctgtttagacagatgaggtctgtttcattgttccttcaggggaattttcttg

SEQ ID NO: 102531 - DNA, 201 bp, Bos taurus
gtgtgcactggcttatttaggcaatgttcaatccttactatatagtctcatttcctactgagattttccgtttcctgtagattcttacttctcttccaattggagaagaccctttaatatttcttgtagggcaagcttagtattgctgaattttttcaatttttacttgtttgagaaattatttctattatacatgacaat

SEQ ID NO: 102532 - DNA, 201 bp, Bos taurus; identical to SEQ ID NO: 21299

SEQ ID NO: 102533 - DNA, 201 bp, Bos taurus
attccttattttatagacacaaaagctatacttttcaactgtatctggtattggcacacagtattcatagcatatattctgaaataaaatcaatctcatacataaaattatacagttttgaggtaatataacatattggctagaaacagctcatcaacttcatatcattttgtttcctttcaataatgtatttctttcata

SEQ ID NO: 102534 - DNA, 201 bp, Bos taurus; identical to SEQ ID NO: 21300

SEQ ID NO: 102535 - DNA, 201 bp, Bos taurus; identical to SEQ ID NO: 21301

SEQ ID NO: 102536 - DNA, 201 bp, Bos taurus; identical to SEQ ID NO: 21302

SEQ ID NO: 102537 - DNA, 201 bp, Bos taurus; identical to SEQ ID NO: 21303

SEQ ID NO: 102538 - DNA, 201 bp, Bos taurus
tcaatgtgttgttctcctgatgacgaatgacttagtcatcagcaaaagtaacagtggcacatatattgtggttatttaggtcacacgacatgcaaaaaaatgccacttcattaggacagaaattatgttgtgggttttaagtgctcagaaataagagtgagacgaattgatttctctgaagcaaaccctgggaggagaaac

SEQ ID NO: 102539 - DNA, 201 bp, Bos taurus; identical to SEQ ID NO: 21304

SEQ ID NO: 102540 - DNA, 201 bp, Bos taurus; identical to SEQ ID NO: 21305

SEQ ID NO: 102541 - DNA, 201 bp, Bos taurus; identical to SEQ ID NO: 21306

SEQ ID NO: 102542 - DNA, 201 bp, Bos taurus
atgtataattcttagaatcaaaccggaataacagtcggtagctgtcatttcatgcttcgctttgactttctctgttgggaagatcagagtacactctttcgatgtgtagccccgcgcccagcagagcagggtcaagaacaataagcagtatgcactcttgttggcaacacgcctgtcagtattagcaagaggaatttagcc

SEQ ID NO: 102543 - DNA, 201 bp, Bos taurus; identical to SEQ ID NO: 21307

SEQ ID NO: 102544 - DNA, 201 bp, Bos taurus; identical to SEQ ID NO: 21308

SEQ ID NO: 102545 - DNA, 201 bp, Bos taurus; identical to SEQ ID NO: 21309

SEQ ID NO: 102546 - DNA, 201 bp, Bos taurus; identical to SEQ ID NO: 21310

SEQ ID NO: 102547 - DNA, 201 bp, Bos taurus; identical to SEQ ID NO: 21311

SEQ ID NO: 102548 - DNA, 201 bp, Bos taurus; identical to SEQ ID NO: 21312

SEQ ID NO: 102549 - DNA, 201 bp, Bos taurus
aacaaaacagagtgtggttattaataaattaggtaatccttggagaagtagatcaaccagttctctactcaccttcaccttactttacaatattttgggggaaaaaagagagacacaaaattaggaaaatatctaagtgatttatttcctgatttcagtttggggaagaacttgttaagctgaaaaggaaatggaaataat

SEQ ID NO: 102550 - DNA, 201 bp, Bos taurus; identical to SEQ ID NO: 21313

SEQ ID NO: 102551 - DNA, 201 bp, Bos taurus
tgcattatgggggatgtaaaatgaatcagatggtggattctgccctcaaagaacttaaagggctatgaactatcaattctcattatgagggttcagagaaggtgaaatgacttctggctgagattaatttgagaaagtgtgtggaactgggtgtggagaaaagcaaacagctccttccctgtagcagaagcacacagagca

SEQ ID NO: 102552 - DNA, 201 bp, Bos taurus; identical to SEQ ID NO: 21314

SEQ ID NO: 102553 - DNA, 201 bp, Bos taurus; identical to SEQ ID NO: 21315

SEQ ID NO: 102554 - DNA, 201 bp, Bos taurus
gatgatgtggggaataacgaggaaatcatccaggatagagagaaaaagacaagtgtatgatgagaagtccttggggaataatgcccacattacacactcatattttgagtatgctttcccactgccttgcagcctccattgtttctgctgagaagttagttattaatcttcttggagttctcttgtacatggtgattcatt

SEQ ID NO: 102555 - DNA, 201 bp, Bos taurus; identical to SEQ ID NO: 21316

SEQ ID NO: 102556 - DNA, 201 bp, Bos taurus; identical to SEQ ID NO: 21317

SEQ ID NO: 102557 - DNA, 201 bp, Bos taurus; identical to SEQ ID NO: 21318

SEQ ID NO: 102558 - DNA, 201 bp, Bos taurus; identical to SEQ ID NO: 21319

SEQ ID NO: 102559 - DNA, 201 bp, Bos taurus
agcccagtgggatgcagtgcctagggttgcaaagagctggacatgaatgaatgacttcactttcactggagacacagctccatcacaggccacaaactcaccagtcttgagtgaggaaacagaggataatttaacaagatgtacattcagttcaggtcagttgctcagtcatgtctgactcttttgacctcatggactgca

SEQ ID NO: 102560 - DNA, 201 bp, Bos taurus
tgaatggaaatcagaattattgggccatatatcctcaaaggcagaaggagtgccattattaaaagactcttctccatactgtggactttaggcaagctcaagttatgattaaagtcatatgcattatgtgcgttaagtggaggaggccaccagggtaaaatcggcaagcatgcagcaggccaagttcactcagtgctcaca

SEQ ID NO: 102561 - DNA, 201 bp, Bos taurus; identical to SEQ ID NO: 21320

SEQ ID NO: 102562 - DNA, 201 bp, Bos taurus; identical to SEQ ID NO: 21321

SEQ ID NO: 102563 - DNA, 201 bp, Bos taurus; identical to SEQ ID NO: 21322

SEQ ID NO: 102564 - DNA, 201 bp, Bos taurus; identical to SEQ ID NO: 21323

SEQ ID NO: 102565 - DNA, 201 bp, Bos taurus; identical to SEQ ID NO: 21324

SEQ ID NO: 102566 - DNA, 201 bp, Bos taurus; identical to SEQ ID NO: 21326

SEQ ID NO: 102567 - DNA, 201 bp, Bos taurus; identical to SEQ ID NO: 21327

SEQ ID NO: 102568 - DNA, 201 bp, Bos taurus; identical to SEQ ID NO: 21328

SEQ ID NO: 102569 - DNA, 201 bp, Bos taurus; identical to SEQ ID NO: 21329

SEQ ID NO: 102570 - DNA, 201 bp, Bos taurus; identical to SEQ ID NO: 21330

SEQ ID NO: 102571 - DNA, 201 bp, Bos taurus; identical to SEQ ID NO: 21331

SEQ ID NO: 102572 - DNA, 201 bp, Bos taurus; identical to SEQ ID NO: 21332

SEQ ID NO: 102573 - DNA, 201 bp, Bos taurus; identical to SEQ ID NO: 21333

SEQ ID NO: 102574 - DNA, 201 bp, Bos taurus; identical to SEQ ID NO: 21334

SEQ ID NO: 102575 - DNA, 201 bp, Bos taurus; identical to SEQ ID NO: 21335

SEQ ID NO: 102576 - DNA, 201 bp, Bos taurus; identical to SEQ ID NO: 21336

SEQ ID NO: 102577 - DNA, 201 bp, Bos taurus; identical to SEQ ID NO: 21337

SEQ ID NO: 102578 - DNA, 201 bp, Bos taurus; identical to SEQ ID NO: 21338

SEQ ID NO: 102579 - DNA, 201 bp, Bos taurus; identical to SEQ ID NO: 21339

SEQ ID NO: 102580 - DNA, 201 bp, Bos taurus; identical to SEQ ID NO: 21340

SEQ ID NO: 102581 - DNA, 201 bp, Bos taurus; identical to SEQ ID NO: 21341

SEQ ID NO: 102582 - DNA, 201 bp, Bos taurus; identical to SEQ ID NO: 21342

SEQ ID NO: 102583 - DNA, 201 bp, Bos taurus; identical to SEQ ID NO: 21343

SEQ ID NO: 102584 - DNA, 201 bp, Bos taurus; identical to SEQ ID NO: 21344

SEQ ID NO: 102585 - DNA, 201 bp, Bos taurus; identical to SEQ ID NO: 21345

SEQ ID NO: 102586 - DNA, 201 bp, Bos taurus; identical to SEQ ID NO: 21346

SEQ ID NO: 102587 - DNA, 201 bp, Bos taurus; identical to SEQ ID NO: 21347

SEQ ID NO: 102588 - DNA, 201 bp, Bos taurus; identical to SEQ ID NO: 21348

SEQ ID NO: 102589 - DNA, 201 bp, Bos taurus
catagagactgaaagttgaggggacgattcatgcagggcaatgtcaaatgcactcgcctgacacgggctagagaggagtcctcagcatgcccagctatgatgaggccaattagaagacttcagatcaagcaatgcttaagccacagtcagtcctcaggagtgaggacctggattgtgactgtggagagagcaaagaggaag

SEQ ID NO: 102590 - DNA, 201 bp, Bos taurus; identical to SEQ ID NO: 21349

SEQ ID NO: 102591 - DNA, 201 bp, Bos taurus; identical to SEQ ID NO: 21350

SEQ ID NO: 102592 - DNA, 201 bp, Bos taurus
tttcttctctctccatggccacatgcccagagaggagggtgtaatataagaagcagagaaaaagatttgagatgggaagaaatcgcgtgaagggagcatctggccaagatgcgggtccagacagcaagggaaatgggtgccagtgttcacggtgggggcacctgctgcaatctctcctgtggtcgggctgcaggttctctg

SEQ ID NO: 102593 - DNA, 201 bp, Bos taurus; identical to SEQ ID NO: 21352

SEQ ID NO: 102594 - DNA, 201 bp, Bos taurus
tctaggtgggaaccccaaagcactctgcccaggggctctaatagaaggccctaggtccagcctctctctctgtcacaccagccttgacccctctacccccaccccaagcccctgtgcttctgtggcctcctcctcccggaccggtgatcaagaagcttctctatttcggtctccttgcgctcacctcagacaccccagggg

SEQ ID NO: 102595 - DNA, 201 bp, Bos taurus
agcctgaagatgactctgtcagtcccaaaacaggactgtctgctccagcgtggggtcattcctggatgtgactatatttggatgtccctctgcacaacagctcagctggtagagaatccacctgcaatgcaggagatcctggtttgatttctgggttgggaagatctactggagaagggataggctacccactccagtatt

SEQ ID NO: 102596 - DNA, 201 bp, Bos taurus; identical to SEQ ID NO: 21354

SEQ ID NO: 102597 - DNA, 201 bp, Bos taurus; identical to SEQ ID NO: 21355

SEQ ID NO: 102598 - DNA, 201 bp, Bos taurus; identical to SEQ ID NO: 21356

SEQ ID NO: 102599 - DNA, 201 bp, Bos taurus
ccattaacttacaggagtctcccacatttttttctacttacagtcccagagtgggattacctgtttgatcacttactttgtcctttgctctgtccctgtctaaaccagccttcttgcatgaccattcactatcttatcttgcaaaacatatactgggagtgctgaaacattatggaaattatgtagttgttaatgaaactc

SEQ ID NO: 102600 - DNA, 201 bp, Bos taurus
tggcactgtaatgacatctgtaactgcctgtgaaaaggtaacacaactcacaggttaaatttgagcacaaacaaattcaaatgagtaatgttttgcacagagaacaacaaacagttttctgcaaatgtgtgctatttctagagaggtggaagagacaggcgttgaatatttcttttgccatctatattaggttatggtcca

SEQ ID NO: 102601 - DNA, 201 bp, Bos taurus; identical to SEQ ID NO: 21358

SEQ ID NO: 102602 - DNA, 201 bp, Bos taurus; identical to SEQ ID NO: 21359

SEQ ID NO: 102603 - DNA, 201 bp, Bos taurus; identical to SEQ ID NO: 21360

SEQ ID NO: 102604 - DNA, 201 bp, Bos taurus
tctcagaccatagagagagccccaaagaatgcaagtgtctagggctgtcctcaatagaccttcacaccagcacatcacaggaatagtcacactcatttgcccttgtcccagacttagaagagataagattcattaaaacaaagactactccgtgttctaatgactactaaagcaaaatgagtctctccaaaacttattttg

SEQ ID NO: 102605 - DNA, 201 bp, Bos taurus; identical to SEQ ID NO: 21361

SEQ ID NO: 102606 - DNA, 201 bp, Bos taurus
gtgggtacaggccttcaaagccctacttgatctagaaatcttttagacccactgtaatagaagggataaggtaccattggcctgctatggggagagccacagtcttcccctcagcccttcctgtgacgacagccctcccctcacaggtctgagggccagtgtggagatctgaccagctgcctattctggttgggcaagcct

SEQ ID NO: 102607 - DNA, 201 bp, Bos taurus; identical to SEQ ID NO: 21362

SEQ ID NO: 102608 - DNA, 201 bp, Bos taurus
ttgctgcgtcttcacctgggggaagggtgaatgagtgctctgctgcctttttcataagggcactagtcccattcatacacactgcacacttatgacctcatcacctccaaaggcctcacctccaaacaccatcatactgggggttgggtttcgacatttgaattttggaggatgccaaaattcaatccacagcagtgaggc

SEQ ID NO: 102609 - DNA, 201 bp, Bos taurus
tgggccacagtccatggggtcacaaagagtcagatatgactttgcaaataaacaacaataagattctttaaaaacacctgacaggttaggaaagagatcagaggaaaagagcattaaggcccctccatgtggcttctctacgggacctttgcccctcctggcctggggactgagtgctcacagggaagctcagagctctga

SEQ ID NO: 102610 - DNA, 201 bp, Bos taurus
cagtatctcattgtgcttaactcaactgggtaacttccctagaaacagttgcagaaagtaaaggggagtatttctgtcagttgccagcatccttctcttatattgtaaccttcttttcactgaaaataaatagtaagatctctcttttttttttttttaagtttgtttccctttgtcctctgtcttcaacaataaaagtta

SEQ ID NO: 102611 - DNA, 201 bp, Bos taurus; identical to SEQ ID NO: 21364

SEQ ID NO: 102612 - DNA, 201 bp, Bos taurus; identical to SEQ ID NO: 21369

SEQ ID NO: 102613 - DNA, 201 bp, Bos taurus; identical to SEQ ID NO: 21370

SEQ ID NO: 102614 - DNA, 201 bp, Bos taurus; identical to SEQ ID NO: 21371

SEQ ID NO: 102615 - DNA, 201 bp, Bos taurus; identical to SEQ ID NO: 21372

SEQ ID NO: 102616 - DNA, 201 bp, Bos taurus; identical to SEQ ID NO: 21373

SEQ ID NO: 102617 - DNA, 201 bp, Bos taurus
gtgaagtcaagtgggccttaggaagcatcactccgaacaaagctagtggaggtgatggaattctagctgagctacgtcaaatcctaaaagataatgctgtgaaagtgccgcggtccatggggcctgtcttagggacttctgaacaacagtaaccacgcgaacagtagacggcaatagagttcaacagtaatgagagaggct

SEQ ID NO: 102618 - DNA, 201 bp, Bos taurus
acccgagcactatgggaggaggttggccctgcccagcgaaggccacgttcagagtgcctcaccacctcagcagggatccactggcccaaagtaaagtcacgtgcactctggtatgagctctgaatcatgtgaccaacatataagcacaagcctgcccagggcaacggtgctgaggatccctgggcctgggtaggaggacac

SEQ ID NO: 102619 - DNA, 201 bp, Bos taurus; identical to SEQ ID NO: 21374

SEQ ID NO: 102620 - DNA, 201 bp, Bos taurus; identical to SEQ ID NO: 21375

SEQ ID NO: 102621 - DNA, 201 bp, Bos taurus; identical to SEQ ID NO: 21376

SEQ ID NO: 102622 - DNA, 201 bp, Bos taurus; identical to SEQ ID NO: 21377

SEQ ID NO: 102623 - DNA, 201 bp, Bos taurus; identical to SEQ ID NO: 21379

SEQ ID NO: 102624 - DNA, 201 bp, Bos taurus; identical to SEQ ID NO: 21380

SEQ ID NO: 102625 - DNA, 201 bp, Bos taurus; identical to SEQ ID NO: 21381

SEQ ID NO: 102626 - DNA, 201 bp, Bos taurus
ccttcttgccgaatacagtgcctagcacagattcacattcccagagggagttatcaagagcatcctgattccaaaagagctctgacttggggaagaaaaaatacagtgtttgtccttagtggccagttctgcccaaaccacccctggggtgcagggcagagaggcgcaacagaaaaaaagacagctctcacagggggagct

SEQ ID NO: 102627 - DNA, 201 bp, Bos taurus; identical to SEQ ID NO: 21382

SEQ ID NO: 102628 - DNA, 201 bp, Bos taurus; identical to SEQ ID NO: 21383

SEQ ID NO: 102629 - DNA, 201 bp, Bos taurus; identical to SEQ ID NO: 21384

SEQ ID NO: 102630 - DNA, 201 bp, Bos taurus
tcaaggtggaagaatgtcacattaagtgaaataaatccctaagtttgttctgacaaagaatccagttatcccaatgaagacccatgtaactttcttacctggtcttttcattcgggaaaacataagtcttgctttacatcaatgaaaaaccatggtgatatgtgtttgaactttaaaagcaatgtctactagtttacattc

SEQ ID NO: 102631 - DNA, 201 bp, Bos taurus
ctagactgttgaatttagtggtataaccatgctccaaatattcctcactgtctgtaggatctatagtgcaacctctctttcattcctaaaactcttcatcagtttaactaagagtttatcgattttatttatatttcaaagaatcgacttttgaccatgttgattttccttattgtttgtttcttattatattgattttga

SEQ ID NO: 102632 - DNA, 201 bp, Bos taurus
tgttcaggcctcctctgtacctcctcccatcttctctagctcctagcaggtaactctgatttttactaaagcctacctttacaactctaacttctcttatgtcactcagggcctccagagatgtaaagtatcttcagttgttttccagtgctgaattaacagagttttaaaaatgcttgcagctcattagggttcattagg

SEQ ID NO: 102633 - DNA, 201 bp, Bos taurus
tgtgtttataggcaatagagggctgtaaggaagctgctcagctcttagctaaggtgggaggaggcaccaagaggttcagtttggagaggaaaggccttcaatactaggcttcaggaagattcatcatcgagaggtgtgaaaagaagcctgtgcatgaagaagccaggcatggggagggtctccacccacctctcccagctc

SEQ ID NO: 102634 - DNA, 201 bp, Bos taurus; identical to SEQ ID NO: 21385

SEQ ID NO: 102635 - DNA, 201 bp, Bos taurus; identical to SEQ ID NO: 21387

SEQ ID NO: 102636 - DNA, 201 bp, Bos taurus
acaaaaataagccttcagtaaatgtattggctcatcaaaccatttatgttggattttttcctggaatataataagaagttatgaagatgatttattgctcatgtaattcaaattgttgtcattcaaactttaggttatgaatattgtttcattaattttagtgctaatgttgtctgaatagctgccatgttatgtttttga

SEQ ID NO: 102637 - DNA, 201 bp, Bos taurus
tgcaggcagcatcagaaaatccacagaggagtctggctttgggggccattggtagcattggagacttgactgtataatgcccagcgtcagccctgtgaactgcagagcagtgtccaacataagggccaggagttcattgttggagcagcctcagacctaactgtgatcctactgatcacagtctgagagcatttatgtatc

SEQ ID NO: 102638 - DNA, 201 bp, Bos taurus
cacagccacctccatttattatttgttgtctaagcctgctttcatgatacaaatggcaggattgcatagttgtgacaaagactatagtcctacaaagccaaatgttgatatctaaccctttataacaaatagttcgctgattcataatctaagatagcactatctattagagtatagtgtgagtctttaagtgggtttatg

SEQ ID NO: 102639 - DNA, 201 bp, Bos taurus; identical to SEQ ID NO: 21388

SEQ ID NO: 102640 - DNA, 201 bp, Bos taurus; identical to SEQ ID NO: 21389

SEQ ID NO: 102641 - DNA, 201 bp, Bos taurus
gactctttctggagagaggtcattatctgatgtctttggtcatttgctacgttagaagtttagatcaatttcatctgattctttctgtttaccctttcttgagggttatttttggggttctctcagaaccctcacagcctgtccttgtaacattgtagtatctaagattgctatactgtctgatatttatgttttttgtga

SEQ ID NO: 102642 - DNA, 201 bp, Bos taurus; identical to SEQ ID NO: 21390

SEQ ID NO: 102643 - DNA, 201 bp, Bos taurus; identical to SEQ ID NO: 21391

SEQ ID NO: 102644 - DNA, 201 bp, Bos taurus
aatttctagaaaaaagaaccaaagcaaggaaatgactacagatttattcataatgaaattaagaaaaggatttcttaaacttgtactagaaagtaaaatgaatggatttggatattaaagtgccattagcacttgacaactgataaaatcaacccttttattaaacaccttctaaatccaagtactagtgagctagataac

SEQ ID NO: 102645 - DNA, 201 bp, Bos taurus
actctttgctttctgtggcctcgtctttttctggccctccctggcttaactttctcccaatttccttcagttgccctcctcttcccatgctgctgctgctgcttccctcactcaggccagccagagacccttttagacagcagtatggctccaggatcttgtgtcataggatgttgcagatttgccatctagtaatggccc

SEQ ID NO: 102646 - DNA, 201 bp, Bos taurus; identical to SEQ ID NO: 21392

SEQ ID NO: 102647 - DNA, 201 bp, Bos taurus; identical to SEQ ID NO: 21394

SEQ ID NO: 102648 - DNA, 201 bp, Bos taurus
ttccagggtggttcttgtattgttaatggctgagttaagttttcatgaactgaggtatatggtccctgtcactgtatgtctcagagtcccaggctagcccctcactaaggtgtggatgtagtttactggctggtcccctggtgagcccaatgcctggatgtgagtgcctgcagacaaagccccaggtgtgtgggatcctga

SEQ ID NO: 102649 - DNA, 201 bp, Bos taurus
tccatagggtcacaaagagtcacacctgagcttaccatacatatcaggcagttacctgttgactttacccacttctcacaggccagcattagagtaatttcgttgctaatagcttcaattccttgccccaccccgccctgagagagaaggaacacacacttgattccccagcctggcccccattttcccctgcagcacagt

SEQ ID NO: 102650 - DNA, 201 bp, Bos taurus
actcacatcccaggacgatggaggaaagacattcaggccacgtgacagtgacagtatattaataactggagccagaaacaaacttttgatactctaagccactaaaacgttcaccttccttgtgactgcagcataactcagtgactcgtacattgtacatgtaaataaaaattttgcagggaactggtatgtgcccctttc

SEQ ID NO: 102651 - DNA, 201 bp, Bos taurus; identical to SEQ ID NO: 21396

SEQ ID NO: 102652 - DNA, 201 bp, Bos taurus; identical to SEQ ID NO: 21397

SEQ ID NO: 102653 - DNA, 201 bp, Bos taurus
ctaccacaacagccactgttttataaaccacatgtagatttgagcaatctcctaggtggactaaaaaaatttacatgcctaggtctctcctgttcggccccgctgcctatgagaggcaactcatccacatttcagggtggcatcaagcagtataccatttcatcggagtccagaagtggcaggacaaagggccaagactct

SEQ ID NO: 102654 - DNA, 201 bp, Bos taurus; identical to SEQ ID NO: 21400

SEQ ID NO: 102655 - DNA, 201 bp, Bos taurus; identical to SEQ ID NO: 21401

SEQ ID NO: 102656 - DNA, 201 bp, Bos taurus; identical to SEQ ID NO: 21403

SEQ ID NO: 102657 - DNA, 201 bp, Bos taurus
ttgtgggccctactagcaaaatgtgagcctgtaagtcacaaacattaaatgtaggaaatacctaacctgcagatgactggggaattctttaagcgcatgcaaaatatgtatttacaacttgttttttgtgaggagttagacaaaacataacctgtggtggattcattttgatatttggcaaaactaatacaattatgtaaa

SEQ ID NO: 102658 - DNA, 201 bp, Bos taurus
ctcaaattttaagattatttttaaggactcaataggttaatacatataaactacttaagaacaatgcctggcagataaaaagaccatggaagtgttggctgctactatgatttttactcatataaaggcagcaaaatatgtgtcacatagtagttactaagtaaaagagagttctatctttctcatatttgggtaagaggt

SEQ ID NO: 102659 - DNA, 201 bp, Bos taurus
gtttctgcattatctatctgctactactggaagtaagctctgtgaggacagtagcattgtattactttcatactccctagagcagtgcctgacacacacagtcagttctcaatgcctcactattgactaactgtcagatattgttctaagacgtttatacacactacttcatttcactccccacaggacatatgtaatttc

SEQ ID NO: 102660 - DNA, 201 bp, Bos taurus; identical to SEQ ID NO: 21405

SEQ ID NO: 102661 - DNA, 201 bp, Bos taurus; identical to SEQ ID NO: 21406

SEQ ID NO: 102662 - DNA, 201 bp, Bos taurus
actttcactttctacttgattgtctggtacctggccctaggctgattcagagtgggaagaatattggcttggtctgaggatttgataaaggagatgaggtatggcctctggtttgtatatcaaaggtacctcccaagggagttgtttgctctctaggattaactattcctgggaatggaggtctcctggatctaggccata

SEQ ID NO: 102663 - DNA, 201 bp, Bos taurus
aaaagaactatgaaactaaatggcctttgctttaggctgggtaagaggaagagacagtgtctgtggaaatggaggaagaggcttgcaataaagcaccaggatggatgatggaacatggccacgatacgggggatttcaacacaactctgaagcagatctcctttgctcaatggcccagtactttcccagtctcaccttata

SEQ ID NO: 102664 - DNA, 201 bp, Bos taurus
tgttttaaaagtacacatatgaaaaatgatagaagttaaaaaaatgagggttgaaaatatgatgatttaacaaagtcacaaaacacagcaacagattatgggctaggtcactgcactgtcctgaactgtccatttcttgagcaacatctgctcccatatattttaaatgatcccaaatctccactgtgacttacaagaact

SEQ ID NO: 102665 - DNA, 201 bp, Bos taurus; identical to SEQ ID NO: 21408

SEQ ID NO: 102666 - DNA, 201 bp, Bos taurus; identical to SEQ ID NO: 21409

SEQ ID NO: 102667 - DNA, 201 bp, Bos taurus; identical to SEQ ID NO: 21410

SEQ ID NO: 102668 - DNA, 201 bp, Bos taurus; identical to SEQ ID NO: 21414

SEQ ID NO: 102669 - DNA, 201 bp, Bos taurus
acctaatagtcttctggagagcacttcagaatagaaaacacccaggggccagcttatcctcggctctgagctactgagcaatctcaagaatacagaaactactctggaagatgtttaaagtcaaaacaccttaaaacttaaattaggtgaacttcaacaattgcctttgttttctttagttgtagcatgggcaaacagaaa

SEQ ID NO: 102670 - DNA, 201 bp, Bos taurus; identical to SEQ ID NO: 21416

SEQ ID NO: 102671 - DNA, 201 bp, Bos taurus; identical to SEQ ID NO: 21419

SEQ ID NO: 102672 - DNA, 201 bp, Bos taurus; identical to SEQ ID NO: 21420

SEQ ID NO: 102673 - DNA, 201 bp, Bos taurus; identical to SEQ ID NO: 21421

SEQ ID NO: 102674 - DNA, 201 bp, Bos taurus; identical to SEQ ID NO: 21422

SEQ ID NO: 102675 - DNA, 201 bp, Bos taurus; identical to SEQ ID NO: 21423

SEQ ID NO: 102676 - DNA, 201 bp, Bos taurus; identical to SEQ ID NO: 21424

SEQ ID NO: 102677 - DNA, 201 bp, Bos taurus; identical to SEQ ID NO: 21425

SEQ ID NO: 102678 - DNA, 201 bp, Bos taurus; identical to SEQ ID NO: 21429

SEQ ID NO: 102679 - DNA, 201 bp, Bos taurus; identical to SEQ ID NO: 21430

SEQ ID NO: 102680 - DNA, 201 bp, Bos taurus
cacacctgggtcagacagcaaagagtgtgagggtggcgagggacccactcatctgaagacttcatttacagctatagaaagtgaggctcaaatgagcccatggccactcaaacgacattccttcttgaaagctgtaacagtggcttgaagtgaaatcaatgctgtactatctgaaaaccaaaacagccatttctggagtgg

SEQ ID NO: 102681 - DNA, 201 bp, Bos taurus; identical to SEQ ID NO: 21432

SEQ ID NO: 102682 - DNA, 201 bp, Bos taurus; identical to SEQ ID NO: 21433

SEQ ID NO: 102683 - DNA, 201 bp, Bos taurus; identical to SEQ ID NO: 21435

SEQ ID NO: 102684 - DNA, 201 bp, Bos taurus; identical to SEQ ID NO: 21440

SEQ ID NO: 102685 - DNA, 201 bp, Bos taurus; identical to SEQ ID NO: 21441

SEQ ID NO: 102686 - DNA, 201 bp, Bos taurus; identical to SEQ ID NO: 21442

SEQ ID NO: 102687 - DNA, 201 bp, Bos taurus; identical to SEQ ID NO: 21445

SEQ ID NO: 102688 - DNA, 201 bp, Bos taurus; identical to SEQ ID NO: 21447

SEQ ID NO: 102689 - DNA, 201 bp, Bos taurus; identical to SEQ ID NO: 21448

SEQ ID NO: 102690 - DNA, 201 bp, Bos taurus; identical to SEQ ID NO: 21449

SEQ ID NO: 102691 - DNA, 201 bp, Bos taurus
caatgggttttaccactcccccactagaccccgtcttacagaaccctctccctagccagctggtgttctctgggctaaagactgtccaacccgttcctccgttttatagaagtttactcactccaggggaaatggtgagtcctccgacctccctcccaaccagtcccatcattccaaccagtggtaccatagagcagcacc

SEQ ID NO: 102692 - DNA, 201 bp, Bos taurus; identical to SEQ ID NO: 21454

SEQ ID NO: 102693 - DNA, 201 bp, Bos taurus; identical to SEQ ID NO: 21455

SEQ ID NO: 102694 - DNA, 201 bp, Bos taurus
gagaaattgaggaaaattttaaaagattatacttgcagtcatgtagcaaattgccagatagtggtcaaaagtgaatgcagtatgacaaattagaaggaacggtagcagactactcaagagctgatggcagcttagattagggtcctggcagagaaaagggtgtgtgggagtataagcactgaaggatgttgaaggggtgca

SEQ ID NO: 102695 - DNA, 201 bp, Bos taurus
aggtctgtcttcaccacctaccacctgattaaacctctctgactctctaacactcagtgggaataaagtgcctcctagttacattgctgtaaagataacacgggagtaccagtgatggacagggaagcctggcgtgctgcagtccatggggtcgcaaagagtgggacacaactgagcaactgaactatacttgttaaacaa

SEQ ID NO: 102696 - DNA, 201 bp, Bos taurus
aagagtacatactctatgattcctttcctataaagtacaaaaaggaggcaaaataaattaatgtcctgctattaaaaatcaggatagcagtcatctatgtggaagactttgataattttccattccatgacccaggtgctggttataagtcatacacatagctaggcacatttctttacatatattatactctgtggttcc

SEQ ID NO: 102697 - DNA, 201 bp, Bos taurus
attttgattaataaagatatgtttgagcctaattataatgatttaaaattcacagtctgaaaccacaattatttttgtaccaatctaataattagtgctagctaactataccacagatgaatcataaaagtttattcacaagtgcaatttatgtacagtaatatttcaatgaaatcttattaaagtttatgatacatctat

SEQ ID NO: 102698 - DNA, 201 bp, Bos taurus; identical to SEQ ID NO: 21456

SEQ ID NO: 102699 - DNA, 201 bp, Bos taurus; identical to SEQ ID NO: 21457

SEQ ID NO: 102700 - DNA, 201 bp, Bos taurus; identical to SEQ ID NO: 21458

SEQ ID NO: 102701 - DNA, 201 bp, Bos taurus; identical to SEQ ID NO: 21459

SEQ ID NO: 102702 - DNA, 201 bp, Bos taurus; identical to SEQ ID NO: 21461

SEQ ID NO: 102703 - DNA, 201 bp, Bos taurus; identical to SEQ ID NO: 21462

SEQ ID NO: 102704 - DNA, 201 bp, Bos taurus; identical to SEQ ID NO: 21463

SEQ ID NO: 102705 - DNA, 201 bp, Bos taurus; identical to SEQ ID NO: 21464

SEQ ID NO: 102706 - DNA, 201 bp, Bos taurus; identical to SEQ ID NO: 21465

SEQ ID NO: 102707 - DNA, 201 bp, Bos taurus; identical to SEQ ID NO: 21467

SEQ ID NO: 102708 - DNA, 201 bp, Bos taurus; identical to SEQ ID NO: 21468

SEQ ID NO: 102709 - DNA, 201 bp, Bos taurus; identical to SEQ ID NO: 21473

SEQ ID NO: 102710 - DNA, 201 bp, Bos taurus; identical to SEQ ID NO: 21474

SEQ ID NO: 102711 - DNA, 201 bp, Bos taurus; identical to SEQ ID NO: 21475

SEQ ID NO: 102712 - DNA, 201 bp, Bos taurus; identical to SEQ ID NO: 21476

SEQ ID NO: 102713 - DNA, 201 bp, Bos taurus; identical to SEQ ID NO: 21477

SEQ ID NO: 102714 - DNA, 201 bp, Bos taurus; identical to SEQ ID NO: 21478

SEQ ID NO: 102715 - DNA, 201 bp, Bos taurus; identical to SEQ ID NO: 21479

SEQ ID NO: 102716 - DNA, 201 bp, Bos taurus; identical to SEQ ID NO: 21481

SEQ ID NO: 102717 - DNA, 201 bp, Bos taurus; identical to SEQ ID NO: 21484

SEQ ID NO: 102718 - DNA, 201 bp, Bos taurus; identical to SEQ ID NO: 21485

SEQ ID NO: 102719 - DNA, 201 bp, Bos taurus; identical to SEQ ID NO: 21486

SEQ ID NO: 102720 - DNA, 201 bp, Bos taurus; identical to SEQ ID NO: 21487

SEQ ID NO: 102721 - DNA, 201 bp, Bos taurus; identical to SEQ ID NO: 21488

SEQ ID NO: 102722 - DNA, 201 bp, Bos taurus; identical to SEQ ID NO: 21491

SEQ ID NO: 102723 - DNA, 201 bp, Bos taurus; identical to SEQ ID NO: 21493

SEQ ID NO: 102724 - DNA, 201 bp, Bos taurus; identical to SEQ ID NO: 21495

SEQ ID NO: 102725 - DNA, 201 bp, Bos taurus; identical to SEQ ID NO: 21496

SEQ ID NO: 102726 - DNA, 201 bp, Bos taurus; identical to SEQ ID NO: 21501

SEQ ID NO: 102727 - DNA, 201 bp, Bos taurus; identical to SEQ ID NO: 21504

SEQ ID NO: 102728 - DNA, 201 bp, Bos taurus; identical to SEQ ID NO: 21510

SEQ ID NO: 102729 - DNA, 201 bp, Bos taurus; identical to SEQ ID NO: 21512

SEQ ID NO: 102730 - DNA, 201 bp, Bos taurus; identical to SEQ ID NO: 21513

SEQ ID NO: 102731 - DNA, 201 bp, Bos taurus; identical to SEQ ID NO: 21514

SEQ ID NO: 102732 - DNA, 201 bp, Bos taurus; identical to SEQ ID NO: 21520

SEQ ID NO: 102733 - DNA, 201 bp, Bos taurus; identical to SEQ ID NO: 21521

SEQ ID NO: 102734 - DNA, 201 bp, Bos taurus; identical to SEQ ID NO: 21523

SEQ ID NO: 102735 - DNA, 201 bp, Bos taurus
aagtatcattcttcagcttctatattcatgactaaacattttcatactaaactttcatgcattccattgttattgaagtagaataattaatgtttataaaaaccattggctagaaccttagaagtactagttacaaaatatattttctttaacatacatacacatttgttattcatcatgttaatagtgtagcctcatatt

SEQ ID NO: 102736 - DNA, 201 bp, Bos taurus; identical to SEQ ID NO: 21530

SEQ ID NO: 102737 - DNA, 201 bp, Bos taurus; identical to SEQ ID NO: 21533

SEQ ID NO: 102738 - DNA, 201 bp, Bos taurus; identical to SEQ ID NO: 21536

SEQ ID NO: 102739 - DNA, 201 bp, Bos taurus; identical to SEQ ID NO: 21537

SEQ ID NO: 102740 - DNA, 201 bp, Bos taurus; identical to SEQ ID NO: 21538

SEQ ID NO: 102741 - DNA, 201 bp, Bos taurus; identical to SEQ ID NO: 21539

SEQ ID NO: 102742 - DNA, 201 bp, Bos taurus; identical to SEQ ID NO: 21540

SEQ ID NO: 102743 - DNA, 201 bp, Bos taurus; identical to SEQ ID NO: 21541

SEQ ID NO: 102744 - DNA, 201 bp, Bos taurus; identical to SEQ ID NO: 21545

SEQ ID NO: 102745 - DNA, 201 bp, Bos taurus; identical to SEQ ID NO: 21546

SEQ ID NO: 102746 - DNA, 201 bp, Bos taurus; identical to SEQ ID NO: 21547

SEQ ID NO: 102747 - DNA, 201 bp, Bos taurus; identical to SEQ ID NO: 21548

SEQ ID NO: 102748 - DNA, 201 bp, Bos taurus; identical to SEQ ID NO: 21549

SEQ ID NO: 102749 - DNA, 201 bp, Bos taurus; identical to SEQ ID NO: 21550

SEQ ID NO: 102750 - DNA, 201 bp, Bos taurus; identical to SEQ ID NO: 21553

SEQ ID NO: 102751 - DNA, 201 bp, Bos taurus; identical to SEQ ID NO: 21554

SEQ ID NO: 102752 - DNA, 201 bp, Bos taurus; identical to SEQ ID NO: 21555

SEQ ID NO: 102753 - DNA, 201 bp, Bos taurus; identical to SEQ ID NO: 21556

SEQ ID NO: 102754 - DNA, 201 bp, Bos taurus; identical to SEQ ID NO: 21557

SEQ ID NO: 102755 - DNA, 201 bp, Bos taurus; identical to SEQ ID NO: 21558

SEQ ID NO: 102756 - DNA, 201 bp, Bos taurus; identical to SEQ ID NO: 21559

SEQ ID NO: 102757 - DNA, 201 bp, Bos taurus; identical to SEQ ID NO: 21560

SEQ ID NO: 102758 - DNA, 201 bp, Bos taurus; identical to SEQ ID NO: 21561

SEQ ID NO: 102759 - DNA, 201 bp, Bos taurus; identical to SEQ ID NO: 21562

SEQ ID NO: 102760 - DNA, 201 bp, Bos taurus; identical to SEQ ID NO: 21563

SEQ ID NO: 102761 - DNA, 201 bp, Bos taurus; identical to SEQ ID NO: 21564

SEQ ID NO: 102762 - DNA, 201 bp, Bos taurus; identical to SEQ ID NO: 21566

SEQ ID NO: 102763 - DNA, 201 bp, Bos taurus; identical to SEQ ID NO: 21567

SEQ ID NO: 102764 - DNA, 201 bp, Bos taurus; identical to SEQ ID NO: 21568

SEQ ID NO: 102765 - DNA, 201 bp, Bos taurus; identical to SEQ ID NO: 21569

SEQ ID NO: 102766 - DNA, 201 bp, Bos taurus; identical to SEQ ID NO: 21571

SEQ ID NO: 102767 - DNA, 201 bp, Bos taurus; identical to SEQ ID NO: 21572

SEQ ID NO: 102768 - DNA, 201 bp, Bos taurus; identical to SEQ ID NO: 21573

SEQ ID NO: 102769 - DNA, 201 bp, Bos taurus; identical to SEQ ID NO: 21576

SEQ ID NO: 102770 - DNA, 201 bp, Bos taurus; identical to SEQ ID NO: 21579

SEQ ID NO: 102771 - DNA, 201 bp, Bos taurus; identical to SEQ ID NO: 21580

SEQ ID NO: 102772 - DNA, 201 bp, Bos taurus; identical to SEQ ID NO: 21581

SEQ ID NO: 102773 - DNA, 201 bp, Bos taurus; identical to SEQ ID NO: 21583

SEQ ID NO: 102774 - DNA, 201 bp, Bos taurus; identical to SEQ ID NO: 21584

SEQ ID NO: 102775 - DNA, 201 bp, Bos taurus; identical to SEQ ID NO: 21585

SEQ ID NO: 102776 - DNA, 201 bp, Bos taurus; identical to SEQ ID NO: 21586

SEQ ID NO: 102777 - DNA, 201 bp, Bos taurus; identical to SEQ ID NO: 21587

SEQ ID NO: 102778 - DNA, 201 bp, Bos taurus; identical to SEQ ID NO: 21588

SEQ ID NO: 102779 - DNA, 201 bp, Bos taurus; identical to SEQ ID NO: 21589

SEQ ID NO: 102780 - DNA, 201 bp, Bos taurus; identical to SEQ ID NO: 21590

SEQ ID NO: 102781 - DNA, 201 bp, Bos taurus; identical to SEQ ID NO: 21592

SEQ ID NO: 102782 - DNA, 201 bp, Bos taurus; identical to SEQ ID NO: 21593

SEQ ID NO: 102783 - DNA, 201 bp, Bos taurus; identical to SEQ ID NO: 21594

SEQ ID NO: 102784 - DNA, 201 bp, Bos taurus; identical to SEQ ID NO: 21595

SEQ ID NO: 102785 - DNA, 201 bp, Bos taurus; identical to SEQ ID NO: 21596

SEQ ID NO: 102786 - DNA, 201 bp, Bos taurus; identical to SEQ ID NO: 21597

SEQ ID NO: 102787 - DNA, 201 bp, Bos taurus; identical to SEQ ID NO: 21598

SEQ ID NO: 102788 - DNA, 201 bp, Bos taurus; identical to SEQ ID NO: 21599

SEQ ID NO: 102789 - DNA, 201 bp, Bos taurus; identical to SEQ ID NO: 21600

SEQ ID NO: 102790 - DNA, 201 bp, Bos taurus; identical to SEQ ID NO: 21601

SEQ ID NO: 102791 - DNA, 201 bp, Bos taurus; identical to SEQ ID NO: 21602

SEQ ID NO: 102792 - DNA, 201 bp, Bos taurus; identical to SEQ ID NO: 21603

SEQ ID NO: 102793 - DNA, 201 bp, Bos taurus; identical to SEQ ID NO: 21604

SEQ ID NO: 102794 - DNA, 201 bp, Bos taurus; identical to SEQ ID NO: 21605

SEQ ID NO: 102795 - DNA, 201 bp, Bos taurus
aaaactaacagggcctcctgaaataaagaaaacccctttgtcattttccacatcgtgaaagtctttggttcttcaatcacttctttctctgtctctcttcatcctttcaatgggcctccaattccaaggtcttcagtattaagttccttgtgttgcacagaaaggagttcaatgaagtcatcctctttcagatctagcttg

SEQ ID NO: 102796 - DNA, 201 bp, Bos taurus
taatgcagaacaataggggcaagtgtaggggtgaaggcaggatgctttgggagagcacagatggttggtcgcttaccccagtgttgaactaaggaaggcccgtctggaggatgtgatgagatctaggctaagtcctctctaagaagcatcatttaggcaaagagaattgggtatggaggatgaaatagcatgccaggcaaa

SEQ ID NO: 102797 - DNA, 201 bp, Bos taurus; identical to SEQ ID NO: 21606

SEQ ID NO: 102798 - DNA, 201 bp, Bos taurus; identical to SEQ ID NO: 21607

SEQ ID NO: 102799 - DNA, 201 bp, Bos taurus; identical to SEQ ID NO: 21608

SEQ ID NO: 102800 - DNA, 201 bp, Bos taurus; identical to SEQ ID NO: 21609

SEQ ID NO: 102801 - DNA, 201 bp, Bos taurus; identical to SEQ ID NO: 21610

SEQ ID NO: 102802 - DNA, 201 bp, Bos taurus
catcactcattagttagtcatagttaagcaagttctatattagtgatctaaaggtataatgggaaaattgctaaactgagagaaagttctgattcaataatcaatatttgcacattctaggaacactttgaaattggggtttggcagaaatggtctctttgtgaatgtatctttgtattgtgaattctctccaaagtgaaa

SEQ ID NO: 102803 - DNA, 201 bp, Bos taurus
aagcattagtagtagagcttaagtgagagaatgtagatttcctaaggattttcagtaggaaaaagaagagtcagaaaattttgaggccagaaatgtagtggaaagtagaatgtcactttggagtcctatctctcaacaagtaaagggccagaggagaaattacttttgaaaatgggtggatgtgcagtaatttgaatgttt

SEQ ID NO: 102804 - DNA, 201 bp, Bos taurus
gtgggcaggagggcaccagtgatgcacagtagttaagaactttggttctacagtcggactgcctgagttcaaaacctggctgcggctttcccttcagtcagtttacctaagctgagtctcagtcctaaacctgagacaagaataaccccaacctgtgtatgtggattaaattagttaatatttgaaaatccttagaagagt

SEQ ID NO: 102805 - DNA, 201 bp, Bos taurus; identical to SEQ ID NO: 21611

SEQ ID NO: 102806 - DNA, 201 bp, Bos taurus
gacgaagaatccaaacagagagaaggaacaagagggcctaccaagtagctgatgatcttggtcttaacttgtcatctcaacagggataaatgctggtctaagtgaaatgttttggcctcccaagaagaaaggaagtagaacaacccaaggtagcatggatatcttcaccattatttatgagctttaaagctaaatgaggaa

SEQ ID NO: 102807 - DNA, 201 bp, Bos taurus
tatttcaggtaccttttccacataagaccagagcctcttggccttaccttttccaaccattaactttgccccagatgcactacagtgatctgctctacacaggctgtttccaagtagagcttcacctactatctgcatgtgggcacagtaactcaccttccttcctggggcttccctgagaaaatgcaaggcacccagata

SEQ ID NO: 102808 - DNA, 201 bp, Bos taurus; identical to SEQ ID NO: 21613

SEQ ID NO: 102809 - DNA, 201 bp, Bos taurus; identical to SEQ ID NO: 21614

SEQ ID NO: 102810 - DNA, 201 bp, Bos taurus; identical to SEQ ID NO: 21617

SEQ ID NO: 102811 - DNA, 201 bp, Bos taurus
acctgaaccaggactcactgtctctgtggaaatggtgattaatctcttcccttccttcctgtatccttcttcccagcacagcttgtgctacccagggccttttgtacaatccagtagaacctggatgaacggaggagagagactcccagggaggacggggtgaaagaatgccttggggtgagtgtgaaggcctgtaatggc

SEQ ID NO: 102812 - DNA, 201 bp, Bos taurus; identical to SEQ ID NO: 21618

SEQ ID NO: 102813 - DNA, 201 bp, Bos taurus; identical to SEQ ID NO: 21620

SEQ ID NO: 102814 - DNA, 201 bp, Bos taurus; identical to SEQ ID NO: 21621

SEQ ID NO: 102815 - DNA, 201 bp, Bos taurus; identical to SEQ ID NO: 21622

SEQ ID NO: 102816 - DNA, 201 bp, Bos taurus; identical to SEQ ID NO: 21623

SEQ ID NO: 102817 - DNA, 201 bp, Bos taurus; identical to SEQ ID NO: 21624

SEQ ID NO: 102818 - DNA, 201 bp, Bos taurus; identical to SEQ ID NO: 21625

SEQ ID NO: 102819 - DNA, 201 bp, Bos taurus; identical to SEQ ID NO: 21627

SEQ ID NO: 102820 - DNA, 201 bp, Bos taurus
agtcatggggggcactggggcataggggtgggtgaggaacggtcagagcatcacagatgtcccaagcttaatccatgggggagaagaaagggttgaaggatggaggagtgggcagttcatttactgataaattctggtcttcttcatgtaaatggtgaaagtatgtggtgtcagggaaaactgcagcactcaaattttatt

SEQ ID NO: 102821 - DNA, 201 bp, Bos taurus
gtctctcataggattattatgttacaatttgaattgagatcttaaccttagtcccacaaagctctcttcctccagtctacttttcatactgtcctcacactcattatttaggcactcatatcttattgtgccatttgacacataaaacatattaggattctctgtttttttccataccagtcagcacagataaagtccaca

SEQ ID NO: 102822 - DNA, 201 bp, Bos taurus
actcaaagattgctagtgcttttaaagcaggcatttcagtagaaggatggtggttgcagttacagaatagggaattagttcgaggagaggagatgatggcgggttggaggctgagggtattgaatactctcaacatgtatattaagagataagaagcaaaaaggatgaacagttcagtaaggatatttgaagggtctttgt

SEQ ID NO: 102823 - DNA, 201 bp, Bos taurus; identical to SEQ ID NO: 21628

SEQ ID NO: 102824 - DNA, 201 bp, Bos taurus; identical to SEQ ID NO: 21629

SEQ ID NO: 102825 - DNA, 201 bp, Bos taurus
tgatctgatgatatttttaagaattttcttttttttcactttgtgcctactcaaatgtcataccatactgaccactgtataagaagcatgttttccatatgaaaaggttatggtgcattgcaacgactagatacatcccagacttaacagtgaaaagcaaacattccagctagactgtgagacataaagcaaaattatatt

SEQ ID NO: 102826 - DNA, 201 bp, Bos taurus; identical to SEQ ID NO: 21630

SEQ ID NO: 102827 - DNA, 201 bp, Bos taurus; identical to SEQ ID NO: 21631

SEQ ID NO: 102828 - DNA, 201 bp, Bos taurus; identical to SEQ ID NO: 21632

SEQ ID NO: 102829 - DNA, 201 bp, Bos taurus
ctaggatgtctggctctaggtgagtgataacaccatcatgattatcttgcagggtaacaagtaatatcccaaatcggtagcagccttctttactgggcccgaggccaaagtggtctttctgatacttgtcccactttgagtctcaacttctacaccagtatgtgtggaataatacagagaaaaccacaaatgacagaggaa

SEQ ID NO: 102830 - DNA, 201 bp, Bos taurus; identical to SEQ ID NO: 21633

SEQ ID NO: 102831 - DNA, 201 bp, Bos taurus
aaatcctttcttaaaattcttaatcatactttctaaaacaataggttttgaggttgaactgcccattaagtgagagttcctaacttatggtggtgccacacaatgaacaaagggaaacactcactttcatctgcctggcctctcacctcacggaaatttagctgtctcttagcattggcacaaagaaggcaatggcaaccc

SEQ ID NO: 102832 - DNA, 201 bp, Bos taurus
tcaatttgactttgtcattcagaaagaaaaaatattggcctttaagacttgctttgcctgtagattgaggtgcacttatctcttcctttcctcattttccgtactcttaacatttccacagaagaaagaaatttgcactgtccagaaggaatgaaaatgtaagaaactctcctggcctctgttcctatatatttgtactca

SEQ ID NO: 102833 - DNA, 201 bp, Bos taurus; identical to SEQ ID NO: 21635

SEQ ID NO: 102834 - DNA, 201 bp, Bos taurus
ccacacaccaacatcagcagctgaacaatagagaggctggcccatcaaatgccggatgcactgaactacagagtaggaccccacccaaggtgctcctttaggagattgatgcgccaccccaggggcccccatctaggtacctgacacgccaaacaacagaaggaccccaggcgagggagcccgctaaatgcctgaatggga

SEQ ID NO: 102835 - DNA, 201 bp, Bos taurus; identical to SEQ ID NO: 21636

SEQ ID NO: 102836 - DNA, 201 bp, Bos taurus
ccatctacatgctctcccttcctgcttctctcctgcctacccttgggagtttccatgtcctactgtgatgttcattcccagtgtcacttattccacgcagctgatagacagaggaggtgggatacaggcaagagaactacagccgcctcccaggtgagttctccagaaagatctaacataaccgacaggagcagaagggga

SEQ ID NO: 102837 - DNA, 201 bp, Bos taurus; identical to SEQ ID NO: 21637

SEQ ID NO: 102838 - DNA, 201 bp, Bos taurus; identical to SEQ ID NO: 21638

SEQ ID NO: 102839 - DNA, 201 bp, Bos taurus; identical to SEQ ID NO: 21639

SEQ ID NO: 102840 - DNA, 201 bp, Bos taurus; identical to SEQ ID NO: 21640

SEQ ID NO: 102841 - DNA, 201 bp, Bos taurus; identical to SEQ ID NO: 21642

SEQ ID NO: 102842 - DNA, 201 bp, Bos taurus; identical to SEQ ID NO: 21643

SEQ ID NO: 102843 - DNA, 201 bp, Bos taurus
tgtcttagcagagatcacaatgggctccatggcagcccggccctggggagaggggaggtcgaggggtgagtctcaagactccttgaaagatgaggtggccagcagttcatgcgttcaccctgcctcacctcagggctgatctgggcaggaacactggagaactcagggttggacgcaaaggcgctcagattgtccacagcc

SEQ ID NO: 102844 - DNA, 201 bp, Bos taurus; identical to SEQ ID NO: 21646

SEQ ID NO: 102845 - DNA, 201 bp, Bos taurus
gtatttgatgattttgttagcagagcacaagaaataaaaaattaatcttaaacatcgaaacaaacataaggaagacaaagactgcctctggcaatggatcgctcataaaaactttctttaaaggcaaaacagcactgctcaagaatgcaaagtccttccaatgtttcccatatagtacctatctatatctttcttgctggc

SEQ ID NO: 102846 - DNA, 201 bp, Bos taurus
agataaaaccctatcatcttaatccaactgcccatcttagcatcattaacagtgggccaaccagatgtgacttctgatgtgatacactgtgaaattcagacatcacctctgcttggtaatcaagcaaaaaatactttccttggctccatcaaactattggatgtgattgccagtttacaggaaacacaggggacagacatc

SEQ ID NO: 102847 - DNA, 201 bp, Bos taurus; identical to SEQ ID NO: 21648

SEQ ID NO: 102848 - DNA, 201 bp, Bos taurus; identical to SEQ ID NO: 21649

SEQ ID NO: 102849 - DNA, 201 bp, Bos taurus; identical to SEQ ID NO: 21650

SEQ ID NO: 102850 - DNA, 201 bp, Bos taurus; identical to SEQ ID NO: 21651

SEQ ID NO: 102851 - DNA, 201 bp, Bos taurus
ggctgtggccagtggagtgagggtagcactgacttggtggcttggctttggtgggtcatctcaaaaacttaggagacacctgactcacacaatagccagaagggattctcaagcatcatctttggccctgtctctaacccacacaatgactgtgtaacactgggggcagggggtcaagtgatgatgaatgaggatcagcct

SEQ ID NO: 102852 - DNA, 201 bp, Bos taurus
tgttaaagggcatgggtcccttcagttccttagggtctgattccttctccttcaggctgtcctgtccggagtctttggcctctccctctaggctggctccttctcttcaaacagccctccctgacccacgttgggctcccctcccctctacccaccaggcccccttttctaggggtgttttcaccaaggatactatgggtc

SEQ ID NO: 102853 - DNA, 201 bp, Bos taurus; identical to SEQ ID NO: 21652

SEQ ID NO: 102854 - DNA, 201 bp, Bos taurus
ctctccgccctccgtcccagcctccttttctggctgcttgcgttacctggggcgcctggtccggctgctaccctgactggggctggactcagcaaattgtgtacacagacaaataggccctgattaactcgttcaacctcatgtctcattctaccacttgacctaaagtttttccccttccctcctgtcaggcgcatctct

SEQ ID NO: 102855 - DNA, 201 bp, Bos taurus
agtggacgcaggaaaatcctacacacctgttggcagatttcactctggcccagagttaccttcttgatttaattccccaagacttctatgtctgaatcatgtaggaaaatgacttcttggataaaatattaaaaggccacacgtggatgttcacagtctccctctgacagctctggtgataatggctcagagggagaagtg

SEQ ID NO: 102856 - DNA, 201 bp, Bos taurus
acagagggtccccgggaccactgaggggccacagaccagccttccggtcctcccttcctcctttccttccttgatggccttttgcgtgcctgcgacataactgtaattgctgatttctctgcctccccacccaagtctctaggagaccaggtggccccaggaagctcttctacagtactccttgctcctggggtgtagaca

SEQ ID NO: 102857 - DNA, 201 bp, Bos taurus
ctgaatgtgcgaaaccaccatatggcacagacattattttgatctgcatttttcgatgaagcaactgaggctcaaagaggctaagccacttgcacgtcattacagatcaagtgactggcaaagcagggagactaatatcaccagcttccattccacagactgttatgcttcttctgtgtgatgaacaacttccaaaattca

SEQ ID NO: 102858 - DNA, 201 bp, Bos taurus
tttaacatcttagtggatccctcattgattagcgagttgaataaaatatttgacttgtgtttatttcatacttgagagagtcataattttatctttttgaaaatcattccttaccaagattaaagtccaacactttctgctaagaaattctattactatttgatgacagtactaccttacctgtctatagtaatttatagt

SEQ ID NO: 102859 - DNA, 201 bp, Bos taurus; identical to SEQ ID NO: 21656

SEQ ID NO: 102860 - DNA, 201 bp, Bos taurus; identical to SEQ ID NO: 21657

SEQ ID NO: 102861 - DNA, 201 bp, Bos taurus; identical to SEQ ID NO: 21658

SEQ ID NO: 102862 - DNA, 201 bp, Bos taurus; identical to SEQ ID NO: 21659

SEQ ID NO: 102863 - DNA, 201 bp, Bos taurus; identical to SEQ ID NO: 21660

SEQ ID NO: 102864 - DNA, 201 bp, Bos taurus; identical to SEQ ID NO: 21661

SEQ ID NO: 102865 - DNA, 201 bp, Bos taurus
aagacaacactctgtctggccttggctctcacttggagatgaccagaggatggaaacagaagtggacagtacggtgagagcagaagctctggctctggcatttgccagtggaggggcctcaggcaagtcacttaatatctctgaaccagctttctctgttgtaaaataaagaaaatagagtccactatgatgaactagttt

SEQ ID NO: 102866 - DNA, 201 bp, Bos taurus; identical to SEQ ID NO: 21662

SEQ ID NO: 102867 - DNA, 201 bp, Bos taurus; identical to SEQ ID NO: 21664

SEQ ID NO: 102868 - DNA, 201 bp, Bos taurus
gcccagagcaagcctgaaacctcaggcctaagtgacaccccttcctggtcacatgtgtggcactcctgtcccacctgccacgtcagcaggatgggaaccacctggccggtgttatcccattgtgcaaatgaggacaatgagatgggagagagacagtgatctacccaaatcactggatggttagcagcagatctcaggcta

SEQ ID NO: 102869 - DNA, 201 bp, Bos taurus; identical to SEQ ID NO: 21666

SEQ ID NO: 102870 - DNA, 201 bp, Bos taurus; identical to SEQ ID NO: 21667

SEQ ID NO: 102871 - DNA, 201 bp, Bos taurus; identical to SEQ ID NO: 21668

SEQ ID NO: 102872 - DNA, 201 bp, Bos taurus; identical to SEQ ID NO: 21672

SEQ ID NO: 102873 - DNA, 201 bp, Bos taurus; identical to SEQ ID NO: 21673

SEQ ID NO: 102874 - DNA, 201 bp, Bos taurus
ctctagttcttgtgtccctaacagtgatcatcacacttcagagctggaaggacctagaggtcagccagactggggcctctcagactgatggcacacaatctcttggggacctgttaacatgcagattcttacgcaatcttacgtcaatctcccaagggccctggatttgacactgactgcagatgctgccagccctcgtgg

SEQ ID NO: 102875 - DNA, 201 bp, Bos taurus; identical to SEQ ID NO: 21674

SEQ ID NO: 102876 - DNA, 201 bp, Bos taurus; identical to SEQ ID NO: 21676

SEQ ID NO: 102877 - DNA, 201 bp, Bos taurus; identical to SEQ ID NO: 21677

SEQ ID NO: 102878 - DNA, 201 bp, Bos taurus; identical to SEQ ID NO: 21678

SEQ ID NO: 102879 - DNA, 201 bp, Bos taurus
ctgcctctaagggttctttttctgctgcagtgatgctgcagaaaagcgctttaaaacattccctgcttacaaatgcactcagttgaatctggaaatcccaacaagggactctaatctccagcaaatattctattcttgacaactaattccaccgaagaattttttttcttagatctaatgggatttaacatcttttgtgat

SEQ ID NO: 102880 - DNA, 201 bp, Bos taurus; identical to SEQ ID NO: 21679

SEQ ID NO: 102881 - DNA, 201 bp, Bos taurus; identical to SEQ ID NO: 21680

SEQ ID NO: 102882 - DNA, 201 bp, Bos taurus; identical to SEQ ID NO: 21682

SEQ ID NO: 102883 - DNA, 201 bp, Bos taurus; identical to SEQ ID NO: 21683

SEQ ID NO: 102884 - DNA, 201 bp, Bos taurus; identical to SEQ ID NO: 21684

SEQ ID NO: 102885 - DNA, 201 bp, Bos taurus; identical to SEQ ID NO: 21685

SEQ ID NO: 102886 - DNA, 201 bp, Bos taurus; identical to SEQ ID NO: 21687

SEQ ID NO: 102887 - DNA, 201 bp, Bos taurus
tcaagtcacagcagaatacctgcaatggagtggggccaccaggcctaaccagggactaccagagaggggcaataaggggtgttattgccaaggtcagggaagacagaatgctaggaatttagggaggcaggtgaaatttaaaagaccatagaggccagagtagggggtaaagctaagaagtcaggcccatcagtgggagat

SEQ ID NO: 102888 - DNA, 201 bp, Bos taurus
taaggcaggagtctggaggcaaggcagagggagaagaaatcaggatgaagatgtaaaaggcagcagaacaagaatgagcaggctgaggtcagcagagaccggagccccggagcccctcctcattcctgataccaatacccccctccctggacagaatcgcctcccttccctcctaacacaaaggggctctcttctcctcct

SEQ ID NO: 102889 - DNA, 201 bp, Bos taurus
aggtgcccgtggcgttgacgatggcccactcgccgctctcccagtagtccttcaggtccaccgtctgctccatctgcaccaggtcgatcttggccttgtcatacgaccaggagccaaacttcatcttgcagttctgctggtcgaaggggaagaaggtgacgtcgatgctgcaggagctcttgtagatggcaggcggtgccc

SEQ ID NO: 102890 - DNA, 201 bp, Bos taurus; identical to SEQ ID NO: 21688

SEQ ID NO: 102891 - DNA, 201 bp, Bos taurus; identical to SEQ ID NO: 21690

SEQ ID NO: 102892 - DNA, 201 bp, Bos taurus
ctgtgtgtcatttattaataatgtaattaaaataacatatttagaattctgtccaaagttaaacatggagtcaagcatagagaaaattgtgttgtaactgttgtgacagcagagaagaatttacagtttaaactctcttaacttgtcatgtgggttattcatacattatgaacaagctcgatactgataatgtacagggtg

SEQ ID NO: 102893 - DNA, 201 bp, Bos taurus
ggagtactctaagtcacagagaccttcaggtacctaaggttgccattgggctcctaatctgtgcgggggtgggggtggggaatgcagacctgggtggcccaagaacccattctcttaacctctgtgcaatgctggcagtcctggaaaagcgtgtcccagagagccgtggccctctgggcccccttggagggctgtccactc

SEQ ID NO: 102894 - DNA, 201 bp, Bos taurus; identical to SEQ ID NO: 21695

SEQ ID NO: 102895 - DNA, 201 bp, Bos taurus
gccaggcacaaggtagtgacagaaaggttgtgcctgaataggggtggtgctattggggaaggatgggatgcagaggggatgggattagagatggagatattgctgggatgggggccccagaagagaggggctggaatctgagtacattagaagagagatacttgagatcttgggttggagattttacaacaggctgagatc

SEQ ID NO: 102896 - DNA, 201 bp, Bos taurus; identical to SEQ ID NO: 21696

SEQ ID NO: 102897 - DNA, 201 bp, Bos taurus
tgggacctacagattggggtttacaaatttttaaaagtccatcttgtttcctaattattaaagtaatatatgcccactatagaagaataactaaatgaaagaggaaaggaaaggccaactgcaatgagacagtaaaatgatgtagctcctttggaaaagactctagcagtttctcaaaaatatcaaatatagagttctcat

SEQ ID NO: 102898 - DNA, 201 bp, Bos taurus; identical to SEQ ID NO: 21697

SEQ ID NO: 102899 - DNA, 201 bp, Bos taurus; identical to SEQ ID NO: 21698

SEQ ID NO: 102900 - DNA, 201 bp, Bos taurus; identical to SEQ ID NO: 21699

SEQ ID NO: 102901 - DNA, 201 bp, Bos taurus; identical to SEQ ID NO: 21700

SEQ ID NO: 102902 - DNA, 201 bp, Bos taurus
aatactcagctctgccctcatatcacgaagcaactatagacaatacataaaagaataagcctgattgtgtcctggtaaaactacttaaaaaaaaaacccaatttggcccaggaggtctaaatgtctatttgaggcattttctttttaatatcttttgtttattaatagtctagaaaaaaataacaagagcgtacttcattc

SEQ ID NO: 102903 - DNA, 201 bp, Bos taurus; identical to SEQ ID NO: 21701

SEQ ID NO: 102904 - DNA, 201 bp, Bos taurus; identical to SEQ ID NO: 21703

SEQ ID NO: 102905 - DNA, 201 bp, Bos taurus; identical to SEQ ID NO: 21704

SEQ ID NO: 102906 - DNA, 201 bp, Bos taurus
agctgtatggggagctgatgttatctttgaggcttttccaaatccacagggctctttcaatgacaagaaacaggtccctctactttccaagataaatgagatacatacagtaacaaagaaagggcaacccagatgaagttcaccccaggaggcccctccaaccgagtgctgcaaggagatatcattaggctatgaagtcct

SEQ ID NO: 102907 - DNA, 201 bp, Bos taurus
tggtttcagttgctctgccctatgagagcagcgttccaccgagtgcctgggaggatgagaataaaggtcaactatttgacacgaagacctagaaagacttgcctgggtttcatagtgggttcctgaattgaaagggaactgagatgctatttaagaaactgaaggagaataatggtctaggatcttgacaggactagacag

SEQ ID NO: 102908 - DNA, 201 bp, Bos taurus
ggataccttcactgtataaagaattctagttggcagtttcattctttcaacattttaaagatgtcattctactgtctcctggcttctactgtctctaccgagaagctagtgatgacctaattgttgctttattgctcctctgaaggtgataatttcctctcatttgggctgcttttgaaacttgaagtcacatatattagt

SEQ ID NO: 102909 - DNA, 201 bp, Bos taurus; identical to SEQ ID NO: 21705

SEQ ID NO: 102910 - DNA, 201 bp, Bos taurus; identical to SEQ ID NO: 21707

SEQ ID NO: 102911 - DNA, 201 bp, Bos taurus
agctgtaaagacagtgagtacccatagaagatttgacatctagtgagaaggtaacttactgaacaaggattccaatgcacggaggcactgccctgatgagacagacatggagatggggaatagaacagaaacaagagaagtcatgttcaaggaggcaggaaagtccttctggagaaaaatgctttgtgacccttgaggtga

SEQ ID NO: 102912 - DNA, 201 bp, Bos taurus
acttctcctctttccctcagtgttctgaaataacatttgaagttctgtttggtctctttggagaactgccaatgacttcaaggcatgtagtgaagttatacatcaagacacaattacatgcagtacttttgaaaagtgattctcacttaggagtaatatacgatatgaatttaataatctgccatactactcctttttttt

SEQ ID NO: 102913 - DNA, 201 bp, Bos taurus; identical to SEQ ID NO: 21709

SEQ ID NO: 102914 - DNA, 201 bp, Bos taurus; identical to SEQ ID NO: 21710

SEQ ID NO: 102915 - DNA, 201 bp, Bos taurus; identical to SEQ ID NO: 21711

SEQ ID NO: 102916 - DNA, 201 bp, Bos taurus; identical to SEQ ID NO: 21712

SEQ ID NO: 102917 - DNA, 201 bp, Bos taurus
tttttcttgatgaactttttttctttaaagaccttaagaagcaatcatttggtaacaggtaggagatgagaaatccagccactagaaaaatgagtcataacactcttattcaaagactcaaaagtattcttcacatgtatttcctgcagggtttcattccttcctggggcaggagtcagtctggcagataacttatctggg

SEQ ID NO: 102918 - DNA, 201 bp, Bos taurus; identical to SEQ ID NO: 21713

SEQ ID NO: 102919 - DNA, 201 bp, Bos taurus; identical to SEQ ID NO: 21714

SEQ ID NO: 102920 - DNA, 201 bp, Bos taurus
agcccagctgctttctgaataatccctggaacaactgtctctgtgggcgctggaggtcccaaggccttctcatttcttccgacttctcttactcgactctcctctagtctgacagtagcaggacaccgtgtcctcctagtgaaggggatctaacttcaactactttccactcaaggaatcaatcaaaatgtttccttctct

SEQ ID NO: 102921 - DNA, 201 bp, Bos taurus
atttagggcctgtgtatataaccttctcatctcaaaataatttaactgcatatgcaaatattcttttttccaataaatccagatgttccagagattgacacggatgtatttttttaggggccagttttcaacctaccacacgcattaaatgtaataaaaaagctcacatatagtcacattgaaatgaaagtgcagaaaaac

SEQ ID NO: 102922 - DNA, 201 bp, Bos taurus; identical to SEQ ID NO: 21716

SEQ ID NO: 102923 - DNA, 201 bp, Bos taurus
caaagaacaaagttcccaggccatattctattttgtttttacttagaaagtctatggctgcaaaacctggaattattggataccatatggcattactgggtgtcccaggtgatgctactggtaaagaacccacctggcaatgcaggagacacaagagacatgggttcgatccctgggttgggaagatcccctggagaaggt

SEQ ID NO: 102924 - DNA, 201 bp, Bos taurus; identical to SEQ ID NO: 21717

SEQ ID NO: 102925 - DNA, 201 bp, Bos taurus
agagggggagggtatgacttttctttcagcttgggatgctaccagctcgggatggccccttcaaagaattccaaagcacggaaaactgttcttcagttactaccacagctgtggtcttcagtttcctagctcggtggtcagactccacctggctttctctttgccttctacccattgcttgcaaacagtcttacacagctc

SEQ ID NO: 102926 - DNA, 201 bp, Bos taurus
caaatgaggatatctgtttgctttgcacatatgtgaagggaaaatatcaatgattagacaaaaaggcactatagcaaaaggggactattctttgccaaataagcagttctgttcctcttcctctccacagcaaagtactttttactaaagtttatatctattaaaataattagttttatttgcagcaactcaataccaatt

SEQ ID NO: 102927 - DNA, 201 bp, Bos taurus; identical to SEQ ID NO: 21720

SEQ ID NO: 102928 - DNA, 201 bp, Bos taurus; identical to SEQ ID NO: 21721

SEQ ID NO: 102929 - DNA, 201 bp, Bos taurus; identical to SEQ ID NO: 21722

SEQ ID NO: 102930 - DNA, 201 bp, Bos taurus
tgctcaacatgcattgtaatgggcagtggcattttcactgggcctgggctgcgaattctcttgaacctttcccttgagtcttcagtttgacacacaccctagaggcatccacacgtcaggcctgttccctttctatggcatcacccctcaccctcccaccttggtgagattccaggaggcaggacaggctttgggcctctt

SEQ ID NO: 102931 - DNA, 201 bp, Bos taurus; identical to SEQ ID NO: 21723

SEQ ID NO: 102932 - DNA, 201 bp, Bos taurus; identical to SEQ ID NO: 21724

SEQ ID NO: 102933 - DNA, 201 bp, Bos taurus
agttccttccttttttctgtctctgttgtgtggatgaaccacatttacgtcatggattcttgggttactttccccttgggctattgtgaaatagccaagtgaatagcactgatgaatagtgctcctgtgaacacggttgtgcaaaaatcttttgggagtccctgttttcagtcctttgggatacggacccaggagtgggat

SEQ ID NO: 102934 - DNA, 201 bp, Bos taurus
aaagtgggtctcactgtgctaaaagcaaggtgtgagagggccacgtttcttctggaggctccagggagagtgtttcctgcctttttagcttctgtaggggttgtattctgtggctcatggcccttccttcatcatcaaagctgtcaatggccagtagagtcctgcactccctcatgtatgaaacctgctcctctgccttcc

SEQ ID NO: 102935 - DNA, 201 bp, Bos taurus
tatctcagaagcctgctggccaagggggcatttttgctgtttgagaggacactctgatcctgacctgggagcgtatgggggagcatttgcgagggggcagaagaagctcctgagataaggaggcccctctgaggtgggagacagatggtgctccagatatgagaccaagaggcagatggtgggtggtgggtggaagagccc

SEQ ID NO: 102936 - DNA, 201 bp, Bos taurus; identical to SEQ ID NO: 21726

SEQ ID NO: 102937 - DNA, 201 bp, Bos taurus
agcaagagtatctggagtgtagtaagcaggacaagcatagtaaaggcaggcatggagacagagaggagacttctctaggcaggcaagaggctttctccagatgggtaaggggcctggatcatagtgtggccaggaggtagagaggaggggtagtgctagaccccatgaagattagacgctgcagggggcttcctgaaaagc

SEQ ID NO: 102938 - DNA, 201 bp, Bos taurus
tcctatgtgagctggaggcttcatcctggctgcactgcagacctgggagagggatgaaggatggaaatgggagggaaacatccctgagtgcctgctaggtattggccctggggtcagagtgccactgaccctactcttgaagctcctcaaactacaacaggggctcaagccacaggagggccccgcaggcctctatgcctc

SEQ ID NO: 102939 - DNA, 201 bp, Bos taurus
gccctgccctactcacccccgtgacccactccccacagggtcttagtccaagttcgaccatcccttcatggctcagacccactccccacagggtgggccctgtctctcagggagaaacaaccctacaatagtcctcaagtacccgcctgctctgacctctgagatgctgcctggcctcaactcccccaggtctaccccaag

SEQ ID NO: 102940 - DNA, 201 bp, Bos taurus; identical to SEQ ID NO: 21727

SEQ ID NO: 102941 - DNA, 201 bp, Bos taurus
ctgcagatttgccttttcgcagttttggaggaacagagaaaacgggtattgggtggagctggatgagaagccacagagggccctgggaatctggagatgaactctggctcctgcctcctctctgagccttaaggaccccaatatgattgaggaaggccagaggctttgtaggtctctctcttcatcatcaggggaatatta

SEQ ID NO: 102942 - DNA, 201 bp, Bos taurus; identical to SEQ ID NO: 21728

SEQ ID NO: 102943 - DNA, 201 bp, Bos taurus; identical to SEQ ID NO: 21729

SEQ ID NO: 102944 - DNA, 201 bp, Bos taurus
tatcccccgggctcctggaagggcacctgaaatgcagcaggtgttcattgctgagtgagtgcaatgccagcctcctccactggcctctgcccccttctcccctctctgcattctcatgtgggaggataaagcacagcgcttattcttaacacaaacaaaggcctaaagttaaaggaaaaaaaatggacatcatagttcgag

SEQ ID NO: 102945 - DNA, 201 bp, Bos taurus
tgacattggccttgatgtttttagtaagcctctcttctggtcagagaggtgggatgtctgtccaaaattctcagagcagcagatccagtgctcaggtctcttgacctggccacagcaagcacatcagctgcatattagaattttcttcagctctctatggggtgacttgcatgatgtgaccttcatgatgcctgatgtgct

SEQ ID NO: 102946 - DNA, 201 bp, Bos taurus; identical to SEQ ID NO: 21733

SEQ ID NO: 102947 - DNA, 201 bp, Bos taurus; identical to SEQ ID NO: 21734

SEQ ID NO: 102948 - DNA, 201 bp, Bos taurus; identical to SEQ ID NO: 21735

SEQ ID NO: 102949 - DNA, 201 bp, Bos taurus
gtgaattttagatattcgaagttgtttccatgacaattagttgtaggaatgtgggatcatttttcaaaagagattctagatcatataaaagaatagagacgtacttagcctccaagttctctaattctacaggagaacataattttagatggcatttgaaattatttacataatacatgctttattatgcgctatgaagaa

SEQ ID NO: 102950 - DNA, 201 bp, Bos taurus; identical to SEQ ID NO: 21737

SEQ ID NO: 102951 - DNA, 201 bp, Bos taurus
tgatttgaacttcctggagtacaagggactttcaagagtcttctccagcactgcagtttgaaagcatcaatttttggtagtcagcctttctacggcccaacgctcgcatctgtacatgactactggaaaaaccatagtttttaagatatggactttgttggcaaagtgatgactctacttttaaatacactgtctaggttt

SEQ ID NO: 102952 - DNA, 201 bp, Bos taurus
cagagcacattgctttttatgatatgataaggcatcatgtggttctcagattccatggaattcttgttctaagtacccatccctttccatcatcgccctcgttcttggattggtccaatgcacagattcggggaagaaatcttgttgtcagtgtccttgcagtttccgtctcttagcaacagcccatgctcctgttcctct

SEQ ID NO: 102953 - DNA, 201 bp, Bos taurus; identical to SEQ ID NO: 21738

SEQ ID NO: 102954 - DNA, 201 bp, Bos taurus
tagaagaggagaggaaggatttcctcattgaaacaacggagggagcatggccctgcgcacaccttgatttagaaggtctggccttcagaactggagagaaaaagtatttgttgctttctgccacccactgtgtgatagtctgttacaactgcctgaggccaaccctggtgcacaggttcttctgctgttttacatgaattg

SEQ ID NO: 102955 - DNA, 201 bp, Bos taurus
cccaggcttcaagcagcaaagaggggctgggcgctcagggctgggagctggcccgcccacatccctctacccaggtggctccaggaggcccctgctggcaacgatccccaagtaaacctaaacaagcctggggttgagggaggtcatgcccaaatcctaacagaaacttggcagtcacaagtcggagctctgggccctggg

SEQ ID NO: 102956 - DNA, 201 bp, Bos taurus
tttgcagaaactaatttgccagtattgggcttagaacaggaggttgtctcttcagggctcattttatagataatatttctggattttaatttgaataaaataaatacaggggatgtctctcccataacaatgctgttttgaggatattaataactcttaggctttgtttgctggctcaggatggcccattcttccaagccc

SEQ ID NO: 102957 - DNA, 201 bp, Bos taurus
aacaagttaaacaatgtgttgctaacttagctaaaaggctggctgtgaatccaaaccgtccatcatcggtaggtgactgatgccctgtgtccttaggcccaccttgtgtttccatctgctcttagaagacagatgatggacaagtcaggaaagaattgcaaaggactgacttctggctggggaacccctttctcatctttg

SEQ ID NO: 102958 - DNA, 201 bp, Bos taurus
ttctctgttgagctgctgagtttctggcccttgtgctcgagagtccagcccggctgctgcctcctggcatccctaagcaaactattcaggtctaaggtcgttgcaggcctcggcccagtgtggagaaattctggctggcatgggctggggtgggggtgcttcttcttaccacttgtccccttgtcatgtgggatttcatac

SEQ ID NO: 102959 - DNA, 201 bp, Bos taurus
gtgggctacagtccctttggctgcaaagagtcgaacaccactgaagtgactgagcacatatacaatgtgttaaaaaaagattttgcactaaataagaattctagtgttcaaagaaaaaaaatccagactccaatcatcttgtattacccagttactatgctacaatgaatttcagttataaaatacagggttcttagcaaa

SEQ ID NO: 102960 - DNA, 201 bp, Bos taurus; identical to SEQ ID NO: 21739

SEQ ID NO: 102961 - DNA, 201 bp, Bos taurus
acgaggcctgtggtctagggcaagggtcgccgctttctggagcgcatatgctatgcaaagttgttcagcttttgatttgaaaaccaccacttatgttaagtacatccaggacttggggactgtggccaagtggctggcccccccattctgagtctattcagatccactaggcgccaccgagcggaagtttcctttccaagg

SEQ ID NO: 102962 - DNA, 201 bp, Bos taurus; identical to SEQ ID NO: 21740

SEQ ID NO: 102963 - DNA, 201 bp, Bos taurus
gggcagccaggccagtgaccacagccccccagcccccacatgctgctgccgcagacctgccaagcctggcgccatctgtcaaggtgcaagtgggccgcacagtcctatcatcaccgacatcacactccacctcctgctttccagacgcccacaagaggaggctttctttccgtggcaaagagcaataaactctgagcgtgt

SEQ ID NO: 102964 - DNA, 201 bp, Bos taurus; identical to SEQ ID NO: 21741

SEQ ID NO: 102965 - DNA, 201 bp, Bos taurus; identical to SEQ ID NO: 21742

SEQ ID NO: 102966 - DNA, 201 bp, Bos taurus; identical to SEQ ID NO: 21743

SEQ ID NO: 102967 - DNA, 201 bp, Bos taurus; identical to SEQ ID NO: 21745

SEQ ID NO: 102968 - DNA, 201 bp, Bos taurus
cttcctctttcatcagagcagctcggaatgtccagcaccaactttgcctgcatctgttttgggaagtaagatgatagctttctccataattattcattgacgtgtacatatcaagatataaggcaagtgaattttctgggcatttgtagttatactctcttctgacttaaagcagatatgcaagccatcttttccaaagtg

SEQ ID NO: 102969 - DNA, 201 bp, Bos taurus
agctggcctgccttgagctcaggctgtctcacaccaggggcaggacctgatagaactctctacctggaactccagagaccaagggctgtggatggggcaccgtggcctctgctatagcagggatacatcaacccttatattaacctcttcatttcttttatttttttatgtatttctttttattttttctgtgtatatgct

SEQ ID NO: 102970 - DNA, 201 bp, Bos taurus
gtcttcatcttggactaaatttattatgtggttggagccaaaaggaaacaatgaattcaaacaaaattctgtttcagtttttcagtggcaggtctttggtggtctctctccatcccagagaactcatgcttttgaactatggtgttggagaagactcttgagtgtcccttggactccaaggagatcaaaccagtccatcct

SEQ ID NO: 102971 - DNA, 201 bp, Bos taurus
gcacaggacacagctctgcaccttccagcagtcactctcagcagctaaaggctgcaccccccagccccacaagcaccttgccttcctacaggccatctgaccccacctccttgctctgttggtgattaaactgtaattaaaacatgtttatggactttcccagtggcccagttgtttagaatccacctgccaatgcagggg

SEQ ID NO: 102972 - DNA, 201 bp, Bos taurus; identical to SEQ ID NO: 21746

SEQ ID NO: 102973 - DNA, 201 bp, Bos taurus; identical to SEQ ID NO: 21747

SEQ ID NO: 102974 - DNA, 201 bp, Bos taurus; identical to SEQ ID NO: 21748

SEQ ID NO: 102975 - DNA, 201 bp, Bos taurus; identical to SEQ ID NO: 21749

SEQ ID NO: 102976 - DNA, 201 bp, Bos taurus; identical to SEQ ID NO: 21750

SEQ ID NO: 102977 - DNA, 201 bp, Bos taurus; identical to SEQ ID NO: 21753

SEQ ID NO: 102978 - DNA, 201 bp, Bos taurus
cagagagttctctctgtcctccctttttaactttcttcttttccttctttttttttatttcctcctctgccttaaccttattccagaatcaacaaacaagttttacatttgtctggcaggaacaaattatgcccaactgttttcttggcctcagttccctattctgttcccagttttatttctaaaacataaatttgacca

SEQ ID NO: 102979 - DNA, 201 bp, Bos taurus
ctgaagggaagtgtgaaagatattttccaaaaactgagagagaataaactatatagaatctttcttatgtttattgtttctctctaagcagtccatgttatctccccaaagcgattttcctttcattgcagatatgcttggctgaccaactggacacaagctgtaaaaatcagagggggagaaattgctttagtagattca

SEQ ID NO: 102980 - DNA, 201 bp, Bos taurus; identical to SEQ ID NO: 21755

SEQ ID NO: 102981 - DNA, 201 bp, Bos taurus
tacttttgagaataccgtggtataacagaggaccaggaacaccagttacaattttctgtggcatattatgcatggttcaattaaaatgtcctgtcaaacaacaacctgagaattaacatagctaatgtccctcctgaagtacatgaattctgatagtaggtttaatgtgatacctatacagttagggtattctgggaagaa

SEQ ID NO: 102982 - DNA, 201 bp, Bos taurus; identical to SEQ ID NO: 21756

SEQ ID NO: 102983 - DNA, 201 bp, Bos taurus; identical to SEQ ID NO: 21757

SEQ ID NO: 102984 - DNA, 201 bp, Bos taurus; identical to SEQ ID NO: 21758

SEQ ID NO: 102985 - DNA, 201 bp, Bos taurus; identical to SEQ ID NO: 21760

SEQ ID NO: 102986 - DNA, 201 bp, Bos taurus
taagtaacaggcaatgttaggttttcaaacctgccatagaagtgtctaataagtccatgatctccataccttcctttatgattcacactgttacttggaacaagaggcagatcaatttagggcagggttagagggataatcatagtaattatctattatttgactagattatccttccttaagtgagtccagtctcccttc

SEQ ID NO: 102987 - DNA, 201 bp, Bos taurus; identical to SEQ ID NO: 21761

SEQ ID NO: 102988 - DNA, 201 bp, Bos taurus; identical to SEQ ID NO: 21764

SEQ ID NO: 102989 - DNA, 201 bp, Bos taurus; identical to SEQ ID NO: 21765

SEQ ID NO: 102990 - DNA, 201 bp, Bos taurus; identical to SEQ ID NO: 21767

SEQ ID NO: 102991 - DNA, 201 bp, Bos taurus; identical to SEQ ID NO: 21768

SEQ ID NO: 102992 - DNA, 201 bp, Bos taurus; identical to SEQ ID NO: 21769

SEQ ID NO: 102993 - DNA, 201 bp, Bos taurus
ccatcgtttggctgtgaaacagttgatattattttttgtcagagatgaggaagaaacagtctaaaaaggtaaatggatcaaggttatataggtggtaaatagtagagtgagggtttgaatccagatctttttggatcctctttctattactctatgatgcctctcgttaaagaactgtattggaaaggttcgccattaacc

SEQ ID NO: 102994 - DNA, 201 bp, Bos taurus; identical to SEQ ID NO: 21770

SEQ ID NO: 102995 - DNA, 201 bp, Bos taurus; identical to SEQ ID NO: 21771

SEQ ID NO: 102996 - DNA, 201 bp, Bos taurus; identical to SEQ ID NO: 21772

SEQ ID NO: 102997 - DNA, 201 bp, Bos taurus
acagaggggaggcaggtttctttgggaaggggagcctgcccacctcccaaagtcaacagtatggaggaacacatcatgggagttggaggagtggccacaacagagataaaaaaaaaaaaaaagtctgtaggatggctggcttgtttaactttttaaacttccctcctttcccccattaaatctacctgcagagtgggtgtc

SEQ ID NO: 102998 - DNA, 201 bp, Bos taurus
gaatgatggaggtgggttggatgagacagcgtggggaaagggccgaactaagagctaaggggcgcctggacttgctggtgcatcagtgggaaaatccgagggctatttaaggagaaaatgggccttgtgacggcttgttatggaggctgtgaagactagtaacacttcctcccctcctgggggagtaaggctggaaccaga

SEQ ID NO: 102999 - DNA, 201 bp, Bos taurus; identical to SEQ ID NO: 21774

SEQ ID NO: 103000 - DNA, 201 bp, Bos taurus
cggagctggtcccatcatgggcctggatggcctcctcggtgcaggtctcccttgggctcccagcccaggcagaggccatcccagcatcaggcatcatcacagtctgccttcctgactcttcgctgcatacaggctctcaccctcctccaaccccaggcccaggctagcacctggccggcagtgtttcctggctgttggact

SEQ ID NO: 103001 - DNA, 201 bp, Bos taurus
gagtctactgatccatcctctgctccccatctcttacccttccctggtaaacccctactcctacttgagcacttacttcaaaaatctctgtcttcgttaagtctcatccaatcctcactcccctcccctcccccaggcttgccctctgggttcctcttttattacagttgttaggtgtttacattccagtttctttactag

SEQ ID NO: 103002 - DNA, 201 bp, Bos taurus
gccttccttgactcacggctgattttcttcctcataatggacaacttaaagattcatatgattgctaatgaaaataagaccacaaacttgcttcagggataagactgtcttcatctttgtatggttagcacatagtaggtgctcattagacgacactgaatggatgaatagtaatactgatttatggaattcaattagcac

SEQ ID NO: 103003 - DNA, 201 bp, Bos taurus; identical to SEQ ID NO: 21778

SEQ ID NO: 103004 - DNA, 201 bp, Bos taurus; identical to SEQ ID NO: 21781

SEQ ID NO: 103005 - DNA, 201 bp, Bos taurus; identical to SEQ ID NO: 21782

SEQ ID NO: 103006 - DNA, 201 bp, Bos taurus; identical to SEQ ID NO: 21783

SEQ ID NO: 103007 - DNA, 201 bp, Bos taurus; identical to SEQ ID NO: 21784

SEQ ID NO: 103008 - DNA, 201 bp, Bos taurus; identical to SEQ ID NO: 21785

SEQ ID NO: 103009 - DNA, 201 bp, Bos taurus; identical to SEQ ID NO: 21786

SEQ ID NO: 103010 - DNA, 201 bp, Bos taurus; identical to SEQ ID NO: 21787

SEQ ID NO: 103011 - DNA, 201 bp, Bos taurus; identical to SEQ ID NO: 21788

SEQ ID NO: 103012 - DNA, 201 bp, Bos taurus; identical to SEQ ID NO: 21789

SEQ ID NO: 103013 - DNA, 201 bp, Bos taurus; identical to SEQ ID NO: 21790

SEQ ID NO: 103014 - DNA, 201 bp, Bos taurus; identical to SEQ ID NO: 21791

SEQ ID NO: 103015 - DNA, 201 bp, Bos taurus; identical to SEQ ID NO: 21792

SEQ ID NO: 103016 - DNA, 201 bp, Bos taurus; identical to SEQ ID NO: 21793

SEQ ID NO: 103017 - DNA, 201 bp, Bos taurus; identical to SEQ ID NO: 21794

SEQ ID NO: 103018 - DNA, 201 bp, Bos taurus; identical to SEQ ID NO: 21795

SEQ ID NO: 103019 - DNA, 201 bp, Bos taurus; identical to SEQ ID NO: 21796

SEQ ID NO: 103020 - DNA, 201 bp, Bos taurus; identical to SEQ ID NO: 21797

SEQ ID NO: 103021 - DNA, 201 bp, Bos taurus; identical to SEQ ID NO: 21798

SEQ ID NO: 103022 - DNA, 201 bp, Bos taurus; identical to SEQ ID NO: 21799

SEQ ID NO: 103023 - DNA, 201 bp, Bos taurus; identical to SEQ ID NO: 21800

SEQ ID NO: 103024 - DNA, 201 bp, Bos taurus; identical to SEQ ID NO: 21801

SEQ ID NO: 103025 - DNA, 201 bp, Bos taurus; identical to SEQ ID NO: 21802

SEQ ID NO: 103026 - DNA, 201 bp, Bos taurus; identical to SEQ ID NO: 21803

SEQ ID NO: 103027 - DNA, 201 bp, Bos taurus; identical to SEQ ID NO: 21804

SEQ ID NO: 103028 - DNA, 201 bp, Bos taurus; identical to SEQ ID NO: 21805

SEQ ID NO: 103029 - DNA, 201 bp, Bos taurus; identical to SEQ ID NO: 21806

SEQ ID NO: 103030 - DNA, 201 bp, Bos taurus; identical to SEQ ID NO: 21807

SEQ ID NO: 103031 - DNA, 201 bp, Bos taurus; identical to SEQ ID NO: 21809

SEQ ID NO: 103032 - DNA, 201 bp, Bos taurus; identical to SEQ ID NO: 21810

SEQ ID NO: 103033 - DNA, 201 bp, Bos taurus; identical to SEQ ID NO: 21811

SEQ ID NO: 103034 - DNA, 201 bp, Bos taurus; identical to SEQ ID NO: 21812

SEQ ID NO: 103035 - DNA, 201 bp, Bos taurus; identical to SEQ ID NO: 21813

SEQ ID NO: 103036 - DNA, 201 bp, Bos taurus; identical to SEQ ID NO: 21814

SEQ ID NO: 103037 - DNA, 201 bp, Bos taurus; identical to SEQ ID NO: 21815

SEQ ID NO: 103038 - DNA, 201 bp, Bos taurus; identical to SEQ ID NO: 21816

SEQ ID NO: 103039 - DNA, 201 bp, Bos taurus; identical to SEQ ID NO: 21817

SEQ ID NO: 103040 - DNA, 201 bp, Bos taurus; identical to SEQ ID NO: 21818

SEQ ID NO: 103041 - DNA, 201 bp, Bos taurus; identical to SEQ ID NO: 21819

SEQ ID NO: 103042 - DNA, 201 bp, Bos taurus; identical to SEQ ID NO: 21820

SEQ ID NO: 103043 - DNA, 201 bp, Bos taurus; identical to SEQ ID NO: 21821

SEQ ID NO: 103044 - DNA, 201 bp, Bos taurus; identical to SEQ ID NO: 21822

SEQ ID NO: 103045 - DNA, 201 bp, Bos taurus; identical to SEQ ID NO: 21823

SEQ ID NO: 103046 - DNA, 201 bp, Bos taurus; identical to SEQ ID NO: 21824

SEQ ID NO: 103047 - DNA, 201 bp, Bos taurus; identical to SEQ ID NO: 21825

SEQ ID NO: 103048 - DNA, 201 bp, Bos taurus; identical to SEQ ID NO: 21826

SEQ ID NO: 103049 - DNA, 201 bp, Bos taurus; identical to SEQ ID NO: 21827

SEQ ID NO: 103050 - DNA, 201 bp, Bos taurus; identical to SEQ ID NO: 21828

SEQ ID NO: 103051 - DNA, 201 bp, Bos taurus; identical to SEQ ID NO: 21829

SEQ ID NO: 103052 - DNA, 201 bp, Bos taurus; identical to SEQ ID NO: 21830

SEQ ID NO: 103053 - DNA, 201 bp, Bos taurus; identical to SEQ ID NO: 21831

SEQ ID NO: 103054 - DNA, 201 bp, Bos taurus; identical to SEQ ID NO: 21832

SEQ ID NO: 103055 - DNA, 201 bp, Bos taurus; identical to SEQ ID NO: 21833

SEQ ID NO: 103056 - DNA, 201 bp, Bos taurus; identical to SEQ ID NO: 21834

SEQ ID NO: 103057 - DNA, 201 bp, Bos taurus; identical to SEQ ID NO: 21835

SEQ ID NO: 103058 - DNA, 201 bp, Bos taurus; identical to SEQ ID NO: 21836

SEQ ID NO: 103059 - DNA, 201 bp, Bos taurus; identical to SEQ ID NO: 21837

SEQ ID NO: 103060 - DNA, 201 bp, Bos taurus; identical to SEQ ID NO: 21838

SEQ ID NO: 103061 - DNA, 201 bp, Bos taurus; identical to SEQ ID NO: 21839

SEQ ID NO: 103062 - DNA, 201 bp, Bos taurus; identical to SEQ ID NO: 21840

SEQ ID NO: 103063 - DNA, 201 bp, Bos taurus; identical to SEQ ID NO: 21841

SEQ ID NO: 103064 - DNA, 201 bp, Bos taurus; identical to SEQ ID NO: 21842

SEQ ID NO: 103065 - DNA, 201 bp, Bos taurus; identical to SEQ ID NO: 21843

SEQ ID NO: 103066 - DNA, 201 bp, Bos taurus; identical to SEQ ID NO: 21844

SEQ ID NO: 103067 - DNA, 201 bp, Bos taurus
gaagagctagatttaaagtggttcaagcttgtactgttcctattttggaaggtgagtctttctactaattctcagaggccattgttcttatttctctgcaatattttgtgttctgtccatggtggacaatatgtgttgctttgcctgcctagttctcttccttcatgagtaccaacccaggccagcccatccaatctacct

SEQ ID NO: 103068 - DNA, 201 bp, Bos taurus
acccaatgaccataagaatgtgtgcactggcaaagacaaatgtaactttttcttctactctgataaggacagcagtgctttctcgggttcataggagccctagagtgtgtatttcagtaaaaggactcctataagaaatcttgacctagaagttactctccaggatttaaaaactgaagatgagccaagagagaagtcctg

SEQ ID NO: 103069 - DNA, 201 bp, Bos taurus
ttcaacatcaactgcctcaaagtcattccttcaaacaacaactaggaatgacaacaggaaagactgaaaagcagtgtgcattgccaacaaaatctatactgaaaatcactaaacatggagattggaacacagtcctagatcaaatcctaaatgaattttagtagaagttcgtgaaataatgtttaaagcacaagaatacat

SEQ ID NO: 103070 - DNA, 201 bp, Bos taurus; identical to SEQ ID NO: 21846

SEQ ID NO: 103071 - DNA, 201 bp, Bos taurus; identical to SEQ ID NO: 21847

SEQ ID NO: 103072 - DNA, 201 bp, Bos taurus; identical to SEQ ID NO: 21849

SEQ ID NO: 103073 - DNA, 201 bp, Bos taurus; identical to SEQ ID NO: 21850

SEQ ID NO: 103074 - DNA, 201 bp, Bos taurus; identical to SEQ ID NO: 21851

SEQ ID NO: 103075 - DNA, 201 bp, Bos taurus
accttgccttttgtttgtgggggaaaaaaagttaaagattaagcttaatgaaagtagtgagaaaaagcaaaaggaaagcaaaggaaaatagtccagcaagaccaaataataagagtatatacattaagcaaagtcaaggacctttagttccatgtcaagggctatagataatttgagtcatatcctttgagccattgtgca

SEQ ID NO: 103076 - DNA, 201 bp, Bos taurus; identical to SEQ ID NO: 21852

SEQ ID NO: 103077 - DNA, 201 bp, Bos taurus
aaaaacatacttatttttctaatatctagtttatagtatcttttaaaagataactctcaataaaataaatttttaaacaattgattttcagattggaaaacaagtaatataagagaaagacactacatggtttcattaccatctgtttcctgatttgtatttcctcatttcattctgaatattcagaatgtgatcatcttt

SEQ ID NO: 103078 - DNA, 201 bp, Bos taurus; identical to SEQ ID NO: 21855

SEQ ID NO: 103079 - DNA, 201 bp, Bos taurus
gctgtgcaaaaccatttaaatttaattaggtacattcacttatttttgtttttatttctcttgcattaggagaaacatcctagtaaaagtcttgctataacttatgttaaagaatactctgtgtaggttctctttcaggagttttatgatttctggttttaggtctataatgcattttgagttttcttttgtatatggtgt

SEQ ID NO: 103080 - DNA, 201 bp, Bos taurus
tagctatctattttgtatatgacagtgcaaatatgtcaatatgctattctcttgtctcactctctccccgtacctgctatgtcctcaagactgttcactatatttgccctgcaaataagttcatttattccctttttgtagattccatacatatgtgctaatatgataaaaataagttttaattattaaatgcctaagtag

SEQ ID NO: 103081 - DNA, 201 bp, Bos taurus
aaatggaaaaataataccctgcttacaatatcatcatttattaaaggtaagaaagacattaataatcaggatcagtaagtataaatacatgagtatttttacacactactaatgtgaattatcaatgcaaagaaatagaggaaaacaacagaatgggaaagactagagatctcttcaagaaaattagagataccaagggaa

SEQ ID NO: 103082 - DNA, 201 bp, Bos taurus
gaaaaggccacaaggtcctcctaatccagttgaataattcttgtttagattgattcaacatttttaaattatttttctcaatttacatttttacatttacattatttttcatatccttcccctgtatagtttattataagatgttgaatatagttccctgtgctatacaatgaatccttattgtttattttatatgtagtg

SEQ ID NO: 103083 - DNA, 201 bp, Bos taurus
gtagaaacgaatttctgcatagagatggaaagtagtgaaacaagtatactgcttatgagtacagtatgtatggatagacacatgggtgggctcagaaggagaatttggccctcatagtagtgaatagcttatatggggcatttcttctgggtttcctttgaccagtcatcacactttgcctggttctaagtccatatttgc

SEQ ID NO: 103084 - DNA, 201 bp, Bos taurus
caagtcagattcctaaagctacccctcacttactgagattacatagacagtgcaatcaaaacctttgaacctcccggattctataggaaggagaacacacgatcaacaagcacctcactcacactaaaatcttaagctccatttctcacataaaactgtatcttaaaacctttctagtcattttaatgagagagagatggg

SEQ ID NO: 103085 - DNA, 201 bp, Bos taurus; identical to SEQ ID NO: 21858

SEQ ID NO: 103086 - DNA, 201 bp, Bos taurus; identical to SEQ ID NO: 21860

SEQ ID NO: 103087 - DNA, 201 bp, Bos taurus; identical to SEQ ID NO: 21861

SEQ ID NO: 103088 - DNA, 201 bp, Bos taurus; identical to SEQ ID NO: 21862

SEQ ID NO: 103089 - DNA, 201 bp, Bos taurus; identical to SEQ ID NO: 21863

SEQ ID NO: 103090 - DNA, 201 bp, Bos taurus
caaaaactcataaactgaaattttgcagcagaaagtatgtgatgtcatctgtagctattttttttaccaaggagaacagtaaccccatgaaagaagtcaggcttcacttgtgattttatgttcaaatctcaagtagttatgtttatcttgcaagaatgcaaggagaaagaggagatatatcgtttctgagactttgatcag

SEQ ID NO: 103091 - DNA, 201 bp, Bos taurus
atgcaaagagaatatctaaataaggtctacaagaaaattttttgtaatgctgcttcctagaggctggaatattaatcaaagctaaatactaattctctttcttacttctacatatggaactctgatttaatttaagtaatgccatattcataagccttattaaaattaattgctcttttcattttttaatctggtttgtca

SEQ ID NO: 103092 - DNA, 201 bp, Bos taurus
aaagttgaggaaagataagaaagagaaaaaaagaaactgagcccttttagggctctttaggtgaagaaggtcaatctgaggatgctgcagaagcatgtcccagcgtgggaaaggaaaagagtggagtttgacataacggaactaaggatagaatgcattcaaagaaggggatggttaactgtgcatgataataataagcaa

SEQ ID NO: 103093 - DNA, 201 bp, Bos taurus; identical to SEQ ID NO: 21864

SEQ ID NO: 103094 - DNA, 201 bp, Bos taurus; identical to SEQ ID NO: 21865

SEQ ID NO: 103095 - DNA, 201 bp, Bos taurus
tctatatgttgaactgaaaacccattttttatttgcacttttataatcccttatatatatatataaagtataaataaaatgttttttaaagatatgaatttaattcagttcttctcagagaatttattcattccagcaataaatcttgctacctttctaagtccttgctttgtgccagaaattgtgctaagctcttagata

SEQ ID NO: 103096 - DNA, 201 bp, Bos taurus; identical to SEQ ID NO: 21871

SEQ ID NO: 103097 - DNA, 201 bp, Bos taurus; identical to SEQ ID NO: 21872

SEQ ID NO: 103098 - DNA, 201 bp, Bos taurus; identical to SEQ ID NO: 21873

SEQ ID NO: 103099 - DNA, 201 bp, Bos taurus; identical to SEQ ID NO: 21874

SEQ ID NO: 103100 - DNA, 201 bp, Bos taurus; identical to SEQ ID NO: 21876

SEQ ID NO: 103101 - DNA, 201 bp, Bos taurus; identical to SEQ ID NO: 21877

SEQ ID NO: 103102 - DNA, 201 bp, Bos taurus; identical to SEQ ID NO: 21882

SEQ ID NO: 103103 - DNA, 201 bp, Bos taurus; identical to SEQ ID NO: 21883

SEQ ID NO: 103104 - DNA, 201 bp, Bos taurus; identical to SEQ ID NO: 21888

SEQ ID NO: 103105 - DNA, 201 bp, Bos taurus; identical to SEQ ID NO: 21895

SEQ ID NO: 103106 - DNA, 201 bp, Bos taurus; identical to SEQ ID NO: 21896

SEQ ID NO: 103107 - DNA, 201 bp, Bos taurus; identical to SEQ ID NO: 21897

SEQ ID NO: 103108 - DNA, 201 bp, Bos taurus; identical to SEQ ID NO: 21900

SEQ ID NO: 103109 - DNA, 201 bp, Bos taurus; identical to SEQ ID NO: 21901

SEQ ID NO: 103110 - DNA, 201 bp, Bos taurus; identical to SEQ ID NO: 21902

SEQ ID NO: 103111 - DNA, 201 bp, Bos taurus; identical to SEQ ID NO: 21903

SEQ ID NO: 103112 - DNA, 201 bp, Bos taurus; identical to SEQ ID NO: 21904

SEQ ID NO: 103113 - DNA, 201 bp, Bos taurus; identical to SEQ ID NO: 21905

SEQ ID NO: 103114 - DNA, 201 bp, Bos taurus; identical to SEQ ID NO: 21907

SEQ ID NO: 103115 - DNA, 201 bp, Bos taurus; identical to SEQ ID NO: 21911

SEQ ID NO: 103116 - DNA, 201 bp, Bos taurus; identical to SEQ ID NO: 21912

SEQ ID NO: 103117 - DNA, 201 bp, Bos taurus; identical to SEQ ID NO: 21915

SEQ ID NO: 103118 - DNA, 201 bp, Bos taurus; identical to SEQ ID NO: 21916

SEQ ID NO: 103119 - DNA, 201 bp, Bos taurus; identical to SEQ ID NO: 21918

SEQ ID NO: 103120 - DNA, 201 bp, Bos taurus; identical to SEQ ID NO: 21919

SEQ ID NO: 103121 - DNA, 201 bp, Bos taurus; identical to SEQ ID NO: 21921

SEQ ID NO: 103122 - DNA, 201 bp, Bos taurus; identical to SEQ ID NO: 21928

SEQ ID NO: 103123 - DNA, 201 bp, Bos taurus; identical to SEQ ID NO: 21929

SEQ ID NO: 103124 - DNA, 201 bp, Bos taurus; identical to SEQ ID NO: 21930

SEQ ID NO: 103125 - DNA, 201 bp, Bos taurus; identical to SEQ ID NO: 21931

SEQ ID NO: 103126 - DNA, 201 bp, Bos taurus; identical to SEQ ID NO: 21932

SEQ ID NO: 103127 - DNA, 201 bp, Bos taurus; identical to SEQ ID NO: 21935

SEQ ID NO: 103128 - DNA, 201 bp, Bos taurus; identical to SEQ ID NO: 21936

SEQ ID NO: 103129 - DNA, 201 bp, Bos taurus; identical to SEQ ID NO: 21938

SEQ ID NO: 103130 - DNA, 201 bp, Bos taurus
actgttagctgcttcagttttcaaaaacaaaatttgagtagttcatataatctggagagagaaataaatcagattcccttacttaaatattatgttgtaatagcctggtgctgagaacagtcctttgttcaacagaactgactgaaacctttctatcacttggcagagatcacaccaggactcaccgtctcagcaattgta

SEQ ID NO: 103131 - DNA, 201 bp, Bos taurus; identical to SEQ ID NO: 21941

SEQ ID NO: 103132 - DNA, 201 bp, Bos taurus
tagcttccattaagttaaccacccaaagattgttttctcatgaaatgttgagctttagtacattaaacttgagtgaacgtgtgaaaccctagtcacctcaatcttaatgaaggcagaaccctaggttcatgcccttctcctcactctctgtccctccccttctctctctctcccgcagtagcctcactgtcttcactatgt

SEQ ID NO: 103133 - DNA, 201 bp, Bos taurus; identical to SEQ ID NO: 21942

SEQ ID NO: 103134 - DNA, 201 bp, Bos taurus
gccagaggagccgtgagtccagacccaaaaggtctagataacttctttacaccagacactgatgtgggtgccactgtcatcccatgtctcctcccagagttccgcagagggagcaaagcaaaggccttctgcttctaagggtctttagcatctttaaagcaccttcccttctggagcagcttctgcctgcaaagtgatggt

SEQ ID NO: 103135 - DNA, 201 bp, Bos taurus
cactgtactaacatgtccttgttttctcaatttacagcaagacggaccttttccccctaaactcagtattggtgtttcaatgggacaggaaatggtgatgcttttgtagtctgtaatcccaccggcttccgaggctctgcgtcagcaccgcgggccatactgtcagtggaagatattatattgctggaccctggtgctcaa

SEQ ID NO: 103136 - DNA, 201 bp, Bos taurus; identical to SEQ ID NO: 21948

SEQ ID NO: 103137 - DNA, 201 bp, Bos taurus
atgtcccattaatttctggacaatgagtaaggggccataaagggcagattggtgactggaaaagtagagagaacgtctttcctggttcttctcagacctccctgggtcttagggccccaactctcttacagtcccgtcttggcccttgtacctcaaacactggggtttccagggctctttgctcacacaagtgctgttctt

SEQ ID NO: 103138 - DNA, 201 bp, Bos taurus
gaatggataaagtaaatgtgtgtatatatatataaaggtcttgaggagctaatgtataaaatggtgactatagttcataatattgtattgtataatggaagtttgctaagagggcagatgtgttaatagactatatgaaaataatcctttcacaaatatcaaatcattactatgtatacatcaaatatcttacaattttgt

SEQ ID NO: 103139 - DNA, 201 bp, Bos taurus; identical to SEQ ID NO: 21949

SEQ ID NO: 103140 - DNA, 201 bp, Bos taurus; identical to SEQ ID NO: 21950

SEQ ID NO: 103141 - DNA, 201 bp, Bos taurus; identical to SEQ ID NO: 21951

SEQ ID NO: 103142 - DNA, 201 bp, Bos taurus; identical to SEQ ID NO: 21952

SEQ ID NO: 103143 - DNA, 201 bp, Bos taurus; identical to SEQ ID NO: 21954

SEQ ID NO: 103144 - DNA, 201 bp, Bos taurus; identical to SEQ ID NO: 21956

SEQ ID NO: 103145 - DNA, 201 bp, Bos taurus; identical to SEQ ID NO: 21957

SEQ ID NO: 103146 - DNA, 201 bp, Bos taurus; identical to SEQ ID NO: 21959

SEQ ID NO: 103147 - DNA, 201 bp, Bos taurus; identical to SEQ ID NO: 21960

SEQ ID NO: 103148 - DNA, 201 bp, Bos taurus; identical to SEQ ID NO: 21964

SEQ ID NO: 103149 - DNA, 201 bp, Bos taurus; identical to SEQ ID NO: 21967

SEQ ID NO: 103150 - DNA, 201 bp, Bos taurus; identical to SEQ ID NO: 21970

SEQ ID NO: 103151 - DNA, 201 bp, Bos taurus; identical to SEQ ID NO: 21972

SEQ ID NO: 103152 - DNA, 201 bp, Bos taurus; identical to SEQ ID NO: 21975

SEQ ID NO: 103153 - DNA, 201 bp, Bos taurus; identical to SEQ ID NO: 21980

SEQ ID NO: 103154 - DNA, 201 bp, Bos taurus; identical to SEQ ID NO: 21981

SEQ ID NO: 103155 - DNA, 201 bp, Bos taurus; identical to SEQ ID NO: 21983

SEQ ID NO: 103156 - DNA, 201 bp, Bos taurus; identical to SEQ ID NO: 21985

SEQ ID NO: 103157 - DNA, 201 bp, Bos taurus; identical to SEQ ID NO: 21988

SEQ ID NO: 103158 - DNA, 201 bp, Bos taurus; identical to SEQ ID NO: 21989

SEQ ID NO: 103159 - DNA, 201 bp, Bos taurus; identical to SEQ ID NO: 21992

SEQ ID NO: 103160 - DNA, 201 bp, Bos taurus; identical to SEQ ID NO: 21993

SEQ ID NO: 103161 - DNA, 201 bp, Bos taurus; identical to SEQ ID NO: 21994

SEQ ID NO: 103162 - DNA, 201 bp, Bos taurus; identical to SEQ ID NO: 21995

SEQ ID NO: 103163 - DNA, 201 bp, Bos taurus; identical to SEQ ID NO: 21996

SEQ ID NO: 103164 - DNA, 201 bp, Bos taurus; identical to SEQ ID NO: 21998

SEQ ID NO: 103165 - DNA, 201 bp, Bos taurus; identical to SEQ ID NO: 21999

SEQ ID NO: 103166 - DNA, 201 bp, Bos taurus; identical to SEQ ID NO: 22004

SEQ ID NO: 103167 - DNA, 201 bp, Bos taurus; identical to SEQ ID NO: 22007

SEQ ID NO: 103168 - DNA, 201 bp, Bos taurus; identical to SEQ ID NO: 22008

SEQ ID NO: 103169 - DNA, 201 bp, Bos taurus; identical to SEQ ID NO: 22009

SEQ ID NO: 103170 - DNA, 201 bp, Bos taurus; identical to SEQ ID NO: 22011

SEQ ID NO: 103171 - DNA, 201 bp, Bos taurus; identical to SEQ ID NO: 22012

SEQ ID NO: 103172 - DNA, 201 bp, Bos taurus; identical to SEQ ID NO: 22013

SEQ ID NO: 103173 - DNA, 201 bp, Bos taurus; identical to SEQ ID NO: 22014

SEQ ID NO: 103174 - DNA, 201 bp, Bos taurus; identical to SEQ ID NO: 22015

SEQ ID NO: 103175 - DNA, 201 bp, Bos taurus; identical to SEQ ID NO: 22016

SEQ ID NO: 103176 - DNA, 201 bp, Bos taurus; identical to SEQ ID NO: 22017

SEQ ID NO: 103177 - DNA, 201 bp, Bos taurus; identical to SEQ ID NO: 22018

SEQ ID NO: 103178 - DNA, 201 bp, Bos taurus; identical to SEQ ID NO: 22019

SEQ ID NO: 103179 - DNA, 201 bp, Bos taurus; identical to SEQ ID NO: 22020

SEQ ID NO: 103180 - DNA, 201 bp, Bos taurus; identical to SEQ ID NO: 22021

SEQ ID NO: 103181 - DNA, 201 bp, Bos taurus; identical to SEQ ID NO: 22025

SEQ ID NO: 103182 - DNA, 201 bp, Bos taurus; identical to SEQ ID NO: 22026

SEQ ID NO: 103183 - DNA, 201 bp, Bos taurus; identical to SEQ ID NO: 22027

SEQ ID NO: 103184 - DNA, 201 bp, Bos taurus; identical to SEQ ID NO: 22029

SEQ ID NO: 103185 - DNA, 201 bp, Bos taurus; identical to SEQ ID NO: 22032

SEQ ID NO: 103186 - DNA, 201 bp, Bos taurus; identical to SEQ ID NO: 22033

SEQ ID NO: 103187 - DNA, 201 bp, Bos taurus; identical to SEQ ID NO: 22034

SEQ ID NO: 103188 - DNA, 201 bp, Bos taurus; identical to SEQ ID NO: 22035

SEQ ID NO: 103189 - DNA, 201 bp, Bos taurus; identical to SEQ ID NO: 22036

SEQ ID NO: 103190 - DNA, 201 bp, Bos taurus; identical to SEQ ID NO: 22039

SEQ ID NO: 103191 - DNA, 201 bp, Bos taurus; identical to SEQ ID NO: 22041

SEQ ID NO: 103192 - DNA, 201 bp, Bos taurus; identical to SEQ ID NO: 22044

SEQ ID NO: 103193 - DNA, 201 bp, Bos taurus; identical to SEQ ID NO: 22045

SEQ ID NO: 103194 - DNA, 201 bp, Bos taurus; identical to SEQ ID NO: 22046

SEQ ID NO: 103195 - DNA, 201 bp, Bos taurus; identical to SEQ ID NO: 22047

SEQ ID NO: 103196 - DNA, 201 bp, Bos taurus; identical to SEQ ID NO: 22048

SEQ ID NO: 103197 - DNA, 201 bp, Bos taurus; identical to SEQ ID NO: 22054

SEQ ID NO: 103198 - DNA, 201 bp, Bos taurus
gaagggttgattgtatttagattagagttaatcaagcaaagctgcagctctccagaagtgagctggaggattcatctttgaaatttaactcaaatcatttaaaatgaaaaaaaaaaaaaaaaggtgattaaaatttcccttttttccctccaatcctcctaagtccctaaagaaatttaagagtatcatcagattgacagc

SEQ ID NO: 103199 - DNA, 201 bp, Bos taurus
tcatgtaattcagaaccaaggtaaaagggtctcatgtcagaaatagtactattagcagccagatcattatagaggttgtttaattaattctttactgtgaggagaaatgccattgacacttcattattttgatactgaaactacaattgggggctttcaaaatgtgtatgtgaaaccacaaatagatcccctcggtccttt

SEQ ID NO: 103200 - DNA, 201 bp, Bos taurus
tgtttcagataaatgagaatctttatgtaagacgaaactgggttattgactcaggacttctcctatctgctgaatctaatacagcaaacatttattggttatcctgatactgacatagctttgtgaattacattcctaggaattctttccagatattcctgccaacatatttagtttcatcttctaggctgaaaatcaatc

SEQ ID NO: 103201 - DNA, 201 bp, Bos taurus; identical to SEQ ID NO: 22055

SEQ ID NO: 103202 - DNA, 201 bp, Bos taurus; identical to SEQ ID NO: 22056

SEQ ID NO: 103203 - DNA, 201 bp, Bos taurus; identical to SEQ ID NO: 22058

SEQ ID NO: 103204 - DNA, 201 bp, Bos taurus; identical to SEQ ID NO: 22059

SEQ ID NO: 103205 - DNA, 201 bp, Bos taurus; identical to SEQ ID NO: 22061

SEQ ID NO: 103206 - DNA, 201 bp, Bos taurus; identical to SEQ ID NO: 22064

SEQ ID NO: 103207 - DNA, 201 bp, Bos taurus; identical to SEQ ID NO: 22065

SEQ ID NO: 103208 - DNA, 201 bp, Bos taurus; identical to SEQ ID NO: 22066

SEQ ID NO: 103209 - DNA, 201 bp, Bos taurus; identical to SEQ ID NO: 22067

SEQ ID NO: 103210 - DNA, 201 bp, Bos taurus; identical to SEQ ID NO: 22068

SEQ ID NO: 103211 - DNA, 201 bp, Bos taurus
atgaacacatttatttctgcaaatgtagaaggatcctacattttcaaaggtgaattgtaaaattataggtttatggtgatccccaagcttctttgccttatgtgtctggcataattgaggatctcacagaacatgattaataactgttatctatggtaatatttcttgaaaggggaaataaactgaggaaaggaaacagag

SEQ ID NO: 103212 - DNA, 201 bp, Bos taurus; identical to SEQ ID NO: 22070

SEQ ID NO: 103213 - DNA, 201 bp, Bos taurus; identical to SEQ ID NO: 22071

SEQ ID NO: 103214 - DNA, 201 bp, Bos taurus; identical to SEQ ID NO: 22072

SEQ ID NO: 103215 - DNA, 201 bp, Bos taurus
tcagtaggccttccaaacgagtttccccctttcatcctctcccctccaccacgtctcccatcagtaacatttcagatcctcttagcacttttattagtccgctgggcctcttcctgaaggtcacattaagatgttaatagtggtttagtgggtttccctgcccaggagtctttaaaaaaacaaacatataaacttttcaat

SEQ ID NO: 103216 - DNA, 201 bp, Bos taurus
aaaataagcgacccgcctcccccggcccagggattcttgtgcactagtccagttgtcagtcctttttatggcagatgctctgtgcttacttttctgctgacgcactggtgaattctttggggaggcctctctgcggatgtccacgcagcaattctttcacaggtgaggcttcttctggttcagttctctgaagcttcctcc

SEQ ID NO: 103217 - DNA, 201 bp, Bos taurus; identical to SEQ ID NO: 22075

SEQ ID NO: 103218 - DNA, 201 bp, Bos taurus; identical to SEQ ID NO: 22076

SEQ ID NO: 103219 - DNA, 201 bp, Bos taurus; identical to SEQ ID NO: 22078

SEQ ID NO: 103220 - DNA, 201 bp, Bos taurus
tcagctcatttaatcatccattgcattgaaatttattgagcgccttctacatggcaggccctggggaagtcacgggagacaagaaaggccatgtccctgccctcataaacttgcagtctagaagggaagcctaacttctaacacaccctttcaatccagtgtgatatgggttatgaaaaacaagaacagggaccctgggag

SEQ ID NO: 103221 - DNA, 201 bp, Bos taurus; identical to SEQ ID NO: 22079

SEQ ID NO: 103222 - DNA, 201 bp, Bos taurus; identical to SEQ ID NO: 22080

SEQ ID NO: 103223 - DNA, 201 bp, Bos taurus; identical to SEQ ID NO: 22082

SEQ ID NO: 103224 - DNA, 201 bp, Bos taurus; identical to SEQ ID NO: 22083

SEQ ID NO: 103225 - DNA, 201 bp, Bos taurus; identical to SEQ ID NO: 22084

SEQ ID NO: 103226 - DNA, 201 bp, Bos taurus; identical to SEQ ID NO: 22085

SEQ ID NO: 103227 - DNA, 201 bp, Bos taurus; identical to SEQ ID NO: 22086

SEQ ID NO: 103228 - DNA, 201 bp, Bos taurus; identical to SEQ ID NO: 22087

SEQ ID NO: 103229 - DNA, 201 bp, Bos taurus; identical to SEQ ID NO: 22090

SEQ ID NO: 103230 - DNA, 201 bp, Bos taurus; identical to SEQ ID NO: 22091

SEQ ID NO: 103231 - DNA, 201 bp, Bos taurus; identical to SEQ ID NO: 22093

SEQ ID NO: 103232 - DNA, 201 bp, Bos taurus; identical to SEQ ID NO: 22094

SEQ ID NO: 103233 - DNA, 201 bp, Bos taurus; identical to SEQ ID NO: 22095

SEQ ID NO: 103234 - DNA, 201 bp, Bos taurus; identical to SEQ ID NO: 22096

SEQ ID NO: 103235 - DNA, 201 bp, Bos taurus; identical to SEQ ID NO: 22097

SEQ ID NO: 103236 - DNA, 201 bp, Bos taurus; identical to SEQ ID NO: 22098

SEQ ID NO: 103237 - DNA, 201 bp, Bos taurus; identical to SEQ ID NO: 22099

SEQ ID NO: 103238 - DNA, 201 bp, Bos taurus; identical to SEQ ID NO: 22100

SEQ ID NO: 103239 - DNA, 201 bp, Bos taurus; identical to SEQ ID NO: 22101

SEQ ID NO: 103240 - DNA, 201 bp, Bos taurus; identical to SEQ ID NO: 22102

SEQ ID NO: 103241 - DNA, 201 bp, Bos taurus; identical to SEQ ID NO: 22103

SEQ ID NO: 103242 - DNA, 201 bp, Bos taurus; identical to SEQ ID NO: 22104

SEQ ID NO: 103243 - DNA, 201 bp, Bos taurus; identical to SEQ ID NO: 22105

SEQ ID NO: 103244 - DNA, 201 bp, Bos taurus; identical to SEQ ID NO: 22106

SEQ ID NO: 103245 - DNA, 201 bp, Bos taurus; identical to SEQ ID NO: 22107

SEQ ID NO: 103246 - DNA, 201 bp, Bos taurus; identical to SEQ ID NO: 22108

SEQ ID NO: 103247 - DNA, 201 bp, Bos taurus; identical to SEQ ID NO: 22109

SEQ ID NO: 103248 - DNA, 201 bp, Bos taurus
ctgtatactcttcgagctatttcacatcaaaatgtagctacacatcaaggagcaaagctatagggtagtcattgtagctagaatttatatattacggtcacttttgctctttgctcttttctagcagaagttccagattttctttaatttataactttccctaattaactcaggactttctctaattattatatttagtct

SEQ ID NO: 103249 - DNA, 201 bp, Bos taurus; identical to SEQ ID NO: 22110

SEQ ID NO: 103250 - DNA, 201 bp, Bos taurus; identical to SEQ ID NO: 22111

SEQ ID NO: 103251 - DNA, 201 bp, Bos taurus; identical to SEQ ID NO: 22112

SEQ ID NO: 103252 - DNA, 201 bp, Bos taurus; identical to SEQ ID NO: 22113

SEQ ID NO: 103253 - DNA, 201 bp, Bos taurus; identical to SEQ ID NO: 22114

SEQ ID NO: 103254 - DNA, 201 bp, Bos taurus; identical to SEQ ID NO: 22115

SEQ ID NO: 103255 - DNA, 201 bp, Bos taurus
tcacatcttaggcatgatttttaactctcatagttactaatgtaatgttggcaaaatgatgggagaatggaagcatacatagcatctttataggaggcaatgtcagagaaactggcttaatgactacaggtcttctagcaaaagaaccttctaaaaagaaatggatatcttttactagttagaatttgtgcatttttattg

SEQ ID NO: 103256 - DNA, 201 bp, Bos taurus
atttacaaactgtcagagataatcctcatcaatttttttcctaccctctttctgataaaatttttatataacctattgtcttatcagagaactcaattaagagccccacaaaactgaagttatttttattctcactggcatgagtcaattatttaatttgattggtaccacaagagccagacatttctatcataatatccc

SEQ ID NO: 103257 - DNA, 201 bp, Bos taurus; identical to SEQ ID NO: 22116

SEQ ID NO: 103258 - DNA, 201 bp, Bos taurus; identical to SEQ ID NO: 22119

SEQ ID NO: 103259 - DNA, 201 bp, Bos taurus; identical to SEQ ID NO: 22120

SEQ ID NO: 103260 - DNA, 201 bp, Bos taurus; identical to SEQ ID NO: 22121

SEQ ID NO: 103261 - DNA, 201 bp, Bos taurus; identical to SEQ ID NO: 22123

SEQ ID NO: 103262 - DNA, 201 bp, Bos taurus
tttgtgtactttactgtacagtactgtatagagtacagtagaacagtatctttatttcaagcccaggatgtccagaagcaagcacaaaagcagcagtgacatagctggtacttttcaaggtactgtaccgaaagagtaaaaatgttttctttcttatttgtttgttttttattatttgtgtgaaaagtattatgaacatat

SEQ ID NO: 103263 - DNA, 201 bp, Bos taurus
gagccaaaacaaaaggtatgactttatcatgattgccattaaatattgttttggttcgtggaaaaatttccttcctctttggataaagaccaaccaaaaacccactccatcaagaacctatgtgtatcagtattatctgtattatttaagggcctgctttcaaggatactcttcagggagagcttagagggctattgcaac

SEQ ID NO: 103264 - DNA, 201 bp, Bos taurus
tgcagtaacaaatgtccattttatggccactgtcagactatatattgtacaatgccccaagattatcagcaatctagacgtaaattatcacaaccctaagtccatgaaacacaagacacatatataatctcccttagtccatgtattgaaatgtttgaattgaaagcttgggctatcaattcaggcagaaaatgtcgtttc

SEQ ID NO: 103265 - DNA, 201 bp, Bos taurus
attatgaaaactagattcagatagtgtctttgagttctatacaatacataaagtcacaggtattttctagatggcaaagaaagataacaaaaactacaaaagatgttgataggctgaatccaggtgatggtattatacccacctatattttaaaagaaaatatcaggaaattgggagttatgcaggtatctataattatac

SEQ ID NO: 103266 - DNA, 201 bp, Bos taurus
aaatggcaatccactccagtattcttgcctggagaattccatgaacagaggagcctggtgggctacactccatggggtcgcaaagagtcagacatggctgagaaacactacaacactacaacaaaacatgactcctgtcctcaatgaaggcaatatataggaagtcttttgagctaggaatcttccaagggggtccaggac

SEQ ID NO: 103267 - DNA, 201 bp, Bos taurus; identical to SEQ ID NO: 22128

SEQ ID NO: 103268 - DNA, 201 bp, Bos taurus
actttcagaaatgacacctgagttcttgtgttttgtaaaaattcctctgaggcttcagtaaatgtatgttgtccaatatggggatagtggaaatagagaggaagagacagaaacatgaatgattttgaaagaagaattcacagaattttgtgattactgacttatctaaatctttcatggggatttatttttatttgtgtg

SEQ ID NO: 103269 - DNA, 201 bp, Bos taurus; identical to SEQ ID NO: 22129

SEQ ID NO: 103270 - DNA, 201 bp, Bos taurus; identical to SEQ ID NO: 22130

SEQ ID NO: 103271 - DNA, 201 bp, Bos taurus; identical to SEQ ID NO: 22132

SEQ ID NO: 103272 - DNA, 201 bp, Bos taurus
gcttctaccattgttaaggtaagccagtctcttgtggtcaaatctggaatgtgttctcatttcccttgtgctttggcacctgtgtgacatcgcattctctgttttcttctcatcccttcctcagcgataactgcttcttcctacatacacattttcccttcttctccccactggtaagatctggcccttcacctgctctgt

SEQ ID NO: 103273 - DNA, 201 bp, Bos taurus
gagtatggaattaagggaagaaatatcctacaattttagaatcttcagtctattgtaggcagattttcagacacaagcaaaacccatcttttaatgttgccgtatccctgatgggtgttttaaatatttctggtacatttacacattttaaagtttgttttgttttgttttaaagctgtttaatttgtaaacacgccctgg

SEQ ID NO: 103274 - DNA, 201 bp, Bos taurus
atcgttatgagattccgagtggcagagcctctggcctgtcaacatttcttgaatactgtagggagggggagcaagttaatgttcttcctctcagcagcccagccacccccacactctccctcatagcaactcagggaatgcggattccagtgcctgtgacagtgtggccatcctagcccccccatctcttgctccaccggc

SEQ ID NO: 103275 - DNA, 201 bp, Bos taurus
gactgaagtgacttagcagtagcagcagcatgggacaatataaagtgtgccaatctatgcataacaggatctcagaagagaaaaggggactgaaaacaacagaagaaattatggctgaaaatctcccaaatctaaggaaacagatatccaggtaaaggaagcacagaagctcccctccaaaaaagatgaacccaaacaaac

SEQ ID NO: 103276 - DNA, 201 bp, Bos taurus
taagtgtattggtaattttttcaatttggacaagtacaatcttcagttctgaaaaactttcttggtaaaaaaatattttttatgttcttgaagtgaagtcacacagtcatgtccgactctttgcaaccccatggactgcagcctaccaggctcctccgtccatgggattctccaggcaagagtactggagtggggtgccat

SEQ ID NO: 103277 - DNA, 201 bp, Bos taurus; identical to SEQ ID NO: 22134

SEQ ID NO: 103278 - DNA, 201 bp, Bos taurus; identical to SEQ ID NO: 22136

SEQ ID NO: 103279 - DNA, 201 bp, Bos taurus
tttattttccccctaacctgtctttagggtctgattcctatattttgttcataatctctagcgtcacttgccactaaaagacatcagacattttggattttttaagttataaaagctcttagcatttcagaaattcacctcatagcattgctcataaaaaggtagattttattaagaaacaaatgaaaatgaagaatgggg

SEQ ID NO: 103280 - DNA, 201 bp, Bos taurus
tttcaggaattttatggacttaagaagctcaaagcaccttgcgtgtatcaactgaagctgtgcctatatgacatcaggaaaaaataaattagcaaataattggattaatataaaagtgaaaaatactatgttaaaatagaaaccagtcccatatttccccttgactttataatattctgcactactgagggagacttgctc

SEQ ID NO: 103281 - DNA, 201 bp, Bos taurus; identical to SEQ ID NO: 22137

SEQ ID NO: 103282 - DNA, 201 bp, Bos taurus; identical to SEQ ID NO: 22140

SEQ ID NO: 103283 - DNA, 201 bp, Bos taurus; identical to SEQ ID NO: 22142

SEQ ID NO: 103284 - DNA, 201 bp, Bos taurus; identical to SEQ ID NO: 22143

SEQ ID NO: 103285 - DNA, 201 bp, Bos taurus
ttccctagtaggataatttgttcattctgtgaagttaatggactactgcagcatttgtaggtattcttctaatatcttaaaaattacatttgccttagctgaacacagttcaaaagtacatgctcacaaatgacatcttcaaaatgttttaactttttataaaagtacgtagttactgagaaatgaaaaaaaaaaagccct

SEQ ID NO: 103286 - DNA, 201 bp, Bos taurus; identical to SEQ ID NO: 22145

SEQ ID NO: 103287 - DNA, 201 bp, Bos taurus
tgatggacagggaggcctggcatgctgcaattcatggggttgcaaagaatcagacatgtctgagtgactgaactgaactgatacaaagaacagtatggaggttccttaagcctgggaacctgcggcctaacaggcatgtggccaatatagtgcagagactctgagaggttaaggtgagcccagaggtggagcaagagagaa

SEQ ID NO: 103288 - DNA, 201 bp, Bos taurus
gaatgttcatgattttttttttttttttaatctgatctgagtgcagagaggggagaagaaaagacctttggacaaggcggatgatgatccttattgtagcattgaatcactgcaatttatggttaaaagtgtgactatgttagatatcatcattgttctcatggctgaaatcaacactgagtaaaattggctagttaccta

SEQ ID NO: 103289 - DNA, 201 bp, Bos taurus
tatattgtaattttctacctagatggccatctctttttgaagacttttctaatcttcttccactctcctctcttcctccttcttcacaagtgcatagacatactggccaggcaggcattcaacgtacatcagctttgctgtatgcacctcatgggattataggttactacaaagtaatggcttttccttatgttcttcaca

SEQ ID NO: 103290 - DNA, 201 bp, Bos taurus; identical to SEQ ID NO: 22146

SEQ ID NO: 103291 - DNA, 201 bp, Bos taurus; identical to SEQ ID NO: 22147

SEQ ID NO: 103292 - DNA, 201 bp, Bos taurus
ctctgaatcaggcaggggaacagttgacctttcatggagggcaacaagccctggtctctttattcttgacaaaattacgcagcaggccatgttcatgttcttgttccgtgttcagaaatccctggagaaagttctgcttcgacaccctgataagagcagctaacagctcagtcttcactgaggggacagggagccggaccc

SEQ ID NO: 103293 - DNA, 201 bp, Bos taurus
aatacctataaaaagagatgggaccaagtatttatcaaacaaattcagttttatgtgaaaatactttataaaggagtttttattgaattttataaaatacgcaacagtgacataaacctgaactcaaatactgaaagataccacagatttacaataccttaattcagaatttgtaattaattatacctaagctagataaaa

SEQ ID NO: 103294 - DNA, 201 bp, Bos taurus
ggtttatactttgtttatctgataaggcctgactttccattgagagaacaaaaactaacagtatattctgtgtcttttttgtagcctccattatcaactttcttctatgaatggatggcacattgactttttcactaataaaacattacatgtggaaaggcagttcttcaataataacatatgttgtcttgttgtgttgga

SEQ ID NO: 103295 - DNA, 201 bp, Bos taurus; identical to SEQ ID NO: 22148

SEQ ID NO: 103296 - DNA, 201 bp, Bos taurus; identical to SEQ ID NO: 22149

SEQ ID NO: 103297 - DNA, 201 bp, Bos taurus; identical to SEQ ID NO: 22150

SEQ ID NO: 103298 - DNA, 201 bp, Bos taurus; identical to SEQ ID NO: 22151

SEQ ID NO: 103299 - DNA, 201 bp, Bos taurus
aacatcacattgtcagagaacacaaggaggcttgagaaacagtggatagaatccttgcttatacttttcaaatactgtagttcatttaaaagatctatgggatacaggaacgtaagttcaaagctgtgtttgacgctctgtatcaggaacctgaaagtttcacagcagagctatagaacacctgcatagccagcagcctgg

SEQ ID NO: 103300 - DNA, 201 bp, Bos taurus
gtttttctaatttgatacaataatctaaactagtaacactgtgtgtacttggatgatcaacctgagtctgtctccatctgtttgtctgtctcttttgtttccctcttaattttaaactacataatattttgaaattgttatatattcatagcttcaaagtaaagtattacagattagattagttgaccagagaaccacttt

SEQ ID NO: 103301 - DNA, 201 bp, Bos taurus
gctcacgattgagtaccaccttaagcaagctagtgagagagcattgtactccaagttttagcagtgtattgttttgaacttaatttgcatattttgttcaatagtgtgactaaacttcatgtgtattatcagtttgttttcttttatggggaattgctcatagtaacatttgctagttttccctaagaagttgttggcaat

SEQ ID NO: 103302 - DNA, 201 bp, Bos taurus; identical to SEQ ID NO: 22152

SEQ ID NO: 103303 - DNA, 201 bp, Bos taurus
gaaagtttttggcaatataaaataaggaaaataaggcttaagagagaacagctactgatgggaggtataggtaatgtttcctagtaggaaaatatattatcataagaagaaacacttaccataaaacatttcagtggggagcagttggaattatgtccccttccattgtgttgacataatgtgaaaacagccagtcaaatc

SEQ ID NO: 103304 - DNA, 201 bp, Bos taurus; identical to SEQ ID NO: 22153

SEQ ID NO: 103305 - DNA, 201 bp, Bos taurus; identical to SEQ ID NO: 22154

SEQ ID NO: 103306 - DNA, 201 bp, Bos taurus
aataatgattcatgtatatctgtgttcctgtactgctgaggtcttctgaacagctcacaattattgggagctatagaaactgtctcccagaaaatagagatacccagagacatttcaggatagtcaagtgttattttcatgagtcaacttaagtttcctttctggaggcatttcctcactttccagggtaacagatcactc

SEQ ID NO: 103307 - DNA, 201 bp, Bos taurus; identical to SEQ ID NO: 22155

SEQ ID NO: 103308 - DNA, 201 bp, Bos taurus; identical to SEQ ID NO: 22156

SEQ ID NO: 103309 - DNA, 201 bp, Bos taurus
gagagggaactggccataaattgtcagcaaccaacactctctggagcttgaagaataaggaccacagtcttgaaggctggtcagatcggcacatcacaacgtcttttctagttagtctgagattcggactattttcaatgaggtccctttctttttctgagagtgtcttcctggtctggttttgactcaatctcaactttg

SEQ ID NO: 103310 - DNA, 201 bp, Bos taurus
tttatggaaaactgtaacaaattgttagttttaaagatggcctcaaattatttgactcttctcacgctaagacattaagtgaggtcagattccctgaacattgaatagagcctggccttagaaaattacttgcatactgtagaaagaatgatgcatgattttccaaggctatgtcagaagaagccatgaaaattctgcctc

SEQ ID NO: 103311 - DNA, 201 bp, Bos taurus; identical to SEQ ID NO: 22157

SEQ ID NO: 103312 - DNA, 201 bp, Bos taurus; identical to SEQ ID NO: 22158

SEQ ID NO: 103313 - DNA, 201 bp, Bos taurus
ttctatctaaagctgcttaaaggcatttatggcgctaagtgccctaatggcgttgatgatctctgtggtgtggagtgctctgagataacaggcaggtcaccttcggcaggcctgccagccaacttgggggataatctcctcaaagctcaggataagctcctgggcatcattcagttctctgcttttaggatcttcaagagt

SEQ ID NO: 103314 - DNA, 201 bp, Bos taurus
ctgctaactggctcacagctcacagctgatccttcactgggagttgccctttgcagtcagacaagttccatgtgcagggtcatgagccctcccttggggtacttgttgacctgtgactgttatatgctgaaagacaaaggtgcatcccttttgcctaaatttttaagatcactcaagttccagagtttcttcaagaatatt

SEQ ID NO: 103315 - DNA, 201 bp, Bos taurus; identical to SEQ ID NO: 22159

SEQ ID NO: 103316 - DNA, 201 bp, Bos taurus; identical to SEQ ID NO: 22160

SEQ ID NO: 103317 - DNA, 201 bp, Bos taurus
attactttaaacactttctccctgaaatacttagaatagtgaagatgttacaagctattgtaacaaataaatttcaaaatttcatgggcccaacatagtcgtcgttcatctaccagtccagtgtgggtgtttctggatagcaagtggcttttcagccttcagatgactactgccctggccaacagcttggctgcaactttg

SEQ ID NO: 103318 - DNA, 201 bp, Bos taurus; identical to SEQ ID NO: 22161

SEQ ID NO: 103319 - DNA, 201 bp, Bos taurus; identical to SEQ ID NO: 22162

SEQ ID NO: 103320 - DNA, 201 bp, Bos taurus
ccaagaaatccttgattcagaacaaaataaatgatattctgataactagcaactgcactatgaagatggaccatgaaaacatccaaaacagggggcacttttgaggttgtaattctttgtctttgatttagttgggatttaatgtattttcacttattttgtcaaagatacatttgtgttgaagtcaaggaaaaacagtgc

SEQ ID NO: 103321 - DNA, 201 bp, Bos taurus
agggctggaactgacacttgctcagaaaataggcccagagagctcctaacaggagctaagtaagacactaagggcacaagaaaaggaagcaggagcttagacaagggcccaggcagagcctcagacactgcacacagaccgtctgctcggtgactgtctttgctttacgcagatatcacaatcatcttcacccaaagccat

SEQ ID NO: 103322 - DNA, 201 bp, Bos taurus
aaccccgagtggggcctcagatttgccatttgaattctccctggcagctgcttcgctttgaatttagagagtggtgctttcaactttgtgaatgaaatgtagggccagcagagtcagaagcccgggcctccttcctgctggcacccagtcttcatggtttcctgtgttagttgccttcgtgagcagcagaaactagaagga

SEQ ID NO: 103323 - DNA, 201 bp, Bos taurus
ccataatgataggaaagaactttgtaaatacattccacatagtattatttttctaattaccaatgtccatttatcttcaggtagatcattcaaggtgtaaatgctatgttcaaagaactatgaaacacttaaagctgtgttatgacgcaggagctacctgagtcccctactaaatgatgctgatggacatgctgtagtgcc

SEQ ID NO: 103324 - DNA, 201 bp, Bos taurus
ctgtgtttttccagacttctttcctttcgtcaaccaattccaaattgacaagcagtactctggactgctgacatcccacaaattggtggaattcagaaatgataactttgttatcattttataggacagtgatctcctagttgcttatttttctcccttcaaattacattcatcagctcttacaagaacagatacctctgt

SEQ ID NO: 103325 - DNA, 201 bp, Bos taurus; identical to SEQ ID NO: 22163

SEQ ID NO: 103326 - DNA, 201 bp, Bos taurus; identical to SEQ ID NO: 22164

SEQ ID NO: 103327 - DNA, 201 bp, Bos taurus; identical to SEQ ID NO: 22165

SEQ ID NO: 103328 - DNA, 201 bp, Bos taurus; identical to SEQ ID NO: 22166

SEQ ID NO: 103329 - DNA, 201 bp, Bos taurus; identical to SEQ ID NO: 22167

SEQ ID NO: 103330 - DNA, 201 bp, Bos taurus
ctttttaagaaagtgcattctgtttttacttaattgtttgaaaatggatctaaattgtatgtccattaacatgctaatatcaaaagtatttttcctgaccgttgtacaatgacacgagttcctcaaatatcatccaatttacctcttgtgagtaatgtctttaactttcataactagagcaggaatatgtattatttagat

SEQ ID NO: 103331 - DNA, 201 bp, Bos taurus
tcgaacctgcacctcctgcattgaatggcaaagtcttaacctctggactgccagggaaatctccagtcaccgtgtttaattagaccctaagtgaaagtgaccttgttagtcgctcagttgtgttccactgtttgcgaccccatggactatatagcctgccaggcttctctgtccatggaattctccaagcaagaataatgg

SEQ ID NO: 103332 - DNA, 201 bp, Bos taurus
cccaccaggctcccccgtccctgggattctccaggcaagaacactggagtgggttgccatttccttctccaaactaaggaatacttgatgtatatattaacggttaccaggccactttctgggcagagctccaaaccaagtggaatagttacgaactgccactcaagctggaggaagctgcagtcagaggtggctcccagt

SEQ ID NO: 103333 - DNA, 201 bp, Bos taurus; identical to SEQ ID NO: 22168

SEQ ID NO: 103334 - DNA, 201 bp, Bos taurus
agagaaagacaaatgctagaagaagtaggcctgcccgccctgttggagcagaagggaagtctgcaatgtataaattgggtaattgctggctgaccttgcctatgaacacatgcagcacctcctggggactcacagatcccatggggcatttggcagtcacccaagaagccgtgtgagcagatggagtgagatgggcaagtt

SEQ ID NO: 103335 - DNA, 201 bp, Bos taurus
aatttaaggttacaagggtaattcataaaacccaggggcatgaaggcagccaagcttcagaagggtctatagcaaagacccagaaaaccattgggggcctatcgatttctccttatttctctaagtactcctgtcccttctctctctctctctctcaggtcatctttatctgggtgatttgcctctgcttgagctttcact

SEQ ID NO: 103336 - DNA, 201 bp, Bos taurus
actgcttgctcttctgggcaaatggctcttctatcagaacagattacttccctgggctaagaggttgcttgcagcttaccagcagttcatttatcaatacttgcttcaggacaatctattatgttacagtttgcccgatctcaaccagattcctgcattggaaaacatttctcctaccacttgaactcagactccaagatg

SEQ ID NO: 103337 - DNA, 201 bp, Bos taurus
actgtgtgtactttgaacatatccaggtggatctaaatgttttctgatactgcatacttgttttcttaagtagaggtgtgtaaaatagggccttctaaccgtagacttgacagctagaaaaatcaagtagaaggacttctctggtggtccagtggctaagactcctgactcctaatacagggggcctgggtttgatccctg

SEQ ID NO: 103338 - DNA, 201 bp, Bos taurus
tcccctccttccctctgactcatggccattgtacctattttgtaaaaaagaaagaaaaaaaaagcctaaataacctctttcttgccccacccaccagtgggcacaaatcatattttcaaaaaagttatagccaactcctctaaatttgctctaatcatcctattattcaaagcctttgttttgtgaatcatttaactctta

SEQ ID NO: 103339 - DNA, 201 bp, Bos taurus; identical to SEQ ID NO: 22169

SEQ ID NO: 103340 - DNA, 201 bp, Bos taurus; identical to SEQ ID NO: 22170

SEQ ID NO: 103341 - DNA, 201 bp, Bos taurus; identical to SEQ ID NO: 22171

SEQ ID NO: 103342 - DNA, 201 bp, Bos taurus; identical to SEQ ID NO: 22172

SEQ ID NO: 103343 - DNA, 201 bp, Bos taurus
gaggcctgactccattctcaggcctctgtttaggcttggggtgaggtgggggcaagattgaagtgctacacttgcaccccaaaggttggtggatggctgtctgaatacatacagataggccttaagaaagagctttatgggaatggaaagaaatagagatgtggcagtggcagccctttgcctagaggccacagtagaatt

SEQ ID NO: 103344 - DNA, 201 bp, Bos taurus
tacctaagtcccacactaatctaatctttaactgatccactgagggcttagaagaaattgttgcattttgataatctgcctttctgaatccttgtccacacgccctagatatacccacatgtagatatgtgtttccatttttggagtgactataccctctggtctacatgttacacaaattccatattagaatttctggct

SEQ ID NO: 103345 - DNA, 201 bp, Bos taurus; identical to SEQ ID NO: 22173

SEQ ID NO: 103346 - DNA, 201 bp, Bos taurus
ccaaggaaaaaagaagagaagaagagtctagaaagaagattcattcatctagtttttccttccaaactcggcaatcaaatggacactcctcctcctaatactatttgggccagtcattcagagtttaacaatatcccaatgtttttcacagtttcacaatctgcagtctcagactctccctaaaagtgcagtttatgaaat

SEQ ID NO: 103347 - DNA, 201 bp, Bos taurus
tctacatggggttagactcaactaccaccagcatcctgcttcaagcctgcgattctcatctttccacattctgcccatggaccctctcctaggaggccagaggtcacttggctctctttctaggtcagctgagaaacaaagacattcaagaggcaaccctcaaccaatgagggacagaagtagtggataaatgccctggcc

SEQ ID NO: 103348 - DNA, 201 bp, Bos taurus; identical to SEQ ID NO: 22174

SEQ ID NO: 103349 - DNA, 201 bp, Bos taurus; identical to SEQ ID NO: 22175

SEQ ID NO: 103350 - DNA, 201 bp, Bos taurus
tggatggaggcttagttttggtttcagtcttgtgggataggatgaatttcgggatcttccctgacatttccttgtcattttattcctggttggccttatacgtggattgagtatgacagtcatgagtgtgtcacagagttgtgcctacattccttagcatctcattttaggcctatgtcaaggggctgcctggtgcctaat

SEQ ID NO: 103351 - DNA, 201 bp, Bos taurus
gcttgaggaggatgcagaggtggagaggggagggttagagcttgaagtctcaggcaggccctcccaccctccgcctgaccctacaactcccactcttctttcctccaatacgaagagctccctgggggaagccagctgggggctgttctcctcttttttccctgtaggaactttctaaagtttggggcacctactgtgcag

SEQ ID NO: 103352 - DNA, 201 bp, Bos taurus; identical to SEQ ID NO: 22176

SEQ ID NO: 103353 - DNA, 201 bp, Bos taurus
ccaatgtgttgacgagttttgtggcaaaccaggctgtaatcctttgatatcactgaaaaaaagatttggcttcctgaagaaagaaaataaagatcatttttaagcataacctgtgaacagatttagattcacagaccatgaaagctggaaaggacacagctctgcataacctctcacttctctcagagacagaaatgaggc

SEQ ID NO: 103354 - DNA, 201 bp, Bos taurus
caaatattgaaagatcacagcataagaaaatgaaatattgaaacatgatacttttaatctatgaccatcaatggataccattttgctttaaatcctacaacataatccattttcaagagaaagcatgttttatctgggaagtttcataaagtaacaccctcttccccagcatgcattttagtgtgtcagcaagtcagtgtt

SEQ ID NO: 103355 - DNA, 201 bp, Bos taurus
gatgggtagagaggtgaagattgggaggttggttttgatctgtgaatcctgagaagttgagagaaatttcaagggggtatgtttgatgtaagggtaagttccaacacagatgagatgagggccaaggaggagaatgttcacaaacatgggataagaacaaacagatgattgagaaaatggagaagatggagaagatctgtg

SEQ ID NO: 103356 - DNA, 201 bp, Bos taurus; identical to SEQ ID NO: 22177

SEQ ID NO: 103357 - DNA, 201 bp, Bos taurus; identical to SEQ ID NO: 22178

SEQ ID NO: 103358 - DNA, 201 bp, Bos taurus; identical to SEQ ID NO: 22179

SEQ ID NO: 103359 - DNA, 201 bp, Bos taurus
aaaaaaagaaagaaaagaaatgttgctataaaaactgaattttaaccaactcttttagggccaagtatgccaatttaaaactccaagaggcccagacacaaggggactctgcacccactcaattcttttttcatgatcctgtacctcatgagatgatcatgaaaaagtgtgaacagggaggatttgagaaaggcccatagg

SEQ ID NO: 103360 - DNA, 201 bp, Bos taurus; identical to SEQ ID NO: 22181

SEQ ID NO: 103361 - DNA, 201 bp, Bos taurus
aaaaatttgaatcattctatatctacttaaaacataaaatatgtaacaaaatattccaaaaaaatccccaaactgtgggcccagatgatttcactagtattctcaataaaacactaagggaagaaattgtataaattctatgcaaacacattcaggaaggaccataatccaactaattatataaggccagcattactctga

SEQ ID NO: 103362 - DNA, 201 bp, Bos taurus; identical to SEQ ID NO: 22182

SEQ ID NO: 103363 - DNA, 201 bp, Bos taurus; identical to SEQ ID NO: 22183

SEQ ID NO: 103364 - DNA, 201 bp, Bos taurus; identical to SEQ ID NO: 22184

SEQ ID NO: 103365 - DNA, 201 bp, Bos taurus; identical to SEQ ID NO: 22185

SEQ ID NO: 103366 - DNA, 201 bp, Bos taurus; identical to SEQ ID NO: 22186

SEQ ID NO: 103367 - DNA, 201 bp, Bos taurus
aatctcttttaacagtgatttccctttaatatctattcacattgtttctctcttttgagtgtcaaagatgagcgcttgcataatgcatggggactttgacaggcacaacatcaattatttcttacactgatttggtagctaaacaataaaagtgaaatgtaccctttagatgaaaatttgccctgaattttttgtggacag

SEQ ID NO: 103368 - DNA, 201 bp, Bos taurus; identical to SEQ ID NO: 22187

SEQ ID NO: 103369 - DNA, 201 bp, Bos taurus; identical to SEQ ID NO: 22189

SEQ ID NO: 103370 - DNA, 201 bp, Bos taurus; identical to SEQ ID NO: 22190

SEQ ID NO: 103371 - DNA, 201 bp, Bos taurus
tcaggctatagaaagaattgatggagacatttttagataatattacttcatttaaaaaaatgtgtgtggataatgtgtatatttgtatatcatgttacttcggtttataccagatccagctaccctcttcagaagtttctaggtagaagagtaaagaatttagaattaaaaataaaagacttgagttggggtccttgcctg

SEQ ID NO: 103372 - DNA, 201 bp, Bos taurus
tctggaggttttagtattgccaacgagtagaaaatgtttccatagaatttcattaactaagtagagtcagagtgactcaagacatgtctggagtttagacgtctttgatggaaacttcgtaggctgcgttttcctctttccccactctgactttacaagccagagcccacatacttggaaacagtaactgggcgattacta

SEQ ID NO: 103373 - DNA, 201 bp, Bos taurus
gggacatgtccgcattcatgatacccaccaggagcatattctaggcctgcatcttgctctctgcaaagggctaggccccctcatcatctttgagcctgtggttctgtcctagctccctattccagaatctatgggctctttccctgcttggcttcgtaccctagtcttggaggagaactttctccagggccacttctgagc

SEQ ID NO: 103374 - DNA, 201 bp, Bos taurus
cttttagttaatcctttttttctttccttttaaagaagaattttatttttttcttgaaacactgtatgcttctaatgtgtttagatgtggatttatttctatcgtttctacattttacatggtgtgctttcaatatcagaactcatatctttttatctagtagttaccacatcaatagccctttagtcagtaatcctgatt

SEQ ID NO: 103375 - DNA, 201 bp, Bos taurus; identical to SEQ ID NO: 22191

SEQ ID NO: 103376 - DNA, 201 bp, Bos taurus; identical to SEQ ID NO: 22192

SEQ ID NO: 103377 - DNA, 201 bp, Bos taurus; identical to SEQ ID NO: 22193

SEQ ID NO: 103378 - DNA, 201 bp, Bos taurus; identical to SEQ ID NO: 22194

SEQ ID NO: 103379 - DNA, 201 bp, Bos taurus; identical to SEQ ID NO: 22195

SEQ ID NO: 103380 - DNA, 201 bp, Bos taurus
acacatcttcactcctgacttttgtcactccaaggggcatgaccgtgtttgacctagagtgttatcaaggtcaccctcgttcctttcttcacatttcccaacgtgggtccttcaggtagcctacgtatctcttccctgtgttcatctattgctttgtttttcaagtcttttttagaggaggaaggtcttctcttaaaatgt

SEQ ID NO: 103381 - DNA, 201 bp, Bos taurus
aaggctacccactccagtattctggcctggagaattccgtggactgtatagtccatggggtcgcaaagagttgtacatgactgagcaactttcacttttactttcttacatattgtggcccataggcattagtttctgcaaaacagtcaataacatgttaaaacttagttcagaaatcacatcctttgttaccatcctctc

SEQ ID NO: 103382 - DNA, 201 bp, Bos taurus; identical to SEQ ID NO: 22196

SEQ ID NO: 103383 - DNA, 201 bp, Bos taurus; identical to SEQ ID NO: 22197

SEQ ID NO: 103384 - DNA, 201 bp, Bos taurus; identical to SEQ ID NO: 22198

SEQ ID NO: 103385 - DNA, 201 bp, Bos taurus; identical to SEQ ID NO: 22199

SEQ ID NO: 103386 - DNA, 201 bp, Bos taurus; identical to SEQ ID NO: 22200

SEQ ID NO: 103387 - DNA, 201 bp, Bos taurus
gctgggcctcagtttccaattctgtaatatggaaatcattacccctcatgtgattgcttggagaaataaagagcttccaatgaatgaataaagtacctggcacagtttatggccagtgcagaggaccaaacagatgacagataaaacataatgaaagacttaagatatcataatcttgttgtaatgaaactgtgcaatgag

SEQ ID NO: 103388 - DNA, 201 bp, Bos taurus
gttatgcttcctttgaggcaacaagtacagggcagtgaggtaaaaaaaaaaaaaaaaagaataactaacagctttcaagaaaacaatctaaaataagcacctgtgtagtgattataaaaatatacagatttcctttccttctactggtaatgtcaaagcccacacaatttgtgatgtgtctgcatgtgatgctcatctagc

SEQ ID NO: 103389 - DNA, 201 bp, Bos taurus
ttgctgctttttcagtttttagggaaacattcttaatgaattttatagaactctgataaaagggttttttaaatactctcaagttttaaactgcttcattatatacaagaagtctgagggtagctgtagcgtttcatatgctttctgagagaaatagactgttttcttggctactggaaatgtttcttatgaaatgaaacc

SEQ ID NO: 103390 - DNA, 201 bp, Bos taurus
tggtgaaatctactaatctttttaattttggaagtttagattattaaaaattaaaattatttgaaatggtttatgaatattagtactaggatattaaaattgttatatttgtataaatcaagataaatgctccaagcaaaggaaaagcaattactaaattcttaaactgttcttcttacatctaaattctaaaaccaagct

SEQ ID NO: 103391 - DNA, 201 bp, Bos taurus
gaccagctgagccacaaggaaagccccagaaagtgagtgattaaggactaaatggaaagaaaaaacacaaaagatgctgaaacaatgcaattgagtggtataagagtaagaaggggtggtacacaatgaaaggaccctgatgacataagcactgagccctcagctggtactaatagttagctggaagtcacctacaattga

SEQ ID NO: 103392 - DNA, 201 bp, Bos taurus
gactcgggaatcgagaagggtatggctgagtggttctggctcagagtctctgatggagttgcagtcaaggcagtcaactgaggccaccatcatttgaagccgggactgacaccacttctaaaatggcttacttatacagcagttgactggaggcctcaggtcctcacccttgaaactctcctcaaaccatgaaactggctt

SEQ ID NO: 103393 - DNA, 201 bp, Bos taurus
agaaattagtaggaagggagaaagaagctaataatgagaccgaaggtaaaaaaaaaacctatggaagatgtgtccgaaatatgaactcttggggaaaatgaaatttatcaatttgttgcatttttaaaaatgttctggatttggaagtcaacagaggagatccaggcactgagttatatgatcaaatgccttagatctcct

SEQ ID NO: 103394 - DNA, 201 bp, Bos taurus; identical to SEQ ID NO: 22201

SEQ ID NO: 103395 - DNA, 201 bp, Bos taurus
tcctttgaatgtagtgactcattattttagagtctggatgtttaatgtgttatttgatcctaaatacagatgaagcacataatttcaagcattggcctagaaacaccagtgaacctgactacagacttcataagggctcctgatttgtgatctatgacggaggactttgtgactcagagagcattatcagccgtttcactg

SEQ ID NO: 103396 - DNA, 201 bp, Bos taurus
tcagtgttcttgcctgggaaatcccatggacagaggagcctgctgggctagtccacagggccccaaaggaatcaaacactacttagggactaaaccacaatcctacatttaggaaaaaattgtaacaacttaccttctgtgttgttatcatcagaaaaggtaatacaaagttcatcagacttttcagttgtaacagcccat

SEQ ID NO: 103397 - DNA, 201 bp, Bos taurus; identical to SEQ ID NO: 22202

SEQ ID NO: 103398 - DNA, 201 bp, Bos taurus
ggcctccatgccaaagcactcactaattctgtgtgatgagtgaggctggcagcagccgtgtgttccccagggacctataccaaggtgcaaacatattgagatgggatgattgctggagcaggcctgcttttccagcccctcggttcatgaggggaatccaaggcagcctgccccgtgagcattgctaattatgttggcttc

SEQ ID NO: 103399 - DNA, 201 bp, Bos taurus
aaggaaatgttttaatcctgaatctgatcatttcatgcgactcctttctttaccctataattccaccagactttttagcatctgtggtaaatcgttctttgcctctcagatccattctctccttcttcctggatacacatgtcacacctgaaccccagttggagtccatatttcctagcttgcttgtgaccttgtgatcaa

SEQ ID NO: 103400 - DNA, 201 bp, Bos taurus
ttccatggagagagggacataggctgacagcagccaggcccaaggggggctgcattgggcgcagaaggggagccaggcctctgcctgcacggacaagatccacttcatccccaaaaggtttttggctccagtatggaggcaatgcttggagtgtgtcctggcctgaggtcctctttcacagtctgggacgcgcgcgtcctc

SEQ ID NO: 103401 - DNA, 201 bp, Bos taurus
tattcagggacgggtccatgtgaactgggaaagcgtgtacaaaattaaatcattttctctgtgggcacgtgttcaacttctggccacctccgatgcttccgaagttagcgattcatttccttgattctgccagcttgtcgctgtcagcatagggcccctctgtacatggtagagtatcctcaaccacagatttactgctac

SEQ ID NO: 103402 - DNA, 201 bp, Bos taurus; identical to SEQ ID NO: 22203

SEQ ID NO: 103403 - DNA, 201 bp, Bos taurus; identical to SEQ ID NO: 22204

SEQ ID NO: 103404 - DNA, 201 bp, Bos taurus
caggaatgttagaaatctcatcttttcccaaatttctcaattttcacaactctgaacttaacaaaatctattattttggcctttagtttattatttctggattatattcaaggccctctgatactgttgccagccgccctttccaacctgtattatctctcttactcagcatggatcttccactccgtttagccatctgta

SEQ ID NO: 103405 - DNA, 201 bp, Bos taurus
gccttgttcttttcttcatttcactcatgataaatgtcagttggtccaaccagacctgcaagcgtccacagtctggccgtgggaaccattcttctgtagcataactcaaccaagaatttgcacagtttcctgtgcagtgatgggaaccccacgatgggtaccaggatgttactagctttccacggcccattctggagacct

SEQ ID NO: 103406 - DNA, 201 bp, Bos taurus; identical to SEQ ID NO: 62730

SEQ ID NO: 103407 - DNA, 201 bp, Bos taurus; identical to SEQ ID NO: 22205

SEQ ID NO: 103408 - DNA, 201 bp, Bos taurus; identical to SEQ ID NO: 22206

SEQ ID NO: 103409 - DNA, 201 bp, Bos taurus; identical to SEQ ID NO: 22207

SEQ ID NO: 103410 - DNA, 201 bp, Bos taurus; identical to SEQ ID NO: 22209

SEQ ID NO: 103411 - DNA, 201 bp, Bos taurus
acttcatgtgagcaactgctagaagttatttgcaatccccattcctaaaatgcatcattaggaggaaagtaaagaatctagagatacccaacgtaatacagattactctaatatttttaaatgcaactagagtggtgtggagtacactgaatttttaaaattataatagatataatttgcacataaataattatttaattg

SEQ ID NO: 103412 - DNA, 201 bp, Bos taurus; identical to SEQ ID NO: 22212

SEQ ID NO: 103413 - DNA, 201 bp, Bos taurus; identical to SEQ ID NO: 22213

SEQ ID NO: 103414 - DNA, 201 bp, Bos taurus; identical to SEQ ID NO: 22214

SEQ ID NO: 103415 - DNA, 201 bp, Bos taurus; identical to SEQ ID NO: 22215

SEQ ID NO: 103416 - DNA, 201 bp, Bos taurus; identical to SEQ ID NO: 22218

SEQ ID NO: 103417 - DNA, 201 bp, Bos taurus
tttttaaaaaacttattgagcaatttaaacctctgttaaatcagtttttgctccctccattttgaagctcaactatggtagttcacatttaagatcattacgccttcttagtgaattgatccatttatcatgatttatttttggtaatattgcttatcttgaaaccttcttttgatattaatatagctattccatctttct

SEQ ID NO: 103418 - DNA, 201 bp, Bos taurus
tcactgctgagtttttatcttcatgggagttgggttggcctcaaagtgtccgaatgtggcttggcattatagattttctctgaaaaatgcattccaaaatatttctgatagatgtggcctgtgttcagttctacaggtaaaaacctagctgggaaagaaaattaatattttctgcagcattttcaagcagtgctctttact

SEQ ID NO: 103419 - DNA, 201 bp, Bos taurus; identical to SEQ ID NO: 22220

SEQ ID NO: 103420 - DNA, 201 bp, Bos taurus
acagcagatttcataacctccgctgggagtggtgggcattccccaccgctggagggcttggtcccttttatccagaaaaatgacaggcgagggggcctgatacaagggcatggacgtggggagaactgggctggagctctgccaggcccctgctaacctgaacagagtgcctttgtgtcctccaccgtgtgggaatagaag

SEQ ID NO: 103421 - DNA, 201 bp, Bos taurus; identical to SEQ ID NO: 22221

SEQ ID NO: 103422 - DNA, 201 bp, Bos taurus
cactccttgaagccagtgcctgacagttaaggagagagaaggtacttgtcggtctgtgctcctgtggctgcactttctggaagatgttcctgctcgtcctcattcgctccctcccatgtagaagcagcgggaaattcctaaagcataggagaagtgttaaatccaaaatgtggtacatcctggaaacactgttcctctggt

SEQ ID NO: 103423 - DNA, 201 bp, Bos taurus; identical to SEQ ID NO: 22222

SEQ ID NO: 103424 - DNA, 201 bp, Bos taurus
ggtgtatttaggtaatggggttatttaaaaccttaatagttctttattcctgttaattgtgagaagaagaggtgctcaagaaccataggccctgaagttttaattctttagtaataattaaagagatttaaaaaatctgcttcccataaatgaatatgattctggcctgcttctgatgtctttccaggaaaaattcagttg

SEQ ID NO: 103425 - DNA, 201 bp, Bos taurus; identical to SEQ ID NO: 22223

SEQ ID NO: 103426 - DNA, 201 bp, Bos taurus
ttggcattttatgttccaaatagctacatcccttgtatgagtcatgcagatagatagatcttttaaattgcttttaagcaattttgataatttgcctttcactgtcaaaataatgactgacgttaataattctgagtgattcagttaaaggaaaagagaacagaaaagtgtgtgccaaataattttgtgctatgatttttg

SEQ ID NO: 103427 - DNA, 201 bp, Bos taurus
taatatcttagatgctattggtatttagtcacttactctttcaaatcccctttcagcttcaagctcttaaataatgcgctttttatatatgcactggattttaccactctagcagaagtttaatccatttcaaagctaccccatgggaatgagtgctgagaatcatgttgcttgattctgaaagtaaaagtatgaaataga

SEQ ID NO: 103428 - DNA, 201 bp, Bos taurus; identical to SEQ ID NO: 22224

SEQ ID NO: 103429 - DNA, 201 bp, Bos taurus; identical to SEQ ID NO: 22225

SEQ ID NO: 103430 - DNA, 201 bp, Bos taurus; identical to SEQ ID NO: 22226

SEQ ID NO: 103431 - DNA, 201 bp, Bos taurus; identical to SEQ ID NO: 22227

SEQ ID NO: 103432 - DNA, 201 bp, Bos taurus; identical to SEQ ID NO: 22228

SEQ ID NO: 103433 - DNA, 201 bp, Bos taurus
acataaaccaatgcttgaaggcatgaatattttctcccttgtttatttttgcttttctagataacaatccatctctgattttatatcactccagataaaacttaatttatttctgggtaatgtaacctgtgaaatgatagcatgaagctgctaatgatacctcaggaagacatgataatgatttctcccaggtgtttgtct

SEQ ID NO: 103434 - DNA, 201 bp, Bos taurus
gaaacttactaaccatttaaaacggttctaaaagctttgaaattgagagtttcagtcatgtaatacagacttcactagatattccactttgattatggccatattgaaattgcatttatgaaagtgaaagttacttagtcgtggctgactctttgtaaccccatgaactatacagtccatagaattctctaggccagaata

SEQ ID NO: 103435 - DNA, 201 bp, Bos taurus; identical to SEQ ID NO: 22229

SEQ ID NO: 103436 - DNA, 201 bp, Bos taurus; identical to SEQ ID NO: 22230

SEQ ID NO: 103437 - DNA, 201 bp, Bos taurus; identical to SEQ ID NO: 22232

SEQ ID NO: 103438 - DNA, 201 bp, Bos taurus
ctcctttttcaaacttggttaaaaattagaagtggtctcctgggccatctggactctctcagatctcagctttctcaatttagaggatggctgtgatgaagttaaacagtggaggtaaagtcacctggctctgttgtgtgctgattccacatacacatgctggattatctctaaggcctgcagtggttcaagtggtggggt

SEQ ID NO: 103439 - DNA, 201 bp, Bos taurus
tcaaaactctttatgttaccactatatggaaatcatgtgccccctcacagcttccaggggtttagaaaaggatactccgtgtctcctaaggcatttgttcgggctggggcagggcttggactgatggtgggaggtgaacctacacaaagagttttgcttgatactgcagagcatttgaggacaatgtttacatgcagctgt

SEQ ID NO: 103440 - DNA, 201 bp, Bos taurus; identical to SEQ ID NO: 22233

SEQ ID NO: 103441 - DNA, 201 bp, Bos taurus; identical to SEQ ID NO: 22234

SEQ ID NO: 103442 - DNA, 201 bp, Bos taurus
aggctgccctgcctgcaaacttggcttaaacctgagttacagaggactggcccccttaagcttctgtccaaggccagcatttatcttaaaggccaaagagtgacctcccagcccaggcagaaaagagtttctaaggcgggaaactcggcagggtatgaggaagggcctgcagtcatctctcctgtgtttctgacttccctc

SEQ ID NO: 103443 - DNA, 201 bp, Bos taurus
agacttctcaactaagagaaaatactaagtttggaaagtttcgttctcgttcaataaagaagctttaaaaacaaagtgatcactggttaaaacatagtatttttgagtttccactaagatcaatcttgtggccgctatttgtattcaatcaacagagttgacattgacagatttgagaagtgagttttgactgtcctctgt

SEQ ID NO: 103444 - DNA, 201 bp, Bos taurus; identical to SEQ ID NO: 22235

SEQ ID NO: 103445 - DNA, 201 bp, Bos taurus
ggaaaattcctcattatttcagaaacatcatgctgaaacttggacttccatactcagcatttctgtcctaattttcaagtgtggatttcacacactcaccatttcatcaagggaatgaaatagacacgaggagaaatattatgtaatattcaattatcactccaactctttcagactatccttttagacttttcgggtgtt

SEQ ID NO: 103446 - DNA, 201 bp, Bos taurus; identical to SEQ ID NO: 22237

SEQ ID NO: 103447 - DNA, 201 bp, Bos taurus; identical to SEQ ID NO: 22238

SEQ ID NO: 103448 - DNA, 201 bp, Bos taurus; identical to SEQ ID NO: 22239

SEQ ID NO: 103449 - DNA, 201 bp, Bos taurus
cataaggtgaggaggaagccataagaagccacagctctgagcatcctctctgagctcctggtcctggggatgctgcttgtcttggagatcctgcttgtcttgtgcagtgggaaccacgggcgggttctgagtgacaccagtccagggcagcccacttcaccagcaaagtgatgatggcaaccaaatccacttagaaaacaa

SEQ ID NO: 103450 - DNA, 201 bp, Bos taurus; identical to SEQ ID NO: 22241

SEQ ID NO: 103451 - DNA, 201 bp, Bos taurus; identical to SEQ ID NO: 22242

SEQ ID NO: 103452 - DNA, 201 bp, Bos taurus; identical to SEQ ID NO: 22243

SEQ ID NO: 103453 - DNA, 201 bp, Bos taurus; identical to SEQ ID NO: 22244

SEQ ID NO: 103454 - DNA, 201 bp, Bos taurus; identical to SEQ ID NO: 22245

SEQ ID NO: 103455 - DNA, 201 bp, Bos taurus; identical to SEQ ID NO: 22248

SEQ ID NO: 103456 - DNA, 201 bp, Bos taurus
taccaagaggtttttggagagagatcctagaaaagacaagcctattgaatcctgtatctagacatgttatgctagtctccagtttttgctggactgtgagcttcccaaggcctgggaaagtgttttgcaattttctttcctgtctccaaagcctagcaaagacatacagtaagcagtaaatgtgtaccataccactgaaat

SEQ ID NO: 103457 - DNA, 201 bp, Bos taurus
ttccttcggtaaaaatcttcaaactattgattataaaactgatcatttatacagctgagtttctactgctggtctagggcaagaattaaaatccatttgtcgggttcacttgagtcaagtgtattcacagatattattttattcataccaataggtcttctattgcttactcatcctaagaaagcaatgacaagcattaac

SEQ ID NO: 103458 - DNA, 201 bp, Bos taurus; identical to SEQ ID NO: 22251

SEQ ID NO: 103459 - DNA, 201 bp, Bos taurus
cactttaaagagggagatttgggagttggggcgggtccacaaagacggctgagcctcaggtcttctatggtttggacttggtggctggtaaatcatccacagagctccagcgaaccacttcctattttcccttccccttatctgagcctctgcttacagctttctttaggagcagagatttctacacttggaagtcaatga

SEQ ID NO: 103460 - DNA, 201 bp, Bos taurus; identical to SEQ ID NO: 22252

SEQ ID NO: 103461 - DNA, 201 bp, Bos taurus
cacagaatgtaaagattgttccaggtattaaaatcaatgaagtttgtttaaaaaaaaagaacacttctgccaaattggcagaaaaaaagtgaatgtaaaataatcaaactaccaaactctttatcgatttaactatgagttttaaaaaaccagatattaagaaaattcagagttcaaaaaatcgtgaccatgttttattga

SEQ ID NO: 103462 - DNA, 201 bp, Bos taurus; identical to SEQ ID NO: 22253

SEQ ID NO: 103463 - DNA, 201 bp, Bos taurus
aacttgatgactacttccatgatataactgtaggttatattttatcagttaaggttctgatatctagatgtatattttaaagctgaccaaaaaaaattctcatgttaagcaatggcataaattctaagcagaaatatgcttgatcactataaaaatgtattaagaacaaaaataaattgtagatatgttttcataacataa

SEQ ID NO: 103464 - DNA, 201 bp, Bos taurus
agatttacacacagcagtataatcactcaagaaatcaaaaaaaaagaaaagagaaaaacatctgtccctaggctactgttgcctgttcagcctctgattttgaaaatttggcctccaacctgttaagtaaatcagtcacttacttaccaatgtaagcaagtaaatttccaaataatggtgccggcatcccccaaatcatgg

SEQ ID NO: 103465 - DNA, 201 bp, Bos taurus; identical to SEQ ID NO: 22255

SEQ ID NO: 103466 - DNA, 201 bp, Bos taurus; identical to SEQ ID NO: 22256

SEQ ID NO: 103467 - DNA, 201 bp, Bos taurus; identical to SEQ ID NO: 22258

SEQ ID NO: 103468 - DNA, 201 bp, Bos taurus; identical to SEQ ID NO: 22259

SEQ ID NO: 103469 - DNA, 201 bp, Bos taurus
tgagtttttaacaatggtaaaatagtctagtctgtttttatgggctcaatgaactaatagctggaaacaatgagactgtgcctggccatgtcatgtagacatcagcatgtagatgttagttaagcaagtaagagaaatttctcccactctgtccttggccacccagtttctctcccaaagtaatcactgtcccttgtgtct

SEQ ID NO: 103470 - DNA, 201 bp, Bos taurus; identical to SEQ ID NO: 22263

SEQ ID NO: 103471 - DNA, 201 bp, Bos taurus; identical to SEQ ID NO: 22264

SEQ ID NO: 103472 - DNA, 201 bp, Bos taurus; identical to SEQ ID NO: 22265

SEQ ID NO: 103473 - DNA, 201 bp, Bos taurus; identical to SEQ ID NO: 22266

SEQ ID NO: 103474 - DNA, 201 bp, Bos taurus; identical to SEQ ID NO: 22267

SEQ ID NO: 103475 - DNA, 201 bp, Bos taurus
cctaaccactggaccaccagagaaatccctggagaaagaaaatcttgacatgagatcatctggaattatctggctgggccctgaatcctgacaagtgtccttagaggagaggggcagagggaggtttgagaccgaaggcagagggtacaaaggagacgtggaggccctgtggccgcagagtcagcgagtggagcgttgcga

SEQ ID NO: 103476 - DNA, 201 bp, Bos taurus
gactgctcctctagtgttctaggatggcccagacaagagtccacagtctgctctgaaagcacagggtccgtgggggaagtaccctcttcctccagtaaccagatttgggggggccccccattcctttccagcctttgtcataggtgtctggaaggccctggagccctgatgaaccaggtggtacacagactggcagcattg

SEQ ID NO: 103477 - DNA, 201 bp, Bos taurus
cattgaaaggacatcttattactaaggaattcatgtaaatttgataacaaaatggcattatagaaagtacactaattagatctgcattttctgcttttcattgccatgttttatcaattcaataccatcttggttggggaaagaaacagatcaaaggtgctgtgtgtctagtgtcactgatggaaaaagtaagtaggagga

SEQ ID NO: 103478 - DNA, 201 bp, Bos taurus; identical to SEQ ID NO: 22271

SEQ ID NO: 103479 - DNA, 201 bp, Bos taurus; identical to SEQ ID NO: 22272

SEQ ID NO: 103480 - DNA, 201 bp, Bos taurus; identical to SEQ ID NO: 22273

SEQ ID NO: 103481 - DNA, 201 bp, Bos taurus; identical to SEQ ID NO: 22274

SEQ ID NO: 103482 - DNA, 201 bp, Bos taurus; identical to SEQ ID NO: 22275

SEQ ID NO: 103483 - DNA, 201 bp, Bos taurus; identical to SEQ ID NO: 22276

SEQ ID NO: 103484 - DNA, 201 bp, Bos taurus; identical to SEQ ID NO: 22277

SEQ ID NO: 103485 - DNA, 201 bp, Bos taurus; identical to SEQ ID NO: 22278

SEQ ID NO: 103486 - DNA, 201 bp, Bos taurus; identical to SEQ ID NO: 22279

SEQ ID NO: 103487 - DNA, 201 bp, Bos taurus; identical to SEQ ID NO: 22280

SEQ ID NO: 103488 - DNA, 201 bp, Bos taurus; identical to SEQ ID NO: 22282

SEQ ID NO: 103489 - DNA, 201 bp, Bos taurus; identical to SEQ ID NO: 22283

SEQ ID NO: 103490 - DNA, 201 bp, Bos taurus
caacaaagttgcaggattaagaggtgtgcagtaggtagcctgtttcaagctaagccatggatactacttgtctaggctgcaaacagcatcgtccttcaactgggccacttctttggattaagctgatccggcctcatccagggtgtccaatgcttgcaacacccacttgacagaaagggaaagggactttgcttagctaat

SEQ ID NO: 103491 - DNA, 201 bp, Bos taurus
agggcttgcacacagaagctgtcagagtggtcacaaagcataagctttcccagcccatctgaaagtaagaaagatgagtgtggaagaactctcttgggcccggaaacacgctctgcggaaagagatggacaggaaactctggatcacgcccttctgtattcctgggcattaagtgggggctccttgtgtctctggcagcct

SEQ ID NO: 103492 - DNA, 201 bp, Bos taurus
tttatttattactttgctatgatctgaatgtttgtcttttcctcaaattcatatgttgaagcataatcctcgctgtgatggtatgtggagcggcggccttcagaatgtgatatggtcacgagagcaggaccctgaggaatagggttagtgcctgtattaaaagacaccacagagctctttgccttggccaccacaggaaga

SEQ ID NO: 103493 - DNA, 201 bp, Bos taurus
gacagtgatcctactgcacacttaaaatatttttaaatgccttaggaaccatggagcaagcagtgttaaaaataataatgtaccaactaaagatatttagcgctctgctaagacaggaggcgatgcagcagaatgagaaaatctgcagattgtgtccacaccatgcgtgttcaagctggagccccacctcacacggggtct

SEQ ID NO: 103494 - DNA, 201 bp, Bos taurus
aggagcctggtgagctctagtccaaaaggtcgcaaagggtcagacacaactcagcaactgtgcacatgcgctaagagagcacggctgaaccattctggccggaacgctcttcacagctactcacctacagcagcagcttcccacccaaggggcaaatgtgtcacccagggtctccaggttggaggccagagggcagaaggt

SEQ ID NO: 103495 - DNA, 201 bp, Bos taurus
tattatggagagacagtttgccagcaaactgctgtatttaacccaatttgagttgctggaagaacccagaaggttgccttgtggaggatggatggtgattaagaatgctgtggagggcgagaggtggaacttgaaagcagaatatacatcacgaaagcacaaataaatttaatgagagaccagggtgtgaaatatcaacaa

SEQ ID NO: 103496 - DNA, 201 bp, Bos taurus
cgagggatcaggtgtgtttgtgggctttgcaaagaccctagcacgactggagagctgagtgcaggaaagactgaagccctttaaacggatggagtactcactattcaataacttaccttgtacgtcatccaaagattgaatgagattcaacaagaaggaaatgggtctcctctgttctccgtgaggtgacgcgtgaacaac

SEQ ID NO: 103497 - DNA, 201 bp, Bos taurus
agcaggccactccaaagaaacagatcctcctctgctttttaacaaaggacagtgctgataagtttatctcaaatactgttagagacttcagacaaatactgtgtgagagcaaacaggcccaggcttgcttgcaggaggattagagaacagtcttgaatgacattgttcttcaggttcctctgggtctagaaagctgtgagt

SEQ ID NO: 103498 - DNA, 201 bp, Bos taurus
tccagggggactcctgagactcgatcccacctttgcgtatgtcgagcctccttcctcatgacctttgccacgggcggagcgcctcacgccggcccccgacaagtggggactgacccagtcctcaaccacgtgtggaaagaactccgctctcttgtgcctcccaccggccttcccatagcaccagctgaatcatcccatgtc

SEQ ID NO: 103499 - DNA, 201 bp, Bos taurus
ctgagtcccacctgtgctatctccttagcaccccgtgtgcggcgaatctcttcctctccatcactacggccttggttcaggcgatctctcttccttggtcctcttccagaacaactgtgtttgttctcaattgctgctgtaataaattgggaaagttagtggcctaaaacagctccaacttattatcttacagctcagtgg

SEQ ID NO: 103500 - DNA, 201 bp, Bos taurus; identical to SEQ ID NO: 22284

SEQ ID NO: 103501 - DNA, 201 bp, Bos taurus; identical to SEQ ID NO: 22285

SEQ ID NO: 103502 - DNA, 201 bp, Bos taurus; identical to SEQ ID NO: 22286

SEQ ID NO: 103503 - DNA, 201 bp, Bos taurus; identical to SEQ ID NO: 22287

SEQ ID NO: 103504 - DNA, 201 bp, Bos taurus; identical to SEQ ID NO: 22288

SEQ ID NO: 103505 - DNA, 201 bp, Bos taurus; identical to SEQ ID NO: 22289

SEQ ID NO: 103506 - DNA, 201 bp, Bos taurus; identical to SEQ ID NO: 22290

SEQ ID NO: 103507 - DNA, 201 bp, Bos taurus; identical to SEQ ID NO: 22294

SEQ ID NO: 103508 - DNA, 201 bp, Bos taurus; identical to SEQ ID NO: 22296

SEQ ID NO: 103509 - DNA, 201 bp, Bos taurus
ctccggcccctctccttgcccctccccctggtctgcgcacgccattcctctgcgcatgtctgtgccctggtcacctttctcataaggacgcaactcatccgggatcagggcccactctaacgatgtctctgtcatctaatcacgtctgtggaggccgcttctgcaaacacggtcacattctgagccccgggcagtcagggt

SEQ ID NO: 103510 - DNA, 201 bp, Bos taurus; identical to SEQ ID NO: 22299

SEQ ID NO: 103511 - DNA, 201 bp, Bos taurus
gaggggaggccgttttccctgctgccctgtcacttcctgtttgccctgggtgcctcctcagtgctgcctaagctgtgctgagtgggcgtctgtaagctccgtgggagctggcctgctaactggtgtgccccgcggtccctggagcggcgttgagtctgcagactgtgctcagtacgaggccagggcggcaggagcaggctc

SEQ ID NO: 103512 - DNA, 201 bp, Bos taurus; identical to SEQ ID NO: 22305

SEQ ID NO: 103513 - DNA, 201 bp, Bos taurus; identical to SEQ ID NO: 22306

SEQ ID NO: 103514 - DNA, 201 bp, Bos taurus
gaacctcattcactgcaacatctttttcttttatttctcctcaaagtatgtttcaggcttctttccttaggaaaacaaatctttctttgacccaatcatccgtttaaataatctctcagttttcctttgccacggcaaactcctcaaaggggacctctctctgagcagtcttgctcagaagatacagtgccttacctttct

SEQ ID NO: 103515 - DNA, 201 bp, Bos taurus; identical to SEQ ID NO: 22307

SEQ ID NO: 103516 - DNA, 201 bp, Bos taurus; identical to SEQ ID NO: 22309

SEQ ID NO: 103517 - DNA, 201 bp, Bos taurus; identical to SEQ ID NO: 22310

SEQ ID NO: 103518 - DNA, 201 bp, Bos taurus; identical to SEQ ID NO: 22311

SEQ ID NO: 103519 - DNA, 201 bp, Bos taurus
agaattcaaatatatttttcatattatatttgtgattggagggagaagactagcacatgaactatcttaggtattgccaggcttttgctgtgaaaggccacgtagtgtttgaggctttgcagaccaaatggtatctctcataagcactcttttctgcctttgtcatgcagaagtagctatagatgataagtgatggatgga

SEQ ID NO: 103520 - DNA, 201 bp, Bos taurus
cctgagcctggtttggcacgtcagtgagccccagtctcactttctctcagggggagtgcttgcagctctctaccttatgtgatgggttgaccagatatccggaggcactgtggcacttacacctgtggaatcatctcaggaccttgtggtagcagggctcatatgaatgcgccctgatccggaagggtagcctggggggat

SEQ ID NO: 103521 - DNA, 201 bp, Bos taurus
cacccctagctcctctcccagtcctcacagaatttaaggttatgacacacactgagagaaagttaaacaaagccggggccgggtacctagccttagggactagagcctgccccggagatgagatggtggggcaggaagcaaggagaaggagccggtgtggaaaccctctcctttgcggccctttcagattcggcctcgttt

SEQ ID NO: 103522 - DNA, 201 bp, Bos taurus; identical to SEQ ID NO: 22314

SEQ ID NO: 103523 - DNA, 201 bp, Bos taurus; identical to SEQ ID NO: 22315

SEQ ID NO: 103524 - DNA, 201 bp, Bos taurus; identical to SEQ ID NO: 22316

SEQ ID NO: 103525 - DNA, 201 bp, Bos taurus
cattgagcatggttcagctttagttggtccaacttcaactgcattggctcaccttttttcatctttgtgaggatacacaactctccaccttatctttcctattagcttggccaatagagagtggattacatactttttgaccaacccactatttccccagatggctttggtagcctctgctggctttttccaaaatgtccg

SEQ ID NO: 103526 - DNA, 201 bp, Bos taurus
atatttctccttcactgtctgactgacttcactcagtgtgacactttctaggtccatccatgttgctgcaaattgctcatcatggatcctgtgatctatcagttccattcctaggtatatcctataggcaaagtcacaggtgaaggtgttcttggccagtaccaggagtagggggaagtaagggaagatgcctagtgctca

SEQ ID NO: 103527 - DNA, 201 bp, Bos taurus; identical to SEQ ID NO: 22317

SEQ ID NO: 103528 - DNA, 201 bp, Bos taurus
tttgtcatgtcctgagcccgccggcacacacaggcccggctggctttagcaaagtgcatgaatgcagcagggctcctgggaagcggccagcgtctggtctgactgcctgagcatcacccagagaccaaggagaaatgggaattctcagcccgaacccagacctcctgagtcagaatctctgtgatcagggccaaggtatct

SEQ ID NO: 103529 - DNA, 201 bp, Bos taurus
aatttggaaaaagtgcactgaggatggcagagcaataggacagggggagactggatccccaaaagtgtgaagccaccctatcaggcctgtactgcttatagtcagatggcttcatgagagaaggtgaatttatatcttctttaagctactattatttgggcctttgttagcagccgtaccaatatcataagtaaaatatca

SEQ ID NO: 103530 - DNA, 201 bp, Bos taurus; identical to SEQ ID NO: 22321

SEQ ID NO: 103531 - DNA, 201 bp, Bos taurus; identical to SEQ ID NO: 22322

SEQ ID NO: 103532 - DNA, 201 bp, Bos taurus; identical to SEQ ID NO: 22324

SEQ ID NO: 103533 - DNA, 201 bp, Bos taurus; identical to SEQ ID NO: 22325

SEQ ID NO: 103534 - DNA, 201 bp, Bos taurus; identical to SEQ ID NO: 22326

SEQ ID NO: 103535 - DNA, 201 bp, Bos taurus; identical to SEQ ID NO: 22327

SEQ ID NO: 103536 - DNA, 201 bp, Bos taurus; identical to SEQ ID NO: 22328

SEQ ID NO: 103537 - DNA, 201 bp, Bos taurus; identical to SEQ ID NO: 22329

SEQ ID NO: 103538 - DNA, 201 bp, Bos taurus; identical to SEQ ID NO: 22330

SEQ ID NO: 103539 - DNA, 201 bp, Bos taurus; identical to SEQ ID NO: 22331

SEQ ID NO: 103540 - DNA, 201 bp, Bos taurus; identical to SEQ ID NO: 22332

SEQ ID NO: 103541 - DNA, 201 bp, Bos taurus
tgtgacacctttgaagccaaatctgaaatagtatcaaatctctataactttaaggtacttactaaatatgcaccctggtttcctcatctcttatgaaaattaaatagggtaatgagtgttaaatactgtaagatcaaaacacttttacagttattgcatttaaaaagatttaacaagctgttaccattaattttattactt

SEQ ID NO: 103542 - DNA, 201 bp, Bos taurus; identical to SEQ ID NO: 22334

SEQ ID NO: 103543 - DNA, 201 bp, Bos taurus
actctggcctggagaattccatggactatacagtccatggggtcgcaaagagtcagacacaactgaacgactttcacttcacttcacttttatgaaataaggggcaggggccgctttaaacaatactcacctccagccatgaagggctccatctcatactctaaccctcactgaggctgctttgtgcttccactgccctgg

SEQ ID NO: 103544 - DNA, 201 bp, Bos taurus; identical to SEQ ID NO: 22337

SEQ ID NO: 103545 - DNA, 201 bp, Bos taurus; identical to SEQ ID NO: 22338

SEQ ID NO: 103546 - DNA, 201 bp, Bos taurus; identical to SEQ ID NO: 22339

SEQ ID NO: 103547 - DNA, 201 bp, Bos taurus; identical to SEQ ID NO: 22340

SEQ ID NO: 103548 - DNA, 201 bp, Bos taurus; identical to SEQ ID NO: 22341

SEQ ID NO: 103549 - DNA, 201 bp, Bos taurus; identical to SEQ ID NO: 22342

SEQ ID NO: 103550 - DNA, 201 bp, Bos taurus; identical to SEQ ID NO: 22343

SEQ ID NO: 103551 - DNA, 201 bp, Bos taurus; identical to SEQ ID NO: 22344

SEQ ID NO: 103552 - DNA, 201 bp, Bos taurus; identical to SEQ ID NO: 22345

SEQ ID NO: 103553 - DNA, 201 bp, Bos taurus; identical to SEQ ID NO: 22346

SEQ ID NO: 103554 - DNA, 201 bp, Bos taurus; identical to SEQ ID NO: 22347

SEQ ID NO: 103555 - DNA, 201 bp, Bos taurus
ctattcttgggccttgatagaaagtcaccacagcagccctgttgggccatgacttgggtctgagaacagaagatcaggagtaaagcagaaagagggcaggatgctgtgtggtgacacgggcccggctgtgccacgtctctgggcaaggagatagttgcctggccacgggccccagagggctggggatggagcaggtggtac

SEQ ID NO: 103556 - DNA, 201 bp, Bos taurus
gagcatcttctcatgtgcctattggccatttgtatatcttctttagagaagtaagacagcaaactcaattgataaatatgtgtatgttctgactgcttcaccaaccagccctttgcctgaggcctccctgttccttgagacacaacagtgttgaaattagtccaattaataatcctataatggcttccctgtggctcagtt

SEQ ID NO: 103557 - DNA, 201 bp, Bos taurus; identical to SEQ ID NO: 22351

SEQ ID NO: 103558 - DNA, 201 bp, Bos taurus; identical to SEQ ID NO: 22354

SEQ ID NO: 103559 - DNA, 201 bp, Bos taurus; identical to SEQ ID NO: 22355

SEQ ID NO: 103560 - DNA, 201 bp, Bos taurus; identical to SEQ ID NO: 22357

SEQ ID NO: 103561 - DNA, 201 bp, Bos taurus; identical to SEQ ID NO: 22358

SEQ ID NO: 103562 - DNA, 201 bp, Bos taurus; identical to SEQ ID NO: 22360

SEQ ID NO: 103563 - DNA, 201 bp, Bos taurus; identical to SEQ ID NO: 22361

SEQ ID NO: 103564 - DNA, 201 bp, Bos taurus; identical to SEQ ID NO: 22362

SEQ ID NO: 103565 - DNA, 201 bp, Bos taurus
gatggcctgctggaaagagtaaggcaggttcttcttggcttgatgaaatgcctgggaagaaaccagccccaactcatggtgtgatccggaagcacttcctgctgcctttggccactgaatgaatagggaggagccgcttcttatcccaccctctaggaggcacctggagcatggagaaataaagggttgggctttggaatc

SEQ ID NO: 103566 - DNA, 201 bp, Bos taurus; identical to SEQ ID NO: 22364

SEQ ID NO: 103567 - DNA, 201 bp, Bos taurus
acagagtctccacccccaacacaaaggcccctgccagggactaggagctcccctgctgtctagactaaccagaaactcatgctcactaacggacagagaaggaaacttggtggatgatgtggcccatacagttcaagtacataaatacctatgtggtgaaaaggccagacttaacctagaggatgattctctctaagcctt

SEQ ID NO: 103568 - DNA, 201 bp, Bos taurus; identical to SEQ ID NO: 22365

SEQ ID NO: 103569 - DNA, 201 bp, Bos taurus
ccggtatttaaacaaaaatgcctagagactgacacactgttctataataagggaataaatatcagtagcaaaaataattataaacaacggtaaactactcgcgaagactttcttagatcttaactgaaaggattaatatgtaaactcattgcctttcttgtggtccctaggaaaggttaagattgtagattataagcatta

SEQ ID NO: 103570 - DNA, 201 bp, Bos taurus; identical to SEQ ID NO: 22369

SEQ ID NO: 103571 - DNA, 201 bp, Bos taurus; identical to SEQ ID NO: 22370

SEQ ID NO: 103572 - DNA, 201 bp, Bos taurus
agaagtctataaataggctattagaaaggatggccatatttcgcttaacttgtctggtttaatctactaatcacagcacaggtgacctcagaattcactagtgtggccaacaccttgagattcttgagaatttgtcctactatcttctttctgttttactccaagtaagtgtaaaatcttggtttggaggaatgtgtcttg

SEQ ID NO: 103573 - DNA, 201 bp, Bos taurus
acgccgctgcactccaggcatttcttttttgctcctgcctccagagtcctccgttgccgatgtcagtcggaagactcgagtgagctggagggggcccaaaaaccagtttcgagcctctggacctccagcgtttgcctggggaccgtgacccttccctttctgcggccctctggccctcttctctactccagacaagttgaa

SEQ ID NO: 103574 - DNA, 201 bp, Bos taurus; identical to SEQ ID NO: 22372

SEQ ID NO: 103575 - DNA, 201 bp, Bos taurus; identical to SEQ ID NO: 22373

SEQ ID NO: 103576 - DNA, 201 bp, Bos taurus; identical to SEQ ID NO: 22374

SEQ ID NO: 103577 - DNA, 201 bp, Bos taurus; identical to SEQ ID NO: 22376

SEQ ID NO: 103578 - DNA, 201 bp, Bos taurus; identical to SEQ ID NO: 22377

SEQ ID NO: 103579 - DNA, 201 bp, Bos taurus; identical to SEQ ID NO: 22379

SEQ ID NO: 103580 - DNA, 201 bp, Bos taurus; identical to SEQ ID NO: 22382

SEQ ID NO: 103581 - DNA, 201 bp, Bos taurus
ggacctggcctgcagtgagtcgctggagccttcaagtaaggtgaggactggggcacagccactggatttagagaccagtgacttggtcattctggggtcgcggaggaagggccaggagggaacagggacagctggcaaacagcctttccaaacgtgtcatcagaaggtgaggagagagagtagaaaccagaaggaaagtgc

SEQ ID NO: 103582 - DNA, 201 bp, Bos taurus; identical to SEQ ID NO: 22383

SEQ ID NO: 103583 - DNA, 201 bp, Bos taurus
gggcctgcctgatggaggggtgccccatctccttcccacagaggctgcctggtgagaggctgcaagttcggtctatgcgatctgctgcacagaagctgagtggccctgggtgagccactgcccctctttcagctctcactgcctctctataaaatggcgctagttattcagacctctcagggtggtttggaggattaaaag

SEQ ID NO: 103584 - DNA, 201 bp, Bos taurus
ggggaagacatcagtctggggattatgagggatgggaacccagagacaggcagagccagcctttggaaaacagtcctgactctgtcccagttttcagctcagggcccctccacggctcagctgagtctccggctcttcttagagtcagctctctcctcagccctcctgtcccaggatgcttttacaggtctcattcctgag

SEQ ID NO: 103585 - DNA, 201 bp, Bos taurus
ggccctcagatgggggcatggtgccatgatgggaaaactccatgggctcattgatgaacccatcattgaagctttctttttttttggtccctacagaaaccgtgatggccttggtcacggcactgggccgttttgtaggcagcaaaggctgttacagcccttgacgtttctgttcctgtctggttctgttgggtgcttttt

SEQ ID NO: 103586 - DNA, 201 bp, Bos taurus; identical to SEQ ID NO: 22384

SEQ ID NO: 103587 - DNA, 201 bp, Bos taurus; identical to SEQ ID NO: 22387

SEQ ID NO: 103588 - DNA, 201 bp, Bos taurus
agcctcagtgggccagctgttccatctcagccaacagagaaatgcggggagaaagaagtggcagtggtttgagcccaggccgaggcgtttgtgcagccgcccacagcagagtcccagccatgggttttagtaaagggtgcatgatgagatgatatgaagcaaattactgaggcagggccacaaaacaaatccccctctgtt

SEQ ID NO: 103589 - DNA, 201 bp, Bos taurus; identical to SEQ ID NO: 22390

SEQ ID NO: 103590 - DNA, 201 bp, Bos taurus; identical to SEQ ID NO: 22392

SEQ ID NO: 103591 - DNA, 201 bp, Bos taurus; identical to SEQ ID NO: 22393

SEQ ID NO: 103592 - DNA, 201 bp, Bos taurus; identical to SEQ ID NO: 22394

SEQ ID NO: 103593 - DNA, 201 bp, Bos taurus
aaacaccatttggaaagtgctttacatgtttactatacccatctcaagcacgctcctcactcaaaacaggctattttaagcaaatattctttggtctatcgattcttttctgccgctctaagatattaaacttacaaacaagaaaatctacctaaatacaaacaccccataactgaatcttaaaatgttatgtgactttga

SEQ ID NO: 103594 - DNA, 201 bp, Bos taurus
gaagcagaggaggcagcatacgttttagaaaaacgtggtgtgggcttgccattgaccatctccttgaaaccactcctttatttctctggtcctttcccattaggcccttacatggcagtgcccacccctgccatttgccttcccttcttgttctcttcctgggtgatgctgtctagcctctggcctcaacctaggtgcagg

SEQ ID NO: 103595 - DNA, 201 bp, Bos taurus; identical to SEQ ID NO: 22395

SEQ ID NO: 103596 - DNA, 201 bp, Bos taurus; identical to SEQ ID NO: 22396

SEQ ID NO: 103597 - DNA, 201 bp, Bos taurus; identical to SEQ ID NO: 22397

SEQ ID NO: 103598 - DNA, 201 bp, Bos taurus; identical to SEQ ID NO: 22398

SEQ ID NO: 103599 - DNA, 201 bp, Bos taurus; identical to SEQ ID NO: 22399

SEQ ID NO: 103600 - DNA, 201 bp, Bos taurus; identical to SEQ ID NO: 22400

SEQ ID NO: 103601 - DNA, 201 bp, Bos taurus; identical to SEQ ID NO: 22401

SEQ ID NO: 103602 - DNA, 201 bp, Bos taurus; identical to SEQ ID NO: 22402

SEQ ID NO: 103603 - DNA, 201 bp, Bos taurus; identical to SEQ ID NO: 22403

SEQ ID NO: 103604 - DNA, 201 bp, Bos taurus; identical to SEQ ID NO: 22404

SEQ ID NO: 103605 - DNA, 201 bp, Bos taurus; identical to SEQ ID NO: 22405

SEQ ID NO: 103606 - DNA, 201 bp, Bos taurus; identical to SEQ ID NO: 22406

SEQ ID NO: 103607 - DNA, 201 bp, Bos taurus; identical to SEQ ID NO: 22407

SEQ ID NO: 103608 - DNA, 201 bp, Bos taurus; identical to SEQ ID NO: 22408

SEQ ID NO: 103609 - DNA, 201 bp, Bos taurus
aaagtgggaacggggaggagctgggccctcctccgggagctgaccggggagtgccagcagcctctccctgggaagctttgtgggaagcccccacgggaggggagaggggccaggtccctgcactgcccatgtcagtcagcagtcatcagcagcatggttcagccgcctctgggcagctgtggcccgcgggggcagggaggc

SEQ ID NO: 103610 - DNA, 201 bp, Bos taurus; identical to SEQ ID NO: 22409

SEQ ID NO: 103611 - DNA, 201 bp, Bos taurus; identical to SEQ ID NO: 22410

SEQ ID NO: 103612 - DNA, 201 bp, Bos taurus; identical to SEQ ID NO: 22411

SEQ ID NO: 103613 - DNA, 201 bp, Bos taurus; identical to SEQ ID NO: 22412

SEQ ID NO: 103614 - DNA, 201 bp, Bos taurus; identical to SEQ ID NO: 22413

SEQ ID NO: 103615 - DNA, 201 bp, Bos taurus; identical to SEQ ID NO: 22414

SEQ ID NO: 103616 - DNA, 201 bp, Bos taurus; identical to SEQ ID NO: 22415

SEQ ID NO: 103617 - DNA, 201 bp, Bos taurus; identical to SEQ ID NO: 22416

SEQ ID NO: 103618 - DNA, 201 bp, Bos taurus; identical to SEQ ID NO: 22417

SEQ ID NO: 103619 - DNA, 201 bp, Bos taurus; identical to SEQ ID NO: 22418

SEQ ID NO: 103620 - DNA, 201 bp, Bos taurus; identical to SEQ ID NO: 22419

SEQ ID NO: 103621 - DNA, 201 bp, Bos taurus; identical to SEQ ID NO: 22420

SEQ ID NO: 103622 - DNA, 201 bp, Bos taurus; identical to SEQ ID NO: 22421

SEQ ID NO: 103623 - DNA, 201 bp, Bos taurus; identical to SEQ ID NO: 22422

SEQ ID NO: 103624 - DNA, 201 bp, Bos taurus; identical to SEQ ID NO: 22423

SEQ ID NO: 103625 - DNA, 201 bp, Bos taurus; identical to SEQ ID NO: 22424

SEQ ID NO: 103626 - DNA, 201 bp, Bos taurus; identical to SEQ ID NO: 22425

SEQ ID NO: 103627 - DNA, 201 bp, Bos taurus; identical to SEQ ID NO: 22426

SEQ ID NO: 103628 - DNA, 201 bp, Bos taurus; identical to SEQ ID NO: 22427

SEQ ID NO: 103629 - DNA, 201 bp, Bos taurus; identical to SEQ ID NO: 22428

SEQ ID NO: 103630 - DNA, 201 bp, Bos taurus; identical to SEQ ID NO: 22429

SEQ ID NO: 103631 - DNA, 201 bp, Bos taurus; identical to SEQ ID NO: 22430

SEQ ID NO: 103632 - DNA, 201 bp, Bos taurus; identical to SEQ ID NO: 22431

SEQ ID NO: 103633 - DNA, 201 bp, Bos taurus; identical to SEQ ID NO: 22432

SEQ ID NO: 103634 - DNA, 201 bp, Bos taurus; identical to SEQ ID NO: 22433

SEQ ID NO: 103635 - DNA, 201 bp, Bos taurus; identical to SEQ ID NO: 22434

SEQ ID NO: 103636 - DNA, 201 bp, Bos taurus; identical to SEQ ID NO: 22435

SEQ ID NO: 103637 - DNA, 201 bp, Bos taurus; identical to SEQ ID NO: 22436

SEQ ID NO: 103638 - DNA, 201 bp, Bos taurus; identical to SEQ ID NO: 22437

SEQ ID NO: 103639 - DNA, 201 bp, Bos taurus; identical to SEQ ID NO: 22438

SEQ ID NO: 103640 - DNA, 201 bp, Bos taurus; identical to SEQ ID NO: 22439

SEQ ID NO: 103641 - DNA, 201 bp, Bos taurus; identical to SEQ ID NO: 22440

SEQ ID NO: 103642 - DNA, 201 bp, Bos taurus; identical to SEQ ID NO: 22441

SEQ ID NO: 103643 - DNA, 201 bp, Bos taurus; identical to SEQ ID NO: 22442

SEQ ID NO: 103644 - DNA, 201 bp, Bos taurus; identical to SEQ ID NO: 22443

SEQ ID NO: 103645 - DNA, 201 bp, Bos taurus; identical to SEQ ID NO: 22444

SEQ ID NO: 103646 - DNA, 201 bp, Bos taurus; identical to SEQ ID NO: 22445

SEQ ID NO: 103647 - DNA, 201 bp, Bos taurus; identical to SEQ ID NO: 22446

SEQ ID NO: 103648 - DNA, 201 bp, Bos taurus; identical to SEQ ID NO: 22447

SEQ ID NO: 103649 - DNA, 201 bp, Bos taurus; identical to SEQ ID NO: 22448

SEQ ID NO: 103650 - DNA, 201 bp, Bos taurus; identical to SEQ ID NO: 22449

SEQ ID NO: 103651 - DNA, 201 bp, Bos taurus; identical to SEQ ID NO: 22450

SEQ ID NO: 103652 - DNA, 201 bp, Bos taurus; identical to SEQ ID NO: 22451

SEQ ID NO: 103653 - DNA, 201 bp, Bos taurus; identical to SEQ ID NO: 22452

SEQ ID NO: 103654 - DNA, 201 bp, Bos taurus; identical to SEQ ID NO: 22453

SEQ ID NO: 103655 - DNA, 201 bp, Bos taurus; identical to SEQ ID NO: 22454

SEQ ID NO: 103656 - DNA, 201 bp, Bos taurus; identical to SEQ ID NO: 22455

SEQ ID NO: 103657 - DNA, 201 bp, Bos taurus; identical to SEQ ID NO: 22456

SEQ ID NO: 103658 - DNA, 201 bp, Bos taurus; identical to SEQ ID NO: 22457

SEQ ID NO: 103659 - DNA, 201 bp, Bos taurus; identical to SEQ ID NO: 22458

SEQ ID NO: 103660 - DNA, 201 bp, Bos taurus; identical to SEQ ID NO: 22459

SEQ ID NO: 103661 - DNA, 201 bp, Bos taurus; identical to SEQ ID NO: 22460

SEQ ID NO: 103662 - DNA, 201 bp, Bos taurus; identical to SEQ ID NO: 22461

SEQ ID NO: 103663 - DNA, 201 bp, Bos taurus; identical to SEQ ID NO: 22462

SEQ ID NO: 103664 - DNA, 201 bp, Bos taurus; identical to SEQ ID NO: 22463

SEQ ID NO: 103665 - DNA, 201 bp, Bos taurus; identical to SEQ ID NO: 22464

SEQ ID NO: 103666 - DNA, 201 bp, Bos taurus; identical to SEQ ID NO: 22465

SEQ ID NO: 103667 - DNA, 201 bp, Bos taurus; identical to SEQ ID NO: 22466

SEQ ID NO: 103668 - DNA, 201 bp, Bos taurus; identical to SEQ ID NO: 22467

SEQ ID NO: 103669 - DNA, 201 bp, Bos taurus; identical to SEQ ID NO: 22468

SEQ ID NO: 103670 - DNA, 201 bp, Bos taurus; identical to SEQ ID NO: 22469

SEQ ID NO: 103671 - DNA, 201 bp, Bos taurus; identical to SEQ ID NO: 22470

SEQ ID NO: 103672 - DNA, 201 bp, Bos taurus; identical to SEQ ID NO: 22471

SEQ ID NO: 103673 - DNA, 201 bp, Bos taurus; identical to SEQ ID NO: 22472

SEQ ID NO: 103674 - DNA, 201 bp, Bos taurus; identical to SEQ ID NO: 22473

SEQ ID NO: 103675 - DNA, 201 bp, Bos taurus; identical to SEQ ID NO: 22474

SEQ ID NO: 103676 - DNA, 201 bp, Bos taurus; identical to SEQ ID NO: 22475

SEQ ID NO: 103677 - DNA, 201 bp, Bos taurus; identical to SEQ ID NO: 22476

SEQ ID NO: 103678 - DNA, 201 bp, Bos taurus; identical to SEQ ID NO: 22477

SEQ ID NO: 103679 - DNA, 201 bp, Bos taurus; identical to SEQ ID NO: 22478

SEQ ID NO: 103680 - DNA, 201 bp, Bos taurus; identical to SEQ ID NO: 22479

SEQ ID NO: 103681 - DNA, 201 bp, Bos taurus; identical to SEQ ID NO: 22480

SEQ ID NO: 103682 - DNA, 201 bp, Bos taurus; identical to SEQ ID NO: 22481

SEQ ID NO: 103683 - DNA, 201 bp, Bos taurus; identical to SEQ ID NO: 22483

SEQ ID NO: 103684 - DNA, 201 bp, Bos taurus; identical to SEQ ID NO: 22484

SEQ ID NO: 103685 - DNA, 201 bp, Bos taurus; identical to SEQ ID NO: 22485

SEQ ID NO: 103686 - DNA, 201 bp, Bos taurus; identical to SEQ ID NO: 22486

SEQ ID NO: 103687 - DNA, 201 bp, Bos taurus; identical to SEQ ID NO: 22487

SEQ ID NO: 103688 - DNA, 201 bp, Bos taurus; identical to SEQ ID NO: 22488

SEQ ID NO: 103689 - DNA, 201 bp, Bos taurus; identical to SEQ ID NO: 22489

SEQ ID NO: 103690 - DNA, 201 bp, Bos taurus; identical to SEQ ID NO: 22490

SEQ ID NO: 103691 - DNA, 201 bp, Bos taurus; identical to SEQ ID NO: 22491

SEQ ID NO: 103692 - DNA, 201 bp, Bos taurus; identical to SEQ ID NO: 22492

SEQ ID NO: 103693 - DNA, 201 bp, Bos taurus; identical to SEQ ID NO: 22493

SEQ ID NO: 103694 - DNA, 201 bp, Bos taurus; identical to SEQ ID NO: 22494

SEQ ID NO: 103695 - DNA, 201 bp, Bos taurus; identical to SEQ ID NO: 22495

SEQ ID NO: 103696 - DNA, 201 bp, Bos taurus; identical to SEQ ID NO: 22496

SEQ ID NO: 103697 - DNA, 201 bp, Bos taurus; identical to SEQ ID NO: 22497

SEQ ID NO: 103698 - DNA, 201 bp, Bos taurus; identical to SEQ ID NO: 22498

SEQ ID NO: 103699 - DNA, 201 bp, Bos taurus; identical to SEQ ID NO: 22499

SEQ ID NO: 103700 - DNA, 201 bp, Bos taurus; identical to SEQ ID NO: 22500

SEQ ID NO: 103701 - DNA, 201 bp, Bos taurus; identical to SEQ ID NO: 22501

SEQ ID NO: 103702 - DNA, 201 bp, Bos taurus; identical to SEQ ID NO: 22503

SEQ ID NO: 103703 - DNA, 201 bp, Bos taurus; identical to SEQ ID NO: 22504

SEQ ID NO: 103704 - DNA, 201 bp, Bos taurus; identical to SEQ ID NO: 22505

SEQ ID NO: 103705 - DNA, 201 bp, Bos taurus; identical to SEQ ID NO: 22506

SEQ ID NO: 103706 - DNA, 201 bp, Bos taurus; identical to SEQ ID NO: 22507

SEQ ID NO: 103707 - DNA, 201 bp, Bos taurus; identical to SEQ ID NO: 22509

SEQ ID NO: 103708 - DNA, 201 bp, Bos taurus; identical to SEQ ID NO: 22510

SEQ ID NO: 103709 - DNA, 201 bp, Bos taurus; identical to SEQ ID NO: 22511

SEQ ID NO: 103710 - DNA, 201 bp, Bos taurus; identical to SEQ ID NO: 22512

SEQ ID NO: 103711 - DNA, 201 bp, Bos taurus; identical to SEQ ID NO: 22513

SEQ ID NO: 103712 - DNA, 201 bp, Bos taurus; identical to SEQ ID NO: 22514

SEQ ID NO: 103713 - DNA, 201 bp, Bos taurus; identical to SEQ ID NO: 22515

SEQ ID NO: 103714 - DNA, 201 bp, Bos taurus; identical to SEQ ID NO: 22516

SEQ ID NO: 103715 - DNA, 201 bp, Bos taurus; identical to SEQ ID NO: 22517

SEQ ID NO: 103716 - DNA, 201 bp, Bos taurus; identical to SEQ ID NO: 22518

SEQ ID NO: 103717 - DNA, 201 bp, Bos taurus; identical to SEQ ID NO: 22519

SEQ ID NO: 103718 - DNA, 201 bp, Bos taurus; identical to SEQ ID NO: 22520

SEQ ID NO: 103719 - DNA, 201 bp, Bos taurus; identical to SEQ ID NO: 22521

SEQ ID NO: 103720 - DNA, 201 bp, Bos taurus; identical to SEQ ID NO: 22522

SEQ ID NO: 103721 - DNA, 201 bp, Bos taurus; identical to SEQ ID NO: 22523

SEQ ID NO: 103722 - DNA, 201 bp, Bos taurus; identical to SEQ ID NO: 22524

SEQ ID NO: 103723 - DNA, 201 bp, Bos taurus; identical to SEQ ID NO: 22525

SEQ ID NO: 103724 - DNA, 201 bp, Bos taurus; identical to SEQ ID NO: 22526

SEQ ID NO: 103725 - DNA, 201 bp, Bos taurus; identical to SEQ ID NO: 22527

SEQ ID NO: 103726 - DNA, 201 bp, Bos taurus; identical to SEQ ID NO: 22528

SEQ ID NO: 103727 - DNA, 201 bp, Bos taurus; identical to SEQ ID NO: 22529

SEQ ID NO: 103728 - DNA, 201 bp, Bos taurus; identical to SEQ ID NO: 22530

SEQ ID NO: 103729 - DNA, 201 bp, Bos taurus; identical to SEQ ID NO: 22531

SEQ ID NO: 103730 - DNA, 201 bp, Bos taurus; identical to SEQ ID NO: 22532

SEQ ID NO: 103731 - DNA, 201 bp, Bos taurus; identical to SEQ ID NO: 22533

SEQ ID NO: 103732 - DNA, 201 bp, Bos taurus; identical to SEQ ID NO: 22534

SEQ ID NO: 103733 - DNA, 201 bp, Bos taurus; identical to SEQ ID NO: 22535

SEQ ID NO: 103734 - DNA, 201 bp, Bos taurus; identical to SEQ ID NO: 22536

SEQ ID NO: 103735 - DNA, 201 bp, Bos taurus; identical to SEQ ID NO: 22537

SEQ ID NO: 103736 - DNA, 201 bp, Bos taurus; identical to SEQ ID NO: 22538

SEQ ID NO: 103737 - DNA, 201 bp, Bos taurus; identical to SEQ ID NO: 22539

SEQ ID NO: 103738 - DNA, 201 bp, Bos taurus; identical to SEQ ID NO: 22540

SEQ ID NO: 103739 - DNA, 201 bp, Bos taurus; identical to SEQ ID NO: 22541

SEQ ID NO: 103740 - DNA, 201 bp, Bos taurus; identical to SEQ ID NO: 22542

SEQ ID NO: 103741 - DNA, 201 bp, Bos taurus; identical to SEQ ID NO: 22543

SEQ ID NO: 103742 - DNA, 201 bp, Bos taurus; identical to SEQ ID NO: 22544

SEQ ID NO: 103743 - DNA, 201 bp, Bos taurus; identical to SEQ ID NO: 22545

SEQ ID NO: 103744 - DNA, 201 bp, Bos taurus; identical to SEQ ID NO: 22546

SEQ ID NO: 103745 - DNA, 201 bp, Bos taurus; identical to SEQ ID NO: 22547

SEQ ID NO: 103746 - DNA, 201 bp, Bos taurus; identical to SEQ ID NO: 22548

SEQ ID NO: 103747 - DNA, 201 bp, Bos taurus; identical to SEQ ID NO: 22549

SEQ ID NO: 103748 - DNA, 201 bp, Bos taurus; identical to SEQ ID NO: 22550

SEQ ID NO: 103749 - DNA, 201 bp, Bos taurus; identical to SEQ ID NO: 22551

SEQ ID NO: 103750 - DNA, 201 bp, Bos taurus; identical to SEQ ID NO: 22552

SEQ ID NO: 103751 - DNA, 201 bp, Bos taurus; identical to SEQ ID NO: 22553

SEQ ID NO: 103752 - DNA, 201 bp, Bos taurus; identical to SEQ ID NO: 22554

SEQ ID NO: 103753 - DNA, 201 bp, Bos taurus; identical to SEQ ID NO: 22555

SEQ ID NO: 103754 - DNA, 201 bp, Bos taurus; identical to SEQ ID NO: 22556

SEQ ID NO: 103755 - DNA, 201 bp, Bos taurus; identical to SEQ ID NO: 63106

SEQ ID NO: 103756 - DNA, 201 bp, Bos taurus; identical to SEQ ID NO: 22558

SEQ ID NO: 103757 - DNA, 201 bp, Bos taurus; identical to SEQ ID NO: 22559

SEQ ID NO: 103758 - DNA, 201 bp, Bos taurus; identical to SEQ ID NO: 22560

SEQ ID NO: 103759 - DNA, 201 bp, Bos taurus; identical to SEQ ID NO: 22561

SEQ ID NO: 103760 - DNA, 201 bp, Bos taurus; identical to SEQ ID NO: 22562

SEQ ID NO: 103761 - DNA, 201 bp, Bos taurus; identical to SEQ ID NO: 22563

SEQ ID NO: 103762 - DNA, 201 bp, Bos taurus; identical to SEQ ID NO: 22564

SEQ ID NO: 103763 - DNA, 201 bp, Bos taurus
actattgattttgagagtgcttttaagtcctggatttatgctctttatcagatagatgactgatctgtgtcttgtcttttcaatcccttagcactgtctgatgaagatgcaaagttttaattttgataaaattcattttatcaatattttcttttatggattatgcttttggtttcatacctaagaaatcattgcctgaca

SEQ ID NO: 103764 - DNA, 201 bp, Bos taurus
agccttgacttatataaacagataaattttaaatggtattagaagaaccctaattcaagttcatcacaggagtggtgattcacagccccttactcagtttgcagacccacagttacttgattaaggaagaaacttgtccctttgtgatgcaggcacaaatgtatggtataactcttctcccaagcttgcatgatctgcggt

SEQ ID NO: 103765 - DNA, 201 bp, Bos taurus
tttgccacctagctctttcttccttgaagcacctacatgaaacactataatgagattcttcctagggaaaactttctccttttagtggactttgcctattgcctgcagtttctgagtggttaatgatattttcttcggatgtcttgagaatccatctctcagagttttctctgaaaatcttggcaaaagccaaccatttcc

SEQ ID NO: 103766 - DNA, 201 bp, Bos taurus; identical to SEQ ID NO: 22566

SEQ ID NO: 103767 - DNA, 201 bp, Bos taurus; identical to SEQ ID NO: 22567

SEQ ID NO: 103768 - DNA, 201 bp, Bos taurus; identical to SEQ ID NO: 22568

SEQ ID NO: 103769 - DNA, 201 bp, Bos taurus; identical to SEQ ID NO: 22571

SEQ ID NO: 103770 - DNA, 201 bp, Bos taurus; identical to SEQ ID NO: 22574

SEQ ID NO: 103771 - DNA, 201 bp, Bos taurus
aagagggggaaggatcttggtggggaaggggacaggcttgagtgggatggtttcgtcagagggaaattcttcatccagcagctctgggtaatgggcctcaagtaacggaagctggtttagtctcttacctgttttgttgagggagacagaagacagatttaggagagagagtggaggatgctgcccccttattctggcccc

SEQ ID NO: 103772 - DNA, 201 bp, Bos taurus; identical to SEQ ID NO: 22580

SEQ ID NO: 103773 - DNA, 201 bp, Bos taurus; identical to SEQ ID NO: 22581

SEQ ID NO: 103774 - DNA, 201 bp, Bos taurus; identical to SEQ ID NO: 22582

SEQ ID NO: 103775 - DNA, 201 bp, Bos taurus; identical to SEQ ID NO: 22583

SEQ ID NO: 103776 - DNA, 201 bp, Bos taurus
ccacgtccaaggtcatgcgtgtggttgctgttgggcctctgtctcttaccctgttagtctcgtcatggggctgtttcttaacttgccacctggcttcctccagcacaggccatccaaggaagagagagtgatccttcaaaatgggagcaacagtttttaagtaacctaaacttggaattgatagcacaccactctggtcat

SEQ ID NO: 103777 - DNA, 201 bp, Bos taurus; identical to SEQ ID NO: 22584

SEQ ID NO: 103778 - DNA, 201 bp, Bos taurus; identical to SEQ ID NO: 22585

SEQ ID NO: 103779 - DNA, 201 bp, Bos taurus; identical to SEQ ID NO: 22586

SEQ ID NO: 103780 - DNA, 201 bp, Bos taurus
agttttaatgcttctatttctcactatcagttcccttcggggactgaagtctttgttcttgttcggtgcagtgtaatttcactgggccttctcttgaccctgatgcttcattggcatagtaggtctgcctccattggtttcttgttagagctagatgatgaaaatgggaatagtttgcatcatcttgattctaaatgcaga

SEQ ID NO: 103781 - DNA, 201 bp, Bos taurus; identical to SEQ ID NO: 22587

SEQ ID NO: 103782 - DNA, 201 bp, Bos taurus; identical to SEQ ID NO: 22588

SEQ ID NO: 103783 - DNA, 201 bp, Bos taurus; identical to SEQ ID NO: 22589

SEQ ID NO: 103784 - DNA, 201 bp, Bos taurus; identical to SEQ ID NO: 22590

SEQ ID NO: 103785 - DNA, 201 bp, Bos taurus; identical to SEQ ID NO: 22591

SEQ ID NO: 103786 - DNA, 201 bp, Bos taurus; identical to SEQ ID NO: 22592

SEQ ID NO: 103787 - DNA, 201 bp, Bos taurus; identical to SEQ ID NO: 22593

SEQ ID NO: 103788 - DNA, 201 bp, Bos taurus
tagccttattttaaggtcagttagagtcaaatgccctgaagggaacatgttttaattcatttttgctccttttttgctatgccctaagcagaaagctacatacctgaatagacctcaatcactctgggttttcataatggcattttgccccaccacattcttcttcatccttgtctgtagtgatgtttactccccaccaca

SEQ ID NO: 103789 - DNA, 201 bp, Bos taurus; identical to SEQ ID NO: 22595

SEQ ID NO: 103790 - DNA, 201 bp, Bos taurus; identical to SEQ ID NO: 22596

SEQ ID NO: 103791 - DNA, 201 bp, Bos taurus; identical to SEQ ID NO: 22597

SEQ ID NO: 103792 - DNA, 201 bp, Bos taurus; identical to SEQ ID NO: 22598

SEQ ID NO: 103793 - DNA, 201 bp, Bos taurus; identical to SEQ ID NO: 22599

SEQ ID NO: 103794 - DNA, 201 bp, Bos taurus; identical to SEQ ID NO: 22600

SEQ ID NO: 103795 - DNA, 201 bp, Bos taurus; identical to SEQ ID NO: 22601

SEQ ID NO: 103796 - DNA, 201 bp, Bos taurus; identical to SEQ ID NO: 22602

SEQ ID NO: 103797 - DNA, 201 bp, Bos taurus; identical to SEQ ID NO: 22603

SEQ ID NO: 103798 - DNA, 201 bp, Bos taurus; identical to SEQ ID NO: 22604

SEQ ID NO: 103799 - DNA, 201 bp, Bos taurus; identical to SEQ ID NO: 22605

SEQ ID NO: 103800 - DNA, 201 bp, Bos taurus; identical to SEQ ID NO: 22606

SEQ ID NO: 103801 - DNA, 201 bp, Bos taurus; identical to SEQ ID NO: 22607

SEQ ID NO: 103802 - DNA, 201 bp, Bos taurus; identical to SEQ ID NO: 63170

SEQ ID NO: 103803 - DNA, 201 bp, Bos taurus
taaagtgcagatttgatcatgtcacggcctaccataccacccttaagggtttccgttgcctctgagtacagctcaaattccctaacaaggttggcaacacccttcgtggctggcctttgcccagcgttgcagctttatttaccagcccactccatggctctctacatgcgtttcctcagtctggacctttaccccaactgc

SEQ ID NO: 103804 - DNA, 201 bp, Bos taurus; identical to SEQ ID NO: 22608

SEQ ID NO: 103805 - DNA, 201 bp, Bos taurus; identical to SEQ ID NO: 22610

SEQ ID NO: 103806 - DNA, 201 bp, Bos taurus
tttaaggcttcaggattagacacagatgcaaatttacagccaatcaaggcttttatcaataaaacatgcagcttcggcctcgtattggtcaaatgaattagcatttaggaaactaagctaaagaaaaaatttaagtaccttctggacaacaagagtttgtaactttctattacttcctttctactatatggcctaagaaat

SEQ ID NO: 103807 - DNA, 201 bp, Bos taurus; identical to SEQ ID NO: 22612

SEQ ID NO: 103808 - DNA, 201 bp, Bos taurus; identical to SEQ ID NO: 22613

SEQ ID NO: 103809 - DNA, 201 bp, Bos taurus; identical to SEQ ID NO: 22614

SEQ ID NO: 103810 - DNA, 201 bp, Bos taurus; identical to SEQ ID NO: 22615

SEQ ID NO: 103811 - DNA, 201 bp, Bos taurus; identical to SEQ ID NO: 22616

SEQ ID NO: 103812 - DNA, 201 bp, Bos taurus; identical to SEQ ID NO: 22617

SEQ ID NO: 103813 - DNA, 201 bp, Bos taurus; identical to SEQ ID NO: 22618

SEQ ID NO: 103814 - DNA, 201 bp, Bos taurus; identical to SEQ ID NO: 22619

SEQ ID NO: 103815 - DNA, 201 bp, Bos taurus; identical to SEQ ID NO: 22620

SEQ ID NO: 103816 - DNA, 201 bp, Bos taurus; identical to SEQ ID NO: 22621

SEQ ID NO: 103817 - DNA, 201 bp, Bos taurus; identical to SEQ ID NO: 22624

SEQ ID NO: 103818 - DNA, 201 bp, Bos taurus; identical to SEQ ID NO: 22626

SEQ ID NO: 103819 - DNA, 201 bp, Bos taurus; identical to SEQ ID NO: 22627

SEQ ID NO: 103820 - DNA, 201 bp, Bos taurus; identical to SEQ ID NO: 22628

SEQ ID NO: 103821 - DNA, 201 bp, Bos taurus; identical to SEQ ID NO: 22635

SEQ ID NO: 103822 - DNA, 201 bp, Bos taurus
ctactctggttctgtcactcagatcttctcaagatgttacagacgatgtcacccaagaaaaagaaaatcttctgttgcacctttcctccatgggttctttctttaccattttttctagtgaaaagaacccaggtgatctttgtactgaaaattcacgtatgcgggagaatatcaaacctcttgcagctgcatttggggctg

SEQ ID NO: 103823 - DNA, 201 bp, Bos taurus; identical to SEQ ID NO: 22639

SEQ ID NO: 103824 - DNA, 201 bp, Bos taurus
agtttgagcaagctttgagagatggtgaaggacagtgaagcctggcgtgttgcagtccatggggtcacagagagttggacgtggccgagtgactgaactgatgctagaggaaatcttgccctaaaaattgaggggctctttttgcatacgtgtgtgtgtgtgctaagtcacttcagtcatgtccaactctttgcaacccta

SEQ ID NO: 103825 - DNA, 201 bp, Bos taurus
tttcatacctgtgaatatgatgctggatgataataaaagtggccagttttgagtaagaatgcaaggcaagaaaaggtcttggttcttgcttgcccattgaaaacccaaagccataattagagctgtcaagtatggcacagctgatgtctttgaccctgttggaaactggtggtagtggtagatatgatgtgaaatctatga

SEQ ID NO: 103826 - DNA, 201 bp, Bos taurus
atttcacttttatgccaaccaacctgagaaatgatgccaagctaatcaggcatcctgtggccccctccttcacactgcctttaaaatcctatttctgaatgtccttggggagctgggactcgttcaccttctcccttggcacacattatccctccaataaaaactattgcttgcctaaaaatcttttgggaacaatattca

SEQ ID NO: 103827 - DNA, 201 bp, Bos taurus
cctgttttttggttggtttgttttgttgtttttttaaacgtctcagaaatgttttacttgtttcttcattgaataaacccacctcccccgccccccgccccgccatgaaatcacaaatatcctttcaactctaaatacttgttacctctcatttctgtcagaaatacctgttatctcagttacagcattcagtgcttcacc

SEQ ID NO: 103828 - DNA, 201 bp, Bos taurus
gagtaggacacaactgagcaactttgactttcactctccagagcgtagtagaaacctcttctgacacaccgcttgagcaccgcggtctggcctctgtctccgaagtcatctctaggagtcctggaaacagcatggatgctgagctgttttttcacattggagaggggggttcagtggctgaagaaatggttcacgctgcca

SEQ ID NO: 103829 - DNA, 201 bp, Bos taurus; identical to SEQ ID NO: 22641

SEQ ID NO: 103830 - DNA, 201 bp, Bos taurus
agaaccccaaaccttgcaaagtagctttagggcccctgtgttgttcagagtggggttagtgaagcagggaaccttgcttgaggcctgacttgtacgtgacggaattgagatttcttttttttttttggcttgtacagactttatttcaggataagcagatggccatgactgataaaatttttaacagaaaaattctactta

SEQ ID NO: 103831 - DNA, 201 bp, Bos taurus
agaataaagagggagtctctttaaagacaagctgggctctggcctatcctggttaacttttgtttttaatgcttttagggagagagttttggtgtcgggtgtatttctctatgtaggcctgtgacttgtttttgtttgatttgtttaagtgaaggagccttgaaagtaagcttattatatggaacagtaggagaacactgt

SEQ ID NO: 103832 - DNA, 201 bp, Bos taurus
agtcgttgcgtcacatgggctcagtagttcaggctcccaggctctagagtacaggtttaggagtggtcatgcatgtgcttaattgcttctcaggatgtggcatcttcccggaccaggggattgaacctgtgtctcctaccttgacaggcaggttgtttacccctgagccaacagggaagccccatttgttagtacatgatg

SEQ ID NO: 103833 - DNA, 201 bp, Bos taurus
ctttactaaaaatatgggttgtaaactgtgagccacaatccagttagtgaatcttttatttagatgtgtttggttttggcaattgcatatttatttttaggtgtatttattaaatgctaatccaaagtgtccttctctcttttagagaaagcatgggattatggcagtcacagagtcccagtgatacaagttccattcagt

SEQ ID NO: 103834 - DNA, 201 bp, Bos taurus
atggagaacagtgtgaggagcaggaaagcagttcgggggttgcctcaccacgaggactcgtgtagtttttttcagtctggcctcacctgtggtgagcaggatggtctcctagcacctcagctgtaagtgttctgctttacagccaatagccttctgggcactcatgatttaagagtgttgctgggtatccttcggggccct

SEQ ID NO: 103835 - DNA, 201 bp, Bos taurus
aatgaaaatattcaatcttcatacaggctgaagaccaacttccagtaatcaggataggccagaaaaatctaaattcttgattttggtgaaaagtgattccagatcattagtagccatgggcacttggatgcagcagatacaaatactttctagaagaagttaactttattctagtcctcaaattatttccaccaatgactt

SEQ ID NO: 103836 - DNA, 201 bp, Bos taurus; identical to SEQ ID NO: 22644

SEQ ID NO: 103837 - DNA, 201 bp, Bos taurus; identical to SEQ ID NO: 22645

SEQ ID NO: 103838 - DNA, 201 bp, Bos taurus; identical to SEQ ID NO: 22647

SEQ ID NO: 103839 - DNA, 201 bp, Bos taurus
agaaaaaacaagaaccagactacatggcctcacccctgagattctgactttgaaggtccaggaggcagcccaggaatccacctttcaccactcacacccaagtcccttgtgtacagggtcctcaggccatatgttgagttgctcaaaggatagttggagggagcagcaggcagagcagagggaaggagacagctccagact

SEQ ID NO: 103840 - DNA, 201 bp, Bos taurus; identical to SEQ ID NO: 22648

SEQ ID NO: 103841 - DNA, 201 bp, Bos taurus; identical to SEQ ID NO: 22649

SEQ ID NO: 103842 - DNA, 201 bp, Bos taurus; identical to SEQ ID NO: 22650

SEQ ID NO: 103843 - DNA, 201 bp, Bos taurus; identical to SEQ ID NO: 22651

SEQ ID NO: 103844 - DNA, 201 bp, Bos taurus
ccagataccaaataactacagctttgcaggccatatagtctgtgtcatctactcaagtctgccttgctgtacaaaagcagccagacaatatgtaaacaaacggacatggatttgtaacaatacaactttataaaagggttttggaaggacaattcattatattgaaatattagatctgtttggaattgctcctgaattctt

SEQ ID NO: 103845 - DNA, 201 bp, Bos taurus
actttctcccacccactgtagatattcctcaaataattctccattggtgttctctttgcattatcactcttggagaaataatcaacacaaactattaccctgattaggagcattttctaattgtactcttaactcttcctctcttacttaaatttctatatttgggtgcactgatactgcctcaattgcattaatttaaag

SEQ ID NO: 103846 - DNA, 201 bp, Bos taurus
gaatgccctagcaatttcctaggcctctttttttttaaggtttaaagagatctataaagaactgctacattttagaccccttcaaatggtacaaaatgaacagcttttaatcaaatcatttcaggtaattaaatattcatttactcccctacagcagttcagtctcctttttttaccctcttctttaccccaccgtatcca

SEQ ID NO: 103847 - DNA, 201 bp, Bos taurus; identical to SEQ ID NO: 22652

SEQ ID NO: 103848 - DNA, 201 bp, Bos taurus
aaaataaggtttctatttcaccatcatcactacctctgacatttctagagggcactactgtgtgacaaggatggtgctgagcaccctacaccaggatcccgttaaatcctcaaaataaggtgggtatgacgacactctcccttctcagagaggcactcgaagagttgaggtcatggcagtacagaggccacgccaggactg

SEQ ID NO: 103849 - DNA, 201 bp, Bos taurus
agggaaaaaggaaggagggaggggaggaaggagttctgatagtcttaaagtttgtctacttcaggtaaaaattccttatggccccctcagatgttggcctattgtttatccccagggaggtaggaagaacaaggctgtaggaacccaggctgactggcttgatctggtggcctctagaagtttaaagtaccattagtatgg

SEQ ID NO: 103850 - DNA, 201 bp, Bos taurus; identical to SEQ ID NO: 22659

SEQ ID NO: 103851 - DNA, 201 bp, Bos taurus; identical to SEQ ID NO: 22660

SEQ ID NO: 103852 - DNA, 201 bp, Bos taurus; identical to SEQ ID NO: 22661

SEQ ID NO: 103853 - DNA, 201 bp, Bos taurus; identical to SEQ ID NO: 22662

SEQ ID NO: 103854 - DNA, 201 bp, Bos taurus; identical to SEQ ID NO: 22663

SEQ ID NO: 103855 - DNA, 201 bp, Bos taurus; identical to SEQ ID NO: 22664

SEQ ID NO: 103856 - DNA, 201 bp, Bos taurus; identical to SEQ ID NO: 22665

SEQ ID NO: 103857 - DNA, 201 bp, Bos taurus; identical to SEQ ID NO: 22668

SEQ ID NO: 103858 - DNA, 201 bp, Bos taurus; identical to SEQ ID NO: 22669

SEQ ID NO: 103859 - DNA, 201 bp, Bos taurus; identical to SEQ ID NO: 22671

SEQ ID NO: 103860 - DNA, 201 bp, Bos taurus; identical to SEQ ID NO: 22672

SEQ ID NO: 103861 - DNA, 201 bp, Bos taurus; identical to SEQ ID NO: 22673

SEQ ID NO: 103862 - DNA, 201 bp, Bos taurus
ttccatttggtcagacgggggcgccatgttaaagtattcagtactgaccccagcaccatcatgctgagaaaggaaagcagaattttccattaagtttgaacccatgctatacagcagtagtccttattgacagtaattgactgtcatgctatacagcagacagtccttattgactcctggtcttcctaaaagagtaacaca

SEQ ID NO: 103863 - DNA, 201 bp, Bos taurus; identical to SEQ ID NO: 22675

SEQ ID NO: 103864 - DNA, 201 bp, Bos taurus; identical to SEQ ID NO: 22676

SEQ ID NO: 103865 - DNA, 201 bp, Bos taurus; identical to SEQ ID NO: 63226

SEQ ID NO: 103866 - DNA, 201 bp, Bos taurus; identical to SEQ ID NO: 22677

SEQ ID NO: 103867 - DNA, 201 bp, Bos taurus
gcttttttccaaagtcttagcttctttcaggatatctattagacctttggtagtaggaaagtcccccaaataccatgtattccctaggatcctcgcctgttttttgtttctttgaccattctagtttatcctgattagatggtactaagctttccagctactgatttggatttcaaggggcattggtaatggagtgataca

SEQ ID NO: 103868 - DNA, 201 bp, Bos taurus
gagctgagaagtgaaaccctccccatggccaagggctgtggacctccctttgcccctgagaatccctttctccattgctgccatcctaccagcgacaacctgggtgtgggcaatgaatggcccctttcctcgattctgtatccacagctgagacggctgcagaagttacgatgctcccggtggatttggaatcatgggtgg

SEQ ID NO: 103869 - DNA, 201 bp, Bos taurus
tctttctccacactgcggagtcaagaaatagagacctgcagccataaaaatatgtaatgaaaagacagagaactgataaacagttataccctgctggtacaattcagtaaggcttacatttaataacacagtggtgggaggacttctgctttgtgtgaaagtgcagttgagtgaggccactaaaccgaagacaaaataaat

SEQ ID NO: 103870 - DNA, 201 bp, Bos taurus; identical to SEQ ID NO: 22678

SEQ ID NO: 103871 - DNA, 201 bp, Bos taurus; identical to SEQ ID NO: 22679

SEQ ID NO: 103872 - DNA, 201 bp, Bos taurus; identical to SEQ ID NO: 22680

SEQ ID NO: 103873 - DNA, 201 bp, Bos taurus; identical to SEQ ID NO: 22683

SEQ ID NO: 103874 - DNA, 201 bp, Bos taurus; identical to SEQ ID NO: 22685

SEQ ID NO: 103875 - DNA, 201 bp, Bos taurus; identical to SEQ ID NO: 22686

SEQ ID NO: 103876 - DNA, 201 bp, Bos taurus; identical to SEQ ID NO: 22688

SEQ ID NO: 103877 - DNA, 201 bp, Bos taurus; identical to SEQ ID NO: 22689

SEQ ID NO: 103878 - DNA, 201 bp, Bos taurus; identical to SEQ ID NO: 22691

SEQ ID NO: 103879 - DNA, 201 bp, Bos taurus; identical to SEQ ID NO: 22695

SEQ ID NO: 103880 - DNA, 201 bp, Bos taurus; identical to SEQ ID NO: 22696

SEQ ID NO: 103881 - DNA, 201 bp, Bos taurus; identical to SEQ ID NO: 22697

SEQ ID NO: 103882 - DNA, 201 bp, Bos taurus; identical to SEQ ID NO: 22698

SEQ ID NO: 103883 - DNA, 201 bp, Bos taurus; identical to SEQ ID NO: 22700

SEQ ID NO: 103884 - DNA, 201 bp, Bos taurus; identical to SEQ ID NO: 22703

SEQ ID NO: 103885 - DNA, 201 bp, Bos taurus; identical to SEQ ID NO: 22704

SEQ ID NO: 103886 - DNA, 201 bp, Bos taurus; identical to SEQ ID NO: 22705

SEQ ID NO: 103887 - DNA, 201 bp, Bos taurus; identical to SEQ ID NO: 22706

SEQ ID NO: 103888 - DNA, 201 bp, Bos taurus; identical to SEQ ID NO: 22707

SEQ ID NO: 103889 - DNA, 201 bp, Bos taurus; identical to SEQ ID NO: 22708

SEQ ID NO: 103890 - DNA, 201 bp, Bos taurus; identical to SEQ ID NO: 22709

SEQ ID NO: 103891 - DNA, 201 bp, Bos taurus; identical to SEQ ID NO: 22711

SEQ ID NO: 103892 - DNA, 201 bp, Bos taurus; identical to SEQ ID NO: 22712

SEQ ID NO: 103893 - DNA, 201 bp, Bos taurus; identical to SEQ ID NO: 22713

SEQ ID NO: 103894 - DNA, 201 bp, Bos taurus; identical to SEQ ID NO: 22714

SEQ ID NO: 103895 - DNA, 201 bp, Bos taurus; identical to SEQ ID NO: 22715

SEQ ID NO: 103896 - DNA, 201 bp, Bos taurus; identical to SEQ ID NO: 22716

SEQ ID NO: 103897 - DNA, 201 bp, Bos taurus; identical to SEQ ID NO: 22717

SEQ ID NO: 103898 - DNA, 201 bp, Bos taurus; identical to SEQ ID NO: 22718

SEQ ID NO: 103899 - DNA, 201 bp, Bos taurus; identical to SEQ ID NO: 22719

SEQ ID NO: 103900 - DNA, 201 bp, Bos taurus; identical to SEQ ID NO: 22720

SEQ ID NO: 103901 - DNA, 201 bp, Bos taurus; identical to SEQ ID NO: 22721

SEQ ID NO: 103902 - DNA, 201 bp, Bos taurus; identical to SEQ ID NO: 22722

SEQ ID NO: 103903 - DNA, 201 bp, Bos taurus; identical to SEQ ID NO: 22723

SEQ ID NO: 103904 - DNA, 201 bp, Bos taurus; identical to SEQ ID NO: 22724

SEQ ID NO: 103905 - DNA, 201 bp, Bos taurus; identical to SEQ ID NO: 22725

SEQ ID NO: 103906 - DNA, 201 bp, Bos taurus; identical to SEQ ID NO: 22726

SEQ ID NO: 103907 - DNA, 201 bp, Bos taurus; identical to SEQ ID NO: 22727

SEQ ID NO: 103908 - DNA, 201 bp, Bos taurus; identical to SEQ ID NO: 22728

SEQ ID NO: 103909 - DNA, 201 bp, Bos taurus; identical to SEQ ID NO: 22729

SEQ ID NO: 103910 - DNA, 201 bp, Bos taurus; identical to SEQ ID NO: 22730

SEQ ID NO: 103911 - DNA, 201 bp, Bos taurus; identical to SEQ ID NO: 22731

SEQ ID NO: 103912 - DNA, 201 bp, Bos taurus; identical to SEQ ID NO: 22732

SEQ ID NO: 103913 - DNA, 201 bp, Bos taurus; identical to SEQ ID NO: 22733

SEQ ID NO: 103914 - DNA, 201 bp, Bos taurus; identical to SEQ ID NO: 22734

SEQ ID NO: 103915 - DNA, 201 bp, Bos taurus; identical to SEQ ID NO: 22735

SEQ ID NO: 103916 - DNA, 201 bp, Bos taurus; identical to SEQ ID NO: 22736

SEQ ID NO: 103917 - DNA, 201 bp, Bos taurus; identical to SEQ ID NO: 22737

SEQ ID NO: 103918 - DNA, 201 bp, Bos taurus; identical to SEQ ID NO: 22738

SEQ ID NO: 103919 - DNA, 201 bp, Bos taurus; identical to SEQ ID NO: 22739

SEQ ID NO: 103920 - DNA, 201 bp, Bos taurus; identical to SEQ ID NO: 22740

SEQ ID NO: 103921 - DNA, 201 bp, Bos taurus; identical to SEQ ID NO: 22741

SEQ ID NO: 103922 - DNA, 201 bp, Bos taurus; identical to SEQ ID NO: 22742

SEQ ID NO: 103923 - DNA, 201 bp, Bos taurus; identical to SEQ ID NO: 22743

SEQ ID NO: 103924 - DNA, 201 bp, Bos taurus; identical to SEQ ID NO: 22744

SEQ ID NO: 103925 - DNA, 201 bp, Bos taurus; identical to SEQ ID NO: 22745

SEQ ID NO: 103926 - DNA, 201 bp, Bos taurus; identical to SEQ ID NO: 22746

SEQ ID NO: 103927 - DNA, 201 bp, Bos taurus; identical to SEQ ID NO: 22747

SEQ ID NO: 103928 - DNA, 201 bp, Bos taurus; identical to SEQ ID NO: 22748

SEQ ID NO: 103929 - DNA, 201 bp, Bos taurus; identical to SEQ ID NO: 22749

SEQ ID NO: 103930 - DNA, 201 bp, Bos taurus; identical to SEQ ID NO: 22750

SEQ ID NO: 103931 - DNA, 201 bp, Bos taurus; identical to SEQ ID NO: 22751

SEQ ID NO: 103932 - DNA, 201 bp, Bos taurus; identical to SEQ ID NO: 22753

SEQ ID NO: 103933 - DNA, 201 bp, Bos taurus; identical to SEQ ID NO: 22754

SEQ ID NO: 103934 - DNA, 201 bp, Bos taurus; identical to SEQ ID NO: 22756

SEQ ID NO: 103935 - DNA, 201 bp, Bos taurus; identical to SEQ ID NO: 22757

SEQ ID NO: 103936 - DNA, 201 bp, Bos taurus; identical to SEQ ID NO: 22762

SEQ ID NO: 103937 - DNA, 201 bp, Bos taurus; identical to SEQ ID NO: 22767

SEQ ID NO: 103938 - DNA, 201 bp, Bos taurus; identical to SEQ ID NO: 22769

SEQ ID NO: 103939 - DNA, 201 bp, Bos taurus; identical to SEQ ID NO: 22773

SEQ ID NO: 103940 - DNA, 201 bp, Bos taurus; identical to SEQ ID NO: 22774

SEQ ID NO: 103941 - DNA, 201 bp, Bos taurus
agtgacctgtctgcctgtcaagtagccagtaggtgctgtgtacagtgatgtccgtgggcttggcaaggttgtttctcagattccaggaaggccctgactttccaggaaccctctgaagaattcccgtccatttgtcttttgattcacacacacacatatatattggccatgccccactttatgggggatcttaattctcca

SEQ ID NO: 103942 - DNA, 201 bp, Bos taurus
taggccaaatgtatggtgcttttaaatgctaatcagtattgtaagaaatgatgttcatcctaaagaggtaagtccctatgctcccccagccccggaggtccggctgcaaagtcctttctctgggccccttcattcacgtctgagcaggatggccaactgtctgggcttcgcagagtctgtcaccatatatgtgtcacacgt

SEQ ID NO: 103943 - DNA, 201 bp, Bos taurus
gctatcaaaaacgaaaggccagtaccacttgccattggtgaatgtcagcctaaaccataggatcaagtttaaattgaaaatgaccgcactgagacttccatggtggcccaggggctagcacttcacaccgccagtgcagggaacctgaggtgcatgtatctttttgaattagtgtctttgtttgtctgtttgttttgggta

SEQ ID NO: 103944 - DNA, 201 bp, Bos taurus
gagtggaggtttggttaccacagagaggattgctaagtgacaaagatattgggagaaggaaatgggagagacaggaaagggtgtgcatgtgggaatgaagttccttggtcttgagtaaagacacctagctcctgccctggaggatggttttcctgcaaacccttagtccacagtgcagggtatacactgaaacactatata

SEQ ID NO: 103945 - DNA, 201 bp, Bos taurus; identical to SEQ ID NO: 22776

SEQ ID NO: 103946 - DNA, 201 bp, Bos taurus; identical to SEQ ID NO: 22777

SEQ ID NO: 103947 - DNA, 201 bp, Bos taurus
ttgcccaagctaaccactgtaccacctggccttagtggaaccctggcctctcagtaggactacctaggtatccagtgaccatgtgatgtggctccagagttgaaaaaggaagagtctgatgagtggatcactggccggggctggcaatggcgccaaaggaaaaaccgaggtcacctcctcgactggtcagctctaagggat

SEQ ID NO: 103948 - DNA, 201 bp, Bos taurus
cggaagggtcaggccatgtcactcgctaggggacttcaaatttcaagaaagacttgtgtgtctgagttcctagaacatcatgagacagagaaacagcccccttgggccagaccacagtggtgaggggaggtgggggaggagggcttggccttcttccctccatgtctgtctgggatagcctatgcctttgggggcagcgtg

SEQ ID NO: 103949 - DNA, 201 bp, Bos taurus; identical to SEQ ID NO: 22778

SEQ ID NO: 103950 - DNA, 201 bp, Bos taurus; identical to SEQ ID NO: 22779

SEQ ID NO: 103951 - DNA, 201 bp, Bos taurus; identical to SEQ ID NO: 22780

SEQ ID NO: 103952 - DNA, 201 bp, Bos taurus; identical to SEQ ID NO: 22781

SEQ ID NO: 103953 - DNA, 201 bp, Bos taurus; identical to SEQ ID NO: 22782

SEQ ID NO: 103954 - DNA, 201 bp, Bos taurus
ggcagattctttacccactgggccacctgggaagccacctaggagacttagtttgcgcatctttaaaatgggcgggtgctgccaacctcctacagttgttgtaacaatgaggtgcccttaaggcccagaagtgcaggagtggggttctcggcccgccctgagggccctcccagcacggcccgtctcggtaggacagaaccc

SEQ ID NO: 103955 - DNA, 201 bp, Bos taurus
ctcttgaacccctgtggatgcatgatctttgtctgcccatccatccctccccagcatgacccctctgttcccctggcaagaaaaggcctttgggaacttccctcctgctgacgtgggtgtctgggggcagtgaagaccagccgattggacatcagtcttcagcctccgcagacacgccctcttctcctggccacgcccctc

SEQ ID NO: 103956 - DNA, 201 bp, Bos taurus; identical to SEQ ID NO: 22783

SEQ ID NO: 103957 - DNA, 201 bp, Bos taurus
ggccccccacccatcaggagatgaagagtgagtccctcatcatgccagggtcacatctggcaccaaagggaagggactttcatgggagtcactcagaggcgaaccttggggacagcatggctggcctgggggctgagaattagccagtcccaccgtatccagagccataaatactccatgatctttgacccacagtaatcc

SEQ ID NO: 103958 - DNA, 201 bp, Bos taurus
gcctcagggcgaggctccccccgcccagccttacctggcagctggggcagaggcagtggggactggtccggcacccacccggcggagtcccctcctgtcctttcagaggcccagtcacagctgaacaaggaggtacacactctcctccttccgccccgaccccaggcgactcccgcccgcacccctcacgtcacaggggca

SEQ ID NO: 103959 - DNA, 201 bp, Bos taurus; identical to SEQ ID NO: 22784

SEQ ID NO: 103960 - DNA, 201 bp, Bos taurus; identical to SEQ ID NO: 22785

SEQ ID NO: 103961 - DNA, 201 bp, Bos taurus; identical to SEQ ID NO: 22786

SEQ ID NO: 103962 - DNA, 201 bp, Bos taurus; identical to SEQ ID NO: 22787

SEQ ID NO: 103963 - DNA, 201 bp, Bos taurus; identical to SEQ ID NO: 22788

SEQ ID NO: 103964 - DNA, 201 bp, Bos taurus; identical to SEQ ID NO: 22789

SEQ ID NO: 103965 - DNA, 201 bp, Bos taurus
agattatggagagcggctacacccgcatcccagtgtttgaagacgagcagtccaacatcgtcgatatcctctatgtcaaggacttggccttcgtggatcctgatgactgcaccccgctcaagaccatcacccgcttctacaaccacccagtgcacttcgtcttccacgacaccaagctggatgccatgctggaggagttca

SEQ ID NO: 103966 - DNA, 201 bp, Bos taurus; identical to SEQ ID NO: 22790

SEQ ID NO: 103967 - DNA, 201 bp, Bos taurus; identical to SEQ ID NO: 22791

SEQ ID NO: 103968 - DNA, 201 bp, Bos taurus; identical to SEQ ID NO: 22792

SEQ ID NO: 103969 - DNA, 201 bp, Bos taurus; identical to SEQ ID NO: 22793

SEQ ID NO: 103970 - DNA, 201 bp, Bos taurus; identical to SEQ ID NO: 22794

SEQ ID NO: 103971 - DNA, 201 bp, Bos taurus; identical to SEQ ID NO: 22795

SEQ ID NO: 103972 - DNA, 201 bp, Bos taurus; identical to SEQ ID NO: 22796

SEQ ID NO: 103973 - DNA, 201 bp, Bos taurus; identical to SEQ ID NO: 22797

SEQ ID NO: 103974 - DNA, 201 bp, Bos taurus; identical to SEQ ID NO: 22798

SEQ ID NO: 103975 - DNA, 201 bp, Bos taurus; identical to SEQ ID NO: 22799

SEQ ID NO: 103976 - DNA, 201 bp, Bos taurus; identical to SEQ ID NO: 22800

SEQ ID NO: 103977 - DNA, 201 bp, Bos taurus; identical to SEQ ID NO: 22801

SEQ ID NO: 103978 - DNA, 201 bp, Bos taurus; identical to SEQ ID NO: 22802

SEQ ID NO: 103979 - DNA, 201 bp, Bos taurus; identical to SEQ ID NO: 22803

SEQ ID NO: 103980 - DNA, 201 bp, Bos taurus; identical to SEQ ID NO: 22804

SEQ ID NO: 103981 - DNA, 201 bp, Bos taurus; identical to SEQ ID NO: 22805

SEQ ID NO: 103982 - DNA, 201 bp, Bos taurus; identical to SEQ ID NO: 22806

SEQ ID NO: 103983 - DNA, 201 bp, Bos taurus; identical to SEQ ID NO: 22807

SEQ ID NO: 103984 - DNA, 201 bp, Bos taurus; identical to SEQ ID NO: 22808

SEQ ID NO: 103985 - DNA, 201 bp, Bos taurus; identical to SEQ ID NO: 22809

SEQ ID NO: 103986 - DNA, 201 bp, Bos taurus; identical to SEQ ID NO: 22810

SEQ ID NO: 103987 - DNA, 201 bp, Bos taurus; identical to SEQ ID NO: 22811

SEQ ID NO: 103988 - DNA, 201 bp, Bos taurus; identical to SEQ ID NO: 22812

SEQ ID NO: 103989 - DNA, 201 bp, Bos taurus; identical to SEQ ID NO: 22813

SEQ ID NO: 103990 - DNA, 201 bp, Bos taurus; identical to SEQ ID NO: 22814

SEQ ID NO: 103991 - DNA, 201 bp, Bos taurus; identical to SEQ ID NO: 22815

SEQ ID NO: 103992 - DNA, 201 bp, Bos taurus; identical to SEQ ID NO: 22816

SEQ ID NO: 103993 - DNA, 201 bp, Bos taurus; identical to SEQ ID NO: 22817

SEQ ID NO: 103994 - DNA, 201 bp, Bos taurus; identical to SEQ ID NO: 22818

SEQ ID NO: 103995 - DNA, 201 bp, Bos taurus; identical to SEQ ID NO: 22819

SEQ ID NO: 103996 - DNA, 201 bp, Bos taurus; identical to SEQ ID NO: 22820

SEQ ID NO: 103997 - DNA, 201 bp, Bos taurus; identical to SEQ ID NO: 22821

SEQ ID NO: 103998 - DNA, 201 bp, Bos taurus; identical to SEQ ID NO: 22822

SEQ ID NO: 103999 - DNA, 201 bp, Bos taurus; identical to SEQ ID NO: 22823

SEQ ID NO: 104000 - DNA, 201 bp, Bos taurus; identical to SEQ ID NO: 22824

SEQ ID NO: 104001 - DNA, 201 bp, Bos taurus; identical to SEQ ID NO: 22826

SEQ ID NO: 104002 - DNA, 201 bp, Bos taurus; identical to SEQ ID NO: 22827

SEQ ID NO: 104003 - DNA, 201 bp, Bos taurus; identical to SEQ ID NO: 22828

SEQ ID NO: 104004 - DNA, 201 bp, Bos taurus; identical to SEQ ID NO: 22829

SEQ ID NO: 104005 - DNA, 201 bp, Bos taurus; identical to SEQ ID NO: 22830

SEQ ID NO: 104006 - DNA, 201 bp, Bos taurus; identical to SEQ ID NO: 22831

SEQ ID NO: 104007 - DNA, 201 bp, Bos taurus; identical to SEQ ID NO: 22832

SEQ ID NO: 104008 - DNA, 201 bp, Bos taurus; identical to SEQ ID NO: 22833

SEQ ID NO: 104009 - DNA, 201 bp, Bos taurus; identical to SEQ ID NO: 22834

SEQ ID NO: 104010 - DNA, 201 bp, Bos taurus; identical to SEQ ID NO: 22835

SEQ ID NO: 104011 - DNA, 201 bp, Bos taurus; identical to SEQ ID NO: 22836

SEQ ID NO: 104012 - DNA, 201 bp, Bos taurus
gatgacaactcgtaatttgtcaggaagtcaagaacagcaggagtggctctgagatacacactaacaaacctctagcatagagggaggccagtggtgatttagaaaaaccacatgtcatttcctcttttttctttcttctacattttcagctcttctcttgtgacacgtcgatacatagactagagcaaaggccgggtgtag

SEQ ID NO: 104013 - DNA, 201 bp, Bos taurus
tctactgctttgttgggaaaaacaagaaggggaattaagaaatatatctttatgtcgatcaatcacactccaatcaatttttttgcaaaaggaatatacatttggctctaagaagaaaacactgtgtgtatgtgtctgtgagtgatttaactttgtttattaaaaaggtttctggggaaaaccagtaatatatatgtttat

SEQ ID NO: 104014 - DNA, 201 bp, Bos taurus; identical to SEQ ID NO: 22837

SEQ ID NO: 104015 - DNA, 201 bp, Bos taurus
cacttcacactggttataatggccgtcatcaaaaaaaaatctacaaacaataaatgctgaagaggatatggagtagagggaatcctcttgcactgttggtggggatgtaaattgatccagctagtattgaagacagtatggaggttaaaaaaaaaaactaggaataaaactacaatatgacccagcagtcccactactggg

SEQ ID NO: 104016 - DNA, 201 bp, Bos taurus
ctatgaaactgactttattctgagtcaaaaatggtcaaatacgggcaatttcatatggctcaacttacttctcacctcagagtggaggtagagcttggctttgggcttggattccatgcaggtaggtccacgttgtgaaactgcctccaaggtacacacagaggcctgcccagcctggagatcctgatcaagcccaataag

SEQ ID NO: 104017 - DNA, 201 bp, Bos taurus; identical to SEQ ID NO: 22838

SEQ ID NO: 104018 - DNA, 201 bp, Bos taurus
ctctcacctctatttagttaccaactggcccacagtattcattttaaaacaaaatcaagccccacagctaaggagagggtagtgtgatgaaagtttacaggcagatacagatggccagtgggcacacaaagaggtgctcaacatcactaaatatcagagaattgaaaatcaaaactacaagaggtatcacctcacactagt

SEQ ID NO: 104019 - DNA, 201 bp, Bos taurus
agggaagccccccttggcccccagaggaaggaaaagaggacatggatccctagaaggcactcagagatgaagaggggactcccttcccagagatagagcttgggccgtggaccactggagggaccgccgggactgactatctttggaggagtcctcagctgagtgcagacttcacatcatctatgcagggggctcagcagt

SEQ ID NO: 104020 - DNA, 201 bp, Bos taurus; identical to SEQ ID NO: 22839

SEQ ID NO: 104021 - DNA, 201 bp, Bos taurus
tctgggggaggagtgtgtagacagccagggggtcagcagggccaccaggagactcaggccggggcaggggtggtggtggttttctggcagggaggaggcctggacacgcatggaggatgagatctgattgtcagctggctgctgtgcggtggggagactacagaagggatgggggccgggtgactgccatggtatcccagc

SEQ ID NO: 104022 - DNA, 201 bp, Bos taurus; identical to SEQ ID NO: 22840

SEQ ID NO: 104023 - DNA, 201 bp, Bos taurus; identical to SEQ ID NO: 22841

SEQ ID NO: 104024 - DNA, 201 bp, Bos taurus; identical to SEQ ID NO: 22842

SEQ ID NO: 104025 - DNA, 201 bp, Bos taurus
gaccagtggaagacagagtggacctggccagtccattggacctgggagatagctggacctgggagagaactcctttcctctttttctcacatatggactacttggaaaccctgaagatatcctatgaaaccaatcaattagatgtgcgtgttagaccctgagactagctaagtaaccatttttctctctttttaatatgtg

SEQ ID NO: 104026 - DNA, 201 bp, Bos taurus; identical to SEQ ID NO: 22843

SEQ ID NO: 104027 - DNA, 201 bp, Bos taurus
agcatttcagaaactcaattctcccccagagagcgcctggggccctggctagccccgcccccactccatacccagaggcacagagagcgaggctccccggagaggcaggaggcttgtcttacgtaaaagacctggcccgaaaaagagctcggatttgggggcactgctgagagagaaagtgggcagactggtcgaggccta

SEQ ID NO: 104028 - DNA, 201 bp, Bos taurus
tgagtaggccaagaggagacgtgtaaggaagacacggacaggtatggggtaagcagggcttggaaagaggtgagatgcacagagaaagtgtaaggaagggcggggccaagtgaggaagttgagaagaggagagctggacacacggttttcagccccgggtggggactaggtagaaggtctgaccactggggagaagggggc

SEQ ID NO: 104029 - DNA, 201 bp, Bos taurus; identical to SEQ ID NO: 22844

SEQ ID NO: 104030 - DNA, 201 bp, Bos taurus
gctctgggccggtcgcacccgtgtacctccgcagggcctggaccttggggaccgggagagccaggatcctcaccaatatcgtcatcccgtgcctcaagttttggaggccacgtcccaggtgacgtggaagcccgtgttgctgccgggagcattgaagctggctcctggtgtgagcatgtggaacccaagtacgcaggtgct

SEQ ID NO: 104031 - DNA, 201 bp, Bos taurus
tgatgtaacctgctttcttcttgactcctacacagagataagacaggcaaactctttaattatggcaaaggaactctatgtactttaacatatcatggaagaagcagtcaaagaaaaagcaataatatacataagcatctcaataaacctcaaactcattaaaaaaatatcacatctacaatacccaagaacaagggcttt

SEQ ID NO: 104032 - DNA, 201 bp, Bos taurus
atttttgagatttcatgataatgctgtttggccctctctctgagcagtgaggtcacattagaagtggagaagcttctgaacattacatcattacctcatatgcataaacaaaccactcccaaagagtgtaagtcctagacatttgtttctaagcagctttagtcatgctgctggtgtcgcctttgcctgactgtaggagtc

SEQ ID NO: 104033 - DNA, 201 bp, Bos taurus
agaaagctgaagagaagccatcgctaggcaggagggggtgctttccggagtaaacaaacctgccagcagtccctcttctcagcagaaagggaagctctggcggacaaggccaaagacacagagaagggagggagctgccggctccgtgggcccatctgtcctcatccccttgtcctgctttccctacagtggggggcagag

SEQ ID NO: 104034 - DNA, 201 bp, Bos taurus; identical to SEQ ID NO: 22845

SEQ ID NO: 104035 - DNA, 201 bp, Bos taurus
gttaaaacatttttatagagtctactctcttgctttatttgccaatttctgcaccagtatctcagcattttaaatataactccaggttttaatatctcctgaattaaatatttctttgttattttctttcaaacctttcttggttattatttatcatttattctccagaaaacctttaaaatcattttttgacattctctc

SEQ ID NO: 104036 - DNA, 201 bp, Bos taurus; identical to SEQ ID NO: 22846

SEQ ID NO: 104037 - DNA, 201 bp, Bos taurus
catctccgtgactgtgctttgttagatggaagatcttagaaataagggaggggcaattctatcaagagacaggagccatctggtcattttacattctttacgtcactgaaatagtgacataagcaggcaatagggagtcataatgttgactaaactatgactaaccttaactatcaaggagaaataaggttaccttagaaa

SEQ ID NO: 104038 - DNA, 201 bp, Bos taurus; identical to SEQ ID NO: 22847

SEQ ID NO: 104039 - DNA, 201 bp, Bos taurus; identical to SEQ ID NO: 22848

SEQ ID NO: 104040 - DNA, 201 bp, Bos taurus; identical to SEQ ID NO: 22849

SEQ ID NO: 104041 - DNA, 201 bp, Bos taurus; identical to SEQ ID NO: 22850

SEQ ID NO: 104042 - DNA, 201 bp, Bos taurus
cttgctcatttgctggtggtagcatcaaggacagtcttgatactcctgaaggatgtatgttaagaatctgcagcttcagaacactgctaaatgttgatgcagggtagtttcctgggctcatgcatgggctaaatgactagccttcacacttatgttaataccgactcatgtccatctggttggtgatgccatccaaccatc

SEQ ID NO: 104043 - DNA, 201 bp, Bos taurus; identical to SEQ ID NO: 22851

SEQ ID NO: 104044 - DNA, 201 bp, Bos taurus
aatatattgagtgagattcccaaacatagaggtttaatttctgatctcatggatgcaaagcaaataaacagaatggccaataaatttgaaccaatacatagagacatgtgatggttttgaagggaaaagaaagtggatattgtactattgaattaggatgaataggtttcattagaaacagcatcttgatgaagaatcagt

SEQ ID NO: 104045 - DNA, 201 bp, Bos taurus; identical to SEQ ID NO: 22852

SEQ ID NO: 104046 - DNA, 201 bp, Bos taurus; identical to SEQ ID NO: 22853

SEQ ID NO: 104047 - DNA, 201 bp, Bos taurus
gtttactgtccttaagcagcacattgcctggacagggatcataggatttaattattaaatctgtgactggctaattgcatagatgctagggttgggtggcctagataggccaactgactccctaaaatgtgagtttttttttttcatttcactgtctggaacagaagaaaatggctgtggttttatgtgagttgcatcctg

SEQ ID NO: 104048 - DNA, 201 bp, Bos taurus
taagtaattcagagtgtggaagagagggtcaagtaatgtggagatgcctccagaaggattagagaacaggccagtgtcccaaggccactggcaaacataggcaccaatagactcactgtctgattagattgtatattgttgtagaatctttagtgaaaggcttttcaggacaaattagcctgtcttgcattctctaggcct

SEQ ID NO: 104049 - DNA, 201 bp, Bos taurus
tctcatgcacataccaggacatggagttgcctgggatgggaggaggttgaatcccagattcttgtgcatgcggcctggccctggggtcctggggcgcatgcccttccagctcctagcgactcccctggttgcaaccgcccagtgggcggtgccagggcaggtttcaggctataaagggctcttggctcccagggcctgagg

SEQ ID NO: 104050 - DNA, 201 bp, Bos taurus; identical to SEQ ID NO: 22854

SEQ ID NO: 104051 - DNA, 201 bp, Bos taurus; identical to SEQ ID NO: 22855

SEQ ID NO: 104052 - DNA, 201 bp, Bos taurus; identical to SEQ ID NO: 22856

SEQ ID NO: 104053 - DNA, 201 bp, Bos taurus; identical to SEQ ID NO: 22857

SEQ ID NO: 104054 - DNA, 201 bp, Bos taurus
aggaactgctttactcagctgttggggcgcttctgggagggggttgagctgactctgcaggtggcagcctaggtggaagggaggggacagggcagagctacttctgtaggagtagctacagggaagaggctactgctggatccatccagcttcatgtgtgggctgaggcagagtccacacatgtccacagcttcatatgca

SEQ ID NO: 104055 - DNA, 201 bp, Bos taurus; identical to SEQ ID NO: 22858

SEQ ID NO: 104056 - DNA, 201 bp, Bos taurus; identical to SEQ ID NO: 22859

SEQ ID NO: 104057 - DNA, 201 bp, Bos taurus; identical to SEQ ID NO: 22860

SEQ ID NO: 104058 - DNA, 201 bp, Bos taurus; identical to SEQ ID NO: 22861

SEQ ID NO: 104059 - DNA, 201 bp, Bos taurus; identical to SEQ ID NO: 22862

SEQ ID NO: 104060 - DNA, 201 bp, Bos taurus
gatatagtcctgcatggaaatcctcaccaagattcatgcaagaggggctgtaggtgaggaatacaggagaggggacactggagaaaatgattactagagacgatgattctagggtaagggctggcccaggtgctgaggagagacttccactctctagacatttgggggaagttacagtagctcagatgtacacatctagta

SEQ ID NO: 104061 - DNA, 201 bp, Bos taurus; identical to SEQ ID NO: 22863

SEQ ID NO: 104062 - DNA, 201 bp, Bos taurus; identical to SEQ ID NO: 22864

SEQ ID NO: 104063 - DNA, 201 bp, Bos taurus; identical to SEQ ID NO: 22865

SEQ ID NO: 104064 - DNA, 201 bp, Bos taurus
gtcttttaattactaaagtgaagtcctgctatgtctgatgggggtggggaggggtctaggctatcactaagacatcagaaagacctggattctggagtatttattgcctggagtttccccccagggcaaagggaataggatccattcccagcatctccttgttgctccccacacagcagttttgggaggctcctgaggtcc

SEQ ID NO: 104065 - DNA, 201 bp, Bos taurus
aacagactattcctatgctgtttaaatgtggcagagaagagtgagagaaggaaaccaagccataacaattataagacattcagacaaatctcactttgagttgatgaaaaatgctgcatgaaaactagtaaatagtatctggcataatattagaataataatacatgataaccaagtgagggttcattccttgtgttgaag

SEQ ID NO: 104066 - DNA, 201 bp, Bos taurus
caggggattgagagtggggacagaggaagaggttcaagaggtaaaggccagcacacagcctgctctttgtttacatggttggctcaggctgtgacaagtacgaaagatgacaatgtgtggtgttggcttggttggaataaaaccattcacatgttcatttgtttgctgatgcattcaaccattcatggattccacaatcac

SEQ ID NO: 104067 - DNA, 201 bp, Bos taurus
tcctttgggcccagttttaaagaatccaggctaacccaggtttagaggctgcagagggctgaaggtcaaagagattaacacacccttgttggactgggtgattgtgcgcttggccagtctccaccaacacacttgcaaacatcttttaattttttttatcatgtattttatcataaattgtgccacttatatattcatata

SEQ ID NO: 104068 - DNA, 201 bp, Bos taurus; identical to SEQ ID NO: 22866

SEQ ID NO: 104069 - DNA, 201 bp, Bos taurus; identical to SEQ ID NO: 22867

SEQ ID NO: 104070 - DNA, 201 bp, Bos taurus; identical to SEQ ID NO: 22868

SEQ ID NO: 104071 - DNA, 201 bp, Bos taurus
cacattcagagggtcgtggtcccagggcagcaccttgagagatggttaaggacccagaggagtgagaaagagtgtccttggacataggaaggtattcaatgtgccctcaagttgccgggccagagacaaagaggttgacttcagctcagcagcgggtctttctcatggttagagccatcccctggactactgtgctcccta

SEQ ID NO: 104072 - DNA, 201 bp, Bos taurus; identical to SEQ ID NO: 22869

SEQ ID NO: 104073 - DNA, 201 bp, Bos taurus; identical to SEQ ID NO: 22870

SEQ ID NO: 104074 - DNA, 201 bp, Bos taurus
tattcctcactcatcttaattcctctgatttaggagcagacatttgccatgttacaaggatgtcaggatggcaaaagtctgacaatgagaagttaatttccgctgcagtagcatggactttatacataacataatcttcaagattcttttgctgttgccttcacatgtgagcaaactgggcacttccctgatgctcgagtt

SEQ ID NO: 104075 - DNA, 201 bp, Bos taurus
gccattgctctgatgacgttcggcactatgtatcccatgagcgtgtacagtgggaaagtgttactccaggtaatggtcatctttcagtatgcatgcttaggattagccatgttcttttaccagattataaaaataaacgtgttcatctgccagattatgaaatttttaggagggtcctgttggagatgaagccaaacagta

SEQ ID NO: 104076 - DNA, 201 bp, Bos taurus; identical to SEQ ID NO: 22871

SEQ ID NO: 104077 - DNA, 201 bp, Bos taurus; identical to SEQ ID NO: 22872

SEQ ID NO: 104078 - DNA, 201 bp, Bos taurus
ttttgcatttttttcccctctgcctaaattgaacccaccagattggttgttccaatctttttgtccccctctcagtgtaagtgcaggccagagagaaacactgccagtgggctcagctttaaagaggagaccggacttgggaacagacaacacaaaagaagaaaggcgagatgagactgaggccgggttggcagagtgagg

SEQ ID NO: 104079 - DNA, 201 bp, Bos taurus
cagcgtgagtgcctgcaggtcagatgggcaccgggtcctggaagtgggggactgagtctcttctccagtgctcttggaggtggatattctgccaactggacgaagtacaaataatcaaaatcataaaatgaggttctgccatgacattaaaaaaaaccattcccagcactgtcccactctgccccacccaacgccagctgg

SEQ ID NO: 104080 - DNA, 201 bp, Bos taurus; identical to SEQ ID NO: 22873

SEQ ID NO: 104081 - DNA, 201 bp, Bos taurus; identical to SEQ ID NO: 22874

SEQ ID NO: 104082 - DNA, 201 bp, Bos taurus
tgcaggaggtggtgattttaggtgcatgtgggagatagaaaggaaaatggagcaacacctctgatggaacccaagactctgttgattctgattatgtttcgtatagatcatctgtatcattctgtatataagcatgccttgcttgatttttctctgtaccattgtcagcagaaattttccagagttattcctttaagatcc

SEQ ID NO: 104083 - DNA, 201 bp, Bos taurus; identical to SEQ ID NO: 22875

SEQ ID NO: 104084 - DNA, 201 bp, Bos taurus; identical to SEQ ID NO: 22876

SEQ ID NO: 104085 - DNA, 201 bp, Bos taurus; identical to SEQ ID NO: 22877

SEQ ID NO: 104086 - DNA, 201 bp, Bos taurus
tacatcagatcgaatttattgtcttttaatactgttctggaaaggtaaggtttttggtagtattggtttttataaaatgctgattggagaggtttactatcctaacccttttaaattccattattgtacaattcaacatgctggggggtcagatcaaaatgtgtttttaagaaattgcagaaaggttttaatatgtctagg

SEQ ID NO: 104087 - DNA, 201 bp, Bos taurus; identical to SEQ ID NO: 22878

SEQ ID NO: 104088 - DNA, 201 bp, Bos taurus; identical to SEQ ID NO: 22879

SEQ ID NO: 104089 - DNA, 201 bp, Bos taurus
ttctgagtagtaaagaggttgtttatgcgaactcaaccaagccagtgtaaagtcccatctgattctgaaggccattgcctctcaccatctcattatgaccaaatggctgggctctctggttcagatagcattgccttctgcatgtggtggggctttactagcctatcttttatggctagatattgggaaacagaatcttca

SEQ ID NO: 104090 - DNA, 201 bp, Bos taurus; identical to SEQ ID NO: 22880

SEQ ID NO: 104091 - DNA, 201 bp, Bos taurus; identical to SEQ ID NO: 22881

SEQ ID NO: 104092 - DNA, 201 bp, Bos taurus; identical to SEQ ID NO: 22882

SEQ ID NO: 104093 - DNA, 201 bp, Bos taurus; identical to SEQ ID NO: 22883

SEQ ID NO: 104094 - DNA, 201 bp, Bos taurus
agaaattctaggttgctgcaaggtataaaataaaaatatctgacttagattggtcaagaaattttctctgaggaggtgacatttatattttatttactctgtgattgctattattgatgaaagttagatctagttatttgactgccacagttgttgatcttaaacaaatagactgccaattatttctccagcaaaagtggt

SEQ ID NO: 104095 - DNA, 201 bp, Bos taurus; identical to SEQ ID NO: 22884

SEQ ID NO: 104096 - DNA, 201 bp, Bos taurus; identical to SEQ ID NO: 22885

SEQ ID NO: 104097 - DNA, 201 bp, Bos taurus; identical to SEQ ID NO: 22886

SEQ ID NO: 104098 - DNA, 201 bp, Bos taurus; identical to SEQ ID NO: 22887

SEQ ID NO: 104099 - DNA, 201 bp, Bos taurus; identical to SEQ ID NO: 22888

SEQ ID NO: 104100 - DNA, 201 bp, Bos taurus
tgcccaaaatctaaaggcaaagactaaagaaatttcactttggagaagagaagtaaaaaagttcacatgtctggaagagaagtctcacagtgttgagtagtaggcatgatagactatcaacaataaagttgaaatgagagtttttattccttatactctttttaattagataaaatttatccatttgtgactgtttttcca

SEQ ID NO: 104101 - DNA, 201 bp, Bos taurus
taaacaaagaccctgaagaattgtcctgtatcagtgatttaaggcacctctttaccgtgcttctcttcattagagaggatgctcataccctttttctctgggtgtgtatttctgcctagcttctatcctaaataaactatttctctgtgtgctctcctattcactgtactgggtctaataataaatgctgaacctgttttt

SEQ ID NO: 104102 - DNA, 201 bp, Bos taurus
accctagaatagctcaagccatgtagatagtgaaggaaaattcatttaaaggcaattatgtttcctctcattttgttttactttttcatgctgtcagccctggaagtgtaaagagcttctaaatggctggtgctggtaagtagtcaaatatttagaagccaagggtctttaatcacctaagtgctttacaatgaatactga

SEQ ID NO: 104103 - DNA, 201 bp, Bos taurus; identical to SEQ ID NO: 22889

SEQ ID NO: 104104 - DNA, 201 bp, Bos taurus; identical to SEQ ID NO: 22890

SEQ ID NO: 104105 - DNA, 201 bp, Bos taurus
atcaattcaaggccaatcctgttttaatctgttgagaccttagccagtaaatcctctaggactagatgtgctggaaaggtcctgcaaagtgatatttgttatattaaaagcacccttggcctgccttacgatgcatagtgattggtttccaaaccttaaactggtctcattaaatgggaaatttttttaaatttaaattat

SEQ ID NO: 104106 - DNA, 201 bp, Bos taurus
ccagttttttcacggtgcagtcaacacaggcttctcacacaagcgggaaaggacagtggcgaggccaggagcgatgtgtttctgctcggcgctccacggcagggcctcgctgaatggcttgttgtttcagagggagcctagaaccagaaagcagacaaacagaagcccacacaaatgtaaatgttgtataaaatcagatac

SEQ ID NO: 104107 - DNA, 201 bp, Bos taurus; identical to SEQ ID NO: 22891

SEQ ID NO: 104108 - DNA, 201 bp, Bos taurus
ttaagtttaacagggttcttctttttccgttttctttttaaagagtagtcagaatgtcttgacgtctaaggagcttcacaaatgctggggcatcaaaatggtttcatcaaaatgttatgggtctaaatattaataaataaaccacctaagtcaaatgaagtggctcaaatagtaaagtgtttgcctgcaatgagggaaacc

SEQ ID NO: 104109 - DNA, 201 bp, Bos taurus; identical to SEQ ID NO: 22892

SEQ ID NO: 104110 - DNA, 201 bp, Bos taurus
tcaccatactaaaaagctatgtaccatatgcctgaaacaatgatcacaatcttcaggctcaggaaatccactagcttctgttagcaggaatactatttcggtcaaatagtgcagcttgagaccttaaatgctaaactccaactacagcgaagccttgatatttgataagaaccaaataataaataatagatgaattctaca

SEQ ID NO: 104111 - DNA, 201 bp, Bos taurus; identical to SEQ ID NO: 22893

SEQ ID NO: 104112 - DNA, 201 bp, Bos taurus
aaaaaaaggaaagaaaacctacaacaattccctgatgtgtacagctggttcttctgcactcagcataacctgggctgtggaaagaagcatttacttactttggtataaaaatcagattatcttgtttcttaaatttctcctttaacaagaggcagtgctttttaaaaaatctagaatatcttctttacacaacaatgttat

SEQ ID NO: 104113 - DNA, 201 bp, Bos taurus; identical to SEQ ID NO: 22894

SEQ ID NO: 104114 - DNA, 201 bp, Bos taurus; identical to SEQ ID NO: 22895

SEQ ID NO: 104115 - DNA, 201 bp, Bos taurus
tccttgagcagctgagcaacaggaatggcctgtgcaggagccatgctctgccagcaggtgtcatctttgcctcatggtttctgctctcatctattttcctcaggattgtttttgaaggccaggaatagaataaatttgcaagtcaatggagttcaactccaaattttaaagtctcctacaagagacacaaatcaacagtgc

SEQ ID NO: 104116 - DNA, 201 bp, Bos taurus
cgctgacggtcccaaatggccaaacaactcattttcccgagcaaactccagggctgtaaagagcattatgataaaatggcttttcatgtaactgtgcttctagtagagaaatatgcacctcaggccaaaatgaggattaaggcttgtctagaagttacattttaatggaaattaatatgctgacaattttagttcttacat

SEQ ID NO: 104117 - DNA, 201 bp, Bos taurus; identical to SEQ ID NO: 22896

SEQ ID NO: 104118 - DNA, 201 bp, Bos taurus; identical to SEQ ID NO: 22897

SEQ ID NO: 104119 - DNA, 201 bp, Bos taurus; identical to SEQ ID NO: 22898

SEQ ID NO: 104120 - DNA, 201 bp, Bos taurus
caaggccaagcagagaggagctctgcaaacagagtgatgagtgagaggaaatacccacatgcccccaccctatcctcatcccctaggagctgagagagacatgaaagaaatggcctcacagcatgaaaactagaaaaggctagaagacaatgaagaaatagcatgccaccagtcatttctactcatgcaagatgagtaggc

SEQ ID NO: 104121 - DNA, 201 bp, Bos taurus
gttgggaactgcactttgagaactgcttctagggccttctctcagaggagcctttagccatgcacagaatagaaggtagagacaaaactgccttgcccagaagaaacaaggcctatcctggtcatctggccattctcctggcctcctcaggccattcacatcttccagaagcacctcttcctccaggaatcttggacctcg

SEQ ID NO: 104122 - DNA, 201 bp, Bos taurus
ctgcattggaaggcagattcttaactactggaccactaggcaagtcccacacacatattcaatctttcaacacacatatatacaagcccttgctacatgctgggcactgcaccaggcactagagatgcagcaggaaacaacacagaaaaatttctgctcttacagagtttactttccagtgattacaaatgaacagacagt

SEQ ID NO: 104123 - DNA, 201 bp, Bos taurus; identical to SEQ ID NO: 22899

SEQ ID NO: 104124 - DNA, 201 bp, Bos taurus; identical to SEQ ID NO: 22900

SEQ ID NO: 104125 - DNA, 201 bp, Bos taurus; identical to SEQ ID NO: 22901

SEQ ID NO: 104126 - DNA, 201 bp, Bos taurus
aagagctcttagacagcatctaatccaatccccaaactgatttaagtaactcgtctttatcctacatccaactctaccctaacagttcacttaatgaattattttaaaataatcttcatgtgaatgaggtaaaactattgtttttttgaggtaatgaggtaaaactattgaactttggaaacagaattagcgtgaaacctt

SEQ ID NO: 104127 - DNA, 201 bp, Bos taurus; identical to SEQ ID NO: 22902

SEQ ID NO: 104128 - DNA, 201 bp, Bos taurus; identical to SEQ ID NO: 22903

SEQ ID NO: 104129 - DNA, 201 bp, Bos taurus
ttgcctttcctcacgttgtgatacctcttctctgttagacttcttgacactctgtcctctaatccgtatcttttttaagcacttctccaataaaataagatacccctctctaattctcaattctccatttaaaaatcttgaaatagttttattttctgattattgaaaaataaattcagagtctgggtaattccaaacgaa

SEQ ID NO: 104130 - DNA, 201 bp, Bos taurus; identical to SEQ ID NO: 22904

SEQ ID NO: 104131 - DNA, 201 bp, Bos taurus; identical to SEQ ID NO: 22905

SEQ ID NO: 104132 - DNA, 201 bp, Bos taurus; identical to SEQ ID NO: 22906

SEQ ID NO: 104133 - DNA, 201 bp, Bos taurus; identical to SEQ ID NO: 22907

SEQ ID NO: 104134 - DNA, 201 bp, Bos taurus
atcacccttccacaaggctccccggaatgggttgattctccccaaggaaagatggaacgctgaccagaagggatagaaataggatgctaggcagccacaattaagtacacaagtatctttaaatgactgctgaatcagctaagaataatgacagaattatcttcaggagcaaaagtctagcaaatagtacttgaagggaaa

SEQ ID NO: 104135 - DNA, 201 bp, Bos taurus
ttcacccactgtaaaagtcttcccagggccagctctgaagagatatgtctgtattggtttccttccaatccctcctgtcaagcaatgaaggatggtagagaaaggccaaaatcctcttttaattttgtatcttctgtcacagcaacatattttatttactaacagttgattttattgacttcaacccacagaattgctttg

SEQ ID NO: 104136 - DNA, 201 bp, Bos taurus; identical to SEQ ID NO: 22908

SEQ ID NO: 104137 - DNA, 201 bp, Bos taurus
tgggggcactgtactacaggctggaggggtggacaacaggaggaagataaacattcctgaaatgaaaagcttaccatagaatatggctgtgtcctaagacgcagcaggccaggatggttgttagcaagcaatgagtccagttcaaagagtaaaagcaacatttaacagaggtggtagatcattaaaggtctaggtagaccc

SEQ ID NO: 104138 - DNA, 201 bp, Bos taurus
tatcacactaactggaaggccagtctggggtgtgctcactggatgcgtcaagatcaattacccctgcggagtttctcttctgcaggaaacaggggaacgcaaggccatcagtattctgtacacacactaacagcttgtgcttgcagagacaataatttttcagctcctttcagattctatttattggttattttccccttt

SEQ ID NO: 104139 - DNA, 201 bp, Bos taurus
gtttaccaggaccaaatagagttgaactaacccaaaggggcagagcagatttcatagaacataagcaagagataggacataactagagaaagaggaaagacagtacaatataaaggaggccaaggagtgcagttaagatctgaatacatggtgggaggccaaataagagagaaggagccatgggtgagatgaggccagtgg

SEQ ID NO: 104140 - DNA, 201 bp, Bos taurus; identical to SEQ ID NO: 22910

SEQ ID NO: 104141 - DNA, 201 bp, Bos taurus
cacacagtgcagctgctacagctagcagcctcgctgagagctgagcatcactccccctcagcctcacaccagtgccaaaatccccatcgggaggcactgatggaacagcaactaggaaggcacacagaagctgtatggtgccccagccacatcagtgcaggactgcatatgtgcacagctacctcctcaaggccagcaaga

SEQ ID NO: 104142 - DNA, 201 bp, Bos taurus; identical to SEQ ID NO: 22911

SEQ ID NO: 104143 - DNA, 201 bp, Bos taurus
attcattaatacccacatgaacatttactgaatactatttaggatggtttaatcttacttcttacagcaattcttttgtagtgtcaactttatttgtgatattgagggaaaggtataatataaaataaagtggtactatatagcaactaatccttgacagttgaatacgcatgccctctttctgacttccccatttaagac

SEQ ID NO: 104144 - DNA, 201 bp, Bos taurus; identical to SEQ ID NO: 22912

SEQ ID NO: 104145 - DNA, 201 bp, Bos taurus; identical to SEQ ID NO: 22913

SEQ ID NO: 104146 - DNA, 201 bp, Bos taurus
aaagttcctgcagagaattcggttgatagcctcatgtgggttcccttctaattcactctgtttttctcttgctgcctttagaaacttctctttatctttagctttggccattttgattgttgtaggtctttgtatgagtctgttggggctcatcttctttggggccctctgtgcatcctgttggagaaggcaatggcaacc

SEQ ID NO: 104147 - DNA, 201 bp, Bos taurus
ttagataacagtagattagcaaaataaagaatgaagtcagtaatataaaagatccctaaatcaaatgcatcattctgattctgttaaggctgagaagacagcattaaaccttcacggaaaacatagcatttaattgaggctcagaaagaaggttaagtttgtctgatgcactgaacaaatgttttgaggaggtataacttc

SEQ ID NO: 104148 - DNA, 201 bp, Bos taurus
agtggtatccccagaaaactgaaagttcaactgaaaagtgtcaaaacatgtaattaagtagaatatttacaacttagtttcttcccaataatttgtaaatactccacttacttggaataggttttaatttcctgtttaacaataactgattctaatcactttctgtttttcagttatgaaaaagagaaaagttatttgagt

SEQ ID NO: 104149 - DNA, 201 bp, Bos taurus; identical to SEQ ID NO: 22914

SEQ ID NO: 104150 - DNA, 201 bp, Bos taurus
attgcctcacaaattgaatatacatatacaattgtatataattcacaggatggcaatacaaattgtataaatatttcacagggcaccatgtgaagtgaaatctataatttcctcctaaacacactcatattgcatgtctactgtagtgaatctctcctattcataatgaaagagaaaaaaatcacaaaggaattaatggga

SEQ ID NO: 104151 - DNA, 201 bp, Bos taurus; identical to SEQ ID NO: 22915

SEQ ID NO: 104152 - DNA, 201 bp, Bos taurus; identical to SEQ ID NO: 22916

SEQ ID NO: 104153 - DNA, 201 bp, Bos taurus; identical to SEQ ID NO: 22917

SEQ ID NO: 104154 - DNA, 201 bp, Bos taurus; identical to SEQ ID NO: 22918

SEQ ID NO: 104155 - DNA, 201 bp, Bos taurus; identical to SEQ ID NO: 22919

SEQ ID NO: 104156 - DNA, 201 bp, Bos taurus; identical to SEQ ID NO: 22920

SEQ ID NO: 104157 - DNA, 201 bp, Bos taurus; identical to SEQ ID NO: 22921

SEQ ID NO: 104158 - DNA, 201 bp, Bos taurus; identical to SEQ ID NO: 22922

SEQ ID NO: 104159 - DNA, 201 bp, Bos taurus
cttacagtctgtggattggtagagtgctctgattcagcctgtggctcagatacagatcaattccacatgctactcattggggggccaccagctccctgaggctggctcatctcattatggatggaagaagcataagaaaaagctagtagaaatttcccatgacccttaaggccttcactcaaaactggatactgtccaatc

SEQ ID NO: 104160 - DNA, 201 bp, Bos taurus
cctacaagtggagactttgaaaaagaaactcctgtctcttcacctcttcctttaagtgccttctcagtgaaggatgctgcagtaccagatgtctgggacaatacccaggccatttcatcagatttctgccattattggatgcagatgattaatagttctgcttgcctggccccgacatgtccactgttaacagaggccttc

SEQ ID NO: 104161 - DNA, 201 bp, Bos taurus; identical to SEQ ID NO: 22923

SEQ ID NO: 104162 - DNA, 201 bp, Bos taurus
tcgttaccagctgagccattgggggacgttcttacaggagccttggcctcagtgaaacacttgacgggcactgtcctctctcttgggacccggccatatttgaacaaggctcagccacacaggtggaatcattgcagaggcaggaccagggtgggggcagccaagtgacagggtggccaccattcccacgccccagggagc

SEQ ID NO: 104163 - DNA, 201 bp, Bos taurus; identical to SEQ ID NO: 22925

SEQ ID NO: 104164 - DNA, 201 bp, Bos taurus; identical to SEQ ID NO: 22926

SEQ ID NO: 104165 - DNA, 201 bp, Bos taurus
accagtgacttaaagtcaacaaaaattatacaccagtattgagttcctttggccaagtaaaccagtttgttgattctgagagatggatgtacagaccaggtgattgacactgctggcctgcagcagaggaggtgtccagtactgggatgatctgctccaggtcttgcaagctaatcattaaatacacagattcctttcctt

SEQ ID NO: 104166 - DNA, 201 bp, Bos taurus
cccccctcaggcctgttgtgttttgggaggaggatttctcttggagggagctgaacagaaggtgaagctttctgaggaacctttctatgtctccccacaggtggatatggcctcccaggtaccttggtttaagcagctggctcacttcaagatgccctggacatctcacaaggactcctgtgagcagggcattcagaacct

SEQ ID NO: 104167 - DNA, 201 bp, Bos taurus
agaggtctgtgggagccactgtggtagaagggaaggcttggagggagcaccctgaaccagcaagtctttcagtcttagcatctcactggaaatgacaagcaatggatttgattaaacgtcagatgcctctggcgccaacattttacaaactggaaagtatgcggggtgtgtaagtaaagaatttcatagaatattaagcat

SEQ ID NO: 104168 - DNA, 201 bp, Bos taurus; identical to SEQ ID NO: 22927

SEQ ID NO: 104169 - DNA, 201 bp, Bos taurus; identical to SEQ ID NO: 22928

SEQ ID NO: 104170 - DNA, 201 bp, Bos taurus
cattgagggtcctctttgggaggatgaattctattaaaccttattttggcaaattgtatagaagcaacgaccacatgaacccatcactagggctccttgtaggcctggggaggggcctgtgggggggaggggggtctcaatatttaggcatcattagcttgacagtgggagaaggcaatggcaccccactccagtagttct

SEQ ID NO: 104171 - DNA, 201 bp, Bos taurus; identical to SEQ ID NO: 22929

SEQ ID NO: 104172 - DNA, 201 bp, Bos taurus
tggcctaacctggccagctccatgcaggtgggagacacacagctgtccccatcatatgattctagagccgtgctcagtgcacttcctggaaagggctaggcagtatatgttttaggctttgcgggccacttggaaactacttagactgctcctgcagcacccaaggacaatgggtgaatgaacaggtatgctccaggagaa

SEQ ID NO: 104173 - DNA, 201 bp, Bos taurus
tcaactcatggtacagtgtggctaccaactgaccagaacagggttcccgtcagacaactacatgctaagtcccttctaccatctagttttaactttcagtaatgtctccacatgtggggaaggcagtcacccttaaacttagcttctttggatttctcctgtttgcagtgcctgcctctctgccctgaattccccctcaag

SEQ ID NO: 104174 - DNA, 201 bp, Bos taurus
tcataaaaaaaaaaaaacactatggggggatgtgggagggttaaagggtgggcagagggttagagtctttcattaaaaatgagcttacttctctgccaaataaatatacacaaacagccaccagattttgaccatgcacttcacagacattaccacttatttgtttaaacctattaatagggctttctgttacttaaagcc

SEQ ID NO: 104175 - DNA, 201 bp, Bos taurus
caaaacacaaaaacagctcctgctgtttattttgatgaggccaagtatcttaaccccacttctatactctaagccccacttctttttataaactgaatttaaaagctattataaaggcctccccagaaattcttatttcatcttaccttgaatatattttctcataattagtcctcaatagaaatgaaaaatgacgttttt

SEQ ID NO: 104176 - DNA, 201 bp, Bos taurus
agtgttcccatgttgcctctgggtttccaaggaccgccttccagggctgccccagccagacccccttttcctgatctaggcctttccctcctaacttccatacttcagaacatactcatactgtgtccctttactcgtccaggtttttggtaggcaaacggtgaattagtctgacactgattaatgtcaccttgttgaaga

SEQ ID NO: 104177 - DNA, 201 bp, Bos taurus; identical to SEQ ID NO: 22930

SEQ ID NO: 104178 - DNA, 201 bp, Bos taurus; identical to SEQ ID NO: 22931

SEQ ID NO: 104179 - DNA, 201 bp, Bos taurus
cccccagagagttccagatgctgccaggcctcttaacaggtagacccagacctggcatagttagtatcacttctttgtatccagttgtccaaagtaagccacaaggccagcccaggctcaaggggagggaagcagattttgtcttttgataggaggagcatgcccctcatggaaggagtaccaatggggccatctttggag

SEQ ID NO: 104180 - DNA, 201 bp, Bos taurus
ttaagtcccacaaacctgacttggagggagtagggaagagggggtgagagttgtttccagtcagaaaactgtgggaaagatgctaatgcaggacactgcatgtcatgtggtgaaagggaacttgtgcccccactgcagcaagacagacggaggcgctgccagttttccagatgttccaacagctttaccacttgccatgag

SEQ ID NO: 104181 - DNA, 201 bp, Bos taurus
tagaatttactcatcttgcataactaaactttgtagccctgaccaacatctctgcatttcctttgtcccctagcccctggtggccaccattctactctttgtatgacttggacgatttagattccacatataagtgagatcatgcaatatttgtctttttgcatttggcttgtttcacttagcataatgtcctccagggcc

SEQ ID NO: 104182 - DNA, 201 bp, Bos taurus
gcggcggttcccacctcggggcaccgataagggtttgataaacaggagcaaatcgcgccctttctggcagagcgcccgggcccttcgctcccggattgccaggagtggaggggagaaggggaggggattgagcctaactccgagtttacggccgcagctgcccctcccgcgtcactgcggcacccccaggcctgagatggc

SEQ ID NO: 104183 - DNA, 201 bp, Bos taurus; identical to SEQ ID NO: 22932

SEQ ID NO: 104184 - DNA, 201 bp, Bos taurus; identical to SEQ ID NO: 22933

SEQ ID NO: 104185 - DNA, 201 bp, Bos taurus
gttactacctcccaccatcaggtgccactcactgccctgagcctcgcgcaggcgcagcctgtggggcggagacccaaggcctcacagccaatcgcagaaggggaggggcggaccaagaagccagccccgccttctcgctcgcgtttattcctcccgctgctttccaggtgcaggataggcggggcgaagagccgtggggcc

SEQ ID NO: 104186 - DNA, 201 bp, Bos taurus; identical to SEQ ID NO: 22934

SEQ ID NO: 104187 - DNA, 201 bp, Bos taurus
ctagagccaggctgatggacaggagaaaggatcaggctggggaaggacccagcatgatccaggtctggatgcaaggccacacttgggggtcagggaggaggtggggttgctgggacacaggaacttgtaagagaataaacaataggacatagaattggatggatagaatagggaagaagaaaaactatttattatgtacca

SEQ ID NO: 104188 - DNA, 201 bp, Bos taurus; identical to SEQ ID NO: 22935

SEQ ID NO: 104189 - DNA, 201 bp, Bos taurus; identical to SEQ ID NO: 22936

SEQ ID NO: 104190 - DNA, 201 bp, Bos taurus; identical to SEQ ID NO: 22937

SEQ ID NO: 104191 - DNA, 201 bp, Bos taurus
ttagtccaataagaggtttgggactttcaaatcacaaccacagtacggctgaatggccaggcccgacagtttagtcacgctgcttttgtggccatcttcctactgagcactcgactcagttataccattaaaattagtacaattccaaagaggctttggtccctagggcccctccgttatggaaaggtgtgaacagaaaat

SEQ ID NO: 104192 - DNA, 201 bp, Bos taurus
ggtgtggaaagcagggagggcagaacaacctctgagactctagccaactgcagtatatattaagggcagcccagatggccgctagccaacaacccgtgccaggtaatttgcaagctgcactttctccttttgaaggtctctttctccaggatacggggaggaggtctgtcccttcccacttctgcacctgccacctgagca

SEQ ID NO: 104193 - DNA, 201 bp, Bos taurus; identical to SEQ ID NO: 22938

SEQ ID NO: 104194 - DNA, 201 bp, Bos taurus; identical to SEQ ID NO: 22939

SEQ ID NO: 104195 - DNA, 201 bp, Bos taurus
gctggaatgacccaggcaggagaggctgctttccagtgaagagtggggccgggtgcaggtgtgtgcagtgaagggtgggctcagcaggctggggtgctcatacctgcactttccaaaggcttggcccttgagctgctcctgggagaaaacctctgagccctgggaagatcctgctggatagcagtgtctttgttcacctgg

SEQ ID NO: 104196 - DNA, 201 bp, Bos taurus; identical to SEQ ID NO: 22940

SEQ ID NO: 104197 - DNA, 201 bp, Bos taurus
tccattacaagaaaaagaaagttctttccgtatcaatatgaactggtttcaaggtgtttaaagtgaaaatgaaaataagataccgaacagtattttgttttattatttgtgtaaacacaaaagcacacggacacctagaaagtggacactagtcacccccggggcagtctgcagcttagggacatgagaaggactgattct

SEQ ID NO: 104198 - DNA, 201 bp, Bos taurus
aaagaggcaaacatctagctatacaggaggcaagggagctggagtctaactgcatttcttaaagccttaaaaccagtactctgggatttagccttgtcctacactcagccttcacaggtaccgtgctactaattcctgagttgtgggagggggaggggtgtgtgtggcgtggactggcctgatttggcttgttccttgtag

SEQ ID NO: 104199 - DNA, 201 bp, Bos taurus
ttgggcaattgtctttttgattaaaattaactgaaaggaaccaaaaggtaagctatttgttccctagctttcaaagagataaatattctattagaagagaagagtaaggcccagtagaactaagggcctcttaacccaactgaccaggagcagaataagtaaacccaacctgtgctgcaagtagggaggaggtttaattga

SEQ ID NO: 104200 - DNA, 201 bp, Bos taurus; identical to SEQ ID NO: 22941

SEQ ID NO: 104201 - DNA, 201 bp, Bos taurus; identical to SEQ ID NO: 22942

SEQ ID NO: 104202 - DNA, 201 bp, Bos taurus; identical to SEQ ID NO: 22943

SEQ ID NO: 104203 - DNA, 201 bp, Bos taurus
gttaacatttaaatcagagggaaaatctgaaataattccagagaatggaagtagtttccccacagttgatatttatgctttattcaattttgaggagcaggtgcttggtgggtgttacaagggtggaaggactttggaaagtaggatatgacggagacccaaacctcacctcttaggctgtgttagatttccgtttccagc

SEQ ID NO: 104204 - DNA, 201 bp, Bos taurus; identical to SEQ ID NO: 22944

SEQ ID NO: 104205 - DNA, 201 bp, Bos taurus
tttcttaaccttctctcctcccctgccccgcccgcagcgtcttgacgtagttgcacggacaacgtgcacccacattcaaagcccacagggggccgtcctcagtgatgcgccgcaggtgctgcgcaggcgcaagcagcaaggtgctggagccggtgtcatggattgcgtcaactgggtggtaagtgaggatcatcagcatgg

SEQ ID NO: 104206 - DNA, 201 bp, Bos taurus
gtttgctgaattatgacaaagggagaaacatgcccttacaatgaagaggtctggcagtacctccatagccaaatggccaaggagtggcatcgcgtgacataatgcacctcctggtctgatgcagagagagacatttaacatctaatcaggacagtatagttggaggagtccagacaactggcctaagccctcaaaggaatt

SEQ ID NO: 104207 - DNA, 201 bp, Bos taurus
acatacacttacatatatattattaagcttcaaacagtattaggacatggatattattgttcctgtcattgttttaggtgaggaaactgaggtttagagaggtgagagaactggttttaaacctaggtagtcttctctggcatctctgctttaatcatgcaaacatcccttctttcgtacatgttgcctctctgaaaccag

SEQ ID NO: 104208 - DNA, 201 bp, Bos taurus
tggtagttggggtacggggccttagttacttagcagcatgtgggatcttctgactagggtttgaacctgtgtcccctgcactggcaggcagattcttaacaactggcccaccaggggaaccccaaggtttattctttaaagggagcagagaatgtctgaactggagacaccagggaccacttatggatgctgggtgctgag

SEQ ID NO: 104209 - DNA, 201 bp, Bos taurus
cagtattcttgcctgggtaatcccatgaagagaggagcctggagggctggagttcatgtggttgcagagtcggacatggcctagcgactaaccaacaatgacaatgtacatgttactttgactccctgagttatgctgtccaatacggtaagcactatcctcttggccactgggcacttgccatgtggctagtcttagttg

SEQ ID NO: 104210 - DNA, 201 bp, Bos taurus; identical to SEQ ID NO: 22945

SEQ ID NO: 104211 - DNA, 201 bp, Bos taurus; identical to SEQ ID NO: 22946

SEQ ID NO: 104212 - DNA, 201 bp, Bos taurus; identical to SEQ ID NO: 22947

SEQ ID NO: 104213 - DNA, 201 bp, Bos taurus; identical to SEQ ID NO: 22948

SEQ ID NO: 104214 - DNA, 201 bp, Bos taurus; identical to SEQ ID NO: 22949

SEQ ID NO: 104215 - DNA, 201 bp, Bos taurus; identical to SEQ ID NO: 22950

SEQ ID NO: 104216 - DNA, 201 bp, Bos taurus; identical to SEQ ID NO: 22951

SEQ ID NO: 104217 - DNA, 201 bp, Bos taurus; identical to SEQ ID NO: 22952

SEQ ID NO: 104218 - DNA, 201 bp, Bos taurus; identical to SEQ ID NO: 22953

SEQ ID NO: 104219 - DNA, 201 bp, Bos taurus
aattagaccttcttttttgacttctggggccaaattggcaccagttacacagagcaaaaagtctgcttagaatcatggatcattcagctgctgaaaaatacggggaattaatctgggtaatttaaatacagaaatagtctacactctactgtttggggcttttcttcccacttaaattttcttatatagatacaacttaaa

SEQ ID NO: 104220 - DNA, 201 bp, Bos taurus
cgtatcagctcttgtcaagctaactttgtctcgtgctcagtaaatttaccttttggttaaaaacagggttcaggtacttccactgtttttacattttcccgtccaagtgacagccagtttagaaactgtagctatcctttagcagcaaacaatcctgtcaccgctgcatgtttcgttttccactccctgggtgctgctctt

SEQ ID NO: 104221 - DNA, 201 bp, Bos taurus; identical to SEQ ID NO: 22954

SEQ ID NO: 104222 - DNA, 201 bp, Bos taurus; identical to SEQ ID NO: 22955

SEQ ID NO: 104223 - DNA, 201 bp, Bos taurus
gtgaaggccagggaagcctggtgtactgcagtccaaggagtctcaaagactcagatacaactgagcgactaaacaataacaatctaaatgggaacaaactagatgtttttaaggccatccagtatgatgaagccatatcaatactgaattaatacatcaccaaagaaattatatatgcagaatatcaaactaataataatg

SEQ ID NO: 104224 - DNA, 201 bp, Bos taurus
gaatttcttcctgatatcctgacatgattaaaaatgcaattattctaatcaagttacaaaagtaagcatcatttgtggtgcccaccaagtcctagtaataacttttcctctgagaacatatcctcccaacctcccactattggtacatcccagaaaaataaaaaatagcaaaactagggttgtcctacagagttctgcttc

SEQ ID NO: 104225 - DNA, 201 bp, Bos taurus
ctggtgtgctgtggtccattaggtcatagggagtcagacacgactgagcaactgagttgactaagagagatagtcaatttcagttctagtgaaaggtaccaagtaagcctgggacattgggatatgacataaagtacagagcttattgtatattaccatggccatgtcaaaaagaaacaagaacaaagttccaccatctga

SEQ ID NO: 104226 - DNA, 201 bp, Bos taurus; identical to SEQ ID NO: 22956

SEQ ID NO: 104227 - DNA, 201 bp, Bos taurus
cagcaagttttaataatattaaatatgtgttggaatatgtgccatgttcagacacatctcagtctgaagcatcttgcatactgatgccaaaggagacttacttaaactttaaattttttatttcagttttttttttttttttggtttaccttaaaaaatagaattagtagacaaaatcaaccacttaatttacattttaga

SEQ ID NO: 104228 - DNA, 201 bp, Bos taurus
ttgtttacaacaataaactcaagatataaagggaaagctgagtgtcagaatcttttgggaaatgttttgacattgaactcttcaagcaggatggaatcttcccttttctcctcactcaaccccattatgcctctcccttcacctcaagatgatgtctttccctttcagtagctctgagaaggagtttgttaaaacttaatt

SEQ ID NO: 104229 - DNA, 201 bp, Bos taurus
gtgctgcagtccatggagttacaaagagttggacaaaactgagcaactgaacaacaacaaagagagtaagttggaaagttttccgtaaatcaagttcttctgttccctcctatctatgccaatactttcatttttattgcattattatatagaaaggttttgagatagcccacccccttttcctctacttatcttttttca

SEQ ID NO: 104230 - DNA, 201 bp, Bos taurus
aggatgctagtaaagttttgaccaactggaaatgaacatgtgtccctgtgttagaatgatcaataatcactcatgctttcagttatgtatttacctcaaggagcagaaatgatctttagcctagtgtcaaatattaagatgtaggcccatgaccttttccagtaaaatatgtacagttacttagaatatggttttgcacat

SEQ ID NO: 104231 - DNA, 201 bp, Bos taurus
gatgtcctcttataatctctacatatttgaagaaattaaaactagtgtaagatagtagcagaaatgttaacacagaaatactgtggagaagatttaatagtttgggtttatttgtttttagaaaatgatagatgatatagtcttcaagtataaattgtaaaattaaactgtgtgtattaattacaagtacttgttagatat

SEQ ID NO: 104232 - DNA, 201 bp, Bos taurus
agtagtcactggatgtcagcattgtttcactaaaatctgtttaccagtattatttttgactgggaaatttataattcttaagtataccaaaatcaccctacattgttttgatcttagagacaaagggaaaaagtcatgtgagcaaaggcaaaagcctcttaaaaaaaagtatgattgattatctttcagtagctaaatttc

SEQ ID NO: 104233 - DNA, 201 bp, Bos taurus
aaaaacaactgactgactctagggccctgggacctcgatttaagtcattaccaaagaggggtgtctccagctggtaagtgttggtgatgctttcagttcccgttctggccctgtttataaaagtttcactctttcgctattcctgctttgcatgtaaaggtgatgctaaaactgagcttggtttgtaactacagacagctt

SEQ ID NO: 104234 - DNA, 201 bp, Bos taurus; identical to SEQ ID NO: 22957

SEQ ID NO: 104235 - DNA, 201 bp, Bos taurus; identical to SEQ ID NO: 22958

SEQ ID NO: 104236 - DNA, 201 bp, Bos taurus; identical to SEQ ID NO: 22959

SEQ ID NO: 104237 - DNA, 201 bp, Bos taurus; identical to SEQ ID NO: 22960

SEQ ID NO: 104238 - DNA, 201 bp, Bos taurus; identical to SEQ ID NO: 22962

SEQ ID NO: 104239 - DNA, 201 bp, Bos taurus
catggactgtagtgcaccaggcacctctgtccatggaattctccaggcaaaagtatggagtgggtagctattctcttctccagaggatctttccaacccagggattgaaattaggtctccggcattacaggggaattctttactttctaggccatgagggaagcccaaagcctacatggttaactctgaatttagcatttt

SEQ ID NO: 104240 - DNA, 201 bp, Bos taurus; identical to SEQ ID NO: 22966

SEQ ID NO: 104241 - DNA, 201 bp, Bos taurus; identical to SEQ ID NO: 22967

SEQ ID NO: 104242 - DNA, 201 bp, Bos taurus; identical to SEQ ID NO: 22968

SEQ ID NO: 104243 - DNA, 201 bp, Bos taurus; identical to SEQ ID NO: 22969

SEQ ID NO: 104244 - DNA, 201 bp, Bos taurus; identical to SEQ ID NO: 22970

SEQ ID NO: 104245 - DNA, 201 bp, Bos taurus
gcttatcatatagttggaatctttcaaagtttgaaactttgttttgaaagcctcggggcatcattgctggatggtaagcaggagaaagataaaatcagctcgggcctttccccatgtctattgtctaggaggatggggaggcgggaattaccaacttgaagctcaaggagccctgatgagattccactccccagtctgtcc

SEQ ID NO: 104246 - DNA, 201 bp, Bos taurus
ctctattctgcctggctttggggaaccatatgggccctagggcgctctcatctgcttccccacacacccatgcgcaggtcctcctagggcctgagcacccagctactcctaggtttgaattcaggcatccagggctgcccatctccggtctgatgctgagacaggagagtggcttttgaggcctggagtctgggattaaat

SEQ ID NO: 104247 - DNA, 201 bp, Bos taurus
cttctggtggtatttctctctatgttgaattttcttagtgtctgaggttatttttagctgttacttcagtgagcttcaaggttgcacgacctgttttaaccgcccgtgtctctgattactccttgccatgacagcattttcgtgtgatgctcgggaaagaaatgagatcttttcttccaggcctttgactcaaagcagaac

SEQ ID NO: 104248 - DNA, 201 bp, Bos taurus; identical to SEQ ID NO: 22971

SEQ ID NO: 104249 - DNA, 201 bp, Bos taurus; identical to SEQ ID NO: 22972

SEQ ID NO: 104250 - DNA, 201 bp, Bos taurus
gatcagcagaatcattagattccagaaaatgcagaacctctgaggcctctgtattcttccattctgatgtcagactactggcagcccacgctgagctgccgtataagaaagtgcagctaggccactagaaagaagcagaggaaggaggggccagctggcattgctggggtttggaagctctgcactgcagattctgttaac

SEQ ID NO: 104251 - DNA, 201 bp, Bos taurus; identical to SEQ ID NO: 22973

SEQ ID NO: 104252 - DNA, 201 bp, Bos taurus
atgtgtttattggaaatagtttctaacaaagtattaaattatcattatgattctgaaaatagtccttatggagcaaacttttaatacctattattagcattattactatatgtactaacttgaaagttatgtacaattctttctcgaaaaactcaattttaagcaaatcaaactaacatatgccctctggtctcagttccc

SEQ ID NO: 104253 - DNA, 201 bp, Bos taurus; identical to SEQ ID NO: 22974

SEQ ID NO: 104254 - DNA, 201 bp, Bos taurus
aacagtgttggctacctgtagtaggaggcagctaatgagttttagcattattatttaatattacaattgtagtcatcactacaccctttcttctaaatctgttgtgttgtttcttcttttgttaactttgctaagaacttcccaaatatgattgtaagctgactgcagggcacgaagatgaggtgataactgctgctgctg

SEQ ID NO: 104255 - DNA, 201 bp, Bos taurus; identical to SEQ ID NO: 22975

SEQ ID NO: 104256 - DNA, 201 bp, Bos taurus; identical to SEQ ID NO: 22976

SEQ ID NO: 104257 - DNA, 201 bp, Bos taurus; identical to SEQ ID NO: 22977

SEQ ID NO: 104258 - DNA, 201 bp, Bos taurus
cttagtaaagagggattgaaaatattatatttttattaaattaaataaaattcttatcaatccatctaatgtaacaaacagaaattaaatagcaaagcatggattagtcacaccataagttcagtcatcaagtaagtcagttgtaggtgtaacatatttaacttaaaataatccttccaaagccgctgtgtatacaagccc

SEQ ID NO: 104259 - DNA, 201 bp, Bos taurus; identical to SEQ ID NO: 22978

SEQ ID NO: 104260 - DNA, 201 bp, Bos taurus
atatgagattcaatagaaaaaaattaatcaagaattatcatcaaatcattatctttggcagaaactaaagtttaaatttgcactattcacattattaggtgtaatcctaatttacttttaataatagcattaaaagcttagcaaaaacagttatcagactgaatggaaaaaatgcaacatacataacgttccaatacaagc

SEQ ID NO: 104261 - DNA, 201 bp, Bos taurus; identical to SEQ ID NO: 22979

SEQ ID NO: 104262 - DNA, 201 bp, Bos taurus; identical to SEQ ID NO: 22980

SEQ ID NO: 104263 - DNA, 201 bp, Bos taurus; identical to SEQ ID NO: 22981

SEQ ID NO: 104264 - DNA, 201 bp, Bos taurus; identical to SEQ ID NO: 22982

SEQ ID NO: 104265 - DNA, 201 bp, Bos taurus; identical to SEQ ID NO: 22983

SEQ ID NO: 104266 - DNA, 201 bp, Bos taurus; identical to SEQ ID NO: 22984

SEQ ID NO: 104267 - DNA, 201 bp, Bos taurus; identical to SEQ ID NO: 22985

SEQ ID NO: 104268 - DNA, 201 bp, Bos taurus; identical to SEQ ID NO: 22986

SEQ ID NO: 104269 - DNA, 201 bp, Bos taurus; identical to SEQ ID NO: 22987

SEQ ID NO: 104270 - DNA, 201 bp, Bos taurus; identical to SEQ ID NO: 22988

SEQ ID NO: 104271 - DNA, 201 bp, Bos taurus; identical to SEQ ID NO: 22989

SEQ ID NO: 104272 - DNA, 201 bp, Bos taurus
tcccctgggcagaggagcctggcaggctacagtccacagcgttgcaaagaatgggccatgactgagcaacttttactcactcacaggccagggtaggaaatgacacacagtgcatgaacgcacgtgccactggctacagttcagtcacatggctacggttcagtcacatggctacagttcagtcacatggccacacctgac

SEQ ID NO: 104273 - DNA, 201 bp, Bos taurus
tacagggaagaaaaaaagtaaatgtagtatgaaagagcacatagtggggaaaagagcttataaagaggagggtaatcgaagaatgcttcatgaggaaggtgggacttgaagtgaactttgaaaaatagatggaattaagatagcagaaaggacagcaagcatttgaggcaaaagtgaaagtgttagtcactcaatcatgtc

SEQ ID NO: 104274 - DNA, 201 bp, Bos taurus
actggaaccactttagcagttctaaaagagccagctctgatccatttccaagaatccacatctggtgatatatgggatgaggcaaactgatcaaagtacccgagtgccaacagtacagggaaaagcagagccaagtgaagagcaggctgtggcttgggggtaaaatgcagtgactaaaatgacaatggactgcacctcata

SEQ ID NO: 104275 - DNA, 201 bp, Bos taurus; identical to SEQ ID NO: 22990

SEQ ID NO: 104276 - DNA, 201 bp, Bos taurus; identical to SEQ ID NO: 22991

SEQ ID NO: 104277 - DNA, 201 bp, Bos taurus; identical to SEQ ID NO: 22993

SEQ ID NO: 104278 - DNA, 201 bp, Bos taurus
cacttctccacaatttcctactgcttattccttgccaaccatcagacctatgtaacatacatggcctgctcttgtggatgctagaattcaaggtgctgacggtcaaaggctttaagctttccattggatttgccacagatgaatcgtgtggtccattattttacagatatttaatgctatgcatgataaaattttactttt

SEQ ID NO: 104279 - DNA, 201 bp, Bos taurus; identical to SEQ ID NO: 22995

SEQ ID NO: 104280 - DNA, 201 bp, Bos taurus; identical to SEQ ID NO: 22997

SEQ ID NO: 104281 - DNA, 201 bp, Bos taurus; identical to SEQ ID NO: 22998

SEQ ID NO: 104282 - DNA, 201 bp, Bos taurus; identical to SEQ ID NO: 22999

SEQ ID NO: 104283 - DNA, 201 bp, Bos taurus; identical to SEQ ID NO: 23000

SEQ ID NO: 104284 - DNA, 201 bp, Bos taurus; identical to SEQ ID NO: 23001

SEQ ID NO: 104285 - DNA, 201 bp, Bos taurus; identical to SEQ ID NO: 23002

SEQ ID NO: 104286 - DNA, 201 bp, Bos taurus; identical to SEQ ID NO: 23003

SEQ ID NO: 104287 - DNA, 201 bp, Bos taurus; identical to SEQ ID NO: 23004

SEQ ID NO: 104288 - DNA, 201 bp, Bos taurus; identical to SEQ ID NO: 23005

SEQ ID NO: 104289 - DNA, 201 bp, Bos taurus; identical to SEQ ID NO: 23006

SEQ ID NO: 104290 - DNA, 201 bp, Bos taurus; identical to SEQ ID NO: 23007

SEQ ID NO: 104291 - DNA, 201 bp, Bos taurus; identical to SEQ ID NO: 23008

SEQ ID NO: 104292 - DNA, 201 bp, Bos taurus; identical to SEQ ID NO: 23009

SEQ ID NO: 104293 - DNA, 201 bp, Bos taurus; identical to SEQ ID NO: 23012

SEQ ID NO: 104294 - DNA, 201 bp, Bos taurus; identical to SEQ ID NO: 23015

SEQ ID NO: 104295 - DNA, 201 bp, Bos taurus
tcctgattgctggactggacacctggctcactgtaacagggggagggcagtgccctccagttatagcagctcaggaaccaactctctctgtgtcctctggtgcctcagcatctgcctccctttccactctttcccccttgaccttctcaagtgttctgcatatgacaaaacactcacacatcgaccaaccttgggaagatg

SEQ ID NO: 104296 - DNA, 201 bp, Bos taurus
atagagagttttgcttgattttgagcacacggattcacaccgtctgtctttgctgtaaagacatgtcttctgtgcagttttagttattctctgggtccaatccaggttcccaattcaaaactatcaacagtcaaaacttgaggttacatgatgagtgctctccgctacaccatgacacttggaattcctcttcctagtgcc

SEQ ID NO: 104297 - DNA, 201 bp, Bos taurus
taattatggcctggcactccataacagaaatgctgaaggctcttgaaggagacaacacttctcattcaagtctactgtcaggctctgtgagttggaagcacgcaccacaaggtttcaggaggaaggactcacgctgaggctgagcctccaatattctggccccctgatgtgaagcgaagagtccacttattggaaaagacc

SEQ ID NO: 104298 - DNA, 201 bp, Bos taurus
aaaggggcatctgatttctccctccctcgtggcctgaacaccagctcccatttatgtaactaacaatgtgagagggggctgcaggctgtctgggggtaataggcccagggacaggtatcaggaaatgaaggttccaatcccagctgattcactatgtgccactgagacaagagctcaaagactgagcctcatcttcaaaaa

SEQ ID NO: 104299 - DNA, 201 bp, Bos taurus
cacatgctgaacttcatccttatttcttgaaagcaggttggctctccagattctgtctctgcctgaagaacctccaacctcaccctgctgtgaaatacccgatcccacaggccagtgtgacctggggcaggttatgtaacccttctgggtctcagggttcggttctttgtaaaatggggtaatgatagtgaattaaatgag

SEQ ID NO: 104300 - DNA, 201 bp, Bos taurus
tgctggaccccacacagacaacacggaaagcctactagagggcagtgacgaggccaagctgccgttcataaagccttcctgtcacacacagggccaacacggtacaaggagcagtaggggactttctgccttcctggaaagataaactacacatatttgttagagagaagaatgtcacaactaaaggctgaaacatgctta

SEQ ID NO: 104301 - DNA, 201 bp, Bos taurus; identical to SEQ ID NO: 23017

SEQ ID NO: 104302 - DNA, 201 bp, Bos taurus; identical to SEQ ID NO: 23018

SEQ ID NO: 104303 - DNA, 201 bp, Bos taurus; identical to SEQ ID NO: 23019

SEQ ID NO: 104304 - DNA, 201 bp, Bos taurus
ccatttactgctgtattcctggtgccacatgcctagagctgtgcctagtgcttggtgcgcacagcgtcagtagttgggaagcaaaggagcgttgaacaaatgcagggaaccatccatgtgccatgcctggatgttgtctggcacacagtcaatatcagccagctgctttcagtatcattactgtcagcgcgtggctagatg

SEQ ID NO: 104305 - DNA, 201 bp, Bos taurus; identical to SEQ ID NO: 23020

SEQ ID NO: 104306 - DNA, 201 bp, Bos taurus
agtgatgtctctgttttttaatatgaaggtggaagaggggaggtaaacaggagggaaggattactgtggctgatgctgttctttcaacttcctgttaagcaggtgtcatggccttctccagaggtccacatcgtagttgagtggtacccaagttcttggctcatattagggcaaggaagcaacagattctattggcaaaat

SEQ ID NO: 104307 - DNA, 201 bp, Bos taurus
tctttgcatcctagacattttcttgaagaggggaagcagggaggtgttgaatgactagcagaagggcacacaggaagggcagtggcctggaaaattgttttcctactcactctctggtgaatggacactgattcccacctccccaccttggctgaccaaaccctgacacaaccctgcacaggcccagtgggctccatggat

SEQ ID NO: 104308 - DNA, 201 bp, Bos taurus; identical to SEQ ID NO: 23021

SEQ ID NO: 104309 - DNA, 201 bp, Bos taurus; identical to SEQ ID NO: 23023

SEQ ID NO: 104310 - DNA, 201 bp, Bos taurus; identical to SEQ ID NO: 23025

SEQ ID NO: 104311 - DNA, 201 bp, Bos taurus; identical to SEQ ID NO: 23026

SEQ ID NO: 104312 - DNA, 201 bp, Bos taurus
ttggccagatttagatatctaagtgaaagactcttcatcatcatcaatatcgatagcaatatcttcattatcccagctacaatttgataggtgtctccattattccaggacttcttcaaggccattttcatattaagttttaataattataataataaaaacattattattatatgatatttcaatttaaaatatccacat

SEQ ID NO: 104313 - DNA, 201 bp, Bos taurus
gggctgcagattcagacacaactgagcacacaaacacatacattagagttgatccatttcattgtattagctattaactcccttatctctccactattttcccccatttcttctaataacaataacataaaacgagtattaaaattttgtctgtaagaacagaataagctcacatgtgaaaaagttgagtttctaaagata

SEQ ID NO: 104314 - DNA, 201 bp, Bos taurus
aatcatttcatttcttgactgatctacgttatacctctggcttaataaccaggtctggctgcaacatgttgctaaaggttatgtctataatgaaatttttcttgtgaaatatcttgctgagactctgctctctgctacacagaagttaatatcaagtgtcttgaaatagtattactgtacatgatattttatttataatat

SEQ ID NO: 104315 - DNA, 201 bp, Bos taurus
taatatttttgcaaagaactgagcattctgtgttataatgtggtaaatttggaagtatgatgctcacagtcctcagggattgctgcttttgcttgtgtaggcttgggaatgtccatttgtgtctatttttcccaagtgtgtactccttttgtacattgaaatttttggctcattttctctatcttcagacagtgatctaac

SEQ ID NO: 104316 - DNA, 201 bp, Bos taurus
ttgtaaaatatacagagaagctgactatagagaactaagtaaaataaaatgaggcaacattaccaataggaaagagtcagcatagactcagaatgaggttcatatttctaagagaaaataaagggggaataaactttcaaacttaaagttagcttaattttctatctctacattaaatattcaaatatggacatatatgtt

SEQ ID NO: 104317 - DNA, 201 bp, Bos taurus; identical to SEQ ID NO: 23027

SEQ ID NO: 104318 - DNA, 201 bp, Bos taurus; identical to SEQ ID NO: 23028

SEQ ID NO: 104319 - DNA, 201 bp, Bos taurus; identical to SEQ ID NO: 23029

SEQ ID NO: 104320 - DNA, 201 bp, Bos taurus
aatgtaattaaaaaaaatgtaaatccaggagaaataataccaaaattacctatggtgtgttataaaacagaataatatgtagcagtcaaaatgaatctactagagccatatatttcaaaatgtaaccatattgctgtgctttgtggttcggtttgtgtccaactttttgtgactccatggactgcaccacaccaggctcct

SEQ ID NO: 104321 - DNA, 201 bp, Bos taurus; identical to SEQ ID NO: 23031

SEQ ID NO: 104322 - DNA, 201 bp, Bos taurus; identical to SEQ ID NO: 23032

SEQ ID NO: 104323 - DNA, 201 bp, Bos taurus; identical to SEQ ID NO: 23033

SEQ ID NO: 104324 - DNA, 201 bp, Bos taurus
ttcctgatcaccttggcctcctcctcaggtggtcccatgtgggattctgtgtctcctgtctctaggatccttgaatctaataaactttgtttttctcagcctctctttctgtctcttcttgtggccacccctgaatagccatctcataaaacgaaacacattcaatctattttgtgctttctctaagtcatggaccaaacc

SEQ ID NO: 104325 - DNA, 201 bp, Bos taurus
acttatgccttagagtcttgatgccagaagaagagaaaaagtaatttattaaaacagtcaacttttaaaaacagttttacaggaagggatgtagaatgtattctcagcattacctcagttgaaataaaggtaaggtattaaagtgaggaaattttggaagatattttcctgctcatttgtgggttggtgggtttttgtttt

SEQ ID NO: 104326 - DNA, 201 bp, Bos taurus
aatgcccccacccttttcaaaaaatcatatgaggtaatatgggtggaaaaatcagtgtacatgtgggaattagagagaggctggggagactaaattcccagtatatttgataaggcatcaagagttccactttcttaatttcctttcttctctgaaaccatatttggctttagtcctgaggacagaaactttctaattgca

SEQ ID NO: 104327 - DNA, 201 bp, Bos taurus
atgagtacatgagtataaaaaccctactcaaaatagcaattgcagtggtcagaggatcttgttttgcagaaattttctgtaaacttattaggatacccttctctgtgtctgtctttgcttcttgaaaccagctgattgcttcttcccctcaagtacaatacttcatgcatgtcttcaactcaggatctcaaggtattctgt

SEQ ID NO: 104328 - DNA, 201 bp, Bos taurus
ggaagatcccctggagaagggaacaagtacccacttcagtattctggcctggagaattccatgaactacagtccatggggtcgcaaagagtcggacacgactgaccgactttcatacttcatacatacataaagtcttagctgggcttcccagctggttcagtggtaaaaaatccatcagcaacgcaggagacacaggttc

SEQ ID NO: 104329 - DNA, 201 bp, Bos taurus; identical to SEQ ID NO: 23037

SEQ ID NO: 104330 - DNA, 201 bp, Bos taurus
gtgtcccctggtgtgtgccaatttcacatccaaataacagatccagtttaggaatctgttgaccattcactgtgcgtaaggcaccatcctaggactttacatgctattacctgatttaatccccacaatgaccctttaagtgttgatattgtgatttttttttttttttttaaggaactggtaactgagttacatttctaa

SEQ ID NO: 104331 - DNA, 201 bp, Bos taurus
aactgtagtctaattatatttagacatatgtaacaggaaaaatgaaaatttgtttttatgaatatttcagaaaagaaacaaaccaatgtttcttgtataaggcttgctgtaacaaaatctaactgcatgccacaccttgaatgataaatcagttcagttcagtcgctcagtagtgtccgactctttgcgaccccatgaatc

SEQ ID NO: 104332 - DNA, 201 bp, Bos taurus
tgtcacataaggataataatttctaatttcagcaatatacatgattaaatgaatgttctgcatccagaaacaatgagaaattgtagttttaaacacatatagaagatttcaacaatatcaacaagaaaagaatacatgtatatctgtgtgggagctaattttcaggattagaaataaagagagatctcaaagtcacaatgg

SEQ ID NO: 104333 - DNA, 201 bp, Bos taurus
accttaagttattttgccaagtccctgagacttagaccctgatcccacaggagatctgtgcatggttacacctcagccaccagtaccattaccacggtaactgtaccttcaccctgggacccaggtgctatagcagttccagggtgctttatcccaggatccatgctccacagactctcactgcttgtgtgccaggactgg

SEQ ID NO: 104334 - DNA, 201 bp, Bos taurus; identical to SEQ ID NO: 23038

SEQ ID NO: 104335 - DNA, 201 bp, Bos taurus; identical to SEQ ID NO: 23039

SEQ ID NO: 104336 - DNA, 201 bp, Bos taurus
tttaaattaatatgagaaattggagaaaacattccttgcaaaacagacatactgtaagaaagagttccaaaatctggataataattttaaaacttccaattttcatctgctaatgagatttgaatgacatatttatgaaatgagaaaaatctggaatcagaaaagatggtattttagctaaaactcataatttcaacatca

SEQ ID NO: 104337 - DNA, 201 bp, Bos taurus
gtataatatattcagggtatgacatttatttttctctttattattaaaaatacacattttattaagaatcacatattgtcttctctcaattttgaaaacaatgaaatagtttattcaaatgcagtttctccactattttcctatactctccactttaaaaaaaaaaacaaaacactttttatatgaatgtttggagttttt

SEQ ID NO: 104338 - DNA, 201 bp, Bos taurus; identical to SEQ ID NO: 23040

SEQ ID NO: 104339 - DNA, 201 bp, Bos taurus
catttgaggtggttctgttattcacatgcttgttatcaataatttaagtacttcctttctaagatgcaaactttgtgtagtgtataattcagaaaactctataatttaggtctataatgacacaatgctctgatttttaaaaatatataattttattttggaatttcactgggagaaattccggtactttaattattcatt

SEQ ID NO: 104340 - DNA, 201 bp, Bos taurus; identical to SEQ ID NO: 23041

SEQ ID NO: 104341 - DNA, 201 bp, Bos taurus
ttcttatattaggactcacagagacacagaagaaactgtcaaagaattccttatttatccatatttatgatcatggaatttcaaagattccaatgtcagttgcaatatattaaaatgacttaaacttgccacttttcaaaaatatgaggttcatttcctattaacatgttcaacttaaaaaaattactaaaaataagaatc

SEQ ID NO: 104342 - DNA, 201 bp, Bos taurus; identical to SEQ ID NO: 23042

SEQ ID NO: 104343 - DNA, 201 bp, Bos taurus; identical to SEQ ID NO: 23043

SEQ ID NO: 104344 - DNA, 201 bp, Bos taurus; identical to SEQ ID NO: 23044

SEQ ID NO: 104345 - DNA, 201 bp, Bos taurus; identical to SEQ ID NO: 23045

SEQ ID NO: 104346 - DNA, 201 bp, Bos taurus
cttccgggaggaaggtttctagggcacaaatgttaaggaggttctcataagggcagtacaagtggtggttcagccccctagtgtgaatgcaatcttaaatcttgccccctaagtgcctcactcacatcactctggtctctgcaatagcccatttttggaattacctcactgccttatcaattggcttccaaattttcagtg

SEQ ID NO: 104347 - DNA, 201 bp, Bos taurus
cttctcatcttttaattgtaaatagtgtataaaattttttcactgttgtcttttatttaggattaaccagttttttaaaaaatgtattctcaggaaacacatgtgtaccataatatgtctcagtacagggttatcagcatatgtggcattgtgatataagagtgaactttcatgttcaagcttatccctttaattacctta

SEQ ID NO: 104348 - DNA, 201 bp, Bos taurus; identical to SEQ ID NO: 23046

SEQ ID NO: 104349 - DNA, 201 bp, Bos taurus
ttaacaacaacaaaaaaaaagctatacacaatacatattacaacattacaaataaactactctgaacagtgtggggaaaagaagagaactgaaagaaaaacggctctaacgctattgcttgcaccttcctagtgttgacattcttgccgcttttcatttattttcttttccaaatttctgaaaagggattacaaagtaaat

SEQ ID NO: 104350 - DNA, 201 bp, Bos taurus; identical to SEQ ID NO: 23047

SEQ ID NO: 104351 - DNA, 201 bp, Bos taurus; identical to SEQ ID NO: 23048

SEQ ID NO: 104352 - DNA, 201 bp, Bos taurus; identical to SEQ ID NO: 23049

SEQ ID NO: 104353 - DNA, 201 bp, Bos taurus; identical to SEQ ID NO: 23050

SEQ ID NO: 104354 - DNA, 201 bp, Bos taurus
aaggcattgtccagtatcaaaagaaatttaaaaggcaattacttactggcaaaggtacttcctgactttagagacaaaacgttgacagaaccaatcaagacaaagtgttctggtagtgtaggccttcttattgtaaaaccaaaagactggtgttatcttttcccttcatggtttaggagttagcagctttatagataaggg

SEQ ID NO: 104355 - DNA, 201 bp, Bos taurus; identical to SEQ ID NO: 23051

SEQ ID NO: 104356 - DNA, 201 bp, Bos taurus; identical to SEQ ID NO: 23052

SEQ ID NO: 104357 - DNA, 201 bp, Bos taurus; identical to SEQ ID NO: 23053

SEQ ID NO: 104358 - DNA, 201 bp, Bos taurus; identical to SEQ ID NO: 23054

SEQ ID NO: 104359 - DNA, 201 bp, Bos taurus; identical to SEQ ID NO: 23056

SEQ ID NO: 104360 - DNA, 201 bp, Bos taurus; identical to SEQ ID NO: 23058

SEQ ID NO: 104361 - DNA, 201 bp, Bos taurus; identical to SEQ ID NO: 23060

SEQ ID NO: 104362 - DNA, 201 bp, Bos taurus; identical to SEQ ID NO: 23061

SEQ ID NO: 104363 - DNA, 201 bp, Bos taurus; identical to SEQ ID NO: 23062

SEQ ID NO: 104364 - DNA, 201 bp, Bos taurus; identical to SEQ ID NO: 23063

SEQ ID NO: 104365 - DNA, 201 bp, Bos taurus; identical to SEQ ID NO: 23064

SEQ ID NO: 104366 - DNA, 201 bp, Bos taurus; identical to SEQ ID NO: 23065

SEQ ID NO: 104367 - DNA, 201 bp, Bos taurus; identical to SEQ ID NO: 23067

SEQ ID NO: 104368 - DNA, 201 bp, Bos taurus; identical to SEQ ID NO: 23068

SEQ ID NO: 104369 - DNA, 201 bp, Bos taurus; identical to SEQ ID NO: 23069

SEQ ID NO: 104370 - DNA, 201 bp, Bos taurus
gaagacaaaggcctaaaatcaaagagttccagcagaaaggaaagaaatgaggcattttgccagctgaagccacgtacccaaagggaaaaggattgtaaggtgaaaggtgtttctcagagatgggcccaacgctgcttctgttttctcatagcctcaggctgggtctatcttttagggcattgtgacccagagtgactaact

SEQ ID NO: 104371 - DNA, 201 bp, Bos taurus; identical to SEQ ID NO: 23070

SEQ ID NO: 104372 - DNA, 201 bp, Bos taurus; identical to SEQ ID NO: 23071

SEQ ID NO: 104373 - DNA, 201 bp, Bos taurus; identical to SEQ ID NO: 23072

SEQ ID NO: 104374 - DNA, 201 bp, Bos taurus
gaagaatccaggaagtggggggtgcgacagtaatgggagacttgcctgaaatcaagacgactgagtatgaagacctgggacggacaggaggaaaaggagcgggaagaacgaggccaccacgcatggtagaaccacctcgtgatttcgtcagtgcagtaaaagctcagacagagggctctgcagcagggccgctgtgcctct

SEQ ID NO: 104375 - DNA, 201 bp, Bos taurus; identical to SEQ ID NO: 23073

SEQ ID NO: 104376 - DNA, 201 bp, Bos taurus; identical to SEQ ID NO: 23075

SEQ ID NO: 104377 - DNA, 201 bp, Bos taurus
gatagtaaatgaagtagaatcagagaaggaaggctcagcaaagggtctcactgcttctgctacagggagcccagtagcaccttttagatggcatttcataccttcatcttgctcttttaacacaactacgatagattacataaatcaattatttttgtttgttgtgggctcctggaatcaaagtaaactgaatgataatta

SEQ ID NO: 104378 - DNA, 201 bp, Bos taurus; identical to SEQ ID NO: 23077

SEQ ID NO: 104379 - DNA, 201 bp, Bos taurus; identical to SEQ ID NO: 23078

SEQ ID NO: 104380 - DNA, 201 bp, Bos taurus; identical to SEQ ID NO: 23080

SEQ ID NO: 104381 - DNA, 201 bp, Bos taurus; identical to SEQ ID NO: 23081

SEQ ID NO: 104382 - DNA, 201 bp, Bos taurus; identical to SEQ ID NO: 23082

SEQ ID NO: 104383 - DNA, 201 bp, Bos taurus; identical to SEQ ID NO: 23083

SEQ ID NO: 104384 - DNA, 201 bp, Bos taurus; identical to SEQ ID NO: 23084

SEQ ID NO: 104385 - DNA, 201 bp, Bos taurus; identical to SEQ ID NO: 23085

SEQ ID NO: 104386 - DNA, 201 bp, Bos taurus; identical to SEQ ID NO: 23086

SEQ ID NO: 104387 - DNA, 201 bp, Bos taurus; identical to SEQ ID NO: 23087

SEQ ID NO: 104388 - DNA, 201 bp, Bos taurus; identical to SEQ ID NO: 23088

SEQ ID NO: 104389 - DNA, 201 bp, Bos taurus; identical to SEQ ID NO: 23089

SEQ ID NO: 104390 - DNA, 201 bp, Bos taurus; identical to SEQ ID NO: 23090

SEQ ID NO: 104391 - DNA, 201 bp, Bos taurus; identical to SEQ ID NO: 23091

SEQ ID NO: 104392 - DNA, 201 bp, Bos taurus; identical to SEQ ID NO: 23092

SEQ ID NO: 104393 - DNA, 201 bp, Bos taurus; identical to SEQ ID NO: 23093

SEQ ID NO: 104394 - DNA, 201 bp, Bos taurus; identical to SEQ ID NO: 23094

SEQ ID NO: 104395 - DNA, 201 bp, Bos taurus; identical to SEQ ID NO: 23095

SEQ ID NO: 104396 - DNA, 201 bp, Bos taurus; identical to SEQ ID NO: 23096

SEQ ID NO: 104397 - DNA, 201 bp, Bos taurus; identical to SEQ ID NO: 23097

SEQ ID NO: 104398 - DNA, 201 bp, Bos taurus; identical to SEQ ID NO: 23099

SEQ ID NO: 104399 - DNA, 201 bp, Bos taurus; identical to SEQ ID NO: 23100

SEQ ID NO: 104400 - DNA, 201 bp, Bos taurus; identical to SEQ ID NO: 23101

SEQ ID NO: 104401 - DNA, 201 bp, Bos taurus; identical to SEQ ID NO: 23102

SEQ ID NO: 104402 - DNA, 201 bp, Bos taurus; identical to SEQ ID NO: 23103

SEQ ID NO: 104403 - DNA, 201 bp, Bos taurus; identical to SEQ ID NO: 23104

SEQ ID NO: 104404 - DNA, 201 bp, Bos taurus; identical to SEQ ID NO: 23105

SEQ ID NO: 104405 - DNA, 201 bp, Bos taurus; identical to SEQ ID NO: 23106

SEQ ID NO: 104406 - DNA, 201 bp, Bos taurus; identical to SEQ ID NO: 23107

SEQ ID NO: 104407 - DNA, 201 bp, Bos taurus; identical to SEQ ID NO: 23108

SEQ ID NO: 104408 - DNA, 201 bp, Bos taurus; identical to SEQ ID NO: 23109

SEQ ID NO: 104409 - DNA, 201 bp, Bos taurus; identical to SEQ ID NO: 23110

SEQ ID NO: 104410 - DNA, 201 bp, Bos taurus; identical to SEQ ID NO: 23111

SEQ ID NO: 104411 - DNA, 201 bp, Bos taurus; identical to SEQ ID NO: 23112

SEQ ID NO: 104412 - DNA, 201 bp, Bos taurus; identical to SEQ ID NO: 23113

SEQ ID NO: 104413 - DNA, 201 bp, Bos taurus; identical to SEQ ID NO: 23114

SEQ ID NO: 104414 - DNA, 201 bp, Bos taurus; identical to SEQ ID NO: 23115

SEQ ID NO: 104415 - DNA, 201 bp, Bos taurus; identical to SEQ ID NO: 23116

SEQ ID NO: 104416 - DNA, 201 bp, Bos taurus; identical to SEQ ID NO: 23117

SEQ ID NO: 104417 - DNA, 201 bp, Bos taurus; identical to SEQ ID NO: 23118

SEQ ID NO: 104418 - DNA, 201 bp, Bos taurus; identical to SEQ ID NO: 23119

SEQ ID NO: 104419 - DNA, 201 bp, Bos taurus; identical to SEQ ID NO: 23120

SEQ ID NO: 104420 - DNA, 201 bp, Bos taurus; identical to SEQ ID NO: 23121

SEQ ID NO: 104421 - DNA, 201 bp, Bos taurus; identical to SEQ ID NO: 23122

SEQ ID NO: 104422 - DNA, 201 bp, Bos taurus; identical to SEQ ID NO: 23123

SEQ ID NO: 104423 - DNA, 201 bp, Bos taurus; identical to SEQ ID NO: 23124

SEQ ID NO: 104424 - DNA, 201 bp, Bos taurus; identical to SEQ ID NO: 23125

SEQ ID NO: 104425 - DNA, 201 bp, Bos taurus; identical to SEQ ID NO: 23126

SEQ ID NO: 104426 - DNA, 201 bp, Bos taurus; identical to SEQ ID NO: 23127

SEQ ID NO: 104427 - DNA, 201 bp, Bos taurus; identical to SEQ ID NO: 23129

SEQ ID NO: 104428 - DNA, 201 bp, Bos taurus; identical to SEQ ID NO: 23130

SEQ ID NO: 104429 - DNA, 201 bp, Bos taurus; identical to SEQ ID NO: 23131

SEQ ID NO: 104430 - DNA, 201 bp, Bos taurus; identical to SEQ ID NO: 23132

SEQ ID NO: 104431 - DNA, 201 bp, Bos taurus; identical to SEQ ID NO: 23133

SEQ ID NO: 104432 - DNA, 201 bp, Bos taurus; identical to SEQ ID NO: 23134

SEQ ID NO: 104433 - DNA, 201 bp, Bos taurus; identical to SEQ ID NO: 23135

SEQ ID NO: 104434 - DNA, 201 bp, Bos taurus; identical to SEQ ID NO: 23136

SEQ ID NO: 104435 - DNA, 201 bp, Bos taurus; identical to SEQ ID NO: 23137

SEQ ID NO: 104436 - DNA, 201 bp, Bos taurus; identical to SEQ ID NO: 23138

SEQ ID NO: 104437 - DNA, 201 bp, Bos taurus; identical to SEQ ID NO: 23139

SEQ ID NO: 104438 - DNA, 201 bp, Bos taurus; identical to SEQ ID NO: 23140

SEQ ID NO: 104439 - DNA, 201 bp, Bos taurus; identical to SEQ ID NO: 23141

SEQ ID NO: 104440 - DNA, 201 bp, Bos taurus; identical to SEQ ID NO: 23142

SEQ ID NO: 104441 - DNA, 201 bp, Bos taurus; identical to SEQ ID NO: 23143

SEQ ID NO: 104442 - DNA, 201 bp, Bos taurus; identical to SEQ ID NO: 23144

SEQ ID NO: 104443 - DNA, 201 bp, Bos taurus; identical to SEQ ID NO: 23145

SEQ ID NO: 104444 - DNA, 201 bp, Bos taurus; identical to SEQ ID NO: 23146

SEQ ID NO: 104445 - DNA, 201 bp, Bos taurus; identical to SEQ ID NO: 23147

SEQ ID NO: 104446 - DNA, 201 bp, Bos taurus; identical to SEQ ID NO: 23148

SEQ ID NO: 104447 - DNA, 201 bp, Bos taurus; identical to SEQ ID NO: 23149

SEQ ID NO: 104448 - DNA, 201 bp, Bos taurus; identical to SEQ ID NO: 23150

SEQ ID NO: 104449 - DNA, 201 bp, Bos taurus; identical to SEQ ID NO: 23151

SEQ ID NO: 104450 - DNA, 201 bp, Bos taurus; identical to SEQ ID NO: 23152

SEQ ID NO: 104451 - DNA, 201 bp, Bos taurus; identical to SEQ ID NO: 23153

SEQ ID NO: 104452 - DNA, 201 bp, Bos taurus; identical to SEQ ID NO: 23154

SEQ ID NO: 104453 - DNA, 201 bp, Bos taurus; identical to SEQ ID NO: 23155

SEQ ID NO: 104454 - DNA, 201 bp, Bos taurus; identical to SEQ ID NO: 23156

SEQ ID NO: 104455 - DNA, 201 bp, Bos taurus; identical to SEQ ID NO: 23157

SEQ ID NO: 104456 - DNA, 201 bp, Bos taurus; identical to SEQ ID NO: 23158

SEQ ID NO: 104457 - DNA, 201 bp, Bos taurus; identical to SEQ ID NO: 23159

SEQ ID NO: 104458 - DNA, 201 bp, Bos taurus; identical to SEQ ID NO: 23160

SEQ ID NO: 104459 - DNA, 201 bp, Bos taurus; identical to SEQ ID NO: 23161

SEQ ID NO: 104460 - DNA, 201 bp, Bos taurus; identical to SEQ ID NO: 23162

SEQ ID NO: 104461 - DNA, 201 bp, Bos taurus; identical to SEQ ID NO: 23163

SEQ ID NO: 104462 - DNA, 201 bp, Bos taurus; identical to SEQ ID NO: 23167

SEQ ID NO: 104463 - DNA, 201 bp, Bos taurus; identical to SEQ ID NO: 23168

SEQ ID NO: 104464 - DNA, 201 bp, Bos taurus; identical to SEQ ID NO: 23169

SEQ ID NO: 104465 - DNA, 201 bp, Bos taurus
ttctccagtaaaagtcctcagcattgttggatgtgctctgggtcccagaatggaaattattgttccttcttggtatttaaaatacacacaccacacaaacggaaatcaagaccctagcacttctctggcacctcttgctccttttaactagagctctttatgatggagacacactattggcacctccagccttgttaacag

SEQ ID NO: 104466 - DNA, 201 bp, Bos taurus; identical to SEQ ID NO: 23170

SEQ ID NO: 104467 - DNA, 201 bp, Bos taurus
tctttctccgtggctatacatggcgcacatggattggacaggcaccattaagcagccatgccctgggcagttgtattcctagtaattgtcgtgtcactgtccacagcaaggttcactttcctctggatcctgacagagattggctctcataacaaaaaggggagttaagcctttttaaccctgcatctcaaaagagcagag

SEQ ID NO: 104468 - DNA, 201 bp, Bos taurus
taaaggtcatttagatcaagagcctcaacttatgactacatctaaaaaataaaaaaatggcttgactgatatcccactctcagacaatggtagagctgatgattgtctataagtctatgcctccatcatcgcacatacagaccacggcacgtagcatagggcactactataaatattcaaaacaaattttaaggaaagaat

SEQ ID NO: 104469 - DNA, 201 bp, Bos taurus
gggagtcttcagggccctctgtgcccacactgatgcctatcgggaagatgaatgaagagtagtggacaggacttacctgggacgggacccactgccagccaacctgctccaaggccaaaaacagtgaggaccacttcagaatgcaggccttcttgccttgccagagcttttatttcacagagcatcccacagtgcaattcc

SEQ ID NO: 104470 - DNA, 201 bp, Bos taurus
caaacttaattaccgcctttactactaagggctctgtatttgccgattttcctactcactgaaatttatttgcaacccacaaatgcacccccaaatcaatgttctcagggcctcttgggatcactggtggacatgcccaatgtggggaaaagccaagccctcttctcaatccccctgctgacactcacattcccagcaaaa

SEQ ID NO: 104471 - DNA, 201 bp, Bos taurus
ctgcgaactcaccccaaggatggggtccttgcctgcccaacactaccacccagaaatagctcccagcccctcatgccagggccggggctgcacttactgctcaggattcctaaaagtgccttgacatctggaaaactgccttctgctcccttactttaagaagagaggcttaggccatcccaagatcagattcaatctaac

SEQ ID NO: 104472 - DNA, 201 bp, Bos taurus
tgctttaaagaaagaaaccaacacaaagctttgctcagctacttatgaatcaacccagttctgacttgcattattgatttgttgcgtgaccttgaggtccttcagcctaagtttttgcttctataacatggggagaaatacaagcataccttggagatgctgagggtccctcaccacaccaccacaataaagccaatatca

SEQ ID NO: 104473 - DNA, 201 bp, Bos taurus; identical to SEQ ID NO: 23175

SEQ ID NO: 104474 - DNA, 201 bp, Bos taurus; identical to SEQ ID NO: 23176

SEQ ID NO: 104475 - DNA, 201 bp, Bos taurus; identical to SEQ ID NO: 23178

SEQ ID NO: 104476 - DNA, 201 bp, Bos taurus; identical to SEQ ID NO: 23179

SEQ ID NO: 104477 - DNA, 201 bp, Bos taurus; identical to SEQ ID NO: 23180

SEQ ID NO: 104478 - DNA, 201 bp, Bos taurus; identical to SEQ ID NO: 23181

SEQ ID NO: 104479 - DNA, 201 bp, Bos taurus
actctacaggctgggttcatggtaagttgtgtccatagagaaatatgaccattcccctaaggcaggtttaccctgcaggcatgactggagccaatcgctccgtctggcccctcagaagaacttagatcccttagcccagagccaaatgggaaggttttgtgcagatgatattccagggagaaaacttcatttgtccatctt

SEQ ID NO: 104480 - DNA, 201 bp, Bos taurus
gcctttgtgaacctgaaacccaccacttaattctgagagccttggaagacagtagctcaaccatttgcacataggaagcaaagccaggaaaatcacatcaggccacttcgttgcttagtcccttacacttggaataccacctaaacttctgactggggcctgcgagacccagaatagccagccgcttcctcctgtcctgcc

SEQ ID NO: 104481 - DNA, 201 bp, Bos taurus; identical to SEQ ID NO: 23182

SEQ ID NO: 104482 - DNA, 201 bp, Bos taurus; identical to SEQ ID NO: 23183

SEQ ID NO: 104483 - DNA, 201 bp, Bos taurus; identical to SEQ ID NO: 23184

SEQ ID NO: 104484 - DNA, 201 bp, Bos taurus
aattgtcgtagggccatgtccagacattcgagtatatagctgtttttaatgacatcatttctgttcatggggtctggaaggttattaatgtgagagagagggggagcgagtataagcactggatcagagatgtgtcctgtgtgactttctgtgggattgttctgagagttgaagaaaatttatgtaaggtgtctagcacag

SEQ ID NO: 104485 - DNA, 201 bp, Bos taurus; identical to SEQ ID NO: 23185

SEQ ID NO: 104486 - DNA, 201 bp, Bos taurus; identical to SEQ ID NO: 23186

SEQ ID NO: 104487 - DNA, 201 bp, Bos taurus
ttgaagaccaggtagaggggctggggcagcagaggcacctggccagacacaaggcccctcacccgggcctgcactgggcaggccactgcccattcactgcttctccatttctgggcaacttcctgagaccagcatcgggctccgagagtccatctccaacacttctggccaccagttctgaccaccaggcctctctcaacc

SEQ ID NO: 104488 - DNA, 201 bp, Bos taurus; identical to SEQ ID NO: 23189

SEQ ID NO: 104489 - DNA, 201 bp, Bos taurus; identical to SEQ ID NO: 23191

SEQ ID NO: 104490 - DNA, 201 bp, Bos taurus; identical to SEQ ID NO: 23197

SEQ ID NO: 104491 - DNA, 201 bp, Bos taurus
ctcaggaagggaggtagtagtaggaggtcaaagttgcttatggtttttatacaggatgaaaggatttgacttcagcctccacatttatttcccttttatttcttttcatttctactattttttggtagttttattatatatattatgtatatattatatatattatgtgtatatagtaataaaagtctaatttataaatat

SEQ ID NO: 104492 - DNA, 201 bp, Bos taurus; identical to SEQ ID NO: 23203

SEQ ID NO: 104493 - DNA, 201 bp, Bos taurus; identical to SEQ ID NO: 23205

SEQ ID NO: 104494 - DNA, 201 bp, Bos taurus; identical to SEQ ID NO: 23206

SEQ ID NO: 104495 - DNA, 201 bp, Bos taurus; identical to SEQ ID NO: 23207

SEQ ID NO: 104496 - DNA, 201 bp, Bos taurus; identical to SEQ ID NO: 23208

SEQ ID NO: 104497 - DNA, 201 bp, Bos taurus; identical to SEQ ID NO: 23209

SEQ ID NO: 104498 - DNA, 201 bp, Bos taurus; identical to SEQ ID NO: 23210

SEQ ID NO: 104499 - DNA, 201 bp, Bos taurus; identical to SEQ ID NO: 63750

SEQ ID NO: 104500 - DNA, 201 bp, Bos taurus; identical to SEQ ID NO: 23211

SEQ ID NO: 104501 - DNA, 201 bp, Bos taurus; identical to SEQ ID NO: 23212

SEQ ID NO: 104502 - DNA, 201 bp, Bos taurus; identical to SEQ ID NO: 23215

SEQ ID NO: 104503 - DNA, 201 bp, Bos taurus; identical to SEQ ID NO: 23216

SEQ ID NO: 104504 - DNA, 201 bp, Bos taurus; identical to SEQ ID NO: 23217

SEQ ID NO: 104505 - DNA, 201 bp, Bos taurus; identical to SEQ ID NO: 23220

SEQ ID NO: 104506 - DNA, 201 bp, Bos taurus; identical to SEQ ID NO: 23221

SEQ ID NO: 104507 - DNA, 201 bp, Bos taurus; identical to SEQ ID NO: 23223

SEQ ID NO: 104508 - DNA, 201 bp, Bos taurus; identical to SEQ ID NO: 23224

SEQ ID NO: 104509 - DNA, 201 bp, Bos taurus; identical to SEQ ID NO: 23225

SEQ ID NO: 104510 - DNA, 201 bp, Bos taurus; identical to SEQ ID NO: 23226

SEQ ID NO: 104511 - DNA, 201 bp, Bos taurus; identical to SEQ ID NO: 23228

SEQ ID NO: 104512 - DNA, 201 bp, Bos taurus; identical to SEQ ID NO: 23229

SEQ ID NO: 104513 - DNA, 201 bp, Bos taurus; identical to SEQ ID NO: 23230

SEQ ID NO: 104514 - DNA, 201 bp, Bos taurus; identical to SEQ ID NO: 23234

SEQ ID NO: 104515 - DNA, 201 bp, Bos taurus; identical to SEQ ID NO: 23235

SEQ ID NO: 104516 - DNA, 201 bp, Bos taurus; identical to SEQ ID NO: 23236

SEQ ID NO: 104517 - DNA, 201 bp, Bos taurus; identical to SEQ ID NO: 23237

SEQ ID NO: 104518 - DNA, 201 bp, Bos taurus; identical to SEQ ID NO: 23238

SEQ ID NO: 104519 - DNA, 201 bp, Bos taurus; identical to SEQ ID NO: 23241

SEQ ID NO: 104520 - DNA, 201 bp, Bos taurus; identical to SEQ ID NO: 23242

SEQ ID NO: 104521 - DNA, 201 bp, Bos taurus; identical to SEQ ID NO: 23243

SEQ ID NO: 104522 - DNA, 201 bp, Bos taurus; identical to SEQ ID NO: 23244

SEQ ID NO: 104523 - DNA, 201 bp, Bos taurus; identical to SEQ ID NO: 23245

SEQ ID NO: 104524 - DNA, 201 bp, Bos taurus; identical to SEQ ID NO: 23246

SEQ ID NO: 104525 - DNA, 201 bp, Bos taurus; identical to SEQ ID NO: 23249

SEQ ID NO: 104526 - DNA, 201 bp, Bos taurus; identical to SEQ ID NO: 23250

SEQ ID NO: 104527 - DNA, 201 bp, Bos taurus; identical to SEQ ID NO: 23251

SEQ ID NO: 104528 - DNA, 201 bp, Bos taurus; identical to SEQ ID NO: 23253

SEQ ID NO: 104529 - DNA, 201 bp, Bos taurus; identical to SEQ ID NO: 23254

SEQ ID NO: 104530 - DNA, 201 bp, Bos taurus; identical to SEQ ID NO: 23255

SEQ ID NO: 104531 - DNA, 201 bp, Bos taurus; identical to SEQ ID NO: 23256

SEQ ID NO: 104532 - DNA, 201 bp, Bos taurus; identical to SEQ ID NO: 23257

SEQ ID NO: 104533 - DNA, 201 bp, Bos taurus; identical to SEQ ID NO: 23258

SEQ ID NO: 104534 - DNA, 201 bp, Bos taurus; identical to SEQ ID NO: 23260

SEQ ID NO: 104535 - DNA, 201 bp, Bos taurus; identical to SEQ ID NO: 23261

SEQ ID NO: 104536 - DNA, 201 bp, Bos taurus; identical to SEQ ID NO: 23262

SEQ ID NO: 104537 - DNA, 201 bp, Bos taurus; identical to SEQ ID NO: 23263

SEQ ID NO: 104538 - DNA, 201 bp, Bos taurus; identical to SEQ ID NO: 23264

SEQ ID NO: 104539 - DNA, 201 bp, Bos taurus; identical to SEQ ID NO: 23265

SEQ ID NO: 104540 - DNA, 201 bp, Bos taurus; identical to SEQ ID NO: 23266

SEQ ID NO: 104541 - DNA, 201 bp, Bos taurus; identical to SEQ ID NO: 23267

SEQ ID NO: 104542 - DNA, 201 bp, Bos taurus; identical to SEQ ID NO: 23268

SEQ ID NO: 104543 - DNA, 201 bp, Bos taurus; identical to SEQ ID NO: 23269

SEQ ID NO: 104544 - DNA, 201 bp, Bos taurus; identical to SEQ ID NO: 23270

SEQ ID NO: 104545 - DNA, 201 bp, Bos taurus; identical to SEQ ID NO: 23271

SEQ ID NO: 104546 - DNA, 201 bp, Bos taurus; identical to SEQ ID NO: 23272

SEQ ID NO: 104547 - DNA, 201 bp, Bos taurus; identical to SEQ ID NO: 23273

SEQ ID NO: 104548 - DNA, 201 bp, Bos taurus; identical to SEQ ID NO: 23274

SEQ ID NO: 104549 - DNA, 201 bp, Bos taurus; identical to SEQ ID NO: 23275

SEQ ID NO: 104550 - DNA, 201 bp, Bos taurus; identical to SEQ ID NO: 23276

SEQ ID NO: 104551 - DNA, 201 bp, Bos taurus; identical to SEQ ID NO: 23277

SEQ ID NO: 104552 - DNA, 201 bp, Bos taurus; identical to SEQ ID NO: 23278

SEQ ID NO: 104553 - DNA, 201 bp, Bos taurus; identical to SEQ ID NO: 23279

SEQ ID NO: 104554 - DNA, 201 bp, Bos taurus; identical to SEQ ID NO: 23280

SEQ ID NO: 104555 - DNA, 201 bp, Bos taurus; identical to SEQ ID NO: 23281

SEQ ID NO: 104556 - DNA, 201 bp, Bos taurus; identical to SEQ ID NO: 23282

SEQ ID NO: 104557 - DNA, 201 bp, Bos taurus; identical to SEQ ID NO: 23283

SEQ ID NO: 104558 - DNA, 201 bp, Bos taurus; identical to SEQ ID NO: 23284

SEQ ID NO: 104559 - DNA, 201 bp, Bos taurus; identical to SEQ ID NO: 23285

SEQ ID NO: 104560 - DNA, 201 bp, Bos taurus; identical to SEQ ID NO: 23286

SEQ ID NO: 104561 - DNA, 201 bp, Bos taurus; identical to SEQ ID NO: 23287

SEQ ID NO: 104562 - DNA, 201 bp, Bos taurus; identical to SEQ ID NO: 23288

SEQ ID NO: 104563 - DNA, 201 bp, Bos taurus; identical to SEQ ID NO: 23289

SEQ ID NO: 104564 - DNA, 201 bp, Bos taurus; identical to SEQ ID NO: 23290

SEQ ID NO: 104565 - DNA, 201 bp, Bos taurus; identical to SEQ ID NO: 23291

SEQ ID NO: 104566 - DNA, 201 bp, Bos taurus; identical to SEQ ID NO: 23294

SEQ ID NO: 104567 - DNA, 201 bp, Bos taurus; identical to SEQ ID NO: 23297

SEQ ID NO: 104568 - DNA, 201 bp, Bos taurus; identical to SEQ ID NO: 23298

SEQ ID NO: 104569 - DNA, 201 bp, Bos taurus; identical to SEQ ID NO: 23301

SEQ ID NO: 104570 - DNA, 201 bp, Bos taurus
ccggggtcggcatcgtctgagggcctgacgggaagcttttgctcgctggggtgtgcgtgtcacagacactcacctcaagttagcacactgccagctccacgagcaggtgaggggccaggccgcccctcccgtgacgttccccgtcgagaaagccccgtgtaactggatgactgaccacttaggggaccctgtctctctctt

SEQ ID NO: 104571 - DNA, 201 bp, Bos taurus
attcactttctctatttttgtccactggagggaagggctatgcaagcaaaatgacttaagccctacagtctaactgagttgggtgatgtagctctcttagcgaacactagccctacccagtgggcacaaaggaatgaacttgtaaagtggtactgaaatttcagaggatatagtggatattccgtatcgaactgagctcaa

SEQ ID NO: 104572 - DNA, 201 bp, Bos taurus
agaataaccagaaagtgtgctgactgaggtctaatcactaaattttgggtaaaagcttgaaaatggcctgttgatagtacataataaccagaacgattatcctctcccttgccgagaattctaattaatggggaaatgcaaaagaaaagggtgagctgagaacagaaggtctcagccatcaagagcttgactctcccagca

SEQ ID NO: 104573 - DNA, 201 bp, Bos taurus
tgtttctgaccatccagcagattaacacagacttgctcagagggtcactggcagaggtcttgagagcagcaagagccacttttccaggctctgcttatgtcgtatttttcctgtctcactggcctgagggagtcacatgcttggcccagagtcagcatattagtctgctcaggctgcctccacaaagcaccacagactggg

SEQ ID NO: 104574 - DNA, 201 bp, Bos taurus
cagtgacttgacaatttcatgccatttcaaaagggccaagtttatattcagacacaggaaaactctggagtgttacctgcatatatgttaatcagccgccgcctcgtgaagagcccacagtggccggcgcgctacggaaccagggcttcctaaggtgtggccagtgcctcctcaccgagctcccaggagcagtgacctctg

SEQ ID NO: 104575 - DNA, 201 bp, Bos taurus; identical to SEQ ID NO: 23302

SEQ ID NO: 104576 - DNA, 201 bp, Bos taurus; identical to SEQ ID NO: 23303

SEQ ID NO: 104577 - DNA, 201 bp, Bos taurus
gttgacactagatctaggacccacaggcctaaaactaggtaactccaaagctggccacacccaccagtggccagcagcctccacataaagcagggcctcaaaactaacctgaccaggggttagccaagcatatcagatcaccaagagtaatcagcctgctacaatagaaggacccacacagcttacacagggggagaccct

SEQ ID NO: 104578 - DNA, 201 bp, Bos taurus
atatgagaaataacatattaatcattcaacagttgctgcttaacccatactaagtaatttacggcaaaggtgaaagaggagaaatgactcaaaactgcaactgtaacctacaataaatattgagcaaatattacattctgtccttttcatcctttctttagtaggctatactctctatggtagctagttttggtggtaaat

SEQ ID NO: 104579 - DNA, 201 bp, Bos taurus
aaattgtaaagcatatgaagcttatatggcttttttctatttacattctgaatagaataatattcttaattttatagaacttatgtctctatagcttatacactagtgtgctagatttttctaaataaaacatttccttggctaataaaactacaagttgtattataaagctttagtgaaagtgactttaatttagaatta

SEQ ID NO: 104580 - DNA, 201 bp, Bos taurus; identical to SEQ ID NO: 23304

SEQ ID NO: 104581 - DNA, 201 bp, Bos taurus; identical to SEQ ID NO: 23305

SEQ ID NO: 104582 - DNA, 201 bp, Bos taurus; identical to SEQ ID NO: 23307

SEQ ID NO: 104583 - DNA, 201 bp, Bos taurus
aaaaatagggaatgacaacttagaagatggtattaatgacttgatattaatgatggtattaattgctttagcaaatcaataaggtggaccttgttttgagctgatatgacatgcactagtaataatagaggatactgtgcatattttttgtttgtttagtcgctaagttgtatccaactctgtgaccacatgggctgtagc

SEQ ID NO: 104584 - DNA, 201 bp, Bos taurus
taattgatatgttccaagaagacagacagaatgagctgagaataaaaatgagaataccattggcagtcactcatttttaatgataagaagtttaggctggatgttttcatgaaaaacaaataacatggctattttggatcagtcagtttcttaaggatgagtatatctgcatttgagtgcatctgtgcatgtgtatatata

SEQ ID NO: 104585 - DNA, 201 bp, Bos taurus; identical to SEQ ID NO: 23308

SEQ ID NO: 104586 - DNA, 201 bp, Bos taurus; identical to SEQ ID NO: 23309

SEQ ID NO: 104587 - DNA, 201 bp, Bos taurus; identical to SEQ ID NO: 23310

SEQ ID NO: 104588 - DNA, 201 bp, Bos taurus; identical to SEQ ID NO: 23311

SEQ ID NO: 104589 - DNA, 201 bp, Bos taurus; identical to SEQ ID NO: 23313

SEQ ID NO: 104590 - DNA, 201 bp, Bos taurus; identical to SEQ ID NO: 23314

SEQ ID NO: 104591 - DNA, 201 bp, Bos taurus; identical to SEQ ID NO: 23317

SEQ ID NO: 104592 - DNA, 201 bp, Bos taurus; identical to SEQ ID NO: 23318

SEQ ID NO: 104593 - DNA, 201 bp, Bos taurus; identical to SEQ ID NO: 23319

SEQ ID NO: 104594 - DNA, 201 bp, Bos taurus; identical to SEQ ID NO: 23320

SEQ ID NO: 104595 - DNA, 201 bp, Bos taurus; identical to SEQ ID NO: 23321

SEQ ID NO: 104596 - DNA, 201 bp, Bos taurus
ccgactccctcaccatcatcaaaggaaactgaagacctaagtaaatgaacaaatatttcatgttcctggaatcaacaccatcacactgtcaagatgaaaacgactgtgttttaaattccaggccccatggaggcaaaaccatgcgttctcacatctcttctgctccatccctcagctcccagctctgtgttcagctgacta

SEQ ID NO: 104597 - DNA, 201 bp, Bos taurus
cttctaaaattttttgattgtttttctgagccaagtttttttttcctcaaatttgttgttatgtgactttgttttactcttaaatattattcagtgcttcatagaacaaataaatccttagggagctgtctgtgaatagaaggcttgctaaagatctgaagaaatatttgatatcttaccatttacctgaatagcaaaact

SEQ ID NO: 104598 - DNA, 201 bp, Bos taurus; identical to SEQ ID NO: 23322

SEQ ID NO: 104599 - DNA, 201 bp, Bos taurus; identical to SEQ ID NO: 23323

SEQ ID NO: 104600 - DNA, 201 bp, Bos taurus
atatatgcaatatatacaatgatccgtttaactgatctatccgttcagttaaaagttatgtcacggctttggtccaccgtcatggagtggcctgcaatttcctgcctagcactttaccattcttttggcagctcacaatctccatcttcctcctggctttgaaagaaactaggatatttgcaaagacctcatgatctggct

SEQ ID NO: 104601 - DNA, 201 bp, Bos taurus
ctattcaatatgtaggaaagtctctaaacactccgcatccattccctcactgctttaaagttttgtttcccctttatttaatgtgagggactggccatttctggcagtgatttctttatcagtctcctaggaagcctatctaatcctgaagcaaataagcctatttgtacgatggccttactcccagagtccccatgagag

SEQ ID NO: 104602 - DNA, 201 bp, Bos taurus; identical to SEQ ID NO: 23326

SEQ ID NO: 104603 - DNA, 201 bp, Bos taurus; identical to SEQ ID NO: 23327

SEQ ID NO: 104604 - DNA, 201 bp, Bos taurus; identical to SEQ ID NO: 23330

SEQ ID NO: 104605 - DNA, 201 bp, Bos taurus
ccaaagtggccccctgccctgtcaggcctggcagacacctttggccatcactcatgttgcctcaaagtgtctcctgccccagggtcatccacacacatcagagcatccatcacgttgcagttgggcctttcagtcagccacactggcgtccagtcctgcatgcgagcacatcctcagaaagtgctgccaagctgcatcagg

SEQ ID NO: 104606 - DNA, 201 bp, Bos taurus; identical to SEQ ID NO: 23332

SEQ ID NO: 104607 - DNA, 201 bp, Bos taurus; identical to SEQ ID NO: 23334

SEQ ID NO: 104608 - DNA, 201 bp, Bos taurus
aaaagaagtctgtatctatgctgtggttgagtctccatggaaaatcgacaacctggacaacactcttcataattaagagtactggtccctacaaagaactccgagtttaaatgaggtgtagttaaaatccaagagtgtctgtacattatgaaatggtttaagggttgtgtattaagcaagggctgttttagttttactttt

SEQ ID NO: 104609 - DNA, 201 bp, Bos taurus; identical to SEQ ID NO: 23335

SEQ ID NO: 104610 - DNA, 201 bp, Bos taurus
gtttaagccaacgtgggggatatgttatttctaatatccttgtaacatcccacagagtatataataataaacatgagaaacagcatatcaaatttcttctaatttctatctgtctcccagtgaaatcaaaggattacaatctgtacataatctacttccagagttcttattgcaatagagtaagactattacccatttaaa

SEQ ID NO: 104611 - DNA, 201 bp, Bos taurus; identical to SEQ ID NO: 23336

SEQ ID NO: 104612 - DNA, 201 bp, Bos taurus
cactggggctgtctgtgaacacatcaggaagcatatctatcctctttcctttgaaactcagcactgaactctgactggggcccacagcaagtgctcaataaacagttgtttgattaattaattaatactatggatgtcctgtcggcaagattcaagaaataattattgaatccatagtgaggcctgtatctctgccatcaa

SEQ ID NO: 104613 - DNA, 201 bp, Bos taurus; identical to SEQ ID NO: 23338

SEQ ID NO: 104614 - DNA, 201 bp, Bos taurus; identical to SEQ ID NO: 23339

SEQ ID NO: 104615 - DNA, 201 bp, Bos taurus; identical to SEQ ID NO: 23340

SEQ ID NO: 104616 - DNA, 201 bp, Bos taurus; identical to SEQ ID NO: 23341

SEQ ID NO: 104617 - DNA, 201 bp, Bos taurus; identical to SEQ ID NO: 23342

SEQ ID NO: 104618 - DNA, 201 bp, Bos taurus; identical to SEQ ID NO: 23343

SEQ ID NO: 104619 - DNA, 201 bp, Bos taurus; identical to SEQ ID NO: 23344

SEQ ID NO: 104620 - DNA, 201 bp, Bos taurus; identical to SEQ ID NO: 23345

SEQ ID NO: 104621 - DNA, 201 bp, Bos taurus; identical to SEQ ID NO: 23346

SEQ ID NO: 104622 - DNA, 201 bp, Bos taurus; identical to SEQ ID NO: 23347

SEQ ID NO: 104623 - DNA, 201 bp, Bos taurus; identical to SEQ ID NO: 23348

SEQ ID NO: 104624 - DNA, 201 bp, Bos taurus; identical to SEQ ID NO: 23349

SEQ ID NO: 104625 - DNA, 201 bp, Bos taurus; identical to SEQ ID NO: 23350

SEQ ID NO: 104626 - DNA, 201 bp, Bos taurus; identical to SEQ ID NO: 23351

SEQ ID NO: 104627 - DNA, 201 bp, Bos taurus; identical to SEQ ID NO: 23352

SEQ ID NO: 104628 - DNA, 201 bp, Bos taurus; identical to SEQ ID NO: 23353

SEQ ID NO: 104629 - DNA, 201 bp, Bos taurus; identical to SEQ ID NO: 23354

SEQ ID NO: 104630 - DNA, 201 bp, Bos taurus; identical to SEQ ID NO: 23355

SEQ ID NO: 104631 - DNA, 201 bp, Bos taurus; identical to SEQ ID NO: 23356

SEQ ID NO: 104632 - DNA, 201 bp, Bos taurus; identical to SEQ ID NO: 23357

SEQ ID NO: 104633 - DNA, 201 bp, Bos taurus; identical to SEQ ID NO: 23358

SEQ ID NO: 104634 - DNA, 201 bp, Bos taurus; identical to SEQ ID NO: 23359

SEQ ID NO: 104635 - DNA, 201 bp, Bos taurus; identical to SEQ ID NO: 23360

SEQ ID NO: 104636 - DNA, 201 bp, Bos taurus; identical to SEQ ID NO: 23361

SEQ ID NO: 104637 - DNA, 201 bp, Bos taurus; identical to SEQ ID NO: 23362

SEQ ID NO: 104638 - DNA, 201 bp, Bos taurus; identical to SEQ ID NO: 23363

SEQ ID NO: 104639 - DNA, 201 bp, Bos taurus; identical to SEQ ID NO: 23364

SEQ ID NO: 104640 - DNA, 201 bp, Bos taurus; identical to SEQ ID NO: 23365

SEQ ID NO: 104641 - DNA, 201 bp, Bos taurus; identical to SEQ ID NO: 23367

SEQ ID NO: 104642 - DNA, 201 bp, Bos taurus; identical to SEQ ID NO: 23368

SEQ ID NO: 104643 - DNA, 201 bp, Bos taurus; identical to SEQ ID NO: 23369

SEQ ID NO: 104644 - DNA, 201 bp, Bos taurus; identical to SEQ ID NO: 23370

SEQ ID NO: 104645 - DNA, 201 bp, Bos taurus; identical to SEQ ID NO: 23371

SEQ ID NO: 104646 - DNA, 201 bp, Bos taurus; identical to SEQ ID NO: 23372

SEQ ID NO: 104647 - DNA, 201 bp, Bos taurus; identical to SEQ ID NO: 23373

SEQ ID NO: 104648 - DNA, 201 bp, Bos taurus; identical to SEQ ID NO: 23374

SEQ ID NO: 104649 - DNA, 201 bp, Bos taurus; identical to SEQ ID NO: 23375

SEQ ID NO: 104650 - DNA, 201 bp, Bos taurus; identical to SEQ ID NO: 23376

SEQ ID NO: 104651 - DNA, 201 bp, Bos taurus; identical to SEQ ID NO: 23377

SEQ ID NO: 104652 - DNA, 201 bp, Bos taurus; identical to SEQ ID NO: 23378

SEQ ID NO: 104653 - DNA, 201 bp, Bos taurus; identical to SEQ ID NO: 23379

SEQ ID NO: 104654 - DNA, 201 bp, Bos taurus; identical to SEQ ID NO: 23380

SEQ ID NO: 104655 - DNA, 201 bp, Bos taurus; identical to SEQ ID NO: 23381

SEQ ID NO: 104656 - DNA, 201 bp, Bos taurus; identical to SEQ ID NO: 23382

SEQ ID NO: 104657 - DNA, 201 bp, Bos taurus; identical to SEQ ID NO: 23383

SEQ ID NO: 104658 - DNA, 201 bp, Bos taurus; identical to SEQ ID NO: 23384

SEQ ID NO: 104659 - DNA, 201 bp, Bos taurus; identical to SEQ ID NO: 23385

SEQ ID NO: 104660 - DNA, 201 bp, Bos taurus; identical to SEQ ID NO: 23386

SEQ ID NO: 104661 - DNA, 201 bp, Bos taurus; identical to SEQ ID NO: 23387

SEQ ID NO: 104662 - DNA, 201 bp, Bos taurus; identical to SEQ ID NO: 23388

SEQ ID NO: 104663 - DNA, 201 bp, Bos taurus; identical to SEQ ID NO: 23389

SEQ ID NO: 104664 - DNA, 201 bp, Bos taurus; identical to SEQ ID NO: 23390

SEQ ID NO: 104665 - DNA, 201 bp, Bos taurus; identical to SEQ ID NO: 23391

SEQ ID NO: 104666 - DNA, 201 bp, Bos taurus; identical to SEQ ID NO: 23392

SEQ ID NO: 104667 - DNA, 201 bp, Bos taurus; identical to SEQ ID NO: 23393

SEQ ID NO: 104668 - DNA, 201 bp, Bos taurus; identical to SEQ ID NO: 23394

SEQ ID NO: 104669 - DNA, 201 bp, Bos taurus; identical to SEQ ID NO: 23395

SEQ ID NO: 104670 - DNA, 201 bp, Bos taurus; identical to SEQ ID NO: 23396

SEQ ID NO: 104671 - DNA, 201 bp, Bos taurus; identical to SEQ ID NO: 23397

SEQ ID NO: 104672 - DNA, 201 bp, Bos taurus; identical to SEQ ID NO: 23398

SEQ ID NO: 104673 - DNA, 201 bp, Bos taurus; identical to SEQ ID NO: 23400

SEQ ID NO: 104674 - DNA, 201 bp, Bos taurus; identical to SEQ ID NO: 23402

SEQ ID NO: 104675 - DNA, 201 bp, Bos taurus; identical to SEQ ID NO: 23403

SEQ ID NO: 104676 - DNA, 201 bp, Bos taurus; identical to SEQ ID NO: 23407

SEQ ID NO: 104677 - DNA, 201 bp, Bos taurus; identical to SEQ ID NO: 23408

SEQ ID NO: 104678 - DNA, 201 bp, Bos taurus; identical to SEQ ID NO: 23409

SEQ ID NO: 104679 - DNA, 201 bp, Bos taurus; identical to SEQ ID NO: 23410

SEQ ID NO: 104680 - DNA, 201 bp, Bos taurus; identical to SEQ ID NO: 23412

SEQ ID NO: 104681 - DNA, 201 bp, Bos taurus; identical to SEQ ID NO: 23413

SEQ ID NO: 104682 - DNA, 201 bp, Bos taurus; identical to SEQ ID NO: 23414

SEQ ID NO: 104683 - DNA, 201 bp, Bos taurus; identical to SEQ ID NO: 23415

SEQ ID NO: 104684 - DNA, 201 bp, Bos taurus; identical to SEQ ID NO: 23416

SEQ ID NO: 104685 - DNA, 201 bp, Bos taurus; identical to SEQ ID NO: 23420

SEQ ID NO: 104686 - DNA, 201 bp, Bos taurus; identical to SEQ ID NO: 23421

SEQ ID NO: 104687 - DNA, 201 bp, Bos taurus; identical to SEQ ID NO: 23422

SEQ ID NO: 104688 - DNA, 201 bp, Bos taurus; identical to SEQ ID NO: 23423

SEQ ID NO: 104689 - DNA, 201 bp, Bos taurus
gccaaaacgccaactctgactttgggggattagtcttgctcaagagacattgcttacttattaagattgagattagttggcaacaaggacagaggtgaacgagtagccagaggtggccacaaagtttatatcacatcatttgcagagtcgccaccttccatgtggggctcagcctgcctagagccccatgcttcatttgca

SEQ ID NO: 104690 - DNA, 201 bp, Bos taurus
tccattttcacatggacctaattcatgtagggaatcaggttaaaaggccataaaagcctggattatgaaatgtatgtgaggttgagacgtaattcatcactggagtggataaacccaaagaccatcctgaccaacgtcaaatccaggtcagcaactaagccaggcagaaatgctttcgctggccagttttggctaccatca

SEQ ID NO: 104691 - DNA, 201 bp, Bos taurus
gcccagtgtgacaaccacatggccagggccgtgaaacagactagtggttcttaaccaggggggtgcacctcagaatctcagggcgatcttttctaaaatacccatacccaggccttggtccctacagactgaattcagaggcaggctggaacctgggcatagacattttgttctgttttacgcacctttggtgaagcacca

SEQ ID NO: 104692 - DNA, 201 bp, Bos taurus
ggagaagggaatggctacccactccagtattctggcctgaagaattccatggactatatagtccatgggttcgcaaagagtcggacacaactgagcaactgtccctttcatgaggaatggggcctcatagaggaaagaacatgggcctcatctagacagggttgttgttcccatgggggaatggagaccccatgtatgtag

SEQ ID NO: 104693 - DNA, 201 bp, Bos taurus
atagctcaagtaggcaggatttattaaagaggcagcagacagtgtaccctcaagtttcttgtctcgacagactacttacagttccagtaggcagcagatagtgcaccgggactgaccccataggagtggctccctcttgcttcccatcttataggttctgtctcttctctctggaacccgattggttcagccttatgcaaa

SEQ ID NO: 104694 - DNA, 201 bp, Bos taurus
ttcaactagggatcatcctataaagtgttctgaacataagcaggtaagaaaagtcctaaagcaaataagcatgggctgggggtgagttgtacattactcaatactgtgaagaataagaacttggggctgttcacagcaaggatgtggcagccccctccctactcccccgcctaactttcagggaacctcaagtcttgctct

SEQ ID NO: 104695 - DNA, 201 bp, Bos taurus
aggctcccgtgtctgcccagcccatcagagaggttgctacactcttgtcgatgagtgtcatcagcaaacttggcaactgggccagctccctccagcctccagaaggattcaatgaaggatccttctggaatagggggagcccagacccatgttccctttcaggaggccccctttctccgtcatttctgtgtcaccagggct

SEQ ID NO: 104696 - DNA, 201 bp, Bos taurus
ctcccacagtgattcatctggccacgttacagcacaaatgtgtcagttttcagggacttggagagctcttaagcaagcacaggtgtgttgttgaggatgccgatatgcaaaggagcaacagtagacagatccatgccccgaggaggctgccagccagtgaggaccagcccagtttccaactggacccccttgatgtggagc

SEQ ID NO: 104697 - DNA, 201 bp, Bos taurus; identical to SEQ ID NO: 23426

SEQ ID NO: 104698 - DNA, 201 bp, Bos taurus; identical to SEQ ID NO: 23427

SEQ ID NO: 104699 - DNA, 201 bp, Bos taurus; identical to SEQ ID NO: 23428

SEQ ID NO: 104700 - DNA, 201 bp, Bos taurus; identical to SEQ ID NO: 23429

SEQ ID NO: 104701 - DNA, 201 bp, Bos taurus; identical to SEQ ID NO: 23430

SEQ ID NO: 104702 - DNA, 201 bp, Bos taurus; identical to SEQ ID NO: 23431

SEQ ID NO: 104703 - DNA, 201 bp, Bos taurus; identical to SEQ ID NO: 23433

SEQ ID NO: 104704 - DNA, 201 bp, Bos taurus; identical to SEQ ID NO: 23434

SEQ ID NO: 104705 - DNA, 201 bp, Bos taurus; identical to SEQ ID NO: 23435

SEQ ID NO: 104706 - DNA, 201 bp, Bos taurus; identical to SEQ ID NO: 23436

SEQ ID NO: 104707 - DNA, 201 bp, Bos taurus; identical to SEQ ID NO: 23437

SEQ ID NO: 104708 - DNA, 201 bp, Bos taurus; identical to SEQ ID NO: 23438

SEQ ID NO: 104709 - DNA, 201 bp, Bos taurus; identical to SEQ ID NO: 23439

SEQ ID NO: 104710 - DNA, 201 bp, Bos taurus; identical to SEQ ID NO: 23440

SEQ ID NO: 104711 - DNA, 201 bp, Bos taurus; identical to SEQ ID NO: 23441

SEQ ID NO: 104712 - DNA, 201 bp, Bos taurus; identical to SEQ ID NO: 23449

SEQ ID NO: 104713 - DNA, 201 bp, Bos taurus; identical to SEQ ID NO: 23450

SEQ ID NO: 104714 - DNA, 201 bp, Bos taurus; identical to SEQ ID NO: 23451

SEQ ID NO: 104715 - DNA, 201 bp, Bos taurus; identical to SEQ ID NO: 23454

SEQ ID NO: 104716 - DNA, 201 bp, Bos taurus; identical to SEQ ID NO: 23456

SEQ ID NO: 104717 - DNA, 201 bp, Bos taurus
actgataactgtcttacgagtcaccattcagctaaaaaattgcaggcggattctttaccagctgagtcacaaaggaagacctcagctaaaataatttgtgccaaaattaatattactgtcagatagtcattggcttataatggttcaacttaaaatttttgacattataatgatgtaaaattaatgcatgttcagtagaaa

SEQ ID NO: 104718 - DNA, 201 bp, Bos taurus
ccatactttttaaatcttttaccataaatgttcaacaaaagtatatttagtaggtttgacctaatataattcctcatcaattttctactttgtatgaagaacaattaaaggcctgaaaatttaccctattgctaagctaacaagttagtcagtatccaccagttctgttatactgcagataatagaacaacctttggtcat

SEQ ID NO: 104719 - DNA, 201 bp, Bos taurus
aaaagaaggtgaaaatatacaatgggaaaagtttcttaataaatgatgttgagaaaaccgtacatttacatgcaaaaaaatacaccttggacactttttttgcactatatataaagaatcaacccaaaacattctaaagtcttaaatgtaagtcataaaattgtagattaaaacatagtaagtcaactatttgacattggt

SEQ ID NO: 104720 - DNA, 201 bp, Bos taurus
tccctttcatgtgttcatctaagtatgtcctttcagagaatttcctgactctgtggataagcagaaacgagattctcacttgaagtatcgcttttttgcaatagtgtctcattgaagcaataagaatccaagttcgtttttgtgtttgctttgtttctcctcattatttctgaataaaggaaatttcagattttgtaaaaa

SEQ ID NO: 104721 - DNA, 201 bp, Bos taurus; identical to SEQ ID NO: 23460

SEQ ID NO: 104722 - DNA, 201 bp, Bos taurus; identical to SEQ ID NO: 23462

SEQ ID NO: 104723 - DNA, 201 bp, Bos taurus; identical to SEQ ID NO: 23463

SEQ ID NO: 104724 - DNA, 201 bp, Bos taurus; identical to SEQ ID NO: 23466

SEQ ID NO: 104725 - DNA, 201 bp, Bos taurus; identical to SEQ ID NO: 23467

SEQ ID NO: 104726 - DNA, 201 bp, Bos taurus; identical to SEQ ID NO: 23470

SEQ ID NO: 104727 - DNA, 201 bp, Bos taurus; identical to SEQ ID NO: 23471

SEQ ID NO: 104728 - DNA, 201 bp, Bos taurus; identical to SEQ ID NO: 23472

SEQ ID NO: 104729 - DNA, 201 bp, Bos taurus; identical to SEQ ID NO: 23474

SEQ ID NO: 104730 - DNA, 201 bp, Bos taurus
tgcagatgagaagtgaaggggatcctcaggataacgtgagagaacagacaacaaggccagatcagagctaatgaaaaacctctaggagaatcttatccaaaattatgaaatgaacagaatgttgcatacatctgaatgtctttcaaagagatttaagctggaggttaacaaattgtagtctgaagttcaaatccaacctaa

SEQ ID NO: 104731 - DNA, 201 bp, Bos taurus; identical to SEQ ID NO: 23475

SEQ ID NO: 104732 - DNA, 201 bp, Bos taurus; identical to SEQ ID NO: 23476

SEQ ID NO: 104733 - DNA, 201 bp, Bos taurus; identical to SEQ ID NO: 23477

SEQ ID NO: 104734 - DNA, 201 bp, Bos taurus; identical to SEQ ID NO: 23478

SEQ ID NO: 104735 - DNA, 201 bp, Bos taurus; identical to SEQ ID NO: 23480

SEQ ID NO: 104736 - DNA, 201 bp, Bos taurus; identical to SEQ ID NO: 23482

SEQ ID NO: 104737 - DNA, 201 bp, Bos taurus; identical to SEQ ID NO: 23483

SEQ ID NO: 104738 - DNA, 201 bp, Bos taurus; identical to SEQ ID NO: 23485

SEQ ID NO: 104739 - DNA, 201 bp, Bos taurus; identical to SEQ ID NO: 23486

SEQ ID NO: 104740 - DNA, 201 bp, Bos taurus; identical to SEQ ID NO: 23487

SEQ ID NO: 104741 - DNA, 201 bp, Bos taurus
caaatggaagctggaatggagaataccttcaaaatcccaaagcaaaataacgtgccaccctatgtgctgcagacccaaccacgccatcaatcaaatacaaaagtaaagatatgctagatgtcaaacacgtacctctcctacaagactcttctcaggaaggaggagacgaaaagcaaaggaggtaaacaaaggaggaggaac

SEQ ID NO: 104742 - DNA, 201 bp, Bos taurus; identical to SEQ ID NO: 23488

SEQ ID NO: 104743 - DNA, 201 bp, Bos taurus; identical to SEQ ID NO: 23489

SEQ ID NO: 104744 - DNA, 201 bp, Bos taurus; identical to SEQ ID NO: 23490

SEQ ID NO: 104745 - DNA, 201 bp, Bos taurus; identical to SEQ ID NO: 23491

SEQ ID NO: 104746 - DNA, 201 bp, Bos taurus
aatagtatcaggctggccaaatcactctttgaaaaacatttaatttgagtatcgtttggtcagtagataaccaaagacattcattttagagtgttttaggttttaaggatatatttatagtgcattttggcaattataagcaattagtttttaggttaaaaatagccttgaagacagctttacagtacttcagattctttc

SEQ ID NO: 104747 - DNA, 201 bp, Bos taurus; identical to SEQ ID NO: 23494

SEQ ID NO: 104748 - DNA, 201 bp, Bos taurus; identical to SEQ ID NO: 23495

SEQ ID NO: 104749 - DNA, 201 bp, Bos taurus
tatatgctttctccatgttctttgtgtaaaataaaagtagtactattcgctgtctttaattatttaatgtttttcctttgtgtcttttctcgtccaattataacataaaccccttaggccctggtcaactgtcacacttcttagacacatagcacagtcctactcaggaaagaaccactccaaacaacaacaaaaagtata

SEQ ID NO: 104750 - DNA, 201 bp, Bos taurus
ggttagtgttgtcttagaaggttattttgactgttgggtaagcagtgggtaaatcctgatttcaggtgtttgtacacacaatttaagatacattgtgtgtatatgtgtttgtagttggcttttctggcccagtcagtgcggactgtgcaatgcagggagagactgtgtcaagttttatcttcattagatgtttaagaattc

SEQ ID NO: 104751 - DNA, 201 bp, Bos taurus; identical to SEQ ID NO: 23498

SEQ ID NO: 104752 - DNA, 201 bp, Bos taurus
ccattgtctccccacaaacaacctagaatgtctcccagtcttccaaccataaaacagatggttatgccaacttgagatgtagaccatgaagaaaatgacatgtgctttcagctaaagctatgagaaatttgtgctttatatgctcaggatagcaaccttcaggcacacaaacggatattattatagtatatcagtttgtat

SEQ ID NO: 104753 - DNA, 201 bp, Bos taurus; identical to SEQ ID NO: 23499

SEQ ID NO: 104754 - DNA, 201 bp, Bos taurus; identical to SEQ ID NO: 23500

SEQ ID NO: 104755 - DNA, 201 bp, Bos taurus; identical to SEQ ID NO: 23501

SEQ ID NO: 104756 - DNA, 201 bp, Bos taurus; identical to SEQ ID NO: 23502

SEQ ID NO: 104757 - DNA, 201 bp, Bos taurus; identical to SEQ ID NO: 23503

SEQ ID NO: 104758 - DNA, 201 bp, Bos taurus; identical to SEQ ID NO: 23504

SEQ ID NO: 104759 - DNA, 201 bp, Bos taurus; identical to SEQ ID NO: 23505

SEQ ID NO: 104760 - DNA, 201 bp, Bos taurus; identical to SEQ ID NO: 23506

SEQ ID NO: 104761 - DNA, 201 bp, Bos taurus; identical to SEQ ID NO: 23507

SEQ ID NO: 104762 - DNA, 201 bp, Bos taurus; identical to SEQ ID NO: 23508

SEQ ID NO: 104763 - DNA, 201 bp, Bos taurus; identical to SEQ ID NO: 23509

SEQ ID NO: 104764 - DNA, 201 bp, Bos taurus; identical to SEQ ID NO: 23510

SEQ ID NO: 104765 - DNA, 201 bp, Bos taurus; identical to SEQ ID NO: 23511

SEQ ID NO: 104766 - DNA, 201 bp, Bos taurus; identical to SEQ ID NO: 23512

SEQ ID NO: 104767 - DNA, 201 bp, Bos taurus; identical to SEQ ID NO: 23513

SEQ ID NO: 104768 - DNA, 201 bp, Bos taurus; identical to SEQ ID NO: 23514

SEQ ID NO: 104769 - DNA, 201 bp, Bos taurus; identical to SEQ ID NO: 23515

SEQ ID NO: 104770 - DNA, 201 bp, Bos taurus; identical to SEQ ID NO: 23516

SEQ ID NO: 104771 - DNA, 201 bp, Bos taurus; identical to SEQ ID NO: 23517

SEQ ID NO: 104772 - DNA, 201 bp, Bos taurus; identical to SEQ ID NO: 23518

SEQ ID NO: 104773 - DNA, 201 bp, Bos taurus; identical to SEQ ID NO: 23519

SEQ ID NO: 104774 - DNA, 201 bp, Bos taurus; identical to SEQ ID NO: 23520

SEQ ID NO: 104775 - DNA, 201 bp, Bos taurus; identical to SEQ ID NO: 23521

SEQ ID NO: 104776 - DNA, 201 bp, Bos taurus; identical to SEQ ID NO: 23522

SEQ ID NO: 104777 - DNA, 201 bp, Bos taurus; identical to SEQ ID NO: 23523

SEQ ID NO: 104778 - DNA, 201 bp, Bos taurus; identical to SEQ ID NO: 23524

SEQ ID NO: 104779 - DNA, 201 bp, Bos taurus; identical to SEQ ID NO: 23525

SEQ ID NO: 104780 - DNA, 201 bp, Bos taurus; identical to SEQ ID NO: 23526

SEQ ID NO: 104781 - DNA, 201 bp, Bos taurus; identical to SEQ ID NO: 23527

SEQ ID NO: 104782 - DNA, 201 bp, Bos taurus; identical to SEQ ID NO: 23528

SEQ ID NO: 104783 - DNA, 201 bp, Bos taurus; identical to SEQ ID NO: 23529

SEQ ID NO: 104784 - DNA, 201 bp, Bos taurus; identical to SEQ ID NO: 23530

SEQ ID NO: 104785 - DNA, 201 bp, Bos taurus; identical to SEQ ID NO: 23531

SEQ ID NO: 104786 - DNA, 201 bp, Bos taurus; identical to SEQ ID NO: 23532

SEQ ID NO: 104787 - DNA, 201 bp, Bos taurus; identical to SEQ ID NO: 23533

SEQ ID NO: 104788 - DNA, 201 bp, Bos taurus; identical to SEQ ID NO: 23534

SEQ ID NO: 104789 - DNA, 201 bp, Bos taurus; identical to SEQ ID NO: 23535

SEQ ID NO: 104790 - DNA, 201 bp, Bos taurus; identical to SEQ ID NO: 23536

SEQ ID NO: 104791 - DNA, 201 bp, Bos taurus; identical to SEQ ID NO: 23537

SEQ ID NO: 104792 - DNA, 201 bp, Bos taurus; identical to SEQ ID NO: 23538

SEQ ID NO: 104793 - DNA, 201 bp, Bos taurus; identical to SEQ ID NO: 23539

SEQ ID NO: 104794 - DNA, 201 bp, Bos taurus; identical to SEQ ID NO: 23540

SEQ ID NO: 104795 - DNA, 201 bp, Bos taurus; identical to SEQ ID NO: 23541

SEQ ID NO: 104796 - DNA, 201 bp, Bos taurus; identical to SEQ ID NO: 23542

SEQ ID NO: 104797 - DNA, 201 bp, Bos taurus; identical to SEQ ID NO: 23543

SEQ ID NO: 104798 - DNA, 201 bp, Bos taurus; identical to SEQ ID NO: 23544

SEQ ID NO: 104799 - DNA, 201 bp, Bos taurus; identical to SEQ ID NO: 23545

SEQ ID NO: 104800 - DNA, 201 bp, Bos taurus; identical to SEQ ID NO: 23546

SEQ ID NO: 104801 - DNA, 201 bp, Bos taurus; identical to SEQ ID NO: 23547

SEQ ID NO: 104802 - DNA, 201 bp, Bos taurus; identical to SEQ ID NO: 23548

SEQ ID NO: 104803 - DNA, 201 bp, Bos taurus; identical to SEQ ID NO: 23549

SEQ ID NO: 104804 - DNA, 201 bp, Bos taurus; identical to SEQ ID NO: 23550

SEQ ID NO: 104805 - DNA, 201 bp, Bos taurus; identical to SEQ ID NO: 23551

SEQ ID NO: 104806 - DNA, 201 bp, Bos taurus; identical to SEQ ID NO: 23552

SEQ ID NO: 104807 - DNA, 201 bp, Bos taurus; identical to SEQ ID NO: 23553

SEQ ID NO: 104808 - DNA, 201 bp, Bos taurus; identical to SEQ ID NO: 23554

SEQ ID NO: 104809 - DNA, 201 bp, Bos taurus; identical to SEQ ID NO: 23555

SEQ ID NO: 104810 - DNA, 201 bp, Bos taurus; identical to SEQ ID NO: 23556

SEQ ID NO: 104811 - DNA, 201 bp, Bos taurus; identical to SEQ ID NO: 23557

SEQ ID NO: 104812 - DNA, 201 bp, Bos taurus; identical to SEQ ID NO: 23558

SEQ ID NO: 104813 - DNA, 201 bp, Bos taurus; identical to SEQ ID NO: 23559

SEQ ID NO: 104814 - DNA, 201 bp, Bos taurus; identical to SEQ ID NO: 23560

SEQ ID NO: 104815 - DNA, 201 bp, Bos taurus; identical to SEQ ID NO: 23561

SEQ ID NO: 104816 - DNA, 201 bp, Bos taurus; identical to SEQ ID NO: 23562

SEQ ID NO: 104817 - DNA, 201 bp, Bos taurus; identical to SEQ ID NO: 23563

SEQ ID NO: 104818 - DNA, 201 bp, Bos taurus; identical to SEQ ID NO: 23564

SEQ ID NO: 104819 - DNA, 201 bp, Bos taurus; identical to SEQ ID NO: 23565

SEQ ID NO: 104820 - DNA, 201 bp, Bos taurus; identical to SEQ ID NO: 23566

SEQ ID NO: 104821 - DNA, 201 bp, Bos taurus; identical to SEQ ID NO: 23567

SEQ ID NO: 104822 - DNA, 201 bp, Bos taurus; identical to SEQ ID NO: 23568

SEQ ID NO: 104823 - DNA, 201 bp, Bos taurus; identical to SEQ ID NO: 23569

SEQ ID NO: 104824 - DNA, 201 bp, Bos taurus; identical to SEQ ID NO: 23570

SEQ ID NO: 104825 - DNA, 201 bp, Bos taurus; identical to SEQ ID NO: 23571

SEQ ID NO: 104826 - DNA, 201 bp, Bos taurus; identical to SEQ ID NO: 23572

SEQ ID NO: 104827 - DNA, 201 bp, Bos taurus; identical to SEQ ID NO: 23573

SEQ ID NO: 104828 - DNA, 201 bp, Bos taurus; identical to SEQ ID NO: 23574

SEQ ID NO: 104829 - DNA, 201 bp, Bos taurus; identical to SEQ ID NO: 23575

SEQ ID NO: 104830 - DNA, 201 bp, Bos taurus; identical to SEQ ID NO: 23576

SEQ ID NO: 104831 - DNA, 201 bp, Bos taurus; identical to SEQ ID NO: 23577

SEQ ID NO: 104832 - DNA, 201 bp, Bos taurus; identical to SEQ ID NO: 23578

SEQ ID NO: 104833 - DNA, 201 bp, Bos taurus; identical to SEQ ID NO: 23579

SEQ ID NO: 104834 - DNA, 201 bp, Bos taurus; identical to SEQ ID NO: 23580

SEQ ID NO: 104835 - DNA, 201 bp, Bos taurus
tgtttttggcagatgaagtccaagtgtttgctcatagagatctattttcgtaaaaataaagctgatcaaagaagcatgaaatggagagcattttgaggccctgttgaaattgaagttagtgtactctgcttactcttgaaaatcttggttttgtgatttgtctaaaaaatgggggaaaggaacgagttcaagaagaattac

SEQ ID NO: 104836 - DNA, 201 bp, Bos taurus
actaccgaattactcagacttggtgaaatatataaatatgagactacttgttgcacacgttttaagaatttcaagatggccactgcagaatgtcaaaccagtatggcacccttctaagcttgggtgttgagggattgtgtataggtcacacacccaagacgctggccctgccaccaaacctcagttcatcacttgtgttat

SEQ ID NO: 104837 - DNA, 201 bp, Bos taurus; identical to SEQ ID NO: 23581

SEQ ID NO: 104838 - DNA, 201 bp, Bos taurus; identical to SEQ ID NO: 23582

SEQ ID NO: 104839 - DNA, 201 bp, Bos taurus; identical to SEQ ID NO: 23583

SEQ ID NO: 104840 - DNA, 201 bp, Bos taurus
gaaccaggtggttgttgctaccttctggcctcctctgcttctgaaatgctgagtgaggctacaaaaaaaagatgatgccaagtgcgatcagggagaaatgaaaagcacatgtatctggccaagcaagtattactttgcagtctattagctatggttaaatatttaacacttttgaaagctctgggttgatgacattctcaa

SEQ ID NO: 104841 - DNA, 201 bp, Bos taurus
cttttctttcaattcttaataatttttatcttgaaatgtgtaaaaaataacagacaagtacagtgagaaacataaagaacccttgtggagtcttccctggggatccaggggttaagactcctcacttccactgcaggggtcacaggttcaatcctcggtcggggaactaagatactgcctcaaagaaaagacaagaaaaga

SEQ ID NO: 104842 - DNA, 201 bp, Bos taurus
tcactcattttcatggacttctacatgggaatagaatatattacaacgtgatgtagttcagaaaatacctcacactcaaaacccttatcaaaagaaacaagttgtagtaccgtttctgttatatggggaaaaaaagaaaaaaataaaaagagagaaaccatttaagatatgcatttatgtgctttataactaggtcttccc

SEQ ID NO: 104843 - DNA, 201 bp, Bos taurus; identical to SEQ ID NO: 23584

SEQ ID NO: 104844 - DNA, 201 bp, Bos taurus
aggagttgacacatttccaagaggtgctcaaggccctctgctctcaggaggcagaaccatctcgcctttgaaagctgacctttccctctccaccccctctcttttccaggcccttctccagagctaacttattcacacatagcaggcagacccctgaagcctactttaaaaagtctcggtctgtaagctatgataggatca

SEQ ID NO: 104845 - DNA, 201 bp, Bos taurus; identical to SEQ ID NO: 23585

SEQ ID NO: 104846 - DNA, 201 bp, Bos taurus; identical to SEQ ID NO: 23586

SEQ ID NO: 104847 - DNA, 201 bp, Bos taurus; identical to SEQ ID NO: 23587

SEQ ID NO: 104848 - DNA, 201 bp, Bos taurus; identical to SEQ ID NO: 23588

SEQ ID NO: 104849 - DNA, 201 bp, Bos taurus
tagcccagtgcccccatccccctgcctccgctaggtcgcaacctgggcgcccctcactccctcgcctcctcgcgggggaccgcggctgccagcgaggccattgccgaagttcggggacgaagactgcatgtcatctcgcttctccttctggcgcgtccacgctccaccggggcggggggacttgaggccctgcttccccat

SEQ ID NO: 104850 - DNA, 201 bp, Bos taurus; identical to SEQ ID NO: 23589

SEQ ID NO: 104851 - DNA, 201 bp, Bos taurus; identical to SEQ ID NO: 23590

SEQ ID NO: 104852 - DNA, 201 bp, Bos taurus; identical to SEQ ID NO: 23592

SEQ ID NO: 104853 - DNA, 201 bp, Bos taurus
tgccgatgatgtgaaaagaaaggataaaaatgatccagattgtaagatgattgctgtgatgcctgggtgacacaggataagtggtaaggattggcagcacgatatgagaaacggaaaatgtaacagtgaggtttagaacttgaaaaatgacaaaatgattatatctttgcgggtatgaggaaggagggcaatggaaaggtc

SEQ ID NO: 104854 - DNA, 201 bp, Bos taurus; identical to SEQ ID NO: 23593

SEQ ID NO: 104855 - DNA, 201 bp, Bos taurus
tacggttgacccttaacaacagggctttgaactttgagtccattcaaacagggatttttttccccccagtaataaatactatagtactagtcttcccaggcggcgctagcggaaaagaacctgcctgccaatgcaggagacgtaagagaggaggatttgatcccccggttgagaagatctcctggagaagggtatggcaac

SEQ ID NO: 104856 - DNA, 201 bp, Bos taurus; identical to SEQ ID NO: 23594

SEQ ID NO: 104857 - DNA, 201 bp, Bos taurus; identical to SEQ ID NO: 23595

SEQ ID NO: 104858 - DNA, 201 bp, Bos taurus
aaagagttgtcaagatacctcctactaaaatcagatttcccagtggacaggcttgtgatatataaagagtcctcctactcagagagaatagggcccttccagcactccttcttgtaccattgcatctacaaggacagaaagttgtatatttcagttcagttcagtcactcagtcatgtccgactctttgccaccccataaa

SEQ ID NO: 104859 - DNA, 201 bp, Bos taurus
gggcctttcagtgaattagagagggcaaatggtgcatgagggtgtcaggctatggtttgtgggtagaaggcatgctcaggtcatgaattacttcagagttcacctgccattgtcctggcccaatcactcattcctcaaagtgcaacagttcagtccaacaaaaccttgcctgagcagctactgaggaccaggaactgtgct

SEQ ID NO: 104860 - DNA, 201 bp, Bos taurus
tctctccccttctcccaccttccccgctaccacccttctctcacccaaattccctgctattacccttttctcacccagattgctgcaatggcctgttgcccgctctttcttctaggactgccttcacaggggagtgaccagtgccaccacgtggagatccacgcatatggaggccccattctcagggctcactgctctgtg

SEQ ID NO: 104861 - DNA, 201 bp, Bos taurus
tatgggtacagacagctgattcacacaaactaacacagcactgtaaaagcaactatatccaataaagactaattttaaaaaatgcagataacatgaccatcgggtttatctaccaggattaagtaacagaattcacgtgatgtgcttagcacagtgcttaggacacagtaagtcttgaataaatggaaggttttttaaaaa

SEQ ID NO: 104862 - DNA, 201 bp, Bos taurus; identical to SEQ ID NO: 23596

SEQ ID NO: 104863 - DNA, 201 bp, Bos taurus; identical to SEQ ID NO: 23597

SEQ ID NO: 104864 - DNA, 201 bp, Bos taurus
acagagaaagacaaatactttatgttgtcacttatatgtggaatctaaaaaaatgcaacaaactggtgaatataacaaagcagaaacagatttactgatatagagaacaaaccagtggttaccagtgagaagagggaaaagggttagggttagataggggtaagaggttaagaggtaagaggttaagagggtaagaggtta

SEQ ID NO: 104865 - DNA, 201 bp, Bos taurus; identical to SEQ ID NO: 23598

SEQ ID NO: 104866 - DNA, 201 bp, Bos taurus; identical to SEQ ID NO: 23599

SEQ ID NO: 104867 - DNA, 201 bp, Bos taurus
aggcagcagatggtttgcagatttggagcgaggattccagaggggaccagggtgatgttggggagagagtggccaggggcccagtggcagatggacaaaggggagcggagagccactgggctctgcttacgcctccttgggccttttcagatggttacacaatgacagttgatagcaaattaaggatgaaatgttttaagc

SEQ ID NO: 104868 - DNA, 201 bp, Bos taurus
gtgtcgttatcgggctagtgtgtcggtttctgggcctggttttcctgttgttggaatgtgcaatgctcgaagctcagaacattgaaatgaatctaaaggcaagtccagctgttggccggcaatgagccttttcctcctgcatctcactgggccttcatcctgcttagggagttggcagcattaaatcccgcccccccaccc

SEQ ID NO: 104869 - DNA, 201 bp, Bos taurus
gccaagcccaccctcctcctccagctgtggccgggtgtcaggaacctagttctcgagggatgggtgtagctccccttcggtgccaaggtcagaacctcgcgctggcagaggaccaggcggccagttcccagggctcgcgttacaccgcagcgcccacagttggcagccgaacccattatcactcttgctctgagggtggcc

SEQ ID NO: 104870 - DNA, 201 bp, Bos taurus; identical to SEQ ID NO: 23600

SEQ ID NO: 104871 - DNA, 201 bp, Bos taurus
ggcggaagaccagaggtcgtggatctggccccaagtgtccccccggccactcctcccccatgacacctgccactgttcaaagttttgtgaataaagtccacaacacccatggtggctcccagcagtattgattctgtttggaagaaatgggaagattaaagcaagtttattctgaaagaaagaaagaaaatgaagtcgttc

SEQ ID NO: 104872 - DNA, 201 bp, Bos taurus
tgggttgcccaggtatttggccaaacattattctgggtattcctctaagggtgtttttgggtgaggttaacacttaaatcagtagactgccctccctatacggtgggcctcgcccaatctgttaaaggccagaatagtacaaaaggctgaccctcaacctgagtaagaggggtagtcttcctgcctgccagctctgagctg

SEQ ID NO: 104873 - DNA, 201 bp, Bos taurus
ggtgaagtcgaatgatggcactcaagcctgtttcacattcccaaggaacagaagaactcactaagacatgtctcagcagccgatgggctggcctcagacatgcacacacaccccttctcctgacctctcccaactacacgggattttacagtataaacagaagcattctggcctggagagtaggtttggcaaaagttatgt

SEQ ID NO: 104874 - DNA, 201 bp, Bos taurus
ttggccattttgctttaaaaagaagaaagaaacttgttttataattacctagtctatgaagagatgccacatttcttcccacatcagaggagcaagacttgaacaaatccaaagctggcccacttggctgaagaatggaaacaactgacgacattgctcccaaaagctttacagacaagatggcatagcttgctgggagtt

SEQ ID NO: 104875 - DNA, 201 bp, Bos taurus
tgccacgaggtatacaggtacctatacccaggaaaacacagaagctgctgtttaagacacaggcacaagtctcctcgtccccagccaagtgactgaggccagcagggtcccccgggggcagcaggggagcccagatggcaccctatgtccgcacgttcatcctctcaccagggcctgaggaggttgccccagtctctgcca

SEQ ID NO: 104876 - DNA, 201 bp, Bos taurus; identical to SEQ ID NO: 23601

SEQ ID NO: 104877 - DNA, 201 bp, Bos taurus; identical to SEQ ID NO: 23602

SEQ ID NO: 104878 - DNA, 201 bp, Bos taurus; identical to SEQ ID NO: 23603

SEQ ID NO: 104879 - DNA, 201 bp, Bos taurus
ttcccttctccaggggatctttgtcacccagggattgaacccctatctcctgaattggcaggcaagttctttgctgctgagccaccagggctcccagttaaacatttaatttattagttactgtgtgacaactatgaaactgtattgttttcttttttattattacgtcattcattcttcacattcaaaattacttgccca

SEQ ID NO: 104880 - DNA, 201 bp, Bos taurus; identical to SEQ ID NO: 23604

SEQ ID NO: 104881 - DNA, 201 bp, Bos taurus
aattgttttcgtgaagtcacataatgtatttggtattatctaaaaagcttttttttttttttcagctttttgactacagtagatattcctaatagtcacatgttttctcttaagttttaccagttaactctttccacattcacctgatttcctctaaagattaaactctccctaatattccagttggcagttggtctgttt

SEQ ID NO: 104882 - DNA, 201 bp, Bos taurus
tcttctcctctgagttggggatctctgcacatacaacagatggccggagtgttcgtgtgtctcagccaggaagtgagagggcggcgtgtcgttcaccagctgggcacgtccccatccttcagggccactgctgtaaagggctgtttttcaccttcgggttcctgcggctctcactccactcaggctcacacgtacctttac

SEQ ID NO: 104883 - DNA, 201 bp, Bos taurus
tttgcatggcatgttttttttttctctcttttgctagctacttatttcactgtgagctctgcaaacatggtgggccgcagaggtgccaggcaccatcatgatgtccaaaaattggctttgtgcatatgctgaattagagattggctggcagaagcagttcacagatcctggattggcagggattcctcatgaaaggaggca

SEQ ID NO: 104884 - DNA, 201 bp, Bos taurus; identical to SEQ ID NO: 23605

SEQ ID NO: 104885 - DNA, 201 bp, Bos taurus; identical to SEQ ID NO: 23606

SEQ ID NO: 104886 - DNA, 201 bp, Bos taurus; identical to SEQ ID NO: 23607

SEQ ID NO: 104887 - DNA, 201 bp, Bos taurus
gacggcagctgttgaacgcagcctctatttcccaggagctgtgaatgcaacttctcttcagcgccagggccagtgtatgccaaccgaagggccaaaaccctccagtcagcaactggtgtacatgtctggcaaggagcagcattgaccttgaggtgtgctagtcaccttcaaccttaaaatccccaaagggccaagtgagcc

SEQ ID NO: 104888 - DNA, 201 bp, Bos taurus; identical to SEQ ID NO: 23608

SEQ ID NO: 104889 - DNA, 201 bp, Bos taurus; identical to SEQ ID NO: 23609

SEQ ID NO: 104890 - DNA, 201 bp, Bos taurus; identical to SEQ ID NO: 23610

SEQ ID NO: 104891 - DNA, 201 bp, Bos taurus; identical to SEQ ID NO: 23611

SEQ ID NO: 104892 - DNA, 201 bp, Bos taurus
agaaagtttgctctaagcttgtaaaaccgaacagatagttcttcctagctctagagacgttttgtctaaataaataagacaagaacctacccttctggaccgagttgggagcaaatgaaatcaattcttcagctgatatgttttagtgtccccttaacactggtagttttataaatgcttgtgattcaaagtccaatgaag

SEQ ID NO: 104893 - DNA, 201 bp, Bos taurus; identical to SEQ ID NO: 23612

SEQ ID NO: 104894 - DNA, 201 bp, Bos taurus; identical to SEQ ID NO: 23617

SEQ ID NO: 104895 - DNA, 201 bp, Bos taurus
atttaaaaccacattttcaggcatctggaaatgatcctgggaacacgcagacaatggaggaacagcagttgctgaggccaagtcctgggtgaatttggttgagaggcagggactccttcctgctcagcccctgattttgaagcggagggtctgcccggccgggcaccgctgagaccccgaggccctgcccgcgctgggaag

SEQ ID NO: 104896 - DNA, 201 bp, Bos taurus; identical to SEQ ID NO: 23619

SEQ ID NO: 104897 - DNA, 201 bp, Bos taurus; identical to SEQ ID NO: 23620

SEQ ID NO: 104898 - DNA, 201 bp, Bos taurus; identical to SEQ ID NO: 23624

SEQ ID NO: 104899 - DNA, 201 bp, Bos taurus; identical to SEQ ID NO: 23625

SEQ ID NO: 104900 - DNA, 201 bp, Bos taurus; identical to SEQ ID NO: 23628

SEQ ID NO: 104901 - DNA, 201 bp, Bos taurus; identical to SEQ ID NO: 23629

SEQ ID NO: 104902 - DNA, 201 bp, Bos taurus; identical to SEQ ID NO: 23630

SEQ ID NO: 104903 - DNA, 201 bp, Bos taurus; identical to SEQ ID NO: 23631

SEQ ID NO: 104904 - DNA, 201 bp, Bos taurus; identical to SEQ ID NO: 23632

SEQ ID NO: 104905 - DNA, 201 bp, Bos taurus
caaggaaaaagacaaaagatcttctgatccccttggtgggggacagctgtttgaaggaaaccactcaagtgattcttttttccccaataataataaaaatctgttccaaggtgacttgttatgtgaaccttttaagaggttggcttattttttttaattctatttccccaggtgtccaattatttgaaggtataaaaataa

SEQ ID NO: 104906 - DNA, 201 bp, Bos taurus
tactcagcctcatctgaccctaaaaggtccgatttaatccagaaaagaatgaccttgacgttatgagattctattatctctatttccccactttttggtgaaccttgtaaatgaatgccactcacttctattatattttaaaaagacttccaccaaggaaaagtgagtcagttgaggaaaaagaaaagaaaaaaacaagaa

SEQ ID NO: 104907 - DNA, 201 bp, Bos taurus; identical to SEQ ID NO: 23633

SEQ ID NO: 104908 - DNA, 201 bp, Bos taurus; identical to SEQ ID NO: 23634

SEQ ID NO: 104909 - DNA, 201 bp, Bos taurus
aacacgtaaataaacgtgttttccttttgacaaactaaagcttgtatctatcacaccacaggttttcccaaaacccactagccccacactcacttctgtaaatgtgaagtcagtttcccaccaaccggcagacctgcttcaggtcagccttatgaatggactctctatgccattcactcagccccttgcctttctggagca

SEQ ID NO: 104910 - DNA, 201 bp, Bos taurus; identical to SEQ ID NO: 23636

SEQ ID NO: 104911 - DNA, 201 bp, Bos taurus; identical to SEQ ID NO: 23637

SEQ ID NO: 104912 - DNA, 201 bp, Bos taurus; identical to SEQ ID NO: 23639

SEQ ID NO: 104913 - DNA, 201 bp, Bos taurus; identical to SEQ ID NO: 23641

SEQ ID NO: 104914 - DNA, 201 bp, Bos taurus; identical to SEQ ID NO: 23643

SEQ ID NO: 104915 - DNA, 201 bp, Bos taurus; identical to SEQ ID NO: 23644

SEQ ID NO: 104916 - DNA, 201 bp, Bos taurus; identical to SEQ ID NO: 23647

SEQ ID NO: 104917 - DNA, 201 bp, Bos taurus; identical to SEQ ID NO: 23648

SEQ ID NO: 104918 - DNA, 201 bp, Bos taurus; identical to SEQ ID NO: 23651

SEQ ID NO: 104919 - DNA, 201 bp, Bos taurus; identical to SEQ ID NO: 23652

SEQ ID NO: 104920 - DNA, 201 bp, Bos taurus
tgcgtcctgtagatggttgggcaggaggctttccctctaccaccaggaatccagcgtcttcacggaccagcatctgcagagccaacgcatcacgagaaatcttaggtgttcaccacatgtgcatcctccctgagctcactagagctccaccagaccaccctccagtgtctccatcttgtccagaacttgtgtctgcctcat

SEQ ID NO: 104921 - DNA, 201 bp, Bos taurus; identical to SEQ ID NO: 23653

SEQ ID NO: 104922 - DNA, 201 bp, Bos taurus; identical to SEQ ID NO: 23654

SEQ ID NO: 104923 - DNA, 201 bp, Bos taurus; identical to SEQ ID NO: 23655

SEQ ID NO: 104924 - DNA, 201 bp, Bos taurus; identical to SEQ ID NO: 23656

SEQ ID NO: 104925 - DNA, 201 bp, Bos taurus; identical to SEQ ID NO: 23657

SEQ ID NO: 104926 - DNA, 201 bp, Bos taurus; identical to SEQ ID NO: 23658

SEQ ID NO: 104927 - DNA, 201 bp, Bos taurus; identical to SEQ ID NO: 23659

SEQ ID NO: 104928 - DNA, 201 bp, Bos taurus; identical to SEQ ID NO: 23660

SEQ ID NO: 104929 - DNA, 201 bp, Bos taurus; identical to SEQ ID NO: 23661

SEQ ID NO: 104930 - DNA, 201 bp, Bos taurus; identical to SEQ ID NO: 64179

SEQ ID NO: 104931 - DNA, 201 bp, Bos taurus; identical to SEQ ID NO: 23662

SEQ ID NO: 104932 - DNA, 201 bp, Bos taurus; identical to SEQ ID NO: 23663

SEQ ID NO: 104933 - DNA, 201 bp, Bos taurus; identical to SEQ ID NO: 23668

SEQ ID NO: 104934 - DNA, 201 bp, Bos taurus; identical to SEQ ID NO: 23670

SEQ ID NO: 104935 - DNA, 201 bp, Bos taurus; identical to SEQ ID NO: 23671

SEQ ID NO: 104936 - DNA, 201 bp, Bos taurus; identical to SEQ ID NO: 23672

SEQ ID NO: 104937 - DNA, 201 bp, Bos taurus; identical to SEQ ID NO: 23673

SEQ ID NO: 104938 - DNA, 201 bp, Bos taurus; identical to SEQ ID NO: 23674

SEQ ID NO: 104939 - DNA, 201 bp, Bos taurus; identical to SEQ ID NO: 23675

SEQ ID NO: 104940 - DNA, 201 bp, Bos taurus; identical to SEQ ID NO: 23677

SEQ ID NO: 104941 - DNA, 201 bp, Bos taurus; identical to SEQ ID NO: 23679

SEQ ID NO: 104942 - DNA, 201 bp, Bos taurus; identical to SEQ ID NO: 23680

SEQ ID NO: 104943 - DNA, 201 bp, Bos taurus; identical to SEQ ID NO: 23681

SEQ ID NO: 104944 - DNA, 201 bp, Bos taurus; identical to SEQ ID NO: 23682

SEQ ID NO: 104945 - DNA, 201 bp, Bos taurus; identical to SEQ ID NO: 23683

SEQ ID NO: 104946 - DNA, 201 bp, Bos taurus; identical to SEQ ID NO: 23684

SEQ ID NO: 104947 - DNA, 201 bp, Bos taurus; identical to SEQ ID NO: 23685

SEQ ID NO: 104948 - DNA, 201 bp, Bos taurus; identical to SEQ ID NO: 23686

SEQ ID NO: 104949 - DNA, 201 bp, Bos taurus; identical to SEQ ID NO: 23687

SEQ ID NO: 104950 - DNA, 201 bp, Bos taurus; identical to SEQ ID NO: 23688

SEQ ID NO: 104951 - DNA, 201 bp, Bos taurus; identical to SEQ ID NO: 23689

SEQ ID NO: 104952 - DNA, 201 bp, Bos taurus; identical to SEQ ID NO: 23690

SEQ ID NO: 104953 - DNA, 201 bp, Bos taurus; identical to SEQ ID NO: 23692

SEQ ID NO: 104954 - DNA, 201 bp, Bos taurus; identical to SEQ ID NO: 23694

SEQ ID NO: 104955 - DNA, 201 bp, Bos taurus; identical to SEQ ID NO: 64222

SEQ ID NO: 104956 - DNA, 201 bp, Bos taurus; identical to SEQ ID NO: 23696

SEQ ID NO: 104957 - DNA, 201 bp, Bos taurus; identical to SEQ ID NO: 23697

SEQ ID NO: 104958 - DNA, 201 bp, Bos taurus; identical to SEQ ID NO: 23698

SEQ ID NO: 104959 - DNA, 201 bp, Bos taurus; identical to SEQ ID NO: 23699

SEQ ID NO: 104960 - DNA, 201 bp, Bos taurus; identical to SEQ ID NO: 23701

SEQ ID NO: 104961 - DNA, 201 bp, Bos taurus; identical to SEQ ID NO: 23703

SEQ ID NO: 104962 - DNA, 201 bp, Bos taurus
agctgtatacacttaggatatgcactctttttggtaggtatgtcatactttaatattttaaactatactttgaaaagtagaaagagcaatggccttgaagtgaaaacctgatgctgccaccaactccttctgcaatactgaaaatgtccatttaattccttgggcctcagtttcctcatctgtaaaaggaaacctgatgaa

SEQ ID NO: 104963 - DNA, 201 bp, Bos taurus; identical to SEQ ID NO: 23704

SEQ ID NO: 104964 - DNA, 201 bp, Bos taurus
tctgagaacagggccttcttgggagaaacaattgcaacacggctgagaggctgtgaggtcagggagggtcctgggtcacggagggttgtggtgggggggggttgtccaaatgtctgttcctggcctctgttccctcaggcagagtcttgcatggcggcacccctgcgagagtgggcaaatgagaaacttcaccatcactcc

SEQ ID NO: 104965 - DNA, 201 bp, Bos taurus; identical to SEQ ID NO: 23705

SEQ ID NO: 104966 - DNA, 201 bp, Bos taurus; identical to SEQ ID NO: 23706

SEQ ID NO: 104967 - DNA, 201 bp, Bos taurus
aaggaccagctgtttgagttaaatagaccaaaatttcaaaaaagaactcagcaaggataatagttcgcagactcttcttgttctctgagaggtgttttgtatttggaggactggagggcagaggggcaagaagcacgggctgttgagactgtgtttaccgagagctgaaatacgccatgttcagagtgtggcgggaacata

SEQ ID NO: 104968 - DNA, 201 bp, Bos taurus
gagttggggctaaatttgtaagatatttgtgctcctggacccttgccagcccgaagtagctgtgttcctccagccgaggcctccccacccgtggatggtctgctccctctctagctcttgcttggtctctgagctggtaatggctcccctccatcactggcctgtggacttcactgtcctttagtgctgccctagcttctg

SEQ ID NO: 104969 - DNA, 201 bp, Bos taurus; identical to SEQ ID NO: 23708

SEQ ID NO: 104970 - DNA, 201 bp, Bos taurus; identical to SEQ ID NO: 23709

SEQ ID NO: 104971 - DNA, 201 bp, Bos taurus; identical to SEQ ID NO: 23710

SEQ ID NO: 104972 - DNA, 201 bp, Bos taurus
gcttcatttcagatgtgtagtgatggcatcgctcagttttttccagacacctggtcaacggccatcatttccctacattttcccatgtcattccggcctcgtcttggagctaacgtgtgcccaggatgcctagctttgatcatgctgtaacccatctgtgggcagttaaggatgcgcaccaagcacatccctttgactaaa

SEQ ID NO: 104973 - DNA, 201 bp, Bos taurus
tgtgtctgaaggcatgggaaatcccttatgaatgtcaacttgatcttccccatcgacccacttacagatgataaagagccagcatcttaagattcctctgcagcggaaggcctgtgccctctgtgaaccgacttttcttattaaatccattgaaatcagggctcaagacaccataagagaagaagtcataaatgacagaaa

SEQ ID NO: 104974 - DNA, 201 bp, Bos taurus
ttagcgactgaacaagaacaagatcacgctttatcttacttgtaattagtaacatatccactgcatgtctcctcctccagtgaggagtaacaggatggggatgcagctatgccatcatcatcaggggccctaaaggacaacctggctcccaagaagggactagaattttactgggacactcttttatctacactcaggaca

SEQ ID NO: 104975 - DNA, 201 bp, Bos taurus; identical to SEQ ID NO: 23711

SEQ ID NO: 104976 - DNA, 201 bp, Bos taurus; identical to SEQ ID NO: 23712

SEQ ID NO: 104977 - DNA, 201 bp, Bos taurus; identical to SEQ ID NO: 23713

SEQ ID NO: 104978 - DNA, 201 bp, Bos taurus; identical to SEQ ID NO: 23714

SEQ ID NO: 104979 - DNA, 201 bp, Bos taurus; identical to SEQ ID NO: 23715

SEQ ID NO: 104980 - DNA, 201 bp, Bos taurus; identical to SEQ ID NO: 23716

SEQ ID NO: 104981 - DNA, 201 bp, Bos taurus; identical to SEQ ID NO: 23717

SEQ ID NO: 104982 - DNA, 201 bp, Bos taurus; identical to SEQ ID NO: 23718

SEQ ID NO: 104983 - DNA, 201 bp, Bos taurus; identical to SEQ ID NO: 23719

SEQ ID NO: 104984 - DNA, 201 bp, Bos taurus; identical to SEQ ID NO: 23720

SEQ ID NO: 104985 - DNA, 201 bp, Bos taurus; identical to SEQ ID NO: 23721

SEQ ID NO: 104986 - DNA, 201 bp, Bos taurus
tattcttaaaattagaggaaaaatgaataggctcaaaataggaggcacagaacgtgaatgaaaaataattgttataacaaagtgcgagcgtaatgctttttgaagcatccccattgaagaaggatgttaatcctttcttaatttttcatggaactgttgtaagcatattacttagagaggtaaatctatgacactttttaa

SEQ ID NO: 104987 - DNA, 201 bp, Bos taurus; identical to SEQ ID NO: 23722

SEQ ID NO: 104988 - DNA, 201 bp, Bos taurus; identical to SEQ ID NO: 23723

SEQ ID NO: 104989 - DNA, 201 bp, Bos taurus
ctccatttcatccttgccaatggtgtcacctgctctgctgcaaatattttatccccaaaagacaagtctcttaaatgccaaaccaaatggaaacaaaggtaagaggacatatattcacatttagagtctggacatctgaatcaatacgtatggctcagagcattaacccactttattgacatagcagccttcttctgagct

SEQ ID NO: 104990 - DNA, 201 bp, Bos taurus; identical to SEQ ID NO: 23724

SEQ ID NO: 104991 - DNA, 201 bp, Bos taurus
cgcacagagtcagacacgactgaagcggcttagcagcagcagcagcatacatgtatatatttccttgctctgtcacctgagagggcctagatgcaatgacaactcagtagtaatacgcacacctagtgccctgatcttgcttttatatatgtattttctggccacgccatgcaacttgtgagattttagttcctcaaccag

SEQ ID NO: 104992 - DNA, 201 bp, Bos taurus; identical to SEQ ID NO: 23725

SEQ ID NO: 104993 - DNA, 201 bp, Bos taurus
actctgcatattttggcagcttccctaagtgtactaataactcatgccaagtacagttggaatgcttcatgagtccagactcagaaagcaactgaatcaaacagtgttcatcttaaaatgatggctgatttgtggtgagtcaagaaacactggactatatatcttaaggtctggaagatccaaaggataagctaatgtgat

SEQ ID NO: 104994 - DNA, 201 bp, Bos taurus; identical to SEQ ID NO: 23726

SEQ ID NO: 104995 - DNA, 201 bp, Bos taurus; identical to SEQ ID NO: 23727

SEQ ID NO: 104996 - DNA, 201 bp, Bos taurus
tgaagctctaactgtcaatgtgactgtatatggagatggggatatttaaagatacgattaaggttaaacaagaccataagggtggggcctaatctgataggaataatgtccttataagaatggaaaaatatttcagggatgtgcatgtacagagaaaaggccatgagaagacagaacaagaagatggccaactacagctca

SEQ ID NO: 104997 - DNA, 201 bp, Bos taurus
gtgccattaattttactatgtattaccaaattcttctcccaagtgttttctcaatttatatttccatgaaaaaaaactctttcttgcatgctctacccaataaaatatatgatcatattttaattttgttaaccaagtgggtatgaaataccaaaatattttattttatgtttttctaaaagttgtaatagatgtcagtta

SEQ ID NO: 104998 - DNA, 201 bp, Bos taurus
catgagattgaatagaaaactacttttatttttcatctcaaataatataaaccaccccatttcaaatatgggaactagtattagatatctacagaattgtcgttgctcagtcactaagtcgtgtctgaccctttgcaaccccatggactggagcacgccaggacactgcatttgaaaatcaagatacttcaagaagtagtt

SEQ ID NO: 104999 - DNA, 201 bp, Bos taurus
actaaatggactactatttgaaagaatactacattaatggtaaaacaattattctcaggaaagagaacatctgaataagactgggagaaaataaaagatagtggggtcagggaggaatttacgtctagattttaatgctgtctttgaatgtcttaatctttatatctagtttttaatgctgtctttgaatgccttagtctc

SEQ ID NO: 105000 - DNA, 201 bp, Bos taurus
ccagcgtcacccacccgagcctggcgacaggcgcgcccaggcgagctccgcggggccgaggtgtctggagagcggccccgggcgcccgcgcgcggcccactgagggtaaccagaaaagccagcctcggggtcgaagtcataaagttactaatcctgtgcagggggagtaagcgtgcctcgggccgcctggggcggtcattt

SEQ ID NO: 105001 - DNA, 201 bp, Bos taurus; identical to SEQ ID NO: 23731

SEQ ID NO: 105002 - DNA, 201 bp, Bos taurus; identical to SEQ ID NO: 23732

SEQ ID NO: 105003 - DNA, 201 bp, Bos taurus; identical to SEQ ID NO: 23733

SEQ ID NO: 105004 - DNA, 201 bp, Bos taurus; identical to SEQ ID NO: 23734

SEQ ID NO: 105005 - DNA, 201 bp, Bos taurus; identical to SEQ ID NO: 23735

SEQ ID NO: 105006 - DNA, 201 bp, Bos taurus
cttaaaattggccactatgcacacagagaacattagcactgtgacataatgggcatgtctgtgagcttgcttgtgatgctcacttcacagtgcacacctgtgtcaaatcatcacattgtgatgattaaacatacacaatttttatcttaaacatacacaatttttatctattttatgccaataaagctggaaaaaaatctt

SEQ ID NO: 105007 - DNA, 201 bp, Bos taurus; identical to SEQ ID NO: 23737

SEQ ID NO: 105008 - DNA, 201 bp, Bos taurus
ttgtttcccaagtgcctgaagcaggtctctaatccactctaaataaactctaatccactcctattgttttgttttttttttcactcctattgttttgaataggttttaataattcccaaatcatatctgcagtccccagctttttttcaggattctctctcatccagtgcaagaaacactagtagtcgactaagcagagta

SEQ ID NO: 105009 - DNA, 201 bp, Bos taurus; identical to SEQ ID NO: 23738

SEQ ID NO: 105010 - DNA, 201 bp, Bos taurus
atccagaccatctctgaggagggtgccctgctagacgtggaggaccgtgtcatgtggactgttctgctcctacctgtggcctgactcatccatggcccccaatggacacacggtgcagagcaccaactgcccggactctataatgtggtgacttggcttctcagggctttgcctgctctttctttattctcagtggatcag

SEQ ID NO: 105011 - DNA, 201 bp, Bos taurus
atgggataagaatctgtgtgtggctctcctataccattagacactggcaggcacctctgttccttttaatccccagatataacaggatgcctctgactctagttacttccaactgccattcataaaactggtggccagacctctcagggggtggtggttctagtgcctttcagactgtcagagcccacttgcccttccctc

SEQ ID NO: 105012 - DNA, 201 bp, Bos taurus
agctgccatgcgggaggaacctgtgtggaggccagaaggggaccctgggtcctcccccgcttagagccgtatgtttggtgaagatttagggtagagaaccaggcaggtacccgtgctggcccttgcctgcctccatctccttcacatcgggctgtctcccctgtgtttcatgatctttttgttccaagcaccacagcttca

SEQ ID NO: 105013 - DNA, 201 bp, Bos taurus; identical to SEQ ID NO: 23743

SEQ ID NO: 105014 - DNA, 201 bp, Bos taurus; identical to SEQ ID NO: 23747

SEQ ID NO: 105015 - DNA, 201 bp, Bos taurus
ggtagggctgtgggccaggcttcacgtttgcccttgggtgggtggggccttaggctgtgctccctgcctgcacatttccacagactggactccatgagctagcagggttaaatggacagatgggtaatcaggctgtgccccaaagttgatcaaggctacagatggggctttgcaatcagataggccattggttgtgttctg

SEQ ID NO: 105016 - DNA, 201 bp, Bos taurus
ttgcaccctttgtttggggggcctattcaaaaatatttctatcattttgtattctttccatgtagttctttcaataatttaaagctgtggatacacgttgtcccaactgcttgttattttggccagaaatgttgctaataattgaggaaaataaaagcagtttaacaaattctgttgaaaacaagatgaaagggtgaataa

SEQ ID NO: 105017 - DNA, 201 bp, Bos taurus
ttcttgtattatagtttttgctgtatcagccataatcaaaagcacatatgcaagcatgaagatgaatttcagtaaatacagtcctgtcagtatccgaatatgtgactcccacccttttctctcttgccttttcagtgttgtagagaatgaggtggttaagcagtcagcatgtctccctgcagtttcagttagtagcacctt

SEQ ID NO: 105018 - DNA, 201 bp, Bos taurus
ttgtccctggagttctctgctgtctagatattaccattccacaatgatgaccacagagatagcaacatcaccctgtaccactcaggccctttgagtgtgcgtggctgattaacacagacacactcattaggatgacatgttatggtgcatttgtagttggggccctggaattctctctttttctttaaactgaagtagagt

SEQ ID NO: 105019 - DNA, 201 bp, Bos taurus; identical to SEQ ID NO: 23750

SEQ ID NO: 105020 - DNA, 201 bp, Bos taurus; identical to SEQ ID NO: 23751

SEQ ID NO: 105021 - DNA, 201 bp, Bos taurus; identical to SEQ ID NO: 23754

SEQ ID NO: 105022 - DNA, 201 bp, Bos taurus; identical to SEQ ID NO: 23758

SEQ ID NO: 105023 - DNA, 201 bp, Bos taurus
gcaggcaacagagcatgggacaaactgctttgggtctaaccaaccgttccctatcataatgccaaatctgatgaagggacttcagggaaacctcgggtttggggcttctccccttcatgctggaatgattcaaaactgtgtatacaaactgattattctgaccaaatgacgtgatatgaacttccatgagaatgacagctc

SEQ ID NO: 105024 - DNA, 201 bp, Bos taurus
ttacctggattttttgacaaggttgaatcaagtgaaaatagactccattcattgaacctttgattgagggtgggtggtgattcatacattctaaaggttaaaaactcttaggacacttaggactttgcctctttgagatgttggctggcctctctccatttcaatggaaacagttgtggtcagtctaatactataaagaga

SEQ ID NO: 105025 - DNA, 201 bp, Bos taurus; identical to SEQ ID NO: 23766

SEQ ID NO: 105026 - DNA, 201 bp, Bos taurus
acgtatcaccttttaagtttccagttatgaaggctgagctccgcagatttgccatgagattcccagtttccacaagcccctcaggcctttctcaacatcccgctggtgccttcttgtcccctccagaccatgtcccttgtgacagccattgtgttctactggccgtggtcaccgcggcctcagccttggtagcccagcacg

SEQ ID NO: 105027 - DNA, 201 bp, Bos taurus; identical to SEQ ID NO: 23767

SEQ ID NO: 105028 - DNA, 201 bp, Bos taurus
ataaaacctcaccttcttctaagacaattataatccgaagaaatcattccttctttggatttctttaagctcaaggaacagtctcgtgtggaaaggcccccgaccccctaaatgttcttccctggatgctgagcattaaaaaagagaacacaagaacaagttcatggtagagtagtaatataatgataaatgtaacttcag

SEQ ID NO: 105029 - DNA, 201 bp, Bos taurus
aaaaatgaaatgaatatagtgtctcccccttctttcgtattctgcactgtcacagagaaaaaagtctcaagcatccactctggccacatcacactcacaccgcaacacgcagagaaggggctctggctggacaacagggtccagaagccactggcacgcgcccaaaaggatgctccccaaagcccttaattatgagacctg

SEQ ID NO: 105030 - DNA, 201 bp, Bos taurus; identical to SEQ ID NO: 23768

SEQ ID NO: 105031 - DNA, 201 bp, Bos taurus
atattgtattttttttaagtttaaaataatattgtatattgtccttgtttacttgaagaggagcttgttttatggctagaacatcattacttacttttttttttacttactgtttttaatagtctcactgcttccccaggtctgtttctatttattgtatgttgtgggaaaacagctaaaaacacatttcttattgagtga

SEQ ID NO: 105032 - DNA, 201 bp, Bos taurus
tctagggcaacagaaagttcttctcatgccccagccttagactcaacctctttcttctccaaggagctctggtgctttttagggggaaatggtagtaatttgattctgggacagagtcacttccgttgtgacaaaagcagggcagaaagttcccagttttacaacttggccactgtttctcaaacctcagttatctaggac

SEQ ID NO: 105033 - DNA, 201 bp, Bos taurus; identical to SEQ ID NO: 23769

SEQ ID NO: 105034 - DNA, 201 bp, Bos taurus; identical to SEQ ID NO: 23772

SEQ ID NO: 105035 - DNA, 201 bp, Bos taurus; identical to SEQ ID NO: 23773

SEQ ID NO: 105036 - DNA, 201 bp, Bos taurus; identical to SEQ ID NO: 23775

SEQ ID NO: 105037 - DNA, 201 bp, Bos taurus; identical to SEQ ID NO: 23778

SEQ ID NO: 105038 - DNA, 201 bp, Bos taurus; identical to SEQ ID NO: 23780

SEQ ID NO: 105039 - DNA, 201 bp, Bos taurus; identical to SEQ ID NO: 23781

SEQ ID NO: 105040 - DNA, 201 bp, Bos taurus; identical to SEQ ID NO: 23786

SEQ ID NO: 105041 - DNA, 201 bp, Bos taurus; identical to SEQ ID NO: 23789

SEQ ID NO: 105042 - DNA, 201 bp, Bos taurus; identical to SEQ ID NO: 23790

SEQ ID NO: 105043 - DNA, 201 bp, Bos taurus; identical to SEQ ID NO: 23793

SEQ ID NO: 105044 - DNA, 201 bp, Bos taurus; identical to SEQ ID NO: 23794

SEQ ID NO: 105045 - DNA, 201 bp, Bos taurus; identical to SEQ ID NO: 23795

SEQ ID NO: 105046 - DNA, 201 bp, Bos taurus; identical to SEQ ID NO: 23796

SEQ ID NO: 105047 - DNA, 201 bp, Bos taurus; identical to SEQ ID NO: 23797

SEQ ID NO: 105048 - DNA, 201 bp, Bos taurus; identical to SEQ ID NO: 23798

SEQ ID NO: 105049 - DNA, 201 bp, Bos taurus; identical to SEQ ID NO: 23799

SEQ ID NO: 105050 - DNA, 201 bp, Bos taurus; identical to SEQ ID NO: 23800

SEQ ID NO: 105051 - DNA, 201 bp, Bos taurus; identical to SEQ ID NO: 23801

SEQ ID NO: 105052 - DNA, 201 bp, Bos taurus; identical to SEQ ID NO: 23802

SEQ ID NO: 105053 - DNA, 201 bp, Bos taurus; identical to SEQ ID NO: 23803

SEQ ID NO: 105054 - DNA, 201 bp, Bos taurus; identical to SEQ ID NO: 23804

SEQ ID NO: 105055 - DNA, 201 bp, Bos taurus; identical to SEQ ID NO: 23805

SEQ ID NO: 105056 - DNA, 201 bp, Bos taurus; identical to SEQ ID NO: 23806

SEQ ID NO: 105057 - DNA, 201 bp, Bos taurus; identical to SEQ ID NO: 23807

SEQ ID NO: 105058 - DNA, 201 bp, Bos taurus; identical to SEQ ID NO: 23808

SEQ ID NO: 105059 - DNA, 201 bp, Bos taurus; identical to SEQ ID NO: 23809

SEQ ID NO: 105060 - DNA, 201 bp, Bos taurus; identical to SEQ ID NO: 23810

SEQ ID NO: 105061 - DNA, 201 bp, Bos taurus; identical to SEQ ID NO: 23811

SEQ ID NO: 105062 - DNA, 201 bp, Bos taurus; identical to SEQ ID NO: 23812

SEQ ID NO: 105063 - DNA, 201 bp, Bos taurus; identical to SEQ ID NO: 23813

SEQ ID NO: 105064 - DNA, 201 bp, Bos taurus; identical to SEQ ID NO: 23814

SEQ ID NO: 105065 - DNA, 201 bp, Bos taurus; identical to SEQ ID NO: 23815

SEQ ID NO: 105066 - DNA, 201 bp, Bos taurus; identical to SEQ ID NO: 23816

SEQ ID NO: 105067 - DNA, 201 bp, Bos taurus; identical to SEQ ID NO: 23817

SEQ ID NO: 105068 - DNA, 201 bp, Bos taurus; identical to SEQ ID NO: 23818

SEQ ID NO: 105069 - DNA, 201 bp, Bos taurus
acactttcaatgtccacaatgttatatgtcaaatacattcaatataaatgctggaaagatagaatttttaaacagaaatggaaatcattggtgtaattttgttaaatactagagaacaggaaggagggccttggctccggctttctattttccatcatctatctaaatatgactgttagtccctgtgaaatatggatatat

SEQ ID NO: 105070 - DNA, 201 bp, Bos taurus; identical to SEQ ID NO: 23819

SEQ ID NO: 105071 - DNA, 201 bp, Bos taurus; identical to SEQ ID NO: 23820

SEQ ID NO: 105072 - DNA, 201 bp, Bos taurus; identical to SEQ ID NO: 23822

SEQ ID NO: 105073 - DNA, 201 bp, Bos taurus; identical to SEQ ID NO: 23823

SEQ ID NO: 105074 - DNA, 201 bp, Bos taurus; identical to SEQ ID NO: 23824

SEQ ID NO: 105075 - DNA, 201 bp, Bos taurus; identical to SEQ ID NO: 23825

SEQ ID NO: 105076 - DNA, 201 bp, Bos taurus; identical to SEQ ID NO: 23827

SEQ ID NO: 105077 - DNA, 201 bp, Bos taurus
ttcttctctaaattaattgtttgtcagtacccaagaagcctctgaatggctttcagtcatctaaaggttcactttctttttccttttttcttcctagaggctacatggtgatgggagattctttcaacacttctctcttcaagcagacattccaaagaattttcagtaaagattttaatggcaatttccgaatggcctttg

SEQ ID NO: 105078 - DNA, 201 bp, Bos taurus; identical to SEQ ID NO: 23829

SEQ ID NO: 105079 - DNA, 201 bp, Bos taurus; identical to SEQ ID NO: 23830

SEQ ID NO: 105080 - DNA, 201 bp, Bos taurus; identical to SEQ ID NO: 23831

SEQ ID NO: 105081 - DNA, 201 bp, Bos taurus; identical to SEQ ID NO: 23832

SEQ ID NO: 105082 - DNA, 201 bp, Bos taurus; identical to SEQ ID NO: 23834

SEQ ID NO: 105083 - DNA, 201 bp, Bos taurus
gcctgagctcacacagaccagagttagtatgaatctacatttctgggttttccaggatgaagtaaatttgaagtcttttatcacatgatcccttctttatgtatccctaaggaatcttatctggccccgtggattttttttttttaacttttaattttgaaataattatagagtcacaggcagttgcaaaatcagttgcaa

SEQ ID NO: 105084 - DNA, 201 bp, Bos taurus; identical to SEQ ID NO: 23835

SEQ ID NO: 105085 - DNA, 201 bp, Bos taurus; identical to SEQ ID NO: 23837

SEQ ID NO: 105086 - DNA, 201 bp, Bos taurus; identical to SEQ ID NO: 23838

SEQ ID NO: 105087 - DNA, 201 bp, Bos taurus; identical to SEQ ID NO: 23839

SEQ ID NO: 105088 - DNA, 201 bp, Bos taurus; identical to SEQ ID NO: 23840

SEQ ID NO: 105089 - DNA, 201 bp, Bos taurus
tctcctagatggggaggaggaggaagaggccacacagacatctaccatttttggctacaaagcatttctccctgttcctaaggtcacttcctgtgccatttgggaaatactccttccccatctaggagaacataagatccctgcctttccctagaagtgtgacctctggggtcctctgctgttacttacctcttcttcccc

SEQ ID NO: 105090 - DNA, 201 bp, Bos taurus; identical to SEQ ID NO: 23842

SEQ ID NO: 105091 - DNA, 201 bp, Bos taurus
tcaggctgtagcacagacactcatggagtgctcagttctctttacatccaaccccatttaaacccccacaacgatcccccaaggcaggccctcccgtcagtgctactctgtggtgaggcaagcggactcagaggctgagtaactggcacatgccggcacccggcagagtgggggccacccaggggccctgtgcaccaccca

SEQ ID NO: 105092 - DNA, 201 bp, Bos taurus
tgggcaggacaaccccactgttaggccagcccatggctactcctctgtctacgcttccttctgcggaaaagggaaggagcccagggaatggtgtcactggatgtgtggaggcctgcgacagtgtcttctctcccctagcctggtgctgacgggaggggtcaagcccagggtccagatgaaggactggacaggacaggtctt

SEQ ID NO: 105093 - DNA, 201 bp, Bos taurus; identical to SEQ ID NO: 23846

SEQ ID NO: 105094 - DNA, 201 bp, Bos taurus; identical to SEQ ID NO: 23847

SEQ ID NO: 105095 - DNA, 201 bp, Bos taurus
ctccactctagctgacctcacctggaggtgcacagcccagacctgcctctggtctgcttctgacacacccaacatatctcatgtggtggtgagagtcccagagagagtgaggtcaaaggccaatggctaaaatcctgagggcactgcagctatgactggagtgacaacagatgagccagtatagaccactggagcctggat

SEQ ID NO: 105096 - DNA, 201 bp, Bos taurus
gcaaatcaggtcacacgttacttcttcagagagctcacttttttgaatactacctatagccaccatcactccattattttctgtaacatagggtcagtaccttggggccctcaggctaaatagcgcttactgcctattttcctaaataaaattgtattggaatgcagccacatttattttttaagattgcctgtggctgtt

SEQ ID NO: 105097 - DNA, 201 bp, Bos taurus; identical to SEQ ID NO: 23848

SEQ ID NO: 105098 - DNA, 201 bp, Bos taurus
ctgtccatgggattctccaggcaagaatattggagtgggtcaccatgcattcctccaggggatcatcctgaccctaggatcaaacccacaaagaggccaaattcaacaaaaccgggtggtctggatcttgtactagaacaagaaccccaaatacaccaaggtagtttgggcacccactgttacaggaactggcccctaatt

SEQ ID NO: 105099 - DNA, 201 bp, Bos taurus; identical to SEQ ID NO: 23849

SEQ ID NO: 105100 - DNA, 201 bp, Bos taurus
acagcttcctacaaatagaatgtcctaattcagtatgtcagttggatcattcgatgaggtgaataaatcatttgtaatcagaataaaagaaataatgtatgcaaagaaaagccaaaaatgcaaattaaggaaaacatgcattttgctggctttctttgataatctacttgcatgtgttaaaaaaaaaaaaatagcacacca

SEQ ID NO: 105101 - DNA, 201 bp, Bos taurus
actttctgataaaaagatgttatttttatttggttaacattaaaactggatttggaagaaccatgcaaattcatacttgtaataaatgcatttatgtaggtacatttaaatttcccattcacaagtacatacgctctttctgaataaggtactttattgcctggcataaggcacttatgcaaaggtttagaaataccaggc

SEQ ID NO: 105102 - DNA, 201 bp, Bos taurus
ttcaataacttattcaccaaaaattgattttaggcttccaagggtacatgagagtaaataagagagccttgcgccctcatgtttagggtatgtgggcagcgtagcggccagggctcatggttcaaaaccctaaagccatgcacacagggctaaatgctcaatgctgcctccctgaaactctgaataaggccagtatttctc

SEQ ID NO: 105103 - DNA, 201 bp, Bos taurus
taatgtctcagatggcaccagcccctccgggtccctacctcagtgaaacgtagcgccttcctgctggcctggcattgtagttaatgagatgtgggtatcaatgaggaaaaagtaaaaagaagaaatacatgaagatatttggttaaaacatgtgatcagtaattcggcagttatggaacgaaatcaatggcaaacagaaat

SEQ ID NO: 105104 - DNA, 201 bp, Bos taurus; identical to SEQ ID NO: 23856

SEQ ID NO: 105105 - DNA, 201 bp, Bos taurus; identical to SEQ ID NO: 23865

SEQ ID NO: 105106 - DNA, 201 bp, Bos taurus
atgcttgtagttcctctgtaactatagatccaaagcaaattgcaagttaatgataaaatgatgggttgtggaaaaaatgagctgcctataggttgaatgtagtgggagatatcctccttcccatgtgcttctctccccaccagccttggcaggtggagctgcttgtgcagttgtgcactcctgatgtggatgttgcagggc

SEQ ID NO: 105107 - DNA, 201 bp, Bos taurus; identical to SEQ ID NO: 23866

SEQ ID NO: 105108 - DNA, 201 bp, Bos taurus; identical to SEQ ID NO: 23870

SEQ ID NO: 105109 - DNA, 201 bp, Bos taurus; identical to SEQ ID NO: 23871

SEQ ID NO: 105110 - DNA, 201 bp, Bos taurus; identical to SEQ ID NO: 23872

SEQ ID NO: 105111 - DNA, 201 bp, Bos taurus; identical to SEQ ID NO: 23873

SEQ ID NO: 105112 - DNA, 201 bp, Bos taurus; identical to SEQ ID NO: 23874

SEQ ID NO: 105113 - DNA, 201 bp, Bos taurus; identical to SEQ ID NO: 23875

SEQ ID NO: 105114 - DNA, 201 bp, Bos taurus; identical to SEQ ID NO: 23876

SEQ ID NO: 105115 - DNA, 201 bp, Bos taurus; identical to SEQ ID NO: 23878

SEQ ID NO: 105116 - DNA, 201 bp, Bos taurus; identical to SEQ ID NO: 23879

SEQ ID NO: 105117 - DNA, 201 bp, Bos taurus; identical to SEQ ID NO: 23880

SEQ ID NO: 105118 - DNA, 201 bp, Bos taurus; identical to SEQ ID NO: 23881

SEQ ID NO: 105119 - DNA, 201 bp, Bos taurus; identical to SEQ ID NO: 23882

SEQ ID NO: 105120 - DNA, 201 bp, Bos taurus; identical to SEQ ID NO: 23883

SEQ ID NO: 105121 - DNA, 201 bp, Bos taurus; identical to SEQ ID NO: 23884

SEQ ID NO: 105122 - DNA, 201 bp, Bos taurus; identical to SEQ ID NO: 23885

SEQ ID NO: 105123 - DNA, 201 bp, Bos taurus; identical to SEQ ID NO: 23886

SEQ ID NO: 105124 - DNA, 201 bp, Bos taurus; identical to SEQ ID NO: 23887

SEQ ID NO: 105125 - DNA, 201 bp, Bos taurus; identical to SEQ ID NO: 23888

SEQ ID NO: 105126 - DNA, 201 bp, Bos taurus
ctcactctttatttttcggccgaggcatgcaggaacgtggctccccgaccaaggaccgaaacctcacccccggcagggaaggtgtggagccctaaccagaggaccaccaggaaatgccctcttaatctttatgtaactgaatatatcaaatctttgtaaatgtatcaatctattttcccccatttttgttcaataaatcct

SEQ ID NO: 105127 - DNA, 201 bp, Bos taurus
ctctccccaaccccgcaaagcaaacttgtggaccggcttcccaccagcagaagcgacagagctcttgggtcgatgcctggctggggccgtgattctgcttcggcatcgtggggggtctccctgcctggtctcttctgttctctccctgcccctgcaattgtttctggggccccaggcaccctgccaatcaggacatctggg

SEQ ID NO: 105128 - DNA, 201 bp, Bos taurus; identical to SEQ ID NO: 23890

SEQ ID NO: 105129 - DNA, 201 bp, Bos taurus; identical to SEQ ID NO: 23891

SEQ ID NO: 105130 - DNA, 201 bp, Bos taurus
cctgcagcaaactagaagctttacaactcttgcccacagatggtttgagaagcacgtcgagaagatatgacgtgtgttcagttaacagggatacgttccttccctgcaccacccgcgtggccagggctgggcgcccagtcagcccccaatgcgaacacgcacccatgttgccattctccatgccgcggatgtcagggcgta

SEQ ID NO: 105131 - DNA, 201 bp, Bos taurus; identical to SEQ ID NO: 23892

SEQ ID NO: 105132 - DNA, 201 bp, Bos taurus; identical to SEQ ID NO: 23893

SEQ ID NO: 105133 - DNA, 201 bp, Bos taurus; identical to SEQ ID NO: 23894

SEQ ID NO: 105134 - DNA, 201 bp, Bos taurus; identical to SEQ ID NO: 23895

SEQ ID NO: 105135 - DNA, 201 bp, Bos taurus
cttgtttaaaatgagaatcctcacgctttacctcagacctactgagtcagaaaccccagggacggagccgcaggtctgtgccaacagcctcaggtggccctgctgccccgtggagttggggctggggtcctcgctccccagcactgggtggcgttcacgtggttccttcatctccccaaaccgtggtgtctatgaatttaa

SEQ ID NO: 105136 - DNA, 201 bp, Bos taurus
tcggatattagaaactcatcttcttgaaatatcttacttacctagaactgcctggtcacctaactgagatttatttccaaaatctcatttggaaaaattatggagattatttcttggggaaatattacacatcacaatgggagaacattttatttcagagaaatggttcttttccatttgatctgcctttaaaatccaccc

SEQ ID NO: 105137 - DNA, 201 bp, Bos taurus
gcagcagcagggctatctgggaaggcatatacaattgattggtgtgtgtaattgtcagacgtattgaatggacacttaagatctgtgcatgttaatgcccataatttataccccaattaaaatgacagtcacatagataaaggtgtctatgtgggattctgcagggaagttctatgaccctggaaactttttgcagaggaa

SEQ ID NO: 105138 - DNA, 201 bp, Bos taurus
ggtggacgtggggagacaccactgttatctatacatgtgcaacaacggctatagcaaactcaggccttccctcataaataaaatcttatgatcatgtgacattctgttttcctattgtcaggagtgatgggagcatctcatttgcaaagagtcttgggaaaacaaaatctgtagaaaacatcatgagatctcaccctttgc

SEQ ID NO: 105139 - DNA, 201 bp, Bos taurus
tgggtatggggcccgctgccactgtgtgagctgccagcaataccatccttgcttccacatgtccacaaaggcagctctcgagactggaagcttctttagccgggcagaaggccaagcggggcgagctggcgagctttttatctcggctctgaactcgtgctctgaggttcagacttaactcagattctcacatgttgggga

SEQ ID NO: 105140 - DNA, 201 bp, Bos taurus
acctgggggagttctcgcataatcccatgctgtttacatttttccagacctctccccagattcccaccttggcttctgctggccattgactcctcactgtggtctttaagtttggtttgggctctgcaaggtctcaagcaacaaaagtgaggttgacttcactctggcccagagacagcatagctcccctacaatgtatgg

SEQ ID NO: 105141 - DNA, 201 bp, Bos taurus; identical to SEQ ID NO: 23898

SEQ ID NO: 105142 - DNA, 201 bp, Bos taurus; identical to SEQ ID NO: 23901

SEQ ID NO: 105143 - DNA, 201 bp, Bos taurus; identical to SEQ ID NO: 23905

SEQ ID NO: 105144 - DNA, 201 bp, Bos taurus; identical to SEQ ID NO: 23906

SEQ ID NO: 105145 - DNA, 201 bp, Bos taurus; identical to SEQ ID NO: 23907

SEQ ID NO: 105146 - DNA, 201 bp, Bos taurus; identical to SEQ ID NO: 23908

SEQ ID NO: 105147 - DNA, 201 bp, Bos taurus; identical to SEQ ID NO: 23910

SEQ ID NO: 105148 - DNA, 201 bp, Bos taurus
actacaagctgtccgctcgctccttcatcggccggcacagccagagcaggaggagggaagatgccctgtcctcggtgagtgcctgagcttctagggccctggatgcccccatcaagtgcgtgtggtgttggggttgagtgctcacaattggggcagacagagcggctcccagcaggatgggccctcgccctcccccagatc

SEQ ID NO: 105149 - DNA, 201 bp, Bos taurus
gctagatggctgtttgaattaggtggcttatggtttacagccaaaaacatcttctgtaagacaagattccaacctacacagaaccccaagtcaggagacccaggtcgattctgggcccagcttctccggaaacctgagaccggcatccatgcctcactctattcacctgtgtggggaggaggcgaatgagacactgcacgt

SEQ ID NO: 105150 - DNA, 201 bp, Bos taurus
tacagtttaagcattttggttacaacgggcaattttctgtacttttttgtgttttcctctgtggattttatggtttcatcaaggcaaagagttacaccaggctgtaattaacagtattgtgcttgtttgaatacttgtttttgtgtattagctccagaaaggtcaggaagaggaacagctgctgactgaaggtggattcag

SEQ ID NO: 105151 - DNA, 201 bp, Bos taurus; identical to SEQ ID NO: 23911

SEQ ID NO: 105152 - DNA, 201 bp, Bos taurus
ggggccagaggaggctgctgggacaaagatgcactgagagctggaggagtccagcaggtgaaagctggaggattcgacagcaagtgcaaaggtcctgtggcgggctctagtgtgggggccctcccagaccacagtgacagctttggcttcttcctcaaggatgatggggagccacagagggttctgagctgggggagtggg

SEQ ID NO: 105153 - DNA, 201 bp, Bos taurus
gaagaggcaggtatagccagagttctatgttcagcaggagtaagatgaggaagcttccaattatcagtttctgtgttctaggactagaggctgcagatcaaatctgcagagacaaagaccaaaggagtgatggatcggaagagagtgaagaagatctaagaacgtgtggcaggcaggtggagaccgagctgaaggcagaag

SEQ ID NO: 105154 - DNA, 201 bp, Bos taurus; identical to SEQ ID NO: 23912

SEQ ID NO: 105155 - DNA, 201 bp, Bos taurus
aagactataaacaaaaatgtccacaccacagttccctttgcaggcacaaaggtgtctctgagggcagcacaggcatcctttttggccagaagccttcattcgctcactcactagttccttgtgtgtcctctggagttacaggagcaaagcacagcctctgcttagggaagcatgtgtcctccggggccacaggaaaccaat

SEQ ID NO: 105156 - DNA, 201 bp, Bos taurus; identical to SEQ ID NO: 23913

SEQ ID NO: 105157 - DNA, 201 bp, Bos taurus; identical to SEQ ID NO: 23919

SEQ ID NO: 105158 - DNA, 201 bp, Bos taurus
catgctgagtgctattatgtgccttggcccattattcaaaataaaaatccttcgaggcaggatctgttattacatttgggtccaaggtcgcacagctgcatgtccaatagaccctggcctctagccccagtcagcctggcttcactggccatcctcccgtcatcacttctggcttttgggaggatgctgtgccttcaggag

SEQ ID NO: 105159 - DNA, 201 bp, Bos taurus; identical to SEQ ID NO: 23924

SEQ ID NO: 105160 - DNA, 201 bp, Bos taurus; identical to SEQ ID NO: 23927

SEQ ID NO: 105161 - DNA, 201 bp, Bos taurus; identical to SEQ ID NO: 23928

SEQ ID NO: 105162 - DNA, 201 bp, Bos taurus; identical to SEQ ID NO: 23930

SEQ ID NO: 105163 - DNA, 201 bp, Bos taurus; identical to SEQ ID NO: 23932

SEQ ID NO: 105164 - DNA, 201 bp, Bos taurus; identical to SEQ ID NO: 23935

SEQ ID NO: 105165 - DNA, 201 bp, Bos taurus; identical to SEQ ID NO: 23937

SEQ ID NO: 105166 - DNA, 201 bp, Bos taurus; identical to SEQ ID NO: 23938

SEQ ID NO: 105167 - DNA, 201 bp, Bos taurus; identical to SEQ ID NO: 23939

SEQ ID NO: 105168 - DNA, 201 bp, Bos taurus; identical to SEQ ID NO: 23941

SEQ ID NO: 105169 - DNA, 201 bp, Bos taurus; identical to SEQ ID NO: 23942

SEQ ID NO: 105170 - DNA, 201 bp, Bos taurus; identical to SEQ ID NO: 23943

SEQ ID NO: 105171 - DNA, 201 bp, Bos taurus; identical to SEQ ID NO: 23944

SEQ ID NO: 105172 - DNA, 201 bp, Bos taurus; identical to SEQ ID NO: 23945

SEQ ID NO: 105173 - DNA, 201 bp, Bos taurus; identical to SEQ ID NO: 23948

SEQ ID NO: 105174 - DNA, 201 bp, Bos taurus; identical to SEQ ID NO: 23949

SEQ ID NO: 105175 - DNA, 201 bp, Bos taurus; identical to SEQ ID NO: 23950

SEQ ID NO: 105176 - DNA, 201 bp, Bos taurus; identical to SEQ ID NO: 23951

SEQ ID NO: 105177 - DNA, 201 bp, Bos taurus; identical to SEQ ID NO: 23955

SEQ ID NO: 105178 - DNA, 201 bp, Bos taurus; identical to SEQ ID NO: 23956

SEQ ID NO: 105179 - DNA, 201 bp, Bos taurus; identical to SEQ ID NO: 23962

SEQ ID NO: 105180 - DNA, 201 bp, Bos taurus; identical to SEQ ID NO: 23964

SEQ ID NO: 105181 - DNA, 201 bp, Bos taurus; identical to SEQ ID NO: 23967

SEQ ID NO: 105182 - DNA, 201 bp, Bos taurus; identical to SEQ ID NO: 23968

SEQ ID NO: 105183 - DNA, 201 bp, Bos taurus; identical to SEQ ID NO: 23969

SEQ ID NO: 105184 - DNA, 201 bp, Bos taurus; identical to SEQ ID NO: 23973

SEQ ID NO: 105185 - DNA, 201 bp, Bos taurus; identical to SEQ ID NO: 23976

SEQ ID NO: 105186 - DNA, 201 bp, Bos taurus; identical to SEQ ID NO: 23977

SEQ ID NO: 105187 - DNA, 201 bp, Bos taurus; identical to SEQ ID NO: 23978

SEQ ID NO: 105188 - DNA, 201 bp, Bos taurus; identical to SEQ ID NO: 23982

SEQ ID NO: 105189 - DNA, 201 bp, Bos taurus; identical to SEQ ID NO: 23983

SEQ ID NO: 105190 - DNA, 201 bp, Bos taurus; identical to SEQ ID NO: 23988

SEQ ID NO: 105191 - DNA, 201 bp, Bos taurus; identical to SEQ ID NO: 23989

SEQ ID NO: 105192 - DNA, 201 bp, Bos taurus; identical to SEQ ID NO: 23990

SEQ ID NO: 105193 - DNA, 201 bp, Bos taurus; identical to SEQ ID NO: 23992

SEQ ID NO: 105194 - DNA, 201 bp, Bos taurus; identical to SEQ ID NO: 23993

SEQ ID NO: 105195 - DNA, 201 bp, Bos taurus; identical to SEQ ID NO: 23994

SEQ ID NO: 105196 - DNA, 201 bp, Bos taurus; identical to SEQ ID NO: 23995

SEQ ID NO: 105197 - DNA, 201 bp, Bos taurus; identical to SEQ ID NO: 23996

SEQ ID NO: 105198 - DNA, 201 bp, Bos taurus; identical to SEQ ID NO: 24002

SEQ ID NO: 105199 - DNA, 201 bp, Bos taurus
aagagtactggagtggggtgccattgtcttctccgattttgtactaagagctatacatatattttttccctctaataaggatccaactagctatatctgtgcccactgaacagatgaggaacctgaggctcgaagcgaacatgtaatttccctgaagacacagagacctggggccaggtctgagattgaaacttgggatgc

SEQ ID NO: 105200 - DNA, 201 bp, Bos taurus; identical to SEQ ID NO: 24006

SEQ ID NO: 105201 - DNA, 201 bp, Bos taurus; identical to SEQ ID NO: 24007

SEQ ID NO: 105202 - DNA, 201 bp, Bos taurus; identical to SEQ ID NO: 24008

SEQ ID NO: 105203 - DNA, 201 bp, Bos taurus; identical to SEQ ID NO: 24009

SEQ ID NO: 105204 - DNA, 201 bp, Bos taurus
aggtgacagcaaagcatgggcctcctgcccgagatcctgggcccaaagggtcaagccgagatggtcactcccccaccccacaaaactccttgcttgggaaacccggacctccggcccctctgccttagcacgtgagagtcctcttctccacccctttcacctgcctctgtatttgacatgttcttacttgctgtgccctgc

SEQ ID NO: 105205 - DNA, 201 bp, Bos taurus; identical to SEQ ID NO: 24010

SEQ ID NO: 105206 - DNA, 201 bp, Bos taurus
atccatggtcagccctccctcgtcttgcggcccgatctcctccccaggctgcggagcctccccgggtctgaacctgctctcctccagcctctgggcccctctttctcccctgtgcctctaatccagctgaggaagggacttccgtttcttgaaaatccccagggggcctccatgcactctccctgtctggtccttcctggc

SEQ ID NO: 105207 - DNA, 201 bp, Bos taurus; identical to SEQ ID NO: 24012

SEQ ID NO: 105208 - DNA, 201 bp, Bos taurus; identical to SEQ ID NO: 24013

SEQ ID NO: 105209 - DNA, 201 bp, Bos taurus; identical to SEQ ID NO: 24014

SEQ ID NO: 105210 - DNA, 201 bp, Bos taurus; identical to SEQ ID NO: 24015

SEQ ID NO: 105211 - DNA, 201 bp, Bos taurus
gtgatgcaagtttggacttgactttaggcaacagtacatccatttccagcccacctgagatccagcaaactggagaatcccagagaccgtttcagagatgtcgagcagaggccagagtggaatctacggatcgactccctcaacatccgtttcaccctcattcctgtatctctctattgcctcgaggccagaaggttaaaa

SEQ ID NO: 105212 - DNA, 201 bp, Bos taurus; identical to SEQ ID NO: 24016

SEQ ID NO: 105213 - DNA, 201 bp, Bos taurus
attcaggtaaccctacagccggcccagggtctggggagacagccaggggaagttttctggatgaaggtcataagtcacccctggcccaggtcctccactgatggttccatctccactggggcacattcacctgctccatctcccagcatttcctctgcttgctgcaccactggtccagagccccagccccctgggccatct

SEQ ID NO: 105214 - DNA, 201 bp, Bos taurus; identical to SEQ ID NO: 24017

SEQ ID NO: 105215 - DNA, 201 bp, Bos taurus
tcctttgatgctgcgcaaggtttgatttcacacaggaggttttctcaccttcattacatatacggggtttctctcctgcatgaattctctgatggatgatgagggctgacttcaggcaggattttccacattcatgacacacatagagtttccttcgttctctgatgctcagtaagattgaacttcacaaagaaggacttt

SEQ ID NO: 105216 - DNA, 201 bp, Bos taurus
aacgatacaaatgtgatgcatgttacaaggcctttaatttttattcactccttattcagcatcagagttcacactggagagaaaccctttcagtgtgatacgtgtggaaaggcctttagccaaaagtcaaccatgcaacgacataaagaaactcatactctagggcaaagctttgaatgtagcagatgtgaagacatcttt

SEQ ID NO: 105217 - DNA, 201 bp, Bos taurus
tccgccctgggaaccaatgtcggtccccagtggcacccactggcctctggaatctcaaacctagcttctggcaggctcaaactagagccaccttgaacaacaacaacaacgaaacaggctggagggcccctgagctatccttaagctacagcatgcagtttggcttcagactccacagaaacaccaagatatcccaggagt

SEQ ID NO: 105218 - DNA, 201 bp, Bos taurus; identical to SEQ ID NO: 24021

SEQ ID NO: 105219 - DNA, 201 bp, Bos taurus; identical to SEQ ID NO: 24022

SEQ ID NO: 105220 - DNA, 201 bp, Bos taurus; identical to SEQ ID NO: 24023

SEQ ID NO: 105221 - DNA, 201 bp, Bos taurus; identical to SEQ ID NO: 24024

SEQ ID NO: 105222 - DNA, 201 bp, Bos taurus; identical to SEQ ID NO: 24025

SEQ ID NO: 105223 - DNA, 201 bp, Bos taurus; identical to SEQ ID NO: 24026

SEQ ID NO: 105224 - DNA, 201 bp, Bos taurus; identical to SEQ ID NO: 24027

SEQ ID NO: 105225 - DNA, 201 bp, Bos taurus
agaggcgctgccatcgtctctgtctgcagaaggcagttggtgacgtgcccgggttcttagaggaagagagtggaggggttggtggtttgactggccatgcggttccaaagtcggctcctccccatggtgatgcctgggtttcttcatgcttgtgaagagccacgggccaattatgctcattacccgttttacagaaggaaa

SEQ ID NO: 105226 - DNA, 201 bp, Bos taurus
attagtgtagggttgatctgggagtgctttaatgtctacttttctctggtgagaaagccatttaattttgtgagatttcaccccaacaagagaggagggcatccaggcatattgaggaagctgtgctctaaacatgctttttccagatgtatagattccaaggtagaagaaggagtgcacatatacaaatcccctgggtcg

SEQ ID NO: 105227 - DNA, 201 bp, Bos taurus; identical to SEQ ID NO: 24031

SEQ ID NO: 105228 - DNA, 201 bp, Bos taurus
agccgggcaatttcaggacgcatgcggtgctgaaacaagacacgtatgtcattaaacacatgggcagagaataaatggacagttttaaagactaagttgccagtggaaaatctggggagatgacatttgaaaagaacagggagaaaagagcagaagagaaacagcttcttcatctgacacaaattcaccacggctggtctt

SEQ ID NO: 105229 - DNA, 201 bp, Bos taurus; identical to SEQ ID NO: 24032

SEQ ID NO: 105230 - DNA, 201 bp, Bos taurus; identical to SEQ ID NO: 24033

SEQ ID NO: 105231 - DNA, 201 bp, Bos taurus; identical to SEQ ID NO: 24034

SEQ ID NO: 105232 - DNA, 201 bp, Bos taurus; identical to SEQ ID NO: 24036

SEQ ID NO: 105233 - DNA, 201 bp, Bos taurus; identical to SEQ ID NO: 24037

SEQ ID NO: 105234 - DNA, 201 bp, Bos taurus; identical to SEQ ID NO: 24038

SEQ ID NO: 105235 - DNA, 201 bp, Bos taurus; identical to SEQ ID NO: 24039

SEQ ID NO: 105236 - DNA, 201 bp, Bos taurus
agtaaaaaacaaaaagactcccaaacaaagaatacatcaaacaggaaagcagagcttatactcttcgtgtttgcaagcgggatttcgggccaagcagcacggaaaccttgaaacagtattttgtgtgtgtgcgtcatgtttctcccaggcaaaggtgctgggtagagcccagaaagcttatggccacagatccaggaatcg

SEQ ID NO: 105237 - DNA, 201 bp, Bos taurus; identical to SEQ ID NO: 24040

SEQ ID NO: 105238 - DNA, 201 bp, Bos taurus; identical to SEQ ID NO: 24042

SEQ ID NO: 105239 - DNA, 201 bp, Bos taurus
cagatagtaaatattttagacttaagggccatatgatctctgtctcagctactcagctctacctttgtagctagaatgtagctgtggacaacacataaacggggcctgtcttcatcctgataaaccttcctttgcaaaaacacaggccacgggctcgatttgccccagaagctgtagttgcctgatctttggtcaacacga

SEQ ID NO: 105240 - DNA, 201 bp, Bos taurus; identical to SEQ ID NO: 24043

SEQ ID NO: 105241 - DNA, 201 bp, Bos taurus
atgatgtgaacatcattattatcccagtgcctagccctagtgatcatcattgtcaccccaataattgatgccttattgaggtctgaccgtgggccaagatatgaacttatcactgtatgtgtgttatcactctacactttcacaacaactctgtgaagtagagggtgttatatggcctcatttctgcaatgagacagttat

SEQ ID NO: 105242 - DNA, 201 bp, Bos taurus
gcagggggcggtgtgtaaaggcctgaggacctcagtaacaatttcagcttctactctgaacgcagtaggaagccacttggagccaagaggagacatgtattcatgaacaaagttacacggcctgaactccgtaaagccagggcagaaactgaatccccagctcacttcctcctgccgtatccatccccactcgcgtgtgct

SEQ ID NO: 105243 - DNA, 201 bp, Bos taurus; identical to SEQ ID NO: 24044

SEQ ID NO: 105244 - DNA, 201 bp, Bos taurus; identical to SEQ ID NO: 24045

SEQ ID NO: 105245 - DNA, 201 bp, Bos taurus; identical to SEQ ID NO: 24046

SEQ ID NO: 105246 - DNA, 201 bp, Bos taurus
ggggcccggaagcagcttctttggtgtgcatcttccggtgatcgatgagactttctttatttggaaacagaaagccgcagaccatgcatatcttatacggcgaggagacgccctcggccgcgggctcctgcaccacctcgttgatggtcgccgggctctccaggccgggctgcagcctgctcttcgcccccgacttgcccg

SEQ ID NO: 105247 - DNA, 201 bp, Bos taurus; identical to SEQ ID NO: 24047

SEQ ID NO: 105248 - DNA, 201 bp, Bos taurus; identical to SEQ ID NO: 24048

SEQ ID NO: 105249 - DNA, 201 bp, Bos taurus; identical to SEQ ID NO: 24050

SEQ ID NO: 105250 - DNA, 201 bp, Bos taurus; identical to SEQ ID NO: 24051

SEQ ID NO: 105251 - DNA, 201 bp, Bos taurus; identical to SEQ ID NO: 24052

SEQ ID NO: 105252 - DNA, 201 bp, Bos taurus
aagatcaattactgctcaacaacagtgatatcatttattggctgtcggctgttgctttaatacaaatacacaaaataacatatatgtaaaatatatttgcgttctgaagcatgataatgaaatagacaaccggaccttagcacccaccttaagaagtcaagtatcacctttatcatcagagttcttgtatgtctctctttg

SEQ ID NO: 105253 - DNA, 201 bp, Bos taurus
tttttgaattcatcagagaaatatatgtacagctcataacaggaatagaagctgcaaagataattcacccactttaagtgccaagtcacagtactcaccatcttccatcttaagtgaagtgtgacagtcgtcagtcatgtccaactctttgcggcctcatggactttagcctgccaggctcctctgtccatagaattctcc

SEQ ID NO: 105254 - DNA, 201 bp, Bos taurus; identical to SEQ ID NO: 24053

SEQ ID NO: 105255 - DNA, 201 bp, Bos taurus; identical to SEQ ID NO: 24055

SEQ ID NO: 105256 - DNA, 201 bp, Bos taurus; identical to SEQ ID NO: 24056

SEQ ID NO: 105257 - DNA, 201 bp, Bos taurus; identical to SEQ ID NO: 24059

SEQ ID NO: 105258 - DNA, 201 bp, Bos taurus; identical to SEQ ID NO: 24060

SEQ ID NO: 105259 - DNA, 201 bp, Bos taurus; identical to SEQ ID NO: 24061

SEQ ID NO: 105260 - DNA, 201 bp, Bos taurus; identical to SEQ ID NO: 24062

SEQ ID NO: 105261 - DNA, 201 bp, Bos taurus; identical to SEQ ID NO: 24063

SEQ ID NO: 105262 - DNA, 201 bp, Bos taurus; identical to SEQ ID NO: 24064

SEQ ID NO: 105263 - DNA, 201 bp, Bos taurus; identical to SEQ ID NO: 24065

SEQ ID NO: 105264 - DNA, 201 bp, Bos taurus; identical to SEQ ID NO: 24066

SEQ ID NO: 105265 - DNA, 201 bp, Bos taurus; identical to SEQ ID NO: 24067

SEQ ID NO: 105266 - DNA, 201 bp, Bos taurus; identical to SEQ ID NO: 24068

SEQ ID NO: 105267 - DNA, 201 bp, Bos taurus; identical to SEQ ID NO: 24069

SEQ ID NO: 105268 - DNA, 201 bp, Bos taurus; identical to SEQ ID NO: 24070

SEQ ID NO: 105269 - DNA, 201 bp, Bos taurus; identical to SEQ ID NO: 24071

SEQ ID NO: 105270 - DNA, 201 bp, Bos taurus; identical to SEQ ID NO: 24072

SEQ ID NO: 105271 - DNA, 201 bp, Bos taurus; identical to SEQ ID NO: 24073

SEQ ID NO: 105272 - DNA, 201 bp, Bos taurus; identical to SEQ ID NO: 24074

SEQ ID NO: 105273 - DNA, 201 bp, Bos taurus; identical to SEQ ID NO: 24075

SEQ ID NO: 105274 - DNA, 201 bp, Bos taurus; identical to SEQ ID NO: 24076

SEQ ID NO: 105275 - DNA, 201 bp, Bos taurus; identical to SEQ ID NO: 24077

SEQ ID NO: 105276 - DNA, 201 bp, Bos taurus; identical to SEQ ID NO: 24078

SEQ ID NO: 105277 - DNA, 201 bp, Bos taurus; identical to SEQ ID NO: 24079

SEQ ID NO: 105278 - DNA, 201 bp, Bos taurus; identical to SEQ ID NO: 24080

SEQ ID NO: 105279 - DNA, 201 bp, Bos taurus; identical to SEQ ID NO: 24081

SEQ ID NO: 105280 - DNA, 201 bp, Bos taurus; identical to SEQ ID NO: 24082

SEQ ID NO: 105281 - DNA, 201 bp, Bos taurus; identical to SEQ ID NO: 24083

SEQ ID NO: 105282 - DNA, 201 bp, Bos taurus; identical to SEQ ID NO: 24084

SEQ ID NO: 105283 - DNA, 201 bp, Bos taurus; identical to SEQ ID NO: 24085

SEQ ID NO: 105284 - DNA, 201 bp, Bos taurus; identical to SEQ ID NO: 24086

SEQ ID NO: 105285 - DNA, 201 bp, Bos taurus; identical to SEQ ID NO: 24087

SEQ ID NO: 105286 - DNA, 201 bp, Bos taurus; identical to SEQ ID NO: 24088

SEQ ID NO: 105287 - DNA, 201 bp, Bos taurus; identical to SEQ ID NO: 24089

SEQ ID NO: 105288 - DNA, 201 bp, Bos taurus; identical to SEQ ID NO: 24090

SEQ ID NO: 105289 - DNA, 201 bp, Bos taurus; identical to SEQ ID NO: 24091

SEQ ID NO: 105290 - DNA, 201 bp, Bos taurus; identical to SEQ ID NO: 24092

SEQ ID NO: 105291 - DNA, 201 bp, Bos taurus; identical to SEQ ID NO: 24093

SEQ ID NO: 105292 - DNA, 201 bp, Bos taurus; identical to SEQ ID NO: 24094

SEQ ID NO: 105293 - DNA, 201 bp, Bos taurus; identical to SEQ ID NO: 24095

SEQ ID NO: 105294 - DNA, 201 bp, Bos taurus; identical to SEQ ID NO: 24096

SEQ ID NO: 105295 - DNA, 201 bp, Bos taurus; identical to SEQ ID NO: 24097

SEQ ID NO: 105296 - DNA, 201 bp, Bos taurus; identical to SEQ ID NO: 24098

SEQ ID NO: 105297 - DNA, 201 bp, Bos taurus; identical to SEQ ID NO: 24099

SEQ ID NO: 105298 - DNA, 201 bp, Bos taurus; identical to SEQ ID NO: 24100

SEQ ID NO: 105299 - DNA, 201 bp, Bos taurus; identical to SEQ ID NO: 24101

SEQ ID NO: 105300 - DNA, 201 bp, Bos taurus; identical to SEQ ID NO: 24102

SEQ ID NO: 105301 - DNA, 201 bp, Bos taurus; identical to SEQ ID NO: 24104

SEQ ID NO: 105302 - DNA, 201 bp, Bos taurus; identical to SEQ ID NO: 24105

SEQ ID NO: 105303 - DNA, 201 bp, Bos taurus; identical to SEQ ID NO: 24106

SEQ ID NO: 105304 - DNA, 201 bp, Bos taurus; identical to SEQ ID NO: 24107

SEQ ID NO: 105305 - DNA, 201 bp, Bos taurus; identical to SEQ ID NO: 24108

SEQ ID NO: 105306 - DNA, 201 bp, Bos taurus; identical to SEQ ID NO: 24109

SEQ ID NO: 105307 - DNA, 201 bp, Bos taurus; identical to SEQ ID NO: 24110

SEQ ID NO: 105308 - DNA, 201 bp, Bos taurus; identical to SEQ ID NO: 24111

SEQ ID NO: 105309 - DNA, 201 bp, Bos taurus; identical to SEQ ID NO: 24112

SEQ ID NO: 105310 - DNA, 201 bp, Bos taurus; identical to SEQ ID NO: 24113

SEQ ID NO: 105311 - DNA, 201 bp, Bos taurus; identical to SEQ ID NO: 24114

SEQ ID NO: 105312 - DNA, 201 bp, Bos taurus; identical to SEQ ID NO: 24115

SEQ ID NO: 105313 - DNA, 201 bp, Bos taurus; identical to SEQ ID NO: 24116

SEQ ID NO: 105314 - DNA, 201 bp, Bos taurus; identical to SEQ ID NO: 24117

SEQ ID NO: 105315 - DNA, 201 bp, Bos taurus; identical to SEQ ID NO: 24118

SEQ ID NO: 105316 - DNA, 201 bp, Bos taurus; identical to SEQ ID NO: 24119

SEQ ID NO: 105317 - DNA, 201 bp, Bos taurus; identical to SEQ ID NO: 24120

SEQ ID NO: 105318 - DNA, 201 bp, Bos taurus; identical to SEQ ID NO: 24121

SEQ ID NO: 105319 - DNA, 201 bp, Bos taurus; identical to SEQ ID NO: 24122

SEQ ID NO: 105320 - DNA, 201 bp, Bos taurus; identical to SEQ ID NO: 24123

SEQ ID NO: 105321 - DNA, 201 bp, Bos taurus; identical to SEQ ID NO: 24124

SEQ ID NO: 105322 - DNA, 201 bp, Bos taurus; identical to SEQ ID NO: 24125

SEQ ID NO: 105323 - DNA, 201 bp, Bos taurus; identical to SEQ ID NO: 24126

SEQ ID NO: 105324 - DNA, 201 bp, Bos taurus; identical to SEQ ID NO: 24127

SEQ ID NO: 105325 - DNA, 201 bp, Bos taurus; identical to SEQ ID NO: 24128

SEQ ID NO: 105326 - DNA, 201 bp, Bos taurus; identical to SEQ ID NO: 24129

SEQ ID NO: 105327 - DNA, 201 bp, Bos taurus; identical to SEQ ID NO: 24130

SEQ ID NO: 105328 - DNA, 201 bp, Bos taurus; identical to SEQ ID NO: 24131

SEQ ID NO: 105329 - DNA, 201 bp, Bos taurus; identical to SEQ ID NO: 24132

SEQ ID NO: 105330 - DNA, 201 bp, Bos taurus; identical to SEQ ID NO: 24133

SEQ ID NO: 105331 - DNA, 201 bp, Bos taurus; identical to SEQ ID NO: 24134

SEQ ID NO: 105332 - DNA, 201 bp, Bos taurus; identical to SEQ ID NO: 24135

SEQ ID NO: 105333 - DNA, 201 bp, Bos taurus; identical to SEQ ID NO: 24136

SEQ ID NO: 105334 - DNA, 201 bp, Bos taurus; identical to SEQ ID NO: 24137

SEQ ID NO: 105335 - DNA, 201 bp, Bos taurus; identical to SEQ ID NO: 24138

SEQ ID NO: 105336 - DNA, 201 bp, Bos taurus; identical to SEQ ID NO: 24139

SEQ ID NO: 105337 - DNA, 201 bp, Bos taurus; identical to SEQ ID NO: 24140

SEQ ID NO: 105338 - DNA, 201 bp, Bos taurus; identical to SEQ ID NO: 24141

SEQ ID NO: 105339 - DNA, 201 bp, Bos taurus; identical to SEQ ID NO: 24142

SEQ ID NO: 105340 - DNA, 201 bp, Bos taurus; identical to SEQ ID NO: 24143

SEQ ID NO: 105341 - DNA, 201 bp, Bos taurus; identical to SEQ ID NO: 24144

SEQ ID NO: 105342 - DNA, 201 bp, Bos taurus; identical to SEQ ID NO: 24145

SEQ ID NO: 105343 - DNA, 201 bp, Bos taurus; identical to SEQ ID NO: 24146

SEQ ID NO: 105344 - DNA, 201 bp, Bos taurus; identical to SEQ ID NO: 24147

SEQ ID NO: 105345 - DNA, 201 bp, Bos taurus; identical to SEQ ID NO: 24148

SEQ ID NO: 105346 - DNA, 201 bp, Bos taurus; identical to SEQ ID NO: 24149

SEQ ID NO: 105347 - DNA, 201 bp, Bos taurus; identical to SEQ ID NO: 24150

SEQ ID NO: 105348 - DNA, 201 bp, Bos taurus; identical to SEQ ID NO: 24151

SEQ ID NO: 105349 - DNA, 201 bp, Bos taurus; identical to SEQ ID NO: 24152

SEQ ID NO: 105350 - DNA, 201 bp, Bos taurus; identical to SEQ ID NO: 24153

SEQ ID NO: 105351 - DNA, 201 bp, Bos taurus; identical to SEQ ID NO: 24154

SEQ ID NO: 105352 - DNA, 201 bp, Bos taurus; identical to SEQ ID NO: 24156

SEQ ID NO: 105353 - DNA, 201 bp, Bos taurus; identical to SEQ ID NO: 24157

SEQ ID NO: 105354 - DNA, 201 bp, Bos taurus; identical to SEQ ID NO: 24158

SEQ ID NO: 105355 - DNA, 201 bp, Bos taurus; identical to SEQ ID NO: 24159

SEQ ID NO: 105356 - DNA, 201 bp, Bos taurus; identical to SEQ ID NO: 24160

SEQ ID NO: 105357 - DNA, 201 bp, Bos taurus; identical to SEQ ID NO: 24161

SEQ ID NO: 105358 - DNA, 201 bp, Bos taurus; identical to SEQ ID NO: 24162

SEQ ID NO: 105359 - DNA, 201 bp, Bos taurus; identical to SEQ ID NO: 24163

SEQ ID NO: 105360 - DNA, 201 bp, Bos taurus; identical to SEQ ID NO: 24164

SEQ ID NO: 105361 - DNA, 201 bp, Bos taurus; identical to SEQ ID NO: 24165

SEQ ID NO: 105362 - DNA, 201 bp, Bos taurus; identical to SEQ ID NO: 24166

SEQ ID NO: 105363 - DNA, 201 bp, Bos taurus; identical to SEQ ID NO: 24167

SEQ ID NO: 105364 - DNA, 201 bp, Bos taurus; identical to SEQ ID NO: 24168

SEQ ID NO: 105365 - DNA, 201 bp, Bos taurus; identical to SEQ ID NO: 24169

SEQ ID NO: 105366 - DNA, 201 bp, Bos taurus; identical to SEQ ID NO: 24170

SEQ ID NO: 105367 - DNA, 201 bp, Bos taurus; identical to SEQ ID NO: 24171

SEQ ID NO: 105368 - DNA, 201 bp, Bos taurus; identical to SEQ ID NO: 24173

SEQ ID NO: 105369 - DNA, 201 bp, Bos taurus; identical to SEQ ID NO: 24174

SEQ ID NO: 105370 - DNA, 201 bp, Bos taurus; identical to SEQ ID NO: 24175

SEQ ID NO: 105371 - DNA, 201 bp, Bos taurus; identical to SEQ ID NO: 24176

SEQ ID NO: 105372 - DNA, 201 bp, Bos taurus; identical to SEQ ID NO: 24177

SEQ ID NO: 105373 - DNA, 201 bp, Bos taurus; identical to SEQ ID NO: 24178

SEQ ID NO: 105374 - DNA, 201 bp, Bos taurus; identical to SEQ ID NO: 24179

SEQ ID NO: 105375 - DNA, 201 bp, Bos taurus; identical to SEQ ID NO: 24180

SEQ ID NO: 105376 - DNA, 201 bp, Bos taurus; identical to SEQ ID NO: 24181

SEQ ID NO: 105377 - DNA, 201 bp, Bos taurus; identical to SEQ ID NO: 24182

SEQ ID NO: 105378 - DNA, 201 bp, Bos taurus; identical to SEQ ID NO: 24183

SEQ ID NO: 105379 - DNA, 201 bp, Bos taurus; identical to SEQ ID NO: 24184

SEQ ID NO: 105380 - DNA, 201 bp, Bos taurus; identical to SEQ ID NO: 24185

SEQ ID NO: 105381 - DNA, 201 bp, Bos taurus; identical to SEQ ID NO: 24186

SEQ ID NO: 105382 - DNA, 201 bp, Bos taurus; identical to SEQ ID NO: 24187

SEQ ID NO: 105383 - DNA, 201 bp, Bos taurus; identical to SEQ ID NO: 24188

SEQ ID NO: 105384 - DNA, 201 bp, Bos taurus; identical to SEQ ID NO: 24189

SEQ ID NO: 105385 - DNA, 201 bp, Bos taurus; identical to SEQ ID NO: 24190

SEQ ID NO: 105386 - DNA, 201 bp, Bos taurus; identical to SEQ ID NO: 24191

SEQ ID NO: 105387 - DNA, 201 bp, Bos taurus; identical to SEQ ID NO: 24192

SEQ ID NO: 105388 - DNA, 201 bp, Bos taurus; identical to SEQ ID NO: 24193

SEQ ID NO: 105389 - DNA, 201 bp, Bos taurus; identical to SEQ ID NO: 24195

SEQ ID NO: 105390 - DNA, 201 bp, Bos taurus; identical to SEQ ID NO: 24196

SEQ ID NO: 105391 - DNA, 201 bp, Bos taurus; identical to SEQ ID NO: 24197

SEQ ID NO: 105392 - DNA, 201 bp, Bos taurus; identical to SEQ ID NO: 24198

SEQ ID NO: 105393 - DNA, 201 bp, Bos taurus; identical to SEQ ID NO: 24199

SEQ ID NO: 105394 - DNA, 201 bp, Bos taurus; identical to SEQ ID NO: 24200

SEQ ID NO: 105395 - DNA, 201 bp, Bos taurus; identical to SEQ ID NO: 24201

SEQ ID NO: 105396 - DNA, 201 bp, Bos taurus; identical to SEQ ID NO: 24202

SEQ ID NO: 105397 - DNA, 201 bp, Bos taurus; identical to SEQ ID NO: 24203

SEQ ID NO: 105398 - DNA, 201 bp, Bos taurus; identical to SEQ ID NO: 24205

SEQ ID NO: 105399 - DNA, 201 bp, Bos taurus; identical to SEQ ID NO: 24206

SEQ ID NO: 105400 - DNA, 201 bp, Bos taurus; identical to SEQ ID NO: 24207

SEQ ID NO: 105401 - DNA, 201 bp, Bos taurus; identical to SEQ ID NO: 24208

SEQ ID NO: 105402 - DNA, 201 bp, Bos taurus; identical to SEQ ID NO: 24209

SEQ ID NO: 105403 - DNA, 201 bp, Bos taurus; identical to SEQ ID NO: 24210

SEQ ID NO: 105404 - DNA, 201 bp, Bos taurus; identical to SEQ ID NO: 24211

SEQ ID NO: 105405 - DNA, 201 bp, Bos taurus; identical to SEQ ID NO: 24212

SEQ ID NO: 105406 - DNA, 201 bp, Bos taurus; identical to SEQ ID NO: 24213

SEQ ID NO: 105407 - DNA, 201 bp, Bos taurus; identical to SEQ ID NO: 24214

SEQ ID NO: 105408 - DNA, 201 bp, Bos taurus; identical to SEQ ID NO: 24215

SEQ ID NO: 105409 - DNA, 201 bp, Bos taurus; identical to SEQ ID NO: 24217

SEQ ID NO: 105410 - DNA, 201 bp, Bos taurus; identical to SEQ ID NO: 24219

SEQ ID NO: 105411 - DNA, 201 bp, Bos taurus; identical to SEQ ID NO: 24221

SEQ ID NO: 105412 - DNA, 201 bp, Bos taurus; identical to SEQ ID NO: 24222

SEQ ID NO: 105413 - DNA, 201 bp, Bos taurus; identical to SEQ ID NO: 24223

SEQ ID NO: 105414 - DNA, 201 bp, Bos taurus; identical to SEQ ID NO: 24225

SEQ ID NO: 105415 - DNA, 201 bp, Bos taurus; identical to SEQ ID NO: 24226

SEQ ID NO: 105416 - DNA, 201 bp, Bos taurus; identical to SEQ ID NO: 24227

SEQ ID NO: 105417 - DNA, 201 bp, Bos taurus; identical to SEQ ID NO: 24228

SEQ ID NO: 105418 - DNA, 201 bp, Bos taurus; identical to SEQ ID NO: 24232

SEQ ID NO: 105419 - DNA, 201 bp, Bos taurus
cacctcgtttcagcttccagaagtcttgattcccaggtggtcagtttcacactatgctccttccctgctcttttgcccctgttttggcccttatgatgctgtcttgtcattgcctgttttccatgagacacttaagctttgtaaaattgtggactcagactgtcttgttcatatttgtatccccagggcagaacacctggc

SEQ ID NO: 105420 - DNA, 201 bp, Bos taurus; identical to SEQ ID NO: 24233

SEQ ID NO: 105421 - DNA, 201 bp, Bos taurus; identical to SEQ ID NO: 24234

SEQ ID NO: 105422 - DNA, 201 bp, Bos taurus; identical to SEQ ID NO: 24237

SEQ ID NO: 105423 - DNA, 201 bp, Bos taurus; identical to SEQ ID NO: 24238

SEQ ID NO: 105424 - DNA, 201 bp, Bos taurus; identical to SEQ ID NO: 24239

SEQ ID NO: 105425 - DNA, 201 bp, Bos taurus; identical to SEQ ID NO: 24240

SEQ ID NO: 105426 - DNA, 201 bp, Bos taurus; identical to SEQ ID NO: 24241

SEQ ID NO: 105427 - DNA, 201 bp, Bos taurus; identical to SEQ ID NO: 24242

SEQ ID NO: 105428 - DNA, 201 bp, Bos taurus; identical to SEQ ID NO: 24243

SEQ ID NO: 105429 - DNA, 201 bp, Bos taurus; identical to SEQ ID NO: 24244

SEQ ID NO: 105430 - DNA, 201 bp, Bos taurus
ctttccaaccctgatatccagttcatgctccagcaactcaagacaggtcaagcttttacaacaccaccacagttaacccatagatgtgagttaacccacagtgagaaaaaaatgactgttgtaaaagctgctgagttttggaatggttttttatatagcattacctaaatgataatacactctccatgaaatggatcttca

SEQ ID NO: 105431 - DNA, 201 bp, Bos taurus
catggaaactgaggaccaaagggattatgtgggttgctatcattacacagctggtaaaagttggagcttggatttgaacctgcgtcctcatcctcaaacactttcagtgactgcagccgctcccacgtttctttggtcagaatctaaccccttggttaaatagcatattaaaaaaaagatagtttgggaagagttttccac

SEQ ID NO: 105432 - DNA, 201 bp, Bos taurus; identical to SEQ ID NO: 24247

SEQ ID NO: 105433 - DNA, 201 bp, Bos taurus; identical to SEQ ID NO: 24248

SEQ ID NO: 105434 - DNA, 201 bp, Bos taurus; identical to SEQ ID NO: 24250

SEQ ID NO: 105435 - DNA, 201 bp, Bos taurus
ccagctcatggaccatgaaacacgagatgaaaggaggaagcaggggagagatactgaggtgtctgtgaccacagggacagcagccctaggggaggggcagtggccggggcagtgggcatgcccacagcgggctggatcatttactttttagtgatcaaccccttggaaaaaatctctcccactggttacacatctggtctt

SEQ ID NO: 105436 - DNA, 201 bp, Bos taurus; identical to SEQ ID NO: 24252

SEQ ID NO: 105437 - DNA, 201 bp, Bos taurus; identical to SEQ ID NO: 24253

SEQ ID NO: 105438 - DNA, 201 bp, Bos taurus; identical to SEQ ID NO: 24255

SEQ ID NO: 105439 - DNA, 201 bp, Bos taurus; identical to SEQ ID NO: 24256

SEQ ID NO: 105440 - DNA, 201 bp, Bos taurus
gcttaaaggaaatgtgctaccaggccatggaaagaactttaaatgcacattcctaagtgaaagaagctccctgagaaggctaaaggctgtatgactccaactgtatggccttttgaaaaagacggaactatggagacagtagaaagttttagcgtttgcagggtgaagcagcagttaaagttgaagtttagtcactcagtc

SEQ ID NO: 105441 - DNA, 201 bp, Bos taurus
atgaccttctcctctcaagcacatacttgttagagaattctaactctccaaaaatccaagtttccttctaactaaaactaaacttagttcctgcctttgcgaagtaatgtaaccacttcaggtgggaaatatatgtaaccttcactcacctgtgtgtctgacatgatattttcctttaaaagctgaaaagttggtatctcc

SEQ ID NO: 105442 - DNA, 201 bp, Bos taurus; identical to SEQ ID NO: 24258

SEQ ID NO: 105443 - DNA, 201 bp, Bos taurus; identical to SEQ ID NO: 24260

SEQ ID NO: 105444 - DNA, 201 bp, Bos taurus
atgctctatgcagggatgagagaaagacaaaactcatgattgttctgcatcctggattcacagggaccactggtccgcatgctcagtcacttaaaacctctcttggagtttagttcatatatattctcaactacaccttgtggcatgttccacacccatgccactgtgatgtttaagatgcagatgagagagaaaaaaaga

SEQ ID NO: 105445 - DNA, 201 bp, Bos taurus; identical to SEQ ID NO: 24261

SEQ ID NO: 105446 - DNA, 201 bp, Bos taurus; identical to SEQ ID NO: 24263

SEQ ID NO: 105447 - DNA, 201 bp, Bos taurus; identical to SEQ ID NO: 24264

SEQ ID NO: 105448 - DNA, 201 bp, Bos taurus; identical to SEQ ID NO: 24265

SEQ ID NO: 105449 - DNA, 201 bp, Bos taurus
cacagcagttctcaaaagacctgcagacatctccaatcagataaagaaggaaaaggatactgaaaatcaagctgaaagagctgatcgaaaaattaggttcagaaagtgtatttttttttttttaagtgaaaagggcccatcctattataaatcctgatgagttcaactactttagaaaattgtccggcagtaaccaggtgg

SEQ ID NO: 105450 - DNA, 201 bp, Bos taurus; identical to SEQ ID NO: 24266

SEQ ID NO: 105451 - DNA, 201 bp, Bos taurus; identical to SEQ ID NO: 24267

SEQ ID NO: 105452 - DNA, 201 bp, Bos taurus
ctgccagcttcccactgtatccttgtgatcccaaagaggacgagaaagctctgtgggttgtcgtctataagagtactaatcctgctcatggtcctctacactcatgaccctgtgacctcccactgtctcctcagtgacctcacactggaggggtagggttacaacacgcaaactgggggatgtacagtgctcgtccttgaa

SEQ ID NO: 105453 - DNA, 201 bp, Bos taurus
cttgggggatttaagtatcctcagatggggaaaaggaaggaaaaatgtatattaccatttcttcagagcatgcttcttcctctgtgtcacatctatttcctgtactgtgcctgggagtaaaaaaacaaaatttgattccacctttcatctctctaatgcccagtctttgctgctgcttaaaatacatcctccacaaaaagc

SEQ ID NO: 105454 - DNA, 201 bp, Bos taurus; identical to SEQ ID NO: 24268

SEQ ID NO: 105455 - DNA, 201 bp, Bos taurus; identical to SEQ ID NO: 24269

SEQ ID NO: 105456 - DNA, 201 bp, Bos taurus; identical to SEQ ID NO: 24270

SEQ ID NO: 105457 - DNA, 201 bp, Bos taurus; identical to SEQ ID NO: 24271

SEQ ID NO: 105458 - DNA, 201 bp, Bos taurus; identical to SEQ ID NO: 24272

SEQ ID NO: 105459 - DNA, 201 bp, Bos taurus; identical to SEQ ID NO: 24273

SEQ ID NO: 105460 - DNA, 201 bp, Bos taurus; identical to SEQ ID NO: 24274

SEQ ID NO: 105461 - DNA, 201 bp, Bos taurus; identical to SEQ ID NO: 24275

SEQ ID NO: 105462 - DNA, 201 bp, Bos taurus; identical to SEQ ID NO: 24277

SEQ ID NO: 105463 - DNA, 201 bp, Bos taurus; identical to SEQ ID NO: 24278

SEQ ID NO: 105464 - DNA, 201 bp, Bos taurus; identical to SEQ ID NO: 24279

SEQ ID NO: 105465 - DNA, 201 bp, Bos taurus; identical to SEQ ID NO: 24280

SEQ ID NO: 105466 - DNA, 201 bp, Bos taurus; identical to SEQ ID NO: 24283

SEQ ID NO: 105467 - DNA, 201 bp, Bos taurus
aatctcaagaagatgtctctagctgtatgatcctgccttttgggaaatacaagttaattttccagaatgtttagaaatcagtgattcataatcgagtcacccttgtgtgcctggcatcttcacatgtttttactgaaacatctaactccaaagtagggactgtttccatttgttgatcaaaagtgggcagaaggaggtggc

SEQ ID NO: 105468 - DNA, 201 bp, Bos taurus
atataatttagtacaagaaagccaattgtgtagtcttgactcagactttgtgttaaaaagcattcatcatgtgcgcttccatgtaagaggaatttaaactctcctcttcgttaggagacctgcctgcagtagaattaaaatagcttctccctgaatgggaacactgacttggcaaagatcaggagcagtcattcaagagga

SEQ ID NO: 105469 - DNA, 201 bp, Bos taurus
gtatcactgtaaattctggggacatccgtcttcctaagaacgtgtgagtcatgtggatgaacactactgttttctgaactattccgttgctcacttactcatgtccattcctgtgccccactccagccagtctcttaaagtgactttcctgcctcattttccattttctctacaactccagaaaggaattcccccgcatgt

SEQ ID NO: 105470 - DNA, 201 bp, Bos taurus
aaatgggcaggggaattctgaactggagagaaggtgaaggatagtgtgtatagctggaatgggaagatagcttttgagatggaaaatgcacttaaactagacatgaacttgagagcatttgtgtagacaaaaagtcaccttaatgaaggcattcttgagaaatccacctttacatcatagcttattcaagaatataccact

SEQ ID NO: 105471 - DNA, 201 bp, Bos taurus
ttggcctttttttttttttttagttgcctcaagtcattttgaaaagaggtaggaagtctaaaaaatagttcaaaatataggagtccctttccccctctcgctgcatgatttctaaggccaattaaaatgccatttcctccaggaagcaacggggatttcctgaacttcaatccattagtactccttctgtaccaccagcac

SEQ ID NO: 105472 - DNA, 201 bp, Bos taurus; identical to SEQ ID NO: 24284

SEQ ID NO: 105473 - DNA, 201 bp, Bos taurus; identical to SEQ ID NO: 24285

SEQ ID NO: 105474 - DNA, 201 bp, Bos taurus
gcattggcaggtgggttctttgacactagtcacacattaacactctgatcagcagatcatcatggaaagactacactacccaaagatacaatatattgggaaaggagacttagtgaaaagtccatcttatataaagtctgcctaggcaataaagccccaattgagaaaatgcaaaggaaattgctgagattgcacacttct

SEQ ID NO: 105475 - DNA, 201 bp, Bos taurus
ccccagaggacttcagcatccctgggtgtgacctatgccctccctggcctctctcttgacccctcactccatgtccctcagctccatcccacctctgtcagccaatcctgagaatgtgccctggatttgtttccactctgacacccacaactccacagaccatcccctctgaccgtacctgcccacccatccatccctctc

SEQ ID NO: 105476 - DNA, 201 bp, Bos taurus; identical to SEQ ID NO: 24286

SEQ ID NO: 105477 - DNA, 201 bp, Bos taurus; identical to SEQ ID NO: 24287

SEQ ID NO: 105478 - DNA, 201 bp, Bos taurus; identical to SEQ ID NO: 24288

SEQ ID NO: 105479 - DNA, 201 bp, Bos taurus; identical to SEQ ID NO: 24290

SEQ ID NO: 105480 - DNA, 201 bp, Bos taurus; identical to SEQ ID NO: 24291

SEQ ID NO: 105481 - DNA, 201 bp, Bos taurus; identical to SEQ ID NO: 24292

SEQ ID NO: 105482 - DNA, 201 bp, Bos taurus; identical to SEQ ID NO: 24293

SEQ ID NO: 105483 - DNA, 201 bp, Bos taurus; identical to SEQ ID NO: 24294

SEQ ID NO: 105484 - DNA, 201 bp, Bos taurus; identical to SEQ ID NO: 24295

SEQ ID NO: 105485 - DNA, 201 bp, Bos taurus; identical to SEQ ID NO: 24297

SEQ ID NO: 105486 - DNA, 201 bp, Bos taurus; identical to SEQ ID NO: 24298

SEQ ID NO: 105487 - DNA, 201 bp, Bos taurus; identical to SEQ ID NO: 24300

SEQ ID NO: 105488 - DNA, 201 bp, Bos taurus; identical to SEQ ID NO: 24301

SEQ ID NO: 105489 - DNA, 201 bp, Bos taurus; identical to SEQ ID NO: 24302

SEQ ID NO: 105490 - DNA, 201 bp, Bos taurus; identical to SEQ ID NO: 24308

SEQ ID NO: 105491 - DNA, 201 bp, Bos taurus; identical to SEQ ID NO: 24309

SEQ ID NO: 105492 - DNA, 201 bp, Bos taurus; identical to SEQ ID NO: 24310

SEQ ID NO: 105493 - DNA, 201 bp, Bos taurus
aacatcttctttatgtagttcattagtttaaaaatgtgttgtttgaattgaatcaatatatcgaaattgagaaagatgagatggacagaaagaataactaacaatattgtaggaaatgttataggtcaaagagaagtccttgcttcaaagaaattttcagtatccaaaaaaaaaaaaaaaagcaattagggcaattaaatg

SEQ ID NO: 105494 - DNA, 201 bp, Bos taurus; identical to SEQ ID NO: 24313

SEQ ID NO: 105495 - DNA, 201 bp, Bos taurus; identical to SEQ ID NO: 24314

SEQ ID NO: 105496 - DNA, 201 bp, Bos taurus; identical to SEQ ID NO: 24315

SEQ ID NO: 105497 - DNA, 201 bp, Bos taurus; identical to SEQ ID NO: 24316

SEQ ID NO: 105498 - DNA, 201 bp, Bos taurus; identical to SEQ ID NO: 24319

SEQ ID NO: 105499 - DNA, 201 bp, Bos taurus; identical to SEQ ID NO: 24320

SEQ ID NO: 105500 - DNA, 201 bp, Bos taurus; identical to SEQ ID NO: 24321

SEQ ID NO: 105501 - DNA, 201 bp, Bos taurus; identical to SEQ ID NO: 24322

SEQ ID NO: 105502 - DNA, 201 bp, Bos taurus; identical to SEQ ID NO: 24325

SEQ ID NO: 105503 - DNA, 201 bp, Bos taurus
tgggagagggaagggtgcaggaggtcaggaaggggtgtggaggggaaaggtcgctatttttccaccattacaggtttaagatgaatactattatggggcccagtcccagctcaagctgctcaaacactgaggttcagcccataggaaataaaaggataacttcttactccagtctcagaatatttttctttgttcatcaac

SEQ ID NO: 105504 - DNA, 201 bp, Bos taurus; identical to SEQ ID NO: 64791

SEQ ID NO: 105505 - DNA, 201 bp, Bos taurus
tccgactctttgcgaccccatggactgcagcccaccagtctcctttgtccatgggattttccaggcaaaagtactggagtggggtgccattgccttcttcgaatcatcatgctatttatttctagttaaattgcccaactgttagctttaagtgttagagcagagagatcgcgatatgggtctggccatttttgctgcagt

SEQ ID NO: 105506 - DNA, 201 bp, Bos taurus; identical to SEQ ID NO: 24327

SEQ ID NO: 105507 - DNA, 201 bp, Bos taurus; identical to SEQ ID NO: 24328

SEQ ID NO: 105508 - DNA, 201 bp, Bos taurus; identical to SEQ ID NO: 24330

SEQ ID NO: 105509 - DNA, 201 bp, Bos taurus; identical to SEQ ID NO: 24331

SEQ ID NO: 105510 - DNA, 201 bp, Bos taurus; identical to SEQ ID NO: 24332

SEQ ID NO: 105511 - DNA, 201 bp, Bos taurus; identical to SEQ ID NO: 24333

SEQ ID NO: 105512 - DNA, 201 bp, Bos taurus; identical to SEQ ID NO: 24334

SEQ ID NO: 105513 - DNA, 201 bp, Bos taurus; identical to SEQ ID NO: 24335

SEQ ID NO: 105514 - DNA, 201 bp, Bos taurus; identical to SEQ ID NO: 24336

SEQ ID NO: 105515 - DNA, 201 bp, Bos taurus; identical to SEQ ID NO: 24338

SEQ ID NO: 105516 - DNA, 201 bp, Bos taurus; identical to SEQ ID NO: 24339

SEQ ID NO: 105517 - DNA, 201 bp, Bos taurus; identical to SEQ ID NO: 24343

SEQ ID NO: 105518 - DNA, 201 bp, Bos taurus; identical to SEQ ID NO: 24344

SEQ ID NO: 105519 - DNA, 201 bp, Bos taurus; identical to SEQ ID NO: 24345

SEQ ID NO: 105520 - DNA, 201 bp, Bos taurus; identical to SEQ ID NO: 24349

SEQ ID NO: 105521 - DNA, 201 bp, Bos taurus; identical to SEQ ID NO: 24350

SEQ ID NO: 105522 - DNA, 201 bp, Bos taurus; identical to SEQ ID NO: 24351

SEQ ID NO: 105523 - DNA, 201 bp, Bos taurus; identical to SEQ ID NO: 24352

SEQ ID NO: 105524 - DNA, 201 bp, Bos taurus; identical to SEQ ID NO: 24353

SEQ ID NO: 105525 - DNA, 201 bp, Bos taurus; identical to SEQ ID NO: 24354

SEQ ID NO: 105526 - DNA, 201 bp, Bos taurus; identical to SEQ ID NO: 24356

SEQ ID NO: 105527 - DNA, 201 bp, Bos taurus; identical to SEQ ID NO: 24357

SEQ ID NO: 105528 - DNA, 201 bp, Bos taurus; identical to SEQ ID NO: 24358

SEQ ID NO: 105529 - DNA, 201 bp, Bos taurus; identical to SEQ ID NO: 24359

SEQ ID NO: 105530 - DNA, 201 bp, Bos taurus; identical to SEQ ID NO: 24360

SEQ ID NO: 105531 - DNA, 201 bp, Bos taurus; identical to SEQ ID NO: 24361

SEQ ID NO: 105532 - DNA, 201 bp, Bos taurus; identical to SEQ ID NO: 24362

SEQ ID NO: 105533 - DNA, 201 bp, Bos taurus; identical to SEQ ID NO: 24363

SEQ ID NO: 105534 - DNA, 201 bp, Bos taurus; identical to SEQ ID NO: 24364

SEQ ID NO: 105535 - DNA, 201 bp, Bos taurus; identical to SEQ ID NO: 24365

SEQ ID NO: 105536 - DNA, 201 bp, Bos taurus; identical to SEQ ID NO: 24366

SEQ ID NO: 105537 - DNA, 201 bp, Bos taurus; identical to SEQ ID NO: 24367

SEQ ID NO: 105538 - DNA, 201 bp, Bos taurus; identical to SEQ ID NO: 24368

SEQ ID NO: 105539 - DNA, 201 bp, Bos taurus; identical to SEQ ID NO: 24370

SEQ ID NO: 105540 - DNA, 201 bp, Bos taurus; identical to SEQ ID NO: 24373

SEQ ID NO: 105541 - DNA, 201 bp, Bos taurus; identical to SEQ ID NO: 24374

SEQ ID NO: 105542 - DNA, 201 bp, Bos taurus; identical to SEQ ID NO: 24376

SEQ ID NO: 105543 - DNA, 201 bp, Bos taurus; identical to SEQ ID NO: 24377

SEQ ID NO: 105544 - DNA, 201 bp, Bos taurus; identical to SEQ ID NO: 24378

SEQ ID NO: 105545 - DNA, 201 bp, Bos taurus; identical to SEQ ID NO: 24381

SEQ ID NO: 105546 - DNA, 201 bp, Bos taurus; identical to SEQ ID NO: 24382

SEQ ID NO: 105547 - DNA, 201 bp, Bos taurus; identical to SEQ ID NO: 24383

SEQ ID NO: 105548 - DNA, 201 bp, Bos taurus; identical to SEQ ID NO: 24384

SEQ ID NO: 105549 - DNA, 201 bp, Bos taurus; identical to SEQ ID NO: 24385

SEQ ID NO: 105550 - DNA, 201 bp, Bos taurus; identical to SEQ ID NO: 24389

SEQ ID NO: 105551 - DNA, 201 bp, Bos taurus; identical to SEQ ID NO: 24393

SEQ ID NO: 105552 - DNA, 201 bp, Bos taurus; identical to SEQ ID NO: 24394

SEQ ID NO: 105553 - DNA, 201 bp, Bos taurus; identical to SEQ ID NO: 24395

SEQ ID NO: 105554 - DNA, 201 bp, Bos taurus; identical to SEQ ID NO: 24396

SEQ ID NO: 105555 - DNA, 201 bp, Bos taurus; identical to SEQ ID NO: 24397

SEQ ID NO: 105556 - DNA, 201 bp, Bos taurus; identical to SEQ ID NO: 24398

SEQ ID NO: 105557 - DNA, 201 bp, Bos taurus; identical to SEQ ID NO: 24400

SEQ ID NO: 105558 - DNA, 201 bp, Bos taurus; identical to SEQ ID NO: 24401

SEQ ID NO: 105559 - DNA, 201 bp, Bos taurus; identical to SEQ ID NO: 24402

SEQ ID NO: 105560 - DNA, 201 bp, Bos taurus; identical to SEQ ID NO: 24403

SEQ ID NO: 105561 - DNA, 201 bp, Bos taurus; identical to SEQ ID NO: 24404

SEQ ID NO: 105562 - DNA, 201 bp, Bos taurus; identical to SEQ ID NO: 24406

SEQ ID NO: 105563 - DNA, 201 bp, Bos taurus; identical to SEQ ID NO: 24407

SEQ ID NO: 105564 - DNA, 201 bp, Bos taurus; identical to SEQ ID NO: 24408

SEQ ID NO: 105565 - DNA, 201 bp, Bos taurus; identical to SEQ ID NO: 24409

SEQ ID NO: 105566 - DNA, 201 bp, Bos taurus; identical to SEQ ID NO: 24410

SEQ ID NO: 105567 - DNA, 201 bp, Bos taurus; identical to SEQ ID NO: 24411

SEQ ID NO: 105568 - DNA, 201 bp, Bos taurus; identical to SEQ ID NO: 24414

SEQ ID NO: 105569 - DNA, 201 bp, Bos taurus; identical to SEQ ID NO: 24415

SEQ ID NO: 105570 - DNA, 201 bp, Bos taurus; identical to SEQ ID NO: 24417

SEQ ID NO: 105571 - DNA, 201 bp, Bos taurus; identical to SEQ ID NO: 24421

SEQ ID NO: 105572 - DNA, 201 bp, Bos taurus; identical to SEQ ID NO: 24426

SEQ ID NO: 105573 - DNA, 201 bp, Bos taurus; identical to SEQ ID NO: 24433

SEQ ID NO: 105574 - DNA, 201 bp, Bos taurus; identical to SEQ ID NO: 24436

SEQ ID NO: 105575 - DNA, 201 bp, Bos taurus; identical to SEQ ID NO: 24437

SEQ ID NO: 105576 - DNA, 201 bp, Bos taurus; identical to SEQ ID NO: 24438

SEQ ID NO: 105577 - DNA, 201 bp, Bos taurus; identical to SEQ ID NO: 24439

SEQ ID NO: 105578 - DNA, 201 bp, Bos taurus; identical to SEQ ID NO: 24440

SEQ ID NO: 105579 - DNA, 201 bp, Bos taurus; identical to SEQ ID NO: 24441

SEQ ID NO: 105580 - DNA, 201 bp, Bos taurus; identical to SEQ ID NO: 24444

SEQ ID NO: 105581 - DNA, 201 bp, Bos taurus; identical to SEQ ID NO: 24445

SEQ ID NO: 105582 - DNA, 201 bp, Bos taurus; identical to SEQ ID NO: 24446

SEQ ID NO: 105583 - DNA, 201 bp, Bos taurus
ctgaacagaccccagctctgtgttctgttctcagtcatggctcagcacccaacccagaggcctgagctccttcagacaccttcagctgtgcactctttcacggaaccaatagtcatggaagatgatttttctgtctagttcaacacttagtttcctgctgaagaccaaggcgtggaagcagtaaggtcatttacttaaggg

SEQ ID NO: 105584 - DNA, 201 bp, Bos taurus
tgccttcaaagagcttaaaatctaaaaaaggggaaatctaggtcaacaggataacttggggcattgaggtaaatggtatggtagacgtcaaggagaggatttataggaacaaatgaaagaggcccctaattcaatgtggggaggatcagggaagaaaactggaggagcagcttccaacaggaaatgagaaagctaaggtgg

SEQ ID NO: 105585 - DNA, 201 bp, Bos taurus; identical to SEQ ID NO: 24447

SEQ ID NO: 105586 - DNA, 201 bp, Bos taurus; identical to SEQ ID NO: 24448

SEQ ID NO: 105587 - DNA, 201 bp, Bos taurus
tgttatattatatattttagtaaaatattagctttggaaccaaagctgcagcatgtactttgtaagctatcattaacagccatgtctatgaaggaaagctacctcttttgaaataaggaaaactgaaatttaatattcatgctggggactgttccctttttacaatgtgaattcaggaagttgttgtaaaatttaaaatta

SEQ ID NO: 105588 - DNA, 201 bp, Bos taurus
ctgctttttcccctacaatcttatgtacaagtagtgaattatatttattcgcaactctccagaaaactcatggaattttttttctttagtctaataacattgttggtactttagtttcacttataaaatattgtattgctttaatgaaagtaagagcaactcgtgacatttcaccatgtgttagtgctgaaaatgttttgc

SEQ ID NO: 105589 - DNA, 201 bp, Bos taurus; identical to SEQ ID NO: 24449

SEQ ID NO: 105590 - DNA, 201 bp, Bos taurus; identical to SEQ ID NO: 24450

SEQ ID NO: 105591 - DNA, 201 bp, Bos taurus; identical to SEQ ID NO: 24451

SEQ ID NO: 105592 - DNA, 201 bp, Bos taurus; identical to SEQ ID NO: 24452

SEQ ID NO: 105593 - DNA, 201 bp, Bos taurus; identical to SEQ ID NO: 24453

SEQ ID NO: 105594 - DNA, 201 bp, Bos taurus; identical to SEQ ID NO: 24454

SEQ ID NO: 105595 - DNA, 201 bp, Bos taurus; identical to SEQ ID NO: 24455

SEQ ID NO: 105596 - DNA, 201 bp, Bos taurus; identical to SEQ ID NO: 24456

SEQ ID NO: 105597 - DNA, 201 bp, Bos taurus; identical to SEQ ID NO: 24457

SEQ ID NO: 105598 - DNA, 201 bp, Bos taurus
atatgagttggtcagctcatatgggtatgagcatacaaaactgtcctgatcatttgccctcagccagtcatttttactgactacctcataaatcataagatcagtctgatgccaaggtgatagaggtggagactctttctgggcccagcagctgagaagcacttaaaattgacctcccagcaatggacaccaattttgaac

SEQ ID NO: 105599 - DNA, 201 bp, Bos taurus; identical to SEQ ID NO: 24458

SEQ ID NO: 105600 - DNA, 201 bp, Bos taurus; identical to SEQ ID NO: 24459

SEQ ID NO: 105601 - DNA, 201 bp, Bos taurus; identical to SEQ ID NO: 24460

SEQ ID NO: 105602 - DNA, 201 bp, Bos taurus
atgtgacaatttaaccaagtgttatttgggctaaagaagttaggaaatatattcctgggtttcctaggaattatagagctgccagtggggtgatccattttcagtgtgaaccaaaggaagaaatgacagttttcacagacatgtgctatgctcttccaaggacaaagctcaaattcctgacagggctaagtaatccactta

SEQ ID NO: 105603 - DNA, 201 bp, Bos taurus
tggtggcctggttgaataattctagtcccttctcacttggaagtgaacagacaatagaagttaatttagtttctgaaagaggctttttagtcactggcagaaaccgggcaacagtaatttgcaaaccctgccctttattaaaattcattgttgctttcagagttagagaactgtaatttcagagatccaagcaagaccaaa

SEQ ID NO: 105604 - DNA, 201 bp, Bos taurus
tttgtttgtttagttttatttgcctatttttgtctgtgctgtgtcttgttgctacatgggctttgctctagttgtcaggagtgggggctactctctagttacagtgtgagggcatctctgtggtgtcttctcttgttgctgagcacaggctctagggtgtgtgagattcagtagttgtggctctagggctctagagcacag

SEQ ID NO: 105605 - DNA, 201 bp, Bos taurus
gtggaagttccagcttatactacttcaaatgagtatgatctcatactcaaaatcagagcaagatcagttattttcagtatctaaataagtgtcacagtaactaaatgtaaataaaatttgattttaagaaaaataaatttctgcaaattattaagcttttttcttcttaataccaataattttgattttattttgtgactt

SEQ ID NO: 105606 - DNA, 201 bp, Bos taurus
tgatggcaaataatttcccatgtttaagggaaaagaaacagtgagactaaagtatggtgaaggtaaagttgctttgtatgagatgagtgagaagggtggacgaagaccagaatttctaggccttctgaggactgagtaaggagtcaaaatttaattcaaggttaatgaaaagtaaagcttggtagtgacatgtcagttgga

SEQ ID NO: 105607 - DNA, 201 bp, Bos taurus
ttaccctttatagatttctcctttgccaactcgtctcatattatttgcaccaaaactgaactagcggtcagtttctttattttttcatcatttttcacctcttagtatgcttttctctcaacctcaactgctccctctcatcggcttcctacatctattaaatgcagtttttccatatattttttttatataataattcag

SEQ ID NO: 105608 - DNA, 201 bp, Bos taurus; identical to SEQ ID NO: 24461

SEQ ID NO: 105609 - DNA, 201 bp, Bos taurus; identical to SEQ ID NO: 24462

SEQ ID NO: 105610 - DNA, 201 bp, Bos taurus; identical to SEQ ID NO: 24463

SEQ ID NO: 105611 - DNA, 201 bp, Bos taurus; identical to SEQ ID NO: 24464

SEQ ID NO: 105612 - DNA, 201 bp, Bos taurus; identical to SEQ ID NO: 24465

SEQ ID NO: 105613 - DNA, 201 bp, Bos taurus; identical to SEQ ID NO: 24466

SEQ ID NO: 105614 - DNA, 201 bp, Bos taurus; identical to SEQ ID NO: 24467

SEQ ID NO: 105615 - DNA, 201 bp, Bos taurus
tataaaataattattcaaaaattctttatgtatgtatgaacaatgtttaacttgtgccaatgaacattttagtaatatacaaataatatgctattattgaattaattatggaatgactttagatatgctatcgccaggttatcctttaatatctagttcttttttgtgtgctataggaagtttttgtgctataggaagaca

SEQ ID NO: 105616 - DNA, 201 bp, Bos taurus
aacattttcaagactcccgagctcttgatatatggtggtgaataacatagaacccttggctgagagaagctgttttggtgtgtgggtcaaatggaagagagtattttataggataggttgataacactgataaaaatgaaaggaactatggaagcacataagagacagttttcctgatctgtttactgcaaggagagcttt

SEQ ID NO: 105617 - DNA, 201 bp, Bos taurus
gtgatagaaatgagaggtcacattctggaaggatcattttcatgggaatcagatcacaaaatataatgacaggaataatatggacaagagtagcaatagttcaagagctaaaatcttcaggtttcaagggatgagagtgtgtcttaagaagaggtcagttcagttcagttcagtcgctcagtcatgtctgactctttgcaa

SEQ ID NO: 105618 - DNA, 201 bp, Bos taurus; identical to SEQ ID NO: 24468

SEQ ID NO: 105619 - DNA, 201 bp, Bos taurus; identical to SEQ ID NO: 24469

SEQ ID NO: 105620 - DNA, 201 bp, Bos taurus
ccactgggatctgggtgtatctgtccattaaaatcagcactctgtggatttgttagtcctactccataaatcaggtactgacttgcgtcaggtcagctaatgtgaaaagctagtggagctgatggaattccagctgagccttttcagttctaaaagatgaggctattaaagtgctgcactcaatatgccagaaaatttgga

SEQ ID NO: 105621 - DNA, 201 bp, Bos taurus; identical to SEQ ID NO: 24470

SEQ ID NO: 105622 - DNA, 201 bp, Bos taurus
gaagcagtagcaaacaaactacccttcttccttatcagtggttgattgttcttgctcctttacagcaaaacaaaagtctctaaatatgactgtatgtattcatcctgtcaaaaagtcagctatttttttaactcatccattaatacattttcattaaatatacagctgtagaaaaattcacactttataagcatgcatctc

SEQ ID NO: 105623 - DNA, 201 bp, Bos taurus; identical to SEQ ID NO: 24471

SEQ ID NO: 105624 - DNA, 201 bp, Bos taurus; identical to SEQ ID NO: 24472

SEQ ID NO: 105625 - DNA, 201 bp, Bos taurus; identical to SEQ ID NO: 24473

SEQ ID NO: 105626 - DNA, 201 bp, Bos taurus; identical to SEQ ID NO: 24474

SEQ ID NO: 105627 - DNA, 201 bp, Bos taurus; identical to SEQ ID NO: 24475

SEQ ID NO: 105628 - DNA, 201 bp, Bos taurus
aatctagtaatgttatgtgtgaatcttttaattcccatataaagatgttgacactttattgtgcatataattttaatggaagctttcattaaagatttcacaaagtatctcccacaaatattccaaggatcttctctccatttttttcacttcatttttctgtatgttcttaatcttgctagaaatctacaactaaatatt

SEQ ID NO: 105629 - DNA, 201 bp, Bos taurus; identical to SEQ ID NO: 24476

SEQ ID NO: 105630 - DNA, 201 bp, Bos taurus; identical to SEQ ID NO: 24477

SEQ ID NO: 105631 - DNA, 201 bp, Bos taurus
ctggaaatctcatgaacagaagagcttggtgggggctacagtccatggggttgcaaagactcaaacacgactgagtgactaagcgtgtacacagggtttggggagatgccatgaatacagataatatccctggtggtgatggcttgtgggatacccagggaagccaataactggtcagaaaaggtcattagggaccaagcc

SEQ ID NO: 105632 - DNA, 201 bp, Bos taurus; identical to SEQ ID NO: 24478

SEQ ID NO: 105633 - DNA, 201 bp, Bos taurus; identical to SEQ ID NO: 24479

SEQ ID NO: 105634 - DNA, 201 bp, Bos taurus; identical to SEQ ID NO: 24480

SEQ ID NO: 105635 - DNA, 201 bp, Bos taurus; identical to SEQ ID NO: 24481

SEQ ID NO: 105636 - DNA, 201 bp, Bos taurus; identical to SEQ ID NO: 24482

SEQ ID NO: 105637 - DNA, 201 bp, Bos taurus
ttggccagttatatttcaagctttagtactttgtgattatagaatgttttcacactttgcttttgcaattgaggttatttttatgacttactgttaattagtgtaactgtcatgcttttttaggaaaaatgtatatagtctttgtgttttcaaagttagataataggtaagtcggtcattatttatagtgttcaaaattac

SEQ ID NO: 105638 - DNA, 201 bp, Bos taurus
cctccctgcggaccagatagcaaccaggcaaagacaaaggtccatccatcttcaggttctgtttgagtcaggtatttatgcttcagagaatatgtacttagggttcttaatttgtaacttttaaggaaagagttcattaaaaaaataacagaaggaaaataaatcaaataggttgctcatggaattttggtttatagttca

SEQ ID NO: 105639 - DNA, 201 bp, Bos taurus; identical to SEQ ID NO: 24483

SEQ ID NO: 105640 - DNA, 201 bp, Bos taurus; identical to SEQ ID NO: 24484

SEQ ID NO: 105641 - DNA, 201 bp, Bos taurus; identical to SEQ ID NO: 24485

SEQ ID NO: 105642 - DNA, 201 bp, Bos taurus; identical to SEQ ID NO: 24486

SEQ ID NO: 105643 - DNA, 201 bp, Bos taurus; identical to SEQ ID NO: 24487

SEQ ID NO: 105644 - DNA, 201 bp, Bos taurus; identical to SEQ ID NO: 24488

SEQ ID NO: 105645 - DNA, 201 bp, Bos taurus
ttcattcttgcagtaaacataaggaaatggtttcagtcttgaaaatgtgcaaaaggcgggcaactctgccacctgtcatttgtcccttgtgtctttgtcattaatttgttttttactaggctgccagcatctcaagttatgctacttctagaaaagtttaattgggttttttgaccctttggtatgaactgtatactgata

SEQ ID NO: 105646 - DNA, 201 bp, Bos taurus; identical to SEQ ID NO: 24491

SEQ ID NO: 105647 - DNA, 201 bp, Bos taurus; identical to SEQ ID NO: 24494

SEQ ID NO: 105648 - DNA, 201 bp, Bos taurus; identical to SEQ ID NO: 24495

SEQ ID NO: 105649 - DNA, 201 bp, Bos taurus; identical to SEQ ID NO: 24497

SEQ ID NO: 105650 - DNA, 201 bp, Bos taurus; identical to SEQ ID NO: 24500

SEQ ID NO: 105651 - DNA, 201 bp, Bos taurus; identical to SEQ ID NO: 24504

SEQ ID NO: 105652 - DNA, 201 bp, Bos taurus; identical to SEQ ID NO: 24506

SEQ ID NO: 105653 - DNA, 201 bp, Bos taurus; identical to SEQ ID NO: 24508

SEQ ID NO: 105654 - DNA, 201 bp, Bos taurus; identical to SEQ ID NO: 24510

SEQ ID NO: 105655 - DNA, 201 bp, Bos taurus; identical to SEQ ID NO: 24511

SEQ ID NO: 105656 - DNA, 201 bp, Bos taurus; identical to SEQ ID NO: 24512

SEQ ID NO: 105657 - DNA, 201 bp, Bos taurus; identical to SEQ ID NO: 24514

SEQ ID NO: 105658 - DNA, 201 bp, Bos taurus; identical to SEQ ID NO: 24515

SEQ ID NO: 105659 - DNA, 201 bp, Bos taurus; identical to SEQ ID NO: 24516

SEQ ID NO: 105660 - DNA, 201 bp, Bos taurus; identical to SEQ ID NO: 24517

SEQ ID NO: 105661 - DNA, 201 bp, Bos taurus; identical to SEQ ID NO: 24518

SEQ ID NO: 105662 - DNA, 201 bp, Bos taurus; identical to SEQ ID NO: 24519

SEQ ID NO: 105663 - DNA, 201 bp, Bos taurus; identical to SEQ ID NO: 24520

SEQ ID NO: 105664 - DNA, 201 bp, Bos taurus; identical to SEQ ID NO: 24521

SEQ ID NO: 105665 - DNA, 201 bp, Bos taurus; identical to SEQ ID NO: 24522

SEQ ID NO: 105666 - DNA, 201 bp, Bos taurus; identical to SEQ ID NO: 24523

SEQ ID NO: 105667 - DNA, 201 bp, Bos taurus; identical to SEQ ID NO: 24524

SEQ ID NO: 105668 - DNA, 201 bp, Bos taurus; identical to SEQ ID NO: 24525

SEQ ID NO: 105669 - DNA, 201 bp, Bos taurus; identical to SEQ ID NO: 24526

SEQ ID NO: 105670 - DNA, 201 bp, Bos taurus; identical to SEQ ID NO: 24527

SEQ ID NO: 105671 - DNA, 201 bp, Bos taurus; identical to SEQ ID NO: 24528

SEQ ID NO: 105672 - DNA, 201 bp, Bos taurus; identical to SEQ ID NO: 24529

SEQ ID NO: 105673 - DNA, 201 bp, Bos taurus; identical to SEQ ID NO: 24531

SEQ ID NO: 105674 - DNA, 201 bp, Bos taurus; identical to SEQ ID NO: 24533

SEQ ID NO: 105675 - DNA, 201 bp, Bos taurus; identical to SEQ ID NO: 24534

SEQ ID NO: 105676 - DNA, 201 bp, Bos taurus; identical to SEQ ID NO: 24535

SEQ ID NO: 105677 - DNA, 201 bp, Bos taurus; identical to SEQ ID NO: 24537

SEQ ID NO: 105678 - DNA, 201 bp, Bos taurus; identical to SEQ ID NO: 24538

SEQ ID NO: 105679 - DNA, 201 bp, Bos taurus; identical to SEQ ID NO: 24539

SEQ ID NO: 105680 - DNA, 201 bp, Bos taurus; identical to SEQ ID NO: 24540

SEQ ID NO: 105681 - DNA, 201 bp, Bos taurus; identical to SEQ ID NO: 24541

SEQ ID NO: 105682 - DNA, 201 bp, Bos taurus; identical to SEQ ID NO: 24542

SEQ ID NO: 105683 - DNA, 201 bp, Bos taurus; identical to SEQ ID NO: 24543

SEQ ID NO: 105684 - DNA, 201 bp, Bos taurus; identical to SEQ ID NO: 24546

SEQ ID NO: 105685 - DNA, 201 bp, Bos taurus; identical to SEQ ID NO: 24549

SEQ ID NO: 105686 - DNA, 201 bp, Bos taurus; identical to SEQ ID NO: 24550

SEQ ID NO: 105687 - DNA, 201 bp, Bos taurus; identical to SEQ ID NO: 24553

SEQ ID NO: 105688 - DNA, 201 bp, Bos taurus; identical to SEQ ID NO: 24555

SEQ ID NO: 105689 - DNA, 201 bp, Bos taurus; identical to SEQ ID NO: 24556

SEQ ID NO: 105690 - DNA, 201 bp, Bos taurus; identical to SEQ ID NO: 24559

SEQ ID NO: 105691 - DNA, 201 bp, Bos taurus; identical to SEQ ID NO: 24560

SEQ ID NO: 105692 - DNA, 201 bp, Bos taurus; identical to SEQ ID NO: 24565

SEQ ID NO: 105693 - DNA, 201 bp, Bos taurus; identical to SEQ ID NO: 24566

SEQ ID NO: 105694 - DNA, 201 bp, Bos taurus; identical to SEQ ID NO: 24567

SEQ ID NO: 105695 - DNA, 201 bp, Bos taurus; identical to SEQ ID NO: 24569

SEQ ID NO: 105696 - DNA, 201 bp, Bos taurus; identical to SEQ ID NO: 24571

SEQ ID NO: 105697 - DNA, 201 bp, Bos taurus; identical to SEQ ID NO: 24572

SEQ ID NO: 105698 - DNA, 201 bp, Bos taurus; identical to SEQ ID NO: 24573

SEQ ID NO: 105699 - DNA, 201 bp, Bos taurus; identical to SEQ ID NO: 24575

SEQ ID NO: 105700 - DNA, 201 bp, Bos taurus; identical to SEQ ID NO: 24576

SEQ ID NO: 105701 - DNA, 201 bp, Bos taurus; identical to SEQ ID NO: 24580

SEQ ID NO: 105702 - DNA, 201 bp, Bos taurus; identical to SEQ ID NO: 24581

SEQ ID NO: 105703 - DNA, 201 bp, Bos taurus; identical to SEQ ID NO: 24583

SEQ ID NO: 105704 - DNA, 201 bp, Bos taurus; identical to SEQ ID NO: 24585

SEQ ID NO: 105705 - DNA, 201 bp, Bos taurus; identical to SEQ ID NO: 24587

SEQ ID NO: 105706 - DNA, 201 bp, Bos taurus; identical to SEQ ID NO: 24589

SEQ ID NO: 105707 - DNA, 201 bp, Bos taurus; identical to SEQ ID NO: 24590

SEQ ID NO: 105708 - DNA, 201 bp, Bos taurus; identical to SEQ ID NO: 24591

SEQ ID NO: 105709 - DNA, 201 bp, Bos taurus; identical to SEQ ID NO: 24592

SEQ ID NO: 105710 - DNA, 201 bp, Bos taurus; identical to SEQ ID NO: 24593

SEQ ID NO: 105711 - DNA, 201 bp, Bos taurus; identical to SEQ ID NO: 24594

SEQ ID NO: 105712 - DNA, 201 bp, Bos taurus; identical to SEQ ID NO: 24595

SEQ ID NO: 105713 - DNA, 201 bp, Bos taurus; identical to SEQ ID NO: 24596

SEQ ID NO: 105714 - DNA, 201 bp, Bos taurus; identical to SEQ ID NO: 24597

SEQ ID NO: 105715 - DNA, 201 bp, Bos taurus; identical to SEQ ID NO: 24600

SEQ ID NO: 105716 - DNA, 201 bp, Bos taurus; identical to SEQ ID NO: 24603

SEQ ID NO: 105717 - DNA, 201 bp, Bos taurus; identical to SEQ ID NO: 24604

SEQ ID NO: 105718 - DNA, 201 bp, Bos taurus; identical to SEQ ID NO: 24605

SEQ ID NO: 105719 - DNA, 201 bp, Bos taurus; identical to SEQ ID NO: 24606

SEQ ID NO: 105720 - DNA, 201 bp, Bos taurus; identical to SEQ ID NO: 24608

SEQ ID NO: 105721 - DNA, 201 bp, Bos taurus
cttgaaatgttccttttcaatacatatcatggacttggtgtctatgtaagccacagaaataccaggtcattcagaatacattacaatatgactgttgtgggaagggcataaaactaaagtcataaacctaaaagttacatagatttatgaaaaacattttaaaagaaactatagttcagggtacttgggaccataaaaatg

SEQ ID NO: 105722 - DNA, 201 bp, Bos taurus; identical to SEQ ID NO: 24609

SEQ ID NO: 105723 - DNA, 201 bp, Bos taurus; identical to SEQ ID NO: 24610

SEQ ID NO: 105724 - DNA, 201 bp, Bos taurus; identical to SEQ ID NO: 24611

SEQ ID NO: 105725 - DNA, 201 bp, Bos taurus; identical to SEQ ID NO: 24612

SEQ ID NO: 105726 - DNA, 201 bp, Bos taurus; identical to SEQ ID NO: 24613

SEQ ID NO: 105727 - DNA, 201 bp, Bos taurus
tgagaggctacctttctaacaagccacaagtggagctgatgctgtctctgaaccatccttgaacagcacagtaactcaatatataaagtgaggggaagctatggccatttaatgactgcagctttatagattcaatgctgttatattttgggaatcaaacataaataatcaacagtgatcacaaaaaagtaagtcttagaa

SEQ ID NO: 105728 - DNA, 201 bp, Bos taurus; identical to SEQ ID NO: 24614

SEQ ID NO: 105729 - DNA, 201 bp, Bos taurus
ccaaagtgttgcttactcctgtgtttggctcagggtctagaagaatttgaagacaagaactttctgcagggactttctccatagggcaggcttgcagaacagtggcctgagtgtagttggatttcttacagcttggctcagggtgacaagtgcaaatgttcaggcaaacgaggttgaggttgtgttgcccttgctgaccta

SEQ ID NO: 105730 - DNA, 201 bp, Bos taurus
gaaaaatggtttgtgaaaccagtcctgtagagattgaaaatcttacctattatttgggcagacagcatagatgtgtatgctggccatcaagcaccagctctggcgacccctctcgtgggtcttcctgacgttggagaagatgtagtttcaaggctggctctgtgtggtttgcctgatgtccattttggccttcagggaggc

SEQ ID NO: 105731 - DNA, 201 bp, Bos taurus; identical to SEQ ID NO: 24615

SEQ ID NO: 105732 - DNA, 201 bp, Bos taurus
aggatcagagatacaactggtgtagacagcaggatacccagcaggtagaggagcccgaggctccactggatggaggacgccagtggccaccagatagcatgtggcactgtgtggctgtcattctctctgcatgcgctctggtggaaaacagggacgcatggatgggtccccagacagcaaggaaatggcgttacaggccat

SEQ ID NO: 105733 - DNA, 201 bp, Bos taurus; identical to SEQ ID NO: 24617

SEQ ID NO: 105734 - DNA, 201 bp, Bos taurus
taccttattctactcctaaatgtacattactccacattcctggactgatgggaaaatccaaagggtctaaggaattatggaaaacaatactaatcctcattgaatctaattgattgtttctgtttgtgtctacatatacaggctggttagaattggtacattttgttagaacatcaatagaaaacaaacataaaaaaccat

SEQ ID NO: 105735 - DNA, 201 bp, Bos taurus
atagttattagtaatgttggccatacatttgtgttcatccacctattgggcatggatataatggcacttccctatccccttgcaactaagtgtggctacatggctttttttggccaatggattgtgagaggaaatgatatgtgtcccttctggatgaaagtgttaaaagtaaggtataaatttagtgacatttggctcagt

SEQ ID NO: 105736 - DNA, 201 bp, Bos taurus; identical to SEQ ID NO: 24618

SEQ ID NO: 105737 - DNA, 201 bp, Bos taurus; identical to SEQ ID NO: 24619

SEQ ID NO: 105738 - DNA, 201 bp, Bos taurus
ttaactctttattggagagatacatgaaaatgttagctttcctcagatgaaaaccaacatgtattaggaggcatgagaaattacaaaaagaagtaatacatgggtggagatcagtcacattttaaaaaggcaaattttaaacaacacaaggttatgagtaattaaatactgagtgaaaacaaatggcctctgtttaataat

SEQ ID NO: 105739 - DNA, 201 bp, Bos taurus
gcctggcgtgctgcagtccatggggtcacaaagagttggacatgactgagtgactgaactgacttcattcatgaaggtggcacccttatattcaagtcatctcccaaaggccccatctccaattagcactattttagggatttagctttaacatatgcttaagggggaatcacaaaccatcatccataacaacccctaacc

SEQ ID NO: 105740 - DNA, 201 bp, Bos taurus; identical to SEQ ID NO: 24622

SEQ ID NO: 105741 - DNA, 201 bp, Bos taurus; identical to SEQ ID NO: 24626

SEQ ID NO: 105742 - DNA, 201 bp, Bos taurus
gcagaacaggctggtggatccaggcaaggaaactgttcacggagtttgtgtttaaactgaaaatgagagtatcaggtggcctaattctaacttcaattcttctagtaagaaattacctgtgttcttatattctttctggaaaattaaatgcatgaaatattttcagtcttgacaggccatcacaatcataatcactataga
